United States Patent 7,888,497 (BIOINFORMATICALLY DETECTABLE GROUP OF NOVEL REGULATORY OLIGONUCLEOTIDES AND USES THEREOF) - sequence listing, part 12

SEQ ID NO: 463260 - DNA, 14 bp, Homo sapiens
ctgtgggcagcacc

SEQ ID NO: 463261 - DNA, 16 bp, Homo sapiens
ctgtgggggtggccat

SEQ ID NO: 463262 - DNA, 17 bp, Homo sapiens
ctgtgggggtggccatc

SEQ ID NO: 463263 - DNA, 18 bp, Homo sapiens
ctgtgtaatctctgatta

SEQ ID NO: 463264 - DNA, 17 bp, Homo sapiens
ctgttaacccagtgttc

SEQ ID NO: 463265 - DNA, 17 bp, Homo sapiens
ctgttagaattaggtaa

SEQ ID NO: 463266 - DNA, 10 bp, Homo sapiens
ctgttccaag

SEQ ID NO: 463267 - DNA, 14 bp, Homo sapiens
ctgttccaagtgtg

SEQ ID NO: 463268 - DNA, 17 bp, Homo sapiens
ctgttccaagtgtgtgt

SEQ ID NO: 463269 - DNA, 15 bp, Homo sapiens
ctgttctaactagta

SEQ ID NO: 463270 - DNA, 15 bp, Homo sapiens
ctgtttaccctccct

SEQ ID NO: 463271 - DNA, 19 bp, Homo sapiens
ctgttttatgtcatactct

SEQ ID NO: 463272 - DNA, 22 bp, Homo sapiens
ctgttttatgtcatactctgtg

SEQ ID NO: 463273 - DNA, 15 bp, Homo sapiens
ctgttttgaataaca

SEQ ID NO: 463274 - DNA, 14 bp, Homo sapiens
ctgtttttgtagtg

SEQ ID NO: 463275 - DNA, 16 bp, Homo sapiens
cttaaacctgtgcttt

SEQ ID NO: 463276 - DNA, 22 bp, Homo sapiens
cttaaacctgtgctttcatgtt

SEQ ID NO: 463277 - DNA, 13 bp, Homo sapiens
cttaaactttgtc

SEQ ID NO: 463278 - DNA, 20 bp, Homo sapiens
cttaaactttgtcacttctg

SEQ ID NO: 463279 - DNA, 21 bp, Homo sapiens
cttaaactttgtcacttctgc

SEQ ID NO: 463280 - DNA, 20 bp, Homo sapiens
cttaaatttctaaaaacagt

SEQ ID NO: 463281 - DNA, 16 bp, Homo sapiens
cttaacataaacttgt

SEQ ID NO: 463282 - DNA, 21 bp, Homo sapiens
cttaacataaacttgtactta

SEQ ID NO: 463283 - DNA, 17 bp, Homo sapiens
cttaactcatctgttat

SEQ ID NO: 463284 - DNA, 14 bp, Homo sapiens
cttaaggggggatg

SEQ ID NO: 463285 - DNA, 20 bp, Homo sapiens
cttaatgttctgaataattt

SEQ ID NO: 463286 - DNA, 16 bp, Homo sapiens
cttacactgaaatcca

SEQ ID NO: 463287 - DNA, 18 bp, Homo sapiens
cttacactgaaatccaaa

SEQ ID NO: 463288 - DNA, 21 bp, Homo sapiens
cttacagtattttctatgtaa

SEQ ID NO: 463289 - DNA, 16 bp, Homo sapiens
cttaccaataataaga

SEQ ID NO: 463290 - DNA, 18 bp, Homo sapiens
cttaccccgtccctttcc

SEQ ID NO: 463291 - DNA, 22 bp, Homo sapiens
cttactaaacattttgttattg

SEQ ID NO: 463292 - DNA, 19 bp, Homo sapiens
cttagaaaacatgggcttt

SEQ ID NO: 463293 - DNA, 15 bp, Homo sapiens
cttagaacctttctt

SEQ ID NO: 463294 - DNA, 22 bp, Homo sapiens
cttagatgacggggcctccttc

SEQ ID NO: 463295 - DNA, 14 bp, Homo sapiens
cttatgctgctgtg

SEQ ID NO: 463296 - DNA, 14 bp, Homo sapiens
cttattttagacaa

SEQ ID NO: 463297 - DNA, 20 bp, Homo sapiens
cttcaaccattccccatggg

SEQ ID NO: 463298 - DNA, 14 bp, Homo sapiens
cttcaaccctgccc

SEQ ID NO: 463299 - DNA, 19 bp, Homo sapiens
cttcaaccctgccctgcac

SEQ ID NO: 463300 - DNA, 22 bp, Homo sapiens
cttcaaccctgccctgcacctt

SEQ ID NO: 463301 - DNA, 19 bp, Homo sapiens
cttcacactgaactcagga

SEQ ID NO: 463302 - DNA, 14 bp, Homo sapiens
cttcaggctcttct

SEQ ID NO: 463303 - DNA, 17 bp, Homo sapiens
cttcaggctcttctcct

SEQ ID NO: 463304 - DNA, 20 bp, Homo sapiens
cttcaggttcctcctaggcg

SEQ ID NO: 463305 - DNA, 13 bp, Homo sapiens
cttcagttctcat

SEQ ID NO: 463306 - DNA, 14 bp, Homo sapiens
cttcagttctcatc

SEQ ID NO: 463307 - DNA, 18 bp, Homo sapiens
cttccaagttcattcata

SEQ ID NO: 463308 - DNA, 15 bp, Homo sapiens
cttccatcctgagga

SEQ ID NO: 463309 - DNA, 16 bp, Homo sapiens
cttccatcctgaggac

SEQ ID NO: 463310 - DNA, 17 bp, Homo sapiens
cttccatcctgaggacc

SEQ ID NO: 463311 - DNA, 13 bp, Homo sapiens
cttccatggtggt

SEQ ID NO: 463312 - DNA, 20 bp, Homo sapiens
cttccatggtggtttcagaa

SEQ ID NO: 463313 - DNA, 15 bp, Homo sapiens
cttcccagctggcag

SEQ ID NO: 463314 - DNA, 19 bp, Homo sapiens
cttcccagctggcagcgcc

SEQ ID NO: 463315 - DNA, 20 bp, Homo sapiens
cttcccagctggcagcgcct

SEQ ID NO: 463316 - DNA, 14 bp, Homo sapiens
cttccccaccccat

SEQ ID NO: 463317 - DNA, 23 bp, Homo sapiens
cttccccaccccataagccctga

SEQ ID NO: 463318 - DNA, 10 bp, Homo sapiens
cttccccact

SEQ ID NO: 463319 - DNA, 12 bp, Homo sapiens
cttccccactcc

SEQ ID NO: 463320 - DNA, 12 bp, Homo sapiens
cttccccctcca

SEQ ID NO: 463321 - DNA, 19 bp, Homo sapiens
cttccccgtgcggcccgtg

SEQ ID NO: 463322 - DNA, 21 bp, Homo sapiens
cttcccctgaggacctttctg

SEQ ID NO: 463323 - DNA, 22 bp, Homo sapiens
cttcccctgcgccctccctccc

SEQ ID NO: 463324 - DNA, 13 bp, Homo sapiens
cttccccttctgt

SEQ ID NO: 463325 - DNA, 16 bp, Homo sapiens
cttcccgcagcaccag

SEQ ID NO: 463326 - DNA, 18 bp, Homo sapiens
cttcccgcagcaccagcc

SEQ ID NO: 463327 - DNA, 20 bp, Homo sapiens
cttcccgccttcaggttcct

SEQ ID NO: 463328 - DNA, 16 bp, Homo sapiens
cttcccgctcagccct

SEQ ID NO: 463329 - DNA, 20 bp, Homo sapiens
cttccctgcttcacgattct

SEQ ID NO: 463330 - DNA, 18 bp, Homo sapiens
cttccgtgagacacaaga

SEQ ID NO: 463331 - DNA, 13 bp, Homo sapiens
cttcctctccact

SEQ ID NO: 463332 - DNA, 15 bp, Homo sapiens
cttcctctccactgc

SEQ ID NO: 463333 - DNA, 18 bp, Homo sapiens
gagcccagaaaaaaggac

SEQ ID NO: 463334 - DNA, 17 bp, Homo sapiens
gagccccccgtgttcac

SEQ ID NO: 463335 - DNA, 12 bp, Homo sapiens
gagccccggagc

SEQ ID NO: 463336 - DNA, 16 bp, Homo sapiens
gagccccggagcacca

SEQ ID NO: 463337 - DNA, 22 bp, Homo sapiens
gagcccctatcctgcaccctct

SEQ ID NO: 463338 - DNA, 16 bp, Homo sapiens
gagccctgagcccaga

SEQ ID NO: 463339 - DNA, 24 bp, Homo sapiens
gagccctgccctcactccactccc

SEQ ID NO: 463340 - DNA, 13 bp, Homo sapiens
gagcctgtctctc

SEQ ID NO: 463341 - DNA, 15 bp, Homo sapiens
gagcgcgtgccttcc

SEQ ID NO: 463342 - DNA, 15 bp, Homo sapiens
gagcgctcctctgcc

SEQ ID NO: 463343 - DNA, 13 bp, Homo sapiens
gagcggctgagga

SEQ ID NO: 463344 - DNA, 23 bp, Homo sapiens
gagcggctgaggacggggcagag

SEQ ID NO: 463345 - DNA, 21 bp, Homo sapiens
gagctaaattacaattgtcat

SEQ ID NO: 463346 - DNA, 17 bp, Homo sapiens
gagctcaggagaaggcc

SEQ ID NO: 463347 - DNA, 17 bp, Homo sapiens
gagctcagtacagggca

SEQ ID NO: 463348 - DNA, 13 bp, Homo sapiens
gagctccaccctc

SEQ ID NO: 463349 - DNA, 14 bp, Homo sapiens
gagctccaccctcc

SEQ ID NO: 463350 - DNA, 17 bp, Homo sapiens
gagctccaccctcccct

SEQ ID NO: 463351 - DNA, 21 bp, Homo sapiens
gagctgagtcggctgggcagg

SEQ ID NO: 463352 - DNA, 15 bp, Homo sapiens
gagctgctcctttgg

SEQ ID NO: 463353 - DNA, 18 bp, Homo sapiens
gagcttgattctaaaggg

SEQ ID NO: 463354 - DNA, 21 bp, Homo sapiens
gagcttgattctaaaggggac

SEQ ID NO: 463355 - DNA, 13 bp, Homo sapiens
gaggaatgtgctt

SEQ ID NO: 463356 - DNA, 19 bp, Homo sapiens
gaggaccgccccaaccctc

SEQ ID NO: 463357 - DNA, 22 bp, Homo sapiens
gaggacggggcagagctgagtc

SEQ ID NO: 463358 - DNA, 10 bp, Homo sapiens
gaggagcacc

SEQ ID NO: 463359 - DNA, 11 bp, Homo sapiens
gaggagcaccc

SEQ ID NO: 463360 - DNA, 14 bp, Homo sapiens
gaggagcaccccca

SEQ ID NO: 463361 - DNA, 15 bp, Homo sapiens
gaggagcacccccag

SEQ ID NO: 463362 - DNA, 17 bp, Homo sapiens
gaggagcacccccagcc

SEQ ID NO: 463363 - DNA, 23 bp, Homo sapiens
gaggagcacccccagcctccccc

SEQ ID NO: 463364 - DNA, 16 bp, Homo sapiens
gaggaggtgtggagtg

SEQ ID NO: 463365 - DNA, 11 bp, Homo sapiens
gaggagtccaa

SEQ ID NO: 463366 - DNA, 14 bp, Homo sapiens
gaggagtccaaaat

SEQ ID NO: 463367 - DNA, 22 bp, Homo sapiens
gaggcagaatggtgggctccag

SEQ ID NO: 463368 - DNA, 14 bp, Homo sapiens
gaggcagggccctg

SEQ ID NO: 463369 - DNA, 15 bp, Homo sapiens
gaggcagggccctgg

SEQ ID NO: 463370 - DNA, 17 bp, Homo sapiens
gaggccagtactttgcc

SEQ ID NO: 463371 - DNA, 12 bp, Homo sapiens
gaggcgcccacc

SEQ ID NO: 463372 - DNA, 13 bp, Homo sapiens
gaggcgcccacct

SEQ ID NO: 463373 - DNA, 14 bp, Homo sapiens
gaggcgcccacctg

SEQ ID NO: 463374 - DNA, 16 bp, Homo sapiens
gaggcgcccacctgcc

SEQ ID NO: 463375 - DNA, 19 bp, Homo sapiens
gaggcgcccacctgcccag

SEQ ID NO: 463376 - DNA, 21 bp, Homo sapiens
gaggcgttgtgaatgtgtccc

SEQ ID NO: 463377 - DNA, 15 bp, Homo sapiens
gaggctgggcccctg

SEQ ID NO: 463378 - DNA, 15 bp, Homo sapiens
gagggaagcccaccc

SEQ ID NO: 463379 - DNA, 23 bp, Homo sapiens
gagggaagcccacccgccccaga

SEQ ID NO: 463380 - DNA, 23 bp, Homo sapiens
gagggacagcagattccacagga

SEQ ID NO: 463381 - DNA, 21 bp, Homo sapiens
gagggatggagaggcggcctc

SEQ ID NO: 463382 - DNA, 16 bp, Homo sapiens
gagggcactggtggcc

SEQ ID NO: 463383 - DNA, 18 bp, Homo sapiens
gagggcactggtggcccg

SEQ ID NO: 463384 - DNA, 13 bp, Homo sapiens
gagggctgagccc

SEQ ID NO: 463385 - DNA, 18 bp, Homo sapiens
gagggctgagcccctcct

SEQ ID NO: 463386 - DNA, 14 bp, Homo sapiens
gaggggactgcatg

SEQ ID NO: 463387 - DNA, 19 bp, Homo sapiens
gaggggactgcatgcaagc

SEQ ID NO: 463388 - DNA, 21 bp, Homo sapiens
gaggggactgcatgcaagctc

SEQ ID NO: 463389 - DNA, 15 bp, Homo sapiens
gaggggagaaaggaa

SEQ ID NO: 463390 - DNA, 18 bp, Homo sapiens
gaggggcctggcagccgt

SEQ ID NO: 463391 - DNA, 20 bp, Homo sapiens
gaggggcctggcagccgtgc

SEQ ID NO: 463392 - DNA, 18 bp, Homo sapiens
gagggggccagagggact

SEQ ID NO: 463393 - DNA, 16 bp, Homo sapiens
gaggggtcagcagggg

SEQ ID NO: 463394 - DNA, 23 bp, Homo sapiens
gaggggtgagacagtgggggtgc

SEQ ID NO: 463395 - DNA, 14 bp, Homo sapiens
gaggtgtggagtgg

SEQ ID NO: 463396 - DNA, 19 bp, Homo sapiens
gaggtgtggagtggagggg

SEQ ID NO: 463397 - DNA, 18 bp, Homo sapiens
gagtccactttcctctct

SEQ ID NO: 463398 - DNA, 21 bp, Homo sapiens
gagtccagctccccccaagat

SEQ ID NO: 463399 - DNA, 14 bp, Homo sapiens
gagtccattgcaaa

SEQ ID NO: 463400 - DNA, 19 bp, Homo sapiens
gagtccattgcaaaaggtt

SEQ ID NO: 463401 - DNA, 15 bp, Homo sapiens
gagtcggctgggcag

SEQ ID NO: 463402 - DNA, 19 bp, Homo sapiens
gagtcggctgggcagggcc

SEQ ID NO: 463403 - DNA, 12 bp, Homo sapiens
gagtctcttctc

SEQ ID NO: 463404 - DNA, 17 bp, Homo sapiens
gagtctcttctccactg

SEQ ID NO: 463405 - DNA, 18 bp, Homo sapiens
gagtctcttctccactgg

SEQ ID NO: 463406 - DNA, 16 bp, Homo sapiens
gagtctgaaggagagg

SEQ ID NO: 463407 - DNA, 15 bp, Homo sapiens
gagtgaatacactgg

SEQ ID NO: 463408 - DNA, 18 bp, Homo sapiens
gagtgaatacactggaat

SEQ ID NO: 463409 - DNA, 20 bp, Homo sapiens
gagtgacatgcggctgccca

SEQ ID NO: 463410 - DNA, 22 bp, Homo sapiens
gagtgatatggcttgtagggtg

SEQ ID NO: 463411 - DNA, 13 bp, Homo sapiens
gagtggctcctcc

SEQ ID NO: 463412 - DNA, 14 bp, Homo sapiens
gagttcaaatactt

SEQ ID NO: 463413 - DNA, 15 bp, Homo sapiens
gagttcaaatacttt

SEQ ID NO: 463414 - DNA, 15 bp, Homo sapiens
gagttctcctggagc

SEQ ID NO: 463415 - DNA, 16 bp, Homo sapiens
gataaaatcttcaact

SEQ ID NO: 463416 - DNA, 13 bp, Homo sapiens
gataaacattaaa

SEQ ID NO: 463417 - DNA, 15 bp, Homo sapiens
gataaacattaaaca

SEQ ID NO: 463418 - DNA, 18 bp, Homo sapiens
gataagtgctcagtattg

SEQ ID NO: 463419 - DNA, 21 bp, Homo sapiens
gataagttccaaaaataccat

SEQ ID NO: 463420 - DNA, 22 bp, Homo sapiens
gatacactgtatctaaaaaata

SEQ ID NO: 463421 - DNA, 18 bp, Homo sapiens
gatactttgatattttca

SEQ ID NO: 463422 - DNA, 15 bp, Homo sapiens
gatatcacgggcccg

SEQ ID NO: 463423 - DNA, 21 bp, Homo sapiens
gatatctttgagggctgacaa

SEQ ID NO: 463424 - DNA, 23 bp, Homo sapiens
gatatgaaagagaaaatgctttc

SEQ ID NO: 463425 - DNA, 20 bp, Homo sapiens
gatatgcatgtagcatataa

SEQ ID NO: 463426 - DNA, 16 bp, Homo sapiens
gatattgtatgtacct

SEQ ID NO: 463427 - DNA, 20 bp, Homo sapiens
gatccctcggtcagcaccgt

SEQ ID NO: 463428 - DNA, 20 bp, Homo sapiens
gatcgtttcacatctgtata

SEQ ID NO: 463429 - DNA, 19 bp, Homo sapiens
gatctaaaaggaggacagg

SEQ ID NO: 463430 - DNA, 20 bp, Homo sapiens
gatctaaaaggaggacaggg

SEQ ID NO: 463431 - DNA, 19 bp, Homo sapiens
gcccacaataatgaataat

SEQ ID NO: 463432 - DNA, 15 bp, Homo sapiens
gcccacccacacccc

SEQ ID NO: 463433 - DNA, 15 bp, Homo sapiens
gcccaccccgctgcc

SEQ ID NO: 463434 - DNA, 21 bp, Homo sapiens
gcccaccccgctgcctggcgg

SEQ ID NO: 463435 - DNA, 23 bp, Homo sapiens
gcccacccctcttcccccttccc

SEQ ID NO: 463436 - DNA, 15 bp, Homo sapiens
gcccacccgccccag

SEQ ID NO: 463437 - DNA, 15 bp, Homo sapiens
gcccaccctgggcct

SEQ ID NO: 463438 - DNA, 17 bp, Homo sapiens
gcccaccctgggcctcc

SEQ ID NO: 463439 - DNA, 19 bp, Homo sapiens
gcccaccctgggcctcccg

SEQ ID NO: 463440 - DNA, 21 bp, Homo sapiens
gcccaccctgggcctcccgtc

SEQ ID NO: 463441 - DNA, 18 bp, Homo sapiens
gcccacgcagagccccgg

SEQ ID NO: 463442 - DNA, 15 bp, Homo sapiens
gcccacgctcctgcc

SEQ ID NO: 463443 - DNA, 19 bp, Homo sapiens
gcccagaacgggcctcccc

SEQ ID NO: 463444 - DNA, 12 bp, Homo sapiens
gcccagcctctc

SEQ ID NO: 463445 - DNA, 15 bp, Homo sapiens
gcccaggaggacctg

SEQ ID NO: 463446 - DNA, 14 bp, Homo sapiens
gcccagtcttgagt

SEQ ID NO: 463447 - DNA, 17 bp, Homo sapiens
gcccagtcttgagtggg

SEQ ID NO: 463448 - DNA, 13 bp, Homo sapiens
gcccagttagccc

SEQ ID NO: 463449 - DNA, 16 bp, Homo sapiens
gcccagttagcccggc

SEQ ID NO: 463450 - DNA, 14 bp, Homo sapiens
gcccatggccccag

SEQ ID NO: 463451 - DNA, 18 bp, Homo sapiens
gcccatggccccagctgg

SEQ ID NO: 463452 - DNA, 17 bp, Homo sapiens
gcccatgtgtcccctca

SEQ ID NO: 463453 - DNA, 22 bp, Homo sapiens
gcccatgtgtcccctcactctg

SEQ ID NO: 463454 - DNA, 17 bp, Homo sapiens
gccccaaccctcggagc

SEQ ID NO: 463455 - DNA, 18 bp, Homo sapiens
gccccacccaccctctgg

SEQ ID NO: 463456 - DNA, 12 bp, Homo sapiens
gccccagagact

SEQ ID NO: 463457 - DNA, 13 bp, Homo sapiens
gccccagagactg

SEQ ID NO: 463458 - DNA, 17 bp, Homo sapiens
gccccagagactgccca

SEQ ID NO: 463459 - DNA, 20 bp, Homo sapiens
gccccagagactgcccaccc

SEQ ID NO: 463460 - DNA, 14 bp, Homo sapiens
gccccagctggctg

SEQ ID NO: 463461 - DNA, 19 bp, Homo sapiens
gccccagctggctgggtcg

SEQ ID NO: 463462 - DNA, 14 bp, Homo sapiens
gccccaggccctcc

SEQ ID NO: 463463 - DNA, 15 bp, Homo sapiens
gccccaggccctccc

SEQ ID NO: 463464 - DNA, 16 bp, Homo sapiens
gccccaggcggagggg

SEQ ID NO: 463465 - DNA, 21 bp, Homo sapiens
gccccatccttcccgcagcac

SEQ ID NO: 463466 - DNA, 22 bp, Homo sapiens
gccccatccttcccgcagcacc

SEQ ID NO: 463467 - DNA, 23 bp, Homo sapiens
gccccatccttcccgcagcacca

SEQ ID NO: 463468 - DNA, 11 bp, Homo sapiens
gccccccactc

SEQ ID NO: 463469 - DNA, 12 bp, Homo sapiens
gccccccactca

SEQ ID NO: 463470 - DNA, 23 bp, Homo sapiens
gccccccagagagagctctgcac

SEQ ID NO: 463471 - DNA, 17 bp, Homo sapiens
gcccccggaggcgccca

SEQ ID NO: 463472 - DNA, 19 bp, Homo sapiens
gcccccggaggcgcccacc

SEQ ID NO: 463473 - DNA, 15 bp, Homo sapiens
gccccctcccccgca

SEQ ID NO: 463474 - DNA, 21 bp, Homo sapiens
gccccctcccccgcagacaga

SEQ ID NO: 463475 - DNA, 15 bp, Homo sapiens
gccccgcgcgtgccc

SEQ ID NO: 463476 - DNA, 21 bp, Homo sapiens
gccccgcgcgtgcccccagcg

SEQ ID NO: 463477 - DNA, 14 bp, Homo sapiens
gccccggagcacca

SEQ ID NO: 463478 - DNA, 18 bp, Homo sapiens
gcccctatcctgcaccct

SEQ ID NO: 463479 - DNA, 19 bp, Homo sapiens
gcccctatcctgcaccctc

SEQ ID NO: 463480 - DNA, 11 bp, Homo sapiens
gcccctcctcg

SEQ ID NO: 463481 - DNA, 17 bp, Homo sapiens
gcccctcctctcctcgt

SEQ ID NO: 463482 - DNA, 19 bp, Homo sapiens
gcccctcctctcctcgtcc

SEQ ID NO: 463483 - DNA, 13 bp, Homo sapiens
gcccctccttctc

SEQ ID NO: 463484 - DNA, 18 bp, Homo sapiens
gcccctccttctcccctc

SEQ ID NO: 463485 - DNA, 23 bp, Homo sapiens
gcccctccttctcccctccagac

SEQ ID NO: 463486 - DNA, 23 bp, Homo sapiens
gcccctctctgtttaccctccct

SEQ ID NO: 463487 - DNA, 17 bp, Homo sapiens
gcccctgctggaccaag

SEQ ID NO: 463488 - DNA, 20 bp, Homo sapiens
gcccctgtaaggtttcaatg

SEQ ID NO: 463489 - DNA, 17 bp, Homo sapiens
gccccttccccctccaa

SEQ ID NO: 463490 - DNA, 17 bp, Homo sapiens
gccccttgaccccacac

SEQ ID NO: 463491 - DNA, 21 bp, Homo sapiens
gcccgaatttctcactccctt

SEQ ID NO: 463492 - DNA, 12 bp, Homo sapiens
gcccgacagcct

SEQ ID NO: 463493 - DNA, 16 bp, Homo sapiens
gcccgacagcctggca

SEQ ID NO: 463494 - DNA, 20 bp, Homo sapiens
gcccgagcgcgtgccttccc

SEQ ID NO: 463495 - DNA, 12 bp, Homo sapiens
gcccgcccaccc

SEQ ID NO: 463496 - DNA, 13 bp, Homo sapiens
gcccgcccacccc

SEQ ID NO: 463497 - DNA, 14 bp, Homo sapiens
gcccgcccaccccg

SEQ ID NO: 463498 - DNA, 12 bp, Homo sapiens
gcccgcccccgc

SEQ ID NO: 463499 - DNA, 13 bp, Homo sapiens
gcccgccctcctc

SEQ ID NO: 463500 - DNA, 15 bp, Homo sapiens
gcccgccctcctctg

SEQ ID NO: 463501 - DNA, 17 bp, Homo sapiens
gcccgccggttggccgg

SEQ ID NO: 463502 - DNA, 17 bp, Homo sapiens
gcccgctcaacctctca

SEQ ID NO: 463503 - DNA, 18 bp, Homo sapiens
gcccgctcaacctctcag

SEQ ID NO: 463504 - DNA, 23 bp, Homo sapiens
gcccgctcaacctctcagatccc

SEQ ID NO: 463505 - DNA, 22 bp, Homo sapiens
gcccggcccacgcagagccccg

SEQ ID NO: 463506 - DNA, 18 bp, Homo sapiens
gcccgtgcaacggaagcc

SEQ ID NO: 463507 - DNA, 21 bp, Homo sapiens
gcccgtgcgcagccgcgctct

SEQ ID NO: 463508 - DNA, 24 bp, Homo sapiens
gcccgtgcgcagccgcgctctgcc

SEQ ID NO: 463509 - DNA, 19 bp, Homo sapiens
gccctcactccactcccct

SEQ ID NO: 463510 - DNA, 15 bp, Homo sapiens
gccctcccccacggc

SEQ ID NO: 463511 - DNA, 20 bp, Homo sapiens
gccctcccccttccccttct

SEQ ID NO: 463512 - DNA, 23 bp, Homo sapiens
gccctcccccttccccttctgtg

SEQ ID NO: 463513 - DNA, 12 bp, Homo sapiens
gccctccctccc

SEQ ID NO: 463514 - DNA, 14 bp, Homo sapiens
gccctccctccctc

SEQ ID NO: 463515 - DNA, 16 bp, Homo sapiens
gccctccctccctcca

SEQ ID NO: 463516 - DNA, 19 bp, Homo sapiens
gccctccctccctccacac

SEQ ID NO: 463517 - DNA, 20 bp, Homo sapiens
gccctccctccctccacacc

SEQ ID NO: 463518 - DNA, 20 bp, Homo sapiens
gccctccctgactccctgtg

SEQ ID NO: 463519 - DNA, 14 bp, Homo sapiens
gccctcctctgccc

SEQ ID NO: 463520 - DNA, 18 bp, Homo sapiens
gccctcctctgccccctc

SEQ ID NO: 463521 - DNA, 13 bp, Homo sapiens
gccctctccaccc

SEQ ID NO: 463522 - DNA, 15 bp, Homo sapiens
gccctctccacccag

SEQ ID NO: 463523 - DNA, 17 bp, Homo sapiens
gccctctccacccagag

SEQ ID NO: 463524 - DNA, 13 bp, Homo sapiens
gccctctttctct

SEQ ID NO: 463525 - DNA, 17 bp, Homo sapiens
gccctctttctctctgt

SEQ ID NO: 463526 - DNA, 22 bp, Homo sapiens
gccctctttctctctgtgtggc

SEQ ID NO: 463527 - DNA, 23 bp, Homo sapiens
gccctgagcccagaaaaaaggac

SEQ ID NO: 463528 - DNA, 22 bp, Homo sapiens
gccctgcaccttgggcacggga

SEQ ID NO: 463529 - DNA, 19 bp, Homo sapiens
gctgcctggcgggcagccc

SEQ ID NO: 463530 - DNA, 21 bp, Homo sapiens
gctgcctggcgggcagcccct

SEQ ID NO: 463531 - DNA, 13 bp, Homo sapiens
gctgcgcctgccc

SEQ ID NO: 463532 - DNA, 14 bp, Homo sapiens
gctgcgcctgcccg

SEQ ID NO: 463533 - DNA, 16 bp, Homo sapiens
gctgcgcctgcccgcc

SEQ ID NO: 463534 - DNA, 14 bp, Homo sapiens
gctgctcctttggg

SEQ ID NO: 463535 - DNA, 12 bp, Homo sapiens
gctgctgtgaat

SEQ ID NO: 463536 - DNA, 14 bp, Homo sapiens
gctggaggaatcag

SEQ ID NO: 463537 - DNA, 23 bp, Homo sapiens
gctggcagcgcctcccgccgcct

SEQ ID NO: 463538 - DNA, 21 bp, Homo sapiens
gctggccagcaccctctcctg

SEQ ID NO: 463539 - DNA, 12 bp, Homo sapiens
gctggccctgcc

SEQ ID NO: 463540 - DNA, 13 bp, Homo sapiens
gctggccctgccc

SEQ ID NO: 463541 - DNA, 15 bp, Homo sapiens
gctggccctgccctc

SEQ ID NO: 463542 - DNA, 15 bp, Homo sapiens
gctgggaagaatgta

SEQ ID NO: 463543 - DNA, 15 bp, Homo sapiens
gctgggcagggccgc

SEQ ID NO: 463544 - DNA, 16 bp, Homo sapiens
gctgggcagggccgca

SEQ ID NO: 463545 - DNA, 17 bp, Homo sapiens
gctgggcagggccgcag

SEQ ID NO: 463546 - DNA, 12 bp, Homo sapiens
gctgggcccagc

SEQ ID NO: 463547 - DNA, 13 bp, Homo sapiens
gctgggcccagcc

SEQ ID NO: 463548 - DNA, 12 bp, Homo sapiens
gctgggcccctg

SEQ ID NO: 463549 - DNA, 13 bp, Homo sapiens
gctgggcccctgg

SEQ ID NO: 463550 - DNA, 15 bp, Homo sapiens
gctgggcccctggga

SEQ ID NO: 463551 - DNA, 13 bp, Homo sapiens
gctggggcctggc

SEQ ID NO: 463552 - DNA, 16 bp, Homo sapiens
gctgggtcgcccctcc

SEQ ID NO: 463553 - DNA, 17 bp, Homo sapiens
gctgggtcgcccctcct

SEQ ID NO: 463554 - DNA, 17 bp, Homo sapiens
gctgggtttgggcagtg

SEQ ID NO: 463555 - DNA, 17 bp, Homo sapiens
gctgtaatgtaacagca

SEQ ID NO: 463556 - DNA, 21 bp, Homo sapiens
gctgtattttcttttatatct

SEQ ID NO: 463557 - DNA, 19 bp, Homo sapiens
gctgtcctccagggcgagc

SEQ ID NO: 463558 - DNA, 20 bp, Homo sapiens
gctgtcctccagggcgagca

SEQ ID NO: 463559 - DNA, 20 bp, Homo sapiens
gctgtcctctcgagcccaga

SEQ ID NO: 463560 - DNA, 21 bp, Homo sapiens
gctgtcgccccaggccctccc

SEQ ID NO: 463561 - DNA, 23 bp, Homo sapiens
gctgtcgccccaggccctccctg

SEQ ID NO: 463562 - DNA, 12 bp, Homo sapiens
gctgtctgtcac

SEQ ID NO: 463563 - DNA, 13 bp, Homo sapiens
gctgtctgtcacc

SEQ ID NO: 463564 - DNA, 16 bp, Homo sapiens
gctgtgctccagcagt

SEQ ID NO: 463565 - DNA, 23 bp, Homo sapiens
gctgtgctccagcagtgctgggc

SEQ ID NO: 463566 - DNA, 23 bp, Homo sapiens
gctgtggcccctccttctcccct

SEQ ID NO: 463567 - DNA, 15 bp, Homo sapiens
gctgtgggcagcacc

SEQ ID NO: 463568 - DNA, 18 bp, Homo sapiens
gctgtgggcagcaccctc

SEQ ID NO: 463569 - DNA, 21 bp, Homo sapiens
gctgtttcgcatccaccgcca

SEQ ID NO: 463570 - DNA, 21 bp, Homo sapiens
gctgttttatgtcatactctg

SEQ ID NO: 463571 - DNA, 17 bp, Homo sapiens
gctgttttgaataacat

SEQ ID NO: 463572 - DNA, 12 bp, Homo sapiens
gcttaaacattt

SEQ ID NO: 463573 - DNA, 14 bp, Homo sapiens
gcttaacataaact

SEQ ID NO: 463574 - DNA, 13 bp, Homo sapiens
gcttagaatgggg

SEQ ID NO: 463575 - DNA, 16 bp, Homo sapiens
gcttagaatggggctt

SEQ ID NO: 463576 - DNA, 17 bp, Homo sapiens
gcttagcgttctgtttc

SEQ ID NO: 463577 - DNA, 23 bp, Homo sapiens
gcttatcagaactcctttctaag

SEQ ID NO: 463578 - DNA, 15 bp, Homo sapiens
gcttcccgctcagcc

SEQ ID NO: 463579 - DNA, 16 bp, Homo sapiens
gcttcccgctcagccc

SEQ ID NO: 463580 - DNA, 13 bp, Homo sapiens
gcttctcctctgc

SEQ ID NO: 463581 - DNA, 21 bp, Homo sapiens
gcttgattctaaaggggacag

SEQ ID NO: 463582 - DNA, 21 bp, Homo sapiens
gcttggaacatttgggagact

SEQ ID NO: 463583 - DNA, 11 bp, Homo sapiens
gcttggagcag

SEQ ID NO: 463584 - DNA, 20 bp, Homo sapiens
gcttggagcagagacggcag

SEQ ID NO: 463585 - DNA, 14 bp, Homo sapiens
gcttggggtagaga

SEQ ID NO: 463586 - DNA, 18 bp, Homo sapiens
gcttgtagggtgaggcgt

SEQ ID NO: 463587 - DNA, 19 bp, Homo sapiens
gcttgtagggtgaggcgtg

SEQ ID NO: 463588 - DNA, 11 bp, Homo sapiens
gcttgttcttc

SEQ ID NO: 463589 - DNA, 22 bp, Homo sapiens
gcttgtttctatactgtttgta

SEQ ID NO: 463590 - DNA, 13 bp, Homo sapiens
gctttcacaaata

SEQ ID NO: 463591 - DNA, 14 bp, Homo sapiens
gctttcacaaatat

SEQ ID NO: 463592 - DNA, 11 bp, Homo sapiens
gctttctattg

SEQ ID NO: 463593 - DNA, 19 bp, Homo sapiens
gctttgggctgccctggtg

SEQ ID NO: 463594 - DNA, 23 bp, Homo sapiens
gcttttcactgctggctgcctta

SEQ ID NO: 463595 - DNA, 21 bp, Homo sapiens
ggaaaaccaagccgtggcttc

SEQ ID NO: 463596 - DNA, 18 bp, Homo sapiens
ggaaagggtgtggcttgg

SEQ ID NO: 463597 - DNA, 20 bp, Homo sapiens
ggaaagttctattatctggg

SEQ ID NO: 463598 - DNA, 13 bp, Homo sapiens
ggaaataaatcta

SEQ ID NO: 463599 - DNA, 17 bp, Homo sapiens
ggaaatgtcaacaagta

SEQ ID NO: 463600 - DNA, 15 bp, Homo sapiens
ggaacaaagacaacc

SEQ ID NO: 463601 - DNA, 20 bp, Homo sapiens
ggaacagccaaagaaactca

SEQ ID NO: 463602 - DNA, 22 bp, Homo sapiens
ggaacatccggaacagccaaag

SEQ ID NO: 463603 - DNA, 13 bp, Homo sapiens
ggaagatgccaag

SEQ ID NO: 463604 - DNA, 15 bp, Homo sapiens
ggaagcccacccgcc

SEQ ID NO: 463605 - DNA, 24 bp, Homo sapiens
ggaagcccacccgccccagagact

SEQ ID NO: 463606 - DNA, 16 bp, Homo sapiens
ggaaggcctgagggaa

SEQ ID NO: 463607 - DNA, 21 bp, Homo sapiens
ggaaggcctgagggaagccca

SEQ ID NO: 463608 - DNA, 18 bp, Homo sapiens
ggacaatgagtggaatac

SEQ ID NO: 463609 - DNA, 17 bp, Homo sapiens
ggacagcagattccaca

SEQ ID NO: 463610 - DNA, 17 bp, Homo sapiens
ggacagcggcccggccc

SEQ ID NO: 463611 - DNA, 22 bp, Homo sapiens
ggacagcggcccggcccacgca

SEQ ID NO: 463612 - DNA, 22 bp, Homo sapiens
ggaccaaggtgcggaccggagc

SEQ ID NO: 463613 - DNA, 17 bp, Homo sapiens
ggacccccgaggccccc

SEQ ID NO: 463614 - DNA, 20 bp, Homo sapiens
ggacccccggcctccaggct

SEQ ID NO: 463615 - DNA, 22 bp, Homo sapiens
ggacccccggcctccaggctgg

SEQ ID NO: 463616 - DNA, 12 bp, Homo sapiens
ggacgctggctc

SEQ ID NO: 463617 - DNA, 15 bp, Homo sapiens
ggacggggcagagct

SEQ ID NO: 463618 - DNA, 16 bp, Homo sapiens
ggacggggcagagctg

SEQ ID NO: 463619 - DNA, 18 bp, Homo sapiens
ggactggcccacccctct

SEQ ID NO: 463620 - DNA, 19 bp, Homo sapiens
ggactggtggcccctgcct

SEQ ID NO: 463621 - DNA, 11 bp, Homo sapiens
ggactttattt

SEQ ID NO: 463622 - DNA, 18 bp, Homo sapiens
ggactttatttaatttca

SEQ ID NO: 463623 - DNA, 22 bp, Homo sapiens
ggactttatttaatttcataaa

SEQ ID NO: 463624 - DNA, 23 bp, Homo sapiens
ggactttatttaatttcataaat

SEQ ID NO: 463625 - DNA, 22 bp, Homo sapiens
ggagaaaggaacttttaaactg

SEQ ID NO: 463626 - DNA, 21 bp, Homo sapiens
ggagaacctcgttgacatgca

SEQ ID NO: 463627 - DNA, 23 bp, Homo sapiens
gggaaggcctgagggaagcccac

SEQ ID NO: 463628 - DNA, 16 bp, Homo sapiens
gggaatccatatcagc

SEQ ID NO: 463629 - DNA, 13 bp, Homo sapiens
gggacagcggccc

SEQ ID NO: 463630 - DNA, 15 bp, Homo sapiens
gggacagcggcccgg

SEQ ID NO: 463631 - DNA, 19 bp, Homo sapiens
gggactggcccacccctct

SEQ ID NO: 463632 - DNA, 23 bp, Homo sapiens
gggactgtcttcaaccctgccct

SEQ ID NO: 463633 - DNA, 23 bp, Homo sapiens
gggagaacctcgttgacatgcac

SEQ ID NO: 463634 - DNA, 13 bp, Homo sapiens
gggagactgagct

SEQ ID NO: 463635 - DNA, 23 bp, Homo sapiens
gggagagcgccacccgcccgccc

SEQ ID NO: 463636 - DNA, 15 bp, Homo sapiens
gggagccatgctctt

SEQ ID NO: 463637 - DNA, 19 bp, Homo sapiens
gggaggagcacccccagcc

SEQ ID NO: 463638 - DNA, 16 bp, Homo sapiens
gggagggaacagacct

SEQ ID NO: 463639 - DNA, 15 bp, Homo sapiens
gggagggtgggcgtg

SEQ ID NO: 463640 - DNA, 20 bp, Homo sapiens
gggagtccactttcctctct

SEQ ID NO: 463641 - DNA, 20 bp, Homo sapiens
gggatctaaaaggaggacag

SEQ ID NO: 463642 - DNA, 23 bp, Homo sapiens
gggcaagagctcaggagaaggcc

SEQ ID NO: 463643 - DNA, 20 bp, Homo sapiens
gggcacgggagagcgccacc

SEQ ID NO: 463644 - DNA, 16 bp, Homo sapiens
gggcactggtggcccg

SEQ ID NO: 463645 - DNA, 16 bp, Homo sapiens
gggcagagctgagtcg

SEQ ID NO: 463646 - DNA, 11 bp, Homo sapiens
gggcagcccct

SEQ ID NO: 463647 - DNA, 12 bp, Homo sapiens
gggcagcccctg

SEQ ID NO: 463648 - DNA, 13 bp, Homo sapiens
gggcaggagctgc

SEQ ID NO: 463649 - DNA, 14 bp, Homo sapiens
gggcagggccgcag

SEQ ID NO: 463650 - DNA, 17 bp, Homo sapiens
gggcagggccgcagggc

SEQ ID NO: 463651 - DNA, 18 bp, Homo sapiens
gggcaggtcctgcccatg

SEQ ID NO: 463652 - DNA, 14 bp, Homo sapiens
gggcagtggagagg

SEQ ID NO: 463653 - DNA, 16 bp, Homo sapiens
gggcagtggagagggg

SEQ ID NO: 463654 - DNA, 20 bp, Homo sapiens
gggcatctgagtccagctcc

SEQ ID NO: 463655 - DNA, 20 bp, Homo sapiens
gggccaagccagggttccag

SEQ ID NO: 463656 - DNA, 19 bp, Homo sapiens
gggcccatggccccagctg

SEQ ID NO: 463657 - DNA, 13 bp, Homo sapiens
gggccccctctct

SEQ ID NO: 463658 - DNA, 17 bp, Homo sapiens
gggcccctccacgcctc

SEQ ID NO: 463659 - DNA, 13 bp, Homo sapiens
gggcccgagcgcg

SEQ ID NO: 463660 - DNA, 17 bp, Homo sapiens
gggcccgctcaacctct

SEQ ID NO: 463661 - DNA, 20 bp, Homo sapiens
gggcccgctcaacctctcag

SEQ ID NO: 463662 - DNA, 14 bp, Homo sapiens
gggccctgggcctc

SEQ ID NO: 463663 - DNA, 19 bp, Homo sapiens
gggccctggggtctctgag

SEQ ID NO: 463664 - DNA, 23 bp, Homo sapiens
gggccctggggtctctgagcagt

SEQ ID NO: 463665 - DNA, 14 bp, Homo sapiens
gggccgcagggcgc

SEQ ID NO: 463666 - DNA, 15 bp, Homo sapiens
gggccgcagggcgct

SEQ ID NO: 463667 - DNA, 23 bp, Homo sapiens
gggccgcagggcgctccggcaga

SEQ ID NO: 463668 - DNA, 14 bp, Homo sapiens
gggccgcctcctcc

SEQ ID NO: 463669 - DNA, 16 bp, Homo sapiens
gggccgcctcctccag

SEQ ID NO: 463670 - DNA, 13 bp, Homo sapiens
gggccgggcaggt

SEQ ID NO: 463671 - DNA, 10 bp, Homo sapiens
gggcctggca

SEQ ID NO: 463672 - DNA, 12 bp, Homo sapiens
gggcctggccta

SEQ ID NO: 463673 - DNA, 18 bp, Homo sapiens
gggcctggcctatttaag

SEQ ID NO: 463674 - DNA, 19 bp, Homo sapiens
gggcgcctgcgctcctctg

SEQ ID NO: 463675 - DNA, 18 bp, Homo sapiens
gggcgctccggcagaggc

SEQ ID NO: 463676 - DNA, 23 bp, Homo sapiens
gggcgctccggcagaggcagggc

SEQ ID NO: 463677 - DNA, 19 bp, Homo sapiens
gggctaactggccccaggc

SEQ ID NO: 463678 - DNA, 20 bp, Homo sapiens
gggctccagagtaggtgggt

SEQ ID NO: 463679 - DNA, 16 bp, Homo sapiens
gggctctgccctccct

SEQ ID NO: 463680 - DNA, 22 bp, Homo sapiens
gggctctgccctccctccttcc

SEQ ID NO: 463681 - DNA, 15 bp, Homo sapiens
gggctgagcccctcc

SEQ ID NO: 463682 - DNA, 21 bp, Homo sapiens
gggctgccctggtgctgccac

SEQ ID NO: 463683 - DNA, 13 bp, Homo sapiens
gggctggccctgc

SEQ ID NO: 463684 - DNA, 23 bp, Homo sapiens
gggcttatcagaactcctttcta

SEQ ID NO: 463685 - DNA, 19 bp, Homo sapiens
gggcttggggtagagagga

SEQ ID NO: 463686 - DNA, 20 bp, Homo sapiens
gggcttggggtagagaggac

SEQ ID NO: 463687 - DNA, 19 bp, Homo sapiens
ggggacagatcttgagcaa

SEQ ID NO: 463688 - DNA, 18 bp, Homo sapiens
ggggactgcatgcaagct

SEQ ID NO: 463689 - DNA, 15 bp, Homo sapiens
ggggaggagcacccc

SEQ ID NO: 463690 - DNA, 16 bp, Homo sapiens
ggggaggagcaccccc

SEQ ID NO: 463691 - DNA, 18 bp, Homo sapiens
ggggaggagcacccccag

SEQ ID NO: 463692 - DNA, 22 bp, Homo sapiens
ggggaggagcacccccagcctc

SEQ ID NO: 463693 - DNA, 14 bp, Homo sapiens
ggggatgggccagg

SEQ ID NO: 463694 - DNA, 13 bp, Homo sapiens
ggggattcaaatg

SEQ ID NO: 463695 - DNA, 18 bp, Homo sapiens
ggggattcaaatgcatga

SEQ ID NO: 463696 - DNA, 22 bp, Homo sapiens
ggggcaagagctcaggagaagg

SEQ ID NO: 463697 - DNA, 14 bp, Homo sapiens
ggggccagagggac

SEQ ID NO: 463698 - DNA, 14 bp, Homo sapiens
ggggccctgggcct

SEQ ID NO: 463699 - DNA, 23 bp, Homo sapiens
ggggctctgccctccctccttcc

SEQ ID NO: 463700 - DNA, 13 bp, Homo sapiens
ggggctggccctg

SEQ ID NO: 463701 - DNA, 17 bp, Homo sapiens
ggggctggccctgccct

SEQ ID NO: 463702 - DNA, 21 bp, Homo sapiens
ggggctggccctgccctcccc

SEQ ID NO: 463703 - DNA, 17 bp, Homo sapiens
ggggcttggaagggcgc

SEQ ID NO: 463704 - DNA, 13 bp, Homo sapiens
ggggcttggagca

SEQ ID NO: 463705 - DNA, 14 bp, Homo sapiens
ggggcttggagcag

SEQ ID NO: 463706 - DNA, 18 bp, Homo sapiens
ggggcttggagcagagac

SEQ ID NO: 463707 - DNA, 20 bp, Homo sapiens
ggggcttggggtagagagga

SEQ ID NO: 463708 - DNA, 23 bp, Homo sapiens
ggggcttggggtagagaggacag

SEQ ID NO: 463709 - DNA, 19 bp, Homo sapiens
gggggctaactggccccag

SEQ ID NO: 463710 - DNA, 20 bp, Homo sapiens
gggggcttggggtagagagg

SEQ ID NO: 463711 - DNA, 23 bp, Homo sapiens
gggggtgcctggtgcgctgtgct

SEQ ID NO: 463712 - DNA, 21 bp, Homo sapiens
ggggtaagttgaagggaaatc

SEQ ID NO: 463713 - DNA, 15 bp, Homo sapiens
ggggtagagaggaca

SEQ ID NO: 463714 - DNA, 20 bp, Homo sapiens
ggggtcgggggaggagcacc

SEQ ID NO: 463715 - DNA, 23 bp, Homo sapiens
ggggtgcctggtgcgctgtgctc

SEQ ID NO: 463716 - DNA, 12 bp, Homo sapiens
ggggtggggtgc

SEQ ID NO: 463717 - DNA, 15 bp, Homo sapiens
ggggtggggtgcctg

SEQ ID NO: 463718 - DNA, 19 bp, Homo sapiens
ggggttgcctcgagtcccc

SEQ ID NO: 463719 - DNA, 18 bp, Homo sapiens
ggggttgggttccagaca

SEQ ID NO: 463720 - DNA, 15 bp, Homo sapiens
gggtagagaggacag

SEQ ID NO: 463721 - DNA, 21 bp, Homo sapiens
gggtcgggggaggagcacccc

SEQ ID NO: 463722 - DNA, 13 bp, Homo sapiens
gggtctctgagca

SEQ ID NO: 463723 - DNA, 14 bp, Homo sapiens
gggtctctgagcag

SEQ ID NO: 463724 - DNA, 22 bp, Homo sapiens
gtcttgttttttttttccactt

SEQ ID NO: 463725 - DNA, 20 bp, Homo sapiens
gtctttagtgatgcaataaa

SEQ ID NO: 463726 - DNA, 23 bp, Homo sapiens
gtctttggagagctcagtacagg

SEQ ID NO: 463727 - DNA, 15 bp, Homo sapiens
gtgaagcccaggagg

SEQ ID NO: 463728 - DNA, 15 bp, Homo sapiens
gtgaagcctttatct

SEQ ID NO: 463729 - DNA, 15 bp, Homo sapiens
gtgaataaaaaccct

SEQ ID NO: 463730 - DNA, 16 bp, Homo sapiens
gtgaataacagactat

SEQ ID NO: 463731 - DNA, 19 bp, Homo sapiens
gtgaatgagtaaataaact

SEQ ID NO: 463732 - DNA, 20 bp, Homo sapiens
gtgaatgagtaaataaactc

SEQ ID NO: 463733 - DNA, 21 bp, Homo sapiens
gtgaatgagtaaataaactct

SEQ ID NO: 463734 - DNA, 16 bp, Homo sapiens
gtgacaggaaagccct

SEQ ID NO: 463735 - DNA, 17 bp, Homo sapiens
gtgacaggaaagccctc

SEQ ID NO: 463736 - DNA, 19 bp, Homo sapiens
gtgaccggcccgccacctt

SEQ ID NO: 463737 - DNA, 12 bp, Homo sapiens
gtgactgtccca

SEQ ID NO: 463738 - DNA, 12 bp, Homo sapiens
gtgatacactgt

SEQ ID NO: 463739 - DNA, 13 bp, Homo sapiens
gtgatgatagcac

SEQ ID NO: 463740 - DNA, 22 bp, Homo sapiens
gtgatggttcccctgttcactc

SEQ ID NO: 463741 - DNA, 15 bp, Homo sapiens
gtgcaatatgagggg

SEQ ID NO: 463742 - DNA, 23 bp, Homo sapiens
gtgcaatatgaggggactgcatg

SEQ ID NO: 463743 - DNA, 18 bp, Homo sapiens
gtgcaggcgcgcaccgcc

SEQ ID NO: 463744 - DNA, 20 bp, Homo sapiens
gtgcaggcgcgcaccgccca

SEQ ID NO: 463745 - DNA, 13 bp, Homo sapiens
gtgcatctcagcc

SEQ ID NO: 463746 - DNA, 14 bp, Homo sapiens
gtgcatctcagccc

SEQ ID NO: 463747 - DNA, 12 bp, Homo sapiens
gtgcatttaaaa

SEQ ID NO: 463748 - DNA, 14 bp, Homo sapiens
gtgccaaagatagc

SEQ ID NO: 463749 - DNA, 13 bp, Homo sapiens
gtgcctgagcccg

SEQ ID NO: 463750 - DNA, 14 bp, Homo sapiens
gtgcctgcaccagg

SEQ ID NO: 463751 - DNA, 15 bp, Homo sapiens
gtgcgcagccgcgct

SEQ ID NO: 463752 - DNA, 11 bp, Homo sapiens
gtgcggcccgt

SEQ ID NO: 463753 - DNA, 19 bp, Homo sapiens
gtgcggcccgtgcgcagcc

SEQ ID NO: 463754 - DNA, 13 bp, Homo sapiens
gtgcgtgtggccc

SEQ ID NO: 463755 - DNA, 22 bp, Homo sapiens
gtgctcagtattgacgacctac

SEQ ID NO: 463756 - DNA, 19 bp, Homo sapiens
gtgctccagcagtgctggg

SEQ ID NO: 463757 - DNA, 17 bp, Homo sapiens
gtgctccctcctcagtc

SEQ ID NO: 463758 - DNA, 13 bp, Homo sapiens
gtgctcggacaca

SEQ ID NO: 463759 - DNA, 17 bp, Homo sapiens
gtgctcggacacagttt

SEQ ID NO: 463760 - DNA, 17 bp, Homo sapiens
gtgctgctgcaccaacc

SEQ ID NO: 463761 - DNA, 14 bp, Homo sapiens
gtgctgggcccagc

SEQ ID NO: 463762 - DNA, 15 bp, Homo sapiens
gtgctgggcccagcc

SEQ ID NO: 463763 - DNA, 17 bp, Homo sapiens
gtgctgtgggcagcacc

SEQ ID NO: 463764 - DNA, 13 bp, Homo sapiens
gtgctttcatgtt

SEQ ID NO: 463765 - DNA, 19 bp, Homo sapiens
gtgctttcatgtttaagaa

SEQ ID NO: 463766 - DNA, 23 bp, Homo sapiens
gtgctttcatgtttaagaaatga

SEQ ID NO: 463767 - DNA, 17 bp, Homo sapiens
gtggactttatttaatt

SEQ ID NO: 463768 - DNA, 12 bp, Homo sapiens
gtggagtggagg

SEQ ID NO: 463769 - DNA, 12 bp, Homo sapiens
gtggatgctctt

SEQ ID NO: 463770 - DNA, 15 bp, Homo sapiens
gtggcaaaaaagaac

SEQ ID NO: 463771 - DNA, 20 bp, Homo sapiens
gtggcaggcacacagcagcc

SEQ ID NO: 463772 - DNA, 23 bp, Homo sapiens
gtggcaggcacacagcagccccc

SEQ ID NO: 463773 - DNA, 21 bp, Homo sapiens
gtggccatccctgggcccctc

SEQ ID NO: 463774 - DNA, 22 bp, Homo sapiens
gtggccatccctgggcccctcc

SEQ ID NO: 463775 - DNA, 14 bp, Homo sapiens
gtggcctcagccct

SEQ ID NO: 463776 - DNA, 15 bp, Homo sapiens
gtggcctcagccctc

SEQ ID NO: 463777 - DNA, 18 bp, Homo sapiens
gtggcctcagccctcaga

SEQ ID NO: 463778 - DNA, 14 bp, Homo sapiens
gtggcctgagaaga

SEQ ID NO: 463779 - DNA, 15 bp, Homo sapiens
gtggctcattctttt

SEQ ID NO: 463780 - DNA, 19 bp, Homo sapiens
gtggcttcccgctcagccc

SEQ ID NO: 463781 - DNA, 21 bp, Homo sapiens
gtggcttcccgctcagccctc

SEQ ID NO: 463782 - DNA, 18 bp, Homo sapiens
gtggcttggaacatttgg

SEQ ID NO: 463783 - DNA, 18 bp, Homo sapiens
gtgggactggcccacccc

SEQ ID NO: 463784 - DNA, 13 bp, Homo sapiens
gtgggatccagag

SEQ ID NO: 463785 - DNA, 14 bp, Homo sapiens
gtgggatccagaga

SEQ ID NO: 463786 - DNA, 17 bp, Homo sapiens
gtgggcagcaccctccc

SEQ ID NO: 463787 - DNA, 15 bp, Homo sapiens
gtggggagcgggggc

SEQ ID NO: 463788 - DNA, 17 bp, Homo sapiens
gtggggcccatggcccc

SEQ ID NO: 463789 - DNA, 20 bp, Homo sapiens
gtggggcccatggccccagc

SEQ ID NO: 463790 - DNA, 24 bp, Homo sapiens
gtggggcttagaatggggcttcca

SEQ ID NO: 463791 - DNA, 14 bp, Homo sapiens
gtggggtgcctgag

SEQ ID NO: 463792 - DNA, 17 bp, Homo sapiens
gtggtcttggagaggag

SEQ ID NO: 463793 - DNA, 15 bp, Homo sapiens
gtggtgatgcctaaa

SEQ ID NO: 463794 - DNA, 14 bp, Homo sapiens
gtggtgtgaggccc

SEQ ID NO: 463795 - DNA, 15 bp, Homo sapiens
gtggtgtgaggcccc

SEQ ID NO: 463796 - DNA, 23 bp, Homo sapiens
gtgtatttctattttgcagcagt

SEQ ID NO: 463797 - DNA, 10 bp, Homo sapiens
gtgtcacagt

SEQ ID NO: 463798 - DNA, 23 bp, Homo sapiens
gtgtcacagttcttggtgactgt

SEQ ID NO: 463799 - DNA, 19 bp, Homo sapiens
gtgtcccagcacctggcac

SEQ ID NO: 463800 - DNA, 13 bp, Homo sapiens
gtgtcccctcact

SEQ ID NO: 463801 - DNA, 14 bp, Homo sapiens
gtgtcccgttgtgt

SEQ ID NO: 463802 - DNA, 17 bp, Homo sapiens
gtgtgaggcccccggag

SEQ ID NO: 463803 - DNA, 13 bp, Homo sapiens
gtgtggagtggag

SEQ ID NO: 463804 - DNA, 17 bp, Homo sapiens
gtgtggagtggaggggt

SEQ ID NO: 463805 - DNA, 16 bp, Homo sapiens
gtgtggcaaacattta

SEQ ID NO: 463806 - DNA, 23 bp, Homo sapiens
gtgtggccctgtgggagtccact

SEQ ID NO: 463807 - DNA, 13 bp, Homo sapiens
gtgtggcctcagc

SEQ ID NO: 463808 - DNA, 17 bp, Homo sapiens
gtgtggcctcagccctc

SEQ ID NO: 463809 - DNA, 15 bp, Homo sapiens
gtgtggggagggtgg

SEQ ID NO: 463810 - DNA, 16 bp, Homo sapiens
gtgtggggagggtggg

SEQ ID NO: 463811 - DNA, 17 bp, Homo sapiens
gtgtggggagggtgggc

SEQ ID NO: 463812 - DNA, 17 bp, Homo sapiens
gtgtgggtttactctgt

SEQ ID NO: 463813 - DNA, 18 bp, Homo sapiens
gtgtgggtttactctgtg

SEQ ID NO: 463814 - DNA, 14 bp, Homo sapiens
gtgttataacacca

SEQ ID NO: 463815 - DNA, 13 bp, Homo sapiens
gtgttcccttggc

SEQ ID NO: 463816 - DNA, 22 bp, Homo sapiens
gtgttttcgagcaggactaaca

SEQ ID NO: 463817 - DNA, 19 bp, Homo sapiens
gtgttttgggtttttaaaa

SEQ ID NO: 463818 - DNA, 21 bp, Homo sapiens
gttaacccagtgttcagcata

SEQ ID NO: 463819 - DNA, 12 bp, Homo sapiens
gttaagccatat

SEQ ID NO: 463820 - DNA, 12 bp, Homo sapiens
gttaaggacttc

SEQ ID NO: 463821 - DNA, 19 bp, Homo sapiens
gttaaggacttctgcagct

SEQ ID NO: 463822 - DNA, 20 bp, Homo sapiens
tatctgctgcctctgaaaat

SEQ ID NO: 463823 - DNA, 21 bp, Homo sapiens
tatctgctgcctctgaaaata

SEQ ID NO: 463824 - DNA, 21 bp, Homo sapiens
tatctgggggactagaacaca

SEQ ID NO: 463825 - DNA, 19 bp, Homo sapiens
tatctgggttttagaaatt

SEQ ID NO: 463826 - DNA, 21 bp, Homo sapiens
tatctgtaaatttaactgcat

SEQ ID NO: 463827 - DNA, 21 bp, Homo sapiens
tatctgtcatctctctggggc

SEQ ID NO: 463828 - DNA, 13 bp, Homo sapiens
tatgaaagagaaa

SEQ ID NO: 463829 - DNA, 14 bp, Homo sapiens
tatgaaagagaaaa

SEQ ID NO: 463830 - DNA, 23 bp, Homo sapiens
tatgaaagagaaaatgctttctc

SEQ ID NO: 463831 - DNA, 22 bp, Homo sapiens
tatgaataattatgtttacctc

SEQ ID NO: 463832 - DNA, 20 bp, Homo sapiens
tatgacaatttcaaaatgca

SEQ ID NO: 463833 - DNA, 21 bp, Homo sapiens
tatgacaatttcaaaatgcat

SEQ ID NO: 463834 - DNA, 22 bp, Homo sapiens
tatgacaatttcaaaatgcatg

SEQ ID NO: 463835 - DNA, 16 bp, Homo sapiens
tatgaggggactgcat

SEQ ID NO: 463836 - DNA, 14 bp, Homo sapiens
tatgattctcctct

SEQ ID NO: 463837 - DNA, 17 bp, Homo sapiens
tatgattgaaaagaaga

SEQ ID NO: 463838 - DNA, 13 bp, Homo sapiens
tatgcatgtagca

SEQ ID NO: 463839 - DNA, 21 bp, Homo sapiens
tatgcatgtagcatataaatg

SEQ ID NO: 463840 - DNA, 22 bp, Homo sapiens
tatgctgagtatgttaagctct

SEQ ID NO: 463841 - DNA, 15 bp, Homo sapiens
tatgctgcaatacat

SEQ ID NO: 463842 - DNA, 11 bp, Homo sapiens
tatgctgctgt

SEQ ID NO: 463843 - DNA, 18 bp, Homo sapiens
tatgctgctgtgaatttt

SEQ ID NO: 463844 - DNA, 19 bp, Homo sapiens
tatgctggccagcaccctc

SEQ ID NO: 463845 - DNA, 22 bp, Homo sapiens
tatgctggccagcaccctctcc

SEQ ID NO: 463846 - DNA, 16 bp, Homo sapiens
tatggaaagggtgtgg

SEQ ID NO: 463847 - DNA, 23 bp, Homo sapiens
tatggcaagtttttggtaatgat

SEQ ID NO: 463848 - DNA, 18 bp, Homo sapiens
tatgggaggaacaaagac

SEQ ID NO: 463849 - DNA, 17 bp, Homo sapiens
tatggtatgctggccag

SEQ ID NO: 463850 - DNA, 15 bp, Homo sapiens
tatgtaagaagaaac

SEQ ID NO: 463851 - DNA, 16 bp, Homo sapiens
tatgtaagaagaaact

SEQ ID NO: 463852 - DNA, 14 bp, Homo sapiens
tatgtagaactgtt

SEQ ID NO: 463853 - DNA, 11 bp, Homo sapiens
tatgtctgtga

SEQ ID NO: 463854 - DNA, 18 bp, Homo sapiens
tatgttaagctctttatg

SEQ ID NO: 463855 - DNA, 19 bp, Homo sapiens
tatgttaagctctttatga

SEQ ID NO: 463856 - DNA, 15 bp, Homo sapiens
tatgtttacctcact

SEQ ID NO: 463857 - DNA, 15 bp, Homo sapiens
tattaaaatactgtt

SEQ ID NO: 463858 - DNA, 15 bp, Homo sapiens
tattaaacttcagca

SEQ ID NO: 463859 - DNA, 23 bp, Homo sapiens
tattataatataatatggaacct

SEQ ID NO: 463860 - DNA, 14 bp, Homo sapiens
tattatgcaaagta

SEQ ID NO: 463861 - DNA, 20 bp, Homo sapiens
tattcaactaatacatggtt

SEQ ID NO: 463862 - DNA, 18 bp, Homo sapiens
tattccatccatatactt

SEQ ID NO: 463863 - DNA, 13 bp, Homo sapiens
tattcctgccttt

SEQ ID NO: 463864 - DNA, 20 bp, Homo sapiens
tattctagtcaactgctgtt

SEQ ID NO: 463865 - DNA, 22 bp, Homo sapiens
tattctagtcaactgctgtttt

SEQ ID NO: 463866 - DNA, 12 bp, Homo sapiens
tattctattgca

SEQ ID NO: 463867 - DNA, 10 bp, Homo sapiens
tattctgtca

SEQ ID NO: 463868 - DNA, 16 bp, Homo sapiens
tattctgtggattcta

SEQ ID NO: 463869 - DNA, 20 bp, Homo sapiens
tattctgtggattctatatt

SEQ ID NO: 463870 - DNA, 21 bp, Homo sapiens
tattctgtggattctatattt

SEQ ID NO: 463871 - DNA, 18 bp, Homo sapiens
tattcttgctttcacaaa

SEQ ID NO: 463872 - DNA, 21 bp, Homo sapiens
tattgacgacctacatctgaa

SEQ ID NO: 463873 - DNA, 23 bp, Homo sapiens
tattgacgacctacatctgaaat

SEQ ID NO: 463874 - DNA, 15 bp, Homo sapiens
tattgtagcatttct

SEQ ID NO: 463875 - DNA, 16 bp, Homo sapiens
tattgtagcatttctt

SEQ ID NO: 463876 - DNA, 14 bp, Homo sapiens
tatttattaaactt

SEQ ID NO: 463877 - DNA, 23 bp, Homo sapiens
tatttatttctagcaaacagatg

SEQ ID NO: 463878 - DNA, 13 bp, Homo sapiens
tatttccaacaaa

SEQ ID NO: 463879 - DNA, 22 bp, Homo sapiens
tatttctaagcttatttctaac

SEQ ID NO: 463880 - DNA, 17 bp, Homo sapiens
tatttctatctgcaaat

SEQ ID NO: 463881 - DNA, 18 bp, Homo sapiens
tatttgaaaaaagaagag

SEQ ID NO: 463882 - DNA, 15 bp, Homo sapiens
tatttgatctggtgc

SEQ ID NO: 463883 - DNA, 21 bp, Homo sapiens
tatttgtagctagaatatcct

SEQ ID NO: 463884 - DNA, 14 bp, Homo sapiens
tattttaaactact

SEQ ID NO: 463885 - DNA, 21 bp, Homo sapiens
tattttaaactactgattgaa

SEQ ID NO: 463886 - DNA, 14 bp, Homo sapiens
tattttactttgtg

SEQ ID NO: 463887 - DNA, 19 bp, Homo sapiens
tattttactttgtgcaata

SEQ ID NO: 463888 - DNA, 19 bp, Homo sapiens
tattttctatatttggatt

SEQ ID NO: 463889 - DNA, 13 bp, Homo sapiens
tattttctgaatt

SEQ ID NO: 463890 - DNA, 14 bp, Homo sapiens
tattttctgaattc

SEQ ID NO: 463891 - DNA, 22 bp, Homo sapiens
tattttctgaattcataaaaat

SEQ ID NO: 463892 - DNA, 14 bp, Homo sapiens
tatttttttctagc

SEQ ID NO: 463893 - DNA, 14 bp, Homo sapiens
tcaaaatacttctt

SEQ ID NO: 463894 - DNA, 23 bp, Homo sapiens
tcaaaatagttctatttctatct

SEQ ID NO: 463895 - DNA, 12 bp, Homo sapiens
tcaaaatgcatg

SEQ ID NO: 463896 - DNA, 15 bp, Homo sapiens
tcaaacactgcttaa

SEQ ID NO: 463897 - DNA, 19 bp, Homo sapiens
tcaaacactgcttaaggaa

SEQ ID NO: 463898 - DNA, 17 bp, Homo sapiens
tcaaacaggaatttctg

SEQ ID NO: 463899 - DNA, 15 bp, Homo sapiens
tcaaacagtgtggct

SEQ ID NO: 463900 - DNA, 23 bp, Homo sapiens
tcaaacagtgtggcttaaacatt

SEQ ID NO: 463901 - DNA, 17 bp, Homo sapiens
tcaaagaacccccctcc

SEQ ID NO: 463902 - DNA, 18 bp, Homo sapiens
tcaaagaacccccctccc

SEQ ID NO: 463903 - DNA, 20 bp, Homo sapiens
tcaaagaacccccctcccca

SEQ ID NO: 463904 - DNA, 20 bp, Homo sapiens
tcaaatgagtttaaaaaaat

SEQ ID NO: 463905 - DNA, 20 bp, Homo sapiens
tcaaatgctactcagtatat

SEQ ID NO: 463906 - DNA, 17 bp, Homo sapiens
tcaacacttattttctg

SEQ ID NO: 463907 - DNA, 15 bp, Homo sapiens
tcaacagcatgtcta

SEQ ID NO: 463908 - DNA, 17 bp, Homo sapiens
tcaacagcatgtctact

SEQ ID NO: 463909 - DNA, 15 bp, Homo sapiens
tcaaccattccccat

SEQ ID NO: 463910 - DNA, 17 bp, Homo sapiens
tcaacctctcagatccc

SEQ ID NO: 463911 - DNA, 17 bp, Homo sapiens
tcaacctggtggcacca

SEQ ID NO: 463912 - DNA, 21 bp, Homo sapiens
tcaacctggtggcaccagatg

SEQ ID NO: 463913 - DNA, 21 bp, Homo sapiens
tcaactctgtgtcccagcacc

SEQ ID NO: 463914 - DNA, 21 bp, Homo sapiens
tcaactttagtatttttacta

SEQ ID NO: 463915 - DNA, 20 bp, Homo sapiens
tcaagagggcactggtggcc

SEQ ID NO: 463916 - DNA, 14 bp, Homo sapiens
tcaagccaggagac

SEQ ID NO: 463917 - DNA, 15 bp, Homo sapiens
tcaagccaggagacc

SEQ ID NO: 463918 - DNA, 21 bp, Homo sapiens
tcaagccaggagaccctgtct

SEQ ID NO: 463919 - DNA, 11 bp, Homo sapiens
tcattcttttc

SEQ ID NO: 463920 - DNA, 16 bp, Homo sapiens
tcattggttacaaatt

SEQ ID NO: 463921 - DNA, 17 bp, Homo sapiens
tcatttacaacttccag

SEQ ID NO: 463922 - DNA, 12 bp, Homo sapiens
tcatttgcatat

SEQ ID NO: 463923 - DNA, 21 bp, Homo sapiens
tccaaataggagtcttctgcc

SEQ ID NO: 463924 - DNA, 14 bp, Homo sapiens
tccaaattctctga

SEQ ID NO: 463925 - DNA, 13 bp, Homo sapiens
tccaacagacacc

SEQ ID NO: 463926 - DNA, 17 bp, Homo sapiens
tccaacagacaccctcc

SEQ ID NO: 463927 - DNA, 23 bp, Homo sapiens
tccaacagacaccctccactctg

SEQ ID NO: 463928 - DNA, 24 bp, Homo sapiens
tccaacagacaccctccactctga

SEQ ID NO: 463929 - DNA, 14 bp, Homo sapiens
tccaagtgtgtgtg

SEQ ID NO: 463930 - DNA, 21 bp, Homo sapiens
tccaagttatttgatctggtg

SEQ ID NO: 463931 - DNA, 22 bp, Homo sapiens
tccaagttatttgatctggtgc

SEQ ID NO: 463932 - DNA, 18 bp, Homo sapiens
tccaagttcattcatact

SEQ ID NO: 463933 - DNA, 14 bp, Homo sapiens
tccaataccctaga

SEQ ID NO: 463934 - DNA, 15 bp, Homo sapiens
tccaataccctagaa

SEQ ID NO: 463935 - DNA, 15 bp, Homo sapiens
tccacacctccaccc

SEQ ID NO: 463936 - DNA, 16 bp, Homo sapiens
tccacacctccacccg

SEQ ID NO: 463937 - DNA, 19 bp, Homo sapiens
tccacacctccacccgtcc

SEQ ID NO: 463938 - DNA, 20 bp, Homo sapiens
tccaccaagggtatctgctg

SEQ ID NO: 463939 - DNA, 14 bp, Homo sapiens
tccacccagaccct

SEQ ID NO: 463940 - DNA, 18 bp, Homo sapiens
tccaccccggctccccct

SEQ ID NO: 463941 - DNA, 14 bp, Homo sapiens
tccaccctcccctc

SEQ ID NO: 463942 - DNA, 17 bp, Homo sapiens
tccaccctcccctcttc

SEQ ID NO: 463943 - DNA, 14 bp, Homo sapiens
tccaccgccacccc

SEQ ID NO: 463944 - DNA, 18 bp, Homo sapiens
tccaccgccaccccactg

SEQ ID NO: 463945 - DNA, 19 bp, Homo sapiens
tccaccgccaccccactga

SEQ ID NO: 463946 - DNA, 16 bp, Homo sapiens
tccacctgtgctgctg

SEQ ID NO: 463947 - DNA, 14 bp, Homo sapiens
tccacgcctcctgg

SEQ ID NO: 463948 - DNA, 15 bp, Homo sapiens
tccacgcctcctggc

SEQ ID NO: 463949 - DNA, 19 bp, Homo sapiens
tccactcccctcatccact

SEQ ID NO: 463950 - DNA, 22 bp, Homo sapiens
tccactcctcccaactctggcc

SEQ ID NO: 463951 - DNA, 12 bp, Homo sapiens
tccactctgagg

SEQ ID NO: 463952 - DNA, 22 bp, Homo sapiens
tccactctgaggtctcaccttc

SEQ ID NO: 463953 - DNA, 21 bp, Homo sapiens
tccacttagaaattgcatttc

SEQ ID NO: 463954 - DNA, 16 bp, Homo sapiens
tccacttccagagggg

SEQ ID NO: 463955 - DNA, 17 bp, Homo sapiens
tccactttcctctctct

SEQ ID NO: 463956 - DNA, 23 bp, Homo sapiens
tccagacagagtggatctggagt

SEQ ID NO: 463957 - DNA, 16 bp, Homo sapiens
tccagacagggtgggg

SEQ ID NO: 463958 - DNA, 9 bp, Homo sapiens
tccagaccc

SEQ ID NO: 463959 - DNA, 14 bp, Homo sapiens
tccagacccctacc

SEQ ID NO: 463960 - DNA, 20 bp, Homo sapiens
tccagacccctaccctttcc

SEQ ID NO: 463961 - DNA, 17 bp, Homo sapiens
tccagacccctggcttt

SEQ ID NO: 463962 - DNA, 18 bp, Homo sapiens
tccagacccctggctttt

SEQ ID NO: 463963 - DNA, 23 bp, Homo sapiens
tccagacccctggcttttcactg

SEQ ID NO: 463964 - DNA, 10 bp, Homo sapiens
tccagagaga

SEQ ID NO: 463965 - DNA, 16 bp, Homo sapiens
tccagagagtggctcc

SEQ ID NO: 463966 - DNA, 15 bp, Homo sapiens
tccagagctcatttc

SEQ ID NO: 463967 - DNA, 21 bp, Homo sapiens
tccagagggggccagagggac

SEQ ID NO: 463968 - DNA, 16 bp, Homo sapiens
tccagattattttcta

SEQ ID NO: 463969 - DNA, 17 bp, Homo sapiens
tccagattattttctat

SEQ ID NO: 463970 - DNA, 22 bp, Homo sapiens
tccagcagtgctgggcccagcc

SEQ ID NO: 463971 - DNA, 18 bp, Homo sapiens
tccagctccccccaagat

SEQ ID NO: 463972 - DNA, 18 bp, Homo sapiens
tccagtttgttctccggg

SEQ ID NO: 463973 - DNA, 14 bp, Homo sapiens
tccatagacacagt

SEQ ID NO: 463974 - DNA, 16 bp, Homo sapiens
tccatagacacagtat

SEQ ID NO: 463975 - DNA, 19 bp, Homo sapiens
tccatatcagctctgcata

SEQ ID NO: 463976 - DNA, 20 bp, Homo sapiens
tccatatcagctctgcataa

SEQ ID NO: 463977 - DNA, 13 bp, Homo sapiens
tccatcctgagga

SEQ ID NO: 463978 - DNA, 21 bp, Homo sapiens
tccattctatgactcttgtct

SEQ ID NO: 463979 - DNA, 13 bp, Homo sapiens
tccattgtatctt

SEQ ID NO: 463980 - DNA, 17 bp, Homo sapiens
tccattttctaaactgt

SEQ ID NO: 463981 - DNA, 21 bp, Homo sapiens
tcccaacgtactcctcagacg

SEQ ID NO: 463982 - DNA, 19 bp, Homo sapiens
tcccacaaaatatttctaa

SEQ ID NO: 463983 - DNA, 17 bp, Homo sapiens
tcccacaggcccttcct

SEQ ID NO: 463984 - DNA, 21 bp, Homo sapiens
tcccacaggcccttcctctcc

SEQ ID NO: 463985 - DNA, 20 bp, Homo sapiens
tcccacccactagccctctt

SEQ ID NO: 463986 - DNA, 12 bp, Homo sapiens
tcccacccctat

SEQ ID NO: 463987 - DNA, 19 bp, Homo sapiens
tcccactgatatcacgggc

SEQ ID NO: 463988 - DNA, 11 bp, Homo sapiens
tcccagaagag

SEQ ID NO: 463989 - DNA, 22 bp, Homo sapiens
tcccagggcccgagcgcgtgcc

SEQ ID NO: 463990 - DNA, 23 bp, Homo sapiens
tcccagggcccgagcgcgtgcct

SEQ ID NO: 463991 - DNA, 17 bp, Homo sapiens
tcccatcgctggaaaac

SEQ ID NO: 463992 - DNA, 17 bp, Homo sapiens
tcccatgggggctccag

SEQ ID NO: 463993 - DNA, 13 bp, Homo sapiens
tccccaaggaaga

SEQ ID NO: 463994 - DNA, 16 bp, Homo sapiens
tccccacccaccaccg

SEQ ID NO: 463995 - DNA, 12 bp, Homo sapiens
tccccaccccat

SEQ ID NO: 463996 - DNA, 23 bp, Homo sapiens
tccccaccccataagccctgaga

SEQ ID NO: 463997 - DNA, 15 bp, Homo sapiens
tccccaccctcccct

SEQ ID NO: 463998 - DNA, 17 bp, Homo sapiens
tccccactcccgtgatg

SEQ ID NO: 463999 - DNA, 18 bp, Homo sapiens
tccccagttaatgtgcca

SEQ ID NO: 464000 - DNA, 20 bp, Homo sapiens
tccccagttaatgtgccaaa

SEQ ID NO: 464001 - DNA, 13 bp, Homo sapiens
tccccattctata

SEQ ID NO: 464002 - DNA, 17 bp, Homo sapiens
tccccattctataaatt

SEQ ID NO: 464003 - DNA, 16 bp, Homo sapiens
tcccccaggctgcgcc

SEQ ID NO: 464004 - DNA, 18 bp, Homo sapiens
tcccccaggctgcgcctg

SEQ ID NO: 464005 - DNA, 19 bp, Homo sapiens
tcccccgcagacagacaga

SEQ ID NO: 464006 - DNA, 20 bp, Homo sapiens
tccccgcagccctctccacc

SEQ ID NO: 464007 - DNA, 15 bp, Homo sapiens
tccccgcccgccctc

SEQ ID NO: 464008 - DNA, 21 bp, Homo sapiens
tccccgcccgccctcctctgc

SEQ ID NO: 464009 - DNA, 17 bp, Homo sapiens
tccccggacgctggctc

SEQ ID NO: 464010 - DNA, 14 bp, Homo sapiens
tcccctcactctgt

SEQ ID NO: 464011 - DNA, 17 bp, Homo sapiens
tcccctcactctgtcag

SEQ ID NO: 464012 - DNA, 21 bp, Homo sapiens
tcccctcactctgtcagccag

SEQ ID NO: 464013 - DNA, 21 bp, Homo sapiens
tcccctccagacccctaccct

SEQ ID NO: 464014 - DNA, 14 bp, Homo sapiens
tcccctctcctgag

SEQ ID NO: 464015 - DNA, 17 bp, Homo sapiens
tcccctctcctgagcct

SEQ ID NO: 464016 - DNA, 20 bp, Homo sapiens
tcccctgaggttaaggggat

SEQ ID NO: 464017 - DNA, 13 bp, Homo sapiens
tctctccctccac

SEQ ID NO: 464018 - DNA, 13 bp, Homo sapiens
tctctctccctcc

SEQ ID NO: 464019 - DNA, 15 bp, Homo sapiens
tctctctccctccac

SEQ ID NO: 464020 - DNA, 16 bp, Homo sapiens
tctctctccctccact

SEQ ID NO: 464021 - DNA, 10 bp, Homo sapiens
tctctctctc

SEQ ID NO: 464022 - DNA, 11 bp, Homo sapiens
tctctctctct

SEQ ID NO: 464023 - DNA, 15 bp, Homo sapiens
tctctctctctctgt

SEQ ID NO: 464024 - DNA, 13 bp, Homo sapiens
tctctctctgttc

SEQ ID NO: 464025 - DNA, 15 bp, Homo sapiens
tctctctctgttcca

SEQ ID NO: 464026 - DNA, 15 bp, Homo sapiens
tctctctggggccct

SEQ ID NO: 464027 - DNA, 21 bp, Homo sapiens
tctctctggggccctgggcct

SEQ ID NO: 464028 - DNA, 15 bp, Homo sapiens
tctctctgtgtggca

SEQ ID NO: 464029 - DNA, 16 bp, Homo sapiens
tctctctgtgtggcaa

SEQ ID NO: 464030 - DNA, 20 bp, Homo sapiens
tctctctgtgtggcaaacat

SEQ ID NO: 464031 - DNA, 16 bp, Homo sapiens
tctctctgttccaagt

SEQ ID NO: 464032 - DNA, 14 bp, Homo sapiens
tctctgatttgcaa

SEQ ID NO: 464033 - DNA, 22 bp, Homo sapiens
tctctgcaggatgggtgaaacc

SEQ ID NO: 464034 - DNA, 18 bp, Homo sapiens
tctctggggccctgggcc

SEQ ID NO: 464035 - DNA, 18 bp, Homo sapiens
tctctgtgtggcaaacat

SEQ ID NO: 464036 - DNA, 12 bp, Homo sapiens
tctctgttccaa

SEQ ID NO: 464037 - DNA, 20 bp, Homo sapiens
tctcttaccccgtccctttc

SEQ ID NO: 464038 - DNA, 11 bp, Homo sapiens
tctcttctcca

SEQ ID NO: 464039 - DNA, 17 bp, Homo sapiens
tctcttcttactgtatt

SEQ ID NO: 464040 - DNA, 20 bp, Homo sapiens
tctgaaaatatttttttcta

SEQ ID NO: 464041 - DNA, 14 bp, Homo sapiens
tctgaaatctacaa

SEQ ID NO: 464042 - DNA, 14 bp, Homo sapiens
tctgaaggagagga

SEQ ID NO: 464043 - DNA, 16 bp, Homo sapiens
tctgaaggagaggagt

SEQ ID NO: 464044 - DNA, 14 bp, Homo sapiens
tctgaaggcctcca

SEQ ID NO: 464045 - DNA, 16 bp, Homo sapiens
tctgaagtcactgcac

SEQ ID NO: 464046 - DNA, 19 bp, Homo sapiens
tctgaagtcccttcctgtc

SEQ ID NO: 464047 - DNA, 16 bp, Homo sapiens
tctgaataatttctta

SEQ ID NO: 464048 - DNA, 13 bp, Homo sapiens
tctgagcagtggg

SEQ ID NO: 464049 - DNA, 16 bp, Homo sapiens
tctgagccctgccctc

SEQ ID NO: 464050 - DNA, 16 bp, Homo sapiens
tctgagctgctaggaa

SEQ ID NO: 464051 - DNA, 19 bp, Homo sapiens
tctgaggagtccaaaatat

SEQ ID NO: 464052 - DNA, 15 bp, Homo sapiens
tctgagtccagctcc

SEQ ID NO: 464053 - DNA, 16 bp, Homo sapiens
tctgagtccagctccc

SEQ ID NO: 464054 - DNA, 17 bp, Homo sapiens
tctgagtccagctcccc

SEQ ID NO: 464055 - DNA, 14 bp, Homo sapiens
tctgatttgcaaat

SEQ ID NO: 464056 - DNA, 16 bp, Homo sapiens
tctgcagtattctgta

SEQ ID NO: 464057 - DNA, 19 bp, Homo sapiens
tctgccatgtttttgcaaa

SEQ ID NO: 464058 - DNA, 24 bp, Homo sapiens
tctgccccctcccccgcagacaga

SEQ ID NO: 464059 - DNA, 22 bp, Homo sapiens
tctgcccctccgtccccagggt

SEQ ID NO: 464060 - DNA, 19 bp, Homo sapiens
tctgccccttgaccccaca

SEQ ID NO: 464061 - DNA, 21 bp, Homo sapiens
tctgccccttgaccccacacg

SEQ ID NO: 464062 - DNA, 22 bp, Homo sapiens
tctgcctcttaacttaaaagaa

SEQ ID NO: 464063 - DNA, 12 bp, Homo sapiens
tctgccttggac

SEQ ID NO: 464064 - DNA, 13 bp, Homo sapiens
tctgcctttgagc

SEQ ID NO: 464065 - DNA, 16 bp, Homo sapiens
tctgctatgtctgtga

SEQ ID NO: 464066 - DNA, 20 bp, Homo sapiens
tctgctgcctctgaaaatat

SEQ ID NO: 464067 - DNA, 21 bp, Homo sapiens
tctgctgcctctgaaaatatt

SEQ ID NO: 464068 - DNA, 22 bp, Homo sapiens
tctgctttggggcttatcagaa

SEQ ID NO: 464069 - DNA, 12 bp, Homo sapiens
tctggagcccct

SEQ ID NO: 464070 - DNA, 20 bp, Homo sapiens
tctggagcccctatcctgca

SEQ ID NO: 464071 - DNA, 15 bp, Homo sapiens
tctggatcctgcact

SEQ ID NO: 464072 - DNA, 15 bp, Homo sapiens
tctggctgtggcccc

SEQ ID NO: 464073 - DNA, 15 bp, Homo sapiens
tctggcttctgcatt

SEQ ID NO: 464074 - DNA, 16 bp, Homo sapiens
tctggggccctgggcc

SEQ ID NO: 464075 - DNA, 14 bp, Homo sapiens
tctggggtggggct

SEQ ID NO: 464076 - DNA, 19 bp, Homo sapiens
tctggggtggggcttggaa

SEQ ID NO: 464077 - DNA, 19 bp, Homo sapiens
tctgtaaatttaactgcat

SEQ ID NO: 464078 - DNA, 17 bp, Homo sapiens
tctgtatatcagctcta

SEQ ID NO: 464079 - DNA, 18 bp, Homo sapiens
tctgtatatcagctctaa

SEQ ID NO: 464080 - DNA, 20 bp, Homo sapiens
tctgtatttaatggttttta

SEQ ID NO: 464081 - DNA, 21 bp, Homo sapiens
tctgtcagccagccgccctgg

SEQ ID NO: 464082 - DNA, 22 bp, Homo sapiens
tctgtcagccagccgccctggg

SEQ ID NO: 464083 - DNA, 21 bp, Homo sapiens
tctgtcatctctctggggccc

SEQ ID NO: 464084 - DNA, 19 bp, Homo sapiens
tctgtcattggttacaaat

SEQ ID NO: 464085 - DNA, 11 bp, Homo sapiens
tctgtctgagc

SEQ ID NO: 464086 - DNA, 14 bp, Homo sapiens
tctgtctgagccct

SEQ ID NO: 464087 - DNA, 19 bp, Homo sapiens
tctgtctgagccctgccct

SEQ ID NO: 464088 - DNA, 14 bp, Homo sapiens
tctgtctgattcta

SEQ ID NO: 464089 - DNA, 16 bp, Homo sapiens
tctgtctgattctatg

SEQ ID NO: 464090 - DNA, 17 bp, Homo sapiens
tctgtctgattctatgc

SEQ ID NO: 464091 - DNA, 23 bp, Homo sapiens
tctgtctttatgtaagaagaaac

SEQ ID NO: 464092 - DNA, 18 bp, Homo sapiens
tctgtgaagcctttatct

SEQ ID NO: 464093 - DNA, 23 bp, Homo sapiens
tctgtgatgtcagtagtgcctgt

SEQ ID NO: 464094 - DNA, 17 bp, Homo sapiens
tctgtgcaataaaacca

SEQ ID NO: 464095 - DNA, 15 bp, Homo sapiens
tctgtggattctata

SEQ ID NO: 464096 - DNA, 20 bp, Homo sapiens
tctgtggattctatatttca

SEQ ID NO: 464097 - DNA, 22 bp, Homo sapiens
tctgtggattctatatttcata

SEQ ID NO: 464098 - DNA, 16 bp, Homo sapiens
tctgtgggactggccc

SEQ ID NO: 464099 - DNA, 23 bp, Homo sapiens
tctgtgggactggcccacccctc

SEQ ID NO: 464100 - DNA, 12 bp, Homo sapiens
tctgtgtggcaa

SEQ ID NO: 464101 - DNA, 10 bp, Homo sapiens
tctgttccaa

SEQ ID NO: 464102 - DNA, 12 bp, Homo sapiens
tctgttccaagt

SEQ ID NO: 464103 - DNA, 15 bp, Homo sapiens
tctgttccaagtgtg

SEQ ID NO: 464104 - DNA, 21 bp, Homo sapiens
tctgttccaagtgtgtgtgca

SEQ ID NO: 464105 - DNA, 18 bp, Homo sapiens
tctgtttaccctccctgt

SEQ ID NO: 464106 - DNA, 23 bp, Homo sapiens
tctgtttaccctccctgtcccct

SEQ ID NO: 464107 - DNA, 17 bp, Homo sapiens
tcttaacttaaaagaac

SEQ ID NO: 464108 - DNA, 14 bp, Homo sapiens
tcttactaaacatt

SEQ ID NO: 464109 - DNA, 24 bp, Homo sapiens
tcttactaaacattttgttattgg

SEQ ID NO: 464110 - DNA, 22 bp, Homo sapiens
tcttagagaataagaataataa

SEQ ID NO: 464111 - DNA, 19 bp, Homo sapiens
tcttatattaaagaagttg

SEQ ID NO: 464112 - DNA, 23 bp, Homo sapiens
tcttatctagcaagaagattcta

SEQ ID NO: 464113 - DNA, 20 bp, Homo sapiens
tcttcaaccctgccctgcac

SEQ ID NO: 464114 - DNA, 13 bp, Homo sapiens
tcttcaaggccaa

SEQ ID NO: 464115 - DNA, 16 bp, Homo sapiens
tgcatttaaaatggac

SEQ ID NO: 464116 - DNA, 21 bp, Homo sapiens
tgcatttgagagaagccacgc

SEQ ID NO: 464117 - DNA, 23 bp, Homo sapiens
tgcatttgagagaagccacgctg

SEQ ID NO: 464118 - DNA, 19 bp, Homo sapiens
tgccaaaaactaaaattca

SEQ ID NO: 464119 - DNA, 14 bp, Homo sapiens
tgccaaagatagca

SEQ ID NO: 464120 - DNA, 21 bp, Homo sapiens
tgccaaagatagcagaagagt

SEQ ID NO: 464121 - DNA, 15 bp, Homo sapiens
tgccacacttcaggc

SEQ ID NO: 464122 - DNA, 22 bp, Homo sapiens
tgccacacttcaggctcttctc

SEQ ID NO: 464123 - DNA, 16 bp, Homo sapiens
tgccagacagagatca

SEQ ID NO: 464124 - DNA, 20 bp, Homo sapiens
tgccagacagagatcagaat

SEQ ID NO: 464125 - DNA, 14 bp, Homo sapiens
tgccatgatctgta

SEQ ID NO: 464126 - DNA, 18 bp, Homo sapiens
tgccattagactgaattt

SEQ ID NO: 464127 - DNA, 19 bp, Homo sapiens
tgccattagactgaattta

SEQ ID NO: 464128 - DNA, 21 bp, Homo sapiens
tgcccaagaatagatgctgac

SEQ ID NO: 464129 - DNA, 12 bp, Homo sapiens
tgcccaccctgg

SEQ ID NO: 464130 - DNA, 17 bp, Homo sapiens
tgcccaccctgggcctc

SEQ ID NO: 464131 - DNA, 15 bp, Homo sapiens
tgcccagtcttgagt

SEQ ID NO: 464132 - DNA, 19 bp, Homo sapiens
tgcccagtcttgagtgggc

SEQ ID NO: 464133 - DNA, 15 bp, Homo sapiens
tgcccagtctttgga

SEQ ID NO: 464134 - DNA, 23 bp, Homo sapiens
tgcccagttagcccggccaagga

SEQ ID NO: 464135 - DNA, 18 bp, Homo sapiens
tgcccatgtgtcccctca

SEQ ID NO: 464136 - DNA, 22 bp, Homo sapiens
tgcccatgtgtcccctcactct

SEQ ID NO: 464137 - DNA, 17 bp, Homo sapiens
tgccccctcccccgcag

SEQ ID NO: 464138 - DNA, 22 bp, Homo sapiens
tgccccctcccccgcagacaga

SEQ ID NO: 464139 - DNA, 16 bp, Homo sapiens
tgccccgcgtcttcag

SEQ ID NO: 464140 - DNA, 15 bp, Homo sapiens
tgcccctcccttcaa

SEQ ID NO: 464141 - DNA, 17 bp, Homo sapiens
tgccccttgaccccaca

SEQ ID NO: 464142 - DNA, 21 bp, Homo sapiens
tgccccttgaccccacacgcc

SEQ ID NO: 464143 - DNA, 19 bp, Homo sapiens
tgccctcactccactcccc

SEQ ID NO: 464144 - DNA, 20 bp, Homo sapiens
tgccctcactccactcccct

SEQ ID NO: 464145 - DNA, 20 bp, Homo sapiens
tgccctccctcggccccacc

SEQ ID NO: 464146 - DNA, 19 bp, Homo sapiens
tgccctcgtctccctggcc

SEQ ID NO: 464147 - DNA, 14 bp, Homo sapiens
tgccctgcaccttg

SEQ ID NO: 464148 - DNA, 14 bp, Homo sapiens
tgccctggtgctgc

SEQ ID NO: 464149 - DNA, 17 bp, Homo sapiens
tgccgctgcaccacggc

SEQ ID NO: 464150 - DNA, 18 bp, Homo sapiens
tgccgctgccgctgcacc

SEQ ID NO: 464151 - DNA, 19 bp, Homo sapiens
tgcctcgagtccccccacc

SEQ ID NO: 464152 - DNA, 12 bp, Homo sapiens
tgcctgagcccg

SEQ ID NO: 464153 - DNA, 14 bp, Homo sapiens
tgcctgagcccgaa

SEQ ID NO: 464154 - DNA, 14 bp, Homo sapiens
tgcctgcaccagga

SEQ ID NO: 464155 - DNA, 18 bp, Homo sapiens
tgcctgcaccaggagaca

SEQ ID NO: 464156 - DNA, 20 bp, Homo sapiens
tgcctgcaccaggagacaga

SEQ ID NO: 464157 - DNA, 19 bp, Homo sapiens
tgcctggtgcgctgtgctc

SEQ ID NO: 464158 - DNA, 23 bp, Homo sapiens
tgcctggtgcgctgtgctccagc

SEQ ID NO: 464159 - DNA, 15 bp, Homo sapiens
tgcctgtatttccaa

SEQ ID NO: 464160 - DNA, 16 bp, Homo sapiens
tgccttctgttttcca

SEQ ID NO: 464161 - DNA, 21 bp, Homo sapiens
tgcctttagcgtgtaaatgga

SEQ ID NO: 464162 - DNA, 18 bp, Homo sapiens
tgcctttgagcttctcct

SEQ ID NO: 464163 - DNA, 13 bp, Homo sapiens
tgcctttgatgtg

SEQ ID NO: 464164 - DNA, 11 bp, Homo sapiens
tgcgccctccc

SEQ ID NO: 464165 - DNA, 17 bp, Homo sapiens
tgcgccctccctccctc

SEQ ID NO: 464166 - DNA, 21 bp, Homo sapiens
tgcgccctccctccctccaca

SEQ ID NO: 464167 - DNA, 12 bp, Homo sapiens
tgcgcctgcccg

SEQ ID NO: 464168 - DNA, 13 bp, Homo sapiens
tgcgctcctctgc

SEQ ID NO: 464169 - DNA, 17 bp, Homo sapiens
tgcgctcctctgcagcc

SEQ ID NO: 464170 - DNA, 15 bp, Homo sapiens
tgcgctgtgctccag

SEQ ID NO: 464171 - DNA, 18 bp, Homo sapiens
tgcgctgtgctccagcag

SEQ ID NO: 464172 - DNA, 16 bp, Homo sapiens
tgcggaccggagcggc

SEQ ID NO: 464173 - DNA, 18 bp, Homo sapiens
tgcggaccggagcggctg

SEQ ID NO: 464174 - DNA, 20 bp, Homo sapiens
tgcggaccggagcggctgag

SEQ ID NO: 464175 - DNA, 20 bp, Homo sapiens
tgcggcaccgcccacccaca

SEQ ID NO: 464176 - DNA, 22 bp, Homo sapiens
tgcgtgaccggcccgccacctt

SEQ ID NO: 464177 - DNA, 20 bp, Homo sapiens
tgcgtgtggccctgtgggag

SEQ ID NO: 464178 - DNA, 13 bp, Homo sapiens
tgctaatgtaatc

SEQ ID NO: 464179 - DNA, 18 bp, Homo sapiens
tgctaatgtaatcattta

SEQ ID NO: 464180 - DNA, 12 bp, Homo sapiens
tgctactcagta

SEQ ID NO: 464181 - DNA, 14 bp, Homo sapiens
tgctagcacaatat

SEQ ID NO: 464182 - DNA, 13 bp, Homo sapiens
tgctagctgtaga

SEQ ID NO: 464183 - DNA, 15 bp, Homo sapiens
tgctcaataaaggtc

SEQ ID NO: 464184 - DNA, 16 bp, Homo sapiens
tgctcacgtctgtgag

SEQ ID NO: 464185 - DNA, 17 bp, Homo sapiens
tgctcacgtctgtgagt

SEQ ID NO: 464186 - DNA, 23 bp, Homo sapiens
tgctcacgtctgtgagtctgtcc

SEQ ID NO: 464187 - DNA, 20 bp, Homo sapiens
tgctcagcaaggggctctgc

SEQ ID NO: 464188 - DNA, 15 bp, Homo sapiens
tgctcatgggaagaa

SEQ ID NO: 464189 - DNA, 16 bp, Homo sapiens
tgctccaacagacacc

SEQ ID NO: 464190 - DNA, 20 bp, Homo sapiens
tgctccagcagtgctgggcc

SEQ ID NO: 464191 - DNA, 16 bp, Homo sapiens
tgctcggacacagttt

SEQ ID NO: 464192 - DNA, 19 bp, Homo sapiens
tgctcgggaaggcctgagg

SEQ ID NO: 464193 - DNA, 15 bp, Homo sapiens
tgctgaagtctcccc

SEQ ID NO: 464194 - DNA, 16 bp, Homo sapiens
tgctgaagtctccccg

SEQ ID NO: 464195 - DNA, 21 bp, Homo sapiens
tgctgactgtactcctcccag

SEQ ID NO: 464196 - DNA, 22 bp, Homo sapiens
tgctgactgtactcctcccagg

SEQ ID NO: 464197 - DNA, 14 bp, Homo sapiens
tgctgcaatacatt

SEQ ID NO: 464198 - DNA, 15 bp, Homo sapiens
tgctgccacacttca

SEQ ID NO: 464199 - DNA, 19 bp, Homo sapiens
tgctgccacacttcaggct

SEQ ID NO: 464200 - DNA, 24 bp, Homo sapiens
tgctgccccacaacacaccttgcc

SEQ ID NO: 464201 - DNA, 12 bp, Homo sapiens
tgctgctgtgaa

SEQ ID NO: 464202 - DNA, 14 bp, Homo sapiens
tgctgctgtgaatt

SEQ ID NO: 464203 - DNA, 15 bp, Homo sapiens
tgctggccagcaccc

SEQ ID NO: 464204 - DNA, 16 bp, Homo sapiens
tgctggccagcaccct

SEQ ID NO: 464205 - DNA, 13 bp, Homo sapiens
tgctggctgcctt

SEQ ID NO: 464206 - DNA, 13 bp, Homo sapiens
tgctgggcccagc

SEQ ID NO: 464207 - DNA, 23 bp, Homo sapiens
tgctgggcccagccggggtgggg

SEQ ID NO: 464208 - DNA, 13 bp, Homo sapiens
tgctgtgggcagc

SEQ ID NO: 464209 - DNA, 16 bp, Homo sapiens
tgctgtgggcagcacc

SEQ ID NO: 464210 - DNA, 18 bp, Homo sapiens
tgctgtgggcagcaccct

SEQ ID NO: 464211 - DNA, 15 bp, Homo sapiens
tgctgtttatatata

SEQ ID NO: 464212 - DNA, 17 bp, Homo sapiens
tgctgttttatgtcata

SEQ ID NO: 464213 - DNA, 14 bp, Homo sapiens
tgtcatactctgtg

SEQ ID NO: 464214 - DNA, 16 bp, Homo sapiens
tgtcattcaagcctgt

SEQ ID NO: 464215 - DNA, 23 bp, Homo sapiens
tgtcattcaagcctgtgaataaa

SEQ ID NO: 464216 - DNA, 17 bp, Homo sapiens
tgtcattggttacaaat

SEQ ID NO: 464217 - DNA, 19 bp, Homo sapiens
tgtccacctgtgctgctgc

SEQ ID NO: 464218 - DNA, 12 bp, Homo sapiens
tgtcccacaaaa

SEQ ID NO: 464219 - DNA, 18 bp, Homo sapiens
tgtcccagcacctggcac

SEQ ID NO: 464220 - DNA, 15 bp, Homo sapiens
tgtccccattctata

SEQ ID NO: 464221 - DNA, 23 bp, Homo sapiens
tgtcccctcactctgtcagccag

SEQ ID NO: 464222 - DNA, 22 bp, Homo sapiens
tgtccctaccgagtctcttctc

SEQ ID NO: 464223 - DNA, 22 bp, Homo sapiens
tgtcctattactgatgtgtgca

SEQ ID NO: 464224 - DNA, 18 bp, Homo sapiens
tgtcctcaggtgaataac

SEQ ID NO: 464225 - DNA, 14 bp, Homo sapiens
tgtcctccagggcg

SEQ ID NO: 464226 - DNA, 15 bp, Homo sapiens
tgtcctccagggcga

SEQ ID NO: 464227 - DNA, 18 bp, Homo sapiens
tgtcctgctcacgtctgt

SEQ ID NO: 464228 - DNA, 19 bp, Homo sapiens
tgtcgccccaggccctccc

SEQ ID NO: 464229 - DNA, 12 bp, Homo sapiens
tgtctactgctt

SEQ ID NO: 464230 - DNA, 15 bp, Homo sapiens
tgtctagtttgcata

SEQ ID NO: 464231 - DNA, 21 bp, Homo sapiens
tgtctagtttgcatacttcct

SEQ ID NO: 464232 - DNA, 19 bp, Homo sapiens
tgtctcaagagggcactgg

SEQ ID NO: 464233 - DNA, 21 bp, Homo sapiens
tgtctcaagagggcactggtg

SEQ ID NO: 464234 - DNA, 23 bp, Homo sapiens
tgtctctccctaccctcttctca

SEQ ID NO: 464235 - DNA, 13 bp, Homo sapiens
tgtctctgaggac

SEQ ID NO: 464236 - DNA, 17 bp, Homo sapiens
tgtctgaagtcactgca

SEQ ID NO: 464237 - DNA, 20 bp, Homo sapiens
tgtctgaagtcactgcacag

SEQ ID NO: 464238 - DNA, 13 bp, Homo sapiens
tgtctgagccctg

SEQ ID NO: 464239 - DNA, 20 bp, Homo sapiens
tgtctgagccctgccctcac

SEQ ID NO: 464240 - DNA, 12 bp, Homo sapiens
tgtctgattcta

SEQ ID NO: 464241 - DNA, 18 bp, Homo sapiens
tgtctggctgtggcccct

SEQ ID NO: 464242 - DNA, 19 bp, Homo sapiens
tgtctggctgtggcccctc

SEQ ID NO: 464243 - DNA, 20 bp, Homo sapiens
tgtctggctgtggcccctcc

SEQ ID NO: 464244 - DNA, 23 bp, Homo sapiens
tgtcttcaaccctgccctgcacc

SEQ ID NO: 464245 - DNA, 19 bp, Homo sapiens
tgtctttatgtaagaagaa

SEQ ID NO: 464246 - DNA, 20 bp, Homo sapiens
tgtctttatgtaagaagaaa

SEQ ID NO: 464247 - DNA, 23 bp, Homo sapiens
tgtctttatgtaagaagaaactg

SEQ ID NO: 464248 - DNA, 22 bp, Homo sapiens
tgtgaaacagggagctatgaga

SEQ ID NO: 464249 - DNA, 14 bp, Homo sapiens
tgtgacttctctct

SEQ ID NO: 464250 - DNA, 20 bp, Homo sapiens
tgtgagtctgtcctttccca

SEQ ID NO: 464251 - DNA, 21 bp, Homo sapiens
tgtgagtctgtcctttcccac

SEQ ID NO: 464252 - DNA, 13 bp, Homo sapiens
tgtgattgaatct

SEQ ID NO: 464253 - DNA, 19 bp, Homo sapiens
tgtgattggcagcttcaaa

SEQ ID NO: 464254 - DNA, 21 bp, Homo sapiens
tgtgccaaaatgtcaattttt

SEQ ID NO: 464255 - DNA, 20 bp, Homo sapiens
tgtgccaaagatagcagaag

SEQ ID NO: 464256 - DNA, 16 bp, Homo sapiens
tgtgcctgcaccagga

SEQ ID NO: 464257 - DNA, 19 bp, Homo sapiens
tgtgctccagcagtgctgg

SEQ ID NO: 464258 - DNA, 20 bp, Homo sapiens
tgtgctccagcagtgctggg

SEQ ID NO: 464259 - DNA, 14 bp, Homo sapiens
tgtgctcggacaca

SEQ ID NO: 464260 - DNA, 16 bp, Homo sapiens
tgtgctcggacacagt

SEQ ID NO: 464261 - DNA, 19 bp, Homo sapiens
tgtgctgtgggcagcaccc

SEQ ID NO: 464262 - DNA, 21 bp, Homo sapiens
tgtgctgtgggcagcaccctc

SEQ ID NO: 464263 - DNA, 22 bp, Homo sapiens
tgtgctgtgggcagcaccctcc

SEQ ID NO: 464264 - DNA, 19 bp, Homo sapiens
tgtgcttgttcttcctctt

SEQ ID NO: 464265 - DNA, 14 bp, Homo sapiens
tgtgctttcatgtt

SEQ ID NO: 464266 - DNA, 19 bp, Homo sapiens
tgtggagtggaggggtcag

SEQ ID NO: 464267 - DNA, 13 bp, Homo sapiens
tgtggatgctctt

SEQ ID NO: 464268 - DNA, 15 bp, Homo sapiens
tgtggcaaacattta

SEQ ID NO: 464269 - DNA, 22 bp, Homo sapiens
tgtggcccctccttctcccctc

SEQ ID NO: 464270 - DNA, 15 bp, Homo sapiens
tgtggccctgtggga

SEQ ID NO: 464271 - DNA, 16 bp, Homo sapiens
tgtggccctgtgggag

SEQ ID NO: 464272 - DNA, 15 bp, Homo sapiens
tgtggcctcagccct

SEQ ID NO: 464273 - DNA, 16 bp, Homo sapiens
tgtgggactggcccac

SEQ ID NO: 464274 - DNA, 20 bp, Homo sapiens
tgtgggagtccactttcctc

SEQ ID NO: 464275 - DNA, 13 bp, Homo sapiens
tgtgggcagcacc

SEQ ID NO: 464276 - DNA, 14 bp, Homo sapiens
tgtgggcagcaccc

SEQ ID NO: 464277 - DNA, 20 bp, Homo sapiens
tgtgggggtggccatccctg

SEQ ID NO: 464278 - DNA, 14 bp, Homo sapiens
tgtggggtaagttg

SEQ ID NO: 464279 - DNA, 16 bp, Homo sapiens
tgtgtaatctctgatt

SEQ ID NO: 464280 - DNA, 20 bp, Homo sapiens
tgtgtattctgtggattcta

SEQ ID NO: 464281 - DNA, 16 bp, Homo sapiens
tgtgtccatgtgaaat

SEQ ID NO: 464282 - DNA, 22 bp, Homo sapiens
tgtgtcccatgcataacacact

SEQ ID NO: 464283 - DNA, 14 bp, Homo sapiens
tgtgtcccctcact

SEQ ID NO: 464284 - DNA, 15 bp, Homo sapiens
tgtgtcccctcactc

SEQ ID NO: 464285 - DNA, 19 bp, Homo sapiens
tgtgtcccctcactctgtc

SEQ ID NO: 464286 - DNA, 16 bp, Homo sapiens
tgtgtctccagctgat

SEQ ID NO: 464287 - DNA, 13 bp, Homo sapiens
tgtgtgcaatgtt

SEQ ID NO: 464288 - DNA, 16 bp, Homo sapiens
tgtgtggcaaacattt

SEQ ID NO: 464289 - DNA, 18 bp, Homo sapiens
tgtgtgggtttactctgt

SEQ ID NO: 464290 - DNA, 14 bp, Homo sapiens
tgtgtgtgcaatgt

SEQ ID NO: 464291 - DNA, 19 bp, Homo sapiens
tgtgttgccattttgtctg

SEQ ID NO: 464292 - DNA, 19 bp, Homo sapiens
tgttaaacgtcacagcagt

SEQ ID NO: 464293 - DNA, 20 bp, Homo sapiens
tgttaaggacttctgcagct

SEQ ID NO: 464294 - DNA, 15 bp, Homo sapiens
tgttatatcagcaga

SEQ ID NO: 464295 - DNA, 14 bp, Homo sapiens
tgttatgtaaacat

SEQ ID NO: 464296 - DNA, 22 bp, Homo sapiens
tgttcaaagaacccccctcccc

SEQ ID NO: 464297 - DNA, 12 bp, Homo sapiens
tgttcacacaca

SEQ ID NO: 464298 - DNA, 13 bp, Homo sapiens
tgttcacacacac

SEQ ID NO: 464299 - DNA, 14 bp, Homo sapiens
tgttccaagtgtgt

SEQ ID NO: 464300 - DNA, 21 bp, Homo sapiens
tgttccaagtgtgtgtgcaat

SEQ ID NO: 464301 - DNA, 15 bp, Homo sapiens
tgttccgttcatctg

SEQ ID NO: 464302 - DNA, 19 bp, Homo sapiens
tgttccgttcatctgagga

SEQ ID NO: 464303 - DNA, 20 bp, Homo sapiens
tgttccgttcatctgaggag

SEQ ID NO: 464304 - DNA, 18 bp, Homo sapiens
tgttgcaaattattctag

SEQ ID NO: 464305 - DNA, 20 bp, Homo sapiens
tgttgcttagtcacttattt

SEQ ID NO: 464306 - DNA, 22 bp, Homo sapiens
tgtttataggaaataaatctaa

SEQ ID NO: 464307 - DNA, 21 bp, Homo sapiens
tgtttatattgtttttatata

SEQ ID NO: 464308 - DNA, 19 bp, Homo sapiens
tgtttcaatgacctgtatt

SEQ ID NO: 464309 - DNA, 14 bp, Homo sapiens
tgtttcgcatccac

SEQ ID NO: 464310 - DNA, 19 bp, Homo sapiens
ttctgtgcaataaaaccaa

SEQ ID NO: 464311 - DNA, 19 bp, Homo sapiens
ttctgtggattctatattt

SEQ ID NO: 464312 - DNA, 12 bp, Homo sapiens
ttctgtggctca

SEQ ID NO: 464313 - DNA, 15 bp, Homo sapiens
ttctgttttagagtt

SEQ ID NO: 464314 - DNA, 20 bp, Homo sapiens
ttcttcatccatagacacag

SEQ ID NO: 464315 - DNA, 12 bp, Homo sapiens
ttcttgaataaa

SEQ ID NO: 464316 - DNA, 17 bp, Homo sapiens
ttcttgctttcacaaat

SEQ ID NO: 464317 - DNA, 18 bp, Homo sapiens
ttcttggtgactgtccca

SEQ ID NO: 464318 - DNA, 20 bp, Homo sapiens
ttctttaacatacatctaag

SEQ ID NO: 464319 - DNA, 12 bp, Homo sapiens
ttctttctatgt

SEQ ID NO: 464320 - DNA, 15 bp, Homo sapiens
ttcttttatatctgt

SEQ ID NO: 464321 - DNA, 16 bp, Homo sapiens
ttcttttatatctgta

SEQ ID NO: 464322 - DNA, 23 bp, Homo sapiens
ttcttttcagcttgtttctatac

SEQ ID NO: 464323 - DNA, 23 bp, Homo sapiens
ttcttttgaatcaatctggcttc

SEQ ID NO: 464324 - DNA, 21 bp, Homo sapiens
ttcttttttcaatgtactgta

SEQ ID NO: 464325 - DNA, 17 bp, Homo sapiens
ttgaagggaaatcaatt

SEQ ID NO: 464326 - DNA, 19 bp, Homo sapiens
ttgaatcaatctggcttct

SEQ ID NO: 464327 - DNA, 23 bp, Homo sapiens
ttgaatctgattggacattttct

SEQ ID NO: 464328 - DNA, 20 bp, Homo sapiens
ttgaatgtccccattctata

SEQ ID NO: 464329 - DNA, 13 bp, Homo sapiens
ttgacctttattt

SEQ ID NO: 464330 - DNA, 21 bp, Homo sapiens
ttgacgacctacatctgaaat

SEQ ID NO: 464331 - DNA, 16 bp, Homo sapiens
ttgactataaaaactg

SEQ ID NO: 464332 - DNA, 15 bp, Homo sapiens
ttgagcaaggcaaga

SEQ ID NO: 464333 - DNA, 16 bp, Homo sapiens
ttgagcttctcctctg

SEQ ID NO: 464334 - DNA, 17 bp, Homo sapiens
ttgagtccattgcaaaa

SEQ ID NO: 464335 - DNA, 17 bp, Homo sapiens
ttgagtgggccccctct

SEQ ID NO: 464336 - DNA, 18 bp, Homo sapiens
ttgagtgggccccctctc

SEQ ID NO: 464337 - DNA, 13 bp, Homo sapiens
ttgatatgtaaca

SEQ ID NO: 464338 - DNA, 22 bp, Homo sapiens
ttgatattttcaacgcagccct

SEQ ID NO: 464339 - DNA, 20 bp, Homo sapiens
ttgatcgatgttaaacgtca

SEQ ID NO: 464340 - DNA, 12 bp, Homo sapiens
ttgatctggtgc

SEQ ID NO: 464341 - DNA, 20 bp, Homo sapiens
ttgatctggtgcgtgtggcc

SEQ ID NO: 464342 - DNA, 23 bp, Homo sapiens
ttgatggtagaaattttatctct

SEQ ID NO: 464343 - DNA, 13 bp, Homo sapiens
ttgattaaaagca

SEQ ID NO: 464344 - DNA, 14 bp, Homo sapiens
ttgcaaaaggttaa

SEQ ID NO: 464345 - DNA, 20 bp, Homo sapiens
ttgcaaatgcacatttgtca

SEQ ID NO: 464346 - DNA, 15 bp, Homo sapiens
ttgcaaattattcta

SEQ ID NO: 464347 - DNA, 19 bp, Homo sapiens
ttgcaaattattctagtca

SEQ ID NO: 464348 - DNA, 20 bp, Homo sapiens
ttgcaaattattctagtcaa

SEQ ID NO: 464349 - DNA, 15 bp, Homo sapiens
ttgcactgtatccaa

SEQ ID NO: 464350 - DNA, 15 bp, Homo sapiens
ttgcacttctgttat

SEQ ID NO: 464351 - DNA, 13 bp, Homo sapiens
ttgcagaaaaaga

SEQ ID NO: 464352 - DNA, 14 bp, Homo sapiens
ttgcagagtaaatc

SEQ ID NO: 464353 - DNA, 20 bp, Homo sapiens
ttgcaggaagagatgctcta

SEQ ID NO: 464354 - DNA, 13 bp, Homo sapiens
ttgcagtaaagtt

SEQ ID NO: 464355 - DNA, 14 bp, Homo sapiens
ttgccagacttaaa

SEQ ID NO: 464356 - DNA, 14 bp, Homo sapiens
ttgccatccttgca

SEQ ID NO: 464357 - DNA, 18 bp, Homo sapiens
ttgcctcgagtcccccca

SEQ ID NO: 464358 - DNA, 19 bp, Homo sapiens
ttgctcctgcatgcaacta

SEQ ID NO: 464359 - DNA, 16 bp, Homo sapiens
ttgctccttgaataag

SEQ ID NO: 464360 - DNA, 14 bp, Homo sapiens
ttgctgtcctccag

SEQ ID NO: 464361 - DNA, 20 bp, Homo sapiens
ttgctgtcctccagggcgag

SEQ ID NO: 464362 - DNA, 22 bp, Homo sapiens
ttgcttagtcacttatttcata

SEQ ID NO: 464363 - DNA, 23 bp, Homo sapiens
ttgctttaaagtacctgtagtga

SEQ ID NO: 464364 - DNA, 13 bp, Homo sapiens
ttgctttgtatgc

SEQ ID NO: 464365 - DNA, 23 bp, Homo sapiens
ttggaacagacctcactgctttg

SEQ ID NO: 464366 - DNA, 23 bp, Homo sapiens
ttggaagggcgctgagggcaggg

SEQ ID NO: 464367 - DNA, 19 bp, Homo sapiens
ttggagagctcagtacagg

SEQ ID NO: 464368 - DNA, 19 bp, Homo sapiens
ttggagaggaggtgtggag

SEQ ID NO: 464369 - DNA, 23 bp, Homo sapiens
ttggagcagagacggcagcccca

SEQ ID NO: 464370 - DNA, 19 bp, Homo sapiens
ttggataggagcttccaga

SEQ ID NO: 464371 - DNA, 12 bp, Homo sapiens
ttggattcacag

SEQ ID NO: 464372 - DNA, 20 bp, Homo sapiens
ttggattcacagcctttgcg

SEQ ID NO: 464373 - DNA, 16 bp, Homo sapiens
ttggcagcttcaaaac

SEQ ID NO: 464374 - DNA, 22 bp, Homo sapiens
ttggcatctctccccatatata

SEQ ID NO: 464375 - DNA, 21 bp, Homo sapiens
ttggcatggatttcctttgac

SEQ ID NO: 464376 - DNA, 13 bp, Homo sapiens
ttggcattatctc

SEQ ID NO: 464377 - DNA, 23 bp, Homo sapiens
ttggcctgtccacctgtgctgct

SEQ ID NO: 464378 - DNA, 17 bp, Homo sapiens
ttggctcctttcccaca

SEQ ID NO: 464379 - DNA, 19 bp, Homo sapiens
ttggctcctttcccacagt

SEQ ID NO: 464380 - DNA, 16 bp, Homo sapiens
ttggctctgttgctgt

SEQ ID NO: 464381 - DNA, 16 bp, Homo sapiens
ttgggaaattcttgca

SEQ ID NO: 464382 - DNA, 20 bp, Homo sapiens
ttgggaaattcttgcactgt

SEQ ID NO: 464383 - DNA, 15 bp, Homo sapiens
ttggggcttatcaga

SEQ ID NO: 464384 - DNA, 20 bp, Homo sapiens
ttggggcttatcagaactcc

SEQ ID NO: 464385 - DNA, 16 bp, Homo sapiens
ttgggggattcaaatg

SEQ ID NO: 464386 - DNA, 14 bp, Homo sapiens
ttgggttccagaca

SEQ ID NO: 464387 - DNA, 19 bp, Homo sapiens
ttggtaatgatgattcaat

SEQ ID NO: 464388 - DNA, 23 bp, Homo sapiens
ttggtaatgatgattcaatcatt

SEQ ID NO: 464389 - DNA, 12 bp, Homo sapiens
ttggtgaataac

SEQ ID NO: 464390 - DNA, 14 bp, Homo sapiens
ttggtgaataacct

SEQ ID NO: 464391 - DNA, 23 bp, Homo sapiens
ttggtggccgcaaccacttgcta

SEQ ID NO: 464392 - DNA, 15 bp, Homo sapiens
ttggttcctccagca

SEQ ID NO: 464393 - DNA, 20 bp, Homo sapiens
ttggttttaaaaaagcatta

SEQ ID NO: 464394 - DNA, 19 bp, Homo sapiens
ttgtaaataatgcttaaca

SEQ ID NO: 464395 - DNA, 14 bp, Homo sapiens
ttgtacttgaataa

SEQ ID NO: 464396 - DNA, 16 bp, Homo sapiens
ttgtagcatttcttga

SEQ ID NO: 464397 - DNA, 17 bp, Homo sapiens
ttgtattttaataaaga

SEQ ID NO: 464398 - DNA, 16 bp, Homo sapiens
ttgtcacttctgctgt

SEQ ID NO: 464399 - DNA, 18 bp, Homo sapiens
ttgtctgaagtcactgca

SEQ ID NO: 464400 - DNA, 20 bp, Homo sapiens
ttgtctgaagtcactgcaca

SEQ ID NO: 464401 - DNA, 20 bp, Homo sapiens
ttgtctggctgtggcccctc

SEQ ID NO: 464402 - DNA, 17 bp, Homo sapiens
ttgtgacaggaaagccc

SEQ ID NO: 464403 - DNA, 23 bp, Homo sapiens
ttgtgacaggaaagccctccccc

SEQ ID NO: 464404 - DNA, 15 bp, Homo sapiens
ttgtgctgtgggcag

SEQ ID NO: 464405 - DNA, 19 bp, Homo sapiens
ttgtgctgtgggcagcacc

SEQ ID NO: 464406 - DNA, 18 bp, Homo sapiens
ttgtggactttatttaat

SEQ ID NO: 464407 - DNA, 19 bp, Homo sapiens
ttttactcaggctttctat

SEQ ID NO: 464408 - DNA, 20 bp, Homo sapiens
ttttactcaggctttctatt

SEQ ID NO: 464409 - DNA, 22 bp, Homo sapiens
ttttactcaggctttctattgg

SEQ ID NO: 464410 - DNA, 17 bp, Homo sapiens
ttttagaaattctataa

SEQ ID NO: 464411 - DNA, 16 bp, Homo sapiens
ttttatatctgtaaat

SEQ ID NO: 464412 - DNA, 22 bp, Homo sapiens
ttttatgtcatactctgtgtaa

SEQ ID NO: 464413 - DNA, 14 bp, Homo sapiens
ttttattgaataac

SEQ ID NO: 464414 - DNA, 13 bp, Homo sapiens
ttttatttctcgg

SEQ ID NO: 464415 - DNA, 10 bp, Homo sapiens
ttttcaaaat

SEQ ID NO: 464416 - DNA, 18 bp, Homo sapiens
ttttcaaaatacttcttt

SEQ ID NO: 464417 - DNA, 20 bp, Homo sapiens
ttttcactgctggctgcctt

SEQ ID NO: 464418 - DNA, 16 bp, Homo sapiens
ttttccatctaaaata

SEQ ID NO: 464419 - DNA, 19 bp, Homo sapiens
ttttccccaattatcctcc

SEQ ID NO: 464420 - DNA, 12 bp, Homo sapiens
ttttctaaactg

SEQ ID NO: 464421 - DNA, 16 bp, Homo sapiens
ttttctgaattcataa

SEQ ID NO: 464422 - DNA, 13 bp, Homo sapiens
ttttctttctatg

SEQ ID NO: 464423 - DNA, 15 bp, Homo sapiens
ttttctttctatgta

SEQ ID NO: 464424 - DNA, 22 bp, Homo sapiens
ttttctttctatgtagaactgt

SEQ ID NO: 464425 - DNA, 23 bp, Homo sapiens
ttttgtaaccatatgattgaaaa

SEQ ID NO: 464426 - DNA, 15 bp, Homo sapiens
ttttgtttcttggtg

SEQ ID NO: 464427 - DNA, 16 bp, Homo sapiens
tttttaaatgattcca

SEQ ID NO: 464428 - DNA, 19 bp, Homo sapiens
tttttaacttatctccagc

SEQ ID NO: 464429 - DNA, 22 bp, Homo sapiens
tttttactcaggctttctattg

SEQ ID NO: 464430 - DNA, 12 bp, Homo sapiens
tttttcctacca

SEQ ID NO: 464431 - DNA, 15 bp, Homo sapiens
tttttggcattatct

SEQ ID NO: 464432 - DNA, 21 bp, Homo sapiens
tttttgtaaccatatgattga

SEQ ID NO: 464433 - DNA, 14 bp, Homo sapiens
ttttttctggtaag

SEQ ID NO: 464434 - DNA, 16 bp, Homo sapiens
ttttttgctatggaag

SEQ ID NO: 464435 - DNA, 19 bp, Homo sapiens
tttttttaaatgattccaa

SEQ ID NO: 464436 - DNA, 12 bp, Homo sapiens
tttttttctagc

SEQ ID NO: 464437 - DNA, 13 bp, Homo sapiens
tttttttctagct

SEQ ID NO: 464438 - DNA, 19 bp, Homo sapiens
cacgggagagcgccacccg

SEQ ID NO: 464439 - DNA, 21 bp, Homo sapiens
cacgggagagcgccacccgcc

SEQ ID NO: 464440 - DNA, 14 bp, Homo sapiens
cacgggcccgctca

SEQ ID NO: 464441 - DNA, 17 bp, Homo sapiens
cacggggtcgggggagg

SEQ ID NO: 464442 - DNA, 19 bp, Homo sapiens
cacggggtcgggggaggag

SEQ ID NO: 464443 - DNA, 23 bp, Homo sapiens
cacggggtcgggggaggagcacc

SEQ ID NO: 464444 - DNA, 16 bp, Homo sapiens
cactaagtaacctcta

SEQ ID NO: 464445 - DNA, 21 bp, Homo sapiens
cactagccctctttctctctg

SEQ ID NO: 464446 - DNA, 20 bp, Homo sapiens
cactaggtgcccagtcttga

SEQ ID NO: 464447 - DNA, 22 bp, Homo sapiens
cactcagtaggtctgaaggcct

SEQ ID NO: 464448 - DNA, 13 bp, Homo sapiens
cactccactcccc

SEQ ID NO: 464449 - DNA, 16 bp, Homo sapiens
cactccactcccctca

SEQ ID NO: 464450 - DNA, 16 bp, Homo sapiens
cactccagacccctgg

SEQ ID NO: 464451 - DNA, 12 bp, Homo sapiens
cactcccagggc

SEQ ID NO: 464452 - DNA, 12 bp, Homo sapiens
cactcccctcat

SEQ ID NO: 464453 - DNA, 14 bp, Homo sapiens
cactcctacctggt

SEQ ID NO: 464454 - DNA, 14 bp, Homo sapiens
cactcctcccaact

SEQ ID NO: 464455 - DNA, 20 bp, Homo sapiens
cactctgaggtctcaccttc

SEQ ID NO: 464456 - DNA, 14 bp, Homo sapiens
cactctgtcagcca

SEQ ID NO: 464457 - DNA, 22 bp, Homo sapiens
cactctgtcagccagccgccct

SEQ ID NO: 464458 - DNA, 19 bp, Homo sapiens
cactgatatcacgggcccg

SEQ ID NO: 464459 - DNA, 21 bp, Homo sapiens
cactgatgggtcctgctgctc

SEQ ID NO: 464460 - DNA, 18 bp, Homo sapiens
cactgcacagtgcatctc

SEQ ID NO: 464461 - DNA, 22 bp, Homo sapiens
cactgcacagtgcatctcagcc

SEQ ID NO: 464462 - DNA, 23 bp, Homo sapiens
cactgcacagtgcatctcagccc

SEQ ID NO: 464463 - DNA, 14 bp, Homo sapiens
cactgctggctgcc

SEQ ID NO: 464464 - DNA, 16 bp, Homo sapiens
cactgctggctgcctt

SEQ ID NO: 464465 - DNA, 18 bp, Homo sapiens
cactggagttcactttca

SEQ ID NO: 464466 - DNA, 21 bp, Homo sapiens
cactggtgcatttaaaatgga

SEQ ID NO: 464467 - DNA, 13 bp, Homo sapiens
cactggtggcccg

SEQ ID NO: 464468 - DNA, 21 bp, Homo sapiens
cactggtggcccgacagcctg

SEQ ID NO: 464469 - DNA, 17 bp, Homo sapiens
cactggtttgtttctca

SEQ ID NO: 464470 - DNA, 18 bp, Homo sapiens
cactggtttgtttctcaa

SEQ ID NO: 464471 - DNA, 19 bp, Homo sapiens
cactgtatctaaaaaataa

SEQ ID NO: 464472 - DNA, 21 bp, Homo sapiens
cacttaaactttgtcacttct

SEQ ID NO: 464473 - DNA, 19 bp, Homo sapiens
cacttagaaattgcatttc

SEQ ID NO: 464474 - DNA, 13 bp, Homo sapiens
cacttatgctgct

SEQ ID NO: 464475 - DNA, 20 bp, Homo sapiens
cacttatgctgctgtgaatt

SEQ ID NO: 464476 - DNA, 16 bp, Homo sapiens
cacttcaggctcttct

SEQ ID NO: 464477 - DNA, 20 bp, Homo sapiens
cacttcaggctcttctcctt

SEQ ID NO: 464478 - DNA, 23 bp, Homo sapiens
cacttcaggctcttctcctttca

SEQ ID NO: 464479 - DNA, 14 bp, Homo sapiens
cagaaaaaaggact

SEQ ID NO: 464480 - DNA, 17 bp, Homo sapiens
cagaaagggcagcccct

SEQ ID NO: 464481 - DNA, 19 bp, Homo sapiens
cagaaatgtggatgctctt

SEQ ID NO: 464482 - DNA, 14 bp, Homo sapiens
cagaacaaaagata

SEQ ID NO: 464483 - DNA, 15 bp, Homo sapiens
cagaaccagcactcc

SEQ ID NO: 464484 - DNA, 16 bp, Homo sapiens
cagaaccagcactccc

SEQ ID NO: 464485 - DNA, 19 bp, Homo sapiens
cagaaccagcactcccagg

SEQ ID NO: 464486 - DNA, 21 bp, Homo sapiens
cagaaccagcactcccagggc

SEQ ID NO: 464487 - DNA, 16 bp, Homo sapiens
cagaacgggcctcccc

SEQ ID NO: 464488 - DNA, 18 bp, Homo sapiens
cagaacgggcctccccgg

SEQ ID NO: 464489 - DNA, 14 bp, Homo sapiens
cagaacgggttctc

SEQ ID NO: 464490 - DNA, 16 bp, Homo sapiens
cagaactcagccttaa

SEQ ID NO: 464491 - DNA, 23 bp, Homo sapiens
cagaatctaactggtggacatgg

SEQ ID NO: 464492 - DNA, 21 bp, Homo sapiens
cagaattgaaccgtcaatgtg

SEQ ID NO: 464493 - DNA, 19 bp, Homo sapiens
cagaatttctttgtcattc

SEQ ID NO: 464494 - DNA, 22 bp, Homo sapiens
cagaatttctttgtcattcaag

SEQ ID NO: 464495 - DNA, 16 bp, Homo sapiens
cagacaccctccactc

SEQ ID NO: 464496 - DNA, 18 bp, Homo sapiens
cagacaccctccactctg

SEQ ID NO: 464497 - DNA, 19 bp, Homo sapiens
cagacaccctccactctga

SEQ ID NO: 464498 - DNA, 20 bp, Homo sapiens
cagacaccctccactctgag

SEQ ID NO: 464499 - DNA, 20 bp, Homo sapiens
cagacactccagtttgccca

SEQ ID NO: 464500 - DNA, 12 bp, Homo sapiens
cagacagagatc

SEQ ID NO: 464501 - DNA, 12 bp, Homo sapiens
cagacagagtgg

SEQ ID NO: 464502 - DNA, 17 bp, Homo sapiens
cagacagggtggggctt

SEQ ID NO: 464503 - DNA, 19 bp, Homo sapiens
cagacagggtggggcttag

SEQ ID NO: 464504 - DNA, 15 bp, Homo sapiens
cagacccctaccctt

SEQ ID NO: 464505 - DNA, 14 bp, Homo sapiens
cagacccctggctt

SEQ ID NO: 464506 - DNA, 20 bp, Homo sapiens
cagacctcactgctttgtag

SEQ ID NO: 464507 - DNA, 17 bp, Homo sapiens
cagacgctgccgctgcc

SEQ ID NO: 464508 - DNA, 20 bp, Homo sapiens
cagacggacgggacagcggc

SEQ ID NO: 464509 - DNA, 17 bp, Homo sapiens
cagacgggctgagagga

SEQ ID NO: 464510 - DNA, 19 bp, Homo sapiens
cagactcgagagggctgag

SEQ ID NO: 464511 - DNA, 22 bp, Homo sapiens
cagactcgagagggctgagccc

SEQ ID NO: 464512 - DNA, 22 bp, Homo sapiens
cagactctctcctctctctccc

SEQ ID NO: 464513 - DNA, 23 bp, Homo sapiens
cagactctctcctctctctccct

SEQ ID NO: 464514 - DNA, 14 bp, Homo sapiens
cagagacggcagcc

SEQ ID NO: 464515 - DNA, 22 bp, Homo sapiens
cagagacggcagccccatcctt

SEQ ID NO: 464516 - DNA, 10 bp, Homo sapiens
cagagactgc

SEQ ID NO: 464517 - DNA, 13 bp, Homo sapiens
cagagactgccca

SEQ ID NO: 464518 - DNA, 19 bp, Homo sapiens
cagagactgcccaccctgg

SEQ ID NO: 464519 - DNA, 21 bp, Homo sapiens
cagagactgcccaccctgggc

SEQ ID NO: 464520 - DNA, 14 bp, Homo sapiens
cagagagtggctcc

SEQ ID NO: 464521 - DNA, 16 bp, Homo sapiens
cagagatcagaattga

SEQ ID NO: 464522 - DNA, 14 bp, Homo sapiens
cagagccccggagc

SEQ ID NO: 464523 - DNA, 19 bp, Homo sapiens
cagagccccggagcaccac

SEQ ID NO: 464524 - DNA, 22 bp, Homo sapiens
cagagctcatttcggggtcagg

SEQ ID NO: 464525 - DNA, 19 bp, Homo sapiens
cagagctgagtcggctggg

SEQ ID NO: 464526 - DNA, 16 bp, Homo sapiens
cagagctggatgctga

SEQ ID NO: 464527 - DNA, 17 bp, Homo sapiens
cagaggagcaaggttta

SEQ ID NO: 464528 - DNA, 14 bp, Homo sapiens
cagaggcagggccc

SEQ ID NO: 464529 - DNA, 16 bp, Homo sapiens
cagaggcagggccctg

SEQ ID NO: 464530 - DNA, 16 bp, Homo sapiens
cagaggccgctctggg

SEQ ID NO: 464531 - DNA, 21 bp, Homo sapiens
cagagtaggtgggtcttggat

SEQ ID NO: 464532 - DNA, 19 bp, Homo sapiens
cagagtggatctggagtct

SEQ ID NO: 464533 - DNA, 19 bp, Homo sapiens
cagatccctcggtcagcac

SEQ ID NO: 464534 - DNA, 16 bp, Homo sapiens
cagatctggaatgtga

SEQ ID NO: 464535 - DNA, 19 bp, Homo sapiens
catggatttcctttgacct

SEQ ID NO: 464536 - DNA, 12 bp, Homo sapiens
catggccccagc

SEQ ID NO: 464537 - DNA, 13 bp, Homo sapiens
catggccccagct

SEQ ID NO: 464538 - DNA, 15 bp, Homo sapiens
catggccccagctgg

SEQ ID NO: 464539 - DNA, 20 bp, Homo sapiens
catggccccagctggctggg

SEQ ID NO: 464540 - DNA, 20 bp, Homo sapiens
catgggaaatgtcaacaagt

SEQ ID NO: 464541 - DNA, 18 bp, Homo sapiens
catggtttttgctctact

SEQ ID NO: 464542 - DNA, 10 bp, Homo sapiens
catgtagcat

SEQ ID NO: 464543 - DNA, 21 bp, Homo sapiens
catgtagcatataaatgttta

SEQ ID NO: 464544 - DNA, 22 bp, Homo sapiens
catgtccctaccgagtctcttc

SEQ ID NO: 464545 - DNA, 22 bp, Homo sapiens
catgtgattggcagcttcaaaa

SEQ ID NO: 464546 - DNA, 15 bp, Homo sapiens
catgtgcaaacgctg

SEQ ID NO: 464547 - DNA, 15 bp, Homo sapiens
catgtgcctgcacca

SEQ ID NO: 464548 - DNA, 20 bp, Homo sapiens
catgtgcctgcaccaggaga

SEQ ID NO: 464549 - DNA, 23 bp, Homo sapiens
catgtgcctgcaccaggagacag

SEQ ID NO: 464550 - DNA, 24 bp, Homo sapiens
catgtgtcccctcactctgtcagc

SEQ ID NO: 464551 - DNA, 24 bp, Homo sapiens
catgtgttgcaaattattctagtc

SEQ ID NO: 464552 - DNA, 18 bp, Homo sapiens
cattagcagtttgctttg

SEQ ID NO: 464553 - DNA, 22 bp, Homo sapiens
cattaggtagatgagaaaacag

SEQ ID NO: 464554 - DNA, 13 bp, Homo sapiens
cacccctcttccc

SEQ ID NO: 464555 - DNA, 14 bp, Homo sapiens
cacccctcttcccc

SEQ ID NO: 464556 - DNA, 18 bp, Homo sapiens
cacccctcttcccccttc

SEQ ID NO: 464557 - DNA, 11 bp, Homo sapiens
cacccgcccca

SEQ ID NO: 464558 - DNA, 12 bp, Homo sapiens
cacccgccccag

SEQ ID NO: 464559 - DNA, 16 bp, Homo sapiens
cacccgccccagagac

SEQ ID NO: 464560 - DNA, 22 bp, Homo sapiens
cacccgccccagagactgccca

SEQ ID NO: 464561 - DNA, 17 bp, Homo sapiens
cacccgcccgcccccgc

SEQ ID NO: 464562 - DNA, 18 bp, Homo sapiens
caccctccactctgaggt

SEQ ID NO: 464563 - DNA, 17 bp, Homo sapiens
caccctcccctctcctg

SEQ ID NO: 464564 - DNA, 18 bp, Homo sapiens
caccctcccctctcctga

SEQ ID NO: 464565 - DNA, 14 bp, Homo sapiens
caccctgggcctcc

SEQ ID NO: 464566 - DNA, 21 bp, Homo sapiens
cacccttccccactcccgtga

SEQ ID NO: 464567 - DNA, 12 bp, Homo sapiens
caccgccacccc

SEQ ID NO: 464568 - DNA, 14 bp, Homo sapiens
caccgccaccccac

SEQ ID NO: 464569 - DNA, 18 bp, Homo sapiens
caccgccaccccactgag

SEQ ID NO: 464570 - DNA, 19 bp, Homo sapiens
caccgggagcctccccctc

SEQ ID NO: 464571 - DNA, 13 bp, Homo sapiens
caccgggcctgga

SEQ ID NO: 464572 - DNA, 20 bp, Homo sapiens
caccgtggtgtgaggccccc

SEQ ID NO: 464573 - DNA, 12 bp, Homo sapiens
cacctccacccg

SEQ ID NO: 464574 - DNA, 12 bp, Homo sapiens
cacctcttcctt

SEQ ID NO: 464575 - DNA, 11 bp, Homo sapiens
cacctgcccag

SEQ ID NO: 464576 - DNA, 12 bp, Homo sapiens
cacctgcccagt

SEQ ID NO: 464577 - DNA, 18 bp, Homo sapiens
cacctgcccagttagccc

SEQ ID NO: 464578 - DNA, 22 bp, Homo sapiens
cacctgcccagttagcccggcc

SEQ ID NO: 464579 - DNA, 19 bp, Homo sapiens
cacctggcacaccagaagt

SEQ ID NO: 464580 - DNA, 14 bp, Homo sapiens
cacctgtgctgctg

SEQ ID NO: 464581 - DNA, 24 bp, Homo sapiens
caccttcccctgaggacctttctg

SEQ ID NO: 464582 - DNA, 15 bp, Homo sapiens
caccttcgcctttgc

SEQ ID NO: 464583 - DNA, 17 bp, Homo sapiens
caccttgtacagaacca

SEQ ID NO: 464584 - DNA, 18 bp, Homo sapiens
caccttgtacagaaccag

SEQ ID NO: 464585 - DNA, 21 bp, Homo sapiens
caccttgtacagaaccagcac

SEQ ID NO: 464586 - DNA, 14 bp, Homo sapiens
cacgcagagccccg

SEQ ID NO: 464587 - DNA, 20 bp, Homo sapiens
cacgcagagccccggagcac

SEQ ID NO: 464588 - DNA, 13 bp, Homo sapiens
cacgcctcctggc

SEQ ID NO: 464589 - DNA, 15 bp, Homo sapiens
cacgcctcctggcca

SEQ ID NO: 464590 - DNA, 17 bp, Homo sapiens
cacgcctcctggccaga

SEQ ID NO: 464591 - DNA, 15 bp, Homo sapiens
cacgctcctgccctc

SEQ ID NO: 464592 - DNA, 15 bp, Homo sapiens
cacgctgacagcctc

SEQ ID NO: 464593 - DNA, 14 bp, Homo sapiens
cacgctgtcctctc

SEQ ID NO: 464594 - DNA, 23 bp, Homo sapiens
cacggccgtccctgacttcccag

SEQ ID NO: 464595 - DNA, 17 bp, Homo sapiens
cacggcgtttttttaca

SEQ ID NO: 464596 - DNA, 18 bp, Homo sapiens
cacgggcccgctcaacct

SEQ ID NO: 464597 - DNA, 23 bp, Homo sapiens
cacgggcccgctcaacctctcag

SEQ ID NO: 464598 - DNA, 13 bp, Homo sapiens
cactagaatgaga

SEQ ID NO: 464599 - DNA, 16 bp, Homo sapiens
cactaggtgcccagtc

SEQ ID NO: 464600 - DNA, 16 bp, Homo sapiens
cactagtagctgtttt

SEQ ID NO: 464601 - DNA, 20 bp, Homo sapiens
cactatggtatgctggccag

SEQ ID NO: 464602 - DNA, 22 bp, Homo sapiens
cactatggtatgctggccagca

SEQ ID NO: 464603 - DNA, 14 bp, Homo sapiens
cactcagtaggtct

SEQ ID NO: 464604 - DNA, 23 bp, Homo sapiens
cactcagtaggtctgaaggcctc

SEQ ID NO: 464605 - DNA, 14 bp, Homo sapiens
cactcccagggccc

SEQ ID NO: 464606 - DNA, 19 bp, Homo sapiens
cactccctttgtggacttt

SEQ ID NO: 464607 - DNA, 20 bp, Homo sapiens
cactccctttgtggacttta

SEQ ID NO: 464608 - DNA, 14 bp, Homo sapiens
cactctacttagca

SEQ ID NO: 464609 - DNA, 17 bp, Homo sapiens
cactctcttcttactgt

SEQ ID NO: 464610 - DNA, 21 bp, Homo sapiens
cactctgaagtcccttcctgt

SEQ ID NO: 464611 - DNA, 15 bp, Homo sapiens
cactctgacagtatt

SEQ ID NO: 464612 - DNA, 21 bp, Homo sapiens
cactctgtcagccagccgccc

SEQ ID NO: 464613 - DNA, 23 bp, Homo sapiens
cactctgtcagccagccgccctg

SEQ ID NO: 464614 - DNA, 14 bp, Homo sapiens
cactgaactcagga

SEQ ID NO: 464615 - DNA, 15 bp, Homo sapiens
cactgagagctgctc

SEQ ID NO: 464616 - DNA, 16 bp, Homo sapiens
cactgagagctgctcc

SEQ ID NO: 464617 - DNA, 18 bp, Homo sapiens
cactgagagctgctcctt

SEQ ID NO: 464618 - DNA, 14 bp, Homo sapiens
cactgagtttgaac

SEQ ID NO: 464619 - DNA, 21 bp, Homo sapiens
cactgatatcacgggcccgct

SEQ ID NO: 464620 - DNA, 22 bp, Homo sapiens
cactgatatcacgggcccgctc

SEQ ID NO: 464621 - DNA, 16 bp, Homo sapiens
cactgatgggtcctgc

SEQ ID NO: 464622 - DNA, 17 bp, Homo sapiens
cactgatgggtcctgct

SEQ ID NO: 464623 - DNA, 19 bp, Homo sapiens
cactgcacagtgcatctca

SEQ ID NO: 464624 - DNA, 21 bp, Homo sapiens
cactgcacagtgcatctcagc

SEQ ID NO: 464625 - DNA, 13 bp, Homo sapiens
cactgctggctgc

SEQ ID NO: 464626 - DNA, 14 bp, Homo sapiens
cactggtgcattta

SEQ ID NO: 464627 - DNA, 19 bp, Homo sapiens
cactggtgcatttaaaatg

SEQ ID NO: 464628 - DNA, 21 bp, Homo sapiens
cactgtaatcttaaaagtgta

SEQ ID NO: 464629 - DNA, 17 bp, Homo sapiens
cacttaaactttgtcac

SEQ ID NO: 464630 - DNA, 20 bp, Homo sapiens
cacttagaaattgcatttcc

SEQ ID NO: 464631 - DNA, 14 bp, Homo sapiens
cacttatgctgctg

SEQ ID NO: 464632 - DNA, 14 bp, Homo sapiens
cacttcaggctctt

SEQ ID NO: 464633 - DNA, 17 bp, Homo sapiens
cacttctatttatttat

SEQ ID NO: 464634 - DNA, 12 bp, Homo sapiens
cacttctgttat

SEQ ID NO: 464635 - DNA, 17 bp, Homo sapiens
cactttgagcctgggaa

SEQ ID NO: 464636 - DNA, 21 bp, Homo sapiens
cactttttctgtctttatgta

SEQ ID NO: 464637 - DNA, 18 bp, Homo sapiens
cagaaaaaaggactgtat

SEQ ID NO: 464638 - DNA, 19 bp, Homo sapiens
cagaaagggcagcccctcc

SEQ ID NO: 464639 - DNA, 16 bp, Homo sapiens
cagaaccaacgggtct

SEQ ID NO: 464640 - DNA, 18 bp, Homo sapiens
cagaaccagcactcccag

SEQ ID NO: 464641 - DNA, 22 bp, Homo sapiens
cagaacccttggagccaatgga

SEQ ID NO: 464642 - DNA, 14 bp, Homo sapiens
cagaacctttgtca

SEQ ID NO: 464643 - DNA, 15 bp, Homo sapiens
cagaacctttgtcaa

SEQ ID NO: 464644 - DNA, 19 bp, Homo sapiens
cagaacctttgtcaacttc

SEQ ID NO: 464645 - DNA, 15 bp, Homo sapiens
cagaacgggcctccc

SEQ ID NO: 464646 - DNA, 17 bp, Homo sapiens
cagaactcctttctaag

SEQ ID NO: 464647 - DNA, 19 bp, Homo sapiens
cagaatggtgggctccaga

SEQ ID NO: 464648 - DNA, 20 bp, Homo sapiens
cagaatggtgggctccagag

SEQ ID NO: 464649 - DNA, 13 bp, Homo sapiens
cagacaccctcca

SEQ ID NO: 464650 - DNA, 22 bp, Homo sapiens
cagacaccctccactctgaggt

SEQ ID NO: 464651 - DNA, 16 bp, Homo sapiens
cagccccccagcacta

SEQ ID NO: 464652 - DNA, 13 bp, Homo sapiens
cagcccctgctgg

SEQ ID NO: 464653 - DNA, 15 bp, Homo sapiens
cagccctccctgccc

SEQ ID NO: 464654 - DNA, 16 bp, Homo sapiens
cagccctctccaccca

SEQ ID NO: 464655 - DNA, 19 bp, Homo sapiens
cagccctctccacccagag

SEQ ID NO: 464656 - DNA, 11 bp, Homo sapiens
cagccctgctt

SEQ ID NO: 464657 - DNA, 13 bp, Homo sapiens
cagccctgctttg

SEQ ID NO: 464658 - DNA, 13 bp, Homo sapiens
cagccgccctggg

SEQ ID NO: 464659 - DNA, 15 bp, Homo sapiens
cagccgccctgggct

SEQ ID NO: 464660 - DNA, 16 bp, Homo sapiens
cagccgcgctctgccc

SEQ ID NO: 464661 - DNA, 19 bp, Homo sapiens
cagccgcgctctgcccctc

SEQ ID NO: 464662 - DNA, 21 bp, Homo sapiens
cagccgcgctctgcccctccg

SEQ ID NO: 464663 - DNA, 20 bp, Homo sapiens
cagccgtgccttcagctcta

SEQ ID NO: 464664 - DNA, 17 bp, Homo sapiens
agtcccttcctgtcctg

SEQ ID NO: 464665 - DNA, 14 bp, Homo sapiens
agtcggctgggcag

SEQ ID NO: 464666 - DNA, 17 bp, Homo sapiens
agtcggctgggcagggc

SEQ ID NO: 464667 - DNA, 19 bp, Homo sapiens
agtcggctgggcagggccg

SEQ ID NO: 464668 - DNA, 18 bp, Homo sapiens
agtctccccgcagccctc

SEQ ID NO: 464669 - DNA, 19 bp, Homo sapiens
agtctctgatttgcaaatg

SEQ ID NO: 464670 - DNA, 16 bp, Homo sapiens
agtctgaaggagagga

SEQ ID NO: 464671 - DNA, 17 bp, Homo sapiens
agtctgaaggagaggag

SEQ ID NO: 464672 - DNA, 20 bp, Homo sapiens
agtctgaaggagaggagtgc

SEQ ID NO: 464673 - DNA, 18 bp, Homo sapiens
agtctgtacttcagttct

SEQ ID NO: 464674 - DNA, 15 bp, Homo sapiens
agtcttactgttttg

SEQ ID NO: 464675 - DNA, 19 bp, Homo sapiens
agtcttactgttttgtgcg

SEQ ID NO: 464676 - DNA, 14 bp, Homo sapiens
agtcttctgcctct

SEQ ID NO: 464677 - DNA, 14 bp, Homo sapiens
agtcttgagtgggc

SEQ ID NO: 464678 - DNA, 19 bp, Homo sapiens
agtctttgggggattcaaa

SEQ ID NO: 464679 - DNA, 20 bp, Homo sapiens
agtctttgggggattcaaat

SEQ ID NO: 464680 - DNA, 21 bp, Homo sapiens
agtctttgggggattcaaatg

SEQ ID NO: 464681 - DNA, 16 bp, Homo sapiens
agtgaagcccaggagg

SEQ ID NO: 464682 - DNA, 16 bp, Homo sapiens
agtgatacactgtatc

SEQ ID NO: 464683 - DNA, 21 bp, Homo sapiens
agtgatacactgtatctaaaa

SEQ ID NO: 464684 - DNA, 17 bp, Homo sapiens
agtgatgcaataaacaa

SEQ ID NO: 464685 - DNA, 15 bp, Homo sapiens
agtgctcagtattga

SEQ ID NO: 464686 - DNA, 15 bp, Homo sapiens
agtgctgggcccagc

SEQ ID NO: 464687 - DNA, 18 bp, Homo sapiens
agtggaggggtcagcagg

SEQ ID NO: 464688 - DNA, 21 bp, Homo sapiens
agtggatctggagtctgaagg

SEQ ID NO: 464689 - DNA, 16 bp, Homo sapiens
agtggcaaaaaagaac

SEQ ID NO: 464690 - DNA, 21 bp, Homo sapiens
agtggcctgagaagagtcgag

SEQ ID NO: 464691 - DNA, 14 bp, Homo sapiens
agtgggccccctct

SEQ ID NO: 464692 - DNA, 17 bp, Homo sapiens
agtgtaacccaagcatt

SEQ ID NO: 464693 - DNA, 15 bp, Homo sapiens
agtgtggcttaaaca

SEQ ID NO: 464694 - DNA, 18 bp, Homo sapiens
agtgtggcttaaacattt

SEQ ID NO: 464695 - DNA, 12 bp, Homo sapiens
agtgtgtacttc

SEQ ID NO: 464696 - DNA, 12 bp, Homo sapiens
agtgtgtgtgca

SEQ ID NO: 464697 - DNA, 18 bp, Homo sapiens
agtgtgtgtgcaatgttc

SEQ ID NO: 464698 - DNA, 23 bp, Homo sapiens
agtgttgaaattggaaaggactt

SEQ ID NO: 464699 - DNA, 15 bp, Homo sapiens
agttaagacaacagg

SEQ ID NO: 464700 - DNA, 16 bp, Homo sapiens
agttagcccggccaag

SEQ ID NO: 464701 - DNA, 23 bp, Homo sapiens
agttagcccggccaaggacactg

SEQ ID NO: 464702 - DNA, 15 bp, Homo sapiens
agttccattctatga

SEQ ID NO: 464703 - DNA, 13 bp, Homo sapiens
agttctatttcta

SEQ ID NO: 464704 - DNA, 12 bp, Homo sapiens
agttctcatctt

SEQ ID NO: 464705 - DNA, 15 bp, Homo sapiens
agttctcatcttgta

SEQ ID NO: 464706 - DNA, 17 bp, Homo sapiens
agttctccttgtacttg

SEQ ID NO: 464707 - DNA, 16 bp, Homo sapiens
agttctgcaataacag

SEQ ID NO: 464708 - DNA, 17 bp, Homo sapiens
agttctgcaataacagt

SEQ ID NO: 464709 - DNA, 22 bp, Homo sapiens
agttgaagggaaatcaatttaa

SEQ ID NO: 464710 - DNA, 13 bp, Homo sapiens
agttgcagtaaag

SEQ ID NO: 464711 - DNA, 16 bp, Homo sapiens
agttgtaagaaaagct

SEQ ID NO: 464712 - DNA, 18 bp, Homo sapiens
agttgtattttaataaag

SEQ ID NO: 464713 - DNA, 21 bp, Homo sapiens
agttgttggtttatactgtat

SEQ ID NO: 464714 - DNA, 15 bp, Homo sapiens
agtttaaaaaaataa

SEQ ID NO: 464715 - DNA, 20 bp, Homo sapiens
agtttaccaatcaacagcat

SEQ ID NO: 464716 - DNA, 13 bp, Homo sapiens
agtttataaaaga

SEQ ID NO: 464717 - DNA, 22 bp, Homo sapiens
agtttattgccctcaaaatctt

SEQ ID NO: 464718 - DNA, 15 bp, Homo sapiens
agtttccagctgctc

SEQ ID NO: 464719 - DNA, 16 bp, Homo sapiens
agtttctatggattca

SEQ ID NO: 464720 - DNA, 19 bp, Homo sapiens
agtttgcatacttcctgga

SEQ ID NO: 464721 - DNA, 23 bp, Homo sapiens
agtttgcatacttcctggatttt

SEQ ID NO: 464722 - DNA, 20 bp, Homo sapiens
agtttggaagtacataaagt

SEQ ID NO: 464723 - DNA, 15 bp, Homo sapiens
agtttgttctccggg

SEQ ID NO: 464724 - DNA, 21 bp, Homo sapiens
agtttgttctccgggtgtggc

SEQ ID NO: 464725 - DNA, 23 bp, Homo sapiens
agtttttggtaatgatgattcaa

SEQ ID NO: 464726 - DNA, 13 bp, Homo sapiens
ataaaaaagaaaa

SEQ ID NO: 464727 - DNA, 21 bp, Homo sapiens
ataaaaaagaaaacttgtgtt

SEQ ID NO: 464728 - DNA, 14 bp, Homo sapiens
ataaaactaggaat

SEQ ID NO: 464729 - DNA, 18 bp, Homo sapiens
ataaaactcagttaaaat

SEQ ID NO: 464730 - DNA, 12 bp, Homo sapiens
ataaaagagctt

SEQ ID NO: 464731 - DNA, 15 bp, Homo sapiens
ataaaagagctttat

SEQ ID NO: 464732 - DNA, 19 bp, Homo sapiens
ataaacaacttaatgttct

SEQ ID NO: 464733 - DNA, 13 bp, Homo sapiens
ataaacattaaac

SEQ ID NO: 464734 - DNA, 14 bp, Homo sapiens
ataaacattaaaca

SEQ ID NO: 464735 - DNA, 15 bp, Homo sapiens
ataaacattaaacac

SEQ ID NO: 464736 - DNA, 13 bp, Homo sapiens
ataaactccttaa

SEQ ID NO: 464737 - DNA, 15 bp, Homo sapiens
ataaacttgtactta

SEQ ID NO: 464738 - DNA, 12 bp, Homo sapiens
ataaagaagaaa

SEQ ID NO: 464739 - DNA, 22 bp, Homo sapiens
agctcaggagaaggcctgcccc

SEQ ID NO: 464740 - DNA, 13 bp, Homo sapiens
agctcagtacagg

SEQ ID NO: 464741 - DNA, 16 bp, Homo sapiens
agctcagtacagggca

SEQ ID NO: 464742 - DNA, 18 bp, Homo sapiens
agctcagtacagggcagg

SEQ ID NO: 464743 - DNA, 16 bp, Homo sapiens
agctccactctgaagt

SEQ ID NO: 464744 - DNA, 13 bp, Homo sapiens
agctctaaagcag

SEQ ID NO: 464745 - DNA, 18 bp, Homo sapiens
agctctaaagcagagatg

SEQ ID NO: 464746 - DNA, 17 bp, Homo sapiens
agctgagtcggctgggc

SEQ ID NO: 464747 - DNA, 19 bp, Homo sapiens
agctgagtcggctgggcag

SEQ ID NO: 464748 - DNA, 14 bp, Homo sapiens
agctgctctccttc

SEQ ID NO: 464749 - DNA, 15 bp, Homo sapiens
agctgctctccttca

SEQ ID NO: 464750 - DNA, 20 bp, Homo sapiens
agctggatgctgagagacct

SEQ ID NO: 464751 - DNA, 18 bp, Homo sapiens
agctggcaaactgtgaat

SEQ ID NO: 464752 - DNA, 16 bp, Homo sapiens
agctggcagcgcctcc

SEQ ID NO: 464753 - DNA, 19 bp, Homo sapiens
agctgtagaaatgtatcct

SEQ ID NO: 464754 - DNA, 20 bp, Homo sapiens
agctgtcactcacaaaaggc

SEQ ID NO: 464755 - DNA, 15 bp, Homo sapiens
agcttatttctaact

SEQ ID NO: 464756 - DNA, 14 bp, Homo sapiens
agcttcaaaacaga

SEQ ID NO: 464757 - DNA, 15 bp, Homo sapiens
agcttccagtagagc

SEQ ID NO: 464758 - DNA, 13 bp, Homo sapiens
agcttctcctctg

SEQ ID NO: 464759 - DNA, 19 bp, Homo sapiens
aggaaaaccaagccgtggc

SEQ ID NO: 464760 - DNA, 20 bp, Homo sapiens
aggaaaaccaagccgtggct

SEQ ID NO: 464761 - DNA, 21 bp, Homo sapiens
aggaaaaccaagccgtggctt

SEQ ID NO: 464762 - DNA, 22 bp, Homo sapiens
aggaaaaccaagccgtggcttc

SEQ ID NO: 464763 - DNA, 23 bp, Homo sapiens
aggaaaataacagagctggatgc

SEQ ID NO: 464764 - DNA, 17 bp, Homo sapiens
aggaaagccctccccct

SEQ ID NO: 464765 - DNA, 23 bp, Homo sapiens
aggaaagccctcccccttcccct

SEQ ID NO: 464766 - DNA, 19 bp, Homo sapiens
aggaaagttctattatctg

SEQ ID NO: 464767 - DNA, 22 bp, Homo sapiens
aggaaagttctattatctgggt

SEQ ID NO: 464768 - DNA, 11 bp, Homo sapiens
aggaatataca

SEQ ID NO: 464769 - DNA, 22 bp, Homo sapiens
aggaatatacatagtctttgtt

SEQ ID NO: 464770 - DNA, 20 bp, Homo sapiens
aggacactgatgggtcctgc

SEQ ID NO: 464771 - DNA, 23 bp, Homo sapiens
aggaccgccccaaccctcggagc

SEQ ID NO: 464772 - DNA, 16 bp, Homo sapiens
aggacggggcagagct

SEQ ID NO: 464773 - DNA, 17 bp, Homo sapiens
aggacggggcagagctg

SEQ ID NO: 464774 - DNA, 19 bp, Homo sapiens
aggactaacaactgggaaa

SEQ ID NO: 464775 - DNA, 18 bp, Homo sapiens
aggactgtatagtttaaa

SEQ ID NO: 464776 - DNA, 23 bp, Homo sapiens
aggactgtatagtttaaagggag

SEQ ID NO: 464777 - DNA, 14 bp, Homo sapiens
aggacttctgcagc

SEQ ID NO: 464778 - DNA, 15 bp, Homo sapiens
aggacttctgcagct

SEQ ID NO: 464779 - DNA, 14 bp, Homo sapiens
aggagaaggcctgc

SEQ ID NO: 464780 - DNA, 19 bp, Homo sapiens
aggagaaggcctgcccccc

SEQ ID NO: 464781 - DNA, 14 bp, Homo sapiens
aggagaccctgtct

SEQ ID NO: 464782 - DNA, 13 bp, Homo sapiens
aggagaggagtgc

SEQ ID NO: 464783 - DNA, 11 bp, Homo sapiens
aggagcacccc

SEQ ID NO: 464784 - DNA, 13 bp, Homo sapiens
aggagcaccccca

SEQ ID NO: 464785 - DNA, 17 bp, Homo sapiens
aggagcacccccagcct

SEQ ID NO: 464786 - DNA, 20 bp, Homo sapiens
aggagcacccccagcctccc

SEQ ID NO: 464787 - DNA, 21 bp, Homo sapiens
aggagcacccccagcctcccc

SEQ ID NO: 464788 - DNA, 22 bp, Homo sapiens
aggagcacccccagcctccccc

SEQ ID NO: 464789 - DNA, 13 bp, Homo sapiens
aggagcactagaa

SEQ ID NO: 464790 - DNA, 16 bp, Homo sapiens
aggaggacctgggggg

SEQ ID NO: 464791 - DNA, 22 bp, Homo sapiens
aggaggacctggggggggcaag

SEQ ID NO: 464792 - DNA, 23 bp, Homo sapiens
aggaggacctggggggggcaaga

SEQ ID NO: 464793 - DNA, 19 bp, Homo sapiens
aggaggtgtggagtggagg

SEQ ID NO: 464794 - DNA, 17 bp, Homo sapiens
aggagtgcgctagagca

SEQ ID NO: 464795 - DNA, 18 bp, Homo sapiens
aggattaatctctaaaat

SEQ ID NO: 464796 - DNA, 22 bp, Homo sapiens
aggattcttttttcaatgtact

SEQ ID NO: 464797 - DNA, 13 bp, Homo sapiens
aggcaagaagtgg

SEQ ID NO: 464798 - DNA, 15 bp, Homo sapiens
aggcacacagcagcc

SEQ ID NO: 464799 - DNA, 21 bp, Homo sapiens
aggcacacagcagccccccag

SEQ ID NO: 464800 - DNA, 15 bp, Homo sapiens
aggcagaatggtggg

SEQ ID NO: 464801 - DNA, 22 bp, Homo sapiens
aggcagagattgggggggcttg

SEQ ID NO: 464802 - DNA, 12 bp, Homo sapiens
aggcagggccct

SEQ ID NO: 464803 - DNA, 13 bp, Homo sapiens
aggcagggccctg

SEQ ID NO: 464804 - DNA, 14 bp, Homo sapiens
aggcagggccctgg

SEQ ID NO: 464805 - DNA, 13 bp, Homo sapiens
aggccagtacttt

SEQ ID NO: 464806 - DNA, 18 bp, Homo sapiens
aggccccagcctccaggc

SEQ ID NO: 464807 - DNA, 22 bp, Homo sapiens
aggcccccctctgcctttgagc

SEQ ID NO: 464808 - DNA, 13 bp, Homo sapiens
aggcccccggagg

SEQ ID NO: 464809 - DNA, 21 bp, Homo sapiens
aggcccccggaggcgcccacc

SEQ ID NO: 464810 - DNA, 21 bp, Homo sapiens
agacgtttttgtgctgtgggc

SEQ ID NO: 464811 - DNA, 17 bp, Homo sapiens
agactcccgcctttgac

SEQ ID NO: 464812 - DNA, 18 bp, Homo sapiens
agactcgagagggctgag

SEQ ID NO: 464813 - DNA, 20 bp, Homo sapiens
agactcgagagggctgagcc

SEQ ID NO: 464814 - DNA, 23 bp, Homo sapiens
agactcgagagggctgagcccct

SEQ ID NO: 464815 - DNA, 12 bp, Homo sapiens
agactgcccacc

SEQ ID NO: 464816 - DNA, 18 bp, Homo sapiens
agactgcccaccctgggc

SEQ ID NO: 464817 - DNA, 20 bp, Homo sapiens
agactgcccaccctgggcct

SEQ ID NO: 464818 - DNA, 20 bp, Homo sapiens
agactttaattcttctcttt

SEQ ID NO: 464819 - DNA, 19 bp, Homo sapiens
agagaaaatgctttctcat

SEQ ID NO: 464820 - DNA, 17 bp, Homo sapiens
agagaagccacgctgtc

SEQ ID NO: 464821 - DNA, 14 bp, Homo sapiens
agagacggcagccc

SEQ ID NO: 464822 - DNA, 16 bp, Homo sapiens
agagactgcccaccct

SEQ ID NO: 464823 - DNA, 19 bp, Homo sapiens
agagactgcccaccctggg

SEQ ID NO: 464824 - DNA, 22 bp, Homo sapiens
agagactgcccaccctgggcct

SEQ ID NO: 464825 - DNA, 20 bp, Homo sapiens
agagagcaaagatggcttcc

SEQ ID NO: 464826 - DNA, 18 bp, Homo sapiens
agagagtgaatacactgg

SEQ ID NO: 464827 - DNA, 20 bp, Homo sapiens
agagcaaagatggcttccgt

SEQ ID NO: 464828 - DNA, 14 bp, Homo sapiens
agagccacaataag

SEQ ID NO: 464829 - DNA, 12 bp, Homo sapiens
agagccctgagc

SEQ ID NO: 464830 - DNA, 16 bp, Homo sapiens
agagcctatggaaagg

SEQ ID NO: 464831 - DNA, 17 bp, Homo sapiens
agagcctatggaaaggg

SEQ ID NO: 464832 - DNA, 20 bp, Homo sapiens
agagcctatggaaagggtgt

SEQ ID NO: 464833 - DNA, 15 bp, Homo sapiens
agagcgccacccgcc

SEQ ID NO: 464834 - DNA, 16 bp, Homo sapiens
agagcgccacccgccc

SEQ ID NO: 464835 - DNA, 16 bp, Homo sapiens
agagctcaggagaagg

SEQ ID NO: 464836 - DNA, 18 bp, Homo sapiens
agagctcaggagaaggcc

SEQ ID NO: 464837 - DNA, 20 bp, Homo sapiens
agagctcagtacagggcagg

SEQ ID NO: 464838 - DNA, 18 bp, Homo sapiens
agagctgagtcggctggg

SEQ ID NO: 464839 - DNA, 14 bp, Homo sapiens
agagctgctccttt

SEQ ID NO: 464840 - DNA, 22 bp, Homo sapiens
agagcttcccctaacctgggtt

SEQ ID NO: 464841 - DNA, 18 bp, Homo sapiens
agaggaggtgtggagtgg

SEQ ID NO: 464842 - DNA, 20 bp, Homo sapiens
agaggaggtgtggagtggag

SEQ ID NO: 464843 - DNA, 11 bp, Homo sapiens
agaggcagggc

SEQ ID NO: 464844 - DNA, 12 bp, Homo sapiens
agaggcagggcc

SEQ ID NO: 464845 - DNA, 15 bp, Homo sapiens
agaggcagggccctg

SEQ ID NO: 464846 - DNA, 16 bp, Homo sapiens
agagggcactcccagg

SEQ ID NO: 464847 - DNA, 12 bp, Homo sapiens
agagggctgagc

SEQ ID NO: 464848 - DNA, 15 bp, Homo sapiens
agagggctgagcccc

SEQ ID NO: 464849 - DNA, 17 bp, Homo sapiens
agagggctgagcccctc

SEQ ID NO: 464850 - DNA, 14 bp, Homo sapiens
agaggggtgagaca

SEQ ID NO: 464851 - DNA, 21 bp, Homo sapiens
agaggggtgagacagtggggg

SEQ ID NO: 464852 - DNA, 12 bp, Homo sapiens
agaggtctccct

SEQ ID NO: 464853 - DNA, 14 bp, Homo sapiens
agaggtctccctat

SEQ ID NO: 464854 - DNA, 22 bp, Homo sapiens
agagtcgagtgatatggcttgt

SEQ ID NO: 464855 - DNA, 18 bp, Homo sapiens
agataaatccaactctga

SEQ ID NO: 464856 - DNA, 20 bp, Homo sapiens
agatccctcggtcagcaccg

SEQ ID NO: 464857 - DNA, 20 bp, Homo sapiens
agatcttgagcaaggcaaga

SEQ ID NO: 464858 - DNA, 23 bp, Homo sapiens
agatgacacataaatctgtctga

SEQ ID NO: 464859 - DNA, 20 bp, Homo sapiens
agatgactggaaacaaggaa

SEQ ID NO: 464860 - DNA, 22 bp, Homo sapiens
agatggcttccgtgagacacaa

SEQ ID NO: 464861 - DNA, 21 bp, Homo sapiens
agattaaaaccagagagaaag

SEQ ID NO: 464862 - DNA, 14 bp, Homo sapiens
agattattttctat

SEQ ID NO: 464863 - DNA, 21 bp, Homo sapiens
agattattttctatatttgga

SEQ ID NO: 464864 - DNA, 21 bp, Homo sapiens
agattccagagagtggctcct

SEQ ID NO: 464865 - DNA, 22 bp, Homo sapiens
agattccagagagtggctcctc

SEQ ID NO: 464866 - DNA, 12 bp, Homo sapiens
agattttgaatg

SEQ ID NO: 464867 - DNA, 21 bp, Homo sapiens
agcaaacagatgtttgttttc

SEQ ID NO: 464868 - DNA, 19 bp, Homo sapiens
agcaaactgaagcccacag

SEQ ID NO: 464869 - DNA, 18 bp, Homo sapiens
agcaaccctacagtatat

SEQ ID NO: 464870 - DNA, 21 bp, Homo sapiens
agcaaccctacagtatataag

SEQ ID NO: 464871 - DNA, 15 bp, Homo sapiens
agcaagaagattcta

SEQ ID NO: 464872 - DNA, 14 bp, Homo sapiens
agcaagtatattta

SEQ ID NO: 464873 - DNA, 14 bp, Homo sapiens
agcacccccagcct

SEQ ID NO: 464874 - DNA, 18 bp, Homo sapiens
aagactactggcctctgt

SEQ ID NO: 464875 - DNA, 19 bp, Homo sapiens
aagactgtcttaatttgca

SEQ ID NO: 464876 - DNA, 18 bp, Homo sapiens
aagagaaacactaatggc

SEQ ID NO: 464877 - DNA, 13 bp, Homo sapiens
aagagatgctcta

SEQ ID NO: 464878 - DNA, 17 bp, Homo sapiens
aagagctcaggagaagg

SEQ ID NO: 464879 - DNA, 18 bp, Homo sapiens
aagaggatatcccttcct

SEQ ID NO: 464880 - DNA, 15 bp, Homo sapiens
aagatagcagaagag

SEQ ID NO: 464881 - DNA, 15 bp, Homo sapiens
aagatagtttattat

SEQ ID NO: 464882 - DNA, 16 bp, Homo sapiens
aagatcccaagtcaaa

SEQ ID NO: 464883 - DNA, 11 bp, Homo sapiens
aagatgccaag

SEQ ID NO: 464884 - DNA, 12 bp, Homo sapiens
aagattccatgg

SEQ ID NO: 464885 - DNA, 22 bp, Homo sapiens
aagccacgctgtcctctcgagc

SEQ ID NO: 464886 - DNA, 19 bp, Homo sapiens
aagccacgttgcagaaaaa

SEQ ID NO: 464887 - DNA, 11 bp, Homo sapiens
aagccaggaga

SEQ ID NO: 464888 - DNA, 12 bp, Homo sapiens
aagccaggagac

SEQ ID NO: 464889 - DNA, 14 bp, Homo sapiens
aagccaggagaccc

SEQ ID NO: 464890 - DNA, 19 bp, Homo sapiens
aagccaggagaccctgtct

SEQ ID NO: 464891 - DNA, 18 bp, Homo sapiens
aagccagggttccagaca

SEQ ID NO: 464892 - DNA, 21 bp, Homo sapiens
aagccatatgacaatttcaaa

SEQ ID NO: 464893 - DNA, 23 bp, Homo sapiens
aagccatatgacaatttcaaaat

SEQ ID NO: 464894 - DNA, 10 bp, Homo sapiens
aagcccaccc

SEQ ID NO: 464895 - DNA, 12 bp, Homo sapiens
aagcccaggagg

SEQ ID NO: 464896 - DNA, 23 bp, Homo sapiens
aagcctgtgaataaaaaccctgt

SEQ ID NO: 464897 - DNA, 15 bp, Homo sapiens
aagctatatatgaat

SEQ ID NO: 464898 - DNA, 12 bp, Homo sapiens
aagcttccagta

SEQ ID NO: 464899 - DNA, 23 bp, Homo sapiens
aaggaaagttctattatctgggt

SEQ ID NO: 464900 - DNA, 13 bp, Homo sapiens
aaggacactgatg

SEQ ID NO: 464901 - DNA, 20 bp, Homo sapiens
aaggacactgatgggtcctg

SEQ ID NO: 464902 - DNA, 18 bp, Homo sapiens
aaggacccggaggggcct

SEQ ID NO: 464903 - DNA, 16 bp, Homo sapiens
aaggacttctgcagct

SEQ ID NO: 464904 - DNA, 17 bp, Homo sapiens
aaggattcttttttcaa

SEQ ID NO: 464905 - DNA, 20 bp, Homo sapiens
aaggattcttttttcaatgt

SEQ ID NO: 464906 - DNA, 13 bp, Homo sapiens
aaggcagcaggcg

SEQ ID NO: 464907 - DNA, 22 bp, Homo sapiens
aaggcctgagggaagcccaccc

SEQ ID NO: 464908 - DNA, 19 bp, Homo sapiens
aaggcctgccccccttccc

SEQ ID NO: 464909 - DNA, 19 bp, Homo sapiens
aaggctgcccctgtaaggt

SEQ ID NO: 464910 - DNA, 17 bp, Homo sapiens
aagggaaatcaatttaa

SEQ ID NO: 464911 - DNA, 16 bp, Homo sapiens
aagggagtaggctgta

SEQ ID NO: 464912 - DNA, 18 bp, Homo sapiens
aagggcagcccctcccca

SEQ ID NO: 464913 - DNA, 16 bp, Homo sapiens
aaggggatctaaaagg

SEQ ID NO: 464914 - DNA, 14 bp, Homo sapiens
aaggtggcatagcc

SEQ ID NO: 464915 - DNA, 14 bp, Homo sapiens
aaggttaagccata

SEQ ID NO: 464916 - DNA, 14 bp, Homo sapiens
aagtcactgcacag

SEQ ID NO: 464917 - DNA, 11 bp, Homo sapiens
aagtctatgct

SEQ ID NO: 464918 - DNA, 18 bp, Homo sapiens
aagtctccccgcagccct

SEQ ID NO: 464919 - DNA, 19 bp, Homo sapiens
aagttcattcatactcaaa

SEQ ID NO: 464920 - DNA, 22 bp, Homo sapiens
aagttcattcatactcaaagag

SEQ ID NO: 464921 - DNA, 14 bp, Homo sapiens
aagttctattatct

SEQ ID NO: 464922 - DNA, 18 bp, Homo sapiens
aagttctattatctgggt

SEQ ID NO: 464923 - DNA, 15 bp, Homo sapiens
aagttgaagggaaat

SEQ ID NO: 464924 - DNA, 13 bp, Homo sapiens
aagttgaccttta

SEQ ID NO: 464925 - DNA, 20 bp, Homo sapiens
aagttgacctttatttatta

SEQ ID NO: 464926 - DNA, 13 bp, Homo sapiens
acggggcagagct

SEQ ID NO: 464927 - DNA, 19 bp, Homo sapiens
acgtaatttgttatatcag

SEQ ID NO: 464928 - DNA, 23 bp, Homo sapiens
acgtaatttgttatatcagcaga

SEQ ID NO: 464929 - DNA, 21 bp, Homo sapiens
acgttgcagaaaaagagcttc

SEQ ID NO: 464930 - DNA, 17 bp, Homo sapiens
actaaaattcaacaaat

SEQ ID NO: 464931 - DNA, 20 bp, Homo sapiens
actaaaattcaacaaatgat

SEQ ID NO: 464932 - DNA, 20 bp, Homo sapiens
actaacaactgggaaataag

SEQ ID NO: 464933 - DNA, 21 bp, Homo sapiens
actaatgaatgcaaaaagata

SEQ ID NO: 464934 - DNA, 18 bp, Homo sapiens
actacagagtgttataac

SEQ ID NO: 464935 - DNA, 19 bp, Homo sapiens
actacaggtattttcatca

SEQ ID NO: 464936 - DNA, 16 bp, Homo sapiens
actagaatgagaaatc

SEQ ID NO: 464937 - DNA, 15 bp, Homo sapiens
actagccctctttct

SEQ ID NO: 464938 - DNA, 22 bp, Homo sapiens
actagccctctttctctctgtg

SEQ ID NO: 464939 - DNA, 23 bp, Homo sapiens
actagccctctttctctctgtgt

SEQ ID NO: 464940 - DNA, 19 bp, Homo sapiens
actaggtgcccagtcttga

SEQ ID NO: 464941 - DNA, 14 bp, Homo sapiens
actagtagctgttt

SEQ ID NO: 464942 - DNA, 21 bp, Homo sapiens
actatggtatgctggccagca

SEQ ID NO: 464943 - DNA, 13 bp, Homo sapiens
actatttcaccat

SEQ ID NO: 464944 - DNA, 18 bp, Homo sapiens
actatttgaaaaaagaag

SEQ ID NO: 464945 - DNA, 19 bp, Homo sapiens
actcaaagaggccagtact

SEQ ID NO: 464946 - DNA, 12 bp, Homo sapiens
actcaaggaatg

SEQ ID NO: 464947 - DNA, 22 bp, Homo sapiens
actcaatgtggaaaaaatattt

SEQ ID NO: 464948 - DNA, 15 bp, Homo sapiens
actcacaaaaggctg

SEQ ID NO: 464949 - DNA, 15 bp, Homo sapiens
actcaccaaaatata

SEQ ID NO: 464950 - DNA, 13 bp, Homo sapiens
actcagaagagtc

SEQ ID NO: 464951 - DNA, 19 bp, Homo sapiens
actcagtaggtctgaaggc

SEQ ID NO: 464952 - DNA, 22 bp, Homo sapiens
actcagttaaaatgtctgtttc

SEQ ID NO: 464953 - DNA, 20 bp, Homo sapiens
actcatctgttatcctgcta

SEQ ID NO: 464954 - DNA, 15 bp, Homo sapiens
actccactcccctca

SEQ ID NO: 464955 - DNA, 18 bp, Homo sapiens
actccagacccctggctt

SEQ ID NO: 464956 - DNA, 19 bp, Homo sapiens
actccagggttaaagaaag

SEQ ID NO: 464957 - DNA, 22 bp, Homo sapiens
actccagtttgcccaccacaac

SEQ ID NO: 464958 - DNA, 11 bp, Homo sapiens
actcccagggc

SEQ ID NO: 464959 - DNA, 16 bp, Homo sapiens
actcccagggcccgag

SEQ ID NO: 464960 - DNA, 17 bp, Homo sapiens
actcccagggcccgagc

SEQ ID NO: 464961 - DNA, 19 bp, Homo sapiens
actcccagggcccgagcgc

SEQ ID NO: 464962 - DNA, 23 bp, Homo sapiens
actccccgcccgccctcctctgc

SEQ ID NO: 464963 - DNA, 19 bp, Homo sapiens
actccctccctttctcttt

SEQ ID NO: 464964 - DNA, 14 bp, Homo sapiens
actcctacctggta

SEQ ID NO: 464965 - DNA, 21 bp, Homo sapiens
actcctcagacgggctgagag

SEQ ID NO: 464966 - DNA, 19 bp, Homo sapiens
actcctcccaactctggcc

SEQ ID NO: 464967 - DNA, 17 bp, Homo sapiens
actcgactctgctgctc

SEQ ID NO: 464968 - DNA, 21 bp, Homo sapiens
actctacttagcatgtcccta

SEQ ID NO: 464969 - DNA, 19 bp, Homo sapiens
actctctcctctctctccc

SEQ ID NO: 464970 - DNA, 20 bp, Homo sapiens
actctcttcttactgtattt

SEQ ID NO: 464971 - DNA, 18 bp, Homo sapiens
actctgaagtcccttcct

SEQ ID NO: 464972 - DNA, 23 bp, Homo sapiens
actctgaagtcccttcctgtcct

SEQ ID NO: 464973 - DNA, 13 bp, Homo sapiens
actctgagctgct

SEQ ID NO: 464974 - DNA, 21 bp, Homo sapiens
actctgagctgctaggaacct

SEQ ID NO: 464975 - DNA, 19 bp, Homo sapiens
actctgaggtctcaccttc

SEQ ID NO: 464976 - DNA, 22 bp, Homo sapiens
actctggccttggttcctccag

SEQ ID NO: 464977 - DNA, 17 bp, Homo sapiens
actctgtcagccagccg

SEQ ID NO: 464978 - DNA, 20 bp, Homo sapiens
actctgtgtaatctctgatt

SEQ ID NO: 464979 - DNA, 21 bp, Homo sapiens
actctgtgtaatctctgatta

SEQ ID NO: 464980 - DNA, 19 bp, Homo sapiens
actcttcttgattaaaagt

SEQ ID NO: 464981 - DNA, 20 bp, Homo sapiens
actcttcttgattaaaagtt

SEQ ID NO: 464982 - DNA, 20 bp, Homo sapiens
actcttgtctcctcctccag

SEQ ID NO: 464983 - DNA, 14 bp, Homo sapiens
atccaactggaagg

SEQ ID NO: 464984 - DNA, 17 bp, Homo sapiens
atccaactggaaggctt

SEQ ID NO: 464985 - DNA, 16 bp, Homo sapiens
atccatacaaaactat

SEQ ID NO: 464986 - DNA, 21 bp, Homo sapiens
atccattttctaaactgtttt

SEQ ID NO: 464987 - DNA, 18 bp, Homo sapiens
atcccaagtcaaacagtg

SEQ ID NO: 464988 - DNA, 20 bp, Homo sapiens
atcccaagtcaaacagtgtg

SEQ ID NO: 464989 - DNA, 22 bp, Homo sapiens
atcccagtttaatattccaata

SEQ ID NO: 464990 - DNA, 22 bp, Homo sapiens
atccccaccctcccctctcctg

SEQ ID NO: 464991 - DNA, 15 bp, Homo sapiens
atcccctcctagcac

SEQ ID NO: 464992 - DNA, 21 bp, Homo sapiens
atccctcggtcagcaccgtgg

SEQ ID NO: 464993 - DNA, 14 bp, Homo sapiens
atcccttggcccct

SEQ ID NO: 464994 - DNA, 24 bp, Homo sapiens
atcctctgcttgtcattctgctaa

SEQ ID NO: 464995 - DNA, 20 bp, Homo sapiens
atcctgaggaccgccccaac

SEQ ID NO: 464996 - DNA, 19 bp, Homo sapiens
atcctgataaacattaaac

SEQ ID NO: 464997 - DNA, 14 bp, Homo sapiens
atcctgcaccctct

SEQ ID NO: 464998 - DNA, 15 bp, Homo sapiens
atcctgcaccctctg

SEQ ID NO: 464999 - DNA, 11 bp, Homo sapiens
atcctgcactc

SEQ ID NO: 465000 - DNA, 16 bp, Homo sapiens
atcctggtgtctagtt

SEQ ID NO: 465001 - DNA, 16 bp, Homo sapiens
atccttccatcctgag

SEQ ID NO: 465002 - DNA, 22 bp, Homo sapiens
atccttcccaacgtactcctca

SEQ ID NO: 465003 - DNA, 14 bp, Homo sapiens
atccttcccgcagc

SEQ ID NO: 465004 - DNA, 17 bp, Homo sapiens
atccttcccgcagcacc

SEQ ID NO: 465005 - DNA, 19 bp, Homo sapiens
atccttcccgcagcaccag

SEQ ID NO: 465006 - DNA, 21 bp, Homo sapiens
atccttcccgcagcaccagcc

SEQ ID NO: 465007 - DNA, 17 bp, Homo sapiens
atcgatgttaaacgtca

SEQ ID NO: 465008 - DNA, 20 bp, Homo sapiens
atcgatgttaaacgtcacag

SEQ ID NO: 465009 - DNA, 23 bp, Homo sapiens
atctaaaatactcaccaaaatat

SEQ ID NO: 465010 - DNA, 22 bp, Homo sapiens
atctagcaagaagattctaaaa

SEQ ID NO: 465011 - DNA, 17 bp, Homo sapiens
atctcaaacactgctta

SEQ ID NO: 465012 - DNA, 16 bp, Homo sapiens
atctcacaaataagta

SEQ ID NO: 465013 - DNA, 11 bp, Homo sapiens
atctcagccca

SEQ ID NO: 465014 - DNA, 18 bp, Homo sapiens
atctccagccaatttcaa

SEQ ID NO: 465015 - DNA, 21 bp, Homo sapiens
atctccagccaatttcaaaga

SEQ ID NO: 465016 - DNA, 15 bp, Homo sapiens
atctctaaaattcta

SEQ ID NO: 465017 - DNA, 19 bp, Homo sapiens
atctctaaaattctagtct

SEQ ID NO: 465018 - DNA, 13 bp, Homo sapiens
atctctctggggc

SEQ ID NO: 465019 - DNA, 20 bp, Homo sapiens
atctctgattaaatttaata

SEQ ID NO: 465020 - DNA, 12 bp, Homo sapiens
atctgaaatcta

SEQ ID NO: 465021 - DNA, 14 bp, Homo sapiens
atctgaaatctaca

SEQ ID NO: 465022 - DNA, 18 bp, Homo sapiens
atctgaaatctacaacat

SEQ ID NO: 465023 - DNA, 19 bp, Homo sapiens
atctgattggacattttct

SEQ ID NO: 465024 - DNA, 13 bp, Homo sapiens
atctgcaaatagt

SEQ ID NO: 465025 - DNA, 15 bp, Homo sapiens
atctgcaaatagttt

SEQ ID NO: 465026 - DNA, 22 bp, Homo sapiens
atctggagtctgaaggagagga

SEQ ID NO: 465027 - DNA, 14 bp, Homo sapiens
atctggcttctgca

SEQ ID NO: 465028 - DNA, 16 bp, Homo sapiens
atctgggttttagaaa

SEQ ID NO: 465029 - DNA, 17 bp, Homo sapiens
atctggtgcgtgtggcc

SEQ ID NO: 465030 - DNA, 18 bp, Homo sapiens
atctggtgcgtgtggccc

SEQ ID NO: 465031 - DNA, 21 bp, Homo sapiens
atctgtctgagccctgccctc

SEQ ID NO: 465032 - DNA, 12 bp, Homo sapiens
atctgtctgatt

SEQ ID NO: 465033 - DNA, 19 bp, Homo sapiens
atctgtgaatcctttgtac

SEQ ID NO: 465034 - DNA, 19 bp, Homo sapiens
atcttcaactaatttttga

SEQ ID NO: 465035 - DNA, 23 bp, Homo sapiens
atcttcccccttcccgccttcag

SEQ ID NO: 465036 - DNA, 14 bp, Homo sapiens
atcttgagcaaggc

SEQ ID NO: 465037 - DNA, 21 bp, Homo sapiens
atctttgtgacaggaaagccc

SEQ ID NO: 465038 - DNA, 17 bp, Homo sapiens
atgaataaagacaccta

SEQ ID NO: 465039 - DNA, 16 bp, Homo sapiens
atgaataattatgttt

SEQ ID NO: 465040 - DNA, 21 bp, Homo sapiens
atgaataattatgtttacctc

SEQ ID NO: 465041 - DNA, 15 bp, Homo sapiens
atgacaatttcaaaa

SEQ ID NO: 465042 - DNA, 16 bp, Homo sapiens
atgacaatttcaaaat

SEQ ID NO: 465043 - DNA, 20 bp, Homo sapiens
atgacaatttcaaaatgcat

SEQ ID NO: 465044 - DNA, 16 bp, Homo sapiens
atgacacataaatctg

SEQ ID NO: 465045 - DNA, 14 bp, Homo sapiens
atgacctaaatcca

SEQ ID NO: 465046 - DNA, 12 bp, Homo sapiens
atgagaaatcat

SEQ ID NO: 465047 - DNA, 14 bp, Homo sapiens
atgagaaatcatgt

SEQ ID NO: 465048 - DNA, 15 bp, Homo sapiens
atgagaaatcatgtt

SEQ ID NO: 465049 - DNA, 18 bp, Homo sapiens
atgagaaattgtgccaaa

SEQ ID NO: 465050 - DNA, 16 bp, Homo sapiens
atgagcagttagaaat

SEQ ID NO: 465051 - DNA, 17 bp, Homo sapiens
atgaggctattaaaaga

SEQ ID NO: 465052 - DNA, 15 bp, Homo sapiens
atgaggggactgcat

SEQ ID NO: 465053 - DNA, 15 bp, Homo sapiens
atgagtaaataaact

SEQ ID NO: 465054 - DNA, 18 bp, Homo sapiens
atgagtaaataaactctt

SEQ ID NO: 465055 - DNA, 16 bp, Homo sapiens
atgagttcaaatactt

SEQ ID NO: 465056 - DNA, 19 bp, Homo sapiens
atgagttcaaatacttttg

SEQ ID NO: 465057 - DNA, 20 bp, Homo sapiens
atgagtttaaaaaaataaca

SEQ ID NO: 465058 - DNA, 19 bp, Homo sapiens
atgatagcgtgcagtagag

SEQ ID NO: 465059 - DNA, 14 bp, Homo sapiens
atgatatgcatgta

SEQ ID NO: 465060 - DNA, 16 bp, Homo sapiens
atgattcaatgtgaat

SEQ ID NO: 465061 - DNA, 17 bp, Homo sapiens
atgattctcctctccca

SEQ ID NO: 465062 - DNA, 14 bp, Homo sapiens
atgattgaaaagaa

SEQ ID NO: 465063 - DNA, 23 bp, Homo sapiens
agactgcccaccctgggcctccc

SEQ ID NO: 465064 - DNA, 14 bp, Homo sapiens
agactgtctcaaga

SEQ ID NO: 465065 - DNA, 17 bp, Homo sapiens
agagaaaatgctttctc

SEQ ID NO: 465066 - DNA, 14 bp, Homo sapiens
agagaagcacccca

SEQ ID NO: 465067 - DNA, 15 bp, Homo sapiens
agagaagccacgctg

SEQ ID NO: 465068 - DNA, 14 bp, Homo sapiens
agagaaggcagcag

SEQ ID NO: 465069 - DNA, 13 bp, Homo sapiens
agagacggcagcc

SEQ ID NO: 465070 - DNA, 16 bp, Homo sapiens
agagacggcagcccca

SEQ ID NO: 465071 - DNA, 20 bp, Homo sapiens
agagacggcagccccatcct

SEQ ID NO: 465072 - DNA, 12 bp, Homo sapiens
agagactgccca

SEQ ID NO: 465073 - DNA, 15 bp, Homo sapiens
agagactgcccaccc

SEQ ID NO: 465074 - DNA, 12 bp, Homo sapiens
agagaggacagt

SEQ ID NO: 465075 - DNA, 20 bp, Homo sapiens
agagagtgaatacactggaa

SEQ ID NO: 465076 - DNA, 14 bp, Homo sapiens
agagcattctgggg

SEQ ID NO: 465077 - DNA, 16 bp, Homo sapiens
agagccccggagcacc

SEQ ID NO: 465078 - DNA, 21 bp, Homo sapiens
agagcctatggaaagggtgtg

SEQ ID NO: 465079 - DNA, 19 bp, Homo sapiens
agagcctttggtgaataac

SEQ ID NO: 465080 - DNA, 18 bp, Homo sapiens
agagcgctcctctgcctt

SEQ ID NO: 465081 - DNA, 17 bp, Homo sapiens
agagctcaggagaaggc

SEQ ID NO: 465082 - DNA, 20 bp, Homo sapiens
agagctcaggagaaggcctg

SEQ ID NO: 465083 - DNA, 20 bp, Homo sapiens
agagctctctattctggaag

SEQ ID NO: 465084 - DNA, 14 bp, Homo sapiens
agagctctgcacgt

SEQ ID NO: 465085 - DNA, 20 bp, Homo sapiens
agagctggcaaactgtgaat

SEQ ID NO: 465086 - DNA, 13 bp, Homo sapiens
agaggaggtgtgg

SEQ ID NO: 465087 - DNA, 14 bp, Homo sapiens
agaggaggtgtgga

SEQ ID NO: 465088 - DNA, 17 bp, Homo sapiens
agaggaggtgtggagtg

SEQ ID NO: 465089 - DNA, 22 bp, Homo sapiens
agaggaggtgtggagtggaggg

SEQ ID NO: 465090 - DNA, 16 bp, Homo sapiens
agaggagtgcgctaga

SEQ ID NO: 465091 - DNA, 13 bp, Homo sapiens
agaggcagggccc

SEQ ID NO: 465092 - DNA, 16 bp, Homo sapiens
agaggcagggccctgg

SEQ ID NO: 465093 - DNA, 16 bp, Homo sapiens
agaggcggcctcgtgc

SEQ ID NO: 465094 - DNA, 18 bp, Homo sapiens
agagggctgagcccctcc

SEQ ID NO: 465095 - DNA, 19 bp, Homo sapiens
agagggctgagcccctcct

SEQ ID NO: 465096 - DNA, 17 bp, Homo sapiens
agagtgaatacactgga

SEQ ID NO: 465097 - DNA, 12 bp, Homo sapiens
agagtggctcct

SEQ ID NO: 465098 - DNA, 13 bp, Homo sapiens
agagtggctcctc

SEQ ID NO: 465099 - DNA, 21 bp, Homo sapiens
agagttctccttgtacttgaa

SEQ ID NO: 465100 - DNA, 15 bp, Homo sapiens
agagttgcagtaaag

SEQ ID NO: 465101 - DNA, 18 bp, Homo sapiens
agataagtgctcagtatt

SEQ ID NO: 465102 - DNA, 19 bp, Homo sapiens
agatatcgagagtttctat

SEQ ID NO: 465103 - DNA, 20 bp, Homo sapiens
agatcagcattcaaaatagt

SEQ ID NO: 465104 - DNA, 24 bp, Homo sapiens
agatcagcattcaaaatagttcta

SEQ ID NO: 465105 - DNA, 19 bp, Homo sapiens
agatcattctccttgtaaa

SEQ ID NO: 465106 - DNA, 20 bp, Homo sapiens
agatcccaagtcaaacagtg

SEQ ID NO: 465107 - DNA, 16 bp, Homo sapiens
agatctggaatgtgaa

SEQ ID NO: 465108 - DNA, 21 bp, Homo sapiens
agatgacacataaatctgtct

SEQ ID NO: 465109 - DNA, 14 bp, Homo sapiens
agatgcaacctcac

SEQ ID NO: 465110 - DNA, 23 bp, Homo sapiens
agatgctgactgtactcctccca

SEQ ID NO: 465111 - DNA, 17 bp, Homo sapiens
agatgggtattaaactt

SEQ ID NO: 465112 - DNA, 21 bp, Homo sapiens
agatgttaattacttttgaaa

SEQ ID NO: 465113 - DNA, 14 bp, Homo sapiens
agatgtttgttttc

SEQ ID NO: 465114 - DNA, 18 bp, Homo sapiens
agatgtttgttttcaaaa

SEQ ID NO: 465115 - DNA, 23 bp, Homo sapiens
agatgtttgttttcaaaatactt

SEQ ID NO: 465116 - DNA, 19 bp, Homo sapiens
agattatatacaaagctgt

SEQ ID NO: 465117 - DNA, 19 bp, Homo sapiens
agattccagagagtggctc

SEQ ID NO: 465118 - DNA, 15 bp, Homo sapiens
agattctaaaacatt

SEQ ID NO: 465119 - DNA, 19 bp, Homo sapiens
agcaaccctacagtatata

SEQ ID NO: 465120 - DNA, 15 bp, Homo sapiens
agcaactgttagctg

SEQ ID NO: 465121 - DNA, 19 bp, Homo sapiens
agcaactgttagctgggaa

SEQ ID NO: 465122 - DNA, 18 bp, Homo sapiens
agcaagaagattctaaaa

SEQ ID NO: 465123 - DNA, 18 bp, Homo sapiens
agcaaggcaagaagtggg

SEQ ID NO: 465124 - DNA, 20 bp, Homo sapiens
agcaaggcaagaagtgggat

SEQ ID NO: 465125 - DNA, 21 bp, Homo sapiens
agcaaggtttaaatttgttat

SEQ ID NO: 465126 - DNA, 18 bp, Homo sapiens
agcaatatgttagcaaga

SEQ ID NO: 465127 - DNA, 17 bp, Homo sapiens
agcaattttcataataa

SEQ ID NO: 465128 - DNA, 17 bp, Homo sapiens
agcaccagcctgagcca

SEQ ID NO: 465129 - DNA, 13 bp, Homo sapiens
agcaccctccccc

SEQ ID NO: 465130 - DNA, 16 bp, Homo sapiens
agcaccctctcctggg

SEQ ID NO: 465131 - DNA, 20 bp, Homo sapiens
agcaccgtggtgtgaggccc

SEQ ID NO: 465132 - DNA, 12 bp, Homo sapiens
agcactcccagg

SEQ ID NO: 465133 - DNA, 14 bp, Homo sapiens
agcactcccagggc

SEQ ID NO: 465134 - DNA, 19 bp, Homo sapiens
agcactcccagggcccgag

SEQ ID NO: 465135 - DNA, 22 bp, Homo sapiens
agcagacactccagtttgccca

SEQ ID NO: 465136 - DNA, 16 bp, Homo sapiens
agcagagacggcagcc

SEQ ID NO: 465137 - DNA, 21 bp, Homo sapiens
agcagagacggcagccccatc

SEQ ID NO: 465138 - DNA, 16 bp, Homo sapiens
agcagagatgtattat

SEQ ID NO: 465139 - DNA, 17 bp, Homo sapiens
agcaggaaagatcccaa

SEQ ID NO: 465140 - DNA, 16 bp, Homo sapiens
agcagtaccatcccac

SEQ ID NO: 465141 - DNA, 11 bp, Homo sapiens
agcagtgctgg

SEQ ID NO: 465142 - DNA, 15 bp, Homo sapiens
agcagtgctgggccc

SEQ ID NO: 465143 - DNA, 17 bp, Homo sapiens
agcagtgctgggcccag

SEQ ID NO: 465144 - DNA, 15 bp, Homo sapiens
agcatagttctgcaa

SEQ ID NO: 465145 - DNA, 21 bp, Homo sapiens
agcatagttctgcaataacag

SEQ ID NO: 465146 - DNA, 22 bp, Homo sapiens
agcatagttctgcaataacagt

SEQ ID NO: 465147 - DNA, 17 bp, Homo sapiens
agcatgtctactgcttg

SEQ ID NO: 465148 - DNA, 18 bp, Homo sapiens
agcattctcactcctacc

SEQ ID NO: 465149 - DNA, 13 bp, Homo sapiens
agcattctggggt

SEQ ID NO: 465150 - DNA, 21 bp, Homo sapiens
agccaacttaaacctgtgctt

SEQ ID NO: 465151 - DNA, 23 bp, Homo sapiens
agccaacttaaacctgtgctttc

SEQ ID NO: 465152 - DNA, 16 bp, Homo sapiens
ataggaaataaatcta

SEQ ID NO: 465153 - DNA, 16 bp, Homo sapiens
ataggagcttccagat

SEQ ID NO: 465154 - DNA, 13 bp, Homo sapiens
ataggaggacaga

SEQ ID NO: 465155 - DNA, 13 bp, Homo sapiens
ataggagttctcc

SEQ ID NO: 465156 - DNA, 18 bp, Homo sapiens
ataggagttctcctggag

SEQ ID NO: 465157 - DNA, 17 bp, Homo sapiens
atagggtttggaagaaa

SEQ ID NO: 465158 - DNA, 23 bp, Homo sapiens
atagtaaataatgattcaatgtg

SEQ ID NO: 465159 - DNA, 23 bp, Homo sapiens
atagtcatgtttctgcagtattc

SEQ ID NO: 465160 - DNA, 14 bp, Homo sapiens
atagtctgtacttc

SEQ ID NO: 465161 - DNA, 20 bp, Homo sapiens
atagtgtgctcggacacagt

SEQ ID NO: 465162 - DNA, 21 bp, Homo sapiens
atagttaattgtggctttatg

SEQ ID NO: 465163 - DNA, 19 bp, Homo sapiens
atagttccattctatgact

SEQ ID NO: 465164 - DNA, 15 bp, Homo sapiens
atagttctatttcta

SEQ ID NO: 465165 - DNA, 22 bp, Homo sapiens
atagtttattatagtctgtact

SEQ ID NO: 465166 - DNA, 17 bp, Homo sapiens
atagttttataaaactc

SEQ ID NO: 465167 - DNA, 14 bp, Homo sapiens
atataaatgtttat

SEQ ID NO: 465168 - DNA, 17 bp, Homo sapiens
atataaattattacttt

SEQ ID NO: 465169 - DNA, 12 bp, Homo sapiens
atataagctttt

SEQ ID NO: 465170 - DNA, 20 bp, Homo sapiens
atataatttgccagacagag

SEQ ID NO: 465171 - DNA, 23 bp, Homo sapiens
atataatttgccagacagagatc

SEQ ID NO: 465172 - DNA, 16 bp, Homo sapiens
atatacagacctccag

SEQ ID NO: 465173 - DNA, 18 bp, Homo sapiens
atatacagacctccagat

SEQ ID NO: 465174 - DNA, 17 bp, Homo sapiens
atatagttgaacaagat

SEQ ID NO: 465175 - DNA, 15 bp, Homo sapiens
atatataaatatcta

SEQ ID NO: 465176 - DNA, 13 bp, Homo sapiens
atatatatgtata

SEQ ID NO: 465177 - DNA, 15 bp, Homo sapiens
atatatttattattt

SEQ ID NO: 465178 - DNA, 22 bp, Homo sapiens
atatatttattattttcatata

SEQ ID NO: 465179 - DNA, 20 bp, Homo sapiens
atatcagctctgcataagat

SEQ ID NO: 465180 - DNA, 23 bp, Homo sapiens
atatctatttatctgtctgagcc

SEQ ID NO: 465181 - DNA, 23 bp, Homo sapiens
atatctgtaaatttaactgcata

SEQ ID NO: 465182 - DNA, 13 bp, Homo sapiens
atatctttcagtt

SEQ ID NO: 465183 - DNA, 17 bp, Homo sapiens
atatgaaagagaaaatg

SEQ ID NO: 465184 - DNA, 19 bp, Homo sapiens
atatgaatgcttgtaatag

SEQ ID NO: 465185 - DNA, 21 bp, Homo sapiens
atatgaggggactgcatgcaa

SEQ ID NO: 465186 - DNA, 12 bp, Homo sapiens
atatgatatgca

SEQ ID NO: 465187 - DNA, 17 bp, Homo sapiens
atatgattctcctctcc

SEQ ID NO: 465188 - DNA, 13 bp, Homo sapiens
atatggaaccttc

SEQ ID NO: 465189 - DNA, 15 bp, Homo sapiens
atatgtttaaaagta

SEQ ID NO: 465190 - DNA, 17 bp, Homo sapiens
atattctgtcattggtt

SEQ ID NO: 465191 - DNA, 14 bp, Homo sapiens
atatttatttctag

SEQ ID NO: 465192 - DNA, 19 bp, Homo sapiens
atatttcacttaaactttg

SEQ ID NO: 465193 - DNA, 18 bp, Homo sapiens
atatttctaagcttattt

SEQ ID NO: 465194 - DNA, 21 bp, Homo sapiens
atatttctaagcttatttcta

SEQ ID NO: 465195 - DNA, 18 bp, Homo sapiens
atatttgtagctagaata

SEQ ID NO: 465196 - DNA, 14 bp, Homo sapiens
atatttttttctag

SEQ ID NO: 465197 - DNA, 22 bp, Homo sapiens
atcaaataatcacaaaatcaca

SEQ ID NO: 465198 - DNA, 15 bp, Homo sapiens
atcaatctggcttct

SEQ ID NO: 465199 - DNA, 19 bp, Homo sapiens
atcaatctggcttctgcat

SEQ ID NO: 465200 - DNA, 20 bp, Homo sapiens
atcacagatgggtattaaac

SEQ ID NO: 465201 - DNA, 22 bp, Homo sapiens
atcacagatgggtattaaactt

SEQ ID NO: 465202 - DNA, 15 bp, Homo sapiens
atcacgggcccgctc

SEQ ID NO: 465203 - DNA, 16 bp, Homo sapiens
atcacgggcccgctca

SEQ ID NO: 465204 - DNA, 20 bp, Homo sapiens
atcacgggcccgctcaacct

SEQ ID NO: 465205 - DNA, 14 bp, Homo sapiens
atcagaaagttggc

SEQ ID NO: 465206 - DNA, 16 bp, Homo sapiens
atcagaactcctttct

SEQ ID NO: 465207 - DNA, 16 bp, Homo sapiens
atcagattagaccagt

SEQ ID NO: 465208 - DNA, 17 bp, Homo sapiens
atcagcagacactccag

SEQ ID NO: 465209 - DNA, 20 bp, Homo sapiens
atcagggcccaaataacagt

SEQ ID NO: 465210 - DNA, 23 bp, Homo sapiens
atcatacttgctccttgaataag

SEQ ID NO: 465211 - DNA, 21 bp, Homo sapiens
atcatttatcttatctagcaa

SEQ ID NO: 465212 - DNA, 14 bp, Homo sapiens
atcattttgggaaa

SEQ ID NO: 465213 - DNA, 22 bp, Homo sapiens
atcattttgggaaattcttgca

SEQ ID NO: 465214 - DNA, 17 bp, Homo sapiens
atccaaaatagtcatgt

SEQ ID NO: 465215 - DNA, 18 bp, Homo sapiens
atccaaaatagtcatgtt

SEQ ID NO: 465216 - DNA, 13 bp, Homo sapiens
atccaactccagg

SEQ ID NO: 465217 - DNA, 16 bp, Homo sapiens
atccacatgaaaataa

SEQ ID NO: 465218 - DNA, 22 bp, Homo sapiens
atccaccgccaccccactgaga

SEQ ID NO: 465219 - DNA, 23 bp, Homo sapiens
atccactaggtgcccagtcttga

SEQ ID NO: 465220 - DNA, 20 bp, Homo sapiens
atccagtttgttctccgggt

SEQ ID NO: 465221 - DNA, 15 bp, Homo sapiens
atccatagacacagt

SEQ ID NO: 465222 - DNA, 15 bp, Homo sapiens
atccatatcagctct

SEQ ID NO: 465223 - DNA, 14 bp, Homo sapiens
atccattttctaaa

SEQ ID NO: 465224 - DNA, 21 bp, Homo sapiens
atcccactgatatcacgggcc

SEQ ID NO: 465225 - DNA, 23 bp, Homo sapiens
atcccagtttaatattccaatac

SEQ ID NO: 465226 - DNA, 18 bp, Homo sapiens
atccctcggtcagcaccg

SEQ ID NO: 465227 - DNA, 13 bp, Homo sapiens
atccctgggcccc

SEQ ID NO: 465228 - DNA, 13 bp, Homo sapiens
atcccttggcccc

SEQ ID NO: 465229 - DNA, 15 bp, Homo sapiens
atcccttggcccctc

SEQ ID NO: 465230 - DNA, 18 bp, Homo sapiens
atcccttggcccctctct

SEQ ID NO: 465231 - DNA, 19 bp, Homo sapiens
atcccttggcccctctctg

SEQ ID NO: 465232 - DNA, 14 bp, Homo sapiens
atcctatactggtt

SEQ ID NO: 465233 - DNA, 18 bp, Homo sapiens
atcctgattattgaatgt

SEQ ID NO: 465234 - DNA, 18 bp, Homo sapiens
atcctgctagctgtagaa

SEQ ID NO: 465235 - DNA, 15 bp, Homo sapiens
atccttcccgcagca

SEQ ID NO: 465236 - DNA, 18 bp, Homo sapiens
atccttcccgcagcacca

SEQ ID NO: 465237 - DNA, 18 bp, Homo sapiens
atccttttatctcacaaa

SEQ ID NO: 465238 - DNA, 20 bp, Homo sapiens
atccttttttattgaataac

SEQ ID NO: 465239 - DNA, 18 bp, Homo sapiens
atcgatccccagcctggt

SEQ ID NO: 465240 - DNA, 21 bp, Homo sapiens
atcgatgttaaacgtcacagc

SEQ ID NO: 465241 - DNA, 21 bp, Homo sapiens
atcggaggctgggcccctggg

SEQ ID NO: 465242 - DNA, 22 bp, Homo sapiens
atcggaggctgggcccctggga

SEQ ID NO: 465243 - DNA, 16 bp, Homo sapiens
atcgtttcacatctgt

SEQ ID NO: 465244 - DNA, 15 bp, Homo sapiens
agccaggccaactgc

SEQ ID NO: 465245 - DNA, 15 bp, Homo sapiens
agccagggttccaga

SEQ ID NO: 465246 - DNA, 19 bp, Homo sapiens
agccagggttccagacagg

SEQ ID NO: 465247 - DNA, 16 bp, Homo sapiens
agcccacccgccccag

SEQ ID NO: 465248 - DNA, 19 bp, Homo sapiens
agcccacccgccccagaga

SEQ ID NO: 465249 - DNA, 21 bp, Homo sapiens
agcccagaacgggcctccccg

SEQ ID NO: 465250 - DNA, 13 bp, Homo sapiens
agccccccactca

SEQ ID NO: 465251 - DNA, 23 bp, Homo sapiens
agcccctatcctgcaccctctgc

SEQ ID NO: 465252 - DNA, 22 bp, Homo sapiens
agcccctccccatggtgcagtg

SEQ ID NO: 465253 - DNA, 17 bp, Homo sapiens
agcccctcctctcctcg

SEQ ID NO: 465254 - DNA, 12 bp, Homo sapiens
agcccctgctgg

SEQ ID NO: 465255 - DNA, 19 bp, Homo sapiens
agcccggccaaggacactg

SEQ ID NO: 465256 - DNA, 20 bp, Homo sapiens
agcccggccaaggacactga

SEQ ID NO: 465257 - DNA, 20 bp, Homo sapiens
agccctcccccttccccttc

SEQ ID NO: 465258 - DNA, 12 bp, Homo sapiens
agccctccctgc

SEQ ID NO: 465259 - DNA, 19 bp, Homo sapiens
agccctctccacccagagg

SEQ ID NO: 465260 - DNA, 16 bp, Homo sapiens
agccctctttctctct

SEQ ID NO: 465261 - DNA, 24 bp, Homo sapiens
agccctctttctctctgtgtggca

SEQ ID NO: 465262 - DNA, 20 bp, Homo sapiens
agccctgctttgggctgccc

SEQ ID NO: 465263 - DNA, 23 bp, Homo sapiens
agccctgctttgggctgccctgg

SEQ ID NO: 465264 - DNA, 13 bp, Homo sapiens
agccgccctgggc

SEQ ID NO: 465265 - DNA, 22 bp, Homo sapiens
agccgccctgggctgtctgtca

SEQ ID NO: 465266 - DNA, 24 bp, Homo sapiens
agccgccctgggctgtctgtcacc

SEQ ID NO: 465267 - DNA, 17 bp, Homo sapiens
agccgcgctctgcccct

SEQ ID NO: 465268 - DNA, 18 bp, Homo sapiens
agccgcgctctgcccctc

SEQ ID NO: 465269 - DNA, 19 bp, Homo sapiens
agccgcgctctgcccctcc

SEQ ID NO: 465270 - DNA, 20 bp, Homo sapiens
agccggggtggggtgcctga

SEQ ID NO: 465271 - DNA, 23 bp, Homo sapiens
agccggggtggggtgcctgagcc

SEQ ID NO: 465272 - DNA, 23 bp, Homo sapiens
agccgtggcttcccgctcagccc

SEQ ID NO: 465273 - DNA, 20 bp, Homo sapiens
agcctccaggcccccaactc

SEQ ID NO: 465274 - DNA, 21 bp, Homo sapiens
agcctccaggcccccaactcc

SEQ ID NO: 465275 - DNA, 11 bp, Homo sapiens
agcctccccca

SEQ ID NO: 465276 - DNA, 21 bp, Homo sapiens
agcctcccccaggctgcgcct

SEQ ID NO: 465277 - DNA, 15 bp, Homo sapiens
agcctccccctcaga

SEQ ID NO: 465278 - DNA, 18 bp, Homo sapiens
agcctcctaggctccctg

SEQ ID NO: 465279 - DNA, 22 bp, Homo sapiens
agcctcctaggctccctgaggt

SEQ ID NO: 465280 - DNA, 13 bp, Homo sapiens
agcctgagctcca

SEQ ID NO: 465281 - DNA, 20 bp, Homo sapiens
agcctggcacagggcagtgg

SEQ ID NO: 465282 - DNA, 22 bp, Homo sapiens
agcctgtgaataaaaaccctgt

SEQ ID NO: 465283 - DNA, 21 bp, Homo sapiens
agcctgttgaaggactacagg

SEQ ID NO: 465284 - DNA, 17 bp, Homo sapiens
agcctttgcgctctggg

SEQ ID NO: 465285 - DNA, 17 bp, Homo sapiens
agcgcctcccgccgcct

SEQ ID NO: 465286 - DNA, 15 bp, Homo sapiens
agcgctatccacaga

SEQ ID NO: 465287 - DNA, 14 bp, Homo sapiens
agcggcccggccca

SEQ ID NO: 465288 - DNA, 19 bp, Homo sapiens
agcgggggctaactggccc

SEQ ID NO: 465289 - DNA, 22 bp, Homo sapiens
agcgggggctaactggccccag

SEQ ID NO: 465290 - DNA, 18 bp, Homo sapiens
agctaaattacaattgtc

SEQ ID NO: 465291 - DNA, 21 bp, Homo sapiens
agctaatcagcattctcactc

SEQ ID NO: 465292 - DNA, 22 bp, Homo sapiens
agctaccaactaagttgtattt

SEQ ID NO: 465293 - DNA, 19 bp, Homo sapiens
agctataacaactctattt

SEQ ID NO: 465294 - DNA, 23 bp, Homo sapiens
agctatatatatatatatatgta

SEQ ID NO: 465295 - DNA, 16 bp, Homo sapiens
agctatatatgaataa

SEQ ID NO: 465296 - DNA, 21 bp, Homo sapiens
agctcaggagaaggcctgccc

SEQ ID NO: 465297 - DNA, 23 bp, Homo sapiens
agctcagggtgctccctcctcag

SEQ ID NO: 465298 - DNA, 17 bp, Homo sapiens
agctcagtacagggcag

SEQ ID NO: 465299 - DNA, 14 bp, Homo sapiens
agctccaccctccc

SEQ ID NO: 465300 - DNA, 15 bp, Homo sapiens
agctccaccctcccc

SEQ ID NO: 465301 - DNA, 19 bp, Homo sapiens
agctccactctgaagtccc

SEQ ID NO: 465302 - DNA, 14 bp, Homo sapiens
agctctgcataaga

SEQ ID NO: 465303 - DNA, 19 bp, Homo sapiens
agctctgcataagattata

SEQ ID NO: 465304 - DNA, 18 bp, Homo sapiens
agctgagtcggctgggca

SEQ ID NO: 465305 - DNA, 23 bp, Homo sapiens
agctgctaggaacctcatttgtc

SEQ ID NO: 465306 - DNA, 14 bp, Homo sapiens
agctgctctattgt

SEQ ID NO: 465307 - DNA, 23 bp, Homo sapiens
agctgctctccttcactctgaca

SEQ ID NO: 465308 - DNA, 12 bp, Homo sapiens
agctggcagcgc

SEQ ID NO: 465309 - DNA, 13 bp, Homo sapiens
agctggcagcgcc

SEQ ID NO: 465310 - DNA, 15 bp, Homo sapiens
agctggcagcgcctc

SEQ ID NO: 465311 - DNA, 17 bp, Homo sapiens
agctggcagcgcctccc

SEQ ID NO: 465312 - DNA, 13 bp, Homo sapiens
agctggctgggtc

SEQ ID NO: 465313 - DNA, 22 bp, Homo sapiens
agctggctgggtcgcccctcct

SEQ ID NO: 465314 - DNA, 16 bp, Homo sapiens
agctgtagaaatgtat

SEQ ID NO: 465315 - DNA, 16 bp, Homo sapiens
agcttatttctaacta

SEQ ID NO: 465316 - DNA, 12 bp, Homo sapiens
agcttcaaaaca

SEQ ID NO: 465317 - DNA, 13 bp, Homo sapiens
agcttcaaaacag

SEQ ID NO: 465318 - DNA, 16 bp, Homo sapiens
agcttcaaaacagaac

SEQ ID NO: 465319 - DNA, 14 bp, Homo sapiens
agcttctcctctgc

SEQ ID NO: 465320 - DNA, 15 bp, Homo sapiens
agcttctcctctgct

SEQ ID NO: 465321 - DNA, 18 bp, Homo sapiens
agcttctcctctgctcca

SEQ ID NO: 465322 - DNA, 11 bp, Homo sapiens
agcttgaatgt

SEQ ID NO: 465323 - DNA, 12 bp, Homo sapiens
agcttgaatgtc

SEQ ID NO: 465324 - DNA, 13 bp, Homo sapiens
agcttgaatgtcc

SEQ ID NO: 465325 - DNA, 16 bp, Homo sapiens
agcttggagggatgga

SEQ ID NO: 465326 - DNA, 13 bp, Homo sapiens
agcttgtttctat

SEQ ID NO: 465327 - DNA, 15 bp, Homo sapiens
aggaaaagagaaaca

SEQ ID NO: 465328 - DNA, 13 bp, Homo sapiens
aggaaacaagctt

SEQ ID NO: 465329 - DNA, 14 bp, Homo sapiens
aggaaagccctccc

SEQ ID NO: 465330 - DNA, 15 bp, Homo sapiens
aggaaatactcagca

SEQ ID NO: 465331 - DNA, 16 bp, Homo sapiens
aggaagagatgctcta

SEQ ID NO: 465332 - DNA, 14 bp, Homo sapiens
aggaaggacatttc

SEQ ID NO: 465333 - DNA, 13 bp, Homo sapiens
aggaagtggaatg

SEQ ID NO: 465334 - DNA, 20 bp, Homo sapiens
aggaatgggccaagccaggg

SEQ ID NO: 465335 - DNA, 20 bp, Homo sapiens
atctagcaagaagattctaa

SEQ ID NO: 465336 - DNA, 21 bp, Homo sapiens
atctatgggagattaaaacca

SEQ ID NO: 465337 - DNA, 23 bp, Homo sapiens
atctattcccatcgctggaaaac

SEQ ID NO: 465338 - DNA, 19 bp, Homo sapiens
atctccagccaatttcaaa

SEQ ID NO: 465339 - DNA, 18 bp, Homo sapiens
atctctaaaattctagtc

SEQ ID NO: 465340 - DNA, 21 bp, Homo sapiens
atctctaaaattctagtctct

SEQ ID NO: 465341 - DNA, 16 bp, Homo sapiens
atctctctggggccct

SEQ ID NO: 465342 - DNA, 20 bp, Homo sapiens
atctctctggggccctgggc

SEQ ID NO: 465343 - DNA, 21 bp, Homo sapiens
atctctgattaaatttaatat

SEQ ID NO: 465344 - DNA, 13 bp, Homo sapiens
atctcttcttcct

SEQ ID NO: 465345 - DNA, 14 bp, Homo sapiens
atctctttctctct

SEQ ID NO: 465346 - DNA, 14 bp, Homo sapiens
atctgaaaagaaat

SEQ ID NO: 465347 - DNA, 15 bp, Homo sapiens
atctgaaatctacaa

SEQ ID NO: 465348 - DNA, 14 bp, Homo sapiens
atctgaggagtcca

SEQ ID NO: 465349 - DNA, 23 bp, Homo sapiens
atctgcaaatagtttcaaatgag

SEQ ID NO: 465350 - DNA, 15 bp, Homo sapiens
atctgctgcctctga

SEQ ID NO: 465351 - DNA, 18 bp, Homo sapiens
atctgctgcctctgaaaa

SEQ ID NO: 465352 - DNA, 20 bp, Homo sapiens
atctgctgcctctgaaaata

SEQ ID NO: 465353 - DNA, 18 bp, Homo sapiens
atctggagtcttcctgta

SEQ ID NO: 465354 - DNA, 15 bp, Homo sapiens
atctggcttctgcat

SEQ ID NO: 465355 - DNA, 22 bp, Homo sapiens
atctggtgcgtgtggccctgtg

SEQ ID NO: 465356 - DNA, 16 bp, Homo sapiens
atctgtaaatttaact

SEQ ID NO: 465357 - DNA, 17 bp, Homo sapiens
atctgtaaatttaactg

SEQ ID NO: 465358 - DNA, 23 bp, Homo sapiens
atctgtaaatttaactgcatata

SEQ ID NO: 465359 - DNA, 16 bp, Homo sapiens
atctgtcatctctctg

SEQ ID NO: 465360 - DNA, 17 bp, Homo sapiens
atctgtcatctctctgg

SEQ ID NO: 465361 - DNA, 19 bp, Homo sapiens
atctgtcatctctctgggg

SEQ ID NO: 465362 - DNA, 13 bp, Homo sapiens
atctgtctgagcc

SEQ ID NO: 465363 - DNA, 15 bp, Homo sapiens
atctgtctgagccct

SEQ ID NO: 465364 - DNA, 19 bp, Homo sapiens
atctgtctgagccctgccc

SEQ ID NO: 465365 - DNA, 13 bp, Homo sapiens
atctgtctgattc

SEQ ID NO: 465366 - DNA, 15 bp, Homo sapiens
atctgtctgattcta

SEQ ID NO: 465367 - DNA, 23 bp, Homo sapiens
atcttaagattccattttggaaa

SEQ ID NO: 465368 - DNA, 13 bp, Homo sapiens
atcttatgttgat

SEQ ID NO: 465369 - DNA, 17 bp, Homo sapiens
atcttccatatgctctt

SEQ ID NO: 465370 - DNA, 14 bp, Homo sapiens
atcttcccccttcc

SEQ ID NO: 465371 - DNA, 14 bp, Homo sapiens
atctttcagttatt

SEQ ID NO: 465372 - DNA, 21 bp, Homo sapiens
atctttcagttattaaatgat

SEQ ID NO: 465373 - DNA, 22 bp, Homo sapiens
atgaaagagaaaatgctttctc

SEQ ID NO: 465374 - DNA, 22 bp, Homo sapiens
atgacacataaatctgtctgat

SEQ ID NO: 465375 - DNA, 23 bp, Homo sapiens
atgacctaaatccattttctaaa

SEQ ID NO: 465376 - DNA, 21 bp, Homo sapiens
atgactggaaacaaggaagga

SEQ ID NO: 465377 - DNA, 17 bp, Homo sapiens
atgactgtttttgtagt

SEQ ID NO: 465378 - DNA, 18 bp, Homo sapiens
atgactgtttttgtagtg

SEQ ID NO: 465379 - DNA, 14 bp, Homo sapiens
atgagtaaataaac

SEQ ID NO: 465380 - DNA, 18 bp, Homo sapiens
atgagttcaaatactttt

SEQ ID NO: 465381 - DNA, 19 bp, Homo sapiens
atgagtttaaaaaaataac

SEQ ID NO: 465382 - DNA, 15 bp, Homo sapiens
atgatactgaattgt

SEQ ID NO: 465383 - DNA, 11 bp, Homo sapiens
atgatatgcat

SEQ ID NO: 465384 - DNA, 12 bp, Homo sapiens
atgatatgcatg

SEQ ID NO: 465385 - DNA, 13 bp, Homo sapiens
atgatatgcatgt

SEQ ID NO: 465386 - DNA, 18 bp, Homo sapiens
atgatatgcatgtagcat

SEQ ID NO: 465387 - DNA, 19 bp, Homo sapiens
atgatatgcatgtagcata

SEQ ID NO: 465388 - DNA, 22 bp, Homo sapiens
atgatctgtatttaatggtttt

SEQ ID NO: 465389 - DNA, 22 bp, Homo sapiens
atgattaggcccgccaaacttc

SEQ ID NO: 465390 - DNA, 22 bp, Homo sapiens
atgattcaatgtgaattttaaa

SEQ ID NO: 465391 - DNA, 12 bp, Homo sapiens
atgattccaaat

SEQ ID NO: 465392 - DNA, 13 bp, Homo sapiens
atgattccaaata

SEQ ID NO: 465393 - DNA, 15 bp, Homo sapiens
atgattctcctctcc

SEQ ID NO: 465394 - DNA, 16 bp, Homo sapiens
atgattctcctctccc

SEQ ID NO: 465395 - DNA, 20 bp, Homo sapiens
atgattgaaaagaagaaagt

SEQ ID NO: 465396 - DNA, 22 bp, Homo sapiens
atgcaaagtaccaactgagcca

SEQ ID NO: 465397 - DNA, 15 bp, Homo sapiens
atgcaagctcagggt

SEQ ID NO: 465398 - DNA, 14 bp, Homo sapiens
atgcataacacact

SEQ ID NO: 465399 - DNA, 17 bp, Homo sapiens
atgcatagacaagtgtt

SEQ ID NO: 465400 - DNA, 18 bp, Homo sapiens
atgcatgatattgtatgt

SEQ ID NO: 465401 - DNA, 21 bp, Homo sapiens
atgcatgatattgtatgtacc

SEQ ID NO: 465402 - DNA, 15 bp, Homo sapiens
atgcatgtagcatat

SEQ ID NO: 465403 - DNA, 23 bp, Homo sapiens
atgcatgtagcatataaatgttt

SEQ ID NO: 465404 - DNA, 24 bp, Homo sapiens
atgcatgtgattggcagcttcaaa

SEQ ID NO: 465405 - DNA, 21 bp, Homo sapiens
atgccagggcgcactttccac

SEQ ID NO: 465406 - DNA, 12 bp, Homo sapiens
atgcctgcctga

SEQ ID NO: 465407 - DNA, 20 bp, Homo sapiens
atgcctgtatttccaacaaa

SEQ ID NO: 465408 - DNA, 19 bp, Homo sapiens
atgccttctgttttccaaa

SEQ ID NO: 465409 - DNA, 23 bp, Homo sapiens
atgctaatgtaatcatttatctt

SEQ ID NO: 465410 - DNA, 22 bp, Homo sapiens
atgctagcacaatattcctatg

SEQ ID NO: 465411 - DNA, 19 bp, Homo sapiens
atgctgctggaggaatcag

SEQ ID NO: 465412 - DNA, 12 bp, Homo sapiens
atgctgctgtga

SEQ ID NO: 465413 - DNA, 14 bp, Homo sapiens
atgctgctgtgaat

SEQ ID NO: 465414 - DNA, 16 bp, Homo sapiens
atgctgctgtgaattt

SEQ ID NO: 465415 - DNA, 12 bp, Homo sapiens
atgctggccagc

SEQ ID NO: 465416 - DNA, 18 bp, Homo sapiens
atgctggccagcaccctc

SEQ ID NO: 465417 - DNA, 10 bp, Homo sapiens
atgctttctc

SEQ ID NO: 465418 - DNA, 16 bp, Homo sapiens
atgctttctcatgcat

SEQ ID NO: 465419 - DNA, 20 bp, Homo sapiens
atgctttctcatgcatagac

SEQ ID NO: 465420 - DNA, 16 bp, Homo sapiens
atggaaagggtgtggc

SEQ ID NO: 465421 - DNA, 20 bp, Homo sapiens
atggaaagggtgtggcttgg

SEQ ID NO: 465422 - DNA, 13 bp, Homo sapiens
atggaaccttccc

SEQ ID NO: 465423 - DNA, 19 bp, Homo sapiens
atggaattatgtataacaa

SEQ ID NO: 465424 - DNA, 20 bp, Homo sapiens
atggagaggcggcctcgtgc

SEQ ID NO: 465425 - DNA, 20 bp, Homo sapiens
atggatgattcttttcccat

SEQ ID NO: 465426 - DNA, 21 bp, Homo sapiens
attctagtcaactgctgtttt

SEQ ID NO: 465427 - DNA, 16 bp, Homo sapiens
attctagtctctgatt

SEQ ID NO: 465428 - DNA, 17 bp, Homo sapiens
attctataaattcaaca

SEQ ID NO: 465429 - DNA, 14 bp, Homo sapiens
attctatatttcat

SEQ ID NO: 465430 - DNA, 15 bp, Homo sapiens
attctatatttcata

SEQ ID NO: 465431 - DNA, 20 bp, Homo sapiens
attctatgcctgtatttcca

SEQ ID NO: 465432 - DNA, 21 bp, Homo sapiens
attctatgcctgtatttccaa

SEQ ID NO: 465433 - DNA, 21 bp, Homo sapiens
aggaatgggccaagccagggt

SEQ ID NO: 465434 - DNA, 20 bp, Homo sapiens
aggacacgaaggctgcccct

SEQ ID NO: 465435 - DNA, 21 bp, Homo sapiens
aggacactgatgggtcctgct

SEQ ID NO: 465436 - DNA, 23 bp, Homo sapiens
aggacagaaccaacgggtctgtg

SEQ ID NO: 465437 - DNA, 17 bp, Homo sapiens
aggacagggagggaaca

SEQ ID NO: 465438 - DNA, 14 bp, Homo sapiens
aggacagtttagga

SEQ ID NO: 465439 - DNA, 18 bp, Homo sapiens
aggacccggaggggcctg

SEQ ID NO: 465440 - DNA, 14 bp, Homo sapiens
aggaccgccccaac

SEQ ID NO: 465441 - DNA, 14 bp, Homo sapiens
aggacggggcagag

SEQ ID NO: 465442 - DNA, 15 bp, Homo sapiens
aggactaacaactgg

SEQ ID NO: 465443 - DNA, 22 bp, Homo sapiens
aggagaaggcctgccccccttc

SEQ ID NO: 465444 - DNA, 17 bp, Homo sapiens
aggagaccctgtctttg

SEQ ID NO: 465445 - DNA, 18 bp, Homo sapiens
aggagcacccccagcctc

SEQ ID NO: 465446 - DNA, 19 bp, Homo sapiens
aggagcacccccagcctcc

SEQ ID NO: 465447 - DNA, 23 bp, Homo sapiens
aggagcacccccagcctccccca

SEQ ID NO: 465448 - DNA, 20 bp, Homo sapiens
aggagcactagaatgagaaa

SEQ ID NO: 465449 - DNA, 16 bp, Homo sapiens
aggagcttccagatgg

SEQ ID NO: 465450 - DNA, 16 bp, Homo sapiens
aggaggtgtggagtgg

SEQ ID NO: 465451 - DNA, 17 bp, Homo sapiens
aggaggtgtggagtgga

SEQ ID NO: 465452 - DNA, 18 bp, Homo sapiens
aggaggtgtggagtggag

SEQ ID NO: 465453 - DNA, 20 bp, Homo sapiens
aggaggtgtggagtggaggg

SEQ ID NO: 465454 - DNA, 21 bp, Homo sapiens
aggaggtgtggagtggagggg

SEQ ID NO: 465455 - DNA, 16 bp, Homo sapiens
aggagtgcccgccttg

SEQ ID NO: 465456 - DNA, 16 bp, Homo sapiens
aggagttctcctggag

SEQ ID NO: 465457 - DNA, 17 bp, Homo sapiens
aggagttctcctggagc

SEQ ID NO: 465458 - DNA, 15 bp, Homo sapiens
aggatgggaagaaaa

SEQ ID NO: 465459 - DNA, 21 bp, Homo sapiens
aggatgggtgaaaccacatgg

SEQ ID NO: 465460 - DNA, 11 bp, Homo sapiens
aggattctttt

SEQ ID NO: 465461 - DNA, 17 bp, Homo sapiens
aggattcttttttcaat

SEQ ID NO: 465462 - DNA, 19 bp, Homo sapiens
aggattcttttttcaatgt

SEQ ID NO: 465463 - DNA, 23 bp, Homo sapiens
aggattcttttttcaatgtactg

SEQ ID NO: 465464 - DNA, 15 bp, Homo sapiens
aggattgaaagggag

SEQ ID NO: 465465 - DNA, 20 bp, Homo sapiens
aggcaacttttcatttttgc

SEQ ID NO: 465466 - DNA, 15 bp, Homo sapiens
aggcaagaagtggga

SEQ ID NO: 465467 - DNA, 17 bp, Homo sapiens
aggcaagaagtgggatt

SEQ ID NO: 465468 - DNA, 17 bp, Homo sapiens
aggcacacagcagcccc

SEQ ID NO: 465469 - DNA, 14 bp, Homo sapiens
aggcagaatggtgg

SEQ ID NO: 465470 - DNA, 23 bp, Homo sapiens
aggcagagattgggggggcttgg

SEQ ID NO: 465471 - DNA, 19 bp, Homo sapiens
aggccagtactttgccatc

SEQ ID NO: 465472 - DNA, 14 bp, Homo sapiens
aggccccagcctcc

SEQ ID NO: 465473 - DNA, 16 bp, Homo sapiens
aggcccccctctgcct

SEQ ID NO: 465474 - DNA, 14 bp, Homo sapiens
aggcccctgccccc

SEQ ID NO: 465475 - DNA, 18 bp, Homo sapiens
aggcccttcctctccact

SEQ ID NO: 465476 - DNA, 19 bp, Homo sapiens
aggcccttcctctccactg

SEQ ID NO: 465477 - DNA, 14 bp, Homo sapiens
aggccgtgtctctg

SEQ ID NO: 465478 - DNA, 16 bp, Homo sapiens
aggccgtgtctctgag

SEQ ID NO: 465479 - DNA, 15 bp, Homo sapiens
aggcctgagggaagc

SEQ ID NO: 465480 - DNA, 19 bp, Homo sapiens
aggcctgagggaagcccac

SEQ ID NO: 465481 - DNA, 20 bp, Homo sapiens
aggcctgagggaagcccacc

SEQ ID NO: 465482 - DNA, 23 bp, Homo sapiens
aggcctgagggaagcccacccgc

SEQ ID NO: 465483 - DNA, 19 bp, Homo sapiens
aggcctgccccccttccca

SEQ ID NO: 465484 - DNA, 23 bp, Homo sapiens
aggcctgccccccttcccacccc

SEQ ID NO: 465485 - DNA, 12 bp, Homo sapiens
aggcgcccacct

SEQ ID NO: 465486 - DNA, 14 bp, Homo sapiens
aggcgccccttccc

SEQ ID NO: 465487 - DNA, 13 bp, Homo sapiens
aggcgctcagagg

SEQ ID NO: 465488 - DNA, 15 bp, Homo sapiens
aggcgctcagaggcc

SEQ ID NO: 465489 - DNA, 20 bp, Homo sapiens
aggcgctcagaggccgctct

SEQ ID NO: 465490 - DNA, 21 bp, Homo sapiens
aggcggcctttgttgctcagc

SEQ ID NO: 465491 - DNA, 18 bp, Homo sapiens
aggcgtgggatccagaga

SEQ ID NO: 465492 - DNA, 17 bp, Homo sapiens
aggctccctgaggtacc

SEQ ID NO: 465493 - DNA, 13 bp, Homo sapiens
aggctcttctcct

SEQ ID NO: 465494 - DNA, 14 bp, Homo sapiens
aggctcttctcctt

SEQ ID NO: 465495 - DNA, 15 bp, Homo sapiens
aggctgcgcctgccc

SEQ ID NO: 465496 - DNA, 16 bp, Homo sapiens
aggctgcgcctgcccg

SEQ ID NO: 465497 - DNA, 18 bp, Homo sapiens
aggctgcgcctgcccgcc

SEQ ID NO: 465498 - DNA, 14 bp, Homo sapiens
aggctgggcccctg

SEQ ID NO: 465499 - DNA, 15 bp, Homo sapiens
aggctgggcccctgg

SEQ ID NO: 465500 - DNA, 16 bp, Homo sapiens
aggctggggcctggcc

SEQ ID NO: 465501 - DNA, 18 bp, Homo sapiens
aggctgtattttctttta

SEQ ID NO: 465502 - DNA, 20 bp, Homo sapiens
aggctgtattttcttttata

SEQ ID NO: 465503 - DNA, 22 bp, Homo sapiens
aggctgtattttcttttatatc

SEQ ID NO: 465504 - DNA, 22 bp, Homo sapiens
aggctttattcttccaagttca

SEQ ID NO: 465505 - DNA, 21 bp, Homo sapiens
agggaaatcaatttaaaggaa

SEQ ID NO: 465506 - DNA, 16 bp, Homo sapiens
agggaaatccaactcc

SEQ ID NO: 465507 - DNA, 19 bp, Homo sapiens
agggaaatccaactccagg

SEQ ID NO: 465508 - DNA, 17 bp, Homo sapiens
agggaagcccacccgcc

SEQ ID NO: 465509 - DNA, 20 bp, Homo sapiens
agggaagcccacccgcccca

SEQ ID NO: 465510 - DNA, 20 bp, Homo sapiens
agggaatccatatcagctct

SEQ ID NO: 465511 - DNA, 18 bp, Homo sapiens
agggacccccgaggcccc

SEQ ID NO: 465512 - DNA, 22 bp, Homo sapiens
agggagggaacagacctcggct

SEQ ID NO: 465513 - DNA, 22 bp, Homo sapiens
agggagtaggctgtattttctt

SEQ ID NO: 465514 - DNA, 17 bp, Homo sapiens
agggatggagaggcggc

SEQ ID NO: 465515 - DNA, 18 bp, Homo sapiens
agggatggagaggcggcc

SEQ ID NO: 465516 - DNA, 14 bp, Homo sapiens
agggcactggtggc

SEQ ID NO: 465517 - DNA, 15 bp, Homo sapiens
agggcaggagctgct

SEQ ID NO: 465518 - DNA, 19 bp, Homo sapiens
agggcagggttctagaagg

SEQ ID NO: 465519 - DNA, 20 bp, Homo sapiens
agggcagggttctagaaggg

SEQ ID NO: 465520 - DNA, 14 bp, Homo sapiens
agggccgcagggcg

SEQ ID NO: 465521 - DNA, 15 bp, Homo sapiens
agggcgctccggcag

SEQ ID NO: 465522 - DNA, 17 bp, Homo sapiens
agggcgctccggcagag

SEQ ID NO: 465523 - DNA, 18 bp, Homo sapiens
agggctgagcccctcctc

SEQ ID NO: 465524 - DNA, 20 bp, Homo sapiens
agggctgagcccctcctctc

SEQ ID NO: 465525 - DNA, 15 bp, Homo sapiens
aggggacagatcttg

SEQ ID NO: 465526 - DNA, 19 bp, Homo sapiens
aggggactgcatgcaagct

SEQ ID NO: 465527 - DNA, 21 bp, Homo sapiens
aggggatctaaaaggaggaca

SEQ ID NO: 465528 - DNA, 24 bp, Homo sapiens
aggggatctaaaaggaggacaggg

SEQ ID NO: 465529 - DNA, 18 bp, Homo sapiens
aggggcctggcagccgtg

SEQ ID NO: 465530 - DNA, 23 bp, Homo sapiens
aggggcctggcagccgtgccttc

SEQ ID NO: 465531 - DNA, 20 bp, Homo sapiens
aggggcttggagcagagacg

SEQ ID NO: 465532 - DNA, 17 bp, Homo sapiens
agggggaagatgccaag

SEQ ID NO: 465533 - DNA, 15 bp, Homo sapiens
agggggccagaggga

SEQ ID NO: 465534 - DNA, 18 bp, Homo sapiens
agggggccagagggactt

SEQ ID NO: 465535 - DNA, 12 bp, Homo sapiens
aggggggttggg

SEQ ID NO: 465536 - DNA, 19 bp, Homo sapiens
aggggggttgggttccaga

SEQ ID NO: 465537 - DNA, 21 bp, Homo sapiens
aggggggttgggttccagaca

SEQ ID NO: 465538 - DNA, 13 bp, Homo sapiens
aggggtcagcagg

SEQ ID NO: 465539 - DNA, 23 bp, Homo sapiens
aggggtgggggagaatggctctg

SEQ ID NO: 465540 - DNA, 23 bp, Homo sapiens
agggtatctgctgcctctgaaaa

SEQ ID NO: 465541 - DNA, 14 bp, Homo sapiens
agggtgaggcgtgg

SEQ ID NO: 465542 - DNA, 15 bp, Homo sapiens
agggtgaggcgtggg

SEQ ID NO: 465543 - DNA, 12 bp, Homo sapiens
agggtgggcgtg

SEQ ID NO: 465544 - DNA, 15 bp, Homo sapiens
agggtgtggcttgga

SEQ ID NO: 465545 - DNA, 15 bp, Homo sapiens
agggttaaagaaagg

SEQ ID NO: 465546 - DNA, 19 bp, Homo sapiens
agggttaaagaaaggcaga

SEQ ID NO: 465547 - DNA, 13 bp, Homo sapiens
agggttccagaca

SEQ ID NO: 465548 - DNA, 14 bp, Homo sapiens
agggttccagacag

SEQ ID NO: 465549 - DNA, 19 bp, Homo sapiens
agggttctaacctttctaa

SEQ ID NO: 465550 - DNA, 13 bp, Homo sapiens
agggttctagaag

SEQ ID NO: 465551 - DNA, 18 bp, Homo sapiens
agggtttacccagtggga

SEQ ID NO: 465552 - DNA, 14 bp, Homo sapiens
aggtaatggatatg

SEQ ID NO: 465553 - DNA, 13 bp, Homo sapiens
aggtcctgcccat

SEQ ID NO: 465554 - DNA, 22 bp, Homo sapiens
aggtctcaccttcgcctttgct

SEQ ID NO: 465555 - DNA, 21 bp, Homo sapiens
aggtgcccagtcttgagtggg

SEQ ID NO: 465556 - DNA, 18 bp, Homo sapiens
aggtgcggaccggagcgg

SEQ ID NO: 465557 - DNA, 13 bp, Homo sapiens
aggtgggtcttgg

SEQ ID NO: 465558 - DNA, 22 bp, Homo sapiens
aggtggtcttggagaggaggtg

SEQ ID NO: 465559 - DNA, 17 bp, Homo sapiens
aggtgtggagtggaggg

SEQ ID NO: 465560 - DNA, 14 bp, Homo sapiens
aggttaagccatat

SEQ ID NO: 465561 - DNA, 13 bp, Homo sapiens
aggttaaggggat

SEQ ID NO: 465562 - DNA, 12 bp, Homo sapiens
aggttcctccta

SEQ ID NO: 465563 - DNA, 21 bp, Homo sapiens
aggttcctcctaggcgctcag

SEQ ID NO: 465564 - DNA, 20 bp, Homo sapiens
aggttgtctgaagtcactgc

SEQ ID NO: 465565 - DNA, 12 bp, Homo sapiens
agtaaataaact

SEQ ID NO: 465566 - DNA, 22 bp, Homo sapiens
agtaaataaactcttcaaggcc

SEQ ID NO: 465567 - DNA, 19 bp, Homo sapiens
agtaacactagtagctgtt

SEQ ID NO: 465568 - DNA, 20 bp, Homo sapiens
agtaagctgctctattgtag

SEQ ID NO: 465569 - DNA, 19 bp, Homo sapiens
agtacagggcaggagctgc

SEQ ID NO: 465570 - DNA, 20 bp, Homo sapiens
agtacataaagtaataactg

SEQ ID NO: 465571 - DNA, 15 bp, Homo sapiens
agtaccatcccactg

SEQ ID NO: 465572 - DNA, 17 bp, Homo sapiens
agtacctgtagtgagaa

SEQ ID NO: 465573 - DNA, 22 bp, Homo sapiens
agtactcactaaaagttctcaa

SEQ ID NO: 465574 - DNA, 16 bp, Homo sapiens
agtacttgctcaataa

SEQ ID NO: 465575 - DNA, 19 bp, Homo sapiens
agtactttgccatccttgc

SEQ ID NO: 465576 - DNA, 19 bp, Homo sapiens
agtagtgcctgtgatcgtg

SEQ ID NO: 465577 - DNA, 14 bp, Homo sapiens
agtatataagcttt

SEQ ID NO: 465578 - DNA, 19 bp, Homo sapiens
agtatatagccttaagtct

SEQ ID NO: 465579 - DNA, 17 bp, Homo sapiens
agtatatttatttctag

SEQ ID NO: 465580 - DNA, 16 bp, Homo sapiens
agtatgttaagctctt

SEQ ID NO: 465581 - DNA, 19 bp, Homo sapiens
agtatgttaagctctttat

SEQ ID NO: 465582 - DNA, 12 bp, Homo sapiens
agtattctgtag

SEQ ID NO: 465583 - DNA, 22 bp, Homo sapiens
agtattctgtagccaacttaaa

SEQ ID NO: 465584 - DNA, 22 bp, Homo sapiens
agtattgacgacctacatctga

SEQ ID NO: 465585 - DNA, 16 bp, Homo sapiens
agtcaaacagtgtggc

SEQ ID NO: 465586 - DNA, 17 bp, Homo sapiens
agtcaaacagtgtggct

SEQ ID NO: 465587 - DNA, 16 bp, Homo sapiens
agtcacttatttcata

SEQ ID NO: 465588 - DNA, 16 bp, Homo sapiens
agtcatctcaaacact

SEQ ID NO: 465589 - DNA, 14 bp, Homo sapiens
agtccactttcctc

SEQ ID NO: 465590 - DNA, 15 bp, Homo sapiens
agtccactttcctct

SEQ ID NO: 465591 - DNA, 21 bp, Homo sapiens
agtcccttccagtcatgtgtg

SEQ ID NO: 465592 - DNA, 20 bp, Homo sapiens
agtcccttcctgtcctgctc

SEQ ID NO: 465593 - DNA, 19 bp, Homo sapiens
agtcctcaccttctgtttt

SEQ ID NO: 465594 - DNA, 16 bp, Homo sapiens
agtcctcctttgcttg

SEQ ID NO: 465595 - DNA, 13 bp, Homo sapiens
agtcggctgggca

SEQ ID NO: 465596 - DNA, 15 bp, Homo sapiens
agtcggctgggcagg

SEQ ID NO: 465597 - DNA, 18 bp, Homo sapiens
agtcggctgggcagggcc

SEQ ID NO: 465598 - DNA, 20 bp, Homo sapiens
agtcggctgggcagggccgc

SEQ ID NO: 465599 - DNA, 23 bp, Homo sapiens
agtctctgatttgcaaatgcaca

SEQ ID NO: 465600 - DNA, 13 bp, Homo sapiens
agtctcttctcca

SEQ ID NO: 465601 - DNA, 19 bp, Homo sapiens
agtctcttctccactggat

SEQ ID NO: 465602 - DNA, 21 bp, Homo sapiens
agtctcttctccactggatgg

SEQ ID NO: 465603 - DNA, 22 bp, Homo sapiens
agtctgtacttcagttctcatc

SEQ ID NO: 465604 - DNA, 15 bp, Homo sapiens
agtcttcctgtagtg

SEQ ID NO: 465605 - DNA, 20 bp, Homo sapiens
agtgaagcccaggaggacct

SEQ ID NO: 465606 - DNA, 17 bp, Homo sapiens
agtgaatgagtaaataa

SEQ ID NO: 465607 - DNA, 15 bp, Homo sapiens
agtgatatggcttgt

SEQ ID NO: 465608 - DNA, 15 bp, Homo sapiens
agtgcatctcagccc

SEQ ID NO: 465609 - DNA, 16 bp, Homo sapiens
agtgcatctcagccca

SEQ ID NO: 465610 - DNA, 13 bp, Homo sapiens
agtgcctgtgatc

SEQ ID NO: 465611 - DNA, 12 bp, Homo sapiens
agtgctgggccc

SEQ ID NO: 465612 - DNA, 16 bp, Homo sapiens
agtgctgggcccagcc

SEQ ID NO: 465613 - DNA, 17 bp, Homo sapiens
agtgctgggcccagccg

SEQ ID NO: 465614 - DNA, 22 bp, Homo sapiens
agtggaagatttcttgactatt

SEQ ID NO: 465615 - DNA, 11 bp, Homo sapiens
agtggaatcat

SEQ ID NO: 465616 - DNA, 17 bp, Homo sapiens
agtggaggggtcagcag

SEQ ID NO: 465617 - DNA, 23 bp, Homo sapiens
agtggaggggtcagcaggggggt

SEQ ID NO: 465618 - DNA, 17 bp, Homo sapiens
agtggcctgagaagagt

SEQ ID NO: 465619 - DNA, 17 bp, Homo sapiens
agtggctcctcccggtg

SEQ ID NO: 465620 - DNA, 21 bp, Homo sapiens
agtggctcctcccggtgccca

SEQ ID NO: 465621 - DNA, 19 bp, Homo sapiens
agtgggacagggcatggcc

SEQ ID NO: 465622 - DNA, 18 bp, Homo sapiens
agtgggattcaggaatgg

SEQ ID NO: 465623 - DNA, 19 bp, Homo sapiens
agtggggcccatggcccca

SEQ ID NO: 465624 - DNA, 20 bp, Homo sapiens
agtggggcccatggccccag

SEQ ID NO: 465625 - DNA, 23 bp, Homo sapiens
agtggttcgggggaaatagttcc

SEQ ID NO: 465626 - DNA, 12 bp, Homo sapiens
agtgtacatttg

SEQ ID NO: 465627 - DNA, 21 bp, Homo sapiens
agtgtacatttgatttgatat

SEQ ID NO: 465628 - DNA, 17 bp, Homo sapiens
agtgtgctcggacacag

SEQ ID NO: 465629 - DNA, 18 bp, Homo sapiens
agtgtgctcggacacagt

SEQ ID NO: 465630 - DNA, 17 bp, Homo sapiens
agtgtggcttaaacatt

SEQ ID NO: 465631 - DNA, 13 bp, Homo sapiens
agtgtgtgtgcaa

SEQ ID NO: 465632 - DNA, 15 bp, Homo sapiens
agtgttgaaattgga

SEQ ID NO: 465633 - DNA, 22 bp, Homo sapiens
agtgtttattaaaatactgttt

SEQ ID NO: 465634 - DNA, 23 bp, Homo sapiens
agttaacagtctcattacagatt

SEQ ID NO: 465635 - DNA, 13 bp, Homo sapiens
agttaatgtgcca

SEQ ID NO: 465636 - DNA, 15 bp, Homo sapiens
agttaatgtgccaaa

SEQ ID NO: 465637 - DNA, 16 bp, Homo sapiens
agttaatgtgccaaaa

SEQ ID NO: 465638 - DNA, 19 bp, Homo sapiens
agttagcccggccaaggac

SEQ ID NO: 465639 - DNA, 20 bp, Homo sapiens
agttcaacctggtggcacca

SEQ ID NO: 465640 - DNA, 21 bp, Homo sapiens
agttcaacctggtggcaccag

SEQ ID NO: 465641 - DNA, 14 bp, Homo sapiens
agttcactttcaat

SEQ ID NO: 465642 - DNA, 23 bp, Homo sapiens
agttcattcatactcaaagaggc

SEQ ID NO: 465643 - DNA, 14 bp, Homo sapiens
agttccataccaag

SEQ ID NO: 465644 - DNA, 16 bp, Homo sapiens
agttccattctatgac

SEQ ID NO: 465645 - DNA, 18 bp, Homo sapiens
agttctattatctgggtt

SEQ ID NO: 465646 - DNA, 19 bp, Homo sapiens
agttctattatctgggttt

SEQ ID NO: 465647 - DNA, 16 bp, Homo sapiens
agttctatttctatct

SEQ ID NO: 465648 - DNA, 23 bp, Homo sapiens
agttctatttctatctgcaaata

SEQ ID NO: 465649 - DNA, 15 bp, Homo sapiens
agttctcctggagca

SEQ ID NO: 465650 - DNA, 22 bp, Homo sapiens
agttcttggcctatgataagtt

SEQ ID NO: 465651 - DNA, 17 bp, Homo sapiens
agttgaagggaaatcaa

SEQ ID NO: 465652 - DNA, 17 bp, Homo sapiens
agttgacctttatttat

SEQ ID NO: 465653 - DNA, 16 bp, Homo sapiens
agttgatatgtaacag

SEQ ID NO: 465654 - DNA, 22 bp, Homo sapiens
agttgctttaaagtacctgtag

SEQ ID NO: 465655 - DNA, 13 bp, Homo sapiens
agttgtcttacac

SEQ ID NO: 465656 - DNA, 22 bp, Homo sapiens
agttgttggtttatactgtata

SEQ ID NO: 465657 - DNA, 14 bp, Homo sapiens
agtttaaaaaaata

SEQ ID NO: 465658 - DNA, 16 bp, Homo sapiens
agtttaaaaaaataac

SEQ ID NO: 465659 - DNA, 17 bp, Homo sapiens
agtttaaaaaaataaca

SEQ ID NO: 465660 - DNA, 14 bp, Homo sapiens
agtttaccaatcaa

SEQ ID NO: 465661 - DNA, 16 bp, Homo sapiens
agtttaccaatcaaca

SEQ ID NO: 465662 - DNA, 17 bp, Homo sapiens
agtttattatagtctgt

SEQ ID NO: 465663 - DNA, 13 bp, Homo sapiens
agtttcaaatgag

SEQ ID NO: 465664 - DNA, 19 bp, Homo sapiens
agtttcacatatttgtagc

SEQ ID NO: 465665 - DNA, 17 bp, Homo sapiens
agtttgcaatcttatgt

SEQ ID NO: 465666 - DNA, 21 bp, Homo sapiens
agtttgcaatcttatgttgat

SEQ ID NO: 465667 - DNA, 13 bp, Homo sapiens
ataaaaaccctgt

SEQ ID NO: 465668 - DNA, 12 bp, Homo sapiens
ataaaaactgcc

SEQ ID NO: 465669 - DNA, 19 bp, Homo sapiens
ataaaagtgatattcctat

SEQ ID NO: 465670 - DNA, 18 bp, Homo sapiens
ataaaagttttttaataa

SEQ ID NO: 465671 - DNA, 14 bp, Homo sapiens
ataaaatcttcaac

SEQ ID NO: 465672 - DNA, 12 bp, Homo sapiens
ataaacattaaa

SEQ ID NO: 465673 - DNA, 17 bp, Homo sapiens
ataaacattaaacactg

SEQ ID NO: 465674 - DNA, 14 bp, Homo sapiens
ataaacgaaacaca

SEQ ID NO: 465675 - DNA, 12 bp, Homo sapiens
ataaactcttca

SEQ ID NO: 465676 - DNA, 13 bp, Homo sapiens
ataaacttgtact

SEQ ID NO: 465677 - DNA, 18 bp, Homo sapiens
ataaagaagaaaataacc

SEQ ID NO: 465678 - DNA, 23 bp, Homo sapiens
ataaaggtcatattggaaacata

SEQ ID NO: 465679 - DNA, 15 bp, Homo sapiens
ataaataaagaagaa

SEQ ID NO: 465680 - DNA, 15 bp, Homo sapiens
ataaatagtaaataa

SEQ ID NO: 465681 - DNA, 12 bp, Homo sapiens
ataaatctaaat

SEQ ID NO: 465682 - DNA, 19 bp, Homo sapiens
ataaatctgtctgattcta

SEQ ID NO: 465683 - DNA, 20 bp, Homo sapiens
ataaatctgtctgattctat

SEQ ID NO: 465684 - DNA, 14 bp, Homo sapiens
ataaatgtttatat

SEQ ID NO: 465685 - DNA, 18 bp, Homo sapiens
ataaattattactttaaa

SEQ ID NO: 465686 - DNA, 20 bp, Homo sapiens
ataaattattactttaaatt

SEQ ID NO: 465687 - DNA, 22 bp, Homo sapiens
ataaattcaacacttattttct

SEQ ID NO: 465688 - DNA, 19 bp, Homo sapiens
ataaattggctcctttccc

SEQ ID NO: 465689 - DNA, 18 bp, Homo sapiens
ataactggatattcttta

SEQ ID NO: 465690 - DNA, 15 bp, Homo sapiens
ataagagacaaagtt

SEQ ID NO: 465691 - DNA, 22 bp, Homo sapiens
ataagagacaaagtttggaagt

SEQ ID NO: 465692 - DNA, 18 bp, Homo sapiens
ataagagttacttccctt

SEQ ID NO: 465693 - DNA, 15 bp, Homo sapiens
ataagtaatatcttt

SEQ ID NO: 465694 - DNA, 19 bp, Homo sapiens
ataagtaatatctttcagt

SEQ ID NO: 465695 - DNA, 15 bp, Homo sapiens
ataagtgctcagtat

SEQ ID NO: 465696 - DNA, 13 bp, Homo sapiens
ataatcaagacaa

SEQ ID NO: 465697 - DNA, 12 bp, Homo sapiens
ataatgaataat

SEQ ID NO: 465698 - DNA, 17 bp, Homo sapiens
ataatgcttaacataaa

SEQ ID NO: 465699 - DNA, 16 bp, Homo sapiens
ataatggaattatgta

SEQ ID NO: 465700 - DNA, 22 bp, Homo sapiens
ataatgtttccctcaagaacaa

SEQ ID NO: 465701 - DNA, 14 bp, Homo sapiens
atacaaagctgtca

SEQ ID NO: 465702 - DNA, 15 bp, Homo sapiens
atacaataaaagagc

SEQ ID NO: 465703 - DNA, 16 bp, Homo sapiens
atacaataaaagagct

SEQ ID NO: 465704 - DNA, 17 bp, Homo sapiens
atacaataaaagagctt

SEQ ID NO: 465705 - DNA, 14 bp, Homo sapiens
atacaccgggcctg

SEQ ID NO: 465706 - DNA, 13 bp, Homo sapiens
atacactggaatt

SEQ ID NO: 465707 - DNA, 19 bp, Homo sapiens
atacagtaagctgctctat

SEQ ID NO: 465708 - DNA, 16 bp, Homo sapiens
atacatggtttaaagt

SEQ ID NO: 465709 - DNA, 16 bp, Homo sapiens
atacattaaaataact

SEQ ID NO: 465710 - DNA, 19 bp, Homo sapiens
ataccctagaagaaaaccc

SEQ ID NO: 465711 - DNA, 21 bp, Homo sapiens
ataccctaggtctccacccct

SEQ ID NO: 465712 - DNA, 23 bp, Homo sapiens
ataccctaggtctccacccctca

SEQ ID NO: 465713 - DNA, 21 bp, Homo sapiens
atactctgtgtaatctctgat

SEQ ID NO: 465714 - DNA, 22 bp, Homo sapiens
atactgcatatcctggtgtcta

SEQ ID NO: 465715 - DNA, 16 bp, Homo sapiens
atactggaaataacct

SEQ ID NO: 465716 - DNA, 15 bp, Homo sapiens
atacttcacactgaa

SEQ ID NO: 465717 - DNA, 12 bp, Homo sapiens
atacttcctgga

SEQ ID NO: 465718 - DNA, 20 bp, Homo sapiens
atacttgctccttgaataag

SEQ ID NO: 465719 - DNA, 13 bp, Homo sapiens
atacttttgtgta

SEQ ID NO: 465720 - DNA, 18 bp, Homo sapiens
atacttttgtgtattctg

SEQ ID NO: 465721 - DNA, 21 bp, Homo sapiens
atagaactgtcccacaaaata

SEQ ID NO: 465722 - DNA, 22 bp, Homo sapiens
atagaactgtcccacaaaatat

SEQ ID NO: 465723 - DNA, 14 bp, Homo sapiens
atagataacagaga

SEQ ID NO: 465724 - DNA, 19 bp, Homo sapiens
atagcactggtttgtttct

SEQ ID NO: 465725 - DNA, 15 bp, Homo sapiens
ataggaaataaatct

SEQ ID NO: 465726 - DNA, 22 bp, Homo sapiens
cctgtgggggtggccatccctg

SEQ ID NO: 465727 - DNA, 16 bp, Homo sapiens
ccttaagaaagctata

SEQ ID NO: 465728 - DNA, 16 bp, Homo sapiens
ccttcaggttcctcct

SEQ ID NO: 465729 - DNA, 14 bp, Homo sapiens
ccttccatcctgag

SEQ ID NO: 465730 - DNA, 17 bp, Homo sapiens
ccttccatcctgaggac

SEQ ID NO: 465731 - DNA, 23 bp, Homo sapiens
ccttcccaacgtactcctcagac

SEQ ID NO: 465732 - DNA, 14 bp, Homo sapiens
ccttcccaccccta

SEQ ID NO: 465733 - DNA, 14 bp, Homo sapiens
ccttccccacccca

SEQ ID NO: 465734 - DNA, 15 bp, Homo sapiens
ccttccccaccccat

SEQ ID NO: 465735 - DNA, 15 bp, Homo sapiens
ccttccccactcccg

SEQ ID NO: 465736 - DNA, 21 bp, Homo sapiens
ccttcccgcagcaccagcctg

SEQ ID NO: 465737 - DNA, 15 bp, Homo sapiens
ccttcccgccttcag

SEQ ID NO: 465738 - DNA, 17 bp, Homo sapiens
ccttcctctccactgcc

SEQ ID NO: 465739 - DNA, 20 bp, Homo sapiens
ccttcctctccactgccttc

SEQ ID NO: 465740 - DNA, 21 bp, Homo sapiens
ccttcctgagtcccttccagt

SEQ ID NO: 465741 - DNA, 16 bp, Homo sapiens
ccttcctgtcctgctc

SEQ ID NO: 465742 - DNA, 17 bp, Homo sapiens
ccttcctgtcctgctca

SEQ ID NO: 465743 - DNA, 18 bp, Homo sapiens
ccttcctgtcctgctcac

SEQ ID NO: 465744 - DNA, 14 bp, Homo sapiens
ccttccttcttgct

SEQ ID NO: 465745 - DNA, 20 bp, Homo sapiens
ccttcgatacaccgggcctg

SEQ ID NO: 465746 - DNA, 20 bp, Homo sapiens
ccttctcccctccagacccc

SEQ ID NO: 465747 - DNA, 21 bp, Homo sapiens
ccttctcccctccagacccct

SEQ ID NO: 465748 - DNA, 22 bp, Homo sapiens
ccttctcccctccagaccccta

SEQ ID NO: 465749 - DNA, 14 bp, Homo sapiens
ccttgaccccacac

SEQ ID NO: 465750 - DNA, 17 bp, Homo sapiens
ccttgaccccacacgcc

SEQ ID NO: 465751 - DNA, 19 bp, Homo sapiens
ccttgagtgacatgcggct

SEQ ID NO: 465752 - DNA, 18 bp, Homo sapiens
ccttgctttctcttctaa

SEQ ID NO: 465753 - DNA, 16 bp, Homo sapiens
ccttggacaccatccc

SEQ ID NO: 465754 - DNA, 18 bp, Homo sapiens
ccttggatgtagtctgag

SEQ ID NO: 465755 - DNA, 14 bp, Homo sapiens
ccttggcccctctc

SEQ ID NO: 465756 - DNA, 17 bp, Homo sapiens
ccttggcccctctctgt

SEQ ID NO: 465757 - DNA, 18 bp, Homo sapiens
ccttggcccctctctgtt

SEQ ID NO: 465758 - DNA, 18 bp, Homo sapiens
ccttgggcacgggagagc

SEQ ID NO: 465759 - DNA, 14 bp, Homo sapiens
ccttggttcctcca

SEQ ID NO: 465760 - DNA, 18 bp, Homo sapiens
ccttggttcctccagcaa

SEQ ID NO: 465761 - DNA, 11 bp, Homo sapiens
ccttgtacttg

SEQ ID NO: 465762 - DNA, 19 bp, Homo sapiens
cctttatttattaaacttc

SEQ ID NO: 465763 - DNA, 22 bp, Homo sapiens
cctttatttattaaacttcagc

SEQ ID NO: 465764 - DNA, 17 bp, Homo sapiens
cctttccctgcatccct

SEQ ID NO: 465765 - DNA, 14 bp, Homo sapiens
cctttccgctgtcg

SEQ ID NO: 465766 - DNA, 21 bp, Homo sapiens
cctttcttttgaatcaatctg

SEQ ID NO: 465767 - DNA, 16 bp, Homo sapiens
cctttgcgctctgggt

SEQ ID NO: 465768 - DNA, 17 bp, Homo sapiens
cctttgtcaacttcagt

SEQ ID NO: 465769 - DNA, 14 bp, Homo sapiens
cctttgtggacttt

SEQ ID NO: 465770 - DNA, 16 bp, Homo sapiens
cgaaacacagaactca

SEQ ID NO: 465771 - DNA, 10 bp, Homo sapiens
cgactctgct

SEQ ID NO: 465772 - DNA, 13 bp, Homo sapiens
cgactctgctgct

SEQ ID NO: 465773 - DNA, 13 bp, Homo sapiens
cgagaagctctcg

SEQ ID NO: 465774 - DNA, 21 bp, Homo sapiens
cgagagggctgagcccctcct

SEQ ID NO: 465775 - DNA, 22 bp, Homo sapiens
cgagagggctgagcccctcctc

SEQ ID NO: 465776 - DNA, 17 bp, Homo sapiens
cgaggcagaatggtggg

SEQ ID NO: 465777 - DNA, 15 bp, Homo sapiens
cgaggcccccctctg

SEQ ID NO: 465778 - DNA, 17 bp, Homo sapiens
cgaggcccccctctgcc

SEQ ID NO: 465779 - DNA, 17 bp, Homo sapiens
cgagtccccccacccct

SEQ ID NO: 465780 - DNA, 21 bp, Homo sapiens
cgagtctcttctccactggat

SEQ ID NO: 465781 - DNA, 15 bp, Homo sapiens
cgatcttcccccttc

SEQ ID NO: 465782 - DNA, 13 bp, Homo sapiens
cgcaccgcccaac

SEQ ID NO: 465783 - DNA, 17 bp, Homo sapiens
cgcagagccccggagca

SEQ ID NO: 465784 - DNA, 16 bp, Homo sapiens
cgcagcaccagcctga

SEQ ID NO: 465785 - DNA, 17 bp, Homo sapiens
cgcagcaccagcctgag

SEQ ID NO: 465786 - DNA, 19 bp, Homo sapiens
cgcagcaccagcctgagcc

SEQ ID NO: 465787 - DNA, 21 bp, Homo sapiens
cgcagcaccagcctgagccac

SEQ ID NO: 465788 - DNA, 22 bp, Homo sapiens
cgcagcaccagcctgagccaca

SEQ ID NO: 465789 - DNA, 22 bp, Homo sapiens
cgcagccctctccacccagagg

SEQ ID NO: 465790 - DNA, 13 bp, Homo sapiens
cgcagccctgctt

SEQ ID NO: 465791 - DNA, 23 bp, Homo sapiens
ccaggattaatctctaaaattct

SEQ ID NO: 465792 - DNA, 13 bp, Homo sapiens
ccaggccccagcc

SEQ ID NO: 465793 - DNA, 20 bp, Homo sapiens
ccaggccccagcctccaggc

SEQ ID NO: 465794 - DNA, 15 bp, Homo sapiens
ccaggcccccaactc

SEQ ID NO: 465795 - DNA, 14 bp, Homo sapiens
ccaggccctccctg

SEQ ID NO: 465796 - DNA, 19 bp, Homo sapiens
ccaggcgccccttccccct

SEQ ID NO: 465797 - DNA, 20 bp, Homo sapiens
ccaggcggaggggcttggag

SEQ ID NO: 465798 - DNA, 12 bp, Homo sapiens
ccaggctgcgcc

SEQ ID NO: 465799 - DNA, 12 bp, Homo sapiens
ccaggctggggc

SEQ ID NO: 465800 - DNA, 13 bp, Homo sapiens
ccaggctggggcc

SEQ ID NO: 465801 - DNA, 13 bp, Homo sapiens
ccagggacccccg

SEQ ID NO: 465802 - DNA, 22 bp, Homo sapiens
ccagggttaaagaaaggcagag

SEQ ID NO: 465803 - DNA, 17 bp, Homo sapiens
ccagggttccagacagg

SEQ ID NO: 465804 - DNA, 21 bp, Homo sapiens
ccagtcttgagtgggccccct

SEQ ID NO: 465805 - DNA, 19 bp, Homo sapiens
ccagtctttggagagctca

SEQ ID NO: 465806 - DNA, 23 bp, Homo sapiens
ccagttagcccggccaaggacac

SEQ ID NO: 465807 - DNA, 14 bp, Homo sapiens
ccagtttgggaact

SEQ ID NO: 465808 - DNA, 13 bp, Homo sapiens
ccataagccctga

SEQ ID NO: 465809 - DNA, 13 bp, Homo sapiens
ccatatataaatt

SEQ ID NO: 465810 - DNA, 16 bp, Homo sapiens
ccatatataaattatt

SEQ ID NO: 465811 - DNA, 19 bp, Homo sapiens
ccatatataaattattact

SEQ ID NO: 465812 - DNA, 23 bp, Homo sapiens
ccatatataaattattactttaa

SEQ ID NO: 465813 - DNA, 14 bp, Homo sapiens
ccatatcagctctg

SEQ ID NO: 465814 - DNA, 20 bp, Homo sapiens
ccatatgacaatttcaaaat

SEQ ID NO: 465815 - DNA, 13 bp, Homo sapiens
ccatcaccagaaa

SEQ ID NO: 465816 - DNA, 14 bp, Homo sapiens
ccatccctgggccc

SEQ ID NO: 465817 - DNA, 12 bp, Homo sapiens
ccatccttcccg

SEQ ID NO: 465818 - DNA, 15 bp, Homo sapiens
ccatccttcccgcag

SEQ ID NO: 465819 - DNA, 16 bp, Homo sapiens
ccatccttcccgcagc

SEQ ID NO: 465820 - DNA, 14 bp, Homo sapiens
ccatctaaaatact

SEQ ID NO: 465821 - DNA, 17 bp, Homo sapiens
ccatcttaaatttctaa

SEQ ID NO: 465822 - DNA, 19 bp, Homo sapiens
ccatgatctgtatttaatg

SEQ ID NO: 465823 - DNA, 15 bp, Homo sapiens
ccatggccccagctg

SEQ ID NO: 465824 - DNA, 16 bp, Homo sapiens
ccatggccccagctgg

SEQ ID NO: 465825 - DNA, 18 bp, Homo sapiens
ccatggccccagctggct

SEQ ID NO: 465826 - DNA, 13 bp, Homo sapiens
ccatggtgcagtg

SEQ ID NO: 465827 - DNA, 17 bp, Homo sapiens
ccatggtggtttcagaa

SEQ ID NO: 465828 - DNA, 20 bp, Homo sapiens
ccatggtggtttcagaaagg

SEQ ID NO: 465829 - DNA, 17 bp, Homo sapiens
ccatgtgtcccctcact

SEQ ID NO: 465830 - DNA, 16 bp, Homo sapiens
ccattctataaattca

SEQ ID NO: 465831 - DNA, 22 bp, Homo sapiens
ccattttctaaactgttttcat

SEQ ID NO: 465832 - DNA, 18 bp, Homo sapiens
ccattttgtctggctgtg

SEQ ID NO: 465833 - DNA, 11 bp, Homo sapiens
cccaaaagatt

SEQ ID NO: 465834 - DNA, 12 bp, Homo sapiens
cccaaacccttc

SEQ ID NO: 465835 - DNA, 23 bp, Homo sapiens
ccccatgtgcctgcaccaggaga

SEQ ID NO: 465836 - DNA, 20 bp, Homo sapiens
cccccaacaccaccccttgc

SEQ ID NO: 465837 - DNA, 12 bp, Homo sapiens
cccccacggccg

SEQ ID NO: 465838 - DNA, 19 bp, Homo sapiens
cccccacggccgtccctga

SEQ ID NO: 465839 - DNA, 18 bp, Homo sapiens
cccccagcctcccccagg

SEQ ID NO: 465840 - DNA, 21 bp, Homo sapiens
cccccagcctcccccaggctg

SEQ ID NO: 465841 - DNA, 19 bp, Homo sapiens
cccccaggctgcgcctgcc

SEQ ID NO: 465842 - DNA, 13 bp, Homo sapiens
ccccccagcacta

SEQ ID NO: 465843 - DNA, 13 bp, Homo sapiens
cccccctccccaa

SEQ ID NO: 465844 - DNA, 12 bp, Homo sapiens
cccccctctgcc

SEQ ID NO: 465845 - DNA, 12 bp, Homo sapiens
cccccgaggccc

SEQ ID NO: 465846 - DNA, 23 bp, Homo sapiens
cccccggaggcgcccacctgccc

SEQ ID NO: 465847 - DNA, 21 bp, Homo sapiens
cccccggcctccaggctgggg

SEQ ID NO: 465848 - DNA, 12 bp, Homo sapiens
ccccctccccaa

SEQ ID NO: 465849 - DNA, 12 bp, Homo sapiens
ccccctctgcct

SEQ ID NO: 465850 - DNA, 18 bp, Homo sapiens
ccccctctgcctttgagc

SEQ ID NO: 465851 - DNA, 19 bp, Homo sapiens
cccccttcccctgcgccct

SEQ ID NO: 465852 - DNA, 16 bp, Homo sapiens
cccccttccccttctg

SEQ ID NO: 465853 - DNA, 20 bp, Homo sapiens
ccccgaggcccccctctgcc

SEQ ID NO: 465854 - DNA, 15 bp, Homo sapiens
ccccgccctcgctcc

SEQ ID NO: 465855 - DNA, 16 bp, Homo sapiens
ccccgcgcgtgccccc

SEQ ID NO: 465856 - DNA, 22 bp, Homo sapiens
ccccgcgcgtgcccccagcgtg

SEQ ID NO: 465857 - DNA, 23 bp, Homo sapiens
ccccgctcacgctgacagcctcc

SEQ ID NO: 465858 - DNA, 12 bp, Homo sapiens
ccccgctctgga

SEQ ID NO: 465859 - DNA, 15 bp, Homo sapiens
ccccgctgcctggcg

SEQ ID NO: 465860 - DNA, 16 bp, Homo sapiens
ccccggacgctggctc

SEQ ID NO: 465861 - DNA, 21 bp, Homo sapiens
ccccggaggcgcccacctgcc

SEQ ID NO: 465862 - DNA, 13 bp, Homo sapiens
ccccgtctgcccc

SEQ ID NO: 465863 - DNA, 21 bp, Homo sapiens
cccctcactctgtcagccagc

SEQ ID NO: 465864 - DNA, 22 bp, Homo sapiens
cccctcactctgtcagccagcc

SEQ ID NO: 465865 - DNA, 21 bp, Homo sapiens
cccctcagatgatctctccac

SEQ ID NO: 465866 - DNA, 12 bp, Homo sapiens
cccctccagacc

SEQ ID NO: 465867 - DNA, 15 bp, Homo sapiens
cccctccccacccac

SEQ ID NO: 465868 - DNA, 11 bp, Homo sapiens
cccctcccccg

SEQ ID NO: 465869 - DNA, 14 bp, Homo sapiens
cccctcccccgcag

SEQ ID NO: 465870 - DNA, 15 bp, Homo sapiens
cccctcccccgcaga

SEQ ID NO: 465871 - DNA, 10 bp, Homo sapiens
cccctcctcg

SEQ ID NO: 465872 - DNA, 22 bp, Homo sapiens
cccctctcctgagcctgtctct

SEQ ID NO: 465873 - DNA, 20 bp, Homo sapiens
cccctctcttaccccgtccc

SEQ ID NO: 465874 - DNA, 23 bp, Homo sapiens
cccctctgcctttgagcttctcc

SEQ ID NO: 465875 - DNA, 14 bp, Homo sapiens
cccctgcgccctcc

SEQ ID NO: 465876 - DNA, 13 bp, Homo sapiens
ccccttcccaccc

SEQ ID NO: 465877 - DNA, 16 bp, Homo sapiens
ccccttccccttctgt

SEQ ID NO: 465878 - DNA, 14 bp, Homo sapiens
ccccttctgtgtca

SEQ ID NO: 465879 - DNA, 15 bp, Homo sapiens
ccccttgaccccaca

SEQ ID NO: 465880 - DNA, 16 bp, Homo sapiens
ccccttgaccccacac

SEQ ID NO: 465881 - DNA, 17 bp, Homo sapiens
ccccttgaccccacacg

SEQ ID NO: 465882 - DNA, 21 bp, Homo sapiens
cccgaggcccccctctgcctt

SEQ ID NO: 465883 - DNA, 13 bp, Homo sapiens
cccgcagcaccag

SEQ ID NO: 465884 - DNA, 17 bp, Homo sapiens
cccgcagcaccagcctg

SEQ ID NO: 465885 - DNA, 21 bp, Homo sapiens
cccgcagccctctccacccag

SEQ ID NO: 465886 - DNA, 22 bp, Homo sapiens
cccgcagccctctccacccaga

SEQ ID NO: 465887 - DNA, 19 bp, Homo sapiens
cccgcccaccccgctgcct

SEQ ID NO: 465888 - DNA, 13 bp, Homo sapiens
cccgccccagaga

SEQ ID NO: 465889 - DNA, 16 bp, Homo sapiens
cccgccccagagactg

SEQ ID NO: 465890 - DNA, 23 bp, Homo sapiens
cagggatgggggatgggccaggg

SEQ ID NO: 465891 - DNA, 13 bp, Homo sapiens
cagggcaggagct

SEQ ID NO: 465892 - DNA, 17 bp, Homo sapiens
cagggcccaaataacag

SEQ ID NO: 465893 - DNA, 12 bp, Homo sapiens
cagggcccgagc

SEQ ID NO: 465894 - DNA, 22 bp, Homo sapiens
cagggccctggggtctctgagc

SEQ ID NO: 465895 - DNA, 24 bp, Homo sapiens
cagggccctggggtctctgagcag

SEQ ID NO: 465896 - DNA, 17 bp, Homo sapiens
cagggccgcagggcgct

SEQ ID NO: 465897 - DNA, 20 bp, Homo sapiens
cagggccgcagggcgctccg

SEQ ID NO: 465898 - DNA, 18 bp, Homo sapiens
cagggcgctccggcagag

SEQ ID NO: 465899 - DNA, 23 bp, Homo sapiens
cagggcgctccggcagaggcagg

SEQ ID NO: 465900 - DNA, 11 bp, Homo sapiens
cagggtgcagg

SEQ ID NO: 465901 - DNA, 23 bp, Homo sapiens
cagggttccagacagggtggggc

SEQ ID NO: 465902 - DNA, 19 bp, Homo sapiens
cagggttctagaaggggcg

SEQ ID NO: 465903 - DNA, 12 bp, Homo sapiens
caggtcctgccc

SEQ ID NO: 465904 - DNA, 22 bp, Homo sapiens
caggtcctgcccatgtgtcccc

SEQ ID NO: 465905 - DNA, 12 bp, Homo sapiens
caggttcctcct

SEQ ID NO: 465906 - DNA, 15 bp, Homo sapiens
caggttcctcctagg

SEQ ID NO: 465907 - DNA, 21 bp, Homo sapiens
caggttcctcctaggcgctca

SEQ ID NO: 465908 - DNA, 14 bp, Homo sapiens
cagtacagggcagg

SEQ ID NO: 465909 - DNA, 16 bp, Homo sapiens
cagtaccatcccactg

SEQ ID NO: 465910 - DNA, 17 bp, Homo sapiens
cagtaccatcccactga

SEQ ID NO: 465911 - DNA, 18 bp, Homo sapiens
cagtacttgctcaataaa

SEQ ID NO: 465912 - DNA, 14 bp, Homo sapiens
cagtatataagctt

SEQ ID NO: 465913 - DNA, 19 bp, Homo sapiens
cagtattaacatcaaagac

SEQ ID NO: 465914 - DNA, 17 bp, Homo sapiens
cagtattctgtagccaa

SEQ ID NO: 465915 - DNA, 18 bp, Homo sapiens
cagtattctgtagccaac

SEQ ID NO: 465916 - DNA, 22 bp, Homo sapiens
cagtattgacgacctacatctg

SEQ ID NO: 465917 - DNA, 17 bp, Homo sapiens
cagtccctacttaggaa

SEQ ID NO: 465918 - DNA, 22 bp, Homo sapiens
cagtcttgagtgggccccctct

SEQ ID NO: 465919 - DNA, 23 bp, Homo sapiens
cagtcttgagtgggccccctctc

SEQ ID NO: 465920 - DNA, 16 bp, Homo sapiens
cagtgcatctcagccc

SEQ ID NO: 465921 - DNA, 13 bp, Homo sapiens
cagtgctgggccc

SEQ ID NO: 465922 - DNA, 15 bp, Homo sapiens
cagtgctgggcccag

SEQ ID NO: 465923 - DNA, 23 bp, Homo sapiens
cagtgctgggcccagccggggtg

SEQ ID NO: 465924 - DNA, 14 bp, Homo sapiens
cagtggaagtgatt

SEQ ID NO: 465925 - DNA, 17 bp, Homo sapiens
cagtggagaggggactt

SEQ ID NO: 465926 - DNA, 14 bp, Homo sapiens
cagtggggcccatg

SEQ ID NO: 465927 - DNA, 21 bp, Homo sapiens
cagtggggcccatggccccag

SEQ ID NO: 465928 - DNA, 14 bp, Homo sapiens
cagtggtgatgcct

SEQ ID NO: 465929 - DNA, 18 bp, Homo sapiens
cagtggttcgggggaaat

SEQ ID NO: 465930 - DNA, 20 bp, Homo sapiens
cagtggttcgggggaaatag

SEQ ID NO: 465931 - DNA, 16 bp, Homo sapiens
cagtgtggcttaaaca

SEQ ID NO: 465932 - DNA, 17 bp, Homo sapiens
cagtgtggcttaaacat

SEQ ID NO: 465933 - DNA, 19 bp, Homo sapiens
cagttaagacaacaggcat

SEQ ID NO: 465934 - DNA, 16 bp, Homo sapiens
cagttaatgtgccaaa

SEQ ID NO: 465935 - DNA, 13 bp, Homo sapiens
cagttaattcttg

SEQ ID NO: 465936 - DNA, 23 bp, Homo sapiens
cagttacagcaggccagaaacat

SEQ ID NO: 465937 - DNA, 23 bp, Homo sapiens
cagttaccccgatccgtttgcaa

SEQ ID NO: 465938 - DNA, 17 bp, Homo sapiens
cagttagcccggccaag

SEQ ID NO: 465939 - DNA, 22 bp, Homo sapiens
cagttcaacctggtggcaccag

SEQ ID NO: 465940 - DNA, 16 bp, Homo sapiens
cagttcttggtgactg

SEQ ID NO: 465941 - DNA, 11 bp, Homo sapiens
cagttgattaa

SEQ ID NO: 465942 - DNA, 14 bp, Homo sapiens
cagttggtgatttt

SEQ ID NO: 465943 - DNA, 17 bp, Homo sapiens
cagttggtgattttaga

SEQ ID NO: 465944 - DNA, 17 bp, Homo sapiens
cagtttaatattccaat

SEQ ID NO: 465945 - DNA, 17 bp, Homo sapiens
cagtttaggacccaagg

SEQ ID NO: 465946 - DNA, 22 bp, Homo sapiens
cagtttaggacccaaggtggtc

SEQ ID NO: 465947 - DNA, 17 bp, Homo sapiens
ccactgagagctgctcc

SEQ ID NO: 465948 - DNA, 19 bp, Homo sapiens
ccactgagagctgctcctt

SEQ ID NO: 465949 - DNA, 24 bp, Homo sapiens
ccactgatatcacgggcccgctca

SEQ ID NO: 465950 - DNA, 21 bp, Homo sapiens
ccactgccttcgatacaccgg

SEQ ID NO: 465951 - DNA, 18 bp, Homo sapiens
ccacttatgctgctgtga

SEQ ID NO: 465952 - DNA, 12 bp, Homo sapiens
ccactttcctct

SEQ ID NO: 465953 - DNA, 13 bp, Homo sapiens
ccactttcctctc

SEQ ID NO: 465954 - DNA, 15 bp, Homo sapiens
ccagaacgggcctcc

SEQ ID NO: 465955 - DNA, 15 bp, Homo sapiens
ccagacagagtggat

SEQ ID NO: 465956 - DNA, 14 bp, Homo sapiens
ccagacagggtggg

SEQ ID NO: 465957 - DNA, 12 bp, Homo sapiens
ccagacccctac

SEQ ID NO: 465958 - DNA, 20 bp, Homo sapiens
ccagacccctaccctttccc

SEQ ID NO: 465959 - DNA, 17 bp, Homo sapiens
ccagactcgagagggct

SEQ ID NO: 465960 - DNA, 18 bp, Homo sapiens
ccagactcgagagggctg

SEQ ID NO: 465961 - DNA, 16 bp, Homo sapiens
ccagagactgcccacc

SEQ ID NO: 465962 - DNA, 19 bp, Homo sapiens
ccagagcctatggaaaggg

SEQ ID NO: 465963 - DNA, 19 bp, Homo sapiens
ccagagggggccagaggga

SEQ ID NO: 465964 - DNA, 20 bp, Homo sapiens
ccagagggggccagagggac

SEQ ID NO: 465965 - DNA, 17 bp, Homo sapiens
ccagattattttctata

SEQ ID NO: 465966 - DNA, 23 bp, Homo sapiens
ccagattattttctatatttgga

SEQ ID NO: 465967 - DNA, 15 bp, Homo sapiens
ccagcacatctctga

SEQ ID NO: 465968 - DNA, 16 bp, Homo sapiens
ccagcaccctctcctg

SEQ ID NO: 465969 - DNA, 15 bp, Homo sapiens
ccagcacctttgtaa

SEQ ID NO: 465970 - DNA, 22 bp, Homo sapiens
ccagcactaaggccgtgtctct

SEQ ID NO: 465971 - DNA, 14 bp, Homo sapiens
ccagcactcccagg

SEQ ID NO: 465972 - DNA, 17 bp, Homo sapiens
ccagcactcccagggcc

SEQ ID NO: 465973 - DNA, 18 bp, Homo sapiens
ccagcactcccagggccc

SEQ ID NO: 465974 - DNA, 21 bp, Homo sapiens
ccagcactcccagggcccgag

SEQ ID NO: 465975 - DNA, 13 bp, Homo sapiens
ccagcagtgctgg

SEQ ID NO: 465976 - DNA, 16 bp, Homo sapiens
ccagcagtgctgggcc

SEQ ID NO: 465977 - DNA, 14 bp, Homo sapiens
ccagccgccctggg

SEQ ID NO: 465978 - DNA, 15 bp, Homo sapiens
ccagccgccctgggc

SEQ ID NO: 465979 - DNA, 23 bp, Homo sapiens
ccagccggggtggggtgcctgag

SEQ ID NO: 465980 - DNA, 17 bp, Homo sapiens
ccagcctcccccaggct

SEQ ID NO: 465981 - DNA, 17 bp, Homo sapiens
ccagcctctccccgctc

SEQ ID NO: 465982 - DNA, 12 bp, Homo sapiens
ccagcctgagcc

SEQ ID NO: 465983 - DNA, 15 bp, Homo sapiens
ccagcctgagccaca

SEQ ID NO: 465984 - DNA, 17 bp, Homo sapiens
ccagcctgagccacagt

SEQ ID NO: 465985 - DNA, 18 bp, Homo sapiens
ccagcctgagccacagtg

SEQ ID NO: 465986 - DNA, 23 bp, Homo sapiens
ccagcgtggggctaacgggcgcc

SEQ ID NO: 465987 - DNA, 16 bp, Homo sapiens
ccagctggcagcgcct

SEQ ID NO: 465988 - DNA, 19 bp, Homo sapiens
ccagctggcagcgcctccc

SEQ ID NO: 465989 - DNA, 14 bp, Homo sapiens
ccagctggctgggt

SEQ ID NO: 465990 - DNA, 16 bp, Homo sapiens
ccagctggctgggtcg

SEQ ID NO: 465991 - DNA, 16 bp, Homo sapiens
ccaggagaccctgtct

SEQ ID NO: 465992 - DNA, 19 bp, Homo sapiens
cagcaccctctcctggggg

SEQ ID NO: 465993 - DNA, 21 bp, Homo sapiens
cagcaccgtggtgtgaggccc

SEQ ID NO: 465994 - DNA, 21 bp, Homo sapiens
cagcactaaggccgtgtctct

SEQ ID NO: 465995 - DNA, 22 bp, Homo sapiens
cagcactaaggccgtgtctctg

SEQ ID NO: 465996 - DNA, 13 bp, Homo sapiens
cagcactcccagg

SEQ ID NO: 465997 - DNA, 15 bp, Homo sapiens
cagcactcccagggc

SEQ ID NO: 465998 - DNA, 13 bp, Homo sapiens
cagcagcccccca

SEQ ID NO: 465999 - DNA, 14 bp, Homo sapiens
cagcagccccccag

SEQ ID NO: 466000 - DNA, 22 bp, Homo sapiens
cagcaggggggttgggttccag

SEQ ID NO: 466001 - DNA, 22 bp, Homo sapiens
cagcagtaccatcccactgata

SEQ ID NO: 466002 - DNA, 21 bp, Homo sapiens
cagcagtacttgctcaataaa

SEQ ID NO: 466003 - DNA, 11 bp, Homo sapiens
cagcagtgctg

SEQ ID NO: 466004 - DNA, 14 bp, Homo sapiens
cagcagtgctgggc

SEQ ID NO: 466005 - DNA, 15 bp, Homo sapiens
cagcagtgctgggcc

SEQ ID NO: 466006 - DNA, 16 bp, Homo sapiens
cagcagtgctgggccc

SEQ ID NO: 466007 - DNA, 17 bp, Homo sapiens
cagcagtgctgggccca

SEQ ID NO: 466008 - DNA, 16 bp, Homo sapiens
cagcatagttctgcaa

SEQ ID NO: 466009 - DNA, 15 bp, Homo sapiens
cagcatgtctactgc

SEQ ID NO: 466010 - DNA, 22 bp, Homo sapiens
cagcattcaaaatagttctatt

SEQ ID NO: 466011 - DNA, 13 bp, Homo sapiens
cagccaaagaaac

SEQ ID NO: 466012 - DNA, 15 bp, Homo sapiens
cagccaaagaaactc

SEQ ID NO: 466013 - DNA, 16 bp, Homo sapiens
cagccaaagaaactca

SEQ ID NO: 466014 - DNA, 22 bp, Homo sapiens
cagccaaagaaactcagaagag

SEQ ID NO: 466015 - DNA, 14 bp, Homo sapiens
cagccagccgccct

SEQ ID NO: 466016 - DNA, 18 bp, Homo sapiens
cagccagccgccctgggc

SEQ ID NO: 466017 - DNA, 19 bp, Homo sapiens
cagccagccgccctgggct

SEQ ID NO: 466018 - DNA, 20 bp, Homo sapiens
cagcccagaacgggcctccc

SEQ ID NO: 466019 - DNA, 14 bp, Homo sapiens
cagcccctgctgga

SEQ ID NO: 466020 - DNA, 17 bp, Homo sapiens
cagcccctgctggacca

SEQ ID NO: 466021 - DNA, 13 bp, Homo sapiens
cagccctccctgc

SEQ ID NO: 466022 - DNA, 18 bp, Homo sapiens
cagccctccctgcccctc

SEQ ID NO: 466023 - DNA, 13 bp, Homo sapiens
cagccctctccac

SEQ ID NO: 466024 - DNA, 15 bp, Homo sapiens
cagccctctccaccc

SEQ ID NO: 466025 - DNA, 23 bp, Homo sapiens
cagccctgctttgggctgccctg

SEQ ID NO: 466026 - DNA, 16 bp, Homo sapiens
cagccgccctgggctg

SEQ ID NO: 466027 - DNA, 14 bp, Homo sapiens
cagccgcgctctgc

SEQ ID NO: 466028 - DNA, 15 bp, Homo sapiens
cagccgcgctctgcc

SEQ ID NO: 466029 - DNA, 17 bp, Homo sapiens
cagccgcgctctgcccc

SEQ ID NO: 466030 - DNA, 22 bp, Homo sapiens
cagccgcgctctgcccctccgt

SEQ ID NO: 466031 - DNA, 14 bp, Homo sapiens
cagccggggtgggg

SEQ ID NO: 466032 - DNA, 15 bp, Homo sapiens
cagccggggtggggt

SEQ ID NO: 466033 - DNA, 23 bp, Homo sapiens
cagccggggtggggtgcctgagc

SEQ ID NO: 466034 - DNA, 11 bp, Homo sapiens
cagcctccccc

SEQ ID NO: 466035 - DNA, 17 bp, Homo sapiens
cagcctcccccaggctg

SEQ ID NO: 466036 - DNA, 16 bp, Homo sapiens
cagcctcctaggctcc

SEQ ID NO: 466037 - DNA, 17 bp, Homo sapiens
cagcctcctaggctccc

SEQ ID NO: 466038 - DNA, 19 bp, Homo sapiens
cagcctcctaggctccctg

SEQ ID NO: 466039 - DNA, 21 bp, Homo sapiens
cagcctcctaggctccctgag

SEQ ID NO: 466040 - DNA, 15 bp, Homo sapiens
cagcctgagctccac

SEQ ID NO: 466041 - DNA, 20 bp, Homo sapiens
cagcctgagctccaccctcc

SEQ ID NO: 466042 - DNA, 21 bp, Homo sapiens
cagcctgagctccaccctccc

SEQ ID NO: 466043 - DNA, 10 bp, Homo sapiens
cagcctggca

SEQ ID NO: 466044 - DNA, 13 bp, Homo sapiens
cagccttaagaaa

SEQ ID NO: 466045 - DNA, 16 bp, Homo sapiens
cagcctttgcgctctg

SEQ ID NO: 466046 - DNA, 13 bp, Homo sapiens
cagcgcctcccgc

SEQ ID NO: 466047 - DNA, 15 bp, Homo sapiens
cagcgcctcccgccg

SEQ ID NO: 466048 - DNA, 21 bp, Homo sapiens
cagcgcctcccgccgcctcgg

SEQ ID NO: 466049 - DNA, 22 bp, Homo sapiens
cagcgcctcccgccgcctcggg

SEQ ID NO: 466050 - DNA, 15 bp, Homo sapiens
cagcggcccggccca

SEQ ID NO: 466051 - DNA, 19 bp, Homo sapiens
cagcggcccggcccacgca

SEQ ID NO: 466052 - DNA, 22 bp, Homo sapiens
cagcggcccggcccacgcagag

SEQ ID NO: 466053 - DNA, 19 bp, Homo sapiens
cagctaatcagcattctca

SEQ ID NO: 466054 - DNA, 14 bp, Homo sapiens
cagctatctgtcat

SEQ ID NO: 466055 - DNA, 23 bp, Homo sapiens
cagctccactctgaagtcccttc

SEQ ID NO: 466056 - DNA, 12 bp, Homo sapiens
cagctctaaagc

SEQ ID NO: 466057 - DNA, 14 bp, Homo sapiens
cagctggcagcgcc

SEQ ID NO: 466058 - DNA, 15 bp, Homo sapiens
cagctggcagcgcct

SEQ ID NO: 466059 - DNA, 13 bp, Homo sapiens
cagcttcaaaaca

SEQ ID NO: 466060 - DNA, 23 bp, Homo sapiens
cagcttgaatgtccccattctat

SEQ ID NO: 466061 - DNA, 12 bp, Homo sapiens
caggaaaataac

SEQ ID NO: 466062 - DNA, 14 bp, Homo sapiens
caggaaaataacag

SEQ ID NO: 466063 - DNA, 14 bp, Homo sapiens
caggaaagatccca

SEQ ID NO: 466064 - DNA, 14 bp, Homo sapiens
caggaaagccctcc

SEQ ID NO: 466065 - DNA, 23 bp, Homo sapiens
caggaaagccctcccccttcccc

SEQ ID NO: 466066 - DNA, 21 bp, Homo sapiens
caggacacgaaggctgcccct

SEQ ID NO: 466067 - DNA, 23 bp, Homo sapiens
caggacacgaaggctgcccctgt

SEQ ID NO: 466068 - DNA, 15 bp, Homo sapiens
caggagaccctgtct

SEQ ID NO: 466069 - DNA, 23 bp, Homo sapiens
caggattaatctctaaaattcta

SEQ ID NO: 466070 - DNA, 17 bp, Homo sapiens
caggcacacagcagccc

SEQ ID NO: 466071 - DNA, 21 bp, Homo sapiens
caggcacacagcagcccccca

SEQ ID NO: 466072 - DNA, 16 bp, Homo sapiens
caggccctccctgact

SEQ ID NO: 466073 - DNA, 20 bp, Homo sapiens
caggccctccctgactccct

SEQ ID NO: 466074 - DNA, 23 bp, Homo sapiens
caggcccttcctctccactgcct

SEQ ID NO: 466075 - DNA, 17 bp, Homo sapiens
caggcgcgcaccgccca

SEQ ID NO: 466076 - DNA, 17 bp, Homo sapiens
caggcggaggggcttgg

SEQ ID NO: 466077 - DNA, 22 bp, Homo sapiens
caggctcttctcctttcacaac

SEQ ID NO: 466078 - DNA, 16 bp, Homo sapiens
caggctgcgcctgccc

SEQ ID NO: 466079 - DNA, 20 bp, Homo sapiens
caggctgcgcctgcccgccc

SEQ ID NO: 466080 - DNA, 23 bp, Homo sapiens
caggctgcgcctgcccgcccgcc

SEQ ID NO: 466081 - DNA, 12 bp, Homo sapiens
caggctggggcc

SEQ ID NO: 466082 - DNA, 15 bp, Homo sapiens
caggctggggcctgg

SEQ ID NO: 466083 - DNA, 11 bp, Homo sapiens
caggctttcta

SEQ ID NO: 466084 - DNA, 12 bp, Homo sapiens
cagggacccccg

SEQ ID NO: 466085 - DNA, 18 bp, Homo sapiens
cagggacccccgaggccc

SEQ ID NO: 466086 - DNA, 22 bp, Homo sapiens
cagggacccccgaggcccccct

SEQ ID NO: 466087 - DNA, 23 bp, Homo sapiens
cagggacccccgaggcccccctc

SEQ ID NO: 466088 - DNA, 19 bp, Homo sapiens
cagggagggaacagacctc

SEQ ID NO: 466089 - DNA, 17 bp, Homo sapiens
cagggatgggggatggg

SEQ ID NO: 466090 - DNA, 16 bp, Homo sapiens
ggctcttctcctttca

SEQ ID NO: 466091 - DNA, 23 bp, Homo sapiens
ggctcttctcctttcacaacctt

SEQ ID NO: 466092 - DNA, 18 bp, Homo sapiens
ggctgagcccctcctctc

SEQ ID NO: 466093 - DNA, 19 bp, Homo sapiens
ggctgagcccctcctctcc

SEQ ID NO: 466094 - DNA, 13 bp, Homo sapiens
ggctgccctggtg

SEQ ID NO: 466095 - DNA, 14 bp, Homo sapiens
ggctgccctggtgc

SEQ ID NO: 466096 - DNA, 22 bp, Homo sapiens
ggctgccctggtgctgccacac

SEQ ID NO: 466097 - DNA, 16 bp, Homo sapiens
ggctggatgtgctttc

SEQ ID NO: 466098 - DNA, 12 bp, Homo sapiens
ggctggccctgc

SEQ ID NO: 466099 - DNA, 13 bp, Homo sapiens
ggctggccctgcc

SEQ ID NO: 466100 - DNA, 18 bp, Homo sapiens
ggctggccctgccctccc

SEQ ID NO: 466101 - DNA, 22 bp, Homo sapiens
ggctggccctgccctcccccac

SEQ ID NO: 466102 - DNA, 13 bp, Homo sapiens
ggctgggcagggc

SEQ ID NO: 466103 - DNA, 13 bp, Homo sapiens
ggctgggcccctg

SEQ ID NO: 466104 - DNA, 15 bp, Homo sapiens
ggctgggcccctggg

SEQ ID NO: 466105 - DNA, 17 bp, Homo sapiens
ggctggggcctggccta

SEQ ID NO: 466106 - DNA, 17 bp, Homo sapiens
ggctgggtcgcccctcc

SEQ ID NO: 466107 - DNA, 16 bp, Homo sapiens
ggctgtattttctttt

SEQ ID NO: 466108 - DNA, 14 bp, Homo sapiens
ggctgtctgtcacc

SEQ ID NO: 466109 - DNA, 14 bp, Homo sapiens
ggctgtggcccctc

SEQ ID NO: 466110 - DNA, 15 bp, Homo sapiens
ggctgtggcccctcc

SEQ ID NO: 466111 - DNA, 16 bp, Homo sapiens
ggctgtggcccctcct

SEQ ID NO: 466112 - DNA, 17 bp, Homo sapiens
ggctgtggcccctcctt

SEQ ID NO: 466113 - DNA, 21 bp, Homo sapiens
ggctgtggcccctccttctcc

SEQ ID NO: 466114 - DNA, 14 bp, Homo sapiens
ggcttaaacatttt

SEQ ID NO: 466115 - DNA, 15 bp, Homo sapiens
ggcttccatggtggt

SEQ ID NO: 466116 - DNA, 14 bp, Homo sapiens
ggcttcccgctcag

SEQ ID NO: 466117 - DNA, 19 bp, Homo sapiens
ggcttcccgctcagccctc

SEQ ID NO: 466118 - DNA, 21 bp, Homo sapiens
ggcttcccgctcagccctccc

SEQ ID NO: 466119 - DNA, 22 bp, Homo sapiens
ggcttcccgctcagccctccct

SEQ ID NO: 466120 - DNA, 16 bp, Homo sapiens
ggcttggaagggcgct

SEQ ID NO: 466121 - DNA, 15 bp, Homo sapiens
ggcttggggtagaga

SEQ ID NO: 466122 - DNA, 18 bp, Homo sapiens
ggcttggggtagagagga

SEQ ID NO: 466123 - DNA, 20 bp, Homo sapiens
ggcttggggtagagaggaca

SEQ ID NO: 466124 - DNA, 16 bp, Homo sapiens
ggcttgtagggtgagg

SEQ ID NO: 466125 - DNA, 15 bp, Homo sapiens
ggcttttcactgctg

SEQ ID NO: 466126 - DNA, 22 bp, Homo sapiens
ggcttttcactgctggctgcct

SEQ ID NO: 466127 - DNA, 14 bp, Homo sapiens
gggaaattcttgca

SEQ ID NO: 466128 - DNA, 22 bp, Homo sapiens
gggaagcccacccgccccagag

SEQ ID NO: 466129 - DNA, 18 bp, Homo sapiens
gggacagcggcccggccc

SEQ ID NO: 466130 - DNA, 23 bp, Homo sapiens
gggacccccggcctccaggctgg

SEQ ID NO: 466131 - DNA, 16 bp, Homo sapiens
gggactgcatgcaagc

SEQ ID NO: 466132 - DNA, 15 bp, Homo sapiens
gggactggcccaccc

SEQ ID NO: 466133 - DNA, 22 bp, Homo sapiens
gggactggcccacccctcttcc

SEQ ID NO: 466134 - DNA, 22 bp, Homo sapiens
gggactgtcttcaaccctgccc

SEQ ID NO: 466135 - DNA, 20 bp, Homo sapiens
gggagaacctcgttgacatg

SEQ ID NO: 466136 - DNA, 23 bp, Homo sapiens
gggagattaaaaccagagagaaa

SEQ ID NO: 466137 - DNA, 23 bp, Homo sapiens
gggagtccactttcctctctctc

SEQ ID NO: 466138 - DNA, 13 bp, Homo sapiens
gggatccagagag

SEQ ID NO: 466139 - DNA, 17 bp, Homo sapiens
gggatctaaaaggagga

SEQ ID NO: 466140 - DNA, 13 bp, Homo sapiens
gggcacgggagag

SEQ ID NO: 466141 - DNA, 17 bp, Homo sapiens
gggcacgggagagcgcc

SEQ ID NO: 466142 - DNA, 23 bp, Homo sapiens
gggcacgggagagcgccacccgc

SEQ ID NO: 466143 - DNA, 13 bp, Homo sapiens
gggcactggtggc

SEQ ID NO: 466144 - DNA, 20 bp, Homo sapiens
gggcagagctgagtcggctg

SEQ ID NO: 466145 - DNA, 17 bp, Homo sapiens
gggcagcaccctccccc

SEQ ID NO: 466146 - DNA, 14 bp, Homo sapiens
gggcagcccctccc

SEQ ID NO: 466147 - DNA, 18 bp, Homo sapiens
ggatgggaagaaaaagga

SEQ ID NO: 466148 - DNA, 19 bp, Homo sapiens
ggatgggggatgggccagg

SEQ ID NO: 466149 - DNA, 18 bp, Homo sapiens
ggatgtcttgagatgtat

SEQ ID NO: 466150 - DNA, 13 bp, Homo sapiens
ggattatctacta

SEQ ID NO: 466151 - DNA, 11 bp, Homo sapiens
ggattcaaatg

SEQ ID NO: 466152 - DNA, 13 bp, Homo sapiens
ggattcacttcta

SEQ ID NO: 466153 - DNA, 15 bp, Homo sapiens
ggattcatgtccaga

SEQ ID NO: 466154 - DNA, 19 bp, Homo sapiens
ggattcttttttcaatgta

SEQ ID NO: 466155 - DNA, 15 bp, Homo sapiens
ggcaaaaaagaacag

SEQ ID NO: 466156 - DNA, 20 bp, Homo sapiens
ggcaacaaaggatggctctg

SEQ ID NO: 466157 - DNA, 20 bp, Homo sapiens
ggcaagagctcaggagaagg

SEQ ID NO: 466158 - DNA, 14 bp, Homo sapiens
ggcacacagcagcc

SEQ ID NO: 466159 - DNA, 16 bp, Homo sapiens
ggcacagggcagtggg

SEQ ID NO: 466160 - DNA, 15 bp, Homo sapiens
ggcacgggagagcgc

SEQ ID NO: 466161 - DNA, 16 bp, Homo sapiens
ggcacgggagagcgcc

SEQ ID NO: 466162 - DNA, 19 bp, Homo sapiens
ggcacgggagagcgccacc

SEQ ID NO: 466163 - DNA, 22 bp, Homo sapiens
ggcacgggagagcgccacccgc

SEQ ID NO: 466164 - DNA, 21 bp, Homo sapiens
ggcagagattgggggggcttg

SEQ ID NO: 466165 - DNA, 13 bp, Homo sapiens
ggcagcaccctcc

SEQ ID NO: 466166 - DNA, 14 bp, Homo sapiens
ggcagcaccctccc

SEQ ID NO: 466167 - DNA, 16 bp, Homo sapiens
ggcagcaccctccccc

SEQ ID NO: 466168 - DNA, 19 bp, Homo sapiens
ggcagcaccctcccccgca

SEQ ID NO: 466169 - DNA, 21 bp, Homo sapiens
ggcagccccatccttcccgca

SEQ ID NO: 466170 - DNA, 22 bp, Homo sapiens
ggcagccccatccttcccgcag

SEQ ID NO: 466171 - DNA, 23 bp, Homo sapiens
ggcagccccatccttcccgcagc

SEQ ID NO: 466172 - DNA, 11 bp, Homo sapiens
ggcagcccctc

SEQ ID NO: 466173 - DNA, 12 bp, Homo sapiens
ggcagcccctcc

SEQ ID NO: 466174 - DNA, 14 bp, Homo sapiens
ggcagcccctgctg

SEQ ID NO: 466175 - DNA, 19 bp, Homo sapiens
ggcagcccctgctggacca

SEQ ID NO: 466176 - DNA, 14 bp, Homo sapiens
ggcaggagctgctg

SEQ ID NO: 466177 - DNA, 20 bp, Homo sapiens
ggcaggcacacagcagcccc

SEQ ID NO: 466178 - DNA, 22 bp, Homo sapiens
ggcaggcacacagcagcccccc

SEQ ID NO: 466179 - DNA, 23 bp, Homo sapiens
ggcagggccctggggtctctgag

SEQ ID NO: 466180 - DNA, 16 bp, Homo sapiens
ggcagggccgcagggc

SEQ ID NO: 466181 - DNA, 17 bp, Homo sapiens
ggcagggccgcagggcg

SEQ ID NO: 466182 - DNA, 15 bp, Homo sapiens
ggcaggtcctgccca

SEQ ID NO: 466183 - DNA, 19 bp, Homo sapiens
ggcaggtcctgcccatgtg

SEQ ID NO: 466184 - DNA, 14 bp, Homo sapiens
ggcagtggagaggg

SEQ ID NO: 466185 - DNA, 18 bp, Homo sapiens
ggcatggccaggtggcca

SEQ ID NO: 466186 - DNA, 19 bp, Homo sapiens
ggccacccttggcctgtcc

SEQ ID NO: 466187 - DNA, 14 bp, Homo sapiens
ggccagacgctgcc

SEQ ID NO: 466188 - DNA, 13 bp, Homo sapiens
ggccagcaccctc

SEQ ID NO: 466189 - DNA, 17 bp, Homo sapiens
ggccagcaccctctcct

SEQ ID NO: 466190 - DNA, 19 bp, Homo sapiens
ggccagcaccctctcctgg

SEQ ID NO: 466191 - DNA, 19 bp, Homo sapiens
ggccaggtggccactccag

SEQ ID NO: 466192 - DNA, 14 bp, Homo sapiens
ggccagtactttgc

SEQ ID NO: 466193 - DNA, 13 bp, Homo sapiens
ggccatccctggg

SEQ ID NO: 466194 - DNA, 14 bp, Homo sapiens
ggcccaaataacag

SEQ ID NO: 466195 - DNA, 21 bp, Homo sapiens
ggcccaaataacagtggcaag

SEQ ID NO: 466196 - DNA, 12 bp, Homo sapiens
ggcccacccctc

SEQ ID NO: 466197 - DNA, 16 bp, Homo sapiens
ggcccacgcagagccc

SEQ ID NO: 466198 - DNA, 20 bp, Homo sapiens
ggcccacgcagagccccgga

SEQ ID NO: 466199 - DNA, 22 bp, Homo sapiens
ggcccacgcagagccccggagc

SEQ ID NO: 466200 - DNA, 19 bp, Homo sapiens
ggcccagccggggtggggt

SEQ ID NO: 466201 - DNA, 13 bp, Homo sapiens
ggcccatggcccc

SEQ ID NO: 466202 - DNA, 15 bp, Homo sapiens
ggcccatggccccag

SEQ ID NO: 466203 - DNA, 18 bp, Homo sapiens
ggcccatggccccagctg

SEQ ID NO: 466204 - DNA, 19 bp, Homo sapiens
ggcccatggccccagctgg

SEQ ID NO: 466205 - DNA, 20 bp, Homo sapiens
ggcccatggccccagctggc

SEQ ID NO: 466206 - DNA, 21 bp, Homo sapiens
ggccccacccaccctctggtc

SEQ ID NO: 466207 - DNA, 17 bp, Homo sapiens
ggccccagcctccaggc

SEQ ID NO: 466208 - DNA, 18 bp, Homo sapiens
ggccccagctggctgggt

SEQ ID NO: 466209 - DNA, 20 bp, Homo sapiens
ggcccccggaggcgcccacc

SEQ ID NO: 466210 - DNA, 18 bp, Homo sapiens
ggccccgcgcgtgccccc

SEQ ID NO: 466211 - DNA, 19 bp, Homo sapiens
ggccccgcgcgtgccccca

SEQ ID NO: 466212 - DNA, 20 bp, Homo sapiens
ggccccgcgcgtgcccccag

SEQ ID NO: 466213 - DNA, 18 bp, Homo sapiens
ggcccctccacgcctcct

SEQ ID NO: 466214 - DNA, 23 bp, Homo sapiens
ggcccctccacgcctcctggcca

SEQ ID NO: 466215 - DNA, 11 bp, Homo sapiens
ggcccctcctt

SEQ ID NO: 466216 - DNA, 15 bp, Homo sapiens
ggcccctccttctcc

SEQ ID NO: 466217 - DNA, 23 bp, Homo sapiens
ggcccctccttctcccctccaga

SEQ ID NO: 466218 - DNA, 14 bp, Homo sapiens
ggcccctgccttgg

SEQ ID NO: 466219 - DNA, 13 bp, Homo sapiens
ggcccctgggatg

SEQ ID NO: 466220 - DNA, 22 bp, Homo sapiens
ggcccctgggatgggaccaggg

SEQ ID NO: 466221 - DNA, 16 bp, Homo sapiens
ggcccgacagcctggc

SEQ ID NO: 466222 - DNA, 17 bp, Homo sapiens
ggcccgacagcctggca

SEQ ID NO: 466223 - DNA, 15 bp, Homo sapiens
ggcccgagcgcgtgc

SEQ ID NO: 466224 - DNA, 20 bp, Homo sapiens
ggcccgctcaacctctcaga

SEQ ID NO: 466225 - DNA, 13 bp, Homo sapiens
ggcccggcccacg

SEQ ID NO: 466226 - DNA, 14 bp, Homo sapiens
ggcccggcccacgc

SEQ ID NO: 466227 - DNA, 15 bp, Homo sapiens
ggcccggcccacgca

SEQ ID NO: 466228 - DNA, 17 bp, Homo sapiens
ggcccggcccacgcaga

SEQ ID NO: 466229 - DNA, 21 bp, Homo sapiens
ggcccggcccacgcagagccc

SEQ ID NO: 466230 - DNA, 20 bp, Homo sapiens
ggcccgtgcgcagccgcgct

SEQ ID NO: 466231 - DNA, 19 bp, Homo sapiens
ggccctccctgactccctg

SEQ ID NO: 466232 - DNA, 21 bp, Homo sapiens
ggccctccctgactccctgtg

SEQ ID NO: 466233 - DNA, 22 bp, Homo sapiens
ggccctccctgactccctgtgg

SEQ ID NO: 466234 - DNA, 15 bp, Homo sapiens
ggccctgccctcccc

SEQ ID NO: 466235 - DNA, 19 bp, Homo sapiens
ggccctgccctcccccacg

SEQ ID NO: 466236 - DNA, 17 bp, Homo sapiens
ggccctggggtctctga

SEQ ID NO: 466237 - DNA, 20 bp, Homo sapiens
ggccctggggtctctgagca

SEQ ID NO: 466238 - DNA, 12 bp, Homo sapiens
ggccctgtggga

SEQ ID NO: 466239 - DNA, 13 bp, Homo sapiens
ggcccttcctctc

SEQ ID NO: 466240 - DNA, 17 bp, Homo sapiens
ggcccttcctctccact

SEQ ID NO: 466241 - DNA, 19 bp, Homo sapiens
ggcccttcctctccactgc

SEQ ID NO: 466242 - DNA, 22 bp, Homo sapiens
ggcccttcctctccactgcctt

SEQ ID NO: 466243 - DNA, 12 bp, Homo sapiens
ggccgcagggcg

SEQ ID NO: 466244 - DNA, 13 bp, Homo sapiens
ggccgcctcctcc

SEQ ID NO: 466245 - DNA, 19 bp, Homo sapiens
gggctgagcccctcctctc

SEQ ID NO: 466246 - DNA, 14 bp, Homo sapiens
gggctgccctggtg

SEQ ID NO: 466247 - DNA, 15 bp, Homo sapiens
gggctgccctggtgc

SEQ ID NO: 466248 - DNA, 14 bp, Homo sapiens
gggctgtctgtcac

SEQ ID NO: 466249 - DNA, 15 bp, Homo sapiens
gggcttagaatgggg

SEQ ID NO: 466250 - DNA, 14 bp, Homo sapiens
gggcttggagcaga

SEQ ID NO: 466251 - DNA, 13 bp, Homo sapiens
gggcttggggtag

SEQ ID NO: 466252 - DNA, 21 bp, Homo sapiens
gggcttggggtagagaggaca

SEQ ID NO: 466253 - DNA, 14 bp, Homo sapiens
ggggagaatggctc

SEQ ID NO: 466254 - DNA, 16 bp, Homo sapiens
ggggagaatggctctg

SEQ ID NO: 466255 - DNA, 13 bp, Homo sapiens
ggggaggagcacc

SEQ ID NO: 466256 - DNA, 22 bp, Homo sapiens
ggggatctaaaaggaggacagg

SEQ ID NO: 466257 - DNA, 14 bp, Homo sapiens
ggggcagagctgag

SEQ ID NO: 466258 - DNA, 17 bp, Homo sapiens
ggggcccatggccccag

SEQ ID NO: 466259 - DNA, 18 bp, Homo sapiens
ggggccctgggcctcagt

SEQ ID NO: 466260 - DNA, 17 bp, Homo sapiens
ggggccgggcaggtcct

SEQ ID NO: 466261 - DNA, 15 bp, Homo sapiens
ggggctaactggccc

SEQ ID NO: 466262 - DNA, 16 bp, Homo sapiens
ggggctaactggcccc

SEQ ID NO: 466263 - DNA, 11 bp, Homo sapiens
ggggctggccc

SEQ ID NO: 466264 - DNA, 15 bp, Homo sapiens
ggggctggccctgcc

SEQ ID NO: 466265 - DNA, 19 bp, Homo sapiens
ggggctggccctgccctcc

SEQ ID NO: 466266 - DNA, 20 bp, Homo sapiens
ggggctggccctgccctccc

SEQ ID NO: 466267 - DNA, 23 bp, Homo sapiens
ggggctggccctgccctccccca

SEQ ID NO: 466268 - DNA, 18 bp, Homo sapiens
ggggcttccatggtggtt

SEQ ID NO: 466269 - DNA, 16 bp, Homo sapiens
ggggcttggagcagag

SEQ ID NO: 466270 - DNA, 24 bp, Homo sapiens
ggggcttggagcagagacggcagc

SEQ ID NO: 466271 - DNA, 15 bp, Homo sapiens
gggggaggagcaccc

SEQ ID NO: 466272 - DNA, 17 bp, Homo sapiens
gggggattcaaatgcat

SEQ ID NO: 466273 - DNA, 18 bp, Homo sapiens
gggggattcaaatgcatg

SEQ ID NO: 466274 - DNA, 21 bp, Homo sapiens
gggggcaagagctcaggagaa

SEQ ID NO: 466275 - DNA, 12 bp, Homo sapiens
gggggccgggca

SEQ ID NO: 466276 - DNA, 12 bp, Homo sapiens
gggggctccaga

SEQ ID NO: 466277 - DNA, 12 bp, Homo sapiens
gggggtggcagg

SEQ ID NO: 466278 - DNA, 15 bp, Homo sapiens
gggggttgggttcca

SEQ ID NO: 466279 - DNA, 21 bp, Homo sapiens
ggggtcgggggaggagcaccc

SEQ ID NO: 466280 - DNA, 15 bp, Homo sapiens
ggggtctctgagcag

SEQ ID NO: 466281 - DNA, 21 bp, Homo sapiens
ggggtgagacagtgggggtgc

SEQ ID NO: 466282 - DNA, 22 bp, Homo sapiens
ggggtgcctggtgcgctgtgct

SEQ ID NO: 466283 - DNA, 15 bp, Homo sapiens
ggggtggggcttgga

SEQ ID NO: 466284 - DNA, 16 bp, Homo sapiens
gggtcgggggaggagc

SEQ ID NO: 466285 - DNA, 22 bp, Homo sapiens
gggtctctgagcagtggggagc

SEQ ID NO: 466286 - DNA, 15 bp, Homo sapiens
gggtgcaggcgcgca

SEQ ID NO: 466287 - DNA, 22 bp, Homo sapiens
gggtgcaggcgcgcaccgccca

SEQ ID NO: 466288 - DNA, 12 bp, Homo sapiens
gggtgcctgagc

SEQ ID NO: 466289 - DNA, 15 bp, Homo sapiens
gggtgcctgagcccg

SEQ ID NO: 466290 - DNA, 13 bp, Homo sapiens
gggtgcctggtgc

SEQ ID NO: 466291 - DNA, 18 bp, Homo sapiens
gggtgcgtgaccggcccg

SEQ ID NO: 466292 - DNA, 20 bp, Homo sapiens
gggtgcgtgaccggcccgcc

SEQ ID NO: 466293 - DNA, 13 bp, Homo sapiens
gggtgtggcctca

SEQ ID NO: 466294 - DNA, 16 bp, Homo sapiens
gggttgggttccagac

SEQ ID NO: 466295 - DNA, 13 bp, Homo sapiens
gggttgttgcaga

SEQ ID NO: 466296 - DNA, 14 bp, Homo sapiens
gggtttgggcagtg

SEQ ID NO: 466297 - DNA, 16 bp, Homo sapiens
ggtacctttccaccca

SEQ ID NO: 466298 - DNA, 12 bp, Homo sapiens
ggtagagaggac

SEQ ID NO: 466299 - DNA, 18 bp, Homo sapiens
ggtagatgagaaaacagg

SEQ ID NO: 466300 - DNA, 21 bp, Homo sapiens
ggtatctgctgcctctgaaaa

SEQ ID NO: 466301 - DNA, 15 bp, Homo sapiens
ggtatgctggccagc

SEQ ID NO: 466302 - DNA, 20 bp, Homo sapiens
ggtatgctggccagcaccct

SEQ ID NO: 466303 - DNA, 15 bp, Homo sapiens
ggtccaccccgtccc

SEQ ID NO: 466304 - DNA, 18 bp, Homo sapiens
ggtccaccccgtcccggc

SEQ ID NO: 466305 - DNA, 20 bp, Homo sapiens
ggtccccggacgctggctcg

SEQ ID NO: 466306 - DNA, 17 bp, Homo sapiens
gctgggcccctgggatg

SEQ ID NO: 466307 - DNA, 12 bp, Homo sapiens
gctggggcctgg

SEQ ID NO: 466308 - DNA, 12 bp, Homo sapiens
gctgggtcgccc

SEQ ID NO: 466309 - DNA, 14 bp, Homo sapiens
gctgggtcgcccct

SEQ ID NO: 466310 - DNA, 21 bp, Homo sapiens
gctgggtttgggcagtggaga

SEQ ID NO: 466311 - DNA, 15 bp, Homo sapiens
gctggtaactgttaa

SEQ ID NO: 466312 - DNA, 14 bp, Homo sapiens
gctgtaatgtaaca

SEQ ID NO: 466313 - DNA, 14 bp, Homo sapiens
gctgtacagatatc

SEQ ID NO: 466314 - DNA, 16 bp, Homo sapiens
gctgtcctccagggcg

SEQ ID NO: 466315 - DNA, 19 bp, Homo sapiens
gctgtcctctcgagcccag

SEQ ID NO: 466316 - DNA, 14 bp, Homo sapiens
gctgtcgccccagg

SEQ ID NO: 466317 - DNA, 18 bp, Homo sapiens
gctgtcgccccaggccct

SEQ ID NO: 466318 - DNA, 14 bp, Homo sapiens
gctgtgaatttttt

SEQ ID NO: 466319 - DNA, 14 bp, Homo sapiens
gctgtggcccctcc

SEQ ID NO: 466320 - DNA, 18 bp, Homo sapiens
gctgtggcccctccttct

SEQ ID NO: 466321 - DNA, 22 bp, Homo sapiens
gcttaacataaacttgtactta

SEQ ID NO: 466322 - DNA, 14 bp, Homo sapiens
gcttaagcctgtgt

SEQ ID NO: 466323 - DNA, 15 bp, Homo sapiens
gcttagaggagctct

SEQ ID NO: 466324 - DNA, 10 bp, Homo sapiens
gcttccagat

SEQ ID NO: 466325 - DNA, 21 bp, Homo sapiens
gcttccatggtggtttcagaa

SEQ ID NO: 466326 - DNA, 17 bp, Homo sapiens
gcttcccgctcagccct

SEQ ID NO: 466327 - DNA, 17 bp, Homo sapiens
gcttccgtgagacacaa

SEQ ID NO: 466328 - DNA, 22 bp, Homo sapiens
gcttgaatgtccccattctata

SEQ ID NO: 466329 - DNA, 21 bp, Homo sapiens
gcttggagcagagacggcagc

SEQ ID NO: 466330 - DNA, 20 bp, Homo sapiens
gcttgtttaaggttcttgct

SEQ ID NO: 466331 - DNA, 21 bp, Homo sapiens
gctttctattggcatggattt

SEQ ID NO: 466332 - DNA, 13 bp, Homo sapiens
gctttctcatgca

SEQ ID NO: 466333 - DNA, 15 bp, Homo sapiens
gctttgggctgccct

SEQ ID NO: 466334 - DNA, 15 bp, Homo sapiens
gctttgtgtgattga

SEQ ID NO: 466335 - DNA, 21 bp, Homo sapiens
gctttgtttaacccaaaagat

SEQ ID NO: 466336 - DNA, 12 bp, Homo sapiens
gcttttcactgc

SEQ ID NO: 466337 - DNA, 18 bp, Homo sapiens
gcttttttctcaataaaa

SEQ ID NO: 466338 - DNA, 16 bp, Homo sapiens
ggaaaaaaatgcgtat

SEQ ID NO: 466339 - DNA, 22 bp, Homo sapiens
ggaaaaccaagccgtggcttcc

SEQ ID NO: 466340 - DNA, 19 bp, Homo sapiens
ggaaaataacagagctgga

SEQ ID NO: 466341 - DNA, 16 bp, Homo sapiens
ggaaagccctccccct

SEQ ID NO: 466342 - DNA, 13 bp, Homo sapiens
ggaaatcaattta

SEQ ID NO: 466343 - DNA, 22 bp, Homo sapiens
ggaaatcaatttaaaggaaagt

SEQ ID NO: 466344 - DNA, 21 bp, Homo sapiens
ggaaattcttgcactgtatcc

SEQ ID NO: 466345 - DNA, 19 bp, Homo sapiens
ggaacagccaaagaaactc

SEQ ID NO: 466346 - DNA, 12 bp, Homo sapiens
ggaaccttccct

SEQ ID NO: 466347 - DNA, 23 bp, Homo sapiens
ggaagaacaaatatgattctcct

SEQ ID NO: 466348 - DNA, 15 bp, Homo sapiens
ggaagagatgctcta

SEQ ID NO: 466349 - DNA, 12 bp, Homo sapiens
ggaagcccaccc

SEQ ID NO: 466350 - DNA, 22 bp, Homo sapiens
ggaagcccacccgccccagaga

SEQ ID NO: 466351 - DNA, 19 bp, Homo sapiens
ggaaggcctgagggaagcc

SEQ ID NO: 466352 - DNA, 22 bp, Homo sapiens
ggaaggcctgagggaagcccac

SEQ ID NO: 466353 - DNA, 13 bp, Homo sapiens
ggaaggctttatt

SEQ ID NO: 466354 - DNA, 16 bp, Homo sapiens
ggaagtacataaagta

SEQ ID NO: 466355 - DNA, 17 bp, Homo sapiens
ggaagtggcctgagaag

SEQ ID NO: 466356 - DNA, 22 bp, Homo sapiens
ggacactgatgggtcctgctgc

SEQ ID NO: 466357 - DNA, 23 bp, Homo sapiens
ggacactgatgggtcctgctgct

SEQ ID NO: 466358 - DNA, 24 bp, Homo sapiens
ggacactgatgggtcctgctgctc

SEQ ID NO: 466359 - DNA, 20 bp, Homo sapiens
ggacagaaccaacgggtctg

SEQ ID NO: 466360 - DNA, 20 bp, Homo sapiens
ggacagaggagcaaggttta

SEQ ID NO: 466361 - DNA, 15 bp, Homo sapiens
ggacagcggcccggc

SEQ ID NO: 466362 - DNA, 18 bp, Homo sapiens
ggacagcggcccggccca

SEQ ID NO: 466363 - DNA, 21 bp, Homo sapiens
ggacagggagggaacagacct

SEQ ID NO: 466364 - DNA, 15 bp, Homo sapiens
ggacagggcatggcc

SEQ ID NO: 466365 - DNA, 22 bp, Homo sapiens
ggacagggcatggccaggtggc

SEQ ID NO: 466366 - DNA, 21 bp, Homo sapiens
ggacccccggcctccaggctg

SEQ ID NO: 466367 - DNA, 14 bp, Homo sapiens
ggaccggagcggct

SEQ ID NO: 466368 - DNA, 23 bp, Homo sapiens
ggacgatagcttggagggatgga

SEQ ID NO: 466369 - DNA, 15 bp, Homo sapiens
ggactgcatgcaagc

SEQ ID NO: 466370 - DNA, 20 bp, Homo sapiens
ggactgtcttcaaccctgcc

SEQ ID NO: 466371 - DNA, 16 bp, Homo sapiens
ggactttatttaattt

SEQ ID NO: 466372 - DNA, 20 bp, Homo sapiens
ggactttatttaatttcata

SEQ ID NO: 466373 - DNA, 21 bp, Homo sapiens
ggactttatttaatttcataa

SEQ ID NO: 466374 - DNA, 18 bp, Homo sapiens
ggacttttgttcatggga

SEQ ID NO: 466375 - DNA, 17 bp, Homo sapiens
ggagagcgccacccgcc

SEQ ID NO: 466376 - DNA, 22 bp, Homo sapiens
ggagagctcagtacagggcagg

SEQ ID NO: 466377 - DNA, 17 bp, Homo sapiens
ggagaggcggcctcgtg

SEQ ID NO: 466378 - DNA, 21 bp, Homo sapiens
ggagaggcggcctcgtgccat

SEQ ID NO: 466379 - DNA, 16 bp, Homo sapiens
ggagcacccccagcct

SEQ ID NO: 466380 - DNA, 18 bp, Homo sapiens
ggagcacccccagcctcc

SEQ ID NO: 466381 - DNA, 20 bp, Homo sapiens
ggagcacccccagcctcccc

SEQ ID NO: 466382 - DNA, 18 bp, Homo sapiens
ggagcactagaatgagaa

SEQ ID NO: 466383 - DNA, 20 bp, Homo sapiens
ggagcactagaatgagaaat

SEQ ID NO: 466384 - DNA, 16 bp, Homo sapiens
ggagccaatggagact

SEQ ID NO: 466385 - DNA, 14 bp, Homo sapiens
ggagccatgctctt

SEQ ID NO: 466386 - DNA, 16 bp, Homo sapiens
ggagcctccccctcag

SEQ ID NO: 466387 - DNA, 20 bp, Homo sapiens
ggagcgggggctaactggcc

SEQ ID NO: 466388 - DNA, 14 bp, Homo sapiens
ggagcttccagatg

SEQ ID NO: 466389 - DNA, 13 bp, Homo sapiens
ggaggacagggag

SEQ ID NO: 466390 - DNA, 15 bp, Homo sapiens
ggaggcctggtctgg

SEQ ID NO: 466391 - DNA, 12 bp, Homo sapiens
ggaggcgcccac

SEQ ID NO: 466392 - DNA, 13 bp, Homo sapiens
ggaggcgcccacc

SEQ ID NO: 466393 - DNA, 21 bp, Homo sapiens
ggaggggcctggcagccgtgc

SEQ ID NO: 466394 - DNA, 17 bp, Homo sapiens
ggaggtgtggagtggag

SEQ ID NO: 466395 - DNA, 22 bp, Homo sapiens
ggagtccactttcctctctctc

SEQ ID NO: 466396 - DNA, 17 bp, Homo sapiens
ggagtctgaaggagagg

SEQ ID NO: 466397 - DNA, 21 bp, Homo sapiens
ggagtggaggggtcagcaggg

SEQ ID NO: 466398 - DNA, 13 bp, Homo sapiens
ggatccagagaga

SEQ ID NO: 466399 - DNA, 15 bp, Homo sapiens
ggatgattcttttcc

SEQ ID NO: 466400 - DNA, 21 bp, Homo sapiens
ggatgctgagagacctcaggg

SEQ ID NO: 466401 - DNA, 18 bp, Homo sapiens
ggatggagaggcggcctc

SEQ ID NO: 466402 - DNA, 15 bp, Homo sapiens
ggatggcccagctga

SEQ ID NO: 466403 - DNA, 17 bp, Homo sapiens
ctgtaaatttaactgca

SEQ ID NO: 466404 - DNA, 17 bp, Homo sapiens
ctgtaaggtttcaatgc

SEQ ID NO: 466405 - DNA, 15 bp, Homo sapiens
ctgtactcctcccag

SEQ ID NO: 466406 - DNA, 19 bp, Homo sapiens
ctgtactcctcccaggcgc

SEQ ID NO: 466407 - DNA, 19 bp, Homo sapiens
ctgtagccaacttaaacct

SEQ ID NO: 466408 - DNA, 17 bp, Homo sapiens
ctgtagtgagaaactga

SEQ ID NO: 466409 - DNA, 18 bp, Homo sapiens
ctgtagtgagaaactgat

SEQ ID NO: 466410 - DNA, 18 bp, Homo sapiens
ctgtatctaaaaaataac

SEQ ID NO: 466411 - DNA, 23 bp, Homo sapiens
ctgtatggcacttattatgaggc

SEQ ID NO: 466412 - DNA, 20 bp, Homo sapiens
ctgtatttaatggtttttat

SEQ ID NO: 466413 - DNA, 20 bp, Homo sapiens
ctgtattttcttttatatct

SEQ ID NO: 466414 - DNA, 18 bp, Homo sapiens
ctgtcactcacaaaaggc

SEQ ID NO: 466415 - DNA, 19 bp, Homo sapiens
ctgtcactcacaaaaggct

SEQ ID NO: 466416 - DNA, 18 bp, Homo sapiens
ctgtcagagaatatgacc

SEQ ID NO: 466417 - DNA, 22 bp, Homo sapiens
ctgtcagccagccgccctgggc

SEQ ID NO: 466418 - DNA, 13 bp, Homo sapiens
ctgtcatctctct

SEQ ID NO: 466419 - DNA, 14 bp, Homo sapiens
ctgtcatctctctg

SEQ ID NO: 466420 - DNA, 17 bp, Homo sapiens
ctgtcatctctctgggg

SEQ ID NO: 466421 - DNA, 15 bp, Homo sapiens
ctgtcccaccgggag

SEQ ID NO: 466422 - DNA, 18 bp, Homo sapiens
ctgtcctctcgagcccag

SEQ ID NO: 466423 - DNA, 13 bp, Homo sapiens
ctgtcctgctcac

SEQ ID NO: 466424 - DNA, 13 bp, Homo sapiens
ctgtcctttccca

SEQ ID NO: 466425 - DNA, 13 bp, Homo sapiens
ctgtcgccccagg

SEQ ID NO: 466426 - DNA, 18 bp, Homo sapiens
ctgtcgccccaggccctc

SEQ ID NO: 466427 - DNA, 20 bp, Homo sapiens
ctgtcgccccaggccctccc

SEQ ID NO: 466428 - DNA, 22 bp, Homo sapiens
ctgtcgccccaggccctccctg

SEQ ID NO: 466429 - DNA, 20 bp, Homo sapiens
ctgtctcaagagggcactgg

SEQ ID NO: 466430 - DNA, 18 bp, Homo sapiens
ctgtctgagccctgccct

SEQ ID NO: 466431 - DNA, 19 bp, Homo sapiens
ctgtctgagccctgccctc

SEQ ID NO: 466432 - DNA, 21 bp, Homo sapiens
ctgtctgagccctgccctcac

SEQ ID NO: 466433 - DNA, 24 bp, Homo sapiens
ctgtctgagccctgccctcactcc

SEQ ID NO: 466434 - DNA, 15 bp, Homo sapiens
ctgtctgattctatg

SEQ ID NO: 466435 - DNA, 16 bp, Homo sapiens
ctgtctgtcaccagct

SEQ ID NO: 466436 - DNA, 19 bp, Homo sapiens
ctgtctgtcaccagctatc

SEQ ID NO: 466437 - DNA, 22 bp, Homo sapiens
ctgtctgtcaccagctatctgt

SEQ ID NO: 466438 - DNA, 15 bp, Homo sapiens
ctgtcttcaaccctg

SEQ ID NO: 466439 - DNA, 16 bp, Homo sapiens
ctgtcttcaaccctgc

SEQ ID NO: 466440 - DNA, 16 bp, Homo sapiens
ctgtctttgctgttta

SEQ ID NO: 466441 - DNA, 15 bp, Homo sapiens
ctgtgagtctgtcct

SEQ ID NO: 466442 - DNA, 18 bp, Homo sapiens
ctgtgagtctgtcctttc

SEQ ID NO: 466443 - DNA, 19 bp, Homo sapiens
ctgtgatcgtgtgttgcca

SEQ ID NO: 466444 - DNA, 23 bp, Homo sapiens
ctgtgctccagcagtgctgggcc

SEQ ID NO: 466445 - DNA, 12 bp, Homo sapiens
ctgtggattcta

SEQ ID NO: 466446 - DNA, 15 bp, Homo sapiens
ctgtggattctatat

SEQ ID NO: 466447 - DNA, 16 bp, Homo sapiens
ctgtggattctatatt

SEQ ID NO: 466448 - DNA, 18 bp, Homo sapiens
ctgtggcccctccttctc

SEQ ID NO: 466449 - DNA, 23 bp, Homo sapiens
ctgtgggactggcccacccctct

SEQ ID NO: 466450 - DNA, 14 bp, Homo sapiens
ctgtgggagtccac

SEQ ID NO: 466451 - DNA, 13 bp, Homo sapiens
ctgtgggcagcac

SEQ ID NO: 466452 - DNA, 15 bp, Homo sapiens
ctgtgggcagcaccc

SEQ ID NO: 466453 - DNA, 17 bp, Homo sapiens
ctgtgtaatctctgatt

SEQ ID NO: 466454 - DNA, 16 bp, Homo sapiens
ctgtgtataaaaaaga

SEQ ID NO: 466455 - DNA, 21 bp, Homo sapiens
ctgtgtggcaaacatttaaaa

SEQ ID NO: 466456 - DNA, 16 bp, Homo sapiens
ctgtgtggggagggtg

SEQ ID NO: 466457 - DNA, 15 bp, Homo sapiens
ctgttcactctactt

SEQ ID NO: 466458 - DNA, 13 bp, Homo sapiens
ctgttcatttcca

SEQ ID NO: 466459 - DNA, 19 bp, Homo sapiens
ctgttccaagtgtgtgtgc

SEQ ID NO: 466460 - DNA, 14 bp, Homo sapiens
ctgtttaccctccc

SEQ ID NO: 466461 - DNA, 16 bp, Homo sapiens
ctgtttaccctccctg

SEQ ID NO: 466462 - DNA, 20 bp, Homo sapiens
ctgtttcgcatccaccgcca

SEQ ID NO: 466463 - DNA, 23 bp, Homo sapiens
ctgtttcgcatccaccgccaccc

SEQ ID NO: 466464 - DNA, 14 bp, Homo sapiens
ctgttttccaaagg

SEQ ID NO: 466465 - DNA, 13 bp, Homo sapiens
cttaaaagaacat

SEQ ID NO: 466466 - DNA, 12 bp, Homo sapiens
cttaaacatttt

SEQ ID NO: 466467 - DNA, 15 bp, Homo sapiens
cttaaacctgtgctt

SEQ ID NO: 466468 - DNA, 19 bp, Homo sapiens
cttaaacctgtgctttcat

SEQ ID NO: 466469 - DNA, 20 bp, Homo sapiens
cttaacataaacttgtactt

SEQ ID NO: 466470 - DNA, 22 bp, Homo sapiens
cttaacataaacttgtacttac

SEQ ID NO: 466471 - DNA, 18 bp, Homo sapiens
cttaacttaaaagaacat

SEQ ID NO: 466472 - DNA, 18 bp, Homo sapiens
cttaagattccattttgg

SEQ ID NO: 466473 - DNA, 21 bp, Homo sapiens
cttaagattccattttggaaa

SEQ ID NO: 466474 - DNA, 16 bp, Homo sapiens
cttaagcctgtgtata

SEQ ID NO: 466475 - DNA, 20 bp, Homo sapiens
cttaagcctgtgtataaaaa

SEQ ID NO: 466476 - DNA, 20 bp, Homo sapiens
cttacattagcagtttgctt

SEQ ID NO: 466477 - DNA, 21 bp, Homo sapiens
cttacattagcagtttgcttt

SEQ ID NO: 466478 - DNA, 21 bp, Homo sapiens
cttactaaacattttgttatt

SEQ ID NO: 466479 - DNA, 17 bp, Homo sapiens
cttagaaattgcatttc

SEQ ID NO: 466480 - DNA, 17 bp, Homo sapiens
cttagaatactgtattg

SEQ ID NO: 466481 - DNA, 12 bp, Homo sapiens
cttagaatgggg

SEQ ID NO: 466482 - DNA, 15 bp, Homo sapiens
cttagcgttctgttt

SEQ ID NO: 466483 - DNA, 17 bp, Homo sapiens
cttagtgtcccttacct

SEQ ID NO: 466484 - DNA, 22 bp, Homo sapiens
cttatctagcaagaagattcta

SEQ ID NO: 466485 - DNA, 15 bp, Homo sapiens
cttatgctgctgtga

SEQ ID NO: 466486 - DNA, 11 bp, Homo sapiens
cttattttctg

SEQ ID NO: 466487 - DNA, 13 bp, Homo sapiens
cttattttctgaa

SEQ ID NO: 466488 - DNA, 19 bp, Homo sapiens
cttattttctgaattcata

SEQ ID NO: 466489 - DNA, 22 bp, Homo sapiens
cttattttctgaattcataaaa

SEQ ID NO: 466490 - DNA, 15 bp, Homo sapiens
cttcaaaacagaacg

SEQ ID NO: 466491 - DNA, 15 bp, Homo sapiens
cttcaaccctgccct

SEQ ID NO: 466492 - DNA, 17 bp, Homo sapiens
cttcaaccctgccctgc

SEQ ID NO: 466493 - DNA, 19 bp, Homo sapiens
gccccagagactgcccacc

SEQ ID NO: 466494 - DNA, 15 bp, Homo sapiens
gccccagctggctgg

SEQ ID NO: 466495 - DNA, 16 bp, Homo sapiens
gccccaggccctccct

SEQ ID NO: 466496 - DNA, 15 bp, Homo sapiens
gccccatccttcccg

SEQ ID NO: 466497 - DNA, 24 bp, Homo sapiens
gccccatccttcccgcagcaccag

SEQ ID NO: 466498 - DNA, 13 bp, Homo sapiens
gccccccactcag

SEQ ID NO: 466499 - DNA, 13 bp, Homo sapiens
gcccccctctgcc

SEQ ID NO: 466500 - DNA, 16 bp, Homo sapiens
gcccccctctgccttt

SEQ ID NO: 466501 - DNA, 20 bp, Homo sapiens
gcccccctctgcctttgagc

SEQ ID NO: 466502 - DNA, 13 bp, Homo sapiens
gccccccttccca

SEQ ID NO: 466503 - DNA, 18 bp, Homo sapiens
gccccccttcccacccct

SEQ ID NO: 466504 - DNA, 16 bp, Homo sapiens
gcccccgccctcgctc

SEQ ID NO: 466505 - DNA, 18 bp, Homo sapiens
gcccccgccctcgctccg

SEQ ID NO: 466506 - DNA, 19 bp, Homo sapiens
gcccccgccctcgctccgg

SEQ ID NO: 466507 - DNA, 20 bp, Homo sapiens
gcccccgccctcgctccggg

SEQ ID NO: 466508 - DNA, 22 bp, Homo sapiens
gcccccggaggcgcccacctgc

SEQ ID NO: 466509 - DNA, 23 bp, Homo sapiens
gcccccggaggcgcccacctgcc

SEQ ID NO: 466510 - DNA, 17 bp, Homo sapiens
gccccctcccccgcaga

SEQ ID NO: 466511 - DNA, 20 bp, Homo sapiens
gccccctcccccgcagacag

SEQ ID NO: 466512 - DNA, 14 bp, Homo sapiens
gccccgcgcgtgcc

SEQ ID NO: 466513 - DNA, 15 bp, Homo sapiens
gccccgcgtcttcag

SEQ ID NO: 466514 - DNA, 16 bp, Homo sapiens
gcccctatcctgcacc

SEQ ID NO: 466515 - DNA, 17 bp, Homo sapiens
gcccctatcctgcaccc

SEQ ID NO: 466516 - DNA, 17 bp, Homo sapiens
gcccctccacgcctcct

SEQ ID NO: 466517 - DNA, 13 bp, Homo sapiens
gcccctccccatg

SEQ ID NO: 466518 - DNA, 17 bp, Homo sapiens
gcccctccccatggtgc

SEQ ID NO: 466519 - DNA, 14 bp, Homo sapiens
gcccctcccttcaa

SEQ ID NO: 466520 - DNA, 15 bp, Homo sapiens
gcccctcccttcaac

SEQ ID NO: 466521 - DNA, 13 bp, Homo sapiens
gcccctccgtccc

SEQ ID NO: 466522 - DNA, 19 bp, Homo sapiens
gcccctccgtccccagggt

SEQ ID NO: 466523 - DNA, 14 bp, Homo sapiens
gcccctccttctcc

SEQ ID NO: 466524 - DNA, 16 bp, Homo sapiens
gcccctccttctcccc

SEQ ID NO: 466525 - DNA, 21 bp, Homo sapiens
gcccctccttctcccctccag

SEQ ID NO: 466526 - DNA, 22 bp, Homo sapiens
gcccctgggatgggaccaggga

SEQ ID NO: 466527 - DNA, 22 bp, Homo sapiens
gcccctgtaaggtttcaatgca

SEQ ID NO: 466528 - DNA, 18 bp, Homo sapiens
gcccgaatttctcactcc

SEQ ID NO: 466529 - DNA, 15 bp, Homo sapiens
gcccgacagcctggc

SEQ ID NO: 466530 - DNA, 17 bp, Homo sapiens
gcccgacagcctggcac

SEQ ID NO: 466531 - DNA, 15 bp, Homo sapiens
gcccgagcgcgtgcc

SEQ ID NO: 466532 - DNA, 21 bp, Homo sapiens
gcccgagcgcgtgccttcccc

SEQ ID NO: 466533 - DNA, 23 bp, Homo sapiens
gcccgccaccttgtacagaacca

SEQ ID NO: 466534 - DNA, 19 bp, Homo sapiens
gcccgcccaccccgctgcc

SEQ ID NO: 466535 - DNA, 21 bp, Homo sapiens
gcccgcccaccccgctgcctg

SEQ ID NO: 466536 - DNA, 16 bp, Homo sapiens
gcccgcccccgccctc

SEQ ID NO: 466537 - DNA, 17 bp, Homo sapiens
gcccgcccccgccctcg

SEQ ID NO: 466538 - DNA, 18 bp, Homo sapiens
gcccgccctcctctgccc

SEQ ID NO: 466539 - DNA, 19 bp, Homo sapiens
gcccgccctcctctgcccc

SEQ ID NO: 466540 - DNA, 22 bp, Homo sapiens
gcccgccctcctctgccccctc

SEQ ID NO: 466541 - DNA, 18 bp, Homo sapiens
gcccgccggttggccggc

SEQ ID NO: 466542 - DNA, 16 bp, Homo sapiens
gcccggcccacgcaga

SEQ ID NO: 466543 - DNA, 18 bp, Homo sapiens
gcccggcccacgcagagc

SEQ ID NO: 466544 - DNA, 14 bp, Homo sapiens
gcccgtgcgcagcc

SEQ ID NO: 466545 - DNA, 15 bp, Homo sapiens
gcccgtgcgcagccg

SEQ ID NO: 466546 - DNA, 18 bp, Homo sapiens
gccctcactccactcccc

SEQ ID NO: 466547 - DNA, 11 bp, Homo sapiens
gccctccctcc

SEQ ID NO: 466548 - DNA, 17 bp, Homo sapiens
gccctccctccctccac

SEQ ID NO: 466549 - DNA, 23 bp, Homo sapiens
gccctccctgactccctgtgggg

SEQ ID NO: 466550 - DNA, 15 bp, Homo sapiens
gccctcctctgcccc

SEQ ID NO: 466551 - DNA, 20 bp, Homo sapiens
gccctcctctgccccctccc

SEQ ID NO: 466552 - DNA, 20 bp, Homo sapiens
gctgcaatacattaaaataa

SEQ ID NO: 466553 - DNA, 15 bp, Homo sapiens
gctgccacacttcag

SEQ ID NO: 466554 - DNA, 18 bp, Homo sapiens
gctgccacacttcaggct

SEQ ID NO: 466555 - DNA, 12 bp, Homo sapiens
gctgccctggtg

SEQ ID NO: 466556 - DNA, 19 bp, Homo sapiens
gctgccctggtgctgccac

SEQ ID NO: 466557 - DNA, 22 bp, Homo sapiens
gctgccctggtgctgccacact

SEQ ID NO: 466558 - DNA, 16 bp, Homo sapiens
gctgccgctgcaccac

SEQ ID NO: 466559 - DNA, 18 bp, Homo sapiens
gctgcctctgaaaatatt

SEQ ID NO: 466560 - DNA, 12 bp, Homo sapiens
gctgcctggagg

SEQ ID NO: 466561 - DNA, 13 bp, Homo sapiens
gctgcctggaggg

SEQ ID NO: 466562 - DNA, 12 bp, Homo sapiens
gctgcctggcgg

SEQ ID NO: 466563 - DNA, 20 bp, Homo sapiens
gctgcctggcgggcagcccc

SEQ ID NO: 466564 - DNA, 22 bp, Homo sapiens
gctgcctggcgggcagcccctg

SEQ ID NO: 466565 - DNA, 15 bp, Homo sapiens
gctgccttagaacct

SEQ ID NO: 466566 - DNA, 12 bp, Homo sapiens
gctgcgcctgcc

SEQ ID NO: 466567 - DNA, 22 bp, Homo sapiens
gctgcgcctgcccgcccgccgg

SEQ ID NO: 466568 - DNA, 16 bp, Homo sapiens
gctgctcgggaaggcc

SEQ ID NO: 466569 - DNA, 18 bp, Homo sapiens
gctgctcgggaaggcctg

SEQ ID NO: 466570 - DNA, 19 bp, Homo sapiens
gctgctcgggaaggcctga

SEQ ID NO: 466571 - DNA, 20 bp, Homo sapiens
gctgctcgggaaggcctgag

SEQ ID NO: 466572 - DNA, 15 bp, Homo sapiens
gctgctgcaccaacc

SEQ ID NO: 466573 - DNA, 13 bp, Homo sapiens
gctgctgtgaatt

SEQ ID NO: 466574 - DNA, 15 bp, Homo sapiens
gctggaccaaggtgc

SEQ ID NO: 466575 - DNA, 20 bp, Homo sapiens
gctggatgctgagagacctc

SEQ ID NO: 466576 - DNA, 15 bp, Homo sapiens
gctggatgtgctttc

SEQ ID NO: 466577 - DNA, 16 bp, Homo sapiens
gctggatgtgctttca

SEQ ID NO: 466578 - DNA, 14 bp, Homo sapiens
gctggcagcgcctc

SEQ ID NO: 466579 - DNA, 16 bp, Homo sapiens
gctggcagcgcctccc

SEQ ID NO: 466580 - DNA, 18 bp, Homo sapiens
gctggcagcgcctcccgc

SEQ ID NO: 466581 - DNA, 14 bp, Homo sapiens
gctggccagcaccc

SEQ ID NO: 466582 - DNA, 16 bp, Homo sapiens
gctggccagcaccctc

SEQ ID NO: 466583 - DNA, 17 bp, Homo sapiens
gctggccagcaccctct

SEQ ID NO: 466584 - DNA, 19 bp, Homo sapiens
gctggccagcaccctctcc

SEQ ID NO: 466585 - DNA, 23 bp, Homo sapiens
gctggccagcaccctctcctggg

SEQ ID NO: 466586 - DNA, 17 bp, Homo sapiens
gctggccctgccctccc

SEQ ID NO: 466587 - DNA, 19 bp, Homo sapiens
gctggccctgccctccccc

SEQ ID NO: 466588 - DNA, 18 bp, Homo sapiens
gctggccggtccaccccg

SEQ ID NO: 466589 - DNA, 20 bp, Homo sapiens
gctggccggtccaccccgtc

SEQ ID NO: 466590 - DNA, 22 bp, Homo sapiens
gctggccggtccaccccgtccc

SEQ ID NO: 466591 - DNA, 13 bp, Homo sapiens
gctgggcagggcc

SEQ ID NO: 466592 - DNA, 16 bp, Homo sapiens
gctgggcccagccggg

SEQ ID NO: 466593 - DNA, 14 bp, Homo sapiens
gctgggcccctggg

SEQ ID NO: 466594 - DNA, 17 bp, Homo sapiens
gaataatggaattatgt

SEQ ID NO: 466595 - DNA, 13 bp, Homo sapiens
gaatactgtattg

SEQ ID NO: 466596 - DNA, 14 bp, Homo sapiens
gaatatacatagtc

SEQ ID NO: 466597 - DNA, 16 bp, Homo sapiens
gaatatacttagaaaa

SEQ ID NO: 466598 - DNA, 20 bp, Homo sapiens
gaatcaatctggcttctgca

SEQ ID NO: 466599 - DNA, 23 bp, Homo sapiens
gaatcaatctggcttctgcatta

SEQ ID NO: 466600 - DNA, 13 bp, Homo sapiens
gaatccacctgca

SEQ ID NO: 466601 - DNA, 16 bp, Homo sapiens
gaatccacctgcagtt

SEQ ID NO: 466602 - DNA, 11 bp, Homo sapiens
gaatcttgatt

SEQ ID NO: 466603 - DNA, 12 bp, Homo sapiens
gaatgagaaatc

SEQ ID NO: 466604 - DNA, 16 bp, Homo sapiens
gaatgagaaatcatgt

SEQ ID NO: 466605 - DNA, 19 bp, Homo sapiens
gaatgagcagttagaaata

SEQ ID NO: 466606 - DNA, 18 bp, Homo sapiens
gaatgagtaaataaactc

SEQ ID NO: 466607 - DNA, 18 bp, Homo sapiens
gaatgcatccaaatagga

SEQ ID NO: 466608 - DNA, 19 bp, Homo sapiens
gaatgggccaagccagggt

SEQ ID NO: 466609 - DNA, 20 bp, Homo sapiens
gaatgggccaagccagggtt

SEQ ID NO: 466610 - DNA, 23 bp, Homo sapiens
gaatgggccaagccagggttcca

SEQ ID NO: 466611 - DNA, 17 bp, Homo sapiens
gaatggtgggctccaga

SEQ ID NO: 466612 - DNA, 19 bp, Homo sapiens
gaatggtgggctccagagt

SEQ ID NO: 466613 - DNA, 17 bp, Homo sapiens
gaatgtccccattctat

SEQ ID NO: 466614 - DNA, 19 bp, Homo sapiens
gaatgtccccattctataa

SEQ ID NO: 466615 - DNA, 21 bp, Homo sapiens
gaatgtccccattctataaat

SEQ ID NO: 466616 - DNA, 17 bp, Homo sapiens
gaatgtgcttttccatc

SEQ ID NO: 466617 - DNA, 16 bp, Homo sapiens
gaattatgtataacaa

SEQ ID NO: 466618 - DNA, 15 bp, Homo sapiens
gaattcataaaaata

SEQ ID NO: 466619 - DNA, 14 bp, Homo sapiens
gacaaaggccttaa

SEQ ID NO: 466620 - DNA, 17 bp, Homo sapiens
gacaatttcaaaatgca

SEQ ID NO: 466621 - DNA, 16 bp, Homo sapiens
gacaccatcccctcct

SEQ ID NO: 466622 - DNA, 15 bp, Homo sapiens
gacaccctccactct

SEQ ID NO: 466623 - DNA, 17 bp, Homo sapiens
gacacctactgagtggc

SEQ ID NO: 466624 - DNA, 18 bp, Homo sapiens
gacactgatgggtcctgc

SEQ ID NO: 466625 - DNA, 21 bp, Homo sapiens
gacactgatgggtcctgctgc

SEQ ID NO: 466626 - DNA, 22 bp, Homo sapiens
gacactgatgggtcctgctgct

SEQ ID NO: 466627 - DNA, 23 bp, Homo sapiens
gacactgatgggtcctgctgctc

SEQ ID NO: 466628 - DNA, 12 bp, Homo sapiens
gacagacagacg

SEQ ID NO: 466629 - DNA, 19 bp, Homo sapiens
gacagacggacgggacagc

SEQ ID NO: 466630 - DNA, 17 bp, Homo sapiens
gacagagaaggcagcag

SEQ ID NO: 466631 - DNA, 18 bp, Homo sapiens
gacagagtggatctggag

SEQ ID NO: 466632 - DNA, 22 bp, Homo sapiens
gacagcggcccggcccacgcag

SEQ ID NO: 466633 - DNA, 17 bp, Homo sapiens
gacaggaaagccctccc

SEQ ID NO: 466634 - DNA, 19 bp, Homo sapiens
gacaggaaagccctccccc

SEQ ID NO: 466635 - DNA, 14 bp, Homo sapiens
gacagggcatggcc

SEQ ID NO: 466636 - DNA, 22 bp, Homo sapiens
gacagggcatggccaggtggcc

SEQ ID NO: 466637 - DNA, 20 bp, Homo sapiens
gaccatttagtcctcacctt

SEQ ID NO: 466638 - DNA, 19 bp, Homo sapiens
gaccccacacgccggggct

SEQ ID NO: 466639 - DNA, 18 bp, Homo sapiens
gaccccacttatgctgct

SEQ ID NO: 466640 - DNA, 20 bp, Homo sapiens
gaccccacttatgctgctgt

SEQ ID NO: 466641 - DNA, 22 bp, Homo sapiens
gacccccgaggcccccctctgc

SEQ ID NO: 466642 - DNA, 20 bp, Homo sapiens
gacccccggcctccaggctg

SEQ ID NO: 466643 - DNA, 21 bp, Homo sapiens
gacccccggcctccaggctgg

SEQ ID NO: 466644 - DNA, 13 bp, Homo sapiens
gacccctggcttt

SEQ ID NO: 466645 - DNA, 21 bp, Homo sapiens
gacccctggcttttcactgct

SEQ ID NO: 466646 - DNA, 17 bp, Homo sapiens
gacccggaggggcctgg

SEQ ID NO: 466647 - DNA, 19 bp, Homo sapiens
gacccggaggggcctggca

SEQ ID NO: 466648 - DNA, 20 bp, Homo sapiens
gacccggaggggcctggcag

SEQ ID NO: 466649 - DNA, 15 bp, Homo sapiens
gaccctccttcccca

SEQ ID NO: 466650 - DNA, 19 bp, Homo sapiens
gaccctccttccccacccc

SEQ ID NO: 466651 - DNA, 20 bp, Homo sapiens
gaccctccttccccacccca

SEQ ID NO: 466652 - DNA, 11 bp, Homo sapiens
gaccggcccgc

SEQ ID NO: 466653 - DNA, 15 bp, Homo sapiens
gaccggcccgccacc

SEQ ID NO: 466654 - DNA, 16 bp, Homo sapiens
gaccggcccgccacct

SEQ ID NO: 466655 - DNA, 18 bp, Homo sapiens
gacctaaatccattttct

SEQ ID NO: 466656 - DNA, 20 bp, Homo sapiens
gacctaaatccattttctaa

SEQ ID NO: 466657 - DNA, 22 bp, Homo sapiens
gacctacatctgaaatctacaa

SEQ ID NO: 466658 - DNA, 23 bp, Homo sapiens
gacctccagattattttctatat

SEQ ID NO: 466659 - DNA, 22 bp, Homo sapiens
gacctgaagagcgctcctctgc

SEQ ID NO: 466660 - DNA, 23 bp, Homo sapiens
gacctgaagagcgctcctctgcc

SEQ ID NO: 466661 - DNA, 20 bp, Homo sapiens
gacctgacgatcttccccct

SEQ ID NO: 466662 - DNA, 16 bp, Homo sapiens
gaccttgaaaagcagt

SEQ ID NO: 466663 - DNA, 14 bp, Homo sapiens
gacgctggtaactg

SEQ ID NO: 466664 - DNA, 19 bp, Homo sapiens
gacgcttaacctttccgct

SEQ ID NO: 466665 - DNA, 15 bp, Homo sapiens
gacggacgggacagc

SEQ ID NO: 466666 - DNA, 13 bp, Homo sapiens
gacggcagcccca

SEQ ID NO: 466667 - DNA, 18 bp, Homo sapiens
gacggcagccccatcctt

SEQ ID NO: 466668 - DNA, 17 bp, Homo sapiens
gatgtattatgcaaagt

SEQ ID NO: 466669 - DNA, 22 bp, Homo sapiens
gattaaatttaatatactgcat

SEQ ID NO: 466670 - DNA, 20 bp, Homo sapiens
gattaatctctaaaattcta

SEQ ID NO: 466671 - DNA, 13 bp, Homo sapiens
gattattgaatgt

SEQ ID NO: 466672 - DNA, 20 bp, Homo sapiens
gattattgaatgttatatca

SEQ ID NO: 466673 - DNA, 22 bp, Homo sapiens
gattcaagactcaatgtggaaa

SEQ ID NO: 466674 - DNA, 20 bp, Homo sapiens
gattccagagagtggctcct

SEQ ID NO: 466675 - DNA, 15 bp, Homo sapiens
gattctaaaggggac

SEQ ID NO: 466676 - DNA, 19 bp, Homo sapiens
gattctaaaggggacagat

SEQ ID NO: 466677 - DNA, 18 bp, Homo sapiens
gattctatgcctgtattt

SEQ ID NO: 466678 - DNA, 13 bp, Homo sapiens
gattctcctctcc

SEQ ID NO: 466679 - DNA, 19 bp, Homo sapiens
gattcttttttcaatgtac

SEQ ID NO: 466680 - DNA, 12 bp, Homo sapiens
gattgaaaagaa

SEQ ID NO: 466681 - DNA, 22 bp, Homo sapiens
gattgaaaagaagaaagtctat

SEQ ID NO: 466682 - DNA, 16 bp, Homo sapiens
gattgggggggcttgg

SEQ ID NO: 466683 - DNA, 17 bp, Homo sapiens
gattgggggggcttggg

SEQ ID NO: 466684 - DNA, 14 bp, Homo sapiens
gattggtaccagag

SEQ ID NO: 466685 - DNA, 14 bp, Homo sapiens
gatttaaactctta

SEQ ID NO: 466686 - DNA, 14 bp, Homo sapiens
gatttattatgaac

SEQ ID NO: 466687 - DNA, 14 bp, Homo sapiens
gatttcctaagctg

SEQ ID NO: 466688 - DNA, 18 bp, Homo sapiens
gatttgagtccattgcaa

SEQ ID NO: 466689 - DNA, 21 bp, Homo sapiens
gatttgcaaatgcacatttgt

SEQ ID NO: 466690 - DNA, 22 bp, Homo sapiens
gattttagatttctttgattgt

SEQ ID NO: 466691 - DNA, 19 bp, Homo sapiens
gcaaaatgttacagaatct

SEQ ID NO: 466692 - DNA, 15 bp, Homo sapiens
gcaaacatttaaaaa

SEQ ID NO: 466693 - DNA, 17 bp, Homo sapiens
gcagggccctggggtct

SEQ ID NO: 466694 - DNA, 13 bp, Homo sapiens
gcagggccgcagg

SEQ ID NO: 466695 - DNA, 17 bp, Homo sapiens
gcagggccgcagggcgc

SEQ ID NO: 466696 - DNA, 19 bp, Homo sapiens
gcagggcgctccggcagag

SEQ ID NO: 466697 - DNA, 13 bp, Homo sapiens
gcaggggggttgg

SEQ ID NO: 466698 - DNA, 13 bp, Homo sapiens
gcagggttctaga

SEQ ID NO: 466699 - DNA, 17 bp, Homo sapiens
gcagggttctagaaggg

SEQ ID NO: 466700 - DNA, 14 bp, Homo sapiens
gcaggtcctgccca

SEQ ID NO: 466701 - DNA, 18 bp, Homo sapiens
gcagtaccatcccactga

SEQ ID NO: 466702 - DNA, 20 bp, Homo sapiens
gcagtaccatcccactgata

SEQ ID NO: 466703 - DNA, 14 bp, Homo sapiens
gcagtacttgctca

SEQ ID NO: 466704 - DNA, 13 bp, Homo sapiens
gcagtgctgggcc

SEQ ID NO: 466705 - DNA, 15 bp, Homo sapiens
gcagtgctgggccca

SEQ ID NO: 466706 - DNA, 15 bp, Homo sapiens
gcagtggagagggga

SEQ ID NO: 466707 - DNA, 17 bp, Homo sapiens
gcagtggagaggggact

SEQ ID NO: 466708 - DNA, 21 bp, Homo sapiens
gcagtggagaggggacttgga

SEQ ID NO: 466709 - DNA, 16 bp, Homo sapiens
gcataagattatatac

SEQ ID NO: 466710 - DNA, 20 bp, Homo sapiens
gcataagattatatacaaag

SEQ ID NO: 466711 - DNA, 13 bp, Homo sapiens
gcatacaataaaa

SEQ ID NO: 466712 - DNA, 16 bp, Homo sapiens
gcatacaataaaagag

SEQ ID NO: 466713 - DNA, 18 bp, Homo sapiens
gcatacaataaaagagct

SEQ ID NO: 466714 - DNA, 19 bp, Homo sapiens
gcatacaataaaagagctt

SEQ ID NO: 466715 - DNA, 20 bp, Homo sapiens
gcatacaataaaagagcttt

SEQ ID NO: 466716 - DNA, 14 bp, Homo sapiens
gcatagacaagtgt

SEQ ID NO: 466717 - DNA, 16 bp, Homo sapiens
gcatagggtttggaag

SEQ ID NO: 466718 - DNA, 20 bp, Homo sapiens
gcatagttctgcaataacag

SEQ ID NO: 466719 - DNA, 11 bp, Homo sapiens
gcatataaatg

SEQ ID NO: 466720 - DNA, 14 bp, Homo sapiens
gcatataaatgttt

SEQ ID NO: 466721 - DNA, 21 bp, Homo sapiens
gcatattagcatcatgtcttt

SEQ ID NO: 466722 - DNA, 13 bp, Homo sapiens
ctgcctctgaaaa

SEQ ID NO: 466723 - DNA, 17 bp, Homo sapiens
ctgcctctgaaaatatt

SEQ ID NO: 466724 - DNA, 15 bp, Homo sapiens
ctgcctggcgggcag

SEQ ID NO: 466725 - DNA, 20 bp, Homo sapiens
ctgcctggcgggcagcccct

SEQ ID NO: 466726 - DNA, 21 bp, Homo sapiens
ctgcctggcgggcagcccctg

SEQ ID NO: 466727 - DNA, 23 bp, Homo sapiens
ctgcctggcgggcagcccctgct

SEQ ID NO: 466728 - DNA, 19 bp, Homo sapiens
ctgcctttgagcttctcct

SEQ ID NO: 466729 - DNA, 23 bp, Homo sapiens
ctgcctttgagcttctcctctgc

SEQ ID NO: 466730 - DNA, 12 bp, Homo sapiens
ctgcgccctccc

SEQ ID NO: 466731 - DNA, 13 bp, Homo sapiens
ctgcgccctccct

SEQ ID NO: 466732 - DNA, 14 bp, Homo sapiens
ctgcgccctccctc

SEQ ID NO: 466733 - DNA, 15 bp, Homo sapiens
ctgcgccctccctcc

SEQ ID NO: 466734 - DNA, 21 bp, Homo sapiens
ctgcgccctccctccctccac

SEQ ID NO: 466735 - DNA, 13 bp, Homo sapiens
ctgcgcctgcccg

SEQ ID NO: 466736 - DNA, 19 bp, Homo sapiens
ctgcgctcctctgcagcct

SEQ ID NO: 466737 - DNA, 20 bp, Homo sapiens
ctgcgctcctctgcagcctg

SEQ ID NO: 466738 - DNA, 21 bp, Homo sapiens
ctgcgctcctctgcagcctga

SEQ ID NO: 466739 - DNA, 18 bp, Homo sapiens
ctgctatgtctgtgatgt

SEQ ID NO: 466740 - DNA, 17 bp, Homo sapiens
ctgctccaacagacacc

SEQ ID NO: 466741 - DNA, 18 bp, Homo sapiens
ctgctccaacagacaccc

SEQ ID NO: 466742 - DNA, 20 bp, Homo sapiens
ctgctccaacagacaccctc

SEQ ID NO: 466743 - DNA, 21 bp, Homo sapiens
ctgctccaacagacaccctcc

SEQ ID NO: 466744 - DNA, 13 bp, Homo sapiens
ctgctcctttggg

SEQ ID NO: 466745 - DNA, 13 bp, Homo sapiens
ctgctcgggaagg

SEQ ID NO: 466746 - DNA, 17 bp, Homo sapiens
ctgctcgggaaggcctg

SEQ ID NO: 466747 - DNA, 15 bp, Homo sapiens
ctgctctattgtagc

SEQ ID NO: 466748 - DNA, 19 bp, Homo sapiens
ctgctgctcgggaaggcct

SEQ ID NO: 466749 - DNA, 23 bp, Homo sapiens
ctgctgctcgggaaggcctgagg

SEQ ID NO: 466750 - DNA, 13 bp, Homo sapiens
ctgctggctgcct

SEQ ID NO: 466751 - DNA, 14 bp, Homo sapiens
ctgctgtgaatttt

SEQ ID NO: 466752 - DNA, 22 bp, Homo sapiens
ctgctgtggtgttcccttggca

SEQ ID NO: 466753 - DNA, 14 bp, Homo sapiens
ctgctgttttatgt

SEQ ID NO: 466754 - DNA, 16 bp, Homo sapiens
ctgctgttttatgtca

SEQ ID NO: 466755 - DNA, 24 bp, Homo sapiens
ctgctgttttatgtcatactctgt

SEQ ID NO: 466756 - DNA, 16 bp, Homo sapiens
ctgcttagtgtccctt

SEQ ID NO: 466757 - DNA, 19 bp, Homo sapiens
ctgcttggatccatacaaa

SEQ ID NO: 466758 - DNA, 21 bp, Homo sapiens
ctggactggtggcccctgcct

SEQ ID NO: 466759 - DNA, 15 bp, Homo sapiens
ctggcacagggcagt

SEQ ID NO: 466760 - DNA, 19 bp, Homo sapiens
ctggcagccgtgccttcag

SEQ ID NO: 466761 - DNA, 20 bp, Homo sapiens
ctggcagccgtgccttcagc

SEQ ID NO: 466762 - DNA, 14 bp, Homo sapiens
ctggcagcgcctcc

SEQ ID NO: 466763 - DNA, 15 bp, Homo sapiens
ctggcagcgcctccc

SEQ ID NO: 466764 - DNA, 16 bp, Homo sapiens
ctggccagacgctgcc

SEQ ID NO: 466765 - DNA, 14 bp, Homo sapiens
ctggccagcaccct

SEQ ID NO: 466766 - DNA, 20 bp, Homo sapiens
ctggccagcaccctctcctg

SEQ ID NO: 466767 - DNA, 16 bp, Homo sapiens
ctggcccacccctctt

SEQ ID NO: 466768 - DNA, 12 bp, Homo sapiens
ctggccccaggc

SEQ ID NO: 466769 - DNA, 13 bp, Homo sapiens
ctggccctgccct

SEQ ID NO: 466770 - DNA, 15 bp, Homo sapiens
ctggcctatttaagc

SEQ ID NO: 466771 - DNA, 16 bp, Homo sapiens
ctggcctatttaagcc

SEQ ID NO: 466772 - DNA, 17 bp, Homo sapiens
ctggcctatttaagccc

SEQ ID NO: 466773 - DNA, 14 bp, Homo sapiens
ctggcgggcagccc

SEQ ID NO: 466774 - DNA, 15 bp, Homo sapiens
ctggcgggcagcccc

SEQ ID NO: 466775 - DNA, 20 bp, Homo sapiens
ctggctacgacttgggacgg

SEQ ID NO: 466776 - DNA, 22 bp, Homo sapiens
ctggctcccacaggcccttcct

SEQ ID NO: 466777 - DNA, 14 bp, Homo sapiens
ctggctgccttaga

SEQ ID NO: 466778 - DNA, 18 bp, Homo sapiens
ctggctgggtcgcccctc

SEQ ID NO: 466779 - DNA, 20 bp, Homo sapiens
ctggctgggtcgcccctcct

SEQ ID NO: 466780 - DNA, 15 bp, Homo sapiens
ctggctgtggcccct

SEQ ID NO: 466781 - DNA, 17 bp, Homo sapiens
ctggctgtggcccctcc

SEQ ID NO: 466782 - DNA, 22 bp, Homo sapiens
ctggctgtggcccctccttctc

SEQ ID NO: 466783 - DNA, 19 bp, Homo sapiens
ctggcttagcgttctgttt

SEQ ID NO: 466784 - DNA, 16 bp, Homo sapiens
ctggcttttcactgct

SEQ ID NO: 466785 - DNA, 20 bp, Homo sapiens
ctggcttttcactgctggct

SEQ ID NO: 466786 - DNA, 19 bp, Homo sapiens
ctgggatgggaccagggat

SEQ ID NO: 466787 - DNA, 22 bp, Homo sapiens
ctgggcagggccgcagggcgct

SEQ ID NO: 466788 - DNA, 12 bp, Homo sapiens
ctgggcccagcc

SEQ ID NO: 466789 - DNA, 14 bp, Homo sapiens
ctgggcccctccac

SEQ ID NO: 466790 - DNA, 15 bp, Homo sapiens
ctgggcccctccacg

SEQ ID NO: 466791 - DNA, 16 bp, Homo sapiens
ctgggcccctccacgc

SEQ ID NO: 466792 - DNA, 20 bp, Homo sapiens
ctgggcccctccacgcctcc

SEQ ID NO: 466793 - DNA, 21 bp, Homo sapiens
ctgggcccctccacgcctcct

SEQ ID NO: 466794 - DNA, 12 bp, Homo sapiens
ctgggcccctgg

SEQ ID NO: 466795 - DNA, 20 bp, Homo sapiens
ctgggcctcagttcaacctg

SEQ ID NO: 466796 - DNA, 12 bp, Homo sapiens
ctgggcctcccg

SEQ ID NO: 466797 - DNA, 22 bp, Homo sapiens
ctgggcctcccgtccgtccgcc

SEQ ID NO: 466798 - DNA, 13 bp, Homo sapiens
ctggggccctggg

SEQ ID NO: 466799 - DNA, 16 bp, Homo sapiens
ctggggccctgggcct

SEQ ID NO: 466800 - DNA, 23 bp, Homo sapiens
ctggggcctggcctatttaagcc

SEQ ID NO: 466801 - DNA, 14 bp, Homo sapiens
ctgggggtggcagg

SEQ ID NO: 466802 - DNA, 16 bp, Homo sapiens
ctggggtctctgagca

SEQ ID NO: 466803 - DNA, 17 bp, Homo sapiens
ctggggtctctgagcag

SEQ ID NO: 466804 - DNA, 18 bp, Homo sapiens
ctggggtctctgagcagt

SEQ ID NO: 466805 - DNA, 23 bp, Homo sapiens
ctggggtctctgagcagtgggga

SEQ ID NO: 466806 - DNA, 22 bp, Homo sapiens
ctgggtttgggcagtggagagg

SEQ ID NO: 466807 - DNA, 23 bp, Homo sapiens
ctgggtttgggcagtggagaggg

SEQ ID NO: 466808 - DNA, 15 bp, Homo sapiens
ctgggttttagaaat

SEQ ID NO: 466809 - DNA, 18 bp, Homo sapiens
ctggtcagtgaagcccag

SEQ ID NO: 466810 - DNA, 16 bp, Homo sapiens
ctggtctggagcccct

SEQ ID NO: 466811 - DNA, 18 bp, Homo sapiens
ctggtctggagcccctat

SEQ ID NO: 466812 - DNA, 14 bp, Homo sapiens
ctggtgcatttaaa

SEQ ID NO: 466813 - DNA, 22 bp, Homo sapiens
ctggtgcatttaaaatggactt

SEQ ID NO: 466814 - DNA, 21 bp, Homo sapiens
ctggtgcgctgtgctccagca

SEQ ID NO: 466815 - DNA, 15 bp, Homo sapiens
ctggtgcgtgtggcc

SEQ ID NO: 466816 - DNA, 16 bp, Homo sapiens
ctggtgcgtgtggccc

SEQ ID NO: 466817 - DNA, 12 bp, Homo sapiens
ctggtgctgcca

SEQ ID NO: 466818 - DNA, 18 bp, Homo sapiens
ctggtgtctagtttgcat

SEQ ID NO: 466819 - DNA, 17 bp, Homo sapiens
ctggttatagttgatat

SEQ ID NO: 466820 - DNA, 23 bp, Homo sapiens
ggttccagacagggtggggctta

SEQ ID NO: 466821 - DNA, 13 bp, Homo sapiens
ggttctagaaggg

SEQ ID NO: 466822 - DNA, 14 bp, Homo sapiens
ggttggaggcctgg

SEQ ID NO: 466823 - DNA, 14 bp, Homo sapiens
ggttgggttccaga

SEQ ID NO: 466824 - DNA, 15 bp, Homo sapiens
ggtttcagaaagggc

SEQ ID NO: 466825 - DNA, 14 bp, Homo sapiens
ggtttgggcagtgg

SEQ ID NO: 466826 - DNA, 17 bp, Homo sapiens
ggttttgttaggggtgg

SEQ ID NO: 466827 - DNA, 21 bp, Homo sapiens
ggtttttatttctcgggtgca

SEQ ID NO: 466828 - DNA, 16 bp, Homo sapiens
gtaaaattcatagcat

SEQ ID NO: 466829 - DNA, 18 bp, Homo sapiens
gtaaacatcataaatagt

SEQ ID NO: 466830 - DNA, 23 bp, Homo sapiens
gtaaacatcataaatagtaaata

SEQ ID NO: 466831 - DNA, 22 bp, Homo sapiens
gtaaataaactcttcaaggcca

SEQ ID NO: 466832 - DNA, 23 bp, Homo sapiens
gtaaataaactcttcaaggccaa

SEQ ID NO: 466833 - DNA, 20 bp, Homo sapiens
gtaaataatgattcaatgtg

SEQ ID NO: 466834 - DNA, 12 bp, Homo sapiens
gtaaatttaact

SEQ ID NO: 466835 - DNA, 17 bp, Homo sapiens
gtaaccaggccccagcc

SEQ ID NO: 466836 - DNA, 20 bp, Homo sapiens
gtaaccaggccccagcctcc

SEQ ID NO: 466837 - DNA, 14 bp, Homo sapiens
gtaactattcttca

SEQ ID NO: 466838 - DNA, 20 bp, Homo sapiens
gtaactgttaacccagtgtt

SEQ ID NO: 466839 - DNA, 13 bp, Homo sapiens
gtaagaagaaact

SEQ ID NO: 466840 - DNA, 15 bp, Homo sapiens
gtaaggtttcaatgc

SEQ ID NO: 466841 - DNA, 16 bp, Homo sapiens
gtaaggtttcaatgca

SEQ ID NO: 466842 - DNA, 19 bp, Homo sapiens
gtaagttgaagggaaatca

SEQ ID NO: 466843 - DNA, 22 bp, Homo sapiens
gtaagttgaagggaaatcaatt

SEQ ID NO: 466844 - DNA, 18 bp, Homo sapiens
gtaataactgttagaatt

SEQ ID NO: 466845 - DNA, 16 bp, Homo sapiens
gtaatagcctcacctt

SEQ ID NO: 466846 - DNA, 20 bp, Homo sapiens
gtaatcacactctcttctta

SEQ ID NO: 466847 - DNA, 20 bp, Homo sapiens
gtaatcatttatcttatcta

SEQ ID NO: 466848 - DNA, 24 bp, Homo sapiens
gtaatcatttatcttatctagcaa

SEQ ID NO: 466849 - DNA, 17 bp, Homo sapiens
gtaatggatatgaaaga

SEQ ID NO: 466850 - DNA, 22 bp, Homo sapiens
gtaatttgttatatcagcagac

SEQ ID NO: 466851 - DNA, 20 bp, Homo sapiens
gtaattttatgagctgtgag

SEQ ID NO: 466852 - DNA, 21 bp, Homo sapiens
gtaccagagcctatggaaagg

SEQ ID NO: 466853 - DNA, 22 bp, Homo sapiens
gtaccagagcctatggaaaggg

SEQ ID NO: 466854 - DNA, 14 bp, Homo sapiens
gtacctttccaccc

SEQ ID NO: 466855 - DNA, 15 bp, Homo sapiens
gtacctttccaccca

SEQ ID NO: 466856 - DNA, 21 bp, Homo sapiens
gtacctttccacccagaccct

SEQ ID NO: 466857 - DNA, 19 bp, Homo sapiens
gtacttacactgaaatcca

SEQ ID NO: 466858 - DNA, 21 bp, Homo sapiens
gtacttcttcatccatagaca

SEQ ID NO: 466859 - DNA, 19 bp, Homo sapiens
gtacttgctcaataaaggt

SEQ ID NO: 466860 - DNA, 20 bp, Homo sapiens
gtagaaattttatctcttct

SEQ ID NO: 466861 - DNA, 22 bp, Homo sapiens
gtagaaattttatctcttcttc

SEQ ID NO: 466862 - DNA, 11 bp, Homo sapiens
gtagagaggac

SEQ ID NO: 466863 - DNA, 16 bp, Homo sapiens
gtagcatataaatgtt

SEQ ID NO: 466864 - DNA, 21 bp, Homo sapiens
gtagctagaatatcctatact

SEQ ID NO: 466865 - DNA, 13 bp, Homo sapiens
gtaggctgtattt

SEQ ID NO: 466866 - DNA, 21 bp, Homo sapiens
gtagggaagaaaactatcctg

SEQ ID NO: 466867 - DNA, 20 bp, Homo sapiens
gtataacaagccaaacattc

SEQ ID NO: 466868 - DNA, 13 bp, Homo sapiens
gtatataagcttt

SEQ ID NO: 466869 - DNA, 14 bp, Homo sapiens
gtatatcagctcta

SEQ ID NO: 466870 - DNA, 20 bp, Homo sapiens
gtatatcagctctaaagcag

SEQ ID NO: 466871 - DNA, 17 bp, Homo sapiens
gtatctaaaaaataact

SEQ ID NO: 466872 - DNA, 21 bp, Homo sapiens
gtatctgctgcctctgaaaat

SEQ ID NO: 466873 - DNA, 18 bp, Homo sapiens
gtatgaataaagacacct

SEQ ID NO: 466874 - DNA, 19 bp, Homo sapiens
gtatgctggccagcaccct

SEQ ID NO: 466875 - DNA, 20 bp, Homo sapiens
gtatgctggccagcaccctc

SEQ ID NO: 466876 - DNA, 21 bp, Homo sapiens
gtatgtccagaacaaaagata

SEQ ID NO: 466877 - DNA, 23 bp, Homo sapiens
gtattgacgacctacatctgaaa

SEQ ID NO: 466878 - DNA, 23 bp, Homo sapiens
gtattgacttctttttggcatta

SEQ ID NO: 466879 - DNA, 23 bp, Homo sapiens
gtattttaataaagattccatgg

SEQ ID NO: 466880 - DNA, 22 bp, Homo sapiens
gtattttcttttatatctgtaa

SEQ ID NO: 466881 - DNA, 21 bp, Homo sapiens
gtcaacaagtatgaataaaga

SEQ ID NO: 466882 - DNA, 18 bp, Homo sapiens
gtcaatgtgaaataaaga

SEQ ID NO: 466883 - DNA, 16 bp, Homo sapiens
gttgggttccagacag

SEQ ID NO: 466884 - DNA, 20 bp, Homo sapiens
gttgttcgatcgtttcacat

SEQ ID NO: 466885 - DNA, 14 bp, Homo sapiens
gtttaaaaaaataa

SEQ ID NO: 466886 - DNA, 14 bp, Homo sapiens
gtttaccctccctg

SEQ ID NO: 466887 - DNA, 17 bp, Homo sapiens
gtttaccctccctgtcc

SEQ ID NO: 466888 - DNA, 13 bp, Homo sapiens
gtttacctcactg

SEQ ID NO: 466889 - DNA, 17 bp, Homo sapiens
gtttacctcactggtgc

SEQ ID NO: 466890 - DNA, 18 bp, Homo sapiens
gtttacctcactggtgca

SEQ ID NO: 466891 - DNA, 13 bp, Homo sapiens
gtttactctgtgc

SEQ ID NO: 466892 - DNA, 21 bp, Homo sapiens
gtttattatagtctgtacttc

SEQ ID NO: 466893 - DNA, 21 bp, Homo sapiens
gtttcagaaagggcagcccct

SEQ ID NO: 466894 - DNA, 23 bp, Homo sapiens
gtttcagaaagggcagcccctcc

SEQ ID NO: 466895 - DNA, 20 bp, Homo sapiens
gtttctatactgtttgtaat

SEQ ID NO: 466896 - DNA, 21 bp, Homo sapiens
gtttctatactgtttgtaata

SEQ ID NO: 466897 - DNA, 22 bp, Homo sapiens
gtttctatactgtttgtaatat

SEQ ID NO: 466898 - DNA, 15 bp, Homo sapiens
gtttctatggattca

SEQ ID NO: 466899 - DNA, 15 bp, Homo sapiens
gtttctgcagtattc

SEQ ID NO: 466900 - DNA, 13 bp, Homo sapiens
gtttgcaagaacc

SEQ ID NO: 466901 - DNA, 17 bp, Homo sapiens
gtttggcaacctttgtg

SEQ ID NO: 466902 - DNA, 15 bp, Homo sapiens
gtttgtaatatacag

SEQ ID NO: 466903 - DNA, 16 bp, Homo sapiens
gttttaaaaaagcatt

SEQ ID NO: 466904 - DNA, 22 bp, Homo sapiens
gttttagaaattctataagaga

SEQ ID NO: 466905 - DNA, 17 bp, Homo sapiens
gttttatgtcatactct

SEQ ID NO: 466906 - DNA, 14 bp, Homo sapiens
gttttcaaaatact

SEQ ID NO: 466907 - DNA, 22 bp, Homo sapiens
gtttttaaaaaaaatattctgt

SEQ ID NO: 466908 - DNA, 17 bp, Homo sapiens
gtttttgctctacttta

SEQ ID NO: 466909 - DNA, 17 bp, Homo sapiens
gtttttgtgctgtgggc

SEQ ID NO: 466910 - DNA, 17 bp, Homo sapiens
taaaaaaaatattctgt

SEQ ID NO: 466911 - DNA, 15 bp, Homo sapiens
taaaaaaataacatc

SEQ ID NO: 466912 - DNA, 13 bp, Homo sapiens
taaaaaagcatta

SEQ ID NO: 466913 - DNA, 13 bp, Homo sapiens
taaaaaataacat

SEQ ID NO: 466914 - DNA, 14 bp, Homo sapiens
taaaaaataacata

SEQ ID NO: 466915 - DNA, 22 bp, Homo sapiens
taaaaaataacatattcttgct

SEQ ID NO: 466916 - DNA, 14 bp, Homo sapiens
taaaaaataactgt

SEQ ID NO: 466917 - DNA, 15 bp, Homo sapiens
taaaaaataactgtg

SEQ ID NO: 466918 - DNA, 18 bp, Homo sapiens
taaaaataaccaaaaaat

SEQ ID NO: 466919 - DNA, 22 bp, Homo sapiens
taaaaataaccaaaaaatgtga

SEQ ID NO: 466920 - DNA, 20 bp, Homo sapiens
taaaatacatggtatctctt

SEQ ID NO: 466921 - DNA, 14 bp, Homo sapiens
taaaatactgtttt

SEQ ID NO: 466922 - DNA, 19 bp, Homo sapiens
taaaattctagtctctgat

SEQ ID NO: 466923 - DNA, 13 bp, Homo sapiens
taaacactgtaat

SEQ ID NO: 466924 - DNA, 13 bp, Homo sapiens
taaacatcataaa

SEQ ID NO: 466925 - DNA, 17 bp, Homo sapiens
taaacattaaacactgt

SEQ ID NO: 466926 - DNA, 13 bp, Homo sapiens
taaactgcagttt

SEQ ID NO: 466927 - DNA, 14 bp, Homo sapiens
taaactgcagtttt

SEQ ID NO: 466928 - DNA, 12 bp, Homo sapiens
taaactgttttc

SEQ ID NO: 466929 - DNA, 14 bp, Homo sapiens
taaactgttttcat

SEQ ID NO: 466930 - DNA, 16 bp, Homo sapiens
taaagaaaggcagaga

SEQ ID NO: 466931 - DNA, 17 bp, Homo sapiens
taaagaaaggcagagat

SEQ ID NO: 466932 - DNA, 20 bp, Homo sapiens
taaagaaaggcagagattgg

SEQ ID NO: 466933 - DNA, 14 bp, Homo sapiens
taaagaagaaaata

SEQ ID NO: 466934 - DNA, 15 bp, Homo sapiens
taaagacacctactg

SEQ ID NO: 466935 - DNA, 15 bp, Homo sapiens
taaagagttctcctt

SEQ ID NO: 466936 - DNA, 22 bp, Homo sapiens
taaagagttctccttgtacttg

SEQ ID NO: 466937 - DNA, 18 bp, Homo sapiens
taaaggaaagttctatta

SEQ ID NO: 466938 - DNA, 19 bp, Homo sapiens
taaagggagccatgctctt

SEQ ID NO: 466939 - DNA, 21 bp, Homo sapiens
taaaggggacagatcttgagc

SEQ ID NO: 466940 - DNA, 16 bp, Homo sapiens
taaagtacctgtagtg

SEQ ID NO: 466941 - DNA, 21 bp, Homo sapiens
taaagtacctgtagtgagaaa

SEQ ID NO: 466942 - DNA, 20 bp, Homo sapiens
taaagttccatgaagacaaa

SEQ ID NO: 466943 - DNA, 16 bp, Homo sapiens
taaataaactcttcaa

SEQ ID NO: 466944 - DNA, 14 bp, Homo sapiens
taaataaagaagaa

SEQ ID NO: 466945 - DNA, 15 bp, Homo sapiens
taaataatgattcaa

SEQ ID NO: 466946 - DNA, 18 bp, Homo sapiens
taaataatgattcaatgt

SEQ ID NO: 466947 - DNA, 14 bp, Homo sapiens
taaataatgcttaa

SEQ ID NO: 466948 - DNA, 22 bp, Homo sapiens
taaatagtatccaactttgtag

SEQ ID NO: 466949 - DNA, 14 bp, Homo sapiens
taaatccattttct

SEQ ID NO: 466950 - DNA, 16 bp, Homo sapiens
taaatccattttctaa

SEQ ID NO: 466951 - DNA, 17 bp, Homo sapiens
taaatccattttctaaa

SEQ ID NO: 466952 - DNA, 19 bp, Homo sapiens
taaatccattttctaaact

SEQ ID NO: 466953 - DNA, 21 bp, Homo sapiens
taaatccattttctaaactgt

SEQ ID NO: 466954 - DNA, 14 bp, Homo sapiens
taaatctaaatata

SEQ ID NO: 466955 - DNA, 17 bp, Homo sapiens
taaatctgtctgattct

SEQ ID NO: 466956 - DNA, 15 bp, Homo sapiens
taaattattacttta

SEQ ID NO: 466957 - DNA, 17 bp, Homo sapiens
taaattattactttaaa

SEQ ID NO: 466958 - DNA, 18 bp, Homo sapiens
taaattggctcctttccc

SEQ ID NO: 466959 - DNA, 18 bp, Homo sapiens
taaatttaactgcatata

SEQ ID NO: 466960 - DNA, 19 bp, Homo sapiens
taaatttaatatactgcat

SEQ ID NO: 466961 - DNA, 20 bp, Homo sapiens
taaatttaatatactgcata

SEQ ID NO: 466962 - DNA, 22 bp, Homo sapiens
taaattttaatgtaaaattcat

SEQ ID NO: 466963 - DNA, 21 bp, Homo sapiens
taacaagccaaacattcttat

SEQ ID NO: 466964 - DNA, 18 bp, Homo sapiens
taacaatgccttgttgta

SEQ ID NO: 466965 - DNA, 20 bp, Homo sapiens
taacagttggtgattttaga

SEQ ID NO: 466966 - DNA, 18 bp, Homo sapiens
taacataaacttgtactt

SEQ ID NO: 466967 - DNA, 20 bp, Homo sapiens
taacatacatctaagtcagt

SEQ ID NO: 466968 - DNA, 22 bp, Homo sapiens
taacatattcttgctttcacaa

SEQ ID NO: 466969 - DNA, 23 bp, Homo sapiens
taacatattcttgctttcacaaa

SEQ ID NO: 466970 - DNA, 13 bp, Homo sapiens
taacatctgaaaa

SEQ ID NO: 466971 - DNA, 15 bp, Homo sapiens
taacatctgaaaaga

SEQ ID NO: 466972 - DNA, 21 bp, Homo sapiens
taaccatatgattgaaaagaa

SEQ ID NO: 466973 - DNA, 19 bp, Homo sapiens
taacccagtgttcagcata

SEQ ID NO: 466974 - DNA, 14 bp, Homo sapiens
taactactaagaat

SEQ ID NO: 466975 - DNA, 22 bp, Homo sapiens
taactactaagaataaataaag

SEQ ID NO: 466976 - DNA, 14 bp, Homo sapiens
taactcatctgtta

SEQ ID NO: 466977 - DNA, 13 bp, Homo sapiens
taactctgcatag

SEQ ID NO: 466978 - DNA, 16 bp, Homo sapiens
taactggatattcttt

SEQ ID NO: 466979 - DNA, 12 bp, Homo sapiens
taactggcccca

SEQ ID NO: 466980 - DNA, 21 bp, Homo sapiens
taactgttaacccagtgttca

SEQ ID NO: 466981 - DNA, 14 bp, Homo sapiens
ttgttgctgctttg

SEQ ID NO: 466982 - DNA, 20 bp, Homo sapiens
ttgtttacatgagttcaaat

SEQ ID NO: 466983 - DNA, 13 bp, Homo sapiens
ttgtttctatact

SEQ ID NO: 466984 - DNA, 22 bp, Homo sapiens
ttgtttctatactgtttgtaat

SEQ ID NO: 466985 - DNA, 20 bp, Homo sapiens
tttaaaaaagcattatcctt

SEQ ID NO: 466986 - DNA, 15 bp, Homo sapiens
tttaaaaaataacat

SEQ ID NO: 466987 - DNA, 21 bp, Homo sapiens
tttaaaatggacttttgttca

SEQ ID NO: 466988 - DNA, 22 bp, Homo sapiens
tttaaacactcttcagagaaat

SEQ ID NO: 466989 - DNA, 13 bp, Homo sapiens
tttaaaggaaagt

SEQ ID NO: 466990 - DNA, 12 bp, Homo sapiens
tttaaatgattc

SEQ ID NO: 466991 - DNA, 15 bp, Homo sapiens
tttaaatgattccaa

SEQ ID NO: 466992 - DNA, 16 bp, Homo sapiens
tttaaatgattccaaa

SEQ ID NO: 466993 - DNA, 17 bp, Homo sapiens
tttaaatgattccaaat

SEQ ID NO: 466994 - DNA, 21 bp, Homo sapiens
tttaaattatatgatatgcat

SEQ ID NO: 466995 - DNA, 15 bp, Homo sapiens
tttaacttatctcca

SEQ ID NO: 466996 - DNA, 19 bp, Homo sapiens
tttaagcgaggcagaatgg

SEQ ID NO: 466997 - DNA, 17 bp, Homo sapiens
tttaatctttgtgacag

SEQ ID NO: 466998 - DNA, 14 bp, Homo sapiens
tttaatgtaaaatt

SEQ ID NO: 466999 - DNA, 12 bp, Homo sapiens
tttaatttcata

SEQ ID NO: 467000 - DNA, 22 bp, Homo sapiens
tttacaacttccagatttgagc

SEQ ID NO: 467001 - DNA, 18 bp, Homo sapiens
tttacctcactggtgcat

SEQ ID NO: 467002 - DNA, 14 bp, Homo sapiens
tttactcaggcttt

SEQ ID NO: 467003 - DNA, 17 bp, Homo sapiens
tttactcaggctttcta

SEQ ID NO: 467004 - DNA, 21 bp, Homo sapiens
tttagacaaccatagaactgt

SEQ ID NO: 467005 - DNA, 19 bp, Homo sapiens
tttagtttaccaatcaaca

SEQ ID NO: 467006 - DNA, 12 bp, Homo sapiens
tttatactgtat

SEQ ID NO: 467007 - DNA, 17 bp, Homo sapiens
tttatattgtttttata

SEQ ID NO: 467008 - DNA, 18 bp, Homo sapiens
tttatattgtttttatat

SEQ ID NO: 467009 - DNA, 16 bp, Homo sapiens
tttatctcttcttcct

SEQ ID NO: 467010 - DNA, 22 bp, Homo sapiens
tttatgaagttaacagtctcat

SEQ ID NO: 467011 - DNA, 13 bp, Homo sapiens
tttattattttca

SEQ ID NO: 467012 - DNA, 15 bp, Homo sapiens
tttattattttcata

SEQ ID NO: 467013 - DNA, 11 bp, Homo sapiens
tttatttaatt

SEQ ID NO: 467014 - DNA, 21 bp, Homo sapiens
tttatttaatttcataaattg

SEQ ID NO: 467015 - DNA, 14 bp, Homo sapiens
tttcaaaatgcatg

SEQ ID NO: 467016 - DNA, 20 bp, Homo sapiens
tttcaaagaaaacagaccag

SEQ ID NO: 467017 - DNA, 23 bp, Homo sapiens
tttcaaatgagtttaaaaaaata

SEQ ID NO: 467018 - DNA, 15 bp, Homo sapiens
tttcaacgcagccct

SEQ ID NO: 467019 - DNA, 13 bp, Homo sapiens
tttcacatctgta

SEQ ID NO: 467020 - DNA, 17 bp, Homo sapiens
tttcactgctggctgcc

SEQ ID NO: 467021 - DNA, 18 bp, Homo sapiens
tttcactgctggctgcct

SEQ ID NO: 467022 - DNA, 11 bp, Homo sapiens
tttcataaatt

SEQ ID NO: 467023 - DNA, 17 bp, Homo sapiens
tttcatccagtttgttc

SEQ ID NO: 467024 - DNA, 22 bp, Homo sapiens
tttcatccagtttgttctccgg

SEQ ID NO: 467025 - DNA, 17 bp, Homo sapiens
tttcatgtgttgcaaat

SEQ ID NO: 467026 - DNA, 12 bp, Homo sapiens
tttccacccaga

SEQ ID NO: 467027 - DNA, 13 bp, Homo sapiens
tttccacccagac

SEQ ID NO: 467028 - DNA, 15 bp, Homo sapiens
tttccacccagaccc

SEQ ID NO: 467029 - DNA, 22 bp, Homo sapiens
tttccgctgtcgccccaggccc

SEQ ID NO: 467030 - DNA, 24 bp, Homo sapiens
tttccgctgtcgccccaggccctc

SEQ ID NO: 467031 - DNA, 13 bp, Homo sapiens
tttcctctctctc

SEQ ID NO: 467032 - DNA, 23 bp, Homo sapiens
tttcctgacagaaggactcaggt

SEQ ID NO: 467033 - DNA, 17 bp, Homo sapiens
tttctaaatttgataat

SEQ ID NO: 467034 - DNA, 18 bp, Homo sapiens
tttctagctataacaact

SEQ ID NO: 467035 - DNA, 17 bp, Homo sapiens
tttctatactgtttgta

SEQ ID NO: 467036 - DNA, 15 bp, Homo sapiens
tttctatctgcaaat

SEQ ID NO: 467037 - DNA, 17 bp, Homo sapiens
tttctatctgcaaatag

SEQ ID NO: 467038 - DNA, 17 bp, Homo sapiens
tttctatggattcactt

SEQ ID NO: 467039 - DNA, 15 bp, Homo sapiens
tttctatgtagaact

SEQ ID NO: 467040 - DNA, 17 bp, Homo sapiens
tttctatgtagaactgt

SEQ ID NO: 467041 - DNA, 21 bp, Homo sapiens
tttctatgtagaactgttcat

SEQ ID NO: 467042 - DNA, 15 bp, Homo sapiens
tttctcatgcataga

SEQ ID NO: 467043 - DNA, 14 bp, Homo sapiens
tttctcattcttgc

SEQ ID NO: 467044 - DNA, 14 bp, Homo sapiens
tttctccgttgtgg

SEQ ID NO: 467045 - DNA, 23 bp, Homo sapiens
tttctcctggaaaacctcagcat

SEQ ID NO: 467046 - DNA, 17 bp, Homo sapiens
tttctctctgtgtggca

SEQ ID NO: 467047 - DNA, 11 bp, Homo sapiens
tttctgaggag

SEQ ID NO: 467048 - DNA, 15 bp, Homo sapiens
tttctggtttgcctg

SEQ ID NO: 467049 - DNA, 13 bp, Homo sapiens
tttctttctatgt

SEQ ID NO: 467050 - DNA, 18 bp, Homo sapiens
tttcttttgaatcaatct

SEQ ID NO: 467051 - DNA, 14 bp, Homo sapiens
tttcttttttctct

SEQ ID NO: 467052 - DNA, 22 bp, Homo sapiens
tttgacctgacgatcttccccc

SEQ ID NO: 467053 - DNA, 21 bp, Homo sapiens
tttgatatacagacctccaga

SEQ ID NO: 467054 - DNA, 21 bp, Homo sapiens
tttgcatacttcctggatttt

SEQ ID NO: 467055 - DNA, 19 bp, Homo sapiens
tttgcatgcaggctgtgtt

SEQ ID NO: 467056 - DNA, 23 bp, Homo sapiens
tttgcctgaatccacctgcagtt

SEQ ID NO: 467057 - DNA, 23 bp, Homo sapiens
tttggagagctcagtacagggca

SEQ ID NO: 467058 - DNA, 13 bp, Homo sapiens
tttggcattatct

SEQ ID NO: 467059 - DNA, 22 bp, Homo sapiens
tttggcattatctctttctctc

SEQ ID NO: 467060 - DNA, 14 bp, Homo sapiens
tttgggctgccctg

SEQ ID NO: 467061 - DNA, 19 bp, Homo sapiens
tttgggggattcaaatgca

SEQ ID NO: 467062 - DNA, 22 bp, Homo sapiens
tttgtaaatatcttttcttctc

SEQ ID NO: 467063 - DNA, 17 bp, Homo sapiens
tttgtaactattcttca

SEQ ID NO: 467064 - DNA, 22 bp, Homo sapiens
tttgtatcctccattgtatctt

SEQ ID NO: 467065 - DNA, 16 bp, Homo sapiens
tttgtatgcactttgt

SEQ ID NO: 467066 - DNA, 23 bp, Homo sapiens
tttgtcattcaagcctgtgaata

SEQ ID NO: 467067 - DNA, 13 bp, Homo sapiens
tttgtgctgtggg

SEQ ID NO: 467068 - DNA, 12 bp, Homo sapiens
tttgtggacttt

SEQ ID NO: 467069 - DNA, 14 bp, Homo sapiens
tttgtgtgattgaa

SEQ ID NO: 467070 - DNA, 15 bp, Homo sapiens
tttgttttttaaaaa

SEQ ID NO: 467071 - DNA, 19 bp, Homo sapiens
ttttaaaaaaaatattctg

SEQ ID NO: 467072 - DNA, 18 bp, Homo sapiens
ttttactcaggctttcta

SEQ ID NO: 467073 - DNA, 12 bp, Homo sapiens
ttttagaaattc

SEQ ID NO: 467074 - DNA, 13 bp, Homo sapiens
ttttatatctgta

SEQ ID NO: 467075 - DNA, 13 bp, Homo sapiens
ttttatctcttct

SEQ ID NO: 467076 - DNA, 17 bp, Homo sapiens
ttttatctcttcttcct

SEQ ID NO: 467077 - DNA, 17 bp, Homo sapiens
ttttatgtcatactctg

SEQ ID NO: 467078 - DNA, 21 bp, Homo sapiens
ttttatgtcatactctgtgta

SEQ ID NO: 467079 - DNA, 16 bp, Homo sapiens
ttttccagctgagcat

SEQ ID NO: 467080 - DNA, 14 bp, Homo sapiens
ttttccatctaaaa

SEQ ID NO: 467081 - DNA, 15 bp, Homo sapiens
ttttccatctaaaat

SEQ ID NO: 467082 - DNA, 19 bp, Homo sapiens
ttttccatctcaaaagtat

SEQ ID NO: 467083 - DNA, 17 bp, Homo sapiens
ttttcccacctctttgg

SEQ ID NO: 467084 - DNA, 15 bp, Homo sapiens
ttttccttcttagat

SEQ ID NO: 467085 - DNA, 14 bp, Homo sapiens
ttttctatatttgg

SEQ ID NO: 467086 - DNA, 22 bp, Homo sapiens
ttttgggaaattcttgcactgt

SEQ ID NO: 467087 - DNA, 13 bp, Homo sapiens
ttttgtcttcaac

SEQ ID NO: 467088 - DNA, 16 bp, Homo sapiens
ttttgtgtattctgtg

SEQ ID NO: 467089 - DNA, 16 bp, Homo sapiens
tttttactcaggcttt

SEQ ID NO: 467090 - DNA, 21 bp, Homo sapiens
tttttactcaggctttctatt

SEQ ID NO: 467091 - DNA, 21 bp, Homo sapiens
tttttataaattataatgcat

SEQ ID NO: 467092 - DNA, 14 bp, Homo sapiens
tttttctagctata

SEQ ID NO: 467093 - DNA, 13 bp, Homo sapiens
tcctgcaccctct

SEQ ID NO: 467094 - DNA, 14 bp, Homo sapiens
tcctgcaccctctg

SEQ ID NO: 467095 - DNA, 15 bp, Homo sapiens
tcctgcaccctctgc

SEQ ID NO: 467096 - DNA, 16 bp, Homo sapiens
tcctgcaccctctgct

SEQ ID NO: 467097 - DNA, 21 bp, Homo sapiens
tcctgcaccctctgctatgtc

SEQ ID NO: 467098 - DNA, 16 bp, Homo sapiens
tcctgcccatgtgtcc

SEQ ID NO: 467099 - DNA, 18 bp, Homo sapiens
tcctgcccatgtgtcccc

SEQ ID NO: 467100 - DNA, 19 bp, Homo sapiens
tcctgcccatgtgtcccct

SEQ ID NO: 467101 - DNA, 14 bp, Homo sapiens
tcctgcgggtttta

SEQ ID NO: 467102 - DNA, 16 bp, Homo sapiens
tcctgcgggttttaat

SEQ ID NO: 467103 - DNA, 21 bp, Homo sapiens
tcctgctgctcgggaaggcct

SEQ ID NO: 467104 - DNA, 21 bp, Homo sapiens
tcctggattttctttctatgt

SEQ ID NO: 467105 - DNA, 10 bp, Homo sapiens
tcctggccag

SEQ ID NO: 467106 - DNA, 15 bp, Homo sapiens
tcctgggggtggcag

SEQ ID NO: 467107 - DNA, 15 bp, Homo sapiens
tcctggtgtctagtt

SEQ ID NO: 467108 - DNA, 22 bp, Homo sapiens
tcctgtagtggcaaaaaagaac

SEQ ID NO: 467109 - DNA, 14 bp, Homo sapiens
tcctgtcctgctca

SEQ ID NO: 467110 - DNA, 14 bp, Homo sapiens
tccttcccgcagca

SEQ ID NO: 467111 - DNA, 22 bp, Homo sapiens
tccttcccgcagcaccagcctg

SEQ ID NO: 467112 - DNA, 18 bp, Homo sapiens
tccttctcccctccagac

SEQ ID NO: 467113 - DNA, 21 bp, Homo sapiens
tccttctcccctccagacccc

SEQ ID NO: 467114 - DNA, 12 bp, Homo sapiens
tccttgtacttg

SEQ ID NO: 467115 - DNA, 13 bp, Homo sapiens
tcctttcccacag

SEQ ID NO: 467116 - DNA, 15 bp, Homo sapiens
tccttttgtatcctc

SEQ ID NO: 467117 - DNA, 19 bp, Homo sapiens
tccttttttattgaataac

SEQ ID NO: 467118 - DNA, 15 bp, Homo sapiens
tcgactctgctgctc

SEQ ID NO: 467119 - DNA, 17 bp, Homo sapiens
tcgagagggctgagccc

SEQ ID NO: 467120 - DNA, 19 bp, Homo sapiens
tcgagagggctgagcccct

SEQ ID NO: 467121 - DNA, 18 bp, Homo sapiens
tcgagtccccccacccct

SEQ ID NO: 467122 - DNA, 15 bp, Homo sapiens
tcgcatccaccgcca

SEQ ID NO: 467123 - DNA, 20 bp, Homo sapiens
tcgcatccaccgccacccca

SEQ ID NO: 467124 - DNA, 22 bp, Homo sapiens
tctcccatgggggctccagaca

SEQ ID NO: 467125 - DNA, 13 bp, Homo sapiens
tctccccatatat

SEQ ID NO: 467126 - DNA, 21 bp, Homo sapiens
tctccccatatataaattatt

SEQ ID NO: 467127 - DNA, 22 bp, Homo sapiens
tctccccatgtgcctgcaccag

SEQ ID NO: 467128 - DNA, 19 bp, Homo sapiens
tctccccgcagccctctcc

SEQ ID NO: 467129 - DNA, 20 bp, Homo sapiens
tctccctaccctcttctcag

SEQ ID NO: 467130 - DNA, 18 bp, Homo sapiens
tctccctataccgagacc

SEQ ID NO: 467131 - DNA, 20 bp, Homo sapiens
tctccctataccgagaccca

SEQ ID NO: 467132 - DNA, 15 bp, Homo sapiens
tctccgggtgtggcc

SEQ ID NO: 467133 - DNA, 18 bp, Homo sapiens
tctccgggtgtggcctca

SEQ ID NO: 467134 - DNA, 17 bp, Homo sapiens
tctcctcgtccggcctg

SEQ ID NO: 467135 - DNA, 12 bp, Homo sapiens
tctcctctccca

SEQ ID NO: 467136 - DNA, 18 bp, Homo sapiens
tctcctctcccaaataaa

SEQ ID NO: 467137 - DNA, 16 bp, Homo sapiens
tctcctctctctccct

SEQ ID NO: 467138 - DNA, 14 bp, Homo sapiens
tctcctctgctcca

SEQ ID NO: 467139 - DNA, 16 bp, Homo sapiens
tctcctgagcctgtct

SEQ ID NO: 467140 - DNA, 18 bp, Homo sapiens
tctcctgagcctgtctct

SEQ ID NO: 467141 - DNA, 20 bp, Homo sapiens
tctcctgagcctgtctctcc

SEQ ID NO: 467142 - DNA, 12 bp, Homo sapiens
tctccttcactc

SEQ ID NO: 467143 - DNA, 12 bp, Homo sapiens
tctccttgtact

SEQ ID NO: 467144 - DNA, 13 bp, Homo sapiens
tctccttgtactt

SEQ ID NO: 467145 - DNA, 18 bp, Homo sapiens
tctcgagcccagatggaa

SEQ ID NO: 467146 - DNA, 23 bp, Homo sapiens
tctctaaaattctagtctctgat

SEQ ID NO: 467147 - DNA, 16 bp, Homo sapiens
tctctccccatatata

SEQ ID NO: 467148 - DNA, 19 bp, Homo sapiens
tctctccccatatataaat

SEQ ID NO: 467149 - DNA, 16 bp, Homo sapiens
tctctccctccactcc

SEQ ID NO: 467150 - DNA, 20 bp, Homo sapiens
tctctccctccactcctccc

SEQ ID NO: 467151 - DNA, 14 bp, Homo sapiens
tctctctctctctg

SEQ ID NO: 467152 - DNA, 12 bp, Homo sapiens
tctctctctctg

SEQ ID NO: 467153 - DNA, 14 bp, Homo sapiens
tgagctgcagcccc

SEQ ID NO: 467154 - DNA, 14 bp, Homo sapiens
tgagcttctcctct

SEQ ID NO: 467155 - DNA, 14 bp, Homo sapiens
tgaggaccgcccca

SEQ ID NO: 467156 - DNA, 15 bp, Homo sapiens
tgaggcccccggagg

SEQ ID NO: 467157 - DNA, 22 bp, Homo sapiens
tgaggcccccggaggcgcccac

SEQ ID NO: 467158 - DNA, 19 bp, Homo sapiens
tgaggcgtgggatccagag

SEQ ID NO: 467159 - DNA, 15 bp, Homo sapiens
tgagggaagcccacc

SEQ ID NO: 467160 - DNA, 16 bp, Homo sapiens
tgagggcagggttcta

SEQ ID NO: 467161 - DNA, 15 bp, Homo sapiens
tgaggggactgcatg

SEQ ID NO: 467162 - DNA, 19 bp, Homo sapiens
tgaggtacctttccaccca

SEQ ID NO: 467163 - DNA, 21 bp, Homo sapiens
tgagtaaataaactcttcaag

SEQ ID NO: 467164 - DNA, 14 bp, Homo sapiens
tgagtcggctgggc

SEQ ID NO: 467165 - DNA, 15 bp, Homo sapiens
tgagtcggctgggca

SEQ ID NO: 467166 - DNA, 20 bp, Homo sapiens
tgagtcggctgggcagggcc

SEQ ID NO: 467167 - DNA, 20 bp, Homo sapiens
tgagtgaatgagtaaataaa

SEQ ID NO: 467168 - DNA, 19 bp, Homo sapiens
tgagtttaaaaaaataaca

SEQ ID NO: 467169 - DNA, 17 bp, Homo sapiens
tgagtttccagctgctc

SEQ ID NO: 467170 - DNA, 14 bp, Homo sapiens
tgatacactgtatc

SEQ ID NO: 467171 - DNA, 22 bp, Homo sapiens
tgatactgaattgttatgtaaa

SEQ ID NO: 467172 - DNA, 14 bp, Homo sapiens
tgatatacagacct

SEQ ID NO: 467173 - DNA, 13 bp, Homo sapiens
tgatatgcatgta

SEQ ID NO: 467174 - DNA, 16 bp, Homo sapiens
tgatatgcatgtagca

SEQ ID NO: 467175 - DNA, 17 bp, Homo sapiens
tgatattgtatgtacct

SEQ ID NO: 467176 - DNA, 21 bp, Homo sapiens
tgatattttcaacgcagccct

SEQ ID NO: 467177 - DNA, 18 bp, Homo sapiens
tgatctggtgcgtgtggc

SEQ ID NO: 467178 - DNA, 16 bp, Homo sapiens
tgatggatatttttga

SEQ ID NO: 467179 - DNA, 23 bp, Homo sapiens
tgatggtagaaattttatctctt

SEQ ID NO: 467180 - DNA, 18 bp, Homo sapiens
tgattaaatttaatatac

SEQ ID NO: 467181 - DNA, 14 bp, Homo sapiens
tgattattgaatgt

SEQ ID NO: 467182 - DNA, 22 bp, Homo sapiens
tgattattgaatgttatatcat

SEQ ID NO: 467183 - DNA, 11 bp, Homo sapiens
tgattcaatgt

SEQ ID NO: 467184 - DNA, 19 bp, Homo sapiens
tgattcaatgtgaatttta

SEQ ID NO: 467185 - DNA, 15 bp, Homo sapiens
tgattctaaagggga

SEQ ID NO: 467186 - DNA, 16 bp, Homo sapiens
tgattctaaaggggac

SEQ ID NO: 467187 - DNA, 17 bp, Homo sapiens
tgattgaaaagaagaaa

SEQ ID NO: 467188 - DNA, 22 bp, Homo sapiens
tgattgaaaagaagaaagtcta

SEQ ID NO: 467189 - DNA, 23 bp, Homo sapiens
tgattggacattttcttcagaga

SEQ ID NO: 467190 - DNA, 19 bp, Homo sapiens
tgattggcagcttcaaaac

SEQ ID NO: 467191 - DNA, 14 bp, Homo sapiens
tgatttgatataca

SEQ ID NO: 467192 - DNA, 14 bp, Homo sapiens
tgcaaacatttctt

SEQ ID NO: 467193 - DNA, 18 bp, Homo sapiens
tgcaaatagtttcaaatg

SEQ ID NO: 467194 - DNA, 19 bp, Homo sapiens
tgcaaatagtttcaaatga

SEQ ID NO: 467195 - DNA, 21 bp, Homo sapiens
tgcaaatattgctattgttta

SEQ ID NO: 467196 - DNA, 17 bp, Homo sapiens
tgcaaatgcacatttgt

SEQ ID NO: 467197 - DNA, 16 bp, Homo sapiens
tgcaaattattctagt

SEQ ID NO: 467198 - DNA, 19 bp, Homo sapiens
tgcaaattattctagtcaa

SEQ ID NO: 467199 - DNA, 13 bp, Homo sapiens
tgcaacctcacta

SEQ ID NO: 467200 - DNA, 16 bp, Homo sapiens
tgcaacggaagccagg

SEQ ID NO: 467201 - DNA, 21 bp, Homo sapiens
tgcaagaaccagatcgtactt

SEQ ID NO: 467202 - DNA, 20 bp, Homo sapiens
tgcaataacagttttaagat

SEQ ID NO: 467203 - DNA, 17 bp, Homo sapiens
tgcacagtgcatctcag

SEQ ID NO: 467204 - DNA, 19 bp, Homo sapiens
tgcacagtgcatctcagcc

SEQ ID NO: 467205 - DNA, 17 bp, Homo sapiens
tgcaccaacctcactgc

SEQ ID NO: 467206 - DNA, 21 bp, Homo sapiens
tgcaccaacctcactgccctc

SEQ ID NO: 467207 - DNA, 13 bp, Homo sapiens
tgcaccaggagac

SEQ ID NO: 467208 - DNA, 14 bp, Homo sapiens
tgcaccaggagaca

SEQ ID NO: 467209 - DNA, 17 bp, Homo sapiens
tgcagacatattttctt

SEQ ID NO: 467210 - DNA, 11 bp, Homo sapiens
tgcagcccaga

SEQ ID NO: 467211 - DNA, 23 bp, Homo sapiens
tgcagcccagaacgggcctcccc

SEQ ID NO: 467212 - DNA, 12 bp, Homo sapiens
tgcagcctgagc

SEQ ID NO: 467213 - DNA, 19 bp, Homo sapiens
tgcagcctgagctccaccc

SEQ ID NO: 467214 - DNA, 20 bp, Homo sapiens
tgcagcctgagctccaccct

SEQ ID NO: 467215 - DNA, 19 bp, Homo sapiens
tgcaggaagagatgctcta

SEQ ID NO: 467216 - DNA, 18 bp, Homo sapiens
tgcaggcgcgcaccgccc

SEQ ID NO: 467217 - DNA, 22 bp, Homo sapiens
tgcagttaccccgatccgtttg

SEQ ID NO: 467218 - DNA, 13 bp, Homo sapiens
tgcataagattat

SEQ ID NO: 467219 - DNA, 12 bp, Homo sapiens
tgcatacaataa

SEQ ID NO: 467220 - DNA, 14 bp, Homo sapiens
tgcatacaataaaa

SEQ ID NO: 467221 - DNA, 19 bp, Homo sapiens
tgcatacaataaaagagct

SEQ ID NO: 467222 - DNA, 21 bp, Homo sapiens
tgcatacttcctggattttct

SEQ ID NO: 467223 - DNA, 19 bp, Homo sapiens
tgcatagacaaaggcctta

SEQ ID NO: 467224 - DNA, 16 bp, Homo sapiens
tgcatagacaagtgtt

SEQ ID NO: 467225 - DNA, 17 bp, Homo sapiens
tgcatagacaagtgttt

SEQ ID NO: 467226 - DNA, 21 bp, Homo sapiens
tgcatattagcatcatgtctt

SEQ ID NO: 467227 - DNA, 17 bp, Homo sapiens
tgcatcccttggcccct

SEQ ID NO: 467228 - DNA, 19 bp, Homo sapiens
tgcatcccttggcccctct

SEQ ID NO: 467229 - DNA, 20 bp, Homo sapiens
tgcatcccttggcccctctc

SEQ ID NO: 467230 - DNA, 14 bp, Homo sapiens
tgcatgatattgta

SEQ ID NO: 467231 - DNA, 16 bp, Homo sapiens
tgcatgatattgtatg

SEQ ID NO: 467232 - DNA, 17 bp, Homo sapiens
tgcatgatattgtatgt

SEQ ID NO: 467233 - DNA, 18 bp, Homo sapiens
tgcatgatattgtatgta

SEQ ID NO: 467234 - DNA, 21 bp, Homo sapiens
tgcatgatattgtatgtacct

SEQ ID NO: 467235 - DNA, 13 bp, Homo sapiens
tgcatgcaactaa

SEQ ID NO: 467236 - DNA, 17 bp, Homo sapiens
tgcatgtagcatataaa

SEQ ID NO: 467237 - DNA, 13 bp, Homo sapiens
tgcatttcctgac

SEQ ID NO: 467238 - DNA, 18 bp, Homo sapiens
tgcatttgagagaagcca

SEQ ID NO: 467239 - DNA, 14 bp, Homo sapiens
tgccacacttcagg

SEQ ID NO: 467240 - DNA, 23 bp, Homo sapiens
tgccagcttcccttttctcccaa

SEQ ID NO: 467241 - DNA, 20 bp, Homo sapiens
tgccagggcgcactttccac

SEQ ID NO: 467242 - DNA, 17 bp, Homo sapiens
tgccatgctcagaaatg

SEQ ID NO: 467243 - DNA, 13 bp, Homo sapiens
tgccatggatgat

SEQ ID NO: 467244 - DNA, 16 bp, Homo sapiens
tgccattttgtctggc

SEQ ID NO: 467245 - DNA, 18 bp, Homo sapiens
tgccattttgtctggctg

SEQ ID NO: 467246 - DNA, 22 bp, Homo sapiens
tgcccaagaatagatgctgact

SEQ ID NO: 467247 - DNA, 23 bp, Homo sapiens
tgcccaagaatagatgctgactg

SEQ ID NO: 467248 - DNA, 21 bp, Homo sapiens
tgcttggatccatacaaaact

SEQ ID NO: 467249 - DNA, 17 bp, Homo sapiens
tgctttaaagtacctgt

SEQ ID NO: 467250 - DNA, 19 bp, Homo sapiens
tgctttcatccaactggaa

SEQ ID NO: 467251 - DNA, 21 bp, Homo sapiens
tgctttgggctgccctggtgc

SEQ ID NO: 467252 - DNA, 16 bp, Homo sapiens
tgctttgtgtgattga

SEQ ID NO: 467253 - DNA, 13 bp, Homo sapiens
tggaaaaaatatt

SEQ ID NO: 467254 - DNA, 16 bp, Homo sapiens
tggaaaaaatatttta

SEQ ID NO: 467255 - DNA, 21 bp, Homo sapiens
tggaaagggtgtggcttggaa

SEQ ID NO: 467256 - DNA, 23 bp, Homo sapiens
tggaagcactgccattagactga

SEQ ID NO: 467257 - DNA, 20 bp, Homo sapiens
tggaagggcgctgagggcag

SEQ ID NO: 467258 - DNA, 15 bp, Homo sapiens
tggactgcgctggac

SEQ ID NO: 467259 - DNA, 16 bp, Homo sapiens
tggactggtggcccct

SEQ ID NO: 467260 - DNA, 20 bp, Homo sapiens
tggactttatttaatttcat

SEQ ID NO: 467261 - DNA, 21 bp, Homo sapiens
tggactttatttaatttcata

SEQ ID NO: 467262 - DNA, 14 bp, Homo sapiens
tggagaactagaga

SEQ ID NO: 467263 - DNA, 17 bp, Homo sapiens
tggagactgtctcaaga

SEQ ID NO: 467264 - DNA, 13 bp, Homo sapiens
tggagaggcggcc

SEQ ID NO: 467265 - DNA, 15 bp, Homo sapiens
tggagaggcggcctc

SEQ ID NO: 467266 - DNA, 17 bp, Homo sapiens
tggagaggggacttgga

SEQ ID NO: 467267 - DNA, 15 bp, Homo sapiens
tggagcccctatcct

SEQ ID NO: 467268 - DNA, 21 bp, Homo sapiens
tggaggccaccaagctgctct

SEQ ID NO: 467269 - DNA, 16 bp, Homo sapiens
tggaggggtcagcagg

SEQ ID NO: 467270 - DNA, 14 bp, Homo sapiens
tggaggttgaatag

SEQ ID NO: 467271 - DNA, 21 bp, Homo sapiens
tggagtctgaaggagaggagt

SEQ ID NO: 467272 - DNA, 14 bp, Homo sapiens
tggagtcttcctgt

SEQ ID NO: 467273 - DNA, 17 bp, Homo sapiens
tggatatgaaagagaaa

SEQ ID NO: 467274 - DNA, 20 bp, Homo sapiens
tggatatgaaagagaaaatg

SEQ ID NO: 467275 - DNA, 18 bp, Homo sapiens
tggatccatacaaaacta

SEQ ID NO: 467276 - DNA, 12 bp, Homo sapiens
tggatctggagt

SEQ ID NO: 467277 - DNA, 18 bp, Homo sapiens
tggatctggagtctgaag

SEQ ID NO: 467278 - DNA, 20 bp, Homo sapiens
tggatgactcggtctgagaa

SEQ ID NO: 467279 - DNA, 12 bp, Homo sapiens
tggattcacttc

SEQ ID NO: 467280 - DNA, 21 bp, Homo sapiens
tggattctatatttcatattg

SEQ ID NO: 467281 - DNA, 21 bp, Homo sapiens
tggattttctttctatgtaga

SEQ ID NO: 467282 - DNA, 13 bp, Homo sapiens
tggcaaacattta

SEQ ID NO: 467283 - DNA, 18 bp, Homo sapiens
tggcagccgtgccttcag

SEQ ID NO: 467284 - DNA, 19 bp, Homo sapiens
tggcagccgtgccttcagc

SEQ ID NO: 467285 - DNA, 22 bp, Homo sapiens
tggcagccgtgccttcagctct

SEQ ID NO: 467286 - DNA, 14 bp, Homo sapiens
tggcagcgcctccc

SEQ ID NO: 467287 - DNA, 15 bp, Homo sapiens
tggcagcgcctcccg

SEQ ID NO: 467288 - DNA, 17 bp, Homo sapiens
tggcagcgcctcccgcc

SEQ ID NO: 467289 - DNA, 22 bp, Homo sapiens
tggcagcgcctcccgccgcctc

SEQ ID NO: 467290 - DNA, 14 bp, Homo sapiens
tggcagcttcaaaa

SEQ ID NO: 467291 - DNA, 15 bp, Homo sapiens
tggcagcttcaaaac

SEQ ID NO: 467292 - DNA, 20 bp, Homo sapiens
tggcaggcacacagcagccc

SEQ ID NO: 467293 - DNA, 21 bp, Homo sapiens
tggcatagagcagcactaaat

SEQ ID NO: 467294 - DNA, 21 bp, Homo sapiens
tggcatctctccccatatata

SEQ ID NO: 467295 - DNA, 23 bp, Homo sapiens
tggcatctctccccatatataaa

SEQ ID NO: 467296 - DNA, 17 bp, Homo sapiens
tggccactccagacccc

SEQ ID NO: 467297 - DNA, 22 bp, Homo sapiens
tggccactccagacccctggct

SEQ ID NO: 467298 - DNA, 19 bp, Homo sapiens
tggccaggtggccactcca

SEQ ID NO: 467299 - DNA, 14 bp, Homo sapiens
tggccatccctggg

SEQ ID NO: 467300 - DNA, 16 bp, Homo sapiens
tggccatccctgggcc

SEQ ID NO: 467301 - DNA, 20 bp, Homo sapiens
tggccatccctgggcccctc

SEQ ID NO: 467302 - DNA, 22 bp, Homo sapiens
tggccatccctgggcccctcca

SEQ ID NO: 467303 - DNA, 13 bp, Homo sapiens
tggcccacccctc

SEQ ID NO: 467304 - DNA, 14 bp, Homo sapiens
tggcccacccctct

SEQ ID NO: 467305 - DNA, 17 bp, Homo sapiens
tggcccacccctcttcc

SEQ ID NO: 467306 - DNA, 23 bp, Homo sapiens
tggcccacccctcttcccccttc

SEQ ID NO: 467307 - DNA, 19 bp, Homo sapiens
tggccccagctggctgggt

SEQ ID NO: 467308 - DNA, 17 bp, Homo sapiens
tggcccctccttctccc

SEQ ID NO: 467309 - DNA, 20 bp, Homo sapiens
tggcccctccttctcccctc

SEQ ID NO: 467310 - DNA, 23 bp, Homo sapiens
tggcccctctctgtttaccctcc

SEQ ID NO: 467311 - DNA, 14 bp, Homo sapiens
tggcccctgccttg

SEQ ID NO: 467312 - DNA, 14 bp, Homo sapiens
tggcccgacagcct

SEQ ID NO: 467313 - DNA, 18 bp, Homo sapiens
tggcccgacagcctggca

SEQ ID NO: 467314 - DNA, 19 bp, Homo sapiens
tggcccgacagcctggcac

SEQ ID NO: 467315 - DNA, 15 bp, Homo sapiens
tggccctgccctccc

SEQ ID NO: 467316 - DNA, 20 bp, Homo sapiens
tggccctgtgggagtccact

SEQ ID NO: 467317 - DNA, 13 bp, Homo sapiens
tggccggctggcc

SEQ ID NO: 467318 - DNA, 14 bp, Homo sapiens
tggccggctggccg

SEQ ID NO: 467319 - DNA, 15 bp, Homo sapiens
tggccggtccacccc

SEQ ID NO: 467320 - DNA, 13 bp, Homo sapiens
tggcctcagccct

SEQ ID NO: 467321 - DNA, 17 bp, Homo sapiens
tggcctcagccctcaga

SEQ ID NO: 467322 - DNA, 15 bp, Homo sapiens
tggcctctgtgccat

SEQ ID NO: 467323 - DNA, 22 bp, Homo sapiens
tggcctgtccacctgtgctgct

SEQ ID NO: 467324 - DNA, 18 bp, Homo sapiens
tggccttggttcctccag

SEQ ID NO: 467325 - DNA, 14 bp, Homo sapiens
tggcgggcagcccc

SEQ ID NO: 467326 - DNA, 16 bp, Homo sapiens
tggcgggcagcccctg

SEQ ID NO: 467327 - DNA, 18 bp, Homo sapiens
tggcgggcagcccctgct

SEQ ID NO: 467328 - DNA, 17 bp, Homo sapiens
tggctcccacaggccct

SEQ ID NO: 467329 - DNA, 16 bp, Homo sapiens
tggctcctcccggtgc

SEQ ID NO: 467330 - DNA, 18 bp, Homo sapiens
tggctcctttcccacagt

SEQ ID NO: 467331 - DNA, 14 bp, Homo sapiens
tggctctgttgctg

SEQ ID NO: 467332 - DNA, 22 bp, Homo sapiens
tggctctgttgctgtcctccag

SEQ ID NO: 467333 - DNA, 21 bp, Homo sapiens
tggctgcagatgactggaaac

SEQ ID NO: 467334 - DNA, 17 bp, Homo sapiens
tggctgggtttgggcag

SEQ ID NO: 467335 - DNA, 18 bp, Homo sapiens
tggcttagcgttctgttt

SEQ ID NO: 467336 - DNA, 16 bp, Homo sapiens
tggcttcccgctcagc

SEQ ID NO: 467337 - DNA, 22 bp, Homo sapiens
tggcttgtagggtgaggcgtgg

SEQ ID NO: 467338 - DNA, 18 bp, Homo sapiens
tggcttttcactgctggc

SEQ ID NO: 467339 - DNA, 19 bp, Homo sapiens
tggcttttcactgctggct

SEQ ID NO: 467340 - DNA, 15 bp, Homo sapiens
tgggaaattcttgca

SEQ ID NO: 467341 - DNA, 15 bp, Homo sapiens
tgggacggaagtggc

SEQ ID NO: 467342 - DNA, 16 bp, Homo sapiens
tgggactggcccaccc

SEQ ID NO: 467343 - DNA, 18 bp, Homo sapiens
tgggactggcccacccct

SEQ ID NO: 467344 - DNA, 23 bp, Homo sapiens
tgggagaacctcgttgacatgca

SEQ ID NO: 467345 - DNA, 14 bp, Homo sapiens
tgggagtccacttt

SEQ ID NO: 467346 - DNA, 16 bp, Homo sapiens
tgggagtccactttcc

SEQ ID NO: 467347 - DNA, 19 bp, Homo sapiens
tgggagtccactttcctct

SEQ ID NO: 467348 - DNA, 20 bp, Homo sapiens
tgggagtccactttcctctc

SEQ ID NO: 467349 - DNA, 21 bp, Homo sapiens
tgggagtccactttcctctct

SEQ ID NO: 467350 - DNA, 23 bp, Homo sapiens
tgggagtccactttcctctctct

SEQ ID NO: 467351 - DNA, 17 bp, Homo sapiens
tgggatccagagagaag

SEQ ID NO: 467352 - DNA, 19 bp, Homo sapiens
tgggatccagagagaagca

SEQ ID NO: 467353 - DNA, 14 bp, Homo sapiens
tgggattcaggaat

SEQ ID NO: 467354 - DNA, 18 bp, Homo sapiens
tgggcacgggagagcgcc

SEQ ID NO: 467355 - DNA, 12 bp, Homo sapiens
tgggcagcaccc

SEQ ID NO: 467356 - DNA, 15 bp, Homo sapiens
tgggcagcaccctcc

SEQ ID NO: 467357 - DNA, 17 bp, Homo sapiens
tgggcagcaccctcccc

SEQ ID NO: 467358 - DNA, 22 bp, Homo sapiens
tgggcagcaccctcccccgcag

SEQ ID NO: 467359 - DNA, 13 bp, Homo sapiens
tgggcagggccgc

SEQ ID NO: 467360 - DNA, 18 bp, Homo sapiens
tgggcagggccgcagggc

SEQ ID NO: 467361 - DNA, 21 bp, Homo sapiens
tgggcagggccgcagggcgct

SEQ ID NO: 467362 - DNA, 22 bp, Homo sapiens
tgggcagggccgcagggcgctc

SEQ ID NO: 467363 - DNA, 13 bp, Homo sapiens
tgggccaagccag

SEQ ID NO: 467364 - DNA, 12 bp, Homo sapiens
tgggcccagccg

SEQ ID NO: 467365 - DNA, 16 bp, Homo sapiens
tgggcccagccggggt

SEQ ID NO: 467366 - DNA, 18 bp, Homo sapiens
tgggcccctccacgcctc

SEQ ID NO: 467367 - DNA, 13 bp, Homo sapiens
tgggcccctggga

SEQ ID NO: 467368 - DNA, 20 bp, Homo sapiens
tgggcctcagttcaacctgg

SEQ ID NO: 467369 - DNA, 11 bp, Homo sapiens
tgggctccaga

SEQ ID NO: 467370 - DNA, 21 bp, Homo sapiens
tgggctgccctggtgctgcca

SEQ ID NO: 467371 - DNA, 14 bp, Homo sapiens
tgggctgtctgtca

SEQ ID NO: 467372 - DNA, 15 bp, Homo sapiens
tggggcccatggccc

SEQ ID NO: 467373 - DNA, 18 bp, Homo sapiens
tggggcccatggccccag

SEQ ID NO: 467374 - DNA, 23 bp, Homo sapiens
tggggcccatggccccagctggc

SEQ ID NO: 467375 - DNA, 18 bp, Homo sapiens
tggggccctgggcctcag

SEQ ID NO: 467376 - DNA, 13 bp, Homo sapiens
tggggcctggcct

SEQ ID NO: 467377 - DNA, 15 bp, Homo sapiens
tggggcctggcctat

SEQ ID NO: 467378 - DNA, 23 bp, Homo sapiens
tggggcctggcctatttaagccc

SEQ ID NO: 467379 - DNA, 21 bp, Homo sapiens
tggggcttagaatggggcttc

SEQ ID NO: 467380 - DNA, 14 bp, Homo sapiens
tggggcttatcaga

SEQ ID NO: 467381 - DNA, 19 bp, Homo sapiens
tgggggattcaaatgcatg

SEQ ID NO: 467382 - DNA, 14 bp, Homo sapiens
tggggggccgggca

SEQ ID NO: 467383 - DNA, 14 bp, Homo sapiens
tgggggggcttggg

SEQ ID NO: 467384 - DNA, 18 bp, Homo sapiens
tggggggttgcctcgagt

SEQ ID NO: 467385 - DNA, 13 bp, Homo sapiens
tgggggtgcctgg

SEQ ID NO: 467386 - DNA, 14 bp, Homo sapiens
tgggggtgcctggt

SEQ ID NO: 467387 - DNA, 16 bp, Homo sapiens
tgggggtggcaggcac

SEQ ID NO: 467388 - DNA, 16 bp, Homo sapiens
tggggtggggcttgga

SEQ ID NO: 467389 - DNA, 13 bp, Homo sapiens
tgggtattaaact

SEQ ID NO: 467390 - DNA, 13 bp, Homo sapiens
tgggtcctgctgc

SEQ ID NO: 467391 - DNA, 14 bp, Homo sapiens
tgggtcctgctgct

SEQ ID NO: 467392 - DNA, 15 bp, Homo sapiens
tgggtcctgctgctc

SEQ ID NO: 467393 - DNA, 16 bp, Homo sapiens
tgggtcctgctgctcg

SEQ ID NO: 467394 - DNA, 14 bp, Homo sapiens
tgggttccagacag

SEQ ID NO: 467395 - DNA, 20 bp, Homo sapiens
tgggttccagacagagtgga

SEQ ID NO: 467396 - DNA, 21 bp, Homo sapiens
tgggttgttgcagagtaaatc

SEQ ID NO: 467397 - DNA, 20 bp, Homo sapiens
tgggtttgggcagtggagag

SEQ ID NO: 467398 - DNA, 23 bp, Homo sapiens
tgggtttttaaaaaaaatattct

SEQ ID NO: 467399 - DNA, 14 bp, Homo sapiens
tggtatgctggcca

SEQ ID NO: 467400 - DNA, 15 bp, Homo sapiens
tggtatgctggccag

SEQ ID NO: 467401 - DNA, 16 bp, Homo sapiens
tggtatgctggccagc

SEQ ID NO: 467402 - DNA, 21 bp, Homo sapiens
tggtatgctggccagcaccct

SEQ ID NO: 467403 - DNA, 22 bp, Homo sapiens
tggtatgctggccagcaccctc

SEQ ID NO: 467404 - DNA, 20 bp, Homo sapiens
tggtattcaactaatacatg

SEQ ID NO: 467405 - DNA, 17 bp, Homo sapiens
tggtcttggagaggagg

SEQ ID NO: 467406 - DNA, 15 bp, Homo sapiens
tggtgcgctgtgctc

SEQ ID NO: 467407 - DNA, 21 bp, Homo sapiens
tggtgcgctgtgctccagcag

SEQ ID NO: 467408 - DNA, 21 bp, Homo sapiens
tggtggcccgacagcctggca

SEQ ID NO: 467409 - DNA, 14 bp, Homo sapiens
tggtgggctccaga

SEQ ID NO: 467410 - DNA, 15 bp, Homo sapiens
tggtgggctccagag

SEQ ID NO: 467411 - DNA, 16 bp, Homo sapiens
tggtgggctccagagt

SEQ ID NO: 467412 - DNA, 19 bp, Homo sapiens
tggtgggctccagagtagg

SEQ ID NO: 467413 - DNA, 17 bp, Homo sapiens
tggtggtttcagaaagg

SEQ ID NO: 467414 - DNA, 19 bp, Homo sapiens
tggtgttgttatggcaagt

SEQ ID NO: 467415 - DNA, 23 bp, Homo sapiens
tggttcccctgttcactctactt

SEQ ID NO: 467416 - DNA, 14 bp, Homo sapiens
tggttcctccagca

SEQ ID NO: 467417 - DNA, 17 bp, Homo sapiens
tggttcgggggaaatag

SEQ ID NO: 467418 - DNA, 22 bp, Homo sapiens
tggttggaggcctggtctggag

SEQ ID NO: 467419 - DNA, 14 bp, Homo sapiens
tggtttatactgta

SEQ ID NO: 467420 - DNA, 15 bp, Homo sapiens
tggtttatactgtat

SEQ ID NO: 467421 - DNA, 14 bp, Homo sapiens
tggtttcagaaagg

SEQ ID NO: 467422 - DNA, 20 bp, Homo sapiens
tggtttttgctctactttat

SEQ ID NO: 467423 - DNA, 13 bp, Homo sapiens
tgtaaaattcata

SEQ ID NO: 467424 - DNA, 14 bp, Homo sapiens
tgtaaataatgctt

SEQ ID NO: 467425 - DNA, 18 bp, Homo sapiens
tgtaaatttaactgcata

SEQ ID NO: 467426 - DNA, 14 bp, Homo sapiens
tgtaagaagaaact

SEQ ID NO: 467427 - DNA, 15 bp, Homo sapiens
tgtaagaagaaactg

SEQ ID NO: 467428 - DNA, 16 bp, Homo sapiens
tgtaaggtttcaatgc

SEQ ID NO: 467429 - DNA, 17 bp, Homo sapiens
tgtaatcacactctctt

SEQ ID NO: 467430 - DNA, 19 bp, Homo sapiens
tgtaatcacactctcttct

SEQ ID NO: 467431 - DNA, 12 bp, Homo sapiens
tgtaatcttaaa

SEQ ID NO: 467432 - DNA, 21 bp, Homo sapiens
tgtacagaaccagcactccca

SEQ ID NO: 467433 - DNA, 22 bp, Homo sapiens
tgtacagaaccagcactcccag

SEQ ID NO: 467434 - DNA, 23 bp, Homo sapiens
tgtacagaaccagcactcccagg

SEQ ID NO: 467435 - DNA, 24 bp, Homo sapiens
tgtacagaaccagcactcccaggg

SEQ ID NO: 467436 - DNA, 12 bp, Homo sapiens
tcttgcactgta

SEQ ID NO: 467437 - DNA, 17 bp, Homo sapiens
tcttgcggcaccgccca

SEQ ID NO: 467438 - DNA, 14 bp, Homo sapiens
tcttgctttcacaa

SEQ ID NO: 467439 - DNA, 16 bp, Homo sapiens
tcttggtgactgtccc

SEQ ID NO: 467440 - DNA, 22 bp, Homo sapiens
tcttgtaaataatgcttaacat

SEQ ID NO: 467441 - DNA, 18 bp, Homo sapiens
tcttgttttttttttcca

SEQ ID NO: 467442 - DNA, 21 bp, Homo sapiens
tcttgttttttttttccactt

SEQ ID NO: 467443 - DNA, 19 bp, Homo sapiens
tctttaacatacatctaag

SEQ ID NO: 467444 - DNA, 12 bp, Homo sapiens
tctttctatgta

SEQ ID NO: 467445 - DNA, 12 bp, Homo sapiens
tctttctctctg

SEQ ID NO: 467446 - DNA, 19 bp, Homo sapiens
tctttgggggattcaaatg

SEQ ID NO: 467447 - DNA, 14 bp, Homo sapiens
tcttttatatctgt

SEQ ID NO: 467448 - DNA, 15 bp, Homo sapiens
tcttttatatctgta

SEQ ID NO: 467449 - DNA, 16 bp, Homo sapiens
tcttttcagcttgttt

SEQ ID NO: 467450 - DNA, 21 bp, Homo sapiens
tcttttcagcttgtttctata

SEQ ID NO: 467451 - DNA, 24 bp, Homo sapiens
tcttttcagcttgtttctatactg

SEQ ID NO: 467452 - DNA, 19 bp, Homo sapiens
tcttttcccatcaccagaa

SEQ ID NO: 467453 - DNA, 13 bp, Homo sapiens
tcttttttcaatg

SEQ ID NO: 467454 - DNA, 18 bp, Homo sapiens
tgaaaaaaagggaaaaca

SEQ ID NO: 467455 - DNA, 14 bp, Homo sapiens
tgaaaactggatta

SEQ ID NO: 467456 - DNA, 21 bp, Homo sapiens
tgaaaactggattatctacta

SEQ ID NO: 467457 - DNA, 21 bp, Homo sapiens
tgaaaagaagaaagtctatgc

SEQ ID NO: 467458 - DNA, 17 bp, Homo sapiens
tgaaactatagaataaa

SEQ ID NO: 467459 - DNA, 22 bp, Homo sapiens
tgaaactatagtggccacactc

SEQ ID NO: 467460 - DNA, 15 bp, Homo sapiens
tgaaagacagtaaag

SEQ ID NO: 467461 - DNA, 17 bp, Homo sapiens
tgaaagagaaaatgctt

SEQ ID NO: 467462 - DNA, 21 bp, Homo sapiens
tgaaagagaaaatgctttctc

SEQ ID NO: 467463 - DNA, 12 bp, Homo sapiens
tgaaataaaact

SEQ ID NO: 467464 - DNA, 21 bp, Homo sapiens
tgaaatccaaaatagtcatgt

SEQ ID NO: 467465 - DNA, 22 bp, Homo sapiens
tgaaatccaaaatagtcatgtt

SEQ ID NO: 467466 - DNA, 12 bp, Homo sapiens
tgaaatctacaa

SEQ ID NO: 467467 - DNA, 23 bp, Homo sapiens
tgaaatctacaacataatgatac

SEQ ID NO: 467468 - DNA, 16 bp, Homo sapiens
tgaaattggaaaggac

SEQ ID NO: 467469 - DNA, 16 bp, Homo sapiens
tgaaccgtcaatgtga

SEQ ID NO: 467470 - DNA, 17 bp, Homo sapiens
tgaaccgtcaatgtgaa

SEQ ID NO: 467471 - DNA, 21 bp, Homo sapiens
tgaagagcgctcctctgcctt

SEQ ID NO: 467472 - DNA, 22 bp, Homo sapiens
tgaagagcgctcctctgccttg

SEQ ID NO: 467473 - DNA, 14 bp, Homo sapiens
tgaagcccaggagg

SEQ ID NO: 467474 - DNA, 13 bp, Homo sapiens
tgaagggaaatca

SEQ ID NO: 467475 - DNA, 16 bp, Homo sapiens
tgaagtcactgcacag

SEQ ID NO: 467476 - DNA, 21 bp, Homo sapiens
tgaagtcactgcacagtgcat

SEQ ID NO: 467477 - DNA, 18 bp, Homo sapiens
tgaagtcccttcctgtcc

SEQ ID NO: 467478 - DNA, 20 bp, Homo sapiens
tgaataacataggtgctctt

SEQ ID NO: 467479 - DNA, 22 bp, Homo sapiens
tgaataataaccacgattccaa

SEQ ID NO: 467480 - DNA, 13 bp, Homo sapiens
tgaataatttctt

SEQ ID NO: 467481 - DNA, 16 bp, Homo sapiens
tgaatccacctgcagt

SEQ ID NO: 467482 - DNA, 18 bp, Homo sapiens
tgaatccacctgcagtta

SEQ ID NO: 467483 - DNA, 18 bp, Homo sapiens
tgaatgaaccatgaatga

SEQ ID NO: 467484 - DNA, 21 bp, Homo sapiens
tgaatgagtaaataaactctt

SEQ ID NO: 467485 - DNA, 22 bp, Homo sapiens
tgaatgagtaaataaactcttc

SEQ ID NO: 467486 - DNA, 20 bp, Homo sapiens
tgaatgtccccattctataa

SEQ ID NO: 467487 - DNA, 21 bp, Homo sapiens
tgaattatccacatgaaaata

SEQ ID NO: 467488 - DNA, 13 bp, Homo sapiens
tgaattcataaaa

SEQ ID NO: 467489 - DNA, 15 bp, Homo sapiens
tgaattcataaaaat

SEQ ID NO: 467490 - DNA, 19 bp, Homo sapiens
tgaattcataaaaataacc

SEQ ID NO: 467491 - DNA, 15 bp, Homo sapiens
tgaatttctggtttg

SEQ ID NO: 467492 - DNA, 17 bp, Homo sapiens
tgacaatttcaaaatgc

SEQ ID NO: 467493 - DNA, 19 bp, Homo sapiens
tgacaggaaagccctcccc

SEQ ID NO: 467494 - DNA, 23 bp, Homo sapiens
tgacagtattaacatcaaagact

SEQ ID NO: 467495 - DNA, 19 bp, Homo sapiens
tgaccccacacgccggggc

SEQ ID NO: 467496 - DNA, 19 bp, Homo sapiens
tgaccccacttatgctgct

SEQ ID NO: 467497 - DNA, 21 bp, Homo sapiens
tgaccccacttatgctgctgt

SEQ ID NO: 467498 - DNA, 18 bp, Homo sapiens
tgaccggcccgccacctt

SEQ ID NO: 467499 - DNA, 19 bp, Homo sapiens
tgaccggcccgccaccttg

SEQ ID NO: 467500 - DNA, 18 bp, Homo sapiens
tgacctaaatccattttc

SEQ ID NO: 467501 - DNA, 19 bp, Homo sapiens
tgacctaaatccattttct

SEQ ID NO: 467502 - DNA, 14 bp, Homo sapiens
tgacctttatttat

SEQ ID NO: 467503 - DNA, 16 bp, Homo sapiens
tgacctttatttatta

SEQ ID NO: 467504 - DNA, 19 bp, Homo sapiens
tgacgacctacatctgaaa

SEQ ID NO: 467505 - DNA, 14 bp, Homo sapiens
tgacgatcttcccc

SEQ ID NO: 467506 - DNA, 15 bp, Homo sapiens
tgacgatcttccccc

SEQ ID NO: 467507 - DNA, 17 bp, Homo sapiens
tgtacagatatcgagag

SEQ ID NO: 467508 - DNA, 16 bp, Homo sapiens
tgtacttcagttctca

SEQ ID NO: 467509 - DNA, 18 bp, Homo sapiens
tgtacttcagttctcatc

SEQ ID NO: 467510 - DNA, 16 bp, Homo sapiens
tgtacttgaataataa

SEQ ID NO: 467511 - DNA, 18 bp, Homo sapiens
tgtagaactgttcatttc

SEQ ID NO: 467512 - DNA, 17 bp, Homo sapiens
tgtagcatttcttgatg

SEQ ID NO: 467513 - DNA, 16 bp, Homo sapiens
tgtagctagaatatcc

SEQ ID NO: 467514 - DNA, 17 bp, Homo sapiens
tgtagtgagaaactgat

SEQ ID NO: 467515 - DNA, 21 bp, Homo sapiens
tgtagtggcaaaaaagaacag

SEQ ID NO: 467516 - DNA, 19 bp, Homo sapiens
tgtatatcagctctaaagc

SEQ ID NO: 467517 - DNA, 22 bp, Homo sapiens
tgtatatcagctctaaagcaga

SEQ ID NO: 467518 - DNA, 18 bp, Homo sapiens
tgtatctaaaaaataact

SEQ ID NO: 467519 - DNA, 21 bp, Homo sapiens
tgtatctaaaaaataactgtg

SEQ ID NO: 467520 - DNA, 23 bp, Homo sapiens
tgtatctaaaaaataactgtgca

SEQ ID NO: 467521 - DNA, 15 bp, Homo sapiens
tgtatttccaacaaa

SEQ ID NO: 467522 - DNA, 13 bp, Homo sapiens
tgtattttaataa

SEQ ID NO: 467523 - DNA, 16 bp, Homo sapiens
tgtattttaataaaga

SEQ ID NO: 467524 - DNA, 19 bp, Homo sapiens
tgtattttcttttatatct

SEQ ID NO: 467525 - DNA, 20 bp, Homo sapiens
tgtattttcttttatatctg

SEQ ID NO: 467526 - DNA, 22 bp, Homo sapiens
tgtcaacttcagttgaaaagag

SEQ ID NO: 467527 - DNA, 13 bp, Homo sapiens
tgtcactcacaaa

SEQ ID NO: 467528 - DNA, 13 bp, Homo sapiens
tgtcagccagccg

SEQ ID NO: 467529 - DNA, 17 bp, Homo sapiens
tgtcagccagccgccct

SEQ ID NO: 467530 - DNA, 22 bp, Homo sapiens
tgtcagccagccgccctgggct

SEQ ID NO: 467531 - DNA, 13 bp, Homo sapiens
tgtcatactctgt

SEQ ID NO: 467532 - DNA, 14 bp, Homo sapiens
tgtcatctctctgg

SEQ ID NO: 467533 - DNA, 22 bp, Homo sapiens
tgtcatctctctggggccctgg

SEQ ID NO: 467534 - DNA, 23 bp, Homo sapiens
tgtcatctctctggggccctggg

SEQ ID NO: 467535 - DNA, 20 bp, Homo sapiens
tgtcattcaagcctgtgaat

SEQ ID NO: 467536 - DNA, 22 bp, Homo sapiens
tgtcattggttacaaattttta

SEQ ID NO: 467537 - DNA, 15 bp, Homo sapiens
tgtcccacaaaatat

SEQ ID NO: 467538 - DNA, 16 bp, Homo sapiens
tgtcccaccgggagcc

SEQ ID NO: 467539 - DNA, 22 bp, Homo sapiens
tgtccccagttaatgtgccaaa

SEQ ID NO: 467540 - DNA, 15 bp, Homo sapiens
tgtcccctcactctg

SEQ ID NO: 467541 - DNA, 16 bp, Homo sapiens
tgtcccctcactctgt

SEQ ID NO: 467542 - DNA, 15 bp, Homo sapiens
tgtcccttacctggc

SEQ ID NO: 467543 - DNA, 20 bp, Homo sapiens
tgtcctctcgagcccagatg

SEQ ID NO: 467544 - DNA, 15 bp, Homo sapiens
tgtcgccccaggccc

SEQ ID NO: 467545 - DNA, 17 bp, Homo sapiens
tgtcgccccaggccctc

SEQ ID NO: 467546 - DNA, 13 bp, Homo sapiens
tgtctactgcttg

SEQ ID NO: 467547 - DNA, 14 bp, Homo sapiens
tgtctccagctgat

SEQ ID NO: 467548 - DNA, 16 bp, Homo sapiens
tgtctgaagtcactgc

SEQ ID NO: 467549 - DNA, 16 bp, Homo sapiens
tgtctgagccctgccc

SEQ ID NO: 467550 - DNA, 14 bp, Homo sapiens
tgtctgattctatg

SEQ ID NO: 467551 - DNA, 16 bp, Homo sapiens
tgtctgattctatgcc

SEQ ID NO: 467552 - DNA, 15 bp, Homo sapiens
tgtctggctgtggcc

SEQ ID NO: 467553 - DNA, 11 bp, Homo sapiens
tgtctgtcacc

SEQ ID NO: 467554 - DNA, 21 bp, Homo sapiens
tgtctgtcaccagctatctgt

SEQ ID NO: 467555 - DNA, 14 bp, Homo sapiens
tgtcttgagatgta

SEQ ID NO: 467556 - DNA, 12 bp, Homo sapiens
tgtctttgctgt

SEQ ID NO: 467557 - DNA, 21 bp, Homo sapiens
tgtctttgctgtttatatata

SEQ ID NO: 467558 - DNA, 13 bp, Homo sapiens
tgtgaaataaaga

SEQ ID NO: 467559 - DNA, 15 bp, Homo sapiens
tgtgattgaatctga

SEQ ID NO: 467560 - DNA, 23 bp, Homo sapiens
tgtgattggcagcttcaaaacag

SEQ ID NO: 467561 - DNA, 13 bp, Homo sapiens
tgtgcaatatgag

SEQ ID NO: 467562 - DNA, 22 bp, Homo sapiens
tgtgcaatatgaggggactgca

SEQ ID NO: 467563 - DNA, 14 bp, Homo sapiens
tgtgccaaagatag

SEQ ID NO: 467564 - DNA, 19 bp, Homo sapiens
tgtgccaaagatagcagaa

SEQ ID NO: 467565 - DNA, 14 bp, Homo sapiens
tgtgcctgcaccag

SEQ ID NO: 467566 - DNA, 18 bp, Homo sapiens
tgtgcctgcaccaggaga

SEQ ID NO: 467567 - DNA, 16 bp, Homo sapiens
tgtgctaagttgtctt

SEQ ID NO: 467568 - DNA, 15 bp, Homo sapiens
tgtgctgtgggcagc

SEQ ID NO: 467569 - DNA, 17 bp, Homo sapiens
tgtgctgtgggcagcac

SEQ ID NO: 467570 - DNA, 16 bp, Homo sapiens
tgtgcttgttcttcct

SEQ ID NO: 467571 - DNA, 12 bp, Homo sapiens
tgtgcttttcca

SEQ ID NO: 467572 - DNA, 20 bp, Homo sapiens
tgtggacaatgagtggaata

SEQ ID NO: 467573 - DNA, 12 bp, Homo sapiens
tgtggagtggag

SEQ ID NO: 467574 - DNA, 13 bp, Homo sapiens
tgtggagtggagg

SEQ ID NO: 467575 - DNA, 14 bp, Homo sapiens
tgtggatgaaaaaa

SEQ ID NO: 467576 - DNA, 16 bp, Homo sapiens
tgtggatgaaaaaaag

SEQ ID NO: 467577 - DNA, 21 bp, Homo sapiens
tgtggatgaaaaaaagggaaa

SEQ ID NO: 467578 - DNA, 21 bp, Homo sapiens
tgtggattctatatttcatat

SEQ ID NO: 467579 - DNA, 13 bp, Homo sapiens
tgtggcaaacatt

SEQ ID NO: 467580 - DNA, 12 bp, Homo sapiens
tgtggcccctcc

SEQ ID NO: 467581 - DNA, 15 bp, Homo sapiens
tgtggcccctccttc

SEQ ID NO: 467582 - DNA, 17 bp, Homo sapiens
tgtggcccctccttctc

SEQ ID NO: 467583 - DNA, 17 bp, Homo sapiens
tgtggccctgtgggagt

SEQ ID NO: 467584 - DNA, 12 bp, Homo sapiens
tgtggcctcagc

SEQ ID NO: 467585 - DNA, 17 bp, Homo sapiens
tgtggcctcagccctca

SEQ ID NO: 467586 - DNA, 18 bp, Homo sapiens
tgtggcctcagccctcag

SEQ ID NO: 467587 - DNA, 16 bp, Homo sapiens
tgtggcttaaacattt

SEQ ID NO: 467588 - DNA, 17 bp, Homo sapiens
tgtggcttaaacatttt

SEQ ID NO: 467589 - DNA, 14 bp, Homo sapiens
tgtgggactggccc

SEQ ID NO: 467590 - DNA, 17 bp, Homo sapiens
tgtgggggtggccatcc

SEQ ID NO: 467591 - DNA, 14 bp, Homo sapiens
tgtgtcccagcacc

SEQ ID NO: 467592 - DNA, 21 bp, Homo sapiens
tgtgtcccatgcataacacac

SEQ ID NO: 467593 - DNA, 12 bp, Homo sapiens
tgtgtcccctca

SEQ ID NO: 467594 - DNA, 17 bp, Homo sapiens
tgtgtcccctcactctg

SEQ ID NO: 467595 - DNA, 22 bp, Homo sapiens
tgtgtcccctcactctgtcagc

SEQ ID NO: 467596 - DNA, 9 bp, Homo sapiens
tgtgtggca

SEQ ID NO: 467597 - DNA, 15 bp, Homo sapiens
tgtgtggcaaacatt

SEQ ID NO: 467598 - DNA, 20 bp, Homo sapiens
tgtgtggctcattcttttca

SEQ ID NO: 467599 - DNA, 13 bp, Homo sapiens
tgtgttcaatctg

SEQ ID NO: 467600 - DNA, 22 bp, Homo sapiens
tgtgttgccattttgtctggct

SEQ ID NO: 467601 - DNA, 24 bp, Homo sapiens
tgtgttgccattttgtctggctgt

SEQ ID NO: 467602 - DNA, 23 bp, Homo sapiens
tgttatcctgctagctgtagaaa

SEQ ID NO: 467603 - DNA, 19 bp, Homo sapiens
tgttatgtaaacatcataa

SEQ ID NO: 467604 - DNA, 21 bp, Homo sapiens
tgttattgggcaagtgattga

SEQ ID NO: 467605 - DNA, 14 bp, Homo sapiens
ttatcttatctagc

SEQ ID NO: 467606 - DNA, 14 bp, Homo sapiens
ttatgctgctgtga

SEQ ID NO: 467607 - DNA, 15 bp, Homo sapiens
ttatgtttacctcac

SEQ ID NO: 467608 - DNA, 22 bp, Homo sapiens
ttatgtttacctcactggtgca

SEQ ID NO: 467609 - DNA, 17 bp, Homo sapiens
ttattaaaatactgttt

SEQ ID NO: 467610 - DNA, 15 bp, Homo sapiens
ttattaaacttcagc

SEQ ID NO: 467611 - DNA, 12 bp, Homo sapiens
ttattactttaa

SEQ ID NO: 467612 - DNA, 22 bp, Homo sapiens
ttattatagtctgtacttcagt

SEQ ID NO: 467613 - DNA, 13 bp, Homo sapiens
ttattattactgt

SEQ ID NO: 467614 - DNA, 22 bp, Homo sapiens
ttattattttcatataatttgc

SEQ ID NO: 467615 - DNA, 19 bp, Homo sapiens
ttcctctccactgccttcg

SEQ ID NO: 467616 - DNA, 12 bp, Homo sapiens
ttcctctctctc

SEQ ID NO: 467617 - DNA, 23 bp, Homo sapiens
ttcgtccttagaatactgtattg

SEQ ID NO: 467618 - DNA, 18 bp, Homo sapiens
ttcgtcttccctgcttca

SEQ ID NO: 467619 - DNA, 15 bp, Homo sapiens
ttctaaactgttttc

SEQ ID NO: 467620 - DNA, 19 bp, Homo sapiens
ttctaaactgttttcatgt

SEQ ID NO: 467621 - DNA, 15 bp, Homo sapiens
ttctagtcaactgct

SEQ ID NO: 467622 - DNA, 23 bp, Homo sapiens
ttctagtctctgatttgcaaatg

SEQ ID NO: 467623 - DNA, 22 bp, Homo sapiens
ttctataaattcaacacttatt

SEQ ID NO: 467624 - DNA, 19 bp, Homo sapiens
ttctatactgtttgtaata

SEQ ID NO: 467625 - DNA, 24 bp, Homo sapiens
ttctatactgtttgtaatatacag

SEQ ID NO: 467626 - DNA, 17 bp, Homo sapiens
ttctatctgcaaatagt

SEQ ID NO: 467627 - DNA, 14 bp, Homo sapiens
ttctatgcctgtat

SEQ ID NO: 467628 - DNA, 13 bp, Homo sapiens
tttgtcttcaact

SEQ ID NO: 467629 - DNA, 17 bp, Homo sapiens
tttgtgctgtgggcagc

SEQ ID NO: 467630 - DNA, 14 bp, Homo sapiens
tttgtggactttat

SEQ ID NO: 467631 - DNA, 23 bp, Homo sapiens
tttgtgtattctgtggattctat

SEQ ID NO: 467632 - DNA, 21 bp, Homo sapiens
tttgttgcagttaattcttgc

SEQ ID NO: 467633 - DNA, 20 bp, Homo sapiens
ttttaaaaaaaatattctgt

SEQ ID NO: 467634 - DNA, 15 bp, Homo sapiens
ttttaaactgcagtt

SEQ ID NO: 467635 - DNA, 18 bp, Homo sapiens
ttttaaatgattccaaat

SEQ ID NO: 467636 - DNA, 21 bp, Homo sapiens
ttttaatttatttcatccagt

SEQ ID NO: 467637 - DNA, 21 bp, Homo sapiens
ttttactcaggctttctattg

SEQ ID NO: 467638 - DNA, 13 bp, Homo sapiens
ttttagatttctt

SEQ ID NO: 467639 - DNA, 16 bp, Homo sapiens
ttttagatttctttga

SEQ ID NO: 467640 - DNA, 17 bp, Homo sapiens
ttttataaattataatg

SEQ ID NO: 467641 - DNA, 14 bp, Homo sapiens
ttttatatctgtaa

SEQ ID NO: 467642 - DNA, 15 bp, Homo sapiens
ttttatatctgtaaa

SEQ ID NO: 467643 - DNA, 22 bp, Homo sapiens
ttttatcttggtagtacatttt

SEQ ID NO: 467644 - DNA, 21 bp, Homo sapiens
ttttcaacgcagccctgcttt

SEQ ID NO: 467645 - DNA, 22 bp, Homo sapiens
ttttcaacgcagccctgctttg

SEQ ID NO: 467646 - DNA, 20 bp, Homo sapiens
ttgtattcctgcctttgatg

SEQ ID NO: 467647 - DNA, 14 bp, Homo sapiens
ttgtcaacttcagt

SEQ ID NO: 467648 - DNA, 16 bp, Homo sapiens
ttgtcaacttcagttg

SEQ ID NO: 467649 - DNA, 13 bp, Homo sapiens
ttgtcactgaata

SEQ ID NO: 467650 - DNA, 14 bp, Homo sapiens
ttgtcacttctgct

SEQ ID NO: 467651 - DNA, 21 bp, Homo sapiens
ttgtcacttctgctgtacaga

SEQ ID NO: 467652 - DNA, 20 bp, Homo sapiens
ttgtcattcaagcctgtgaa

SEQ ID NO: 467653 - DNA, 21 bp, Homo sapiens
ttgtcattcaagcctgtgaat

SEQ ID NO: 467654 - DNA, 15 bp, Homo sapiens
ttgtcattctgctaa

SEQ ID NO: 467655 - DNA, 16 bp, Homo sapiens
ttgtcattctgctaat

SEQ ID NO: 467656 - DNA, 13 bp, Homo sapiens
ttgtcatttataa

SEQ ID NO: 467657 - DNA, 16 bp, Homo sapiens
ttgtctggctgtggcc

SEQ ID NO: 467658 - DNA, 21 bp, Homo sapiens
ttgtctgtgtatttctatttt

SEQ ID NO: 467659 - DNA, 10 bp, Homo sapiens
ttgtgccaaa

SEQ ID NO: 467660 - DNA, 15 bp, Homo sapiens
ttgtgcggtgtgtct

SEQ ID NO: 467661 - DNA, 19 bp, Homo sapiens
ttttcataataaaaggcat

SEQ ID NO: 467662 - DNA, 14 bp, Homo sapiens
ttttcgtcttccct

SEQ ID NO: 467663 - DNA, 13 bp, Homo sapiens
ttttctaaactgt

SEQ ID NO: 467664 - DNA, 15 bp, Homo sapiens
ttttctaaactgttt

SEQ ID NO: 467665 - DNA, 22 bp, Homo sapiens
ttttctaaactgttttcatgtg

SEQ ID NO: 467666 - DNA, 23 bp, Homo sapiens
ttttctaaactgttttcatgtgt

SEQ ID NO: 467667 - DNA, 13 bp, Homo sapiens
ttttctacagctt

SEQ ID NO: 467668 - DNA, 15 bp, Homo sapiens
ttttctatatttgga

SEQ ID NO: 467669 - DNA, 21 bp, Homo sapiens
ttttctgaattcataaaaata

SEQ ID NO: 467670 - DNA, 14 bp, Homo sapiens
ttttctttctatgt

SEQ ID NO: 467671 - DNA, 16 bp, Homo sapiens
ttttcttttatatctg

SEQ ID NO: 467672 - DNA, 19 bp, Homo sapiens
tttttaaatgattccaaat

SEQ ID NO: 467673 - DNA, 17 bp, Homo sapiens
tttttactacataatta

SEQ ID NO: 467674 - DNA, 13 bp, Homo sapiens
tttttatatatta

SEQ ID NO: 467675 - DNA, 12 bp, Homo sapiens
ttttttcaatgt

SEQ ID NO: 467676 - DNA, 22 bp, Homo sapiens
aacatccggaacagccaaagaa

SEQ ID NO: 467677 - DNA, 14 bp, Homo sapiens
aacatctgaaaaga

SEQ ID NO: 467678 - DNA, 11 bp, Homo sapiens
aacattaaaca

SEQ ID NO: 467679 - DNA, 15 bp, Homo sapiens
aacatttcagtgttt

SEQ ID NO: 467680 - DNA, 22 bp, Homo sapiens
aacatttcagtgttttgctttt

SEQ ID NO: 467681 - DNA, 20 bp, Homo sapiens
aacatttgggagactgagct

SEQ ID NO: 467682 - DNA, 21 bp, Homo sapiens
aaccactgggatcagctggtg

SEQ ID NO: 467683 - DNA, 15 bp, Homo sapiens
aaccagcactcccag

SEQ ID NO: 467684 - DNA, 18 bp, Homo sapiens
aaccaggccccagcctcc

SEQ ID NO: 467685 - DNA, 19 bp, Homo sapiens
aaccatatgattgaaaaga

SEQ ID NO: 467686 - DNA, 21 bp, Homo sapiens
aaccatatgattgaaaagaag

SEQ ID NO: 467687 - DNA, 12 bp, Homo sapiens
aacccagtgttc

SEQ ID NO: 467688 - DNA, 13 bp, Homo sapiens
aacccagtgttca

SEQ ID NO: 467689 - DNA, 11 bp, Homo sapiens
aacccccacct

SEQ ID NO: 467690 - DNA, 12 bp, Homo sapiens
aacccccacctc

SEQ ID NO: 467691 - DNA, 16 bp, Homo sapiens
aacccccacctcccgg

SEQ ID NO: 467692 - DNA, 19 bp, Homo sapiens
aaccctacagtatataagc

SEQ ID NO: 467693 - DNA, 21 bp, Homo sapiens
aaccctcggagccccccactc

SEQ ID NO: 467694 - DNA, 23 bp, Homo sapiens
aaccctcggagccccccactcag

SEQ ID NO: 467695 - DNA, 11 bp, Homo sapiens
aaccctgccct

SEQ ID NO: 467696 - DNA, 21 bp, Homo sapiens
aacccttggagccaatggaga

SEQ ID NO: 467697 - DNA, 16 bp, Homo sapiens
aaccgtcaatgtgaaa

SEQ ID NO: 467698 - DNA, 20 bp, Homo sapiens
aacctcactgccctccctcg

SEQ ID NO: 467699 - DNA, 23 bp, Homo sapiens
aacctcactgccctccctcggcc

SEQ ID NO: 467700 - DNA, 19 bp, Homo sapiens
aacctcgttgacatgcaca

SEQ ID NO: 467701 - DNA, 15 bp, Homo sapiens
aacctctcagatccc

SEQ ID NO: 467702 - DNA, 18 bp, Homo sapiens
aacctgtgctttcatgtt

SEQ ID NO: 467703 - DNA, 23 bp, Homo sapiens
aacctgtgctttcatgtttaaga

SEQ ID NO: 467704 - DNA, 14 bp, Homo sapiens
aaccttccctccaa

SEQ ID NO: 467705 - DNA, 22 bp, Homo sapiens
aacctttccgctgtcgccccag

SEQ ID NO: 467706 - DNA, 16 bp, Homo sapiens
aacgaaacacagaact

SEQ ID NO: 467707 - DNA, 20 bp, Homo sapiens
aacgagatttgccaaaaact

SEQ ID NO: 467708 - DNA, 17 bp, Homo sapiens
aacgatcagacagatct

SEQ ID NO: 467709 - DNA, 13 bp, Homo sapiens
aacgggtctgtgg

SEQ ID NO: 467710 - DNA, 16 bp, Homo sapiens
aacgggttctcccatg

SEQ ID NO: 467711 - DNA, 16 bp, Homo sapiens
aactaaaattcaacaa

SEQ ID NO: 467712 - DNA, 17 bp, Homo sapiens
aactaaaattcaacaaa

SEQ ID NO: 467713 - DNA, 16 bp, Homo sapiens
aactaacaatgccttg

SEQ ID NO: 467714 - DNA, 21 bp, Homo sapiens
aactaagcaagtatatttatt

SEQ ID NO: 467715 - DNA, 15 bp, Homo sapiens
aactaagttgtattt

SEQ ID NO: 467716 - DNA, 16 bp, Homo sapiens
aactaattcaataaaa

SEQ ID NO: 467717 - DNA, 18 bp, Homo sapiens
aactactaagaataaata

SEQ ID NO: 467718 - DNA, 14 bp, Homo sapiens
aactactgattgaa

SEQ ID NO: 467719 - DNA, 21 bp, Homo sapiens
aactatcctgcgggttttaat

SEQ ID NO: 467720 - DNA, 16 bp, Homo sapiens
aactatcggttcaagt

SEQ ID NO: 467721 - DNA, 11 bp, Homo sapiens
aactcatcaaa

SEQ ID NO: 467722 - DNA, 19 bp, Homo sapiens
aactccgcccagcctctcc

SEQ ID NO: 467723 - DNA, 19 bp, Homo sapiens
aactctgcatagacaaagg

SEQ ID NO: 467724 - DNA, 17 bp, Homo sapiens
aactctgtgtcccagca

SEQ ID NO: 467725 - DNA, 11 bp, Homo sapiens
aactcttcaag

SEQ ID NO: 467726 - DNA, 14 bp, Homo sapiens
aactcttcaaggcc

SEQ ID NO: 467727 - DNA, 18 bp, Homo sapiens
aactgagccaaaaacaat

SEQ ID NO: 467728 - DNA, 20 bp, Homo sapiens
aactgcagttttaacttttt

SEQ ID NO: 467729 - DNA, 16 bp, Homo sapiens
aactgcatatagataa

SEQ ID NO: 467730 - DNA, 21 bp, Homo sapiens
aactgcccccctcctttccaa

SEQ ID NO: 467731 - DNA, 20 bp, Homo sapiens
aactgctgttttatgtcata

SEQ ID NO: 467732 - DNA, 21 bp, Homo sapiens
aactgctgttttatgtcatac

SEQ ID NO: 467733 - DNA, 22 bp, Homo sapiens
aactggtggacatggctgttca

SEQ ID NO: 467734 - DNA, 23 bp, Homo sapiens
aactgtcccacaaaatatttcta

SEQ ID NO: 467735 - DNA, 18 bp, Homo sapiens
aacttaaacctgtgcttt

SEQ ID NO: 467736 - DNA, 20 bp, Homo sapiens
aacttaatgttctgaataat

SEQ ID NO: 467737 - DNA, 12 bp, Homo sapiens
aacttcagcaac

SEQ ID NO: 467738 - DNA, 20 bp, Homo sapiens
aacttgtacttacactgaaa

SEQ ID NO: 467739 - DNA, 22 bp, Homo sapiens
aacttgtcagaatttctttgtc

SEQ ID NO: 467740 - DNA, 18 bp, Homo sapiens
aacttgtgttcaatctgt

SEQ ID NO: 467741 - DNA, 11 bp, Homo sapiens
aactttgtcac

SEQ ID NO: 467742 - DNA, 13 bp, Homo sapiens
aagaaaaaggaaa

SEQ ID NO: 467743 - DNA, 13 bp, Homo sapiens
aagaaaacccgag

SEQ ID NO: 467744 - DNA, 15 bp, Homo sapiens
aagaaagtctatgct

SEQ ID NO: 467745 - DNA, 16 bp, Homo sapiens
aagaaagtctatgctt

SEQ ID NO: 467746 - DNA, 15 bp, Homo sapiens
aagaaatgagaaatt

SEQ ID NO: 467747 - DNA, 22 bp, Homo sapiens
aagaaatgagaaattgtgccaa

SEQ ID NO: 467748 - DNA, 23 bp, Homo sapiens
aagaaatgagaaattgtgccaaa

SEQ ID NO: 467749 - DNA, 21 bp, Homo sapiens
aagaacagtgttgaaattgga

SEQ ID NO: 467750 - DNA, 17 bp, Homo sapiens
aagaacccccctcccca

SEQ ID NO: 467751 - DNA, 18 bp, Homo sapiens
aagaacccccctccccaa

SEQ ID NO: 467752 - DNA, 11 bp, Homo sapiens
aagaagaaact

SEQ ID NO: 467753 - DNA, 20 bp, Homo sapiens
aagaagaaagtctatgctta

SEQ ID NO: 467754 - DNA, 14 bp, Homo sapiens
aagaagattctaaa

SEQ ID NO: 467755 - DNA, 21 bp, Homo sapiens
aagagaaacactaatggccaa

SEQ ID NO: 467756 - DNA, 19 bp, Homo sapiens
aagagattctattaaaagc

SEQ ID NO: 467757 - DNA, 17 bp, Homo sapiens
aagagcgctcctctgcc

SEQ ID NO: 467758 - DNA, 22 bp, Homo sapiens
aagagtcgagtgatatggcttg

SEQ ID NO: 467759 - DNA, 20 bp, Homo sapiens
aagataaatccaactctgac

SEQ ID NO: 467760 - DNA, 12 bp, Homo sapiens
aagatgccaagg

SEQ ID NO: 467761 - DNA, 23 bp, Homo sapiens
aagatggcttccgtgagacacaa

SEQ ID NO: 467762 - DNA, 19 bp, Homo sapiens
aagatgttaattacttttg

SEQ ID NO: 467763 - DNA, 21 bp, Homo sapiens
aagattatatacaaagctgtc

SEQ ID NO: 467764 - DNA, 13 bp, Homo sapiens
aagattcaattta

SEQ ID NO: 467765 - DNA, 16 bp, Homo sapiens
aagattccattttgga

SEQ ID NO: 467766 - DNA, 17 bp, Homo sapiens
aagattccattttggaa

SEQ ID NO: 467767 - DNA, 12 bp, Homo sapiens
aagattctaaaa

SEQ ID NO: 467768 - DNA, 18 bp, Homo sapiens
aagattctaaaacattct

SEQ ID NO: 467769 - DNA, 19 bp, Homo sapiens
aagatttccctaaaaattc

SEQ ID NO: 467770 - DNA, 15 bp, Homo sapiens
aagcaactgtaaaaa

SEQ ID NO: 467771 - DNA, 20 bp, Homo sapiens
aagcaagtatatttatttct

SEQ ID NO: 467772 - DNA, 19 bp, Homo sapiens
aagcagtgcgtgtgaaaca

SEQ ID NO: 467773 - DNA, 14 bp, Homo sapiens
acagatcttgagca

SEQ ID NO: 467774 - DNA, 17 bp, Homo sapiens
acagatcttgagcaagg

SEQ ID NO: 467775 - DNA, 17 bp, Homo sapiens
acagatgaccgcaataa

SEQ ID NO: 467776 - DNA, 23 bp, Homo sapiens
acagatgggtattaaacttgtca

SEQ ID NO: 467777 - DNA, 22 bp, Homo sapiens
acagcaattttcataataaaag

SEQ ID NO: 467778 - DNA, 15 bp, Homo sapiens
acagcagtacttgct

SEQ ID NO: 467779 - DNA, 17 bp, Homo sapiens
acagccaaagaaactca

SEQ ID NO: 467780 - DNA, 20 bp, Homo sapiens
acagcctcctaggctccctg

SEQ ID NO: 467781 - DNA, 21 bp, Homo sapiens
acagcctcctaggctccctga

SEQ ID NO: 467782 - DNA, 20 bp, Homo sapiens
acagcctttgcgctctgggt

SEQ ID NO: 467783 - DNA, 22 bp, Homo sapiens
acagcctttgcgctctgggttt

SEQ ID NO: 467784 - DNA, 13 bp, Homo sapiens
acagcggcccggc

SEQ ID NO: 467785 - DNA, 21 bp, Homo sapiens
acagcggcccggcccacgcag

SEQ ID NO: 467786 - DNA, 20 bp, Homo sapiens
acagctaatcagcattctca

SEQ ID NO: 467787 - DNA, 16 bp, Homo sapiens
acaggaaagccctccc

SEQ ID NO: 467788 - DNA, 22 bp, Homo sapiens
acaggaatttctgttagcaata

SEQ ID NO: 467789 - DNA, 15 bp, Homo sapiens
acaggacacgaaggc

SEQ ID NO: 467790 - DNA, 15 bp, Homo sapiens
acaggcccttcctct

SEQ ID NO: 467791 - DNA, 18 bp, Homo sapiens
acagggcaggagctgctg

SEQ ID NO: 467792 - DNA, 21 bp, Homo sapiens
acagggtggggcttagaatgg

SEQ ID NO: 467793 - DNA, 18 bp, Homo sapiens
acagtatataagcttttt

SEQ ID NO: 467794 - DNA, 21 bp, Homo sapiens
acagtattaacatcaaagact

SEQ ID NO: 467795 - DNA, 14 bp, Homo sapiens
acagtctcattaca

SEQ ID NO: 467796 - DNA, 17 bp, Homo sapiens
acagtgcatctcagccc

SEQ ID NO: 467797 - DNA, 14 bp, Homo sapiens
acagtggggcccat

SEQ ID NO: 467798 - DNA, 18 bp, Homo sapiens
acagtggggcccatggcc

SEQ ID NO: 467799 - DNA, 17 bp, Homo sapiens
acagttcttggtgactg

SEQ ID NO: 467800 - DNA, 22 bp, Homo sapiens
acagttcttggtgactgtccca

SEQ ID NO: 467801 - DNA, 16 bp, Homo sapiens
acagtttttgtaacca

SEQ ID NO: 467802 - DNA, 15 bp, Homo sapiens
acatacacaaatggg

SEQ ID NO: 467803 - DNA, 15 bp, Homo sapiens
acataggtgctcttc

SEQ ID NO: 467804 - DNA, 22 bp, Homo sapiens
acatatttgtagctagaatatc

SEQ ID NO: 467805 - DNA, 14 bp, Homo sapiens
acatcaaagactcc

SEQ ID NO: 467806 - DNA, 18 bp, Homo sapiens
acatcataaatagtaaat

SEQ ID NO: 467807 - DNA, 12 bp, Homo sapiens
acatctgaaaag

SEQ ID NO: 467808 - DNA, 14 bp, Homo sapiens
acatctgaaaagaa

SEQ ID NO: 467809 - DNA, 18 bp, Homo sapiens
acatctgaaaagaaatgc

SEQ ID NO: 467810 - DNA, 15 bp, Homo sapiens
acatcttttaactgc

SEQ ID NO: 467811 - DNA, 19 bp, Homo sapiens
acatgaagttgtaagaaaa

SEQ ID NO: 467812 - DNA, 13 bp, Homo sapiens
acatgagttcaaa

SEQ ID NO: 467813 - DNA, 15 bp, Homo sapiens
acatgagttcaaata

SEQ ID NO: 467814 - DNA, 18 bp, Homo sapiens
acatgagttcaaatactt

SEQ ID NO: 467815 - DNA, 19 bp, Homo sapiens
acatgagttcaaatacttt

SEQ ID NO: 467816 - DNA, 12 bp, Homo sapiens
acatgcacagtt

SEQ ID NO: 467817 - DNA, 19 bp, Homo sapiens
acattaaacactgtaatct

SEQ ID NO: 467818 - DNA, 18 bp, Homo sapiens
acattctttaacatacat

SEQ ID NO: 467819 - DNA, 15 bp, Homo sapiens
accaacctcactgcc

SEQ ID NO: 467820 - DNA, 14 bp, Homo sapiens
accaactgagccaa

SEQ ID NO: 467821 - DNA, 15 bp, Homo sapiens
accaagccgtggctt

SEQ ID NO: 467822 - DNA, 17 bp, Homo sapiens
accaagggtatctgctg

SEQ ID NO: 467823 - DNA, 20 bp, Homo sapiens
accaaggtgcggaccggagc

SEQ ID NO: 467824 - DNA, 19 bp, Homo sapiens
accacggggtcgggggagg

SEQ ID NO: 467825 - DNA, 17 bp, Homo sapiens
accactgggatcagctg

SEQ ID NO: 467826 - DNA, 21 bp, Homo sapiens
accagagcctatggaaagggt

SEQ ID NO: 467827 - DNA, 15 bp, Homo sapiens
accagcactcccagg

SEQ ID NO: 467828 - DNA, 16 bp, Homo sapiens
accagcactcccaggg

SEQ ID NO: 467829 - DNA, 19 bp, Homo sapiens
accagctatctgtcatctc

SEQ ID NO: 467830 - DNA, 21 bp, Homo sapiens
accagctatctgtcatctctc

SEQ ID NO: 467831 - DNA, 23 bp, Homo sapiens
accagctatctgtcatctctctg

SEQ ID NO: 467832 - DNA, 16 bp, Homo sapiens
accaggccccagcctc

SEQ ID NO: 467833 - DNA, 13 bp, Homo sapiens
accatcccactga

SEQ ID NO: 467834 - DNA, 15 bp, Homo sapiens
accatcccactgata

SEQ ID NO: 467835 - DNA, 20 bp, Homo sapiens
accatccttccatcctgagg

SEQ ID NO: 467836 - DNA, 15 bp, Homo sapiens
accattatggctttg

SEQ ID NO: 467837 - DNA, 12 bp, Homo sapiens
acccaaaagatt

SEQ ID NO: 467838 - DNA, 23 bp, Homo sapiens
acccaaggtggtcttggagagga

SEQ ID NO: 467839 - DNA, 14 bp, Homo sapiens
acccaattttaaaa

SEQ ID NO: 467840 - DNA, 21 bp, Homo sapiens
acccaattttaaaaaataaca

SEQ ID NO: 467841 - DNA, 14 bp, Homo sapiens
acccaccatccttc

SEQ ID NO: 467842 - DNA, 15 bp, Homo sapiens
acccaccatccttcc

SEQ ID NO: 467843 - DNA, 16 bp, Homo sapiens
acccactagccctctt

SEQ ID NO: 467844 - DNA, 20 bp, Homo sapiens
acccagaccctccttcccca

SEQ ID NO: 467845 - DNA, 13 bp, Homo sapiens
acccagaggtctc

SEQ ID NO: 467846 - DNA, 19 bp, Homo sapiens
acccagaggtctccctata

SEQ ID NO: 467847 - DNA, 20 bp, Homo sapiens
accccacacgccggggctgg

SEQ ID NO: 467848 - DNA, 20 bp, Homo sapiens
accccaccacacacaccctt

SEQ ID NO: 467849 - DNA, 20 bp, Homo sapiens
accccactgagagctgctcc

SEQ ID NO: 467850 - DNA, 17 bp, Homo sapiens
accccacttatgctgct

SEQ ID NO: 467851 - DNA, 18 bp, Homo sapiens
accccacttatgctgctg

SEQ ID NO: 467852 - DNA, 21 bp, Homo sapiens
accccagtttgggaactcatc

SEQ ID NO: 467853 - DNA, 12 bp, Homo sapiens
acccccaacacc

SEQ ID NO: 467854 - DNA, 15 bp, Homo sapiens
acccccaacaccacc

SEQ ID NO: 467855 - DNA, 15 bp, Homo sapiens
acccccgaggccccc

SEQ ID NO: 467856 - DNA, 21 bp, Homo sapiens
acccccgaggcccccctctgc

SEQ ID NO: 467857 - DNA, 20 bp, Homo sapiens
acccccggcctccaggctgg

SEQ ID NO: 467858 - DNA, 16 bp, Homo sapiens
accccgctcacgctga

SEQ ID NO: 467859 - DNA, 13 bp, Homo sapiens
accccgctgcctg

SEQ ID NO: 467860 - DNA, 19 bp, Homo sapiens
accccggctccccctgcca

SEQ ID NO: 467861 - DNA, 20 bp, Homo sapiens
accccggctccccctgccag

SEQ ID NO: 467862 - DNA, 20 bp, Homo sapiens
accccgtcccggccccgcgc

SEQ ID NO: 467863 - DNA, 17 bp, Homo sapiens
accccgtccctttccct

SEQ ID NO: 467864 - DNA, 21 bp, Homo sapiens
accccgtccctttccctgcat

SEQ ID NO: 467865 - DNA, 13 bp, Homo sapiens
accccgtctgccc

SEQ ID NO: 467866 - DNA, 12 bp, Homo sapiens
acccctggcttt

SEQ ID NO: 467867 - DNA, 15 bp, Homo sapiens
acccctggcttttca

SEQ ID NO: 467868 - DNA, 18 bp, Homo sapiens
acccctggcttttcactg

SEQ ID NO: 467869 - DNA, 19 bp, Homo sapiens
acccctggcttttcactgc

SEQ ID NO: 467870 - DNA, 16 bp, Homo sapiens
agaaaaccagtggaag

SEQ ID NO: 467871 - DNA, 11 bp, Homo sapiens
agaaaataacc

SEQ ID NO: 467872 - DNA, 15 bp, Homo sapiens
agaaaatgctttctc

SEQ ID NO: 467873 - DNA, 23 bp, Homo sapiens
agaaaatgctttctcatgcatag

SEQ ID NO: 467874 - DNA, 16 bp, Homo sapiens
agaaaccgacgacaaa

SEQ ID NO: 467875 - DNA, 17 bp, Homo sapiens
agaaacgagatttgcca

SEQ ID NO: 467876 - DNA, 20 bp, Homo sapiens
agaaacgatcagacagatct

SEQ ID NO: 467877 - DNA, 16 bp, Homo sapiens
agaaactcagaagagt

SEQ ID NO: 467878 - DNA, 18 bp, Homo sapiens
agaaagctatatatgaat

SEQ ID NO: 467879 - DNA, 17 bp, Homo sapiens
agaaaggcagagattgg

SEQ ID NO: 467880 - DNA, 20 bp, Homo sapiens
agaaagggcagcccctcccc

SEQ ID NO: 467881 - DNA, 15 bp, Homo sapiens
agaaagtcatccttt

SEQ ID NO: 467882 - DNA, 13 bp, Homo sapiens
agaaagtctatgc

SEQ ID NO: 467883 - DNA, 12 bp, Homo sapiens
agaaatgctaat

SEQ ID NO: 467884 - DNA, 20 bp, Homo sapiens
agaaattctataagagacaa

SEQ ID NO: 467885 - DNA, 17 bp, Homo sapiens
agaaattgtgccaaaga

SEQ ID NO: 467886 - DNA, 19 bp, Homo sapiens
agaaattgtgccaaagata

SEQ ID NO: 467887 - DNA, 22 bp, Homo sapiens
agaacaaatatgattctcctct

SEQ ID NO: 467888 - DNA, 17 bp, Homo sapiens
agaacaaggaattgctt

SEQ ID NO: 467889 - DNA, 14 bp, Homo sapiens
agaacagtgttgaa

SEQ ID NO: 467890 - DNA, 17 bp, Homo sapiens
agaacataggaattttg

SEQ ID NO: 467891 - DNA, 22 bp, Homo sapiens
agaaccagatcgtacttgaaac

SEQ ID NO: 467892 - DNA, 17 bp, Homo sapiens
agaaccagcactcccag

SEQ ID NO: 467893 - DNA, 20 bp, Homo sapiens
agaacctcgttgacatgcac

SEQ ID NO: 467894 - DNA, 13 bp, Homo sapiens
agaacctttgtca

SEQ ID NO: 467895 - DNA, 14 bp, Homo sapiens
agaacctttgtcaa

SEQ ID NO: 467896 - DNA, 15 bp, Homo sapiens
agaacgggcctcccc

SEQ ID NO: 467897 - DNA, 21 bp, Homo sapiens
agaacgggttctcccatgggg

SEQ ID NO: 467898 - DNA, 17 bp, Homo sapiens
agaactcctttctaagg

SEQ ID NO: 467899 - DNA, 11 bp, Homo sapiens
agaagaaaacc

SEQ ID NO: 467900 - DNA, 16 bp, Homo sapiens
agaagatgttaattac

SEQ ID NO: 467901 - DNA, 15 bp, Homo sapiens
agaagattctaaaac

SEQ ID NO: 467902 - DNA, 22 bp, Homo sapiens
agaagcacaggaatagtgagtg

SEQ ID NO: 467903 - DNA, 19 bp, Homo sapiens
agaaggattcttttttcaa

SEQ ID NO: 467904 - DNA, 15 bp, Homo sapiens
agaaggcctgccccc

SEQ ID NO: 467905 - DNA, 22 bp, Homo sapiens
agaagtgggattcaggaatggg

SEQ ID NO: 467906 - DNA, 15 bp, Homo sapiens
agaagttgatggata

SEQ ID NO: 467907 - DNA, 14 bp, Homo sapiens
agaatactgtattg

SEQ ID NO: 467908 - DNA, 22 bp, Homo sapiens
agaatctaactggtggacatgg

SEQ ID NO: 467909 - DNA, 13 bp, Homo sapiens
agaatgagaaatc

SEQ ID NO: 467910 - DNA, 15 bp, Homo sapiens
agaatgagaaatcat

SEQ ID NO: 467911 - DNA, 18 bp, Homo sapiens
agaatgagaaatcatgtt

SEQ ID NO: 467912 - DNA, 15 bp, Homo sapiens
agaatggctctggct

SEQ ID NO: 467913 - DNA, 13 bp, Homo sapiens
agaatggtgggct

SEQ ID NO: 467914 - DNA, 21 bp, Homo sapiens
agaatggtgggctccagagta

SEQ ID NO: 467915 - DNA, 13 bp, Homo sapiens
agacaaaggcctt

SEQ ID NO: 467916 - DNA, 21 bp, Homo sapiens
agacaaagtttggaagtacat

SEQ ID NO: 467917 - DNA, 15 bp, Homo sapiens
agacaacaggcattt

SEQ ID NO: 467918 - DNA, 19 bp, Homo sapiens
agacacagtattgacttct

SEQ ID NO: 467919 - DNA, 24 bp, Homo sapiens
agacagacggacgggacagcggcc

SEQ ID NO: 467920 - DNA, 13 bp, Homo sapiens
agacagagtggat

SEQ ID NO: 467921 - DNA, 18 bp, Homo sapiens
agacagagtggatctgga

SEQ ID NO: 467922 - DNA, 19 bp, Homo sapiens
agacagagtggatctggag

SEQ ID NO: 467923 - DNA, 20 bp, Homo sapiens
agacagatctggaatgtgaa

SEQ ID NO: 467924 - DNA, 23 bp, Homo sapiens
agacagggtggggcttagaatgg

SEQ ID NO: 467925 - DNA, 20 bp, Homo sapiens
agacagtgggggtgcctggt

SEQ ID NO: 467926 - DNA, 17 bp, Homo sapiens
agacccaccatccttcc

SEQ ID NO: 467927 - DNA, 15 bp, Homo sapiens
agaccctccttcccc

SEQ ID NO: 467928 - DNA, 18 bp, Homo sapiens
agaccctccttccccacc

SEQ ID NO: 467929 - DNA, 21 bp, Homo sapiens
agaccctccttccccacccca

SEQ ID NO: 467930 - DNA, 21 bp, Homo sapiens
agaccctgtctttgctgttta

SEQ ID NO: 467931 - DNA, 14 bp, Homo sapiens
agaccgatccttcc

SEQ ID NO: 467932 - DNA, 16 bp, Homo sapiens
agaccgatccttccca

SEQ ID NO: 467933 - DNA, 23 bp, Homo sapiens
agacctccagattattttctata

SEQ ID NO: 467934 - DNA, 16 bp, Homo sapiens
agacctcggctgtgtg

SEQ ID NO: 467935 - DNA, 16 bp, Homo sapiens
agacgctgccgctgcc

SEQ ID NO: 467936 - DNA, 20 bp, Homo sapiens
agacggacgggacagcggcc

SEQ ID NO: 467937 - DNA, 14 bp, Homo sapiens
agacggcagcccca

SEQ ID NO: 467938 - DNA, 23 bp, Homo sapiens
agactaatgaatgcaaaaagata

SEQ ID NO: 467939 - DNA, 14 bp, Homo sapiens
agactcaatgtgga

SEQ ID NO: 467940 - DNA, 19 bp, Homo sapiens
agactcgagagggctgagc

SEQ ID NO: 467941 - DNA, 21 bp, Homo sapiens
agactcgagagggctgagccc

SEQ ID NO: 467942 - DNA, 17 bp, Homo sapiens
agactctctcctctctc

SEQ ID NO: 467943 - DNA, 11 bp, Homo sapiens
agactgcccac

SEQ ID NO: 467944 - DNA, 13 bp, Homo sapiens
agactgcccaccc

SEQ ID NO: 467945 - DNA, 16 bp, Homo sapiens
agagaaaatgctttct

SEQ ID NO: 467946 - DNA, 20 bp, Homo sapiens
agagaaacactaatggccaa

SEQ ID NO: 467947 - DNA, 20 bp, Homo sapiens
agagaagccacgctgtcctc

SEQ ID NO: 467948 - DNA, 19 bp, Homo sapiens
agagacggcagccccatcc

SEQ ID NO: 467949 - DNA, 16 bp, Homo sapiens
agagcattctggggtg

SEQ ID NO: 467950 - DNA, 20 bp, Homo sapiens
agagcattctggggtggggc

SEQ ID NO: 467951 - DNA, 12 bp, Homo sapiens
agagccccggag

SEQ ID NO: 467952 - DNA, 17 bp, Homo sapiens
agagccccggagcacca

SEQ ID NO: 467953 - DNA, 22 bp, Homo sapiens
agagccccggagcaccacgggg

SEQ ID NO: 467954 - DNA, 17 bp, Homo sapiens
agagccctgagcccaga

SEQ ID NO: 467955 - DNA, 19 bp, Homo sapiens
agagcgccacccgcccgcc

SEQ ID NO: 467956 - DNA, 19 bp, Homo sapiens
agagcgctcctctgccttg

SEQ ID NO: 467957 - DNA, 20 bp, Homo sapiens
agagcgctcctctgccttgg

SEQ ID NO: 467958 - DNA, 14 bp, Homo sapiens
agagctcaggagaa

SEQ ID NO: 467959 - DNA, 16 bp, Homo sapiens
agagctcagtacaggg

SEQ ID NO: 467960 - DNA, 17 bp, Homo sapiens
agagctcagtacagggc

SEQ ID NO: 467961 - DNA, 15 bp, Homo sapiens
agagctgctcctttg

SEQ ID NO: 467962 - DNA, 23 bp, Homo sapiens
agagcttcttatattaaagaagt

SEQ ID NO: 467963 - DNA, 21 bp, Homo sapiens
agaggaggtgtggagtggagg

SEQ ID NO: 467964 - DNA, 17 bp, Homo sapiens
agaggcagggccctggg

SEQ ID NO: 467965 - DNA, 13 bp, Homo sapiens
agagggctgagcc

SEQ ID NO: 467966 - DNA, 14 bp, Homo sapiens
agagggctgagccc

SEQ ID NO: 467967 - DNA, 22 bp, Homo sapiens
aggaagttttgcatgcaggctg

SEQ ID NO: 467968 - DNA, 19 bp, Homo sapiens
aggaatgggccaagccagg

SEQ ID NO: 467969 - DNA, 17 bp, Homo sapiens
aggaatgtgcttttcca

SEQ ID NO: 467970 - DNA, 12 bp, Homo sapiens
aggacactgatg

SEQ ID NO: 467971 - DNA, 18 bp, Homo sapiens
aggacactgatgggtcct

SEQ ID NO: 467972 - DNA, 23 bp, Homo sapiens
aggacactgatgggtcctgctgc

SEQ ID NO: 467973 - DNA, 12 bp, Homo sapiens
aggacagggagg

SEQ ID NO: 467974 - DNA, 18 bp, Homo sapiens
aggacagtttaggaccca

SEQ ID NO: 467975 - DNA, 13 bp, Homo sapiens
aggacccaaggtg

SEQ ID NO: 467976 - DNA, 20 bp, Homo sapiens
aggacccaaggtggtcttgg

SEQ ID NO: 467977 - DNA, 21 bp, Homo sapiens
aggacccaaggtggtcttgga

SEQ ID NO: 467978 - DNA, 17 bp, Homo sapiens
aggacccggaggggcct

SEQ ID NO: 467979 - DNA, 21 bp, Homo sapiens
aggacccggaggggcctggca

SEQ ID NO: 467980 - DNA, 15 bp, Homo sapiens
aggacggggcagagc

SEQ ID NO: 467981 - DNA, 21 bp, Homo sapiens
aggacgtcatcggaggctggg

SEQ ID NO: 467982 - DNA, 14 bp, Homo sapiens
aggactacaggtat

SEQ ID NO: 467983 - DNA, 13 bp, Homo sapiens
aggacttctgcag

SEQ ID NO: 467984 - DNA, 16 bp, Homo sapiens
aggagaaggcctgccc

SEQ ID NO: 467985 - DNA, 17 bp, Homo sapiens
aggagaaggcctgcccc

SEQ ID NO: 467986 - DNA, 20 bp, Homo sapiens
aggagaaggcctgcccccct

SEQ ID NO: 467987 - DNA, 15 bp, Homo sapiens
aggagaccctgtctt

SEQ ID NO: 467988 - DNA, 10 bp, Homo sapiens
aggagcaccc

SEQ ID NO: 467989 - DNA, 16 bp, Homo sapiens
aggagcacccccagcc

SEQ ID NO: 467990 - DNA, 13 bp, Homo sapiens
aggagcttccaga

SEQ ID NO: 467991 - DNA, 11 bp, Homo sapiens
aggaggacagg

SEQ ID NO: 467992 - DNA, 15 bp, Homo sapiens
aggaggtgtggagtg

SEQ ID NO: 467993 - DNA, 23 bp, Homo sapiens
aggaggtgtggagtggaggggtc

SEQ ID NO: 467994 - DNA, 16 bp, Homo sapiens
aggagttaatgatcgt

SEQ ID NO: 467995 - DNA, 20 bp, Homo sapiens
aggattaatctctaaaattc

SEQ ID NO: 467996 - DNA, 20 bp, Homo sapiens
aggattcttttttcaatgta

SEQ ID NO: 467997 - DNA, 18 bp, Homo sapiens
aggcacacagcagccccc

SEQ ID NO: 467998 - DNA, 20 bp, Homo sapiens
aggcacacagcagcccccca

SEQ ID NO: 467999 - DNA, 13 bp, Homo sapiens
aggccccagcctc

SEQ ID NO: 468000 - DNA, 15 bp, Homo sapiens
aggccccagcctcca

SEQ ID NO: 468001 - DNA, 15 bp, Homo sapiens
aggcccccctctgcc

SEQ ID NO: 468002 - DNA, 19 bp, Homo sapiens
aggcccccctctgcctttg

SEQ ID NO: 468003 - DNA, 20 bp, Homo sapiens
aggcccccctctgcctttga

SEQ ID NO: 468004 - DNA, 10 bp, Homo sapiens
aggccctccc

SEQ ID NO: 468005 - DNA, 14 bp, Homo sapiens
aggccctccctgac

SEQ ID NO: 468006 - DNA, 17 bp, Homo sapiens
aggccctccctgactcc

SEQ ID NO: 468007 - DNA, 22 bp, Homo sapiens
aggccctccctgactccctgtg

SEQ ID NO: 468008 - DNA, 23 bp, Homo sapiens
aggccctccctgactccctgtgg

SEQ ID NO: 468009 - DNA, 17 bp, Homo sapiens
aggcccttcctctccac

SEQ ID NO: 468010 - DNA, 22 bp, Homo sapiens
aggcccttcctctccactgcct

SEQ ID NO: 468011 - DNA, 13 bp, Homo sapiens
aggccgctctggg

SEQ ID NO: 468012 - DNA, 17 bp, Homo sapiens
aggcctgagggaagccc

SEQ ID NO: 468013 - DNA, 18 bp, Homo sapiens
aggcctgagggaagccca

SEQ ID NO: 468014 - DNA, 21 bp, Homo sapiens
aggcctgagggaagcccaccc

SEQ ID NO: 468015 - DNA, 15 bp, Homo sapiens
aggcctgcccccctt

SEQ ID NO: 468016 - DNA, 16 bp, Homo sapiens
aggcctgccccccttc

SEQ ID NO: 468017 - DNA, 14 bp, Homo sapiens
aggcctggtctgga

SEQ ID NO: 468018 - DNA, 16 bp, Homo sapiens
aggcctggtctggagc

SEQ ID NO: 468019 - DNA, 15 bp, Homo sapiens
aggcgcccacctgcc

SEQ ID NO: 468020 - DNA, 18 bp, Homo sapiens
aggcgcccacctgcccag

SEQ ID NO: 468021 - DNA, 19 bp, Homo sapiens
aggcgcccacctgcccagt

SEQ ID NO: 468022 - DNA, 14 bp, Homo sapiens
aggcgcgcaccgcc

SEQ ID NO: 468023 - DNA, 21 bp, Homo sapiens
aggcgcgcaccgcccaacccc

SEQ ID NO: 468024 - DNA, 16 bp, Homo sapiens
aggcgctcagaggccg

SEQ ID NO: 468025 - DNA, 21 bp, Homo sapiens
aggcggaggggcttggagcag

SEQ ID NO: 468026 - DNA, 13 bp, Homo sapiens
aggctccctgagg

SEQ ID NO: 468027 - DNA, 14 bp, Homo sapiens
aggctgcgcctgcc

SEQ ID NO: 468028 - DNA, 18 bp, Homo sapiens
aggctggatgtgctttca

SEQ ID NO: 468029 - DNA, 10 bp, Homo sapiens
aggctggggc

SEQ ID NO: 468030 - DNA, 12 bp, Homo sapiens
aggctggggcct

SEQ ID NO: 468031 - DNA, 15 bp, Homo sapiens
aggctggggcctggc

SEQ ID NO: 468032 - DNA, 23 bp, Homo sapiens
aggctgtattttcttttatatct

SEQ ID NO: 468033 - DNA, 17 bp, Homo sapiens
aggctttctattggcat

SEQ ID NO: 468034 - DNA, 23 bp, Homo sapiens
aggctttctattggcatggattt

SEQ ID NO: 468035 - DNA, 14 bp, Homo sapiens
agggaaatcaattt

SEQ ID NO: 468036 - DNA, 22 bp, Homo sapiens
agggaaatcaatttaaaggaaa

SEQ ID NO: 468037 - DNA, 15 bp, Homo sapiens
agggaagcagtgcgt

SEQ ID NO: 468038 - DNA, 14 bp, Homo sapiens
agggaagcccaccc

SEQ ID NO: 468039 - DNA, 16 bp, Homo sapiens
agggaagcccacccgc

SEQ ID NO: 468040 - DNA, 23 bp, Homo sapiens
agggaagcccacccgccccagag

SEQ ID NO: 468041 - DNA, 14 bp, Homo sapiens
agggacagtggtct

SEQ ID NO: 468042 - DNA, 18 bp, Homo sapiens
agggactttgcctgccca

SEQ ID NO: 468043 - DNA, 19 bp, Homo sapiens
agggaggggagaaaggaac

SEQ ID NO: 468044 - DNA, 14 bp, Homo sapiens
agggcagcccctcc

SEQ ID NO: 468045 - DNA, 17 bp, Homo sapiens
agggcagggttctagaa

SEQ ID NO: 468046 - DNA, 22 bp, Homo sapiens
agggcagggttctagaaggggc

SEQ ID NO: 468047 - DNA, 17 bp, Homo sapiens
agggcccaaataacagt

SEQ ID NO: 468048 - DNA, 19 bp, Homo sapiens
agggcccgagcgcgtgcct

SEQ ID NO: 468049 - DNA, 15 bp, Homo sapiens
agggccctggggtct

SEQ ID NO: 468050 - DNA, 23 bp, Homo sapiens
agggcgctccggcagaggcaggg

SEQ ID NO: 468051 - DNA, 15 bp, Homo sapiens
agggcgctgagggca

SEQ ID NO: 468052 - DNA, 18 bp, Homo sapiens
agggcgctgagggcaggg

SEQ ID NO: 468053 - DNA, 13 bp, Homo sapiens
agggctgagcccc

SEQ ID NO: 468054 - DNA, 17 bp, Homo sapiens
agggctgagcccctcct

SEQ ID NO: 468055 - DNA, 12 bp, Homo sapiens
aggggactgcat

SEQ ID NO: 468056 - DNA, 16 bp, Homo sapiens
aggggactgcatgcaa

SEQ ID NO: 468057 - DNA, 15 bp, Homo sapiens
aggggagaaaggaac

SEQ ID NO: 468058 - DNA, 16 bp, Homo sapiens
aggggatctaaaagga

SEQ ID NO: 468059 - DNA, 20 bp, Homo sapiens
aggggatctaaaaggaggac

SEQ ID NO: 468060 - DNA, 22 bp, Homo sapiens
aggggatctaaaaggaggacag

SEQ ID NO: 468061 - DNA, 13 bp, Homo sapiens
aggggcctggcag

SEQ ID NO: 468062 - DNA, 15 bp, Homo sapiens
aggggcctggcagcc

SEQ ID NO: 468063 - DNA, 17 bp, Homo sapiens
aggggcttggagcagag

SEQ ID NO: 468064 - DNA, 17 bp, Homo sapiens
agggggccagagggact

SEQ ID NO: 468065 - DNA, 20 bp, Homo sapiens
agtttcacatatttgtagct

SEQ ID NO: 468066 - DNA, 19 bp, Homo sapiens
agtttctatggattcactt

SEQ ID NO: 468067 - DNA, 21 bp, Homo sapiens
agtttctatggattcacttct

SEQ ID NO: 468068 - DNA, 14 bp, Homo sapiens
agttttataaaact

SEQ ID NO: 468069 - DNA, 19 bp, Homo sapiens
ataaaactcagttaaaatg

SEQ ID NO: 468070 - DNA, 15 bp, Homo sapiens
ataaaatcttcaact

SEQ ID NO: 468071 - DNA, 23 bp, Homo sapiens
ataaaatcttcaactaatttttg

SEQ ID NO: 468072 - DNA, 16 bp, Homo sapiens
ataaacgaaacacaga

SEQ ID NO: 468073 - DNA, 18 bp, Homo sapiens
ataaactcttcaaggcca

SEQ ID NO: 468074 - DNA, 16 bp, Homo sapiens
ataaacttgtacttac

SEQ ID NO: 468075 - DNA, 14 bp, Homo sapiens
ataaataaagaaga

SEQ ID NO: 468076 - DNA, 21 bp, Homo sapiens
ataaataaagaagaaaataac

SEQ ID NO: 468077 - DNA, 13 bp, Homo sapiens
ataaatatctatt

SEQ ID NO: 468078 - DNA, 16 bp, Homo sapiens
ataaatatctatttat

SEQ ID NO: 468079 - DNA, 22 bp, Homo sapiens
ataaatatctatttatctgtct

SEQ ID NO: 468080 - DNA, 24 bp, Homo sapiens
ataaatatctatttatctgtctga

SEQ ID NO: 468081 - DNA, 12 bp, Homo sapiens
ataaatctgtct

SEQ ID NO: 468082 - DNA, 17 bp, Homo sapiens
ataaatctgtctgattc

SEQ ID NO: 468083 - DNA, 22 bp, Homo sapiens
ataaatctgtctgattctatgc

SEQ ID NO: 468084 - DNA, 15 bp, Homo sapiens
ataaatgtttatatt

SEQ ID NO: 468085 - DNA, 19 bp, Homo sapiens
ataaattataatgcatcta

SEQ ID NO: 468086 - DNA, 21 bp, Homo sapiens
ataaattataatgcatctaaa

SEQ ID NO: 468087 - DNA, 12 bp, Homo sapiens
ataaattattac

SEQ ID NO: 468088 - DNA, 15 bp, Homo sapiens
ataacaactctattt

SEQ ID NO: 468089 - DNA, 20 bp, Homo sapiens
ataacagagctggatgctga

SEQ ID NO: 468090 - DNA, 20 bp, Homo sapiens
ataacagcttgaaaactgga

SEQ ID NO: 468091 - DNA, 21 bp, Homo sapiens
ataacagcttgaaaactggat

SEQ ID NO: 468092 - DNA, 13 bp, Homo sapiens
ataacagtggcaa

SEQ ID NO: 468093 - DNA, 16 bp, Homo sapiens
ataacagttttaagat

SEQ ID NO: 468094 - DNA, 13 bp, Homo sapiens
ataacatctgaaa

SEQ ID NO: 468095 - DNA, 14 bp, Homo sapiens
ataacatctgaaaa

SEQ ID NO: 468096 - DNA, 17 bp, Homo sapiens
ataacatctgaaaagaa

SEQ ID NO: 468097 - DNA, 14 bp, Homo sapiens
ataaccaaaaaatg

SEQ ID NO: 468098 - DNA, 20 bp, Homo sapiens
ataaccaaaaaatgtgagct

SEQ ID NO: 468099 - DNA, 19 bp, Homo sapiens
ataagccctgagactcccg

SEQ ID NO: 468100 - DNA, 16 bp, Homo sapiens
ataatatcctgaataa

SEQ ID NO: 468101 - DNA, 17 bp, Homo sapiens
ataatatcctgaataac

SEQ ID NO: 468102 - DNA, 23 bp, Homo sapiens
ataatatggaaccttccctccaa

SEQ ID NO: 468103 - DNA, 13 bp, Homo sapiens
ataatgatgatga

SEQ ID NO: 468104 - DNA, 15 bp, Homo sapiens
ataatgattcaatgt

SEQ ID NO: 468105 - DNA, 19 bp, Homo sapiens
ataatgattcaatgtgaat

SEQ ID NO: 468106 - DNA, 14 bp, Homo sapiens
ataatgcatctaaa

SEQ ID NO: 468107 - DNA, 20 bp, Homo sapiens
ataatgcttaacataaactt

SEQ ID NO: 468108 - DNA, 18 bp, Homo sapiens
ataattaaattttaatgt

SEQ ID NO: 468109 - DNA, 15 bp, Homo sapiens
ataattatgtttacc

SEQ ID NO: 468110 - DNA, 18 bp, Homo sapiens
atacaataaaagagcttt

SEQ ID NO: 468111 - DNA, 15 bp, Homo sapiens
atacactggaattca

SEQ ID NO: 468112 - DNA, 14 bp, Homo sapiens
atacactgtatcta

SEQ ID NO: 468113 - DNA, 15 bp, Homo sapiens
atacagtttttgtaa

SEQ ID NO: 468114 - DNA, 23 bp, Homo sapiens
atacatctaagtcagtttcacat

SEQ ID NO: 468115 - DNA, 13 bp, Homo sapiens
atacattaaaata

SEQ ID NO: 468116 - DNA, 15 bp, Homo sapiens
atacattaaaataac

SEQ ID NO: 468117 - DNA, 19 bp, Homo sapiens
ataccctaggtctccaccc

SEQ ID NO: 468118 - DNA, 16 bp, Homo sapiens
atacctctaataacct

SEQ ID NO: 468119 - DNA, 22 bp, Homo sapiens
atactcaaagaggccagtactt

SEQ ID NO: 468120 - DNA, 15 bp, Homo sapiens
atactcaccaaaata

SEQ ID NO: 468121 - DNA, 16 bp, Homo sapiens
atactcaccaaaatat

SEQ ID NO: 468122 - DNA, 17 bp, Homo sapiens
atactccaaggtggcat

SEQ ID NO: 468123 - DNA, 22 bp, Homo sapiens
atactccaaggtggcatagcca

SEQ ID NO: 468124 - DNA, 18 bp, Homo sapiens
atactgaattgttatgta

SEQ ID NO: 468125 - DNA, 21 bp, Homo sapiens
atactgcatatcctggtgtct

SEQ ID NO: 468126 - DNA, 14 bp, Homo sapiens
atactggttatagt

SEQ ID NO: 468127 - DNA, 16 bp, Homo sapiens
atactgtttgtaatat

SEQ ID NO: 468128 - DNA, 19 bp, Homo sapiens
atactgtttgtaatataca

SEQ ID NO: 468129 - DNA, 14 bp, Homo sapiens
atacttcacactga

SEQ ID NO: 468130 - DNA, 22 bp, Homo sapiens
atacttcctggattttctttct

SEQ ID NO: 468131 - DNA, 16 bp, Homo sapiens
atacttctttttcatt

SEQ ID NO: 468132 - DNA, 20 bp, Homo sapiens
atactttctgagatggtggt

SEQ ID NO: 468133 - DNA, 23 bp, Homo sapiens
atagaactgtcccacaaaatatt

SEQ ID NO: 468134 - DNA, 16 bp, Homo sapiens
atagacaaaggcctta

SEQ ID NO: 468135 - DNA, 21 bp, Homo sapiens
atagacaagtgttttgggttt

SEQ ID NO: 468136 - DNA, 19 bp, Homo sapiens
atagacacagtattgactt

SEQ ID NO: 468137 - DNA, 13 bp, Homo sapiens
atagataattatc

SEQ ID NO: 468138 - DNA, 18 bp, Homo sapiens
atagccattcatttacaa

SEQ ID NO: 468139 - DNA, 17 bp, Homo sapiens
ataggaaataaatctaa

SEQ ID NO: 468140 - DNA, 15 bp, Homo sapiens
atagggtttggaaga

SEQ ID NO: 468141 - DNA, 20 bp, Homo sapiens
atagtcatgtttctgcagta

SEQ ID NO: 468142 - DNA, 13 bp, Homo sapiens
atagtctgtactt

SEQ ID NO: 468143 - DNA, 13 bp, Homo sapiens
atagttctatttc

SEQ ID NO: 468144 - DNA, 22 bp, Homo sapiens
atagttctgcaataacagtttt

SEQ ID NO: 468145 - DNA, 16 bp, Homo sapiens
atagttgaacaagatt

SEQ ID NO: 468146 - DNA, 20 bp, Homo sapiens
atagttgatatgtaacagtt

SEQ ID NO: 468147 - DNA, 15 bp, Homo sapiens
atagtttaaagggag

SEQ ID NO: 468148 - DNA, 15 bp, Homo sapiens
atataaattattact

SEQ ID NO: 468149 - DNA, 22 bp, Homo sapiens
atataatttgccagacagagat

SEQ ID NO: 468150 - DNA, 12 bp, Homo sapiens
atatactgcata

SEQ ID NO: 468151 - DNA, 14 bp, Homo sapiens
atatactgcatatc

SEQ ID NO: 468152 - DNA, 10 bp, Homo sapiens
atatataaat

SEQ ID NO: 468153 - DNA, 15 bp, Homo sapiens
atatatatatatgta

SEQ ID NO: 468154 - DNA, 14 bp, Homo sapiens
atatatatatgtat

SEQ ID NO: 468155 - DNA, 19 bp, Homo sapiens
atatcagcagacactccag

SEQ ID NO: 468156 - DNA, 11 bp, Homo sapiens
atatcagctct

SEQ ID NO: 468157 - DNA, 22 bp, Homo sapiens
atatcagctctaaagcagagat

SEQ ID NO: 468158 - DNA, 14 bp, Homo sapiens
atatcagctctgca

SEQ ID NO: 468159 - DNA, 14 bp, Homo sapiens
atatcctatactgg

SEQ ID NO: 468160 - DNA, 14 bp, Homo sapiens
atatcctgaataac

SEQ ID NO: 468161 - DNA, 13 bp, Homo sapiens
atatctatttatc

SEQ ID NO: 468162 - DNA, 16 bp, Homo sapiens
atatgaataattatgt

SEQ ID NO: 468163 - DNA, 16 bp, Homo sapiens
atggtgggctccagag

SEQ ID NO: 468164 - DNA, 17 bp, Homo sapiens
atggtggtttcagaaag

SEQ ID NO: 468165 - DNA, 19 bp, Homo sapiens
atggttcccctgttcactc

SEQ ID NO: 468166 - DNA, 16 bp, Homo sapiens
atggtttaacaaaatg

SEQ ID NO: 468167 - DNA, 12 bp, Homo sapiens
atgtaaaattca

SEQ ID NO: 468168 - DNA, 15 bp, Homo sapiens
atgtaagaagaaact

SEQ ID NO: 468169 - DNA, 16 bp, Homo sapiens
atgtaagaagaaactg

SEQ ID NO: 468170 - DNA, 15 bp, Homo sapiens
atgtagaactgttca

SEQ ID NO: 468171 - DNA, 16 bp, Homo sapiens
atgtagaactgttcat

SEQ ID NO: 468172 - DNA, 14 bp, Homo sapiens
atgtatatatttat

SEQ ID NO: 468173 - DNA, 16 bp, Homo sapiens
atgtatatatttatta

SEQ ID NO: 468174 - DNA, 15 bp, Homo sapiens
atgtatcctgataaa

SEQ ID NO: 468175 - DNA, 14 bp, Homo sapiens
atgtctctttgcca

SEQ ID NO: 468176 - DNA, 18 bp, Homo sapiens
atgtcttgagatgtatta

SEQ ID NO: 468177 - DNA, 15 bp, Homo sapiens
atgtgattggcagct

SEQ ID NO: 468178 - DNA, 23 bp, Homo sapiens
atgtgattggcagcttcaaaaca

SEQ ID NO: 468179 - DNA, 17 bp, Homo sapiens
atgtggcattggggggc

SEQ ID NO: 468180 - DNA, 13 bp, Homo sapiens
atgtgtcccctca

SEQ ID NO: 468181 - DNA, 15 bp, Homo sapiens
atgtgtcccctcact

SEQ ID NO: 468182 - DNA, 19 bp, Homo sapiens
atgtgtcccctcactctgt

SEQ ID NO: 468183 - DNA, 22 bp, Homo sapiens
atgtgtcccctcactctgtcag

SEQ ID NO: 468184 - DNA, 24 bp, Homo sapiens
atgtgtcccctcactctgtcagcc

SEQ ID NO: 468185 - DNA, 19 bp, Homo sapiens
atgtgtggctcattctttt

SEQ ID NO: 468186 - DNA, 17 bp, Homo sapiens
atgttaaacgtcacagc

SEQ ID NO: 468187 - DNA, 20 bp, Homo sapiens
atgttacagaatctaactgg

SEQ ID NO: 468188 - DNA, 14 bp, Homo sapiens
atgttaccttcaca

SEQ ID NO: 468189 - DNA, 22 bp, Homo sapiens
atgttccgttcatctgaggagt

SEQ ID NO: 468190 - DNA, 16 bp, Homo sapiens
atgttctgaataattt

SEQ ID NO: 468191 - DNA, 16 bp, Homo sapiens
atgttgatcgatgtta

SEQ ID NO: 468192 - DNA, 15 bp, Homo sapiens
atgttgttcaaatgc

SEQ ID NO: 468193 - DNA, 19 bp, Homo sapiens
atgttgttcaaatgcattt

SEQ ID NO: 468194 - DNA, 22 bp, Homo sapiens
atgttgttcgatcgtttcacat

SEQ ID NO: 468195 - DNA, 19 bp, Homo sapiens
atgtttaagaaatgagaaa

SEQ ID NO: 468196 - DNA, 22 bp, Homo sapiens
atgtttacctcactggtgcatt

SEQ ID NO: 468197 - DNA, 14 bp, Homo sapiens
atgtttatattgtt

SEQ ID NO: 468198 - DNA, 18 bp, Homo sapiens
atgtttatattgttttta

SEQ ID NO: 468199 - DNA, 18 bp, Homo sapiens
atgtttcattattctttc

SEQ ID NO: 468200 - DNA, 13 bp, Homo sapiens
atgtttgttttca

SEQ ID NO: 468201 - DNA, 15 bp, Homo sapiens
attaaacactgtaat

SEQ ID NO: 468202 - DNA, 12 bp, Homo sapiens
attaaagaagtt

SEQ ID NO: 468203 - DNA, 15 bp, Homo sapiens
attaaattttaatgt

SEQ ID NO: 468204 - DNA, 16 bp, Homo sapiens
attaaattttaatgta

SEQ ID NO: 468205 - DNA, 13 bp, Homo sapiens
attaactctgcat

SEQ ID NO: 468206 - DNA, 20 bp, Homo sapiens
attaactctgcatagacaaa

SEQ ID NO: 468207 - DNA, 23 bp, Homo sapiens
attaatagtaggattattcctag

SEQ ID NO: 468208 - DNA, 12 bp, Homo sapiens
attaatctctaa

SEQ ID NO: 468209 - DNA, 14 bp, Homo sapiens
attacatcctctgc

SEQ ID NO: 468210 - DNA, 15 bp, Homo sapiens
attactttaaattat

SEQ ID NO: 468211 - DNA, 16 bp, Homo sapiens
attactttaaattata

SEQ ID NO: 468212 - DNA, 22 bp, Homo sapiens
attactttaaattatatgatat

SEQ ID NO: 468213 - DNA, 23 bp, Homo sapiens
attactttaaattatatgatatg

SEQ ID NO: 468214 - DNA, 17 bp, Homo sapiens
attacttttgaaaaagg

SEQ ID NO: 468215 - DNA, 17 bp, Homo sapiens
attagactgaatttaac

SEQ ID NO: 468216 - DNA, 13 bp, Homo sapiens
attataagttgac

SEQ ID NO: 468217 - DNA, 17 bp, Homo sapiens
attataagttgaccttt

SEQ ID NO: 468218 - DNA, 16 bp, Homo sapiens
attataatgcatctaa

SEQ ID NO: 468219 - DNA, 14 bp, Homo sapiens
attatagtctgtac

SEQ ID NO: 468220 - DNA, 15 bp, Homo sapiens
attatagtctgtact

SEQ ID NO: 468221 - DNA, 13 bp, Homo sapiens
attatctctttct

SEQ ID NO: 468222 - DNA, 13 bp, Homo sapiens
attatctgggttt

SEQ ID NO: 468223 - DNA, 17 bp, Homo sapiens
attatctgggttttaga

SEQ ID NO: 468224 - DNA, 21 bp, Homo sapiens
attatggctttgtgcttgttc

SEQ ID NO: 468225 - DNA, 14 bp, Homo sapiens
attattattactgt

SEQ ID NO: 468226 - DNA, 22 bp, Homo sapiens
attcaaaatagttctatttcta

SEQ ID NO: 468227 - DNA, 23 bp, Homo sapiens
attcaaaatagttctatttctat

SEQ ID NO: 468228 - DNA, 11 bp, Homo sapiens
attcaaatgca

SEQ ID NO: 468229 - DNA, 13 bp, Homo sapiens
attcaaatgcatg

SEQ ID NO: 468230 - DNA, 15 bp, Homo sapiens
attcaaatgcatgat

SEQ ID NO: 468231 - DNA, 14 bp, Homo sapiens
attcaacacttatt

SEQ ID NO: 468232 - DNA, 15 bp, Homo sapiens
attcaacacttattt

SEQ ID NO: 468233 - DNA, 13 bp, Homo sapiens
attcatactcaaa

SEQ ID NO: 468234 - DNA, 14 bp, Homo sapiens
attcatactcaaag

SEQ ID NO: 468235 - DNA, 15 bp, Homo sapiens
attcatactcaaaga

SEQ ID NO: 468236 - DNA, 14 bp, Homo sapiens
attcatttacaact

SEQ ID NO: 468237 - DNA, 23 bp, Homo sapiens
attccaaataaaacttgagccca

SEQ ID NO: 468238 - DNA, 20 bp, Homo sapiens
attccaccaggattaatctc

SEQ ID NO: 468239 - DNA, 21 bp, Homo sapiens
attccagagagtggctcctcc

SEQ ID NO: 468240 - DNA, 14 bp, Homo sapiens
attccattttggaa

SEQ ID NO: 468241 - DNA, 15 bp, Homo sapiens
attcctgcctttgat

SEQ ID NO: 468242 - DNA, 15 bp, Homo sapiens
attctagtcaactgc

SEQ ID NO: 468243 - DNA, 17 bp, Homo sapiens
attctagtcaactgctg

SEQ ID NO: 468244 - DNA, 21 bp, Homo sapiens
attctagtctctgatttgcaa

SEQ ID NO: 468245 - DNA, 20 bp, Homo sapiens
attctataagagacaaagtt

SEQ ID NO: 468246 - DNA, 11 bp, Homo sapiens
attctcctctc

SEQ ID NO: 468247 - DNA, 13 bp, Homo sapiens
attctcctctccc

SEQ ID NO: 468248 - DNA, 18 bp, Homo sapiens
attctgctaatttatgaa

SEQ ID NO: 468249 - DNA, 21 bp, Homo sapiens
attctgctaatttatgaagat

SEQ ID NO: 468250 - DNA, 16 bp, Homo sapiens
attctggggtggggct

SEQ ID NO: 468251 - DNA, 20 bp, Homo sapiens
attctggggtggggcttgga

SEQ ID NO: 468252 - DNA, 22 bp, Homo sapiens
attctgtcattggttacaaatt

SEQ ID NO: 468253 - DNA, 18 bp, Homo sapiens
attctgtggattctatat

SEQ ID NO: 468254 - DNA, 12 bp, Homo sapiens
attcttgcactg

SEQ ID NO: 468255 - DNA, 13 bp, Homo sapiens
attcttgcactgt

SEQ ID NO: 468256 - DNA, 14 bp, Homo sapiens
attcttgcactgta

SEQ ID NO: 468257 - DNA, 16 bp, Homo sapiens
attcttgcactgtatc

SEQ ID NO: 468258 - DNA, 19 bp, Homo sapiens
attcttgctttcacaaata

SEQ ID NO: 468259 - DNA, 20 bp, Homo sapiens
attcttttcccatcaccaga

SEQ ID NO: 468260 - DNA, 21 bp, Homo sapiens
attcttttttcaatgtactgt

SEQ ID NO: 468261 - DNA, 19 bp, Homo sapiens
cacaactaacaatgccttg

SEQ ID NO: 468262 - DNA, 20 bp, Homo sapiens
cacaattttcactttttctg

SEQ ID NO: 468263 - DNA, 23 bp, Homo sapiens
cacacagcagccccccagcacta

SEQ ID NO: 468264 - DNA, 18 bp, Homo sapiens
cacaccccgtctgcccct

SEQ ID NO: 468265 - DNA, 13 bp, Homo sapiens
cacacccttcccc

SEQ ID NO: 468266 - DNA, 17 bp, Homo sapiens
cacacccttccccactc

SEQ ID NO: 468267 - DNA, 18 bp, Homo sapiens
cacacctccacccgtcct

SEQ ID NO: 468268 - DNA, 15 bp, Homo sapiens
cacacgccggggctg

SEQ ID NO: 468269 - DNA, 20 bp, Homo sapiens
cacacgccggggctggccct

SEQ ID NO: 468270 - DNA, 23 bp, Homo sapiens
cacacgccggggctggccctgcc

SEQ ID NO: 468271 - DNA, 14 bp, Homo sapiens
cacacttcaggctc

SEQ ID NO: 468272 - DNA, 21 bp, Homo sapiens
cacacttcaggctcttctcct

SEQ ID NO: 468273 - DNA, 22 bp, Homo sapiens
cacacttcaggctcttctcctt

SEQ ID NO: 468274 - DNA, 13 bp, Homo sapiens
cacagaacccttg

SEQ ID NO: 468275 - DNA, 16 bp, Homo sapiens
cacagaactcagcctt

SEQ ID NO: 468276 - DNA, 18 bp, Homo sapiens
cacagaactcagccttaa

SEQ ID NO: 468277 - DNA, 11 bp, Homo sapiens
cacagcagccc

SEQ ID NO: 468278 - DNA, 20 bp, Homo sapiens
cacagcagccccccagcact

SEQ ID NO: 468279 - DNA, 18 bp, Homo sapiens
cacagcagtacttgctca

SEQ ID NO: 468280 - DNA, 23 bp, Homo sapiens
cacagccgtttgaatatatttta

SEQ ID NO: 468281 - DNA, 19 bp, Homo sapiens
cacaggacacgaaggctgc

SEQ ID NO: 468282 - DNA, 20 bp, Homo sapiens
cacaggacacgaaggctgcc

SEQ ID NO: 468283 - DNA, 17 bp, Homo sapiens
cacaggcccttcctctc

SEQ ID NO: 468284 - DNA, 21 bp, Homo sapiens
cacaggcccttcctctccact

SEQ ID NO: 468285 - DNA, 19 bp, Homo sapiens
cacagtgcatctcagccca

SEQ ID NO: 468286 - DNA, 20 bp, Homo sapiens
cacagttctggctataaact

SEQ ID NO: 468287 - DNA, 18 bp, Homo sapiens
cacataaatctgtctgat

SEQ ID NO: 468288 - DNA, 19 bp, Homo sapiens
cacataaatctgtctgatt

SEQ ID NO: 468289 - DNA, 22 bp, Homo sapiens
cacataaatctgtctgattcta

SEQ ID NO: 468290 - DNA, 22 bp, Homo sapiens
cacatccaccccggctccccct

SEQ ID NO: 468291 - DNA, 15 bp, Homo sapiens
cacatccccaccctc

SEQ ID NO: 468292 - DNA, 16 bp, Homo sapiens
caccaacctcactgcc

SEQ ID NO: 468293 - DNA, 17 bp, Homo sapiens
caccaacctcactgccc

SEQ ID NO: 468294 - DNA, 19 bp, Homo sapiens
caccaagggtatctgctgc

SEQ ID NO: 468295 - DNA, 21 bp, Homo sapiens
caccaagggtatctgctgcct

SEQ ID NO: 468296 - DNA, 19 bp, Homo sapiens
caccacaactaacaatgcc

SEQ ID NO: 468297 - DNA, 17 bp, Homo sapiens
caccaccccttgcccaa

SEQ ID NO: 468298 - DNA, 23 bp, Homo sapiens
caccagatgcaacctcactatgg

SEQ ID NO: 468299 - DNA, 18 bp, Homo sapiens
caccagcctgagccacag

SEQ ID NO: 468300 - DNA, 22 bp, Homo sapiens
caccatcccctcctagcacaag

SEQ ID NO: 468301 - DNA, 14 bp, Homo sapiens
caccatccttccat

SEQ ID NO: 468302 - DNA, 17 bp, Homo sapiens
caccatccttccatcct

SEQ ID NO: 468303 - DNA, 21 bp, Homo sapiens
caccatccttccatcctgagg

SEQ ID NO: 468304 - DNA, 18 bp, Homo sapiens
caccatctggagtcttcc

SEQ ID NO: 468305 - DNA, 19 bp, Homo sapiens
cacccaattttaaaaaata

SEQ ID NO: 468306 - DNA, 13 bp, Homo sapiens
cacccacaccccg

SEQ ID NO: 468307 - DNA, 19 bp, Homo sapiens
cacccacaccccgtctgcc

SEQ ID NO: 468308 - DNA, 22 bp, Homo sapiens
cacccacaccccgtctgcccct

SEQ ID NO: 468309 - DNA, 19 bp, Homo sapiens
cacccaccaccgctcccgc

SEQ ID NO: 468310 - DNA, 13 bp, Homo sapiens
cacccagaggtct

SEQ ID NO: 468311 - DNA, 14 bp, Homo sapiens
cacccagaggtctc

SEQ ID NO: 468312 - DNA, 18 bp, Homo sapiens
cacccagaggtctcccta

SEQ ID NO: 468313 - DNA, 13 bp, Homo sapiens
caccccactgaga

SEQ ID NO: 468314 - DNA, 16 bp, Homo sapiens
caccccactgagagct

SEQ ID NO: 468315 - DNA, 21 bp, Homo sapiens
caccccactgagagctgctcc

SEQ ID NO: 468316 - DNA, 23 bp, Homo sapiens
caccccactgagagctgctcctt

SEQ ID NO: 468317 - DNA, 20 bp, Homo sapiens
caccccataagccctgagac

SEQ ID NO: 468318 - DNA, 13 bp, Homo sapiens
cacccccagcctc

SEQ ID NO: 468319 - DNA, 14 bp, Homo sapiens
caccccgctgcctg

SEQ ID NO: 468320 - DNA, 18 bp, Homo sapiens
caccccgctgcctggcgg

SEQ ID NO: 468321 - DNA, 15 bp, Homo sapiens
caccccgtcccggcc

SEQ ID NO: 468322 - DNA, 19 bp, Homo sapiens
caccccgtcccggccccgc

SEQ ID NO: 468323 - DNA, 15 bp, Homo sapiens
caccccgtctgcccc

SEQ ID NO: 468324 - DNA, 13 bp, Homo sapiens
caccccttgccca

SEQ ID NO: 468325 - DNA, 13 bp, Homo sapiens
cacccgccccaga

SEQ ID NO: 468326 - DNA, 18 bp, Homo sapiens
cacccgccccagagactg

SEQ ID NO: 468327 - DNA, 19 bp, Homo sapiens
cacccgcccgcccccgccc

SEQ ID NO: 468328 - DNA, 17 bp, Homo sapiens
cacccgtcctggggtgg

SEQ ID NO: 468329 - DNA, 14 bp, Homo sapiens
caccctccactctg

SEQ ID NO: 468330 - DNA, 15 bp, Homo sapiens
caccctccactctga

SEQ ID NO: 468331 - DNA, 16 bp, Homo sapiens
caccctccactctgag

SEQ ID NO: 468332 - DNA, 17 bp, Homo sapiens
caccctccactctgagg

SEQ ID NO: 468333 - DNA, 15 bp, Homo sapiens
caccctctcctgggg

SEQ ID NO: 468334 - DNA, 14 bp, Homo sapiens
cacccttccccact

SEQ ID NO: 468335 - DNA, 15 bp, Homo sapiens
cacccttccccactc

SEQ ID NO: 468336 - DNA, 13 bp, Homo sapiens
caccgccacccca

SEQ ID NO: 468337 - DNA, 20 bp, Homo sapiens
caccgcccaacccccacctc

SEQ ID NO: 468338 - DNA, 21 bp, Homo sapiens
caccgcccaacccccacctcc

SEQ ID NO: 468339 - DNA, 13 bp, Homo sapiens
caccgcccaccca

SEQ ID NO: 468340 - DNA, 14 bp, Homo sapiens
caccgcccacccac

SEQ ID NO: 468341 - DNA, 22 bp, Homo sapiens
caccgcccacccacaccccgtc

SEQ ID NO: 468342 - DNA, 17 bp, Homo sapiens
caccgggagcctccccc

SEQ ID NO: 468343 - DNA, 22 bp, Homo sapiens
cacctcccggtgtatgcagtgg

SEQ ID NO: 468344 - DNA, 23 bp, Homo sapiens
cacctcccggtgtatgcagtggt

SEQ ID NO: 468345 - DNA, 14 bp, Homo sapiens
cacctgcccagtta

SEQ ID NO: 468346 - DNA, 13 bp, Homo sapiens
caccttctgtttt

SEQ ID NO: 468347 - DNA, 23 bp, Homo sapiens
caccttgggcacgggagagcgcc

SEQ ID NO: 468348 - DNA, 23 bp, Homo sapiens
caccttgtacagaaccagcactc

SEQ ID NO: 468349 - DNA, 22 bp, Homo sapiens
cacctttgtaaatacacaattc

SEQ ID NO: 468350 - DNA, 20 bp, Homo sapiens
cacgattccaacccaggtct

SEQ ID NO: 468351 - DNA, 21 bp, Homo sapiens
cacgattccaacccaggtctg

SEQ ID NO: 468352 - DNA, 16 bp, Homo sapiens
cacgcagagccccgga

SEQ ID NO: 468353 - DNA, 23 bp, Homo sapiens
cacgcagagccccggagcaccac

SEQ ID NO: 468354 - DNA, 17 bp, Homo sapiens
cacgccggggctggccc

SEQ ID NO: 468355 - DNA, 18 bp, Homo sapiens
cacgcctcctggccagac

SEQ ID NO: 468356 - DNA, 18 bp, Homo sapiens
cacgctgacagcctccta

SEQ ID NO: 468357 - DNA, 19 bp, Homo sapiens
cacgctgacagcctcctag

SEQ ID NO: 468358 - DNA, 13 bp, Homo sapiens
cacgctgtcctct

SEQ ID NO: 468359 - DNA, 22 bp, Homo sapiens
cacgctgtcctctcgagcccag

SEQ ID NO: 468360 - DNA, 21 bp, Homo sapiens
cacggccgtccctgacttccc

SEQ ID NO: 468361 - DNA, 15 bp, Homo sapiens
cacgggagagcgcca

SEQ ID NO: 468362 - DNA, 16 bp, Homo sapiens
cacgggagagcgccac

SEQ ID NO: 468363 - DNA, 12 bp, Homo sapiens
cacgggcccgct

SEQ ID NO: 468364 - DNA, 22 bp, Homo sapiens
cacggggtcgggggaggagcac

SEQ ID NO: 468365 - DNA, 14 bp, Homo sapiens
cacgttgcagaaaa

SEQ ID NO: 468366 - DNA, 21 bp, Homo sapiens
cactaaggccgtgtctctgag

SEQ ID NO: 468367 - DNA, 22 bp, Homo sapiens
cactaatggccaagtgtacatt

SEQ ID NO: 468368 - DNA, 16 bp, Homo sapiens
cactagaatgagaaat

SEQ ID NO: 468369 - DNA, 23 bp, Homo sapiens
cactagccctctttctctctgtg

SEQ ID NO: 468370 - DNA, 21 bp, Homo sapiens
cactaggtgcccagtcttgag

SEQ ID NO: 468371 - DNA, 19 bp, Homo sapiens
cactatggtatgctggcca

SEQ ID NO: 468372 - DNA, 21 bp, Homo sapiens
cactatggtatgctggccagc

SEQ ID NO: 468373 - DNA, 15 bp, Homo sapiens
cactccactcccctc

SEQ ID NO: 468374 - DNA, 17 bp, Homo sapiens
cactccactcccctcat

SEQ ID NO: 468375 - DNA, 17 bp, Homo sapiens
cactccagacccctggc

SEQ ID NO: 468376 - DNA, 13 bp, Homo sapiens
cactcccagggcc

SEQ ID NO: 468377 - DNA, 15 bp, Homo sapiens
cactcccagggcccg

SEQ ID NO: 468378 - DNA, 16 bp, Homo sapiens
cactcccctcatccac

SEQ ID NO: 468379 - DNA, 13 bp, Homo sapiens
cactcctacctgg

SEQ ID NO: 468380 - DNA, 11 bp, Homo sapiens
cactctgaagt

SEQ ID NO: 468381 - DNA, 18 bp, Homo sapiens
cactctgaagtcccttcc

SEQ ID NO: 468382 - DNA, 20 bp, Homo sapiens
cactctgaagtcccttcctg

SEQ ID NO: 468383 - DNA, 12 bp, Homo sapiens
cactctgtcagc

SEQ ID NO: 468384 - DNA, 16 bp, Homo sapiens
cactctgtcagccagc

SEQ ID NO: 468385 - DNA, 17 bp, Homo sapiens
cactctgtcagccagcc

SEQ ID NO: 468386 - DNA, 18 bp, Homo sapiens
cactctgtcagccagccg

SEQ ID NO: 468387 - DNA, 22 bp, Homo sapiens
cactgaataatggaattatgta

SEQ ID NO: 468388 - DNA, 12 bp, Homo sapiens
cactgctggctg

SEQ ID NO: 468389 - DNA, 15 bp, Homo sapiens
cactgctggctgcct

SEQ ID NO: 468390 - DNA, 21 bp, Homo sapiens
cactgctggctgccttagaac

SEQ ID NO: 468391 - DNA, 16 bp, Homo sapiens
cactggtgcatttaaa

SEQ ID NO: 468392 - DNA, 23 bp, Homo sapiens
cactggtggcccgacagcctggc

SEQ ID NO: 468393 - DNA, 16 bp, Homo sapiens
cactgtaatcttaaaa

SEQ ID NO: 468394 - DNA, 16 bp, Homo sapiens
cacttaaactttgtca

SEQ ID NO: 468395 - DNA, 22 bp, Homo sapiens
cacttaaactttgtcacttctg

SEQ ID NO: 468396 - DNA, 17 bp, Homo sapiens
cacttagaaattgcatt

SEQ ID NO: 468397 - DNA, 24 bp, Homo sapiens
cacttagaaattgcatttcctgac

SEQ ID NO: 468398 - DNA, 15 bp, Homo sapiens
cacttatgctgctgt

SEQ ID NO: 468399 - DNA, 14 bp, Homo sapiens
cacttatttcataa

SEQ ID NO: 468400 - DNA, 17 bp, Homo sapiens
cacttatttcataaaca

SEQ ID NO: 468401 - DNA, 12 bp, Homo sapiens
cacttattttct

SEQ ID NO: 468402 - DNA, 18 bp, Homo sapiens
cacttattttctgaattc

SEQ ID NO: 468403 - DNA, 14 bp, Homo sapiens
cacttccagagggg

SEQ ID NO: 468404 - DNA, 18 bp, Homo sapiens
cacttccagagggggcca

SEQ ID NO: 468405 - DNA, 19 bp, Homo sapiens
cacttctatttatttatta

SEQ ID NO: 468406 - DNA, 12 bp, Homo sapiens
cacttctgctgt

SEQ ID NO: 468407 - DNA, 13 bp, Homo sapiens
cacttctgttatc

SEQ ID NO: 468408 - DNA, 21 bp, Homo sapiens
cactttagaggcttgatcatg

SEQ ID NO: 468409 - DNA, 17 bp, Homo sapiens
cactttccacttccaga

SEQ ID NO: 468410 - DNA, 18 bp, Homo sapiens
cactttccacttccagag

SEQ ID NO: 468411 - DNA, 14 bp, Homo sapiens
cactttcctctctc

SEQ ID NO: 468412 - DNA, 15 bp, Homo sapiens
cactttcctctctct

SEQ ID NO: 468413 - DNA, 16 bp, Homo sapiens
cactttcctctctctc

SEQ ID NO: 468414 - DNA, 19 bp, Homo sapiens
cactttgagcctgggaaat

SEQ ID NO: 468415 - DNA, 13 bp, Homo sapiens
cacttttttataa

SEQ ID NO: 468416 - DNA, 15 bp, Homo sapiens
cagaaaaaaggactg

SEQ ID NO: 468417 - DNA, 19 bp, Homo sapiens
cagaaaaaaggactgtata

SEQ ID NO: 468418 - DNA, 17 bp, Homo sapiens
cagaaaaagagcttccc

SEQ ID NO: 468419 - DNA, 20 bp, Homo sapiens
cagaaagggcagcccctccc

SEQ ID NO: 468420 - DNA, 20 bp, Homo sapiens
cagaaccaacgggtctgtgg

SEQ ID NO: 468421 - DNA, 21 bp, Homo sapiens
cagaaccaacgggtctgtggg

SEQ ID NO: 468422 - DNA, 13 bp, Homo sapiens
cagaaccagcact

SEQ ID NO: 468423 - DNA, 14 bp, Homo sapiens
cagaaccagcactc

SEQ ID NO: 468424 - DNA, 23 bp, Homo sapiens
cagaagtcagttgcaaattttag

SEQ ID NO: 468425 - DNA, 15 bp, Homo sapiens
cagacagacagacag

SEQ ID NO: 468426 - DNA, 13 bp, Homo sapiens
cagacagagtgga

SEQ ID NO: 468427 - DNA, 14 bp, Homo sapiens
cagacagagtggat

SEQ ID NO: 468428 - DNA, 15 bp, Homo sapiens
cagacagggtggggc

SEQ ID NO: 468429 - DNA, 16 bp, Homo sapiens
cagacagggtggggct

SEQ ID NO: 468430 - DNA, 18 bp, Homo sapiens
cagacccctaccctttcc

SEQ ID NO: 468431 - DNA, 18 bp, Homo sapiens
cagacccctggcttttca

SEQ ID NO: 468432 - DNA, 22 bp, Homo sapiens
cagacccctggcttttcactgc

SEQ ID NO: 468433 - DNA, 23 bp, Homo sapiens
cagacccctggcttttcactgct

SEQ ID NO: 468434 - DNA, 16 bp, Homo sapiens
cagaccctccttcccc

SEQ ID NO: 468435 - DNA, 17 bp, Homo sapiens
cagactctctcctctct

SEQ ID NO: 468436 - DNA, 18 bp, Homo sapiens
cagagacggcagccccat

SEQ ID NO: 468437 - DNA, 20 bp, Homo sapiens
cagagactgcccaccctggg

SEQ ID NO: 468438 - DNA, 23 bp, Homo sapiens
cagagactgcccaccctgggcct

SEQ ID NO: 468439 - DNA, 20 bp, Homo sapiens
cagagattgggggggcttgg

SEQ ID NO: 468440 - DNA, 21 bp, Homo sapiens
cagagattgggggggcttggg

SEQ ID NO: 468441 - DNA, 15 bp, Homo sapiens
cagagccccggagca

SEQ ID NO: 468442 - DNA, 13 bp, Homo sapiens
cagagctggatgc

SEQ ID NO: 468443 - DNA, 14 bp, Homo sapiens
cagagctggatgct

SEQ ID NO: 468444 - DNA, 17 bp, Homo sapiens
cagaggcagggccctgg

SEQ ID NO: 468445 - DNA, 19 bp, Homo sapiens
cagaggcagggccctgggg

SEQ ID NO: 468446 - DNA, 15 bp, Homo sapiens
cagagggggccagag

SEQ ID NO: 468447 - DNA, 15 bp, Homo sapiens
cagagtaggtgggtc

SEQ ID NO: 468448 - DNA, 15 bp, Homo sapiens
cagagtggatctgga

SEQ ID NO: 468449 - DNA, 14 bp, Homo sapiens
cagatccctcggtc

SEQ ID NO: 468450 - DNA, 21 bp, Homo sapiens
cagatccctcggtcagcaccg

SEQ ID NO: 468451 - DNA, 14 bp, Homo sapiens
cagattattttcta

SEQ ID NO: 468452 - DNA, 15 bp, Homo sapiens
cagattattttctat

SEQ ID NO: 468453 - DNA, 16 bp, Homo sapiens
cagattattttctata

SEQ ID NO: 468454 - DNA, 14 bp, Homo sapiens
cagattccacagga

SEQ ID NO: 468455 - DNA, 20 bp, Homo sapiens
cagcaaccctacagtatata

SEQ ID NO: 468456 - DNA, 20 bp, Homo sapiens
catcccttggcccctctctg

SEQ ID NO: 468457 - DNA, 14 bp, Homo sapiens
catcctgaggaccg

SEQ ID NO: 468458 - DNA, 21 bp, Homo sapiens
catcctgaggaccgccccaac

SEQ ID NO: 468459 - DNA, 19 bp, Homo sapiens
catcctgattattgaatgt

SEQ ID NO: 468460 - DNA, 16 bp, Homo sapiens
catccttccatcctga

SEQ ID NO: 468461 - DNA, 19 bp, Homo sapiens
catccttgcacttctgtta

SEQ ID NO: 468462 - DNA, 21 bp, Homo sapiens
catcggaggctgggcccctgg

SEQ ID NO: 468463 - DNA, 14 bp, Homo sapiens
catctaaaatactc

SEQ ID NO: 468464 - DNA, 21 bp, Homo sapiens
catctctccccatatataaat

SEQ ID NO: 468465 - DNA, 12 bp, Homo sapiens
catctgaaaaga

SEQ ID NO: 468466 - DNA, 13 bp, Homo sapiens
catctgaaaagaa

SEQ ID NO: 468467 - DNA, 21 bp, Homo sapiens
catctgaaatctacaacataa

SEQ ID NO: 468468 - DNA, 16 bp, Homo sapiens
catctgaggagtccaa

SEQ ID NO: 468469 - DNA, 16 bp, Homo sapiens
catctgagtccagctc

SEQ ID NO: 468470 - DNA, 18 bp, Homo sapiens
catctgttatcctgctag

SEQ ID NO: 468471 - DNA, 12 bp, Homo sapiens
catcttgtaaat

SEQ ID NO: 468472 - DNA, 18 bp, Homo sapiens
catcttgtaaataatgct

SEQ ID NO: 468473 - DNA, 19 bp, Homo sapiens
catgaagttgtaagaaaag

SEQ ID NO: 468474 - DNA, 15 bp, Homo sapiens
catgaatgaatgaac

SEQ ID NO: 468475 - DNA, 13 bp, Homo sapiens
catgatattgtat

SEQ ID NO: 468476 - DNA, 23 bp, Homo sapiens
catgatctgtatttaatggtttt

SEQ ID NO: 468477 - DNA, 13 bp, Homo sapiens
catggatgattct

SEQ ID NO: 468478 - DNA, 14 bp, Homo sapiens
catggatgattctt

SEQ ID NO: 468479 - DNA, 14 bp, Homo sapiens
catggattgattaa

SEQ ID NO: 468480 - DNA, 19 bp, Homo sapiens
catggattgattaaaagca

SEQ ID NO: 468481 - DNA, 23 bp, Homo sapiens
catggatttcctttgacctctca

SEQ ID NO: 468482 - DNA, 15 bp, Homo sapiens
catgggggctccaga

SEQ ID NO: 468483 - DNA, 14 bp, Homo sapiens
catggtatctcttt

SEQ ID NO: 468484 - DNA, 19 bp, Homo sapiens
catgtagcatataaatgtt

SEQ ID NO: 468485 - DNA, 23 bp, Homo sapiens
catgtagcatataaatgtttata

SEQ ID NO: 468486 - DNA, 16 bp, Homo sapiens
catgtccctaccgagt

SEQ ID NO: 468487 - DNA, 16 bp, Homo sapiens
catgtctctttgccaa

SEQ ID NO: 468488 - DNA, 21 bp, Homo sapiens
catgtgattggcagcttcaaa

SEQ ID NO: 468489 - DNA, 17 bp, Homo sapiens
catgtgcctgcaccagg

SEQ ID NO: 468490 - DNA, 18 bp, Homo sapiens
catgtgcctgcaccagga

SEQ ID NO: 468491 - DNA, 15 bp, Homo sapiens
catgtgtcccctcac

SEQ ID NO: 468492 - DNA, 20 bp, Homo sapiens
catgtgttgcaaattattct

SEQ ID NO: 468493 - DNA, 21 bp, Homo sapiens
catgtgttgcaaattattcta

SEQ ID NO: 468494 - DNA, 23 bp, Homo sapiens
catgtgttgcaaattattctagt

SEQ ID NO: 468495 - DNA, 16 bp, Homo sapiens
catgtttaagaaatga

SEQ ID NO: 468496 - DNA, 21 bp, Homo sapiens
catgtttaagaaatgagaaat

SEQ ID NO: 468497 - DNA, 22 bp, Homo sapiens
catgtttctgcagtattctgta

SEQ ID NO: 468498 - DNA, 16 bp, Homo sapiens
cattaaacactgtaat

SEQ ID NO: 468499 - DNA, 18 bp, Homo sapiens
cattaaacactgtaatct

SEQ ID NO: 468500 - DNA, 20 bp, Homo sapiens
cattagactgaatttaacta

SEQ ID NO: 468501 - DNA, 17 bp, Homo sapiens
cattatctctttctctc

SEQ ID NO: 468502 - DNA, 16 bp, Homo sapiens
cattatggctttgtgc

SEQ ID NO: 468503 - DNA, 20 bp, Homo sapiens
cattcaaaatagttctattt

SEQ ID NO: 468504 - DNA, 22 bp, Homo sapiens
cattcaaaatagttctatttct

SEQ ID NO: 468505 - DNA, 23 bp, Homo sapiens
cattcaaaatagttctatttcta

SEQ ID NO: 468506 - DNA, 15 bp, Homo sapiens
cattcaagcctgtga

SEQ ID NO: 468507 - DNA, 19 bp, Homo sapiens
cattcatactcaaagaggc

SEQ ID NO: 468508 - DNA, 23 bp, Homo sapiens
cattcccttggatgtagtctgag

SEQ ID NO: 468509 - DNA, 14 bp, Homo sapiens
cattctcactccta

SEQ ID NO: 468510 - DNA, 18 bp, Homo sapiens
cattctggggtggggctt

SEQ ID NO: 468511 - DNA, 20 bp, Homo sapiens
cattctggggtggggcttgg

SEQ ID NO: 468512 - DNA, 13 bp, Homo sapiens
cattcttatttta

SEQ ID NO: 468513 - DNA, 15 bp, Homo sapiens
cattcttattttaga

SEQ ID NO: 468514 - DNA, 13 bp, Homo sapiens
cattgcaaaaggt

SEQ ID NO: 468515 - DNA, 16 bp, Homo sapiens
cattgcaaaaggttaa

SEQ ID NO: 468516 - DNA, 22 bp, Homo sapiens
cattgcaaaaggttaagccata

SEQ ID NO: 468517 - DNA, 22 bp, Homo sapiens
cattgcaggaagagatgctcta

SEQ ID NO: 468518 - DNA, 19 bp, Homo sapiens
cattggggggccgggcagg

SEQ ID NO: 468519 - DNA, 14 bp, Homo sapiens
cattggttacaaat

SEQ ID NO: 468520 - DNA, 19 bp, Homo sapiens
cattgtattttactttgtg

SEQ ID NO: 468521 - DNA, 13 bp, Homo sapiens
catttaaaatgga

SEQ ID NO: 468522 - DNA, 14 bp, Homo sapiens
catttaaaatggac

SEQ ID NO: 468523 - DNA, 14 bp, Homo sapiens
catttagtcctcac

SEQ ID NO: 468524 - DNA, 18 bp, Homo sapiens
catttagtcctcaccttc

SEQ ID NO: 468525 - DNA, 15 bp, Homo sapiens
cattttctaaactgt

SEQ ID NO: 468526 - DNA, 18 bp, Homo sapiens
cattttctaaactgtttt

SEQ ID NO: 468527 - DNA, 22 bp, Homo sapiens
cattttcttcagagagctaaat

SEQ ID NO: 468528 - DNA, 16 bp, Homo sapiens
cattttgggaaattct

SEQ ID NO: 468529 - DNA, 20 bp, Homo sapiens
cattttgggggtttttaatc

SEQ ID NO: 468530 - DNA, 18 bp, Homo sapiens
cattttgtctggctgtgg

SEQ ID NO: 468531 - DNA, 19 bp, Homo sapiens
ccaaaaacaataaacgaaa

SEQ ID NO: 468532 - DNA, 13 bp, Homo sapiens
ccaaaatgtcaat

SEQ ID NO: 468533 - DNA, 17 bp, Homo sapiens
ccaaagaaactcagaag

SEQ ID NO: 468534 - DNA, 23 bp, Homo sapiens
ccaaataggagtcttctgcctct

SEQ ID NO: 468535 - DNA, 15 bp, Homo sapiens
ccaaatgcaatgtga

SEQ ID NO: 468536 - DNA, 13 bp, Homo sapiens
ccaaattctctga

SEQ ID NO: 468537 - DNA, 18 bp, Homo sapiens
ccaacaccaccccttgcc

SEQ ID NO: 468538 - DNA, 14 bp, Homo sapiens
ccaacagacaccct

SEQ ID NO: 468539 - DNA, 15 bp, Homo sapiens
ccaacagacaccctc

SEQ ID NO: 468540 - DNA, 18 bp, Homo sapiens
ccaacagacaccctccac

SEQ ID NO: 468541 - DNA, 21 bp, Homo sapiens
ccaaccctcggagccccccac

SEQ ID NO: 468542 - DNA, 22 bp, Homo sapiens
ccaaccctcggagccccccact

SEQ ID NO: 468543 - DNA, 15 bp, Homo sapiens
ccaacctcactgccc

SEQ ID NO: 468544 - DNA, 14 bp, Homo sapiens
ccaactaagttgta

SEQ ID NO: 468545 - DNA, 18 bp, Homo sapiens
ccaactctggccttggtt

SEQ ID NO: 468546 - DNA, 19 bp, Homo sapiens
ccaagaatagatgctgact

SEQ ID NO: 468547 - DNA, 20 bp, Homo sapiens
ccaagaatagatgctgactg

SEQ ID NO: 468548 - DNA, 23 bp, Homo sapiens
ccaagccagggttccagacaggg

SEQ ID NO: 468549 - DNA, 15 bp, Homo sapiens
ccaagccgtggcttc

SEQ ID NO: 468550 - DNA, 16 bp, Homo sapiens
ccaagccgtggcttcc

SEQ ID NO: 468551 - DNA, 21 bp, Homo sapiens
ccaagccgtggcttcccgctc

SEQ ID NO: 468552 - DNA, 22 bp, Homo sapiens
ccaaggacactgatgggtcctg

SEQ ID NO: 468553 - DNA, 16 bp, Homo sapiens
cccaggcggaggggct

SEQ ID NO: 468554 - DNA, 23 bp, Homo sapiens
cccaggcggaggggcttggagca

SEQ ID NO: 468555 - DNA, 16 bp, Homo sapiens
cccaggctgcgcctgc

SEQ ID NO: 468556 - DNA, 21 bp, Homo sapiens
cccaggctgcgcctgcccgcc

SEQ ID NO: 468557 - DNA, 13 bp, Homo sapiens
cccagggcccgag

SEQ ID NO: 468558 - DNA, 14 bp, Homo sapiens
cccagggtgcaggc

SEQ ID NO: 468559 - DNA, 16 bp, Homo sapiens
cccagtcttgagtggg

SEQ ID NO: 468560 - DNA, 16 bp, Homo sapiens
cccagttagcccggcc

SEQ ID NO: 468561 - DNA, 17 bp, Homo sapiens
cccagttagcccggcca

SEQ ID NO: 468562 - DNA, 13 bp, Homo sapiens
cccatatataaat

SEQ ID NO: 468563 - DNA, 15 bp, Homo sapiens
cccatatataaatta

SEQ ID NO: 468564 - DNA, 18 bp, Homo sapiens
cccatccttcccgcagca

SEQ ID NO: 468565 - DNA, 12 bp, Homo sapiens
cccatggcccca

SEQ ID NO: 468566 - DNA, 13 bp, Homo sapiens
cccatggccccag

SEQ ID NO: 468567 - DNA, 15 bp, Homo sapiens
cccatggccccagct

SEQ ID NO: 468568 - DNA, 17 bp, Homo sapiens
cccatggccccagctgg

SEQ ID NO: 468569 - DNA, 18 bp, Homo sapiens
cccatggccccagctggc

SEQ ID NO: 468570 - DNA, 22 bp, Homo sapiens
cccatgtgcctgcaccaggaga

SEQ ID NO: 468571 - DNA, 19 bp, Homo sapiens
ccccaagatgagctgcagc

SEQ ID NO: 468572 - DNA, 12 bp, Homo sapiens
ccccaaggaaga

SEQ ID NO: 468573 - DNA, 21 bp, Homo sapiens
ccccacacgccggggctggcc

SEQ ID NO: 468574 - DNA, 18 bp, Homo sapiens
ccccaccacacacaccct

SEQ ID NO: 468575 - DNA, 13 bp, Homo sapiens
ccccacccaccac

SEQ ID NO: 468576 - DNA, 22 bp, Homo sapiens
ccccactcagtaggtctgaagg

SEQ ID NO: 468577 - DNA, 18 bp, Homo sapiens
ccccactgagagctgctc

SEQ ID NO: 468578 - DNA, 20 bp, Homo sapiens
ccccacttatgctgctgtga

SEQ ID NO: 468579 - DNA, 18 bp, Homo sapiens
ccccagagactgcccacc

SEQ ID NO: 468580 - DNA, 22 bp, Homo sapiens
ccccagagagagctctgcacgt

SEQ ID NO: 468581 - DNA, 16 bp, Homo sapiens
ccccagcctcccccag

SEQ ID NO: 468582 - DNA, 18 bp, Homo sapiens
ccccagcctcccccaggc

SEQ ID NO: 468583 - DNA, 20 bp, Homo sapiens
ccccagcctcccccaggctg

SEQ ID NO: 468584 - DNA, 22 bp, Homo sapiens
ccccagcgtggggctaacgggc

SEQ ID NO: 468585 - DNA, 14 bp, Homo sapiens
ccccaggccctccc

SEQ ID NO: 468586 - DNA, 19 bp, Homo sapiens
ccccaggcggaggggcttg

SEQ ID NO: 468587 - DNA, 14 bp, Homo sapiens
ccccaggctgcgcc

SEQ ID NO: 468588 - DNA, 20 bp, Homo sapiens
ccccaggctgcgcctgcccg

SEQ ID NO: 468589 - DNA, 16 bp, Homo sapiens
ccccagggtgcaggcg

SEQ ID NO: 468590 - DNA, 17 bp, Homo sapiens
ccccataagccctgaga

SEQ ID NO: 468591 - DNA, 16 bp, Homo sapiens
ccccatatataaatta

SEQ ID NO: 468592 - DNA, 18 bp, Homo sapiens
ccccatatataaattatt

SEQ ID NO: 468593 - DNA, 17 bp, Homo sapiens
ccccatccttcccgcag

SEQ ID NO: 468594 - DNA, 19 bp, Homo sapiens
ccccatggtgcagtgaaga

SEQ ID NO: 468595 - DNA, 12 bp, Homo sapiens
cccccacccctc

SEQ ID NO: 468596 - DNA, 14 bp, Homo sapiens
cccccacctcccgg

SEQ ID NO: 468597 - DNA, 15 bp, Homo sapiens
cccccacggccgtcc

SEQ ID NO: 468598 - DNA, 12 bp, Homo sapiens
cccccagcctcc

SEQ ID NO: 468599 - DNA, 18 bp, Homo sapiens
cccccaggctgcgcctgc

SEQ ID NO: 468600 - DNA, 12 bp, Homo sapiens
ccccccagcact

SEQ ID NO: 468601 - DNA, 13 bp, Homo sapiens
cccccgaggcccc

SEQ ID NO: 468602 - DNA, 14 bp, Homo sapiens
cccccgaggccccc

SEQ ID NO: 468603 - DNA, 20 bp, Homo sapiens
cccccgaggcccccctctgc

SEQ ID NO: 468604 - DNA, 14 bp, Homo sapiens
cccccggaggcgcc

SEQ ID NO: 468605 - DNA, 14 bp, Homo sapiens
ccccctcccccgca

SEQ ID NO: 468606 - DNA, 18 bp, Homo sapiens
ccccctcctttccaaata

SEQ ID NO: 468607 - DNA, 17 bp, Homo sapiens
ccccctctgcctttgag

SEQ ID NO: 468608 - DNA, 13 bp, Homo sapiens
cccccttcccctg

SEQ ID NO: 468609 - DNA, 21 bp, Homo sapiens
ccccgaggcccccctctgcct

SEQ ID NO: 468610 - DNA, 19 bp, Homo sapiens
ccccgcagccctctccacc

SEQ ID NO: 468611 - DNA, 18 bp, Homo sapiens
ccccgcccgccctcctct

SEQ ID NO: 468612 - DNA, 20 bp, Homo sapiens
ccccgcccgccctcctctgc

SEQ ID NO: 468613 - DNA, 23 bp, Homo sapiens
ccccgcccgccctcctctgcccc

SEQ ID NO: 468614 - DNA, 15 bp, Homo sapiens
ccccgcgtcttcagc

SEQ ID NO: 468615 - DNA, 17 bp, Homo sapiens
ccccggacgctggctcg

SEQ ID NO: 468616 - DNA, 20 bp, Homo sapiens
ccccggagcaccacggggtc

SEQ ID NO: 468617 - DNA, 18 bp, Homo sapiens
ccccgtcccggccccgcg

SEQ ID NO: 468618 - DNA, 15 bp, Homo sapiens
ccccgtccctttccc

SEQ ID NO: 468619 - DNA, 17 bp, Homo sapiens
ccccgtccctttccctg

SEQ ID NO: 468620 - DNA, 13 bp, Homo sapiens
ccccgtgcggccc

SEQ ID NO: 468621 - DNA, 22 bp, Homo sapiens
ccccgtgcggcccgtgcgcagc

SEQ ID NO: 468622 - DNA, 14 bp, Homo sapiens
cccctatcctgcac

SEQ ID NO: 468623 - DNA, 21 bp, Homo sapiens
cccctatcctgcaccctctgc

SEQ ID NO: 468624 - DNA, 15 bp, Homo sapiens
cccctcactctgtca

SEQ ID NO: 468625 - DNA, 20 bp, Homo sapiens
cccctcagatgatctctcca

SEQ ID NO: 468626 - DNA, 11 bp, Homo sapiens
cccctccagac

SEQ ID NO: 468627 - DNA, 12 bp, Homo sapiens
cccctccccatg

SEQ ID NO: 468628 - DNA, 18 bp, Homo sapiens
cccctcccccgcagacag

SEQ ID NO: 468629 - DNA, 16 bp, Homo sapiens
cccctccgtccccagg

SEQ ID NO: 468630 - DNA, 20 bp, Homo sapiens
cccctccgtccccagggtgc

SEQ ID NO: 468631 - DNA, 13 bp, Homo sapiens
cccctcctagcac

SEQ ID NO: 468632 - DNA, 19 bp, Homo sapiens
cccctcctcgggcgcctgc

SEQ ID NO: 468633 - DNA, 21 bp, Homo sapiens
cccctcctcgggcgcctgcgc

SEQ ID NO: 468634 - DNA, 11 bp, Homo sapiens
cccctccttct

SEQ ID NO: 468635 - DNA, 13 bp, Homo sapiens
cccctccttctcc

SEQ ID NO: 468636 - DNA, 20 bp, Homo sapiens
cccctccttctcccctccag

SEQ ID NO: 468637 - DNA, 21 bp, Homo sapiens
cccctccttctcccctccaga

SEQ ID NO: 468638 - DNA, 23 bp, Homo sapiens
cccctcttcttgcggcaccgccc

SEQ ID NO: 468639 - DNA, 18 bp, Homo sapiens
cccctcttgagaggggtg

SEQ ID NO: 468640 - DNA, 18 bp, Homo sapiens
cccctgaggacctttctg

SEQ ID NO: 468641 - DNA, 12 bp, Homo sapiens
cccctgccagca

SEQ ID NO: 468642 - DNA, 17 bp, Homo sapiens
cccctgcgccctccctc

SEQ ID NO: 468643 - DNA, 15 bp, Homo sapiens
cccctgttcactcta

SEQ ID NO: 468644 - DNA, 17 bp, Homo sapiens
ccccttcccgccttcag

SEQ ID NO: 468645 - DNA, 17 bp, Homo sapiens
ccccttctgtgtcacag

SEQ ID NO: 468646 - DNA, 14 bp, Homo sapiens
cccgacagcctggc

SEQ ID NO: 468647 - DNA, 20 bp, Homo sapiens
cccgagcgcgtgccttcccc

SEQ ID NO: 468648 - DNA, 15 bp, Homo sapiens
cccgaggcccccctc

SEQ ID NO: 468649 - DNA, 19 bp, Homo sapiens
cccgaggcccccctctgcc

SEQ ID NO: 468650 - DNA, 22 bp, Homo sapiens
cccgcagcaccagcctgagcca

SEQ ID NO: 468651 - DNA, 15 bp, Homo sapiens
cccgcagccctctcc

SEQ ID NO: 468652 - DNA, 16 bp, Homo sapiens
cccgcagccctctcca

SEQ ID NO: 468653 - DNA, 16 bp, Homo sapiens
cccgcccaccccgctg

SEQ ID NO: 468654 - DNA, 17 bp, Homo sapiens
cccgcccaccccgctgc

SEQ ID NO: 468655 - DNA, 12 bp, Homo sapiens
cccgccccagag

SEQ ID NO: 468656 - DNA, 15 bp, Homo sapiens
cccgccctcctctgc

SEQ ID NO: 468657 - DNA, 21 bp, Homo sapiens
cccgccggttggccggctggc

SEQ ID NO: 468658 - DNA, 23 bp, Homo sapiens
cccgccggttggccggctggccg

SEQ ID NO: 468659 - DNA, 21 bp, Homo sapiens
cccgccttcaggttcctccta

SEQ ID NO: 468660 - DNA, 24 bp, Homo sapiens
cccgccttcaggttcctcctaggc

SEQ ID NO: 468661 - DNA, 17 bp, Homo sapiens
cccgcgcgtgcccccag

SEQ ID NO: 468662 - DNA, 18 bp, Homo sapiens
cccgcgcgtgcccccagc

SEQ ID NO: 468663 - DNA, 23 bp, Homo sapiens
cccgctcagccctccctgcccct

SEQ ID NO: 468664 - DNA, 13 bp, Homo sapiens
cccggagctcaag

SEQ ID NO: 468665 - DNA, 18 bp, Homo sapiens
cccggaggcgcccacctg

SEQ ID NO: 468666 - DNA, 18 bp, Homo sapiens
cccggaggggcctggcag

SEQ ID NO: 468667 - DNA, 16 bp, Homo sapiens
cccggccaaggacact

SEQ ID NO: 468668 - DNA, 14 bp, Homo sapiens
cccggcccacgcag

SEQ ID NO: 468669 - DNA, 17 bp, Homo sapiens
cccggcccacgcagagc

SEQ ID NO: 468670 - DNA, 20 bp, Homo sapiens
cccggccccgcgcgtgcccc

SEQ ID NO: 468671 - DNA, 17 bp, Homo sapiens
cccggcctccaggctgg

SEQ ID NO: 468672 - DNA, 18 bp, Homo sapiens
cccggcctccaggctggg

SEQ ID NO: 468673 - DNA, 21 bp, Homo sapiens
cccggcctccaggctggggcc

SEQ ID NO: 468674 - DNA, 19 bp, Homo sapiens
cccggctccccctgccagc

SEQ ID NO: 468675 - DNA, 18 bp, Homo sapiens
cccggtgcccaagaatag

SEQ ID NO: 468676 - DNA, 17 bp, Homo sapiens
cccggtgtatgcagtgg

SEQ ID NO: 468677 - DNA, 13 bp, Homo sapiens
cccgtctgcccct

SEQ ID NO: 468678 - DNA, 16 bp, Homo sapiens
cccgtgcgcagccgcg

SEQ ID NO: 468679 - DNA, 20 bp, Homo sapiens
cccgtgcggcccgtgcgcag

SEQ ID NO: 468680 - DNA, 21 bp, Homo sapiens
ccctaagttcctatttcattt

SEQ ID NO: 468681 - DNA, 17 bp, Homo sapiens
ccctaccctcttctcag

SEQ ID NO: 468682 - DNA, 18 bp, Homo sapiens
ccctaccgagtctcttct

SEQ ID NO: 468683 - DNA, 17 bp, Homo sapiens
ccctagaagaaaacccg

SEQ ID NO: 468684 - DNA, 20 bp, Homo sapiens
ccctaggtctccacccctca

SEQ ID NO: 468685 - DNA, 14 bp, Homo sapiens
ccctatcctgcacc

SEQ ID NO: 468686 - DNA, 15 bp, Homo sapiens
ccctatcctgcaccc

SEQ ID NO: 468687 - DNA, 16 bp, Homo sapiens
ccctatcctgcaccct

SEQ ID NO: 468688 - DNA, 18 bp, Homo sapiens
ccctatcctgcaccctct

SEQ ID NO: 468689 - DNA, 15 bp, Homo sapiens
ccctcactccactcc

SEQ ID NO: 468690 - DNA, 17 bp, Homo sapiens
ccctcactccactcccc

SEQ ID NO: 468691 - DNA, 17 bp, Homo sapiens
ccctcactctgtcagcc

SEQ ID NO: 468692 - DNA, 18 bp, Homo sapiens
ccctcactctgtcagcca

SEQ ID NO: 468693 - DNA, 19 bp, Homo sapiens
ccctccacacctccacccg

SEQ ID NO: 468694 - DNA, 20 bp, Homo sapiens
ccctccacgcctcctggcca

SEQ ID NO: 468695 - DNA, 21 bp, Homo sapiens
ccctccacgcctcctggccag

SEQ ID NO: 468696 - DNA, 14 bp, Homo sapiens
ccctccactcctcc

SEQ ID NO: 468697 - DNA, 19 bp, Homo sapiens
ccctccactcctcccaact

SEQ ID NO: 468698 - DNA, 15 bp, Homo sapiens
ccctccactctgagg

SEQ ID NO: 468699 - DNA, 11 bp, Homo sapiens
ccctccagacc

SEQ ID NO: 468700 - DNA, 19 bp, Homo sapiens
ccctccagacccctaccct

SEQ ID NO: 468701 - DNA, 14 bp, Homo sapiens
ccctcccccacggc

SEQ ID NO: 468702 - DNA, 17 bp, Homo sapiens
ccctcccccgcagacag

SEQ ID NO: 468703 - DNA, 11 bp, Homo sapiens
ccctccctccc

SEQ ID NO: 468704 - DNA, 13 bp, Homo sapiens
ccctccctgactc

SEQ ID NO: 468705 - DNA, 15 bp, Homo sapiens
ccctccgtccccagg

SEQ ID NO: 468706 - DNA, 16 bp, Homo sapiens
ccctccgtccccaggg

SEQ ID NO: 468707 - DNA, 12 bp, Homo sapiens
ccctcctagcac

SEQ ID NO: 468708 - DNA, 12 bp, Homo sapiens
ccctcctctgcc

SEQ ID NO: 468709 - DNA, 14 bp, Homo sapiens
ccctcctctgcccc

SEQ ID NO: 468710 - DNA, 16 bp, Homo sapiens
ccctcctctgccccct

SEQ ID NO: 468711 - DNA, 18 bp, Homo sapiens
ccctcctctgccccctcc

SEQ ID NO: 468712 - DNA, 16 bp, Homo sapiens
ccctccttccccaccc

SEQ ID NO: 468713 - DNA, 17 bp, Homo sapiens
ccctccttctcccctcc

SEQ ID NO: 468714 - DNA, 14 bp, Homo sapiens
ccctcggtcagcac

SEQ ID NO: 468715 - DNA, 15 bp, Homo sapiens
ccctcggtcagcacc

SEQ ID NO: 468716 - DNA, 20 bp, Homo sapiens
ccctcgtctccctggccacc

SEQ ID NO: 468717 - DNA, 22 bp, Homo sapiens
ccctctcctgagcctgtctctc

SEQ ID NO: 468718 - DNA, 13 bp, Homo sapiens
ccctctcctgggg

SEQ ID NO: 468719 - DNA, 14 bp, Homo sapiens
ccctctgcctttga

SEQ ID NO: 468720 - DNA, 21 bp, Homo sapiens
ccctctgcctttgagcttctc

SEQ ID NO: 468721 - DNA, 21 bp, Homo sapiens
ccctctgctatgtctgtgatg

SEQ ID NO: 468722 - DNA, 20 bp, Homo sapiens
ccctcttcccccttcccctg

SEQ ID NO: 468723 - DNA, 23 bp, Homo sapiens
ccctcttctcagctccactctga

SEQ ID NO: 468724 - DNA, 17 bp, Homo sapiens
ccctctttctctctgtg

SEQ ID NO: 468725 - DNA, 18 bp, Homo sapiens
ccctctttctctctgtgt

SEQ ID NO: 468726 - DNA, 20 bp, Homo sapiens
ccctctttctctctgtgtgg

SEQ ID NO: 468727 - DNA, 13 bp, Homo sapiens
ccctgacttccca

SEQ ID NO: 468728 - DNA, 21 bp, Homo sapiens
ccctgagactcccgcctttga

SEQ ID NO: 468729 - DNA, 23 bp, Homo sapiens
ccctgagcccagaaaaaaggact

SEQ ID NO: 468730 - DNA, 13 bp, Homo sapiens
ccctgaggtacct

SEQ ID NO: 468731 - DNA, 19 bp, Homo sapiens
ccctgcaccttgggcacgg

SEQ ID NO: 468732 - DNA, 16 bp, Homo sapiens
ccctgcatcccttggc

SEQ ID NO: 468733 - DNA, 22 bp, Homo sapiens
ccctgcatcccttggcccctct

SEQ ID NO: 468734 - DNA, 23 bp, Homo sapiens
ccctgcccctcccttcaaccatt

SEQ ID NO: 468735 - DNA, 21 bp, Homo sapiens
ccctgccctcactccactccc

SEQ ID NO: 468736 - DNA, 15 bp, Homo sapiens
ccctgccctccccca

SEQ ID NO: 468737 - DNA, 14 bp, Homo sapiens
ccctgccctgcacc

SEQ ID NO: 468738 - DNA, 23 bp, Homo sapiens
ccctgcttagtgtcccttacctg

SEQ ID NO: 468739 - DNA, 17 bp, Homo sapiens
ccctgctttgggctgcc

SEQ ID NO: 468740 - DNA, 19 bp, Homo sapiens
ccctggctcccacaggccc

SEQ ID NO: 468741 - DNA, 18 bp, Homo sapiens
ccctggcttttcactgct

SEQ ID NO: 468742 - DNA, 19 bp, Homo sapiens
ccctgggatgggaccaggg

SEQ ID NO: 468743 - DNA, 17 bp, Homo sapiens
ccctgggcccctccacg

SEQ ID NO: 468744 - DNA, 18 bp, Homo sapiens
ccctgggcccctccacgc

SEQ ID NO: 468745 - DNA, 19 bp, Homo sapiens
ccctgggctgtctgtcacc

SEQ ID NO: 468746 - DNA, 20 bp, Homo sapiens
ccctgggctgtctgtcacca

SEQ ID NO: 468747 - DNA, 22 bp, Homo sapiens
ccctggggtctctgagcagtgg

SEQ ID NO: 468748 - DNA, 17 bp, Homo sapiens
cctctgctccaacagac

SEQ ID NO: 468749 - DNA, 22 bp, Homo sapiens
cctctgcttgtcattctgctaa

SEQ ID NO: 468750 - DNA, 23 bp, Homo sapiens
cctctgcttgtcattctgctaat

SEQ ID NO: 468751 - DNA, 12 bp, Homo sapiens
cctctggtcctt

SEQ ID NO: 468752 - DNA, 15 bp, Homo sapiens
cctcttcccccttcc

SEQ ID NO: 468753 - DNA, 16 bp, Homo sapiens
cctcttctcagctcca

SEQ ID NO: 468754 - DNA, 17 bp, Homo sapiens
cctcttctcagctccac

SEQ ID NO: 468755 - DNA, 22 bp, Homo sapiens
cctcttctcagctccactctga

SEQ ID NO: 468756 - DNA, 19 bp, Homo sapiens
cctcttgagaggggtgaga

SEQ ID NO: 468757 - DNA, 18 bp, Homo sapiens
cctctttctctctgtgtg

SEQ ID NO: 468758 - DNA, 14 bp, Homo sapiens
cctgaaataaaact

SEQ ID NO: 468759 - DNA, 19 bp, Homo sapiens
cctgaagagcgctcctctg

SEQ ID NO: 468760 - DNA, 20 bp, Homo sapiens
cctgaagagcgctcctctgc

SEQ ID NO: 468761 - DNA, 22 bp, Homo sapiens
cctgaagagcgctcctctgcct

SEQ ID NO: 468762 - DNA, 19 bp, Homo sapiens
cctgacgatcttccccctt

SEQ ID NO: 468763 - DNA, 22 bp, Homo sapiens
cctgacgatcttcccccttccc

SEQ ID NO: 468764 - DNA, 17 bp, Homo sapiens
cctgactccctgtgggg

SEQ ID NO: 468765 - DNA, 14 bp, Homo sapiens
cctgacttcccagc

SEQ ID NO: 468766 - DNA, 16 bp, Homo sapiens
cctgacttcccagctg

SEQ ID NO: 468767 - DNA, 21 bp, Homo sapiens
cctgacttcccagctggcagc

SEQ ID NO: 468768 - DNA, 13 bp, Homo sapiens
cctgagactcccg

SEQ ID NO: 468769 - DNA, 20 bp, Homo sapiens
cctgagactcccgcctttga

SEQ ID NO: 468770 - DNA, 21 bp, Homo sapiens
cctgagccacagtggggccca

SEQ ID NO: 468771 - DNA, 13 bp, Homo sapiens
cctgagcctgtct

SEQ ID NO: 468772 - DNA, 15 bp, Homo sapiens
cctgagcctgtctct

SEQ ID NO: 468773 - DNA, 15 bp, Homo sapiens
cctgagctccaccct

SEQ ID NO: 468774 - DNA, 20 bp, Homo sapiens
cctgaggacctttctgagga

SEQ ID NO: 468775 - DNA, 17 bp, Homo sapiens
cctgagggaagcccacc

SEQ ID NO: 468776 - DNA, 18 bp, Homo sapiens
cctgagggaagcccaccc

SEQ ID NO: 468777 - DNA, 22 bp, Homo sapiens
cctgagggaagcccacccgccc

SEQ ID NO: 468778 - DNA, 22 bp, Homo sapiens
cctgaggtacctttccacccag

SEQ ID NO: 468779 - DNA, 22 bp, Homo sapiens
cctgataaacattaaacactgt

SEQ ID NO: 468780 - DNA, 23 bp, Homo sapiens
cctgataaacattaaacactgta

SEQ ID NO: 468781 - DNA, 18 bp, Homo sapiens
cctgattattgaatgtta

SEQ ID NO: 468782 - DNA, 21 bp, Homo sapiens
cctgcatcccttggcccctct

SEQ ID NO: 468783 - DNA, 15 bp, Homo sapiens
cctgcatgcaactaa

SEQ ID NO: 468784 - DNA, 16 bp, Homo sapiens
cctgcatgcaactaat

SEQ ID NO: 468785 - DNA, 18 bp, Homo sapiens
cctgcccagttagcccgg

SEQ ID NO: 468786 - DNA, 20 bp, Homo sapiens
cctgcccagttagcccggcc

SEQ ID NO: 468787 - DNA, 12 bp, Homo sapiens
cctgcccatgtg

SEQ ID NO: 468788 - DNA, 12 bp, Homo sapiens
cctgcccccctt

SEQ ID NO: 468789 - DNA, 20 bp, Homo sapiens
cctgccccccttcccacccc

SEQ ID NO: 468790 - DNA, 18 bp, Homo sapiens
cctgcccctcccttcaac

SEQ ID NO: 468791 - DNA, 13 bp, Homo sapiens
cctgccctcactc

SEQ ID NO: 468792 - DNA, 20 bp, Homo sapiens
cctgccctcactccactccc

SEQ ID NO: 468793 - DNA, 19 bp, Homo sapiens
cctgccctcccccacggcc

SEQ ID NO: 468794 - DNA, 21 bp, Homo sapiens
cctgcgccctccctccctcca

SEQ ID NO: 468795 - DNA, 12 bp, Homo sapiens
cctgcgctcctc

SEQ ID NO: 468796 - DNA, 17 bp, Homo sapiens
cctgctagctgtagaaa

SEQ ID NO: 468797 - DNA, 20 bp, Homo sapiens
cctgctgctcgggaaggcct

SEQ ID NO: 468798 - DNA, 17 bp, Homo sapiens
cctgctttgggctgccc

SEQ ID NO: 468799 - DNA, 19 bp, Homo sapiens
cctgctttgggctgccctg

SEQ ID NO: 468800 - DNA, 23 bp, Homo sapiens
cctgctttgggctgccctggtgc

SEQ ID NO: 468801 - DNA, 12 bp, Homo sapiens
cctggagaacta

SEQ ID NO: 468802 - DNA, 13 bp, Homo sapiens
cctggatgttata

SEQ ID NO: 468803 - DNA, 13 bp, Homo sapiens
cctggattttctt

SEQ ID NO: 468804 - DNA, 13 bp, Homo sapiens
cctggcacaccag

SEQ ID NO: 468805 - DNA, 14 bp, Homo sapiens
cctggcacaccaga

SEQ ID NO: 468806 - DNA, 18 bp, Homo sapiens
cctggcagccgtgccttc

SEQ ID NO: 468807 - DNA, 22 bp, Homo sapiens
cctggcagccgtgccttcagct

SEQ ID NO: 468808 - DNA, 13 bp, Homo sapiens
cctggccaccctt

SEQ ID NO: 468809 - DNA, 13 bp, Homo sapiens
cctggccagacgc

SEQ ID NO: 468810 - DNA, 14 bp, Homo sapiens
cctggcctatttaa

SEQ ID NO: 468811 - DNA, 17 bp, Homo sapiens
cctggcctatttaagcc

SEQ ID NO: 468812 - DNA, 19 bp, Homo sapiens
cctggcgggcagcccctgc

SEQ ID NO: 468813 - DNA, 18 bp, Homo sapiens
cctggcttttcactgctg

SEQ ID NO: 468814 - DNA, 21 bp, Homo sapiens
cctggcttttcactgctggct

SEQ ID NO: 468815 - DNA, 24 bp, Homo sapiens
cctggcttttcactgctggctgcc

SEQ ID NO: 468816 - DNA, 18 bp, Homo sapiens
cctgggcccctccacgcc

SEQ ID NO: 468817 - DNA, 22 bp, Homo sapiens
cctgggcccctccacgcctcct

SEQ ID NO: 468818 - DNA, 23 bp, Homo sapiens
cctgggcccctccacgcctcctg

SEQ ID NO: 468819 - DNA, 14 bp, Homo sapiens
cctgggcctcagtt

SEQ ID NO: 468820 - DNA, 15 bp, Homo sapiens
cctgggcctcccgtc

SEQ ID NO: 468821 - DNA, 14 bp, Homo sapiens
cctgggggtggcag

SEQ ID NO: 468822 - DNA, 15 bp, Homo sapiens
cctgggggtggcagg

SEQ ID NO: 468823 - DNA, 18 bp, Homo sapiens
cctgggggtggcaggcac

SEQ ID NO: 468824 - DNA, 16 bp, Homo sapiens
cctggggtctctgagc

SEQ ID NO: 468825 - DNA, 17 bp, Homo sapiens
cctggggtctctgagca

SEQ ID NO: 468826 - DNA, 20 bp, Homo sapiens
cctggggtctctgagcagtg

SEQ ID NO: 468827 - DNA, 19 bp, Homo sapiens
cctggggtggttggaggcc

SEQ ID NO: 468828 - DNA, 21 bp, Homo sapiens
cctggggtggttggaggcctg

SEQ ID NO: 468829 - DNA, 17 bp, Homo sapiens
cctggtctggagcccct

SEQ ID NO: 468830 - DNA, 18 bp, Homo sapiens
cctggtctggagccccta

SEQ ID NO: 468831 - DNA, 14 bp, Homo sapiens
cctggtgtctagtt

SEQ ID NO: 468832 - DNA, 13 bp, Homo sapiens
cctgtagtgagaa

SEQ ID NO: 468833 - DNA, 19 bp, Homo sapiens
cctgtccacctgtgctgct

SEQ ID NO: 468834 - DNA, 13 bp, Homo sapiens
cctgtcctgctca

SEQ ID NO: 468835 - DNA, 13 bp, Homo sapiens
cctgtctctccct

SEQ ID NO: 468836 - DNA, 14 bp, Homo sapiens
cctgtctctcccta

SEQ ID NO: 468837 - DNA, 19 bp, Homo sapiens
cctgtgaatggcagcctga

SEQ ID NO: 468838 - DNA, 17 bp, Homo sapiens
cctgtgatcgtgtgttg

SEQ ID NO: 468839 - DNA, 20 bp, Homo sapiens
cctgtgatcgtgtgttgcca

SEQ ID NO: 468840 - DNA, 13 bp, Homo sapiens
cctgtgctttcat

SEQ ID NO: 468841 - DNA, 15 bp, Homo sapiens
cctgtgggagtccac

SEQ ID NO: 468842 - DNA, 15 bp, Homo sapiens
cctgtgggggtggcc

SEQ ID NO: 468843 - DNA, 14 bp, Homo sapiens
ccttaagaaagcta

SEQ ID NO: 468844 - DNA, 15 bp, Homo sapiens
ccttaagaaagctat

SEQ ID NO: 468845 - DNA, 15 bp, Homo sapiens
cggggcagagctgag

SEQ ID NO: 468846 - DNA, 23 bp, Homo sapiens
cggggctggccctgccctccccc

SEQ ID NO: 468847 - DNA, 19 bp, Homo sapiens
cgggggaggagcaccccca

SEQ ID NO: 468848 - DNA, 23 bp, Homo sapiens
cgggggaggagcacccccagcct

SEQ ID NO: 468849 - DNA, 18 bp, Homo sapiens
cgggggctaactggcccc

SEQ ID NO: 468850 - DNA, 18 bp, Homo sapiens
cggggtcgggggaggagc

SEQ ID NO: 468851 - DNA, 23 bp, Homo sapiens
cgggtgcgtgaccggcccgccac

SEQ ID NO: 468852 - DNA, 16 bp, Homo sapiens
cgggtgtggcctcagc

SEQ ID NO: 468853 - DNA, 19 bp, Homo sapiens
cgggtgtggcctcagccct

SEQ ID NO: 468854 - DNA, 20 bp, Homo sapiens
cgggtgtggcctcagccctc

SEQ ID NO: 468855 - DNA, 15 bp, Homo sapiens
cggtccaccccgtcc

SEQ ID NO: 468856 - DNA, 15 bp, Homo sapiens
cggtggtgaggcagt

SEQ ID NO: 468857 - DNA, 16 bp, Homo sapiens
cggtgtatgcagtggt

SEQ ID NO: 468858 - DNA, 17 bp, Homo sapiens
cggttggccggctggcc

SEQ ID NO: 468859 - DNA, 13 bp, Homo sapiens
cgtccccagggtg

SEQ ID NO: 468860 - DNA, 14 bp, Homo sapiens
cgtccccagggtgc

SEQ ID NO: 468861 - DNA, 14 bp, Homo sapiens
cgtcccggccccgc

SEQ ID NO: 468862 - DNA, 22 bp, Homo sapiens
cgtccctttccctgcatccctt

SEQ ID NO: 468863 - DNA, 14 bp, Homo sapiens
cgtccggcctgcag

SEQ ID NO: 468864 - DNA, 15 bp, Homo sapiens
cgtccggcctgcagc

SEQ ID NO: 468865 - DNA, 17 bp, Homo sapiens
cgtccggcctgcagccc

SEQ ID NO: 468866 - DNA, 22 bp, Homo sapiens
cgtcctggggtggttggaggcc

SEQ ID NO: 468867 - DNA, 15 bp, Homo sapiens
cgtctccctggccac

SEQ ID NO: 468868 - DNA, 10 bp, Homo sapiens
cgtctgcccc

SEQ ID NO: 468869 - DNA, 22 bp, Homo sapiens
cgtctgccccttgaccccacac

SEQ ID NO: 468870 - DNA, 15 bp, Homo sapiens
cgtgaccggcccgcc

SEQ ID NO: 468871 - DNA, 22 bp, Homo sapiens
cgtgacttcagactctctcctc

SEQ ID NO: 468872 - DNA, 18 bp, Homo sapiens
cgtgccttcagctctaca

SEQ ID NO: 468873 - DNA, 23 bp, Homo sapiens
cgtgcgcagccgcgctctgcccc

SEQ ID NO: 468874 - DNA, 21 bp, Homo sapiens
cgtgcggcccgtgcgcagccg

SEQ ID NO: 468875 - DNA, 17 bp, Homo sapiens
cgtgggatccagagaga

SEQ ID NO: 468876 - DNA, 14 bp, Homo sapiens
cgtggtgtgaggcc

SEQ ID NO: 468877 - DNA, 16 bp, Homo sapiens
cgtggtgtgaggcccc

SEQ ID NO: 468878 - DNA, 14 bp, Homo sapiens
ctaaaaaataactg

SEQ ID NO: 468879 - DNA, 18 bp, Homo sapiens
ctaaaaaataactgtgca

SEQ ID NO: 468880 - DNA, 16 bp, Homo sapiens
ctaaaaggaggacagg

SEQ ID NO: 468881 - DNA, 17 bp, Homo sapiens
ctaaaatactcaccaaa

SEQ ID NO: 468882 - DNA, 19 bp, Homo sapiens
ctaaaattcaacaaatgat

SEQ ID NO: 468883 - DNA, 14 bp, Homo sapiens
ctaaaattctagtc

SEQ ID NO: 468884 - DNA, 22 bp, Homo sapiens
ctaaaattctagtctctgattt

SEQ ID NO: 468885 - DNA, 13 bp, Homo sapiens
ctaaagcagagat

SEQ ID NO: 468886 - DNA, 14 bp, Homo sapiens
ctaaagcagagatg

SEQ ID NO: 468887 - DNA, 21 bp, Homo sapiens
ctaaaggggacagatcttgag

SEQ ID NO: 468888 - DNA, 16 bp, Homo sapiens
ctaaatccattttcta

SEQ ID NO: 468889 - DNA, 19 bp, Homo sapiens
ctaaatccattttctaaac

SEQ ID NO: 468890 - DNA, 13 bp, Homo sapiens
ctaacgggcgcct

SEQ ID NO: 468891 - DNA, 16 bp, Homo sapiens
ctaactagtaatcttg

SEQ ID NO: 468892 - DNA, 16 bp, Homo sapiens
ctaagaataaataaag

SEQ ID NO: 468893 - DNA, 18 bp, Homo sapiens
ctaagctgttggaagggg

SEQ ID NO: 468894 - DNA, 13 bp, Homo sapiens
ctaagcttatttc

SEQ ID NO: 468895 - DNA, 22 bp, Homo sapiens
ctaagtcagtttcacatatttg

SEQ ID NO: 468896 - DNA, 17 bp, Homo sapiens
ctaagttgtattttaat

SEQ ID NO: 468897 - DNA, 20 bp, Homo sapiens
ctaatgaatgcaaaaagata

SEQ ID NO: 468898 - DNA, 19 bp, Homo sapiens
ctaatgtaatcatttatct

SEQ ID NO: 468899 - DNA, 21 bp, Homo sapiens
ctaatgtaatcatttatctta

SEQ ID NO: 468900 - DNA, 12 bp, Homo sapiens
ctacagtatata

SEQ ID NO: 468901 - DNA, 15 bp, Homo sapiens
ctacatctgaaatct

SEQ ID NO: 468902 - DNA, 17 bp, Homo sapiens
ctaccgagtctcttctc

SEQ ID NO: 468903 - DNA, 19 bp, Homo sapiens
ctaccgagtctcttctcca

SEQ ID NO: 468904 - DNA, 17 bp, Homo sapiens
ctactaagaataaataa

SEQ ID NO: 468905 - DNA, 15 bp, Homo sapiens
ctactatttgaaaaa

SEQ ID NO: 468906 - DNA, 16 bp, Homo sapiens
ctactgattgaatgtt

SEQ ID NO: 468907 - DNA, 14 bp, Homo sapiens
ctagaaggggcgag

SEQ ID NO: 468908 - DNA, 20 bp, Homo sapiens
ctagaatgagaaatcatgtt

SEQ ID NO: 468909 - DNA, 13 bp, Homo sapiens
ctagagcattctg

SEQ ID NO: 468910 - DNA, 20 bp, Homo sapiens
ctagagcattctggggtggg

SEQ ID NO: 468911 - DNA, 23 bp, Homo sapiens
ctagagcattctggggtggggct

SEQ ID NO: 468912 - DNA, 17 bp, Homo sapiens
ctagcaagaagattcta

SEQ ID NO: 468913 - DNA, 21 bp, Homo sapiens
ctagcaagaagattctaaaac

SEQ ID NO: 468914 - DNA, 19 bp, Homo sapiens
ctagcacaaggagtgcccg

SEQ ID NO: 468915 - DNA, 19 bp, Homo sapiens
ctagccctctttctctctg

SEQ ID NO: 468916 - DNA, 20 bp, Homo sapiens
ctagccctctttctctctgt

SEQ ID NO: 468917 - DNA, 17 bp, Homo sapiens
ctagctataacaactct

SEQ ID NO: 468918 - DNA, 21 bp, Homo sapiens
ctaggctccctgaggtacctt

SEQ ID NO: 468919 - DNA, 15 bp, Homo sapiens
ctaggtctccacccc

SEQ ID NO: 468920 - DNA, 18 bp, Homo sapiens
ctaggtgcccagtcttga

SEQ ID NO: 468921 - DNA, 17 bp, Homo sapiens
ctaggttaataggagga

SEQ ID NO: 468922 - DNA, 15 bp, Homo sapiens
ctagtcaactgctgt

SEQ ID NO: 468923 - DNA, 18 bp, Homo sapiens
ctagtcctattctattgc

SEQ ID NO: 468924 - DNA, 20 bp, Homo sapiens
ctagtcgtgaatcatttctc

SEQ ID NO: 468925 - DNA, 21 bp, Homo sapiens
ctataaattcaacacttattt

SEQ ID NO: 468926 - DNA, 22 bp, Homo sapiens
ctataagagacaaagtttggaa

SEQ ID NO: 468927 - DNA, 23 bp, Homo sapiens
ctataagggagtaggctgtattt

SEQ ID NO: 468928 - DNA, 21 bp, Homo sapiens
ctataccctaggtctccaccc

SEQ ID NO: 468929 - DNA, 16 bp, Homo sapiens
ctatactgtttgtaat

SEQ ID NO: 468930 - DNA, 12 bp, Homo sapiens
ctatagaataaa

SEQ ID NO: 468931 - DNA, 21 bp, Homo sapiens
ctatagtggccacactctgcc

SEQ ID NO: 468932 - DNA, 22 bp, Homo sapiens
ctatatatatatatatatgtat

SEQ ID NO: 468933 - DNA, 22 bp, Homo sapiens
ctatatatgaataattatgttt

SEQ ID NO: 468934 - DNA, 14 bp, Homo sapiens
ctatatttcatatt

SEQ ID NO: 468935 - DNA, 15 bp, Homo sapiens
ctatatttcatattg

SEQ ID NO: 468936 - DNA, 16 bp, Homo sapiens
ctatatttcatattga

SEQ ID NO: 468937 - DNA, 22 bp, Homo sapiens
ctatatttggattcacagcctt

SEQ ID NO: 468938 - DNA, 23 bp, Homo sapiens
ctatatttggattcacagccttt

SEQ ID NO: 468939 - DNA, 15 bp, Homo sapiens
ctatcctgcaccctc

SEQ ID NO: 468940 - DNA, 17 bp, Homo sapiens
ctatcctgcaccctctg

SEQ ID NO: 468941 - DNA, 21 bp, Homo sapiens
ctatcctgcaccctctgctat

SEQ ID NO: 468942 - DNA, 16 bp, Homo sapiens
ctctccacccagaggt

SEQ ID NO: 468943 - DNA, 13 bp, Homo sapiens
ctctccacggtag

SEQ ID NO: 468944 - DNA, 11 bp, Homo sapiens
ctctccactgc

SEQ ID NO: 468945 - DNA, 15 bp, Homo sapiens
ctctccccatatata

SEQ ID NO: 468946 - DNA, 21 bp, Homo sapiens
ctctccctaccctcttctcag

SEQ ID NO: 468947 - DNA, 16 bp, Homo sapiens
ctctcctgagcctgtc

SEQ ID NO: 468948 - DNA, 18 bp, Homo sapiens
ctctcctgagcctgtctc

SEQ ID NO: 468949 - DNA, 12 bp, Homo sapiens
ctctctattctg

SEQ ID NO: 468950 - DNA, 13 bp, Homo sapiens
ctctctcctctct

SEQ ID NO: 468951 - DNA, 18 bp, Homo sapiens
ctctctcctctctctccc

SEQ ID NO: 468952 - DNA, 12 bp, Homo sapiens
ctctctctccct

SEQ ID NO: 468953 - DNA, 13 bp, Homo sapiens
ctctctctctctg

SEQ ID NO: 468954 - DNA, 11 bp, Homo sapiens
ctctctctctg

SEQ ID NO: 468955 - DNA, 13 bp, Homo sapiens
ctctctctctgtt

SEQ ID NO: 468956 - DNA, 14 bp, Homo sapiens
ctctctctctgttc

SEQ ID NO: 468957 - DNA, 16 bp, Homo sapiens
ctctctctctgttcca

SEQ ID NO: 468958 - DNA, 9 bp, Homo sapiens
ctctctctg

SEQ ID NO: 468959 - DNA, 11 bp, Homo sapiens
ctctctctgtt

SEQ ID NO: 468960 - DNA, 17 bp, Homo sapiens
ctctctggggccctggg

SEQ ID NO: 468961 - DNA, 13 bp, Homo sapiens
ctctctgttccaa

SEQ ID NO: 468962 - DNA, 12 bp, Homo sapiens
ctctctgtttac

SEQ ID NO: 468963 - DNA, 21 bp, Homo sapiens
ctctctgtttaccctccctgt

SEQ ID NO: 468964 - DNA, 13 bp, Homo sapiens
ctctcttcttact

SEQ ID NO: 468965 - DNA, 21 bp, Homo sapiens
ctctgaaaatatttttttcta

SEQ ID NO: 468966 - DNA, 24 bp, Homo sapiens
ctctgaaaatatttttttctagct

SEQ ID NO: 468967 - DNA, 15 bp, Homo sapiens
ctctgaagtcccttc

SEQ ID NO: 468968 - DNA, 23 bp, Homo sapiens
ctctgaagtcccttcctgtcctg

SEQ ID NO: 468969 - DNA, 14 bp, Homo sapiens
ctctgagcagtggg

SEQ ID NO: 468970 - DNA, 18 bp, Homo sapiens
ctctgagcagtggggagc

SEQ ID NO: 468971 - DNA, 21 bp, Homo sapiens
ctctgaggtctcaccttcgcc

SEQ ID NO: 468972 - DNA, 12 bp, Homo sapiens
ctctgcagcctg

SEQ ID NO: 468973 - DNA, 14 bp, Homo sapiens
ctctgcagcctgag

SEQ ID NO: 468974 - DNA, 18 bp, Homo sapiens
ctctgcagcctgagctcc

SEQ ID NO: 468975 - DNA, 23 bp, Homo sapiens
ctctgcataagattatatacaaa

SEQ ID NO: 468976 - DNA, 20 bp, Homo sapiens
ctctgcatagacaaaggcct

SEQ ID NO: 468977 - DNA, 14 bp, Homo sapiens
ctctgccccctccc

SEQ ID NO: 468978 - DNA, 20 bp, Homo sapiens
ctctgccccctcccccgcag

SEQ ID NO: 468979 - DNA, 10 bp, Homo sapiens
ctctgcccct

SEQ ID NO: 468980 - DNA, 23 bp, Homo sapiens
ctctgcccctccgtccccagggt

SEQ ID NO: 468981 - DNA, 13 bp, Homo sapiens
ctctgccttggac

SEQ ID NO: 468982 - DNA, 12 bp, Homo sapiens
ctctgcctttga

SEQ ID NO: 468983 - DNA, 18 bp, Homo sapiens
ctctgcctttgagcttct

SEQ ID NO: 468984 - DNA, 20 bp, Homo sapiens
ctctgcctttgagcttctcc

SEQ ID NO: 468985 - DNA, 22 bp, Homo sapiens
ctctgcctttgagcttctcctc

SEQ ID NO: 468986 - DNA, 19 bp, Homo sapiens
ctctgctccaacagacacc

SEQ ID NO: 468987 - DNA, 21 bp, Homo sapiens
ctctgctccaacagacaccct

SEQ ID NO: 468988 - DNA, 15 bp, Homo sapiens
ctctggatcctgcac

SEQ ID NO: 468989 - DNA, 16 bp, Homo sapiens
ctctggatcctgcact

SEQ ID NO: 468990 - DNA, 23 bp, Homo sapiens
ctctggccttggttcctccagca

SEQ ID NO: 468991 - DNA, 17 bp, Homo sapiens
ctctggggggttgcctc

SEQ ID NO: 468992 - DNA, 18 bp, Homo sapiens
ctctggggggttgcctcg

SEQ ID NO: 468993 - DNA, 20 bp, Homo sapiens
ctctggggggttgcctcgag

SEQ ID NO: 468994 - DNA, 14 bp, Homo sapiens
ctctggtccttctg

SEQ ID NO: 468995 - DNA, 17 bp, Homo sapiens
ctctgtcagccagccgc

SEQ ID NO: 468996 - DNA, 13 bp, Homo sapiens
ctctgtgtaatct

SEQ ID NO: 468997 - DNA, 19 bp, Homo sapiens
ctctgtgtaatctctgatt

SEQ ID NO: 468998 - DNA, 20 bp, Homo sapiens
ctctgtgtggcaaacattta

SEQ ID NO: 468999 - DNA, 13 bp, Homo sapiens
ctctgttccaagt

SEQ ID NO: 469000 - DNA, 16 bp, Homo sapiens
ctctgttccaagtgtg

SEQ ID NO: 469001 - DNA, 19 bp, Homo sapiens
ctctgttccaagtgtgtgt

SEQ ID NO: 469002 - DNA, 20 bp, Homo sapiens
ctctgttccaagtgtgtgtg

SEQ ID NO: 469003 - DNA, 15 bp, Homo sapiens
ctctgtttaccctcc

SEQ ID NO: 469004 - DNA, 17 bp, Homo sapiens
ctctgtttaccctccct

SEQ ID NO: 469005 - DNA, 19 bp, Homo sapiens
ctcttaacttaaaagaaca

SEQ ID NO: 469006 - DNA, 22 bp, Homo sapiens
ctcttacctgtaatagcctcac

SEQ ID NO: 469007 - DNA, 12 bp, Homo sapiens
ctcttcaaggcc

SEQ ID NO: 469008 - DNA, 13 bp, Homo sapiens
ctcttcaaggcca

SEQ ID NO: 469009 - DNA, 14 bp, Homo sapiens
ctcttcaaggccaa

SEQ ID NO: 469010 - DNA, 13 bp, Homo sapiens
ctcttcccccttc

SEQ ID NO: 469011 - DNA, 14 bp, Homo sapiens
ctcttcccccttcc

SEQ ID NO: 469012 - DNA, 23 bp, Homo sapiens
ctcttccttgctttctcttctaa

SEQ ID NO: 469013 - DNA, 15 bp, Homo sapiens
ctcttctcagctcca

SEQ ID NO: 469014 - DNA, 14 bp, Homo sapiens
ctcttctccactgg

SEQ ID NO: 469015 - DNA, 15 bp, Homo sapiens
ctcttctccactgga

SEQ ID NO: 469016 - DNA, 16 bp, Homo sapiens
ctcttctcctttcaca

SEQ ID NO: 469017 - DNA, 11 bp, Homo sapiens
ctcttcttcct

SEQ ID NO: 469018 - DNA, 23 bp, Homo sapiens
ctcttcttgcggcaccgcccacc

SEQ ID NO: 469019 - DNA, 16 bp, Homo sapiens
ctcttgagaggggtga

SEQ ID NO: 469020 - DNA, 23 bp, Homo sapiens
ctctttagttgatttaaactctt

SEQ ID NO: 469021 - DNA, 17 bp, Homo sapiens
ctctttctcattcttgc

SEQ ID NO: 469022 - DNA, 14 bp, Homo sapiens
ctctttctctctgt

SEQ ID NO: 469023 - DNA, 17 bp, Homo sapiens
ctctttctctctgtgtg

SEQ ID NO: 469024 - DNA, 14 bp, Homo sapiens
ctctttctctcttt

SEQ ID NO: 469025 - DNA, 17 bp, Homo sapiens
ctctttgaaaattcttg

SEQ ID NO: 469026 - DNA, 16 bp, Homo sapiens
ctcttttaaatcagat

SEQ ID NO: 469027 - DNA, 23 bp, Homo sapiens
ctgaaaagaaatgctaatgtaat

SEQ ID NO: 469028 - DNA, 23 bp, Homo sapiens
ctgaaaatatttttttctagcta

SEQ ID NO: 469029 - DNA, 17 bp, Homo sapiens
ctgaaatccaaaatagt

SEQ ID NO: 469030 - DNA, 13 bp, Homo sapiens
ctgaaatctacaa

SEQ ID NO: 469031 - DNA, 14 bp, Homo sapiens
ctgaactttggaag

SEQ ID NO: 469032 - DNA, 17 bp, Homo sapiens
ctgaagtcactgcacag

SEQ ID NO: 469033 - DNA, 18 bp, Homo sapiens
ctgaagtcccttcctgtc

SEQ ID NO: 469034 - DNA, 21 bp, Homo sapiens
ctgaagtcccttcctgtcctg

SEQ ID NO: 469035 - DNA, 20 bp, Homo sapiens
ctgaattgttatgtaaacat

SEQ ID NO: 469036 - DNA, 14 bp, Homo sapiens
ctgacagcctccta

SEQ ID NO: 469037 - DNA, 15 bp, Homo sapiens
ctgacagcctcctag

SEQ ID NO: 469038 - DNA, 16 bp, Homo sapiens
ctgacagcctcctagg

SEQ ID NO: 469039 - DNA, 22 bp, Homo sapiens
ctgacagcctcctaggctccct

SEQ ID NO: 469040 - DNA, 21 bp, Homo sapiens
ctgaccccacttatgctgctg

SEQ ID NO: 469041 - DNA, 22 bp, Homo sapiens
ctgaccccacttatgctgctgt

SEQ ID NO: 469042 - DNA, 21 bp, Homo sapiens
ctgactccctgtgggggtggc

SEQ ID NO: 469043 - DNA, 13 bp, Homo sapiens
ctgacttcccagc

SEQ ID NO: 469044 - DNA, 14 bp, Homo sapiens
ctgacttcccagct

SEQ ID NO: 469045 - DNA, 18 bp, Homo sapiens
ctgacttcccagctggca

SEQ ID NO: 469046 - DNA, 15 bp, Homo sapiens
ctgagagctgctcct

SEQ ID NO: 469047 - DNA, 16 bp, Homo sapiens
ctgagcagtggggagc

SEQ ID NO: 469048 - DNA, 21 bp, Homo sapiens
ctgagccaaaaacaataaacg

SEQ ID NO: 469049 - DNA, 17 bp, Homo sapiens
ctgagccacagtggggc

SEQ ID NO: 469050 - DNA, 21 bp, Homo sapiens
ctgagccacagtggggcccat

SEQ ID NO: 469051 - DNA, 21 bp, Homo sapiens
ctgagcccagaaaaaaggact

SEQ ID NO: 469052 - DNA, 15 bp, Homo sapiens
ctgagcccctcctct

SEQ ID NO: 469053 - DNA, 19 bp, Homo sapiens
ctgagcccctcctctcctc

SEQ ID NO: 469054 - DNA, 17 bp, Homo sapiens
ctgagcccgaatttctc

SEQ ID NO: 469055 - DNA, 14 bp, Homo sapiens
ctgagccctgccct

SEQ ID NO: 469056 - DNA, 16 bp, Homo sapiens
ctgagcctgtctctcc

SEQ ID NO: 469057 - DNA, 22 bp, Homo sapiens
ctgagcttgattctaaagggga

SEQ ID NO: 469058 - DNA, 19 bp, Homo sapiens
ctgaggacggggcagagct

SEQ ID NO: 469059 - DNA, 12 bp, Homo sapiens
ctgaggagtcca

SEQ ID NO: 469060 - DNA, 19 bp, Homo sapiens
ctgaggccccttaactcat

SEQ ID NO: 469061 - DNA, 14 bp, Homo sapiens
ctgagggaagccca

SEQ ID NO: 469062 - DNA, 19 bp, Homo sapiens
ctgagggcagggttctaga

SEQ ID NO: 469063 - DNA, 21 bp, Homo sapiens
ctgagggcagggttctagaag

SEQ ID NO: 469064 - DNA, 16 bp, Homo sapiens
ctgaggttaaggggat

SEQ ID NO: 469065 - DNA, 20 bp, Homo sapiens
ctgagtatgttaagctcttt

SEQ ID NO: 469066 - DNA, 13 bp, Homo sapiens
ctgagtccagctc

SEQ ID NO: 469067 - DNA, 14 bp, Homo sapiens
ctgagtccagctcc

SEQ ID NO: 469068 - DNA, 14 bp, Homo sapiens
ctgagtcggctggg

SEQ ID NO: 469069 - DNA, 19 bp, Homo sapiens
ctgattctatgcctgtatt

SEQ ID NO: 469070 - DNA, 23 bp, Homo sapiens
ctgattttgagctcaatctctgc

SEQ ID NO: 469071 - DNA, 20 bp, Homo sapiens
ctgcaaatagtttcaaatga

SEQ ID NO: 469072 - DNA, 11 bp, Homo sapiens
ctgcaccagga

SEQ ID NO: 469073 - DNA, 14 bp, Homo sapiens
ctgcaccaggagac

SEQ ID NO: 469074 - DNA, 13 bp, Homo sapiens
ctgcaccctctgc

SEQ ID NO: 469075 - DNA, 16 bp, Homo sapiens
ctgcaccctctgctat

SEQ ID NO: 469076 - DNA, 23 bp, Homo sapiens
ctgcaccttgggcacgggagagc

SEQ ID NO: 469077 - DNA, 22 bp, Homo sapiens
ctgcagcccagaacgggcctcc

SEQ ID NO: 469078 - DNA, 15 bp, Homo sapiens
ctgcagtattctgta

SEQ ID NO: 469079 - DNA, 14 bp, Homo sapiens
ctgcatagacaaag

SEQ ID NO: 469080 - DNA, 19 bp, Homo sapiens
ctgcatagacaaaggcctt

SEQ ID NO: 469081 - DNA, 21 bp, Homo sapiens
ctgcatatcctggtgtctagt

SEQ ID NO: 469082 - DNA, 18 bp, Homo sapiens
ctgcatcccttggcccct

SEQ ID NO: 469083 - DNA, 20 bp, Homo sapiens
ctgcatcccttggcccctct

SEQ ID NO: 469084 - DNA, 22 bp, Homo sapiens
ctgcatcccttggcccctctct

SEQ ID NO: 469085 - DNA, 13 bp, Homo sapiens
ctgcatgcaagct

SEQ ID NO: 469086 - DNA, 16 bp, Homo sapiens
ctgcatgcaagctcag

SEQ ID NO: 469087 - DNA, 20 bp, Homo sapiens
ctgcatgcaagctcagggtg

SEQ ID NO: 469088 - DNA, 13 bp, Homo sapiens
ctgccacacttca

SEQ ID NO: 469089 - DNA, 12 bp, Homo sapiens
ctgcccaccctg

SEQ ID NO: 469090 - DNA, 13 bp, Homo sapiens
ctgcccaccctgg

SEQ ID NO: 469091 - DNA, 15 bp, Homo sapiens
ctgcccaccctgggc

SEQ ID NO: 469092 - DNA, 21 bp, Homo sapiens
ctgcccaccctgggcctcccg

SEQ ID NO: 469093 - DNA, 14 bp, Homo sapiens
ctgcccagttagcc

SEQ ID NO: 469094 - DNA, 17 bp, Homo sapiens
ctgccccctcccccgca

SEQ ID NO: 469095 - DNA, 22 bp, Homo sapiens
ctgccccctcccccgcagacag

SEQ ID NO: 469096 - DNA, 17 bp, Homo sapiens
ctgccccttgaccccac

SEQ ID NO: 469097 - DNA, 22 bp, Homo sapiens
ctgccccttgaccccacacgcc

SEQ ID NO: 469098 - DNA, 14 bp, Homo sapiens
ctgccctccctcgg

SEQ ID NO: 469099 - DNA, 21 bp, Homo sapiens
ctgccctccctcggccccacc

SEQ ID NO: 469100 - DNA, 14 bp, Homo sapiens
ctgccctggtgctg

SEQ ID NO: 469101 - DNA, 15 bp, Homo sapiens
ctgccctggtgctgc

SEQ ID NO: 469102 - DNA, 17 bp, Homo sapiens
ctgccctggtgctgcca

SEQ ID NO: 469103 - DNA, 18 bp, Homo sapiens
ctgccctggtgctgccac

SEQ ID NO: 469104 - DNA, 19 bp, Homo sapiens
ctgccctggtgctgccaca

SEQ ID NO: 469105 - DNA, 20 bp, Homo sapiens
ctgccctggtgctgccacac

SEQ ID NO: 469106 - DNA, 21 bp, Homo sapiens
ctgccctggtgctgccacact

SEQ ID NO: 469107 - DNA, 14 bp, Homo sapiens
ctgcctctgaaaat

SEQ ID NO: 469108 - DNA, 19 bp, Homo sapiens
ctgcctctgaaaatatttt

SEQ ID NO: 469109 - DNA, 21 bp, Homo sapiens
ctgcctcttaacttaaaagaa

SEQ ID NO: 469110 - DNA, 23 bp, Homo sapiens
ctgcctcttaacttaaaagaaca

SEQ ID NO: 469111 - DNA, 17 bp, Homo sapiens
ctgcctggcgggcagcc

SEQ ID NO: 469112 - DNA, 18 bp, Homo sapiens
ctgcctttgagcttctcc

SEQ ID NO: 469113 - DNA, 22 bp, Homo sapiens
ctgcctttgagcttctcctctg

SEQ ID NO: 469114 - DNA, 20 bp, Homo sapiens
ctgcgccctccctccctcca

SEQ ID NO: 469115 - DNA, 18 bp, Homo sapiens
ctgcgctcctctgcagcc

SEQ ID NO: 469116 - DNA, 23 bp, Homo sapiens
ctgcgctcctctgcagcctgagc

SEQ ID NO: 469117 - DNA, 22 bp, Homo sapiens
ctgctaatttatgaagatagtt

SEQ ID NO: 469118 - DNA, 19 bp, Homo sapiens
ctgctagctgtagaaatgt

SEQ ID NO: 469119 - DNA, 14 bp, Homo sapiens
ctgctatgtctgtg

SEQ ID NO: 469120 - DNA, 16 bp, Homo sapiens
ctgctcacgtctgtga

SEQ ID NO: 469121 - DNA, 18 bp, Homo sapiens
ctgctcacgtctgtgagt

SEQ ID NO: 469122 - DNA, 23 bp, Homo sapiens
ctgctctattgtagcatttcttg

SEQ ID NO: 469123 - DNA, 18 bp, Homo sapiens
ctgctctccttcactctg

SEQ ID NO: 469124 - DNA, 23 bp, Homo sapiens
ctgctgcaccaacctcactgccc

SEQ ID NO: 469125 - DNA, 22 bp, Homo sapiens
ctgctgctcgggaaggcctgag

SEQ ID NO: 469126 - DNA, 19 bp, Homo sapiens
ctgctggaccaaggtgcgg

SEQ ID NO: 469127 - DNA, 22 bp, Homo sapiens
ctgctggaccaaggtgcggacc

SEQ ID NO: 469128 - DNA, 14 bp, Homo sapiens
ctgctggctgcctt

SEQ ID NO: 469129 - DNA, 15 bp, Homo sapiens
ctgctggctgcctta

SEQ ID NO: 469130 - DNA, 18 bp, Homo sapiens
ctgctgtagcaacagagc

SEQ ID NO: 469131 - DNA, 17 bp, Homo sapiens
ctgctgttttatgtcat

SEQ ID NO: 469132 - DNA, 22 bp, Homo sapiens
ctgcttggatccatacaaaact

SEQ ID NO: 469133 - DNA, 20 bp, Homo sapiens
ctgcttgtcattctgctaat

SEQ ID NO: 469134 - DNA, 20 bp, Homo sapiens
ctggaccaaggtgcggaccg

SEQ ID NO: 469135 - DNA, 23 bp, Homo sapiens
ctggagcccctatcctgcaccct

SEQ ID NO: 469136 - DNA, 19 bp, Homo sapiens
ctggagtctgaaggagagg

SEQ ID NO: 469137 - DNA, 19 bp, Homo sapiens
cttcctctccactgccttc

SEQ ID NO: 469138 - DNA, 13 bp, Homo sapiens
cttcctgtcctgc

SEQ ID NO: 469139 - DNA, 16 bp, Homo sapiens
cttcgatacaccgggc

SEQ ID NO: 469140 - DNA, 21 bp, Homo sapiens
cttcgatacaccgggcctgga

SEQ ID NO: 469141 - DNA, 13 bp, Homo sapiens
cttcgcctttgct

SEQ ID NO: 469142 - DNA, 16 bp, Homo sapiens
cttctagtggccttag

SEQ ID NO: 469143 - DNA, 14 bp, Homo sapiens
cttctccactggat

SEQ ID NO: 469144 - DNA, 19 bp, Homo sapiens
cttctcccctccagacccc

SEQ ID NO: 469145 - DNA, 22 bp, Homo sapiens
cttctcctctgctccaacagac

SEQ ID NO: 469146 - DNA, 22 bp, Homo sapiens
cttctcctttcacaaccttctg

SEQ ID NO: 469147 - DNA, 20 bp, Homo sapiens
cttctgcattactattaact

SEQ ID NO: 469148 - DNA, 15 bp, Homo sapiens
cttctgtgcaataaa

SEQ ID NO: 469149 - DNA, 13 bp, Homo sapiens
cttctgtggctca

SEQ ID NO: 469150 - DNA, 17 bp, Homo sapiens
cttctgttttccaaagg

SEQ ID NO: 469151 - DNA, 14 bp, Homo sapiens
cttcttgcggcacc

SEQ ID NO: 469152 - DNA, 20 bp, Homo sapiens
cttcttgcggcaccgcccac

SEQ ID NO: 469153 - DNA, 22 bp, Homo sapiens
cttcttgcggcaccgcccaccc

SEQ ID NO: 469154 - DNA, 13 bp, Homo sapiens
cttcttgcttctc

SEQ ID NO: 469155 - DNA, 22 bp, Homo sapiens
cttgaaaatgtggcttcttcaa

SEQ ID NO: 469156 - DNA, 21 bp, Homo sapiens
cttgaatgtccccattctata

SEQ ID NO: 469157 - DNA, 19 bp, Homo sapiens
cttgactataaaaactgcc

SEQ ID NO: 469158 - DNA, 21 bp, Homo sapiens
cttgagaggggtgagacagtg

SEQ ID NO: 469159 - DNA, 22 bp, Homo sapiens
cttgagcaaggcaagaagtggg

SEQ ID NO: 469160 - DNA, 10 bp, Homo sapiens
cttgagccca

SEQ ID NO: 469161 - DNA, 23 bp, Homo sapiens
cttgatgttgcttagtcacttat

SEQ ID NO: 469162 - DNA, 13 bp, Homo sapiens
cttgattaaaagt

SEQ ID NO: 469163 - DNA, 13 bp, Homo sapiens
cttgattctaaag

SEQ ID NO: 469164 - DNA, 20 bp, Homo sapiens
cttgattctaaaggggacag

SEQ ID NO: 469165 - DNA, 14 bp, Homo sapiens
cttgcactgtatcc

SEQ ID NO: 469166 - DNA, 22 bp, Homo sapiens
cttgcggcaccgcccacccaca

SEQ ID NO: 469167 - DNA, 16 bp, Homo sapiens
cttgctttcacaaata

SEQ ID NO: 469168 - DNA, 18 bp, Homo sapiens
cttgctttcacaaatata

SEQ ID NO: 469169 - DNA, 18 bp, Homo sapiens
cttggaacatttgggaga

SEQ ID NO: 469170 - DNA, 17 bp, Homo sapiens
cttggacaccatcccct

SEQ ID NO: 469171 - DNA, 19 bp, Homo sapiens
cttggagaggaggtgtgga

SEQ ID NO: 469172 - DNA, 16 bp, Homo sapiens
cttggagcagagacgg

SEQ ID NO: 469173 - DNA, 22 bp, Homo sapiens
cttggagccaatggagactgtc

SEQ ID NO: 469174 - DNA, 21 bp, Homo sapiens
cttggataggagcttccagat

SEQ ID NO: 469175 - DNA, 20 bp, Homo sapiens
cttggatccatacaaaacta

SEQ ID NO: 469176 - DNA, 13 bp, Homo sapiens
cttggcctgtcca

SEQ ID NO: 469177 - DNA, 19 bp, Homo sapiens
cttggggtagagaggacag

SEQ ID NO: 469178 - DNA, 15 bp, Homo sapiens
cttggtgactgtccc

SEQ ID NO: 469179 - DNA, 15 bp, Homo sapiens
cttggttcctccagc

SEQ ID NO: 469180 - DNA, 16 bp, Homo sapiens
cttggttcctccagca

SEQ ID NO: 469181 - DNA, 21 bp, Homo sapiens
cttgtaaataatgcttaacat

SEQ ID NO: 469182 - DNA, 14 bp, Homo sapiens
cttgtacagaacca

SEQ ID NO: 469183 - DNA, 19 bp, Homo sapiens
cttgtagggtgaggcgtgg

SEQ ID NO: 469184 - DNA, 16 bp, Homo sapiens
cttgtcattctgctaa

SEQ ID NO: 469185 - DNA, 16 bp, Homo sapiens
cttgtctgtgtatttc

SEQ ID NO: 469186 - DNA, 12 bp, Homo sapiens
cttgttcttcct

SEQ ID NO: 469187 - DNA, 18 bp, Homo sapiens
cttgttgtattcctgcct

SEQ ID NO: 469188 - DNA, 16 bp, Homo sapiens
cttgtttctatactgt

SEQ ID NO: 469189 - DNA, 21 bp, Homo sapiens
cttgttttttttttccactta

SEQ ID NO: 469190 - DNA, 10 bp, Homo sapiens
ctttaaatta

SEQ ID NO: 469191 - DNA, 16 bp, Homo sapiens
ctttatctatgggaga

SEQ ID NO: 469192 - DNA, 23 bp, Homo sapiens
ctttatctatgggagattaaaac

SEQ ID NO: 469193 - DNA, 15 bp, Homo sapiens
ctttatttaatttca

SEQ ID NO: 469194 - DNA, 17 bp, Homo sapiens
ctttatttaatttcata

SEQ ID NO: 469195 - DNA, 19 bp, Homo sapiens
ctttatttaatttcataaa

SEQ ID NO: 469196 - DNA, 20 bp, Homo sapiens
ctttatttaatttcataaat

SEQ ID NO: 469197 - DNA, 22 bp, Homo sapiens
ctttccacccagaccctccttc

SEQ ID NO: 469198 - DNA, 19 bp, Homo sapiens
ctttccacttccagagggg

SEQ ID NO: 469199 - DNA, 16 bp, Homo sapiens
ctttccctgcatccct

SEQ ID NO: 469200 - DNA, 17 bp, Homo sapiens
ctttccctgcatccctt

SEQ ID NO: 469201 - DNA, 21 bp, Homo sapiens
ctttccgctgtcgccccaggc

SEQ ID NO: 469202 - DNA, 19 bp, Homo sapiens
ctttctatgtagaactgtt

SEQ ID NO: 469203 - DNA, 14 bp, Homo sapiens
ctttctcttctaat

SEQ ID NO: 469204 - DNA, 22 bp, Homo sapiens
ctttgacctgacgatcttcccc

SEQ ID NO: 469205 - DNA, 18 bp, Homo sapiens
ctttgagcttctcctctg

SEQ ID NO: 469206 - DNA, 22 bp, Homo sapiens
ctttgcctgcccagtctttgga

SEQ ID NO: 469207 - DNA, 17 bp, Homo sapiens
ctttgcgctctgggttt

SEQ ID NO: 469208 - DNA, 15 bp, Homo sapiens
ctttgggctgccctg

SEQ ID NO: 469209 - DNA, 21 bp, Homo sapiens
ctttgggctgccctggtgctg

SEQ ID NO: 469210 - DNA, 21 bp, Homo sapiens
ctttggggcttatcagaactc

SEQ ID NO: 469211 - DNA, 20 bp, Homo sapiens
ctttgggggattcaaatgca

SEQ ID NO: 469212 - DNA, 22 bp, Homo sapiens
ctttgtgacaggaaagccctcc

SEQ ID NO: 469213 - DNA, 15 bp, Homo sapiens
ctttgtgtgattgaa

SEQ ID NO: 469214 - DNA, 17 bp, Homo sapiens
cttttaaactgcagttt

SEQ ID NO: 469215 - DNA, 17 bp, Homo sapiens
cttttcactgctggctg

SEQ ID NO: 469216 - DNA, 15 bp, Homo sapiens
cttttcagcttgttt

SEQ ID NO: 469217 - DNA, 18 bp, Homo sapiens
cttttcagcttgtttcta

SEQ ID NO: 469218 - DNA, 20 bp, Homo sapiens
cttttcagcttgtttctata

SEQ ID NO: 469219 - DNA, 22 bp, Homo sapiens
cttttgaaaaaggatcatggtt

SEQ ID NO: 469220 - DNA, 17 bp, Homo sapiens
cttttgaatcaatctgg

SEQ ID NO: 469221 - DNA, 19 bp, Homo sapiens
cttttggagcaaagtggtt

SEQ ID NO: 469222 - DNA, 12 bp, Homo sapiens
cttttttcaatg

SEQ ID NO: 469223 - DNA, 14 bp, Homo sapiens
cttttttcaatgta

SEQ ID NO: 469224 - DNA, 15 bp, Homo sapiens
cttttttcaatgtac

SEQ ID NO: 469225 - DNA, 11 bp, Homo sapiens
gaaaaaaggac

SEQ ID NO: 469226 - DNA, 12 bp, Homo sapiens
gaaaaaatattt

SEQ ID NO: 469227 - DNA, 15 bp, Homo sapiens
gaaaaaatattttaa

SEQ ID NO: 469228 - DNA, 13 bp, Homo sapiens
gaaaacccgaggg

SEQ ID NO: 469229 - DNA, 15 bp, Homo sapiens
gaaaagagaaacact

SEQ ID NO: 469230 - DNA, 23 bp, Homo sapiens
gaaaataacagagctggatgctg

SEQ ID NO: 469231 - DNA, 13 bp, Homo sapiens
gaaaatgctttct

SEQ ID NO: 469232 - DNA, 13 bp, Homo sapiens
gaaacaaggaagg

SEQ ID NO: 469233 - DNA, 18 bp, Homo sapiens
gaaacacagaactcagcc

SEQ ID NO: 469234 - DNA, 19 bp, Homo sapiens
gacatggcaacaaaggatg

SEQ ID NO: 469235 - DNA, 14 bp, Homo sapiens
gacatggctgttca

SEQ ID NO: 469236 - DNA, 21 bp, Homo sapiens
gaccaaggtgcggaccggagc

SEQ ID NO: 469237 - DNA, 11 bp, Homo sapiens
gaccagcatag

SEQ ID NO: 469238 - DNA, 18 bp, Homo sapiens
gaccatttagtcctcacc

SEQ ID NO: 469239 - DNA, 14 bp, Homo sapiens
gacccaccatcctt

SEQ ID NO: 469240 - DNA, 22 bp, Homo sapiens
gacccaccatccttccatcctg

SEQ ID NO: 469241 - DNA, 20 bp, Homo sapiens
gaccccacacgccggggctg

SEQ ID NO: 469242 - DNA, 19 bp, Homo sapiens
gaccccacttatgctgctg

SEQ ID NO: 469243 - DNA, 23 bp, Homo sapiens
gaccccacttatgctgctgtgaa

SEQ ID NO: 469244 - DNA, 22 bp, Homo sapiens
gacccccggcctccaggctggg

SEQ ID NO: 469245 - DNA, 23 bp, Homo sapiens
gacccccggcctccaggctgggg

SEQ ID NO: 469246 - DNA, 18 bp, Homo sapiens
gacccctaccctttccca

SEQ ID NO: 469247 - DNA, 17 bp, Homo sapiens
gaccctccttccccacc

SEQ ID NO: 469248 - DNA, 21 bp, Homo sapiens
gaccctccttccccaccccat

SEQ ID NO: 469249 - DNA, 22 bp, Homo sapiens
gaccctccttccccaccccata

SEQ ID NO: 469250 - DNA, 15 bp, Homo sapiens
gaccgccccaaccct

SEQ ID NO: 469251 - DNA, 18 bp, Homo sapiens
gaccggagcggctgagga

SEQ ID NO: 469252 - DNA, 15 bp, Homo sapiens
gacctacatctgaaa

SEQ ID NO: 469253 - DNA, 17 bp, Homo sapiens
gacctacatctgaaatc

SEQ ID NO: 469254 - DNA, 20 bp, Homo sapiens
gacctccagattattttcta

SEQ ID NO: 469255 - DNA, 22 bp, Homo sapiens
gacctccagattattttctata

SEQ ID NO: 469256 - DNA, 19 bp, Homo sapiens
gacctgacgatcttccccc

SEQ ID NO: 469257 - DNA, 15 bp, Homo sapiens
gacgacctacatctg

SEQ ID NO: 469258 - DNA, 20 bp, Homo sapiens
gacgacctacatctgaaatc

SEQ ID NO: 469259 - DNA, 21 bp, Homo sapiens
gacggaagtggcctgagaaga

SEQ ID NO: 469260 - DNA, 19 bp, Homo sapiens
gacggacgggacagcggcc

SEQ ID NO: 469261 - DNA, 14 bp, Homo sapiens
gacggcagccccat

SEQ ID NO: 469262 - DNA, 12 bp, Homo sapiens
gacgggacagcg

SEQ ID NO: 469263 - DNA, 22 bp, Homo sapiens
gacgggacagcggcccggccca

SEQ ID NO: 469264 - DNA, 13 bp, Homo sapiens
gacggggcagagc

SEQ ID NO: 469265 - DNA, 14 bp, Homo sapiens
gacggggcagagct

SEQ ID NO: 469266 - DNA, 15 bp, Homo sapiens
gacggggcagagctg

SEQ ID NO: 469267 - DNA, 19 bp, Homo sapiens
gacgtcatcggaggctggg

SEQ ID NO: 469268 - DNA, 22 bp, Homo sapiens
gacgtcatcggaggctgggccc

SEQ ID NO: 469269 - DNA, 17 bp, Homo sapiens
gacgtttttgtgctgtg

SEQ ID NO: 469270 - DNA, 22 bp, Homo sapiens
gactcaatgtggaaaaaatatt

SEQ ID NO: 469271 - DNA, 21 bp, Homo sapiens
gactccccgcccgccctcctc

SEQ ID NO: 469272 - DNA, 15 bp, Homo sapiens
gactcccgcctttga

SEQ ID NO: 469273 - DNA, 24 bp, Homo sapiens
gactccctgtgggggtggccatcc

SEQ ID NO: 469274 - DNA, 15 bp, Homo sapiens
gactcgagagggctg

SEQ ID NO: 469275 - DNA, 17 bp, Homo sapiens
gactcgagagggctgag

SEQ ID NO: 469276 - DNA, 14 bp, Homo sapiens
gactctctcctctc

SEQ ID NO: 469277 - DNA, 23 bp, Homo sapiens
gactctctcctctctctccctcc

SEQ ID NO: 469278 - DNA, 13 bp, Homo sapiens
gactctgagctgc

SEQ ID NO: 469279 - DNA, 19 bp, Homo sapiens
gactctgagctgctaggaa

SEQ ID NO: 469280 - DNA, 14 bp, Homo sapiens
gactgcatgcaagc

SEQ ID NO: 469281 - DNA, 12 bp, Homo sapiens
gactgcccaccc

SEQ ID NO: 469282 - DNA, 18 bp, Homo sapiens
gactgcccaccctgggcc

SEQ ID NO: 469283 - DNA, 21 bp, Homo sapiens
gactgcccaccctgggcctcc

SEQ ID NO: 469284 - DNA, 14 bp, Homo sapiens
gactgcgctggacg

SEQ ID NO: 469285 - DNA, 22 bp, Homo sapiens
gactggcccacccctcttcccc

SEQ ID NO: 469286 - DNA, 19 bp, Homo sapiens
gactgtcccaccgggagcc

SEQ ID NO: 469287 - DNA, 21 bp, Homo sapiens
gactgtcttcaaccctgccct

SEQ ID NO: 469288 - DNA, 22 bp, Homo sapiens
gactgttctaactagtaatctt

SEQ ID NO: 469289 - DNA, 23 bp, Homo sapiens
gacttcagactctctcctctctc

SEQ ID NO: 469290 - DNA, 22 bp, Homo sapiens
gacttcccagctggcagcgcct

SEQ ID NO: 469291 - DNA, 16 bp, Homo sapiens
gacttggataggagct

SEQ ID NO: 469292 - DNA, 16 bp, Homo sapiens
gactttatttaatttc

SEQ ID NO: 469293 - DNA, 18 bp, Homo sapiens
gactttatttaatttcat

SEQ ID NO: 469294 - DNA, 16 bp, Homo sapiens
gagaaaatgctttctc

SEQ ID NO: 469295 - DNA, 22 bp, Homo sapiens
gagaaaatgctttctcatgcat

SEQ ID NO: 469296 - DNA, 16 bp, Homo sapiens
gagaaaggaactttta

SEQ ID NO: 469297 - DNA, 20 bp, Homo sapiens
gagaaggacccggaggggcc

SEQ ID NO: 469298 - DNA, 23 bp, Homo sapiens
gagaaggacccggaggggcctgg

SEQ ID NO: 469299 - DNA, 18 bp, Homo sapiens
gagaaggcctgcccccct

SEQ ID NO: 469300 - DNA, 21 bp, Homo sapiens
gagaaggcctgccccccttcc

SEQ ID NO: 469301 - DNA, 22 bp, Homo sapiens
gagaaggcctgccccccttccc

SEQ ID NO: 469302 - DNA, 14 bp, Homo sapiens
gagaatggctctgg

SEQ ID NO: 469303 - DNA, 23 bp, Homo sapiens
gagacaaagtttggaagtacata

SEQ ID NO: 469304 - DNA, 14 bp, Homo sapiens
gagacggcagcccc

SEQ ID NO: 469305 - DNA, 13 bp, Homo sapiens
gagactgcccacc

SEQ ID NO: 469306 - DNA, 14 bp, Homo sapiens
gagactgcccaccc

SEQ ID NO: 469307 - DNA, 14 bp, Homo sapiens
gagagcgccacccg

SEQ ID NO: 469308 - DNA, 20 bp, Homo sapiens
gagagctcagtacagggcag

SEQ ID NO: 469309 - DNA, 21 bp, Homo sapiens
gagagctcagtacagggcagg

SEQ ID NO: 469310 - DNA, 14 bp, Homo sapiens
gagagctgctcctt

SEQ ID NO: 469311 - DNA, 17 bp, Homo sapiens
gagagctgctcctttgg

SEQ ID NO: 469312 - DNA, 16 bp, Homo sapiens
gagaggcggcctcgtg

SEQ ID NO: 469313 - DNA, 13 bp, Homo sapiens
gagagtggctcct

SEQ ID NO: 469314 - DNA, 14 bp, Homo sapiens
gagatcagcattca

SEQ ID NO: 469315 - DNA, 20 bp, Homo sapiens
gagcaaagatggcttccgtg

SEQ ID NO: 469316 - DNA, 20 bp, Homo sapiens
gagcaaggcaagaagtggga

SEQ ID NO: 469317 - DNA, 21 bp, Homo sapiens
gagcacaagaagtttcttcag

SEQ ID NO: 469318 - DNA, 20 bp, Homo sapiens
gagcacccccagcctccccc

SEQ ID NO: 469319 - DNA, 17 bp, Homo sapiens
gagcactagaatgagaa

SEQ ID NO: 469320 - DNA, 20 bp, Homo sapiens
gagcactagaatgagaaatc

SEQ ID NO: 469321 - DNA, 21 bp, Homo sapiens
gagcactagaatgagaaatca

SEQ ID NO: 469322 - DNA, 18 bp, Homo sapiens
gagcagagacggcagccc

SEQ ID NO: 469323 - DNA, 21 bp, Homo sapiens
gagcagagacggcagccccat

SEQ ID NO: 469324 - DNA, 22 bp, Homo sapiens
gagcaggactaacaactgggaa

SEQ ID NO: 469325 - DNA, 11 bp, Homo sapiens
gagcagtgggg

SEQ ID NO: 469326 - DNA, 18 bp, Homo sapiens
gagcattctggggtgggg

SEQ ID NO: 469327 - DNA, 20 bp, Homo sapiens
gagccacagtggggcccatg

SEQ ID NO: 469328 - DNA, 24 bp, Homo sapiens
gagccacagtggggcccatggccc

SEQ ID NO: 469329 - DNA, 14 bp, Homo sapiens
gagccatgctctta

SEQ ID NO: 469330 - DNA, 16 bp, Homo sapiens
gatctggtgcgtgtgg

SEQ ID NO: 469331 - DNA, 22 bp, Homo sapiens
gatctggtgcgtgtggccctgt

SEQ ID NO: 469332 - DNA, 16 bp, Homo sapiens
gatcttcccccttccc

SEQ ID NO: 469333 - DNA, 13 bp, Homo sapiens
gatgatctctcca

SEQ ID NO: 469334 - DNA, 18 bp, Homo sapiens
gatgcaacctcactatgg

SEQ ID NO: 469335 - DNA, 13 bp, Homo sapiens
gatgcaataaaca

SEQ ID NO: 469336 - DNA, 15 bp, Homo sapiens
gatggagaggcggcc

SEQ ID NO: 469337 - DNA, 21 bp, Homo sapiens
gatggagaggcggcctcgtgc

SEQ ID NO: 469338 - DNA, 23 bp, Homo sapiens
gatggaggaaaaccaagccgtgg

SEQ ID NO: 469339 - DNA, 21 bp, Homo sapiens
gatggcttccgtgagacacaa

SEQ ID NO: 469340 - DNA, 14 bp, Homo sapiens
gatgggaccaggga

SEQ ID NO: 469341 - DNA, 20 bp, Homo sapiens
gatgggaccagggatggggg

SEQ ID NO: 469342 - DNA, 12 bp, Homo sapiens
gatgggccaggg

SEQ ID NO: 469343 - DNA, 22 bp, Homo sapiens
gatgggtattaaacttgtcaga

SEQ ID NO: 469344 - DNA, 14 bp, Homo sapiens
gatgggtcctgctg

SEQ ID NO: 469345 - DNA, 21 bp, Homo sapiens
gatgggttttgttaggggtgg

SEQ ID NO: 469346 - DNA, 23 bp, Homo sapiens
gatgggttttgttaggggtgggg

SEQ ID NO: 469347 - DNA, 22 bp, Homo sapiens
gatgtcttaacctattcccaaa

SEQ ID NO: 469348 - DNA, 20 bp, Homo sapiens
gatgtgtggctcattctttt

SEQ ID NO: 469349 - DNA, 21 bp, Homo sapiens
gattaatctctaaaattctag

SEQ ID NO: 469350 - DNA, 15 bp, Homo sapiens
gattcaggaatgggc

SEQ ID NO: 469351 - DNA, 15 bp, Homo sapiens
gattccacaggacac

SEQ ID NO: 469352 - DNA, 19 bp, Homo sapiens
gattccagagagtggctcc

SEQ ID NO: 469353 - DNA, 22 bp, Homo sapiens
gattccagagagtggctcctcc

SEQ ID NO: 469354 - DNA, 16 bp, Homo sapiens
gattccattttggaaa

SEQ ID NO: 469355 - DNA, 18 bp, Homo sapiens
gattccattttggaaaat

SEQ ID NO: 469356 - DNA, 18 bp, Homo sapiens
gattctatatttcatatt

SEQ ID NO: 469357 - DNA, 22 bp, Homo sapiens
gattctatgcctgtatttccaa

SEQ ID NO: 469358 - DNA, 12 bp, Homo sapiens
gattctcctctc

SEQ ID NO: 469359 - DNA, 13 bp, Homo sapiens
gattctcttctca

SEQ ID NO: 469360 - DNA, 18 bp, Homo sapiens
gattcttttttcaatgta

SEQ ID NO: 469361 - DNA, 16 bp, Homo sapiens
gattgaaaagaagaaa

SEQ ID NO: 469362 - DNA, 22 bp, Homo sapiens
gattggcagcttcaaaacagaa

SEQ ID NO: 469363 - DNA, 22 bp, Homo sapiens
gatttgagtccattgcaaaagg

SEQ ID NO: 469364 - DNA, 19 bp, Homo sapiens
gcaaaaaagaacagtgttg

SEQ ID NO: 469365 - DNA, 21 bp, Homo sapiens
gcaaaaaagaacagtgttgaa

SEQ ID NO: 469366 - DNA, 18 bp, Homo sapiens
gcaaactgaagcccacag

SEQ ID NO: 469367 - DNA, 22 bp, Homo sapiens
gcaaagtaccaactgagccaaa

SEQ ID NO: 469368 - DNA, 17 bp, Homo sapiens
gcaaccctacagtatat

SEQ ID NO: 469369 - DNA, 22 bp, Homo sapiens
gcaaccctacagtatataagct

SEQ ID NO: 469370 - DNA, 15 bp, Homo sapiens
gcaacctcactatgg

SEQ ID NO: 469371 - DNA, 15 bp, Homo sapiens
gcaactgacagatga

SEQ ID NO: 469372 - DNA, 18 bp, Homo sapiens
gcaagaagattctaaaac

SEQ ID NO: 469373 - DNA, 21 bp, Homo sapiens
gcaagaagattctaaaacatt

SEQ ID NO: 469374 - DNA, 14 bp, Homo sapiens
gcaagagctcagga

SEQ ID NO: 469375 - DNA, 17 bp, Homo sapiens
gcaaggcaagaagtggg

SEQ ID NO: 469376 - DNA, 19 bp, Homo sapiens
gcaatacattaaaataact

SEQ ID NO: 469377 - DNA, 19 bp, Homo sapiens
gcaatatgaggggactgca

SEQ ID NO: 469378 - DNA, 20 bp, Homo sapiens
gcaatatgaggggactgcat

SEQ ID NO: 469379 - DNA, 22 bp, Homo sapiens
gcaatatgaggggactgcatgc

SEQ ID NO: 469380 - DNA, 20 bp, Homo sapiens
gcaatgttccgttcatctga

SEQ ID NO: 469381 - DNA, 15 bp, Homo sapiens
gcacaaggagtgccc

SEQ ID NO: 469382 - DNA, 16 bp, Homo sapiens
gcacaaggagtgcccg

SEQ ID NO: 469383 - DNA, 13 bp, Homo sapiens
gcacacagcagcc

SEQ ID NO: 469384 - DNA, 16 bp, Homo sapiens
gcacagggcagtggga

SEQ ID NO: 469385 - DNA, 19 bp, Homo sapiens
gcacagtgcatctcagccc

SEQ ID NO: 469386 - DNA, 20 bp, Homo sapiens
gcacagtgcatctcagccca

SEQ ID NO: 469387 - DNA, 18 bp, Homo sapiens
gcaccaacctcactgccc

SEQ ID NO: 469388 - DNA, 16 bp, Homo sapiens
gcaccagatgacacat

SEQ ID NO: 469389 - DNA, 16 bp, Homo sapiens
gcaccagcctgagcca

SEQ ID NO: 469390 - DNA, 13 bp, Homo sapiens
gcaccaggagaca

SEQ ID NO: 469391 - DNA, 18 bp, Homo sapiens
gcacccccagcctccccc

SEQ ID NO: 469392 - DNA, 19 bp, Homo sapiens
gcacccccagcctccccca

SEQ ID NO: 469393 - DNA, 16 bp, Homo sapiens
gcaccctcccccgcag

SEQ ID NO: 469394 - DNA, 18 bp, Homo sapiens
gcaccctctcctgggggt

SEQ ID NO: 469395 - DNA, 23 bp, Homo sapiens
gcaccgcccaacccccacctccc

SEQ ID NO: 469396 - DNA, 13 bp, Homo sapiens
gcaccgcccaccc

SEQ ID NO: 469397 - DNA, 15 bp, Homo sapiens
gcaccgcccacccac

SEQ ID NO: 469398 - DNA, 13 bp, Homo sapiens
gcaccttgggcac

SEQ ID NO: 469399 - DNA, 19 bp, Homo sapiens
gcactaaggccgtgtctct

SEQ ID NO: 469400 - DNA, 20 bp, Homo sapiens
gcactaaggccgtgtctctg

SEQ ID NO: 469401 - DNA, 15 bp, Homo sapiens
gcactagaatgagaa

SEQ ID NO: 469402 - DNA, 17 bp, Homo sapiens
gcactagaatgagaaat

SEQ ID NO: 469403 - DNA, 19 bp, Homo sapiens
gcactagaatgagaaatca

SEQ ID NO: 469404 - DNA, 16 bp, Homo sapiens
gcactcccagggcccg

SEQ ID NO: 469405 - DNA, 18 bp, Homo sapiens
gcactcccagggcccgag

SEQ ID NO: 469406 - DNA, 14 bp, Homo sapiens
gcactggtggcccg

SEQ ID NO: 469407 - DNA, 22 bp, Homo sapiens
gcactggtggcccgacagcctg

SEQ ID NO: 469408 - DNA, 23 bp, Homo sapiens
gcactggtggcccgacagcctgg

SEQ ID NO: 469409 - DNA, 13 bp, Homo sapiens
gcactgtttcttc

SEQ ID NO: 469410 - DNA, 17 bp, Homo sapiens
gcacttctgttatcagg

SEQ ID NO: 469411 - DNA, 19 bp, Homo sapiens
gcagaatggtgggctccag

SEQ ID NO: 469412 - DNA, 22 bp, Homo sapiens
gcagagacgaggtgtcttcctt

SEQ ID NO: 469413 - DNA, 18 bp, Homo sapiens
gcagagacggcagcccca

SEQ ID NO: 469414 - DNA, 22 bp, Homo sapiens
gcagagacggcagccccatcct

SEQ ID NO: 469415 - DNA, 18 bp, Homo sapiens
gcagagccagtcttcctc

SEQ ID NO: 469416 - DNA, 13 bp, Homo sapiens
gcagagccccgga

SEQ ID NO: 469417 - DNA, 14 bp, Homo sapiens
gcagagccccggag

SEQ ID NO: 469418 - DNA, 16 bp, Homo sapiens
gcagagccccggagca

SEQ ID NO: 469419 - DNA, 20 bp, Homo sapiens
gcagagccccggagcaccac

SEQ ID NO: 469420 - DNA, 15 bp, Homo sapiens
gcagaggcagggccc

SEQ ID NO: 469421 - DNA, 18 bp, Homo sapiens
gcagaggcagggccctgg

SEQ ID NO: 469422 - DNA, 20 bp, Homo sapiens
gcagaggcagggccctgggg

SEQ ID NO: 469423 - DNA, 14 bp, Homo sapiens
gcagcaccagcctg

SEQ ID NO: 469424 - DNA, 17 bp, Homo sapiens
gcagcaccagcctgagc

SEQ ID NO: 469425 - DNA, 22 bp, Homo sapiens
gcagcaccagcctgagccacag

SEQ ID NO: 469426 - DNA, 23 bp, Homo sapiens
gcagcaccagcctgagccacagt

SEQ ID NO: 469427 - DNA, 19 bp, Homo sapiens
gccctgccctcactccact

SEQ ID NO: 469428 - DNA, 15 bp, Homo sapiens
gccctgccctccccc

SEQ ID NO: 469429 - DNA, 16 bp, Homo sapiens
gccctgccctccccca

SEQ ID NO: 469430 - DNA, 18 bp, Homo sapiens
gccctgctttgggctgcc

SEQ ID NO: 469431 - DNA, 21 bp, Homo sapiens
gccctgctttgggctgccctg

SEQ ID NO: 469432 - DNA, 22 bp, Homo sapiens
gccctgctttgggctgccctgg

SEQ ID NO: 469433 - DNA, 15 bp, Homo sapiens
gccctggctcccaca

SEQ ID NO: 469434 - DNA, 20 bp, Homo sapiens
gccctggctcccacaggccc

SEQ ID NO: 469435 - DNA, 16 bp, Homo sapiens
gccctggggtctctga

SEQ ID NO: 469436 - DNA, 20 bp, Homo sapiens
gccctggggtctctgagcag

SEQ ID NO: 469437 - DNA, 21 bp, Homo sapiens
gccctggtgctgccacacttc

SEQ ID NO: 469438 - DNA, 18 bp, Homo sapiens
gccctgtgggagtccact

SEQ ID NO: 469439 - DNA, 21 bp, Homo sapiens
gccctgtgggagtccactttc

SEQ ID NO: 469440 - DNA, 12 bp, Homo sapiens
gcccttcctctc

SEQ ID NO: 469441 - DNA, 14 bp, Homo sapiens
gcccttcctctcca

SEQ ID NO: 469442 - DNA, 19 bp, Homo sapiens
gcccttcctctccactgcc

SEQ ID NO: 469443 - DNA, 20 bp, Homo sapiens
gcccttcctctccactgcct

SEQ ID NO: 469444 - DNA, 22 bp, Homo sapiens
gcccttcctctccactgccttc

SEQ ID NO: 469445 - DNA, 13 bp, Homo sapiens
gccgcagggcgct

SEQ ID NO: 469446 - DNA, 20 bp, Homo sapiens
gccgcagggcgctccggcag

SEQ ID NO: 469447 - DNA, 13 bp, Homo sapiens
gccgccctgggct

SEQ ID NO: 469448 - DNA, 17 bp, Homo sapiens
gccgcctcctccagact

SEQ ID NO: 469449 - DNA, 13 bp, Homo sapiens
gccgcctcgggcc

SEQ ID NO: 469450 - DNA, 19 bp, Homo sapiens
gccgcgctctgcccctccg

SEQ ID NO: 469451 - DNA, 14 bp, Homo sapiens
gccggggctggccc

SEQ ID NO: 469452 - DNA, 17 bp, Homo sapiens
gccggggctggccctgc

SEQ ID NO: 469453 - DNA, 19 bp, Homo sapiens
gccggggtggggtgcctga

SEQ ID NO: 469454 - DNA, 13 bp, Homo sapiens
gccggtccacccc

SEQ ID NO: 469455 - DNA, 14 bp, Homo sapiens
gccggtccaccccg

SEQ ID NO: 469456 - DNA, 18 bp, Homo sapiens
gccggtccaccccgtccc

SEQ ID NO: 469457 - DNA, 12 bp, Homo sapiens
gccgtggcttcc

SEQ ID NO: 469458 - DNA, 15 bp, Homo sapiens
gccgtggcttcccgc

SEQ ID NO: 469459 - DNA, 20 bp, Homo sapiens
gcctatggaaagggtgtggc

SEQ ID NO: 469460 - DNA, 14 bp, Homo sapiens
gcctcagccctcag

SEQ ID NO: 469461 - DNA, 15 bp, Homo sapiens
gcctccaggctgggg

SEQ ID NO: 469462 - DNA, 12 bp, Homo sapiens
gcctcccccagg

SEQ ID NO: 469463 - DNA, 14 bp, Homo sapiens
gcctccccctcaga

SEQ ID NO: 469464 - DNA, 21 bp, Homo sapiens
gcctccccgggggtccccgga

SEQ ID NO: 469465 - DNA, 19 bp, Homo sapiens
gcctcctaggctccctgag

SEQ ID NO: 469466 - DNA, 14 bp, Homo sapiens
gcctcctccagact

SEQ ID NO: 469467 - DNA, 16 bp, Homo sapiens
gcctcctccagactcg

SEQ ID NO: 469468 - DNA, 12 bp, Homo sapiens
gcctcctggcca

SEQ ID NO: 469469 - DNA, 13 bp, Homo sapiens
gcctcctggccag

SEQ ID NO: 469470 - DNA, 15 bp, Homo sapiens
gcctcgagtcccccc

SEQ ID NO: 469471 - DNA, 16 bp, Homo sapiens
gcctcgagtcccccca

SEQ ID NO: 469472 - DNA, 22 bp, Homo sapiens
gcctcgagtccccccacccctc

SEQ ID NO: 469473 - DNA, 19 bp, Homo sapiens
gcctcgggccgcctcctcc

SEQ ID NO: 469474 - DNA, 13 bp, Homo sapiens
gcctcgtgccatg

SEQ ID NO: 469475 - DNA, 14 bp, Homo sapiens
gcctcgtgccatga

SEQ ID NO: 469476 - DNA, 20 bp, Homo sapiens
gcctcttaacttaaaagaac

SEQ ID NO: 469477 - DNA, 20 bp, Homo sapiens
gcctgaatccacctgcagtt

SEQ ID NO: 469478 - DNA, 13 bp, Homo sapiens
gcctgagaagagt

SEQ ID NO: 469479 - DNA, 12 bp, Homo sapiens
gcctgagccaca

SEQ ID NO: 469480 - DNA, 22 bp, Homo sapiens
gcctgagccacagtggggccca

SEQ ID NO: 469481 - DNA, 17 bp, Homo sapiens
gcctgagctccaccctc

SEQ ID NO: 469482 - DNA, 19 bp, Homo sapiens
gcctgagggaagcccaccc

SEQ ID NO: 469483 - DNA, 13 bp, Homo sapiens
gcctgcaccagga

SEQ ID NO: 469484 - DNA, 15 bp, Homo sapiens
gcctgcagcccagaa

SEQ ID NO: 469485 - DNA, 15 bp, Homo sapiens
gcctgcccgcccgcc

SEQ ID NO: 469486 - DNA, 17 bp, Homo sapiens
gcctgcccgcccgccgg

SEQ ID NO: 469487 - DNA, 17 bp, Homo sapiens
gcctgcgctcctctgca

SEQ ID NO: 469488 - DNA, 18 bp, Homo sapiens
gcctgcgctcctctgcag

SEQ ID NO: 469489 - DNA, 18 bp, Homo sapiens
gcctggcacagggcagtg

SEQ ID NO: 469490 - DNA, 18 bp, Homo sapiens
gcctgggaaataagcccc

SEQ ID NO: 469491 - DNA, 19 bp, Homo sapiens
gcctggtctggagccccta

SEQ ID NO: 469492 - DNA, 15 bp, Homo sapiens
gcctggtgcgctgtg

SEQ ID NO: 469493 - DNA, 18 bp, Homo sapiens
gcctggtgcgctgtgctc

SEQ ID NO: 469494 - DNA, 21 bp, Homo sapiens
gcctgtccacctgtgctgctg

SEQ ID NO: 469495 - DNA, 17 bp, Homo sapiens
gccttaagaaagctata

SEQ ID NO: 469496 - DNA, 16 bp, Homo sapiens
gccttaagtcttactg

SEQ ID NO: 469497 - DNA, 20 bp, Homo sapiens
gccttcaggttcctcctagg

SEQ ID NO: 469498 - DNA, 22 bp, Homo sapiens
gccttcgatacaccgggcctgg

SEQ ID NO: 469499 - DNA, 21 bp, Homo sapiens
gccttgagtgacatgcggctg

SEQ ID NO: 469500 - DNA, 23 bp, Homo sapiens
gccttgtctgtgtatttctattt

SEQ ID NO: 469501 - DNA, 18 bp, Homo sapiens
gccttgttgtattcctgc

SEQ ID NO: 469502 - DNA, 17 bp, Homo sapiens
gcctttgagcttctcct

SEQ ID NO: 469503 - DNA, 22 bp, Homo sapiens
gcgcaccgcccaacccccacct

SEQ ID NO: 469504 - DNA, 19 bp, Homo sapiens
gcgcagccgcgctctgccc

SEQ ID NO: 469505 - DNA, 15 bp, Homo sapiens
gcgccacccgcccgc

SEQ ID NO: 469506 - DNA, 16 bp, Homo sapiens
gcgcccacctgcccag

SEQ ID NO: 469507 - DNA, 14 bp, Homo sapiens
gcgcctcccgccgc

SEQ ID NO: 469508 - DNA, 17 bp, Homo sapiens
gcgcctcccgccgcctc

SEQ ID NO: 469509 - DNA, 21 bp, Homo sapiens
gcgcctcccgccgcctcgggc

SEQ ID NO: 469510 - DNA, 14 bp, Homo sapiens
gcgcctgcccgccc

SEQ ID NO: 469511 - DNA, 13 bp, Homo sapiens
gcgcgcaccgccc

SEQ ID NO: 469512 - DNA, 22 bp, Homo sapiens
gcgcgcaccgcccaacccccac

SEQ ID NO: 469513 - DNA, 14 bp, Homo sapiens
gcgcgtgcccccag

SEQ ID NO: 469514 - DNA, 15 bp, Homo sapiens
gcgcgtgcccccagc

SEQ ID NO: 469515 - DNA, 16 bp, Homo sapiens
gcgcgtgcccccagcg

SEQ ID NO: 469516 - DNA, 23 bp, Homo sapiens
gcgctagagcattctggggtggg

SEQ ID NO: 469517 - DNA, 15 bp, Homo sapiens
gcgctatccacagaa

SEQ ID NO: 469518 - DNA, 20 bp, Homo sapiens
gcgctccggcagaggcaggg

SEQ ID NO: 469519 - DNA, 21 bp, Homo sapiens
gcgctccggcagaggcagggc

SEQ ID NO: 469520 - DNA, 13 bp, Homo sapiens
gcgctcctctgca

SEQ ID NO: 469521 - DNA, 14 bp, Homo sapiens
gcgctcctctgcag

SEQ ID NO: 469522 - DNA, 13 bp, Homo sapiens
gcgctcctctgcc

SEQ ID NO: 469523 - DNA, 18 bp, Homo sapiens
gcgctctgcccctccgtc

SEQ ID NO: 469524 - DNA, 20 bp, Homo sapiens
gcgctctgcccctccgtccc

SEQ ID NO: 469525 - DNA, 16 bp, Homo sapiens
ggagaatggctctggc

SEQ ID NO: 469526 - DNA, 16 bp, Homo sapiens
ggagactgtctcaaga

SEQ ID NO: 469527 - DNA, 15 bp, Homo sapiens
ggagagcgccacccg

SEQ ID NO: 469528 - DNA, 14 bp, Homo sapiens
ggagaggagtgcgc

SEQ ID NO: 469529 - DNA, 13 bp, Homo sapiens
ggagaggcggcct

SEQ ID NO: 469530 - DNA, 14 bp, Homo sapiens
ggagaggcggcctc

SEQ ID NO: 469531 - DNA, 15 bp, Homo sapiens
ggagattaaaaccag

SEQ ID NO: 469532 - DNA, 13 bp, Homo sapiens
ggagcaaggttta

SEQ ID NO: 469533 - DNA, 22 bp, Homo sapiens
ggagcacccccagcctccccca

SEQ ID NO: 469534 - DNA, 19 bp, Homo sapiens
ggagcagagacggcagccc

SEQ ID NO: 469535 - DNA, 21 bp, Homo sapiens
ggagcagagacggcagcccca

SEQ ID NO: 469536 - DNA, 23 bp, Homo sapiens
ggagccccccgtgttcacacaca

SEQ ID NO: 469537 - DNA, 13 bp, Homo sapiens
ggagcggctgagg

SEQ ID NO: 469538 - DNA, 23 bp, Homo sapiens
ggagcgggggctaactggcccca

SEQ ID NO: 469539 - DNA, 14 bp, Homo sapiens
ggaggacagggagg

SEQ ID NO: 469540 - DNA, 16 bp, Homo sapiens
ggaggactgttctaac

SEQ ID NO: 469541 - DNA, 11 bp, Homo sapiens
ggaggagcacc

SEQ ID NO: 469542 - DNA, 18 bp, Homo sapiens
ggaggagcacccccagcc

SEQ ID NO: 469543 - DNA, 20 bp, Homo sapiens
ggaggagcacccccagcctc

SEQ ID NO: 469544 - DNA, 14 bp, Homo sapiens
ggaggcctggtctg

SEQ ID NO: 469545 - DNA, 20 bp, Homo sapiens
ggaggcctggtctggagccc

SEQ ID NO: 469546 - DNA, 15 bp, Homo sapiens
ggaggcgcccacctg

SEQ ID NO: 469547 - DNA, 16 bp, Homo sapiens
ggaggcgcccacctgc

SEQ ID NO: 469548 - DNA, 19 bp, Homo sapiens
ggaggcgcccacctgccca

SEQ ID NO: 469549 - DNA, 20 bp, Homo sapiens
ggaggcgcccacctgcccag

SEQ ID NO: 469550 - DNA, 23 bp, Homo sapiens
ggaggcgcccacctgcccagtta

SEQ ID NO: 469551 - DNA, 13 bp, Homo sapiens
ggaggctgggccc

SEQ ID NO: 469552 - DNA, 14 bp, Homo sapiens
ggaggctgggcccc

SEQ ID NO: 469553 - DNA, 17 bp, Homo sapiens
ggaggctgggcccctgg

SEQ ID NO: 469554 - DNA, 22 bp, Homo sapiens
ggaggtgtggagtggaggggtc

SEQ ID NO: 469555 - DNA, 14 bp, Homo sapiens
ggagtccactttcc

SEQ ID NO: 469556 - DNA, 15 bp, Homo sapiens
ggagtccactttcct

SEQ ID NO: 469557 - DNA, 16 bp, Homo sapiens
ggagtccactttcctc

SEQ ID NO: 469558 - DNA, 18 bp, Homo sapiens
ggagtccactttcctctc

SEQ ID NO: 469559 - DNA, 20 bp, Homo sapiens
ggagtctgaaggagaggagt

SEQ ID NO: 469560 - DNA, 15 bp, Homo sapiens
ggatccagagagaag

SEQ ID NO: 469561 - DNA, 12 bp, Homo sapiens
ggatcctgcact

SEQ ID NO: 469562 - DNA, 19 bp, Homo sapiens
ggatctaaaaggaggacag

SEQ ID NO: 469563 - DNA, 17 bp, Homo sapiens
ggatgggccagggttta

SEQ ID NO: 469564 - DNA, 17 bp, Homo sapiens
ggatgggggatgggcca

SEQ ID NO: 469565 - DNA, 12 bp, Homo sapiens
ggatgtgctttc

SEQ ID NO: 469566 - DNA, 15 bp, Homo sapiens
ggattcaaatgcatg

SEQ ID NO: 469567 - DNA, 17 bp, Homo sapiens
ggattcacttctattta

SEQ ID NO: 469568 - DNA, 15 bp, Homo sapiens
ggattggtaccagag

SEQ ID NO: 469569 - DNA, 14 bp, Homo sapiens
ggcaaaaaagaaca

SEQ ID NO: 469570 - DNA, 11 bp, Homo sapiens
ggcaaacattt

SEQ ID NO: 469571 - DNA, 21 bp, Homo sapiens
ggcaagagctcaggagaaggc

SEQ ID NO: 469572 - DNA, 16 bp, Homo sapiens
ggcacacagcagcccc

SEQ ID NO: 469573 - DNA, 17 bp, Homo sapiens
ggcacacagcagccccc

SEQ ID NO: 469574 - DNA, 17 bp, Homo sapiens
ggcaccagatgcaacct

SEQ ID NO: 469575 - DNA, 18 bp, Homo sapiens
ggcaccagatgcaacctc

SEQ ID NO: 469576 - DNA, 14 bp, Homo sapiens
ggcaccgcccaccc

SEQ ID NO: 469577 - DNA, 21 bp, Homo sapiens
ggcaccgcccacccacacccc

SEQ ID NO: 469578 - DNA, 18 bp, Homo sapiens
ggcacgggagagcgccac

SEQ ID NO: 469579 - DNA, 21 bp, Homo sapiens
ggcagaatggtgggctccaga

SEQ ID NO: 469580 - DNA, 22 bp, Homo sapiens
ggcagaatggtgggctccagag

SEQ ID NO: 469581 - DNA, 23 bp, Homo sapiens
ggcagagattgggggggcttggg

SEQ ID NO: 469582 - DNA, 22 bp, Homo sapiens
ggcagagctgagtcggctgggc

SEQ ID NO: 469583 - DNA, 15 bp, Homo sapiens
ggcagaggcagggcc

SEQ ID NO: 469584 - DNA, 17 bp, Homo sapiens
ggcagaggcagggccct

SEQ ID NO: 469585 - DNA, 12 bp, Homo sapiens
ggcagcaccctc

SEQ ID NO: 469586 - DNA, 20 bp, Homo sapiens
ggcagcaccctcccccgcag

SEQ ID NO: 469587 - DNA, 13 bp, Homo sapiens
ggcagccccatcc

SEQ ID NO: 469588 - DNA, 19 bp, Homo sapiens
ggcagccccatccttcccg

SEQ ID NO: 469589 - DNA, 18 bp, Homo sapiens
ggcagccgtgccttcagc

SEQ ID NO: 469590 - DNA, 21 bp, Homo sapiens
ggcagccgtgccttcagctct

SEQ ID NO: 469591 - DNA, 22 bp, Homo sapiens
ggcagccgtgccttcagctcta

SEQ ID NO: 469592 - DNA, 15 bp, Homo sapiens
ggcagcgcctcccgc

SEQ ID NO: 469593 - DNA, 20 bp, Homo sapiens
ggcagcgcctcccgccgcct

SEQ ID NO: 469594 - DNA, 17 bp, Homo sapiens
ggcaggcacacagcagc

SEQ ID NO: 469595 - DNA, 19 bp, Homo sapiens
ggcaggcacacagcagccc

SEQ ID NO: 469596 - DNA, 11 bp, Homo sapiens
ggcagggccct

SEQ ID NO: 469597 - DNA, 23 bp, Homo sapiens
ggcatctctccccatatataaat

SEQ ID NO: 469598 - DNA, 19 bp, Homo sapiens
ggcatctgagtccagctcc

SEQ ID NO: 469599 - DNA, 17 bp, Homo sapiens
ggcatggccaggtggcc

SEQ ID NO: 469600 - DNA, 22 bp, Homo sapiens
ggccaagccagggttccagaca

SEQ ID NO: 469601 - DNA, 14 bp, Homo sapiens
ggccacactctgcc

SEQ ID NO: 469602 - DNA, 12 bp, Homo sapiens
ggccagagggac

SEQ ID NO: 469603 - DNA, 12 bp, Homo sapiens
ggccagcaccct

SEQ ID NO: 469604 - DNA, 16 bp, Homo sapiens
ggccagcaccctctcc

SEQ ID NO: 469605 - DNA, 16 bp, Homo sapiens
ggccatccctgggccc

SEQ ID NO: 469606 - DNA, 20 bp, Homo sapiens
ggccatccctgggcccctcc

SEQ ID NO: 469607 - DNA, 20 bp, Homo sapiens
ggcccaaataacagtggcaa

SEQ ID NO: 469608 - DNA, 17 bp, Homo sapiens
ggcccacgcagagcccc

SEQ ID NO: 469609 - DNA, 21 bp, Homo sapiens
ggcccacgcagagccccggag

SEQ ID NO: 469610 - DNA, 22 bp, Homo sapiens
ggcccagggggaagatgccaag

SEQ ID NO: 469611 - DNA, 21 bp, Homo sapiens
ggcccatggccccagctggct

SEQ ID NO: 469612 - DNA, 18 bp, Homo sapiens
ggccccacccaccctctg

SEQ ID NO: 469613 - DNA, 22 bp, Homo sapiens
ggccccacccaccctctggtcc

SEQ ID NO: 469614 - DNA, 23 bp, Homo sapiens
ggccccacccaccctctggtcct

SEQ ID NO: 469615 - DNA, 12 bp, Homo sapiens
ggccccagctgg

SEQ ID NO: 469616 - DNA, 14 bp, Homo sapiens
ggccccagctggct

SEQ ID NO: 469617 - DNA, 22 bp, Homo sapiens
ggccccaggcggaggggcttgg

SEQ ID NO: 469618 - DNA, 14 bp, Homo sapiens
ggcccccctctgcc

SEQ ID NO: 469619 - DNA, 22 bp, Homo sapiens
ggcccccggaggcgcccacctg

SEQ ID NO: 469620 - DNA, 12 bp, Homo sapiens
ggcccctccacg

SEQ ID NO: 469621 - DNA, 11 bp, Homo sapiens
ggcccctctct

SEQ ID NO: 469622 - DNA, 12 bp, Homo sapiens
ggcccctgggat

SEQ ID NO: 469623 - DNA, 17 bp, Homo sapiens
gggtgagacagtggggg

SEQ ID NO: 469624 - DNA, 21 bp, Homo sapiens
gggtgcatttgagagaagcca

SEQ ID NO: 469625 - DNA, 18 bp, Homo sapiens
gggtgctccctcctcagt

SEQ ID NO: 469626 - DNA, 12 bp, Homo sapiens
gggtggcaggca

SEQ ID NO: 469627 - DNA, 22 bp, Homo sapiens
gggtggcaggcacacagcagcc

SEQ ID NO: 469628 - DNA, 16 bp, Homo sapiens
gggtggggtgcctgag

SEQ ID NO: 469629 - DNA, 11 bp, Homo sapiens
gggtgtggcct

SEQ ID NO: 469630 - DNA, 15 bp, Homo sapiens
gggtgtggcctcagc

SEQ ID NO: 469631 - DNA, 12 bp, Homo sapiens
gggtgtggcttg

SEQ ID NO: 469632 - DNA, 14 bp, Homo sapiens
gggttaaagaaagg

SEQ ID NO: 469633 - DNA, 12 bp, Homo sapiens
gggttccagaca

SEQ ID NO: 469634 - DNA, 16 bp, Homo sapiens
gggttccagacagagt

SEQ ID NO: 469635 - DNA, 20 bp, Homo sapiens
gggttccagacagagtggat

SEQ ID NO: 469636 - DNA, 14 bp, Homo sapiens
gggttccagacagg

SEQ ID NO: 469637 - DNA, 14 bp, Homo sapiens
gggttgcctcgagt

SEQ ID NO: 469638 - DNA, 15 bp, Homo sapiens
gggttgggttccaga

SEQ ID NO: 469639 - DNA, 17 bp, Homo sapiens
gggttttagaaattcta

SEQ ID NO: 469640 - DNA, 18 bp, Homo sapiens
gggttttgttaggggtgg

SEQ ID NO: 469641 - DNA, 23 bp, Homo sapiens
gggtttttaatctttgtgacagg

SEQ ID NO: 469642 - DNA, 17 bp, Homo sapiens
ggtacctttccacccag

SEQ ID NO: 469643 - DNA, 23 bp, Homo sapiens
ggtacctttccacccagaccctc

SEQ ID NO: 469644 - DNA, 14 bp, Homo sapiens
ggtatctctttctc

SEQ ID NO: 469645 - DNA, 13 bp, Homo sapiens
ggtatgctggcca

SEQ ID NO: 469646 - DNA, 14 bp, Homo sapiens
ggtatgctggccag

SEQ ID NO: 469647 - DNA, 21 bp, Homo sapiens
ggtatgctggccagcaccctc

SEQ ID NO: 469648 - DNA, 11 bp, Homo sapiens
ggtattaaact

SEQ ID NO: 469649 - DNA, 17 bp, Homo sapiens
ggtcacttaagggggga

SEQ ID NO: 469650 - DNA, 16 bp, Homo sapiens
ggtcaggtgggaaagc

SEQ ID NO: 469651 - DNA, 21 bp, Homo sapiens
ggtcagtgaagcccaggagga

SEQ ID NO: 469652 - DNA, 20 bp, Homo sapiens
ggtccaccccgtcccggccc

SEQ ID NO: 469653 - DNA, 23 bp, Homo sapiens
ggtccaccccgtcccggccccgc

SEQ ID NO: 469654 - DNA, 14 bp, Homo sapiens
ggtcctgctgctcg

SEQ ID NO: 469655 - DNA, 20 bp, Homo sapiens
ggtcctgctgctcgggaagg

SEQ ID NO: 469656 - DNA, 15 bp, Homo sapiens
ggtccttctgacccc

SEQ ID NO: 469657 - DNA, 21 bp, Homo sapiens
ggtcgggggaggagcaccccc

SEQ ID NO: 469658 - DNA, 13 bp, Homo sapiens
ggtctccacccct

SEQ ID NO: 469659 - DNA, 18 bp, Homo sapiens
ggtctccacccctcaagc

SEQ ID NO: 469660 - DNA, 15 bp, Homo sapiens
ggtctggagccccta

SEQ ID NO: 469661 - DNA, 13 bp, Homo sapiens
ggtcttggagagg

SEQ ID NO: 469662 - DNA, 14 bp, Homo sapiens
ggtcttggagagga

SEQ ID NO: 469663 - DNA, 16 bp, Homo sapiens
ggtcttggagaggagg

SEQ ID NO: 469664 - DNA, 17 bp, Homo sapiens
ggtgaagagcatagtta

SEQ ID NO: 469665 - DNA, 20 bp, Homo sapiens
ggtgcaggcgcgcaccgccc

SEQ ID NO: 469666 - DNA, 14 bp, Homo sapiens
ggtgcgctgtgctc

SEQ ID NO: 469667 - DNA, 18 bp, Homo sapiens
ggtgcggaccggagcggc

SEQ ID NO: 469668 - DNA, 20 bp, Homo sapiens
ggtgcggaccggagcggctg

SEQ ID NO: 469669 - DNA, 13 bp, Homo sapiens
ggtgcgtgtggcc

SEQ ID NO: 469670 - DNA, 12 bp, Homo sapiens
ggtggcaccaga

SEQ ID NO: 469671 - DNA, 20 bp, Homo sapiens
ggtggcaccagatgcaacct

SEQ ID NO: 469672 - DNA, 21 bp, Homo sapiens
ggtggccatccctgggcccct

SEQ ID NO: 469673 - DNA, 23 bp, Homo sapiens
ggtggccatccctgggcccctcc

SEQ ID NO: 469674 - DNA, 14 bp, Homo sapiens
ggtgggctccagag

SEQ ID NO: 469675 - DNA, 15 bp, Homo sapiens
ggtgggctccagagt

SEQ ID NO: 469676 - DNA, 16 bp, Homo sapiens
ggtggggtgcctgagc

SEQ ID NO: 469677 - DNA, 17 bp, Homo sapiens
ggtggggtgcctgagcc

SEQ ID NO: 469678 - DNA, 18 bp, Homo sapiens
ggtggggtgcctgagccc

SEQ ID NO: 469679 - DNA, 18 bp, Homo sapiens
ggtggtcttggagaggag

SEQ ID NO: 469680 - DNA, 17 bp, Homo sapiens
ggtggttggaggcctgg

SEQ ID NO: 469681 - DNA, 15 bp, Homo sapiens
ggtgtggagtggagg

SEQ ID NO: 469682 - DNA, 12 bp, Homo sapiens
ggtgtggcctca

SEQ ID NO: 469683 - DNA, 13 bp, Homo sapiens
ggtgtggcctcag

SEQ ID NO: 469684 - DNA, 19 bp, Homo sapiens
ggttaataggaggacagaa

SEQ ID NO: 469685 - DNA, 13 bp, Homo sapiens
ggttccagacaga

SEQ ID NO: 469686 - DNA, 15 bp, Homo sapiens
ggttcccctgttcac

SEQ ID NO: 469687 - DNA, 13 bp, Homo sapiens
ggttcctcctagg

SEQ ID NO: 469688 - DNA, 18 bp, Homo sapiens
ggttctagaaggggcgag

SEQ ID NO: 469689 - DNA, 14 bp, Homo sapiens
ggttgttccttttt

SEQ ID NO: 469690 - DNA, 22 bp, Homo sapiens
ggtttactctgtgctaagttgt

SEQ ID NO: 469691 - DNA, 21 bp, Homo sapiens
ggtttttaatctttgtgacag

SEQ ID NO: 469692 - DNA, 23 bp, Homo sapiens
gtaaaaaatcagattagaccagt

SEQ ID NO: 469693 - DNA, 23 bp, Homo sapiens
gtaaaaagactactggcctctgt

SEQ ID NO: 469694 - DNA, 17 bp, Homo sapiens
gtaaataaactcttcaa

SEQ ID NO: 469695 - DNA, 23 bp, Homo sapiens
gtaaatcccacgacataagctgg

SEQ ID NO: 469696 - DNA, 14 bp, Homo sapiens
gtaaatttaactgc

SEQ ID NO: 469697 - DNA, 20 bp, Homo sapiens
gtaacactagtagctgtttt

SEQ ID NO: 469698 - DNA, 22 bp, Homo sapiens
gtaactgttaacccagtgttca

SEQ ID NO: 469699 - DNA, 11 bp, Homo sapiens
gtaagaagaaa

SEQ ID NO: 469700 - DNA, 18 bp, Homo sapiens
gtaagttgaagggaaatc

SEQ ID NO: 469701 - DNA, 17 bp, Homo sapiens
gtaatcatttatcttat

SEQ ID NO: 469702 - DNA, 14 bp, Homo sapiens
gtaatctctgatta

SEQ ID NO: 469703 - DNA, 23 bp, Homo sapiens
gtaatctctgattaaatttaata

SEQ ID NO: 469704 - DNA, 21 bp, Homo sapiens
gtaatggatatgaaagagaaa

SEQ ID NO: 469705 - DNA, 17 bp, Homo sapiens
gtacacccaattttaaa

SEQ ID NO: 469706 - DNA, 17 bp, Homo sapiens
gtacagaaccagcactc

SEQ ID NO: 469707 - DNA, 23 bp, Homo sapiens
gtacagaaccagcactcccaggg

SEQ ID NO: 469708 - DNA, 16 bp, Homo sapiens
gtacagggcaggagct

SEQ ID NO: 469709 - DNA, 18 bp, Homo sapiens
gtacagggcaggagctgc

SEQ ID NO: 469710 - DNA, 19 bp, Homo sapiens
gtacagggcaggagctgct

SEQ ID NO: 469711 - DNA, 16 bp, Homo sapiens
gtacataaagtaataa

SEQ ID NO: 469712 - DNA, 21 bp, Homo sapiens
gtacataaagtaataactgtt

SEQ ID NO: 469713 - DNA, 22 bp, Homo sapiens
gtacataaagtaataactgtta

SEQ ID NO: 469714 - DNA, 14 bp, Homo sapiens
gtaccaactgagcc

SEQ ID NO: 469715 - DNA, 15 bp, Homo sapiens
gtaccatcccactga

SEQ ID NO: 469716 - DNA, 19 bp, Homo sapiens
gtaccatcccactgatatc

SEQ ID NO: 469717 - DNA, 20 bp, Homo sapiens
gtacctttccacccagaccc

SEQ ID NO: 469718 - DNA, 23 bp, Homo sapiens
gtacctttccacccagaccctcc

SEQ ID NO: 469719 - DNA, 11 bp, Homo sapiens
gtactgtattg

SEQ ID NO: 469720 - DNA, 16 bp, Homo sapiens
gtacttacactgaaat

SEQ ID NO: 469721 - DNA, 16 bp, Homo sapiens
gttacaaatttttact

SEQ ID NO: 469722 - DNA, 22 bp, Homo sapiens
gttactgcctaggagttaatga

SEQ ID NO: 469723 - DNA, 18 bp, Homo sapiens
gttagcccggccaaggac

SEQ ID NO: 469724 - DNA, 21 bp, Homo sapiens
gttaggggtgggggagaatgg

SEQ ID NO: 469725 - DNA, 16 bp, Homo sapiens
gttatagttgatatgt

SEQ ID NO: 469726 - DNA, 23 bp, Homo sapiens
gttatcagggcccaaataacagt

SEQ ID NO: 469727 - DNA, 22 bp, Homo sapiens
gttcaaatgcattttgggggtt

SEQ ID NO: 469728 - DNA, 20 bp, Homo sapiens
gttcaacctggtggcaccag

SEQ ID NO: 469729 - DNA, 13 bp, Homo sapiens
gttcagcatagag

SEQ ID NO: 469730 - DNA, 22 bp, Homo sapiens
gttcattcatactcaaagaggc

SEQ ID NO: 469731 - DNA, 11 bp, Homo sapiens
gttccaagtgt

SEQ ID NO: 469732 - DNA, 15 bp, Homo sapiens
gttccagacagagtg

SEQ ID NO: 469733 - DNA, 20 bp, Homo sapiens
gttccagacagggtggggct

SEQ ID NO: 469734 - DNA, 16 bp, Homo sapiens
gttccatgaagacaaa

SEQ ID NO: 469735 - DNA, 19 bp, Homo sapiens
gttcctaaagaaaaagata

SEQ ID NO: 469736 - DNA, 22 bp, Homo sapiens
gttcctcctaggcgctcagagg

SEQ ID NO: 469737 - DNA, 15 bp, Homo sapiens
gttcctttttctttt

SEQ ID NO: 469738 - DNA, 14 bp, Homo sapiens
gttctatttctatc

SEQ ID NO: 469739 - DNA, 22 bp, Homo sapiens
gttctatttctatctgcaaata

SEQ ID NO: 469740 - DNA, 15 bp, Homo sapiens
gttctcccatggggg

SEQ ID NO: 469741 - DNA, 16 bp, Homo sapiens
gttctcccatgggggc

SEQ ID NO: 469742 - DNA, 23 bp, Homo sapiens
gttctccgggtgtggcctcagcc

SEQ ID NO: 469743 - DNA, 22 bp, Homo sapiens
gttctctacctaatatgttctg

SEQ ID NO: 469744 - DNA, 15 bp, Homo sapiens
gttcttttaagccca

SEQ ID NO: 469745 - DNA, 22 bp, Homo sapiens
gttgaacaagccacgttgcaga

SEQ ID NO: 469746 - DNA, 16 bp, Homo sapiens
gttgaagggaaatcaa

SEQ ID NO: 469747 - DNA, 15 bp, Homo sapiens
gttgcacaacacaga

SEQ ID NO: 469748 - DNA, 20 bp, Homo sapiens
gttggccggctggccggtcc

SEQ ID NO: 469749 - DNA, 19 bp, Homo sapiens
gttgggttccagacagagt

SEQ ID NO: 469750 - DNA, 22 bp, Homo sapiens
gttgggttccagacagagtgga

SEQ ID NO: 469751 - DNA, 20 bp, Homo sapiens
gttgtattcctgcctttgat

SEQ ID NO: 469752 - DNA, 17 bp, Homo sapiens
gtttaaaaaaataacat

SEQ ID NO: 469753 - DNA, 18 bp, Homo sapiens
gtttacaaccttgtgagc

SEQ ID NO: 469754 - DNA, 13 bp, Homo sapiens
gtttaccctccct

SEQ ID NO: 469755 - DNA, 18 bp, Homo sapiens
gtttaccctccctgtccc

SEQ ID NO: 469756 - DNA, 21 bp, Homo sapiens
gtttacctcactggtgcattt

SEQ ID NO: 469757 - DNA, 23 bp, Homo sapiens
gtttacctcactggtgcatttaa

SEQ ID NO: 469758 - DNA, 14 bp, Homo sapiens
gtttagctgtgaaa

SEQ ID NO: 469759 - DNA, 12 bp, Homo sapiens
gtttatactgta

SEQ ID NO: 469760 - DNA, 21 bp, Homo sapiens
gtttcaatgcatacaataaaa

SEQ ID NO: 469761 - DNA, 23 bp, Homo sapiens
gtttcgcatccaccgccacccca

SEQ ID NO: 469762 - DNA, 19 bp, Homo sapiens
gtttctatactgtttgtaa

SEQ ID NO: 469763 - DNA, 22 bp, Homo sapiens
gtttctatggattcacttctat

SEQ ID NO: 469764 - DNA, 22 bp, Homo sapiens
gtttctcaagcgctatccacag

SEQ ID NO: 469765 - DNA, 18 bp, Homo sapiens
gtttctgcagtattctgt

SEQ ID NO: 469766 - DNA, 23 bp, Homo sapiens
gtttgtaatatacagtttttgta

SEQ ID NO: 469767 - DNA, 16 bp, Homo sapiens
gttttatttgtttact

SEQ ID NO: 469768 - DNA, 20 bp, Homo sapiens
gttttccccaattatcctcc

SEQ ID NO: 469769 - DNA, 20 bp, Homo sapiens
gtttttaatctttgtgacag

SEQ ID NO: 469770 - DNA, 12 bp, Homo sapiens
gtttttgtgctg

SEQ ID NO: 469771 - DNA, 16 bp, Homo sapiens
gttttttaggaatcag

SEQ ID NO: 469772 - DNA, 18 bp, Homo sapiens
gtttttttacaacattca

SEQ ID NO: 469773 - DNA, 21 bp, Homo sapiens
taaaaaaaatattctgtcatt

SEQ ID NO: 469774 - DNA, 13 bp, Homo sapiens
taaaaaaataaca

SEQ ID NO: 469775 - DNA, 15 bp, Homo sapiens
taaaaaataacatat

SEQ ID NO: 469776 - DNA, 12 bp, Homo sapiens
taaaaaataact

SEQ ID NO: 469777 - DNA, 22 bp, Homo sapiens
taaaagactgtcttaatttgca

SEQ ID NO: 469778 - DNA, 11 bp, Homo sapiens
taaaagagctt

SEQ ID NO: 469779 - DNA, 21 bp, Homo sapiens
taaaatcagtgtgcttgcctt

SEQ ID NO: 469780 - DNA, 14 bp, Homo sapiens
taaaattcaacaaa

SEQ ID NO: 469781 - DNA, 12 bp, Homo sapiens
taaaattctagt

SEQ ID NO: 469782 - DNA, 13 bp, Homo sapiens
taaaattctagtc

SEQ ID NO: 469783 - DNA, 16 bp, Homo sapiens
taaacactgtaatctt

SEQ ID NO: 469784 - DNA, 17 bp, Homo sapiens
taaacactgtaatctta

SEQ ID NO: 469785 - DNA, 20 bp, Homo sapiens
taaacctgtgctttcatgtt

SEQ ID NO: 469786 - DNA, 21 bp, Homo sapiens
taaacctgtgctttcatgttt

SEQ ID NO: 469787 - DNA, 12 bp, Homo sapiens
taaactcttcaa

SEQ ID NO: 469788 - DNA, 15 bp, Homo sapiens
taaactcttcaaggc

SEQ ID NO: 469789 - DNA, 13 bp, Homo sapiens
taaacttcagcaa

SEQ ID NO: 469790 - DNA, 13 bp, Homo sapiens
taaacttgtactt

SEQ ID NO: 469791 - DNA, 14 bp, Homo sapiens
taaacttgtcagaa

SEQ ID NO: 469792 - DNA, 12 bp, Homo sapiens
taaactttgtca

SEQ ID NO: 469793 - DNA, 17 bp, Homo sapiens
taaagaagaaaataacc

SEQ ID NO: 469794 - DNA, 18 bp, Homo sapiens
taaagaccatttagtcct

SEQ ID NO: 469795 - DNA, 14 bp, Homo sapiens
taaagtacctgtag

SEQ ID NO: 469796 - DNA, 22 bp, Homo sapiens
taaataaactcttcaaggccaa

SEQ ID NO: 469797 - DNA, 15 bp, Homo sapiens
taaataaagaagaaa

SEQ ID NO: 469798 - DNA, 12 bp, Homo sapiens
taaatagtaaat

SEQ ID NO: 469799 - DNA, 17 bp, Homo sapiens
taaatagtaaataatga

SEQ ID NO: 469800 - DNA, 15 bp, Homo sapiens
taaatccattttcta

SEQ ID NO: 469801 - DNA, 20 bp, Homo sapiens
taaatccattttctaaactg

SEQ ID NO: 469802 - DNA, 15 bp, Homo sapiens
taaatcccacgacat

SEQ ID NO: 469803 - DNA, 13 bp, Homo sapiens
taaatctaaatat

SEQ ID NO: 469804 - DNA, 21 bp, Homo sapiens
taaatctgtctgattctatgc

SEQ ID NO: 469805 - DNA, 12 bp, Homo sapiens
taaatgattcca

SEQ ID NO: 469806 - DNA, 13 bp, Homo sapiens
taaatgattccaa

SEQ ID NO: 469807 - DNA, 15 bp, Homo sapiens
taaatgattccaaat

SEQ ID NO: 469808 - DNA, 19 bp, Homo sapiens
taaattacaattgtcattt

SEQ ID NO: 469809 - DNA, 22 bp, Homo sapiens
taaattatatgatatgcatgta

SEQ ID NO: 469810 - DNA, 13 bp, Homo sapiens
taaattattactt

SEQ ID NO: 469811 - DNA, 13 bp, Homo sapiens
taaattggctcct

SEQ ID NO: 469812 - DNA, 14 bp, Homo sapiens
taaattggctcctt

SEQ ID NO: 469813 - DNA, 23 bp, Homo sapiens
taaattggctcctttcccacagt

SEQ ID NO: 469814 - DNA, 16 bp, Homo sapiens
taaatttaactgcata

SEQ ID NO: 469815 - DNA, 14 bp, Homo sapiens
taaattttaatgta

SEQ ID NO: 469816 - DNA, 15 bp, Homo sapiens
taaattttaatgtaa

SEQ ID NO: 469817 - DNA, 22 bp, Homo sapiens
taacaaacgtaatttgttatat

SEQ ID NO: 469818 - DNA, 18 bp, Homo sapiens
taacaagccaaacattct

SEQ ID NO: 469819 - DNA, 19 bp, Homo sapiens
tcaagcgctatccacagaa

SEQ ID NO: 469820 - DNA, 23 bp, Homo sapiens
tcaatacttttgtgtattctgtg

SEQ ID NO: 469821 - DNA, 20 bp, Homo sapiens
tcaatctggcttctgcatta

SEQ ID NO: 469822 - DNA, 22 bp, Homo sapiens
tcaatctggcttctgcattact

SEQ ID NO: 469823 - DNA, 23 bp, Homo sapiens
tcaatgcatacaataaaagagct

SEQ ID NO: 469824 - DNA, 17 bp, Homo sapiens
tcaatgtgaaataaaga

SEQ ID NO: 469825 - DNA, 19 bp, Homo sapiens
tcaatgtgaaataaagagt

SEQ ID NO: 469826 - DNA, 22 bp, Homo sapiens
tcacaaataagtaatatctttc

SEQ ID NO: 469827 - DNA, 22 bp, Homo sapiens
tcacaaatatagttgaacaaga

SEQ ID NO: 469828 - DNA, 19 bp, Homo sapiens
tcacactctcttcttactg

SEQ ID NO: 469829 - DNA, 20 bp, Homo sapiens
tcacagatgggtattaaact

SEQ ID NO: 469830 - DNA, 17 bp, Homo sapiens
tcacagcagtacttgct

SEQ ID NO: 469831 - DNA, 23 bp, Homo sapiens
tcacatatttgtagctagaatat

SEQ ID NO: 469832 - DNA, 22 bp, Homo sapiens
tcacatctgtatatcagctcta

SEQ ID NO: 469833 - DNA, 17 bp, Homo sapiens
tcaccagaaatgatagc

SEQ ID NO: 469834 - DNA, 23 bp, Homo sapiens
tcacctccattaaccaagaaaac

SEQ ID NO: 469835 - DNA, 17 bp, Homo sapiens
tcaccttcgcctttgct

SEQ ID NO: 469836 - DNA, 20 bp, Homo sapiens
tcaccttggctctgttgctg

SEQ ID NO: 469837 - DNA, 15 bp, Homo sapiens
tcacgctgacagcct

SEQ ID NO: 469838 - DNA, 18 bp, Homo sapiens
tcacgctgacagcctcct

SEQ ID NO: 469839 - DNA, 13 bp, Homo sapiens
tcactatggtatg

SEQ ID NO: 469840 - DNA, 23 bp, Homo sapiens
tcactatggtatgctggccagca

SEQ ID NO: 469841 - DNA, 20 bp, Homo sapiens
tcactccactcccctcatcc

SEQ ID NO: 469842 - DNA, 15 bp, Homo sapiens
tcactccctgtcata

SEQ ID NO: 469843 - DNA, 20 bp, Homo sapiens
tcactctacccccaacacca

SEQ ID NO: 469844 - DNA, 19 bp, Homo sapiens
tcactctacttagcatgtc

SEQ ID NO: 469845 - DNA, 20 bp, Homo sapiens
tcactctacttagcatgtcc

SEQ ID NO: 469846 - DNA, 20 bp, Homo sapiens
tcactctgacagtattaaca

SEQ ID NO: 469847 - DNA, 15 bp, Homo sapiens
tcactctgtcagcca

SEQ ID NO: 469848 - DNA, 17 bp, Homo sapiens
tcactctgtcagccagc

SEQ ID NO: 469849 - DNA, 18 bp, Homo sapiens
tcactctgtcagccagcc

SEQ ID NO: 469850 - DNA, 22 bp, Homo sapiens
tcactgaataatggaattatgt

SEQ ID NO: 469851 - DNA, 20 bp, Homo sapiens
tcactgcacagtgcatctca

SEQ ID NO: 469852 - DNA, 17 bp, Homo sapiens
tcactgccctccctcgg

SEQ ID NO: 469853 - DNA, 22 bp, Homo sapiens
tcactgccctccctcggcccca

SEQ ID NO: 469854 - DNA, 14 bp, Homo sapiens
tcactgctggctgc

SEQ ID NO: 469855 - DNA, 16 bp, Homo sapiens
tcactgctggctgcct

SEQ ID NO: 469856 - DNA, 22 bp, Homo sapiens
tcactgctggctgccttagaac

SEQ ID NO: 469857 - DNA, 14 bp, Homo sapiens
tcactgctttgtag

SEQ ID NO: 469858 - DNA, 11 bp, Homo sapiens
tcacttaaggg

SEQ ID NO: 469859 - DNA, 22 bp, Homo sapiens
tcacttaaggggggatgtcttg

SEQ ID NO: 469860 - DNA, 22 bp, Homo sapiens
tcacttgtcctcagtttttcct

SEQ ID NO: 469861 - DNA, 21 bp, Homo sapiens
tcactttagaggcttgatcat

SEQ ID NO: 469862 - DNA, 20 bp, Homo sapiens
tcagaaagggcagcccctcc

SEQ ID NO: 469863 - DNA, 16 bp, Homo sapiens
tcagaacaatccgatt

SEQ ID NO: 469864 - DNA, 17 bp, Homo sapiens
tcagaactcctttctaa

SEQ ID NO: 469865 - DNA, 21 bp, Homo sapiens
tcagaagagtcccggagctca

SEQ ID NO: 469866 - DNA, 22 bp, Homo sapiens
tcagaattgaaccgtcaatgtg

SEQ ID NO: 469867 - DNA, 22 bp, Homo sapiens
tcagacagatctggaatgtgaa

SEQ ID NO: 469868 - DNA, 13 bp, Homo sapiens
tcagagtaacaca

SEQ ID NO: 469869 - DNA, 14 bp, Homo sapiens
tcagagttctctgt

SEQ ID NO: 469870 - DNA, 12 bp, Homo sapiens
tcagatccctcg

SEQ ID NO: 469871 - DNA, 16 bp, Homo sapiens
tcagatccctcggtca

SEQ ID NO: 469872 - DNA, 22 bp, Homo sapiens
tcagatccctcggtcagcaccg

SEQ ID NO: 469873 - DNA, 20 bp, Homo sapiens
tcagcaaggggctctgccct

SEQ ID NO: 469874 - DNA, 21 bp, Homo sapiens
tcagcaccgtggtgtgaggcc

SEQ ID NO: 469875 - DNA, 13 bp, Homo sapiens
tcagcagacactc

SEQ ID NO: 469876 - DNA, 15 bp, Homo sapiens
tcagcattcaaaata

SEQ ID NO: 469877 - DNA, 20 bp, Homo sapiens
tcagcattcaaaatagttct

SEQ ID NO: 469878 - DNA, 15 bp, Homo sapiens
tcagccagccgccct

SEQ ID NO: 469879 - DNA, 18 bp, Homo sapiens
tcagccagccgccctggg

SEQ ID NO: 469880 - DNA, 23 bp, Homo sapiens
tcagccagccgccctgggctgtc

SEQ ID NO: 469881 - DNA, 13 bp, Homo sapiens
tcagccctccctg

SEQ ID NO: 469882 - DNA, 17 bp, Homo sapiens
tcagctggtgtcagtcc

SEQ ID NO: 469883 - DNA, 14 bp, Homo sapiens
tcagcttgtttcta

SEQ ID NO: 469884 - DNA, 21 bp, Homo sapiens
tcaggaatgggccaagccagg

SEQ ID NO: 469885 - DNA, 19 bp, Homo sapiens
tcagtacacccaattttaa

SEQ ID NO: 469886 - DNA, 12 bp, Homo sapiens
tcagtacagggc

SEQ ID NO: 469887 - DNA, 17 bp, Homo sapiens
tcagtaggtctgaaggc

SEQ ID NO: 469888 - DNA, 19 bp, Homo sapiens
tcagtaggtctgaaggcct

SEQ ID NO: 469889 - DNA, 22 bp, Homo sapiens
tcagtaggtctgaaggcctcca

SEQ ID NO: 469890 - DNA, 16 bp, Homo sapiens
tcagtagtgcctgtga

SEQ ID NO: 469891 - DNA, 15 bp, Homo sapiens
tcagtctttggggga

SEQ ID NO: 469892 - DNA, 17 bp, Homo sapiens
tcagtgaagcccaggag

SEQ ID NO: 469893 - DNA, 18 bp, Homo sapiens
tcagtgaagcccaggagg

SEQ ID NO: 469894 - DNA, 23 bp, Homo sapiens
tcagtgaagcccaggaggacctg

SEQ ID NO: 469895 - DNA, 14 bp, Homo sapiens
tcagttctcatctt

SEQ ID NO: 469896 - DNA, 19 bp, Homo sapiens
tcagttctcatcttgtaaa

SEQ ID NO: 469897 - DNA, 18 bp, Homo sapiens
tcagttggaattgaagac

SEQ ID NO: 469898 - DNA, 23 bp, Homo sapiens
tcataaattggctcctttcccac

SEQ ID NO: 469899 - DNA, 17 bp, Homo sapiens
tcatactgaaattgttt

SEQ ID NO: 469900 - DNA, 22 bp, Homo sapiens
tcatacttgctccttgaataag

SEQ ID NO: 469901 - DNA, 23 bp, Homo sapiens
tcatataatttgccagacagaga

SEQ ID NO: 469902 - DNA, 19 bp, Homo sapiens
tcatccatagacacagtat

SEQ ID NO: 469903 - DNA, 23 bp, Homo sapiens
tcatcggaggctgggcccctggg

SEQ ID NO: 469904 - DNA, 16 bp, Homo sapiens
tcatctcaaacactgc

SEQ ID NO: 469905 - DNA, 20 bp, Homo sapiens
tcatgacaaccgacgaagaa

SEQ ID NO: 469906 - DNA, 19 bp, Homo sapiens
tcatgcatagacaagtgtt

SEQ ID NO: 469907 - DNA, 23 bp, Homo sapiens
tcatgtgttgcaaattattctag

SEQ ID NO: 469908 - DNA, 13 bp, Homo sapiens
tcatgtttaagaa

SEQ ID NO: 469909 - DNA, 14 bp, Homo sapiens
tcattaaacaaaca

SEQ ID NO: 469910 - DNA, 18 bp, Homo sapiens
tcattacatcctctgctt

SEQ ID NO: 469911 - DNA, 17 bp, Homo sapiens
tcattcaagcctgtgaa

SEQ ID NO: 469912 - DNA, 18 bp, Homo sapiens
tcattcaagcctgtgaat

SEQ ID NO: 469913 - DNA, 19 bp, Homo sapiens
tcattctgctaatttatga

SEQ ID NO: 469914 - DNA, 20 bp, Homo sapiens
tcattcttgccctttgagaa

SEQ ID NO: 469915 - DNA, 19 bp, Homo sapiens
tccttcactctgacagtat

SEQ ID NO: 469916 - DNA, 23 bp, Homo sapiens
tccttcccgcagcaccagcctga

SEQ ID NO: 469917 - DNA, 13 bp, Homo sapiens
tccttctcccctc

SEQ ID NO: 469918 - DNA, 14 bp, Homo sapiens
tccttctcccctcc

SEQ ID NO: 469919 - DNA, 12 bp, Homo sapiens
tccttctttaaa

SEQ ID NO: 469920 - DNA, 17 bp, Homo sapiens
tccttgtacttgaataa

SEQ ID NO: 469921 - DNA, 16 bp, Homo sapiens
tcctttcacaaccttc

SEQ ID NO: 469922 - DNA, 20 bp, Homo sapiens
tcctttcacaaccttctgtg

SEQ ID NO: 469923 - DNA, 12 bp, Homo sapiens
tcctttcccaca

SEQ ID NO: 469924 - DNA, 14 bp, Homo sapiens
tcctttcccacagt

SEQ ID NO: 469925 - DNA, 15 bp, Homo sapiens
tcctttcccacagtc

SEQ ID NO: 469926 - DNA, 18 bp, Homo sapiens
tcctttgacctctcactt

SEQ ID NO: 469927 - DNA, 13 bp, Homo sapiens
tcgagagggctga

SEQ ID NO: 469928 - DNA, 13 bp, Homo sapiens
tcgagcccagatg

SEQ ID NO: 469929 - DNA, 21 bp, Homo sapiens
tcgagtgatatggcttgtagg

SEQ ID NO: 469930 - DNA, 15 bp, Homo sapiens
tcgatcgtttcacat

SEQ ID NO: 469931 - DNA, 21 bp, Homo sapiens
tcgcatccaccgccaccccac

SEQ ID NO: 469932 - DNA, 13 bp, Homo sapiens
tcggagcccccca

SEQ ID NO: 469933 - DNA, 13 bp, Homo sapiens
tcggaggctgggc

SEQ ID NO: 469934 - DNA, 14 bp, Homo sapiens
tcggctgggcaggg

SEQ ID NO: 469935 - DNA, 21 bp, Homo sapiens
tcggctgggcagggccgcagg

SEQ ID NO: 469936 - DNA, 15 bp, Homo sapiens
tcgggaaggcctgag

SEQ ID NO: 469937 - DNA, 16 bp, Homo sapiens
tcgggaaggcctgagg

SEQ ID NO: 469938 - DNA, 16 bp, Homo sapiens
tcgggccgcctcctcc

SEQ ID NO: 469939 - DNA, 19 bp, Homo sapiens
tcgggccgcctcctccaga

SEQ ID NO: 469940 - DNA, 21 bp, Homo sapiens
tcgggcgcctgcgctcctctg

SEQ ID NO: 469941 - DNA, 16 bp, Homo sapiens
tcgggggaggagcacc

SEQ ID NO: 469942 - DNA, 17 bp, Homo sapiens
tcgggggaggagcaccc

SEQ ID NO: 469943 - DNA, 23 bp, Homo sapiens
tcgggggaggagcacccccagcc

SEQ ID NO: 469944 - DNA, 14 bp, Homo sapiens
tcgtccggcctgca

SEQ ID NO: 469945 - DNA, 16 bp, Homo sapiens
tcgtccggcctgcagc

SEQ ID NO: 469946 - DNA, 14 bp, Homo sapiens
tctaaaattctagt

SEQ ID NO: 469947 - DNA, 23 bp, Homo sapiens
tctaacactcgactctgctgctc

SEQ ID NO: 469948 - DNA, 23 bp, Homo sapiens
tctaagaaatggctttccacatc

SEQ ID NO: 469949 - DNA, 11 bp, Homo sapiens
tctaagctgtt

SEQ ID NO: 469950 - DNA, 17 bp, Homo sapiens
tctaagtcagtttcaca

SEQ ID NO: 469951 - DNA, 22 bp, Homo sapiens
tctacaacataatgatactgaa

SEQ ID NO: 469952 - DNA, 20 bp, Homo sapiens
tctacagctaatcagcattc

SEQ ID NO: 469953 - DNA, 17 bp, Homo sapiens
tctacccccaacaccac

SEQ ID NO: 469954 - DNA, 22 bp, Homo sapiens
tctagcaagaagattctaaaac

SEQ ID NO: 469955 - DNA, 22 bp, Homo sapiens
tctagctataacaactctattt

SEQ ID NO: 469956 - DNA, 23 bp, Homo sapiens
tctagctataacaactctatttt

SEQ ID NO: 469957 - DNA, 16 bp, Homo sapiens
tctagtcctattctat

SEQ ID NO: 469958 - DNA, 14 bp, Homo sapiens
tctagtctctgatt

SEQ ID NO: 469959 - DNA, 16 bp, Homo sapiens
tctataagagacaaag

SEQ ID NO: 469960 - DNA, 17 bp, Homo sapiens
tctatactgtttgtaat

SEQ ID NO: 469961 - DNA, 22 bp, Homo sapiens
tctatactgtttgtaatataca

SEQ ID NO: 469962 - DNA, 23 bp, Homo sapiens
tctatactgtttgtaatatacag

SEQ ID NO: 469963 - DNA, 18 bp, Homo sapiens
tctatatgtttaaaagta

SEQ ID NO: 469964 - DNA, 16 bp, Homo sapiens
tctatatttcatattg

SEQ ID NO: 469965 - DNA, 17 bp, Homo sapiens
tctatatttcatattga

SEQ ID NO: 469966 - DNA, 18 bp, Homo sapiens
tctatggattcacttcta

SEQ ID NO: 469967 - DNA, 19 bp, Homo sapiens
tctatggattcacttctat

SEQ ID NO: 469968 - DNA, 14 bp, Homo sapiens
tctatgtagaactg

SEQ ID NO: 469969 - DNA, 17 bp, Homo sapiens
tctatgtagaactgttc

SEQ ID NO: 469970 - DNA, 20 bp, Homo sapiens
tctatgtagaactgttcatt

SEQ ID NO: 469971 - DNA, 20 bp, Homo sapiens
tctattatctgggttttaga

SEQ ID NO: 469972 - DNA, 23 bp, Homo sapiens
tctattatctgggttttagaaat

SEQ ID NO: 469973 - DNA, 15 bp, Homo sapiens
tctattgtagcattt

SEQ ID NO: 469974 - DNA, 17 bp, Homo sapiens
tctattgtagcatttct

SEQ ID NO: 469975 - DNA, 16 bp, Homo sapiens
tctatttctatctgca

SEQ ID NO: 469976 - DNA, 19 bp, Homo sapiens
tctatttctatctgcaaat

SEQ ID NO: 469977 - DNA, 15 bp, Homo sapiens
tctattttgcagcag

SEQ ID NO: 469978 - DNA, 18 bp, Homo sapiens
tctcaagagggcactggt

SEQ ID NO: 469979 - DNA, 19 bp, Homo sapiens
tctcaagagggcactggtg

SEQ ID NO: 469980 - DNA, 22 bp, Homo sapiens
tctcaagcgctatccacagaac

SEQ ID NO: 469981 - DNA, 15 bp, Homo sapiens
tctcacaaataagta

SEQ ID NO: 469982 - DNA, 17 bp, Homo sapiens
tctcagcaaattcttga

SEQ ID NO: 469983 - DNA, 17 bp, Homo sapiens
tctcagctccactctga

SEQ ID NO: 469984 - DNA, 21 bp, Homo sapiens
tctcatgcatagacaagtgtt

SEQ ID NO: 469985 - DNA, 14 bp, Homo sapiens
tctccacccagagg

SEQ ID NO: 469986 - DNA, 16 bp, Homo sapiens
tctccacccagaggtc

SEQ ID NO: 469987 - DNA, 16 bp, Homo sapiens
tctccacccctcaagc

SEQ ID NO: 469988 - DNA, 21 bp, Homo sapiens
tctccacccctcaagccagga

SEQ ID NO: 469989 - DNA, 14 bp, Homo sapiens
tctccactgccttc

SEQ ID NO: 469990 - DNA, 12 bp, Homo sapiens
tctccagctgat

SEQ ID NO: 469991 - DNA, 13 bp, Homo sapiens
tctcccatggggg

SEQ ID NO: 469992 - DNA, 16 bp, Homo sapiens
tctccccgcagccctc

SEQ ID NO: 469993 - DNA, 17 bp, Homo sapiens
tctccccgcagccctct

SEQ ID NO: 469994 - DNA, 12 bp, Homo sapiens
tctccccgctct

SEQ ID NO: 469995 - DNA, 19 bp, Homo sapiens
tctccctaccctcttctca

SEQ ID NO: 469996 - DNA, 21 bp, Homo sapiens
tctccctataccgagacccac

SEQ ID NO: 469997 - DNA, 11 bp, Homo sapiens
tctccctccac

SEQ ID NO: 469998 - DNA, 12 bp, Homo sapiens
tctccctccact

SEQ ID NO: 469999 - DNA, 14 bp, Homo sapiens
tctccctccactcc

SEQ ID NO: 470000 - DNA, 20 bp, Homo sapiens
tctccctggccacccttggc

SEQ ID NO: 470001 - DNA, 17 bp, Homo sapiens
tctccgggtgtggcctc

SEQ ID NO: 470002 - DNA, 21 bp, Homo sapiens
tctccgggtgtggcctcagcc

SEQ ID NO: 470003 - DNA, 20 bp, Homo sapiens
tctcctcgtccggcctgcag

SEQ ID NO: 470004 - DNA, 22 bp, Homo sapiens
tctcctctctctccctccactc

SEQ ID NO: 470005 - DNA, 23 bp, Homo sapiens
tctcctctgctccaacagacacc

SEQ ID NO: 470006 - DNA, 15 bp, Homo sapiens
tctcctgagcctgtc

SEQ ID NO: 470007 - DNA, 18 bp, Homo sapiens
tctcctgggggtggcagg

SEQ ID NO: 470008 - DNA, 19 bp, Homo sapiens
tctcctgggggtggcaggc

SEQ ID NO: 470009 - DNA, 14 bp, Homo sapiens
tctccttgtacttg

SEQ ID NO: 470010 - DNA, 13 bp, Homo sapiens
tctcgagcccaga

SEQ ID NO: 470011 - DNA, 21 bp, Homo sapiens
tctcgggtgcatttgagagaa

SEQ ID NO: 470012 - DNA, 16 bp, Homo sapiens
tctctaaaattctagt

SEQ ID NO: 470013 - DNA, 14 bp, Homo sapiens
tcttcaaggccaag

SEQ ID NO: 470014 - DNA, 21 bp, Homo sapiens
tcttcagctgtttcgcatcca

SEQ ID NO: 470015 - DNA, 23 bp, Homo sapiens
tcttcagctgtttcgcatccacc

SEQ ID NO: 470016 - DNA, 20 bp, Homo sapiens
tcttccaagttcattcatac

SEQ ID NO: 470017 - DNA, 12 bp, Homo sapiens
tcttcccccttc

SEQ ID NO: 470018 - DNA, 19 bp, Homo sapiens
tcttcccccttcccgcctt

SEQ ID NO: 470019 - DNA, 21 bp, Homo sapiens
tcttcccccttcccgccttca

SEQ ID NO: 470020 - DNA, 16 bp, Homo sapiens
tcttctcagctccact

SEQ ID NO: 470021 - DNA, 16 bp, Homo sapiens
tcttctccactggatg

SEQ ID NO: 470022 - DNA, 13 bp, Homo sapiens
tcttctcctttca

SEQ ID NO: 470023 - DNA, 20 bp, Homo sapiens
tcttcttgcggcaccgccca

SEQ ID NO: 470024 - DNA, 11 bp, Homo sapiens
tcttgaataaa

SEQ ID NO: 470025 - DNA, 13 bp, Homo sapiens
tcttgaataaact

SEQ ID NO: 470026 - DNA, 23 bp, Homo sapiens
tcttgagatgtattatgcaaagt

SEQ ID NO: 470027 - DNA, 18 bp, Homo sapiens
tcttgagtgggccccctc

SEQ ID NO: 470028 - DNA, 19 bp, Homo sapiens
tcttgagtgggccccctct

SEQ ID NO: 470029 - DNA, 16 bp, Homo sapiens
tcttgatgttgcttag

SEQ ID NO: 470030 - DNA, 15 bp, Homo sapiens
tcttgattaaaagtt

SEQ ID NO: 470031 - DNA, 19 bp, Homo sapiens
tcttgcactgtatccaagt

SEQ ID NO: 470032 - DNA, 13 bp, Homo sapiens
tcttgctttcaca

SEQ ID NO: 470033 - DNA, 17 bp, Homo sapiens
tcttgctttcacaaata

SEQ ID NO: 470034 - DNA, 12 bp, Homo sapiens
tcttggagagga

SEQ ID NO: 470035 - DNA, 19 bp, Homo sapiens
tcttggagaggaggtgtgg

SEQ ID NO: 470036 - DNA, 22 bp, Homo sapiens
tctttaacatacatctaagtca

SEQ ID NO: 470037 - DNA, 14 bp, Homo sapiens
tctttctctctgtg

SEQ ID NO: 470038 - DNA, 19 bp, Homo sapiens
tctttgctgtttatatata

SEQ ID NO: 470039 - DNA, 22 bp, Homo sapiens
tctttggagagctcagtacagg

SEQ ID NO: 470040 - DNA, 17 bp, Homo sapiens
tctttgggggattcaaa

SEQ ID NO: 470041 - DNA, 14 bp, Homo sapiens
tctttgtgacagga

SEQ ID NO: 470042 - DNA, 16 bp, Homo sapiens
tctttgtgacaggaaa

SEQ ID NO: 470043 - DNA, 17 bp, Homo sapiens
tcttttatatctgtaaa

SEQ ID NO: 470044 - DNA, 19 bp, Homo sapiens
tcttttatatctgtaaatt

SEQ ID NO: 470045 - DNA, 14 bp, Homo sapiens
tcttttttcaatgt

SEQ ID NO: 470046 - DNA, 20 bp, Homo sapiens
tcttttttcaatgtactgta

SEQ ID NO: 470047 - DNA, 16 bp, Homo sapiens
tgaaaagaaatgctaa

SEQ ID NO: 470048 - DNA, 17 bp, Homo sapiens
tgaaaagaaatgctaat

SEQ ID NO: 470049 - DNA, 12 bp, Homo sapiens
tgaaaagaagaa

SEQ ID NO: 470050 - DNA, 18 bp, Homo sapiens
tgaaaagaagaaagtcta

SEQ ID NO: 470051 - DNA, 22 bp, Homo sapiens
tgaaaagaagaaagtctatgct

SEQ ID NO: 470052 - DNA, 19 bp, Homo sapiens
tgaaaatatttttttctag

SEQ ID NO: 470053 - DNA, 20 bp, Homo sapiens
tgaaaatatttttttctagc

SEQ ID NO: 470054 - DNA, 12 bp, Homo sapiens
tgaaaattcttg

SEQ ID NO: 470055 - DNA, 11 bp, Homo sapiens
tgaaagagaaa

SEQ ID NO: 470056 - DNA, 13 bp, Homo sapiens
tgaaagagaaaat

SEQ ID NO: 470057 - DNA, 14 bp, Homo sapiens
tgaaagagaaaatg

SEQ ID NO: 470058 - DNA, 15 bp, Homo sapiens
tgaaataaagagttc

SEQ ID NO: 470059 - DNA, 21 bp, Homo sapiens
tgaaataaagagttctccttg

SEQ ID NO: 470060 - DNA, 18 bp, Homo sapiens
tgaaattggaaaggactt

SEQ ID NO: 470061 - DNA, 18 bp, Homo sapiens
tgaaccgtcaatgtgaaa

SEQ ID NO: 470062 - DNA, 21 bp, Homo sapiens
tgaaccgtcaatgtgaaataa

SEQ ID NO: 470063 - DNA, 18 bp, Homo sapiens
tgaagagcgctcctctgc

SEQ ID NO: 470064 - DNA, 16 bp, Homo sapiens
tgaagcccaggaggac

SEQ ID NO: 470065 - DNA, 21 bp, Homo sapiens
tgaagggaaatcaatttaaag

SEQ ID NO: 470066 - DNA, 14 bp, Homo sapiens
tgaagtcactgcac

SEQ ID NO: 470067 - DNA, 14 bp, Homo sapiens
tgaagtcccttcct

SEQ ID NO: 470068 - DNA, 12 bp, Homo sapiens
tgaagtctcccc

SEQ ID NO: 470069 - DNA, 20 bp, Homo sapiens
tgaagtctccccgcagccct

SEQ ID NO: 470070 - DNA, 14 bp, Homo sapiens
tgaataaaaaccct

SEQ ID NO: 470071 - DNA, 14 bp, Homo sapiens
tgaataaagacacc

SEQ ID NO: 470072 - DNA, 15 bp, Homo sapiens
tgaataaagacacct

SEQ ID NO: 470073 - DNA, 16 bp, Homo sapiens
tgaataattatgttta

SEQ ID NO: 470074 - DNA, 22 bp, Homo sapiens
tgaatgtccccattctataaat

SEQ ID NO: 470075 - DNA, 14 bp, Homo sapiens
tgaattgttatgta

SEQ ID NO: 470076 - DNA, 20 bp, Homo sapiens
tgaatttctggtttgcctga

SEQ ID NO: 470077 - DNA, 22 bp, Homo sapiens
tgaatttctggtttgcctgaat

SEQ ID NO: 470078 - DNA, 15 bp, Homo sapiens
tgaattttaaaatgc

SEQ ID NO: 470079 - DNA, 18 bp, Homo sapiens
tgaattttttcctaccat

SEQ ID NO: 470080 - DNA, 15 bp, Homo sapiens
tgacagcctcctagg

SEQ ID NO: 470081 - DNA, 23 bp, Homo sapiens
tgacagcctcctaggctccctga

SEQ ID NO: 470082 - DNA, 16 bp, Homo sapiens
tgacaggaaagccctc

SEQ ID NO: 470083 - DNA, 21 bp, Homo sapiens
tgacaggaaagccctccccct

SEQ ID NO: 470084 - DNA, 14 bp, Homo sapiens
tgaccccacacgcc

SEQ ID NO: 470085 - DNA, 22 bp, Homo sapiens
tgaccccacacgccggggctgg

SEQ ID NO: 470086 - DNA, 20 bp, Homo sapiens
tgaccccacttatgctgctg

SEQ ID NO: 470087 - DNA, 20 bp, Homo sapiens
tgacctaaatccattttcta

SEQ ID NO: 470088 - DNA, 21 bp, Homo sapiens
tgacctgacgatcttccccct

SEQ ID NO: 470089 - DNA, 18 bp, Homo sapiens
tgacctttatttattaaa

SEQ ID NO: 470090 - DNA, 23 bp, Homo sapiens
tgacctttatttattaaacttca

SEQ ID NO: 470091 - DNA, 21 bp, Homo sapiens
tgacgacctacatctgaaatc

SEQ ID NO: 470092 - DNA, 15 bp, Homo sapiens
tgactataaaaactg

SEQ ID NO: 470093 - DNA, 13 bp, Homo sapiens
tgactccctgtgg

SEQ ID NO: 470094 - DNA, 16 bp, Homo sapiens
tgactgtactcctccc

SEQ ID NO: 470095 - DNA, 22 bp, Homo sapiens
tgactgtcccaccgggagcctc

SEQ ID NO: 470096 - DNA, 19 bp, Homo sapiens
tgacttcagactctctcct

SEQ ID NO: 470097 - DNA, 16 bp, Homo sapiens
tgacttcccagctggc

SEQ ID NO: 470098 - DNA, 18 bp, Homo sapiens
tgacttcccagctggcag

SEQ ID NO: 470099 - DNA, 11 bp, Homo sapiens
tgacttctctc

SEQ ID NO: 470100 - DNA, 22 bp, Homo sapiens
tgagaaattgtgccaaagatag

SEQ ID NO: 470101 - DNA, 14 bp, Homo sapiens
tgagacagtggggg

SEQ ID NO: 470102 - DNA, 15 bp, Homo sapiens
tgagactcccgcctt

SEQ ID NO: 470103 - DNA, 19 bp, Homo sapiens
tgagactcccgcctttgac

SEQ ID NO: 470104 - DNA, 17 bp, Homo sapiens
tgagagaagccacgctg

SEQ ID NO: 470105 - DNA, 22 bp, Homo sapiens
tgagagaagccacgctgtcctc

SEQ ID NO: 470106 - DNA, 17 bp, Homo sapiens
tgagagctgctcctttg

SEQ ID NO: 470107 - DNA, 13 bp, Homo sapiens
tgagagtcatctc

SEQ ID NO: 470108 - DNA, 16 bp, Homo sapiens
tgagagtcatctcaaa

SEQ ID NO: 470109 - DNA, 20 bp, Homo sapiens
tgagagtcatctcaaacact

SEQ ID NO: 470110 - DNA, 18 bp, Homo sapiens
tgagatcagcattcaaaa

SEQ ID NO: 470111 - DNA, 21 bp, Homo sapiens
tgcttagtcacttatttcata

SEQ ID NO: 470112 - DNA, 23 bp, Homo sapiens
tgcttagtcacttatttcataaa

SEQ ID NO: 470113 - DNA, 16 bp, Homo sapiens
tgcttggatccataca

SEQ ID NO: 470114 - DNA, 18 bp, Homo sapiens
tgcttggatccatacaaa

SEQ ID NO: 470115 - DNA, 20 bp, Homo sapiens
tgcttggatccatacaaaac

SEQ ID NO: 470116 - DNA, 18 bp, Homo sapiens
tgcttgtcattctgctaa

SEQ ID NO: 470117 - DNA, 12 bp, Homo sapiens
tgctttcatcca

SEQ ID NO: 470118 - DNA, 17 bp, Homo sapiens
tgctttgggctgccctg

SEQ ID NO: 470119 - DNA, 19 bp, Homo sapiens
tgctttgggctgccctggt

SEQ ID NO: 470120 - DNA, 20 bp, Homo sapiens
tgctttgggctgccctggtg

SEQ ID NO: 470121 - DNA, 23 bp, Homo sapiens
tgctttggggcttatcagaactc

SEQ ID NO: 470122 - DNA, 16 bp, Homo sapiens
tgctttgtttccttct

SEQ ID NO: 470123 - DNA, 12 bp, Homo sapiens
tgcttttccatc

SEQ ID NO: 470124 - DNA, 18 bp, Homo sapiens
tgcttttccatctaaaat

SEQ ID NO: 470125 - DNA, 22 bp, Homo sapiens
tggaaagacgtttttgtgctgt

SEQ ID NO: 470126 - DNA, 13 bp, Homo sapiens
tggaaagggtgtg

SEQ ID NO: 470127 - DNA, 22 bp, Homo sapiens
tggaaagggtgtggcttggaac

SEQ ID NO: 470128 - DNA, 13 bp, Homo sapiens
tggaaccttccct

SEQ ID NO: 470129 - DNA, 16 bp, Homo sapiens
tggaagaaagggagaa

SEQ ID NO: 470130 - DNA, 22 bp, Homo sapiens
tggaaggctttattcttccaag

SEQ ID NO: 470131 - DNA, 15 bp, Homo sapiens
tggaatgttggctgt

SEQ ID NO: 470132 - DNA, 14 bp, Homo sapiens
tggagactgtctca

SEQ ID NO: 470133 - DNA, 21 bp, Homo sapiens
tggagagctcagtacagggca

SEQ ID NO: 470134 - DNA, 23 bp, Homo sapiens
tggagagctcagtacagggcagg

SEQ ID NO: 470135 - DNA, 17 bp, Homo sapiens
tggagcagagacggcag

SEQ ID NO: 470136 - DNA, 21 bp, Homo sapiens
tggaggaaaaccaagccgtgg

SEQ ID NO: 470137 - DNA, 18 bp, Homo sapiens
tggaggcctggtctggag

SEQ ID NO: 470138 - DNA, 19 bp, Homo sapiens
tggaggcctggtctggagc

SEQ ID NO: 470139 - DNA, 21 bp, Homo sapiens
tggaggcctggtctggagccc

SEQ ID NO: 470140 - DNA, 20 bp, Homo sapiens
tggagtctgaaggagaggag

SEQ ID NO: 470141 - DNA, 23 bp, Homo sapiens
tggagtctgaaggagaggagtgc

SEQ ID NO: 470142 - DNA, 11 bp, Homo sapiens
tggagtggagg

SEQ ID NO: 470143 - DNA, 20 bp, Homo sapiens
tggagtggaggggtcagcag

SEQ ID NO: 470144 - DNA, 22 bp, Homo sapiens
tggagttcactttcaattgctt

SEQ ID NO: 470145 - DNA, 13 bp, Homo sapiens
tggatgtgctttc

SEQ ID NO: 470146 - DNA, 20 bp, Homo sapiens
tggattatctactacagagt

SEQ ID NO: 470147 - DNA, 13 bp, Homo sapiens
tggattcacttct

SEQ ID NO: 470148 - DNA, 15 bp, Homo sapiens
tggattctatatttc

SEQ ID NO: 470149 - DNA, 16 bp, Homo sapiens
tggattctatatttca

SEQ ID NO: 470150 - DNA, 23 bp, Homo sapiens
tggatttcctttgacctctcact

SEQ ID NO: 470151 - DNA, 14 bp, Homo sapiens
tggcaaaaaagaac

SEQ ID NO: 470152 - DNA, 12 bp, Homo sapiens
tggcaaacattt

SEQ ID NO: 470153 - DNA, 15 bp, Homo sapiens
tggcacagggcagtg

SEQ ID NO: 470154 - DNA, 19 bp, Homo sapiens
tggcaccagatgcaacctc

SEQ ID NO: 470155 - DNA, 20 bp, Homo sapiens
tggcagccgtgccttcagct

SEQ ID NO: 470156 - DNA, 21 bp, Homo sapiens
tggcagccgtgccttcagctc

SEQ ID NO: 470157 - DNA, 19 bp, Homo sapiens
tggcagcttcaaaacagaa

SEQ ID NO: 470158 - DNA, 23 bp, Homo sapiens
tggcagcttcaaaacagaacggg

SEQ ID NO: 470159 - DNA, 19 bp, Homo sapiens
tggcaggcacacagcagcc

SEQ ID NO: 470160 - DNA, 21 bp, Homo sapiens
tggcaggcacacagcagcccc

SEQ ID NO: 470161 - DNA, 18 bp, Homo sapiens
tggccaagtgtacatttg

SEQ ID NO: 470162 - DNA, 19 bp, Homo sapiens
tggccacactctgccttcc

SEQ ID NO: 470163 - DNA, 20 bp, Homo sapiens
tggccactccagacccctgg

SEQ ID NO: 470164 - DNA, 19 bp, Homo sapiens
tggccagacgctgccgctg

SEQ ID NO: 470165 - DNA, 12 bp, Homo sapiens
tggccagcaccc

SEQ ID NO: 470166 - DNA, 15 bp, Homo sapiens
tggccagcaccctct

SEQ ID NO: 470167 - DNA, 11 bp, Homo sapiens
tggccaggtgg

SEQ ID NO: 470168 - DNA, 12 bp, Homo sapiens
tggccatccctg

SEQ ID NO: 470169 - DNA, 18 bp, Homo sapiens
tggcccacccctcttccc

SEQ ID NO: 470170 - DNA, 14 bp, Homo sapiens
tggccccagctggc

SEQ ID NO: 470171 - DNA, 17 bp, Homo sapiens
tggccccagctggctgg

SEQ ID NO: 470172 - DNA, 18 bp, Homo sapiens
tggcccctccttctcccc

SEQ ID NO: 470173 - DNA, 10 bp, Homo sapiens
tggcccctct

SEQ ID NO: 470174 - DNA, 15 bp, Homo sapiens
tggcccgacagcctg

SEQ ID NO: 470175 - DNA, 16 bp, Homo sapiens
tggcccgacagcctgg

SEQ ID NO: 470176 - DNA, 18 bp, Homo sapiens
tggccctgccctccccca

SEQ ID NO: 470177 - DNA, 22 bp, Homo sapiens
tggccctgccctcccccacggc

SEQ ID NO: 470178 - DNA, 12 bp, Homo sapiens
tggccctgtggg

SEQ ID NO: 470179 - DNA, 13 bp, Homo sapiens
tggccctgtggga

SEQ ID NO: 470180 - DNA, 14 bp, Homo sapiens
tggccctgtgggag

SEQ ID NO: 470181 - DNA, 16 bp, Homo sapiens
tggccctgtgggagtc

SEQ ID NO: 470182 - DNA, 16 bp, Homo sapiens
tggccggtccaccccg

SEQ ID NO: 470183 - DNA, 16 bp, Homo sapiens
tggcctatttaagccc

SEQ ID NO: 470184 - DNA, 14 bp, Homo sapiens
tggcctcagccctc

SEQ ID NO: 470185 - DNA, 15 bp, Homo sapiens
tggcctgagaagagt

SEQ ID NO: 470186 - DNA, 19 bp, Homo sapiens
tggcctgagaagagtcgag

SEQ ID NO: 470187 - DNA, 15 bp, Homo sapiens
tggcgggcagcccct

SEQ ID NO: 470188 - DNA, 17 bp, Homo sapiens
tggcgggcagcccctgc

SEQ ID NO: 470189 - DNA, 20 bp, Homo sapiens
tggcgggcagcccctgctgg

SEQ ID NO: 470190 - DNA, 14 bp, Homo sapiens
tggctcccacaggc

SEQ ID NO: 470191 - DNA, 20 bp, Homo sapiens
tggctcccacaggcccttcc

SEQ ID NO: 470192 - DNA, 13 bp, Homo sapiens
tggctcctttccc

SEQ ID NO: 470193 - DNA, 14 bp, Homo sapiens
tggctcctttccca

SEQ ID NO: 470194 - DNA, 16 bp, Homo sapiens
tggctgggtcgcccct

SEQ ID NO: 470195 - DNA, 22 bp, Homo sapiens
tggctgggtttgggcagtggag

SEQ ID NO: 470196 - DNA, 15 bp, Homo sapiens
tggcttcccgctcag

SEQ ID NO: 470197 - DNA, 18 bp, Homo sapiens
tggcttcccgctcagccc

SEQ ID NO: 470198 - DNA, 19 bp, Homo sapiens
tggcttccgtgagacacaa

SEQ ID NO: 470199 - DNA, 12 bp, Homo sapiens
tggcttgtaggg

SEQ ID NO: 470200 - DNA, 16 bp, Homo sapiens
tggcttgtagggtgag

SEQ ID NO: 470201 - DNA, 22 bp, Homo sapiens
tggctttccacatccccaccct

SEQ ID NO: 470202 - DNA, 14 bp, Homo sapiens
tggctttgccttta

SEQ ID NO: 470203 - DNA, 14 bp, Homo sapiens
tggcttttcactgc

SEQ ID NO: 470204 - DNA, 16 bp, Homo sapiens
tggcttttcactgctg

SEQ ID NO: 470205 - DNA, 21 bp, Homo sapiens
tggcttttcactgctggctgc

SEQ ID NO: 470206 - DNA, 17 bp, Homo sapiens
tgggaaattcttgcact

SEQ ID NO: 470207 - DNA, 22 bp, Homo sapiens
tgggacagaggagcaaggttta

SEQ ID NO: 470208 - DNA, 17 bp, Homo sapiens
tgggactggcccacccc

SEQ ID NO: 470209 - DNA, 16 bp, Homo sapiens
tgtttctatactgttt

SEQ ID NO: 470210 - DNA, 23 bp, Homo sapiens
tgtttctatactgtttgtaatat

SEQ ID NO: 470211 - DNA, 17 bp, Homo sapiens
tgttttacaatggctgg

SEQ ID NO: 470212 - DNA, 20 bp, Homo sapiens
tgttttatgtcatactctgt

SEQ ID NO: 470213 - DNA, 13 bp, Homo sapiens
tgttttggaatgt

SEQ ID NO: 470214 - DNA, 19 bp, Homo sapiens
tgttttttttttccactta

SEQ ID NO: 470215 - DNA, 22 bp, Homo sapiens
ttaaaaaaaatattctgtcatt

SEQ ID NO: 470216 - DNA, 13 bp, Homo sapiens
ttaaaaaataaca

SEQ ID NO: 470217 - DNA, 12 bp, Homo sapiens
ttaaaagaacat

SEQ ID NO: 470218 - DNA, 18 bp, Homo sapiens
ttaaacctgtgctttcat

SEQ ID NO: 470219 - DNA, 17 bp, Homo sapiens
ttaaacttgtcagaatt

SEQ ID NO: 470220 - DNA, 12 bp, Homo sapiens
ttaaagaaaggc

SEQ ID NO: 470221 - DNA, 14 bp, Homo sapiens
ttaaatgattccaa

SEQ ID NO: 470222 - DNA, 15 bp, Homo sapiens
ttaaatgattccaaa

SEQ ID NO: 470223 - DNA, 12 bp, Homo sapiens
ttaaattatatg

SEQ ID NO: 470224 - DNA, 13 bp, Homo sapiens
ttaaattatatga

SEQ ID NO: 470225 - DNA, 15 bp, Homo sapiens
ttaaattatatgata

SEQ ID NO: 470226 - DNA, 20 bp, Homo sapiens
ttaacataaacttgtactta

SEQ ID NO: 470227 - DNA, 17 bp, Homo sapiens
ttaacctttccgctgtc

SEQ ID NO: 470228 - DNA, 13 bp, Homo sapiens
ttaactgcatata

SEQ ID NO: 470229 - DNA, 16 bp, Homo sapiens
ttaacttaaaagaaca

SEQ ID NO: 470230 - DNA, 17 bp, Homo sapiens
ttaagaaatgagaaatt

SEQ ID NO: 470231 - DNA, 15 bp, Homo sapiens
ttaagattccatttt

SEQ ID NO: 470232 - DNA, 18 bp, Homo sapiens
ttaaggggggatgtcttg

SEQ ID NO: 470233 - DNA, 15 bp, Homo sapiens
ttaagtcttactgtt

SEQ ID NO: 470234 - DNA, 18 bp, Homo sapiens
ttaagtcttactgttttg

SEQ ID NO: 470235 - DNA, 16 bp, Homo sapiens
ttaagtgactgagaag

SEQ ID NO: 470236 - DNA, 14 bp, Homo sapiens
ttaatatactgcat

SEQ ID NO: 470237 - DNA, 20 bp, Homo sapiens
ttaatatactgcatatcctg

SEQ ID NO: 470238 - DNA, 14 bp, Homo sapiens
ttaatctctaaaat

SEQ ID NO: 470239 - DNA, 18 bp, Homo sapiens
ttaatgtaaaattcatag

SEQ ID NO: 470240 - DNA, 11 bp, Homo sapiens
ttaatgtgcca

SEQ ID NO: 470241 - DNA, 20 bp, Homo sapiens
ttaattacttttgaaaaagg

SEQ ID NO: 470242 - DNA, 13 bp, Homo sapiens
ttaattcttctct

SEQ ID NO: 470243 - DNA, 18 bp, Homo sapiens
ttaattgtggctttatga

SEQ ID NO: 470244 - DNA, 14 bp, Homo sapiens
ttaatttatttcat

SEQ ID NO: 470245 - DNA, 13 bp, Homo sapiens
ttaatttcataaa

SEQ ID NO: 470246 - DNA, 15 bp, Homo sapiens
ttacaaatttttact

SEQ ID NO: 470247 - DNA, 13 bp, Homo sapiens
ttacaattgtcat

SEQ ID NO: 470248 - DNA, 23 bp, Homo sapiens
ttacacttctcaaatgctactca

SEQ ID NO: 470249 - DNA, 12 bp, Homo sapiens
ttaccctccctg

SEQ ID NO: 470250 - DNA, 13 bp, Homo sapiens
ttaccctccctgt

SEQ ID NO: 470251 - DNA, 16 bp, Homo sapiens
ttaccctttcttttga

SEQ ID NO: 470252 - DNA, 19 bp, Homo sapiens
ttacctgtaatagcctcac

SEQ ID NO: 470253 - DNA, 13 bp, Homo sapiens
ttactaaacattt

SEQ ID NO: 470254 - DNA, 16 bp, Homo sapiens
ttactaaacattttgt

SEQ ID NO: 470255 - DNA, 22 bp, Homo sapiens
ttactacataattaaattttaa

SEQ ID NO: 470256 - DNA, 18 bp, Homo sapiens
ttactcaggctttctatt

SEQ ID NO: 470257 - DNA, 14 bp, Homo sapiens
ttactgttcttatt

SEQ ID NO: 470258 - DNA, 15 bp, Homo sapiens
ttactttaaattata

SEQ ID NO: 470259 - DNA, 13 bp, Homo sapiens
ttactttgtgcaa

SEQ ID NO: 470260 - DNA, 15 bp, Homo sapiens
ttagaaattctataa

SEQ ID NO: 470261 - DNA, 17 bp, Homo sapiens
ttagaaattgcatttcc

SEQ ID NO: 470262 - DNA, 13 bp, Homo sapiens
ttagaacctttct

SEQ ID NO: 470263 - DNA, 18 bp, Homo sapiens
ttagacaaccatagaact

SEQ ID NO: 470264 - DNA, 20 bp, Homo sapiens
ttagacaaccatagaactgt

SEQ ID NO: 470265 - DNA, 13 bp, Homo sapiens
ttagagtgtctta

SEQ ID NO: 470266 - DNA, 16 bp, Homo sapiens
ttagggaaatccaact

SEQ ID NO: 470267 - DNA, 23 bp, Homo sapiens
ttaggtagatgagaaaacaggct

SEQ ID NO: 470268 - DNA, 14 bp, Homo sapiens
ttagtatttttact

SEQ ID NO: 470269 - DNA, 14 bp, Homo sapiens
ttagtcctcacctt

SEQ ID NO: 470270 - DNA, 19 bp, Homo sapiens
ttagtcctcaccttctgtt

SEQ ID NO: 470271 - DNA, 14 bp, Homo sapiens
ttataagttgacct

SEQ ID NO: 470272 - DNA, 21 bp, Homo sapiens
ttataatataatatggaacct

SEQ ID NO: 470273 - DNA, 19 bp, Homo sapiens
ttataccaggttacctcac

SEQ ID NO: 470274 - DNA, 17 bp, Homo sapiens
ttataggaaataaatct

SEQ ID NO: 470275 - DNA, 20 bp, Homo sapiens
ttataggaaataaatctaaa

SEQ ID NO: 470276 - DNA, 21 bp, Homo sapiens
ttataggaaataaatctaaat

SEQ ID NO: 470277 - DNA, 17 bp, Homo sapiens
ttatagttgatatgtaa

SEQ ID NO: 470278 - DNA, 15 bp, Homo sapiens
ttatatacaaagctg

SEQ ID NO: 470279 - DNA, 16 bp, Homo sapiens
ttatatattataagtt

SEQ ID NO: 470280 - DNA, 23 bp, Homo sapiens
ttatatattataagttgaccttt

SEQ ID NO: 470281 - DNA, 12 bp, Homo sapiens
ttatatcatcaa

SEQ ID NO: 470282 - DNA, 12 bp, Homo sapiens
ttatatctgtaa

SEQ ID NO: 470283 - DNA, 16 bp, Homo sapiens
ttatatgatatgcatg

SEQ ID NO: 470284 - DNA, 20 bp, Homo sapiens
ttatattgtttttatatatt

SEQ ID NO: 470285 - DNA, 21 bp, Homo sapiens
ttatcctgctagctgtagaaa

SEQ ID NO: 470286 - DNA, 13 bp, Homo sapiens
ttatctcacaaat

SEQ ID NO: 470287 - DNA, 20 bp, Homo sapiens
ttatctccagccaatttcaa

SEQ ID NO: 470288 - DNA, 22 bp, Homo sapiens
ttatctccagccaatttcaaag

SEQ ID NO: 470289 - DNA, 20 bp, Homo sapiens
ttatctgggttttagaaatt

SEQ ID NO: 470290 - DNA, 11 bp, Homo sapiens
ttatctgtctg

SEQ ID NO: 470291 - DNA, 17 bp, Homo sapiens
ttatctgtctgagccct

SEQ ID NO: 470292 - DNA, 21 bp, Homo sapiens
ttatgagctgtgagaagggtg

SEQ ID NO: 470293 - DNA, 13 bp, Homo sapiens
ttatgctgctgtg

SEQ ID NO: 470294 - DNA, 16 bp, Homo sapiens
ttatgctgctgtgaat

SEQ ID NO: 470295 - DNA, 17 bp, Homo sapiens
ttatgtaagaagaaact

SEQ ID NO: 470296 - DNA, 11 bp, Homo sapiens
ttatgtcatac

SEQ ID NO: 470297 - DNA, 23 bp, Homo sapiens
ttatgtcatactctgtgtaatct

SEQ ID NO: 470298 - DNA, 21 bp, Homo sapiens
ttatgttgttcaaatgcattt

SEQ ID NO: 470299 - DNA, 16 bp, Homo sapiens
ttattactttaaatta

SEQ ID NO: 470300 - DNA, 18 bp, Homo sapiens
ttattatagtctgtactt

SEQ ID NO: 470301 - DNA, 13 bp, Homo sapiens
ttattcttccaag

SEQ ID NO: 470302 - DNA, 12 bp, Homo sapiens
ttattgaatgtt

SEQ ID NO: 470303 - DNA, 18 bp, Homo sapiens
ttatttaatttcataaat

SEQ ID NO: 470304 - DNA, 20 bp, Homo sapiens
ttatttaatttcataaattg

SEQ ID NO: 470305 - DNA, 21 bp, Homo sapiens
ttatttaatttcataaattgg

SEQ ID NO: 470306 - DNA, 17 bp, Homo sapiens
ttatttattaaacttca

SEQ ID NO: 470307 - DNA, 21 bp, Homo sapiens
ttgtggactttatttaatttc

SEQ ID NO: 470308 - DNA, 15 bp, Homo sapiens
ttgtggcacctcaac

SEQ ID NO: 470309 - DNA, 20 bp, Homo sapiens
ttgtgtgggtttactctgtg

SEQ ID NO: 470310 - DNA, 23 bp, Homo sapiens
ttgtgtgggtttactctgtgcta

SEQ ID NO: 470311 - DNA, 15 bp, Homo sapiens
ttgtgtggtattcaa

SEQ ID NO: 470312 - DNA, 23 bp, Homo sapiens
ttgttcgatcgtttcacatctgt

SEQ ID NO: 470313 - DNA, 14 bp, Homo sapiens
ttgttgtattcctg

SEQ ID NO: 470314 - DNA, 12 bp, Homo sapiens
ttgtttctatac

SEQ ID NO: 470315 - DNA, 15 bp, Homo sapiens
ttgtttctatactgt

SEQ ID NO: 470316 - DNA, 19 bp, Homo sapiens
tttaaaaaaaatattctgt

SEQ ID NO: 470317 - DNA, 20 bp, Homo sapiens
tttaaaaaaaatattctgtc

SEQ ID NO: 470318 - DNA, 15 bp, Homo sapiens
tttaaaaaaataaca

SEQ ID NO: 470319 - DNA, 23 bp, Homo sapiens
tttaaaaaaataacatctgaaaa

SEQ ID NO: 470320 - DNA, 21 bp, Homo sapiens
tttaaaaaataacatattctt

SEQ ID NO: 470321 - DNA, 14 bp, Homo sapiens
tttaaattatatga

SEQ ID NO: 470322 - DNA, 16 bp, Homo sapiens
tttaacccaaaagatt

SEQ ID NO: 470323 - DNA, 21 bp, Homo sapiens
tttaactactaagaataaata

SEQ ID NO: 470324 - DNA, 16 bp, Homo sapiens
tttaagaaatgagaaa

SEQ ID NO: 470325 - DNA, 21 bp, Homo sapiens
tttaagaaatgagaaattgtg

SEQ ID NO: 470326 - DNA, 22 bp, Homo sapiens
tttacccagtgggacagaggag

SEQ ID NO: 470327 - DNA, 13 bp, Homo sapiens
tttaccctccctg

SEQ ID NO: 470328 - DNA, 22 bp, Homo sapiens
tttactacataattaaatttta

SEQ ID NO: 470329 - DNA, 14 bp, Homo sapiens
tttactttgtgcaa

SEQ ID NO: 470330 - DNA, 16 bp, Homo sapiens
tttagtcctcaccttc

SEQ ID NO: 470331 - DNA, 16 bp, Homo sapiens
tttatatctgtaaatt

SEQ ID NO: 470332 - DNA, 22 bp, Homo sapiens
tttatctgtgaatcctttgtac

SEQ ID NO: 470333 - DNA, 20 bp, Homo sapiens
tttatcttccatatgctctt

SEQ ID NO: 470334 - DNA, 14 bp, Homo sapiens
tttatgaagatagt

SEQ ID NO: 470335 - DNA, 15 bp, Homo sapiens
tttatgaagttaaca

SEQ ID NO: 470336 - DNA, 17 bp, Homo sapiens
tttattattattactgt

SEQ ID NO: 470337 - DNA, 22 bp, Homo sapiens
tttatttattaaacttcagcaa

SEQ ID NO: 470338 - DNA, 20 bp, Homo sapiens
tttatttctagcaaacagat

SEQ ID NO: 470339 - DNA, 12 bp, Homo sapiens
tttcaaaatgca

SEQ ID NO: 470340 - DNA, 13 bp, Homo sapiens
tttcaaaatgcat

SEQ ID NO: 470341 - DNA, 18 bp, Homo sapiens
tttcaaaatgcatgtgat

SEQ ID NO: 470342 - DNA, 19 bp, Homo sapiens
tttcaaaatgcatgtgatt

SEQ ID NO: 470343 - DNA, 11 bp, Homo sapiens
tttcaaatgag

SEQ ID NO: 470344 - DNA, 19 bp, Homo sapiens
tttcaaatgagtttaaaaa

SEQ ID NO: 470345 - DNA, 20 bp, Homo sapiens
tttcaaatgagtttaaaaaa

SEQ ID NO: 470346 - DNA, 21 bp, Homo sapiens
tttcaacgcagccctgctttg

SEQ ID NO: 470347 - DNA, 23 bp, Homo sapiens
tttcaatgcatacaataaaagag

SEQ ID NO: 470348 - DNA, 22 bp, Homo sapiens
tttcacaaccttctgtggctca

SEQ ID NO: 470349 - DNA, 18 bp, Homo sapiens
tttcacatatttgtagct

SEQ ID NO: 470350 - DNA, 14 bp, Homo sapiens
tttcacatctgtat

SEQ ID NO: 470351 - DNA, 20 bp, Homo sapiens
tttcactgctggctgcctta

SEQ ID NO: 470352 - DNA, 22 bp, Homo sapiens
tttcactgctggctgccttaga

SEQ ID NO: 470353 - DNA, 24 bp, Homo sapiens
tttcactgctggctgccttagaac

SEQ ID NO: 470354 - DNA, 20 bp, Homo sapiens
tttcagaaagggcagcccct

SEQ ID NO: 470355 - DNA, 23 bp, Homo sapiens
tttcagaaagggcagcccctccc

SEQ ID NO: 470356 - DNA, 17 bp, Homo sapiens
tttcagcttgtttctat

SEQ ID NO: 470357 - DNA, 22 bp, Homo sapiens
tttcagcttgtttctatactgt

SEQ ID NO: 470358 - DNA, 18 bp, Homo sapiens
tttcataaattggctcct

SEQ ID NO: 470359 - DNA, 15 bp, Homo sapiens
tttcataataaaagg

SEQ ID NO: 470360 - DNA, 21 bp, Homo sapiens
tttcatccagtttgttctccg

SEQ ID NO: 470361 - DNA, 21 bp, Homo sapiens
tttcatgtgttgcaaattatt

SEQ ID NO: 470362 - DNA, 14 bp, Homo sapiens
tttcatgtttaaga

SEQ ID NO: 470363 - DNA, 22 bp, Homo sapiens
tttccaacaaacttactgtcag

SEQ ID NO: 470364 - DNA, 19 bp, Homo sapiens
tttccacatccccaccctc

SEQ ID NO: 470365 - DNA, 16 bp, Homo sapiens
tttccacccagaccct

SEQ ID NO: 470366 - DNA, 19 bp, Homo sapiens
tttccacccagaccctcct

SEQ ID NO: 470367 - DNA, 14 bp, Homo sapiens
tttccatctaaaat

SEQ ID NO: 470368 - DNA, 16 bp, Homo sapiens
tttcccatcaccagaa

SEQ ID NO: 470369 - DNA, 18 bp, Homo sapiens
tttccccaattatcctcc

SEQ ID NO: 470370 - DNA, 23 bp, Homo sapiens
tttccccagaccgatccttccca

SEQ ID NO: 470371 - DNA, 14 bp, Homo sapiens
tttccctgcatccc

SEQ ID NO: 470372 - DNA, 15 bp, Homo sapiens
tttccctgcatccct

SEQ ID NO: 470373 - DNA, 16 bp, Homo sapiens
tttcgcatccaccgcc

SEQ ID NO: 470374 - DNA, 12 bp, Homo sapiens
tttctaaactgt

SEQ ID NO: 470375 - DNA, 23 bp, Homo sapiens
tttctagctataacaactctatt

SEQ ID NO: 470376 - DNA, 19 bp, Homo sapiens
tttctatgtagaactgttc

SEQ ID NO: 470377 - DNA, 12 bp, Homo sapiens
tttctctctgtg

SEQ ID NO: 470378 - DNA, 13 bp, Homo sapiens
tttctctctgtgt

SEQ ID NO: 470379 - DNA, 23 bp, Homo sapiens
tttctctctgtgtggcaaacatt

SEQ ID NO: 470380 - DNA, 17 bp, Homo sapiens
tttctgcagtattctgt

SEQ ID NO: 470381 - DNA, 13 bp, Homo sapiens
tttgaataacata

SEQ ID NO: 470382 - DNA, 14 bp, Homo sapiens
tttgaatcaatctg

SEQ ID NO: 470383 - DNA, 19 bp, Homo sapiens
tttgaatcaatctggcttc

SEQ ID NO: 470384 - DNA, 22 bp, Homo sapiens
tttgaattatccacatgaaaat

SEQ ID NO: 470385 - DNA, 15 bp, Homo sapiens
tttgagcttctcctc

SEQ ID NO: 470386 - DNA, 13 bp, Homo sapiens
tttgatctggtgc

SEQ ID NO: 470387 - DNA, 14 bp, Homo sapiens
tttgattgtgaaac

SEQ ID NO: 470388 - DNA, 18 bp, Homo sapiens
tttgatttgatatacaga

SEQ ID NO: 470389 - DNA, 16 bp, Homo sapiens
tttgccagacttaaat

SEQ ID NO: 470390 - DNA, 17 bp, Homo sapiens
tttggcaacctttgtgt

SEQ ID NO: 470391 - DNA, 13 bp, Homo sapiens
tttggtgaataac

SEQ ID NO: 470392 - DNA, 23 bp, Homo sapiens
tttggttcctaaagaaaaagata

SEQ ID NO: 470393 - DNA, 17 bp, Homo sapiens
tttgtcaacttcagttg

SEQ ID NO: 470394 - DNA, 13 bp, Homo sapiens
tttgtcactgaat

SEQ ID NO: 470395 - DNA, 16 bp, Homo sapiens
tttgtctggctgtggc

SEQ ID NO: 470396 - DNA, 22 bp, Homo sapiens
tttgtctggctgtggcccctcc

SEQ ID NO: 470397 - DNA, 14 bp, Homo sapiens
tttgtgctgtgggc

SEQ ID NO: 470398 - DNA, 22 bp, Homo sapiens
tttgtgctgtgggcagcaccct

SEQ ID NO: 470399 - DNA, 16 bp, Homo sapiens
tttgtgcttgttcttc

SEQ ID NO: 470400 - DNA, 13 bp, Homo sapiens
tttgtgtgattga

SEQ ID NO: 470401 - DNA, 21 bp, Homo sapiens
tttgttctccgggtgtggcct

SEQ ID NO: 470402 - DNA, 16 bp, Homo sapiens
ttttaaaaaataacat

SEQ ID NO: 470403 - DNA, 22 bp, Homo sapiens
ttttaaagggagccatgctctt

SEQ ID NO: 470404 - DNA, 12 bp, Homo sapiens
aaaaaaataaca

SEQ ID NO: 470405 - DNA, 13 bp, Homo sapiens
aaaaaatatttta

SEQ ID NO: 470406 - DNA, 13 bp, Homo sapiens
aaaaactgccccc

SEQ ID NO: 470407 - DNA, 16 bp, Homo sapiens
aaaaaggatcatggtt

SEQ ID NO: 470408 - DNA, 20 bp, Homo sapiens
aaaaagggaaaacaaatatt

SEQ ID NO: 470409 - DNA, 15 bp, Homo sapiens
aaaaagtcaaacttt

SEQ ID NO: 470410 - DNA, 17 bp, Homo sapiens
aaaaatgtgagctataa

SEQ ID NO: 470411 - DNA, 20 bp, Homo sapiens
aaaacagaacgggttctccc

SEQ ID NO: 470412 - DNA, 18 bp, Homo sapiens
aaaacagaccagcatagt

SEQ ID NO: 470413 - DNA, 19 bp, Homo sapiens
aaaaccaagccgtggcttc

SEQ ID NO: 470414 - DNA, 12 bp, Homo sapiens
aaaaccagagag

SEQ ID NO: 470415 - DNA, 14 bp, Homo sapiens
aaaagaagaaagtc

SEQ ID NO: 470416 - DNA, 14 bp, Homo sapiens
aaaagactgtctta

SEQ ID NO: 470417 - DNA, 12 bp, Homo sapiens
aaaagagcttta

SEQ ID NO: 470418 - DNA, 13 bp, Homo sapiens
aaaagagctttat

SEQ ID NO: 470419 - DNA, 14 bp, Homo sapiens
aaaaggttaagcca

SEQ ID NO: 470420 - DNA, 16 bp, Homo sapiens
aaaaggttaagccata

SEQ ID NO: 470421 - DNA, 20 bp, Homo sapiens
aaaataacagagctggatgc

SEQ ID NO: 470422 - DNA, 17 bp, Homo sapiens
aaaataacatctgaaaa

SEQ ID NO: 470423 - DNA, 19 bp, Homo sapiens
aaaatacttctttttcatt

SEQ ID NO: 470424 - DNA, 17 bp, Homo sapiens
aaaatagttctatttct

SEQ ID NO: 470425 - DNA, 19 bp, Homo sapiens
aaaatagttctatttctat

SEQ ID NO: 470426 - DNA, 15 bp, Homo sapiens
aaaatattctgtcat

SEQ ID NO: 470427 - DNA, 19 bp, Homo sapiens
aaaatatttttttctagct

SEQ ID NO: 470428 - DNA, 13 bp, Homo sapiens
aaaatgcatgtga

SEQ ID NO: 470429 - DNA, 15 bp, Homo sapiens
aaaatgcatgtgatt

SEQ ID NO: 470430 - DNA, 13 bp, Homo sapiens
aaaatgctttctc

SEQ ID NO: 470431 - DNA, 22 bp, Homo sapiens
aaaatgctttctcatgcataga

SEQ ID NO: 470432 - DNA, 13 bp, Homo sapiens
aaaattcaacaaa

SEQ ID NO: 470433 - DNA, 18 bp, Homo sapiens
aaacaaggaaggacattt

SEQ ID NO: 470434 - DNA, 21 bp, Homo sapiens
aaacaataaacgaaacacaga

SEQ ID NO: 470435 - DNA, 12 bp, Homo sapiens
aaacactgtaat

SEQ ID NO: 470436 - DNA, 12 bp, Homo sapiens
aaacattaaaca

SEQ ID NO: 470437 - DNA, 14 bp, Homo sapiens
aaacattaaacact

SEQ ID NO: 470438 - DNA, 13 bp, Homo sapiens
aaacattcttatt

SEQ ID NO: 470439 - DNA, 20 bp, Homo sapiens
aaacatttctttttccttct

SEQ ID NO: 470440 - DNA, 18 bp, Homo sapiens
aaacattttttgtttctt

SEQ ID NO: 470441 - DNA, 14 bp, Homo sapiens
aaaccaagccgtgg

SEQ ID NO: 470442 - DNA, 20 bp, Homo sapiens
aaacctgtgctttcatgttt

SEQ ID NO: 470443 - DNA, 16 bp, Homo sapiens
aaactaaaattcaaca

SEQ ID NO: 470444 - DNA, 22 bp, Homo sapiens
aaactaaaattcaacaaatgat

SEQ ID NO: 470445 - DNA, 20 bp, Homo sapiens
aaactactgattgaatgtta

SEQ ID NO: 470446 - DNA, 16 bp, Homo sapiens
aaactatagaataaag

SEQ ID NO: 470447 - DNA, 17 bp, Homo sapiens
aaactcaaaatctggga

SEQ ID NO: 470448 - DNA, 14 bp, Homo sapiens
aaactcttcaaggc

SEQ ID NO: 470449 - DNA, 16 bp, Homo sapiens
aaactcttcaaggcca

SEQ ID NO: 470450 - DNA, 16 bp, Homo sapiens
aaactgcagttttaac

SEQ ID NO: 470451 - DNA, 14 bp, Homo sapiens
aaacttactgtcag

SEQ ID NO: 470452 - DNA, 17 bp, Homo sapiens
aaacttgagcccactcc

SEQ ID NO: 470453 - DNA, 13 bp, Homo sapiens
aaagaacagtgtt

SEQ ID NO: 470454 - DNA, 16 bp, Homo sapiens
aaagaagaaaataacc

SEQ ID NO: 470455 - DNA, 13 bp, Homo sapiens
aaagaagaaagtc

SEQ ID NO: 470456 - DNA, 16 bp, Homo sapiens
aaagaagaaagtctat

SEQ ID NO: 470457 - DNA, 20 bp, Homo sapiens
aaagcagagatgtattatgg

SEQ ID NO: 470458 - DNA, 17 bp, Homo sapiens
aaagccctcccccttcc

SEQ ID NO: 470459 - DNA, 13 bp, Homo sapiens
aaagcttccagta

SEQ ID NO: 470460 - DNA, 15 bp, Homo sapiens
aaaggaaacaagctt

SEQ ID NO: 470461 - DNA, 21 bp, Homo sapiens
aaaggaaagttctattatctg

SEQ ID NO: 470462 - DNA, 16 bp, Homo sapiens
aaaggatcatggtttt

SEQ ID NO: 470463 - DNA, 16 bp, Homo sapiens
aaaggcagagattggg

SEQ ID NO: 470464 - DNA, 18 bp, Homo sapiens
aaaggctggatgtgcttt

SEQ ID NO: 470465 - DNA, 16 bp, Homo sapiens
aaaggtcatattggaa

SEQ ID NO: 470466 - DNA, 20 bp, Homo sapiens
aaagtaccaactgagccaaa

SEQ ID NO: 470467 - DNA, 14 bp, Homo sapiens
aaagtctatgctta

SEQ ID NO: 470468 - DNA, 18 bp, Homo sapiens
aaataaaacttgagccca

SEQ ID NO: 470469 - DNA, 11 bp, Homo sapiens
aaataaactct

SEQ ID NO: 470470 - DNA, 15 bp, Homo sapiens
aaataaactcttcaa

SEQ ID NO: 470471 - DNA, 15 bp, Homo sapiens
aaataaagagccata

SEQ ID NO: 470472 - DNA, 12 bp, Homo sapiens
aaataaatctaa

SEQ ID NO: 470473 - DNA, 14 bp, Homo sapiens
aaataacatattct

SEQ ID NO: 470474 - DNA, 15 bp, Homo sapiens
aaataagtaatatct

SEQ ID NO: 470475 - DNA, 17 bp, Homo sapiens
aaataatgattcaatgt

SEQ ID NO: 470476 - DNA, 20 bp, Homo sapiens
aaataatgattcaatgtgaa

SEQ ID NO: 470477 - DNA, 18 bp, Homo sapiens
aaatactcaccaaaatat

SEQ ID NO: 470478 - DNA, 12 bp, Homo sapiens
aaatactgtttt

SEQ ID NO: 470479 - DNA, 19 bp, Homo sapiens
aaatacttctttttcatta

SEQ ID NO: 470480 - DNA, 13 bp, Homo sapiens
aaatagtcatgtt

SEQ ID NO: 470481 - DNA, 18 bp, Homo sapiens
aaatagttctatttctat

SEQ ID NO: 470482 - DNA, 12 bp, Homo sapiens
aaatattctgtc

SEQ ID NO: 470483 - DNA, 13 bp, Homo sapiens
aaatattctgtca

SEQ ID NO: 470484 - DNA, 14 bp, Homo sapiens
aaatattctgtcat

SEQ ID NO: 470485 - DNA, 20 bp, Homo sapiens
aaatatttctaagcttattt

SEQ ID NO: 470486 - DNA, 16 bp, Homo sapiens
aaatatttttttctag

SEQ ID NO: 470487 - DNA, 18 bp, Homo sapiens
aaatatttttttctagct

SEQ ID NO: 470488 - DNA, 21 bp, Homo sapiens
aaatatttttttctagctata

SEQ ID NO: 470489 - DNA, 22 bp, Homo sapiens
aaatatttttttctagctataa

SEQ ID NO: 470490 - DNA, 21 bp, Homo sapiens
aaatccattttctaaactgtt

SEQ ID NO: 470491 - DNA, 20 bp, Homo sapiens
aaatctacaacataatgata

SEQ ID NO: 470492 - DNA, 16 bp, Homo sapiens
aaatctgtctgattct

SEQ ID NO: 470493 - DNA, 20 bp, Homo sapiens
aaatctgtctgattctatgc

SEQ ID NO: 470494 - DNA, 14 bp, Homo sapiens
aaatgcatgatatt

SEQ ID NO: 470495 - DNA, 14 bp, Homo sapiens
aaatgctaatgtaa

SEQ ID NO: 470496 - DNA, 15 bp, Homo sapiens
aaatgctactcagta

SEQ ID NO: 470497 - DNA, 18 bp, Homo sapiens
aaatgctttctcatgcat

SEQ ID NO: 470498 - DNA, 21 bp, Homo sapiens
aaatgctttctcatgcataga

SEQ ID NO: 470499 - DNA, 19 bp, Homo sapiens
aaatggacttttgttcatg

SEQ ID NO: 470500 - DNA, 21 bp, Homo sapiens
aaatgtatcctgataaacatt

SEQ ID NO: 470501 - DNA, 12 bp, Homo sapiens
aatcctttgtac

SEQ ID NO: 470502 - DNA, 19 bp, Homo sapiens
aatctctaaaattctagtc

SEQ ID NO: 470503 - DNA, 19 bp, Homo sapiens
aatctgattggacattttc

SEQ ID NO: 470504 - DNA, 16 bp, Homo sapiens
aatctgtctgattcta

SEQ ID NO: 470505 - DNA, 17 bp, Homo sapiens
aatctgtctgattctat

SEQ ID NO: 470506 - DNA, 19 bp, Homo sapiens
aatctgtctgattctatgc

SEQ ID NO: 470507 - DNA, 21 bp, Homo sapiens
aatctgtgaagcctttatcta

SEQ ID NO: 470508 - DNA, 23 bp, Homo sapiens
aatctgtgaagcctttatctatg

SEQ ID NO: 470509 - DNA, 15 bp, Homo sapiens
aatcttaaaagtgta

SEQ ID NO: 470510 - DNA, 16 bp, Homo sapiens
aatctttgtgacagga

SEQ ID NO: 470511 - DNA, 15 bp, Homo sapiens
aatgagaaatcatgt

SEQ ID NO: 470512 - DNA, 14 bp, Homo sapiens
aatgagaaattgtg

SEQ ID NO: 470513 - DNA, 15 bp, Homo sapiens
aatgagaaattgtgc

SEQ ID NO: 470514 - DNA, 22 bp, Homo sapiens
aatgagaaattgtgccaaagat

SEQ ID NO: 470515 - DNA, 19 bp, Homo sapiens
aatgagtaaataaactctt

SEQ ID NO: 470516 - DNA, 21 bp, Homo sapiens
aatgagtaaataaactcttca

SEQ ID NO: 470517 - DNA, 21 bp, Homo sapiens
aatgagtttaaaaaaataaca

SEQ ID NO: 470518 - DNA, 17 bp, Homo sapiens
aatgatactgaattgtt

SEQ ID NO: 470519 - DNA, 18 bp, Homo sapiens
aatgatagataatgcctt

SEQ ID NO: 470520 - DNA, 14 bp, Homo sapiens
aatgattcaatgtg

SEQ ID NO: 470521 - DNA, 15 bp, Homo sapiens
aatgattcaatgtga

SEQ ID NO: 470522 - DNA, 15 bp, Homo sapiens
aatgattccaaataa

SEQ ID NO: 470523 - DNA, 16 bp, Homo sapiens
aatgcaaatattgcta

SEQ ID NO: 470524 - DNA, 20 bp, Homo sapiens
aatgcaaatattgctattgt

SEQ ID NO: 470525 - DNA, 16 bp, Homo sapiens
aatgcatacaataaaa

SEQ ID NO: 470526 - DNA, 20 bp, Homo sapiens
aatgcatacaataaaagagc

SEQ ID NO: 470527 - DNA, 19 bp, Homo sapiens
aatgcatccaaataggagt

SEQ ID NO: 470528 - DNA, 13 bp, Homo sapiens
aatgcatgtgatt

SEQ ID NO: 470529 - DNA, 22 bp, Homo sapiens
aatgctaatgtaatcatttatc

SEQ ID NO: 470530 - DNA, 16 bp, Homo sapiens
aatgcttaacataaac

SEQ ID NO: 470531 - DNA, 18 bp, Homo sapiens
aatgctttctcatgcata

SEQ ID NO: 470532 - DNA, 20 bp, Homo sapiens
aatggcagcctgaggaagtt

SEQ ID NO: 470533 - DNA, 18 bp, Homo sapiens
aatggccaagtgtacatt

SEQ ID NO: 470534 - DNA, 19 bp, Homo sapiens
aatggccaagtgtacattt

SEQ ID NO: 470535 - DNA, 16 bp, Homo sapiens
aatggctgggtttggg

SEQ ID NO: 470536 - DNA, 14 bp, Homo sapiens
aatgtatcctgata

SEQ ID NO: 470537 - DNA, 12 bp, Homo sapiens
aatgtgccaaaa

SEQ ID NO: 470538 - DNA, 18 bp, Homo sapiens
aatgtgccaaaatgtcaa

SEQ ID NO: 470539 - DNA, 15 bp, Homo sapiens
aatgtgcttttccat

SEQ ID NO: 470540 - DNA, 20 bp, Homo sapiens
aatgtgcttttccatctaaa

SEQ ID NO: 470541 - DNA, 21 bp, Homo sapiens
aatgttaaggacttctgcagc

SEQ ID NO: 470542 - DNA, 17 bp, Homo sapiens
aatgttatatcatcaat

SEQ ID NO: 470543 - DNA, 18 bp, Homo sapiens
aatgttccgttcatctga

SEQ ID NO: 470544 - DNA, 15 bp, Homo sapiens
aatgttggctgtaat

SEQ ID NO: 470545 - DNA, 23 bp, Homo sapiens
aattacaattgtcatttataaaa

SEQ ID NO: 470546 - DNA, 19 bp, Homo sapiens
aattacctaagagccacaa

SEQ ID NO: 470547 - DNA, 15 bp, Homo sapiens
aattacttttgaaaa

SEQ ID NO: 470548 - DNA, 14 bp, Homo sapiens
aattaggtaatgga

SEQ ID NO: 470549 - DNA, 16 bp, Homo sapiens
atgcaaatattgctat

SEQ ID NO: 470550 - DNA, 21 bp, Homo sapiens
atgcacatttgtcactgaata

SEQ ID NO: 470551 - DNA, 17 bp, Homo sapiens
atgcatacaataaaaga

SEQ ID NO: 470552 - DNA, 20 bp, Homo sapiens
atgcatacaataaaagagct

SEQ ID NO: 470553 - DNA, 19 bp, Homo sapiens
atgcatccaaataggagtc

SEQ ID NO: 470554 - DNA, 22 bp, Homo sapiens
atgcatgatattgtatgtacct

SEQ ID NO: 470555 - DNA, 13 bp, Homo sapiens
atgcatgtagcat

SEQ ID NO: 470556 - DNA, 16 bp, Homo sapiens
atgcatgtagcatata

SEQ ID NO: 470557 - DNA, 18 bp, Homo sapiens
atgccacacgtaaacact

SEQ ID NO: 470558 - DNA, 19 bp, Homo sapiens
atgcccaggaaaataacag

SEQ ID NO: 470559 - DNA, 17 bp, Homo sapiens
atgcctgtatttccaac

SEQ ID NO: 470560 - DNA, 21 bp, Homo sapiens
atgcctttctagtcctattct

SEQ ID NO: 470561 - DNA, 18 bp, Homo sapiens
attcaacacttattttct

SEQ ID NO: 470562 - DNA, 19 bp, Homo sapiens
attcaactaatacatggtt

SEQ ID NO: 470563 - DNA, 20 bp, Homo sapiens
attcaactaatacatggttt

SEQ ID NO: 470564 - DNA, 17 bp, Homo sapiens
attcaatgtgaatttta

SEQ ID NO: 470565 - DNA, 18 bp, Homo sapiens
attcatagcatcctgatt

SEQ ID NO: 470566 - DNA, 22 bp, Homo sapiens
attccacaggacacgaaggctg

SEQ ID NO: 470567 - DNA, 18 bp, Homo sapiens
attccagagagtggctcc

SEQ ID NO: 470568 - DNA, 19 bp, Homo sapiens
attccagagagtggctcct

SEQ ID NO: 470569 - DNA, 13 bp, Homo sapiens
attccattttgga

SEQ ID NO: 470570 - DNA, 16 bp, Homo sapiens
attctaaaacattctt

SEQ ID NO: 470571 - DNA, 17 bp, Homo sapiens
attctagtctctgattt

SEQ ID NO: 470572 - DNA, 23 bp, Homo sapiens
attctagtctctgatttgcaaat

SEQ ID NO: 470573 - DNA, 14 bp, Homo sapiens
attctataaattca

SEQ ID NO: 470574 - DNA, 15 bp, Homo sapiens
attctataaattcaa

SEQ ID NO: 470575 - DNA, 15 bp, Homo sapiens
attctataagagaca

SEQ ID NO: 470576 - DNA, 22 bp, Homo sapiens
attctattgcagttatagaaaa

SEQ ID NO: 470577 - DNA, 16 bp, Homo sapiens
attctctgattttgag

SEQ ID NO: 470578 - DNA, 17 bp, Homo sapiens
attctgctaatttatga

SEQ ID NO: 470579 - DNA, 16 bp, Homo sapiens
attctgtggattctat

SEQ ID NO: 470580 - DNA, 20 bp, Homo sapiens
attcttgctttcacaaatat

SEQ ID NO: 470581 - DNA, 16 bp, Homo sapiens
attcttttttcaatgt

SEQ ID NO: 470582 - DNA, 15 bp, Homo sapiens
attgaaaagaagaaa

SEQ ID NO: 470583 - DNA, 18 bp, Homo sapiens
attgaaaagaagaaagtc

SEQ ID NO: 470584 - DNA, 20 bp, Homo sapiens
attgaaccgtcaatgtgaaa

SEQ ID NO: 470585 - DNA, 22 bp, Homo sapiens
attgaaccgtcaatgtgaaata

SEQ ID NO: 470586 - DNA, 19 bp, Homo sapiens
attgacgacctacatctga

SEQ ID NO: 470587 - DNA, 14 bp, Homo sapiens
attgattaaaagca

SEQ ID NO: 470588 - DNA, 19 bp, Homo sapiens
attgcaaaaggttaagcca

SEQ ID NO: 470589 - DNA, 20 bp, Homo sapiens
attgcaaaaggttaagccat

SEQ ID NO: 470590 - DNA, 16 bp, Homo sapiens
attgcatttcctgaca

SEQ ID NO: 470591 - DNA, 20 bp, Homo sapiens
attgcttctgtgcaataaaa

SEQ ID NO: 470592 - DNA, 16 bp, Homo sapiens
attggctcctttccca

SEQ ID NO: 470593 - DNA, 20 bp, Homo sapiens
attggctcctttcccacagt

SEQ ID NO: 470594 - DNA, 21 bp, Homo sapiens
attggctcctttcccacagtc

SEQ ID NO: 470595 - DNA, 17 bp, Homo sapiens
attgggcaagtgattga

SEQ ID NO: 470596 - DNA, 15 bp, Homo sapiens
attgggggggcttgg

SEQ ID NO: 470597 - DNA, 16 bp, Homo sapiens
attgggggggcttggg

SEQ ID NO: 470598 - DNA, 15 bp, Homo sapiens
attggtaccagagcc

SEQ ID NO: 470599 - DNA, 20 bp, Homo sapiens
attggttacaaatttttact

SEQ ID NO: 470600 - DNA, 15 bp, Homo sapiens
attgtagcatttctt

SEQ ID NO: 470601 - DNA, 21 bp, Homo sapiens
attgtattcctcacattcaca

SEQ ID NO: 470602 - DNA, 13 bp, Homo sapiens
attgtattttact

SEQ ID NO: 470603 - DNA, 19 bp, Homo sapiens
attgtattttactttgtgc

SEQ ID NO: 470604 - DNA, 22 bp, Homo sapiens
attgtattttactttgtgcaat

SEQ ID NO: 470605 - DNA, 13 bp, Homo sapiens
attgtcatttata

SEQ ID NO: 470606 - DNA, 12 bp, Homo sapiens
attgtgccaaag

SEQ ID NO: 470607 - DNA, 13 bp, Homo sapiens
attgtggctttat

SEQ ID NO: 470608 - DNA, 14 bp, Homo sapiens
attgtttaaaagca

SEQ ID NO: 470609 - DNA, 14 bp, Homo sapiens
attgtttttatata

SEQ ID NO: 470610 - DNA, 15 bp, Homo sapiens
attgtttttatatat

SEQ ID NO: 470611 - DNA, 15 bp, Homo sapiens
atttaaaggaaagtt

SEQ ID NO: 470612 - DNA, 18 bp, Homo sapiens
atttaactgcatatagat

SEQ ID NO: 470613 - DNA, 10 bp, Homo sapiens
atttaagccc

SEQ ID NO: 470614 - DNA, 20 bp, Homo sapiens
atttaatggtttttatttct

SEQ ID NO: 470615 - DNA, 16 bp, Homo sapiens
atttacaacttccaga

SEQ ID NO: 470616 - DNA, 18 bp, Homo sapiens
atttacaacttccagatt

SEQ ID NO: 470617 - DNA, 18 bp, Homo sapiens
atttacagttactgccta

SEQ ID NO: 470618 - DNA, 15 bp, Homo sapiens
atttagtcctcacct

SEQ ID NO: 470619 - DNA, 16 bp, Homo sapiens
atttagtcctcacctt

SEQ ID NO: 470620 - DNA, 17 bp, Homo sapiens
atttatctgtctgagcc

SEQ ID NO: 470621 - DNA, 14 bp, Homo sapiens
atttatctgtgaat

SEQ ID NO: 470622 - DNA, 23 bp, Homo sapiens
atttatcttatctagcaagaaga

SEQ ID NO: 470623 - DNA, 15 bp, Homo sapiens
atttatgaagatagt

SEQ ID NO: 470624 - DNA, 16 bp, Homo sapiens
atttatgaagatagtt

SEQ ID NO: 470625 - DNA, 18 bp, Homo sapiens
atttatgatcacttggaa

SEQ ID NO: 470626 - DNA, 10 bp, Homo sapiens
atttattatg

SEQ ID NO: 470627 - DNA, 14 bp, Homo sapiens
atttattattttca

SEQ ID NO: 470628 - DNA, 15 bp, Homo sapiens
atttatttattatta

SEQ ID NO: 470629 - DNA, 16 bp, Homo sapiens
atttatttcatccagt

SEQ ID NO: 470630 - DNA, 16 bp, Homo sapiens
atttcaaagaaaacag

SEQ ID NO: 470631 - DNA, 19 bp, Homo sapiens
atttcaccatgttgccaat

SEQ ID NO: 470632 - DNA, 21 bp, Homo sapiens
atttcacttaaactttgtcac

SEQ ID NO: 470633 - DNA, 18 bp, Homo sapiens
atttcataaattggctcc

SEQ ID NO: 470634 - DNA, 19 bp, Homo sapiens
atttcataaattggctcct

SEQ ID NO: 470635 - DNA, 15 bp, Homo sapiens
atttccaccaagggt

SEQ ID NO: 470636 - DNA, 14 bp, Homo sapiens
atttccctaaaaat

SEQ ID NO: 470637 - DNA, 21 bp, Homo sapiens
atttccgtgagagtcatctca

SEQ ID NO: 470638 - DNA, 16 bp, Homo sapiens
atttctaagcttattt

SEQ ID NO: 470639 - DNA, 19 bp, Homo sapiens
atttctaagcttatttcta

SEQ ID NO: 470640 - DNA, 21 bp, Homo sapiens
atttctaagcttatttctaac

SEQ ID NO: 470641 - DNA, 22 bp, Homo sapiens
atttctaagcttatttctaact

SEQ ID NO: 470642 - DNA, 15 bp, Homo sapiens
atttctatctgcaaa

SEQ ID NO: 470643 - DNA, 18 bp, Homo sapiens
atttgaaaaaagaagagg

SEQ ID NO: 470644 - DNA, 21 bp, Homo sapiens
atttgatatacagacctccag

SEQ ID NO: 470645 - DNA, 20 bp, Homo sapiens
atttgatctggtgcgtgtgg

SEQ ID NO: 470646 - DNA, 15 bp, Homo sapiens
atttgccaaaaacta

SEQ ID NO: 470647 - DNA, 13 bp, Homo sapiens
agcctgaggaagt

SEQ ID NO: 470648 - DNA, 14 bp, Homo sapiens
agcctgtctctccc

SEQ ID NO: 470649 - DNA, 23 bp, Homo sapiens
agcctgtgaataaaaaccctgta

SEQ ID NO: 470650 - DNA, 17 bp, Homo sapiens
agccttaagaaagctat

SEQ ID NO: 470651 - DNA, 20 bp, Homo sapiens
agcctttgcgctctgggttt

SEQ ID NO: 470652 - DNA, 17 bp, Homo sapiens
agcctttggtgaataac

SEQ ID NO: 470653 - DNA, 19 bp, Homo sapiens
agcgaggcagaatggtggg

SEQ ID NO: 470654 - DNA, 21 bp, Homo sapiens
agcgaggcagaatggtgggct

SEQ ID NO: 470655 - DNA, 15 bp, Homo sapiens
agcgcctcccgccgc

SEQ ID NO: 470656 - DNA, 16 bp, Homo sapiens
agcgctcctctgcctt

SEQ ID NO: 470657 - DNA, 15 bp, Homo sapiens
agcggcccggcccac

SEQ ID NO: 470658 - DNA, 18 bp, Homo sapiens
agcggcccggcccacgca

SEQ ID NO: 470659 - DNA, 22 bp, Homo sapiens
agcggcccggcccacgcagagc

SEQ ID NO: 470660 - DNA, 21 bp, Homo sapiens
agcggctgaggacggggcaga

SEQ ID NO: 470661 - DNA, 22 bp, Homo sapiens
agcggctgaggacggggcagag

SEQ ID NO: 470662 - DNA, 23 bp, Homo sapiens
agcggctgaggacggggcagagc

SEQ ID NO: 470663 - DNA, 20 bp, Homo sapiens
agcgggggctaactggcccc

SEQ ID NO: 470664 - DNA, 23 bp, Homo sapiens
agcgggggctaactggccccagg

SEQ ID NO: 470665 - DNA, 14 bp, Homo sapiens
agctaaaattttta

SEQ ID NO: 470666 - DNA, 16 bp, Homo sapiens
agctagaatatcctat

SEQ ID NO: 470667 - DNA, 18 bp, Homo sapiens
agctataacaactctatt

SEQ ID NO: 470668 - DNA, 18 bp, Homo sapiens
agctatctgtcatctctc

SEQ ID NO: 470669 - DNA, 15 bp, Homo sapiens
agctatgagagatgt

SEQ ID NO: 470670 - DNA, 18 bp, Homo sapiens
agctatgcgcaatgtggc

SEQ ID NO: 470671 - DNA, 15 bp, Homo sapiens
agctcaggagaaggc

SEQ ID NO: 470672 - DNA, 18 bp, Homo sapiens
agctcaggagaaggcctg

SEQ ID NO: 470673 - DNA, 17 bp, Homo sapiens
acaatttcaaaatgcat

SEQ ID NO: 470674 - DNA, 15 bp, Homo sapiens
acacacaatggcaag

SEQ ID NO: 470675 - DNA, 15 bp, Homo sapiens
acacacacccttccc

SEQ ID NO: 470676 - DNA, 22 bp, Homo sapiens
acacacacccttccccactccc

SEQ ID NO: 470677 - DNA, 20 bp, Homo sapiens
acacacccttccccactccc

SEQ ID NO: 470678 - DNA, 21 bp, Homo sapiens
acacataaatctgtctgattc

SEQ ID NO: 470679 - DNA, 16 bp, Homo sapiens
acaccctccactctga

SEQ ID NO: 470680 - DNA, 19 bp, Homo sapiens
acaccctccactctgaggt

SEQ ID NO: 470681 - DNA, 15 bp, Homo sapiens
acacccttccccact

SEQ ID NO: 470682 - DNA, 19 bp, Homo sapiens
acacccttccccactcccg

SEQ ID NO: 470683 - DNA, 14 bp, Homo sapiens
acaccgggcctgga

SEQ ID NO: 470684 - DNA, 12 bp, Homo sapiens
acacctccaccc

SEQ ID NO: 470685 - DNA, 17 bp, Homo sapiens
acacgccggggctggcc

SEQ ID NO: 470686 - DNA, 19 bp, Homo sapiens
acacggctgatatctttga

SEQ ID NO: 470687 - DNA, 23 bp, Homo sapiens
acactagtagctgttttgaataa

SEQ ID NO: 470688 - DNA, 18 bp, Homo sapiens
acactgaactcaggatgg

SEQ ID NO: 470689 - DNA, 23 bp, Homo sapiens
acactgatgggtcctgctgctcg

SEQ ID NO: 470690 - DNA, 14 bp, Homo sapiens
acactgtaatctta

SEQ ID NO: 470691 - DNA, 14 bp, Homo sapiens
acacttattttctg

SEQ ID NO: 470692 - DNA, 15 bp, Homo sapiens
acacttattttctga

SEQ ID NO: 470693 - DNA, 21 bp, Homo sapiens
acacttattttctgaattcat

SEQ ID NO: 470694 - DNA, 15 bp, Homo sapiens
acacttcaggctctt

SEQ ID NO: 470695 - DNA, 16 bp, Homo sapiens
acagaaccagcactcc

SEQ ID NO: 470696 - DNA, 14 bp, Homo sapiens
acagacaccctcca

SEQ ID NO: 470697 - DNA, 21 bp, Homo sapiens
acagacagagaaggcagcagg

SEQ ID NO: 470698 - DNA, 16 bp, Homo sapiens
acagaccagcatagtt

SEQ ID NO: 470699 - DNA, 20 bp, Homo sapiens
acagacggacgggacagcgg

SEQ ID NO: 470700 - DNA, 23 bp, Homo sapiens
acagacggacgggacagcggccc

SEQ ID NO: 470701 - DNA, 15 bp, Homo sapiens
acagagctggatgct

SEQ ID NO: 470702 - DNA, 15 bp, Homo sapiens
acagagtggatctgg

SEQ ID NO: 470703 - DNA, 20 bp, Homo sapiens
acagagtggatctggagtct

SEQ ID NO: 470704 - DNA, 17 bp, Homo sapiens
acagcaattttcataat

SEQ ID NO: 470705 - DNA, 15 bp, Homo sapiens
acagcagattccaca

SEQ ID NO: 470706 - DNA, 19 bp, Homo sapiens
acagcagattccacaggac

SEQ ID NO: 470707 - DNA, 15 bp, Homo sapiens
acagccaaagaaact

SEQ ID NO: 470708 - DNA, 21 bp, Homo sapiens
acagccaaagaaactcagaag

SEQ ID NO: 470709 - DNA, 16 bp, Homo sapiens
acagcctgaaggaatt

SEQ ID NO: 470710 - DNA, 15 bp, Homo sapiens
acagcggcccggccc

SEQ ID NO: 470711 - DNA, 19 bp, Homo sapiens
acagcgtaacggagggtga

SEQ ID NO: 470712 - DNA, 23 bp, Homo sapiens
acagctaggttaataggaggaca

SEQ ID NO: 470713 - DNA, 18 bp, Homo sapiens
acagcttgaggaaagagc

SEQ ID NO: 470714 - DNA, 17 bp, Homo sapiens
acaggaaagccctcccc

SEQ ID NO: 470715 - DNA, 19 bp, Homo sapiens
acaggaaagccctccccct

SEQ ID NO: 470716 - DNA, 13 bp, Homo sapiens
acaggcccttcct

SEQ ID NO: 470717 - DNA, 22 bp, Homo sapiens
acaggcccttcctctccactgc

SEQ ID NO: 470718 - DNA, 22 bp, Homo sapiens
agaagagtcccggagctcaagg

SEQ ID NO: 470719 - DNA, 14 bp, Homo sapiens
agaagattctaaaa

SEQ ID NO: 470720 - DNA, 16 bp, Homo sapiens
agaagcaccccaccac

SEQ ID NO: 470721 - DNA, 20 bp, Homo sapiens
agaagccacgctgtcctctc

SEQ ID NO: 470722 - DNA, 18 bp, Homo sapiens
agaagctctcgagggaag

SEQ ID NO: 470723 - DNA, 22 bp, Homo sapiens
agaaggattcttttttcaatgt

SEQ ID NO: 470724 - DNA, 16 bp, Homo sapiens
agaaggcctgcccccc

SEQ ID NO: 470725 - DNA, 21 bp, Homo sapiens
agaaggcctgccccccttccc

SEQ ID NO: 470726 - DNA, 14 bp, Homo sapiens
agaagtaactcccc

SEQ ID NO: 470727 - DNA, 14 bp, Homo sapiens
agaagttgatggat

SEQ ID NO: 470728 - DNA, 14 bp, Homo sapiens
agaataaataaaga

SEQ ID NO: 470729 - DNA, 19 bp, Homo sapiens
agaataaataaagaagaaa

SEQ ID NO: 470730 - DNA, 18 bp, Homo sapiens
agaatacagtaagctgct

SEQ ID NO: 470731 - DNA, 16 bp, Homo sapiens
agaatagatgctgact

SEQ ID NO: 470732 - DNA, 20 bp, Homo sapiens
agaatagttaaattggcttg

SEQ ID NO: 470733 - DNA, 14 bp, Homo sapiens
agaatgagaaatca

SEQ ID NO: 470734 - DNA, 20 bp, Homo sapiens
agaatggtgggctccagagt

SEQ ID NO: 470735 - DNA, 22 bp, Homo sapiens
agaattgaaccgtcaatgtgaa

SEQ ID NO: 470736 - DNA, 12 bp, Homo sapiens
agacaaaggcct

SEQ ID NO: 470737 - DNA, 13 bp, Homo sapiens
agacaacaggcat

SEQ ID NO: 470738 - DNA, 20 bp, Homo sapiens
agacaccctccactctgagg

SEQ ID NO: 470739 - DNA, 21 bp, Homo sapiens
agacactccagtttgcccacc

SEQ ID NO: 470740 - DNA, 11 bp, Homo sapiens
agacagagatc

SEQ ID NO: 470741 - DNA, 12 bp, Homo sapiens
agacagagtgga

SEQ ID NO: 470742 - DNA, 16 bp, Homo sapiens
agacagagtggatctg

SEQ ID NO: 470743 - DNA, 14 bp, Homo sapiens
agacagggtggggc

SEQ ID NO: 470744 - DNA, 17 bp, Homo sapiens
agacagggtggggctta

SEQ ID NO: 470745 - DNA, 19 bp, Homo sapiens
agacagggtggggcttaga

SEQ ID NO: 470746 - DNA, 18 bp, Homo sapiens
agaccagcatagttctgc

SEQ ID NO: 470747 - DNA, 15 bp, Homo sapiens
agacccctggctttt

SEQ ID NO: 470748 - DNA, 13 bp, Homo sapiens
agaccctccttcc

SEQ ID NO: 470749 - DNA, 17 bp, Homo sapiens
agaccctccttccccac

SEQ ID NO: 470750 - DNA, 20 bp, Homo sapiens
agaccctccttccccacccc

SEQ ID NO: 470751 - DNA, 15 bp, Homo sapiens
agacctccagattat

SEQ ID NO: 470752 - DNA, 23 bp, Homo sapiens
acctacttatttcagattcacct

SEQ ID NO: 470753 - DNA, 20 bp, Homo sapiens
acctcaacatttcagtgttt

SEQ ID NO: 470754 - DNA, 23 bp, Homo sapiens
acctcactatggtatgctggcca

SEQ ID NO: 470755 - DNA, 24 bp, Homo sapiens
acctcactatggtatgctggccag

SEQ ID NO: 470756 - DNA, 20 bp, Homo sapiens
acctcactgccctccctcgg

SEQ ID NO: 470757 - DNA, 20 bp, Homo sapiens
acctcgttgacatgcacagt

SEQ ID NO: 470758 - DNA, 20 bp, Homo sapiens
acctgaagagcgctcctctg

SEQ ID NO: 470759 - DNA, 13 bp, Homo sapiens
acctgacgatctt

SEQ ID NO: 470760 - DNA, 20 bp, Homo sapiens
acctgacgatcttccccctt

SEQ ID NO: 470761 - DNA, 21 bp, Homo sapiens
acctgacgatcttcccccttc

SEQ ID NO: 470762 - DNA, 17 bp, Homo sapiens
accttcgcctttgctga

SEQ ID NO: 470763 - DNA, 23 bp, Homo sapiens
accttgggcacgggagagcgcca

SEQ ID NO: 470764 - DNA, 22 bp, Homo sapiens
accttgtacagaaccagcactc

SEQ ID NO: 470765 - DNA, 22 bp, Homo sapiens
acctttatttattaaacttcag

SEQ ID NO: 470766 - DNA, 15 bp, Homo sapiens
acctttccacccaga

SEQ ID NO: 470767 - DNA, 19 bp, Homo sapiens
acctttccacccagaccct

SEQ ID NO: 470768 - DNA, 19 bp, Homo sapiens
acctttccgctgtcgcccc

SEQ ID NO: 470769 - DNA, 13 bp, Homo sapiens
acctttgtcaact

SEQ ID NO: 470770 - DNA, 21 bp, Homo sapiens
acgaaacacagaactcagcct

SEQ ID NO: 470771 - DNA, 17 bp, Homo sapiens
acgaaggctgcccctgt

SEQ ID NO: 470772 - DNA, 14 bp, Homo sapiens
acgacataagctgg

SEQ ID NO: 470773 - DNA, 12 bp, Homo sapiens
acgatcttcccc

SEQ ID NO: 470774 - DNA, 18 bp, Homo sapiens
acgatcttcccccttccc

SEQ ID NO: 470775 - DNA, 22 bp, Homo sapiens
acgattcttaccctttcttttg

SEQ ID NO: 470776 - DNA, 12 bp, Homo sapiens
acgcagagcccc

SEQ ID NO: 470777 - DNA, 14 bp, Homo sapiens
acgcagagccccgg

SEQ ID NO: 470778 - DNA, 18 bp, Homo sapiens
acgcagagccccggagca

SEQ ID NO: 470779 - DNA, 15 bp, Homo sapiens
acgccggggctggcc

SEQ ID NO: 470780 - DNA, 23 bp, Homo sapiens
acgccggggctggccctgccctc

SEQ ID NO: 470781 - DNA, 12 bp, Homo sapiens
acgcctcctggc

SEQ ID NO: 470782 - DNA, 14 bp, Homo sapiens
acgcctcctggcca

SEQ ID NO: 470783 - DNA, 19 bp, Homo sapiens
acgctgacagcctcctagg

SEQ ID NO: 470784 - DNA, 20 bp, Homo sapiens
acgctgtcctctcgagccca

SEQ ID NO: 470785 - DNA, 20 bp, Homo sapiens
acgcttaacctttccgctgt

SEQ ID NO: 470786 - DNA, 17 bp, Homo sapiens
acggaagtggcctgaga

SEQ ID NO: 470787 - DNA, 14 bp, Homo sapiens
acggccgtccctga

SEQ ID NO: 470788 - DNA, 23 bp, Homo sapiens
acggccgtccctgacttcccagc

SEQ ID NO: 470789 - DNA, 13 bp, Homo sapiens
acggcgttttttt

SEQ ID NO: 470790 - DNA, 17 bp, Homo sapiens
acgggacagcggcccgg

SEQ ID NO: 470791 - DNA, 19 bp, Homo sapiens
acttatgctgctgtgaatt

SEQ ID NO: 470792 - DNA, 21 bp, Homo sapiens
acttattttctgaattcataa

SEQ ID NO: 470793 - DNA, 13 bp, Homo sapiens
acttcacactgaa

SEQ ID NO: 470794 - DNA, 17 bp, Homo sapiens
acttcaggctcttctcc

SEQ ID NO: 470795 - DNA, 15 bp, Homo sapiens
acttcagttctcatc

SEQ ID NO: 470796 - DNA, 18 bp, Homo sapiens
acttcagttctcatcttg

SEQ ID NO: 470797 - DNA, 20 bp, Homo sapiens
acttcagttctcatcttgta

SEQ ID NO: 470798 - DNA, 13 bp, Homo sapiens
acttcccagctgg

SEQ ID NO: 470799 - DNA, 14 bp, Homo sapiens
acttcccagctggc

SEQ ID NO: 470800 - DNA, 15 bp, Homo sapiens
acttcccagctggca

SEQ ID NO: 470801 - DNA, 20 bp, Homo sapiens
acttcccagctggcagcgcc

SEQ ID NO: 470802 - DNA, 22 bp, Homo sapiens
acttcctggattttctttctat

SEQ ID NO: 470803 - DNA, 23 bp, Homo sapiens
acttcctggattttctttctatg

SEQ ID NO: 470804 - DNA, 18 bp, Homo sapiens
acttctgaactttggaag

SEQ ID NO: 470805 - DNA, 15 bp, Homo sapiens
acttctgttatcagg

SEQ ID NO: 470806 - DNA, 20 bp, Homo sapiens
acttctgttatcagggccca

SEQ ID NO: 470807 - DNA, 23 bp, Homo sapiens
acttcttcatccatagacacagt

SEQ ID NO: 470808 - DNA, 22 bp, Homo sapiens
acttggataggagcttccagat

SEQ ID NO: 470809 - DNA, 21 bp, Homo sapiens
acttgtacttacactgaaatc

SEQ ID NO: 470810 - DNA, 21 bp, Homo sapiens
acttgtgttcaatctgtgaag

SEQ ID NO: 470811 - DNA, 16 bp, Homo sapiens
actttaaattatatga

SEQ ID NO: 470812 - DNA, 15 bp, Homo sapiens
actttatttaatttc

SEQ ID NO: 470813 - DNA, 16 bp, Homo sapiens
actttatttaatttca

SEQ ID NO: 470814 - DNA, 19 bp, Homo sapiens
actttatttaatttcataa

SEQ ID NO: 470815 - DNA, 20 bp, Homo sapiens
actttatttaatttcataaa

SEQ ID NO: 470816 - DNA, 12 bp, Homo sapiens
actttcctctct

SEQ ID NO: 470817 - DNA, 18 bp, Homo sapiens
actttgagcctgggaaat

SEQ ID NO: 470818 - DNA, 17 bp, Homo sapiens
actttgtgcaatatgag

SEQ ID NO: 470819 - DNA, 15 bp, Homo sapiens
acttttgaaaaagga

SEQ ID NO: 470820 - DNA, 16 bp, Homo sapiens
acttttgaaaaaggat

SEQ ID NO: 470821 - DNA, 16 bp, Homo sapiens
acttttgtgtattctg

SEQ ID NO: 470822 - DNA, 20 bp, Homo sapiens
acttttgtgtattctgtgga

SEQ ID NO: 470823 - DNA, 21 bp, Homo sapiens
actttttcagagttgctttaa

SEQ ID NO: 470824 - DNA, 13 bp, Homo sapiens
agaaaaaaggact

SEQ ID NO: 470825 - DNA, 17 bp, Homo sapiens
agaaaaaaggactgtat

SEQ ID NO: 470826 - DNA, 13 bp, Homo sapiens
agaaaacccgagg

SEQ ID NO: 470827 - DNA, 13 bp, Homo sapiens
agaaaatgctttc

SEQ ID NO: 470828 - DNA, 16 bp, Homo sapiens
agaaaatgctttctca

SEQ ID NO: 470829 - DNA, 22 bp, Homo sapiens
agaaaatgctttctcatgcata

SEQ ID NO: 470830 - DNA, 17 bp, Homo sapiens
agaaagggcagcccctc

SEQ ID NO: 470831 - DNA, 12 bp, Homo sapiens
agaaatcatgtt

SEQ ID NO: 470832 - DNA, 14 bp, Homo sapiens
agaaatgagaaatt

SEQ ID NO: 470833 - DNA, 21 bp, Homo sapiens
agaaatgctaatgtaatcatt

SEQ ID NO: 470834 - DNA, 15 bp, Homo sapiens
agaaatggctttcca

SEQ ID NO: 470835 - DNA, 12 bp, Homo sapiens
agaaattctata

SEQ ID NO: 470836 - DNA, 13 bp, Homo sapiens
agaaattctataa

SEQ ID NO: 470837 - DNA, 20 bp, Homo sapiens
agaaattgtgccaaagatag

SEQ ID NO: 470838 - DNA, 15 bp, Homo sapiens
agaaattttatctct

SEQ ID NO: 470839 - DNA, 14 bp, Homo sapiens
agaacaaacagaaa

SEQ ID NO: 470840 - DNA, 22 bp, Homo sapiens
agaacagtgttgaaattggaaa

SEQ ID NO: 470841 - DNA, 16 bp, Homo sapiens
agaaccagcactccca

SEQ ID NO: 470842 - DNA, 18 bp, Homo sapiens
agaaccagcactcccagg

SEQ ID NO: 470843 - DNA, 19 bp, Homo sapiens
agaaccagcactcccaggg

SEQ ID NO: 470844 - DNA, 15 bp, Homo sapiens
agaacccccctcccc

SEQ ID NO: 470845 - DNA, 22 bp, Homo sapiens
agaacccccctccccaaggaag

SEQ ID NO: 470846 - DNA, 13 bp, Homo sapiens
agaacgggcctcc

SEQ ID NO: 470847 - DNA, 15 bp, Homo sapiens
agaactcagccttaa

SEQ ID NO: 470848 - DNA, 19 bp, Homo sapiens
agaactcagccttaagaaa

SEQ ID NO: 470849 - DNA, 23 bp, Homo sapiens
agaactcagccttaagaaagcta

SEQ ID NO: 470850 - DNA, 15 bp, Homo sapiens
agaactcctttctaa

SEQ ID NO: 470851 - DNA, 13 bp, Homo sapiens
agaagaaaacccg

SEQ ID NO: 470852 - DNA, 20 bp, Homo sapiens
cgcctcccgccgcctcgggc

SEQ ID NO: 470853 - DNA, 17 bp, Homo sapiens
cgcctcctccagactcg

SEQ ID NO: 470854 - DNA, 13 bp, Homo sapiens
cgcctcctggcca

SEQ ID NO: 470855 - DNA, 15 bp, Homo sapiens
cgcctcctggccaga

SEQ ID NO: 470856 - DNA, 16 bp, Homo sapiens
cgcctcctggccagac

SEQ ID NO: 470857 - DNA, 16 bp, Homo sapiens
cgcctgcgctcctctg

SEQ ID NO: 470858 - DNA, 21 bp, Homo sapiens
cgccttcaggttcctcctagg

SEQ ID NO: 470859 - DNA, 22 bp, Homo sapiens
cgccttcaggttcctcctaggc

SEQ ID NO: 470860 - DNA, 22 bp, Homo sapiens
cgcctttgctgaagtctccccg

SEQ ID NO: 470861 - DNA, 21 bp, Homo sapiens
cgcgcaccgcccaacccccac

SEQ ID NO: 470862 - DNA, 15 bp, Homo sapiens
cgcgcgtgcccccag

SEQ ID NO: 470863 - DNA, 14 bp, Homo sapiens
cgcgctctgcccct

SEQ ID NO: 470864 - DNA, 17 bp, Homo sapiens
cgcgctctgcccctccg

SEQ ID NO: 470865 - DNA, 13 bp, Homo sapiens
cgcgtgccttccc

SEQ ID NO: 470866 - DNA, 14 bp, Homo sapiens
cgcgtgccttcccc

SEQ ID NO: 470867 - DNA, 15 bp, Homo sapiens
cgctcaacctctcag

SEQ ID NO: 470868 - DNA, 13 bp, Homo sapiens
cgctcagaggccg

SEQ ID NO: 470869 - DNA, 14 bp, Homo sapiens
cgctcagaggccgc

SEQ ID NO: 470870 - DNA, 15 bp, Homo sapiens
cgctcagaggccgct

SEQ ID NO: 470871 - DNA, 15 bp, Homo sapiens
cgctccggcagaggc

SEQ ID NO: 470872 - DNA, 16 bp, Homo sapiens
cgctccggcagaggca

SEQ ID NO: 470873 - DNA, 17 bp, Homo sapiens
cgctccggcagaggcag

SEQ ID NO: 470874 - DNA, 20 bp, Homo sapiens
cgctccggcagaggcagggc

SEQ ID NO: 470875 - DNA, 23 bp, Homo sapiens
cgctccgggtgcgtgaccggccc

SEQ ID NO: 470876 - DNA, 19 bp, Homo sapiens
cgctcctctgcagcctgag

SEQ ID NO: 470877 - DNA, 20 bp, Homo sapiens
cgctcctctgcagcctgagc

SEQ ID NO: 470878 - DNA, 13 bp, Homo sapiens
cgctctgcccctc

SEQ ID NO: 470879 - DNA, 14 bp, Homo sapiens
cgctctgcccctcc

SEQ ID NO: 470880 - DNA, 22 bp, Homo sapiens
cgctctgcccctccgtccccag

SEQ ID NO: 470881 - DNA, 16 bp, Homo sapiens
cgctctggatcctgca

SEQ ID NO: 470882 - DNA, 21 bp, Homo sapiens
cgctctggggggttgcctcga

SEQ ID NO: 470883 - DNA, 18 bp, Homo sapiens
cgctgacagcctcctagg

SEQ ID NO: 470884 - DNA, 18 bp, Homo sapiens
cgctgccgctgccgctgc

SEQ ID NO: 470885 - DNA, 12 bp, Homo sapiens
cgctgcctggcg

SEQ ID NO: 470886 - DNA, 18 bp, Homo sapiens
cgctgcctggcgggcagc

SEQ ID NO: 470887 - DNA, 22 bp, Homo sapiens
cgctgcctggcgggcagcccct

SEQ ID NO: 470888 - DNA, 16 bp, Homo sapiens
cgctgtcctctcgagc

SEQ ID NO: 470889 - DNA, 16 bp, Homo sapiens
cgctgtcgccccaggc

SEQ ID NO: 470890 - DNA, 10 bp, Homo sapiens
cgctgtgctc

SEQ ID NO: 470891 - DNA, 15 bp, Homo sapiens
cgctgtgctccagca

SEQ ID NO: 470892 - DNA, 16 bp, Homo sapiens
cgctgtgctccagcag

SEQ ID NO: 470893 - DNA, 21 bp, Homo sapiens
cgctgtgctccagcagtgctg

SEQ ID NO: 470894 - DNA, 16 bp, Homo sapiens
cggaacagccaaagaa

SEQ ID NO: 470895 - DNA, 21 bp, Homo sapiens
cggaagtggcctgagaagagt

SEQ ID NO: 470896 - DNA, 18 bp, Homo sapiens
cggaccggagcggctgag

SEQ ID NO: 470897 - DNA, 19 bp, Homo sapiens
cggaccggagcggctgagg

SEQ ID NO: 470898 - DNA, 17 bp, Homo sapiens
cggagccccccactcag

SEQ ID NO: 470899 - DNA, 14 bp, Homo sapiens
cggagcggctgagg

SEQ ID NO: 470900 - DNA, 15 bp, Homo sapiens
cggagcggctgagga

SEQ ID NO: 470901 - DNA, 16 bp, Homo sapiens
cggagcggctgaggac

SEQ ID NO: 470902 - DNA, 15 bp, Homo sapiens
cggaggcgcccacct

SEQ ID NO: 470903 - DNA, 17 bp, Homo sapiens
cggaggcgcccacctgc

SEQ ID NO: 470904 - DNA, 19 bp, Homo sapiens
cggaggcgcccacctgccc

SEQ ID NO: 470905 - DNA, 20 bp, Homo sapiens
cggaggcgcccacctgccca

SEQ ID NO: 470906 - DNA, 18 bp, Homo sapiens
cggaggctgggcccctgg

SEQ ID NO: 470907 - DNA, 17 bp, Homo sapiens
cggaggggcttggagca

SEQ ID NO: 470908 - DNA, 20 bp, Homo sapiens
cggaggggcttggagcagag

SEQ ID NO: 470909 - DNA, 13 bp, Homo sapiens
cggcaccgcccac

SEQ ID NO: 470910 - DNA, 18 bp, Homo sapiens
cggcagaggcagggccct

SEQ ID NO: 470911 - DNA, 19 bp, Homo sapiens
cggcagaggcagggccctg

SEQ ID NO: 470912 - DNA, 15 bp, Homo sapiens
cggccaaggacactg

SEQ ID NO: 470913 - DNA, 16 bp, Homo sapiens
cggccaaggacactga

SEQ ID NO: 470914 - DNA, 15 bp, Homo sapiens
cggcccacgcagagc

SEQ ID NO: 470915 - DNA, 16 bp, Homo sapiens
cggcccacgcagagcc

SEQ ID NO: 470916 - DNA, 19 bp, Homo sapiens
cggcccacgcagagccccg

SEQ ID NO: 470917 - DNA, 23 bp, Homo sapiens
cggcccacgcagagccccggagc

SEQ ID NO: 470918 - DNA, 21 bp, Homo sapiens
cggccccacccaccctctggt

SEQ ID NO: 470919 - DNA, 15 bp, Homo sapiens
cggcccggcccacgc

SEQ ID NO: 470920 - DNA, 20 bp, Homo sapiens
cggcccggcccacgcagagc

SEQ ID NO: 470921 - DNA, 13 bp, Homo sapiens
cggccgtccctga

SEQ ID NO: 470922 - DNA, 15 bp, Homo sapiens
cggcctccaggctgg

SEQ ID NO: 470923 - DNA, 16 bp, Homo sapiens
cggctgaggacggggc

SEQ ID NO: 470924 - DNA, 21 bp, Homo sapiens
cggctgaggacggggcagagc

SEQ ID NO: 470925 - DNA, 14 bp, Homo sapiens
cggctggccggtcc

SEQ ID NO: 470926 - DNA, 18 bp, Homo sapiens
cggctggccggtccaccc

SEQ ID NO: 470927 - DNA, 14 bp, Homo sapiens
cgggaaggcctgag

SEQ ID NO: 470928 - DNA, 20 bp, Homo sapiens
cgggaaggcctgagggaagc

SEQ ID NO: 470929 - DNA, 18 bp, Homo sapiens
cgggacagcggcccggcc

SEQ ID NO: 470930 - DNA, 17 bp, Homo sapiens
cgggacccccggcctcc

SEQ ID NO: 470931 - DNA, 18 bp, Homo sapiens
cgggacccccggcctcca

SEQ ID NO: 470932 - DNA, 19 bp, Homo sapiens
cgggacccccggcctccag

SEQ ID NO: 470933 - DNA, 23 bp, Homo sapiens
cgggacccccggcctccaggctg

SEQ ID NO: 470934 - DNA, 17 bp, Homo sapiens
cgggagagcgccacccg

SEQ ID NO: 470935 - DNA, 19 bp, Homo sapiens
cgggagagcgccacccgcc

SEQ ID NO: 470936 - DNA, 21 bp, Homo sapiens
cgggcaggtcctgcccatgtg

SEQ ID NO: 470937 - DNA, 23 bp, Homo sapiens
cgggcaggtcctgcccatgtgtc

SEQ ID NO: 470938 - DNA, 17 bp, Homo sapiens
cgggccgcctcctccag

SEQ ID NO: 470939 - DNA, 21 bp, Homo sapiens
cgggccgcctcctccagactc

SEQ ID NO: 470940 - DNA, 12 bp, Homo sapiens
cgggcgcctgcg

SEQ ID NO: 470941 - DNA, 16 bp, Homo sapiens
cgggcgcctgcgctcc

SEQ ID NO: 470942 - DNA, 18 bp, Homo sapiens
cgggcgcctgcgctcctc

SEQ ID NO: 470943 - DNA, 20 bp, Homo sapiens
cgggcgcctgcgctcctctg

SEQ ID NO: 470944 - DNA, 13 bp, Homo sapiens
cggggcagagctg

SEQ ID NO: 470945 - DNA, 11 bp, Homo sapiens
cggggctggcc

SEQ ID NO: 470946 - DNA, 20 bp, Homo sapiens
cggggctggccctgccctcc

SEQ ID NO: 470947 - DNA, 18 bp, Homo sapiens
cgggggaggagcaccccc

SEQ ID NO: 470948 - DNA, 22 bp, Homo sapiens
cgggggaggagcacccccagcc

SEQ ID NO: 470949 - DNA, 17 bp, Homo sapiens
cgggggctaactggccc

SEQ ID NO: 470950 - DNA, 20 bp, Homo sapiens
cctcctcgggcgcctgcgct

SEQ ID NO: 470951 - DNA, 21 bp, Homo sapiens
cctcctcgggcgcctgcgctc

SEQ ID NO: 470952 - DNA, 14 bp, Homo sapiens
cctcctctcctcgt

SEQ ID NO: 470953 - DNA, 23 bp, Homo sapiens
cctcctctcctcgtccggcctgc

SEQ ID NO: 470954 - DNA, 14 bp, Homo sapiens
cctcctggccagac

SEQ ID NO: 470955 - DNA, 18 bp, Homo sapiens
cctccttccccaccccat

SEQ ID NO: 470956 - DNA, 12 bp, Homo sapiens
cctccttctccc

SEQ ID NO: 470957 - DNA, 17 bp, Homo sapiens
cctccttctcccctcca

SEQ ID NO: 470958 - DNA, 21 bp, Homo sapiens
cctcgagtccccccacccctc

SEQ ID NO: 470959 - DNA, 16 bp, Homo sapiens
cctcggagccccccac

SEQ ID NO: 470960 - DNA, 22 bp, Homo sapiens
cctcggccccacccaccctctg

SEQ ID NO: 470961 - DNA, 13 bp, Homo sapiens
cctcggctgtgtg

SEQ ID NO: 470962 - DNA, 15 bp, Homo sapiens
cctcgggccgcctcc

SEQ ID NO: 470963 - DNA, 16 bp, Homo sapiens
cctcgggccgcctcct

SEQ ID NO: 470964 - DNA, 20 bp, Homo sapiens
cctcgggcgcctgcgctcct

SEQ ID NO: 470965 - DNA, 23 bp, Homo sapiens
cctcgggcgcctgcgctcctctg

SEQ ID NO: 470966 - DNA, 18 bp, Homo sapiens
cctctcagatccctcggt

SEQ ID NO: 470967 - DNA, 23 bp, Homo sapiens
cctctccacccagaggtctccct

SEQ ID NO: 470968 - DNA, 23 bp, Homo sapiens
cctctcccaaataaactccttaa

SEQ ID NO: 470969 - DNA, 16 bp, Homo sapiens
cctctcctcgtccggc

SEQ ID NO: 470970 - DNA, 23 bp, Homo sapiens
cctctcctcgtccggcctgcagc

SEQ ID NO: 470971 - DNA, 16 bp, Homo sapiens
cctctcctgagcctgt

SEQ ID NO: 470972 - DNA, 14 bp, Homo sapiens
cctctcctgggggt

SEQ ID NO: 470973 - DNA, 17 bp, Homo sapiens
cctctctctccctccac

SEQ ID NO: 470974 - DNA, 18 bp, Homo sapiens
cctctctctccctccact

SEQ ID NO: 470975 - DNA, 13 bp, Homo sapiens
cctctctctctct

SEQ ID NO: 470976 - DNA, 20 bp, Homo sapiens
cctctctctctctctctctg

SEQ ID NO: 470977 - DNA, 21 bp, Homo sapiens
cctctctctctctctctctgt

SEQ ID NO: 470978 - DNA, 16 bp, Homo sapiens
cctctcttaccccgtc

SEQ ID NO: 470979 - DNA, 17 bp, Homo sapiens
cctctcttaccccgtcc

SEQ ID NO: 470980 - DNA, 22 bp, Homo sapiens
cctctgaaaatatttttttcta

SEQ ID NO: 470981 - DNA, 22 bp, Homo sapiens
cctctgcagcctgagctccacc

SEQ ID NO: 470982 - DNA, 13 bp, Homo sapiens
cctctgccccctc

SEQ ID NO: 470983 - DNA, 13 bp, Homo sapiens
cctctgcctttga

SEQ ID NO: 470984 - DNA, 21 bp, Homo sapiens
cctctgcctttgagcttctcc

SEQ ID NO: 470985 - DNA, 12 bp, Homo sapiens
cctctgctccaa

SEQ ID NO: 470986 - DNA, 20 bp, Homo sapiens
cctctgctccaacagacacc

SEQ ID NO: 470987 - DNA, 22 bp, Homo sapiens
cctctgctccaacagacaccct

SEQ ID NO: 470988 - DNA, 17 bp, Homo sapiens
cctctgcttgtcattct

SEQ ID NO: 470989 - DNA, 21 bp, Homo sapiens
cctctgcttgtcattctgcta

SEQ ID NO: 470990 - DNA, 15 bp, Homo sapiens
cctcttctcagctcc

SEQ ID NO: 470991 - DNA, 18 bp, Homo sapiens
cctcttctcagctccact

SEQ ID NO: 470992 - DNA, 16 bp, Homo sapiens
cctctttctctctgtg

SEQ ID NO: 470993 - DNA, 21 bp, Homo sapiens
cctctttctctctgtgtggca

SEQ ID NO: 470994 - DNA, 22 bp, Homo sapiens
cctctttctctctgtgtggcaa

SEQ ID NO: 470995 - DNA, 23 bp, Homo sapiens
cctctttctctctgtgtggcaaa

SEQ ID NO: 470996 - DNA, 16 bp, Homo sapiens
cctgaatccacctgca

SEQ ID NO: 470997 - DNA, 16 bp, Homo sapiens
cctgactccctgtggg

SEQ ID NO: 470998 - DNA, 19 bp, Homo sapiens
cctgacttcccagctggca

SEQ ID NO: 470999 - DNA, 20 bp, Homo sapiens
cctgacttcccagctggcag

SEQ ID NO: 471000 - DNA, 15 bp, Homo sapiens
cctgagactcccgcc

SEQ ID NO: 471001 - DNA, 17 bp, Homo sapiens
cctgagccacagtgggg

SEQ ID NO: 471002 - DNA, 23 bp, Homo sapiens
cctgagccacagtggggcccatg

SEQ ID NO: 471003 - DNA, 23 bp, Homo sapiens
cctgagcccagaaaaaaggactg

SEQ ID NO: 471004 - DNA, 12 bp, Homo sapiens
cctgagcctgtc

SEQ ID NO: 471005 - DNA, 14 bp, Homo sapiens
cctgagctccaccc

SEQ ID NO: 471006 - DNA, 19 bp, Homo sapiens
cctgagctccaccctcccc

SEQ ID NO: 471007 - DNA, 22 bp, Homo sapiens
cctgaggaccgccccaaccctc

SEQ ID NO: 471008 - DNA, 19 bp, Homo sapiens
cctgagggaagcccacccg

SEQ ID NO: 471009 - DNA, 20 bp, Homo sapiens
cctgagggaagcccacccgc

SEQ ID NO: 471010 - DNA, 16 bp, Homo sapiens
cctgaggtacctttcc

SEQ ID NO: 471011 - DNA, 20 bp, Homo sapiens
cctgaggtacctttccaccc

SEQ ID NO: 471012 - DNA, 14 bp, Homo sapiens
cctgcaccaggaga

SEQ ID NO: 471013 - DNA, 14 bp, Homo sapiens
cctgcaccctctgc

SEQ ID NO: 471014 - DNA, 18 bp, Homo sapiens
cctgcaccttgggcacgg

SEQ ID NO: 471015 - DNA, 12 bp, Homo sapiens
cctgccagcaac

SEQ ID NO: 471016 - DNA, 19 bp, Homo sapiens
cctgcccatgtgtcccctc

SEQ ID NO: 471017 - DNA, 22 bp, Homo sapiens
cctgcccatgtgtcccctcact

SEQ ID NO: 471018 - DNA, 19 bp, Homo sapiens
cctgccccccttcccaccc

SEQ ID NO: 471019 - DNA, 14 bp, Homo sapiens
cctgcccctccctt

SEQ ID NO: 471020 - DNA, 16 bp, Homo sapiens
cctgcccctcccttca

SEQ ID NO: 471021 - DNA, 18 bp, Homo sapiens
cctgccctcactccactc

SEQ ID NO: 471022 - DNA, 13 bp, Homo sapiens
cctgccctccccc

SEQ ID NO: 471023 - DNA, 13 bp, Homo sapiens
cctgccctgcacc

SEQ ID NO: 471024 - DNA, 14 bp, Homo sapiens
cctgcgccctccct

SEQ ID NO: 471025 - DNA, 15 bp, Homo sapiens
cctgcgccctccctc

SEQ ID NO: 471026 - DNA, 22 bp, Homo sapiens
cctgcgccctccctccctccac

SEQ ID NO: 471027 - DNA, 23 bp, Homo sapiens
cctgcgccctccctccctccaca

SEQ ID NO: 471028 - DNA, 14 bp, Homo sapiens
cctgcgctcctctg

SEQ ID NO: 471029 - DNA, 15 bp, Homo sapiens
cctgcgctcctctgc

SEQ ID NO: 471030 - DNA, 16 bp, Homo sapiens
cctgcgctcctctgca

SEQ ID NO: 471031 - DNA, 20 bp, Homo sapiens
cctgcgctcctctgcagcct

SEQ ID NO: 471032 - DNA, 19 bp, Homo sapiens
cctgctcacgtctgtgagt

SEQ ID NO: 471033 - DNA, 17 bp, Homo sapiens
cctggactggtggcccc

SEQ ID NO: 471034 - DNA, 13 bp, Homo sapiens
cctggagaactag

SEQ ID NO: 471035 - DNA, 13 bp, Homo sapiens
cctggcctattta

SEQ ID NO: 471036 - DNA, 15 bp, Homo sapiens
cctggcctatttaag

SEQ ID NO: 471037 - DNA, 20 bp, Homo sapiens
cctggcctatttaagccccc

SEQ ID NO: 471038 - DNA, 12 bp, Homo sapiens
cctggcgggcag

SEQ ID NO: 471039 - DNA, 23 bp, Homo sapiens
cctggctcccacaggcccttcct

SEQ ID NO: 471040 - DNA, 16 bp, Homo sapiens
cctggcttttcactgc

SEQ ID NO: 471041 - DNA, 17 bp, Homo sapiens
cctggcttttcactgct

SEQ ID NO: 471042 - DNA, 22 bp, Homo sapiens
cctggcttttcactgctggctg

SEQ ID NO: 471043 - DNA, 23 bp, Homo sapiens
cctggcttttcactgctggctgc

SEQ ID NO: 471044 - DNA, 18 bp, Homo sapiens
cctgggatgggaccaggg

SEQ ID NO: 471045 - DNA, 13 bp, Homo sapiens
cctgggcctcccg

SEQ ID NO: 471046 - DNA, 22 bp, Homo sapiens
cctgggcctcccgtccgtccgc

SEQ ID NO: 471047 - DNA, 13 bp, Homo sapiens
cctggggggggca

SEQ ID NO: 471048 - DNA, 17 bp, Homo sapiens
cctgggggtggcaggca

SEQ ID NO: 471049 - DNA, 14 bp, Homo sapiens
cctggggtctctga

SEQ ID NO: 471050 - DNA, 20 bp, Homo sapiens
cctggggtggttggaggcct

SEQ ID NO: 471051 - DNA, 14 bp, Homo sapiens
cctggtctggagcc

SEQ ID NO: 471052 - DNA, 21 bp, Homo sapiens
cctggtctggagcccctatcc

SEQ ID NO: 471053 - DNA, 14 bp, Homo sapiens
cctggtgcgctgtg

SEQ ID NO: 471054 - DNA, 18 bp, Homo sapiens
cctggtgcgctgtgctcc

SEQ ID NO: 471055 - DNA, 23 bp, Homo sapiens
cctggtgcgctgtgctccagcag

SEQ ID NO: 471056 - DNA, 21 bp, Homo sapiens
cctggtgctgccacacttcag

SEQ ID NO: 471057 - DNA, 13 bp, Homo sapiens
cctggtggcacca

SEQ ID NO: 471058 - DNA, 16 bp, Homo sapiens
cctggtgtctagtttg

SEQ ID NO: 471059 - DNA, 14 bp, Homo sapiens
cctgtagtgagaaa

SEQ ID NO: 471060 - DNA, 17 bp, Homo sapiens
cctgtccacctgtgctg

SEQ ID NO: 471061 - DNA, 20 bp, Homo sapiens
cctgtctctccctaccctct

SEQ ID NO: 471062 - DNA, 11 bp, Homo sapiens
cctgtgctttc

SEQ ID NO: 471063 - DNA, 16 bp, Homo sapiens
cctgtgggagtccact

SEQ ID NO: 471064 - DNA, 17 bp, Homo sapiens
cctgtgggagtccactt

SEQ ID NO: 471065 - DNA, 21 bp, Homo sapiens
cctgtgggagtccactttcct

SEQ ID NO: 471066 - DNA, 22 bp, Homo sapiens
cctgtgggagtccactttcctc

SEQ ID NO: 471067 - DNA, 23 bp, Homo sapiens
cctgtgggagtccactttcctct

SEQ ID NO: 471068 - DNA, 21 bp, Homo sapiens
cctgtgggggtggccatccct

SEQ ID NO: 471069 - DNA, 21 bp, Homo sapiens
cctgtgtataaaaaagaaaac

SEQ ID NO: 471070 - DNA, 14 bp, Homo sapiens
ccttcaaccattcc

SEQ ID NO: 471071 - DNA, 13 bp, Homo sapiens
ccttcactctgac

SEQ ID NO: 471072 - DNA, 18 bp, Homo sapiens
ccttcaggttcctcctag

SEQ ID NO: 471073 - DNA, 21 bp, Homo sapiens
ccttcccctgcgccctccctc

SEQ ID NO: 471074 - DNA, 23 bp, Homo sapiens
ccttcccctgcgccctccctccc

SEQ ID NO: 471075 - DNA, 14 bp, Homo sapiens
ccttccccttctgt

SEQ ID NO: 471076 - DNA, 15 bp, Homo sapiens
ccttcccgcagcacc

SEQ ID NO: 471077 - DNA, 14 bp, Homo sapiens
ccttcctgtcctgc

SEQ ID NO: 471078 - DNA, 23 bp, Homo sapiens
ccttcgatacaccgggcctggag

SEQ ID NO: 471079 - DNA, 15 bp, Homo sapiens
ccttctcccctccag

SEQ ID NO: 471080 - DNA, 21 bp, Homo sapiens
ccttctgtggctcacagaacc

SEQ ID NO: 471081 - DNA, 13 bp, Homo sapiens
ccttggcccctct

SEQ ID NO: 471082 - DNA, 15 bp, Homo sapiens
ccttggcccctctct

SEQ ID NO: 471083 - DNA, 14 bp, Homo sapiens
ccttgggcacggga

SEQ ID NO: 471084 - DNA, 17 bp, Homo sapiens
ccttgggcacgggagag

SEQ ID NO: 471085 - DNA, 13 bp, Homo sapiens
ccttggttcctcc

SEQ ID NO: 471086 - DNA, 17 bp, Homo sapiens
ccttggttcctccagca

SEQ ID NO: 471087 - DNA, 22 bp, Homo sapiens
ccttgtacagaaccagcactcc

SEQ ID NO: 471088 - DNA, 11 bp, Homo sapiens
cctttatttat

SEQ ID NO: 471089 - DNA, 18 bp, Homo sapiens
cctttatttattaaactt

SEQ ID NO: 471090 - DNA, 15 bp, Homo sapiens
cctttcacaaccttc

SEQ ID NO: 471091 - DNA, 14 bp, Homo sapiens
cctttccctgcatc

SEQ ID NO: 471092 - DNA, 18 bp, Homo sapiens
cctttccctgcatccctt

SEQ ID NO: 471093 - DNA, 22 bp, Homo sapiens
cctttctagtcctattctattg

SEQ ID NO: 471094 - DNA, 16 bp, Homo sapiens
cctttgagcttctcct

SEQ ID NO: 471095 - DNA, 20 bp, Homo sapiens
cctttgagcttctcctctgc

SEQ ID NO: 471096 - DNA, 16 bp, Homo sapiens
cctttggcatctagat

SEQ ID NO: 471097 - DNA, 14 bp, Homo sapiens
cctttgttgctcag

SEQ ID NO: 471098 - DNA, 15 bp, Homo sapiens
cgaaacaccccgctc

SEQ ID NO: 471099 - DNA, 12 bp, Homo sapiens
cgacagcctggc

SEQ ID NO: 471100 - DNA, 24 bp, Homo sapiens
cgagacccaccatccttccatcct

SEQ ID NO: 471101 - DNA, 15 bp, Homo sapiens
cgagagggctgagcc

SEQ ID NO: 471102 - DNA, 16 bp, Homo sapiens
cgagagggctgagccc

SEQ ID NO: 471103 - DNA, 18 bp, Homo sapiens
cgagagggctgagcccct

SEQ ID NO: 471104 - DNA, 22 bp, Homo sapiens
cgagcaggactaacaactggga

SEQ ID NO: 471105 - DNA, 20 bp, Homo sapiens
cgagtccccccacccctccc

SEQ ID NO: 471106 - DNA, 16 bp, Homo sapiens
cgagtctcttctccac

SEQ ID NO: 471107 - DNA, 17 bp, Homo sapiens
cgagtctcttctccact

SEQ ID NO: 471108 - DNA, 18 bp, Homo sapiens
cgagtctcttctccactg

SEQ ID NO: 471109 - DNA, 13 bp, Homo sapiens
cgatttcctaagc

SEQ ID NO: 471110 - DNA, 14 bp, Homo sapiens
cgcagagccccgga

SEQ ID NO: 471111 - DNA, 16 bp, Homo sapiens
cgcagagccccggagc

SEQ ID NO: 471112 - DNA, 20 bp, Homo sapiens
cgcagagccccggagcacca

SEQ ID NO: 471113 - DNA, 18 bp, Homo sapiens
cgcagcaccagcctgagc

SEQ ID NO: 471114 - DNA, 15 bp, Homo sapiens
cgcagccctctccac

SEQ ID NO: 471115 - DNA, 18 bp, Homo sapiens
cgcagccctctccaccca

SEQ ID NO: 471116 - DNA, 20 bp, Homo sapiens
cgcagccctctccacccaga

SEQ ID NO: 471117 - DNA, 13 bp, Homo sapiens
cgcagggcgctcc

SEQ ID NO: 471118 - DNA, 18 bp, Homo sapiens
cgcagggcgctccggcag

SEQ ID NO: 471119 - DNA, 15 bp, Homo sapiens
cgcatccaccgccac

SEQ ID NO: 471120 - DNA, 23 bp, Homo sapiens
cgccaaacttctgaactttggaa

SEQ ID NO: 471121 - DNA, 11 bp, Homo sapiens
cgccacccgcc

SEQ ID NO: 471122 - DNA, 22 bp, Homo sapiens
cgccacccgcccgcccccgccc

SEQ ID NO: 471123 - DNA, 19 bp, Homo sapiens
cgcccaacccccacctccc

SEQ ID NO: 471124 - DNA, 12 bp, Homo sapiens
cgcccacctgcc

SEQ ID NO: 471125 - DNA, 15 bp, Homo sapiens
cgcccacctgcccag

SEQ ID NO: 471126 - DNA, 16 bp, Homo sapiens
cgcccacctgcccagt

SEQ ID NO: 471127 - DNA, 17 bp, Homo sapiens
cgcccacctgcccagtt

SEQ ID NO: 471128 - DNA, 13 bp, Homo sapiens
cgccccagagact

SEQ ID NO: 471129 - DNA, 16 bp, Homo sapiens
cgccccagagactgcc

SEQ ID NO: 471130 - DNA, 21 bp, Homo sapiens
cgccccagagactgcccaccc

SEQ ID NO: 471131 - DNA, 22 bp, Homo sapiens
cgccccagagactgcccaccct

SEQ ID NO: 471132 - DNA, 14 bp, Homo sapiens
cgccccaggccctc

SEQ ID NO: 471133 - DNA, 12 bp, Homo sapiens
cgcccctcctcg

SEQ ID NO: 471134 - DNA, 20 bp, Homo sapiens
cgcccgcccaccccgctgcc

SEQ ID NO: 471135 - DNA, 22 bp, Homo sapiens
cgcccgcccaccccgctgcctg

SEQ ID NO: 471136 - DNA, 21 bp, Homo sapiens
cgcccgccggttggccggctg

SEQ ID NO: 471137 - DNA, 11 bp, Homo sapiens
cgccctcctct

SEQ ID NO: 471138 - DNA, 18 bp, Homo sapiens
cgccctgggctgtctgtc

SEQ ID NO: 471139 - DNA, 19 bp, Homo sapiens
cgccctgggctgtctgtca

SEQ ID NO: 471140 - DNA, 22 bp, Homo sapiens
cgccctgggctgtctgtcacca

SEQ ID NO: 471141 - DNA, 14 bp, Homo sapiens
cgccggggctggcc

SEQ ID NO: 471142 - DNA, 17 bp, Homo sapiens
cgccggggctggccctg

SEQ ID NO: 471143 - DNA, 18 bp, Homo sapiens
cgccggggctggccctgc

SEQ ID NO: 471144 - DNA, 14 bp, Homo sapiens
cgcctcccgccgcc

SEQ ID NO: 471145 - DNA, 19 bp, Homo sapiens
ccgcgctctgcccctccgt

SEQ ID NO: 471146 - DNA, 15 bp, Homo sapiens
ccgctcaacctctca

SEQ ID NO: 471147 - DNA, 20 bp, Homo sapiens
ccgctcacgctgacagcctc

SEQ ID NO: 471148 - DNA, 22 bp, Homo sapiens
ccgctcacgctgacagcctcct

SEQ ID NO: 471149 - DNA, 11 bp, Homo sapiens
ccgctcagccc

SEQ ID NO: 471150 - DNA, 12 bp, Homo sapiens
ccgctcagccct

SEQ ID NO: 471151 - DNA, 13 bp, Homo sapiens
ccgctcccgcggg

SEQ ID NO: 471152 - DNA, 16 bp, Homo sapiens
ccgctgccgctgcacc

SEQ ID NO: 471153 - DNA, 17 bp, Homo sapiens
ccgctgccgctgcacca

SEQ ID NO: 471154 - DNA, 21 bp, Homo sapiens
ccgctgcctggcgggcagccc

SEQ ID NO: 471155 - DNA, 19 bp, Homo sapiens
ccgctgtcgccccaggccc

SEQ ID NO: 471156 - DNA, 20 bp, Homo sapiens
ccgctgtcgccccaggccct

SEQ ID NO: 471157 - DNA, 12 bp, Homo sapiens
ccggagcaccac

SEQ ID NO: 471158 - DNA, 14 bp, Homo sapiens
ccggagcggctgag

SEQ ID NO: 471159 - DNA, 15 bp, Homo sapiens
ccggagcggctgagg

SEQ ID NO: 471160 - DNA, 17 bp, Homo sapiens
ccggaggcgcccacctg

SEQ ID NO: 471161 - DNA, 18 bp, Homo sapiens
ccggaggcgcccacctgc

SEQ ID NO: 471162 - DNA, 17 bp, Homo sapiens
ccggaggggcctggcag

SEQ ID NO: 471163 - DNA, 21 bp, Homo sapiens
ccggaggggcctggcagccgt

SEQ ID NO: 471164 - DNA, 12 bp, Homo sapiens
ccggcagaggca

SEQ ID NO: 471165 - DNA, 16 bp, Homo sapiens
ccggcagaggcagggc

SEQ ID NO: 471166 - DNA, 21 bp, Homo sapiens
ccggcagaggcagggccctgg

SEQ ID NO: 471167 - DNA, 14 bp, Homo sapiens
ccggcccacgcaga

SEQ ID NO: 471168 - DNA, 18 bp, Homo sapiens
ccggcccacgcagagccc

SEQ ID NO: 471169 - DNA, 17 bp, Homo sapiens
ccggccccgcgcgtgcc

SEQ ID NO: 471170 - DNA, 18 bp, Homo sapiens
ccggccccgcgcgtgccc

SEQ ID NO: 471171 - DNA, 20 bp, Homo sapiens
ccggccccgcgcgtgccccc

SEQ ID NO: 471172 - DNA, 18 bp, Homo sapiens
ccggcctccaggctgggg

SEQ ID NO: 471173 - DNA, 20 bp, Homo sapiens
ccggcctccaggctggggcc

SEQ ID NO: 471174 - DNA, 17 bp, Homo sapiens
ccggcctgcagcccaga

SEQ ID NO: 471175 - DNA, 20 bp, Homo sapiens
ccggctccccctgccagcaa

SEQ ID NO: 471176 - DNA, 18 bp, Homo sapiens
ccggctggccggtccacc

SEQ ID NO: 471177 - DNA, 19 bp, Homo sapiens
ccgggagcctccccctcag

SEQ ID NO: 471178 - DNA, 19 bp, Homo sapiens
ccgggcaggtcctgcccat

SEQ ID NO: 471179 - DNA, 15 bp, Homo sapiens
ccggggctggccctg

SEQ ID NO: 471180 - DNA, 17 bp, Homo sapiens
ccgggtgtggcctcagc

SEQ ID NO: 471181 - DNA, 18 bp, Homo sapiens
ccgggtgtggcctcagcc

SEQ ID NO: 471182 - DNA, 18 bp, Homo sapiens
ccggttggccggctggcc

SEQ ID NO: 471183 - DNA, 14 bp, Homo sapiens
ccgtcccggccccg

SEQ ID NO: 471184 - DNA, 13 bp, Homo sapiens
ccgtccctttccc

SEQ ID NO: 471185 - DNA, 12 bp, Homo sapiens
ccgtccgcccgc

SEQ ID NO: 471186 - DNA, 14 bp, Homo sapiens
ccgtgagacacaag

SEQ ID NO: 471187 - DNA, 21 bp, Homo sapiens
ccgtgcaacggaagccaggcc

SEQ ID NO: 471188 - DNA, 19 bp, Homo sapiens
ccgtgcgcagccgcgctct

SEQ ID NO: 471189 - DNA, 14 bp, Homo sapiens
ccgtgcggcccgtg

SEQ ID NO: 471190 - DNA, 15 bp, Homo sapiens
ccgtgttcacacaca

SEQ ID NO: 471191 - DNA, 17 bp, Homo sapiens
ccgttcatctgaggagt

SEQ ID NO: 471192 - DNA, 16 bp, Homo sapiens
cctaaagaaaaagata

SEQ ID NO: 471193 - DNA, 18 bp, Homo sapiens
cctaaatccattttctaa

SEQ ID NO: 471194 - DNA, 17 bp, Homo sapiens
cctacagtatataagct

SEQ ID NO: 471195 - DNA, 23 bp, Homo sapiens
cctacatctgaaatctacaacat

SEQ ID NO: 471196 - DNA, 15 bp, Homo sapiens
cctaccctcttctca

SEQ ID NO: 471197 - DNA, 14 bp, Homo sapiens
cctaccctttccca

SEQ ID NO: 471198 - DNA, 21 bp, Homo sapiens
cctaccgagtctcttctccac

SEQ ID NO: 471199 - DNA, 16 bp, Homo sapiens
cctaggcgctcagagg

SEQ ID NO: 471200 - DNA, 20 bp, Homo sapiens
cctaggcgctcagaggccgc

SEQ ID NO: 471201 - DNA, 13 bp, Homo sapiens
cctaggctccctg

SEQ ID NO: 471202 - DNA, 17 bp, Homo sapiens
cctaggctccctgaggt

SEQ ID NO: 471203 - DNA, 15 bp, Homo sapiens
cctaggtctccaccc

SEQ ID NO: 471204 - DNA, 16 bp, Homo sapiens
cctataccgagaccca

SEQ ID NO: 471205 - DNA, 17 bp, Homo sapiens
cctatcctgcaccctct

SEQ ID NO: 471206 - DNA, 18 bp, Homo sapiens
cctatcctgcaccctctg

SEQ ID NO: 471207 - DNA, 21 bp, Homo sapiens
cctatggaaagggtgtggctt

SEQ ID NO: 471208 - DNA, 12 bp, Homo sapiens
cctatttaagcc

SEQ ID NO: 471209 - DNA, 13 bp, Homo sapiens
cctcaagccagga

SEQ ID NO: 471210 - DNA, 23 bp, Homo sapiens
cctcaagccaggagaccctgtct

SEQ ID NO: 471211 - DNA, 22 bp, Homo sapiens
cctcactatggtatgctggcca

SEQ ID NO: 471212 - DNA, 17 bp, Homo sapiens
cctcactccactcccct

SEQ ID NO: 471213 - DNA, 23 bp, Homo sapiens
cctcactccactcccctcatcca

SEQ ID NO: 471214 - DNA, 15 bp, Homo sapiens
cctcactctgtcagc

SEQ ID NO: 471215 - DNA, 16 bp, Homo sapiens
cctcactctgtcagcc

SEQ ID NO: 471216 - DNA, 19 bp, Homo sapiens
cctcactctgtcagccagc

SEQ ID NO: 471217 - DNA, 15 bp, Homo sapiens
cctcactggtgcatt

SEQ ID NO: 471218 - DNA, 21 bp, Homo sapiens
cctcactggtgcatttaaaat

SEQ ID NO: 471219 - DNA, 21 bp, Homo sapiens
cctcagatgatctctccacgg

SEQ ID NO: 471220 - DNA, 13 bp, Homo sapiens
cctcagccctcag

SEQ ID NO: 471221 - DNA, 16 bp, Homo sapiens
cctcagccctcagaac

SEQ ID NO: 471222 - DNA, 14 bp, Homo sapiens
cctccacacctcca

SEQ ID NO: 471223 - DNA, 13 bp, Homo sapiens
cctccacgcctcc

SEQ ID NO: 471224 - DNA, 13 bp, Homo sapiens
cctccactctgag

SEQ ID NO: 471225 - DNA, 9 bp, Homo sapiens
cctccagac

SEQ ID NO: 471226 - DNA, 10 bp, Homo sapiens
cctccagacc

SEQ ID NO: 471227 - DNA, 14 bp, Homo sapiens
cctccagaccccta

SEQ ID NO: 471228 - DNA, 20 bp, Homo sapiens
cctccagattattttctata

SEQ ID NO: 471229 - DNA, 14 bp, Homo sapiens
cctccaggctgggg

SEQ ID NO: 471230 - DNA, 16 bp, Homo sapiens
cctccaggctggggcc

SEQ ID NO: 471231 - DNA, 15 bp, Homo sapiens
cctcccccaggctgc

SEQ ID NO: 471232 - DNA, 13 bp, Homo sapiens
cctcccccgcaga

SEQ ID NO: 471233 - DNA, 23 bp, Homo sapiens
cctcccgccgcctcgggccgcct

SEQ ID NO: 471234 - DNA, 13 bp, Homo sapiens
cctcccggtgccc

SEQ ID NO: 471235 - DNA, 19 bp, Homo sapiens
cctccctccacacctccac

SEQ ID NO: 471236 - DNA, 12 bp, Homo sapiens
cctccctccttc

SEQ ID NO: 471237 - DNA, 14 bp, Homo sapiens
cctccctccttcct

SEQ ID NO: 471238 - DNA, 13 bp, Homo sapiens
cctccctgcccct

SEQ ID NO: 471239 - DNA, 15 bp, Homo sapiens
cctccctgtcccctg

SEQ ID NO: 471240 - DNA, 20 bp, Homo sapiens
cctcctaggcgctcagaggc

SEQ ID NO: 471241 - DNA, 11 bp, Homo sapiens
cctcctccaga

SEQ ID NO: 471242 - DNA, 13 bp, Homo sapiens
cctcctccagact

SEQ ID NO: 471243 - DNA, 14 bp, Homo sapiens
cctcctccagactc

SEQ ID NO: 471244 - DNA, 23 bp, Homo sapiens
cccccagcactaaggccgtgtct

SEQ ID NO: 471245 - DNA, 22 bp, Homo sapiens
cccccagcctcccccaggctgc

SEQ ID NO: 471246 - DNA, 16 bp, Homo sapiens
cccccaggctgcgcct

SEQ ID NO: 471247 - DNA, 20 bp, Homo sapiens
cccccaggctgcgcctgccc

SEQ ID NO: 471248 - DNA, 13 bp, Homo sapiens
cccccctcctttc

SEQ ID NO: 471249 - DNA, 12 bp, Homo sapiens
ccccccttccca

SEQ ID NO: 471250 - DNA, 16 bp, Homo sapiens
cccccgaggcccccct

SEQ ID NO: 471251 - DNA, 16 bp, Homo sapiens
cccccgccctcgctcc

SEQ ID NO: 471252 - DNA, 13 bp, Homo sapiens
ccccctctgcctt

SEQ ID NO: 471253 - DNA, 15 bp, Homo sapiens
ccccctctgcctttg

SEQ ID NO: 471254 - DNA, 13 bp, Homo sapiens
ccccgaggccccc

SEQ ID NO: 471255 - DNA, 14 bp, Homo sapiens
ccccgaggcccccc

SEQ ID NO: 471256 - DNA, 13 bp, Homo sapiens
ccccgcagccctc

SEQ ID NO: 471257 - DNA, 17 bp, Homo sapiens
ccccgcagccctctcca

SEQ ID NO: 471258 - DNA, 18 bp, Homo sapiens
ccccgcagccctctccac

SEQ ID NO: 471259 - DNA, 19 bp, Homo sapiens
ccccgcgcgtgcccccagc

SEQ ID NO: 471260 - DNA, 15 bp, Homo sapiens
ccccggcctccaggc

SEQ ID NO: 471261 - DNA, 22 bp, Homo sapiens
ccccggcctccaggctggggcc

SEQ ID NO: 471262 - DNA, 18 bp, Homo sapiens
ccccggtgtgcggtgcat

SEQ ID NO: 471263 - DNA, 16 bp, Homo sapiens
ccccgtccctttccct

SEQ ID NO: 471264 - DNA, 23 bp, Homo sapiens
ccccgtctgccccttgaccccac

SEQ ID NO: 471265 - DNA, 14 bp, Homo sapiens
cccctaccctttcc

SEQ ID NO: 471266 - DNA, 15 bp, Homo sapiens
cccctatcctgcacc

SEQ ID NO: 471267 - DNA, 17 bp, Homo sapiens
cccctatcctgcaccct

SEQ ID NO: 471268 - DNA, 23 bp, Homo sapiens
cccctcagatgatctctccacgg

SEQ ID NO: 471269 - DNA, 19 bp, Homo sapiens
cccctccacgcctcctggc

SEQ ID NO: 471270 - DNA, 13 bp, Homo sapiens
cccctccagaccc

SEQ ID NO: 471271 - DNA, 20 bp, Homo sapiens
cccctccagacccctaccct

SEQ ID NO: 471272 - DNA, 12 bp, Homo sapiens
cccctccccaag

SEQ ID NO: 471273 - DNA, 14 bp, Homo sapiens
cccctccccaccca

SEQ ID NO: 471274 - DNA, 16 bp, Homo sapiens
cccctcccccgcagac

SEQ ID NO: 471275 - DNA, 22 bp, Homo sapiens
cccctcctcgggcgcctgcgct

SEQ ID NO: 471276 - DNA, 12 bp, Homo sapiens
cccctccttctc

SEQ ID NO: 471277 - DNA, 19 bp, Homo sapiens
cccctccttctcccctcca

SEQ ID NO: 471278 - DNA, 22 bp, Homo sapiens
cccctccttctcccctccagac

SEQ ID NO: 471279 - DNA, 15 bp, Homo sapiens
cccctctgcctttga

SEQ ID NO: 471280 - DNA, 17 bp, Homo sapiens
cccctcttcccccttcc

SEQ ID NO: 471281 - DNA, 20 bp, Homo sapiens
cccctcttgagaggggtgag

SEQ ID NO: 471282 - DNA, 23 bp, Homo sapiens
cccctgcgccctccctccctcca

SEQ ID NO: 471283 - DNA, 14 bp, Homo sapiens
cccctgctggacca

SEQ ID NO: 471284 - DNA, 23 bp, Homo sapiens
cccctggcttttcactgctggct

SEQ ID NO: 471285 - DNA, 14 bp, Homo sapiens
ccccttcccacccc

SEQ ID NO: 471286 - DNA, 13 bp, Homo sapiens
ccccttcccctgc

SEQ ID NO: 471287 - DNA, 15 bp, Homo sapiens
ccccttcccctgcgc

SEQ ID NO: 471288 - DNA, 18 bp, Homo sapiens
ccccttcccctgcgccct

SEQ ID NO: 471289 - DNA, 18 bp, Homo sapiens
cccgaggcccccctctgc

SEQ ID NO: 471290 - DNA, 20 bp, Homo sapiens
cccgaggcccccctctgcct

SEQ ID NO: 471291 - DNA, 23 bp, Homo sapiens
cccgaggcccccctctgcctttg

SEQ ID NO: 471292 - DNA, 15 bp, Homo sapiens
cccgcagacagacag

SEQ ID NO: 471293 - DNA, 16 bp, Homo sapiens
cccgcagacagacaga

SEQ ID NO: 471294 - DNA, 15 bp, Homo sapiens
cccgcagcaccagcc

SEQ ID NO: 471295 - DNA, 18 bp, Homo sapiens
cccgcagcaccagcctga

SEQ ID NO: 471296 - DNA, 17 bp, Homo sapiens
cccgcagccctctccac

SEQ ID NO: 471297 - DNA, 18 bp, Homo sapiens
cccgcccccgccctcgct

SEQ ID NO: 471298 - DNA, 15 bp, Homo sapiens
cccgcccgccctcct

SEQ ID NO: 471299 - DNA, 14 bp, Homo sapiens
cccgccctcctctg

SEQ ID NO: 471300 - DNA, 22 bp, Homo sapiens
cccgccggttggccggctggcc

SEQ ID NO: 471301 - DNA, 15 bp, Homo sapiens
cccgcgcgtgccccc

SEQ ID NO: 471302 - DNA, 17 bp, Homo sapiens
cccgcgggaagccagcc

SEQ ID NO: 471303 - DNA, 21 bp, Homo sapiens
cccgctcacgctgacagcctc

SEQ ID NO: 471304 - DNA, 19 bp, Homo sapiens
cccgctcagccctccctgc

SEQ ID NO: 471305 - DNA, 14 bp, Homo sapiens
cccgctgcctggcg

SEQ ID NO: 471306 - DNA, 19 bp, Homo sapiens
cccgctgcctggcgggcag

SEQ ID NO: 471307 - DNA, 19 bp, Homo sapiens
cccggagcaccacggggtc

SEQ ID NO: 471308 - DNA, 16 bp, Homo sapiens
cccggaggcgcccacc

SEQ ID NO: 471309 - DNA, 17 bp, Homo sapiens
cccggaggcgcccacct

SEQ ID NO: 471310 - DNA, 14 bp, Homo sapiens
cagttctcatcttg

SEQ ID NO: 471311 - DNA, 21 bp, Homo sapiens
cagttcttggcctatgataag

SEQ ID NO: 471312 - DNA, 20 bp, Homo sapiens
cagttgagaaaatttgaatg

SEQ ID NO: 471313 - DNA, 21 bp, Homo sapiens
cagtttgctttgtatgcactt

SEQ ID NO: 471314 - DNA, 19 bp, Homo sapiens
cagttttaactttttctaa

SEQ ID NO: 471315 - DNA, 16 bp, Homo sapiens
cagttttgtcttcgta

SEQ ID NO: 471316 - DNA, 15 bp, Homo sapiens
cataaatagtaaata

SEQ ID NO: 471317 - DNA, 15 bp, Homo sapiens
cataaattggctcct

SEQ ID NO: 471318 - DNA, 22 bp, Homo sapiens
cataaattggctcctttcccac

SEQ ID NO: 471319 - DNA, 17 bp, Homo sapiens
cataagattatatacaa

SEQ ID NO: 471320 - DNA, 23 bp, Homo sapiens
cataagattatatacaaagctgt

SEQ ID NO: 471321 - DNA, 22 bp, Homo sapiens
cataatgatactgaattgttat

SEQ ID NO: 471322 - DNA, 14 bp, Homo sapiens
catacaataaaaga

SEQ ID NO: 471323 - DNA, 15 bp, Homo sapiens
catacaataaaagag

SEQ ID NO: 471324 - DNA, 17 bp, Homo sapiens
catacaataaaagagct

SEQ ID NO: 471325 - DNA, 19 bp, Homo sapiens
catacaataaaagagcttt

SEQ ID NO: 471326 - DNA, 22 bp, Homo sapiens
catacacccccacctcctgcaa

SEQ ID NO: 471327 - DNA, 19 bp, Homo sapiens
catactctgtgtaatctct

SEQ ID NO: 471328 - DNA, 22 bp, Homo sapiens
catactctgtgtaatctctgat

SEQ ID NO: 471329 - DNA, 20 bp, Homo sapiens
catacttcctggattttctt

SEQ ID NO: 471330 - DNA, 20 bp, Homo sapiens
catagacaaaggccttaaca

SEQ ID NO: 471331 - DNA, 13 bp, Homo sapiens
catagagtgagtt

SEQ ID NO: 471332 - DNA, 15 bp, Homo sapiens
catagggtttggaag

SEQ ID NO: 471333 - DNA, 16 bp, Homo sapiens
catagtctttgtttac

SEQ ID NO: 471334 - DNA, 19 bp, Homo sapiens
catagtgatggttcccctg

SEQ ID NO: 471335 - DNA, 22 bp, Homo sapiens
catagtgatggttcccctgttc

SEQ ID NO: 471336 - DNA, 19 bp, Homo sapiens
catatatgctactagaaaa

SEQ ID NO: 471337 - DNA, 15 bp, Homo sapiens
catatcctggtgtct

SEQ ID NO: 471338 - DNA, 19 bp, Homo sapiens
catatcctggtgtctagtt

SEQ ID NO: 471339 - DNA, 21 bp, Homo sapiens
catatgacaatttcaaaatgc

SEQ ID NO: 471340 - DNA, 22 bp, Homo sapiens
catatgacaatttcaaaatgca

SEQ ID NO: 471341 - DNA, 14 bp, Homo sapiens
catatgattgaaaa

SEQ ID NO: 471342 - DNA, 15 bp, Homo sapiens
catatgattgaaaag

SEQ ID NO: 471343 - DNA, 19 bp, Homo sapiens
catatgattgaaaagaaga

SEQ ID NO: 471344 - DNA, 21 bp, Homo sapiens
catatgattgaaaagaagaaa

SEQ ID NO: 471345 - DNA, 23 bp, Homo sapiens
catattcttgctttcacaaatat

SEQ ID NO: 471346 - DNA, 22 bp, Homo sapiens
catattgagatcagcattcaaa

SEQ ID NO: 471347 - DNA, 18 bp, Homo sapiens
catccaccgccaccccac

SEQ ID NO: 471348 - DNA, 19 bp, Homo sapiens
catccaccgccaccccact

SEQ ID NO: 471349 - DNA, 22 bp, Homo sapiens
catccaccgccaccccactgag

SEQ ID NO: 471350 - DNA, 20 bp, Homo sapiens
catccactaggtgcccagtc

SEQ ID NO: 471351 - DNA, 14 bp, Homo sapiens
catccagtttgttc

SEQ ID NO: 471352 - DNA, 15 bp, Homo sapiens
catccatagacacag

SEQ ID NO: 471353 - DNA, 18 bp, Homo sapiens
catccatagacacagtat

SEQ ID NO: 471354 - DNA, 13 bp, Homo sapiens
catcccactgata

SEQ ID NO: 471355 - DNA, 18 bp, Homo sapiens
catcccactgatatcacg

SEQ ID NO: 471356 - DNA, 11 bp, Homo sapiens
catccctgggc

SEQ ID NO: 471357 - DNA, 17 bp, Homo sapiens
catccctgggcccctcc

SEQ ID NO: 471358 - DNA, 19 bp, Homo sapiens
catccctgggcccctccac

SEQ ID NO: 471359 - DNA, 24 bp, Homo sapiens
catccctgggcccctccacgcctc

SEQ ID NO: 471360 - DNA, 17 bp, Homo sapiens
catcccttggcccctct

SEQ ID NO: 471361 - DNA, 14 bp, Homo sapiens
catcctgattattg

SEQ ID NO: 471362 - DNA, 13 bp, Homo sapiens
catccttcccgca

SEQ ID NO: 471363 - DNA, 14 bp, Homo sapiens
catccttcccgcag

SEQ ID NO: 471364 - DNA, 18 bp, Homo sapiens
catccttcccgcagcacc

SEQ ID NO: 471365 - DNA, 23 bp, Homo sapiens
catccttcccgcagcaccagcct

SEQ ID NO: 471366 - DNA, 17 bp, Homo sapiens
catccttgcacttctgt

SEQ ID NO: 471367 - DNA, 14 bp, Homo sapiens
catcgctggaaaac

SEQ ID NO: 471368 - DNA, 16 bp, Homo sapiens
catcgctggaaaacag

SEQ ID NO: 471369 - DNA, 19 bp, Homo sapiens
catcggaggctgggcccct

SEQ ID NO: 471370 - DNA, 20 bp, Homo sapiens
catcggaggctgggcccctg

SEQ ID NO: 471371 - DNA, 22 bp, Homo sapiens
catcggaggctgggcccctggg

SEQ ID NO: 471372 - DNA, 19 bp, Homo sapiens
catctaaataattcatctt

SEQ ID NO: 471373 - DNA, 16 bp, Homo sapiens
catctcaaacactgct

SEQ ID NO: 471374 - DNA, 17 bp, Homo sapiens
catctcaaacactgctt

SEQ ID NO: 471375 - DNA, 21 bp, Homo sapiens
catctcatcgtcctagaaagc

SEQ ID NO: 471376 - DNA, 13 bp, Homo sapiens
catctgaaatcta

SEQ ID NO: 471377 - DNA, 15 bp, Homo sapiens
catctgaggagtcca

SEQ ID NO: 471378 - DNA, 17 bp, Homo sapiens
catctgagtccagctcc

SEQ ID NO: 471379 - DNA, 18 bp, Homo sapiens
catctgagtccagctccc

SEQ ID NO: 471380 - DNA, 17 bp, Homo sapiens
catctggagtcttcctg

SEQ ID NO: 471381 - DNA, 15 bp, Homo sapiens
catgagttcaaatac

SEQ ID NO: 471382 - DNA, 16 bp, Homo sapiens
catgatattgtatgta

SEQ ID NO: 471383 - DNA, 18 bp, Homo sapiens
catgatgctcatgactta

SEQ ID NO: 471384 - DNA, 14 bp, Homo sapiens
catgcaagctcagg

SEQ ID NO: 471385 - DNA, 15 bp, Homo sapiens
catgcataacacact

SEQ ID NO: 471386 - DNA, 13 bp, Homo sapiens
catgcggctgccc

SEQ ID NO: 471387 - DNA, 16 bp, Homo sapiens
catgcggctgcccacg

SEQ ID NO: 471388 - DNA, 16 bp, Homo sapiens
ccacctgtgctgctgc

SEQ ID NO: 471389 - DNA, 13 bp, Homo sapiens
ccacgcagagccc

SEQ ID NO: 471390 - DNA, 16 bp, Homo sapiens
ccacgcagagccccgg

SEQ ID NO: 471391 - DNA, 14 bp, Homo sapiens
ccacgcctcctggc

SEQ ID NO: 471392 - DNA, 18 bp, Homo sapiens
ccacgcctcctggccaga

SEQ ID NO: 471393 - DNA, 16 bp, Homo sapiens
ccacggccgtccctga

SEQ ID NO: 471394 - DNA, 20 bp, Homo sapiens
ccactagccctctttctctc

SEQ ID NO: 471395 - DNA, 22 bp, Homo sapiens
ccactcagtaggtctgaaggcc

SEQ ID NO: 471396 - DNA, 17 bp, Homo sapiens
ccactccagacccctgg

SEQ ID NO: 471397 - DNA, 13 bp, Homo sapiens
ccactcctcccaa

SEQ ID NO: 471398 - DNA, 18 bp, Homo sapiens
ccactcctcccaactctg

SEQ ID NO: 471399 - DNA, 21 bp, Homo sapiens
ccactctgaagtcccttcctg

SEQ ID NO: 471400 - DNA, 22 bp, Homo sapiens
ccactctgaagtcccttcctgt

SEQ ID NO: 471401 - DNA, 20 bp, Homo sapiens
ccactctgaggtctcacctt

SEQ ID NO: 471402 - DNA, 15 bp, Homo sapiens
ccactgagagctgct

SEQ ID NO: 471403 - DNA, 18 bp, Homo sapiens
ccactgagagctgctcct

SEQ ID NO: 471404 - DNA, 23 bp, Homo sapiens
ccactgatatcacgggcccgctc

SEQ ID NO: 471405 - DNA, 18 bp, Homo sapiens
ccactggagttcactttc

SEQ ID NO: 471406 - DNA, 20 bp, Homo sapiens
ccacttatgctgctgtgaat

SEQ ID NO: 471407 - DNA, 15 bp, Homo sapiens
ccacttccagagggg

SEQ ID NO: 471408 - DNA, 14 bp, Homo sapiens
ccactttcctctct

SEQ ID NO: 471409 - DNA, 15 bp, Homo sapiens
ccactttcctctctc

SEQ ID NO: 471410 - DNA, 15 bp, Homo sapiens
ataaagaagaaaata

SEQ ID NO: 471411 - DNA, 22 bp, Homo sapiens
ataaagagttctccttgtactt

SEQ ID NO: 471412 - DNA, 18 bp, Homo sapiens
ataaagtaataactgtta

SEQ ID NO: 471413 - DNA, 16 bp, Homo sapiens
ataaataaagaagaaa

SEQ ID NO: 471414 - DNA, 18 bp, Homo sapiens
ataaataaagaagaaaat

SEQ ID NO: 471415 - DNA, 15 bp, Homo sapiens
ataaatatctattta

SEQ ID NO: 471416 - DNA, 13 bp, Homo sapiens
ataaatctaaata

SEQ ID NO: 471417 - DNA, 18 bp, Homo sapiens
ataaatgtttatattgtt

SEQ ID NO: 471418 - DNA, 13 bp, Homo sapiens
ataaattataatg

SEQ ID NO: 471419 - DNA, 13 bp, Homo sapiens
ataaattattact

SEQ ID NO: 471420 - DNA, 14 bp, Homo sapiens
ataaattattactt

SEQ ID NO: 471421 - DNA, 16 bp, Homo sapiens
ataaattattacttta

SEQ ID NO: 471422 - DNA, 20 bp, Homo sapiens
ataaattggctcctttccca

SEQ ID NO: 471423 - DNA, 13 bp, Homo sapiens
ataacaactctat

SEQ ID NO: 471424 - DNA, 20 bp, Homo sapiens
ataacaagccaaacattctt

SEQ ID NO: 471425 - DNA, 17 bp, Homo sapiens
ataacaccatctggagt

SEQ ID NO: 471426 - DNA, 15 bp, Homo sapiens
ataacatattcttgc

SEQ ID NO: 471427 - DNA, 17 bp, Homo sapiens
ataacatattcttgctt

SEQ ID NO: 471428 - DNA, 16 bp, Homo sapiens
ataacatctgaaaaga

SEQ ID NO: 471429 - DNA, 20 bp, Homo sapiens
ataacatctgaaaagaaatg

SEQ ID NO: 471430 - DNA, 18 bp, Homo sapiens
ataagattatatacaaag

SEQ ID NO: 471431 - DNA, 20 bp, Homo sapiens
caagccagggttccagacag

SEQ ID NO: 471432 - DNA, 17 bp, Homo sapiens
caagcccttgcccagag

SEQ ID NO: 471433 - DNA, 19 bp, Homo sapiens
caagctgctctccttcact

SEQ ID NO: 471434 - DNA, 13 bp, Homo sapiens
caaggaaggacat

SEQ ID NO: 471435 - DNA, 15 bp, Homo sapiens
caaggaaggacattt

SEQ ID NO: 471436 - DNA, 14 bp, Homo sapiens
caaggacactgatg

SEQ ID NO: 471437 - DNA, 20 bp, Homo sapiens
ggacccggaggggcctggca

SEQ ID NO: 471438 - DNA, 21 bp, Homo sapiens
ggacccggaggggcctggcag

SEQ ID NO: 471439 - DNA, 17 bp, Homo sapiens
ggaccggagcggctgag

SEQ ID NO: 471440 - DNA, 19 bp, Homo sapiens
ggaccggagcggctgagga

SEQ ID NO: 471441 - DNA, 20 bp, Homo sapiens
ggaccggagcggctgaggac

SEQ ID NO: 471442 - DNA, 22 bp, Homo sapiens
ggaccggagcggctgaggacgg

SEQ ID NO: 471443 - DNA, 22 bp, Homo sapiens
ggacgtcatcggaggctgggcc

SEQ ID NO: 471444 - DNA, 20 bp, Homo sapiens
ggactgcatgcaagctcagg

SEQ ID NO: 471445 - DNA, 19 bp, Homo sapiens
ggactgtcttcaaccctgc

SEQ ID NO: 471446 - DNA, 23 bp, Homo sapiens
ggactgtcttcaaccctgccctg

SEQ ID NO: 471447 - DNA, 18 bp, Homo sapiens
ggacttctgcagctatgc

SEQ ID NO: 471448 - DNA, 13 bp, Homo sapiens
ggactttgcctgc

SEQ ID NO: 471449 - DNA, 22 bp, Homo sapiens
ggagaacctcgttgacatgcac

SEQ ID NO: 471450 - DNA, 13 bp, Homo sapiens
ggagaaggcctgc

SEQ ID NO: 471451 - DNA, 16 bp, Homo sapiens
ggagaaggcctgcccc

SEQ ID NO: 471452 - DNA, 21 bp, Homo sapiens
ggagagctcagtacagggcag

SEQ ID NO: 471453 - DNA, 22 bp, Homo sapiens
ggagattaaaaccagagagaaa

SEQ ID NO: 471454 - DNA, 12 bp, Homo sapiens
ggagcaccccca

SEQ ID NO: 471455 - DNA, 14 bp, Homo sapiens
ggagcacccccagc

SEQ ID NO: 471456 - DNA, 19 bp, Homo sapiens
ggagcacccccagcctccc

SEQ ID NO: 471457 - DNA, 18 bp, Homo sapiens
ggagcagagacggcagcc

SEQ ID NO: 471458 - DNA, 23 bp, Homo sapiens
ggagcagagacggcagccccatc

SEQ ID NO: 471459 - DNA, 14 bp, Homo sapiens
ggagcctccccctc

SEQ ID NO: 471460 - DNA, 14 bp, Homo sapiens
ggagcggctgagga

SEQ ID NO: 471461 - DNA, 22 bp, Homo sapiens
ggagcggctgaggacggggcag

SEQ ID NO: 471462 - DNA, 23 bp, Homo sapiens
ggagcggctgaggacggggcaga

SEQ ID NO: 471463 - DNA, 21 bp, Homo sapiens
ggagcgggggctaactggccc

SEQ ID NO: 471464 - DNA, 22 bp, Homo sapiens
ggagcgggggctaactggcccc

SEQ ID NO: 471465 - DNA, 20 bp, Homo sapiens
ggaggaaaaccaagccgtgg

SEQ ID NO: 471466 - DNA, 21 bp, Homo sapiens
ggaggaaaaccaagccgtggc

SEQ ID NO: 471467 - DNA, 18 bp, Homo sapiens
ggaggacctggggggggc

SEQ ID NO: 471468 - DNA, 13 bp, Homo sapiens
ggaggactgttct

SEQ ID NO: 471469 - DNA, 13 bp, Homo sapiens
ggaggagcacccc

SEQ ID NO: 471470 - DNA, 15 bp, Homo sapiens
ggaggagcaccccca

SEQ ID NO: 471471 - DNA, 14 bp, Homo sapiens
ggaggcgcccacct

SEQ ID NO: 471472 - DNA, 12 bp, Homo sapiens
ggaggctgggcc

SEQ ID NO: 471473 - DNA, 23 bp, Homo sapiens
ggaggctgggcccctgggatggg

SEQ ID NO: 471474 - DNA, 18 bp, Homo sapiens
ggaggggcctggcagccg

SEQ ID NO: 471475 - DNA, 13 bp, Homo sapiens
ggaggggcttgga

SEQ ID NO: 471476 - DNA, 20 bp, Homo sapiens
ggaggggcttggagcagaga

SEQ ID NO: 471477 - DNA, 19 bp, Homo sapiens
ggagtctgaaggagaggag

SEQ ID NO: 471478 - DNA, 14 bp, Homo sapiens
ggagttctcctgga

SEQ ID NO: 471479 - DNA, 17 bp, Homo sapiens
ggataggagcttccaga

SEQ ID NO: 471480 - DNA, 15 bp, Homo sapiens
ggatatgaaagagaa

SEQ ID NO: 471481 - DNA, 23 bp, Homo sapiens
ggatcatggtttttgctctactt

SEQ ID NO: 471482 - DNA, 11 bp, Homo sapiens
ggatccagaga

SEQ ID NO: 471483 - DNA, 12 bp, Homo sapiens
ggatccagagag

SEQ ID NO: 471484 - DNA, 22 bp, Homo sapiens
ggatctggagtctgaaggagag

SEQ ID NO: 471485 - DNA, 16 bp, Homo sapiens
ggatggagaggcggcc

SEQ ID NO: 471486 - DNA, 17 bp, Homo sapiens
ggatggagaggcggcct

SEQ ID NO: 471487 - DNA, 15 bp, Homo sapiens
ggatgggaccaggga

SEQ ID NO: 471488 - DNA, 13 bp, Homo sapiens
ggattcaaatgca

SEQ ID NO: 471489 - DNA, 14 bp, Homo sapiens
ggattcaaatgcat

SEQ ID NO: 471490 - DNA, 12 bp, Homo sapiens
ggattcaggaat

SEQ ID NO: 471491 - DNA, 18 bp, Homo sapiens
ggattggtaccagagcct

SEQ ID NO: 471492 - DNA, 18 bp, Homo sapiens
ggcaagagctcaggagaa

SEQ ID NO: 471493 - DNA, 22 bp, Homo sapiens
ggcaagagctcaggagaaggcc

SEQ ID NO: 471494 - DNA, 13 bp, Homo sapiens
ggcaagtgattga

SEQ ID NO: 471495 - DNA, 18 bp, Homo sapiens
ggcacacagcagcccccc

SEQ ID NO: 471496 - DNA, 13 bp, Homo sapiens
ggcaccgcccacc

SEQ ID NO: 471497 - DNA, 16 bp, Homo sapiens
ggcaccgcccacccac

SEQ ID NO: 471498 - DNA, 23 bp, Homo sapiens
ggcacctcaacatttcagtgttt

SEQ ID NO: 471499 - DNA, 13 bp, Homo sapiens
ggcacgggagagc

SEQ ID NO: 471500 - DNA, 23 bp, Homo sapiens
ggcacgggagagcgccacccgcc

SEQ ID NO: 471501 - DNA, 22 bp, Homo sapiens
ggcactcccaggcccctgcccc

SEQ ID NO: 471502 - DNA, 15 bp, Homo sapiens
ggcagaatggtgggc

SEQ ID NO: 471503 - DNA, 16 bp, Homo sapiens
ggcagaatggtgggct

SEQ ID NO: 471504 - DNA, 19 bp, Homo sapiens
ggcagagattgggggggct

SEQ ID NO: 471505 - DNA, 16 bp, Homo sapiens
ggcagaggcagggccc

SEQ ID NO: 471506 - DNA, 15 bp, Homo sapiens
ggcagcccctcccca

SEQ ID NO: 471507 - DNA, 17 bp, Homo sapiens
ggcagcgcctcccgccg

SEQ ID NO: 471508 - DNA, 13 bp, Homo sapiens
ggcagcttcaaaa

SEQ ID NO: 471509 - DNA, 12 bp, Homo sapiens
ggcaggagctgc

SEQ ID NO: 471510 - DNA, 13 bp, Homo sapiens
ggcagggttctag

SEQ ID NO: 471511 - DNA, 18 bp, Homo sapiens
ggcagggttctagaaggg

SEQ ID NO: 471512 - DNA, 21 bp, Homo sapiens
ggccaagccagggttccagac

SEQ ID NO: 471513 - DNA, 12 bp, Homo sapiens
ggccaaggacac

SEQ ID NO: 471514 - DNA, 20 bp, Homo sapiens
ggccaaggacactgatgggt

SEQ ID NO: 471515 - DNA, 13 bp, Homo sapiens
ggccacccttggc

SEQ ID NO: 471516 - DNA, 17 bp, Homo sapiens
ggccactccagacccct

SEQ ID NO: 471517 - DNA, 21 bp, Homo sapiens
ggccagagggactttgcctgc

SEQ ID NO: 471518 - DNA, 13 bp, Homo sapiens
ggccagggacccc

SEQ ID NO: 471519 - DNA, 18 bp, Homo sapiens
ggccagggacccccgagg

SEQ ID NO: 471520 - DNA, 23 bp, Homo sapiens
ggccagggacccccgaggccccc

SEQ ID NO: 471521 - DNA, 17 bp, Homo sapiens
ggccatccctgggcccc

SEQ ID NO: 471522 - DNA, 14 bp, Homo sapiens
ggcccacgcagagc

SEQ ID NO: 471523 - DNA, 23 bp, Homo sapiens
ggcccacgcagagccccggagca

SEQ ID NO: 471524 - DNA, 16 bp, Homo sapiens
ggcccatggccccagc

SEQ ID NO: 471525 - DNA, 13 bp, Homo sapiens
ggccccagctggc

SEQ ID NO: 471526 - DNA, 18 bp, Homo sapiens
ggcccccggaggcgccca

SEQ ID NO: 471527 - DNA, 21 bp, Homo sapiens
ggcccccggaggcgcccacct

SEQ ID NO: 471528 - DNA, 14 bp, Homo sapiens
ggccccgcgcgtgc

SEQ ID NO: 471529 - DNA, 13 bp, Homo sapiens
ggcccctccacgc

SEQ ID NO: 471530 - DNA, 20 bp, Homo sapiens
ggcccctccttctcccctcc

SEQ ID NO: 471531 - DNA, 14 bp, Homo sapiens
ggcccgccaccttg

SEQ ID NO: 471532 - DNA, 22 bp, Homo sapiens
ggcccggcccacgcagagcccc

SEQ ID NO: 471533 - DNA, 14 bp, Homo sapiens
ggcccgtgcgcagc

SEQ ID NO: 471534 - DNA, 15 bp, Homo sapiens
ggcccgtgcgcagcc

SEQ ID NO: 471535 - DNA, 18 bp, Homo sapiens
gctctctattctggaaga

SEQ ID NO: 471536 - DNA, 12 bp, Homo sapiens
gctctgcccctc

SEQ ID NO: 471537 - DNA, 16 bp, Homo sapiens
gctctgcccctccgtc

SEQ ID NO: 471538 - DNA, 23 bp, Homo sapiens
gctctgcccctccgtccccaggg

SEQ ID NO: 471539 - DNA, 23 bp, Homo sapiens
gctctggggggttgcctcgagtc

SEQ ID NO: 471540 - DNA, 21 bp, Homo sapiens
gctcttctcctttcacaacct

SEQ ID NO: 471541 - DNA, 16 bp, Homo sapiens
gctgaaagacagtaaa

SEQ ID NO: 471542 - DNA, 14 bp, Homo sapiens
gctgaagtctcccc

SEQ ID NO: 471543 - DNA, 13 bp, Homo sapiens
gctgacagcctcc

SEQ ID NO: 471544 - DNA, 13 bp, Homo sapiens
gctgagcccctcc

SEQ ID NO: 471545 - DNA, 19 bp, Homo sapiens
gctgagcccctcctctcct

SEQ ID NO: 471546 - DNA, 19 bp, Homo sapiens
gctgaggacggggcagagc

SEQ ID NO: 471547 - DNA, 16 bp, Homo sapiens
gctgagtcggctgggc

SEQ ID NO: 471548 - DNA, 18 bp, Homo sapiens
gctgagtcggctgggcag

SEQ ID NO: 471549 - DNA, 22 bp, Homo sapiens
gctgagtcggctgggcagggcc

SEQ ID NO: 471550 - DNA, 12 bp, Homo sapiens
gctgcaccaacc

SEQ ID NO: 471551 - DNA, 20 bp, Homo sapiens
gctgcccacgctcctgccct

SEQ ID NO: 471552 - DNA, 17 bp, Homo sapiens
gctgccctggtgctgcc

SEQ ID NO: 471553 - DNA, 17 bp, Homo sapiens
gctgccgctgcaccacg

SEQ ID NO: 471554 - DNA, 17 bp, Homo sapiens
gctgccgctgccgctgc

SEQ ID NO: 471555 - DNA, 19 bp, Homo sapiens
gctgcctctgaaaatattt

SEQ ID NO: 471556 - DNA, 16 bp, Homo sapiens
gctgcctggcgggcag

SEQ ID NO: 471557 - DNA, 17 bp, Homo sapiens
gctgcctggcgggcagc

SEQ ID NO: 471558 - DNA, 23 bp, Homo sapiens
gctgcctggcgggcagcccctgc

SEQ ID NO: 471559 - DNA, 20 bp, Homo sapiens
gctgccttagaacctttctt

SEQ ID NO: 471560 - DNA, 18 bp, Homo sapiens
gctgcgcctgcccgcccg

SEQ ID NO: 471561 - DNA, 13 bp, Homo sapiens
gctgctcctttgg

SEQ ID NO: 471562 - DNA, 21 bp, Homo sapiens
gctgctcgggaaggcctgagg

SEQ ID NO: 471563 - DNA, 23 bp, Homo sapiens
gctgctctattgtagcatttctt

SEQ ID NO: 471564 - DNA, 23 bp, Homo sapiens
gctgctctccttcactctgacag

SEQ ID NO: 471565 - DNA, 14 bp, Homo sapiens
gctgctgtgaattt

SEQ ID NO: 471566 - DNA, 17 bp, Homo sapiens
gctggcaaactgtgaat

SEQ ID NO: 471567 - DNA, 12 bp, Homo sapiens
gctggccagcac

SEQ ID NO: 471568 - DNA, 14 bp, Homo sapiens
gctggccctgccct

SEQ ID NO: 471569 - DNA, 20 bp, Homo sapiens
gctggccctgccctccccca

SEQ ID NO: 471570 - DNA, 21 bp, Homo sapiens
gctggccctgccctcccccac

SEQ ID NO: 471571 - DNA, 11 bp, Homo sapiens
gctggctgcct

SEQ ID NO: 471572 - DNA, 20 bp, Homo sapiens
gctggctgccttagaacctt

SEQ ID NO: 471573 - DNA, 21 bp, Homo sapiens
gctggctgggtcgcccctcct

SEQ ID NO: 471574 - DNA, 18 bp, Homo sapiens
gctgggcagggccgcagg

SEQ ID NO: 471575 - DNA, 14 bp, Homo sapiens
gctgggcccagccg

SEQ ID NO: 471576 - DNA, 23 bp, Homo sapiens
gctgggcccctgggatgggacca

SEQ ID NO: 471577 - DNA, 16 bp, Homo sapiens
gctggggcctggccta

SEQ ID NO: 471578 - DNA, 18 bp, Homo sapiens
gctgggtcgcccctcctc

SEQ ID NO: 471579 - DNA, 16 bp, Homo sapiens
gctgtattttctttta

SEQ ID NO: 471580 - DNA, 23 bp, Homo sapiens
gctgtattttcttttatatctgt

SEQ ID NO: 471581 - DNA, 17 bp, Homo sapiens
gctgtcctctcgagccc

SEQ ID NO: 471582 - DNA, 16 bp, Homo sapiens
gctgtcgccccaggcc

SEQ ID NO: 471583 - DNA, 20 bp, Homo sapiens
gctgtcgccccaggccctcc

SEQ ID NO: 471584 - DNA, 16 bp, Homo sapiens
gctgtctgtcaccagc

SEQ ID NO: 471585 - DNA, 21 bp, Homo sapiens
gctgtctgtcaccagctatct

SEQ ID NO: 471586 - DNA, 15 bp, Homo sapiens
gctgtggcccctcct

SEQ ID NO: 471587 - DNA, 13 bp, Homo sapiens
gctgtgggcagca

SEQ ID NO: 471588 - DNA, 10 bp, Homo sapiens
gccctccctc

SEQ ID NO: 471589 - DNA, 23 bp, Homo sapiens
gccctccctcggccccacccacc

SEQ ID NO: 471590 - DNA, 17 bp, Homo sapiens
gccctccctgactccct

SEQ ID NO: 471591 - DNA, 22 bp, Homo sapiens
gccctccctgactccctgtggg

SEQ ID NO: 471592 - DNA, 12 bp, Homo sapiens
gccctcctctgc

SEQ ID NO: 471593 - DNA, 21 bp, Homo sapiens
gccctcctctgccccctcccc

SEQ ID NO: 471594 - DNA, 23 bp, Homo sapiens
gccctcctctgccccctcccccg

SEQ ID NO: 471595 - DNA, 14 bp, Homo sapiens
gccctctccaccca

SEQ ID NO: 471596 - DNA, 16 bp, Homo sapiens
gccctctttctctctg

SEQ ID NO: 471597 - DNA, 18 bp, Homo sapiens
gccctctttctctctgtg

SEQ ID NO: 471598 - DNA, 21 bp, Homo sapiens
gccctctttctctctgtgtgg

SEQ ID NO: 471599 - DNA, 11 bp, Homo sapiens
gccctgagact

SEQ ID NO: 471600 - DNA, 14 bp, Homo sapiens
gccctgagactccc

SEQ ID NO: 471601 - DNA, 13 bp, Homo sapiens
gccctgccctcac

SEQ ID NO: 471602 - DNA, 17 bp, Homo sapiens
gccctgccctcactcca

SEQ ID NO: 471603 - DNA, 18 bp, Homo sapiens
gccctgccctcactccac

SEQ ID NO: 471604 - DNA, 14 bp, Homo sapiens
gccctgccctcccc

SEQ ID NO: 471605 - DNA, 19 bp, Homo sapiens
gccctgctttgggctgccc

SEQ ID NO: 471606 - DNA, 12 bp, Homo sapiens
gccctgggcctc

SEQ ID NO: 471607 - DNA, 13 bp, Homo sapiens
gccctgggcctca

SEQ ID NO: 471608 - DNA, 14 bp, Homo sapiens
gccctgggcctcag

SEQ ID NO: 471609 - DNA, 20 bp, Homo sapiens
gccctgggctgtctgtcacc

SEQ ID NO: 471610 - DNA, 21 bp, Homo sapiens
gccctgggctgtctgtcacca

SEQ ID NO: 471611 - DNA, 22 bp, Homo sapiens
gccctgggctgtctgtcaccag

SEQ ID NO: 471612 - DNA, 23 bp, Homo sapiens
gccctgggctgtctgtcaccagc

SEQ ID NO: 471613 - DNA, 15 bp, Homo sapiens
gccctggtgctgcca

SEQ ID NO: 471614 - DNA, 11 bp, Homo sapiens
gccctgtggga

SEQ ID NO: 471615 - DNA, 16 bp, Homo sapiens
gccctgtgggagtcca

SEQ ID NO: 471616 - DNA, 18 bp, Homo sapiens
gcccttcctctccactgc

SEQ ID NO: 471617 - DNA, 21 bp, Homo sapiens
gcccttcctctccactgcctt

SEQ ID NO: 471618 - DNA, 18 bp, Homo sapiens
gccgcagggcgctccggc

SEQ ID NO: 471619 - DNA, 19 bp, Homo sapiens
gccgcagggcgctccggca

SEQ ID NO: 471620 - DNA, 12 bp, Homo sapiens
gccgccctgggc

SEQ ID NO: 471621 - DNA, 13 bp, Homo sapiens
gccgcctcctcca

SEQ ID NO: 471622 - DNA, 20 bp, Homo sapiens
gccgcctcgggccgcctcct

SEQ ID NO: 471623 - DNA, 24 bp, Homo sapiens
gccgcctcgggccgcctcctccag

SEQ ID NO: 471624 - DNA, 14 bp, Homo sapiens
gccgcgctctgccc

SEQ ID NO: 471625 - DNA, 15 bp, Homo sapiens
gccgcgctctgcccc

SEQ ID NO: 471626 - DNA, 16 bp, Homo sapiens
gccgctgccgctgcac

SEQ ID NO: 471627 - DNA, 12 bp, Homo sapiens
gccggctggccg

SEQ ID NO: 471628 - DNA, 14 bp, Homo sapiens
gccgggcaggtcct

SEQ ID NO: 471629 - DNA, 17 bp, Homo sapiens
gccgggcaggtcctgcc

SEQ ID NO: 471630 - DNA, 18 bp, Homo sapiens
gccgggcaggtcctgccc

SEQ ID NO: 471631 - DNA, 17 bp, Homo sapiens
gccggggactggccact

SEQ ID NO: 471632 - DNA, 15 bp, Homo sapiens
gccggggctggccct

SEQ ID NO: 471633 - DNA, 22 bp, Homo sapiens
gccggggtggggtgcctgagcc

SEQ ID NO: 471634 - DNA, 23 bp, Homo sapiens
gccggggtggggtgcctgagccc

SEQ ID NO: 471635 - DNA, 19 bp, Homo sapiens
gccggttggccggctggcc

SEQ ID NO: 471636 - DNA, 17 bp, Homo sapiens
gccgtccctgacttccc

SEQ ID NO: 471637 - DNA, 19 bp, Homo sapiens
gccgtccctgacttcccag

SEQ ID NO: 471638 - DNA, 14 bp, Homo sapiens
gccgtgccttcagc

SEQ ID NO: 471639 - DNA, 19 bp, Homo sapiens
gccgtgccttcagctctac

SEQ ID NO: 471640 - DNA, 22 bp, Homo sapiens
gccgtggcttcccgctcagccc

SEQ ID NO: 471641 - DNA, 22 bp, Homo sapiens
gccgttagggaaatccaactcc

SEQ ID NO: 471642 - DNA, 15 bp, Homo sapiens
gcctatggaaagggt

SEQ ID NO: 471643 - DNA, 15 bp, Homo sapiens
gcctatttaagcccc

SEQ ID NO: 471644 - DNA, 13 bp, Homo sapiens
gcctcagccctca

SEQ ID NO: 471645 - DNA, 15 bp, Homo sapiens
gcctcagccctcaga

SEQ ID NO: 471646 - DNA, 21 bp, Homo sapiens
gcctccaggcccccaactccg

SEQ ID NO: 471647 - DNA, 13 bp, Homo sapiens
gcctccaggctgg

SEQ ID NO: 471648 - DNA, 14 bp, Homo sapiens
gcctccaggctggg

SEQ ID NO: 471649 - DNA, 16 bp, Homo sapiens
gcctccaggctggggc

SEQ ID NO: 471650 - DNA, 17 bp, Homo sapiens
gcctccaggctggggcc

SEQ ID NO: 471651 - DNA, 13 bp, Homo sapiens
gcctcccccaggc

SEQ ID NO: 471652 - DNA, 21 bp, Homo sapiens
gcctcccgtccgtccgcccgc

SEQ ID NO: 471653 - DNA, 14 bp, Homo sapiens
gcctcctaggctcc

SEQ ID NO: 471654 - DNA, 17 bp, Homo sapiens
gcctcctaggctccctg

SEQ ID NO: 471655 - DNA, 20 bp, Homo sapiens
gcctcctaggctccctgagg

SEQ ID NO: 471656 - DNA, 13 bp, Homo sapiens
gcctcctccagac

SEQ ID NO: 471657 - DNA, 15 bp, Homo sapiens
gcctcctccagactc

SEQ ID NO: 471658 - DNA, 16 bp, Homo sapiens
gcctcctggccagacg

SEQ ID NO: 471659 - DNA, 21 bp, Homo sapiens
gcctcgagtccccccacccct

SEQ ID NO: 471660 - DNA, 14 bp, Homo sapiens
gcctcgggccgcct

SEQ ID NO: 471661 - DNA, 21 bp, Homo sapiens
gcctcgggccgcctcctccag

SEQ ID NO: 471662 - DNA, 18 bp, Homo sapiens
gcctctccccgctctgga

SEQ ID NO: 471663 - DNA, 13 bp, Homo sapiens
gcctctgaaaata

SEQ ID NO: 471664 - DNA, 15 bp, Homo sapiens
gcctctgaaaatatt

SEQ ID NO: 471665 - DNA, 21 bp, Homo sapiens
gcctgagccacagtggggccc

SEQ ID NO: 471666 - DNA, 16 bp, Homo sapiens
gcctgagctccaccct

SEQ ID NO: 471667 - DNA, 20 bp, Homo sapiens
gcctgagctccaccctcccc

SEQ ID NO: 471668 - DNA, 21 bp, Homo sapiens
gcctgagctccaccctcccct

SEQ ID NO: 471669 - DNA, 22 bp, Homo sapiens
gcctgagctccaccctcccctc

SEQ ID NO: 471670 - DNA, 23 bp, Homo sapiens
gcctgagctccaccctcccctct

SEQ ID NO: 471671 - DNA, 13 bp, Homo sapiens
gcctgagggaagc

SEQ ID NO: 471672 - DNA, 16 bp, Homo sapiens
gcctgagggaagccca

SEQ ID NO: 471673 - DNA, 21 bp, Homo sapiens
gcctgagggaagcccacccgc

SEQ ID NO: 471674 - DNA, 15 bp, Homo sapiens
gcctgcaccaggaga

SEQ ID NO: 471675 - DNA, 12 bp, Homo sapiens
gcctgcagccca

SEQ ID NO: 471676 - DNA, 16 bp, Homo sapiens
gcctgcccgcccgccg

SEQ ID NO: 471677 - DNA, 14 bp, Homo sapiens
gcctgcgctcctct

SEQ ID NO: 471678 - DNA, 19 bp, Homo sapiens
gcctgcgctcctctgcagc

SEQ ID NO: 471679 - DNA, 20 bp, Homo sapiens
gcctgcgctcctctgcagcc

SEQ ID NO: 471680 - DNA, 23 bp, Homo sapiens
gcctgcgctcctctgcagcctga

SEQ ID NO: 471681 - DNA, 13 bp, Homo sapiens
gcctggcacaggg

SEQ ID NO: 471682 - DNA, 19 bp, Homo sapiens
gcctggcacagggcagtgg

SEQ ID NO: 471683 - DNA, 11 bp, Homo sapiens
gcctggcctat

SEQ ID NO: 471684 - DNA, 14 bp, Homo sapiens
gcctggcgggcagc

SEQ ID NO: 471685 - DNA, 15 bp, Homo sapiens
gcctggcgggcagcc

SEQ ID NO: 471686 - DNA, 18 bp, Homo sapiens
gccacccttggcctgtcc

SEQ ID NO: 471687 - DNA, 22 bp, Homo sapiens
gccacgctgtcctctcgagccc

SEQ ID NO: 471688 - DNA, 17 bp, Homo sapiens
gccacgttgcagaaaaa

SEQ ID NO: 471689 - DNA, 18 bp, Homo sapiens
gccactccagacccctgg

SEQ ID NO: 471690 - DNA, 15 bp, Homo sapiens
gccagagggactttg

SEQ ID NO: 471691 - DNA, 13 bp, Homo sapiens
gccagcaccctct

SEQ ID NO: 471692 - DNA, 14 bp, Homo sapiens
gccagcaccctctc

SEQ ID NO: 471693 - DNA, 15 bp, Homo sapiens
gccagcaccctctcc

SEQ ID NO: 471694 - DNA, 16 bp, Homo sapiens
gccagcaccctctcct

SEQ ID NO: 471695 - DNA, 20 bp, Homo sapiens
gccagcaccctctcctgggg

SEQ ID NO: 471696 - DNA, 17 bp, Homo sapiens
gccagccgccctgggct

SEQ ID NO: 471697 - DNA, 13 bp, Homo sapiens
gccagggaccccc

SEQ ID NO: 471698 - DNA, 15 bp, Homo sapiens
gccagggacccccga

SEQ ID NO: 471699 - DNA, 22 bp, Homo sapiens
gccagggttccagacagggtgg

SEQ ID NO: 471700 - DNA, 20 bp, Homo sapiens
gccatccctgggcccctcca

SEQ ID NO: 471701 - DNA, 22 bp, Homo sapiens
gccatgatctgtatttaatggt

SEQ ID NO: 471702 - DNA, 22 bp, Homo sapiens
gccattagactgaatttaacta

SEQ ID NO: 471703 - DNA, 14 bp, Homo sapiens
gcccaacccccacc

SEQ ID NO: 471704 - DNA, 15 bp, Homo sapiens
gcccaacccccacct

SEQ ID NO: 471705 - DNA, 22 bp, Homo sapiens
gcccaagaatagatgctgactg

SEQ ID NO: 471706 - DNA, 17 bp, Homo sapiens
gcccaccccgctgcctg

SEQ ID NO: 471707 - DNA, 22 bp, Homo sapiens
gcccacccctcttcccccttcc

SEQ ID NO: 471708 - DNA, 14 bp, Homo sapiens
gcccacccgcccca

SEQ ID NO: 471709 - DNA, 19 bp, Homo sapiens
gcccacccgccccagagac

SEQ ID NO: 471710 - DNA, 20 bp, Homo sapiens
gcccacccgccccagagact

SEQ ID NO: 471711 - DNA, 13 bp, Homo sapiens
gcccaccctgggc

SEQ ID NO: 471712 - DNA, 20 bp, Homo sapiens
gcccaccctgggcctcccgt

SEQ ID NO: 471713 - DNA, 12 bp, Homo sapiens
gcccacctgccc

SEQ ID NO: 471714 - DNA, 18 bp, Homo sapiens
gcccagaacgggcctccc

SEQ ID NO: 471715 - DNA, 22 bp, Homo sapiens
gcccagaacgggcctccccggg

SEQ ID NO: 471716 - DNA, 16 bp, Homo sapiens
gcccagccggggtggg

SEQ ID NO: 471717 - DNA, 18 bp, Homo sapiens
gcccagtctttggagagc

SEQ ID NO: 471718 - DNA, 15 bp, Homo sapiens
gcccagttagcccgg

SEQ ID NO: 471719 - DNA, 17 bp, Homo sapiens
gcccagttagcccggcc

SEQ ID NO: 471720 - DNA, 14 bp, Homo sapiens
gcccatgtgtcccc

SEQ ID NO: 471721 - DNA, 23 bp, Homo sapiens
gcccatgtgtcccctcactctgt

SEQ ID NO: 471722 - DNA, 16 bp, Homo sapiens
gccccagagactgccc

SEQ ID NO: 471723 - DNA, 18 bp, Homo sapiens
gccccagagactgcccac

SEQ ID NO: 471724 - DNA, 21 bp, Homo sapiens
gccccagagactgcccaccct

SEQ ID NO: 471725 - DNA, 22 bp, Homo sapiens
gccccagagactgcccaccctg

SEQ ID NO: 471726 - DNA, 23 bp, Homo sapiens
gccccagagactgcccaccctgg

SEQ ID NO: 471727 - DNA, 13 bp, Homo sapiens
gccccagctggct

SEQ ID NO: 471728 - DNA, 17 bp, Homo sapiens
gccccagctggctgggt

SEQ ID NO: 471729 - DNA, 18 bp, Homo sapiens
gccccagctggctgggtc

SEQ ID NO: 471730 - DNA, 11 bp, Homo sapiens
gccccaggccc

SEQ ID NO: 471731 - DNA, 20 bp, Homo sapiens
gccccaggccctccctgact

SEQ ID NO: 471732 - DNA, 17 bp, Homo sapiens
gccccaggcggaggggc

SEQ ID NO: 471733 - DNA, 19 bp, Homo sapiens
gccccaggcggaggggctt

SEQ ID NO: 471734 - DNA, 11 bp, Homo sapiens
gccccatcctt

SEQ ID NO: 471735 - DNA, 13 bp, Homo sapiens
gccccatccttcc

SEQ ID NO: 471736 - DNA, 20 bp, Homo sapiens
gcccccaactccgcccagcc

SEQ ID NO: 471737 - DNA, 17 bp, Homo sapiens
gccccccactcagtagg

SEQ ID NO: 471738 - DNA, 12 bp, Homo sapiens
gccccccagcac

SEQ ID NO: 471739 - DNA, 15 bp, Homo sapiens
gccccccttcccacc

SEQ ID NO: 471740 - DNA, 21 bp, Homo sapiens
gcccccggaggcgcccacctg

SEQ ID NO: 471741 - DNA, 12 bp, Homo sapiens
gccccctccccc

SEQ ID NO: 471742 - DNA, 13 bp, Homo sapiens
gccccctcccccg

SEQ ID NO: 471743 - DNA, 11 bp, Homo sapiens
gccccctctct

SEQ ID NO: 471744 - DNA, 21 bp, Homo sapiens
gccccctctcttaccccgtcc

SEQ ID NO: 471745 - DNA, 17 bp, Homo sapiens
gccccgcgcgtgccccc

SEQ ID NO: 471746 - DNA, 19 bp, Homo sapiens
gccccgcgcgtgcccccag

SEQ ID NO: 471747 - DNA, 20 bp, Homo sapiens
gccccgcgcgtgcccccagc

SEQ ID NO: 471748 - DNA, 13 bp, Homo sapiens
gccccggagcacc

SEQ ID NO: 471749 - DNA, 14 bp, Homo sapiens
gcccctatcctgca

SEQ ID NO: 471750 - DNA, 15 bp, Homo sapiens
gcccctatcctgcac

SEQ ID NO: 471751 - DNA, 22 bp, Homo sapiens
gcccctatcctgcaccctctgc

SEQ ID NO: 471752 - DNA, 21 bp, Homo sapiens
gcccctccacgcctcctggcc

SEQ ID NO: 471753 - DNA, 12 bp, Homo sapiens
gcccctcccttc

SEQ ID NO: 471754 - DNA, 14 bp, Homo sapiens
gcccctccgtcccc

SEQ ID NO: 471755 - DNA, 17 bp, Homo sapiens
gcccctccgtccccagg

SEQ ID NO: 471756 - DNA, 20 bp, Homo sapiens
gcccctcctcgggcgcctgc

SEQ ID NO: 471757 - DNA, 21 bp, Homo sapiens
gcccctcctcgggcgcctgcg

SEQ ID NO: 471758 - DNA, 17 bp, Homo sapiens
gcccctccttctcccct

SEQ ID NO: 471759 - DNA, 19 bp, Homo sapiens
gcccctccttctcccctcc

SEQ ID NO: 471760 - DNA, 14 bp, Homo sapiens
gcactcccagggcc

SEQ ID NO: 471761 - DNA, 21 bp, Homo sapiens
gcactcccagggcccgagcgc

SEQ ID NO: 471762 - DNA, 19 bp, Homo sapiens
gcactggtggcccgacagc

SEQ ID NO: 471763 - DNA, 15 bp, Homo sapiens
gcactggtttgtttc

SEQ ID NO: 471764 - DNA, 23 bp, Homo sapiens
gcacttattatgaggctattaaa

SEQ ID NO: 471765 - DNA, 19 bp, Homo sapiens
gcagaaatgtggatgctct

SEQ ID NO: 471766 - DNA, 20 bp, Homo sapiens
gcagaaatgtggatgctctt

SEQ ID NO: 471767 - DNA, 14 bp, Homo sapiens
gcagagacggcagc

SEQ ID NO: 471768 - DNA, 15 bp, Homo sapiens
gcagagacggcagcc

SEQ ID NO: 471769 - DNA, 22 bp, Homo sapiens
gcagagattgggggggcttggg

SEQ ID NO: 471770 - DNA, 17 bp, Homo sapiens
gcagagccccggagcac

SEQ ID NO: 471771 - DNA, 18 bp, Homo sapiens
gcagagccccggagcacc

SEQ ID NO: 471772 - DNA, 13 bp, Homo sapiens
gcagagctgagtc

SEQ ID NO: 471773 - DNA, 11 bp, Homo sapiens
gcagaggcagg

SEQ ID NO: 471774 - DNA, 12 bp, Homo sapiens
gcagaggcaggg

SEQ ID NO: 471775 - DNA, 17 bp, Homo sapiens
gcagaggcagggccctg

SEQ ID NO: 471776 - DNA, 12 bp, Homo sapiens
gcagattccaca

SEQ ID NO: 471777 - DNA, 13 bp, Homo sapiens
gcagcaccagcct

SEQ ID NO: 471778 - DNA, 15 bp, Homo sapiens
gcagcaccagcctga

SEQ ID NO: 471779 - DNA, 18 bp, Homo sapiens
gcagcaccagcctgagcc

SEQ ID NO: 471780 - DNA, 19 bp, Homo sapiens
gcagcaccagcctgagcca

SEQ ID NO: 471781 - DNA, 12 bp, Homo sapiens
gcagcaccctcc

SEQ ID NO: 471782 - DNA, 13 bp, Homo sapiens
gcagcaccctccc

SEQ ID NO: 471783 - DNA, 19 bp, Homo sapiens
gcagcaccctcccccgcag

SEQ ID NO: 471784 - DNA, 16 bp, Homo sapiens
gcagcagtaccatccc

SEQ ID NO: 471785 - DNA, 17 bp, Homo sapiens
gcagcagtaccatccca

SEQ ID NO: 471786 - DNA, 19 bp, Homo sapiens
gcagcccagaacgggcctc

SEQ ID NO: 471787 - DNA, 21 bp, Homo sapiens
gcagcccagaacgggcctccc

SEQ ID NO: 471788 - DNA, 17 bp, Homo sapiens
gcagccccatccttccc

SEQ ID NO: 471789 - DNA, 13 bp, Homo sapiens
gcagccccccaga

SEQ ID NO: 471790 - DNA, 15 bp, Homo sapiens
gcagccccccagcac

SEQ ID NO: 471791 - DNA, 12 bp, Homo sapiens
gcagcccctccc

SEQ ID NO: 471792 - DNA, 14 bp, Homo sapiens
gcagcccctcccca

SEQ ID NO: 471793 - DNA, 12 bp, Homo sapiens
gcagccctctcc

SEQ ID NO: 471794 - DNA, 13 bp, Homo sapiens
gcagccctctcca

SEQ ID NO: 471795 - DNA, 16 bp, Homo sapiens
gcagccctctccaccc

SEQ ID NO: 471796 - DNA, 16 bp, Homo sapiens
gcagccgcgctctgcc

SEQ ID NO: 471797 - DNA, 17 bp, Homo sapiens
gcagccgcgctctgccc

SEQ ID NO: 471798 - DNA, 19 bp, Homo sapiens
gcagccgcgctctgcccct

SEQ ID NO: 471799 - DNA, 14 bp, Homo sapiens
gcagccgtgccttc

SEQ ID NO: 471800 - DNA, 15 bp, Homo sapiens
gcagcctgagctcca

SEQ ID NO: 471801 - DNA, 18 bp, Homo sapiens
gcagcctgagctccaccc

SEQ ID NO: 471802 - DNA, 20 bp, Homo sapiens
gcagcctgagctccaccctc

SEQ ID NO: 471803 - DNA, 19 bp, Homo sapiens
gcagctatgcgcaatgtgg

SEQ ID NO: 471804 - DNA, 21 bp, Homo sapiens
gcagctatgcgcaatgtggca

SEQ ID NO: 471805 - DNA, 12 bp, Homo sapiens
gcaggagctgct

SEQ ID NO: 471806 - DNA, 22 bp, Homo sapiens
gcaggatgggtgaaaccacatg

SEQ ID NO: 471807 - DNA, 19 bp, Homo sapiens
gcaggcacacagcagcccc

SEQ ID NO: 471808 - DNA, 21 bp, Homo sapiens
gcagggccctggggtctctga

SEQ ID NO: 471809 - DNA, 23 bp, Homo sapiens
gcagggccctggggtctctgagc

SEQ ID NO: 471810 - DNA, 21 bp, Homo sapiens
gcaggggggttgggttccaga

SEQ ID NO: 471811 - DNA, 22 bp, Homo sapiens
gcaggggggttgggttccagac

SEQ ID NO: 471812 - DNA, 14 bp, Homo sapiens
gcagggttctagaa

SEQ ID NO: 471813 - DNA, 16 bp, Homo sapiens
gcaggtcctgcccatg

SEQ ID NO: 471814 - DNA, 13 bp, Homo sapiens
gcagtagagagca

SEQ ID NO: 471815 - DNA, 18 bp, Homo sapiens
gcagtgctgggcccagcc

SEQ ID NO: 471816 - DNA, 19 bp, Homo sapiens
gcagtgctgggcccagccg

SEQ ID NO: 471817 - DNA, 12 bp, Homo sapiens
gcagtggggagc

SEQ ID NO: 471818 - DNA, 14 bp, Homo sapiens
gcagttatagaaaa

SEQ ID NO: 471819 - DNA, 12 bp, Homo sapiens
gcataacacagc

SEQ ID NO: 471820 - DNA, 17 bp, Homo sapiens
gcatacaataaaagagc

SEQ ID NO: 471821 - DNA, 21 bp, Homo sapiens
gcatacaataaaagagcttta

SEQ ID NO: 471822 - DNA, 20 bp, Homo sapiens
gcatagtgtgctcggacaca

SEQ ID NO: 471823 - DNA, 20 bp, Homo sapiens
gcatatcctggtgtctagtt

SEQ ID NO: 471824 - DNA, 19 bp, Homo sapiens
gcatcatgtctctttgcca

SEQ ID NO: 471825 - DNA, 16 bp, Homo sapiens
gcatccaaataggagt

SEQ ID NO: 471826 - DNA, 12 bp, Homo sapiens
gcatccaccgcc

SEQ ID NO: 471827 - DNA, 19 bp, Homo sapiens
gcatccaccgccaccccac

SEQ ID NO: 471828 - DNA, 22 bp, Homo sapiens
gcatcccttggcccctctctgt

SEQ ID NO: 471829 - DNA, 13 bp, Homo sapiens
gcatctcagccca

SEQ ID NO: 471830 - DNA, 16 bp, Homo sapiens
gcatgatattgtatgt

SEQ ID NO: 471831 - DNA, 16 bp, Homo sapiens
gcatgcaggctgtgtt

SEQ ID NO: 471832 - DNA, 17 bp, Homo sapiens
gcatgtagcatataaat

SEQ ID NO: 471833 - DNA, 23 bp, Homo sapiens
gcatgtccctaccgagtctcttc

SEQ ID NO: 471834 - DNA, 14 bp, Homo sapiens
gcatgtctactgct

SEQ ID NO: 471835 - DNA, 15 bp, Homo sapiens
gcattactattaact

SEQ ID NO: 471836 - DNA, 21 bp, Homo sapiens
gcattcaaaatagttctattt

SEQ ID NO: 471837 - DNA, 22 bp, Homo sapiens
gcattttgggggtttttaatct

SEQ ID NO: 471838 - DNA, 21 bp, Homo sapiens
gccaaaaactaaaattcaaca

SEQ ID NO: 471839 - DNA, 16 bp, Homo sapiens
gccaaaatgtcaattt

SEQ ID NO: 471840 - DNA, 16 bp, Homo sapiens
gccaaacattcttatt

SEQ ID NO: 471841 - DNA, 12 bp, Homo sapiens
gccaaagaaact

SEQ ID NO: 471842 - DNA, 13 bp, Homo sapiens
gccaaagaaactc

SEQ ID NO: 471843 - DNA, 20 bp, Homo sapiens
gccaaagatagcagaagagt

SEQ ID NO: 471844 - DNA, 13 bp, Homo sapiens
gagatcagaattg

SEQ ID NO: 471845 - DNA, 14 bp, Homo sapiens
gagatcagaattga

SEQ ID NO: 471846 - DNA, 15 bp, Homo sapiens
gagatcagcattcaa

SEQ ID NO: 471847 - DNA, 15 bp, Homo sapiens
gagcaacttgagggt

SEQ ID NO: 471848 - DNA, 17 bp, Homo sapiens
gagcaaggcaagaagtg

SEQ ID NO: 471849 - DNA, 22 bp, Homo sapiens
gagcaccacggggtcgggggag

SEQ ID NO: 471850 - DNA, 21 bp, Homo sapiens
gagcaccagatgacacataaa

SEQ ID NO: 471851 - DNA, 12 bp, Homo sapiens
gagcacccccag

SEQ ID NO: 471852 - DNA, 13 bp, Homo sapiens
gagcacccccagc

SEQ ID NO: 471853 - DNA, 15 bp, Homo sapiens
gagcacccccagcct

SEQ ID NO: 471854 - DNA, 16 bp, Homo sapiens
gagcacccccagcctc

SEQ ID NO: 471855 - DNA, 18 bp, Homo sapiens
gagcacccccagcctccc

SEQ ID NO: 471856 - DNA, 19 bp, Homo sapiens
gagcacccccagcctcccc

SEQ ID NO: 471857 - DNA, 22 bp, Homo sapiens
gagcacccccagcctcccccag

SEQ ID NO: 471858 - DNA, 22 bp, Homo sapiens
gagcactagaatgagaaatcat

SEQ ID NO: 471859 - DNA, 11 bp, Homo sapiens
gagcagagacg

SEQ ID NO: 471860 - DNA, 19 bp, Homo sapiens
gagcaggactaacaactgg

SEQ ID NO: 471861 - DNA, 19 bp, Homo sapiens
gagccacagtggggcccat

SEQ ID NO: 471862 - DNA, 23 bp, Homo sapiens
gagccacagtggggcccatggcc

SEQ ID NO: 471863 - DNA, 13 bp, Homo sapiens
gagccatgctctt

SEQ ID NO: 471864 - DNA, 19 bp, Homo sapiens
gagcccagaaaaaaggact

SEQ ID NO: 471865 - DNA, 12 bp, Homo sapiens
gagccccccact

SEQ ID NO: 471866 - DNA, 13 bp, Homo sapiens
gagccccggagca

SEQ ID NO: 471867 - DNA, 14 bp, Homo sapiens
gagccccggagcac

SEQ ID NO: 471868 - DNA, 13 bp, Homo sapiens
gagcccctcctct

SEQ ID NO: 471869 - DNA, 17 bp, Homo sapiens
gagcccctcctctcctc

SEQ ID NO: 471870 - DNA, 13 bp, Homo sapiens
gagccctgagccc

SEQ ID NO: 471871 - DNA, 12 bp, Homo sapiens
gagccctgccct

SEQ ID NO: 471872 - DNA, 13 bp, Homo sapiens
gagccctgccctc

SEQ ID NO: 471873 - DNA, 19 bp, Homo sapiens
gagccctgccctcactcca

SEQ ID NO: 471874 - DNA, 13 bp, Homo sapiens
gagcctccccctc

SEQ ID NO: 471875 - DNA, 17 bp, Homo sapiens
gagcctccccctcagat

SEQ ID NO: 471876 - DNA, 16 bp, Homo sapiens
gagcctgtctctccct

SEQ ID NO: 471877 - DNA, 18 bp, Homo sapiens
gagcctttggtgaataac

SEQ ID NO: 471878 - DNA, 13 bp, Homo sapiens
gagcgccacccgc

SEQ ID NO: 471879 - DNA, 14 bp, Homo sapiens
gagcggctgaggac

SEQ ID NO: 471880 - DNA, 19 bp, Homo sapiens
gagcgggggctaactggcc

SEQ ID NO: 471881 - DNA, 22 bp, Homo sapiens
gagcgggggctaactggcccca

SEQ ID NO: 471882 - DNA, 17 bp, Homo sapiens
gagctcaatctctgcag

SEQ ID NO: 471883 - DNA, 22 bp, Homo sapiens
gagctccaccctcccctcttct

SEQ ID NO: 471884 - DNA, 17 bp, Homo sapiens
gagctgagtcggctggg

SEQ ID NO: 471885 - DNA, 18 bp, Homo sapiens
gagctgagtcggctgggc

SEQ ID NO: 471886 - DNA, 20 bp, Homo sapiens
gagctgagtcggctgggcag

SEQ ID NO: 471887 - DNA, 14 bp, Homo sapiens
gagctgcagccccc

SEQ ID NO: 471888 - DNA, 16 bp, Homo sapiens
gagctgcagcccccca

SEQ ID NO: 471889 - DNA, 22 bp, Homo sapiens
gagcttcccctaacctgggttg

SEQ ID NO: 471890 - DNA, 19 bp, Homo sapiens
gagcttctcctctgctcca

SEQ ID NO: 471891 - DNA, 22 bp, Homo sapiens
gagcttcttatattaaagaagt

SEQ ID NO: 471892 - DNA, 23 bp, Homo sapiens
gaggaaaaccaagccgtggcttc

SEQ ID NO: 471893 - DNA, 14 bp, Homo sapiens
gaggacagggaggg

SEQ ID NO: 471894 - DNA, 18 bp, Homo sapiens
gaggacggggcagagctg

SEQ ID NO: 471895 - DNA, 16 bp, Homo sapiens
gaggagcacccccagc

SEQ ID NO: 471896 - DNA, 18 bp, Homo sapiens
gaggagcacccccagcct

SEQ ID NO: 471897 - DNA, 19 bp, Homo sapiens
gaggagcacccccagcctc

SEQ ID NO: 471898 - DNA, 20 bp, Homo sapiens
gaggaggtgtggagtggagg

SEQ ID NO: 471899 - DNA, 17 bp, Homo sapiens
gaggatgaacatctttt

SEQ ID NO: 471900 - DNA, 11 bp, Homo sapiens
gaggcccccct

SEQ ID NO: 471901 - DNA, 16 bp, Homo sapiens
gaggcccccctctgcc

SEQ ID NO: 471902 - DNA, 14 bp, Homo sapiens
gaggccgctctggg

SEQ ID NO: 471903 - DNA, 12 bp, Homo sapiens
gaggcctggtct

SEQ ID NO: 471904 - DNA, 19 bp, Homo sapiens
gaggcctggtctggagccc

SEQ ID NO: 471905 - DNA, 15 bp, Homo sapiens
gaggcgcccacctgc

SEQ ID NO: 471906 - DNA, 20 bp, Homo sapiens
gaggcgtatgtggcaaaatg

SEQ ID NO: 471907 - DNA, 22 bp, Homo sapiens
gaggcgtgggatccagagagaa

SEQ ID NO: 471908 - DNA, 16 bp, Homo sapiens
gaggctgggcccctgg

SEQ ID NO: 471909 - DNA, 17 bp, Homo sapiens
gaggctgggcccctggg

SEQ ID NO: 471910 - DNA, 19 bp, Homo sapiens
gaggctgggcccctgggat

SEQ ID NO: 471911 - DNA, 20 bp, Homo sapiens
gaggctttaagcgaggcaga

SEQ ID NO: 471912 - DNA, 15 bp, Homo sapiens
gagggctgacaaggc

SEQ ID NO: 471913 - DNA, 15 bp, Homo sapiens
gaggggcttggagca

SEQ ID NO: 471914 - DNA, 17 bp, Homo sapiens
gaggggcttggagcaga

SEQ ID NO: 471915 - DNA, 21 bp, Homo sapiens
gagtagataagtgctcagtat

SEQ ID NO: 471916 - DNA, 19 bp, Homo sapiens
gagtaggctgtattttctt

SEQ ID NO: 471917 - DNA, 22 bp, Homo sapiens
gagtatgttaagctctttatga

SEQ ID NO: 471918 - DNA, 14 bp, Homo sapiens
gagtccactttcct

SEQ ID NO: 471919 - DNA, 13 bp, Homo sapiens
gagtccagctccc

SEQ ID NO: 471920 - DNA, 14 bp, Homo sapiens
gagtccagctcccc

SEQ ID NO: 471921 - DNA, 15 bp, Homo sapiens
gagtccagctccccc

SEQ ID NO: 471922 - DNA, 17 bp, Homo sapiens
gagtccattgcaaaagg

SEQ ID NO: 471923 - DNA, 14 bp, Homo sapiens
gagtccccccaccc

SEQ ID NO: 471924 - DNA, 15 bp, Homo sapiens
gagtccccccacccc

SEQ ID NO: 471925 - DNA, 18 bp, Homo sapiens
gagtccccccacccctcc

SEQ ID NO: 471926 - DNA, 12 bp, Homo sapiens
gagtcggctggg

SEQ ID NO: 471927 - DNA, 16 bp, Homo sapiens
gagtcggctgggcagg

SEQ ID NO: 471928 - DNA, 18 bp, Homo sapiens
gagtcggctgggcagggc

SEQ ID NO: 471929 - DNA, 23 bp, Homo sapiens
gagtcggctgggcagggccgcag

SEQ ID NO: 471930 - DNA, 18 bp, Homo sapiens
gagtctgaaggagaggag

SEQ ID NO: 471931 - DNA, 19 bp, Homo sapiens
gagtctgaaggagaggagt

SEQ ID NO: 471932 - DNA, 17 bp, Homo sapiens
gagtctgtcctttccca

SEQ ID NO: 471933 - DNA, 19 bp, Homo sapiens
gagtggaggggtcagcagg

SEQ ID NO: 471934 - DNA, 18 bp, Homo sapiens
gagtggatctggagtctg

SEQ ID NO: 471935 - DNA, 19 bp, Homo sapiens
gagttctccttgtacttga

SEQ ID NO: 471936 - DNA, 23 bp, Homo sapiens
gagtttaaaaaaataacatctga

SEQ ID NO: 471937 - DNA, 20 bp, Homo sapiens
gacagcctcctaggctccct

SEQ ID NO: 471938 - DNA, 19 bp, Homo sapiens
gacagcctggcacagggca

SEQ ID NO: 471939 - DNA, 18 bp, Homo sapiens
gacagcggcccggcccac

SEQ ID NO: 471940 - DNA, 20 bp, Homo sapiens
gacaggaaagccctccccct

SEQ ID NO: 471941 - DNA, 12 bp, Homo sapiens
gacagggtgggg

SEQ ID NO: 471942 - DNA, 17 bp, Homo sapiens
gacagtgggggtgcctg

SEQ ID NO: 471943 - DNA, 12 bp, Homo sapiens
gacatgcacagt

SEQ ID NO: 471944 - DNA, 23 bp, Homo sapiens
gacatgcggctgcccacgctcct

SEQ ID NO: 471945 - DNA, 16 bp, Homo sapiens
gacatggcaacaaagg

SEQ ID NO: 471946 - DNA, 12 bp, Homo sapiens
gacattgtattt

SEQ ID NO: 471947 - DNA, 15 bp, Homo sapiens
gacattttcttcaga

SEQ ID NO: 471948 - DNA, 18 bp, Homo sapiens
gaccagcatagttctgca

SEQ ID NO: 471949 - DNA, 22 bp, Homo sapiens
gaccagggatgggggatgggcc

SEQ ID NO: 471950 - DNA, 19 bp, Homo sapiens
gaccatttagtcctcacct

SEQ ID NO: 471951 - DNA, 15 bp, Homo sapiens
gacccaccatccttc

SEQ ID NO: 471952 - DNA, 17 bp, Homo sapiens
gacccaccatccttcca

SEQ ID NO: 471953 - DNA, 23 bp, Homo sapiens
gacccaccatccttccatcctga

SEQ ID NO: 471954 - DNA, 10 bp, Homo sapiens
gaccccacac

SEQ ID NO: 471955 - DNA, 21 bp, Homo sapiens
gaccccacacgccggggctgg

SEQ ID NO: 471956 - DNA, 22 bp, Homo sapiens
gaccccacacgccggggctggc

SEQ ID NO: 471957 - DNA, 14 bp, Homo sapiens
gacccccgaggccc

SEQ ID NO: 471958 - DNA, 20 bp, Homo sapiens
gacccccgaggcccccctct

SEQ ID NO: 471959 - DNA, 16 bp, Homo sapiens
gacccctaccctttcc

SEQ ID NO: 471960 - DNA, 13 bp, Homo sapiens
gaccctccttccc

SEQ ID NO: 471961 - DNA, 17 bp, Homo sapiens
gaccctgtctttgctgt

SEQ ID NO: 471962 - DNA, 18 bp, Homo sapiens
gaccgccccaaccctcgg

SEQ ID NO: 471963 - DNA, 19 bp, Homo sapiens
gaccggagcggctgaggac

SEQ ID NO: 471964 - DNA, 19 bp, Homo sapiens
gacctaaatccattttcta

SEQ ID NO: 471965 - DNA, 22 bp, Homo sapiens
gacctcggctgtgtggggaggg

SEQ ID NO: 471966 - DNA, 17 bp, Homo sapiens
gacctctcactttttta

SEQ ID NO: 471967 - DNA, 20 bp, Homo sapiens
gacctctcacttttttataa

SEQ ID NO: 471968 - DNA, 11 bp, Homo sapiens
gacctttattt

SEQ ID NO: 471969 - DNA, 21 bp, Homo sapiens
gacctttatttattaaacttc

SEQ ID NO: 471970 - DNA, 23 bp, Homo sapiens
gacctttatttattaaacttcag

SEQ ID NO: 471971 - DNA, 18 bp, Homo sapiens
gacgatcttcccccttcc

SEQ ID NO: 471972 - DNA, 19 bp, Homo sapiens
gacgatcttcccccttccc

SEQ ID NO: 471973 - DNA, 14 bp, Homo sapiens
gacggaagtggcct

SEQ ID NO: 471974 - DNA, 12 bp, Homo sapiens
gacggcagcccc

SEQ ID NO: 471975 - DNA, 16 bp, Homo sapiens
gacggcagccccatcc

SEQ ID NO: 471976 - DNA, 21 bp, Homo sapiens
gacgggacagcggcccggccc

SEQ ID NO: 471977 - DNA, 19 bp, Homo sapiens
gacgtttttgtgctgtggg

SEQ ID NO: 471978 - DNA, 16 bp, Homo sapiens
gactaacaactgggaa

SEQ ID NO: 471979 - DNA, 17 bp, Homo sapiens
gactacaggtattttca

SEQ ID NO: 471980 - DNA, 15 bp, Homo sapiens
gactcaggttgtctg

SEQ ID NO: 471981 - DNA, 22 bp, Homo sapiens
gactccccgcccgccctcctct

SEQ ID NO: 471982 - DNA, 23 bp, Homo sapiens
gactccccgcccgccctcctctg

SEQ ID NO: 471983 - DNA, 23 bp, Homo sapiens
gactccctgtgggggtggccatc

SEQ ID NO: 471984 - DNA, 19 bp, Homo sapiens
gactcgagagggctgagcc

SEQ ID NO: 471985 - DNA, 21 bp, Homo sapiens
gactcgagagggctgagcccc

SEQ ID NO: 471986 - DNA, 15 bp, Homo sapiens
gactctctcctctct

SEQ ID NO: 471987 - DNA, 20 bp, Homo sapiens
gactctctcctctctctccc

SEQ ID NO: 471988 - DNA, 22 bp, Homo sapiens
gactgaatttaactactaagaa

SEQ ID NO: 471989 - DNA, 15 bp, Homo sapiens
gactgcatgcaagct

SEQ ID NO: 471990 - DNA, 10 bp, Homo sapiens
gactgcccac

SEQ ID NO: 471991 - DNA, 15 bp, Homo sapiens
gactgcccaccctgg

SEQ ID NO: 471992 - DNA, 17 bp, Homo sapiens
gactgcccaccctgggc

SEQ ID NO: 471993 - DNA, 19 bp, Homo sapiens
gactgcccaccctgggcct

SEQ ID NO: 471994 - DNA, 20 bp, Homo sapiens
gactgcccaccctgggcctc

SEQ ID NO: 471995 - DNA, 23 bp, Homo sapiens
gactgcccaccctgggcctcccg

SEQ ID NO: 471996 - DNA, 19 bp, Homo sapiens
gactggcccacccctcttc

SEQ ID NO: 471997 - DNA, 23 bp, Homo sapiens
gactgtactcctcccaggcgccc

SEQ ID NO: 471998 - DNA, 11 bp, Homo sapiens
gactgtcccac

SEQ ID NO: 471999 - DNA, 23 bp, Homo sapiens
gactgtcccaccgggagcctccc

SEQ ID NO: 472000 - DNA, 17 bp, Homo sapiens
gactgtcttcaaccctg

SEQ ID NO: 472001 - DNA, 15 bp, Homo sapiens
gacttcccagctggc

SEQ ID NO: 472002 - DNA, 13 bp, Homo sapiens
gacttctgcagct

SEQ ID NO: 472003 - DNA, 23 bp, Homo sapiens
gacttggataggagcttccagat

SEQ ID NO: 472004 - DNA, 17 bp, Homo sapiens
gactttatttaatttca

SEQ ID NO: 472005 - DNA, 20 bp, Homo sapiens
gactttatttaatttcataa

SEQ ID NO: 472006 - DNA, 23 bp, Homo sapiens
gagaagatgttaattacttttga

SEQ ID NO: 472007 - DNA, 20 bp, Homo sapiens
gagaagccacgctgtcctct

SEQ ID NO: 472008 - DNA, 18 bp, Homo sapiens
gagaagctctcgagggaa

SEQ ID NO: 472009 - DNA, 20 bp, Homo sapiens
gagaagctctcgagggaagc

SEQ ID NO: 472010 - DNA, 17 bp, Homo sapiens
gagaaggattctttttt

SEQ ID NO: 472011 - DNA, 14 bp, Homo sapiens
gagaaggcctgccc

SEQ ID NO: 472012 - DNA, 23 bp, Homo sapiens
gagaaggcctgccccccttccca

SEQ ID NO: 472013 - DNA, 13 bp, Homo sapiens
gagaatggctctg

SEQ ID NO: 472014 - DNA, 13 bp, Homo sapiens
gagacagtggggg

SEQ ID NO: 472015 - DNA, 18 bp, Homo sapiens
gagacccaccatccttcc

SEQ ID NO: 472016 - DNA, 13 bp, Homo sapiens
gagacggcagccc

SEQ ID NO: 472017 - DNA, 15 bp, Homo sapiens
gagacggcagcccca

SEQ ID NO: 472018 - DNA, 19 bp, Homo sapiens
gagacggcagccccatcct

SEQ ID NO: 472019 - DNA, 17 bp, Homo sapiens
gagactgcccaccctgg

SEQ ID NO: 472020 - DNA, 20 bp, Homo sapiens
gagactgcccaccctgggcc

SEQ ID NO: 472021 - DNA, 20 bp, Homo sapiens
gagagcctttggtgaataac

SEQ ID NO: 472022 - DNA, 22 bp, Homo sapiens
gagagcgccacccgcccgcccc

SEQ ID NO: 472023 - DNA, 13 bp, Homo sapiens
gagagctgctcct

SEQ ID NO: 472024 - DNA, 15 bp, Homo sapiens
gagaggaggtgtgga

SEQ ID NO: 472025 - DNA, 15 bp, Homo sapiens
gagaggatgaacatc

SEQ ID NO: 472026 - DNA, 18 bp, Homo sapiens
cttttcactgctggctgc

SEQ ID NO: 472027 - DNA, 19 bp, Homo sapiens
cttttcagcttgtttctat

SEQ ID NO: 472028 - DNA, 16 bp, Homo sapiens
cttttccatctaaaat

SEQ ID NO: 472029 - DNA, 21 bp, Homo sapiens
cttttgaatcaatctggcttc

SEQ ID NO: 472030 - DNA, 22 bp, Homo sapiens
cttttgaatcaatctggcttct

SEQ ID NO: 472031 - DNA, 14 bp, Homo sapiens
cttttgtgtattct

SEQ ID NO: 472032 - DNA, 16 bp, Homo sapiens
cttttgtgtattctgt

SEQ ID NO: 472033 - DNA, 20 bp, Homo sapiens
cttttttataaattataatg

SEQ ID NO: 472034 - DNA, 19 bp, Homo sapiens
gaaaaaaagggaaaacaaa

SEQ ID NO: 472035 - DNA, 10 bp, Homo sapiens
gaaaaaggat

SEQ ID NO: 472036 - DNA, 19 bp, Homo sapiens
gaaaaccaagccgtggctt

SEQ ID NO: 472037 - DNA, 12 bp, Homo sapiens
gaaaagaagaaa

SEQ ID NO: 472038 - DNA, 20 bp, Homo sapiens
gaaaatagtaaatgctttgt

SEQ ID NO: 472039 - DNA, 17 bp, Homo sapiens
gaaaatatttttttcta

SEQ ID NO: 472040 - DNA, 18 bp, Homo sapiens
gaaaatatttttttctag

SEQ ID NO: 472041 - DNA, 15 bp, Homo sapiens
gaaaatgctttctca

SEQ ID NO: 472042 - DNA, 16 bp, Homo sapiens
gaaacgagatttgcca

SEQ ID NO: 472043 - DNA, 13 bp, Homo sapiens
gaaactcagaaga

SEQ ID NO: 472044 - DNA, 12 bp, Homo sapiens
gaaagacagtaa

SEQ ID NO: 472045 - DNA, 20 bp, Homo sapiens
gaaagacgtttttgtgctgt

SEQ ID NO: 472046 - DNA, 16 bp, Homo sapiens
gaaagagaaaatgctt

SEQ ID NO: 472047 - DNA, 19 bp, Homo sapiens
gaaagagaaaatgctttct

SEQ ID NO: 472048 - DNA, 23 bp, Homo sapiens
gaaagagaaaatgctttctcatg

SEQ ID NO: 472049 - DNA, 14 bp, Homo sapiens
gaaagatcccaagt

SEQ ID NO: 472050 - DNA, 21 bp, Homo sapiens
gaaagccctcccccttcccct

SEQ ID NO: 472051 - DNA, 14 bp, Homo sapiens
gaaaggactttgtg

SEQ ID NO: 472052 - DNA, 17 bp, Homo sapiens
gaaagggcagcccctcc

SEQ ID NO: 472053 - DNA, 14 bp, Homo sapiens
gaaagtctatgctt

SEQ ID NO: 472054 - DNA, 13 bp, Homo sapiens
gaaagttctatta

SEQ ID NO: 472055 - DNA, 15 bp, Homo sapiens
gaaagttttattttc

SEQ ID NO: 472056 - DNA, 16 bp, Homo sapiens
gaaataaatctaaata

SEQ ID NO: 472057 - DNA, 21 bp, Homo sapiens
gaaataagcaaaaaactgcat

SEQ ID NO: 472058 - DNA, 14 bp, Homo sapiens
gaaatccaaaatag

SEQ ID NO: 472059 - DNA, 16 bp, Homo sapiens
gaaatccaactccagg

SEQ ID NO: 472060 - DNA, 12 bp, Homo sapiens
gaaatgagaaat

SEQ ID NO: 472061 - DNA, 14 bp, Homo sapiens
gaaatgagaaattg

SEQ ID NO: 472062 - DNA, 12 bp, Homo sapiens
gaaattctataa

SEQ ID NO: 472063 - DNA, 19 bp, Homo sapiens
gaaattctataagagacaa

SEQ ID NO: 472064 - DNA, 19 bp, Homo sapiens
gaaattgcatttcctgaca

SEQ ID NO: 472065 - DNA, 15 bp, Homo sapiens
gaaattggaaaggac

SEQ ID NO: 472066 - DNA, 24 bp, Homo sapiens
gaaatttcaaagtatgtttcatta

SEQ ID NO: 472067 - DNA, 12 bp, Homo sapiens
gaacaaagacaa

SEQ ID NO: 472068 - DNA, 24 bp, Homo sapiens
gaacaaatatgattctcctctccc

SEQ ID NO: 472069 - DNA, 21 bp, Homo sapiens
gaacagtgttgaaattggaaa

SEQ ID NO: 472070 - DNA, 18 bp, Homo sapiens
gaacatttgggagactga

SEQ ID NO: 472071 - DNA, 22 bp, Homo sapiens
gaaccagcactcccagggcccg

SEQ ID NO: 472072 - DNA, 23 bp, Homo sapiens
gaaccagcactcccagggcccga

SEQ ID NO: 472073 - DNA, 15 bp, Homo sapiens
gaacccccctcccca

SEQ ID NO: 472074 - DNA, 20 bp, Homo sapiens
gaacctcgttgacatgcaca

SEQ ID NO: 472075 - DNA, 16 bp, Homo sapiens
gaacctgctcttcatt

SEQ ID NO: 472076 - DNA, 14 bp, Homo sapiens
gaactcagccttaa

SEQ ID NO: 472077 - DNA, 22 bp, Homo sapiens
gaactcaggatgggaagaaaaa

SEQ ID NO: 472078 - DNA, 17 bp, Homo sapiens
gaactgtcccacaaaat

SEQ ID NO: 472079 - DNA, 16 bp, Homo sapiens
gaactgttcatttcca

SEQ ID NO: 472080 - DNA, 20 bp, Homo sapiens
gaacttttaaactgcagttt

SEQ ID NO: 472081 - DNA, 12 bp, Homo sapiens
gaagaaaaagga

SEQ ID NO: 472082 - DNA, 17 bp, Homo sapiens
gaagagcgctcctctgc

SEQ ID NO: 472083 - DNA, 16 bp, Homo sapiens
gaagagtagataagtg

SEQ ID NO: 472084 - DNA, 21 bp, Homo sapiens
gaagatgttaattacttttga

SEQ ID NO: 472085 - DNA, 15 bp, Homo sapiens
gaagattctaaaaca

SEQ ID NO: 472086 - DNA, 13 bp, Homo sapiens
gaagcaccccacc

SEQ ID NO: 472087 - DNA, 17 bp, Homo sapiens
gaagcagtgtgtacttc

SEQ ID NO: 472088 - DNA, 15 bp, Homo sapiens
gaagccacgctgtcc

SEQ ID NO: 472089 - DNA, 16 bp, Homo sapiens
gaagccacgctgtcct

SEQ ID NO: 472090 - DNA, 11 bp, Homo sapiens
gaagcccaccc

SEQ ID NO: 472091 - DNA, 18 bp, Homo sapiens
gaagcccacccgccccag

SEQ ID NO: 472092 - DNA, 23 bp, Homo sapiens
gaagcccacccgccccagagact

SEQ ID NO: 472093 - DNA, 13 bp, Homo sapiens
gaaggagaggagt

SEQ ID NO: 472094 - DNA, 14 bp, Homo sapiens
gaaggagaggagtg

SEQ ID NO: 472095 - DNA, 16 bp, Homo sapiens
gaaggagaggagtgcg

SEQ ID NO: 472096 - DNA, 16 bp, Homo sapiens
gaagggaaatcaattt

SEQ ID NO: 472097 - DNA, 19 bp, Homo sapiens
gaagggcgctgagggcagg

SEQ ID NO: 472098 - DNA, 14 bp, Homo sapiens
gaagtcccttcctg

SEQ ID NO: 472099 - DNA, 15 bp, Homo sapiens
gaagtggcctgagaa

SEQ ID NO: 472100 - DNA, 22 bp, Homo sapiens
gaagtgggattcaggaatgggc

SEQ ID NO: 472101 - DNA, 16 bp, Homo sapiens
gaagttgtaagaaaag

SEQ ID NO: 472102 - DNA, 14 bp, Homo sapiens
gaataaaaaccctg

SEQ ID NO: 472103 - DNA, 15 bp, Homo sapiens
gaataaaaaccctgt

SEQ ID NO: 472104 - DNA, 14 bp, Homo sapiens
gaatacactggaat

SEQ ID NO: 472105 - DNA, 21 bp, Homo sapiens
gaatacagtaagctgctctat

SEQ ID NO: 472106 - DNA, 24 bp, Homo sapiens
gaatactgtattgttacagctgaa

SEQ ID NO: 472107 - DNA, 19 bp, Homo sapiens
gaatacttcctgaaataaa

SEQ ID NO: 472108 - DNA, 23 bp, Homo sapiens
gaatacttcctgaaataaaactg

SEQ ID NO: 472109 - DNA, 20 bp, Homo sapiens
gaataggagttctcctggag

SEQ ID NO: 472110 - DNA, 20 bp, Homo sapiens
gaatctaacttgatcttgtt

SEQ ID NO: 472111 - DNA, 15 bp, Homo sapiens
gaatgagtaaataaa

SEQ ID NO: 472112 - DNA, 18 bp, Homo sapiens
gaatgtccccattctata

SEQ ID NO: 472113 - DNA, 22 bp, Homo sapiens
gaatgtgcttttccatctaaaa

SEQ ID NO: 472114 - DNA, 22 bp, Homo sapiens
gaatgttatatcatcaatactt

SEQ ID NO: 472115 - DNA, 12 bp, Homo sapiens
gaattcataaaa

SEQ ID NO: 472116 - DNA, 22 bp, Homo sapiens
gaatttaactactaagaataaa

SEQ ID NO: 472117 - DNA, 17 bp, Homo sapiens
gacaaaggccttaacaa

SEQ ID NO: 472118 - DNA, 13 bp, Homo sapiens
gacaatttcaaaa

SEQ ID NO: 472119 - DNA, 14 bp, Homo sapiens
gacaatttcaaaat

SEQ ID NO: 472120 - DNA, 16 bp, Homo sapiens
gacaccctccactctg

SEQ ID NO: 472121 - DNA, 17 bp, Homo sapiens
gacaccctccactctga

SEQ ID NO: 472122 - DNA, 18 bp, Homo sapiens
gacacgaaggctgcccct

SEQ ID NO: 472123 - DNA, 20 bp, Homo sapiens
gacactgatgggtcctgctg

SEQ ID NO: 472124 - DNA, 13 bp, Homo sapiens
cttctcctctgct

SEQ ID NO: 472125 - DNA, 17 bp, Homo sapiens
cttctcctttcacaacc

SEQ ID NO: 472126 - DNA, 17 bp, Homo sapiens
cttctgaactttggaag

SEQ ID NO: 472127 - DNA, 18 bp, Homo sapiens
cttctgaactttggaagc

SEQ ID NO: 472128 - DNA, 14 bp, Homo sapiens
cttctgaccccact

SEQ ID NO: 472129 - DNA, 23 bp, Homo sapiens
cttctgaccccacttatgctgct

SEQ ID NO: 472130 - DNA, 18 bp, Homo sapiens
cttctgcattactattaa

SEQ ID NO: 472131 - DNA, 22 bp, Homo sapiens
cttctgtggctcacagaaccct

SEQ ID NO: 472132 - DNA, 10 bp, Homo sapiens
cttgaatgtc

SEQ ID NO: 472133 - DNA, 14 bp, Homo sapiens
cttgaccccacacg

SEQ ID NO: 472134 - DNA, 18 bp, Homo sapiens
cttgaccttttcgacgct

SEQ ID NO: 472135 - DNA, 14 bp, Homo sapiens
cttgagcccactcc

SEQ ID NO: 472136 - DNA, 18 bp, Homo sapiens
cttgagtgacatgcggct

SEQ ID NO: 472137 - DNA, 16 bp, Homo sapiens
cttgagtgggccccct

SEQ ID NO: 472138 - DNA, 17 bp, Homo sapiens
cttgagtgggccccctc

SEQ ID NO: 472139 - DNA, 18 bp, Homo sapiens
cttgagtgggccccctct

SEQ ID NO: 472140 - DNA, 14 bp, Homo sapiens
cttgatgttgctta

SEQ ID NO: 472141 - DNA, 18 bp, Homo sapiens
cttgcactgtatccaagt

SEQ ID NO: 472142 - DNA, 19 bp, Homo sapiens
cttgcacttctgttatcag

SEQ ID NO: 472143 - DNA, 21 bp, Homo sapiens
cttgcggcaccgcccacccac

SEQ ID NO: 472144 - DNA, 19 bp, Homo sapiens
cttgctcaataaaggtcat

SEQ ID NO: 472145 - DNA, 20 bp, Homo sapiens
cttgctcaataaaggtcata

SEQ ID NO: 472146 - DNA, 22 bp, Homo sapiens
cttggagcagagacggcagccc

SEQ ID NO: 472147 - DNA, 23 bp, Homo sapiens
cttggagcagagacggcagcccc

SEQ ID NO: 472148 - DNA, 15 bp, Homo sapiens
cttggataggagctt

SEQ ID NO: 472149 - DNA, 12 bp, Homo sapiens
cttggcccctct

SEQ ID NO: 472150 - DNA, 14 bp, Homo sapiens
cttggcccctctct

SEQ ID NO: 472151 - DNA, 14 bp, Homo sapiens
cttggcctgtccac

SEQ ID NO: 472152 - DNA, 15 bp, Homo sapiens
cttggcctgtccacc

SEQ ID NO: 472153 - DNA, 23 bp, Homo sapiens
cttgggacggaagtggcctgaga

SEQ ID NO: 472154 - DNA, 19 bp, Homo sapiens
cttgggcacgggagagcgc

SEQ ID NO: 472155 - DNA, 23 bp, Homo sapiens
cttgggcacgggagagcgccacc

SEQ ID NO: 472156 - DNA, 16 bp, Homo sapiens
cttggggtagagagga

SEQ ID NO: 472157 - DNA, 16 bp, Homo sapiens
cttggtgactgtccca

SEQ ID NO: 472158 - DNA, 17 bp, Homo sapiens
cttgtaaataatgctta

SEQ ID NO: 472159 - DNA, 21 bp, Homo sapiens
cttgtacagaaccagcactcc

SEQ ID NO: 472160 - DNA, 19 bp, Homo sapiens
cttgtacttacactgaaat

SEQ ID NO: 472161 - DNA, 21 bp, Homo sapiens
cttgtacttacactgaaatcc

SEQ ID NO: 472162 - DNA, 18 bp, Homo sapiens
cttgtctcctcctccagg

SEQ ID NO: 472163 - DNA, 19 bp, Homo sapiens
cttgtctcctcctccagga

SEQ ID NO: 472164 - DNA, 15 bp, Homo sapiens
cttgtgttcaatctg

SEQ ID NO: 472165 - DNA, 13 bp, Homo sapiens
cttgttcttcctc

SEQ ID NO: 472166 - DNA, 14 bp, Homo sapiens
cttgttgtattcct

SEQ ID NO: 472167 - DNA, 20 bp, Homo sapiens
cttgtttaaggttcttgctg

SEQ ID NO: 472168 - DNA, 17 bp, Homo sapiens
cttgtttctatactgtt

SEQ ID NO: 472169 - DNA, 23 bp, Homo sapiens
cttgtttctatactgtttgtaat

SEQ ID NO: 472170 - DNA, 18 bp, Homo sapiens
ctttaaagtacctgtagt

SEQ ID NO: 472171 - DNA, 12 bp, Homo sapiens
ctttaaattata

SEQ ID NO: 472172 - DNA, 13 bp, Homo sapiens
ctttaaattatat

SEQ ID NO: 472173 - DNA, 21 bp, Homo sapiens
ctttaaattatatgatatgca

SEQ ID NO: 472174 - DNA, 22 bp, Homo sapiens
ctttaaattatatgatatgcat

SEQ ID NO: 472175 - DNA, 23 bp, Homo sapiens
ctttaaattatatgatatgcatg

SEQ ID NO: 472176 - DNA, 20 bp, Homo sapiens
ctttaagcgaggcagaatgg

SEQ ID NO: 472177 - DNA, 14 bp, Homo sapiens
ctttataatcaaga

SEQ ID NO: 472178 - DNA, 23 bp, Homo sapiens
ctttatgactgtttttgtagtgg

SEQ ID NO: 472179 - DNA, 16 bp, Homo sapiens
ctttatgtaagaagaa

SEQ ID NO: 472180 - DNA, 19 bp, Homo sapiens
ctttatgtaagaagaaact

SEQ ID NO: 472181 - DNA, 20 bp, Homo sapiens
ctttatgtaagaagaaactg

SEQ ID NO: 472182 - DNA, 17 bp, Homo sapiens
ctttattcttccaagtt

SEQ ID NO: 472183 - DNA, 12 bp, Homo sapiens
ctttatttaatt

SEQ ID NO: 472184 - DNA, 16 bp, Homo sapiens
ctttatttaatttcat

SEQ ID NO: 472185 - DNA, 19 bp, Homo sapiens
ctttatttattaaacttca

SEQ ID NO: 472186 - DNA, 12 bp, Homo sapiens
ctttccacccag

SEQ ID NO: 472187 - DNA, 14 bp, Homo sapiens
ctttccacccagac

SEQ ID NO: 472188 - DNA, 17 bp, Homo sapiens
ctttccacccagaccct

SEQ ID NO: 472189 - DNA, 23 bp, Homo sapiens
ctttccacccagaccctccttcc

SEQ ID NO: 472190 - DNA, 14 bp, Homo sapiens
ctttcccaaaccct

SEQ ID NO: 472191 - DNA, 12 bp, Homo sapiens
ctttcccacagt

SEQ ID NO: 472192 - DNA, 13 bp, Homo sapiens
ctttcccacagtc

SEQ ID NO: 472193 - DNA, 15 bp, Homo sapiens
ctttccgctgtcgcc

SEQ ID NO: 472194 - DNA, 18 bp, Homo sapiens
ctttctaagctttcttac

SEQ ID NO: 472195 - DNA, 20 bp, Homo sapiens
ctttctagtcctattctatt

SEQ ID NO: 472196 - DNA, 20 bp, Homo sapiens
ctttctatgtagaactgttc

SEQ ID NO: 472197 - DNA, 13 bp, Homo sapiens
ctttctattggca

SEQ ID NO: 472198 - DNA, 13 bp, Homo sapiens
ctttctctctgtg

SEQ ID NO: 472199 - DNA, 20 bp, Homo sapiens
ctttctctctgtgtggcaaa

SEQ ID NO: 472200 - DNA, 17 bp, Homo sapiens
ctttcttttttctctga

SEQ ID NO: 472201 - DNA, 17 bp, Homo sapiens
ctttgagcctgggaaat

SEQ ID NO: 472202 - DNA, 13 bp, Homo sapiens
ctttgagcttctc

SEQ ID NO: 472203 - DNA, 22 bp, Homo sapiens
ctttgagcttctcctctgctcc

SEQ ID NO: 472204 - DNA, 22 bp, Homo sapiens
ctttgatattttcaacgcagcc

SEQ ID NO: 472205 - DNA, 23 bp, Homo sapiens
ctttgatgtggatgaaaaaaagg

SEQ ID NO: 472206 - DNA, 17 bp, Homo sapiens
ctttgattgtgaaacag

SEQ ID NO: 472207 - DNA, 16 bp, Homo sapiens
ctttgcgctctgggtt

SEQ ID NO: 472208 - DNA, 13 bp, Homo sapiens
ctttgctgtttat

SEQ ID NO: 472209 - DNA, 15 bp, Homo sapiens
ctttgctgtttatat

SEQ ID NO: 472210 - DNA, 21 bp, Homo sapiens
ctttggagagctcagtacagg

SEQ ID NO: 472211 - DNA, 19 bp, Homo sapiens
ctttgggctgccctggtgc

SEQ ID NO: 472212 - DNA, 20 bp, Homo sapiens
ctttgggctgccctggtgct

SEQ ID NO: 472213 - DNA, 18 bp, Homo sapiens
ctttgggggattcaaatg

SEQ ID NO: 472214 - DNA, 22 bp, Homo sapiens
ctttgggggattcaaatgcatg

SEQ ID NO: 472215 - DNA, 14 bp, Homo sapiens
ctttggtgaataac

SEQ ID NO: 472216 - DNA, 15 bp, Homo sapiens
ctttgtcacttctgc

SEQ ID NO: 472217 - DNA, 14 bp, Homo sapiens
ctttgtgcttgttc

SEQ ID NO: 472218 - DNA, 13 bp, Homo sapiens
ctttgtggacttt

SEQ ID NO: 472219 - DNA, 16 bp, Homo sapiens
ctttgtggactttatt

SEQ ID NO: 472220 - DNA, 20 bp, Homo sapiens
ctttgtggactttatttaat

SEQ ID NO: 472221 - DNA, 16 bp, Homo sapiens
cttttcactgctggct

SEQ ID NO: 472222 - DNA, 23 bp, Homo sapiens
ctggggggttgcctcgagtcccc

SEQ ID NO: 472223 - DNA, 19 bp, Homo sapiens
ctggggtctctgagcagtg

SEQ ID NO: 472224 - DNA, 21 bp, Homo sapiens
ctggggtctctgagcagtggg

SEQ ID NO: 472225 - DNA, 15 bp, Homo sapiens
ctggggtggggcttg

SEQ ID NO: 472226 - DNA, 20 bp, Homo sapiens
ctggggtggttggaggcctg

SEQ ID NO: 472227 - DNA, 21 bp, Homo sapiens
ctggggtggttggaggcctgg

SEQ ID NO: 472228 - DNA, 22 bp, Homo sapiens
ctggggtggttggaggcctggt

SEQ ID NO: 472229 - DNA, 14 bp, Homo sapiens
ctgggtcgcccctc

SEQ ID NO: 472230 - DNA, 17 bp, Homo sapiens
ctgggtcgcccctcctc

SEQ ID NO: 472231 - DNA, 18 bp, Homo sapiens
ctgggtcgcccctcctcg

SEQ ID NO: 472232 - DNA, 22 bp, Homo sapiens
ctgggttgttgcagagtaaatc

SEQ ID NO: 472233 - DNA, 19 bp, Homo sapiens
ctggtccttctgaccccac

SEQ ID NO: 472234 - DNA, 13 bp, Homo sapiens
ctggtctggagcc

SEQ ID NO: 472235 - DNA, 20 bp, Homo sapiens
ctggtctggagcccctatcc

SEQ ID NO: 472236 - DNA, 15 bp, Homo sapiens
ctggtgcgctgtgct

SEQ ID NO: 472237 - DNA, 16 bp, Homo sapiens
ctggtgcgctgtgctc

SEQ ID NO: 472238 - DNA, 19 bp, Homo sapiens
ctggtgcgctgtgctccag

SEQ ID NO: 472239 - DNA, 18 bp, Homo sapiens
ctggtgcgtgtggccctg

SEQ ID NO: 472240 - DNA, 21 bp, Homo sapiens
ctggtgcgtgtggccctgtgg

SEQ ID NO: 472241 - DNA, 22 bp, Homo sapiens
ctggtgcgtgtggccctgtggg

SEQ ID NO: 472242 - DNA, 20 bp, Homo sapiens
ctggtgctgccacacttcag

SEQ ID NO: 472243 - DNA, 12 bp, Homo sapiens
ctggtggcacca

SEQ ID NO: 472244 - DNA, 18 bp, Homo sapiens
ctggtggcaccagatgca

SEQ ID NO: 472245 - DNA, 15 bp, Homo sapiens
ctggtggcccctgcc

SEQ ID NO: 472246 - DNA, 20 bp, Homo sapiens
ctggtggcccgacagcctgg

SEQ ID NO: 472247 - DNA, 21 bp, Homo sapiens
ctgtaaatttaactgcatata

SEQ ID NO: 472248 - DNA, 17 bp, Homo sapiens
ctgtaatagcctcacct

SEQ ID NO: 472249 - DNA, 18 bp, Homo sapiens
ctgtaatagcctcacctt

SEQ ID NO: 472250 - DNA, 19 bp, Homo sapiens
ctgtaatagcctcaccttc

SEQ ID NO: 472251 - DNA, 21 bp, Homo sapiens
ctgtactcctcccaggcgccc

SEQ ID NO: 472252 - DNA, 18 bp, Homo sapiens
ctgtacttcagttctcat

SEQ ID NO: 472253 - DNA, 19 bp, Homo sapiens
ctgtacttcagttctcatc

SEQ ID NO: 472254 - DNA, 13 bp, Homo sapiens
ctgtagtgagaaa

SEQ ID NO: 472255 - DNA, 19 bp, Homo sapiens
ctgtagtgagaaactgatt

SEQ ID NO: 472256 - DNA, 21 bp, Homo sapiens
ctgtagtggcaaaaaagaaca

SEQ ID NO: 472257 - DNA, 12 bp, Homo sapiens
ctgtattttctt

SEQ ID NO: 472258 - DNA, 22 bp, Homo sapiens
ctgtattttcttttatatctgt

SEQ ID NO: 472259 - DNA, 23 bp, Homo sapiens
ctgtattttcttttatatctgta

SEQ ID NO: 472260 - DNA, 16 bp, Homo sapiens
ctgtattttgccagac

SEQ ID NO: 472261 - DNA, 18 bp, Homo sapiens
ctgtcatctctctggggc

SEQ ID NO: 472262 - DNA, 15 bp, Homo sapiens
ctgtccacctgtgct

SEQ ID NO: 472263 - DNA, 20 bp, Homo sapiens
ctgtccacctgtgctgctgc

SEQ ID NO: 472264 - DNA, 16 bp, Homo sapiens
ctgtcccacaaaatat

SEQ ID NO: 472265 - DNA, 21 bp, Homo sapiens
ctgtcccacaaaatatttcta

SEQ ID NO: 472266 - DNA, 22 bp, Homo sapiens
ctgtcccaccgggagcctcccc

SEQ ID NO: 472267 - DNA, 19 bp, Homo sapiens
ctgtcctcaggtgaataac

SEQ ID NO: 472268 - DNA, 18 bp, Homo sapiens
ctgtcctgctcacgtctg

SEQ ID NO: 472269 - DNA, 22 bp, Homo sapiens
ctgtcctgctcacgtctgtgag

SEQ ID NO: 472270 - DNA, 19 bp, Homo sapiens
ctgtctcaagagggcactg

SEQ ID NO: 472271 - DNA, 21 bp, Homo sapiens
ctgtctctccctaccctcttc

SEQ ID NO: 472272 - DNA, 12 bp, Homo sapiens
ctgtctgagccc

SEQ ID NO: 472273 - DNA, 13 bp, Homo sapiens
ctgtctgagccct

SEQ ID NO: 472274 - DNA, 22 bp, Homo sapiens
ctgtctgagccctgccctcact

SEQ ID NO: 472275 - DNA, 14 bp, Homo sapiens
ctgtctgattctat

SEQ ID NO: 472276 - DNA, 18 bp, Homo sapiens
ctgtcttcaaccctgccc

SEQ ID NO: 472277 - DNA, 21 bp, Homo sapiens
ctgtcttcaaccctgccctgc

SEQ ID NO: 472278 - DNA, 20 bp, Homo sapiens
ctgtctttatgtaagaagaa

SEQ ID NO: 472279 - DNA, 20 bp, Homo sapiens
ctgtgagtctgtcctttccc

SEQ ID NO: 472280 - DNA, 17 bp, Homo sapiens
ctgtgctaagttgtctt

SEQ ID NO: 472281 - DNA, 18 bp, Homo sapiens
ctgtgctaagttgtctta

SEQ ID NO: 472282 - DNA, 14 bp, Homo sapiens
ctgtgctccagcag

SEQ ID NO: 472283 - DNA, 20 bp, Homo sapiens
ctgtgctccagcagtgctgg

SEQ ID NO: 472284 - DNA, 14 bp, Homo sapiens
ctgtggattctata

SEQ ID NO: 472285 - DNA, 14 bp, Homo sapiens
ctgtggcccctcct

SEQ ID NO: 472286 - DNA, 16 bp, Homo sapiens
ctgtggcccctccttc

SEQ ID NO: 472287 - DNA, 21 bp, Homo sapiens
ctgtgggactggcccacccct

SEQ ID NO: 472288 - DNA, 19 bp, Homo sapiens
ctgtgggagtccactttcc

SEQ ID NO: 472289 - DNA, 21 bp, Homo sapiens
ctgtgggagtccactttcctc

SEQ ID NO: 472290 - DNA, 21 bp, Homo sapiens
ctgtgggcagcaccctccccc

SEQ ID NO: 472291 - DNA, 23 bp, Homo sapiens
ctgtgggcagcaccctcccccgc

SEQ ID NO: 472292 - DNA, 14 bp, Homo sapiens
ctgtgggggtggcc

SEQ ID NO: 472293 - DNA, 12 bp, Homo sapiens
ccctccctccac

SEQ ID NO: 472294 - DNA, 16 bp, Homo sapiens
ccctccctccctccac

SEQ ID NO: 472295 - DNA, 14 bp, Homo sapiens
ccctccctccttcc

SEQ ID NO: 472296 - DNA, 20 bp, Homo sapiens
ccctccctgactccctgtgg

SEQ ID NO: 472297 - DNA, 13 bp, Homo sapiens
ccctccctgtccc

SEQ ID NO: 472298 - DNA, 12 bp, Homo sapiens
ccctccttcccc

SEQ ID NO: 472299 - DNA, 15 bp, Homo sapiens
ccctccttctcccct

SEQ ID NO: 472300 - DNA, 16 bp, Homo sapiens
ccctccttctcccctc

SEQ ID NO: 472301 - DNA, 21 bp, Homo sapiens
ccctccttctcccctccagac

SEQ ID NO: 472302 - DNA, 17 bp, Homo sapiens
ccctcctttccaaataa

SEQ ID NO: 472303 - DNA, 13 bp, Homo sapiens
ccctcggagcccc

SEQ ID NO: 472304 - DNA, 14 bp, Homo sapiens
ccctcgtctccctg

SEQ ID NO: 472305 - DNA, 15 bp, Homo sapiens
ccctcgtctccctgg

SEQ ID NO: 472306 - DNA, 14 bp, Homo sapiens
ccctctccacccag

SEQ ID NO: 472307 - DNA, 15 bp, Homo sapiens
ccctctccacccaga

SEQ ID NO: 472308 - DNA, 17 bp, Homo sapiens
ccctctccacccagagg

SEQ ID NO: 472309 - DNA, 20 bp, Homo sapiens
ccctctcctgagcctgtctc

SEQ ID NO: 472310 - DNA, 20 bp, Homo sapiens
ccctctgcctttgagcttct

SEQ ID NO: 472311 - DNA, 17 bp, Homo sapiens
ccctctggtccttctga

SEQ ID NO: 472312 - DNA, 17 bp, Homo sapiens
ccctcttcccccttccc

SEQ ID NO: 472313 - DNA, 22 bp, Homo sapiens
ccctcttcttgcggcaccgccc

SEQ ID NO: 472314 - DNA, 16 bp, Homo sapiens
ccctgactccctgtgg

SEQ ID NO: 472315 - DNA, 14 bp, Homo sapiens
ccctgacttcccag

SEQ ID NO: 472316 - DNA, 15 bp, Homo sapiens
ccctgacttcccagc

SEQ ID NO: 472317 - DNA, 17 bp, Homo sapiens
ccctgccctcactccac

SEQ ID NO: 472318 - DNA, 17 bp, Homo sapiens
ccctgccctcccccacg

SEQ ID NO: 472319 - DNA, 12 bp, Homo sapiens
ccctgccctgca

SEQ ID NO: 472320 - DNA, 15 bp, Homo sapiens
ccctgccctgcacct

SEQ ID NO: 472321 - DNA, 13 bp, Homo sapiens
ccctgcgccctcc

SEQ ID NO: 472322 - DNA, 13 bp, Homo sapiens
ccctgctggacca

SEQ ID NO: 472323 - DNA, 18 bp, Homo sapiens
ccctgctttgggctgccc

SEQ ID NO: 472324 - DNA, 22 bp, Homo sapiens
ccctgctttgggctgccctggt

SEQ ID NO: 472325 - DNA, 23 bp, Homo sapiens
ccctggactggtggcccctgcct

SEQ ID NO: 472326 - DNA, 13 bp, Homo sapiens
ccctggcttttca

SEQ ID NO: 472327 - DNA, 19 bp, Homo sapiens
ccctgggcccctccacgcc

SEQ ID NO: 472328 - DNA, 22 bp, Homo sapiens
ccctgggcccctccacgcctcc

SEQ ID NO: 472329 - DNA, 23 bp, Homo sapiens
ccctgggcctcagttcaacctgg

SEQ ID NO: 472330 - DNA, 17 bp, Homo sapiens
ccctgggcctcccgtcc

SEQ ID NO: 472331 - DNA, 18 bp, Homo sapiens
ccctggggtctctgagca

SEQ ID NO: 472332 - DNA, 21 bp, Homo sapiens
ccctggggtctctgagcagtg

SEQ ID NO: 472333 - DNA, 15 bp, Homo sapiens
ccctggtgctgccac

SEQ ID NO: 472334 - DNA, 16 bp, Homo sapiens
ccctggtgctgccaca

SEQ ID NO: 472335 - DNA, 21 bp, Homo sapiens
ccctggtgctgccacacttca

SEQ ID NO: 472336 - DNA, 12 bp, Homo sapiens
ccctgtaaggtt

SEQ ID NO: 472337 - DNA, 23 bp, Homo sapiens
ccctgtattcccacccctggact

SEQ ID NO: 472338 - DNA, 14 bp, Homo sapiens
ccctgtcccctgag

SEQ ID NO: 472339 - DNA, 14 bp, Homo sapiens
ccctgtgggagtcc

SEQ ID NO: 472340 - DNA, 20 bp, Homo sapiens
ccctgtgggagtccactttc

SEQ ID NO: 472341 - DNA, 12 bp, Homo sapiens
cccttccccact

SEQ ID NO: 472342 - DNA, 16 bp, Homo sapiens
cccttccccactcccg

SEQ ID NO: 472343 - DNA, 18 bp, Homo sapiens
cccttccccactcccgtg

SEQ ID NO: 472344 - DNA, 14 bp, Homo sapiens
cccttcccctgcgc

SEQ ID NO: 472345 - DNA, 18 bp, Homo sapiens
cccttcccctgcgccctc

SEQ ID NO: 472346 - DNA, 21 bp, Homo sapiens
cccttcccctgcgccctccct

SEQ ID NO: 472347 - DNA, 13 bp, Homo sapiens
cccttcctgtcct

SEQ ID NO: 472348 - DNA, 16 bp, Homo sapiens
cccttcctgtcctgct

SEQ ID NO: 472349 - DNA, 17 bp, Homo sapiens
cccttcctgtcctgctc

SEQ ID NO: 472350 - DNA, 18 bp, Homo sapiens
cccttcctgtcctgctca

SEQ ID NO: 472351 - DNA, 14 bp, Homo sapiens
cccttgaccccaca

SEQ ID NO: 472352 - DNA, 22 bp, Homo sapiens
ccctttgtggactttatttaat

SEQ ID NO: 472353 - DNA, 12 bp, Homo sapiens
ccgacagcctgg

SEQ ID NO: 472354 - DNA, 13 bp, Homo sapiens
ccgacagcctggc

SEQ ID NO: 472355 - DNA, 14 bp, Homo sapiens
ccgagcgcgtgcct

SEQ ID NO: 472356 - DNA, 20 bp, Homo sapiens
ctctgattttgagctcaatc

SEQ ID NO: 472357 - DNA, 13 bp, Homo sapiens
ctctgcagcctga

SEQ ID NO: 472358 - DNA, 16 bp, Homo sapiens
ctctgcagcctgagct

SEQ ID NO: 472359 - DNA, 23 bp, Homo sapiens
ctctgcagcctgagctccaccct

SEQ ID NO: 472360 - DNA, 15 bp, Homo sapiens
ctctgcaggatgggt

SEQ ID NO: 472361 - DNA, 15 bp, Homo sapiens
ctctgccccctcccc

SEQ ID NO: 472362 - DNA, 21 bp, Homo sapiens
ctctgccccctcccccgcaga

SEQ ID NO: 472363 - DNA, 21 bp, Homo sapiens
ctctgcccctccgtccccagg

SEQ ID NO: 472364 - DNA, 14 bp, Homo sapiens
ctctgcctttgagc

SEQ ID NO: 472365 - DNA, 20 bp, Homo sapiens
ctctgctatgtctgtgatgt

SEQ ID NO: 472366 - DNA, 18 bp, Homo sapiens
ctctgctccaacagacac

SEQ ID NO: 472367 - DNA, 14 bp, Homo sapiens
ctctggggccctgg

SEQ ID NO: 472368 - DNA, 15 bp, Homo sapiens
ctctggggccctggg

SEQ ID NO: 472369 - DNA, 16 bp, Homo sapiens
ctctggggggttgcct

SEQ ID NO: 472370 - DNA, 15 bp, Homo sapiens
ctctgtcagccagcc

SEQ ID NO: 472371 - DNA, 21 bp, Homo sapiens
ctctgtcagccagccgccctg

SEQ ID NO: 472372 - DNA, 23 bp, Homo sapiens
ctctgtcagccagccgccctggg

SEQ ID NO: 472373 - DNA, 12 bp, Homo sapiens
ctctgtgtggca

SEQ ID NO: 472374 - DNA, 13 bp, Homo sapiens
ctctgtgtggcaa

SEQ ID NO: 472375 - DNA, 22 bp, Homo sapiens
ctctgttccaagtgtgtgtgca

SEQ ID NO: 472376 - DNA, 18 bp, Homo sapiens
ctctgtttaccctccctg

SEQ ID NO: 472377 - DNA, 20 bp, Homo sapiens
ctctgtttaccctccctgtc

SEQ ID NO: 472378 - DNA, 21 bp, Homo sapiens
ctctgtttaccctccctgtcc

SEQ ID NO: 472379 - DNA, 20 bp, Homo sapiens
ctcttaacttaaaagaacat

SEQ ID NO: 472380 - DNA, 13 bp, Homo sapiens
ctcttaccccgtc

SEQ ID NO: 472381 - DNA, 15 bp, Homo sapiens
ctcttcccccttccc

SEQ ID NO: 472382 - DNA, 16 bp, Homo sapiens
ctcttcccccttcccc

SEQ ID NO: 472383 - DNA, 19 bp, Homo sapiens
ctcttcccccttcccctgc

SEQ ID NO: 472384 - DNA, 17 bp, Homo sapiens
ctcttctccactggatg

SEQ ID NO: 472385 - DNA, 16 bp, Homo sapiens
ctcttcttgcggcacc

SEQ ID NO: 472386 - DNA, 22 bp, Homo sapiens
ctcttcttgcggcaccgcccac

SEQ ID NO: 472387 - DNA, 18 bp, Homo sapiens
ctctttctctctgtgtgg

SEQ ID NO: 472388 - DNA, 19 bp, Homo sapiens
ctgccctcactccactccc

SEQ ID NO: 472389 - DNA, 16 bp, Homo sapiens
ctgccctcccccacgg

SEQ ID NO: 472390 - DNA, 18 bp, Homo sapiens
ctgccctcccccacggcc

SEQ ID NO: 472391 - DNA, 21 bp, Homo sapiens
ctgccctcccccacggccgtc

SEQ ID NO: 472392 - DNA, 17 bp, Homo sapiens
ctgccctccctccttcc

SEQ ID NO: 472393 - DNA, 15 bp, Homo sapiens
ctgccctgcaccttg

SEQ ID NO: 472394 - DNA, 13 bp, Homo sapiens
ctgccctggtgct

SEQ ID NO: 472395 - DNA, 16 bp, Homo sapiens
ctgccctggtgctgcc

SEQ ID NO: 472396 - DNA, 14 bp, Homo sapiens
ctgccgctgcacca

SEQ ID NO: 472397 - DNA, 15 bp, Homo sapiens
ctgccgctgcaccac

SEQ ID NO: 472398 - DNA, 16 bp, Homo sapiens
ctgccgctgcaccacg

SEQ ID NO: 472399 - DNA, 18 bp, Homo sapiens
ctgccgctgccgctgcac

SEQ ID NO: 472400 - DNA, 14 bp, Homo sapiens
ctgcctggcgggca

SEQ ID NO: 472401 - DNA, 16 bp, Homo sapiens
ctgcctggcgggcagc

SEQ ID NO: 472402 - DNA, 22 bp, Homo sapiens
ctgcctggcgggcagcccctgc

SEQ ID NO: 472403 - DNA, 13 bp, Homo sapiens
ctgccttggacac

SEQ ID NO: 472404 - DNA, 21 bp, Homo sapiens
ctgccttggacaccatcccct

SEQ ID NO: 472405 - DNA, 16 bp, Homo sapiens
ctgcgccctccctccc

SEQ ID NO: 472406 - DNA, 14 bp, Homo sapiens
ctgcgcctgcccgc

SEQ ID NO: 472407 - DNA, 13 bp, Homo sapiens
ctgcgctcctctg

SEQ ID NO: 472408 - DNA, 16 bp, Homo sapiens
ctgcgctcctctgcag

SEQ ID NO: 472409 - DNA, 20 bp, Homo sapiens
ctgcgctggacgatagcttg

SEQ ID NO: 472410 - DNA, 15 bp, Homo sapiens
ctgctagctgtagaa

SEQ ID NO: 472411 - DNA, 22 bp, Homo sapiens
ctgctccaacagacaccctcca

SEQ ID NO: 472412 - DNA, 23 bp, Homo sapiens
ctgctccaacagacaccctccac

SEQ ID NO: 472413 - DNA, 12 bp, Homo sapiens
ctgctcgggaag

SEQ ID NO: 472414 - DNA, 15 bp, Homo sapiens
ctgctcgggaaggcc

SEQ ID NO: 472415 - DNA, 20 bp, Homo sapiens
ctgctcgggaaggcctgagg

SEQ ID NO: 472416 - DNA, 21 bp, Homo sapiens
ctgctcgggaaggcctgaggg

SEQ ID NO: 472417 - DNA, 15 bp, Homo sapiens
ctgctctccttcact

SEQ ID NO: 472418 - DNA, 14 bp, Homo sapiens
ctgctgagtgaatg

SEQ ID NO: 472419 - DNA, 15 bp, Homo sapiens
ctgctgcctctgaaa

SEQ ID NO: 472420 - DNA, 17 bp, Homo sapiens
ctgctgctcgggaaggc

SEQ ID NO: 472421 - DNA, 21 bp, Homo sapiens
ctgctgctcgggaaggcctga

SEQ ID NO: 472422 - DNA, 15 bp, Homo sapiens
ctgctgtggtgttcc

SEQ ID NO: 472423 - DNA, 12 bp, Homo sapiens
ctgctgttttat

SEQ ID NO: 472424 - DNA, 12 bp, Homo sapiens
ctgcttagtgtc

SEQ ID NO: 472425 - DNA, 13 bp, Homo sapiens
ctgcttggatcca

SEQ ID NO: 472426 - DNA, 18 bp, Homo sapiens
ctgcttggatccatacaa

SEQ ID NO: 472427 - DNA, 18 bp, Homo sapiens
ctgcttgtcattctgcta

SEQ ID NO: 472428 - DNA, 18 bp, Homo sapiens
ctgctttgggctgccctg

SEQ ID NO: 472429 - DNA, 19 bp, Homo sapiens
ctgctttgggctgccctgg

SEQ ID NO: 472430 - DNA, 20 bp, Homo sapiens
ctgctttgggctgccctggt

SEQ ID NO: 472431 - DNA, 23 bp, Homo sapiens
ctgctttgggctgccctggtgct

SEQ ID NO: 472432 - DNA, 21 bp, Homo sapiens
ctggaaagcacgccggcctgc

SEQ ID NO: 472433 - DNA, 22 bp, Homo sapiens
ctggaaagcacgccggcctgcg

SEQ ID NO: 472434 - DNA, 16 bp, Homo sapiens
ctggaaggctttattc

SEQ ID NO: 472435 - DNA, 16 bp, Homo sapiens
ctggaccaaggtgcgg

SEQ ID NO: 472436 - DNA, 22 bp, Homo sapiens
ctggaccaaggtgcggaccgga

SEQ ID NO: 472437 - DNA, 15 bp, Homo sapiens
ctggagaactagaga

SEQ ID NO: 472438 - DNA, 12 bp, Homo sapiens
ctggagccccta

SEQ ID NO: 472439 - DNA, 19 bp, Homo sapiens
ctggagcccctatcctgca

SEQ ID NO: 472440 - DNA, 13 bp, Homo sapiens
ctggagtctgaag

SEQ ID NO: 472441 - DNA, 16 bp, Homo sapiens
ctggagtctgaaggag

SEQ ID NO: 472442 - DNA, 16 bp, Homo sapiens
ctggatattcatgaaa

SEQ ID NO: 472443 - DNA, 12 bp, Homo sapiens
ctggatgctgag

SEQ ID NO: 472444 - DNA, 20 bp, Homo sapiens
ctggatgctgagagacctca

SEQ ID NO: 472445 - DNA, 13 bp, Homo sapiens
ctggatgtgcttt

SEQ ID NO: 472446 - DNA, 15 bp, Homo sapiens
ctggatgtgctttca

SEQ ID NO: 472447 - DNA, 17 bp, Homo sapiens
ctggcagccgtgccttc

SEQ ID NO: 472448 - DNA, 18 bp, Homo sapiens
ctggcagccgtgccttca

SEQ ID NO: 472449 - DNA, 22 bp, Homo sapiens
ctggcagccgtgccttcagctc

SEQ ID NO: 472450 - DNA, 16 bp, Homo sapiens
ctggcagcgcctcccg

SEQ ID NO: 472451 - DNA, 15 bp, Homo sapiens
ctggccacccttggc

SEQ ID NO: 472452 - DNA, 22 bp, Homo sapiens
ctggccacccttggcctgtcca

SEQ ID NO: 472453 - DNA, 15 bp, Homo sapiens
ctggccagcaccctc

SEQ ID NO: 472454 - DNA, 22 bp, Homo sapiens
ctggccagcaccctctcctggg

SEQ ID NO: 472455 - DNA, 15 bp, Homo sapiens
ctggcccacccctct

SEQ ID NO: 472456 - DNA, 17 bp, Homo sapiens
ctggcccacccctcttc

SEQ ID NO: 472457 - DNA, 21 bp, Homo sapiens
ctatggaaagggtgtggcttg

SEQ ID NO: 472458 - DNA, 22 bp, Homo sapiens
ctatggattcacttctatttat

SEQ ID NO: 472459 - DNA, 18 bp, Homo sapiens
ctatggtatgctggccag

SEQ ID NO: 472460 - DNA, 13 bp, Homo sapiens
ctatgtctgtgat

SEQ ID NO: 472461 - DNA, 22 bp, Homo sapiens
ctattcattacatcctctgctt

SEQ ID NO: 472462 - DNA, 18 bp, Homo sapiens
ctattgtaagttgttggt

SEQ ID NO: 472463 - DNA, 10 bp, Homo sapiens
ctatttaagc

SEQ ID NO: 472464 - DNA, 12 bp, Homo sapiens
ctatttctatct

SEQ ID NO: 472465 - DNA, 14 bp, Homo sapiens
ctatttctatctgc

SEQ ID NO: 472466 - DNA, 15 bp, Homo sapiens
ctatttctatctgca

SEQ ID NO: 472467 - DNA, 15 bp, Homo sapiens
ctattttgcagcagt

SEQ ID NO: 472468 - DNA, 20 bp, Homo sapiens
ctcaaagaggccagtacttt

SEQ ID NO: 472469 - DNA, 12 bp, Homo sapiens
ctcaacctctca

SEQ ID NO: 472470 - DNA, 14 bp, Homo sapiens
ctcaacctctcaga

SEQ ID NO: 472471 - DNA, 12 bp, Homo sapiens
ctcaagccagga

SEQ ID NO: 472472 - DNA, 13 bp, Homo sapiens
ctcaagccaggag

SEQ ID NO: 472473 - DNA, 23 bp, Homo sapiens
ctcaattattttgcattttttct

SEQ ID NO: 472474 - DNA, 14 bp, Homo sapiens
ctcaccttctgttt

SEQ ID NO: 472475 - DNA, 15 bp, Homo sapiens
ctcaccttctgtttt

SEQ ID NO: 472476 - DNA, 14 bp, Homo sapiens
ctcacgctgacagc

SEQ ID NO: 472477 - DNA, 18 bp, Homo sapiens
ctcacgctgacagcctcc

SEQ ID NO: 472478 - DNA, 21 bp, Homo sapiens
ctcacgctgacagcctcctag

SEQ ID NO: 472479 - DNA, 14 bp, Homo sapiens
ctcacgtctgtgag

SEQ ID NO: 472480 - DNA, 21 bp, Homo sapiens
ctcactatggtatgctggcca

SEQ ID NO: 472481 - DNA, 23 bp, Homo sapiens
ctcactatggtatgctggccagc

SEQ ID NO: 472482 - DNA, 14 bp, Homo sapiens
ctcactccactccc

SEQ ID NO: 472483 - DNA, 15 bp, Homo sapiens
ctcactccactcccc

SEQ ID NO: 472484 - DNA, 12 bp, Homo sapiens
ctcactcccttt

SEQ ID NO: 472485 - DNA, 15 bp, Homo sapiens
ctcactcctacctgg

SEQ ID NO: 472486 - DNA, 14 bp, Homo sapiens
ctcacttttttata

SEQ ID NO: 472487 - DNA, 18 bp, Homo sapiens
ctcagaggccgctctggg

SEQ ID NO: 472488 - DNA, 23 bp, Homo sapiens
ctcagatccctcggtcagcaccg

SEQ ID NO: 472489 - DNA, 17 bp, Homo sapiens
ctcagatgatctctcca

SEQ ID NO: 472490 - DNA, 15 bp, Homo sapiens
ctcagcaaattcttg

SEQ ID NO: 472491 - DNA, 16 bp, Homo sapiens
ctcagcaaattcttga

SEQ ID NO: 472492 - DNA, 22 bp, Homo sapiens
ctcagcaactgttagctgggaa

SEQ ID NO: 472493 - DNA, 19 bp, Homo sapiens
cgggggctaactggcccca

SEQ ID NO: 472494 - DNA, 22 bp, Homo sapiens
cgggggtccccggacgctggct

SEQ ID NO: 472495 - DNA, 19 bp, Homo sapiens
cggggtggggtgcctgagc

SEQ ID NO: 472496 - DNA, 21 bp, Homo sapiens
cggggtggggtgcctgagccc

SEQ ID NO: 472497 - DNA, 13 bp, Homo sapiens
cgggtctgtggga

SEQ ID NO: 472498 - DNA, 14 bp, Homo sapiens
cgggtgtggcctca

SEQ ID NO: 472499 - DNA, 15 bp, Homo sapiens
cgggtgtggcctcag

SEQ ID NO: 472500 - DNA, 23 bp, Homo sapiens
cggtgcatacacccccacctcct

SEQ ID NO: 472501 - DNA, 18 bp, Homo sapiens
cggttggccggctggccg

SEQ ID NO: 472502 - DNA, 14 bp, Homo sapiens
cgtactcctcagac

SEQ ID NO: 472503 - DNA, 19 bp, Homo sapiens
cgtatgtggcaaaatgtta

SEQ ID NO: 472504 - DNA, 13 bp, Homo sapiens
cgtcaatgtgaaa

SEQ ID NO: 472505 - DNA, 21 bp, Homo sapiens
cgtcaatgtgaaataaagagt

SEQ ID NO: 472506 - DNA, 18 bp, Homo sapiens
cgtcatcggaggctgggc

SEQ ID NO: 472507 - DNA, 22 bp, Homo sapiens
cgtcccggccccgcgcgtgccc

SEQ ID NO: 472508 - DNA, 17 bp, Homo sapiens
cgtccctgacttcccag

SEQ ID NO: 472509 - DNA, 23 bp, Homo sapiens
cgtccctttccctgcatcccttg

SEQ ID NO: 472510 - DNA, 20 bp, Homo sapiens
cgtccgcccgcccaccccgc

SEQ ID NO: 472511 - DNA, 23 bp, Homo sapiens
cgtcctggggtggttggaggcct

SEQ ID NO: 472512 - DNA, 12 bp, Homo sapiens
cgtctgcccctt

SEQ ID NO: 472513 - DNA, 13 bp, Homo sapiens
cgtcttccctgct

SEQ ID NO: 472514 - DNA, 16 bp, Homo sapiens
cgtgacttcagactct

SEQ ID NO: 472515 - DNA, 20 bp, Homo sapiens
cgtgcaacggaagccaggcc

SEQ ID NO: 472516 - DNA, 16 bp, Homo sapiens
cgtgccatgatctgta

SEQ ID NO: 472517 - DNA, 16 bp, Homo sapiens
cgtgccttcagctcta

SEQ ID NO: 472518 - DNA, 13 bp, Homo sapiens
cgtgccttccccg

SEQ ID NO: 472519 - DNA, 22 bp, Homo sapiens
cgtgcgcagccgcgctctgccc

SEQ ID NO: 472520 - DNA, 18 bp, Homo sapiens
cgtggcttcccgctcagc

SEQ ID NO: 472521 - DNA, 21 bp, Homo sapiens
cgtggcttcccgctcagccct

SEQ ID NO: 472522 - DNA, 14 bp, Homo sapiens
cgtgggatccagag

SEQ ID NO: 472523 - DNA, 19 bp, Homo sapiens
cgtggggctaacgggcgcc

SEQ ID NO: 472524 - DNA, 14 bp, Homo sapiens
cgtgtggccctgtg

SEQ ID NO: 472525 - DNA, 15 bp, Homo sapiens
cgtgtggccctgtgg

SEQ ID NO: 472526 - DNA, 16 bp, Homo sapiens
cgtgtggccctgtggg

SEQ ID NO: 472527 - DNA, 18 bp, Homo sapiens
cgtgtggccctgtgggag

SEQ ID NO: 472528 - DNA, 19 bp, Homo sapiens
cgtgtggccctgtgggagt

SEQ ID NO: 472529 - DNA, 15 bp, Homo sapiens
cgtgttcacacacac

SEQ ID NO: 472530 - DNA, 14 bp, Homo sapiens
cgttcatctgagga

SEQ ID NO: 472531 - DNA, 16 bp, Homo sapiens
cgttgacatgcacagt

SEQ ID NO: 472532 - DNA, 21 bp, Homo sapiens
cgttgtgtgggtttactctgt

SEQ ID NO: 472533 - DNA, 15 bp, Homo sapiens
cgtttcacatctgta

SEQ ID NO: 472534 - DNA, 19 bp, Homo sapiens
cgtttttgtgctgtgggca

SEQ ID NO: 472535 - DNA, 13 bp, Homo sapiens
ctaaaaaataact

SEQ ID NO: 472536 - DNA, 21 bp, Homo sapiens
ctaaaagttctcaaatattgg

SEQ ID NO: 472537 - DNA, 21 bp, Homo sapiens
ctaaaattctagtctctgatt

SEQ ID NO: 472538 - DNA, 14 bp, Homo sapiens
ctaaactgttttca

SEQ ID NO: 472539 - DNA, 16 bp, Homo sapiens
ctaaagcagagatgta

SEQ ID NO: 472540 - DNA, 18 bp, Homo sapiens
ctaaataatatcctgaat

SEQ ID NO: 472541 - DNA, 21 bp, Homo sapiens
ctaaataatatcctgaataac

SEQ ID NO: 472542 - DNA, 17 bp, Homo sapiens
ctaaatccattttctaa

SEQ ID NO: 472543 - DNA, 22 bp, Homo sapiens
ctaaatccattttctaaactgt

SEQ ID NO: 472544 - DNA, 19 bp, Homo sapiens
ctaaattacaattgtcatt

SEQ ID NO: 472545 - DNA, 14 bp, Homo sapiens
ctaaatttgataat

SEQ ID NO: 472546 - DNA, 22 bp, Homo sapiens
ctaacctgggttgttgcagagt

SEQ ID NO: 472547 - DNA, 14 bp, Homo sapiens
ctaacgggcgcctt

SEQ ID NO: 472548 - DNA, 12 bp, Homo sapiens
ctaactggcccc

SEQ ID NO: 472549 - DNA, 16 bp, Homo sapiens
ctaactggccccaggc

SEQ ID NO: 472550 - DNA, 17 bp, Homo sapiens
ctaagaataaataaaga

SEQ ID NO: 472551 - DNA, 21 bp, Homo sapiens
ctaagaataaataaagaagaa

SEQ ID NO: 472552 - DNA, 15 bp, Homo sapiens
ctaagcttatttcta

SEQ ID NO: 472553 - DNA, 16 bp, Homo sapiens
ctaagcttatttctaa

SEQ ID NO: 472554 - DNA, 21 bp, Homo sapiens
ctaagttgtattttaataaag

SEQ ID NO: 472555 - DNA, 22 bp, Homo sapiens
ctaagttgtattttaataaaga

SEQ ID NO: 472556 - DNA, 17 bp, Homo sapiens
ctaatcagcattctcac

SEQ ID NO: 472557 - DNA, 20 bp, Homo sapiens
ctaatcagcattctcactcc

SEQ ID NO: 472558 - DNA, 12 bp, Homo sapiens
ctaatttttcct

SEQ ID NO: 472559 - DNA, 14 bp, Homo sapiens
ctacagtatataag

SEQ ID NO: 472560 - DNA, 22 bp, Homo sapiens
ctacataattaaattttaatgt

SEQ ID NO: 472561 - DNA, 20 bp, Homo sapiens
ctacatctgaaatctacaac

SEQ ID NO: 472562 - DNA, 22 bp, Homo sapiens
ctacttagcatgtccctaccga

SEQ ID NO: 472563 - DNA, 15 bp, Homo sapiens
ctagaagaaaacccg

SEQ ID NO: 472564 - DNA, 18 bp, Homo sapiens
ctagaagaaaacccgagg

SEQ ID NO: 472565 - DNA, 13 bp, Homo sapiens
ctagcaagaagat

SEQ ID NO: 472566 - DNA, 18 bp, Homo sapiens
ctagcaagaagattctaa

SEQ ID NO: 472567 - DNA, 18 bp, Homo sapiens
ctagcacaaggagtgccc

SEQ ID NO: 472568 - DNA, 23 bp, Homo sapiens
ctagccctctttctctctgtgtg

SEQ ID NO: 472569 - DNA, 23 bp, Homo sapiens
ctaggcgctcagaggccgctctg

SEQ ID NO: 472570 - DNA, 18 bp, Homo sapiens
ctaggctccctgaggtac

SEQ ID NO: 472571 - DNA, 16 bp, Homo sapiens
ctaggtctccacccct

SEQ ID NO: 472572 - DNA, 19 bp, Homo sapiens
ctaggtctccacccctcaa

SEQ ID NO: 472573 - DNA, 15 bp, Homo sapiens
ctaggtgcccagtct

SEQ ID NO: 472574 - DNA, 17 bp, Homo sapiens
ctagtcaactgctgttt

SEQ ID NO: 472575 - DNA, 14 bp, Homo sapiens
ctagtctctgattt

SEQ ID NO: 472576 - DNA, 17 bp, Homo sapiens
ctagtctctgatttgca

SEQ ID NO: 472577 - DNA, 23 bp, Homo sapiens
ctagtctctgatttgcaaatgca

SEQ ID NO: 472578 - DNA, 21 bp, Homo sapiens
ctagtgatacactgtatctaa

SEQ ID NO: 472579 - DNA, 17 bp, Homo sapiens
ctataaaaactgccccc

SEQ ID NO: 472580 - DNA, 17 bp, Homo sapiens
ctataacaactctattt

SEQ ID NO: 472581 - DNA, 18 bp, Homo sapiens
ctataacaactctatttt

SEQ ID NO: 472582 - DNA, 15 bp, Homo sapiens
ctataagagacaaag

SEQ ID NO: 472583 - DNA, 22 bp, Homo sapiens
ctataagggagtaggctgtatt

SEQ ID NO: 472584 - DNA, 20 bp, Homo sapiens
ctatatatatatatatatgt

SEQ ID NO: 472585 - DNA, 23 bp, Homo sapiens
ctatatatgaataattatgttta

SEQ ID NO: 472586 - DNA, 13 bp, Homo sapiens
ctatatttcatat

SEQ ID NO: 472587 - DNA, 17 bp, Homo sapiens
ctatatttggattcaca

SEQ ID NO: 472588 - DNA, 18 bp, Homo sapiens
ctatccacagaacctttg

SEQ ID NO: 472589 - DNA, 16 bp, Homo sapiens
ctatgcctgtatttcc

SEQ ID NO: 472590 - DNA, 14 bp, Homo sapiens
cagtttgctttgta

SEQ ID NO: 472591 - DNA, 21 bp, Homo sapiens
cataaaaataaccaaaaaatg

SEQ ID NO: 472592 - DNA, 23 bp, Homo sapiens
cataaatagtaaataatgattca

SEQ ID NO: 472593 - DNA, 15 bp, Homo sapiens
cataaatctgtctga

SEQ ID NO: 472594 - DNA, 21 bp, Homo sapiens
cataaattggctcctttccca

SEQ ID NO: 472595 - DNA, 22 bp, Homo sapiens
cataagattatatacaaagctg

SEQ ID NO: 472596 - DNA, 21 bp, Homo sapiens
cataagctggtatcagtggtt

SEQ ID NO: 472597 - DNA, 19 bp, Homo sapiens
cataatgatactgaattgt

SEQ ID NO: 472598 - DNA, 13 bp, Homo sapiens
cataattaaattt

SEQ ID NO: 472599 - DNA, 19 bp, Homo sapiens
catacagagtgtcctgatt

SEQ ID NO: 472600 - DNA, 15 bp, Homo sapiens
catacttcctggatt

SEQ ID NO: 472601 - DNA, 21 bp, Homo sapiens
catacttgctccttgaataag

SEQ ID NO: 472602 - DNA, 23 bp, Homo sapiens
catagaactgtcccacaaaatat

SEQ ID NO: 472603 - DNA, 13 bp, Homo sapiens
catagacaaaggc

SEQ ID NO: 472604 - DNA, 15 bp, Homo sapiens
catagacaaaggcct

SEQ ID NO: 472605 - DNA, 17 bp, Homo sapiens
catagacaaaggcctta

SEQ ID NO: 472606 - DNA, 15 bp, Homo sapiens
catagacacagtatt

SEQ ID NO: 472607 - DNA, 15 bp, Homo sapiens
catagagctatatat

SEQ ID NO: 472608 - DNA, 21 bp, Homo sapiens
catagccattcatttacaact

SEQ ID NO: 472609 - DNA, 20 bp, Homo sapiens
catagggtttggaagaaagg

SEQ ID NO: 472610 - DNA, 15 bp, Homo sapiens
cataggtgctcttcc

SEQ ID NO: 472611 - DNA, 14 bp, Homo sapiens
catagtctttgttt

SEQ ID NO: 472612 - DNA, 21 bp, Homo sapiens
catagtgtgctcggacacagt

SEQ ID NO: 472613 - DNA, 13 bp, Homo sapiens
catagttctgcaa

SEQ ID NO: 472614 - DNA, 12 bp, Homo sapiens
catataaatgtt

SEQ ID NO: 472615 - DNA, 17 bp, Homo sapiens
catataaatgtttatat

SEQ ID NO: 472616 - DNA, 20 bp, Homo sapiens
catataaatgtttatattgt

SEQ ID NO: 472617 - DNA, 20 bp, Homo sapiens
catataatttgccagacaga

SEQ ID NO: 472618 - DNA, 23 bp, Homo sapiens
catataatttgccagacagagat

SEQ ID NO: 472619 - DNA, 12 bp, Homo sapiens
catatataaatt

SEQ ID NO: 472620 - DNA, 13 bp, Homo sapiens
catatataaatta

SEQ ID NO: 472621 - DNA, 16 bp, Homo sapiens
catatataaattatta

SEQ ID NO: 472622 - DNA, 13 bp, Homo sapiens
catatcagctctg

SEQ ID NO: 472623 - DNA, 17 bp, Homo sapiens
catatcagctctgcata

SEQ ID NO: 472624 - DNA, 18 bp, Homo sapiens
catatcagctctgcataa

SEQ ID NO: 472625 - DNA, 23 bp, Homo sapiens
catatgacaatttcaaaatgcat

SEQ ID NO: 472626 - DNA, 21 bp, Homo sapiens
catattcttgctttcacaaat

SEQ ID NO: 472627 - DNA, 21 bp, Homo sapiens
catattgagatcagcattcaa

SEQ ID NO: 472628 - DNA, 14 bp, Homo sapiens
catatttgtagcta

SEQ ID NO: 472629 - DNA, 19 bp, Homo sapiens
catcaaagactccgagaag

SEQ ID NO: 472630 - DNA, 20 bp, Homo sapiens
tgttgaaattggaaaggact

SEQ ID NO: 472631 - DNA, 18 bp, Homo sapiens
tgttgccattttgtctgg

SEQ ID NO: 472632 - DNA, 16 bp, Homo sapiens
tgttgtattcctgcct

SEQ ID NO: 472633 - DNA, 18 bp, Homo sapiens
tgtttaacccaaaagatt

SEQ ID NO: 472634 - DNA, 19 bp, Homo sapiens
tgtttaagaaatgagaaat

SEQ ID NO: 472635 - DNA, 12 bp, Homo sapiens
tgtttacatgag

SEQ ID NO: 472636 - DNA, 16 bp, Homo sapiens
tgtttaccctccctgt

SEQ ID NO: 472637 - DNA, 22 bp, Homo sapiens
tgtttaccctccctgtcccctg

SEQ ID NO: 472638 - DNA, 12 bp, Homo sapiens
tgtttacctcac

SEQ ID NO: 472639 - DNA, 21 bp, Homo sapiens
tgtttacctcactggtgcatt

SEQ ID NO: 472640 - DNA, 14 bp, Homo sapiens
tgtttagtaataca

SEQ ID NO: 472641 - DNA, 22 bp, Homo sapiens
tgtttatattgtttttatatat

SEQ ID NO: 472642 - DNA, 21 bp, Homo sapiens
tgtttccctcaagaacaaaca

SEQ ID NO: 472643 - DNA, 14 bp, Homo sapiens
tgtttctatactgt

SEQ ID NO: 472644 - DNA, 22 bp, Homo sapiens
tgtttctatactgtttgtaata

SEQ ID NO: 472645 - DNA, 20 bp, Homo sapiens
tgtttctgcagtattctgta

SEQ ID NO: 472646 - DNA, 18 bp, Homo sapiens
tgtattcccacccctgga

SEQ ID NO: 472647 - DNA, 19 bp, Homo sapiens
tgtattctgtggattctat

SEQ ID NO: 472648 - DNA, 18 bp, Homo sapiens
tgtattttactttgtgca

SEQ ID NO: 472649 - DNA, 21 bp, Homo sapiens
tgtattttcttttatatctgt

SEQ ID NO: 472650 - DNA, 23 bp, Homo sapiens
tgtattttcttttatatctgtaa

SEQ ID NO: 472651 - DNA, 20 bp, Homo sapiens
tgtcaatttttaacttatct

SEQ ID NO: 472652 - DNA, 14 bp, Homo sapiens
tgtcaccagctatc

SEQ ID NO: 472653 - DNA, 19 bp, Homo sapiens
tgtcaccagctatctgtca

SEQ ID NO: 472654 - DNA, 17 bp, Homo sapiens
tgtcagaatttctttgt

SEQ ID NO: 472655 - DNA, 16 bp, Homo sapiens
tgtcagccagccgccc

SEQ ID NO: 472656 - DNA, 17 bp, Homo sapiens
tgtcagtagtgcctgtg

SEQ ID NO: 472657 - DNA, 15 bp, Homo sapiens
tgtcatactctgtgt

SEQ ID NO: 472658 - DNA, 16 bp, Homo sapiens
tgtcatactctgtgta

SEQ ID NO: 472659 - DNA, 18 bp, Homo sapiens
tgtcatactctgtgtaat

SEQ ID NO: 472660 - DNA, 20 bp, Homo sapiens
tgtcatactctgtgtaatct

SEQ ID NO: 472661 - DNA, 19 bp, Homo sapiens
tgtcattcaagcctgtgaa

SEQ ID NO: 472662 - DNA, 16 bp, Homo sapiens
tgtcattggttacaaa

SEQ ID NO: 472663 - DNA, 13 bp, Homo sapiens
tgtccacctgtgc

SEQ ID NO: 472664 - DNA, 16 bp, Homo sapiens
tgtccatgtgaaattt

SEQ ID NO: 472665 - DNA, 18 bp, Homo sapiens
tgtcccaccgggagcctc

SEQ ID NO: 472666 - DNA, 23 bp, Homo sapiens
tgggcccctccacgcctcctggc

SEQ ID NO: 472667 - DNA, 13 bp, Homo sapiens
tgggcgtgacttc

SEQ ID NO: 472668 - DNA, 13 bp, Homo sapiens
tgggctccagagt

SEQ ID NO: 472669 - DNA, 16 bp, Homo sapiens
tgggctccagagtagg

SEQ ID NO: 472670 - DNA, 13 bp, Homo sapiens
tgggctgccctgg

SEQ ID NO: 472671 - DNA, 14 bp, Homo sapiens
tgggctgccctggt

SEQ ID NO: 472672 - DNA, 16 bp, Homo sapiens
tgggctgccctggtgc

SEQ ID NO: 472673 - DNA, 17 bp, Homo sapiens
tgggctgccctggtgct

SEQ ID NO: 472674 - DNA, 19 bp, Homo sapiens
tgggctgccctggtgctgc

SEQ ID NO: 472675 - DNA, 12 bp, Homo sapiens
tgggctgtctgt

SEQ ID NO: 472676 - DNA, 15 bp, Homo sapiens
tgggctgtctgtcac

SEQ ID NO: 472677 - DNA, 16 bp, Homo sapiens
tgggctgtctgtcacc

SEQ ID NO: 472678 - DNA, 18 bp, Homo sapiens
tgggctgtctgtcaccag

SEQ ID NO: 472679 - DNA, 19 bp, Homo sapiens
tgggctgtctgtcaccagc

SEQ ID NO: 472680 - DNA, 23 bp, Homo sapiens
tggggagcgggggctaactggcc

SEQ ID NO: 472681 - DNA, 20 bp, Homo sapiens
tggggcactgtttcttctca

SEQ ID NO: 472682 - DNA, 17 bp, Homo sapiens
tggggcccatggcccca

SEQ ID NO: 472683 - DNA, 12 bp, Homo sapiens
tggggccctggg

SEQ ID NO: 472684 - DNA, 17 bp, Homo sapiens
tggggccctgggcctca

SEQ ID NO: 472685 - DNA, 19 bp, Homo sapiens
tggggccctgggcctcagt

SEQ ID NO: 472686 - DNA, 14 bp, Homo sapiens
tggggcctggccta

SEQ ID NO: 472687 - DNA, 21 bp, Homo sapiens
tggggcctggcctatttaagc

SEQ ID NO: 472688 - DNA, 22 bp, Homo sapiens
tggggcttggaagggcgctgag

SEQ ID NO: 472689 - DNA, 19 bp, Homo sapiens
tgggggagaatggctctgg

SEQ ID NO: 472690 - DNA, 14 bp, Homo sapiens
tgcatgcaactaat

SEQ ID NO: 472691 - DNA, 22 bp, Homo sapiens
tgcatgtgattggcagcttcaa

SEQ ID NO: 472692 - DNA, 22 bp, Homo sapiens
tgcattactattaactctgcat

SEQ ID NO: 472693 - DNA, 15 bp, Homo sapiens
tgcatttaaaatgga

SEQ ID NO: 472694 - DNA, 17 bp, Homo sapiens
tgccaaaaactaaaatt

SEQ ID NO: 472695 - DNA, 22 bp, Homo sapiens
tgccaaaaactaaaattcaaca

SEQ ID NO: 472696 - DNA, 18 bp, Homo sapiens
tgccaaaatgtcaatttt

SEQ ID NO: 472697 - DNA, 13 bp, Homo sapiens
tgccaaagatagc

SEQ ID NO: 472698 - DNA, 23 bp, Homo sapiens
tgccacacttcaggctcttctcc

SEQ ID NO: 472699 - DNA, 15 bp, Homo sapiens
tgccagacagagatc

SEQ ID NO: 472700 - DNA, 14 bp, Homo sapiens
tgccagacttaaat

SEQ ID NO: 472701 - DNA, 15 bp, Homo sapiens
tgccatgatctgtat

SEQ ID NO: 472702 - DNA, 17 bp, Homo sapiens
tgccatgatctgtattt

SEQ ID NO: 472703 - DNA, 19 bp, Homo sapiens
tgccattttgtctggctgt

SEQ ID NO: 472704 - DNA, 20 bp, Homo sapiens
tgccattttgtctggctgtg

SEQ ID NO: 472705 - DNA, 22 bp, Homo sapiens
tgccattttgtctggctgtggc

SEQ ID NO: 472706 - DNA, 20 bp, Homo sapiens
tgcccaccacaactaacaat

SEQ ID NO: 472707 - DNA, 16 bp, Homo sapiens
tgcccaccctgggcct

SEQ ID NO: 472708 - DNA, 19 bp, Homo sapiens
tgcccacgctcctgccctc

SEQ ID NO: 472709 - DNA, 16 bp, Homo sapiens
tgcccagttagcccgg

SEQ ID NO: 472710 - DNA, 14 bp, Homo sapiens
tgcccatgtgtccc

SEQ ID NO: 472711 - DNA, 11 bp, Homo sapiens
tgccccccttc

SEQ ID NO: 472712 - DNA, 16 bp, Homo sapiens
tgccccctcccccgca

SEQ ID NO: 472713 - DNA, 19 bp, Homo sapiens
tgccccctcccccgcagac

SEQ ID NO: 472714 - DNA, 20 bp, Homo sapiens
tgccccctcccccgcagaca

SEQ ID NO: 472715 - DNA, 20 bp, Homo sapiens
tgccccttgaccccacacgc

SEQ ID NO: 472716 - DNA, 19 bp, Homo sapiens
tgccctattgtaagttgtt

SEQ ID NO: 472717 - DNA, 22 bp, Homo sapiens
tgccctcactccactcccctca

SEQ ID NO: 472718 - DNA, 17 bp, Homo sapiens
tgccctcccccacggcc

SEQ ID NO: 472719 - DNA, 15 bp, Homo sapiens
tgccctccctccttc

SEQ ID NO: 472720 - DNA, 16 bp, Homo sapiens
tgccctccctccttcc

SEQ ID NO: 472721 - DNA, 12 bp, Homo sapiens
tgccctgcacct

SEQ ID NO: 472722 - DNA, 21 bp, Homo sapiens
tgccctggtgctgccacactt

SEQ ID NO: 472723 - DNA, 14 bp, Homo sapiens
tgccgctgcaccac

SEQ ID NO: 472724 - DNA, 24 bp, Homo sapiens
tgcctcgagtccccccacccctcc

SEQ ID NO: 472725 - DNA, 17 bp, Homo sapiens
tgcctctgaaaatattt

SEQ ID NO: 472726 - DNA, 19 bp, Homo sapiens
tgcctgaatccacctgcag

SEQ ID NO: 472727 - DNA, 11 bp, Homo sapiens
tgcctgagccc

SEQ ID NO: 472728 - DNA, 20 bp, Homo sapiens
tgcctgagcccgaatttctc

SEQ ID NO: 472729 - DNA, 15 bp, Homo sapiens
tgcctgcaccaggag

SEQ ID NO: 472730 - DNA, 16 bp, Homo sapiens
tgcctgcaccaggaga

SEQ ID NO: 472731 - DNA, 17 bp, Homo sapiens
tgcctggagggaatcca

SEQ ID NO: 472732 - DNA, 20 bp, Homo sapiens
tgcctggcgggcagcccctg

SEQ ID NO: 472733 - DNA, 21 bp, Homo sapiens
tgcctggcgggcagcccctgc

SEQ ID NO: 472734 - DNA, 14 bp, Homo sapiens
tgccttagaacctt

SEQ ID NO: 472735 - DNA, 13 bp, Homo sapiens
tgccttcagctct

SEQ ID NO: 472736 - DNA, 17 bp, Homo sapiens
tgccttcagctctacag

SEQ ID NO: 472737 - DNA, 18 bp, Homo sapiens
tgcctttagcgtgtaaat

SEQ ID NO: 472738 - DNA, 13 bp, Homo sapiens
tgcctttctagtc

SEQ ID NO: 472739 - DNA, 22 bp, Homo sapiens
tgcctttgagcttctcctctgc

SEQ ID NO: 472740 - DNA, 13 bp, Homo sapiens
tgcgcaatgtggc

SEQ ID NO: 472741 - DNA, 19 bp, Homo sapiens
tgcgcagccgcgctctgcc

SEQ ID NO: 472742 - DNA, 21 bp, Homo sapiens
tgcgcagccgcgctctgcccc

SEQ ID NO: 472743 - DNA, 13 bp, Homo sapiens
tgcgccctccctc

SEQ ID NO: 472744 - DNA, 20 bp, Homo sapiens
tgcgccctccctccctccac

SEQ ID NO: 472745 - DNA, 14 bp, Homo sapiens
tgcgctcctctgca

SEQ ID NO: 472746 - DNA, 20 bp, Homo sapiens
tgcgctcctctgcagcctga

SEQ ID NO: 472747 - DNA, 11 bp, Homo sapiens
tgcgctgtgct

SEQ ID NO: 472748 - DNA, 12 bp, Homo sapiens
tgcgctgtgctc

SEQ ID NO: 472749 - DNA, 23 bp, Homo sapiens
tgcggaccggagcggctgaggac

SEQ ID NO: 472750 - DNA, 15 bp, Homo sapiens
tgcggcaccgcccac

SEQ ID NO: 472751 - DNA, 18 bp, Homo sapiens
tgcggcaccgcccaccca

SEQ ID NO: 472752 - DNA, 19 bp, Homo sapiens
tgcggcccgtgcgcagccg

SEQ ID NO: 472753 - DNA, 13 bp, Homo sapiens
tgcggtgtgtctc

SEQ ID NO: 472754 - DNA, 17 bp, Homo sapiens
tgcgtgaccggcccgcc

SEQ ID NO: 472755 - DNA, 16 bp, Homo sapiens
tgcgtgtggccctgtg

SEQ ID NO: 472756 - DNA, 14 bp, Homo sapiens
tgctaatgtaatca

SEQ ID NO: 472757 - DNA, 15 bp, Homo sapiens
tgctaatttatgaag

SEQ ID NO: 472758 - DNA, 20 bp, Homo sapiens
tgctaatttatgaagatagt

SEQ ID NO: 472759 - DNA, 22 bp, Homo sapiens
tgctagtgatacactgtatcta

SEQ ID NO: 472760 - DNA, 15 bp, Homo sapiens
tgctatgtctgtgat

SEQ ID NO: 472761 - DNA, 13 bp, Homo sapiens
tgctattgtttat

SEQ ID NO: 472762 - DNA, 14 bp, Homo sapiens
tgctattgtttata

SEQ ID NO: 472763 - DNA, 19 bp, Homo sapiens
tgctattgtttataggaaa

SEQ ID NO: 472764 - DNA, 22 bp, Homo sapiens
tgctattgtttataggaaataa

SEQ ID NO: 472765 - DNA, 22 bp, Homo sapiens
tgctcacgtctgtgagtctgtc

SEQ ID NO: 472766 - DNA, 22 bp, Homo sapiens
tgctccaacagacaccctccac

SEQ ID NO: 472767 - DNA, 19 bp, Homo sapiens
tgctccagcagtgctgggc

SEQ ID NO: 472768 - DNA, 22 bp, Homo sapiens
tgctccagcagtgctgggccca

SEQ ID NO: 472769 - DNA, 12 bp, Homo sapiens
tgctcctttggg

SEQ ID NO: 472770 - DNA, 22 bp, Homo sapiens
tgctcggacacagttttgtctt

SEQ ID NO: 472771 - DNA, 14 bp, Homo sapiens
tgctctccttcact

SEQ ID NO: 472772 - DNA, 20 bp, Homo sapiens
tgctctccttcactctgaca

SEQ ID NO: 472773 - DNA, 16 bp, Homo sapiens
tgctgagagacctcag

SEQ ID NO: 472774 - DNA, 16 bp, Homo sapiens
tgctgcaatacattaa

SEQ ID NO: 472775 - DNA, 19 bp, Homo sapiens
tgctgcaatacattaaaat

SEQ ID NO: 472776 - DNA, 16 bp, Homo sapiens
tgctgccacacttcag

SEQ ID NO: 472777 - DNA, 22 bp, Homo sapiens
tgctgccacacttcaggctctt

SEQ ID NO: 472778 - DNA, 16 bp, Homo sapiens
tgctgctcgggaaggc

SEQ ID NO: 472779 - DNA, 14 bp, Homo sapiens
tgctggccagcacc

SEQ ID NO: 472780 - DNA, 17 bp, Homo sapiens
tgctggccagcaccctc

SEQ ID NO: 472781 - DNA, 18 bp, Homo sapiens
tgctggccagcaccctct

SEQ ID NO: 472782 - DNA, 19 bp, Homo sapiens
tgctggccagcaccctctc

SEQ ID NO: 472783 - DNA, 14 bp, Homo sapiens
tgctggctgcctta

SEQ ID NO: 472784 - DNA, 20 bp, Homo sapiens
tgctgtcctccagggcgagc

SEQ ID NO: 472785 - DNA, 11 bp, Homo sapiens
tgctgtgggca

SEQ ID NO: 472786 - DNA, 17 bp, Homo sapiens
tgctgtgggcagcaccc

SEQ ID NO: 472787 - DNA, 16 bp, Homo sapiens
tgctgtttatatatat

SEQ ID NO: 472788 - DNA, 11 bp, Homo sapiens
tcttcaaggcc

SEQ ID NO: 472789 - DNA, 16 bp, Homo sapiens
tcttcatccatagaca

SEQ ID NO: 472790 - DNA, 18 bp, Homo sapiens
tcttcatccatagacaca

SEQ ID NO: 472791 - DNA, 23 bp, Homo sapiens
tcttcccccttcccctgcgccct

SEQ ID NO: 472792 - DNA, 24 bp, Homo sapiens
tcttcccccttcccctgcgccctc

SEQ ID NO: 472793 - DNA, 15 bp, Homo sapiens
tcttcccccttcccg

SEQ ID NO: 472794 - DNA, 12 bp, Homo sapiens
tcttccctgctt

SEQ ID NO: 472795 - DNA, 13 bp, Homo sapiens
tcttccctgcttc

SEQ ID NO: 472796 - DNA, 21 bp, Homo sapiens
tcttccctgcttcacgattct

SEQ ID NO: 472797 - DNA, 13 bp, Homo sapiens
tcttcctgtagtg

SEQ ID NO: 472798 - DNA, 13 bp, Homo sapiens
tcttctatattaa

SEQ ID NO: 472799 - DNA, 15 bp, Homo sapiens
tcttctcagctccac

SEQ ID NO: 472800 - DNA, 12 bp, Homo sapiens
tcttctccactg

SEQ ID NO: 472801 - DNA, 14 bp, Homo sapiens
tcttctcctttcac

SEQ ID NO: 472802 - DNA, 22 bp, Homo sapiens
tcttgagcaaggcaagaagtgg

SEQ ID NO: 472803 - DNA, 17 bp, Homo sapiens
tcttgagtgggccccct

SEQ ID NO: 472804 - DNA, 19 bp, Homo sapiens
tcttgcggcaccgcccacc

SEQ ID NO: 472805 - DNA, 18 bp, Homo sapiens
tcttgctttcacaaatat

SEQ ID NO: 472806 - DNA, 21 bp, Homo sapiens
tcttgctttcacaaatatagt

SEQ ID NO: 472807 - DNA, 13 bp, Homo sapiens
tcttggagaggag

SEQ ID NO: 472808 - DNA, 14 bp, Homo sapiens
tcttggagaggagg

SEQ ID NO: 472809 - DNA, 21 bp, Homo sapiens
tcttggattggtaccagagcc

SEQ ID NO: 472810 - DNA, 18 bp, Homo sapiens
tcttggccctattcatta

SEQ ID NO: 472811 - DNA, 17 bp, Homo sapiens
tctttaacatacatcta

SEQ ID NO: 472812 - DNA, 15 bp, Homo sapiens
tctttatgactgttt

SEQ ID NO: 472813 - DNA, 15 bp, Homo sapiens
tctttctctctgtgt

SEQ ID NO: 472814 - DNA, 19 bp, Homo sapiens
tctttctctctgtgtggca

SEQ ID NO: 472815 - DNA, 17 bp, Homo sapiens
tctttctctctttccat

SEQ ID NO: 472816 - DNA, 20 bp, Homo sapiens
tctttctctctttccatctc

SEQ ID NO: 472817 - DNA, 15 bp, Homo sapiens
tctttgattgtgaaa

SEQ ID NO: 472818 - DNA, 23 bp, Homo sapiens
tctttgggggattcaaatgcatg

SEQ ID NO: 472819 - DNA, 20 bp, Homo sapiens
tctttgtgacaggaaagccc

SEQ ID NO: 472820 - DNA, 22 bp, Homo sapiens
tctttgtgacaggaaagccctc

SEQ ID NO: 472821 - DNA, 12 bp, Homo sapiens
tcttttaactgc

SEQ ID NO: 472822 - DNA, 18 bp, Homo sapiens
tcttttatatctgtaaat

SEQ ID NO: 472823 - DNA, 23 bp, Homo sapiens
tcttttatatctgtaaatttaac

SEQ ID NO: 472824 - DNA, 19 bp, Homo sapiens
tcttttcagcttgtttcta

SEQ ID NO: 472825 - DNA, 23 bp, Homo sapiens
tcttttgaatcaatctggcttct

SEQ ID NO: 472826 - DNA, 23 bp, Homo sapiens
tgaaaaaaagggaaaacaaatat

SEQ ID NO: 472827 - DNA, 12 bp, Homo sapiens
tgaaaaaagaag

SEQ ID NO: 472828 - DNA, 11 bp, Homo sapiens
tgaaaaaggat

SEQ ID NO: 472829 - DNA, 19 bp, Homo sapiens
tgaaaagaagaaagtctat

SEQ ID NO: 472830 - DNA, 21 bp, Homo sapiens
tgaaaatatttttttctagct

SEQ ID NO: 472831 - DNA, 22 bp, Homo sapiens
tgaaaatatttttttctagcta

SEQ ID NO: 472832 - DNA, 18 bp, Homo sapiens
tgaaataaagagttctcc

SEQ ID NO: 472833 - DNA, 13 bp, Homo sapiens
tgaaatctacaac

SEQ ID NO: 472834 - DNA, 15 bp, Homo sapiens
tgaaatctacaacat

SEQ ID NO: 472835 - DNA, 17 bp, Homo sapiens
tgaaattggaaaggact

SEQ ID NO: 472836 - DNA, 15 bp, Homo sapiens
tgaacaagatttccc

SEQ ID NO: 472837 - DNA, 20 bp, Homo sapiens
tgaacaagccacgttgcaga

SEQ ID NO: 472838 - DNA, 17 bp, Homo sapiens
tgaacacagatcattct

SEQ ID NO: 472839 - DNA, 19 bp, Homo sapiens
tgaaccgtcaatgtgaaat

SEQ ID NO: 472840 - DNA, 22 bp, Homo sapiens
tgaaccgtcaatgtgaaataaa

SEQ ID NO: 472841 - DNA, 14 bp, Homo sapiens
tgaactttggaagc

SEQ ID NO: 472842 - DNA, 15 bp, Homo sapiens
tgaagcccaggagga

SEQ ID NO: 472843 - DNA, 13 bp, Homo sapiens
tgaagcctttatc

SEQ ID NO: 472844 - DNA, 17 bp, Homo sapiens
tgaagggaaatcaattt

SEQ ID NO: 472845 - DNA, 21 bp, Homo sapiens
tgaagtcccttcctgtcctgc

SEQ ID NO: 472846 - DNA, 16 bp, Homo sapiens
tggcacagggcagtgg

SEQ ID NO: 472847 - DNA, 18 bp, Homo sapiens
tggcacagggcagtggga

SEQ ID NO: 472848 - DNA, 20 bp, Homo sapiens
tggcaccagatgcaacctca

SEQ ID NO: 472849 - DNA, 16 bp, Homo sapiens
tggcagccgtgccttc

SEQ ID NO: 472850 - DNA, 17 bp, Homo sapiens
tggcagccgtgccttca

SEQ ID NO: 472851 - DNA, 15 bp, Homo sapiens
tggcatagagcagca

SEQ ID NO: 472852 - DNA, 18 bp, Homo sapiens
tggcatagccattcattt

SEQ ID NO: 472853 - DNA, 20 bp, Homo sapiens
tggccacccttggcctgtcc

SEQ ID NO: 472854 - DNA, 18 bp, Homo sapiens
tggccagcaccctctcct

SEQ ID NO: 472855 - DNA, 21 bp, Homo sapiens
tggcccacccctcttccccct

SEQ ID NO: 472856 - DNA, 16 bp, Homo sapiens
tggccccagctggctg

SEQ ID NO: 472857 - DNA, 20 bp, Homo sapiens
tggccccagctggctgggtc

SEQ ID NO: 472858 - DNA, 21 bp, Homo sapiens
tggcccctccttctcccctcc

SEQ ID NO: 472859 - DNA, 23 bp, Homo sapiens
tggcccctccttctcccctccag

SEQ ID NO: 472860 - DNA, 14 bp, Homo sapiens
tggcccctctctgt

SEQ ID NO: 472861 - DNA, 17 bp, Homo sapiens
tggcccgacagcctggc

SEQ ID NO: 472862 - DNA, 16 bp, Homo sapiens
tggccctgccctcccc

SEQ ID NO: 472863 - DNA, 21 bp, Homo sapiens
tggccctgtgggagtccactt

SEQ ID NO: 472864 - DNA, 12 bp, Homo sapiens
tggccggctggc

SEQ ID NO: 472865 - DNA, 15 bp, Homo sapiens
tggcctatttaagcc

SEQ ID NO: 472866 - DNA, 16 bp, Homo sapiens
tggcctcagccctcag

SEQ ID NO: 472867 - DNA, 14 bp, Homo sapiens
tggcctgagaagag

SEQ ID NO: 472868 - DNA, 22 bp, Homo sapiens
tggcgcatagtgtgctcggaca

SEQ ID NO: 472869 - DNA, 15 bp, Homo sapiens
tggctcctttcccac

SEQ ID NO: 472870 - DNA, 19 bp, Homo sapiens
tggctcctttcccacagtc

SEQ ID NO: 472871 - DNA, 21 bp, Homo sapiens
tggctctgttgctgtcctcca

SEQ ID NO: 472872 - DNA, 20 bp, Homo sapiens
tggctgggtcgcccctcctc

SEQ ID NO: 472873 - DNA, 20 bp, Homo sapiens
tggctgggtttgggcagtgg

SEQ ID NO: 472874 - DNA, 18 bp, Homo sapiens
tggctgtggcccctcctt

SEQ ID NO: 472875 - DNA, 23 bp, Homo sapiens
tggctgtggcccctccttctccc

SEQ ID NO: 472876 - DNA, 14 bp, Homo sapiens
tggcttaaacattt

SEQ ID NO: 472877 - DNA, 15 bp, Homo sapiens
tggcttaaacatttt

SEQ ID NO: 472878 - DNA, 18 bp, Homo sapiens
tggcttaagcctgtgtat

SEQ ID NO: 472879 - DNA, 17 bp, Homo sapiens
tggcttcccgctcagcc

SEQ ID NO: 472880 - DNA, 20 bp, Homo sapiens
tggcttcccgctcagccctc

SEQ ID NO: 472881 - DNA, 18 bp, Homo sapiens
tggcttccgtgagacaca

SEQ ID NO: 472882 - DNA, 15 bp, Homo sapiens
tggcttttcactgct

SEQ ID NO: 472883 - DNA, 19 bp, Homo sapiens
tgggaaattcttgcactgt

SEQ ID NO: 472884 - DNA, 20 bp, Homo sapiens
tgggaaattcttgcactgta

SEQ ID NO: 472885 - DNA, 16 bp, Homo sapiens
tgggacagggcatggc

SEQ ID NO: 472886 - DNA, 18 bp, Homo sapiens
tgggaccagggatggggg

SEQ ID NO: 472887 - DNA, 14 bp, Homo sapiens
tgggacggaagtgg

SEQ ID NO: 472888 - DNA, 16 bp, Homo sapiens
tgggagactgagcttg

SEQ ID NO: 472889 - DNA, 17 bp, Homo sapiens
tgggaggaacaaagaca

SEQ ID NO: 472890 - DNA, 14 bp, Homo sapiens
tgggatccagagag

SEQ ID NO: 472891 - DNA, 15 bp, Homo sapiens
tgggatccagagaga

SEQ ID NO: 472892 - DNA, 15 bp, Homo sapiens
tgggcaagtgattga

SEQ ID NO: 472893 - DNA, 15 bp, Homo sapiens
tgggcacgggagagc

SEQ ID NO: 472894 - DNA, 14 bp, Homo sapiens
tgggcagcaccctc

SEQ ID NO: 472895 - DNA, 16 bp, Homo sapiens
tgggcagcaccctccc

SEQ ID NO: 472896 - DNA, 16 bp, Homo sapiens
tgggcagggccgcagg

SEQ ID NO: 472897 - DNA, 13 bp, Homo sapiens
tgggcagtggaga

SEQ ID NO: 472898 - DNA, 14 bp, Homo sapiens
tgggcagtggagag

SEQ ID NO: 472899 - DNA, 15 bp, Homo sapiens
tgggcagtggagagg

SEQ ID NO: 472900 - DNA, 10 bp, Homo sapiens
tgggccaggg

SEQ ID NO: 472901 - DNA, 22 bp, Homo sapiens
tgggcccagccggggtggggtg

SEQ ID NO: 472902 - DNA, 17 bp, Homo sapiens
tgggcccctccacgcct

SEQ ID NO: 472903 - DNA, 22 bp, Homo sapiens
tgggcccctccacgcctcctgg

SEQ ID NO: 472904 - DNA, 14 bp, Homo sapiens
tcccctccagaccc

SEQ ID NO: 472905 - DNA, 13 bp, Homo sapiens
tcccctctcctga

SEQ ID NO: 472906 - DNA, 19 bp, Homo sapiens
tcccctgaggacctttctg

SEQ ID NO: 472907 - DNA, 14 bp, Homo sapiens
tcccgcagcaccag

SEQ ID NO: 472908 - DNA, 23 bp, Homo sapiens
tcccgcagcaccagcctgagcca

SEQ ID NO: 472909 - DNA, 15 bp, Homo sapiens
tcccgccgcctcggg

SEQ ID NO: 472910 - DNA, 18 bp, Homo sapiens
tcccgccgcctcgggccg

SEQ ID NO: 472911 - DNA, 23 bp, Homo sapiens
tcccgccgcctcgggccgcctcc

SEQ ID NO: 472912 - DNA, 19 bp, Homo sapiens
tcccgccttcaggttcctc

SEQ ID NO: 472913 - DNA, 21 bp, Homo sapiens
tcccgccttcaggttcctcct

SEQ ID NO: 472914 - DNA, 15 bp, Homo sapiens
tcccgcctttgacct

SEQ ID NO: 472915 - DNA, 14 bp, Homo sapiens
tcccgctcagccct

SEQ ID NO: 472916 - DNA, 16 bp, Homo sapiens
tcccgctcagccctcc

SEQ ID NO: 472917 - DNA, 20 bp, Homo sapiens
tcccgctcagccctccctgc

SEQ ID NO: 472918 - DNA, 14 bp, Homo sapiens
tcccggccccgcgc

SEQ ID NO: 472919 - DNA, 23 bp, Homo sapiens
tcccggccccgcgcgtgccccca

SEQ ID NO: 472920 - DNA, 16 bp, Homo sapiens
tcccggtcctctgcat

SEQ ID NO: 472921 - DNA, 15 bp, Homo sapiens
tcccgtccgtccgcc

SEQ ID NO: 472922 - DNA, 19 bp, Homo sapiens
tccctaccctcttctcagc

SEQ ID NO: 472923 - DNA, 22 bp, Homo sapiens
tccctaccgagtctcttctcca

SEQ ID NO: 472924 - DNA, 23 bp, Homo sapiens
tccctaccgagtctcttctccac

SEQ ID NO: 472925 - DNA, 13 bp, Homo sapiens
tccctccactcct

SEQ ID NO: 472926 - DNA, 15 bp, Homo sapiens
tccctccactcctcc

SEQ ID NO: 472927 - DNA, 22 bp, Homo sapiens
tccctccactcctcccaactct

SEQ ID NO: 472928 - DNA, 12 bp, Homo sapiens
tccctccctcca

SEQ ID NO: 472929 - DNA, 15 bp, Homo sapiens
tccctgacttcccag

SEQ ID NO: 472930 - DNA, 18 bp, Homo sapiens
tccctgaggtacctttcc

SEQ ID NO: 472931 - DNA, 20 bp, Homo sapiens
tccctgaggtacctttccac

SEQ ID NO: 472932 - DNA, 14 bp, Homo sapiens
tccctgcccctccc

SEQ ID NO: 472933 - DNA, 20 bp, Homo sapiens
tccctgcccctcccttcaac

SEQ ID NO: 472934 - DNA, 11 bp, Homo sapiens
tccctgtgggg

SEQ ID NO: 472935 - DNA, 13 bp, Homo sapiens
tcccttcctacag

SEQ ID NO: 472936 - DNA, 14 bp, Homo sapiens
tcccttcctgtcct

SEQ ID NO: 472937 - DNA, 16 bp, Homo sapiens
tcccttggcccctctc

SEQ ID NO: 472938 - DNA, 13 bp, Homo sapiens
tccctttccctgc

SEQ ID NO: 472939 - DNA, 14 bp, Homo sapiens
tccctttccctgca

SEQ ID NO: 472940 - DNA, 22 bp, Homo sapiens
tccctttgtggactttatttaa

SEQ ID NO: 472941 - DNA, 19 bp, Homo sapiens
tccgcccagcctctccccg

SEQ ID NO: 472942 - DNA, 16 bp, Homo sapiens
tccgcccgcccacccc

SEQ ID NO: 472943 - DNA, 16 bp, Homo sapiens
tccgctgtcgccccag

SEQ ID NO: 472944 - DNA, 18 bp, Homo sapiens
tccgctgtcgccccaggc

SEQ ID NO: 472945 - DNA, 18 bp, Homo sapiens
tccggcagaggcagggcc

SEQ ID NO: 472946 - DNA, 21 bp, Homo sapiens
tccggcagaggcagggccctg

SEQ ID NO: 472947 - DNA, 14 bp, Homo sapiens
tccggcctgcagcc

SEQ ID NO: 472948 - DNA, 17 bp, Homo sapiens
tccgggtgtggcctcag

SEQ ID NO: 472949 - DNA, 19 bp, Homo sapiens
tccgggtgtggcctcagcc

SEQ ID NO: 472950 - DNA, 20 bp, Homo sapiens
tccgggtgtggcctcagccc

SEQ ID NO: 472951 - DNA, 14 bp, Homo sapiens
tccgtgagacacaa

SEQ ID NO: 472952 - DNA, 20 bp, Homo sapiens
tccgtgagagtcatctcaaa

SEQ ID NO: 472953 - DNA, 17 bp, Homo sapiens
tcctaaagaaaaagata

SEQ ID NO: 472954 - DNA, 20 bp, Homo sapiens
tcctagcacaaggagtgccc

SEQ ID NO: 472955 - DNA, 16 bp, Homo sapiens
tcctaggcgctcagag

SEQ ID NO: 472956 - DNA, 18 bp, Homo sapiens
tcctaggcgctcagaggc

SEQ ID NO: 472957 - DNA, 22 bp, Homo sapiens
tcctaggctccctgaggtacct

SEQ ID NO: 472958 - DNA, 17 bp, Homo sapiens
tcctcccaactctggcc

SEQ ID NO: 472959 - DNA, 13 bp, Homo sapiens
tcctcccaggcgc

SEQ ID NO: 472960 - DNA, 21 bp, Homo sapiens
tcctcccaggcgccccttccc

SEQ ID NO: 472961 - DNA, 19 bp, Homo sapiens
tcctccttcactccctgtc

SEQ ID NO: 472962 - DNA, 15 bp, Homo sapiens
tcctcgggcgcctgc

SEQ ID NO: 472963 - DNA, 22 bp, Homo sapiens
tcctcgtccggcctgcagccca

SEQ ID NO: 472964 - DNA, 12 bp, Homo sapiens
tcctctccactg

SEQ ID NO: 472965 - DNA, 14 bp, Homo sapiens
tcctctccactgcc

SEQ ID NO: 472966 - DNA, 17 bp, Homo sapiens
tcctctccactgccttc

SEQ ID NO: 472967 - DNA, 23 bp, Homo sapiens
tcctctcctcgtccggcctgcag

SEQ ID NO: 472968 - DNA, 15 bp, Homo sapiens
tcctctcgagcccag

SEQ ID NO: 472969 - DNA, 22 bp, Homo sapiens
tcctctcgagcccagatggaaa

SEQ ID NO: 472970 - DNA, 12 bp, Homo sapiens
tcctctgccccc

SEQ ID NO: 472971 - DNA, 20 bp, Homo sapiens
tcctctgccccctcccccgc

SEQ ID NO: 472972 - DNA, 13 bp, Homo sapiens
tcctctgccttgg

SEQ ID NO: 472973 - DNA, 12 bp, Homo sapiens
tcctctgctcca

SEQ ID NO: 472974 - DNA, 23 bp, Homo sapiens
tcctctgctccaacagacaccct

SEQ ID NO: 472975 - DNA, 17 bp, Homo sapiens
tcctctgcttgtcattc

SEQ ID NO: 472976 - DNA, 14 bp, Homo sapiens
tcctcttacctgta

SEQ ID NO: 472977 - DNA, 11 bp, Homo sapiens
tcctgaataac

SEQ ID NO: 472978 - DNA, 16 bp, Homo sapiens
tcctgaggaccgcccc

SEQ ID NO: 472979 - DNA, 21 bp, Homo sapiens
tcctgaggaccgccccaaccc

SEQ ID NO: 472980 - DNA, 22 bp, Homo sapiens
tcctgaggaccgccccaaccct

SEQ ID NO: 472981 - DNA, 20 bp, Homo sapiens
tcctgcccatgtgtcccctc

SEQ ID NO: 472982 - DNA, 17 bp, Homo sapiens
tcctgctagctgtagaa

SEQ ID NO: 472983 - DNA, 22 bp, Homo sapiens
tcctgctagctgtagaaatgta

SEQ ID NO: 472984 - DNA, 21 bp, Homo sapiens
tcctgctcacgtctgtgagtc

SEQ ID NO: 472985 - DNA, 12 bp, Homo sapiens
tcctgctgctcg

SEQ ID NO: 472986 - DNA, 22 bp, Homo sapiens
tcctgctgctcgggaaggcctg

SEQ ID NO: 472987 - DNA, 20 bp, Homo sapiens
tcctggattttctttctatg

SEQ ID NO: 472988 - DNA, 16 bp, Homo sapiens
tcctgggggtggcagg

SEQ ID NO: 472989 - DNA, 18 bp, Homo sapiens
tcctgggggtggcaggca

SEQ ID NO: 472990 - DNA, 19 bp, Homo sapiens
tcctgggggtggcaggcac

SEQ ID NO: 472991 - DNA, 18 bp, Homo sapiens
tcctggggtggttggagg

SEQ ID NO: 472992 - DNA, 13 bp, Homo sapiens
tcctggtgtctag

SEQ ID NO: 472993 - DNA, 22 bp, Homo sapiens
tcctgtgatagagttcttttaa

SEQ ID NO: 472994 - DNA, 14 bp, Homo sapiens
tccttccatcctga

SEQ ID NO: 472995 - DNA, 16 bp, Homo sapiens
tccttccatcctgagg

SEQ ID NO: 472996 - DNA, 18 bp, Homo sapiens
tccttccatcctgaggac

SEQ ID NO: 472997 - DNA, 14 bp, Homo sapiens
tccttccccacccc

SEQ ID NO: 472998 - DNA, 15 bp, Homo sapiens
tccttccccacccca

SEQ ID NO: 472999 - DNA, 17 bp, Homo sapiens
tccttccccaccccata

SEQ ID NO: 473000 - DNA, 20 bp, Homo sapiens
tccttccccaccccataagc

SEQ ID NO: 473001 - DNA, 18 bp, Homo sapiens
tccttcccgcagcaccag

SEQ ID NO: 473002 - DNA, 16 bp, Homo sapiens
tcatccatagacacag

SEQ ID NO: 473003 - DNA, 18 bp, Homo sapiens
tcatccatagacacagta

SEQ ID NO: 473004 - DNA, 13 bp, Homo sapiens
tcatctctctggg

SEQ ID NO: 473005 - DNA, 14 bp, Homo sapiens
tcatctctctgggg

SEQ ID NO: 473006 - DNA, 15 bp, Homo sapiens
tcatctctctggggc

SEQ ID NO: 473007 - DNA, 16 bp, Homo sapiens
tcatctctctggggcc

SEQ ID NO: 473008 - DNA, 18 bp, Homo sapiens
tcatctgaggagtccaaa

SEQ ID NO: 473009 - DNA, 22 bp, Homo sapiens
tcatctgaggagtccaaaatat

SEQ ID NO: 473010 - DNA, 18 bp, Homo sapiens
tcatctgttatcctgcta

SEQ ID NO: 473011 - DNA, 14 bp, Homo sapiens
tcatgcatagacaa

SEQ ID NO: 473012 - DNA, 13 bp, Homo sapiens
tcatgggaagaac

SEQ ID NO: 473013 - DNA, 15 bp, Homo sapiens
tcatgtttaagaaat

SEQ ID NO: 473014 - DNA, 20 bp, Homo sapiens
tcatgtttaagaaatgagaa

SEQ ID NO: 473015 - DNA, 23 bp, Homo sapiens
tcatgtttaagaaatgagaaatt

SEQ ID NO: 473016 - DNA, 14 bp, Homo sapiens
tcatgtttctgcag

SEQ ID NO: 473017 - DNA, 23 bp, Homo sapiens
tcatgtttctgcagtattctgta

SEQ ID NO: 473018 - DNA, 15 bp, Homo sapiens
tcattcatactcaaa

SEQ ID NO: 473019 - DNA, 20 bp, Homo sapiens
tcattcttttcagcttgttt

SEQ ID NO: 473020 - DNA, 19 bp, Homo sapiens
tcatttacaacttccagat

SEQ ID NO: 473021 - DNA, 21 bp, Homo sapiens
tcatttataaaaccatcaaaa

SEQ ID NO: 473022 - DNA, 21 bp, Homo sapiens
tccaaataaaacttgagccca

SEQ ID NO: 473023 - DNA, 23 bp, Homo sapiens
tccaaataggagtcttctgcctc

SEQ ID NO: 473024 - DNA, 15 bp, Homo sapiens
tccaacagacaccct

SEQ ID NO: 473025 - DNA, 18 bp, Homo sapiens
tccaacagacaccctcca

SEQ ID NO: 473026 - DNA, 17 bp, Homo sapiens
tccaagtgtgtgtgcaa

SEQ ID NO: 473027 - DNA, 11 bp, Homo sapiens
tccacccagac

SEQ ID NO: 473028 - DNA, 23 bp, Homo sapiens
tccacccagaccctccttcccca

SEQ ID NO: 473029 - DNA, 15 bp, Homo sapiens
tccacccagaggtct

SEQ ID NO: 473030 - DNA, 18 bp, Homo sapiens
tccacccagaggtctccc

SEQ ID NO: 473031 - DNA, 21 bp, Homo sapiens
tccacccctcaagccaggaga

SEQ ID NO: 473032 - DNA, 17 bp, Homo sapiens
tccaccgccaccccact

SEQ ID NO: 473033 - DNA, 14 bp, Homo sapiens
tccacctgcagtta

SEQ ID NO: 473034 - DNA, 17 bp, Homo sapiens
tccacctgtgctgctgc

SEQ ID NO: 473035 - DNA, 19 bp, Homo sapiens
tccacgcctcctggccaga

SEQ ID NO: 473036 - DNA, 17 bp, Homo sapiens
tccactaggtgcccagt

SEQ ID NO: 473037 - DNA, 14 bp, Homo sapiens
tccactcccctcat

SEQ ID NO: 473038 - DNA, 15 bp, Homo sapiens
tccactcccctcatc

SEQ ID NO: 473039 - DNA, 23 bp, Homo sapiens
tccactcctcccaactctggcct

SEQ ID NO: 473040 - DNA, 13 bp, Homo sapiens
tccactctgaggt

SEQ ID NO: 473041 - DNA, 16 bp, Homo sapiens
tccactctgaggtctc

SEQ ID NO: 473042 - DNA, 15 bp, Homo sapiens
tccactgccttcgat

SEQ ID NO: 473043 - DNA, 23 bp, Homo sapiens
tccacttcagggttctaaccttt

SEQ ID NO: 473044 - DNA, 17 bp, Homo sapiens
tccacttccagaggggg

SEQ ID NO: 473045 - DNA, 18 bp, Homo sapiens
tccactttcctctctctc

SEQ ID NO: 473046 - DNA, 18 bp, Homo sapiens
tccagacagggtggggct

SEQ ID NO: 473047 - DNA, 15 bp, Homo sapiens
tccagacccctggct

SEQ ID NO: 473048 - DNA, 23 bp, Homo sapiens
tccagactcgagagggctgagcc

SEQ ID NO: 473049 - DNA, 13 bp, Homo sapiens
tccagagagaagc

SEQ ID NO: 473050 - DNA, 19 bp, Homo sapiens
tccagagagtggctcctcc

SEQ ID NO: 473051 - DNA, 18 bp, Homo sapiens
tccagattattttctata

SEQ ID NO: 473052 - DNA, 19 bp, Homo sapiens
tccagattattttctatat

SEQ ID NO: 473053 - DNA, 15 bp, Homo sapiens
tccagcagtgctggg

SEQ ID NO: 473054 - DNA, 17 bp, Homo sapiens
tccagcagtgctgggcc

SEQ ID NO: 473055 - DNA, 19 bp, Homo sapiens
tccagcagtgctgggccca

SEQ ID NO: 473056 - DNA, 11 bp, Homo sapiens
tccagctgctc

SEQ ID NO: 473057 - DNA, 14 bp, Homo sapiens
tccaggctggggcc

SEQ ID NO: 473058 - DNA, 19 bp, Homo sapiens
tccaggctggggcctggcc

SEQ ID NO: 473059 - DNA, 20 bp, Homo sapiens
tccagggcgagcactttcca

SEQ ID NO: 473060 - DNA, 15 bp, Homo sapiens
tccagtagagcttct

SEQ ID NO: 473061 - DNA, 22 bp, Homo sapiens
tccagtagagcttcttatatta

SEQ ID NO: 473062 - DNA, 15 bp, Homo sapiens
tccagtttgcccacc

SEQ ID NO: 473063 - DNA, 17 bp, Homo sapiens
tccatagacacagtatt

SEQ ID NO: 473064 - DNA, 14 bp, Homo sapiens
tccatatcagctct

SEQ ID NO: 473065 - DNA, 12 bp, Homo sapiens
tccatcctgagg

SEQ ID NO: 473066 - DNA, 20 bp, Homo sapiens
tccatcctgaggaccgcccc

SEQ ID NO: 473067 - DNA, 23 bp, Homo sapiens
tccatggtggtttcagaaagggc

SEQ ID NO: 473068 - DNA, 12 bp, Homo sapiens
tccattgcaaaa

SEQ ID NO: 473069 - DNA, 19 bp, Homo sapiens
tccattttctaaactgttt

SEQ ID NO: 473070 - DNA, 13 bp, Homo sapiens
tccattttggaaa

SEQ ID NO: 473071 - DNA, 14 bp, Homo sapiens
tcccaactctggcc

SEQ ID NO: 473072 - DNA, 20 bp, Homo sapiens
tcccaactctggccttggtt

SEQ ID NO: 473073 - DNA, 17 bp, Homo sapiens
tcccacaaaatatttct

SEQ ID NO: 473074 - DNA, 15 bp, Homo sapiens
tcccacaggcccttc

SEQ ID NO: 473075 - DNA, 22 bp, Homo sapiens
tcccacaggcccttcctctcca

SEQ ID NO: 473076 - DNA, 22 bp, Homo sapiens
tcccacccctataccctaggtc

SEQ ID NO: 473077 - DNA, 12 bp, Homo sapiens
tcccaccgggag

SEQ ID NO: 473078 - DNA, 16 bp, Homo sapiens
tcccagctggcagcgc

SEQ ID NO: 473079 - DNA, 17 bp, Homo sapiens
tcccagctggcagcgcc

SEQ ID NO: 473080 - DNA, 21 bp, Homo sapiens
tcccagctggcagcgcctccc

SEQ ID NO: 473081 - DNA, 22 bp, Homo sapiens
tcccagctggcagcgcctcccg

SEQ ID NO: 473082 - DNA, 20 bp, Homo sapiens
tcccaggcgccccttccccc

SEQ ID NO: 473083 - DNA, 21 bp, Homo sapiens
tcccaggcgccccttccccct

SEQ ID NO: 473084 - DNA, 11 bp, Homo sapiens
tcccagggccc

SEQ ID NO: 473085 - DNA, 20 bp, Homo sapiens
tcccatgggggctccagaca

SEQ ID NO: 473086 - DNA, 23 bp, Homo sapiens
tcccatgggggctccagacattg

SEQ ID NO: 473087 - DNA, 18 bp, Homo sapiens
tccccacccaccaccgct

SEQ ID NO: 473088 - DNA, 22 bp, Homo sapiens
tccccaccccataagccctgag

SEQ ID NO: 473089 - DNA, 20 bp, Homo sapiens
tccccatgtgcctgcaccag

SEQ ID NO: 473090 - DNA, 19 bp, Homo sapiens
tccccccacccctccccac

SEQ ID NO: 473091 - DNA, 13 bp, Homo sapiens
tccccctgccagc

SEQ ID NO: 473092 - DNA, 15 bp, Homo sapiens
tccccctgccagcaa

SEQ ID NO: 473093 - DNA, 11 bp, Homo sapiens
tcccccttccc

SEQ ID NO: 473094 - DNA, 18 bp, Homo sapiens
tccccgcagccctctcca

SEQ ID NO: 473095 - DNA, 14 bp, Homo sapiens
tccccgctctggat

SEQ ID NO: 473096 - DNA, 16 bp, Homo sapiens
tcccctcactctgtca

SEQ ID NO: 473097 - DNA, 18 bp, Homo sapiens
tcccctcactctgtcagc

SEQ ID NO: 473098 - DNA, 12 bp, Homo sapiens
tcccctccagac

SEQ ID NO: 473099 - DNA, 13 bp, Homo sapiens
tcccctccagacc

SEQ ID NO: 473100 - DNA, 18 bp, Homo sapiens
tgagaggatgaacatctt

SEQ ID NO: 473101 - DNA, 19 bp, Homo sapiens
tgagatcagcattcaaaat

SEQ ID NO: 473102 - DNA, 21 bp, Homo sapiens
tgagatcagcattcaaaatag

SEQ ID NO: 473103 - DNA, 19 bp, Homo sapiens
tgagcaaggcaagaagtgg

SEQ ID NO: 473104 - DNA, 12 bp, Homo sapiens
tgagcagtgggg

SEQ ID NO: 473105 - DNA, 13 bp, Homo sapiens
tgagcagtgggga

SEQ ID NO: 473106 - DNA, 17 bp, Homo sapiens
tgagcagtggggagcgg

SEQ ID NO: 473107 - DNA, 15 bp, Homo sapiens
tgagcccagaaaaaa

SEQ ID NO: 473108 - DNA, 11 bp, Homo sapiens
tgagcccctcc

SEQ ID NO: 473109 - DNA, 15 bp, Homo sapiens
tgagcccctcctctc

SEQ ID NO: 473110 - DNA, 19 bp, Homo sapiens
tgagcccgaatttctcact

SEQ ID NO: 473111 - DNA, 20 bp, Homo sapiens
tgagcccgaatttctcactc

SEQ ID NO: 473112 - DNA, 22 bp, Homo sapiens
tgagccctgccctcactccact

SEQ ID NO: 473113 - DNA, 16 bp, Homo sapiens
tgagcctgggaaataa

SEQ ID NO: 473114 - DNA, 15 bp, Homo sapiens
tgagctccaccctcc

SEQ ID NO: 473115 - DNA, 16 bp, Homo sapiens
tgagctccaccctccc

SEQ ID NO: 473116 - DNA, 17 bp, Homo sapiens
tgagctccaccctcccc

SEQ ID NO: 473117 - DNA, 12 bp, Homo sapiens
tgagctgcagcc

SEQ ID NO: 473118 - DNA, 17 bp, Homo sapiens
tgagcttctcctctgct

SEQ ID NO: 473119 - DNA, 21 bp, Homo sapiens
tgagcttctcctctgctccaa

SEQ ID NO: 473120 - DNA, 16 bp, Homo sapiens
tgaggaagttttgcat

SEQ ID NO: 473121 - DNA, 17 bp, Homo sapiens
tgaggacggggcagagc

SEQ ID NO: 473122 - DNA, 12 bp, Homo sapiens
tgaggagtccaa

SEQ ID NO: 473123 - DNA, 15 bp, Homo sapiens
tgaggagtccaaaat

SEQ ID NO: 473124 - DNA, 20 bp, Homo sapiens
tgaggcgtatgtggcaaaat

SEQ ID NO: 473125 - DNA, 20 bp, Homo sapiens
tgaggcgtgggatccagaga

SEQ ID NO: 473126 - DNA, 22 bp, Homo sapiens
tgaggcgtgggatccagagaga

SEQ ID NO: 473127 - DNA, 13 bp, Homo sapiens
tgagggaagccca

SEQ ID NO: 473128 - DNA, 16 bp, Homo sapiens
tgagggaagcccaccc

SEQ ID NO: 473129 - DNA, 22 bp, Homo sapiens
tgagggaagcccacccgcccca

SEQ ID NO: 473130 - DNA, 16 bp, Homo sapiens
tgagggctgacaaggc

SEQ ID NO: 473131 - DNA, 17 bp, Homo sapiens
tgaggtacctttccacc

SEQ ID NO: 473132 - DNA, 17 bp, Homo sapiens
tgagtaaataaactctt

SEQ ID NO: 473133 - DNA, 20 bp, Homo sapiens
tgagtaaataaactcttcaa

SEQ ID NO: 473134 - DNA, 16 bp, Homo sapiens
tgagtcggctgggcag

SEQ ID NO: 473135 - DNA, 17 bp, Homo sapiens
tgagtcggctgggcagg

SEQ ID NO: 473136 - DNA, 12 bp, Homo sapiens
tgagtctgtcct

SEQ ID NO: 473137 - DNA, 16 bp, Homo sapiens
tgagtgacatgcggct

SEQ ID NO: 473138 - DNA, 18 bp, Homo sapiens
tgagtgacatgcggctgc

SEQ ID NO: 473139 - DNA, 21 bp, Homo sapiens
tgagtttaaaaaaataacatc

SEQ ID NO: 473140 - DNA, 18 bp, Homo sapiens
tgatacactgtatctaaa

SEQ ID NO: 473141 - DNA, 21 bp, Homo sapiens
tgatactgaattgttatgtaa

SEQ ID NO: 473142 - DNA, 21 bp, Homo sapiens
tgatagcactggtttgtttct

SEQ ID NO: 473143 - DNA, 17 bp, Homo sapiens
tgatatgcatgtagcat

SEQ ID NO: 473144 - DNA, 19 bp, Homo sapiens
tgatattttcaacgcagcc

SEQ ID NO: 473145 - DNA, 22 bp, Homo sapiens
tgatattttcaacgcagccctg

SEQ ID NO: 473146 - DNA, 19 bp, Homo sapiens
tgatcgatgttaaacgtca

SEQ ID NO: 473147 - DNA, 20 bp, Homo sapiens
tgatcgatgttaaacgtcac

SEQ ID NO: 473148 - DNA, 16 bp, Homo sapiens
tgatcgtgtgttgcca

SEQ ID NO: 473149 - DNA, 17 bp, Homo sapiens
tgatctaaggaccccag

SEQ ID NO: 473150 - DNA, 12 bp, Homo sapiens
tgatctctccac

SEQ ID NO: 473151 - DNA, 14 bp, Homo sapiens
tgatctctccacgg

SEQ ID NO: 473152 - DNA, 22 bp, Homo sapiens
tgatctggtgcgtgtggccctg

SEQ ID NO: 473153 - DNA, 19 bp, Homo sapiens
tgattaaatttaatatact

SEQ ID NO: 473154 - DNA, 13 bp, Homo sapiens
tgattattgaatg

SEQ ID NO: 473155 - DNA, 17 bp, Homo sapiens
tgattattgaatgttat

SEQ ID NO: 473156 - DNA, 15 bp, Homo sapiens
tgattcaatgtgaat

SEQ ID NO: 473157 - DNA, 11 bp, Homo sapiens
tgattccaaat

SEQ ID NO: 473158 - DNA, 11 bp, Homo sapiens
tgattctcctc

SEQ ID NO: 473159 - DNA, 14 bp, Homo sapiens
tgattctcctctcc

SEQ ID NO: 473160 - DNA, 15 bp, Homo sapiens
tgattctcctctccc

SEQ ID NO: 473161 - DNA, 15 bp, Homo sapiens
tgattcttttcccat

SEQ ID NO: 473162 - DNA, 20 bp, Homo sapiens
tgattggcagcttcaaaaca

SEQ ID NO: 473163 - DNA, 22 bp, Homo sapiens
tgattggcagcttcaaaacaga

SEQ ID NO: 473164 - DNA, 19 bp, Homo sapiens
tgatttgatatacagacct

SEQ ID NO: 473165 - DNA, 13 bp, Homo sapiens
tgattttaacttt

SEQ ID NO: 473166 - DNA, 15 bp, Homo sapiens
tgcaaattattctag

SEQ ID NO: 473167 - DNA, 17 bp, Homo sapiens
tgcaaattattctagtc

SEQ ID NO: 473168 - DNA, 21 bp, Homo sapiens
tgcaaattattctagtcaact

SEQ ID NO: 473169 - DNA, 19 bp, Homo sapiens
tgcaactaattcaataaaa

SEQ ID NO: 473170 - DNA, 19 bp, Homo sapiens
tgcaataacagttttaaga

SEQ ID NO: 473171 - DNA, 21 bp, Homo sapiens
tgcaataacagttttaagatg

SEQ ID NO: 473172 - DNA, 14 bp, Homo sapiens
tgcaatatgagggg

SEQ ID NO: 473173 - DNA, 23 bp, Homo sapiens
tgcaatatgaggggactgcatgc

SEQ ID NO: 473174 - DNA, 21 bp, Homo sapiens
tgcaatgttccgttcatctga

SEQ ID NO: 473175 - DNA, 16 bp, Homo sapiens
tgcactctaacactcg

SEQ ID NO: 473176 - DNA, 14 bp, Homo sapiens
tgcacttctgttat

SEQ ID NO: 473177 - DNA, 21 bp, Homo sapiens
tgcagaatacagtaagctgct

SEQ ID NO: 473178 - DNA, 13 bp, Homo sapiens
tgcagagtaaatc

SEQ ID NO: 473179 - DNA, 23 bp, Homo sapiens
tgcagagtaaatcccacgacata

SEQ ID NO: 473180 - DNA, 20 bp, Homo sapiens
tgcagatgactggaaacaag

SEQ ID NO: 473181 - DNA, 19 bp, Homo sapiens
tgcagcagtaccatcccac

SEQ ID NO: 473182 - DNA, 21 bp, Homo sapiens
tgcagcagtaccatcccactg

SEQ ID NO: 473183 - DNA, 19 bp, Homo sapiens
tgcagcccagaacgggcct

SEQ ID NO: 473184 - DNA, 20 bp, Homo sapiens
tgcagcccagaacgggcctc

SEQ ID NO: 473185 - DNA, 22 bp, Homo sapiens
tgcagcccagaacgggcctccc

SEQ ID NO: 473186 - DNA, 13 bp, Homo sapiens
tgcagcctgagct

SEQ ID NO: 473187 - DNA, 16 bp, Homo sapiens
tgcagcctgagctcca

SEQ ID NO: 473188 - DNA, 20 bp, Homo sapiens
tgcagctatgcgcaatgtgg

SEQ ID NO: 473189 - DNA, 19 bp, Homo sapiens
tgcaggcgcgcaccgccca

SEQ ID NO: 473190 - DNA, 15 bp, Homo sapiens
tgcagtattctgtag

SEQ ID NO: 473191 - DNA, 16 bp, Homo sapiens
tgcagttaattcttgc

SEQ ID NO: 473192 - DNA, 16 bp, Homo sapiens
tgcatacaataaaaga

SEQ ID NO: 473193 - DNA, 22 bp, Homo sapiens
tgcatacaataaaagagcttta

SEQ ID NO: 473194 - DNA, 12 bp, Homo sapiens
tgcatagacaaa

SEQ ID NO: 473195 - DNA, 22 bp, Homo sapiens
tgcatcccttggcccctctctg

SEQ ID NO: 473196 - DNA, 13 bp, Homo sapiens
tgcatctcagccc

SEQ ID NO: 473197 - DNA, 15 bp, Homo sapiens
tgcatctcagcccac

SEQ ID NO: 473198 - DNA, 21 bp, Homo sapiens
gtcccttcctgtcctgctcac

SEQ ID NO: 473199 - DNA, 15 bp, Homo sapiens
gtccgcccgcccacc

SEQ ID NO: 473200 - DNA, 16 bp, Homo sapiens
gtccggcctgcagccc

SEQ ID NO: 473201 - DNA, 13 bp, Homo sapiens
gtcctgatttgtg

SEQ ID NO: 473202 - DNA, 17 bp, Homo sapiens
gtcctgcccatgtgtcc

SEQ ID NO: 473203 - DNA, 21 bp, Homo sapiens
gtcctgctcacgtctgtgagt

SEQ ID NO: 473204 - DNA, 12 bp, Homo sapiens
gtcctggggtgg

SEQ ID NO: 473205 - DNA, 23 bp, Homo sapiens
gtcgccccaggccctccctgact

SEQ ID NO: 473206 - DNA, 13 bp, Homo sapiens
gtcggctgggcag

SEQ ID NO: 473207 - DNA, 16 bp, Homo sapiens
gtcggctgggcagggc

SEQ ID NO: 473208 - DNA, 14 bp, Homo sapiens
gtcgggggaggagc

SEQ ID NO: 473209 - DNA, 22 bp, Homo sapiens
gtctcaagagggcactggtggc

SEQ ID NO: 473210 - DNA, 16 bp, Homo sapiens
gtctccacccctcaag

SEQ ID NO: 473211 - DNA, 20 bp, Homo sapiens
gtctctccctaccctcttct

SEQ ID NO: 473212 - DNA, 17 bp, Homo sapiens
gtctctgagcagtgggg

SEQ ID NO: 473213 - DNA, 22 bp, Homo sapiens
gtctgaaggagaggagtgcgct

SEQ ID NO: 473214 - DNA, 16 bp, Homo sapiens
gtctgaaggcctccat

SEQ ID NO: 473215 - DNA, 10 bp, Homo sapiens
gtctgagccc

SEQ ID NO: 473216 - DNA, 16 bp, Homo sapiens
gtctgagccctgccct

SEQ ID NO: 473217 - DNA, 13 bp, Homo sapiens
gtctgagctgctg

SEQ ID NO: 473218 - DNA, 22 bp, Homo sapiens
gtctgattctatgcctgtattt

SEQ ID NO: 473219 - DNA, 17 bp, Homo sapiens
gtctgccccttgacccc

SEQ ID NO: 473220 - DNA, 15 bp, Homo sapiens
gtctggagcccctat

SEQ ID NO: 473221 - DNA, 22 bp, Homo sapiens
gtctggagcccctatcctgcac

SEQ ID NO: 473222 - DNA, 15 bp, Homo sapiens
gtctggctgtggccc

SEQ ID NO: 473223 - DNA, 19 bp, Homo sapiens
gtctggctgtggcccctcc

SEQ ID NO: 473224 - DNA, 18 bp, Homo sapiens
gtctgtgagtctgtcctt

SEQ ID NO: 473225 - DNA, 15 bp, Homo sapiens
gtcttcaaccctgcc

SEQ ID NO: 473226 - DNA, 22 bp, Homo sapiens
gtcttcctcctcagtcttctca

SEQ ID NO: 473227 - DNA, 13 bp, Homo sapiens
gtcttgagtgggc

SEQ ID NO: 473228 - DNA, 16 bp, Homo sapiens
gtcttgagtgggcccc

SEQ ID NO: 473229 - DNA, 22 bp, Homo sapiens
gtctttatgtaagaagaaactg

SEQ ID NO: 473230 - DNA, 16 bp, Homo sapiens
gtctttgctgtttata

SEQ ID NO: 473231 - DNA, 22 bp, Homo sapiens
gtctttgggggattcaaatgca

SEQ ID NO: 473232 - DNA, 21 bp, Homo sapiens
gtgaagaatttatctgtgaat

SEQ ID NO: 473233 - DNA, 16 bp, Homo sapiens
gtgaagcccaggagga

SEQ ID NO: 473234 - DNA, 21 bp, Homo sapiens
gtgaagcccaggaggacctgg

SEQ ID NO: 473235 - DNA, 20 bp, Homo sapiens
gtgaattttaaaatgcaaat

SEQ ID NO: 473236 - DNA, 15 bp, Homo sapiens
gtgacaggaaagccc

SEQ ID NO: 473237 - DNA, 21 bp, Homo sapiens
gtgacatgcggctgcccacgc

SEQ ID NO: 473238 - DNA, 15 bp, Homo sapiens
gtgaccggcccgcca

SEQ ID NO: 473239 - DNA, 16 bp, Homo sapiens
gtgaccggcccgccac

SEQ ID NO: 473240 - DNA, 13 bp, Homo sapiens
gtgactgtcccac

SEQ ID NO: 473241 - DNA, 23 bp, Homo sapiens
gtgactgtcccaccgggagcctc

SEQ ID NO: 473242 - DNA, 20 bp, Homo sapiens
gtgacttcagactctctcct

SEQ ID NO: 473243 - DNA, 23 bp, Homo sapiens
gtgacttcagactctctcctctc

SEQ ID NO: 473244 - DNA, 15 bp, Homo sapiens
gtgagacagtggggg

SEQ ID NO: 473245 - DNA, 22 bp, Homo sapiens
gtgagacagtgggggtgcctgg

SEQ ID NO: 473246 - DNA, 16 bp, Homo sapiens
gtgaggcccccggagg

SEQ ID NO: 473247 - DNA, 20 bp, Homo sapiens
gtgaggcccccggaggcgcc

SEQ ID NO: 473248 - DNA, 13 bp, Homo sapiens
gtgaggcgtggga

SEQ ID NO: 473249 - DNA, 14 bp, Homo sapiens
gtgagtctgtcctt

SEQ ID NO: 473250 - DNA, 18 bp, Homo sapiens
gtgagtctgtcctttccc

SEQ ID NO: 473251 - DNA, 14 bp, Homo sapiens
gtgatacactgtat

SEQ ID NO: 473252 - DNA, 13 bp, Homo sapiens
gtgatactccaag

SEQ ID NO: 473253 - DNA, 23 bp, Homo sapiens
gtgcaaaactaccacattctgtc

SEQ ID NO: 473254 - DNA, 12 bp, Homo sapiens
gtgcaatatgag

SEQ ID NO: 473255 - DNA, 16 bp, Homo sapiens
gtgcaatatgagggga

SEQ ID NO: 473256 - DNA, 24 bp, Homo sapiens
gtgcaatatgaggggactgcatgc

SEQ ID NO: 473257 - DNA, 17 bp, Homo sapiens
gtgcatttaaaatggac

SEQ ID NO: 473258 - DNA, 18 bp, Homo sapiens
gtgcatttaaaatggact

SEQ ID NO: 473259 - DNA, 22 bp, Homo sapiens
gtgcatttgagagaagccacgc

SEQ ID NO: 473260 - DNA, 14 bp, Homo sapiens
gtgcccagtcttga

SEQ ID NO: 473261 - DNA, 12 bp, Homo sapiens
gtgcccccagcg

SEQ ID NO: 473262 - DNA, 21 bp, Homo sapiens
gtgcctgcaccaggagacaga

SEQ ID NO: 473263 - DNA, 20 bp, Homo sapiens
gtgcctggtgcgctgtgctc

SEQ ID NO: 473264 - DNA, 23 bp, Homo sapiens
gtgcgcagccgcgctctgcccct

SEQ ID NO: 473265 - DNA, 14 bp, Homo sapiens
taactgttagaatt

SEQ ID NO: 473266 - DNA, 21 bp, Homo sapiens
taacttaaaagaacataggaa

SEQ ID NO: 473267 - DNA, 18 bp, Homo sapiens
taacttatctccagccaa

SEQ ID NO: 473268 - DNA, 13 bp, Homo sapiens
taacttctgttac

SEQ ID NO: 473269 - DNA, 15 bp, Homo sapiens
taacttttattatct

SEQ ID NO: 473270 - DNA, 18 bp, Homo sapiens
taagaaatggctttccac

SEQ ID NO: 473271 - DNA, 20 bp, Homo sapiens
taagaaatggctttccacat

SEQ ID NO: 473272 - DNA, 16 bp, Homo sapiens
taagacaacaggcatt

SEQ ID NO: 473273 - DNA, 17 bp, Homo sapiens
taagacaacaggcattt

SEQ ID NO: 473274 - DNA, 19 bp, Homo sapiens
taagagacaaagtttggaa

SEQ ID NO: 473275 - DNA, 14 bp, Homo sapiens
taagattccagaga

SEQ ID NO: 473276 - DNA, 21 bp, Homo sapiens
taagattccattttggaaaat

SEQ ID NO: 473277 - DNA, 22 bp, Homo sapiens
taagcaagtatatttatttcta

SEQ ID NO: 473278 - DNA, 19 bp, Homo sapiens
taagctggtatcagtggtt

SEQ ID NO: 473279 - DNA, 14 bp, Homo sapiens
taagcttatttcta

SEQ ID NO: 473280 - DNA, 15 bp, Homo sapiens
taaggaaaagagaaa

SEQ ID NO: 473281 - DNA, 23 bp, Homo sapiens
taagggagtaggctgtattttct

SEQ ID NO: 473282 - DNA, 14 bp, Homo sapiens
taaggtttcaatgc

SEQ ID NO: 473283 - DNA, 22 bp, Homo sapiens
taagtaacctctacaggcattt

SEQ ID NO: 473284 - DNA, 16 bp, Homo sapiens
taagtaatatctttca

SEQ ID NO: 473285 - DNA, 18 bp, Homo sapiens
taagtgcatttattgcct

SEQ ID NO: 473286 - DNA, 15 bp, Homo sapiens
taagtgctcagtatt

SEQ ID NO: 473287 - DNA, 19 bp, Homo sapiens
taagttgaagggaaatcaa

SEQ ID NO: 473288 - DNA, 15 bp, Homo sapiens
taagttgacctttat

SEQ ID NO: 473289 - DNA, 18 bp, Homo sapiens
taagttgacctttattta

SEQ ID NO: 473290 - DNA, 14 bp, Homo sapiens
taagttgtcttaca

SEQ ID NO: 473291 - DNA, 15 bp, Homo sapiens
taagttgtcttacac

SEQ ID NO: 473292 - DNA, 22 bp, Homo sapiens
taataaccaaatgcaatgtgaa

SEQ ID NO: 473293 - DNA, 16 bp, Homo sapiens
taatatactgcatatc

SEQ ID NO: 473294 - DNA, 16 bp, Homo sapiens
taatatcctgaataac

SEQ ID NO: 473295 - DNA, 13 bp, Homo sapiens
taatatctttcag

SEQ ID NO: 473296 - DNA, 19 bp, Homo sapiens
taatatctttcagttatta

SEQ ID NO: 473297 - DNA, 13 bp, Homo sapiens
taatatggaacct

SEQ ID NO: 473298 - DNA, 14 bp, Homo sapiens
taatcatttatctt

SEQ ID NO: 473299 - DNA, 18 bp, Homo sapiens
taatctctaaaattctag

SEQ ID NO: 473300 - DNA, 20 bp, Homo sapiens
taatctctaaaattctagtc

SEQ ID NO: 473301 - DNA, 21 bp, Homo sapiens
taatctctaaaattctagtct

SEQ ID NO: 473302 - DNA, 13 bp, Homo sapiens
taatctctgatta

SEQ ID NO: 473303 - DNA, 22 bp, Homo sapiens
taatctctgattaaatttaata

SEQ ID NO: 473304 - DNA, 23 bp, Homo sapiens
taatctctgattaaatttaatat

SEQ ID NO: 473305 - DNA, 19 bp, Homo sapiens
taatgaatgcaaaaagata

SEQ ID NO: 473306 - DNA, 14 bp, Homo sapiens
taatggccaagtgt

SEQ ID NO: 473307 - DNA, 15 bp, Homo sapiens
taatggccaagtgta

SEQ ID NO: 473308 - DNA, 19 bp, Homo sapiens
taatggtttttatttctcg

SEQ ID NO: 473309 - DNA, 19 bp, Homo sapiens
taatgtaaaattcatagca

SEQ ID NO: 473310 - DNA, 15 bp, Homo sapiens
taatgtaatcattta

SEQ ID NO: 473311 - DNA, 12 bp, Homo sapiens
taatgtgccaaa

SEQ ID NO: 473312 - DNA, 19 bp, Homo sapiens
taatgtttccctcaagaac

SEQ ID NO: 473313 - DNA, 16 bp, Homo sapiens
taattaaattttaatg

SEQ ID NO: 473314 - DNA, 20 bp, Homo sapiens
taattatgtttacctcactg

SEQ ID NO: 473315 - DNA, 21 bp, Homo sapiens
taatttcataaattggctcct

SEQ ID NO: 473316 - DNA, 15 bp, Homo sapiens
taatttgttatatca

SEQ ID NO: 473317 - DNA, 17 bp, Homo sapiens
tacaaatttttactcag

SEQ ID NO: 473318 - DNA, 20 bp, Homo sapiens
tacaaatttttactcaggct

SEQ ID NO: 473319 - DNA, 22 bp, Homo sapiens
tacaaatttttactcaggcttt

SEQ ID NO: 473320 - DNA, 17 bp, Homo sapiens
tacaacattcaacttta

SEQ ID NO: 473321 - DNA, 13 bp, Homo sapiens
tacaataaaagag

SEQ ID NO: 473322 - DNA, 13 bp, Homo sapiens
tacacccaatttt

SEQ ID NO: 473323 - DNA, 14 bp, Homo sapiens
tacactgaaatcca

SEQ ID NO: 473324 - DNA, 20 bp, Homo sapiens
tacagaaccagcactcccag

SEQ ID NO: 473325 - DNA, 14 bp, Homo sapiens
tacagagtgttata

SEQ ID NO: 473326 - DNA, 14 bp, Homo sapiens
tacagatttagttt

SEQ ID NO: 473327 - DNA, 16 bp, Homo sapiens
tacagatttagtttac

SEQ ID NO: 473328 - DNA, 18 bp, Homo sapiens
tacagctaatcagcattc

SEQ ID NO: 473329 - DNA, 18 bp, Homo sapiens
tacagggcaggagctgct

SEQ ID NO: 473330 - DNA, 19 bp, Homo sapiens
tacagggcaggagctgctg

SEQ ID NO: 473331 - DNA, 18 bp, Homo sapiens
tacagtaagctgctctat

SEQ ID NO: 473332 - DNA, 12 bp, Homo sapiens
tacagtatataa

SEQ ID NO: 473333 - DNA, 15 bp, Homo sapiens
tacataattaaattt

SEQ ID NO: 473334 - DNA, 13 bp, Homo sapiens
tacatcctctgct

SEQ ID NO: 473335 - DNA, 14 bp, Homo sapiens
tacatctaagtcag

SEQ ID NO: 473336 - DNA, 15 bp, Homo sapiens
tacatctaagtcagt

SEQ ID NO: 473337 - DNA, 17 bp, Homo sapiens
tacatctaagtcagttt

SEQ ID NO: 473338 - DNA, 14 bp, Homo sapiens
tacatctgaaatct

SEQ ID NO: 473339 - DNA, 16 bp, Homo sapiens
tacatctgaaatctac

SEQ ID NO: 473340 - DNA, 16 bp, Homo sapiens
tacatgagttcaaata

SEQ ID NO: 473341 - DNA, 13 bp, Homo sapiens
tacatggtatctc

SEQ ID NO: 473342 - DNA, 22 bp, Homo sapiens
tacatttgatttgatatacaga

SEQ ID NO: 473343 - DNA, 22 bp, Homo sapiens
taccaatcaacagcatgtctac

SEQ ID NO: 473344 - DNA, 21 bp, Homo sapiens
taccattatggctttgtgctt

SEQ ID NO: 473345 - DNA, 18 bp, Homo sapiens
taccctagaagaaaaccc

SEQ ID NO: 473346 - DNA, 20 bp, Homo sapiens
taccctaggtctccacccct

SEQ ID NO: 473347 - DNA, 13 bp, Homo sapiens
taccctccctgtc

SEQ ID NO: 473348 - DNA, 18 bp, Homo sapiens
taccgagtctcttctcca

SEQ ID NO: 473349 - DNA, 22 bp, Homo sapiens
taccgagtctcttctccactgg

SEQ ID NO: 473350 - DNA, 20 bp, Homo sapiens
tacctcactggtgcatttaa

SEQ ID NO: 473351 - DNA, 22 bp, Homo sapiens
tacctggcttagcgttctgttt

SEQ ID NO: 473352 - DNA, 17 bp, Homo sapiens
tacctgggaaatttgcc

SEQ ID NO: 473353 - DNA, 19 bp, Homo sapiens
tacctttccacccagaccc

SEQ ID NO: 473354 - DNA, 21 bp, Homo sapiens
tacggctatctagttgtctga

SEQ ID NO: 473355 - DNA, 18 bp, Homo sapiens
tactaaacattttgttat

SEQ ID NO: 473356 - DNA, 22 bp, Homo sapiens
tactaagaataaataaagaaga

SEQ ID NO: 473357 - DNA, 17 bp, Homo sapiens
tactcaccaaaatatag

SEQ ID NO: 473358 - DNA, 16 bp, Homo sapiens
tactcaggctttctat

SEQ ID NO: 473359 - DNA, 14 bp, Homo sapiens
tactgaattgttat

SEQ ID NO: 473360 - DNA, 14 bp, Homo sapiens
tactgattgaatgt

SEQ ID NO: 473361 - DNA, 17 bp, Homo sapiens
tactgcagaatacagta

SEQ ID NO: 473362 - DNA, 22 bp, Homo sapiens
tactgcttggatccatacaaaa

SEQ ID NO: 473363 - DNA, 12 bp, Homo sapiens
tatatctgtaaa

SEQ ID NO: 473364 - DNA, 21 bp, Homo sapiens
tatatctgtaaatttaactgc

SEQ ID NO: 473365 - DNA, 16 bp, Homo sapiens
tatatgatatgcatgt

SEQ ID NO: 473366 - DNA, 20 bp, Homo sapiens
tatattgtttttatatatta

SEQ ID NO: 473367 - DNA, 22 bp, Homo sapiens
tatattgtttttatatattata

SEQ ID NO: 473368 - DNA, 18 bp, Homo sapiens
tatatttattattttcat

SEQ ID NO: 473369 - DNA, 19 bp, Homo sapiens
tatcagaactcctttctaa

SEQ ID NO: 473370 - DNA, 22 bp, Homo sapiens
tatcagaactcctttctaagga

SEQ ID NO: 473371 - DNA, 19 bp, Homo sapiens
tatcagcagacactccagt

SEQ ID NO: 473372 - DNA, 13 bp, Homo sapiens
tatcagtggttcg

SEQ ID NO: 473373 - DNA, 21 bp, Homo sapiens
tatcagtggttcgggggaaat

SEQ ID NO: 473374 - DNA, 22 bp, Homo sapiens
tatcagtggttcgggggaaata

SEQ ID NO: 473375 - DNA, 16 bp, Homo sapiens
tatccacatgaaaata

SEQ ID NO: 473376 - DNA, 21 bp, Homo sapiens
tatcctgcgggttttaattta

SEQ ID NO: 473377 - DNA, 19 bp, Homo sapiens
tatcctgctagctgtagaa

SEQ ID NO: 473378 - DNA, 18 bp, Homo sapiens
tatcctggtgtctagttt

SEQ ID NO: 473379 - DNA, 20 bp, Homo sapiens
tatcctggtgtctagtttgc

SEQ ID NO: 473380 - DNA, 21 bp, Homo sapiens
tatccttttttattgaataac

SEQ ID NO: 473381 - DNA, 21 bp, Homo sapiens
tatctagcaagaagattctaa

SEQ ID NO: 473382 - DNA, 22 bp, Homo sapiens
tatctagcaagaagattctaaa

SEQ ID NO: 473383 - DNA, 17 bp, Homo sapiens
tatctatttatctgtct

SEQ ID NO: 473384 - DNA, 18 bp, Homo sapiens
tatctatttatctgtctg

SEQ ID NO: 473385 - DNA, 13 bp, Homo sapiens
tatctctttctct

SEQ ID NO: 473386 - DNA, 19 bp, Homo sapiens
tatctgcaaatagtttcaa

SEQ ID NO: 473387 - DNA, 19 bp, Homo sapiens
tatctgctgcctctgaaaa

SEQ ID NO: 473388 - DNA, 22 bp, Homo sapiens
tatctgctgcctctgaaaatat

SEQ ID NO: 473389 - DNA, 18 bp, Homo sapiens
tatctgtaaatttaactg

SEQ ID NO: 473390 - DNA, 14 bp, Homo sapiens
tatctgtctgagcc

SEQ ID NO: 473391 - DNA, 22 bp, Homo sapiens
tatctgtctgagccctgccctc

SEQ ID NO: 473392 - DNA, 18 bp, Homo sapiens
tatcttccatatgctctt

SEQ ID NO: 473393 - DNA, 22 bp, Homo sapiens
tatgaaagagaaaatgctttct

SEQ ID NO: 473394 - DNA, 17 bp, Homo sapiens
tatgaagttaacagtct

SEQ ID NO: 473395 - DNA, 18 bp, Homo sapiens
tatgaataaagacaccta

SEQ ID NO: 473396 - DNA, 19 bp, Homo sapiens
tatgaataattatgtttac

SEQ ID NO: 473397 - DNA, 15 bp, Homo sapiens
tatgacaatttcaaa

SEQ ID NO: 473398 - DNA, 21 bp, Homo sapiens
tatgacctaaatccattttct

SEQ ID NO: 473399 - DNA, 23 bp, Homo sapiens
tatgacctaaatccattttctaa

SEQ ID NO: 473400 - DNA, 17 bp, Homo sapiens
tatgaggggactgcatg

SEQ ID NO: 473401 - DNA, 22 bp, Homo sapiens
tatgaggggactgcatgcaagc

SEQ ID NO: 473402 - DNA, 14 bp, Homo sapiens
tatgattgaaaaga

SEQ ID NO: 473403 - DNA, 11 bp, Homo sapiens
tatgcatgtag

SEQ ID NO: 473404 - DNA, 20 bp, Homo sapiens
tatgcatgtagcatataaat

SEQ ID NO: 473405 - DNA, 22 bp, Homo sapiens
tatgccagggcgcactttccac

SEQ ID NO: 473406 - DNA, 13 bp, Homo sapiens
tatgcctgtattt

SEQ ID NO: 473407 - DNA, 13 bp, Homo sapiens
tatgctggccagc

SEQ ID NO: 473408 - DNA, 20 bp, Homo sapiens
tatggaaccttccctccaaa

SEQ ID NO: 473409 - DNA, 16 bp, Homo sapiens
tatggattcacttcta

SEQ ID NO: 473410 - DNA, 21 bp, Homo sapiens
tatggcacttattatgaggct

SEQ ID NO: 473411 - DNA, 14 bp, Homo sapiens
tatggctttgtgct

SEQ ID NO: 473412 - DNA, 14 bp, Homo sapiens
tatgggaggaacaa

SEQ ID NO: 473413 - DNA, 19 bp, Homo sapiens
tatggtatgctggccagca

SEQ ID NO: 473414 - DNA, 23 bp, Homo sapiens
tatggtatgctggccagcaccct

SEQ ID NO: 473415 - DNA, 16 bp, Homo sapiens
tatggtgatactccaa

SEQ ID NO: 473416 - DNA, 17 bp, Homo sapiens
tatggtgatactccaag

SEQ ID NO: 473417 - DNA, 14 bp, Homo sapiens
tatgtaagaagaaa

SEQ ID NO: 473418 - DNA, 12 bp, Homo sapiens
tatgtctgtgat

SEQ ID NO: 473419 - DNA, 17 bp, Homo sapiens
tattaaacttgtcagaa

SEQ ID NO: 473420 - DNA, 18 bp, Homo sapiens
tattaaacttgtcagaat

SEQ ID NO: 473421 - DNA, 18 bp, Homo sapiens
tattaactctgcatagac

SEQ ID NO: 473422 - DNA, 20 bp, Homo sapiens
tattaactctgcatagacaa

SEQ ID NO: 473423 - DNA, 23 bp, Homo sapiens
tattaactctgcatagacaaagg

SEQ ID NO: 473424 - DNA, 16 bp, Homo sapiens
tattactgatgtgtgc

SEQ ID NO: 473425 - DNA, 13 bp, Homo sapiens
tattactgttctt

SEQ ID NO: 473426 - DNA, 15 bp, Homo sapiens
tattactttaaatta

SEQ ID NO: 473427 - DNA, 14 bp, Homo sapiens
tattatagtctgta

SEQ ID NO: 473428 - DNA, 22 bp, Homo sapiens
tattatggtgatactccaaggt

SEQ ID NO: 473429 - DNA, 19 bp, Homo sapiens
tattcaactaatacatggt

SEQ ID NO: 473430 - DNA, 20 bp, Homo sapiens
tattccaataccctagaaga

SEQ ID NO: 473431 - DNA, 19 bp, Homo sapiens
tattctagtcaactgctgt

SEQ ID NO: 473432 - DNA, 16 bp, Homo sapiens
tattcttgctttcaca

SEQ ID NO: 473433 - DNA, 19 bp, Homo sapiens
tattcttgctttcacaaat

SEQ ID NO: 473434 - DNA, 21 bp, Homo sapiens
tattgagatcagcattcaaaa

SEQ ID NO: 473435 - DNA, 20 bp, Homo sapiens
tattggcatggatttccttt

SEQ ID NO: 473436 - DNA, 17 bp, Homo sapiens
tattgtagcatttcttg

SEQ ID NO: 473437 - DNA, 16 bp, Homo sapiens
tattgttgctgctttg

SEQ ID NO: 473438 - DNA, 11 bp, Homo sapiens
tatttaagccc

SEQ ID NO: 473439 - DNA, 13 bp, Homo sapiens
tatttaatttcat

SEQ ID NO: 473440 - DNA, 14 bp, Homo sapiens
tatttaatttcata

SEQ ID NO: 473441 - DNA, 18 bp, Homo sapiens
tatttaatttcataaatt

SEQ ID NO: 473442 - DNA, 19 bp, Homo sapiens
tatttaatttcataaattg

SEQ ID NO: 473443 - DNA, 11 bp, Homo sapiens
tatttcactta

SEQ ID NO: 473444 - DNA, 19 bp, Homo sapiens
tatttcacttaaactttgt

SEQ ID NO: 473445 - DNA, 15 bp, Homo sapiens
tatttcatattgaga

SEQ ID NO: 473446 - DNA, 17 bp, Homo sapiens
tatttctaagcttattt

SEQ ID NO: 473447 - DNA, 20 bp, Homo sapiens
tatttctaagcttatttcta

SEQ ID NO: 473448 - DNA, 13 bp, Homo sapiens
tatttctatctgc

SEQ ID NO: 473449 - DNA, 20 bp, Homo sapiens
tatttggattcacagccttt

SEQ ID NO: 473450 - DNA, 17 bp, Homo sapiens
tatttgtagctagaata

SEQ ID NO: 473451 - DNA, 19 bp, Homo sapiens
tattttcaacgcagccctg

SEQ ID NO: 473452 - DNA, 12 bp, Homo sapiens
tattttctatat

SEQ ID NO: 473453 - DNA, 15 bp, Homo sapiens
tatttttttctagct

SEQ ID NO: 473454 - DNA, 15 bp, Homo sapiens
tcaaaatacttcttt

SEQ ID NO: 473455 - DNA, 15 bp, Homo sapiens
tcaaaatagttctat

SEQ ID NO: 473456 - DNA, 16 bp, Homo sapiens
tcataaatagtaaata

SEQ ID NO: 473457 - DNA, 16 bp, Homo sapiens
tcataaattggctcct

SEQ ID NO: 473458 - DNA, 20 bp, Homo sapiens
tcataaattggctcctttcc

SEQ ID NO: 473459 - DNA, 21 bp, Homo sapiens
tcataaattggctcctttccc

SEQ ID NO: 473460 - DNA, 13 bp, Homo sapiens
tcatactcaaaga

SEQ ID NO: 473461 - DNA, 23 bp, Homo sapiens
tcatattgagatcagcattcaaa

SEQ ID NO: 473462 - DNA, 19 bp, Homo sapiens
tcatccaactggaaggctt

SEQ ID NO: 473463 - DNA, 21 bp, Homo sapiens
tcatccactaggtgcccagtc

SEQ ID NO: 473464 - DNA, 15 bp, Homo sapiens
gtgctcggacacagt

SEQ ID NO: 473465 - DNA, 12 bp, Homo sapiens
gtgctgccacac

SEQ ID NO: 473466 - DNA, 21 bp, Homo sapiens
gtgctgccacacttcaggctc

SEQ ID NO: 473467 - DNA, 16 bp, Homo sapiens
gtgctgggcccagccg

SEQ ID NO: 473468 - DNA, 20 bp, Homo sapiens
gtgctgtgggcagcaccctc

SEQ ID NO: 473469 - DNA, 12 bp, Homo sapiens
gtggactttatt

SEQ ID NO: 473470 - DNA, 22 bp, Homo sapiens
gtggactttatttaatttcata

SEQ ID NO: 473471 - DNA, 12 bp, Homo sapiens
gtggatgaaaaa

SEQ ID NO: 473472 - DNA, 13 bp, Homo sapiens
gtggattctatat

SEQ ID NO: 473473 - DNA, 14 bp, Homo sapiens
gtggcaaaaaagaa

SEQ ID NO: 473474 - DNA, 16 bp, Homo sapiens
gtggcaaaaaagaaca

SEQ ID NO: 473475 - DNA, 22 bp, Homo sapiens
gtggcaaaaaagaacagtgttg

SEQ ID NO: 473476 - DNA, 19 bp, Homo sapiens
gtggcaggcacacagcagc

SEQ ID NO: 473477 - DNA, 16 bp, Homo sapiens
gtggccatccctgggc

SEQ ID NO: 473478 - DNA, 19 bp, Homo sapiens
gtggccatccctgggcccc

SEQ ID NO: 473479 - DNA, 20 bp, Homo sapiens
gtggccatccctgggcccct

SEQ ID NO: 473480 - DNA, 12 bp, Homo sapiens
gtggcccctcct

SEQ ID NO: 473481 - DNA, 17 bp, Homo sapiens
gtggcccgacagcctgg

SEQ ID NO: 473482 - DNA, 13 bp, Homo sapiens
gtggcctcagccc

SEQ ID NO: 473483 - DNA, 19 bp, Homo sapiens
gtggcctcagccctcagaa

SEQ ID NO: 473484 - DNA, 15 bp, Homo sapiens
gtggcttaaacattt

SEQ ID NO: 473485 - DNA, 18 bp, Homo sapiens
gtggcttcccgctcagcc

SEQ ID NO: 473486 - DNA, 17 bp, Homo sapiens
gtgggacagaggagcaa

SEQ ID NO: 473487 - DNA, 21 bp, Homo sapiens
gtgggactggcccacccctct

SEQ ID NO: 473488 - DNA, 21 bp, Homo sapiens
gtgggagtccactttcctctc

SEQ ID NO: 473489 - DNA, 22 bp, Homo sapiens
gtgggagtccactttcctctct

SEQ ID NO: 473490 - DNA, 15 bp, Homo sapiens
gtgggatccagagag

SEQ ID NO: 473491 - DNA, 15 bp, Homo sapiens
gtgggcagcaccctc

SEQ ID NO: 473492 - DNA, 13 bp, Homo sapiens
gtgggctccagag

SEQ ID NO: 473493 - DNA, 17 bp, Homo sapiens
gtgggctccagagtagg

SEQ ID NO: 473494 - DNA, 16 bp, Homo sapiens
gtggggcccatggccc

SEQ ID NO: 473495 - DNA, 18 bp, Homo sapiens
gtggggcccatggcccca

SEQ ID NO: 473496 - DNA, 19 bp, Homo sapiens
gtggggcccatggccccag

SEQ ID NO: 473497 - DNA, 21 bp, Homo sapiens
gtggggcccatggccccagct

SEQ ID NO: 473498 - DNA, 23 bp, Homo sapiens
gtggggcccatggccccagctgg

SEQ ID NO: 473499 - DNA, 18 bp, Homo sapiens
gtggggcttagaatgggg

SEQ ID NO: 473500 - DNA, 13 bp, Homo sapiens
gtggggtgcctga

SEQ ID NO: 473501 - DNA, 15 bp, Homo sapiens
gtggtcttggagagg

SEQ ID NO: 473502 - DNA, 18 bp, Homo sapiens
gtggtcttggagaggagg

SEQ ID NO: 473503 - DNA, 16 bp, Homo sapiens
gtggtgtgaggccccc

SEQ ID NO: 473504 - DNA, 13 bp, Homo sapiens
gtggttggaggcc

SEQ ID NO: 473505 - DNA, 22 bp, Homo sapiens
gtggttggaggcctggtctgga

SEQ ID NO: 473506 - DNA, 16 bp, Homo sapiens
gtgtaatctctgatta

SEQ ID NO: 473507 - DNA, 20 bp, Homo sapiens
gtgtattctgtggattctat

SEQ ID NO: 473508 - DNA, 20 bp, Homo sapiens
gtgtcccctcactctgtcag

SEQ ID NO: 473509 - DNA, 12 bp, Homo sapiens
gtgtgaggcccc

SEQ ID NO: 473510 - DNA, 16 bp, Homo sapiens
gtgtgattgaatctga

SEQ ID NO: 473511 - DNA, 14 bp, Homo sapiens
gtgtggcaaacatt

SEQ ID NO: 473512 - DNA, 15 bp, Homo sapiens
gtgtggcaaacattt

SEQ ID NO: 473513 - DNA, 17 bp, Homo sapiens
gtgtggccctgtgggag

SEQ ID NO: 473514 - DNA, 12 bp, Homo sapiens
gtgtggcctcag

SEQ ID NO: 473515 - DNA, 17 bp, Homo sapiens
gtgtggcttaaacattt

SEQ ID NO: 473516 - DNA, 15 bp, Homo sapiens
gtgtggcttggaaca

SEQ ID NO: 473517 - DNA, 13 bp, Homo sapiens
gtgtggggagggt

SEQ ID NO: 473518 - DNA, 14 bp, Homo sapiens
gtgtggggagggtg

SEQ ID NO: 473519 - DNA, 21 bp, Homo sapiens
gtgttgcaaattattctagtc

SEQ ID NO: 473520 - DNA, 13 bp, Homo sapiens
gtgttttgggttt

SEQ ID NO: 473521 - DNA, 13 bp, Homo sapiens
gttaagacaacag

SEQ ID NO: 473522 - DNA, 15 bp, Homo sapiens
gttaaggggatctaa

SEQ ID NO: 473523 - DNA, 20 bp, Homo sapiens
gttaattacttttgaaaaag

SEQ ID NO: 473524 - DNA, 12 bp, Homo sapiens
gttacagctgaa

SEQ ID NO: 473525 - DNA, 14 bp, Homo sapiens
gttacatagaaagt

SEQ ID NO: 473526 - DNA, 13 bp, Homo sapiens
gttagcaagagag

SEQ ID NO: 473527 - DNA, 23 bp, Homo sapiens
gttagggaaatccaactccaggg

SEQ ID NO: 473528 - DNA, 13 bp, Homo sapiens
gttaggggtgggg

SEQ ID NO: 473529 - DNA, 16 bp, Homo sapiens
gttaggggtgggggag

SEQ ID NO: 473530 - DNA, 16 bp, Homo sapiens
gttcaatctgtgaagc

SEQ ID NO: 473531 - DNA, 24 bp, Homo sapiens
gttcactctacttagcatgtccct

SEQ ID NO: 473532 - DNA, 11 bp, Homo sapiens
gttcattcaca

SEQ ID NO: 473533 - DNA, 17 bp, Homo sapiens
gttcattcatactcaaa

SEQ ID NO: 473534 - DNA, 9 bp, Homo sapiens
gttccaagt

SEQ ID NO: 473535 - DNA, 14 bp, Homo sapiens
gttccaagtgtgtg

SEQ ID NO: 473536 - DNA, 17 bp, Homo sapiens
gttccaagtgtgtgtgc

SEQ ID NO: 473537 - DNA, 19 bp, Homo sapiens
gttccaagtgtgtgtgcaa

SEQ ID NO: 473538 - DNA, 13 bp, Homo sapiens
gttcctccagcaa

SEQ ID NO: 473539 - DNA, 20 bp, Homo sapiens
gttctccgggtgtggcctca

SEQ ID NO: 473540 - DNA, 15 bp, Homo sapiens
gttctgaataatttc

SEQ ID NO: 473541 - DNA, 18 bp, Homo sapiens
gttctgaataatttctta

SEQ ID NO: 473542 - DNA, 18 bp, Homo sapiens
gttcttcctcttacctgt

SEQ ID NO: 473543 - DNA, 14 bp, Homo sapiens
gttgacatgcacag

SEQ ID NO: 473544 - DNA, 22 bp, Homo sapiens
gttgctcagcaaggggctctgc

SEQ ID NO: 473545 - DNA, 10 bp, Homo sapiens
gttgctgtcc

SEQ ID NO: 473546 - DNA, 20 bp, Homo sapiens
gttgctgtcctccagggcga

SEQ ID NO: 473547 - DNA, 19 bp, Homo sapiens
gttggaggcctggtctgga

SEQ ID NO: 473548 - DNA, 16 bp, Homo sapiens
gttggccggctggccg

SEQ ID NO: 473549 - DNA, 13 bp, Homo sapiens
gttgggttccaga

SEQ ID NO: 473550 - DNA, 15 bp, Homo sapiens
gttgggttccagaca

SEQ ID NO: 473551 - DNA, 22 bp, Homo sapiens
gccctcctctgccccctccccc

SEQ ID NO: 473552 - DNA, 23 bp, Homo sapiens
gccctctccacccagaggtctcc

SEQ ID NO: 473553 - DNA, 15 bp, Homo sapiens
gccctctttctctct

SEQ ID NO: 473554 - DNA, 23 bp, Homo sapiens
gccctctttctctctgtgtggca

SEQ ID NO: 473555 - DNA, 22 bp, Homo sapiens
gccctgagactcccgcctttga

SEQ ID NO: 473556 - DNA, 10 bp, Homo sapiens
gccctgccct

SEQ ID NO: 473557 - DNA, 12 bp, Homo sapiens
gccctggggtct

SEQ ID NO: 473558 - DNA, 15 bp, Homo sapiens
gccctggggtctctg

SEQ ID NO: 473559 - DNA, 17 bp, Homo sapiens
gccctggggtctctgag

SEQ ID NO: 473560 - DNA, 18 bp, Homo sapiens
gccctggggtctctgagc

SEQ ID NO: 473561 - DNA, 17 bp, Homo sapiens
gccctgtgggagtccac

SEQ ID NO: 473562 - DNA, 20 bp, Homo sapiens
gccgatttcctaagctgttg

SEQ ID NO: 473563 - DNA, 21 bp, Homo sapiens
gccgcagggcgctccggcaga

SEQ ID NO: 473564 - DNA, 23 bp, Homo sapiens
gccgcagggcgctccggcagagg

SEQ ID NO: 473565 - DNA, 15 bp, Homo sapiens
gccgccctgggctgt

SEQ ID NO: 473566 - DNA, 24 bp, Homo sapiens
gccgccctgggctgtctgtcacca

SEQ ID NO: 473567 - DNA, 12 bp, Homo sapiens
gccgcctcctcc

SEQ ID NO: 473568 - DNA, 14 bp, Homo sapiens
gccgcctcctccag

SEQ ID NO: 473569 - DNA, 22 bp, Homo sapiens
gccgcctcgggccgcctcctcc

SEQ ID NO: 473570 - DNA, 23 bp, Homo sapiens
gccgcctcgggccgcctcctcca

SEQ ID NO: 473571 - DNA, 13 bp, Homo sapiens
gccgcgctctgcc

SEQ ID NO: 473572 - DNA, 16 bp, Homo sapiens
gccgcgctctgcccct

SEQ ID NO: 473573 - DNA, 17 bp, Homo sapiens
gccgcgctctgcccctc

SEQ ID NO: 473574 - DNA, 18 bp, Homo sapiens
gccgcgctctgcccctcc

SEQ ID NO: 473575 - DNA, 18 bp, Homo sapiens
gccggggactggccactg

SEQ ID NO: 473576 - DNA, 16 bp, Homo sapiens
gccggggctggccctg

SEQ ID NO: 473577 - DNA, 18 bp, Homo sapiens
gccggggctggccctgcc

SEQ ID NO: 473578 - DNA, 19 bp, Homo sapiens
gccggggctggccctgccc

SEQ ID NO: 473579 - DNA, 21 bp, Homo sapiens
gccggggctggccctgccctc

SEQ ID NO: 473580 - DNA, 23 bp, Homo sapiens
gccggtccaccccgtcccggccc

SEQ ID NO: 473581 - DNA, 15 bp, Homo sapiens
gccggttggccggct

SEQ ID NO: 473582 - DNA, 22 bp, Homo sapiens
gccgtccctgacttcccagctg

SEQ ID NO: 473583 - DNA, 17 bp, Homo sapiens
gccgtgccttcagctct

SEQ ID NO: 473584 - DNA, 19 bp, Homo sapiens
gccgtggcttcccgctcag

SEQ ID NO: 473585 - DNA, 22 bp, Homo sapiens
gccgtttgaatatattttatct

SEQ ID NO: 473586 - DNA, 23 bp, Homo sapiens
gccgtttgaatatattttatctt

SEQ ID NO: 473587 - DNA, 22 bp, Homo sapiens
gcctatggaaagggtgtggctt

SEQ ID NO: 473588 - DNA, 12 bp, Homo sapiens
gcctcagccctc

SEQ ID NO: 473589 - DNA, 12 bp, Homo sapiens
gaggacctttct

SEQ ID NO: 473590 - DNA, 17 bp, Homo sapiens
gaggacggggcagagct

SEQ ID NO: 473591 - DNA, 22 bp, Homo sapiens
gaggacgtcatcggaggctggg

SEQ ID NO: 473592 - DNA, 23 bp, Homo sapiens
gaggacgtcatcggaggctgggc

SEQ ID NO: 473593 - DNA, 13 bp, Homo sapiens
gaggactgttcta

SEQ ID NO: 473594 - DNA, 13 bp, Homo sapiens
gaggagcaccccc

SEQ ID NO: 473595 - DNA, 20 bp, Homo sapiens
gaggagcacccccagcctcc

SEQ ID NO: 473596 - DNA, 21 bp, Homo sapiens
gaggagcacccccagcctccc

SEQ ID NO: 473597 - DNA, 19 bp, Homo sapiens
gaggaggtgtggagtggag

SEQ ID NO: 473598 - DNA, 12 bp, Homo sapiens
gaggagtccaaa

SEQ ID NO: 473599 - DNA, 13 bp, Homo sapiens
gaggagtccaaaa

SEQ ID NO: 473600 - DNA, 15 bp, Homo sapiens
gaggcagaatggtgg

SEQ ID NO: 473601 - DNA, 23 bp, Homo sapiens
gaggcagaatggtgggctccaga

SEQ ID NO: 473602 - DNA, 12 bp, Homo sapiens
gaggcagggccc

SEQ ID NO: 473603 - DNA, 17 bp, Homo sapiens
gaggcagggccctgggg

SEQ ID NO: 473604 - DNA, 23 bp, Homo sapiens
gaggcccccctctgcctttgagc

SEQ ID NO: 473605 - DNA, 13 bp, Homo sapiens
gaggcccccggag

SEQ ID NO: 473606 - DNA, 15 bp, Homo sapiens
gaggcctggtctgga

SEQ ID NO: 473607 - DNA, 16 bp, Homo sapiens
gaggcgtgggatccag

SEQ ID NO: 473608 - DNA, 21 bp, Homo sapiens
gaggcgtgggatccagagaga

SEQ ID NO: 473609 - DNA, 17 bp, Homo sapiens
gagggaagcccacccgc

SEQ ID NO: 473610 - DNA, 18 bp, Homo sapiens
gagggaagcccacccgcc

SEQ ID NO: 473611 - DNA, 22 bp, Homo sapiens
gagggaagcccacccgccccag

SEQ ID NO: 473612 - DNA, 22 bp, Homo sapiens
gagggaatccatatcagctctg

SEQ ID NO: 473613 - DNA, 20 bp, Homo sapiens
gagggacagcagattccaca

SEQ ID NO: 473614 - DNA, 12 bp, Homo sapiens
gagggcactggt

SEQ ID NO: 473615 - DNA, 14 bp, Homo sapiens
gagggctgacaagg

SEQ ID NO: 473616 - DNA, 14 bp, Homo sapiens
gagggctgagcccc

SEQ ID NO: 473617 - DNA, 15 bp, Homo sapiens
gagggctgagcccct

SEQ ID NO: 473618 - DNA, 23 bp, Homo sapiens
gaggggcaactgatgaacacagg

SEQ ID NO: 473619 - DNA, 14 bp, Homo sapiens
gaggggcctggcag

SEQ ID NO: 473620 - DNA, 16 bp, Homo sapiens
gagggggccagaggga

SEQ ID NO: 473621 - DNA, 18 bp, Homo sapiens
gaggtgtggagtggaggg

SEQ ID NO: 473622 - DNA, 15 bp, Homo sapiens
gagtaggctgtattt

SEQ ID NO: 473623 - DNA, 21 bp, Homo sapiens
gagtccccccacccctcccca

SEQ ID NO: 473624 - DNA, 20 bp, Homo sapiens
gagtcggctgggcagggccg

SEQ ID NO: 473625 - DNA, 14 bp, Homo sapiens
gagtctcttctcca

SEQ ID NO: 473626 - DNA, 15 bp, Homo sapiens
gagtctgaaggagag

SEQ ID NO: 473627 - DNA, 17 bp, Homo sapiens
gagtctgaaggagagga

SEQ ID NO: 473628 - DNA, 19 bp, Homo sapiens
gagtgaatgagtaaataaa

SEQ ID NO: 473629 - DNA, 15 bp, Homo sapiens
gagtggctcctcccg

SEQ ID NO: 473630 - DNA, 14 bp, Homo sapiens
gagtgggccccctc

SEQ ID NO: 473631 - DNA, 19 bp, Homo sapiens
gagtttaaaaaaataacat

SEQ ID NO: 473632 - DNA, 13 bp, Homo sapiens
gagtttctatgga

SEQ ID NO: 473633 - DNA, 17 bp, Homo sapiens
gataattattggtaatt

SEQ ID NO: 473634 - DNA, 21 bp, Homo sapiens
gatactgaattgttatgtaaa

SEQ ID NO: 473635 - DNA, 22 bp, Homo sapiens
gatagcactggtttgtttctca

SEQ ID NO: 473636 - DNA, 16 bp, Homo sapiens
gataggagcttccaga

SEQ ID NO: 473637 - DNA, 17 bp, Homo sapiens
gataggagcttccagat

SEQ ID NO: 473638 - DNA, 13 bp, Homo sapiens
gatagtttattat

SEQ ID NO: 473639 - DNA, 17 bp, Homo sapiens
gatatgaaagagaaaat

SEQ ID NO: 473640 - DNA, 21 bp, Homo sapiens
gatatgcatgtagcatataaa

SEQ ID NO: 473641 - DNA, 22 bp, Homo sapiens
gatatgcatgtagcatataaat

SEQ ID NO: 473642 - DNA, 19 bp, Homo sapiens
gatattttcaacgcagccc

SEQ ID NO: 473643 - DNA, 22 bp, Homo sapiens
gatattttcaacgcagccctgc

SEQ ID NO: 473644 - DNA, 24 bp, Homo sapiens
gatcagcattcaaaatagttctat

SEQ ID NO: 473645 - DNA, 15 bp, Homo sapiens
gatccagagagaagc

SEQ ID NO: 473646 - DNA, 16 bp, Homo sapiens
gatccagagagaagca

SEQ ID NO: 473647 - DNA, 23 bp, Homo sapiens
gatccagagagaagcaccccacc

SEQ ID NO: 473648 - DNA, 19 bp, Homo sapiens
gatccctcggtcagcaccg

SEQ ID NO: 473649 - DNA, 18 bp, Homo sapiens
gatctaaaaggaggacag

SEQ ID NO: 473650 - DNA, 14 bp, Homo sapiens
gatctggagtctga

SEQ ID NO: 473651 - DNA, 15 bp, Homo sapiens
gatctggagtctgaa

SEQ ID NO: 473652 - DNA, 17 bp, Homo sapiens
gatctggagtctgaagg

SEQ ID NO: 473653 - DNA, 22 bp, Homo sapiens
gatcttgagcaaggcaagaagt

SEQ ID NO: 473654 - DNA, 20 bp, Homo sapiens
gatgaaaaaaagggaaaaca

SEQ ID NO: 473655 - DNA, 22 bp, Homo sapiens
gatgaaaaaaagggaaaacaaa

SEQ ID NO: 473656 - DNA, 22 bp, Homo sapiens
gatgatctctccacggtagcac

SEQ ID NO: 473657 - DNA, 17 bp, Homo sapiens
gatgctgactgtactcc

SEQ ID NO: 473658 - DNA, 20 bp, Homo sapiens
gatgctgactgtactcctcc

SEQ ID NO: 473659 - DNA, 22 bp, Homo sapiens
gatggcttccgtgagacacaag

SEQ ID NO: 473660 - DNA, 16 bp, Homo sapiens
gatgggggatgggcca

SEQ ID NO: 473661 - DNA, 12 bp, Homo sapiens
gcccacccctct

SEQ ID NO: 473662 - DNA, 16 bp, Homo sapiens
gcccacccctcttccc

SEQ ID NO: 473663 - DNA, 14 bp, Homo sapiens
gcccaccctgggcc

SEQ ID NO: 473664 - DNA, 18 bp, Homo sapiens
gcccaccctgggcctccc

SEQ ID NO: 473665 - DNA, 13 bp, Homo sapiens
gcccacctgccca

SEQ ID NO: 473666 - DNA, 13 bp, Homo sapiens
gcccacgcagagc

SEQ ID NO: 473667 - DNA, 15 bp, Homo sapiens
gcccacgcagagccc

SEQ ID NO: 473668 - DNA, 16 bp, Homo sapiens
gcccacgcagagcccc

SEQ ID NO: 473669 - DNA, 19 bp, Homo sapiens
gcccacgcagagccccgga

SEQ ID NO: 473670 - DNA, 22 bp, Homo sapiens
gcccacgcagagccccggagca

SEQ ID NO: 473671 - DNA, 15 bp, Homo sapiens
gcccagaaaaaagga

SEQ ID NO: 473672 - DNA, 16 bp, Homo sapiens
gcccagaaaaaaggac

SEQ ID NO: 473673 - DNA, 17 bp, Homo sapiens
gcccagaacgggcctcc

SEQ ID NO: 473674 - DNA, 23 bp, Homo sapiens
gcccagccggggtggggtgcctg

SEQ ID NO: 473675 - DNA, 11 bp, Homo sapiens
gcccagcctct

SEQ ID NO: 473676 - DNA, 13 bp, Homo sapiens
gcccagcctctcc

SEQ ID NO: 473677 - DNA, 22 bp, Homo sapiens
gcccagggggaagatgccaagg

SEQ ID NO: 473678 - DNA, 23 bp, Homo sapiens
gcccagtcttgagtgggccccct

SEQ ID NO: 473679 - DNA, 20 bp, Homo sapiens
gcccagttagcccggccaag

SEQ ID NO: 473680 - DNA, 23 bp, Homo sapiens
gcccagttagcccggccaaggac

SEQ ID NO: 473681 - DNA, 13 bp, Homo sapiens
gcccatggcccca

SEQ ID NO: 473682 - DNA, 15 bp, Homo sapiens
gcccatggccccagc

SEQ ID NO: 473683 - DNA, 17 bp, Homo sapiens
gcccatggccccagctg

SEQ ID NO: 473684 - DNA, 19 bp, Homo sapiens
gcccatggccccagctggc

SEQ ID NO: 473685 - DNA, 21 bp, Homo sapiens
gcccatggccccagctggctg

SEQ ID NO: 473686 - DNA, 22 bp, Homo sapiens
gcccatggccccagctggctgg

SEQ ID NO: 473687 - DNA, 16 bp, Homo sapiens
gcccatgtgtcccctc

SEQ ID NO: 473688 - DNA, 18 bp, Homo sapiens
gcccatgtgtcccctcac

SEQ ID NO: 473689 - DNA, 19 bp, Homo sapiens
gcccatgtgtcccctcact

SEQ ID NO: 473690 - DNA, 19 bp, Homo sapiens
gccccaaccctcggagccc

SEQ ID NO: 473691 - DNA, 17 bp, Homo sapiens
gccccacccaccctctg

SEQ ID NO: 473692 - DNA, 19 bp, Homo sapiens
gccccacccaccctctggt

SEQ ID NO: 473693 - DNA, 15 bp, Homo sapiens
ctccttccccacccc

SEQ ID NO: 473694 - DNA, 16 bp, Homo sapiens
ctccttccccacccca

SEQ ID NO: 473695 - DNA, 17 bp, Homo sapiens
ctccttccccaccccat

SEQ ID NO: 473696 - DNA, 13 bp, Homo sapiens
ctccttctcccct

SEQ ID NO: 473697 - DNA, 15 bp, Homo sapiens
ctccttctcccctcc

SEQ ID NO: 473698 - DNA, 16 bp, Homo sapiens
ctccttctcccctcca

SEQ ID NO: 473699 - DNA, 18 bp, Homo sapiens
ctccttctcccctccaga

SEQ ID NO: 473700 - DNA, 17 bp, Homo sapiens
ctgaattgttatgtaaa

SEQ ID NO: 473701 - DNA, 12 bp, Homo sapiens
ctgaatttaact

SEQ ID NO: 473702 - DNA, 20 bp, Homo sapiens
ctgaccccacttatgctgct

SEQ ID NO: 473703 - DNA, 23 bp, Homo sapiens
ctgaccccacttatgctgctgtg

SEQ ID NO: 473704 - DNA, 21 bp, Homo sapiens
ctgacgatcttcccccttccc

SEQ ID NO: 473705 - DNA, 14 bp, Homo sapiens
ctgactccctgtgg

SEQ ID NO: 473706 - DNA, 16 bp, Homo sapiens
ctgactccctgtgggg

SEQ ID NO: 473707 - DNA, 17 bp, Homo sapiens
ctgactccctgtggggg

SEQ ID NO: 473708 - DNA, 17 bp, Homo sapiens
ctgactgtactcctccc

SEQ ID NO: 473709 - DNA, 16 bp, Homo sapiens
ctgacttcccagctgg

SEQ ID NO: 473710 - DNA, 17 bp, Homo sapiens
ctgacttcccagctggc

SEQ ID NO: 473711 - DNA, 22 bp, Homo sapiens
ctgacttcccagctggcagcgc

SEQ ID NO: 473712 - DNA, 23 bp, Homo sapiens
ctgacttcccagctggcagcgcc

SEQ ID NO: 473713 - DNA, 24 bp, Homo sapiens
ctgacttcccagctggcagcgcct

SEQ ID NO: 473714 - DNA, 18 bp, Homo sapiens
ctgagaagagtcgagtga

SEQ ID NO: 473715 - DNA, 22 bp, Homo sapiens
ctgagaagatgttaattacttt

SEQ ID NO: 473716 - DNA, 19 bp, Homo sapiens
ctgagactcccgcctttga

SEQ ID NO: 473717 - DNA, 20 bp, Homo sapiens
ctgagactcccgcctttgac

SEQ ID NO: 473718 - DNA, 20 bp, Homo sapiens
ctgagagctgctcctttggg

SEQ ID NO: 473719 - DNA, 14 bp, Homo sapiens
ctgagcagtgggga

SEQ ID NO: 473720 - DNA, 14 bp, Homo sapiens
ctgagccacagtgg

SEQ ID NO: 473721 - DNA, 16 bp, Homo sapiens
ctgagcccagaaaaaa

SEQ ID NO: 473722 - DNA, 22 bp, Homo sapiens
ctgagcccagaaaaaaggactg

SEQ ID NO: 473723 - DNA, 14 bp, Homo sapiens
ctgagcccctcctc

SEQ ID NO: 473724 - DNA, 16 bp, Homo sapiens
ctgagcccctcctctc

SEQ ID NO: 473725 - DNA, 14 bp, Homo sapiens
ctgagctccaccct

SEQ ID NO: 473726 - DNA, 15 bp, Homo sapiens
ctgagctccaccctc

SEQ ID NO: 473727 - DNA, 16 bp, Homo sapiens
ctgagctccaccctcc

SEQ ID NO: 473728 - DNA, 23 bp, Homo sapiens
ctgagcttgattctaaaggggac

SEQ ID NO: 473729 - DNA, 17 bp, Homo sapiens
ctgaggacggggcagag

SEQ ID NO: 473730 - DNA, 20 bp, Homo sapiens
ctgaggacggggcagagctg

SEQ ID NO: 473731 - DNA, 22 bp, Homo sapiens
ctgaggacggggcagagctgag

SEQ ID NO: 473732 - DNA, 16 bp, Homo sapiens
ctgaggagtaaaaaga

SEQ ID NO: 473733 - DNA, 14 bp, Homo sapiens
ctgaggagtccaaa

SEQ ID NO: 473734 - DNA, 18 bp, Homo sapiens
ctgagggaagcccacccg

SEQ ID NO: 473735 - DNA, 23 bp, Homo sapiens
ctgaggtacctttccacccagac

SEQ ID NO: 473736 - DNA, 15 bp, Homo sapiens
ctgaggttaagggga

SEQ ID NO: 473737 - DNA, 15 bp, Homo sapiens
ctgagtccagctccc

SEQ ID NO: 473738 - DNA, 15 bp, Homo sapiens
ctgagtcggctgggc

SEQ ID NO: 473739 - DNA, 20 bp, Homo sapiens
ctgagtcggctgggcagggc

SEQ ID NO: 473740 - DNA, 21 bp, Homo sapiens
ctgagtcggctgggcagggcc

SEQ ID NO: 473741 - DNA, 22 bp, Homo sapiens
ctgagtttgaacacagatcatt

SEQ ID NO: 473742 - DNA, 12 bp, Homo sapiens
ctgataaacatt

SEQ ID NO: 473743 - DNA, 20 bp, Homo sapiens
ctgatatcacgggcccgctc

SEQ ID NO: 473744 - DNA, 15 bp, Homo sapiens
ctgatgggtcctgct

SEQ ID NO: 473745 - DNA, 16 bp, Homo sapiens
ctgatgggtcctgctg

SEQ ID NO: 473746 - DNA, 15 bp, Homo sapiens
ctgattattgaatgt

SEQ ID NO: 473747 - DNA, 15 bp, Homo sapiens
ctgattttgagctca

SEQ ID NO: 473748 - DNA, 14 bp, Homo sapiens
ctgcaaatagtttc

SEQ ID NO: 473749 - DNA, 14 bp, Homo sapiens
ctgcaataacagtt

SEQ ID NO: 473750 - DNA, 17 bp, Homo sapiens
ctgcaataacagtttta

SEQ ID NO: 473751 - DNA, 16 bp, Homo sapiens
ctgcaatacattaaaa

SEQ ID NO: 473752 - DNA, 17 bp, Homo sapiens
ctgcaatacattaaaat

SEQ ID NO: 473753 - DNA, 18 bp, Homo sapiens
ctgcacagtgcatctcag

SEQ ID NO: 473754 - DNA, 20 bp, Homo sapiens
ctgcaccaacctcactgccc

SEQ ID NO: 473755 - DNA, 23 bp, Homo sapiens
ctgcaccctctgctatgtctgtg

SEQ ID NO: 473756 - DNA, 14 bp, Homo sapiens
ctgcaccttgggca

SEQ ID NO: 473757 - DNA, 15 bp, Homo sapiens
ctgcaccttgggcac

SEQ ID NO: 473758 - DNA, 13 bp, Homo sapiens
ctgcagcccagaa

SEQ ID NO: 473759 - DNA, 13 bp, Homo sapiens
ctgcagcctgagc

SEQ ID NO: 473760 - DNA, 15 bp, Homo sapiens
ctgcagcctgagctc

SEQ ID NO: 473761 - DNA, 16 bp, Homo sapiens
ctgcagcctgagctcc

SEQ ID NO: 473762 - DNA, 23 bp, Homo sapiens
ctgcagcctgagctccaccctcc

SEQ ID NO: 473763 - DNA, 21 bp, Homo sapiens
ctgcagctatgcgcaatgtgg

SEQ ID NO: 473764 - DNA, 14 bp, Homo sapiens
ctgcagtattctgt

SEQ ID NO: 473765 - DNA, 16 bp, Homo sapiens
ctgcagtattctgtag

SEQ ID NO: 473766 - DNA, 15 bp, Homo sapiens
ctgcataagattata

SEQ ID NO: 473767 - DNA, 15 bp, Homo sapiens
ctgcatagacaaagg

SEQ ID NO: 473768 - DNA, 15 bp, Homo sapiens
ctgcatcccttggcc

SEQ ID NO: 473769 - DNA, 17 bp, Homo sapiens
ctgccacacttcaggct

SEQ ID NO: 473770 - DNA, 22 bp, Homo sapiens
ctgccacacttcaggctcttct

SEQ ID NO: 473771 - DNA, 20 bp, Homo sapiens
ctgcccagttagcccggcca

SEQ ID NO: 473772 - DNA, 21 bp, Homo sapiens
ctgcccagttagcccggccaa

SEQ ID NO: 473773 - DNA, 22 bp, Homo sapiens
ctgcccatgtgtcccctcactc

SEQ ID NO: 473774 - DNA, 15 bp, Homo sapiens
ctgcccccctccttt

SEQ ID NO: 473775 - DNA, 18 bp, Homo sapiens
ctgcccccctcctttcca

SEQ ID NO: 473776 - DNA, 14 bp, Homo sapiens
ctgccccccttccc

SEQ ID NO: 473777 - DNA, 15 bp, Homo sapiens
ctgccccccttccca

SEQ ID NO: 473778 - DNA, 21 bp, Homo sapiens
ctgccccctcccccgcagaca

SEQ ID NO: 473779 - DNA, 23 bp, Homo sapiens
ctgcccctgtaaggtttcaatgc

SEQ ID NO: 473780 - DNA, 19 bp, Homo sapiens
ctgccccttgaccccacac

SEQ ID NO: 473781 - DNA, 18 bp, Homo sapiens
ctgccctcactccactcc

SEQ ID NO: 473782 - DNA, 20 bp, Homo sapiens
ctgccctcactccactcccc

SEQ ID NO: 473783 - DNA, 12 bp, Homo sapiens
ctgccctccccc

SEQ ID NO: 473784 - DNA, 15 bp, Homo sapiens
ctgccctcccccacg

SEQ ID NO: 473785 - DNA, 22 bp, Homo sapiens
ctgccctcccccacggccgtcc

SEQ ID NO: 473786 - DNA, 18 bp, Homo sapiens
ctgccctccctccttcct

SEQ ID NO: 473787 - DNA, 22 bp, Homo sapiens
ctgccctcgtctccctggccac

SEQ ID NO: 473788 - DNA, 13 bp, Homo sapiens
ctgccctgcacct

SEQ ID NO: 473789 - DNA, 13 bp, Homo sapiens
ctgccgctgcacc

SEQ ID NO: 473790 - DNA, 19 bp, Homo sapiens
ctgccgctgccgctgcacc

SEQ ID NO: 473791 - DNA, 22 bp, Homo sapiens
ctttagaatagttaaattggct

SEQ ID NO: 473792 - DNA, 10 bp, Homo sapiens
ctttatcatg

SEQ ID NO: 473793 - DNA, 14 bp, Homo sapiens
ctttatcatgctac

SEQ ID NO: 473794 - DNA, 17 bp, Homo sapiens
ctttatgtaagaagaaa

SEQ ID NO: 473795 - DNA, 14 bp, Homo sapiens
ctttatttaatttc

SEQ ID NO: 473796 - DNA, 18 bp, Homo sapiens
ctttatttaatttcataa

SEQ ID NO: 473797 - DNA, 21 bp, Homo sapiens
ctttatttaatttcataaatt

SEQ ID NO: 473798 - DNA, 18 bp, Homo sapiens
ctttatttattaaacttc

SEQ ID NO: 473799 - DNA, 21 bp, Homo sapiens
ctttatttattaaacttcagc

SEQ ID NO: 473800 - DNA, 24 bp, Homo sapiens
ctttcaattgcttctgtgcaataa

SEQ ID NO: 473801 - DNA, 16 bp, Homo sapiens
ctttcacaaccttctg

SEQ ID NO: 473802 - DNA, 17 bp, Homo sapiens
ctttcagttattaaatg

SEQ ID NO: 473803 - DNA, 20 bp, Homo sapiens
ctttcatgtttaagaaatga

SEQ ID NO: 473804 - DNA, 13 bp, Homo sapiens
ctttccacccaga

SEQ ID NO: 473805 - DNA, 16 bp, Homo sapiens
ctttccacccagaccc

SEQ ID NO: 473806 - DNA, 15 bp, Homo sapiens
ctttccctgcatccc

SEQ ID NO: 473807 - DNA, 19 bp, Homo sapiens
ctttccgctgtcgccccag

SEQ ID NO: 473808 - DNA, 20 bp, Homo sapiens
ctttctaacccactaagtaa

SEQ ID NO: 473809 - DNA, 21 bp, Homo sapiens
ctttctagtcctattctattg

SEQ ID NO: 473810 - DNA, 13 bp, Homo sapiens
ctttctatgtaga

SEQ ID NO: 473811 - DNA, 10 bp, Homo sapiens
ctttctcatg

SEQ ID NO: 473812 - DNA, 18 bp, Homo sapiens
ctttctctctgtgtggca

SEQ ID NO: 473813 - DNA, 20 bp, Homo sapiens
ctttcttttgaatcaatctg

SEQ ID NO: 473814 - DNA, 21 bp, Homo sapiens
ctttgacctgacgatcttccc

SEQ ID NO: 473815 - DNA, 19 bp, Homo sapiens
ctttgagcctgggaaataa

SEQ ID NO: 473816 - DNA, 21 bp, Homo sapiens
ctttgagcttctcctctgctc

SEQ ID NO: 473817 - DNA, 18 bp, Homo sapiens
ctttgctgaagtctcccc

SEQ ID NO: 473818 - DNA, 22 bp, Homo sapiens
ctttgctgaagtctccccgcag

SEQ ID NO: 473819 - DNA, 14 bp, Homo sapiens
ctttgggctgccct

SEQ ID NO: 473820 - DNA, 21 bp, Homo sapiens
ctttgggggattcaaatgcat

SEQ ID NO: 473821 - DNA, 23 bp, Homo sapiens
ctttgggggattcaaatgcatga

SEQ ID NO: 473822 - DNA, 23 bp, Homo sapiens
ctttgtcacagggtgttggaaga

SEQ ID NO: 473823 - DNA, 21 bp, Homo sapiens
ctttgtcacttctgctgtaca

SEQ ID NO: 473824 - DNA, 15 bp, Homo sapiens
ctttgtgcttgttct

SEQ ID NO: 473825 - DNA, 15 bp, Homo sapiens
ctttgtggactttat

SEQ ID NO: 473826 - DNA, 12 bp, Homo sapiens
cttttcactgct

SEQ ID NO: 473827 - DNA, 20 bp, Homo sapiens
cttttcactgctggctgcct

SEQ ID NO: 473828 - DNA, 17 bp, Homo sapiens
cttttcagcttgtttct

SEQ ID NO: 473829 - DNA, 14 bp, Homo sapiens
cttttcatttttgc

SEQ ID NO: 473830 - DNA, 18 bp, Homo sapiens
cttttcccacctctttgg

SEQ ID NO: 473831 - DNA, 15 bp, Homo sapiens
cttttgaaaaaggat

SEQ ID NO: 473832 - DNA, 16 bp, Homo sapiens
cttttgaatcaatctg

SEQ ID NO: 473833 - DNA, 21 bp, Homo sapiens
ctttttcagagttgctttaaa

SEQ ID NO: 473834 - DNA, 19 bp, Homo sapiens
cttttttcaatgtactgta

SEQ ID NO: 473835 - DNA, 21 bp, Homo sapiens
gaaaaaaagggaaaacaaata

SEQ ID NO: 473836 - DNA, 15 bp, Homo sapiens
gaaaaaaggaagtgg

SEQ ID NO: 473837 - DNA, 19 bp, Homo sapiens
gaaaacaaatatttcactt

SEQ ID NO: 473838 - DNA, 18 bp, Homo sapiens
gaaaaccaagccgtggct

SEQ ID NO: 473839 - DNA, 15 bp, Homo sapiens
gaaaagaaatgctaa

SEQ ID NO: 473840 - DNA, 19 bp, Homo sapiens
gaaaagaagaaagtctatg

SEQ ID NO: 473841 - DNA, 16 bp, Homo sapiens
gaaacaaggaaggaca

SEQ ID NO: 473842 - DNA, 18 bp, Homo sapiens
gaaagccctcccccttcc

SEQ ID NO: 473843 - DNA, 20 bp, Homo sapiens
gaaaggcagagattgggggg

SEQ ID NO: 473844 - DNA, 18 bp, Homo sapiens
gaaagggcagcccctccc

SEQ ID NO: 473845 - DNA, 15 bp, Homo sapiens
gaaatcaatttaaag

SEQ ID NO: 473846 - DNA, 19 bp, Homo sapiens
gaaatcaatttaaaggaaa

SEQ ID NO: 473847 - DNA, 11 bp, Homo sapiens
gaaatgagaaa

SEQ ID NO: 473848 - DNA, 16 bp, Homo sapiens
gaaattctataagaga

SEQ ID NO: 473849 - DNA, 17 bp, Homo sapiens
gaaattctataagagac

SEQ ID NO: 473850 - DNA, 16 bp, Homo sapiens
gaaattggaaaggact

SEQ ID NO: 473851 - DNA, 19 bp, Homo sapiens
gaaattggaaaggactttg

SEQ ID NO: 473852 - DNA, 16 bp, Homo sapiens
gaaattttatctcttc

SEQ ID NO: 473853 - DNA, 15 bp, Homo sapiens
gaacaagatttccct

SEQ ID NO: 473854 - DNA, 15 bp, Homo sapiens
gaacagacctcggct

SEQ ID NO: 473855 - DNA, 13 bp, Homo sapiens
gaaccagcactcc

SEQ ID NO: 473856 - DNA, 14 bp, Homo sapiens
gaaccagcactccc

SEQ ID NO: 473857 - DNA, 18 bp, Homo sapiens
gaaccagcactcccaggg

SEQ ID NO: 473858 - DNA, 20 bp, Homo sapiens
gaaccagcactcccagggcc

SEQ ID NO: 473859 - DNA, 13 bp, Homo sapiens
gaacccccctccc

SEQ ID NO: 473860 - DNA, 10 bp, Homo sapiens
gaaccttccc

SEQ ID NO: 473861 - DNA, 14 bp, Homo sapiens
gaacgggcctcccc

SEQ ID NO: 473862 - DNA, 15 bp, Homo sapiens
gaacgggcctccccg

SEQ ID NO: 473863 - DNA, 18 bp, Homo sapiens
gaagaaaaaggaaacaag

SEQ ID NO: 473864 - DNA, 15 bp, Homo sapiens
gaagaaaacccgagg

SEQ ID NO: 473865 - DNA, 17 bp, Homo sapiens
gaagaaagtctatgctt

SEQ ID NO: 473866 - DNA, 19 bp, Homo sapiens
gaagagcgctcctctgcct

SEQ ID NO: 473867 - DNA, 12 bp, Homo sapiens
gaagatgccaag

SEQ ID NO: 473868 - DNA, 23 bp, Homo sapiens
cggctgggcagggccgcagggcg

SEQ ID NO: 473869 - DNA, 20 bp, Homo sapiens
cgggacccccggcctccagg

SEQ ID NO: 473870 - DNA, 14 bp, Homo sapiens
cgggagcctccccc

SEQ ID NO: 473871 - DNA, 12 bp, Homo sapiens
cgggcagcccct

SEQ ID NO: 473872 - DNA, 14 bp, Homo sapiens
cgggcagcccctgc

SEQ ID NO: 473873 - DNA, 21 bp, Homo sapiens
cgggcagcccctgctggacca

SEQ ID NO: 473874 - DNA, 13 bp, Homo sapiens
cgggccgcctcct

SEQ ID NO: 473875 - DNA, 18 bp, Homo sapiens
cgggccgcctcctccaga

SEQ ID NO: 473876 - DNA, 19 bp, Homo sapiens
cgggccgcctcctccagac

SEQ ID NO: 473877 - DNA, 16 bp, Homo sapiens
ctataagagacaaagt

SEQ ID NO: 473878 - DNA, 18 bp, Homo sapiens
ctataagagacaaagttt

SEQ ID NO: 473879 - DNA, 15 bp, Homo sapiens
ctataccgagaccca

SEQ ID NO: 473880 - DNA, 16 bp, Homo sapiens
ctataccgagacccac

SEQ ID NO: 473881 - DNA, 16 bp, Homo sapiens
ctatactggttatagt

SEQ ID NO: 473882 - DNA, 14 bp, Homo sapiens
ctatcctgcaccct

SEQ ID NO: 473883 - DNA, 16 bp, Homo sapiens
ctatcctgcaccctct

SEQ ID NO: 473884 - DNA, 18 bp, Homo sapiens
ctatcctgcaccctctgc

SEQ ID NO: 473885 - DNA, 22 bp, Homo sapiens
ctatccttttttattgaataac

SEQ ID NO: 473886 - DNA, 21 bp, Homo sapiens
ctatctgtcatctctctgggg

SEQ ID NO: 473887 - DNA, 22 bp, Homo sapiens
ctatctgtcatctctctggggc

SEQ ID NO: 473888 - DNA, 16 bp, Homo sapiens
ctatgagagatgtgtc

SEQ ID NO: 473889 - DNA, 14 bp, Homo sapiens
ctatgcctgtattt

SEQ ID NO: 473890 - DNA, 17 bp, Homo sapiens
ctatgcctgtatttcca

SEQ ID NO: 473891 - DNA, 18 bp, Homo sapiens
ctatgcctgtatttccaa

SEQ ID NO: 473892 - DNA, 21 bp, Homo sapiens
ctatggtatgctggccagcac

SEQ ID NO: 473893 - DNA, 15 bp, Homo sapiens
ctatgtagaactgtt

SEQ ID NO: 473894 - DNA, 12 bp, Homo sapiens
ctatgtctgtga

SEQ ID NO: 473895 - DNA, 13 bp, Homo sapiens
ctattaactctgc

SEQ ID NO: 473896 - DNA, 14 bp, Homo sapiens
ctattactgatgtg

SEQ ID NO: 473897 - DNA, 15 bp, Homo sapiens
ctattatctgggttt

SEQ ID NO: 473898 - DNA, 20 bp, Homo sapiens
ctattatctgggttttagaa

SEQ ID NO: 473899 - DNA, 23 bp, Homo sapiens
ctattatctgggttttagaaatt

SEQ ID NO: 473900 - DNA, 16 bp, Homo sapiens
ctattcattacatcct

SEQ ID NO: 473901 - DNA, 18 bp, Homo sapiens
ctattcattacatcctct

SEQ ID NO: 473902 - DNA, 16 bp, Homo sapiens
ctattcccatcgctgg

SEQ ID NO: 473903 - DNA, 16 bp, Homo sapiens
ctatttaagccccctc

SEQ ID NO: 473904 - DNA, 17 bp, Homo sapiens
ctatttgaaaaaagaag

SEQ ID NO: 473905 - DNA, 19 bp, Homo sapiens
ctcaaagaggccagtactt

SEQ ID NO: 473906 - DNA, 17 bp, Homo sapiens
ctcaaatagcctttctt

SEQ ID NO: 473907 - DNA, 21 bp, Homo sapiens
ctcaagagggcactggtggcc

SEQ ID NO: 473908 - DNA, 14 bp, Homo sapiens
ctcaagccaggaga

SEQ ID NO: 473909 - DNA, 15 bp, Homo sapiens
ctcaagccaggagac

SEQ ID NO: 473910 - DNA, 20 bp, Homo sapiens
ctcaatgtggaaaaaatatt

SEQ ID NO: 473911 - DNA, 13 bp, Homo sapiens
ctcaccaaaatat

SEQ ID NO: 473912 - DNA, 16 bp, Homo sapiens
ctcaccttcgcctttg

SEQ ID NO: 473913 - DNA, 17 bp, Homo sapiens
ctcacgctgacagcctc

SEQ ID NO: 473914 - DNA, 19 bp, Homo sapiens
ctcacgctgacagcctcct

SEQ ID NO: 473915 - DNA, 23 bp, Homo sapiens
ctcacgtctgtgagtctgtcctt

SEQ ID NO: 473916 - DNA, 17 bp, Homo sapiens
ctcactccactcccctc

SEQ ID NO: 473917 - DNA, 19 bp, Homo sapiens
ctcactcctacctggtaat

SEQ ID NO: 473918 - DNA, 11 bp, Homo sapiens
ctcactctgtc

SEQ ID NO: 473919 - DNA, 13 bp, Homo sapiens
ctcactctgtcag

SEQ ID NO: 473920 - DNA, 14 bp, Homo sapiens
ctcactctgtcagc

SEQ ID NO: 473921 - DNA, 15 bp, Homo sapiens
ctcactctgtcagcc

SEQ ID NO: 473922 - DNA, 12 bp, Homo sapiens
ctcactgccctc

SEQ ID NO: 473923 - DNA, 15 bp, Homo sapiens
ctcactggtgcattt

SEQ ID NO: 473924 - DNA, 18 bp, Homo sapiens
ctcactggtgcatttaaa

SEQ ID NO: 473925 - DNA, 19 bp, Homo sapiens
ctcagacgggctgagagga

SEQ ID NO: 473926 - DNA, 15 bp, Homo sapiens
ctcagatccctcggt

SEQ ID NO: 473927 - DNA, 13 bp, Homo sapiens
ctcagatgatctc

SEQ ID NO: 473928 - DNA, 23 bp, Homo sapiens
ctcagcaaattcttgaataaact

SEQ ID NO: 473929 - DNA, 21 bp, Homo sapiens
ctcagcccacatagtgatggt

SEQ ID NO: 473930 - DNA, 21 bp, Homo sapiens
ctcagccttaagaaagctata

SEQ ID NO: 473931 - DNA, 12 bp, Homo sapiens
ctcagctccact

SEQ ID NO: 473932 - DNA, 17 bp, Homo sapiens
ctcaggagaaggcctgc

SEQ ID NO: 473933 - DNA, 14 bp, Homo sapiens
ctcaggctttctat

SEQ ID NO: 473934 - DNA, 16 bp, Homo sapiens
ctcagtacagggcagg

SEQ ID NO: 473935 - DNA, 22 bp, Homo sapiens
ctcagtaggtctgaaggcctcc

SEQ ID NO: 473936 - DNA, 17 bp, Homo sapiens
ctcagtattgacgacct

SEQ ID NO: 473937 - DNA, 22 bp, Homo sapiens
ctcagtctttgggggattcaaa

SEQ ID NO: 473938 - DNA, 13 bp, Homo sapiens
ctcagttaaaatg

SEQ ID NO: 473939 - DNA, 14 bp, Homo sapiens
ctcagttaaaatgt

SEQ ID NO: 473940 - DNA, 14 bp, Homo sapiens
ctcagtttctctgg

SEQ ID NO: 473941 - DNA, 22 bp, Homo sapiens
ctcatctagtttgatgactaaa

SEQ ID NO: 473942 - DNA, 14 bp, Homo sapiens
ctcatcttgtaaat

SEQ ID NO: 473943 - DNA, 18 bp, Homo sapiens
ctcattacagatttagtt

SEQ ID NO: 473944 - DNA, 15 bp, Homo sapiens
ctccaacagacaccc

SEQ ID NO: 473945 - DNA, 16 bp, Homo sapiens
ctccaacagacaccct

SEQ ID NO: 473946 - DNA, 20 bp, Homo sapiens
ctccaacagacaccctccac

SEQ ID NO: 473947 - DNA, 22 bp, Homo sapiens
ctccaatcccaccaaccctcag

SEQ ID NO: 473948 - DNA, 14 bp, Homo sapiens
ctccacacctccac

SEQ ID NO: 473949 - DNA, 15 bp, Homo sapiens
ctccacccagaggtc

SEQ ID NO: 473950 - DNA, 16 bp, Homo sapiens
ctccacccagaggtct

SEQ ID NO: 473951 - DNA, 18 bp, Homo sapiens
ctccacccctcaagccag

SEQ ID NO: 473952 - DNA, 22 bp, Homo sapiens
ctccacccctcaagccaggaga

SEQ ID NO: 473953 - DNA, 19 bp, Homo sapiens
ctccacgcctcctggccag

SEQ ID NO: 473954 - DNA, 15 bp, Homo sapiens
ctccactcccctcat

SEQ ID NO: 473955 - DNA, 17 bp, Homo sapiens
ctccactcctcccaact

SEQ ID NO: 473956 - DNA, 14 bp, Homo sapiens
ctccactctgaagt

SEQ ID NO: 473957 - DNA, 18 bp, Homo sapiens
ctccactctgaagtccct

SEQ ID NO: 473958 - DNA, 16 bp, Homo sapiens
ctccactgccttcgat

SEQ ID NO: 473959 - DNA, 9 bp, Homo sapiens
ctccagacc

SEQ ID NO: 473960 - DNA, 20 bp, Homo sapiens
ctccagacccctaccctttc

SEQ ID NO: 473961 - DNA, 22 bp, Homo sapiens
ctccagacccctaccctttccc

SEQ ID NO: 473962 - DNA, 14 bp, Homo sapiens
ctccagacccctgg

SEQ ID NO: 473963 - DNA, 19 bp, Homo sapiens
ctccagacccctggctttt

SEQ ID NO: 473964 - DNA, 18 bp, Homo sapiens
ctccagactcgagagggc

SEQ ID NO: 473965 - DNA, 19 bp, Homo sapiens
ctccagactcgagagggct

SEQ ID NO: 473966 - DNA, 16 bp, Homo sapiens
cctctggtccttctga

SEQ ID NO: 473967 - DNA, 21 bp, Homo sapiens
cctctggtccttctgacccca

SEQ ID NO: 473968 - DNA, 14 bp, Homo sapiens
cctcttcccccttc

SEQ ID NO: 473969 - DNA, 13 bp, Homo sapiens
cctcttctcagct

SEQ ID NO: 473970 - DNA, 21 bp, Homo sapiens
cctcttcttgcggcaccgccc

SEQ ID NO: 473971 - DNA, 13 bp, Homo sapiens
cctctttctctct

SEQ ID NO: 473972 - DNA, 14 bp, Homo sapiens
cctctttctctctg

SEQ ID NO: 473973 - DNA, 15 bp, Homo sapiens
cctctttctctctgt

SEQ ID NO: 473974 - DNA, 17 bp, Homo sapiens
cctgaagagcgctcctc

SEQ ID NO: 473975 - DNA, 16 bp, Homo sapiens
cctgacagaaggactc

SEQ ID NO: 473976 - DNA, 15 bp, Homo sapiens
cctgacgatcttccc

SEQ ID NO: 473977 - DNA, 17 bp, Homo sapiens
cctgacgatcttccccc

SEQ ID NO: 473978 - DNA, 18 bp, Homo sapiens
cctgacgatcttccccct

SEQ ID NO: 473979 - DNA, 15 bp, Homo sapiens
cctgacttcccagct

SEQ ID NO: 473980 - DNA, 14 bp, Homo sapiens
cctgagactcccgc

SEQ ID NO: 473981 - DNA, 19 bp, Homo sapiens
cctgagactcccgcctttg

SEQ ID NO: 473982 - DNA, 16 bp, Homo sapiens
cctgagccacagtggg

SEQ ID NO: 473983 - DNA, 14 bp, Homo sapiens
cctgagcctgtctc

SEQ ID NO: 473984 - DNA, 13 bp, Homo sapiens
cctgagctccacc

SEQ ID NO: 473985 - DNA, 16 bp, Homo sapiens
cctgagctccaccctc

SEQ ID NO: 473986 - DNA, 22 bp, Homo sapiens
cctgagctccaccctcccctct

SEQ ID NO: 473987 - DNA, 15 bp, Homo sapiens
cctgagggaagccca

SEQ ID NO: 473988 - DNA, 16 bp, Homo sapiens
cctgagggaagcccac

SEQ ID NO: 473989 - DNA, 23 bp, Homo sapiens
cctgaggtacctttccacccaga

SEQ ID NO: 473990 - DNA, 16 bp, Homo sapiens
cctgaggttaagggga

SEQ ID NO: 473991 - DNA, 17 bp, Homo sapiens
cctgcaccaggagacag

SEQ ID NO: 473992 - DNA, 13 bp, Homo sapiens
cctgcagcccaga

SEQ ID NO: 473993 - DNA, 15 bp, Homo sapiens
cctgcagcccagaac

SEQ ID NO: 473994 - DNA, 16 bp, Homo sapiens
cctgcatcccttggcc

SEQ ID NO: 473995 - DNA, 19 bp, Homo sapiens
cctgcatcccttggcccct

SEQ ID NO: 473996 - DNA, 22 bp, Homo sapiens
cctgcatcccttggcccctctc

SEQ ID NO: 473997 - DNA, 18 bp, Homo sapiens
cctgcatgcaactaattc

SEQ ID NO: 473998 - DNA, 11 bp, Homo sapiens
cctgccagcaa

SEQ ID NO: 473999 - DNA, 14 bp, Homo sapiens
cctgccccccttcc

SEQ ID NO: 474000 - DNA, 15 bp, Homo sapiens
cctgccccccttccc

SEQ ID NO: 474001 - DNA, 22 bp, Homo sapiens
cctgccccccttcccaccccta

SEQ ID NO: 474002 - DNA, 13 bp, Homo sapiens
cctgcccgcccgc

SEQ ID NO: 474003 - DNA, 15 bp, Homo sapiens
cctgcccgcccgccg

SEQ ID NO: 474004 - DNA, 12 bp, Homo sapiens
cctgccctcact

SEQ ID NO: 474005 - DNA, 16 bp, Homo sapiens
cctgccctcccccacg

SEQ ID NO: 474006 - DNA, 17 bp, Homo sapiens
cctgccctcccccacgg

SEQ ID NO: 474007 - DNA, 13 bp, Homo sapiens
cctgcctttgatg

SEQ ID NO: 474008 - DNA, 18 bp, Homo sapiens
cctgcgctcctctgcagc

SEQ ID NO: 474009 - DNA, 21 bp, Homo sapiens
cctgcgctcctctgcagcctg

SEQ ID NO: 474010 - DNA, 16 bp, Homo sapiens
cctgcgggttttaatt

SEQ ID NO: 474011 - DNA, 18 bp, Homo sapiens
cctgctcacgtctgtgag

SEQ ID NO: 474012 - DNA, 17 bp, Homo sapiens
cctgctgctcgggaagg

SEQ ID NO: 474013 - DNA, 18 bp, Homo sapiens
cctgctgctcgggaaggc

SEQ ID NO: 474014 - DNA, 23 bp, Homo sapiens
cctgctgctcgggaaggcctgag

SEQ ID NO: 474015 - DNA, 18 bp, Homo sapiens
cctgctttgggctgccct

SEQ ID NO: 474016 - DNA, 20 bp, Homo sapiens
cctggattttctttctatgt

SEQ ID NO: 474017 - DNA, 12 bp, Homo sapiens
cctggcacacca

SEQ ID NO: 474018 - DNA, 16 bp, Homo sapiens
cctggcacagggcagt

SEQ ID NO: 474019 - DNA, 17 bp, Homo sapiens
cctggcacagggcagtg

SEQ ID NO: 474020 - DNA, 18 bp, Homo sapiens
cctggcacagggcagtgg

SEQ ID NO: 474021 - DNA, 21 bp, Homo sapiens
cctggcagccgtgccttcagc

SEQ ID NO: 474022 - DNA, 14 bp, Homo sapiens
cctggccacccttg

SEQ ID NO: 474023 - DNA, 16 bp, Homo sapiens
cctggcctatttaagc

SEQ ID NO: 474024 - DNA, 13 bp, Homo sapiens
cctggcgggcagc

SEQ ID NO: 474025 - DNA, 14 bp, Homo sapiens
cctggcgggcagcc

SEQ ID NO: 474026 - DNA, 15 bp, Homo sapiens
cctggcgggcagccc

SEQ ID NO: 474027 - DNA, 18 bp, Homo sapiens
ccctgcccctcccttcaa

SEQ ID NO: 474028 - DNA, 18 bp, Homo sapiens
ccctgccctcactccact

SEQ ID NO: 474029 - DNA, 13 bp, Homo sapiens
ccctgccctgcac

SEQ ID NO: 474030 - DNA, 23 bp, Homo sapiens
ccctgcgccctccctccctccac

SEQ ID NO: 474031 - DNA, 12 bp, Homo sapiens
ccctgctggacc

SEQ ID NO: 474032 - DNA, 20 bp, Homo sapiens
ccctgctttgggctgccctg

SEQ ID NO: 474033 - DNA, 23 bp, Homo sapiens
ccctgctttgggctgccctggtg

SEQ ID NO: 474034 - DNA, 17 bp, Homo sapiens
ccctggctcccacaggc

SEQ ID NO: 474035 - DNA, 17 bp, Homo sapiens
ccctggcttttcactgc

SEQ ID NO: 474036 - DNA, 19 bp, Homo sapiens
ccctggcttttcactgctg

SEQ ID NO: 474037 - DNA, 22 bp, Homo sapiens
ccctggcttttcactgctggct

SEQ ID NO: 474038 - DNA, 20 bp, Homo sapiens
ccctgggatgggaccaggga

SEQ ID NO: 474039 - DNA, 15 bp, Homo sapiens
ccctgggcccctcca

SEQ ID NO: 474040 - DNA, 16 bp, Homo sapiens
ccctgggcccctccac

SEQ ID NO: 474041 - DNA, 13 bp, Homo sapiens
ccctgggcctcag

SEQ ID NO: 474042 - DNA, 13 bp, Homo sapiens
ccctgggcctccc

SEQ ID NO: 474043 - DNA, 14 bp, Homo sapiens
ccctgggcctcccg

SEQ ID NO: 474044 - DNA, 14 bp, Homo sapiens
ccctggtgctgcca

SEQ ID NO: 474045 - DNA, 17 bp, Homo sapiens
ccctggtgctgccacac

SEQ ID NO: 474046 - DNA, 19 bp, Homo sapiens
ccctgtaaggtttcaatgc

SEQ ID NO: 474047 - DNA, 15 bp, Homo sapiens
ccctgtgggagtcca

SEQ ID NO: 474048 - DNA, 17 bp, Homo sapiens
ccctgtgggagtccact

SEQ ID NO: 474049 - DNA, 22 bp, Homo sapiens
ccctgtgggagtccactttcct

SEQ ID NO: 474050 - DNA, 18 bp, Homo sapiens
ccctgtgggggtggccat

SEQ ID NO: 474051 - DNA, 24 bp, Homo sapiens
ccctgtgggggtggccatccctgg

SEQ ID NO: 474052 - DNA, 13 bp, Homo sapiens
ccctgttcactct

SEQ ID NO: 474053 - DNA, 14 bp, Homo sapiens
ccctgttcactcta

SEQ ID NO: 474054 - DNA, 14 bp, Homo sapiens
cccttcaaccattc

SEQ ID NO: 474055 - DNA, 13 bp, Homo sapiens
cccttcccacccc

SEQ ID NO: 474056 - DNA, 16 bp, Homo sapiens
cccttcccgccttcag

SEQ ID NO: 474057 - DNA, 13 bp, Homo sapiens
cccttcctctcca

SEQ ID NO: 474058 - DNA, 21 bp, Homo sapiens
cccttcctgtcctgctcacgt

SEQ ID NO: 474059 - DNA, 17 bp, Homo sapiens
cccttctgtgtcacagt

SEQ ID NO: 474060 - DNA, 15 bp, Homo sapiens
cccttgaccccacac

SEQ ID NO: 474061 - DNA, 20 bp, Homo sapiens
cccttgcccaaccaatgcac

SEQ ID NO: 474062 - DNA, 12 bp, Homo sapiens
ccctttccctgc

SEQ ID NO: 474063 - DNA, 14 bp, Homo sapiens
ccctttccctgcat

SEQ ID NO: 474064 - DNA, 18 bp, Homo sapiens
ccctttccctgcatccct

SEQ ID NO: 474065 - DNA, 23 bp, Homo sapiens
ccctttgtggactttatttaatt

SEQ ID NO: 474066 - DNA, 15 bp, Homo sapiens
ccgacagcctggcac

SEQ ID NO: 474067 - DNA, 20 bp, Homo sapiens
ccgagacccaccatccttcc

SEQ ID NO: 474068 - DNA, 12 bp, Homo sapiens
cccaaataacag

SEQ ID NO: 474069 - DNA, 15 bp, Homo sapiens
cccaacaccacccct

SEQ ID NO: 474070 - DNA, 12 bp, Homo sapiens
cccaacccccac

SEQ ID NO: 474071 - DNA, 18 bp, Homo sapiens
cccaacccccacctcccg

SEQ ID NO: 474072 - DNA, 15 bp, Homo sapiens
cccaaccctcggagc

SEQ ID NO: 474073 - DNA, 19 bp, Homo sapiens
cccaacgtactcctcagac

SEQ ID NO: 474074 - DNA, 18 bp, Homo sapiens
cccaactccgcccagcct

SEQ ID NO: 474075 - DNA, 20 bp, Homo sapiens
cccaagaatagatgctgact

SEQ ID NO: 474076 - DNA, 21 bp, Homo sapiens
cccaaggtggtcttggagagg

SEQ ID NO: 474077 - DNA, 20 bp, Homo sapiens
cccaattttaaaaaataaca

SEQ ID NO: 474078 - DNA, 12 bp, Homo sapiens
cccacaaaatat

SEQ ID NO: 474079 - DNA, 19 bp, Homo sapiens
cccacaaaatatttctaag

SEQ ID NO: 474080 - DNA, 15 bp, Homo sapiens
cccacaccccgtctg

SEQ ID NO: 474081 - DNA, 17 bp, Homo sapiens
cccacaccccgtctgcc

SEQ ID NO: 474082 - DNA, 20 bp, Homo sapiens
cccacaccccgtctgcccct

SEQ ID NO: 474083 - DNA, 19 bp, Homo sapiens
cccacatagtgatggttcc

SEQ ID NO: 474084 - DNA, 20 bp, Homo sapiens
cccaccacaactaacaatgc

SEQ ID NO: 474085 - DNA, 21 bp, Homo sapiens
cccaccacaactaacaatgcc

SEQ ID NO: 474086 - DNA, 16 bp, Homo sapiens
cccacccacaccccgt

SEQ ID NO: 474087 - DNA, 15 bp, Homo sapiens
cccacccctccccac

SEQ ID NO: 474088 - DNA, 16 bp, Homo sapiens
cccacccctccccacc

SEQ ID NO: 474089 - DNA, 15 bp, Homo sapiens
cccacccctcttccc

SEQ ID NO: 474090 - DNA, 18 bp, Homo sapiens
cccacccgccccagagac

SEQ ID NO: 474091 - DNA, 20 bp, Homo sapiens
cccaccctcccctctcctga

SEQ ID NO: 474092 - DNA, 14 bp, Homo sapiens
cccaccctgggcct

SEQ ID NO: 474093 - DNA, 16 bp, Homo sapiens
cccaccgggagcctcc

SEQ ID NO: 474094 - DNA, 14 bp, Homo sapiens
cccacctcccggtg

SEQ ID NO: 474095 - DNA, 13 bp, Homo sapiens
cccacctgcccag

SEQ ID NO: 474096 - DNA, 14 bp, Homo sapiens
cccacctgcccagt

SEQ ID NO: 474097 - DNA, 13 bp, Homo sapiens
cccacgcagagcc

SEQ ID NO: 474098 - DNA, 15 bp, Homo sapiens
cccacgcagagcccc

SEQ ID NO: 474099 - DNA, 20 bp, Homo sapiens
cccacgcagagccccggagc

SEQ ID NO: 474100 - DNA, 22 bp, Homo sapiens
cccacgcagagccccggagcac

SEQ ID NO: 474101 - DNA, 15 bp, Homo sapiens
cccacgctcctgccc

SEQ ID NO: 474102 - DNA, 16 bp, Homo sapiens
cccacgctcctgccct

SEQ ID NO: 474103 - DNA, 23 bp, Homo sapiens
cccacggccgtccctgacttccc

SEQ ID NO: 474104 - DNA, 18 bp, Homo sapiens
cccactagccctctttct

SEQ ID NO: 474105 - DNA, 19 bp, Homo sapiens
cccactagccctctttctc

SEQ ID NO: 474106 - DNA, 14 bp, Homo sapiens
cccactgagagctg

SEQ ID NO: 474107 - DNA, 18 bp, Homo sapiens
cccactgagagctgctcc

SEQ ID NO: 474108 - DNA, 20 bp, Homo sapiens
cccactgatatcacgggccc

SEQ ID NO: 474109 - DNA, 21 bp, Homo sapiens
cccactgatatcacgggcccg

SEQ ID NO: 474110 - DNA, 17 bp, Homo sapiens
cccacttatgctgctgt

SEQ ID NO: 474111 - DNA, 16 bp, Homo sapiens
cccagaacgggcctcc

SEQ ID NO: 474112 - DNA, 18 bp, Homo sapiens
cccagaacgggcctcccc

SEQ ID NO: 474113 - DNA, 20 bp, Homo sapiens
cccagaacgggcctccccgg

SEQ ID NO: 474114 - DNA, 14 bp, Homo sapiens
cccagcacctggca

SEQ ID NO: 474115 - DNA, 17 bp, Homo sapiens
cccagcacctggcacac

SEQ ID NO: 474116 - DNA, 16 bp, Homo sapiens
cccagccggggtgggg

SEQ ID NO: 474117 - DNA, 19 bp, Homo sapiens
cccagcctcccccaggctg

SEQ ID NO: 474118 - DNA, 20 bp, Homo sapiens
cccagcctcccccaggctgc

SEQ ID NO: 474119 - DNA, 23 bp, Homo sapiens
cccagcctctccccgctctggat

SEQ ID NO: 474120 - DNA, 15 bp, Homo sapiens
cccagctggcagcgc

SEQ ID NO: 474121 - DNA, 15 bp, Homo sapiens
cccagctggctgggt

SEQ ID NO: 474122 - DNA, 19 bp, Homo sapiens
ccaataccctagaagaaaa

SEQ ID NO: 474123 - DNA, 22 bp, Homo sapiens
ccaataccctagaagaaaaccc

SEQ ID NO: 474124 - DNA, 22 bp, Homo sapiens
ccaatcaacagcatgtctactg

SEQ ID NO: 474125 - DNA, 18 bp, Homo sapiens
ccacaactaacaatgcct

SEQ ID NO: 474126 - DNA, 22 bp, Homo sapiens
ccacacgccggggctggccctg

SEQ ID NO: 474127 - DNA, 16 bp, Homo sapiens
ccacacttcaggctct

SEQ ID NO: 474128 - DNA, 17 bp, Homo sapiens
ccacagaacctttgtca

SEQ ID NO: 474129 - DNA, 18 bp, Homo sapiens
ccacagaacctttgtcaa

SEQ ID NO: 474130 - DNA, 20 bp, Homo sapiens
ccacaggacacgaaggctgc

SEQ ID NO: 474131 - DNA, 16 bp, Homo sapiens
ccacaggcccttcctc

SEQ ID NO: 474132 - DNA, 17 bp, Homo sapiens
ccacaggcccttcctct

SEQ ID NO: 474133 - DNA, 19 bp, Homo sapiens
ccacaggcccttcctctcc

SEQ ID NO: 474134 - DNA, 21 bp, Homo sapiens
ccacatccccaccctcccctc

SEQ ID NO: 474135 - DNA, 16 bp, Homo sapiens
ccaccacacacaccct

SEQ ID NO: 474136 - DNA, 22 bp, Homo sapiens
ccaccacacacacccttcccca

SEQ ID NO: 474137 - DNA, 13 bp, Homo sapiens
ccacccaccctct

SEQ ID NO: 474138 - DNA, 20 bp, Homo sapiens
ccacccagaccctccttccc

SEQ ID NO: 474139 - DNA, 18 bp, Homo sapiens
ccaccccataagccctga

SEQ ID NO: 474140 - DNA, 22 bp, Homo sapiens
ccaccccggctccccctgccag

SEQ ID NO: 474141 - DNA, 23 bp, Homo sapiens
ccaccccggctccccctgccagc

SEQ ID NO: 474142 - DNA, 14 bp, Homo sapiens
ccaccccgtcccgg

SEQ ID NO: 474143 - DNA, 13 bp, Homo sapiens
ccacccctcaagc

SEQ ID NO: 474144 - DNA, 21 bp, Homo sapiens
ccacccctcttcccccttccc

SEQ ID NO: 474145 - DNA, 22 bp, Homo sapiens
ccacccgccccagagactgccc

SEQ ID NO: 474146 - DNA, 21 bp, Homo sapiens
ccacccggcggcggccaggga

SEQ ID NO: 474147 - DNA, 23 bp, Homo sapiens
ccacccggcggcggccagggacc

SEQ ID NO: 474148 - DNA, 13 bp, Homo sapiens
ccaccctgggcct

SEQ ID NO: 474149 - DNA, 14 bp, Homo sapiens
ccaccctgggcctc

SEQ ID NO: 474150 - DNA, 15 bp, Homo sapiens
ccaccctgggcctcc

SEQ ID NO: 474151 - DNA, 16 bp, Homo sapiens
ccaccctgggcctccc

SEQ ID NO: 474152 - DNA, 16 bp, Homo sapiens
ccaccgggagcctccc

SEQ ID NO: 474153 - DNA, 22 bp, Homo sapiens
ccaccgggagcctccccctcag

SEQ ID NO: 474154 - DNA, 12 bp, Homo sapiens
ccacctgcccag

SEQ ID NO: 474155 - DNA, 22 bp, Homo sapiens
ccacctgcccagttagcccggc

SEQ ID NO: 474156 - DNA, 14 bp, Homo sapiens
ccacctgtgctgct

SEQ ID NO: 474157 - DNA, 17 bp, Homo sapiens
ccacgcagagccccgga

SEQ ID NO: 474158 - DNA, 19 bp, Homo sapiens
ccacgcctcctggccagac

SEQ ID NO: 474159 - DNA, 12 bp, Homo sapiens
ccacgctcctgc

SEQ ID NO: 474160 - DNA, 16 bp, Homo sapiens
ccacgctcctgccctc

SEQ ID NO: 474161 - DNA, 11 bp, Homo sapiens
ccacgctgtcc

SEQ ID NO: 474162 - DNA, 15 bp, Homo sapiens
ccactaagtaacctc

SEQ ID NO: 474163 - DNA, 21 bp, Homo sapiens
ccactagccctctttctctct

SEQ ID NO: 474164 - DNA, 18 bp, Homo sapiens
ccactaggtgcccagtct

SEQ ID NO: 474165 - DNA, 19 bp, Homo sapiens
ccactccagacccctggct

SEQ ID NO: 474166 - DNA, 12 bp, Homo sapiens
ccactcccctca

SEQ ID NO: 474167 - DNA, 17 bp, Homo sapiens
ccactcccctcatccac

SEQ ID NO: 474168 - DNA, 18 bp, Homo sapiens
ccactcccctcatccact

SEQ ID NO: 474169 - DNA, 16 bp, Homo sapiens
ccactcctcccaactc

SEQ ID NO: 474170 - DNA, 17 bp, Homo sapiens
ccactcctcccaactct

SEQ ID NO: 474171 - DNA, 16 bp, Homo sapiens
ccactctgaggtctca

SEQ ID NO: 474172 - DNA, 23 bp, Homo sapiens
ccactctgaggtctcaccttcgc

SEQ ID NO: 474173 - DNA, 23 bp, Homo sapiens
ccactgaagtccccctttctcct

SEQ ID NO: 474174 - DNA, 18 bp, Homo sapiens
caaatgcacatttgtcac

SEQ ID NO: 474175 - DNA, 10 bp, Homo sapiens
caaatgcatg

SEQ ID NO: 474176 - DNA, 21 bp, Homo sapiens
caaatgcatgatattgtatgt

SEQ ID NO: 474177 - DNA, 15 bp, Homo sapiens
caaattattctagtc

SEQ ID NO: 474178 - DNA, 22 bp, Homo sapiens
caaattcttgaataaactcccc

SEQ ID NO: 474179 - DNA, 14 bp, Homo sapiens
caaatttttactca

SEQ ID NO: 474180 - DNA, 15 bp, Homo sapiens
caaatttttactcag

SEQ ID NO: 474181 - DNA, 14 bp, Homo sapiens
caacagacaccctc

SEQ ID NO: 474182 - DNA, 19 bp, Homo sapiens
caacagacaccctccactc

SEQ ID NO: 474183 - DNA, 18 bp, Homo sapiens
caacagggtttttttcca

SEQ ID NO: 474184 - DNA, 14 bp, Homo sapiens
caaccatagaactg

SEQ ID NO: 474185 - DNA, 12 bp, Homo sapiens
caacccccacct

SEQ ID NO: 474186 - DNA, 13 bp, Homo sapiens
caacccccacctc

SEQ ID NO: 474187 - DNA, 16 bp, Homo sapiens
caaccctacagtatat

SEQ ID NO: 474188 - DNA, 16 bp, Homo sapiens
caaccctcggagcccc

SEQ ID NO: 474189 - DNA, 17 bp, Homo sapiens
caaccctcggagccccc

SEQ ID NO: 474190 - DNA, 18 bp, Homo sapiens
caaccctcggagcccccc

SEQ ID NO: 474191 - DNA, 19 bp, Homo sapiens
caaccctcggagcccccca

SEQ ID NO: 474192 - DNA, 12 bp, Homo sapiens
caaccctgccct

SEQ ID NO: 474193 - DNA, 18 bp, Homo sapiens
caaccctgccctgcacct

SEQ ID NO: 474194 - DNA, 14 bp, Homo sapiens
caacctcactgccc

SEQ ID NO: 474195 - DNA, 18 bp, Homo sapiens
caacctggtggcaccaga

SEQ ID NO: 474196 - DNA, 13 bp, Homo sapiens
caacgcagccctg

SEQ ID NO: 474197 - DNA, 16 bp, Homo sapiens
caacgctcactctacc

SEQ ID NO: 474198 - DNA, 15 bp, Homo sapiens
caacgggtctgtggg

SEQ ID NO: 474199 - DNA, 14 bp, Homo sapiens
caactaacaatgcc

SEQ ID NO: 474200 - DNA, 15 bp, Homo sapiens
caactaagttgtatt

SEQ ID NO: 474201 - DNA, 17 bp, Homo sapiens
caactccgcccagcctc

SEQ ID NO: 474202 - DNA, 18 bp, Homo sapiens
caactccgcccagcctct

SEQ ID NO: 474203 - DNA, 13 bp, Homo sapiens
caactctgactgt

SEQ ID NO: 474204 - DNA, 18 bp, Homo sapiens
caactctgactgtaaaat

SEQ ID NO: 474205 - DNA, 16 bp, Homo sapiens
caactgctgttttatg

SEQ ID NO: 474206 - DNA, 18 bp, Homo sapiens
caactgttagctgggaag

SEQ ID NO: 474207 - DNA, 19 bp, Homo sapiens
caagaagattctaaaacat

SEQ ID NO: 474208 - DNA, 14 bp, Homo sapiens
caagaagtgggatt

SEQ ID NO: 474209 - DNA, 14 bp, Homo sapiens
caagagctcaggag

SEQ ID NO: 474210 - DNA, 14 bp, Homo sapiens
caagagggcactgg

SEQ ID NO: 474211 - DNA, 15 bp, Homo sapiens
caagagggcactggt

SEQ ID NO: 474212 - DNA, 18 bp, Homo sapiens
caagagggcactggtggc

SEQ ID NO: 474213 - DNA, 21 bp, Homo sapiens
caagatgagctgcagcccccc

SEQ ID NO: 474214 - DNA, 18 bp, Homo sapiens
caagatttccctaaaaat

SEQ ID NO: 474215 - DNA, 15 bp, Homo sapiens
caagccaaacattct

SEQ ID NO: 474216 - DNA, 19 bp, Homo sapiens
caagccaaacattcttatt

SEQ ID NO: 474217 - DNA, 19 bp, Homo sapiens
caagccaggagaccctgtc

SEQ ID NO: 474218 - DNA, 16 bp, Homo sapiens
caagccagggttccag

SEQ ID NO: 474219 - DNA, 19 bp, Homo sapiens
caagccagggttccagaca

SEQ ID NO: 474220 - DNA, 14 bp, Homo sapiens
caagccgtggcttc

SEQ ID NO: 474221 - DNA, 15 bp, Homo sapiens
caaggcaagaagtgg

SEQ ID NO: 474222 - DNA, 21 bp, Homo sapiens
caagggaggggagaaaggaac

SEQ ID NO: 474223 - DNA, 16 bp, Homo sapiens
caagtatgaataaaga

SEQ ID NO: 474224 - DNA, 17 bp, Homo sapiens
caagtcaaacagtgtgg

SEQ ID NO: 474225 - DNA, 12 bp, Homo sapiens
caagtgtacatt

SEQ ID NO: 474226 - DNA, 13 bp, Homo sapiens
caataaaagagct

SEQ ID NO: 474227 - DNA, 15 bp, Homo sapiens
caataaaagagcttt

SEQ ID NO: 474228 - DNA, 18 bp, Homo sapiens
caataaacgaaacacaga

SEQ ID NO: 474229 - DNA, 13 bp, Homo sapiens
caataaagcaatg

SEQ ID NO: 474230 - DNA, 20 bp, Homo sapiens
caataccctagaagaaaacc

SEQ ID NO: 474231 - DNA, 10 bp, Homo sapiens
caatatgagg

SEQ ID NO: 474232 - DNA, 13 bp, Homo sapiens
caatatgggagga

SEQ ID NO: 474233 - DNA, 21 bp, Homo sapiens
caatatgggaggaacaaagac

SEQ ID NO: 474234 - DNA, 22 bp, Homo sapiens
caatcaacagcatgtctactgc

SEQ ID NO: 474235 - DNA, 13 bp, Homo sapiens
caatcatctagat

SEQ ID NO: 474236 - DNA, 17 bp, Homo sapiens
caatcccaccaaccctc

SEQ ID NO: 474237 - DNA, 23 bp, Homo sapiens
caatcccaccaaccctcagagcc

SEQ ID NO: 474238 - DNA, 12 bp, Homo sapiens
caatcttatgtt

SEQ ID NO: 474239 - DNA, 16 bp, Homo sapiens
caatcttatgttgatc

SEQ ID NO: 474240 - DNA, 20 bp, Homo sapiens
caatgcatacaataaaagag

SEQ ID NO: 474241 - DNA, 21 bp, Homo sapiens
caatgctagcacaatattcct

SEQ ID NO: 474242 - DNA, 22 bp, Homo sapiens
caatgctagcacaatattccta

SEQ ID NO: 474243 - DNA, 22 bp, Homo sapiens
caatggctgggtttgggcagtg

SEQ ID NO: 474244 - DNA, 15 bp, Homo sapiens
caatgtactgtattg

SEQ ID NO: 474245 - DNA, 22 bp, Homo sapiens
caatgtggaaaaaatattttaa

SEQ ID NO: 474246 - DNA, 23 bp, Homo sapiens
caatgtggaaaaaatattttaaa

SEQ ID NO: 474247 - DNA, 21 bp, Homo sapiens
caatgttccgttcatctgagg

SEQ ID NO: 474248 - DNA, 14 bp, Homo sapiens
caattgtcatttat

SEQ ID NO: 474249 - DNA, 15 bp, Homo sapiens
caattgtcatttata

SEQ ID NO: 474250 - DNA, 16 bp, Homo sapiens
caatttcaaaatgcat

SEQ ID NO: 474251 - DNA, 18 bp, Homo sapiens
caatttcaaaatgcatgt

SEQ ID NO: 474252 - DNA, 23 bp, Homo sapiens
caatttcaaaatgcatgtgattg

SEQ ID NO: 474253 - DNA, 16 bp, Homo sapiens
caattttaaaaaataa

SEQ ID NO: 474254 - DNA, 18 bp, Homo sapiens
caattttaaaaaataaca

SEQ ID NO: 474255 - DNA, 19 bp, Homo sapiens
caatttttaacttatctcc

SEQ ID NO: 474256 - DNA, 17 bp, Homo sapiens
cacaaccttctgtggct

SEQ ID NO: 474257 - DNA, 19 bp, Homo sapiens
cacaaccttctgtggctca

SEQ ID NO: 474258 - DNA, 15 bp, Homo sapiens
cacaactaacaatgc

SEQ ID NO: 474259 - DNA, 16 bp, Homo sapiens
cacaaggagtgcccgc

SEQ ID NO: 474260 - DNA, 20 bp, Homo sapiens
cacaaggagtgcccgccttg

SEQ ID NO: 474261 - DNA, 14 bp, Homo sapiens
cacacacacccttc

SEQ ID NO: 474262 - DNA, 16 bp, Homo sapiens
cacacacacccttccc

SEQ ID NO: 474263 - DNA, 12 bp, Homo sapiens
cacacagcagcc

SEQ ID NO: 474264 - DNA, 14 bp, Homo sapiens
cacacagcagcccc

SEQ ID NO: 474265 - DNA, 20 bp, Homo sapiens
cacacagcagccccccagca

SEQ ID NO: 474266 - DNA, 17 bp, Homo sapiens
cacacattctgtataat

SEQ ID NO: 474267 - DNA, 19 bp, Homo sapiens
cacaccagaagtgccatgc

SEQ ID NO: 474268 - DNA, 16 bp, Homo sapiens
cacaccccgtctgccc

SEQ ID NO: 474269 - DNA, 19 bp, Homo sapiens
cacaccccgtctgcccctt

SEQ ID NO: 474270 - DNA, 18 bp, Homo sapiens
cacacgccggggctggcc

SEQ ID NO: 474271 - DNA, 19 bp, Homo sapiens
cacacgccggggctggccc

SEQ ID NO: 474272 - DNA, 12 bp, Homo sapiens
atggattcactt

SEQ ID NO: 474273 - DNA, 14 bp, Homo sapiens
atggattcacttct

SEQ ID NO: 474274 - DNA, 16 bp, Homo sapiens
atggattcacttctat

SEQ ID NO: 474275 - DNA, 22 bp, Homo sapiens
atggccaggtggccactccaga

SEQ ID NO: 474276 - DNA, 13 bp, Homo sapiens
atggccccagctg

SEQ ID NO: 474277 - DNA, 14 bp, Homo sapiens
atggccccagctgg

SEQ ID NO: 474278 - DNA, 15 bp, Homo sapiens
atggccccagctggc

SEQ ID NO: 474279 - DNA, 20 bp, Homo sapiens
atggccccagctggctgggt

SEQ ID NO: 474280 - DNA, 18 bp, Homo sapiens
atgggaggaacaaagaca

SEQ ID NO: 474281 - DNA, 23 bp, Homo sapiens
atgggccaagccagggttccaga

SEQ ID NO: 474282 - DNA, 22 bp, Homo sapiens
atgggggctccagacattgtat

SEQ ID NO: 474283 - DNA, 15 bp, Homo sapiens
atgggtattaaactt

SEQ ID NO: 474284 - DNA, 23 bp, Homo sapiens
atggtatgctggccagcaccctc

SEQ ID NO: 474285 - DNA, 16 bp, Homo sapiens
atggtgcagtgaagaa

SEQ ID NO: 474286 - DNA, 15 bp, Homo sapiens
atggtgggctccaga

SEQ ID NO: 474287 - DNA, 19 bp, Homo sapiens
atggtgggctccagagtag

SEQ ID NO: 474288 - DNA, 16 bp, Homo sapiens
atggtttttgctctac

SEQ ID NO: 474289 - DNA, 22 bp, Homo sapiens
atgtaacagttggtgattttag

SEQ ID NO: 474290 - DNA, 18 bp, Homo sapiens
atgtaagaagaaactgct

SEQ ID NO: 474291 - DNA, 16 bp, Homo sapiens
atgtaatcatttatct

SEQ ID NO: 474292 - DNA, 12 bp, Homo sapiens
atgtactgtatt

SEQ ID NO: 474293 - DNA, 13 bp, Homo sapiens
atgtactgtattg

SEQ ID NO: 474294 - DNA, 12 bp, Homo sapiens
atgtagaactgt

SEQ ID NO: 474295 - DNA, 21 bp, Homo sapiens
atgtagaactgttcatttcca

SEQ ID NO: 474296 - DNA, 15 bp, Homo sapiens
atgtagcatataaat

SEQ ID NO: 474297 - DNA, 22 bp, Homo sapiens
atgtatcctgataaacattaaa

SEQ ID NO: 474298 - DNA, 16 bp, Homo sapiens
atgtattatgcaaagt

SEQ ID NO: 474299 - DNA, 14 bp, Homo sapiens
atgtattatggtga

SEQ ID NO: 474300 - DNA, 17 bp, Homo sapiens
atgtcagtagtgcctgt

SEQ ID NO: 474301 - DNA, 14 bp, Homo sapiens
atgtcatactctgt

SEQ ID NO: 474302 - DNA, 21 bp, Homo sapiens
atgtccccattctataaattc

SEQ ID NO: 474303 - DNA, 24 bp, Homo sapiens
atgtccctaccgagtctcttctcc

SEQ ID NO: 474304 - DNA, 13 bp, Homo sapiens
atgtctactgctt

SEQ ID NO: 474305 - DNA, 10 bp, Homo sapiens
atgtctgtga

SEQ ID NO: 474306 - DNA, 11 bp, Homo sapiens
atgtctgtgat

SEQ ID NO: 474307 - DNA, 17 bp, Homo sapiens
atgtcttgagatgtatt

SEQ ID NO: 474308 - DNA, 22 bp, Homo sapiens
atgtcttgagatgtattatgca

SEQ ID NO: 474309 - DNA, 19 bp, Homo sapiens
atgtgaaataaagagttct

SEQ ID NO: 474310 - DNA, 14 bp, Homo sapiens
atgtgagctataat

SEQ ID NO: 474311 - DNA, 19 bp, Homo sapiens
atgtgagctataatgtttc

SEQ ID NO: 474312 - DNA, 14 bp, Homo sapiens
atgtggatgctctt

SEQ ID NO: 474313 - DNA, 16 bp, Homo sapiens
atgtgtccatgtgaaa

SEQ ID NO: 474314 - DNA, 13 bp, Homo sapiens
atgtgtgcatcat

SEQ ID NO: 474315 - DNA, 22 bp, Homo sapiens
atgtgttgcaaattattctagt

SEQ ID NO: 474316 - DNA, 18 bp, Homo sapiens
atgttccgttcatctgag

SEQ ID NO: 474317 - DNA, 18 bp, Homo sapiens
atgttctgaataatttct

SEQ ID NO: 474318 - DNA, 14 bp, Homo sapiens
atgttgatcgatgt

SEQ ID NO: 474319 - DNA, 19 bp, Homo sapiens
atgttgttcgatcgtttca

SEQ ID NO: 474320 - DNA, 19 bp, Homo sapiens
atgtttacctcactggtgc

SEQ ID NO: 474321 - DNA, 13 bp, Homo sapiens
atgtttatattgt

SEQ ID NO: 474322 - DNA, 20 bp, Homo sapiens
atgtttctgcagtattctgt

SEQ ID NO: 474323 - DNA, 22 bp, Homo sapiens
atgtttctgcagtattctgtag

SEQ ID NO: 474324 - DNA, 21 bp, Homo sapiens
atgtttgttttcaaaatactt

SEQ ID NO: 474325 - DNA, 22 bp, Homo sapiens
attaaaaatatacaatttcttg

SEQ ID NO: 474326 - DNA, 20 bp, Homo sapiens
attaaaataactaagcaagt

SEQ ID NO: 474327 - DNA, 14 bp, Homo sapiens
attaaacactgtaa

SEQ ID NO: 474328 - DNA, 15 bp, Homo sapiens
attaaacttcagcaa

SEQ ID NO: 474329 - DNA, 15 bp, Homo sapiens
attaaatttaatata

SEQ ID NO: 474330 - DNA, 17 bp, Homo sapiens
attaaatttaatatact

SEQ ID NO: 474331 - DNA, 15 bp, Homo sapiens
attaactctgcatag

SEQ ID NO: 474332 - DNA, 23 bp, Homo sapiens
attaactctgcatagacaaaggc

SEQ ID NO: 474333 - DNA, 22 bp, Homo sapiens
attaatagtaggattattccta

SEQ ID NO: 474334 - DNA, 13 bp, Homo sapiens
attaatctctaaa

SEQ ID NO: 474335 - DNA, 19 bp, Homo sapiens
attactttaaattatatga

SEQ ID NO: 474336 - DNA, 20 bp, Homo sapiens
attagaaaatgtatttatag

SEQ ID NO: 474337 - DNA, 18 bp, Homo sapiens
attagactgaatttaact

SEQ ID NO: 474338 - DNA, 17 bp, Homo sapiens
attagcagtttgctttg

SEQ ID NO: 474339 - DNA, 11 bp, Homo sapiens
attataagttg

SEQ ID NO: 474340 - DNA, 16 bp, Homo sapiens
attataagttgacctt

SEQ ID NO: 474341 - DNA, 15 bp, Homo sapiens
attataatgcatcta

SEQ ID NO: 474342 - DNA, 11 bp, Homo sapiens
attatatataa

SEQ ID NO: 474343 - DNA, 13 bp, Homo sapiens
attatatgatatg

SEQ ID NO: 474344 - DNA, 16 bp, Homo sapiens
attatatgatatgcat

SEQ ID NO: 474345 - DNA, 18 bp, Homo sapiens
attatatgatatgcatgt

SEQ ID NO: 474346 - DNA, 16 bp, Homo sapiens
attatctctttctctc

SEQ ID NO: 474347 - DNA, 18 bp, Homo sapiens
attatggtgatactccaa

SEQ ID NO: 474348 - DNA, 15 bp, Homo sapiens
attatgtataacaag

SEQ ID NO: 474349 - DNA, 18 bp, Homo sapiens
attatgtttacctcactg

SEQ ID NO: 474350 - DNA, 17 bp, Homo sapiens
attattactttaaatta

SEQ ID NO: 474351 - DNA, 22 bp, Homo sapiens
attattctagtcaactgctgtt

SEQ ID NO: 474352 - DNA, 12 bp, Homo sapiens
attcaaaatagt

SEQ ID NO: 474353 - DNA, 22 bp, Homo sapiens
attcaaatgcatgatattgtat

SEQ ID NO: 474354 - DNA, 13 bp, Homo sapiens
attcaacaaatga

SEQ ID NO: 474355 - DNA, 19 bp, Homo sapiens
attcaacacttattttctg

SEQ ID NO: 474356 - DNA, 21 bp, Homo sapiens
attcaactctgtgtcccagca

SEQ ID NO: 474357 - DNA, 18 bp, Homo sapiens
attcaatcattttgggaa

SEQ ID NO: 474358 - DNA, 12 bp, Homo sapiens
attcaatgtgaa

SEQ ID NO: 474359 - DNA, 16 bp, Homo sapiens
attcacttctatttat

SEQ ID NO: 474360 - DNA, 14 bp, Homo sapiens
attcataaaaataa

SEQ ID NO: 474361 - DNA, 23 bp, Homo sapiens
attcataaaaataaccaaaaaat

SEQ ID NO: 474362 - DNA, 19 bp, Homo sapiens
attcatagcatcctgatta

SEQ ID NO: 474363 - DNA, 21 bp, Homo sapiens
attcatagcatcctgattatt

SEQ ID NO: 474364 - DNA, 21 bp, Homo sapiens
attcattacatcctctgcttg

SEQ ID NO: 474365 - DNA, 22 bp, Homo sapiens
attccaacccaggtctgctttg

SEQ ID NO: 474366 - DNA, 14 bp, Homo sapiens
attccatccatata

SEQ ID NO: 474367 - DNA, 18 bp, Homo sapiens
attccatccatatacttt

SEQ ID NO: 474368 - DNA, 15 bp, Homo sapiens
attctaaaacattct

SEQ ID NO: 474369 - DNA, 15 bp, Homo sapiens
caaagaacccccctc

SEQ ID NO: 474370 - DNA, 16 bp, Homo sapiens
caaagaacccccctcc

SEQ ID NO: 474371 - DNA, 20 bp, Homo sapiens
caaagtaccaactgagccaa

SEQ ID NO: 474372 - DNA, 14 bp, Homo sapiens
caaagtttggaagt

SEQ ID NO: 474373 - DNA, 14 bp, Homo sapiens
caaatatagttgaa

SEQ ID NO: 474374 - DNA, 17 bp, Homo sapiens
caaatatgattctcctc

SEQ ID NO: 474375 - DNA, 19 bp, Homo sapiens
caaatatgattctcctctc

SEQ ID NO: 474376 - DNA, 16 bp, Homo sapiens
caaatattcattttga

SEQ ID NO: 474377 - DNA, 13 bp, Homo sapiens
caaatatttcact

SEQ ID NO: 474378 - DNA, 23 bp, Homo sapiens
caaatccaacgcttttcccacct

SEQ ID NO: 474379 - DNA, 10 bp, Homo sapiens
aaaaaagaag

SEQ ID NO: 474380 - DNA, 21 bp, Homo sapiens
aaaaaataacatattcttgct

SEQ ID NO: 474381 - DNA, 15 bp, Homo sapiens
aaaaaatgcgtatat

SEQ ID NO: 474382 - DNA, 19 bp, Homo sapiens
aaaactatcggttcaagtt

SEQ ID NO: 474383 - DNA, 11 bp, Homo sapiens
aaaactgcccc

SEQ ID NO: 474384 - DNA, 10 bp, Homo sapiens
aaaagaacat

SEQ ID NO: 474385 - DNA, 14 bp, Homo sapiens
aaaagaacatagga

SEQ ID NO: 474386 - DNA, 21 bp, Homo sapiens
aaaagaacataggaattttgt

SEQ ID NO: 474387 - DNA, 21 bp, Homo sapiens
aaaagaagaaagtctatgctt

SEQ ID NO: 474388 - DNA, 16 bp, Homo sapiens
aaaagagctttatccc

SEQ ID NO: 474389 - DNA, 19 bp, Homo sapiens
aaaataacatctgaaaaga

SEQ ID NO: 474390 - DNA, 21 bp, Homo sapiens
aaaatacttctttttcattat

SEQ ID NO: 474391 - DNA, 21 bp, Homo sapiens
aaaatagtcatgtttctgcag

SEQ ID NO: 474392 - DNA, 20 bp, Homo sapiens
aaaatatttctaagcttatt

SEQ ID NO: 474393 - DNA, 23 bp, Homo sapiens
aaaatatttctaagcttatttct

SEQ ID NO: 474394 - DNA, 12 bp, Homo sapiens
aaaatgctttct

SEQ ID NO: 474395 - DNA, 17 bp, Homo sapiens
aaaatgctttctcatgc

SEQ ID NO: 474396 - DNA, 20 bp, Homo sapiens
aaaatggacttttgttcatg

SEQ ID NO: 474397 - DNA, 20 bp, Homo sapiens
aaaatgtcaatttttaactt

SEQ ID NO: 474398 - DNA, 19 bp, Homo sapiens
aaacactgcttaaggaaaa

SEQ ID NO: 474399 - DNA, 14 bp, Homo sapiens
aaacactgtaatct

SEQ ID NO: 474400 - DNA, 23 bp, Homo sapiens
aaacagtgtggcttaaacatttt

SEQ ID NO: 474401 - DNA, 22 bp, Homo sapiens
aaacagttaagacaacaggcat

SEQ ID NO: 474402 - DNA, 15 bp, Homo sapiens
aaacattaaacactg

SEQ ID NO: 474403 - DNA, 21 bp, Homo sapiens
aaacattaaacactgtaatct

SEQ ID NO: 474404 - DNA, 18 bp, Homo sapiens
aaactatcggttcaagtt

SEQ ID NO: 474405 - DNA, 21 bp, Homo sapiens
aaactatcggttcaagttgat

SEQ ID NO: 474406 - DNA, 16 bp, Homo sapiens
aaactcagttaaaatg

SEQ ID NO: 474407 - DNA, 17 bp, Homo sapiens
aaactcttcaaggccaa

SEQ ID NO: 474408 - DNA, 12 bp, Homo sapiens
aaactgcagttt

SEQ ID NO: 474409 - DNA, 21 bp, Homo sapiens
aaactgcagttttaacttttt

SEQ ID NO: 474410 - DNA, 20 bp, Homo sapiens
aaactgcccccctcctttcc

SEQ ID NO: 474411 - DNA, 14 bp, Homo sapiens
aaactgttttcatg

SEQ ID NO: 474412 - DNA, 21 bp, Homo sapiens
aaacttactgtcagagaatat

SEQ ID NO: 474413 - DNA, 16 bp, Homo sapiens
aaacttcagcaaccct

SEQ ID NO: 474414 - DNA, 15 bp, Homo sapiens
aaactttgtcacttc

SEQ ID NO: 474415 - DNA, 16 bp, Homo sapiens
aaactttgtcacttct

SEQ ID NO: 474416 - DNA, 13 bp, Homo sapiens
aaagaaaacagac

SEQ ID NO: 474417 - DNA, 17 bp, Homo sapiens
aaagaagaaagtctatg

SEQ ID NO: 474418 - DNA, 19 bp, Homo sapiens
aaagacacctactgagtgg

SEQ ID NO: 474419 - DNA, 12 bp, Homo sapiens
aaagagcttccc

SEQ ID NO: 474420 - DNA, 13 bp, Homo sapiens
aaagatagcagaa

SEQ ID NO: 474421 - DNA, 19 bp, Homo sapiens
aaagatagcagaagagtag

SEQ ID NO: 474422 - DNA, 17 bp, Homo sapiens
aaagcctctgtgctgca

SEQ ID NO: 474423 - DNA, 14 bp, Homo sapiens
aaaggactttgtgt

SEQ ID NO: 474424 - DNA, 15 bp, Homo sapiens
aaaggcagagattgg

SEQ ID NO: 474425 - DNA, 12 bp, Homo sapiens
aaagttaaaaag

SEQ ID NO: 474426 - DNA, 13 bp, Homo sapiens
aaagttctattat

SEQ ID NO: 474427 - DNA, 12 bp, Homo sapiens
aaataaactctt

SEQ ID NO: 474428 - DNA, 14 bp, Homo sapiens
aaataaactcttca

SEQ ID NO: 474429 - DNA, 17 bp, Homo sapiens
aaataacatattcttgc

SEQ ID NO: 474430 - DNA, 12 bp, Homo sapiens
aaataactgtgc

SEQ ID NO: 474431 - DNA, 22 bp, Homo sapiens
aaataatgcttaacataaactt

SEQ ID NO: 474432 - DNA, 19 bp, Homo sapiens
aaatactcaccaaaatata

SEQ ID NO: 474433 - DNA, 18 bp, Homo sapiens
aaatactgttttggaatg

SEQ ID NO: 474434 - DNA, 15 bp, Homo sapiens
aaatagttctatttc

SEQ ID NO: 474435 - DNA, 15 bp, Homo sapiens
aagaaaacccgaggg

SEQ ID NO: 474436 - DNA, 21 bp, Homo sapiens
aagaaagctatatatgaataa

SEQ ID NO: 474437 - DNA, 22 bp, Homo sapiens
aagaaagggagaaggattcttt

SEQ ID NO: 474438 - DNA, 14 bp, Homo sapiens
aagaaatgagaaat

SEQ ID NO: 474439 - DNA, 21 bp, Homo sapiens
aagaaatgagaaattgtgcca

SEQ ID NO: 474440 - DNA, 16 bp, Homo sapiens
aagaaatgctaatgta

SEQ ID NO: 474441 - DNA, 19 bp, Homo sapiens
aagaaatgctaatgtaatc

SEQ ID NO: 474442 - DNA, 13 bp, Homo sapiens
aagaacagtgttg

SEQ ID NO: 474443 - DNA, 13 bp, Homo sapiens
aagaacataggaa

SEQ ID NO: 474444 - DNA, 14 bp, Homo sapiens
aagaacccccctcc

SEQ ID NO: 474445 - DNA, 12 bp, Homo sapiens
aagaagaaactg

SEQ ID NO: 474446 - DNA, 17 bp, Homo sapiens
aagaataaataaagaag

SEQ ID NO: 474447 - DNA, 22 bp, Homo sapiens
aagacgtttttgtgctgtgggc

SEQ ID NO: 474448 - DNA, 22 bp, Homo sapiens
aagagaaaatgctttctcatgc

SEQ ID NO: 474449 - DNA, 14 bp, Homo sapiens
aagaggtggattca

SEQ ID NO: 474450 - DNA, 22 bp, Homo sapiens
aagagttctccttgtacttgaa

SEQ ID NO: 474451 - DNA, 20 bp, Homo sapiens
aagatagcagaagagtagat

SEQ ID NO: 474452 - DNA, 18 bp, Homo sapiens
aagatgagctgcagcccc

SEQ ID NO: 474453 - DNA, 20 bp, Homo sapiens
aagatgttaattacttttga

SEQ ID NO: 474454 - DNA, 15 bp, Homo sapiens
aagattatatacaaa

SEQ ID NO: 474455 - DNA, 20 bp, Homo sapiens
aagattatatacaaagctgt

SEQ ID NO: 474456 - DNA, 18 bp, Homo sapiens
aagattccattttggaaa

SEQ ID NO: 474457 - DNA, 15 bp, Homo sapiens
aagcaaaaaactgca

SEQ ID NO: 474458 - DNA, 15 bp, Homo sapiens
aagcaagtatattta

SEQ ID NO: 474459 - DNA, 14 bp, Homo sapiens
aagcatttaggaat

SEQ ID NO: 474460 - DNA, 16 bp, Homo sapiens
aagccacgctgtcctc

SEQ ID NO: 474461 - DNA, 15 bp, Homo sapiens
aagccacgttgcaga

SEQ ID NO: 474462 - DNA, 19 bp, Homo sapiens
aagccagggttccagacag

SEQ ID NO: 474463 - DNA, 21 bp, Homo sapiens
aagcccacccgccccagagac

SEQ ID NO: 474464 - DNA, 22 bp, Homo sapiens
aagcccacccgccccagagact

SEQ ID NO: 474465 - DNA, 13 bp, Homo sapiens
aagccgtggcttc

SEQ ID NO: 474466 - DNA, 20 bp, Homo sapiens
aagctttcttacaatgtgga

SEQ ID NO: 474467 - DNA, 17 bp, Homo sapiens
aaggaacttttaaactg

SEQ ID NO: 474468 - DNA, 22 bp, Homo sapiens
aaggaacttttaaactgcagtt

SEQ ID NO: 474469 - DNA, 13 bp, Homo sapiens
aaggacttctgca

SEQ ID NO: 474470 - DNA, 11 bp, Homo sapiens
aaggagaggag

SEQ ID NO: 474471 - DNA, 21 bp, Homo sapiens
aaggagcactagaatgagaaa

SEQ ID NO: 474472 - DNA, 17 bp, Homo sapiens
aaggagtgcccgccttg

SEQ ID NO: 474473 - DNA, 21 bp, Homo sapiens
aaggattcttttttcaatgta

SEQ ID NO: 474474 - DNA, 15 bp, Homo sapiens
aaggcaagaagtggg

SEQ ID NO: 474475 - DNA, 16 bp, Homo sapiens
aaggcaagaagtggga

SEQ ID NO: 474476 - DNA, 16 bp, Homo sapiens
aaggccgtgtctctga

SEQ ID NO: 474477 - DNA, 17 bp, Homo sapiens
aaggccgtgtctctgag

SEQ ID NO: 474478 - DNA, 14 bp, Homo sapiens
aaggccgttaggga

SEQ ID NO: 474479 - DNA, 19 bp, Homo sapiens
aaggcctgagggaagccca

SEQ ID NO: 474480 - DNA, 16 bp, Homo sapiens
aaggcctgcccccctt

SEQ ID NO: 474481 - DNA, 22 bp, Homo sapiens
aaggcctgtgaatggcagcctg

SEQ ID NO: 474482 - DNA, 21 bp, Homo sapiens
aaggctgcccctgtaaggttt

SEQ ID NO: 474483 - DNA, 17 bp, Homo sapiens
aaggctggatgtgcttt

SEQ ID NO: 474484 - DNA, 16 bp, Homo sapiens
aagggaggtaaaaaat

SEQ ID NO: 474485 - DNA, 14 bp, Homo sapiens
aagggcagcccctc

SEQ ID NO: 474486 - DNA, 15 bp, Homo sapiens
aagggcagcccctcc

SEQ ID NO: 474487 - DNA, 17 bp, Homo sapiens
aagggcagcccctcccc

SEQ ID NO: 474488 - DNA, 18 bp, Homo sapiens
aagggcgctgagggcagg

SEQ ID NO: 474489 - DNA, 23 bp, Homo sapiens
aaggtggtcttggagaggaggtg

SEQ ID NO: 474490 - DNA, 22 bp, Homo sapiens
aagtaaccaggccccagcctcc

SEQ ID NO: 474491 - DNA, 19 bp, Homo sapiens
aagtaacctctacaggcat

SEQ ID NO: 474492 - DNA, 15 bp, Homo sapiens
aagtacataaagtaa

SEQ ID NO: 474493 - DNA, 13 bp, Homo sapiens
aagtcccttcctg

SEQ ID NO: 474494 - DNA, 20 bp, Homo sapiens
aagtctcgtgagaatatact

SEQ ID NO: 474495 - DNA, 15 bp, Homo sapiens
aagtcttactgtttt

SEQ ID NO: 474496 - DNA, 12 bp, Homo sapiens
aagtgctcagta

SEQ ID NO: 474497 - DNA, 21 bp, Homo sapiens
aagtggcctgagaagagtcga

SEQ ID NO: 474498 - DNA, 19 bp, Homo sapiens
aagtgggattcaggaatgg

SEQ ID NO: 474499 - DNA, 14 bp, Homo sapiens
aagtgtacatttga

SEQ ID NO: 474500 - DNA, 21 bp, Homo sapiens
aagtgtacatttgatttgata

SEQ ID NO: 474501 - DNA, 17 bp, Homo sapiens
aagttatttgatctggt

SEQ ID NO: 474502 - DNA, 19 bp, Homo sapiens
aagttatttgatctggtgc

SEQ ID NO: 474503 - DNA, 13 bp, Homo sapiens
aataaaagagctt

SEQ ID NO: 474504 - DNA, 14 bp, Homo sapiens
aataaaagagcttt

SEQ ID NO: 474505 - DNA, 16 bp, Homo sapiens
aataaaaggcattcat

SEQ ID NO: 474506 - DNA, 14 bp, Homo sapiens
aataaactcttcaa

SEQ ID NO: 474507 - DNA, 19 bp, Homo sapiens
aataaactcttcaaggcca

SEQ ID NO: 474508 - DNA, 18 bp, Homo sapiens
aataaagaagaaaataac

SEQ ID NO: 474509 - DNA, 12 bp, Homo sapiens
aataacatattc

SEQ ID NO: 474510 - DNA, 16 bp, Homo sapiens
aataacatctgaaaag

SEQ ID NO: 474511 - DNA, 19 bp, Homo sapiens
aataacatctgaaaagaaa

SEQ ID NO: 474512 - DNA, 14 bp, Homo sapiens
aataacctgtgaat

SEQ ID NO: 474513 - DNA, 20 bp, Homo sapiens
aataactggatattctttat

SEQ ID NO: 474514 - DNA, 23 bp, Homo sapiens
aataagcaaaaaactgcatcgat

SEQ ID NO: 474515 - DNA, 20 bp, Homo sapiens
aataatgattcaatgtgaat

SEQ ID NO: 474516 - DNA, 15 bp, Homo sapiens
aataccatttatcta

SEQ ID NO: 474517 - DNA, 13 bp, Homo sapiens
aatactcaccaaa

SEQ ID NO: 474518 - DNA, 23 bp, Homo sapiens
aatagataacagagaatcttgat

SEQ ID NO: 474519 - DNA, 16 bp, Homo sapiens
aatagatgctgactgt

SEQ ID NO: 474520 - DNA, 16 bp, Homo sapiens
aatagtcatgtttctg

SEQ ID NO: 474521 - DNA, 19 bp, Homo sapiens
aatagttccattctatgac

SEQ ID NO: 474522 - DNA, 13 bp, Homo sapiens
aatagttctattt

SEQ ID NO: 474523 - DNA, 19 bp, Homo sapiens
aatagttctatttctatct

SEQ ID NO: 474524 - DNA, 17 bp, Homo sapiens
aatatagttgaacaaga

SEQ ID NO: 474525 - DNA, 18 bp, Homo sapiens
aatatagttgaacaagat

SEQ ID NO: 474526 - DNA, 23 bp, Homo sapiens
aatatcctatactggttatagtt

SEQ ID NO: 474527 - DNA, 19 bp, Homo sapiens
aatatctatttatctgtct

SEQ ID NO: 474528 - DNA, 21 bp, Homo sapiens
aatatgaggggactgcatgca

SEQ ID NO: 474529 - DNA, 22 bp, Homo sapiens
aatatgaggggactgcatgcaa

SEQ ID NO: 474530 - DNA, 19 bp, Homo sapiens
aatatgattctcctctccc

SEQ ID NO: 474531 - DNA, 18 bp, Homo sapiens
aatatggaaccttccctc

SEQ ID NO: 474532 - DNA, 22 bp, Homo sapiens
acaatgccttgttgtattcctg

SEQ ID NO: 474533 - DNA, 16 bp, Homo sapiens
acaatggctgggtttg

SEQ ID NO: 474534 - DNA, 18 bp, Homo sapiens
acaatggctgggtttggg

SEQ ID NO: 474535 - DNA, 13 bp, Homo sapiens
acaatttcaaaat

SEQ ID NO: 474536 - DNA, 15 bp, Homo sapiens
acaatttcaaaatgc

SEQ ID NO: 474537 - DNA, 20 bp, Homo sapiens
acaatttcaaaatgcatgtg

SEQ ID NO: 474538 - DNA, 22 bp, Homo sapiens
acacaattttcactttttctgt

SEQ ID NO: 474539 - DNA, 19 bp, Homo sapiens
acacactactggatagtga

SEQ ID NO: 474540 - DNA, 13 bp, Homo sapiens
acacagcagcccc

SEQ ID NO: 474541 - DNA, 15 bp, Homo sapiens
acaccagaagtgcca

SEQ ID NO: 474542 - DNA, 18 bp, Homo sapiens
acacccccacctcctgca

SEQ ID NO: 474543 - DNA, 18 bp, Homo sapiens
acaccccgctcacgctga

SEQ ID NO: 474544 - DNA, 16 bp, Homo sapiens
acaccccgtctgcccc

SEQ ID NO: 474545 - DNA, 17 bp, Homo sapiens
acaccccgtctgcccct

SEQ ID NO: 474546 - DNA, 14 bp, Homo sapiens
acaccctccactct

SEQ ID NO: 474547 - DNA, 20 bp, Homo sapiens
acacctcccaccccctgtat

SEQ ID NO: 474548 - DNA, 18 bp, Homo sapiens
acacgccggggctggccc

SEQ ID NO: 474549 - DNA, 20 bp, Homo sapiens
acacgccggggctggccctg

SEQ ID NO: 474550 - DNA, 21 bp, Homo sapiens
acacgccggggctggccctgc

SEQ ID NO: 474551 - DNA, 15 bp, Homo sapiens
acactagccaaggaa

SEQ ID NO: 474552 - DNA, 20 bp, Homo sapiens
acactgatgggtcctgctgc

SEQ ID NO: 474553 - DNA, 22 bp, Homo sapiens
acactgatgggtcctgctgctc

SEQ ID NO: 474554 - DNA, 22 bp, Homo sapiens
acactggaattcagacaccgac

SEQ ID NO: 474555 - DNA, 16 bp, Homo sapiens
acactgtatctaaaaa

SEQ ID NO: 474556 - DNA, 17 bp, Homo sapiens
acacttattttctgaat

SEQ ID NO: 474557 - DNA, 19 bp, Homo sapiens
acacttcaggctcttctcc

SEQ ID NO: 474558 - DNA, 16 bp, Homo sapiens
acagaaacgagatttg

SEQ ID NO: 474559 - DNA, 14 bp, Homo sapiens
acagaaccagcact

SEQ ID NO: 474560 - DNA, 22 bp, Homo sapiens
acagaccagcatagttctgcaa

SEQ ID NO: 474561 - DNA, 19 bp, Homo sapiens
acagacctccagattattt

SEQ ID NO: 474562 - DNA, 22 bp, Homo sapiens
acagacggacgggacagcggcc

SEQ ID NO: 474563 - DNA, 13 bp, Homo sapiens
acagatatcgaga

SEQ ID NO: 474564 - DNA, 12 bp, Homo sapiens
acagatcttgag

SEQ ID NO: 474565 - DNA, 22 bp, Homo sapiens
acagatgaccgcaataatgaat

SEQ ID NO: 474566 - DNA, 18 bp, Homo sapiens
acagcaattttcataata

SEQ ID NO: 474567 - DNA, 20 bp, Homo sapiens
acagcagccccccagcacta

SEQ ID NO: 474568 - DNA, 17 bp, Homo sapiens
acagcagtacttgctca

SEQ ID NO: 474569 - DNA, 13 bp, Homo sapiens
acagccaaagaaa

SEQ ID NO: 474570 - DNA, 16 bp, Homo sapiens
acagccaaagaaactc

SEQ ID NO: 474571 - DNA, 23 bp, Homo sapiens
acagccaaagaaactcagaagag

SEQ ID NO: 474572 - DNA, 12 bp, Homo sapiens
acagcctcctag

SEQ ID NO: 474573 - DNA, 13 bp, Homo sapiens
acagcctcctagg

SEQ ID NO: 474574 - DNA, 14 bp, Homo sapiens
acagcctcctaggc

SEQ ID NO: 474575 - DNA, 11 bp, Homo sapiens
acagcctggca

SEQ ID NO: 474576 - DNA, 14 bp, Homo sapiens
acagcctggcacag

SEQ ID NO: 474577 - DNA, 14 bp, Homo sapiens
acagcggcccggcc

SEQ ID NO: 474578 - DNA, 16 bp, Homo sapiens
acagcggcccggccca

SEQ ID NO: 474579 - DNA, 18 bp, Homo sapiens
acagcggcccggcccacg

SEQ ID NO: 474580 - DNA, 20 bp, Homo sapiens
acagcggcccggcccacgca

SEQ ID NO: 474581 - DNA, 22 bp, Homo sapiens
acagctaatcagcattctcact

SEQ ID NO: 474582 - DNA, 19 bp, Homo sapiens
acagctgaaagacagtaaa

SEQ ID NO: 474583 - DNA, 16 bp, Homo sapiens
aatatgggaggaacaa

SEQ ID NO: 474584 - DNA, 10 bp, Homo sapiens
aatattctgt

SEQ ID NO: 474585 - DNA, 22 bp, Homo sapiens
aatattgctattgtttatagga

SEQ ID NO: 474586 - DNA, 23 bp, Homo sapiens
aatattgctattgtttataggaa

SEQ ID NO: 474587 - DNA, 18 bp, Homo sapiens
aatatttttttctagcta

SEQ ID NO: 474588 - DNA, 18 bp, Homo sapiens
aatcaacagcatgtctac

SEQ ID NO: 474589 - DNA, 15 bp, Homo sapiens
aatcaatctggcttc

SEQ ID NO: 474590 - DNA, 16 bp, Homo sapiens
aatcaatctggcttct

SEQ ID NO: 474591 - DNA, 17 bp, Homo sapiens
aatcagattagaccagt

SEQ ID NO: 474592 - DNA, 16 bp, Homo sapiens
aatcattttgggaaat

SEQ ID NO: 474593 - DNA, 17 bp, Homo sapiens
aatccatatcagctctg

SEQ ID NO: 474594 - DNA, 18 bp, Homo sapiens
aatccattttctaaactg

SEQ ID NO: 474595 - DNA, 19 bp, Homo sapiens
aatccattttctaaactgt

SEQ ID NO: 474596 - DNA, 23 bp, Homo sapiens
aatccattttctaaactgttttc

SEQ ID NO: 474597 - DNA, 20 bp, Homo sapiens
aatcctccaaccaggctcct

SEQ ID NO: 474598 - DNA, 13 bp, Homo sapiens
aatctaaatataa

SEQ ID NO: 474599 - DNA, 12 bp, Homo sapiens
aatctctgatta

SEQ ID NO: 474600 - DNA, 17 bp, Homo sapiens
aatctggcttctgcatt

SEQ ID NO: 474601 - DNA, 13 bp, Homo sapiens
aatcttatgttga

SEQ ID NO: 474602 - DNA, 18 bp, Homo sapiens
aatcttggccctattcat

SEQ ID NO: 474603 - DNA, 20 bp, Homo sapiens
aatcttggccctattcatta

SEQ ID NO: 474604 - DNA, 20 bp, Homo sapiens
aatgagaaattgtgccaaag

SEQ ID NO: 474605 - DNA, 17 bp, Homo sapiens
aatgagcagttagaaat

SEQ ID NO: 474606 - DNA, 13 bp, Homo sapiens
aatgagtaaataa

SEQ ID NO: 474607 - DNA, 23 bp, Homo sapiens
aatgagtaaataaactcttcaag

SEQ ID NO: 474608 - DNA, 22 bp, Homo sapiens
aatgagtttaaaaaaataacat

SEQ ID NO: 474609 - DNA, 22 bp, Homo sapiens
aatgatcgttctgggtcagctt

SEQ ID NO: 474610 - DNA, 16 bp, Homo sapiens
aatgatgattcaatca

SEQ ID NO: 474611 - DNA, 20 bp, Homo sapiens
aatgatgattcaatcatttt

SEQ ID NO: 474612 - DNA, 19 bp, Homo sapiens
aatgcatacaataaaagag

SEQ ID NO: 474613 - DNA, 21 bp, Homo sapiens
aatgcatacaataaaagagct

SEQ ID NO: 474614 - DNA, 23 bp, Homo sapiens
aatgcatacaataaaagagcttt

SEQ ID NO: 474615 - DNA, 14 bp, Homo sapiens
aatgcatgatattg

SEQ ID NO: 474616 - DNA, 19 bp, Homo sapiens
aatgcatgatattgtatgt

SEQ ID NO: 474617 - DNA, 14 bp, Homo sapiens
aatgcatgtgattg

SEQ ID NO: 474618 - DNA, 22 bp, Homo sapiens
aatgccttctgttttccaaagg

SEQ ID NO: 474619 - DNA, 17 bp, Homo sapiens
aatgccttgttgtattc

SEQ ID NO: 474620 - DNA, 13 bp, Homo sapiens
aatgctaatgtaa

SEQ ID NO: 474621 - DNA, 12 bp, Homo sapiens
aatgctttctca

SEQ ID NO: 474622 - DNA, 13 bp, Homo sapiens
aatgctttctcat

SEQ ID NO: 474623 - DNA, 15 bp, Homo sapiens
aatggctgggtttgg

SEQ ID NO: 474624 - DNA, 19 bp, Homo sapiens
aatggtgggctccagagta

SEQ ID NO: 474625 - DNA, 15 bp, Homo sapiens
aatgtaaaattcata

SEQ ID NO: 474626 - DNA, 17 bp, Homo sapiens
aatgtaaaattcatagc

SEQ ID NO: 474627 - DNA, 13 bp, Homo sapiens
aatgtaatcattt

SEQ ID NO: 474628 - DNA, 14 bp, Homo sapiens
aatgtaatcattta

SEQ ID NO: 474629 - DNA, 13 bp, Homo sapiens
aatgtactgtatt

SEQ ID NO: 474630 - DNA, 17 bp, Homo sapiens
aatgtcaatttttaact

SEQ ID NO: 474631 - DNA, 12 bp, Homo sapiens
aatgtcatctct

SEQ ID NO: 474632 - DNA, 16 bp, Homo sapiens
aatgtccccattctat

SEQ ID NO: 474633 - DNA, 17 bp, Homo sapiens
aatgtccccattctata

SEQ ID NO: 474634 - DNA, 23 bp, Homo sapiens
aatgtccccattctataaattca

SEQ ID NO: 474635 - DNA, 23 bp, Homo sapiens
aatgtgaattttaaaatgcaaat

SEQ ID NO: 474636 - DNA, 23 bp, Homo sapiens
aatgttggttacatgaatgaatg

SEQ ID NO: 474637 - DNA, 22 bp, Homo sapiens
agggccctggggtctctgagca

SEQ ID NO: 474638 - DNA, 16 bp, Homo sapiens
agggccgcagggcgct

SEQ ID NO: 474639 - DNA, 16 bp, Homo sapiens
agggcgctccggcaga

SEQ ID NO: 474640 - DNA, 18 bp, Homo sapiens
agggcgctccggcagagg

SEQ ID NO: 474641 - DNA, 20 bp, Homo sapiens
agggcgctccggcagaggca

SEQ ID NO: 474642 - DNA, 16 bp, Homo sapiens
agggctgacaaggcgt

SEQ ID NO: 474643 - DNA, 12 bp, Homo sapiens
agggctgagccc

SEQ ID NO: 474644 - DNA, 16 bp, Homo sapiens
agggctgagcccctcc

SEQ ID NO: 474645 - DNA, 19 bp, Homo sapiens
agggctgagcccctcctct

SEQ ID NO: 474646 - DNA, 20 bp, Homo sapiens
aggggactgcatgcaagctc

SEQ ID NO: 474647 - DNA, 21 bp, Homo sapiens
aggggacttggataggagctt

SEQ ID NO: 474648 - DNA, 14 bp, Homo sapiens
aggggagaaaggaa

SEQ ID NO: 474649 - DNA, 16 bp, Homo sapiens
aggggagaaaggaact

SEQ ID NO: 474650 - DNA, 12 bp, Homo sapiens
aggggcctggca

SEQ ID NO: 474651 - DNA, 19 bp, Homo sapiens
agggggaagatgccaaggg

SEQ ID NO: 474652 - DNA, 12 bp, Homo sapiens
agggggccagag

SEQ ID NO: 474653 - DNA, 21 bp, Homo sapiens
agggtatgtcagctacatgaa

SEQ ID NO: 474654 - DNA, 23 bp, Homo sapiens
agggtgaggcgtgggatccagag

SEQ ID NO: 474655 - DNA, 19 bp, Homo sapiens
agggtgctccctcctcagt

SEQ ID NO: 474656 - DNA, 13 bp, Homo sapiens
agggtgtggcttg

SEQ ID NO: 474657 - DNA, 14 bp, Homo sapiens
agggtgtggcttgg

SEQ ID NO: 474658 - DNA, 12 bp, Homo sapiens
agggttccagac

SEQ ID NO: 474659 - DNA, 15 bp, Homo sapiens
agggttccagacagg

SEQ ID NO: 474660 - DNA, 19 bp, Homo sapiens
aggtacctttccacccaga

SEQ ID NO: 474661 - DNA, 15 bp, Homo sapiens
aggtcctgcccatgt

SEQ ID NO: 474662 - DNA, 23 bp, Homo sapiens
aggtcctgcccatgtgtcccctc

SEQ ID NO: 474663 - DNA, 15 bp, Homo sapiens
aggtctcaccttcgc

SEQ ID NO: 474664 - DNA, 20 bp, Homo sapiens
aggtctcaccttcgcctttg

SEQ ID NO: 474665 - DNA, 12 bp, Homo sapiens
aggtctccaccc

SEQ ID NO: 474666 - DNA, 19 bp, Homo sapiens
aggtctccacccctcaagc

SEQ ID NO: 474667 - DNA, 16 bp, Homo sapiens
aggtctgaaggcctcc

SEQ ID NO: 474668 - DNA, 17 bp, Homo sapiens
aggtctgaaggcctcca

SEQ ID NO: 474669 - DNA, 20 bp, Homo sapiens
aggtgctcttcctcatctca

SEQ ID NO: 474670 - DNA, 17 bp, Homo sapiens
aggtggccactccagac

SEQ ID NO: 474671 - DNA, 14 bp, Homo sapiens
aggtgggtcttgga

SEQ ID NO: 474672 - DNA, 18 bp, Homo sapiens
aggtggtcttggagagga

SEQ ID NO: 474673 - DNA, 13 bp, Homo sapiens
aggtgtggagtgg

SEQ ID NO: 474674 - DNA, 14 bp, Homo sapiens
aggtgtggagtgga

SEQ ID NO: 474675 - DNA, 19 bp, Homo sapiens
aggttaaggggatctaaaa

SEQ ID NO: 474676 - DNA, 23 bp, Homo sapiens
aggttaataggaggacagaacca

SEQ ID NO: 474677 - DNA, 13 bp, Homo sapiens
aggtttcaatgca

SEQ ID NO: 474678 - DNA, 21 bp, Homo sapiens
agtaaataatgattcaatgtg

SEQ ID NO: 474679 - DNA, 15 bp, Homo sapiens
agtaataactgttag

SEQ ID NO: 474680 - DNA, 17 bp, Homo sapiens
agtaatatctttcagtt

SEQ ID NO: 474681 - DNA, 12 bp, Homo sapiens
agtacagggcag

SEQ ID NO: 474682 - DNA, 13 bp, Homo sapiens
agtacagggcagg

SEQ ID NO: 474683 - DNA, 21 bp, Homo sapiens
agtacataaagtaataactgt

SEQ ID NO: 474684 - DNA, 16 bp, Homo sapiens
agtaccaactgagcca

SEQ ID NO: 474685 - DNA, 14 bp, Homo sapiens
agtaccatcccact

SEQ ID NO: 474686 - DNA, 16 bp, Homo sapiens
agtaccatcccactga

SEQ ID NO: 474687 - DNA, 21 bp, Homo sapiens
agtacttgctcaataaaggtc

SEQ ID NO: 474688 - DNA, 18 bp, Homo sapiens
agtaggtctgaaggcctc

SEQ ID NO: 474689 - DNA, 16 bp, Homo sapiens
agtaggtgggtcttgg

SEQ ID NO: 474690 - DNA, 12 bp, Homo sapiens
agtagtgctatc

SEQ ID NO: 474691 - DNA, 16 bp, Homo sapiens
agtatgaataaagaca

SEQ ID NO: 474692 - DNA, 17 bp, Homo sapiens
agtattaacatcaaaga

SEQ ID NO: 474693 - DNA, 21 bp, Homo sapiens
agtcaactgctgttttatgtc

SEQ ID NO: 474694 - DNA, 17 bp, Homo sapiens
agtcatgtgtgcatcat

SEQ ID NO: 474695 - DNA, 17 bp, Homo sapiens
agtcatgtttctgcagt

SEQ ID NO: 474696 - DNA, 13 bp, Homo sapiens
agtccactttcct

SEQ ID NO: 474697 - DNA, 18 bp, Homo sapiens
agtccactttcctctctc

SEQ ID NO: 474698 - DNA, 19 bp, Homo sapiens
agtccactttcctctctct

SEQ ID NO: 474699 - DNA, 11 bp, Homo sapiens
agtccagctcc

SEQ ID NO: 474700 - DNA, 12 bp, Homo sapiens
agtccagctccc

SEQ ID NO: 474701 - DNA, 19 bp, Homo sapiens
agtccagctccccccaaga

SEQ ID NO: 474702 - DNA, 13 bp, Homo sapiens
agtcccttcctgt

SEQ ID NO: 474703 - DNA, 16 bp, Homo sapiens
agtcctattctattgc

SEQ ID NO: 474704 - DNA, 16 bp, Homo sapiens
agtctcattacagatt

SEQ ID NO: 474705 - DNA, 14 bp, Homo sapiens
agtctcttctccac

SEQ ID NO: 474706 - DNA, 17 bp, Homo sapiens
agtctcttctccactgg

SEQ ID NO: 474707 - DNA, 19 bp, Homo sapiens
agtctgaaggagaggagtg

SEQ ID NO: 474708 - DNA, 11 bp, Homo sapiens
agtctgtcctt

SEQ ID NO: 474709 - DNA, 13 bp, Homo sapiens
agtcttctgcctc

SEQ ID NO: 474710 - DNA, 17 bp, Homo sapiens
agtcttgagtgggcccc

SEQ ID NO: 474711 - DNA, 13 bp, Homo sapiens
agtgaagaaaatg

SEQ ID NO: 474712 - DNA, 15 bp, Homo sapiens
agtgaagcccaggag

SEQ ID NO: 474713 - DNA, 20 bp, Homo sapiens
agtgaatgagtaaataaact

SEQ ID NO: 474714 - DNA, 14 bp, Homo sapiens
agtgacatgcggct

SEQ ID NO: 474715 - DNA, 18 bp, Homo sapiens
agtgatacactgtatcta

SEQ ID NO: 474716 - DNA, 13 bp, Homo sapiens
agcgggggctaac

SEQ ID NO: 474717 - DNA, 14 bp, Homo sapiens
agctacatgaagtt

SEQ ID NO: 474718 - DNA, 17 bp, Homo sapiens
agctataacaactctat

SEQ ID NO: 474719 - DNA, 21 bp, Homo sapiens
agctatatatatatatatatg

SEQ ID NO: 474720 - DNA, 18 bp, Homo sapiens
agctatgagagatgtgtc

SEQ ID NO: 474721 - DNA, 17 bp, Homo sapiens
agctatgcgcaatgtgg

SEQ ID NO: 474722 - DNA, 14 bp, Homo sapiens
agctcaggagaagg

SEQ ID NO: 474723 - DNA, 15 bp, Homo sapiens
agctctaaagcagag

SEQ ID NO: 474724 - DNA, 16 bp, Homo sapiens
agctctaaagcagaga

SEQ ID NO: 474725 - DNA, 21 bp, Homo sapiens
agctctaaagcagagatgtat

SEQ ID NO: 474726 - DNA, 20 bp, Homo sapiens
agctgagtcggctgggcagg

SEQ ID NO: 474727 - DNA, 23 bp, Homo sapiens
agctgagtcggctgggcagggcc

SEQ ID NO: 474728 - DNA, 18 bp, Homo sapiens
agctgctctccttcactc

SEQ ID NO: 474729 - DNA, 19 bp, Homo sapiens
agctggcagcgcctcccgc

SEQ ID NO: 474730 - DNA, 17 bp, Homo sapiens
agctgttttgaataaca

SEQ ID NO: 474731 - DNA, 12 bp, Homo sapiens
agcttatttcta

SEQ ID NO: 474732 - DNA, 15 bp, Homo sapiens
agcttcaaaacagaa

SEQ ID NO: 474733 - DNA, 15 bp, Homo sapiens
agcttcaaagttggc

SEQ ID NO: 474734 - DNA, 23 bp, Homo sapiens
agcttgaatgtccccattctata

SEQ ID NO: 474735 - DNA, 12 bp, Homo sapiens
agcttgtttcta

SEQ ID NO: 474736 - DNA, 14 bp, Homo sapiens
agcttgtttctata

SEQ ID NO: 474737 - DNA, 23 bp, Homo sapiens
aggaaaaccaagccgtggcttcc

SEQ ID NO: 474738 - DNA, 14 bp, Homo sapiens
aggaaacaagcttt

SEQ ID NO: 474739 - DNA, 13 bp, Homo sapiens
aggaaagccctcc

SEQ ID NO: 474740 - DNA, 13 bp, Homo sapiens
aggaaagttctat

SEQ ID NO: 474741 - DNA, 22 bp, Homo sapiens
aggaacatccggaacagccaaa

SEQ ID NO: 474742 - DNA, 21 bp, Homo sapiens
aggaccccagtttgggaactc

SEQ ID NO: 474743 - DNA, 20 bp, Homo sapiens
aggacccggaggggcctggc

SEQ ID NO: 474744 - DNA, 22 bp, Homo sapiens
aggacccggaggggcctggcag

SEQ ID NO: 474745 - DNA, 15 bp, Homo sapiens
aggaccgccccaacc

SEQ ID NO: 474746 - DNA, 18 bp, Homo sapiens
aggaccgccccaaccctc

SEQ ID NO: 474747 - DNA, 22 bp, Homo sapiens
aggaccgccccaaccctcggag

SEQ ID NO: 474748 - DNA, 16 bp, Homo sapiens
aggacctttctgagga

SEQ ID NO: 474749 - DNA, 14 bp, Homo sapiens
aggactgttctaac

SEQ ID NO: 474750 - DNA, 16 bp, Homo sapiens
aggagaccctgtcttt

SEQ ID NO: 474751 - DNA, 9 bp, Homo sapiens
aggagcacc

SEQ ID NO: 474752 - DNA, 14 bp, Homo sapiens
aggagcacccccag

SEQ ID NO: 474753 - DNA, 15 bp, Homo sapiens
aggagcacccccagc

SEQ ID NO: 474754 - DNA, 14 bp, Homo sapiens
aggagcttccagat

SEQ ID NO: 474755 - DNA, 12 bp, Homo sapiens
aggaggacaggg

SEQ ID NO: 474756 - DNA, 15 bp, Homo sapiens
aggaggacagggagg

SEQ ID NO: 474757 - DNA, 22 bp, Homo sapiens
aggatgaacatcttttaactgc

SEQ ID NO: 474758 - DNA, 20 bp, Homo sapiens
aggatgggaagaaaaaggaa

SEQ ID NO: 474759 - DNA, 21 bp, Homo sapiens
aggatgggaagaaaaaggaaa

SEQ ID NO: 474760 - DNA, 17 bp, Homo sapiens
aggattaatctctaaaa

SEQ ID NO: 474761 - DNA, 14 bp, Homo sapiens
aggcacacagcagc

SEQ ID NO: 474762 - DNA, 16 bp, Homo sapiens
aggcacacagcagccc

SEQ ID NO: 474763 - DNA, 23 bp, Homo sapiens
aggcacacagcagccccccagca

SEQ ID NO: 474764 - DNA, 20 bp, Homo sapiens
aggcagaatggtgggctcca

SEQ ID NO: 474765 - DNA, 21 bp, Homo sapiens
aggcagaatggtgggctccag

SEQ ID NO: 474766 - DNA, 23 bp, Homo sapiens
aggcagaatggtgggctccagag

SEQ ID NO: 474767 - DNA, 22 bp, Homo sapiens
aggcagttgagaaaatttgaat

SEQ ID NO: 474768 - DNA, 15 bp, Homo sapiens
aggccaactgccccg

SEQ ID NO: 474769 - DNA, 19 bp, Homo sapiens
aggccccagcctccaggcc

SEQ ID NO: 474770 - DNA, 13 bp, Homo sapiens
aggcccccctctg

SEQ ID NO: 474771 - DNA, 21 bp, Homo sapiens
aggcccccctctgcctttgag

SEQ ID NO: 474772 - DNA, 19 bp, Homo sapiens
aggcccccggaggcgccca

SEQ ID NO: 474773 - DNA, 22 bp, Homo sapiens
aggcccccggaggcgcccacct

SEQ ID NO: 474774 - DNA, 14 bp, Homo sapiens
aggccgctctgggg

SEQ ID NO: 474775 - DNA, 22 bp, Homo sapiens
aggcctgagggaagcccacccg

SEQ ID NO: 474776 - DNA, 17 bp, Homo sapiens
aggcctgccccccttcc

SEQ ID NO: 474777 - DNA, 15 bp, Homo sapiens
aggcctggtctggag

SEQ ID NO: 474778 - DNA, 21 bp, Homo sapiens
aggcctggtctggagccccta

SEQ ID NO: 474779 - DNA, 22 bp, Homo sapiens
aggcctggtctggagcccctat

SEQ ID NO: 474780 - DNA, 23 bp, Homo sapiens
aggcctggtctggagcccctatc

SEQ ID NO: 474781 - DNA, 17 bp, Homo sapiens
aggcgcccacctgccca

SEQ ID NO: 474782 - DNA, 21 bp, Homo sapiens
aggcgcccacctgcccagtta

SEQ ID NO: 474783 - DNA, 19 bp, Homo sapiens
aggcgcgcaccgcccaacc

SEQ ID NO: 474784 - DNA, 14 bp, Homo sapiens
aggcgctcagaggc

SEQ ID NO: 474785 - DNA, 17 bp, Homo sapiens
aggcgctcagaggccgc

SEQ ID NO: 474786 - DNA, 18 bp, Homo sapiens
aggcgctcagaggccgct

SEQ ID NO: 474787 - DNA, 23 bp, Homo sapiens
aggcggaggggcttggagcagag

SEQ ID NO: 474788 - DNA, 13 bp, Homo sapiens
aggcgtgggatcc

SEQ ID NO: 474789 - DNA, 17 bp, Homo sapiens
aggcgtgggatccagag

SEQ ID NO: 474790 - DNA, 22 bp, Homo sapiens
aggcgtgggatccagagagaag

SEQ ID NO: 474791 - DNA, 19 bp, Homo sapiens
caccccataagccctgaga

SEQ ID NO: 474792 - DNA, 10 bp, Homo sapiens
cacccccagc

SEQ ID NO: 474793 - DNA, 15 bp, Homo sapiens
cacccccagcctccc

SEQ ID NO: 474794 - DNA, 17 bp, Homo sapiens
cacccccagcctccccc

SEQ ID NO: 474795 - DNA, 14 bp, Homo sapiens
caccccgctcacgc

SEQ ID NO: 474796 - DNA, 23 bp, Homo sapiens
caccccgctgcctggcgggcagc

SEQ ID NO: 474797 - DNA, 12 bp, Homo sapiens
caccccgtcccg

SEQ ID NO: 474798 - DNA, 14 bp, Homo sapiens
caccccgtctgccc

SEQ ID NO: 474799 - DNA, 14 bp, Homo sapiens
cacccctaaagaga

SEQ ID NO: 474800 - DNA, 21 bp, Homo sapiens
cacccctcttcccccttcccc

SEQ ID NO: 474801 - DNA, 17 bp, Homo sapiens
cacccgccccagagact

SEQ ID NO: 474802 - DNA, 13 bp, Homo sapiens
caccctccactct

SEQ ID NO: 474803 - DNA, 13 bp, Homo sapiens
caccctcccctct

SEQ ID NO: 474804 - DNA, 14 bp, Homo sapiens
caccctcccctctt

SEQ ID NO: 474805 - DNA, 21 bp, Homo sapiens
caccctctgctatgtctgtga

SEQ ID NO: 474806 - DNA, 13 bp, Homo sapiens
caccctctggtcc

SEQ ID NO: 474807 - DNA, 13 bp, Homo sapiens
caccctgggcctc

SEQ ID NO: 474808 - DNA, 16 bp, Homo sapiens
caccctgggcctcccg

SEQ ID NO: 474809 - DNA, 18 bp, Homo sapiens
caccctgggcctcccgtc

SEQ ID NO: 474810 - DNA, 11 bp, Homo sapiens
cacccttcccc

SEQ ID NO: 474811 - DNA, 17 bp, Homo sapiens
cacccttccccactccc

SEQ ID NO: 474812 - DNA, 17 bp, Homo sapiens
cacccttggcctgtcca

SEQ ID NO: 474813 - DNA, 15 bp, Homo sapiens
caccgcccaaccccc

SEQ ID NO: 474814 - DNA, 12 bp, Homo sapiens
caccgcccaccc

SEQ ID NO: 474815 - DNA, 13 bp, Homo sapiens
caccgggagcctc

SEQ ID NO: 474816 - DNA, 21 bp, Homo sapiens
caccgtggtgtgaggcccccg

SEQ ID NO: 474817 - DNA, 12 bp, Homo sapiens
cacctactgagt

SEQ ID NO: 474818 - DNA, 11 bp, Homo sapiens
cacctccaccc

SEQ ID NO: 474819 - DNA, 15 bp, Homo sapiens
cacctccacccgtcc

SEQ ID NO: 474820 - DNA, 13 bp, Homo sapiens
cacctctttgtca

SEQ ID NO: 474821 - DNA, 21 bp, Homo sapiens
cacctgcccagttagcccggc

SEQ ID NO: 474822 - DNA, 14 bp, Homo sapiens
cacctggcacacca

SEQ ID NO: 474823 - DNA, 13 bp, Homo sapiens
cacctgtgctgct

SEQ ID NO: 474824 - DNA, 15 bp, Homo sapiens
cacctgtgctgctgc

SEQ ID NO: 474825 - DNA, 21 bp, Homo sapiens
caccttccctagttctttgca

SEQ ID NO: 474826 - DNA, 17 bp, Homo sapiens
cacgacataagctggta

SEQ ID NO: 474827 - DNA, 21 bp, Homo sapiens
cacgcagagccccggagcacc

SEQ ID NO: 474828 - DNA, 22 bp, Homo sapiens
cacgccggggctggccctgccc

SEQ ID NO: 474829 - DNA, 18 bp, Homo sapiens
cacgctcctgccctcgtc

SEQ ID NO: 474830 - DNA, 16 bp, Homo sapiens
cacgctgacagcctcc

SEQ ID NO: 474831 - DNA, 17 bp, Homo sapiens
cacgctgacagcctcct

SEQ ID NO: 474832 - DNA, 20 bp, Homo sapiens
cacgctgacagcctcctagg

SEQ ID NO: 474833 - DNA, 23 bp, Homo sapiens
cacgctgtcctctcgagcccaga

SEQ ID NO: 474834 - DNA, 13 bp, Homo sapiens
cacgggagagcgc

SEQ ID NO: 474835 - DNA, 19 bp, Homo sapiens
atcagaactcctttctaag

SEQ ID NO: 474836 - DNA, 22 bp, Homo sapiens
atcagcattcaaaatagttcta

SEQ ID NO: 474837 - DNA, 15 bp, Homo sapiens
atcagctctgcataa

SEQ ID NO: 474838 - DNA, 22 bp, Homo sapiens
atcagctctgcataagattata

SEQ ID NO: 474839 - DNA, 21 bp, Homo sapiens
atcagtggttcgggggaaata

SEQ ID NO: 474840 - DNA, 20 bp, Homo sapiens
atcatcaatacttttgtgta

SEQ ID NO: 474841 - DNA, 19 bp, Homo sapiens
atcatggtttttgctctac

SEQ ID NO: 474842 - DNA, 13 bp, Homo sapiens
atcattctccttg

SEQ ID NO: 474843 - DNA, 16 bp, Homo sapiens
atccaactggaaggct

SEQ ID NO: 474844 - DNA, 21 bp, Homo sapiens
atccaactggaaggctttatt

SEQ ID NO: 474845 - DNA, 14 bp, Homo sapiens
atccaactttgtag

SEQ ID NO: 474846 - DNA, 16 bp, Homo sapiens
atccaccgccacccca

SEQ ID NO: 474847 - DNA, 14 bp, Homo sapiens
atccacctgcagtt

SEQ ID NO: 474848 - DNA, 19 bp, Homo sapiens
atccactaggtgcccagtc

SEQ ID NO: 474849 - DNA, 20 bp, Homo sapiens
atccagagagaagcacccca

SEQ ID NO: 474850 - DNA, 21 bp, Homo sapiens
atccagagagaagcaccccac

SEQ ID NO: 474851 - DNA, 11 bp, Homo sapiens
atccatacaaa

SEQ ID NO: 474852 - DNA, 14 bp, Homo sapiens
atccatagacacag

SEQ ID NO: 474853 - DNA, 16 bp, Homo sapiens
atccatatcagctctg

SEQ ID NO: 474854 - DNA, 12 bp, Homo sapiens
atccattttcta

SEQ ID NO: 474855 - DNA, 20 bp, Homo sapiens
atccattttctaaactgttt

SEQ ID NO: 474856 - DNA, 13 bp, Homo sapiens
atcccaagtcaaa

SEQ ID NO: 474857 - DNA, 19 bp, Homo sapiens
atcccaagtcaaacagtgt

SEQ ID NO: 474858 - DNA, 15 bp, Homo sapiens
atccctgggcccctc

SEQ ID NO: 474859 - DNA, 16 bp, Homo sapiens
atccctgggcccctcc

SEQ ID NO: 474860 - DNA, 18 bp, Homo sapiens
cttgtttctatactgttt

SEQ ID NO: 474861 - DNA, 16 bp, Homo sapiens
ctttaaagtacctgta

SEQ ID NO: 474862 - DNA, 17 bp, Homo sapiens
ctttaaagtacctgtag

SEQ ID NO: 474863 - DNA, 23 bp, Homo sapiens
ctttaaagtacctgtagtgagaa

SEQ ID NO: 474864 - DNA, 14 bp, Homo sapiens
ctttaaattatatg

SEQ ID NO: 474865 - DNA, 17 bp, Homo sapiens
ctttaagcgaggcagaa

SEQ ID NO: 474866 - DNA, 16 bp, Homo sapiens
ctttaattcttttccc

SEQ ID NO: 474867 - DNA, 13 bp, Homo sapiens
cagctggcagcgc

SEQ ID NO: 474868 - DNA, 19 bp, Homo sapiens
cagctggcagcgcctcccg

SEQ ID NO: 474869 - DNA, 23 bp, Homo sapiens
cagctggcagcgcctcccgccgc

SEQ ID NO: 474870 - DNA, 17 bp, Homo sapiens
cagcttcaaaacagaac

SEQ ID NO: 474871 - DNA, 13 bp, Homo sapiens
cagcttgtttcta

SEQ ID NO: 474872 - DNA, 14 bp, Homo sapiens
cagcttgtttctat

SEQ ID NO: 474873 - DNA, 17 bp, Homo sapiens
caggaaagatcccaagt

SEQ ID NO: 474874 - DNA, 17 bp, Homo sapiens
caggaaagccctccccc

SEQ ID NO: 474875 - DNA, 20 bp, Homo sapiens
caggaaagccctcccccttc

SEQ ID NO: 474876 - DNA, 15 bp, Homo sapiens
caggagaaggcctgc

SEQ ID NO: 474877 - DNA, 19 bp, Homo sapiens
caggagaaggcctgccccc

SEQ ID NO: 474878 - DNA, 23 bp, Homo sapiens
caggaggacctggggggggcaag

SEQ ID NO: 474879 - DNA, 20 bp, Homo sapiens
caggatgggaagaaaaagga

SEQ ID NO: 474880 - DNA, 21 bp, Homo sapiens
caggatgggaagaaaaaggaa

SEQ ID NO: 474881 - DNA, 19 bp, Homo sapiens
caggattaatctctaaaat

SEQ ID NO: 474882 - DNA, 16 bp, Homo sapiens
caggcacacagcagcc

SEQ ID NO: 474883 - DNA, 18 bp, Homo sapiens
caggcacacagcagcccc

SEQ ID NO: 474884 - DNA, 19 bp, Homo sapiens
caggccctccctgactccc

SEQ ID NO: 474885 - DNA, 23 bp, Homo sapiens
caggccctccctgactccctgtg

SEQ ID NO: 474886 - DNA, 15 bp, Homo sapiens
caggcccttcctctc

SEQ ID NO: 474887 - DNA, 16 bp, Homo sapiens
caggcccttcctctcc

SEQ ID NO: 474888 - DNA, 10 bp, Homo sapiens
aaaaaagaac

SEQ ID NO: 474889 - DNA, 12 bp, Homo sapiens
aaaaaatatttt

SEQ ID NO: 474890 - DNA, 22 bp, Homo sapiens
aaaaagcaggaaagatcccaag

SEQ ID NO: 474891 - DNA, 13 bp, Homo sapiens
aaaaatattccat

SEQ ID NO: 474892 - DNA, 18 bp, Homo sapiens
aaaacaaatatttcactt

SEQ ID NO: 474893 - DNA, 20 bp, Homo sapiens
aaaaccatcaaaaatattcc

SEQ ID NO: 474894 - DNA, 18 bp, Homo sapiens
aaaacttgagcccactcc

SEQ ID NO: 474895 - DNA, 13 bp, Homo sapiens
aaaagagcttccc

SEQ ID NO: 474896 - DNA, 15 bp, Homo sapiens
aaaagtcaaactttc

SEQ ID NO: 474897 - DNA, 13 bp, Homo sapiens
aaaataacatatt

SEQ ID NO: 474898 - DNA, 16 bp, Homo sapiens
aaaataacatctgaaa

SEQ ID NO: 474899 - DNA, 20 bp, Homo sapiens
aaaataacatctgaaaagaa

SEQ ID NO: 474900 - DNA, 15 bp, Homo sapiens
aaaatactcaccaaa

SEQ ID NO: 474901 - DNA, 14 bp, Homo sapiens
aaaatagttctatt

SEQ ID NO: 474902 - DNA, 15 bp, Homo sapiens
aaaatagttctattt

SEQ ID NO: 474903 - DNA, 18 bp, Homo sapiens
aaaatagttctatttcta

SEQ ID NO: 474904 - DNA, 21 bp, Homo sapiens
aaaatatagttaattgtggct

SEQ ID NO: 474905 - DNA, 11 bp, Homo sapiens
aaaatattctg

SEQ ID NO: 474906 - DNA, 16 bp, Homo sapiens
aaaatattctgtcatt

SEQ ID NO: 474907 - DNA, 19 bp, Homo sapiens
aaaatgctttctcatgcat

SEQ ID NO: 474908 - DNA, 13 bp, Homo sapiens
aaaattctagtct

SEQ ID NO: 474909 - DNA, 11 bp, Homo sapiens
aaaattcttgt

SEQ ID NO: 474910 - DNA, 17 bp, Homo sapiens
aaacaaatatttcactt

SEQ ID NO: 474911 - DNA, 21 bp, Homo sapiens
aaacaagtctcattagctctc

SEQ ID NO: 474912 - DNA, 15 bp, Homo sapiens
aaacactgtaatctt

SEQ ID NO: 474913 - DNA, 23 bp, Homo sapiens
aaacactgtaatcttaaaagtgt

SEQ ID NO: 474914 - DNA, 14 bp, Homo sapiens
aaacagaaacgaga

SEQ ID NO: 474915 - DNA, 22 bp, Homo sapiens
aaacagaaacgagatttgccaa

SEQ ID NO: 474916 - DNA, 18 bp, Homo sapiens
aagccaaacattcttatt

SEQ ID NO: 474917 - DNA, 20 bp, Homo sapiens
aagccaggagaccctgtctt

SEQ ID NO: 474918 - DNA, 18 bp, Homo sapiens
aagccatatgacaatttc

SEQ ID NO: 474919 - DNA, 20 bp, Homo sapiens
aagccatatgacaatttcaa

SEQ ID NO: 474920 - DNA, 22 bp, Homo sapiens
aagccatatgacaatttcaaaa

SEQ ID NO: 474921 - DNA, 13 bp, Homo sapiens
aagcccacccgcc

SEQ ID NO: 474922 - DNA, 15 bp, Homo sapiens
aagcccaggaggacc

SEQ ID NO: 474923 - DNA, 18 bp, Homo sapiens
aagccccctcttgagagg

SEQ ID NO: 474924 - DNA, 15 bp, Homo sapiens
aagccgtggcttccc

SEQ ID NO: 474925 - DNA, 12 bp, Homo sapiens
aagcctgtgaat

SEQ ID NO: 474926 - DNA, 17 bp, Homo sapiens
aagctatatatgaataa

SEQ ID NO: 474927 - DNA, 14 bp, Homo sapiens
aaggaaaagagaaa

SEQ ID NO: 474928 - DNA, 19 bp, Homo sapiens
aaggaacttttaaactgca

SEQ ID NO: 474929 - DNA, 21 bp, Homo sapiens
aaggacccggaggggcctggc

SEQ ID NO: 474930 - DNA, 22 bp, Homo sapiens
aaggacccggaggggcctggca

SEQ ID NO: 474931 - DNA, 23 bp, Homo sapiens
aaggagaggagtgcgctagagca

SEQ ID NO: 474932 - DNA, 15 bp, Homo sapiens
aaggattcttttttc

SEQ ID NO: 474933 - DNA, 23 bp, Homo sapiens
aaggcctgagggaagcccacccg

SEQ ID NO: 474934 - DNA, 23 bp, Homo sapiens
aagggaaaacaaatatttcactt

SEQ ID NO: 474935 - DNA, 14 bp, Homo sapiens
aagggaaatcaatt

SEQ ID NO: 474936 - DNA, 19 bp, Homo sapiens
aagggagtaggctgtattt

SEQ ID NO: 474937 - DNA, 18 bp, Homo sapiens
aagggcaagatgtaaagc

SEQ ID NO: 474938 - DNA, 15 bp, Homo sapiens
aagggtatctgctgc

SEQ ID NO: 474939 - DNA, 14 bp, Homo sapiens
aagggtgtggcttg

SEQ ID NO: 474940 - DNA, 12 bp, Homo sapiens
aaggtcatctca

SEQ ID NO: 474941 - DNA, 20 bp, Homo sapiens
aaggtggtcttggagaggag

SEQ ID NO: 474942 - DNA, 20 bp, Homo sapiens
aagtaacctctacaggcatt

SEQ ID NO: 474943 - DNA, 12 bp, Homo sapiens
aagtacctgtag

SEQ ID NO: 474944 - DNA, 16 bp, Homo sapiens
aagtcaaacagtgtgg

SEQ ID NO: 474945 - DNA, 18 bp, Homo sapiens
aagtcccttcctgtcctg

SEQ ID NO: 474946 - DNA, 12 bp, Homo sapiens
aagtctatgctt

SEQ ID NO: 474947 - DNA, 13 bp, Homo sapiens
aagtctatgctta

SEQ ID NO: 474948 - DNA, 14 bp, Homo sapiens
aagtctccccgcag

SEQ ID NO: 474949 - DNA, 19 bp, Homo sapiens
aagtctccccgcagccctc

SEQ ID NO: 474950 - DNA, 14 bp, Homo sapiens
aagtgattgaaaat

SEQ ID NO: 474951 - DNA, 16 bp, Homo sapiens
aagtgcatttattgcc

SEQ ID NO: 474952 - DNA, 14 bp, Homo sapiens
aagtgctcagtatt

SEQ ID NO: 474953 - DNA, 18 bp, Homo sapiens
aagtggcctgagaagagt

SEQ ID NO: 474954 - DNA, 17 bp, Homo sapiens
aagtgtgtgtgcaatgt

SEQ ID NO: 474955 - DNA, 24 bp, Homo sapiens
aagttcattcatactcaaagaggc

SEQ ID NO: 474956 - DNA, 12 bp, Homo sapiens
aagttgaccttt

SEQ ID NO: 474957 - DNA, 22 bp, Homo sapiens
aagtttggaagtacataaagta

SEQ ID NO: 474958 - DNA, 15 bp, Homo sapiens
aagtttttggtaatg

SEQ ID NO: 474959 - DNA, 18 bp, Homo sapiens
aataaaagagctttatcc

SEQ ID NO: 474960 - DNA, 21 bp, Homo sapiens
aataaactccccagcgtatcc

SEQ ID NO: 474961 - DNA, 12 bp, Homo sapiens
aataaagaagaa

SEQ ID NO: 474962 - DNA, 19 bp, Homo sapiens
aataacagagctggatgct

SEQ ID NO: 474963 - DNA, 14 bp, Homo sapiens
aataacatattctt

SEQ ID NO: 474964 - DNA, 17 bp, Homo sapiens
aataacatctgaaaaga

SEQ ID NO: 474965 - DNA, 13 bp, Homo sapiens
aataatgaataat

SEQ ID NO: 474966 - DNA, 16 bp, Homo sapiens
aataatgattcaatgt

SEQ ID NO: 474967 - DNA, 23 bp, Homo sapiens
aataatgcttaacataaacttgt

SEQ ID NO: 474968 - DNA, 19 bp, Homo sapiens
aatacagtaagctgctcta

SEQ ID NO: 474969 - DNA, 23 bp, Homo sapiens
aatactgtattgttacagctgaa

SEQ ID NO: 474970 - DNA, 18 bp, Homo sapiens
aataggaggacagaacca

SEQ ID NO: 474971 - DNA, 19 bp, Homo sapiens
aatagtaaataatgattca

SEQ ID NO: 474972 - DNA, 16 bp, Homo sapiens
aatagttccattctat

SEQ ID NO: 474973 - DNA, 18 bp, Homo sapiens
aatagttctatttctatc

SEQ ID NO: 474974 - DNA, 23 bp, Homo sapiens
aatagttctatttctatctgcaa

SEQ ID NO: 474975 - DNA, 15 bp, Homo sapiens
aatatagttaattgt

SEQ ID NO: 474976 - DNA, 19 bp, Homo sapiens
aatatattttatcttggta

SEQ ID NO: 474977 - DNA, 22 bp, Homo sapiens
aatatctatttatctgtctgag

SEQ ID NO: 474978 - DNA, 23 bp, Homo sapiens
aatatctatttatctgtctgagc

SEQ ID NO: 474979 - DNA, 19 bp, Homo sapiens
aatatgaggggactgcatg

SEQ ID NO: 474980 - DNA, 20 bp, Homo sapiens
aatatgaggggactgcatgc

SEQ ID NO: 474981 - DNA, 20 bp, Homo sapiens
aatatgattctcctctccca

SEQ ID NO: 474982 - DNA, 21 bp, Homo sapiens
aatatggaaccttccctccaa

SEQ ID NO: 474983 - DNA, 16 bp, Homo sapiens
aatcaatttaaaggaa

SEQ ID NO: 474984 - DNA, 19 bp, Homo sapiens
aatcagcattctcactcct

SEQ ID NO: 474985 - DNA, 12 bp, Homo sapiens
aatccaactcca

SEQ ID NO: 474986 - DNA, 17 bp, Homo sapiens
aatctctgattaaattt

SEQ ID NO: 474987 - DNA, 18 bp, Homo sapiens
aatctgattggacatttt

SEQ ID NO: 474988 - DNA, 14 bp, Homo sapiens
aatctggcttctgc

SEQ ID NO: 474989 - DNA, 18 bp, Homo sapiens
aatctgtctgattctatg

SEQ ID NO: 474990 - DNA, 22 bp, Homo sapiens
aatctttgtgacaggaaagccc

SEQ ID NO: 474991 - DNA, 12 bp, Homo sapiens
aatgagaaatca

SEQ ID NO: 474992 - DNA, 19 bp, Homo sapiens
aatgagaaattgtgccaaa

SEQ ID NO: 474993 - DNA, 14 bp, Homo sapiens
aatgagtaaataaa

SEQ ID NO: 474994 - DNA, 18 bp, Homo sapiens
aatgagtttaaaaaaata

SEQ ID NO: 474995 - DNA, 19 bp, Homo sapiens
aatgagtttaaaaaaataa

SEQ ID NO: 474996 - DNA, 16 bp, Homo sapiens
aatgattcaatgtgaa

SEQ ID NO: 474997 - DNA, 20 bp, Homo sapiens
aatgattcaatgtgaatttt

SEQ ID NO: 474998 - DNA, 11 bp, Homo sapiens
aatgattccaa

SEQ ID NO: 474999 - DNA, 12 bp, Homo sapiens
aatgattccaaa

SEQ ID NO: 475000 - DNA, 14 bp, Homo sapiens
aatgcatacaataa

SEQ ID NO: 475001 - DNA, 23 bp, Homo sapiens
aatgcatgatattgtatgtacct

SEQ ID NO: 475002 - DNA, 15 bp, Homo sapiens
aatgccttgttgtat

SEQ ID NO: 475003 - DNA, 18 bp, Homo sapiens
aatgccttgttgtattcc

SEQ ID NO: 475004 - DNA, 22 bp, Homo sapiens
aatgctagcacaatattcctat

SEQ ID NO: 475005 - DNA, 18 bp, Homo sapiens
aatgcttaacataaactt

SEQ ID NO: 475006 - DNA, 11 bp, Homo sapiens
aatgctttctc

SEQ ID NO: 475007 - DNA, 21 bp, Homo sapiens
aatgctttctcatgcatagac

SEQ ID NO: 475008 - DNA, 17 bp, Homo sapiens
aatggaagcactgccat

SEQ ID NO: 475009 - DNA, 13 bp, Homo sapiens
aatggcagcctga

SEQ ID NO: 475010 - DNA, 14 bp, Homo sapiens
aatggccaagtgta

SEQ ID NO: 475011 - DNA, 22 bp, Homo sapiens
aatggctgggtttgggcagtgg

SEQ ID NO: 475012 - DNA, 16 bp, Homo sapiens
aatggtgggctccaga

SEQ ID NO: 475013 - DNA, 21 bp, Homo sapiens
acccctggcttttcactgctg

SEQ ID NO: 475014 - DNA, 13 bp, Homo sapiens
acccgccccagag

SEQ ID NO: 475015 - DNA, 23 bp, Homo sapiens
acccgccccagagactgcccacc

SEQ ID NO: 475016 - DNA, 15 bp, Homo sapiens
acccggaggggcctg

SEQ ID NO: 475017 - DNA, 18 bp, Homo sapiens
acccggaggggcctggca

SEQ ID NO: 475018 - DNA, 21 bp, Homo sapiens
acccggaggggcctggcagcc

SEQ ID NO: 475019 - DNA, 12 bp, Homo sapiens
acccgtcctggg

SEQ ID NO: 475020 - DNA, 15 bp, Homo sapiens
accctacagtatata

SEQ ID NO: 475021 - DNA, 21 bp, Homo sapiens
accctacagtatataagcttt

SEQ ID NO: 475022 - DNA, 15 bp, Homo sapiens
accctagaagaaaac

SEQ ID NO: 475023 - DNA, 23 bp, Homo sapiens
accctaggtctccacccctcaag

SEQ ID NO: 475024 - DNA, 13 bp, Homo sapiens
accctccactctg

SEQ ID NO: 475025 - DNA, 14 bp, Homo sapiens
accctcccctctcc

SEQ ID NO: 475026 - DNA, 17 bp, Homo sapiens
accctccctgtcccctg

SEQ ID NO: 475027 - DNA, 19 bp, Homo sapiens
accctccctgtcccctgag

SEQ ID NO: 475028 - DNA, 20 bp, Homo sapiens
accctctcctgggggtggca

SEQ ID NO: 475029 - DNA, 21 bp, Homo sapiens
accctctcctgggggtggcag

SEQ ID NO: 475030 - DNA, 19 bp, Homo sapiens
accctctgctatgtctgtg

SEQ ID NO: 475031 - DNA, 23 bp, Homo sapiens
accctcttctcagctccactctg

SEQ ID NO: 475032 - DNA, 14 bp, Homo sapiens
accctgccctgcac

SEQ ID NO: 475033 - DNA, 15 bp, Homo sapiens
accctgccctgcacc

SEQ ID NO: 475034 - DNA, 19 bp, Homo sapiens
accctgccctgcaccttgg

SEQ ID NO: 475035 - DNA, 15 bp, Homo sapiens
accctgtaaaagaca

SEQ ID NO: 475036 - DNA, 14 bp, Homo sapiens
acccttccccactc

SEQ ID NO: 475037 - DNA, 17 bp, Homo sapiens
acccttccccactcccg

SEQ ID NO: 475038 - DNA, 16 bp, Homo sapiens
acccttggcctgtcca

SEQ ID NO: 475039 - DNA, 17 bp, Homo sapiens
accgactctgagctgct

SEQ ID NO: 475040 - DNA, 16 bp, Homo sapiens
accgagtctcttctcc

SEQ ID NO: 475041 - DNA, 20 bp, Homo sapiens
accgcccaacccccacctcc

SEQ ID NO: 475042 - DNA, 14 bp, Homo sapiens
accgcccacccaca

SEQ ID NO: 475043 - DNA, 14 bp, Homo sapiens
accgccccaaccct

SEQ ID NO: 475044 - DNA, 18 bp, Homo sapiens
accgccccaaccctcgga

SEQ ID NO: 475045 - DNA, 20 bp, Homo sapiens
accgccccaaccctcggagc

SEQ ID NO: 475046 - DNA, 19 bp, Homo sapiens
accgggagcctccccctca

SEQ ID NO: 475047 - DNA, 12 bp, Homo sapiens
accgtcaatgtg

SEQ ID NO: 475048 - DNA, 14 bp, Homo sapiens
accgtcaatgtgaa

SEQ ID NO: 475049 - DNA, 15 bp, Homo sapiens
accgtcaatgtgaaa

SEQ ID NO: 475050 - DNA, 21 bp, Homo sapiens
acctaaatccattttctaaac

SEQ ID NO: 475051 - DNA, 16 bp, Homo sapiens
acctcactatggtatg

SEQ ID NO: 475052 - DNA, 17 bp, Homo sapiens
acctcactgctttgtag

SEQ ID NO: 475053 - DNA, 21 bp, Homo sapiens
acctgaagagcgctcctctgc

SEQ ID NO: 475054 - DNA, 23 bp, Homo sapiens
acctgaagagcgctcctctgcct

SEQ ID NO: 475055 - DNA, 17 bp, Homo sapiens
acctgacgatcttcccc

SEQ ID NO: 475056 - DNA, 19 bp, Homo sapiens
acctgacgatcttccccct

SEQ ID NO: 475057 - DNA, 23 bp, Homo sapiens
acctgacgatcttcccccttccc

SEQ ID NO: 475058 - DNA, 13 bp, Homo sapiens
acctggcacacca

SEQ ID NO: 475059 - DNA, 23 bp, Homo sapiens
acctggcacaccagaagtgccat

SEQ ID NO: 475060 - DNA, 20 bp, Homo sapiens
acctggtggcaccagatgca

SEQ ID NO: 475061 - DNA, 16 bp, Homo sapiens
acctgtagtgagaaac

SEQ ID NO: 475062 - DNA, 20 bp, Homo sapiens
acctgtagtgagaaactgat

SEQ ID NO: 475063 - DNA, 19 bp, Homo sapiens
accttgggcacgggagagc

SEQ ID NO: 475064 - DNA, 13 bp, Homo sapiens
acctttccaccca

SEQ ID NO: 475065 - DNA, 16 bp, Homo sapiens
acctttccacccagac

SEQ ID NO: 475066 - DNA, 22 bp, Homo sapiens
acctttctaacccactaagtaa

SEQ ID NO: 475067 - DNA, 22 bp, Homo sapiens
acctttctgaggagtaaaaaga

SEQ ID NO: 475068 - DNA, 11 bp, Homo sapiens
acgagatttgc

SEQ ID NO: 475069 - DNA, 13 bp, Homo sapiens
acgatcttccccc

SEQ ID NO: 475070 - DNA, 15 bp, Homo sapiens
acgcagagccccgga

SEQ ID NO: 475071 - DNA, 16 bp, Homo sapiens
acgcagagccccggag

SEQ ID NO: 475072 - DNA, 19 bp, Homo sapiens
acgcagagccccggagcac

SEQ ID NO: 475073 - DNA, 23 bp, Homo sapiens
acgcagccctgctttgggctgcc

SEQ ID NO: 475074 - DNA, 17 bp, Homo sapiens
acgccggggctggccct

SEQ ID NO: 475075 - DNA, 18 bp, Homo sapiens
acgccggggctggccctg

SEQ ID NO: 475076 - DNA, 16 bp, Homo sapiens
acgcctcctggccaga

SEQ ID NO: 475077 - DNA, 14 bp, Homo sapiens
acgctgacagcctc

SEQ ID NO: 475078 - DNA, 15 bp, Homo sapiens
acgctgacagcctcc

SEQ ID NO: 475079 - DNA, 22 bp, Homo sapiens
acgctgccgctgccgctgcacc

SEQ ID NO: 475080 - DNA, 14 bp, Homo sapiens
acgctgtcctctcg

SEQ ID NO: 475081 - DNA, 14 bp, Homo sapiens
acggaagccaggcc

SEQ ID NO: 475082 - DNA, 22 bp, Homo sapiens
acggaagtggcctgagaagagt

SEQ ID NO: 475083 - DNA, 12 bp, Homo sapiens
acggcagcccca

SEQ ID NO: 475084 - DNA, 15 bp, Homo sapiens
acggcagccccatcc

SEQ ID NO: 475085 - DNA, 12 bp, Homo sapiens
acgggagagcgc

SEQ ID NO: 475086 - DNA, 21 bp, Homo sapiens
acggggtcgggggaggagcac

SEQ ID NO: 475087 - DNA, 22 bp, Homo sapiens
acgggtctgtgggactggccca

SEQ ID NO: 475088 - DNA, 21 bp, Homo sapiens
acgtcatcggaggctgggccc

SEQ ID NO: 475089 - DNA, 16 bp, Homo sapiens
acgtctgtgagtctgt

SEQ ID NO: 475090 - DNA, 12 bp, Homo sapiens
actaaaattcaa

SEQ ID NO: 475091 - DNA, 13 bp, Homo sapiens
actaaacattttg

SEQ ID NO: 475092 - DNA, 14 bp, Homo sapiens
actaaacattttgt

SEQ ID NO: 475093 - DNA, 21 bp, Homo sapiens
actaacaatgccttgttgtat

SEQ ID NO: 475094 - DNA, 14 bp, Homo sapiens
actactaagaataa

SEQ ID NO: 475095 - DNA, 15 bp, Homo sapiens
actagaatgagaaat

SEQ ID NO: 475096 - DNA, 12 bp, Homo sapiens
actagccctctt

SEQ ID NO: 475097 - DNA, 20 bp, Homo sapiens
actagccctctttctctctg

SEQ ID NO: 475098 - DNA, 20 bp, Homo sapiens
actaggtgcccagtcttgag

SEQ ID NO: 475099 - DNA, 16 bp, Homo sapiens
actagtagctgttttg

SEQ ID NO: 475100 - DNA, 22 bp, Homo sapiens
actatggtatgctggccagcac

SEQ ID NO: 475101 - DNA, 17 bp, Homo sapiens
actattaggaggaatgt

SEQ ID NO: 475102 - DNA, 19 bp, Homo sapiens
actatttgaaaaaagaaga

SEQ ID NO: 475103 - DNA, 20 bp, Homo sapiens
actcactaaaagttctcaaa

SEQ ID NO: 475104 - DNA, 12 bp, Homo sapiens
actcagaagagt

SEQ ID NO: 475105 - DNA, 19 bp, Homo sapiens
actcagcaactgttagctg

SEQ ID NO: 475106 - DNA, 23 bp, Homo sapiens
actcaggatgggaagaaaaagga

SEQ ID NO: 475107 - DNA, 21 bp, Homo sapiens
actcagtaggtctgaaggcct

SEQ ID NO: 475108 - DNA, 23 bp, Homo sapiens
actcagtaggtctgaaggcctcc

SEQ ID NO: 475109 - DNA, 13 bp, Homo sapiens
actcatctgttat

SEQ ID NO: 475110 - DNA, 23 bp, Homo sapiens
agaggtctccctataccgagacc

SEQ ID NO: 475111 - DNA, 15 bp, Homo sapiens
agagtgaatacactg

SEQ ID NO: 475112 - DNA, 19 bp, Homo sapiens
agagtgaatacactggaat

SEQ ID NO: 475113 - DNA, 16 bp, Homo sapiens
agagtggatctggagt

SEQ ID NO: 475114 - DNA, 14 bp, Homo sapiens
agagtggctcctcc

SEQ ID NO: 475115 - DNA, 15 bp, Homo sapiens
agagtggctcctccc

SEQ ID NO: 475116 - DNA, 18 bp, Homo sapiens
agagttctccttgtactt

SEQ ID NO: 475117 - DNA, 17 bp, Homo sapiens
agagttgctttaaagta

SEQ ID NO: 475118 - DNA, 12 bp, Homo sapiens
agataagtgctc

SEQ ID NO: 475119 - DNA, 12 bp, Homo sapiens
agatatggtgga

SEQ ID NO: 475120 - DNA, 15 bp, Homo sapiens
agatcagcattcaaa

SEQ ID NO: 475121 - DNA, 15 bp, Homo sapiens
agatcccaagtcaaa

SEQ ID NO: 475122 - DNA, 15 bp, Homo sapiens
agatccctcggtcag

SEQ ID NO: 475123 - DNA, 19 bp, Homo sapiens
agatccctcggtcagcacc

SEQ ID NO: 475124 - DNA, 22 bp, Homo sapiens
agatccctcggtcagcaccgtg

SEQ ID NO: 475125 - DNA, 16 bp, Homo sapiens
agatcttgagcaaggc

SEQ ID NO: 475126 - DNA, 17 bp, Homo sapiens
agatcttgagcaaggca

SEQ ID NO: 475127 - DNA, 14 bp, Homo sapiens
agatgacacataaa

SEQ ID NO: 475128 - DNA, 18 bp, Homo sapiens
agatgacacataaatctg

SEQ ID NO: 475129 - DNA, 19 bp, Homo sapiens
agatgacacataaatctgt

SEQ ID NO: 475130 - DNA, 13 bp, Homo sapiens
agatgactggaaa

SEQ ID NO: 475131 - DNA, 14 bp, Homo sapiens
agatgatctctcca

SEQ ID NO: 475132 - DNA, 20 bp, Homo sapiens
agatgctgactgtactcctc

SEQ ID NO: 475133 - DNA, 16 bp, Homo sapiens
agatgggtattaaact

SEQ ID NO: 475134 - DNA, 18 bp, Homo sapiens
agatgggtattaaacttg

SEQ ID NO: 475135 - DNA, 22 bp, Homo sapiens
agatgggttttgttaggggtgg

SEQ ID NO: 475136 - DNA, 16 bp, Homo sapiens
agatgtattatgcaaa

SEQ ID NO: 475137 - DNA, 18 bp, Homo sapiens
agatgtattatgcaaagt

SEQ ID NO: 475138 - DNA, 20 bp, Homo sapiens
agattaaaaccagagagaaa

SEQ ID NO: 475139 - DNA, 17 bp, Homo sapiens
agattatatacaaagct

SEQ ID NO: 475140 - DNA, 21 bp, Homo sapiens
agattatatacaaagctgtca

SEQ ID NO: 475141 - DNA, 15 bp, Homo sapiens
agattattttctata

SEQ ID NO: 475142 - DNA, 14 bp, Homo sapiens
agattccacaggac

SEQ ID NO: 475143 - DNA, 18 bp, Homo sapiens
agattccagagagtggct

SEQ ID NO: 475144 - DNA, 17 bp, Homo sapiens
agattctaaaacattct

SEQ ID NO: 475145 - DNA, 16 bp, Homo sapiens
agattgggggggcttg

SEQ ID NO: 475146 - DNA, 13 bp, Homo sapiens
agatttagtttac

SEQ ID NO: 475147 - DNA, 13 bp, Homo sapiens
agatttattatga

SEQ ID NO: 475148 - DNA, 15 bp, Homo sapiens
agatttgagctgcct

SEQ ID NO: 475149 - DNA, 17 bp, Homo sapiens
agatttttctcatctcc

SEQ ID NO: 475150 - DNA, 18 bp, Homo sapiens
agcaaattcttgaataaa

SEQ ID NO: 475151 - DNA, 20 bp, Homo sapiens
agcaactgttagctgggaag

SEQ ID NO: 475152 - DNA, 16 bp, Homo sapiens
agcaagaagattctaa

SEQ ID NO: 475153 - DNA, 19 bp, Homo sapiens
agcaagaagattctaaaac

SEQ ID NO: 475154 - DNA, 15 bp, Homo sapiens
agcaaggggctctgc

SEQ ID NO: 475155 - DNA, 16 bp, Homo sapiens
agcaccacggggtcgg

SEQ ID NO: 475156 - DNA, 13 bp, Homo sapiens
agcaccagcctga

SEQ ID NO: 475157 - DNA, 15 bp, Homo sapiens
agcaccagcctgagc

SEQ ID NO: 475158 - DNA, 17 bp, Homo sapiens
agcaccccaccacacac

SEQ ID NO: 475159 - DNA, 21 bp, Homo sapiens
agcaccccaccacacacaccc

SEQ ID NO: 475160 - DNA, 11 bp, Homo sapiens
agcacccccag

SEQ ID NO: 475161 - DNA, 15 bp, Homo sapiens
agcacccccagcctc

SEQ ID NO: 475162 - DNA, 19 bp, Homo sapiens
agcacccccagcctccccc

SEQ ID NO: 475163 - DNA, 21 bp, Homo sapiens
agcacccccagcctcccccag

SEQ ID NO: 475164 - DNA, 12 bp, Homo sapiens
agcaccctctcc

SEQ ID NO: 475165 - DNA, 16 bp, Homo sapiens
agcaccgtggtgtgag

SEQ ID NO: 475166 - DNA, 17 bp, Homo sapiens
agcaccgtggtgtgagg

SEQ ID NO: 475167 - DNA, 17 bp, Homo sapiens
agcactaaggccgtgtc

SEQ ID NO: 475168 - DNA, 17 bp, Homo sapiens
agcactagaatgagaaa

SEQ ID NO: 475169 - DNA, 23 bp, Homo sapiens
agcacttgaccttttcgacgctt

SEQ ID NO: 475170 - DNA, 17 bp, Homo sapiens
agcagagacggcagccc

SEQ ID NO: 475171 - DNA, 15 bp, Homo sapiens
agcagattccacagg

SEQ ID NO: 475172 - DNA, 22 bp, Homo sapiens
agcaggggggttgggttccaga

SEQ ID NO: 475173 - DNA, 18 bp, Homo sapiens
agcagtaccatcccactg

SEQ ID NO: 475174 - DNA, 12 bp, Homo sapiens
agcagtgctggg

SEQ ID NO: 475175 - DNA, 18 bp, Homo sapiens
agcagtgctgggcccagc

SEQ ID NO: 475176 - DNA, 13 bp, Homo sapiens
agcagtggggagc

SEQ ID NO: 475177 - DNA, 14 bp, Homo sapiens
agcagttagaaata

SEQ ID NO: 475178 - DNA, 14 bp, Homo sapiens
agcagtttgctttg

SEQ ID NO: 475179 - DNA, 20 bp, Homo sapiens
agcatagttctgcaataaca

SEQ ID NO: 475180 - DNA, 14 bp, Homo sapiens
agcatataaatgtt

SEQ ID NO: 475181 - DNA, 21 bp, Homo sapiens
agcatcctgattattgaatgt

SEQ ID NO: 475182 - DNA, 15 bp, Homo sapiens
agcattcaaaatagt

SEQ ID NO: 475183 - DNA, 20 bp, Homo sapiens
agcattctcactcctacctg

SEQ ID NO: 475184 - DNA, 17 bp, Homo sapiens
agccaaaaacaataaac

SEQ ID NO: 475185 - DNA, 20 bp, Homo sapiens
agccaaaaacaataaacgaa

SEQ ID NO: 475186 - DNA, 17 bp, Homo sapiens
agccaaacattcttatt

SEQ ID NO: 475187 - DNA, 14 bp, Homo sapiens
agccaaagaaactc

SEQ ID NO: 475188 - DNA, 13 bp, Homo sapiens
agccacagtgggg

SEQ ID NO: 475189 - DNA, 14 bp, Homo sapiens
agccacagtggggc

SEQ ID NO: 475190 - DNA, 18 bp, Homo sapiens
agccacgctgtcctctcg

SEQ ID NO: 475191 - DNA, 23 bp, Homo sapiens
agccacgctgtcctctcgagccc

SEQ ID NO: 475192 - DNA, 12 bp, Homo sapiens
agccagcccgtg

SEQ ID NO: 475193 - DNA, 14 bp, Homo sapiens
agccagccgccctg

SEQ ID NO: 475194 - DNA, 12 bp, Homo sapiens
agccaggagacc

SEQ ID NO: 475195 - DNA, 15 bp, Homo sapiens
agccaggagaccctg

SEQ ID NO: 475196 - DNA, 18 bp, Homo sapiens
agccaggagaccctgtct

SEQ ID NO: 475197 - DNA, 23 bp, Homo sapiens
agccatatgacaatttcaaaatg

SEQ ID NO: 475198 - DNA, 15 bp, Homo sapiens
agccattcatttaca

SEQ ID NO: 475199 - DNA, 20 bp, Homo sapiens
agcccacccgccccagagac

SEQ ID NO: 475200 - DNA, 23 bp, Homo sapiens
agcccacccgccccagagactgc

SEQ ID NO: 475201 - DNA, 20 bp, Homo sapiens
agcccagatggaaagacgtt

SEQ ID NO: 475202 - DNA, 19 bp, Homo sapiens
agccccatccttcccgcag

SEQ ID NO: 475203 - DNA, 11 bp, Homo sapiens
agccccccact

SEQ ID NO: 475204 - DNA, 14 bp, Homo sapiens
agccccccagcact

SEQ ID NO: 475205 - DNA, 17 bp, Homo sapiens
agcccctatcctgcacc

SEQ ID NO: 475206 - DNA, 12 bp, Homo sapiens
agcccctcccca

SEQ ID NO: 475207 - DNA, 21 bp, Homo sapiens
agcccctccccatggtgcagt

SEQ ID NO: 475208 - DNA, 22 bp, Homo sapiens
agggtatctgctgcctctgaaa

SEQ ID NO: 475209 - DNA, 13 bp, Homo sapiens
agggtgaggcgtg

SEQ ID NO: 475210 - DNA, 16 bp, Homo sapiens
agggtgaggcgtggga

SEQ ID NO: 475211 - DNA, 22 bp, Homo sapiens
agggtgaggcgtgggatccaga

SEQ ID NO: 475212 - DNA, 15 bp, Homo sapiens
agggtggggcttaga

SEQ ID NO: 475213 - DNA, 20 bp, Homo sapiens
agggtgtggcttggaacatt

SEQ ID NO: 475214 - DNA, 16 bp, Homo sapiens
agggttaaagaaaggc

SEQ ID NO: 475215 - DNA, 20 bp, Homo sapiens
agggttccagacagggtggg

SEQ ID NO: 475216 - DNA, 16 bp, Homo sapiens
agggttctaacctttc

SEQ ID NO: 475217 - DNA, 22 bp, Homo sapiens
agggttctagaaggggcgaggc

SEQ ID NO: 475218 - DNA, 20 bp, Homo sapiens
aggtacctttccacccagac

SEQ ID NO: 475219 - DNA, 21 bp, Homo sapiens
aggtacctttccacccagacc

SEQ ID NO: 475220 - DNA, 20 bp, Homo sapiens
aggtcctgcccatgtgtccc

SEQ ID NO: 475221 - DNA, 15 bp, Homo sapiens
aggtctccacccctc

SEQ ID NO: 475222 - DNA, 16 bp, Homo sapiens
aggtctccacccctca

SEQ ID NO: 475223 - DNA, 17 bp, Homo sapiens
aggtctccacccctcaa

SEQ ID NO: 475224 - DNA, 13 bp, Homo sapiens
aggtgcccagtct

SEQ ID NO: 475225 - DNA, 22 bp, Homo sapiens
aggtgcccagtcttgagtgggc

SEQ ID NO: 475226 - DNA, 21 bp, Homo sapiens
aggtgcggaccggagcggctg

SEQ ID NO: 475227 - DNA, 14 bp, Homo sapiens
aggtggccactcca

SEQ ID NO: 475228 - DNA, 15 bp, Homo sapiens
aggtgggtcttggat

SEQ ID NO: 475229 - DNA, 13 bp, Homo sapiens
aggtggtcttgga

SEQ ID NO: 475230 - DNA, 14 bp, Homo sapiens
aggtggtcttggag

SEQ ID NO: 475231 - DNA, 15 bp, Homo sapiens
aggtggtcttggaga

SEQ ID NO: 475232 - DNA, 20 bp, Homo sapiens
aggtggtcttggagaggagg

SEQ ID NO: 475233 - DNA, 15 bp, Homo sapiens
aggttcctcctaggc

SEQ ID NO: 475234 - DNA, 17 bp, Homo sapiens
aggttctgtgcaaaact

SEQ ID NO: 475235 - DNA, 16 bp, Homo sapiens
aggttgtctgaagtca

SEQ ID NO: 475236 - DNA, 12 bp, Homo sapiens
aggtttcaatgc

SEQ ID NO: 475237 - DNA, 14 bp, Homo sapiens
agtaaataaactct

SEQ ID NO: 475238 - DNA, 17 bp, Homo sapiens
agtaaataaactcttca

SEQ ID NO: 475239 - DNA, 18 bp, Homo sapiens
agtaaataaactcttcaa

SEQ ID NO: 475240 - DNA, 16 bp, Homo sapiens
agtacataaagtaata

SEQ ID NO: 475241 - DNA, 17 bp, Homo sapiens
agtaccatcccactgat

SEQ ID NO: 475242 - DNA, 18 bp, Homo sapiens
agtacctgtagtgagaaa

SEQ ID NO: 475243 - DNA, 13 bp, Homo sapiens
agtacttgctcaa

SEQ ID NO: 475244 - DNA, 14 bp, Homo sapiens
agtaggctgtattt

SEQ ID NO: 475245 - DNA, 18 bp, Homo sapiens
agtaggctgtattttctt

SEQ ID NO: 475246 - DNA, 16 bp, Homo sapiens
agtagtgcctgtgatc

SEQ ID NO: 475247 - DNA, 19 bp, Homo sapiens
agtcagtacacccaatttt

SEQ ID NO: 475248 - DNA, 13 bp, Homo sapiens
agtcatcatctca

SEQ ID NO: 475249 - DNA, 12 bp, Homo sapiens
agtcatctcaaa

SEQ ID NO: 475250 - DNA, 22 bp, Homo sapiens
agtcatctcaaacactgcttaa

SEQ ID NO: 475251 - DNA, 17 bp, Homo sapiens
agtccactttcctctct

SEQ ID NO: 475252 - DNA, 15 bp, Homo sapiens
agtccccccacccct

SEQ ID NO: 475253 - DNA, 21 bp, Homo sapiens
agtccccccacccctccccac

SEQ ID NO: 475254 - DNA, 22 bp, Homo sapiens
agtccccccacccctccccacc

SEQ ID NO: 475255 - DNA, 14 bp, Homo sapiens
agtcccttccagtc

SEQ ID NO: 475256 - DNA, 22 bp, Homo sapiens
agtcccttcctgtcctgctcac

SEQ ID NO: 475257 - DNA, 19 bp, Homo sapiens
agtctccccgcagccctct

SEQ ID NO: 475258 - DNA, 23 bp, Homo sapiens
agtctccccgcagccctctccac

SEQ ID NO: 475259 - DNA, 15 bp, Homo sapiens
agtctcttctccact

SEQ ID NO: 475260 - DNA, 16 bp, Homo sapiens
agtctcttctccactg

SEQ ID NO: 475261 - DNA, 18 bp, Homo sapiens
agtctcttctccactgga

SEQ ID NO: 475262 - DNA, 15 bp, Homo sapiens
agtctgaaggagagg

SEQ ID NO: 475263 - DNA, 12 bp, Homo sapiens
agtctgtacttc

SEQ ID NO: 475264 - DNA, 19 bp, Homo sapiens
agtctgtacttcagttctc

SEQ ID NO: 475265 - DNA, 14 bp, Homo sapiens
agtctgtcctttcc

SEQ ID NO: 475266 - DNA, 15 bp, Homo sapiens
agtcttgagtgggcc

SEQ ID NO: 475267 - DNA, 23 bp, Homo sapiens
agtcttgagtgggccccctctct

SEQ ID NO: 475268 - DNA, 23 bp, Homo sapiens
agtctttgggggattcaaatgca

SEQ ID NO: 475269 - DNA, 13 bp, Homo sapiens
agtctttgtttac

SEQ ID NO: 475270 - DNA, 17 bp, Homo sapiens
agtgaagcccaggagga

SEQ ID NO: 475271 - DNA, 15 bp, Homo sapiens
agtgaatacactgga

SEQ ID NO: 475272 - DNA, 19 bp, Homo sapiens
agtgagtttccagctgctc

SEQ ID NO: 475273 - DNA, 15 bp, Homo sapiens
agtgatacactgtat

SEQ ID NO: 475274 - DNA, 23 bp, Homo sapiens
agtgatatggcttgtagggtgag

SEQ ID NO: 475275 - DNA, 14 bp, Homo sapiens
agtgcatctcagcc

SEQ ID NO: 475276 - DNA, 19 bp, Homo sapiens
agtgcgtgtgaaacagcgt

SEQ ID NO: 475277 - DNA, 13 bp, Homo sapiens
agtgctgggccca

SEQ ID NO: 475278 - DNA, 14 bp, Homo sapiens
agtggagaggggac

SEQ ID NO: 475279 - DNA, 15 bp, Homo sapiens
agtggcaaaaaagaa

SEQ ID NO: 475280 - DNA, 17 bp, Homo sapiens
agtggcaaaaaagaaca

SEQ ID NO: 475281 - DNA, 18 bp, Homo sapiens
agtggcaaaaaagaacag

SEQ ID NO: 475282 - DNA, 13 bp, Homo sapiens
agtggctcctccc

SEQ ID NO: 475283 - DNA, 22 bp, Homo sapiens
agtggggcccatggccccagct

SEQ ID NO: 475284 - DNA, 20 bp, Homo sapiens
agtggtctaattcaactctg

SEQ ID NO: 475285 - DNA, 16 bp, Homo sapiens
agtgtcctgatttgtg

SEQ ID NO: 475286 - DNA, 21 bp, Homo sapiens
agtgtgtagaaacacagccta

SEQ ID NO: 475287 - DNA, 16 bp, Homo sapiens
agtgttcagcatagag

SEQ ID NO: 475288 - DNA, 19 bp, Homo sapiens
agtgttgaaattggaaagg

SEQ ID NO: 475289 - DNA, 19 bp, Homo sapiens
agttaagacaacaggcatt

SEQ ID NO: 475290 - DNA, 22 bp, Homo sapiens
agttaccccgatccgtttgcaa

SEQ ID NO: 475291 - DNA, 14 bp, Homo sapiens
agttcaaatacttt

SEQ ID NO: 475292 - DNA, 14 bp, Homo sapiens
agttctatttctat

SEQ ID NO: 475293 - DNA, 20 bp, Homo sapiens
agttctatttctatctgcaa

SEQ ID NO: 475294 - DNA, 13 bp, Homo sapiens
agttctccttgta

SEQ ID NO: 475295 - DNA, 19 bp, Homo sapiens
agttcttggtgactgtccc

SEQ ID NO: 475296 - DNA, 20 bp, Homo sapiens
agttcttggtgactgtccca

SEQ ID NO: 475297 - DNA, 21 bp, Homo sapiens
agttcttggtgactgtcccac

SEQ ID NO: 475298 - DNA, 11 bp, Homo sapiens
agttgaccttt

SEQ ID NO: 475299 - DNA, 12 bp, Homo sapiens
agttgaccttta

SEQ ID NO: 475300 - DNA, 20 bp, Homo sapiens
agttggtgattttagatttc

SEQ ID NO: 475301 - DNA, 20 bp, Homo sapiens
agttgtattttaataaagat

SEQ ID NO: 475302 - DNA, 17 bp, Homo sapiens
agttgtctgagctgctg

SEQ ID NO: 475303 - DNA, 18 bp, Homo sapiens
agtttaaaaaaataacat

SEQ ID NO: 475304 - DNA, 21 bp, Homo sapiens
agtttataaaagactgtctta

SEQ ID NO: 475305 - DNA, 20 bp, Homo sapiens
agtttattatagtctgtact

SEQ ID NO: 475306 - DNA, 21 bp, Homo sapiens
atctgggttttagaaattcta

SEQ ID NO: 475307 - DNA, 23 bp, Homo sapiens
atctggtgcgtgtggccctgtgg

SEQ ID NO: 475308 - DNA, 17 bp, Homo sapiens
atctgtatatcagctct

SEQ ID NO: 475309 - DNA, 18 bp, Homo sapiens
atctgtatatcagctcta

SEQ ID NO: 475310 - DNA, 22 bp, Homo sapiens
atctgtatttaatggtttttat

SEQ ID NO: 475311 - DNA, 17 bp, Homo sapiens
atctgtctgagccctgc

SEQ ID NO: 475312 - DNA, 18 bp, Homo sapiens
atctgtctgagccctgcc

SEQ ID NO: 475313 - DNA, 17 bp, Homo sapiens
atctgtctgattctatg

SEQ ID NO: 475314 - DNA, 18 bp, Homo sapiens
atctgtctgattctatgc

SEQ ID NO: 475315 - DNA, 20 bp, Homo sapiens
atctgtgaagcctttatcta

SEQ ID NO: 475316 - DNA, 15 bp, Homo sapiens
atcttaaaagtgtaa

SEQ ID NO: 475317 - DNA, 15 bp, Homo sapiens
atcttaaatttctaa

SEQ ID NO: 475318 - DNA, 21 bp, Homo sapiens
atcttctatatgtttaaaagt

SEQ ID NO: 475319 - DNA, 17 bp, Homo sapiens
atcttgagcaaggcaag

SEQ ID NO: 475320 - DNA, 11 bp, Homo sapiens
atcttgattaa

SEQ ID NO: 475321 - DNA, 22 bp, Homo sapiens
atcttgtaaataatgcttaaca

SEQ ID NO: 475322 - DNA, 13 bp, Homo sapiens
atcttttaactgc

SEQ ID NO: 475323 - DNA, 13 bp, Homo sapiens
atgaaagagaaaa

SEQ ID NO: 475324 - DNA, 20 bp, Homo sapiens
atgaaccgcaatatgggagg

SEQ ID NO: 475325 - DNA, 19 bp, Homo sapiens
atgacaatttcaaaatgca

SEQ ID NO: 475326 - DNA, 22 bp, Homo sapiens
atgacaatttcaaaatgcatgt

SEQ ID NO: 475327 - DNA, 14 bp, Homo sapiens
atgactggaaacaa

SEQ ID NO: 475328 - DNA, 22 bp, Homo sapiens
atgagaaattgtgccaaagata

SEQ ID NO: 475329 - DNA, 19 bp, Homo sapiens
atgagcagttagaaataca

SEQ ID NO: 475330 - DNA, 22 bp, Homo sapiens
atgaggggactgcatgcaagct

SEQ ID NO: 475331 - DNA, 13 bp, Homo sapiens
atgagtaaataaa

SEQ ID NO: 475332 - DNA, 17 bp, Homo sapiens
atgagtaaataaactct

SEQ ID NO: 475333 - DNA, 17 bp, Homo sapiens
atgagtttaaaaaaata

SEQ ID NO: 475334 - DNA, 21 bp, Homo sapiens
atgagtttaaaaaaataacat

SEQ ID NO: 475335 - DNA, 21 bp, Homo sapiens
atgatactgaattgttatgta

SEQ ID NO: 475336 - DNA, 12 bp, Homo sapiens
atgatataaaca

SEQ ID NO: 475337 - DNA, 18 bp, Homo sapiens
atgatattgtatgtacct

SEQ ID NO: 475338 - DNA, 20 bp, Homo sapiens
atgatcgttctgggtcagct

SEQ ID NO: 475339 - DNA, 13 bp, Homo sapiens
atgattcaatgtg

SEQ ID NO: 475340 - DNA, 14 bp, Homo sapiens
atgattcaatgtga

SEQ ID NO: 475341 - DNA, 21 bp, Homo sapiens
atgattcaatgtgaattttaa

SEQ ID NO: 475342 - DNA, 11 bp, Homo sapiens
atgattccaaa

SEQ ID NO: 475343 - DNA, 13 bp, Homo sapiens
atgattctcctct

SEQ ID NO: 475344 - DNA, 16 bp, Homo sapiens
atgattgaaaagaaga

SEQ ID NO: 475345 - DNA, 20 bp, Homo sapiens
atgcaactaattcaataaaa

SEQ ID NO: 475346 - DNA, 17 bp, Homo sapiens
atgcacacccattcaca

SEQ ID NO: 475347 - DNA, 15 bp, Homo sapiens
atgcacagtttgcaa

SEQ ID NO: 475348 - DNA, 15 bp, Homo sapiens
atgcatacaataaaa

SEQ ID NO: 475349 - DNA, 21 bp, Homo sapiens
atgcatacaataaaagagctt

SEQ ID NO: 475350 - DNA, 22 bp, Homo sapiens
atgcatacaataaaagagcttt

SEQ ID NO: 475351 - DNA, 14 bp, Homo sapiens
atgcatgtagcata

SEQ ID NO: 475352 - DNA, 15 bp, Homo sapiens
atgccacacgtaaac

SEQ ID NO: 475353 - DNA, 12 bp, Homo sapiens
atgcctgtattt

SEQ ID NO: 475354 - DNA, 19 bp, Homo sapiens
atgcctgtatttccaacaa

SEQ ID NO: 475355 - DNA, 13 bp, Homo sapiens
atgcctttctagt

SEQ ID NO: 475356 - DNA, 17 bp, Homo sapiens
atgcctttttggttttg

SEQ ID NO: 475357 - DNA, 13 bp, Homo sapiens
atgctaatgtaat

SEQ ID NO: 475358 - DNA, 16 bp, Homo sapiens
atgctactcagtatat

SEQ ID NO: 475359 - DNA, 16 bp, Homo sapiens
atgctcttaaaggcag

SEQ ID NO: 475360 - DNA, 21 bp, Homo sapiens
atgctgactgtactcctccca

SEQ ID NO: 475361 - DNA, 22 bp, Homo sapiens
atgctgagtatgttaagctctt

SEQ ID NO: 475362 - DNA, 13 bp, Homo sapiens
atgctggccagca

SEQ ID NO: 475363 - DNA, 14 bp, Homo sapiens
atgctggccagcac

SEQ ID NO: 475364 - DNA, 16 bp, Homo sapiens
atgctggccagcaccc

SEQ ID NO: 475365 - DNA, 17 bp, Homo sapiens
atgctggccagcaccct

SEQ ID NO: 475366 - DNA, 20 bp, Homo sapiens
atgctggccagcaccctctc

SEQ ID NO: 475367 - DNA, 21 bp, Homo sapiens
atgctggccagcaccctctcc

SEQ ID NO: 475368 - DNA, 22 bp, Homo sapiens
atgctggccagcaccctctcct

SEQ ID NO: 475369 - DNA, 15 bp, Homo sapiens
atgcttaacataaac

SEQ ID NO: 475370 - DNA, 22 bp, Homo sapiens
atgctttgtgtgattgaatctg

SEQ ID NO: 475371 - DNA, 15 bp, Homo sapiens
atggaaagggtgtgg

SEQ ID NO: 475372 - DNA, 21 bp, Homo sapiens
atggaaagggtgtggcttgga

SEQ ID NO: 475373 - DNA, 14 bp, Homo sapiens
atggaaccttccct

SEQ ID NO: 475374 - DNA, 15 bp, Homo sapiens
atggaaccttccctc

SEQ ID NO: 475375 - DNA, 21 bp, Homo sapiens
atggaaccttccctccaaatt

SEQ ID NO: 475376 - DNA, 16 bp, Homo sapiens
atggagaggcggcctc

SEQ ID NO: 475377 - DNA, 18 bp, Homo sapiens
atggagaggcggcctcgt

SEQ ID NO: 475378 - DNA, 16 bp, Homo sapiens
atggaggaaaaccaag

SEQ ID NO: 475379 - DNA, 22 bp, Homo sapiens
atggaggaaaaccaagccgtgg

SEQ ID NO: 475380 - DNA, 17 bp, Homo sapiens
atggcaagtttttggta

SEQ ID NO: 475381 - DNA, 15 bp, Homo sapiens
atggccaagtgtaca

SEQ ID NO: 475382 - DNA, 17 bp, Homo sapiens
atggccaagtgtacatt

SEQ ID NO: 475383 - DNA, 16 bp, Homo sapiens
atggccaggtggccac

SEQ ID NO: 475384 - DNA, 16 bp, Homo sapiens
atggccccagctggct

SEQ ID NO: 475385 - DNA, 13 bp, Homo sapiens
atggctctggcta

SEQ ID NO: 475386 - DNA, 16 bp, Homo sapiens
atggctgggtttgggc

SEQ ID NO: 475387 - DNA, 19 bp, Homo sapiens
atggcttccgtgagacaca

SEQ ID NO: 475388 - DNA, 19 bp, Homo sapiens
atggcttgtagggtgaggc

SEQ ID NO: 475389 - DNA, 16 bp, Homo sapiens
atgggaagaaaaagga

SEQ ID NO: 475390 - DNA, 20 bp, Homo sapiens
atgggagattaaaaccagag

SEQ ID NO: 475391 - DNA, 14 bp, Homo sapiens
atgggaggaacaaa

SEQ ID NO: 475392 - DNA, 15 bp, Homo sapiens
atgggccaagccagg

SEQ ID NO: 475393 - DNA, 16 bp, Homo sapiens
atgggccaagccaggg

SEQ ID NO: 475394 - DNA, 23 bp, Homo sapiens
atgggccagggtttacccagtgg

SEQ ID NO: 475395 - DNA, 18 bp, Homo sapiens
atgggggatgggccaggg

SEQ ID NO: 475396 - DNA, 21 bp, Homo sapiens
atgggttttgttaggggtggg

SEQ ID NO: 475397 - DNA, 13 bp, Homo sapiens
atggtatctcttt

SEQ ID NO: 475398 - DNA, 15 bp, Homo sapiens
atggtatgctggcca

SEQ ID NO: 475399 - DNA, 16 bp, Homo sapiens
atggtatgctggccag

SEQ ID NO: 475400 - DNA, 17 bp, Homo sapiens
atggtatgctggccagc

SEQ ID NO: 475401 - DNA, 11 bp, Homo sapiens
atggtgcagtg

SEQ ID NO: 475402 - DNA, 13 bp, Homo sapiens
atggtgcagtgaa

SEQ ID NO: 475403 - DNA, 17 bp, Homo sapiens
atggtgcagtgaagaaa

SEQ ID NO: 475404 - DNA, 20 bp, Homo sapiens
caaagaggccagtactttgc

SEQ ID NO: 475405 - DNA, 13 bp, Homo sapiens
caaagatagcaga

SEQ ID NO: 475406 - DNA, 14 bp, Homo sapiens
caaagatggcttcc

SEQ ID NO: 475407 - DNA, 19 bp, Homo sapiens
caaagtaccaactgagcca

SEQ ID NO: 475408 - DNA, 14 bp, Homo sapiens
caaataagtaatat

SEQ ID NO: 475409 - DNA, 22 bp, Homo sapiens
caaataagtaatatctttcagt

SEQ ID NO: 475410 - DNA, 14 bp, Homo sapiens
caaatatttcactt

SEQ ID NO: 475411 - DNA, 11 bp, Homo sapiens
caaatgcatga

SEQ ID NO: 475412 - DNA, 17 bp, Homo sapiens
caaattattctagtcaa

SEQ ID NO: 475413 - DNA, 20 bp, Homo sapiens
caaatttttactcaggcttt

SEQ ID NO: 475414 - DNA, 22 bp, Homo sapiens
caaatttttactcaggctttct

SEQ ID NO: 475415 - DNA, 23 bp, Homo sapiens
caaatttttactcaggctttcta

SEQ ID NO: 475416 - DNA, 16 bp, Homo sapiens
caacacttattttctg

SEQ ID NO: 475417 - DNA, 13 bp, Homo sapiens
caacagacaccct

SEQ ID NO: 475418 - DNA, 16 bp, Homo sapiens
caacagacaccctcca

SEQ ID NO: 475419 - DNA, 17 bp, Homo sapiens
caacagcatgtctactg

SEQ ID NO: 475420 - DNA, 22 bp, Homo sapiens
caaccaatgcacacagtagggc

SEQ ID NO: 475421 - DNA, 13 bp, Homo sapiens
caaccacttgcta

SEQ ID NO: 475422 - DNA, 13 bp, Homo sapiens
caacccaggtctg

SEQ ID NO: 475423 - DNA, 18 bp, Homo sapiens
caacccccacctcccggt

SEQ ID NO: 475424 - DNA, 13 bp, Homo sapiens
caaccctcagagc

SEQ ID NO: 475425 - DNA, 18 bp, Homo sapiens
caaccctcagagccaccc

SEQ ID NO: 475426 - DNA, 14 bp, Homo sapiens
caaccctgccctgc

SEQ ID NO: 475427 - DNA, 16 bp, Homo sapiens
caacctctcagatccc

SEQ ID NO: 475428 - DNA, 16 bp, Homo sapiens
caaccttctgtggctc

SEQ ID NO: 475429 - DNA, 11 bp, Homo sapiens
caacctttgtg

SEQ ID NO: 475430 - DNA, 15 bp, Homo sapiens
caacgcagccctgct

SEQ ID NO: 475431 - DNA, 18 bp, Homo sapiens
caacgcagccctgctttg

SEQ ID NO: 475432 - DNA, 23 bp, Homo sapiens
caactaagtagactttaattctt

SEQ ID NO: 475433 - DNA, 14 bp, Homo sapiens
caactaatttttga

SEQ ID NO: 475434 - DNA, 19 bp, Homo sapiens
caactccgcccagcctctc

SEQ ID NO: 475435 - DNA, 11 bp, Homo sapiens
caactctggcc

SEQ ID NO: 475436 - DNA, 15 bp, Homo sapiens
caactctggccttgg

SEQ ID NO: 475437 - DNA, 13 bp, Homo sapiens
caactgagccaaa

SEQ ID NO: 475438 - DNA, 23 bp, Homo sapiens
caactgagccaaaaacaataaac

SEQ ID NO: 475439 - DNA, 17 bp, Homo sapiens
caactgctgttttatgt

SEQ ID NO: 475440 - DNA, 18 bp, Homo sapiens
caactggaaggctttatt

SEQ ID NO: 475441 - DNA, 14 bp, Homo sapiens
caacttaaacctgt

SEQ ID NO: 475442 - DNA, 18 bp, Homo sapiens
caacttaaacctgtgctt

SEQ ID NO: 475443 - DNA, 21 bp, Homo sapiens
caacttaatgttctgaataat

SEQ ID NO: 475444 - DNA, 16 bp, Homo sapiens
caacttccagatttga

SEQ ID NO: 475445 - DNA, 19 bp, Homo sapiens
caactttagtatttttact

SEQ ID NO: 475446 - DNA, 15 bp, Homo sapiens
caagagctcaggaga

SEQ ID NO: 475447 - DNA, 17 bp, Homo sapiens
caagagggcactggtgg

SEQ ID NO: 475448 - DNA, 20 bp, Homo sapiens
caagagggcactggtggccc

SEQ ID NO: 475449 - DNA, 19 bp, Homo sapiens
caagatgagctgcagcccc

SEQ ID NO: 475450 - DNA, 16 bp, Homo sapiens
caagccacgttgcaga

SEQ ID NO: 475451 - DNA, 15 bp, Homo sapiens
caagccgtggcttcc

SEQ ID NO: 475452 - DNA, 16 bp, Homo sapiens
caagccgtggcttccc

SEQ ID NO: 475453 - DNA, 17 bp, Homo sapiens
caaggaaggacatttcc

SEQ ID NO: 475454 - DNA, 12 bp, Homo sapiens
caaggacactga

SEQ ID NO: 475455 - DNA, 18 bp, Homo sapiens
caaggagtgcccgccttg

SEQ ID NO: 475456 - DNA, 16 bp, Homo sapiens
caaggcaagaagtggg

SEQ ID NO: 475457 - DNA, 15 bp, Homo sapiens
caaggtggtcttgga

SEQ ID NO: 475458 - DNA, 19 bp, Homo sapiens
caaggtggtcttggagagg

SEQ ID NO: 475459 - DNA, 21 bp, Homo sapiens
caaggtggtcttggagaggag

SEQ ID NO: 475460 - DNA, 20 bp, Homo sapiens
caagtatatttatttctagc

SEQ ID NO: 475461 - DNA, 19 bp, Homo sapiens
caagtatgaataaagacac

SEQ ID NO: 475462 - DNA, 21 bp, Homo sapiens
caagtatgaataaagacacct

SEQ ID NO: 475463 - DNA, 15 bp, Homo sapiens
caagtgattgaaaat

SEQ ID NO: 475464 - DNA, 12 bp, Homo sapiens
caataaaaccaa

SEQ ID NO: 475465 - DNA, 18 bp, Homo sapiens
caataaaagagctttatc

SEQ ID NO: 475466 - DNA, 21 bp, Homo sapiens
caataaacgaaacacagaact

SEQ ID NO: 475467 - DNA, 13 bp, Homo sapiens
caataacagtttt

SEQ ID NO: 475468 - DNA, 17 bp, Homo sapiens
caataacagttttaaga

SEQ ID NO: 475469 - DNA, 14 bp, Homo sapiens
caataatgaataat

SEQ ID NO: 475470 - DNA, 16 bp, Homo sapiens
caatacattaaaataa

SEQ ID NO: 475471 - DNA, 12 bp, Homo sapiens
caataccctaga

SEQ ID NO: 475472 - DNA, 17 bp, Homo sapiens
caataccctagaagaaa

SEQ ID NO: 475473 - DNA, 21 bp, Homo sapiens
caataccctagaagaaaaccc

SEQ ID NO: 475474 - DNA, 19 bp, Homo sapiens
caatacttttgtgtattct

SEQ ID NO: 475475 - DNA, 20 bp, Homo sapiens
caatacttttgtgtattctg

SEQ ID NO: 475476 - DNA, 19 bp, Homo sapiens
caatatgaggggactgcat

SEQ ID NO: 475477 - DNA, 14 bp, Homo sapiens
caatatgggaggaa

SEQ ID NO: 475478 - DNA, 18 bp, Homo sapiens
caatatgttagcaagaga

SEQ ID NO: 475479 - DNA, 16 bp, Homo sapiens
caatcccaccaaccct

SEQ ID NO: 475480 - DNA, 13 bp, Homo sapiens
caatctggcttct

SEQ ID NO: 475481 - DNA, 23 bp, Homo sapiens
caatctgtgaagcctttatctat

SEQ ID NO: 475482 - DNA, 15 bp, Homo sapiens
caatgacctgtattt

SEQ ID NO: 475483 - DNA, 15 bp, Homo sapiens
caatgcatacaataa

SEQ ID NO: 475484 - DNA, 18 bp, Homo sapiens
caatgcatacaataaaag

SEQ ID NO: 475485 - DNA, 22 bp, Homo sapiens
caatgcatacaataaaagagct

SEQ ID NO: 475486 - DNA, 20 bp, Homo sapiens
caatggagactgtctcaaga

SEQ ID NO: 475487 - DNA, 21 bp, Homo sapiens
caatgtgaattttaaaatgca

SEQ ID NO: 475488 - DNA, 20 bp, Homo sapiens
caatgtggaaaaaatatttt

SEQ ID NO: 475489 - DNA, 19 bp, Homo sapiens
caatgttccgttcatctga

SEQ ID NO: 475490 - DNA, 22 bp, Homo sapiens
caatgttccgttcatctgagga

SEQ ID NO: 475491 - DNA, 20 bp, Homo sapiens
caattatgatagcttatgta

SEQ ID NO: 475492 - DNA, 21 bp, Homo sapiens
caattgcttctgtgcaataaa

SEQ ID NO: 475493 - DNA, 17 bp, Homo sapiens
caatttcaaaatgcatg

SEQ ID NO: 475494 - DNA, 20 bp, Homo sapiens
caatttcaaaatgcatgtga

SEQ ID NO: 475495 - DNA, 17 bp, Homo sapiens
caatttcaaagaaaaca

SEQ ID NO: 475496 - DNA, 15 bp, Homo sapiens
caattttaaaaaata

SEQ ID NO: 475497 - DNA, 14 bp, Homo sapiens
caatttttaactta

SEQ ID NO: 475498 - DNA, 22 bp, Homo sapiens
cacaaaaggctggatgtgcttt

SEQ ID NO: 475499 - DNA, 23 bp, Homo sapiens
cacaaccttctgtggctcacaga

SEQ ID NO: 475500 - DNA, 13 bp, Homo sapiens
cacaactaacaat

SEQ ID NO: 475501 - DNA, 18 bp, Homo sapiens
cacaactaacaatgcctt

SEQ ID NO: 475502 - DNA, 13 bp, Homo sapiens
cagggcgctccgg

SEQ ID NO: 475503 - DNA, 14 bp, Homo sapiens
cagggcgctccggc

SEQ ID NO: 475504 - DNA, 17 bp, Homo sapiens
cagggcgctccggcaga

SEQ ID NO: 475505 - DNA, 19 bp, Homo sapiens
cagggcgctccggcagagg

SEQ ID NO: 475506 - DNA, 20 bp, Homo sapiens
cagggcgctccggcagaggc

SEQ ID NO: 475507 - DNA, 23 bp, Homo sapiens
cagggtgcaggcgcgcaccgccc

SEQ ID NO: 475508 - DNA, 17 bp, Homo sapiens
cagggtgctccctcctc

SEQ ID NO: 475509 - DNA, 18 bp, Homo sapiens
cagggtgctccctcctca

SEQ ID NO: 475510 - DNA, 20 bp, Homo sapiens
cagggtgctccctcctcagt

SEQ ID NO: 475511 - DNA, 22 bp, Homo sapiens
cagggttaaagaaaggcagaga

SEQ ID NO: 475512 - DNA, 18 bp, Homo sapiens
cagggttccagacagggt

SEQ ID NO: 475513 - DNA, 21 bp, Homo sapiens
cagggttccagacagggtggg

SEQ ID NO: 475514 - DNA, 21 bp, Homo sapiens
cagggttctagaaggggcgag

SEQ ID NO: 475515 - DNA, 19 bp, Homo sapiens
cagggtttacccagtggga

SEQ ID NO: 475516 - DNA, 13 bp, Homo sapiens
caggtcctgccca

SEQ ID NO: 475517 - DNA, 18 bp, Homo sapiens
caggtcctgcccatgtgt

SEQ ID NO: 475518 - DNA, 21 bp, Homo sapiens
caggtcctgcccatgtgtccc

SEQ ID NO: 475519 - DNA, 15 bp, Homo sapiens
caggtggccactcca

SEQ ID NO: 475520 - DNA, 13 bp, Homo sapiens
caggtgggaaagc

SEQ ID NO: 475521 - DNA, 16 bp, Homo sapiens
caggttcctcctaggc

SEQ ID NO: 475522 - DNA, 19 bp, Homo sapiens
cagtaagctgctctattgt

SEQ ID NO: 475523 - DNA, 15 bp, Homo sapiens
cagtaccatcccact

SEQ ID NO: 475524 - DNA, 14 bp, Homo sapiens
cagtacttgctcaa

SEQ ID NO: 475525 - DNA, 19 bp, Homo sapiens
cagtacttgctcaataaag

SEQ ID NO: 475526 - DNA, 12 bp, Homo sapiens
cagtatataagc

SEQ ID NO: 475527 - DNA, 20 bp, Homo sapiens
cagtattaacatcaaagact

SEQ ID NO: 475528 - DNA, 14 bp, Homo sapiens
cagtattctgtagc

SEQ ID NO: 475529 - DNA, 21 bp, Homo sapiens
cagtattgacgacctacatct

SEQ ID NO: 475530 - DNA, 17 bp, Homo sapiens
cagtcttgagtgggccc

SEQ ID NO: 475531 - DNA, 18 bp, Homo sapiens
cagtcttgagtgggcccc

SEQ ID NO: 475532 - DNA, 20 bp, Homo sapiens
cagtcttgagtgggccccct

SEQ ID NO: 475533 - DNA, 14 bp, Homo sapiens
cagtctttggagag

SEQ ID NO: 475534 - DNA, 20 bp, Homo sapiens
cagtctttgggggattcaaa

SEQ ID NO: 475535 - DNA, 22 bp, Homo sapiens
cagtctttgggggattcaaatg

SEQ ID NO: 475536 - DNA, 16 bp, Homo sapiens
cagtgaagcccaggag

SEQ ID NO: 475537 - DNA, 21 bp, Homo sapiens
cagtggagaggggacttggat

SEQ ID NO: 475538 - DNA, 13 bp, Homo sapiens
cagtggggcccat

SEQ ID NO: 475539 - DNA, 22 bp, Homo sapiens
cagtggggcccatggccccagc

SEQ ID NO: 475540 - DNA, 15 bp, Homo sapiens
cagtgggggtgcctg

SEQ ID NO: 475541 - DNA, 11 bp, Homo sapiens
cagtgtggctt

SEQ ID NO: 475542 - DNA, 19 bp, Homo sapiens
cagtgtggcttaaacattt

SEQ ID NO: 475543 - DNA, 12 bp, Homo sapiens
cagttaaaatgt

SEQ ID NO: 475544 - DNA, 12 bp, Homo sapiens
cagttagaaata

SEQ ID NO: 475545 - DNA, 18 bp, Homo sapiens
cagttagcccggccaagg

SEQ ID NO: 475546 - DNA, 19 bp, Homo sapiens
cagttagcccggccaagga

SEQ ID NO: 475547 - DNA, 14 bp, Homo sapiens
cagttattaaatga

SEQ ID NO: 475548 - DNA, 17 bp, Homo sapiens
cagttcaacctggtggc

SEQ ID NO: 475549 - DNA, 13 bp, Homo sapiens
cagttctcatctt

SEQ ID NO: 475550 - DNA, 22 bp, Homo sapiens
cagttgaaaagaggtggattca

SEQ ID NO: 475551 - DNA, 19 bp, Homo sapiens
cagtttaatattccaatac

SEQ ID NO: 475552 - DNA, 16 bp, Homo sapiens
cagtttgatattttga

SEQ ID NO: 475553 - DNA, 16 bp, Homo sapiens
cataaaaataaccaaa

SEQ ID NO: 475554 - DNA, 14 bp, Homo sapiens
cataaagtaataac

SEQ ID NO: 475555 - DNA, 22 bp, Homo sapiens
cataaagtaataactgttagaa

SEQ ID NO: 475556 - DNA, 20 bp, Homo sapiens
cataaatctgtctgattcta

SEQ ID NO: 475557 - DNA, 11 bp, Homo sapiens
cataaattggc

SEQ ID NO: 475558 - DNA, 12 bp, Homo sapiens
cataaattggct

SEQ ID NO: 475559 - DNA, 20 bp, Homo sapiens
cataaattggctcctttccc

SEQ ID NO: 475560 - DNA, 18 bp, Homo sapiens
cataagccctgagactcc

SEQ ID NO: 475561 - DNA, 14 bp, Homo sapiens
cataataaaaggca

SEQ ID NO: 475562 - DNA, 14 bp, Homo sapiens
cataatgatactga

SEQ ID NO: 475563 - DNA, 17 bp, Homo sapiens
cataattaaattttaat

SEQ ID NO: 475564 - DNA, 18 bp, Homo sapiens
cataattaaattttaatg

SEQ ID NO: 475565 - DNA, 12 bp, Homo sapiens
catacaataaaa

SEQ ID NO: 475566 - DNA, 13 bp, Homo sapiens
catacaataaaag

SEQ ID NO: 475567 - DNA, 21 bp, Homo sapiens
catacaataaaagagctttat

SEQ ID NO: 475568 - DNA, 22 bp, Homo sapiens
catacaataaaagagctttatc

SEQ ID NO: 475569 - DNA, 13 bp, Homo sapiens
catacattcctaa

SEQ ID NO: 475570 - DNA, 13 bp, Homo sapiens
catactctgtgta

SEQ ID NO: 475571 - DNA, 23 bp, Homo sapiens
catactctgtgtaatctctgatt

SEQ ID NO: 475572 - DNA, 13 bp, Homo sapiens
catagacacagta

SEQ ID NO: 475573 - DNA, 14 bp, Homo sapiens
catagagcagcact

SEQ ID NO: 475574 - DNA, 22 bp, Homo sapiens
catagtgtgctcggacacagtt

SEQ ID NO: 475575 - DNA, 16 bp, Homo sapiens
catagttctgcaataa

SEQ ID NO: 475576 - DNA, 11 bp, Homo sapiens
catataaatgt

SEQ ID NO: 475577 - DNA, 16 bp, Homo sapiens
catataaatgtttata

SEQ ID NO: 475578 - DNA, 22 bp, Homo sapiens
catataaatgtttatattgttt

SEQ ID NO: 475579 - DNA, 14 bp, Homo sapiens
catatataaattat

SEQ ID NO: 475580 - DNA, 19 bp, Homo sapiens
catatataaattattactt

SEQ ID NO: 475581 - DNA, 20 bp, Homo sapiens
catatataaattattacttt

SEQ ID NO: 475582 - DNA, 20 bp, Homo sapiens
catatcctggtgtctagttt

SEQ ID NO: 475583 - DNA, 16 bp, Homo sapiens
catatgacaatttcaa

SEQ ID NO: 475584 - DNA, 18 bp, Homo sapiens
catatgacaatttcaaaa

SEQ ID NO: 475585 - DNA, 19 bp, Homo sapiens
catatgacaatttcaaaat

SEQ ID NO: 475586 - DNA, 16 bp, Homo sapiens
catatgattgaaaaga

SEQ ID NO: 475587 - DNA, 20 bp, Homo sapiens
catatgattgaaaagaagaa

SEQ ID NO: 475588 - DNA, 22 bp, Homo sapiens
catatgattgaaaagaagaaag

SEQ ID NO: 475589 - DNA, 23 bp, Homo sapiens
catcaatacttttgtgtattctg

SEQ ID NO: 475590 - DNA, 14 bp, Homo sapiens
catcatcctcactg

SEQ ID NO: 475591 - DNA, 14 bp, Homo sapiens
catcatgtctcttt

SEQ ID NO: 475592 - DNA, 16 bp, Homo sapiens
catccaaataggagtc

SEQ ID NO: 475593 - DNA, 14 bp, Homo sapiens
catccaccgccacc

SEQ ID NO: 475594 - DNA, 16 bp, Homo sapiens
catccaccgccacccc

SEQ ID NO: 475595 - DNA, 16 bp, Homo sapiens
catccagtttgttctc

SEQ ID NO: 475596 - DNA, 22 bp, Homo sapiens
catcccactgatatcacgggcc

SEQ ID NO: 475597 - DNA, 22 bp, Homo sapiens
catccctgggcccctccacgcc

SEQ ID NO: 475598 - DNA, 15 bp, Homo sapiens
catcccttggcccct

SEQ ID NO: 475599 - DNA, 18 bp, Homo sapiens
catcccttggcccctctc

SEQ ID NO: 475600 - DNA, 16 bp, Homo sapiens
ccaaggtggtcttgga

SEQ ID NO: 475601 - DNA, 21 bp, Homo sapiens
ccaaggtggtcttggagagga

SEQ ID NO: 475602 - DNA, 22 bp, Homo sapiens
ccaaggtggtcttggagaggag

SEQ ID NO: 475603 - DNA, 21 bp, Homo sapiens
ccaagtaaccaggccccagcc

SEQ ID NO: 475604 - DNA, 21 bp, Homo sapiens
ccaatggagactgtctcaaga

SEQ ID NO: 475605 - DNA, 17 bp, Homo sapiens
ccaattttaaaaaataa

SEQ ID NO: 475606 - DNA, 20 bp, Homo sapiens
ccaattttaaaaaataacat

SEQ ID NO: 475607 - DNA, 18 bp, Homo sapiens
ccacaaaatatttctaag

SEQ ID NO: 475608 - DNA, 13 bp, Homo sapiens
ccacaactaacaa

SEQ ID NO: 475609 - DNA, 14 bp, Homo sapiens
ccacacacaccctt

SEQ ID NO: 475610 - DNA, 17 bp, Homo sapiens
ccacacacacccttccc

SEQ ID NO: 475611 - DNA, 17 bp, Homo sapiens
ccacaccccgtctgccc

SEQ ID NO: 475612 - DNA, 14 bp, Homo sapiens
ccacacgccggggc

SEQ ID NO: 475613 - DNA, 18 bp, Homo sapiens
ccacacgccggggctggc

SEQ ID NO: 475614 - DNA, 22 bp, Homo sapiens
ccacacttcaggctcttctcct

SEQ ID NO: 475615 - DNA, 15 bp, Homo sapiens
ccacaggcccttcct

SEQ ID NO: 475616 - DNA, 20 bp, Homo sapiens
ccacagtggggcccatggcc

SEQ ID NO: 475617 - DNA, 23 bp, Homo sapiens
ccacagtggggcccatggcccca

SEQ ID NO: 475618 - DNA, 24 bp, Homo sapiens
ccacagtggggcccatggccccag

SEQ ID NO: 475619 - DNA, 19 bp, Homo sapiens
ccacatagtgatggttccc

SEQ ID NO: 475620 - DNA, 22 bp, Homo sapiens
ccacatagtgatggttcccctg

SEQ ID NO: 475621 - DNA, 22 bp, Homo sapiens
ccaccaagctgctctccttcac

SEQ ID NO: 475622 - DNA, 23 bp, Homo sapiens
ccaccaagggtatctgctgcctc

SEQ ID NO: 475623 - DNA, 19 bp, Homo sapiens
ccaccacacacacccttcc

SEQ ID NO: 475624 - DNA, 15 bp, Homo sapiens
ccacccactagccct

SEQ ID NO: 475625 - DNA, 16 bp, Homo sapiens
ccacccagaggtctcc

SEQ ID NO: 475626 - DNA, 20 bp, Homo sapiens
ccacccagaggtctccctat

SEQ ID NO: 475627 - DNA, 17 bp, Homo sapiens
ccaccccgctgcctggc

SEQ ID NO: 475628 - DNA, 14 bp, Homo sapiens
ccacccctccccac

SEQ ID NO: 475629 - DNA, 14 bp, Homo sapiens
ccacccctcttccc

SEQ ID NO: 475630 - DNA, 17 bp, Homo sapiens
ccacccctcttccccct

SEQ ID NO: 475631 - DNA, 18 bp, Homo sapiens
ccacccgccccagagact

SEQ ID NO: 475632 - DNA, 20 bp, Homo sapiens
ccacccgccccagagactgc

SEQ ID NO: 475633 - DNA, 21 bp, Homo sapiens
ccacccgcccgcccccgccct

SEQ ID NO: 475634 - DNA, 14 bp, Homo sapiens
ccaccctcccctct

SEQ ID NO: 475635 - DNA, 12 bp, Homo sapiens
ccaccctctggt

SEQ ID NO: 475636 - DNA, 22 bp, Homo sapiens
ccacccttggcctgtccacctg

SEQ ID NO: 475637 - DNA, 13 bp, Homo sapiens
ccaccgccacccc

SEQ ID NO: 475638 - DNA, 21 bp, Homo sapiens
ccacctgcccagttagcccgg

SEQ ID NO: 475639 - DNA, 23 bp, Homo sapiens
ccaccttgtacagaaccagcact

SEQ ID NO: 475640 - DNA, 14 bp, Homo sapiens
ccacgcagagcccc

SEQ ID NO: 475641 - DNA, 19 bp, Homo sapiens
ccacgcagagccccggagc

SEQ ID NO: 475642 - DNA, 20 bp, Homo sapiens
ccacgcagagccccggagca

SEQ ID NO: 475643 - DNA, 15 bp, Homo sapiens
ccacgcctcctggcc

SEQ ID NO: 475644 - DNA, 17 bp, Homo sapiens
ccacgcctcctggccag

SEQ ID NO: 475645 - DNA, 12 bp, Homo sapiens
ccacgctgtcct

SEQ ID NO: 475646 - DNA, 18 bp, Homo sapiens
ccacggggtcgggggagg

SEQ ID NO: 475647 - DNA, 22 bp, Homo sapiens
ccacggggtcgggggaggagca

SEQ ID NO: 475648 - DNA, 23 bp, Homo sapiens
ccacggggtcgggggaggagcac

SEQ ID NO: 475649 - DNA, 23 bp, Homo sapiens
ccactagccctctttctctctgt

SEQ ID NO: 475650 - DNA, 20 bp, Homo sapiens
ccactccagacccctggctt

SEQ ID NO: 475651 - DNA, 11 bp, Homo sapiens
ccactcctccc

SEQ ID NO: 475652 - DNA, 22 bp, Homo sapiens
ccactcctcccaactctggcct

SEQ ID NO: 475653 - DNA, 18 bp, Homo sapiens
ccactctgaggtctcacc

SEQ ID NO: 475654 - DNA, 22 bp, Homo sapiens
ccactctgaggtctcaccttcg

SEQ ID NO: 475655 - DNA, 21 bp, Homo sapiens
ccactgagagctgctcctttg

SEQ ID NO: 475656 - DNA, 19 bp, Homo sapiens
ccacttagaaattgcattt

SEQ ID NO: 475657 - DNA, 21 bp, Homo sapiens
ccacttagaaattgcatttcc

SEQ ID NO: 475658 - DNA, 14 bp, Homo sapiens
ccacttatgctgct

SEQ ID NO: 475659 - DNA, 16 bp, Homo sapiens
ccactttcctctctct

SEQ ID NO: 475660 - DNA, 15 bp, Homo sapiens
ccagaaaaaaggact

SEQ ID NO: 475661 - DNA, 14 bp, Homo sapiens
ccagaacgggcctc

SEQ ID NO: 475662 - DNA, 18 bp, Homo sapiens
ccagacagagtggatctg

SEQ ID NO: 475663 - DNA, 19 bp, Homo sapiens
ccagacagagtggatctgg

SEQ ID NO: 475664 - DNA, 13 bp, Homo sapiens
ccagacattgtat

SEQ ID NO: 475665 - DNA, 15 bp, Homo sapiens
ccagacattgtattt

SEQ ID NO: 475666 - DNA, 9 bp, Homo sapiens
ccagacccc

SEQ ID NO: 475667 - DNA, 21 bp, Homo sapiens
ccagacccctaccctttccca

SEQ ID NO: 475668 - DNA, 14 bp, Homo sapiens
ccagacccctggct

SEQ ID NO: 475669 - DNA, 15 bp, Homo sapiens
ccagacccctggctt

SEQ ID NO: 475670 - DNA, 17 bp, Homo sapiens
ccagacccctggctttt

SEQ ID NO: 475671 - DNA, 24 bp, Homo sapiens
ccagacccctggcttttcactgct

SEQ ID NO: 475672 - DNA, 20 bp, Homo sapiens
ccagaccctccttccccacc

SEQ ID NO: 475673 - DNA, 22 bp, Homo sapiens
ccagaccctccttccccacccc

SEQ ID NO: 475674 - DNA, 18 bp, Homo sapiens
ccagacgctgccgctgcc

SEQ ID NO: 475675 - DNA, 16 bp, Homo sapiens
ccagactcgagagggc

SEQ ID NO: 475676 - DNA, 13 bp, Homo sapiens
ccagagactgccc

SEQ ID NO: 475677 - DNA, 15 bp, Homo sapiens
ccagagactgcccac

SEQ ID NO: 475678 - DNA, 20 bp, Homo sapiens
ccagagagaagcaccccacc

SEQ ID NO: 475679 - DNA, 15 bp, Homo sapiens
ccagagagtggctcc

SEQ ID NO: 475680 - DNA, 22 bp, Homo sapiens
ccagagagtggctcctcccggt

SEQ ID NO: 475681 - DNA, 21 bp, Homo sapiens
ccagagtaggtgggtcttgga

SEQ ID NO: 475682 - DNA, 18 bp, Homo sapiens
ccagcaccctctcctggg

SEQ ID NO: 475683 - DNA, 19 bp, Homo sapiens
ccagcaccctctcctgggg

SEQ ID NO: 475684 - DNA, 19 bp, Homo sapiens
ccagcactcccagggcccg

SEQ ID NO: 475685 - DNA, 15 bp, Homo sapiens
ccagcagtgctgggc

SEQ ID NO: 475686 - DNA, 21 bp, Homo sapiens
ccagcagtgctgggcccagcc

SEQ ID NO: 475687 - DNA, 23 bp, Homo sapiens
ccagcagtgctgggcccagccgg

SEQ ID NO: 475688 - DNA, 17 bp, Homo sapiens
ccagccggggtggggtg

SEQ ID NO: 475689 - DNA, 21 bp, Homo sapiens
ccagccggggtggggtgcctg

SEQ ID NO: 475690 - DNA, 13 bp, Homo sapiens
ccagcctccaggc

SEQ ID NO: 475691 - DNA, 12 bp, Homo sapiens
ccagcctccccc

SEQ ID NO: 475692 - DNA, 12 bp, Homo sapiens
ccagcgtggggc

SEQ ID NO: 475693 - DNA, 21 bp, Homo sapiens
ccagctatctgtcatctctct

SEQ ID NO: 475694 - DNA, 17 bp, Homo sapiens
ccagctggcagcgcctc

SEQ ID NO: 475695 - DNA, 22 bp, Homo sapiens
ccagctggctgggtcgcccctc

SEQ ID NO: 475696 - DNA, 14 bp, Homo sapiens
ccaggccaactgcc

SEQ ID NO: 475697 - DNA, 22 bp, Homo sapiens
cctacagtatataagctttttt

SEQ ID NO: 475698 - DNA, 13 bp, Homo sapiens
cctacatctgaaa

SEQ ID NO: 475699 - DNA, 16 bp, Homo sapiens
cctaccgagtctcttc

SEQ ID NO: 475700 - DNA, 17 bp, Homo sapiens
cctaccgagtctcttct

SEQ ID NO: 475701 - DNA, 17 bp, Homo sapiens
cctagaagaaaacccga

SEQ ID NO: 475702 - DNA, 15 bp, Homo sapiens
cctaggctccctgag

SEQ ID NO: 475703 - DNA, 16 bp, Homo sapiens
cctaggtctccacccc

SEQ ID NO: 475704 - DNA, 20 bp, Homo sapiens
cctataccctaggtctccac

SEQ ID NO: 475705 - DNA, 22 bp, Homo sapiens
cctataccctaggtctccaccc

SEQ ID NO: 475706 - DNA, 18 bp, Homo sapiens
cctatactggttatagtt

SEQ ID NO: 475707 - DNA, 16 bp, Homo sapiens
cctatcctgcaccctc

SEQ ID NO: 475708 - DNA, 18 bp, Homo sapiens
cctatggaaagggtgtgg

SEQ ID NO: 475709 - DNA, 13 bp, Homo sapiens
cctatttaagccc

SEQ ID NO: 475710 - DNA, 20 bp, Homo sapiens
cctcaagccaggagaccctg

SEQ ID NO: 475711 - DNA, 22 bp, Homo sapiens
cctcaagccaggagaccctgtc

SEQ ID NO: 475712 - DNA, 20 bp, Homo sapiens
cctcactatggtatgctggc

SEQ ID NO: 475713 - DNA, 19 bp, Homo sapiens
cctcactccactcccctca

SEQ ID NO: 475714 - DNA, 22 bp, Homo sapiens
cctcactccactcccctcatcc

SEQ ID NO: 475715 - DNA, 20 bp, Homo sapiens
cctcactctgtcagccagcc

SEQ ID NO: 475716 - DNA, 22 bp, Homo sapiens
cctcactctgtcagccagccgc

SEQ ID NO: 475717 - DNA, 17 bp, Homo sapiens
cctcactggtgcattta

SEQ ID NO: 475718 - DNA, 18 bp, Homo sapiens
cctcactggtgcatttaa

SEQ ID NO: 475719 - DNA, 20 bp, Homo sapiens
cctcagacgggctgagagga

SEQ ID NO: 475720 - DNA, 16 bp, Homo sapiens
cctcagagccacccct

SEQ ID NO: 475721 - DNA, 19 bp, Homo sapiens
cctcagatgatctctccac

SEQ ID NO: 475722 - DNA, 11 bp, Homo sapiens
cctcagccctc

SEQ ID NO: 475723 - DNA, 14 bp, Homo sapiens
cctcagccctcaga

SEQ ID NO: 475724 - DNA, 19 bp, Homo sapiens
cctcagtctttgggggatt

SEQ ID NO: 475725 - DNA, 23 bp, Homo sapiens
cctcagttcaacctggtggcacc

SEQ ID NO: 475726 - DNA, 15 bp, Homo sapiens
cctccacacctccac

SEQ ID NO: 475727 - DNA, 14 bp, Homo sapiens
cctccacgcctcct

SEQ ID NO: 475728 - DNA, 20 bp, Homo sapiens
cctccacgcctcctggccag

SEQ ID NO: 475729 - DNA, 14 bp, Homo sapiens
cctccactcctccc

SEQ ID NO: 475730 - DNA, 16 bp, Homo sapiens
cctccactcctcccaa

SEQ ID NO: 475731 - DNA, 16 bp, Homo sapiens
cctccactctgaggtc

SEQ ID NO: 475732 - DNA, 20 bp, Homo sapiens
cctccaggaggactgttcta

SEQ ID NO: 475733 - DNA, 13 bp, Homo sapiens
cctccaggctggg

SEQ ID NO: 475734 - DNA, 20 bp, Homo sapiens
cctccaggctggggcctggc

SEQ ID NO: 475735 - DNA, 20 bp, Homo sapiens
cctccatttgtaccgaaaca

SEQ ID NO: 475736 - DNA, 16 bp, Homo sapiens
cctcccaactctggcc

SEQ ID NO: 475737 - DNA, 21 bp, Homo sapiens
cctcccaactctggccttggt

SEQ ID NO: 475738 - DNA, 14 bp, Homo sapiens
cctcccaggcgccc

SEQ ID NO: 475739 - DNA, 14 bp, Homo sapiens
cctccccacccacc

SEQ ID NO: 475740 - DNA, 17 bp, Homo sapiens
cctcccccgcagacaga

SEQ ID NO: 475741 - DNA, 14 bp, Homo sapiens
cctcccccttcccc

SEQ ID NO: 475742 - DNA, 14 bp, Homo sapiens
cctcccctctcctg

SEQ ID NO: 475743 - DNA, 15 bp, Homo sapiens
cctcccctctcctga

SEQ ID NO: 475744 - DNA, 16 bp, Homo sapiens
cctcccggtgcccaag

SEQ ID NO: 475745 - DNA, 14 bp, Homo sapiens
cctccctccctcca

SEQ ID NO: 475746 - DNA, 16 bp, Homo sapiens
cctccctccctccaca

SEQ ID NO: 475747 - DNA, 19 bp, Homo sapiens
cctccctgactccctgtgg

SEQ ID NO: 475748 - DNA, 24 bp, Homo sapiens
cctccctgcccctcccttcaacca

SEQ ID NO: 475749 - DNA, 11 bp, Homo sapiens
cctccctgtcc

SEQ ID NO: 475750 - DNA, 17 bp, Homo sapiens
cctcctaggcgctcaga

SEQ ID NO: 475751 - DNA, 18 bp, Homo sapiens
cctcctaggcgctcagag

SEQ ID NO: 475752 - DNA, 17 bp, Homo sapiens
cctcctaggctccctga

SEQ ID NO: 475753 - DNA, 22 bp, Homo sapiens
cctcctaggctccctgaggtac

SEQ ID NO: 475754 - DNA, 22 bp, Homo sapiens
cctcctcgggcgcctgcgctcc

SEQ ID NO: 475755 - DNA, 23 bp, Homo sapiens
cctcctcgggcgcctgcgctcct

SEQ ID NO: 475756 - DNA, 13 bp, Homo sapiens
cctcctctcctcg

SEQ ID NO: 475757 - DNA, 13 bp, Homo sapiens
cctcctctgcccc

SEQ ID NO: 475758 - DNA, 17 bp, Homo sapiens
cctcctctgccccctcc

SEQ ID NO: 475759 - DNA, 23 bp, Homo sapiens
cctcctctgccccctcccccgca

SEQ ID NO: 475760 - DNA, 12 bp, Homo sapiens
cctccttcccca

SEQ ID NO: 475761 - DNA, 14 bp, Homo sapiens
cctccttccccacc

SEQ ID NO: 475762 - DNA, 13 bp, Homo sapiens
cctccttctcccc

SEQ ID NO: 475763 - DNA, 21 bp, Homo sapiens
cctccttctcccctccagacc

SEQ ID NO: 475764 - DNA, 18 bp, Homo sapiens
cctcgagtccccccaccc

SEQ ID NO: 475765 - DNA, 18 bp, Homo sapiens
cctcggagccccccactc

SEQ ID NO: 475766 - DNA, 15 bp, Homo sapiens
cctcggccccaccca

SEQ ID NO: 475767 - DNA, 21 bp, Homo sapiens
cctcgggccgcctcctccaga

SEQ ID NO: 475768 - DNA, 14 bp, Homo sapiens
cctcgggcgcctgc

SEQ ID NO: 475769 - DNA, 16 bp, Homo sapiens
cctcgggcgcctgcgc

SEQ ID NO: 475770 - DNA, 18 bp, Homo sapiens
cctcggtcagcaccgtgg

SEQ ID NO: 475771 - DNA, 17 bp, Homo sapiens
cctcgtccggcctgcag

SEQ ID NO: 475772 - DNA, 16 bp, Homo sapiens
cctcgtctccctggcc

SEQ ID NO: 475773 - DNA, 13 bp, Homo sapiens
cctctccacccag

SEQ ID NO: 475774 - DNA, 14 bp, Homo sapiens
cctctccacccaga

SEQ ID NO: 475775 - DNA, 16 bp, Homo sapiens
cctctccacccagagg

SEQ ID NO: 475776 - DNA, 20 bp, Homo sapiens
cctctccacccagaggtctc

SEQ ID NO: 475777 - DNA, 14 bp, Homo sapiens
cctctcccaaataa

SEQ ID NO: 475778 - DNA, 12 bp, Homo sapiens
cctctcctcgtc

SEQ ID NO: 475779 - DNA, 21 bp, Homo sapiens
cctctcctcgtccggcctgca

SEQ ID NO: 475780 - DNA, 14 bp, Homo sapiens
cctctcgagcccag

SEQ ID NO: 475781 - DNA, 15 bp, Homo sapiens
cctctcgagcccaga

SEQ ID NO: 475782 - DNA, 16 bp, Homo sapiens
cctctcgagcccagat

SEQ ID NO: 475783 - DNA, 20 bp, Homo sapiens
cctctctctccctccactcc

SEQ ID NO: 475784 - DNA, 18 bp, Homo sapiens
cctctcttaccccgtccc

SEQ ID NO: 475785 - DNA, 11 bp, Homo sapiens
cctctgaaaat

SEQ ID NO: 475786 - DNA, 18 bp, Homo sapiens
cctctgcagcctgagctc

SEQ ID NO: 475787 - DNA, 11 bp, Homo sapiens
cctctgccccc

SEQ ID NO: 475788 - DNA, 21 bp, Homo sapiens
cctctgccccctcccccgcag

SEQ ID NO: 475789 - DNA, 14 bp, Homo sapiens
cctctgccttggac

SEQ ID NO: 475790 - DNA, 15 bp, Homo sapiens
cctctgccttggaca

SEQ ID NO: 475791 - DNA, 19 bp, Homo sapiens
cctctgcctttgagcttct

SEQ ID NO: 475792 - DNA, 22 bp, Homo sapiens
cctctgcctttgagcttctcct

SEQ ID NO: 475793 - DNA, 19 bp, Homo sapiens
cctctgctatgtctgtgat

SEQ ID NO: 475794 - DNA, 20 bp, Homo sapiens
cctctgctatgtctgtgatg

SEQ ID NO: 475795 - DNA, 16 bp, Homo sapiens
ccttaccaataataag

SEQ ID NO: 475796 - DNA, 14 bp, Homo sapiens
ccttagaacctttc

SEQ ID NO: 475797 - DNA, 16 bp, Homo sapiens
ccttagaacctttctt

SEQ ID NO: 475798 - DNA, 18 bp, Homo sapiens
ccttagaacctttcttac

SEQ ID NO: 475799 - DNA, 18 bp, Homo sapiens
ccttcactccctgtcata

SEQ ID NO: 475800 - DNA, 14 bp, Homo sapiens
ccttcaggttcctc

SEQ ID NO: 475801 - DNA, 19 bp, Homo sapiens
ccttcaggttcctcctagg

SEQ ID NO: 475802 - DNA, 20 bp, Homo sapiens
ccttcaggttcctcctaggc

SEQ ID NO: 475803 - DNA, 22 bp, Homo sapiens
ccttcaggttcctcctaggcgc

SEQ ID NO: 475804 - DNA, 21 bp, Homo sapiens
ccttccacttcagggttctaa

SEQ ID NO: 475805 - DNA, 15 bp, Homo sapiens
ccttccatcctgagg

SEQ ID NO: 475806 - DNA, 16 bp, Homo sapiens
ccttccatcctgagga

SEQ ID NO: 475807 - DNA, 18 bp, Homo sapiens
ccttccatcctgaggacc

SEQ ID NO: 475808 - DNA, 22 bp, Homo sapiens
ccttcccaacgtactcctcaga

SEQ ID NO: 475809 - DNA, 12 bp, Homo sapiens
ccttccccactc

SEQ ID NO: 475810 - DNA, 14 bp, Homo sapiens
ccttccccactccc

SEQ ID NO: 475811 - DNA, 19 bp, Homo sapiens
ccttccccctccaatccca

SEQ ID NO: 475812 - DNA, 13 bp, Homo sapiens
ccttcccctgcgc

SEQ ID NO: 475813 - DNA, 17 bp, Homo sapiens
ccttcccctgcgccctc

SEQ ID NO: 475814 - DNA, 20 bp, Homo sapiens
ccttccctagttctttgcat

SEQ ID NO: 475815 - DNA, 13 bp, Homo sapiens
ccttccctccaaa

SEQ ID NO: 475816 - DNA, 15 bp, Homo sapiens
ccttcctctccactg

SEQ ID NO: 475817 - DNA, 16 bp, Homo sapiens
ccttcctctccactgc

SEQ ID NO: 475818 - DNA, 13 bp, Homo sapiens
ccttcctgtcctg

SEQ ID NO: 475819 - DNA, 15 bp, Homo sapiens
ccttcgatacaccgg

SEQ ID NO: 475820 - DNA, 12 bp, Homo sapiens
ccttcgcctttg

SEQ ID NO: 475821 - DNA, 17 bp, Homo sapiens
ccttctcccctccagac

SEQ ID NO: 475822 - DNA, 14 bp, Homo sapiens
ccttctgtggctca

SEQ ID NO: 475823 - DNA, 12 bp, Homo sapiens
ccttctgtgtca

SEQ ID NO: 475824 - DNA, 19 bp, Homo sapiens
ccttctgttttccaaagga

SEQ ID NO: 475825 - DNA, 23 bp, Homo sapiens
ccttcttcaaacaggaatttctg

SEQ ID NO: 475826 - DNA, 13 bp, Homo sapiens
cctttccacccag

SEQ ID NO: 475827 - DNA, 19 bp, Homo sapiens
cctttccacccagaccctc

SEQ ID NO: 475828 - DNA, 13 bp, Homo sapiens
cctttcccacagt

SEQ ID NO: 475829 - DNA, 14 bp, Homo sapiens
cctttcccacagtc

SEQ ID NO: 475830 - DNA, 22 bp, Homo sapiens
cctttcccacccactagccctc

SEQ ID NO: 475831 - DNA, 13 bp, Homo sapiens
cctttccctgcat

SEQ ID NO: 475832 - DNA, 14 bp, Homo sapiens
cctttgacctgacg

SEQ ID NO: 475833 - DNA, 15 bp, Homo sapiens
cctttgtcaacttca

SEQ ID NO: 475834 - DNA, 16 bp, Homo sapiens
cctttgtcaacttcag

SEQ ID NO: 475835 - DNA, 18 bp, Homo sapiens
cctttgtggactttattt

SEQ ID NO: 475836 - DNA, 16 bp, Homo sapiens
cgacctacatctgaaa

SEQ ID NO: 475837 - DNA, 20 bp, Homo sapiens
cgactctgctgctcatggga

SEQ ID NO: 475838 - DNA, 23 bp, Homo sapiens
cgacttgggacggaagtggcctg

SEQ ID NO: 475839 - DNA, 12 bp, Homo sapiens
cgagagggctga

SEQ ID NO: 475840 - DNA, 17 bp, Homo sapiens
cgagagggctgagcccc

SEQ ID NO: 475841 - DNA, 19 bp, Homo sapiens
cgagagggctgagcccctc

SEQ ID NO: 475842 - DNA, 20 bp, Homo sapiens
cgagagggctgagcccctcc

SEQ ID NO: 475843 - DNA, 17 bp, Homo sapiens
cgagcgcgtgccttccc

SEQ ID NO: 475844 - DNA, 19 bp, Homo sapiens
cgaggcagaatggtgggct

SEQ ID NO: 475845 - DNA, 16 bp, Homo sapiens
cgaggcccccctctgc

SEQ ID NO: 475846 - DNA, 20 bp, Homo sapiens
cgaggcccccctctgccttt

SEQ ID NO: 475847 - DNA, 14 bp, Homo sapiens
cgagtccccccacc

SEQ ID NO: 475848 - DNA, 18 bp, Homo sapiens
cgagtccccccacccctc

SEQ ID NO: 475849 - DNA, 19 bp, Homo sapiens
cgagtccccccacccctcc

SEQ ID NO: 475850 - DNA, 18 bp, Homo sapiens
cgatacaccgggcctgga

SEQ ID NO: 475851 - DNA, 20 bp, Homo sapiens
cgatacaccgggcctggaga

SEQ ID NO: 475852 - DNA, 21 bp, Homo sapiens
cgatacaccgggcctggagaa

SEQ ID NO: 475853 - DNA, 12 bp, Homo sapiens
cgatcttccccc

SEQ ID NO: 475854 - DNA, 15 bp, Homo sapiens
cgatttcctaagctg

SEQ ID NO: 475855 - DNA, 14 bp, Homo sapiens
cgcaccgcccaacc

SEQ ID NO: 475856 - DNA, 19 bp, Homo sapiens
cgcagagccccggagcacc

SEQ ID NO: 475857 - DNA, 12 bp, Homo sapiens
cgcagccctctc

SEQ ID NO: 475858 - DNA, 14 bp, Homo sapiens
cgcagccctctcca

SEQ ID NO: 475859 - DNA, 19 bp, Homo sapiens
cgcagccctctccacccag

SEQ ID NO: 475860 - DNA, 21 bp, Homo sapiens
cgcagccctctccacccagag

SEQ ID NO: 475861 - DNA, 15 bp, Homo sapiens
cgcagccctgctttg

SEQ ID NO: 475862 - DNA, 16 bp, Homo sapiens
cgcagccgcgctctgc

SEQ ID NO: 475863 - DNA, 19 bp, Homo sapiens
cgcagccgcgctctgcccc

SEQ ID NO: 475864 - DNA, 20 bp, Homo sapiens
cgcagggcgctccggcagag

SEQ ID NO: 475865 - DNA, 22 bp, Homo sapiens
cgcatagtgtgctcggacacag

SEQ ID NO: 475866 - DNA, 13 bp, Homo sapiens
cgcatccaccgcc

SEQ ID NO: 475867 - DNA, 21 bp, Homo sapiens
cgcatccaccgccaccccact

SEQ ID NO: 475868 - DNA, 18 bp, Homo sapiens
cgccaccccactgagagc

SEQ ID NO: 475869 - DNA, 20 bp, Homo sapiens
cgccaccttgtacagaacca

SEQ ID NO: 475870 - DNA, 13 bp, Homo sapiens
cgcccacccacac

SEQ ID NO: 475871 - DNA, 14 bp, Homo sapiens
cgcccacccacacc

SEQ ID NO: 475872 - DNA, 15 bp, Homo sapiens
cgcccacccacaccc

SEQ ID NO: 475873 - DNA, 10 bp, Homo sapiens
cgcccacccc

SEQ ID NO: 475874 - DNA, 14 bp, Homo sapiens
cgcccaccccgctg

SEQ ID NO: 475875 - DNA, 18 bp, Homo sapiens
cgcccaccccgctgcctg

SEQ ID NO: 475876 - DNA, 19 bp, Homo sapiens
cgcccaccccgctgcctgg

SEQ ID NO: 475877 - DNA, 20 bp, Homo sapiens
cgcccaccccgctgcctggc

SEQ ID NO: 475878 - DNA, 17 bp, Homo sapiens
cgccccaaccctcggag

SEQ ID NO: 475879 - DNA, 14 bp, Homo sapiens
cgccccagagactg

SEQ ID NO: 475880 - DNA, 18 bp, Homo sapiens
cgccccagagactgccca

SEQ ID NO: 475881 - DNA, 20 bp, Homo sapiens
cgccccagagactgcccacc

SEQ ID NO: 475882 - DNA, 13 bp, Homo sapiens
cgccccttccccc

SEQ ID NO: 475883 - DNA, 12 bp, Homo sapiens
cgcccgcccacc

SEQ ID NO: 475884 - DNA, 13 bp, Homo sapiens
cgcccgcccaccc

SEQ ID NO: 475885 - DNA, 13 bp, Homo sapiens
cgcccgcccccgc

SEQ ID NO: 475886 - DNA, 15 bp, Homo sapiens
cgcccgccctcctct

SEQ ID NO: 475887 - DNA, 16 bp, Homo sapiens
cgcccgccctcctctg

SEQ ID NO: 475888 - DNA, 22 bp, Homo sapiens
cgcccgccctcctctgccccct

SEQ ID NO: 475889 - DNA, 16 bp, Homo sapiens
cgcccgccggttggcc

SEQ ID NO: 475890 - DNA, 13 bp, Homo sapiens
cgccctccctccc

SEQ ID NO: 475891 - DNA, 23 bp, Homo sapiens
cgccctcctctgccccctccccc

SEQ ID NO: 475892 - DNA, 15 bp, Homo sapiens
cgccctgggctgtct

SEQ ID NO: 475893 - DNA, 15 bp, Homo sapiens
ctatctgcaaatagt

SEQ ID NO: 475894 - DNA, 20 bp, Homo sapiens
ctatctgcaaatagtttcaa

SEQ ID NO: 475895 - DNA, 16 bp, Homo sapiens
ctatggattcacttct

SEQ ID NO: 475896 - DNA, 17 bp, Homo sapiens
ctatggattcacttcta

SEQ ID NO: 475897 - DNA, 20 bp, Homo sapiens
ctatggattcacttctattt

SEQ ID NO: 475898 - DNA, 21 bp, Homo sapiens
ctatgggagattaaaaccaga

SEQ ID NO: 475899 - DNA, 17 bp, Homo sapiens
ctatggtatgctggcca

SEQ ID NO: 475900 - DNA, 19 bp, Homo sapiens
ctatggtatgctggccagc

SEQ ID NO: 475901 - DNA, 20 bp, Homo sapiens
ctatggtatgctggccagca

SEQ ID NO: 475902 - DNA, 22 bp, Homo sapiens
ctatggtatgctggccagcacc

SEQ ID NO: 475903 - DNA, 22 bp, Homo sapiens
ctattatctgggttttagaaat

SEQ ID NO: 475904 - DNA, 14 bp, Homo sapiens
ctattctattgcag

SEQ ID NO: 475905 - DNA, 18 bp, Homo sapiens
ctattgcagttatagaaa

SEQ ID NO: 475906 - DNA, 16 bp, Homo sapiens
ctattgtagcatttct

SEQ ID NO: 475907 - DNA, 14 bp, Homo sapiens
ctattgtttatagg

SEQ ID NO: 475908 - DNA, 11 bp, Homo sapiens
ctatttaagcc

SEQ ID NO: 475909 - DNA, 12 bp, Homo sapiens
ctatttaagccc

SEQ ID NO: 475910 - DNA, 11 bp, Homo sapiens
ctatttatctg

SEQ ID NO: 475911 - DNA, 21 bp, Homo sapiens
ctatttcaccatgttgccaat

SEQ ID NO: 475912 - DNA, 18 bp, Homo sapiens
ctcaacatttcagtgttt

SEQ ID NO: 475913 - DNA, 13 bp, Homo sapiens
ctcaacctctcag

SEQ ID NO: 475914 - DNA, 19 bp, Homo sapiens
ctcaagagggcactggtgg

SEQ ID NO: 475915 - DNA, 18 bp, Homo sapiens
ctcaagccaggagaccct

SEQ ID NO: 475916 - DNA, 22 bp, Homo sapiens
ctcaagccaggagaccctgtct

SEQ ID NO: 475917 - DNA, 14 bp, Homo sapiens
ctcaataaaggtca

SEQ ID NO: 475918 - DNA, 23 bp, Homo sapiens
ctcacaaaaggctggatgtgctt

SEQ ID NO: 475919 - DNA, 21 bp, Homo sapiens
ctcaccaaaatatagttaatt

SEQ ID NO: 475920 - DNA, 17 bp, Homo sapiens
ctcaccttcgcctttgc

SEQ ID NO: 475921 - DNA, 16 bp, Homo sapiens
ctcacgctgacagcct

SEQ ID NO: 475922 - DNA, 20 bp, Homo sapiens
ctcacgctgacagcctccta

SEQ ID NO: 475923 - DNA, 20 bp, Homo sapiens
ctcactatggtatgctggcc

SEQ ID NO: 475924 - DNA, 22 bp, Homo sapiens
ctcactatggtatgctggccag

SEQ ID NO: 475925 - DNA, 24 bp, Homo sapiens
ctcactatggtatgctggccagca

SEQ ID NO: 475926 - DNA, 16 bp, Homo sapiens
ctcactccactcccct

SEQ ID NO: 475927 - DNA, 21 bp, Homo sapiens
ctcactccctttgtggacttt

SEQ ID NO: 475928 - DNA, 13 bp, Homo sapiens
ctcactcctacct

SEQ ID NO: 475929 - DNA, 17 bp, Homo sapiens
ctcactcctacctggta

SEQ ID NO: 475930 - DNA, 12 bp, Homo sapiens
ctcactctgtca

SEQ ID NO: 475931 - DNA, 13 bp, Homo sapiens
ctcactgccctcc

SEQ ID NO: 475932 - DNA, 21 bp, Homo sapiens
ctcactggtgcatttaaaatg

SEQ ID NO: 475933 - DNA, 17 bp, Homo sapiens
ctcagacgggctgagag

SEQ ID NO: 475934 - DNA, 15 bp, Homo sapiens
ctcagagccacccct

SEQ ID NO: 475935 - DNA, 19 bp, Homo sapiens
ctcagaggccgctctgggg

SEQ ID NO: 475936 - DNA, 20 bp, Homo sapiens
ctcagatgatctctccacgg

SEQ ID NO: 475937 - DNA, 23 bp, Homo sapiens
ctcagcaactgttagctgggaag

SEQ ID NO: 475938 - DNA, 16 bp, Homo sapiens
ctcagccctcagaaca

SEQ ID NO: 475939 - DNA, 14 bp, Homo sapiens
ctcagccctccctg

SEQ ID NO: 475940 - DNA, 19 bp, Homo sapiens
ctcagccctccctgcccct

SEQ ID NO: 475941 - DNA, 20 bp, Homo sapiens
ctcagccctccctgcccctc

SEQ ID NO: 475942 - DNA, 21 bp, Homo sapiens
ctcagccctccctgcccctcc

SEQ ID NO: 475943 - DNA, 15 bp, Homo sapiens
ctcagctccactctg

SEQ ID NO: 475944 - DNA, 17 bp, Homo sapiens
ctcagctccactctgaa

SEQ ID NO: 475945 - DNA, 13 bp, Homo sapiens
ctcaggagaaggc

SEQ ID NO: 475946 - DNA, 19 bp, Homo sapiens
ctcaggagaaggcctgccc

SEQ ID NO: 475947 - DNA, 15 bp, Homo sapiens
ctcaggatgggaaga

SEQ ID NO: 475948 - DNA, 18 bp, Homo sapiens
ctcaggatgggaagaaaa

SEQ ID NO: 475949 - DNA, 21 bp, Homo sapiens
ctcagggtgctccctcctcag

SEQ ID NO: 475950 - DNA, 22 bp, Homo sapiens
ctcagggtgctccctcctcagt

SEQ ID NO: 475951 - DNA, 14 bp, Homo sapiens
ctcaggtgaataac

SEQ ID NO: 475952 - DNA, 15 bp, Homo sapiens
ctcagtacagggcag

SEQ ID NO: 475953 - DNA, 13 bp, Homo sapiens
ctcagtagaaagg

SEQ ID NO: 475954 - DNA, 23 bp, Homo sapiens
ctcagtaggtctgaaggcctcca

SEQ ID NO: 475955 - DNA, 20 bp, Homo sapiens
ctcagttaaaatgtctgttt

SEQ ID NO: 475956 - DNA, 19 bp, Homo sapiens
ctcattacagatttagttt

SEQ ID NO: 475957 - DNA, 22 bp, Homo sapiens
ctcattcttttcagcttgtttc

SEQ ID NO: 475958 - DNA, 14 bp, Homo sapiens
ctccaacagacacc

SEQ ID NO: 475959 - DNA, 18 bp, Homo sapiens
ctccaacagacaccctcc

SEQ ID NO: 475960 - DNA, 19 bp, Homo sapiens
ctccaacagacaccctcca

SEQ ID NO: 475961 - DNA, 13 bp, Homo sapiens
ctccacacctcca

SEQ ID NO: 475962 - DNA, 16 bp, Homo sapiens
ctccacacctccaccc

SEQ ID NO: 475963 - DNA, 13 bp, Homo sapiens
ctccacccagagg

SEQ ID NO: 475964 - DNA, 17 bp, Homo sapiens
ctccacccagaggtctc

SEQ ID NO: 475965 - DNA, 20 bp, Homo sapiens
ctccacccagaggtctccct

SEQ ID NO: 475966 - DNA, 14 bp, Homo sapiens
ctccacccctcaag

SEQ ID NO: 475967 - DNA, 21 bp, Homo sapiens
ctccacccctcaagccaggag

SEQ ID NO: 475968 - DNA, 14 bp, Homo sapiens
ctccacgcctcctg

SEQ ID NO: 475969 - DNA, 16 bp, Homo sapiens
ctccacgcctcctggc

SEQ ID NO: 475970 - DNA, 21 bp, Homo sapiens
ctccacggtagcacttgacct

SEQ ID NO: 475971 - DNA, 14 bp, Homo sapiens
ctccactcccctca

SEQ ID NO: 475972 - DNA, 17 bp, Homo sapiens
ctccactctgaggtctc

SEQ ID NO: 475973 - DNA, 11 bp, Homo sapiens
ctccactgcct

SEQ ID NO: 475974 - DNA, 13 bp, Homo sapiens
ctccactgccttc

SEQ ID NO: 475975 - DNA, 14 bp, Homo sapiens
ctccactgccttcg

SEQ ID NO: 475976 - DNA, 15 bp, Homo sapiens
ctccagacattgtat

SEQ ID NO: 475977 - DNA, 17 bp, Homo sapiens
ctccagacattgtattt

SEQ ID NO: 475978 - DNA, 15 bp, Homo sapiens
ctccagacccctggc

SEQ ID NO: 475979 - DNA, 21 bp, Homo sapiens
ctccagacccctggcttttca

SEQ ID NO: 475980 - DNA, 21 bp, Homo sapiens
ctccagactcgagagggctga

SEQ ID NO: 475981 - DNA, 15 bp, Homo sapiens
ctccagagtaggtgg

SEQ ID NO: 475982 - DNA, 18 bp, Homo sapiens
ctccagattattttctat

SEQ ID NO: 475983 - DNA, 19 bp, Homo sapiens
ctccagattattttctata

SEQ ID NO: 475984 - DNA, 17 bp, Homo sapiens
ctccagcagtgctgggc

SEQ ID NO: 475985 - DNA, 20 bp, Homo sapiens
ctccagcagtgctgggccca

SEQ ID NO: 475986 - DNA, 22 bp, Homo sapiens
ctccagcagtgctgggcccagc

SEQ ID NO: 475987 - DNA, 18 bp, Homo sapiens
ctccaggaggactgttct

SEQ ID NO: 475988 - DNA, 12 bp, Homo sapiens
ctccaggctggg

SEQ ID NO: 475989 - DNA, 13 bp, Homo sapiens
ctccaggctgggg

SEQ ID NO: 475990 - DNA, 20 bp, Homo sapiens
ctggagtctgaaggagagga

SEQ ID NO: 475991 - DNA, 21 bp, Homo sapiens
ctggagtctgaaggagaggag

SEQ ID NO: 475992 - DNA, 14 bp, Homo sapiens
ctggatcctgcact

SEQ ID NO: 475993 - DNA, 12 bp, Homo sapiens
ctggattttctt

SEQ ID NO: 475994 - DNA, 16 bp, Homo sapiens
ctggcacagggcagtg

SEQ ID NO: 475995 - DNA, 13 bp, Homo sapiens
ctggcagccgtgc

SEQ ID NO: 475996 - DNA, 17 bp, Homo sapiens
ctggcagcgcctcccgc

SEQ ID NO: 475997 - DNA, 22 bp, Homo sapiens
ctggcagcgcctcccgccgcct

SEQ ID NO: 475998 - DNA, 15 bp, Homo sapiens
ctggcatagagcagc

SEQ ID NO: 475999 - DNA, 14 bp, Homo sapiens
ctggccacccttgg

SEQ ID NO: 476000 - DNA, 13 bp, Homo sapiens
ctggccagcaccc

SEQ ID NO: 476001 - DNA, 13 bp, Homo sapiens
ctggcccacccct

SEQ ID NO: 476002 - DNA, 14 bp, Homo sapiens
ctggccccaggcgg

SEQ ID NO: 476003 - DNA, 18 bp, Homo sapiens
ctggccccaggcggaggg

SEQ ID NO: 476004 - DNA, 19 bp, Homo sapiens
ctggccccaggcggagggg

SEQ ID NO: 476005 - DNA, 21 bp, Homo sapiens
ctggccccaggcggaggggct

SEQ ID NO: 476006 - DNA, 15 bp, Homo sapiens
ctggccctgccctcc

SEQ ID NO: 476007 - DNA, 16 bp, Homo sapiens
ctggccctgccctccc

SEQ ID NO: 476008 - DNA, 15 bp, Homo sapiens
ctggccggtccaccc

SEQ ID NO: 476009 - DNA, 14 bp, Homo sapiens
ctggcctatttaag

SEQ ID NO: 476010 - DNA, 17 bp, Homo sapiens
ctggccttggttcctcc

SEQ ID NO: 476011 - DNA, 19 bp, Homo sapiens
ctggccttggttcctccag

SEQ ID NO: 476012 - DNA, 21 bp, Homo sapiens
ctggccttggttcctccagca

SEQ ID NO: 476013 - DNA, 20 bp, Homo sapiens
ctggcgggcagcccctgctg

SEQ ID NO: 476014 - DNA, 18 bp, Homo sapiens
ctggctcccacaggccct

SEQ ID NO: 476015 - DNA, 21 bp, Homo sapiens
ctggctgtggcccctccttct

SEQ ID NO: 476016 - DNA, 22 bp, Homo sapiens
ctggcttttcactgctggctgc

SEQ ID NO: 476017 - DNA, 16 bp, Homo sapiens
ctgggatgggaccagg

SEQ ID NO: 476018 - DNA, 17 bp, Homo sapiens
ctgggatgggaccaggg

SEQ ID NO: 476019 - DNA, 17 bp, Homo sapiens
ctgggcagggccgcagg

SEQ ID NO: 476020 - DNA, 18 bp, Homo sapiens
ctgggcccagccggggtg

SEQ ID NO: 476021 - DNA, 19 bp, Homo sapiens
ctgggcccctccacgcctc

SEQ ID NO: 476022 - DNA, 14 bp, Homo sapiens
ctgggcccctggga

SEQ ID NO: 476023 - DNA, 18 bp, Homo sapiens
ctgggctgtctgtcacca

SEQ ID NO: 476024 - DNA, 15 bp, Homo sapiens
ctggggccctgggcc

SEQ ID NO: 476025 - DNA, 19 bp, Homo sapiens
ctggggccctgggcctcag

SEQ ID NO: 476026 - DNA, 20 bp, Homo sapiens
ctggggccctgggcctcagt

SEQ ID NO: 476027 - DNA, 13 bp, Homo sapiens
ctggggcctggcc

SEQ ID NO: 476028 - DNA, 18 bp, Homo sapiens
ctggggggttgcctcgag

SEQ ID NO: 476029 - DNA, 13 bp, Homo sapiens
ctgggggtggcag

SEQ ID NO: 476030 - DNA, 17 bp, Homo sapiens
ctgggggtggcaggcac

SEQ ID NO: 476031 - DNA, 20 bp, Homo sapiens
ctggggtctctgagcagtgg

SEQ ID NO: 476032 - DNA, 16 bp, Homo sapiens
ctggggtggggcttgg

SEQ ID NO: 476033 - DNA, 24 bp, Homo sapiens
ctggggtgggggtgggaggccagc

SEQ ID NO: 476034 - DNA, 17 bp, Homo sapiens
ctggggtggttggaggc

SEQ ID NO: 476035 - DNA, 15 bp, Homo sapiens
ctgggtcgcccctcc

SEQ ID NO: 476036 - DNA, 16 bp, Homo sapiens
ctgggtcgcccctcct

SEQ ID NO: 476037 - DNA, 22 bp, Homo sapiens
ctgggtcgcccctcctcgggcg

SEQ ID NO: 476038 - DNA, 14 bp, Homo sapiens
ctgggtttgggcag

SEQ ID NO: 476039 - DNA, 16 bp, Homo sapiens
ctgggtttgggcagtg

SEQ ID NO: 476040 - DNA, 17 bp, Homo sapiens
ctgggtttgggcagtgg

SEQ ID NO: 476041 - DNA, 21 bp, Homo sapiens
ctgggtttgggcagtggagag

SEQ ID NO: 476042 - DNA, 13 bp, Homo sapiens
ctggtaagttgga

SEQ ID NO: 476043 - DNA, 17 bp, Homo sapiens
ctggtccttctgacccc

SEQ ID NO: 476044 - DNA, 20 bp, Homo sapiens
ctggtccttctgaccccact

SEQ ID NO: 476045 - DNA, 12 bp, Homo sapiens
ctggtctggagc

SEQ ID NO: 476046 - DNA, 21 bp, Homo sapiens
ctggtctggagcccctatcct

SEQ ID NO: 476047 - DNA, 14 bp, Homo sapiens
ctggtgcgctgtgc

SEQ ID NO: 476048 - DNA, 18 bp, Homo sapiens
ctggtgcgctgtgctcca

SEQ ID NO: 476049 - DNA, 23 bp, Homo sapiens
ctggtgcgctgtgctccagcagt

SEQ ID NO: 476050 - DNA, 20 bp, Homo sapiens
ctggtgcgtgtggccctgtg

SEQ ID NO: 476051 - DNA, 13 bp, Homo sapiens
ctggtgctgccac

SEQ ID NO: 476052 - DNA, 13 bp, Homo sapiens
ctggtggcaccag

SEQ ID NO: 476053 - DNA, 14 bp, Homo sapiens
ctggtggcaccaga

SEQ ID NO: 476054 - DNA, 19 bp, Homo sapiens
ctggtggcaccagatgcaa

SEQ ID NO: 476055 - DNA, 22 bp, Homo sapiens
ctggtggcaccagatgcaacct

SEQ ID NO: 476056 - DNA, 16 bp, Homo sapiens
ctggtggcccctgcct

SEQ ID NO: 476057 - DNA, 21 bp, Homo sapiens
ctggtggcccgacagcctggc

SEQ ID NO: 476058 - DNA, 22 bp, Homo sapiens
ctggtggcccgacagcctggca

SEQ ID NO: 476059 - DNA, 13 bp, Homo sapiens
ctggtgtctagtt

SEQ ID NO: 476060 - DNA, 15 bp, Homo sapiens
ctggtttgtttctca

SEQ ID NO: 476061 - DNA, 21 bp, Homo sapiens
ctggtttgtttctcaagcgct

SEQ ID NO: 476062 - DNA, 20 bp, Homo sapiens
ctgtaaaatacatggtatct

SEQ ID NO: 476063 - DNA, 19 bp, Homo sapiens
ctgtaaatttaactgcata

SEQ ID NO: 476064 - DNA, 20 bp, Homo sapiens
ctgtaaatttaactgcatat

SEQ ID NO: 476065 - DNA, 20 bp, Homo sapiens
ctgtaatcacactctcttct

SEQ ID NO: 476066 - DNA, 16 bp, Homo sapiens
ctgtactcctcccagg

SEQ ID NO: 476067 - DNA, 22 bp, Homo sapiens
ctgtagtggcaaaaaagaacag

SEQ ID NO: 476068 - DNA, 16 bp, Homo sapiens
ctgtatatcagctcta

SEQ ID NO: 476069 - DNA, 23 bp, Homo sapiens
ctgtatccaagttatttgatctg

SEQ ID NO: 476070 - DNA, 21 bp, Homo sapiens
ctgtatctaaaaaataactgt

SEQ ID NO: 476071 - DNA, 19 bp, Homo sapiens
ctgtattgttacagctgaa

SEQ ID NO: 476072 - DNA, 20 bp, Homo sapiens
ctgtcagagaatatgaccta

SEQ ID NO: 476073 - DNA, 21 bp, Homo sapiens
ctgtcagccagccgccctggg

SEQ ID NO: 476074 - DNA, 16 bp, Homo sapiens
ctgtcatctctctggg

SEQ ID NO: 476075 - DNA, 17 bp, Homo sapiens
ctgtccacctgtgctgc

SEQ ID NO: 476076 - DNA, 21 bp, Homo sapiens
ctgtccacctgtgctgctgca

SEQ ID NO: 476077 - DNA, 22 bp, Homo sapiens
ctgtcccacaaaatatttctaa

SEQ ID NO: 476078 - DNA, 14 bp, Homo sapiens
ctgtcctccagggc

SEQ ID NO: 476079 - DNA, 16 bp, Homo sapiens
ctgtcctccagggcga

SEQ ID NO: 476080 - DNA, 15 bp, Homo sapiens
ctgtcctgctcacgt

SEQ ID NO: 476081 - DNA, 16 bp, Homo sapiens
ctgtcgccccaggccc

SEQ ID NO: 476082 - DNA, 21 bp, Homo sapiens
ctgtctcaagagggcactggt

SEQ ID NO: 476083 - DNA, 22 bp, Homo sapiens
ctgtctcaagagggcactggtg

SEQ ID NO: 476084 - DNA, 23 bp, Homo sapiens
ctgtctctccctaccctcttctc

SEQ ID NO: 476085 - DNA, 17 bp, Homo sapiens
ctgtctgagccctgccc

SEQ ID NO: 476086 - DNA, 11 bp, Homo sapiens
ctgtctgattc

SEQ ID NO: 476087 - DNA, 18 bp, Homo sapiens
gaaacgagatttgccaaa

SEQ ID NO: 476088 - DNA, 11 bp, Homo sapiens
gaaagagaaaa

SEQ ID NO: 476089 - DNA, 18 bp, Homo sapiens
gaaagatcccaagtcaaa

SEQ ID NO: 476090 - DNA, 14 bp, Homo sapiens
gaaagccctccccc

SEQ ID NO: 476091 - DNA, 15 bp, Homo sapiens
gaaagctatatatga

SEQ ID NO: 476092 - DNA, 20 bp, Homo sapiens
gaaagggcagcccctcccca

SEQ ID NO: 476093 - DNA, 18 bp, Homo sapiens
gaaagggtgtggcttgga

SEQ ID NO: 476094 - DNA, 22 bp, Homo sapiens
gaaagttctattatctgggttt

SEQ ID NO: 476095 - DNA, 16 bp, Homo sapiens
gaaatgtatcctgata

SEQ ID NO: 476096 - DNA, 16 bp, Homo sapiens
gaaattcttgcactgt

SEQ ID NO: 476097 - DNA, 17 bp, Homo sapiens
gaaattcttgcactgta

SEQ ID NO: 476098 - DNA, 14 bp, Homo sapiens
gaaattgtgccaaa

SEQ ID NO: 476099 - DNA, 15 bp, Homo sapiens
gaaattgtgccaaag

SEQ ID NO: 476100 - DNA, 20 bp, Homo sapiens
gaaattgtgccaaagatagc

SEQ ID NO: 476101 - DNA, 21 bp, Homo sapiens
gaaattgtgccaaagatagca

SEQ ID NO: 476102 - DNA, 15 bp, Homo sapiens
gaaattttatctctt

SEQ ID NO: 476103 - DNA, 13 bp, Homo sapiens
gaacaaagacaac

SEQ ID NO: 476104 - DNA, 23 bp, Homo sapiens
gaacaaatatgattctcctctcc

SEQ ID NO: 476105 - DNA, 18 bp, Homo sapiens
gaacagccaaagaaactc

SEQ ID NO: 476106 - DNA, 17 bp, Homo sapiens
gaacataggaattttgt

SEQ ID NO: 476107 - DNA, 16 bp, Homo sapiens
gaaccagcactcccag

SEQ ID NO: 476108 - DNA, 21 bp, Homo sapiens
gaaccagcactcccagggccc

SEQ ID NO: 476109 - DNA, 16 bp, Homo sapiens
gaacccccctccccaa

SEQ ID NO: 476110 - DNA, 22 bp, Homo sapiens
gaacctcgttgacatgcacagt

SEQ ID NO: 476111 - DNA, 15 bp, Homo sapiens
gaaccttccctccaa

SEQ ID NO: 476112 - DNA, 13 bp, Homo sapiens
gaacctttgtcaa

SEQ ID NO: 476113 - DNA, 17 bp, Homo sapiens
gaactcagccttaagaa

SEQ ID NO: 476114 - DNA, 21 bp, Homo sapiens
gaactcagccttaagaaagct

SEQ ID NO: 476115 - DNA, 21 bp, Homo sapiens
gaactcaggatgggaagaaaa

SEQ ID NO: 476116 - DNA, 18 bp, Homo sapiens
gaactgtcccacaaaata

SEQ ID NO: 476117 - DNA, 20 bp, Homo sapiens
gaactgtcccacaaaatatt

SEQ ID NO: 476118 - DNA, 17 bp, Homo sapiens
gaacttttaaactgcag

SEQ ID NO: 476119 - DNA, 19 bp, Homo sapiens
gaacttttaaactgcagtt

SEQ ID NO: 476120 - DNA, 13 bp, Homo sapiens
gaagaaaaaggaa

SEQ ID NO: 476121 - DNA, 21 bp, Homo sapiens
gaagaaaactatcctgcgggt

SEQ ID NO: 476122 - DNA, 12 bp, Homo sapiens
gaagaaagggag

SEQ ID NO: 476123 - DNA, 19 bp, Homo sapiens
gaagaactagccatgtgct

SEQ ID NO: 476124 - DNA, 20 bp, Homo sapiens
gaagatgttaattacttttg

SEQ ID NO: 476125 - DNA, 13 bp, Homo sapiens
gaagattctaaaa

SEQ ID NO: 476126 - DNA, 21 bp, Homo sapiens
gaagattctaaaacattcttt

SEQ ID NO: 476127 - DNA, 16 bp, Homo sapiens
gaagcaccccaccaca

SEQ ID NO: 476128 - DNA, 12 bp, Homo sapiens
gaagcccacccg

SEQ ID NO: 476129 - DNA, 21 bp, Homo sapiens
gaagcccacccgccccagaga

SEQ ID NO: 476130 - DNA, 22 bp, Homo sapiens
gaagcccacccgccccagagac

SEQ ID NO: 476131 - DNA, 13 bp, Homo sapiens
gaagcccaggagg

SEQ ID NO: 476132 - DNA, 14 bp, Homo sapiens
gaagcccaggagga

SEQ ID NO: 476133 - DNA, 20 bp, Homo sapiens
gaagcccaggaggacctggg

SEQ ID NO: 476134 - DNA, 13 bp, Homo sapiens
gaaggactacagg

SEQ ID NO: 476135 - DNA, 12 bp, Homo sapiens
gaaggcctgagg

SEQ ID NO: 476136 - DNA, 17 bp, Homo sapiens
gaaggcctgagggaagc

SEQ ID NO: 476137 - DNA, 22 bp, Homo sapiens
gaaggcctgagggaagcccacc

SEQ ID NO: 476138 - DNA, 19 bp, Homo sapiens
gaaggcctgccccccttcc

SEQ ID NO: 476139 - DNA, 13 bp, Homo sapiens
gaaggctgcccct

SEQ ID NO: 476140 - DNA, 18 bp, Homo sapiens
gaagggaaatcaatttaa

SEQ ID NO: 476141 - DNA, 15 bp, Homo sapiens
gaagtcccttcctgt

SEQ ID NO: 476142 - DNA, 18 bp, Homo sapiens
gaagtcccttcctgtcct

SEQ ID NO: 476143 - DNA, 19 bp, Homo sapiens
gaagtcccttcctgtcctg

SEQ ID NO: 476144 - DNA, 19 bp, Homo sapiens
gaagtctccccgcagccct

SEQ ID NO: 476145 - DNA, 20 bp, Homo sapiens
gaagtctccccgcagccctc

SEQ ID NO: 476146 - DNA, 21 bp, Homo sapiens
gaagtctccccgcagccctct

SEQ ID NO: 476147 - DNA, 12 bp, Homo sapiens
gaagtggaatgg

SEQ ID NO: 476148 - DNA, 19 bp, Homo sapiens
gaagtgggattcaggaatg

SEQ ID NO: 476149 - DNA, 18 bp, Homo sapiens
gaataaataaagaagaaa

SEQ ID NO: 476150 - DNA, 14 bp, Homo sapiens
gaataatttcttac

SEQ ID NO: 476151 - DNA, 15 bp, Homo sapiens
gaatacttcctgaaa

SEQ ID NO: 476152 - DNA, 17 bp, Homo sapiens
gaatcaatctggcttct

SEQ ID NO: 476153 - DNA, 17 bp, Homo sapiens
gaatccacctgcagtta

SEQ ID NO: 476154 - DNA, 23 bp, Homo sapiens
gaatgagtaaataaactcttcaa

SEQ ID NO: 476155 - DNA, 11 bp, Homo sapiens
gaatggggctt

SEQ ID NO: 476156 - DNA, 17 bp, Homo sapiens
gaatggggcttccatgg

SEQ ID NO: 476157 - DNA, 15 bp, Homo sapiens
gaatggtgggctcca

SEQ ID NO: 476158 - DNA, 18 bp, Homo sapiens
gaatggtgggctccagag

SEQ ID NO: 476159 - DNA, 21 bp, Homo sapiens
gaatgtttggcaacctttgtg

SEQ ID NO: 476160 - DNA, 15 bp, Homo sapiens
gaattaggtaatgga

SEQ ID NO: 476161 - DNA, 18 bp, Homo sapiens
gaattcataaaaataacc

SEQ ID NO: 476162 - DNA, 23 bp, Homo sapiens
gaattgaaccgtcaatgtgaaat

SEQ ID NO: 476163 - DNA, 20 bp, Homo sapiens
gaatttctttgtcattcaag

SEQ ID NO: 476164 - DNA, 13 bp, Homo sapiens
gaattttaaaatg

SEQ ID NO: 476165 - DNA, 19 bp, Homo sapiens
gaattttaaaatgcaaata

SEQ ID NO: 476166 - DNA, 22 bp, Homo sapiens
gaattttttttttaaatgattc

SEQ ID NO: 476167 - DNA, 16 bp, Homo sapiens
gacacagtattgactt

SEQ ID NO: 476168 - DNA, 15 bp, Homo sapiens
gacacagttttgtct

SEQ ID NO: 476169 - DNA, 15 bp, Homo sapiens
gacacataaatctgt

SEQ ID NO: 476170 - DNA, 20 bp, Homo sapiens
gacacataaatctgtctgat

SEQ ID NO: 476171 - DNA, 19 bp, Homo sapiens
gacaccctccactctgagg

SEQ ID NO: 476172 - DNA, 21 bp, Homo sapiens
gacaccctccactctgaggtc

SEQ ID NO: 476173 - DNA, 19 bp, Homo sapiens
gacagaaccaacgggtctg

SEQ ID NO: 476174 - DNA, 23 bp, Homo sapiens
gacagacggacgggacagcggcc

SEQ ID NO: 476175 - DNA, 15 bp, Homo sapiens
gacagagatcagaat

SEQ ID NO: 476176 - DNA, 18 bp, Homo sapiens
gacagatcttgagcaagg

SEQ ID NO: 476177 - DNA, 12 bp, Homo sapiens
gacagcctggca

SEQ ID NO: 476178 - DNA, 16 bp, Homo sapiens
gacagcggcccggccc

SEQ ID NO: 476179 - DNA, 21 bp, Homo sapiens
gacagcggcccggcccacgca

SEQ ID NO: 476180 - DNA, 15 bp, Homo sapiens
gacagggcatggcca

SEQ ID NO: 476181 - DNA, 20 bp, Homo sapiens
gacagggcatggccaggtgg

SEQ ID NO: 476182 - DNA, 18 bp, Homo sapiens
gacagtgggggtgcctgg

SEQ ID NO: 476183 - DNA, 23 bp, Homo sapiens
gacataagctggtatcagtggtt

SEQ ID NO: 476184 - DNA, 20 bp, Homo sapiens
gcagcaccctcccccgcagc

SEQ ID NO: 476185 - DNA, 21 bp, Homo sapiens
gcagcagtaccatcccactga

SEQ ID NO: 476186 - DNA, 18 bp, Homo sapiens
gcagccccatccttcccg

SEQ ID NO: 476187 - DNA, 11 bp, Homo sapiens
gcagcccctgc

SEQ ID NO: 476188 - DNA, 15 bp, Homo sapiens
gcagcccctgctgga

SEQ ID NO: 476189 - DNA, 18 bp, Homo sapiens
gcagcccctgctggacca

SEQ ID NO: 476190 - DNA, 14 bp, Homo sapiens
gcagccctctccac

SEQ ID NO: 476191 - DNA, 17 bp, Homo sapiens
gcagccctctccaccca

SEQ ID NO: 476192 - DNA, 22 bp, Homo sapiens
gcagccctctccacccagaggt

SEQ ID NO: 476193 - DNA, 23 bp, Homo sapiens
gcagccctctccacccagaggtc

SEQ ID NO: 476194 - DNA, 24 bp, Homo sapiens
gcagccctgctttgggctgccctg

SEQ ID NO: 476195 - DNA, 15 bp, Homo sapiens
gcagccgcgctctgc

SEQ ID NO: 476196 - DNA, 17 bp, Homo sapiens
gcagccgtgccttcagc

SEQ ID NO: 476197 - DNA, 18 bp, Homo sapiens
gcagccgtgccttcagct

SEQ ID NO: 476198 - DNA, 11 bp, Homo sapiens
gcagcctgagc

SEQ ID NO: 476199 - DNA, 13 bp, Homo sapiens
gcagcctgagctc

SEQ ID NO: 476200 - DNA, 17 bp, Homo sapiens
gcagcctgagctccacc

SEQ ID NO: 476201 - DNA, 22 bp, Homo sapiens
gcagcctgagctccaccctccc

SEQ ID NO: 476202 - DNA, 17 bp, Homo sapiens
gcagcgcctcccgccgc

SEQ ID NO: 476203 - DNA, 13 bp, Homo sapiens
gcagcttcaaaac

SEQ ID NO: 476204 - DNA, 17 bp, Homo sapiens
gcaggaagagatgctct

SEQ ID NO: 476205 - DNA, 21 bp, Homo sapiens
gcaggactaacaactgggaaa

SEQ ID NO: 476206 - DNA, 16 bp, Homo sapiens
gcaggcacacagcagc

SEQ ID NO: 476207 - DNA, 17 bp, Homo sapiens
gcaggcgcgcaccgccc

SEQ ID NO: 476208 - DNA, 22 bp, Homo sapiens
gcaggcggcctttgttgctcag

SEQ ID NO: 476209 - DNA, 14 bp, Homo sapiens
gcagggccctgggg

SEQ ID NO: 476210 - DNA, 15 bp, Homo sapiens
gcagggccctggggt

SEQ ID NO: 476211 - DNA, 14 bp, Homo sapiens
gcagggccgcaggg

SEQ ID NO: 476212 - DNA, 18 bp, Homo sapiens
gcagggccgcagggcgct

SEQ ID NO: 476213 - DNA, 17 bp, Homo sapiens
gcagggcgctccggcag

SEQ ID NO: 476214 - DNA, 20 bp, Homo sapiens
gcagggcgctccggcagagg

SEQ ID NO: 476215 - DNA, 14 bp, Homo sapiens
gcaggggggttggg

SEQ ID NO: 476216 - DNA, 23 bp, Homo sapiens
gcaggggggttgggttccagaca

SEQ ID NO: 476217 - DNA, 23 bp, Homo sapiens
gcagggttctagaaggggcgagg

SEQ ID NO: 476218 - DNA, 15 bp, Homo sapiens
gcaggtcctgcccat

SEQ ID NO: 476219 - DNA, 15 bp, Homo sapiens
gcagtacttgctcaa

SEQ ID NO: 476220 - DNA, 12 bp, Homo sapiens
gcagtgctgggc

SEQ ID NO: 476221 - DNA, 14 bp, Homo sapiens
gcagtgctgggccc

SEQ ID NO: 476222 - DNA, 21 bp, Homo sapiens
gcagtgctgggcccagccggg

SEQ ID NO: 476223 - DNA, 13 bp, Homo sapiens
gcagtggagaggg

SEQ ID NO: 476224 - DNA, 24 bp, Homo sapiens
gcagtggagaggggacttggatag

SEQ ID NO: 476225 - DNA, 21 bp, Homo sapiens
gcagtgggacagggcatggcc

SEQ ID NO: 476226 - DNA, 13 bp, Homo sapiens
gcataacacacta

SEQ ID NO: 476227 - DNA, 15 bp, Homo sapiens
gcatacaataaaaga

SEQ ID NO: 476228 - DNA, 22 bp, Homo sapiens
gcatacaataaaagagctttat

SEQ ID NO: 476229 - DNA, 21 bp, Homo sapiens
gcatacacccccacctcctgc

SEQ ID NO: 476230 - DNA, 16 bp, Homo sapiens
gcatagacaagtgttt

SEQ ID NO: 476231 - DNA, 16 bp, Homo sapiens
gcatagccattcattt

SEQ ID NO: 476232 - DNA, 21 bp, Homo sapiens
gcatagggtttggaagaaagg

SEQ ID NO: 476233 - DNA, 16 bp, Homo sapiens
gcatataaatgtttat

SEQ ID NO: 476234 - DNA, 13 bp, Homo sapiens
gcatccaccgcca

SEQ ID NO: 476235 - DNA, 18 bp, Homo sapiens
gcatcccttggcccctct

SEQ ID NO: 476236 - DNA, 20 bp, Homo sapiens
gcatcccttggcccctctct

SEQ ID NO: 476237 - DNA, 14 bp, Homo sapiens
gcatctcagcccac

SEQ ID NO: 476238 - DNA, 14 bp, Homo sapiens
gcatgcaagctcag

SEQ ID NO: 476239 - DNA, 15 bp, Homo sapiens
gcatgcaagctcagg

SEQ ID NO: 476240 - DNA, 17 bp, Homo sapiens
gcatgcaggctgtgttt

SEQ ID NO: 476241 - DNA, 14 bp, Homo sapiens
gcatggccaggtgg

SEQ ID NO: 476242 - DNA, 13 bp, Homo sapiens
gcatgtctactgc

SEQ ID NO: 476243 - DNA, 17 bp, Homo sapiens
gcattatctctttctct

SEQ ID NO: 476244 - DNA, 18 bp, Homo sapiens
gcattatctctttctctc

SEQ ID NO: 476245 - DNA, 24 bp, Homo sapiens
gcattcaaaatagttctatttcta

SEQ ID NO: 476246 - DNA, 16 bp, Homo sapiens
gcattggggggccggg

SEQ ID NO: 476247 - DNA, 14 bp, Homo sapiens
gcatttaaaatgga

SEQ ID NO: 476248 - DNA, 15 bp, Homo sapiens
gcatttaaaatggac

SEQ ID NO: 476249 - DNA, 20 bp, Homo sapiens
gcatttcttgatgttgctta

SEQ ID NO: 476250 - DNA, 19 bp, Homo sapiens
gccaaaatgtcaattttta

SEQ ID NO: 476251 - DNA, 22 bp, Homo sapiens
gccaaaatgtcaatttttaact

SEQ ID NO: 476252 - DNA, 21 bp, Homo sapiens
gccaaacattcttattttaga

SEQ ID NO: 476253 - DNA, 19 bp, Homo sapiens
gccaatggagactgtctca

SEQ ID NO: 476254 - DNA, 18 bp, Homo sapiens
gccaatttcaaagaaaac

SEQ ID NO: 476255 - DNA, 13 bp, Homo sapiens
gccacagtggggc

SEQ ID NO: 476256 - DNA, 22 bp, Homo sapiens
gccacagtggggcccatggccc

SEQ ID NO: 476257 - DNA, 18 bp, Homo sapiens
gccaccttgtacagaacc

SEQ ID NO: 476258 - DNA, 15 bp, Homo sapiens
gccacgctgtcctct

SEQ ID NO: 476259 - DNA, 19 bp, Homo sapiens
gccacgctgtcctctcgag

SEQ ID NO: 476260 - DNA, 14 bp, Homo sapiens
gccagacagagatc

SEQ ID NO: 476261 - DNA, 11 bp, Homo sapiens
gccagagggac

SEQ ID NO: 476262 - DNA, 18 bp, Homo sapiens
gccagcaccctctcctgg

SEQ ID NO: 476263 - DNA, 21 bp, Homo sapiens
gccagcaccctctcctggggg

SEQ ID NO: 476264 - DNA, 10 bp, Homo sapiens
gccaggagac

SEQ ID NO: 476265 - DNA, 14 bp, Homo sapiens
gccaggagaccctg

SEQ ID NO: 476266 - DNA, 17 bp, Homo sapiens
gccaggccaactgcccc

SEQ ID NO: 476267 - DNA, 19 bp, Homo sapiens
gccagggacccccgaggcc

SEQ ID NO: 476268 - DNA, 21 bp, Homo sapiens
gccagggacccccgaggcccc

SEQ ID NO: 476269 - DNA, 15 bp, Homo sapiens
gccagggttccagac

SEQ ID NO: 476270 - DNA, 16 bp, Homo sapiens
gccagggttccagaca

SEQ ID NO: 476271 - DNA, 19 bp, Homo sapiens
gccagggtttacccagtgg

SEQ ID NO: 476272 - DNA, 18 bp, Homo sapiens
gccaggtggccactccag

SEQ ID NO: 476273 - DNA, 12 bp, Homo sapiens
gccatccctggg

SEQ ID NO: 476274 - DNA, 16 bp, Homo sapiens
gccatccctgggcccc

SEQ ID NO: 476275 - DNA, 19 bp, Homo sapiens
gccatccctgggcccctcc

SEQ ID NO: 476276 - DNA, 18 bp, Homo sapiens
gccattttgtctggctgt

SEQ ID NO: 476277 - DNA, 14 bp, Homo sapiens
gcccaaataacagt

SEQ ID NO: 476278 - DNA, 17 bp, Homo sapiens
gcccaaataacagtggc

SEQ ID NO: 476279 - DNA, 13 bp, Homo sapiens
gcccaacccccac

SEQ ID NO: 476280 - DNA, 17 bp, Homo sapiens
gcccaacccccacctcc

SEQ ID NO: 476281 - DNA, 18 bp, Homo sapiens
gcccaacccccacctccc

SEQ ID NO: 476282 - DNA, 13 bp, Homo sapiens
gcgctctgggttt

SEQ ID NO: 476283 - DNA, 22 bp, Homo sapiens
gcgctggacgatagcttggagg

SEQ ID NO: 476284 - DNA, 11 bp, Homo sapiens
gcgctgtgctc

SEQ ID NO: 476285 - DNA, 12 bp, Homo sapiens
gcgctgtgctcc

SEQ ID NO: 476286 - DNA, 17 bp, Homo sapiens
gcgctgtgctccagcag

SEQ ID NO: 476287 - DNA, 20 bp, Homo sapiens
gcggaccggagcggctgagg

SEQ ID NO: 476288 - DNA, 12 bp, Homo sapiens
gcggcaccgccc

SEQ ID NO: 476289 - DNA, 16 bp, Homo sapiens
gcggcaccgcccaccc

SEQ ID NO: 476290 - DNA, 14 bp, Homo sapiens
gcggccagggaccc

SEQ ID NO: 476291 - DNA, 14 bp, Homo sapiens
gcggcccggcccac

SEQ ID NO: 476292 - DNA, 17 bp, Homo sapiens
gcggcccggcccacgca

SEQ ID NO: 476293 - DNA, 17 bp, Homo sapiens
gcggcccgtgcgcagcc

SEQ ID NO: 476294 - DNA, 20 bp, Homo sapiens
gcggcccgtgcgcagccgcg

SEQ ID NO: 476295 - DNA, 14 bp, Homo sapiens
gcggcggccaggga

SEQ ID NO: 476296 - DNA, 12 bp, Homo sapiens
gcgggcagcccc

SEQ ID NO: 476297 - DNA, 13 bp, Homo sapiens
gcgggcagcccct

SEQ ID NO: 476298 - DNA, 22 bp, Homo sapiens
gcgggcagcccctgctggacca

SEQ ID NO: 476299 - DNA, 17 bp, Homo sapiens
gcgggggctaactggcc

SEQ ID NO: 476300 - DNA, 22 bp, Homo sapiens
gcgggggctaactggccccagg

SEQ ID NO: 476301 - DNA, 23 bp, Homo sapiens
gcgggggctaactggccccaggc

SEQ ID NO: 476302 - DNA, 18 bp, Homo sapiens
gcgtgaccggcccgccac

SEQ ID NO: 476303 - DNA, 24 bp, Homo sapiens
gcgtgacttcagactctctcctct

SEQ ID NO: 476304 - DNA, 20 bp, Homo sapiens
gcgtgcttgcatgtgctgca

SEQ ID NO: 476305 - DNA, 16 bp, Homo sapiens
gcgtgggatccagaga

SEQ ID NO: 476306 - DNA, 18 bp, Homo sapiens
gctaaattacaattgtca

SEQ ID NO: 476307 - DNA, 13 bp, Homo sapiens
gctaacaagtagc

SEQ ID NO: 476308 - DNA, 17 bp, Homo sapiens
gctaagttgtcttacac

SEQ ID NO: 476309 - DNA, 17 bp, Homo sapiens
gctaatcagcattctca

SEQ ID NO: 476310 - DNA, 20 bp, Homo sapiens
gctaatgtaatcatttatct

SEQ ID NO: 476311 - DNA, 19 bp, Homo sapiens
gctagagcattctggggtg

SEQ ID NO: 476312 - DNA, 20 bp, Homo sapiens
gctagagcattctggggtgg

SEQ ID NO: 476313 - DNA, 18 bp, Homo sapiens
gctaggttaataggagga

SEQ ID NO: 476314 - DNA, 18 bp, Homo sapiens
gctagtgatacactgtat

SEQ ID NO: 476315 - DNA, 21 bp, Homo sapiens
gctatccacagaacctttgtc

SEQ ID NO: 476316 - DNA, 23 bp, Homo sapiens
gctatccacagaacctttgtcaa

SEQ ID NO: 476317 - DNA, 15 bp, Homo sapiens
gctatgtctgtgatg

SEQ ID NO: 476318 - DNA, 14 bp, Homo sapiens
gctcaataaaggtc

SEQ ID NO: 476319 - DNA, 19 bp, Homo sapiens
gctcacgctgacagcctcc

SEQ ID NO: 476320 - DNA, 24 bp, Homo sapiens
gctcacgctgacagcctcctaggc

SEQ ID NO: 476321 - DNA, 16 bp, Homo sapiens
gctcacgtctgtgagt

SEQ ID NO: 476322 - DNA, 13 bp, Homo sapiens
gctcagaggccgc

SEQ ID NO: 476323 - DNA, 15 bp, Homo sapiens
gctcagccctccctg

SEQ ID NO: 476324 - DNA, 17 bp, Homo sapiens
gctcagccctccctgcc

SEQ ID NO: 476325 - DNA, 12 bp, Homo sapiens
gctcagtacagg

SEQ ID NO: 476326 - DNA, 16 bp, Homo sapiens
gctcagtacagggcag

SEQ ID NO: 476327 - DNA, 17 bp, Homo sapiens
gctcagtacagggcagg

SEQ ID NO: 476328 - DNA, 17 bp, Homo sapiens
gctccaccctcccctct

SEQ ID NO: 476329 - DNA, 15 bp, Homo sapiens
gctccactctgaagt

SEQ ID NO: 476330 - DNA, 21 bp, Homo sapiens
gctccactctgaagtcccttc

SEQ ID NO: 476331 - DNA, 23 bp, Homo sapiens
gctccactctgaagtcccttcct

SEQ ID NO: 476332 - DNA, 11 bp, Homo sapiens
gctccagcagt

SEQ ID NO: 476333 - DNA, 17 bp, Homo sapiens
gctccagcagtgctggg

SEQ ID NO: 476334 - DNA, 21 bp, Homo sapiens
gctccagcagtgctgggccca

SEQ ID NO: 476335 - DNA, 22 bp, Homo sapiens
gctccagcagtgctgggcccag

SEQ ID NO: 476336 - DNA, 22 bp, Homo sapiens
gctcccacaggcccttcctctc

SEQ ID NO: 476337 - DNA, 13 bp, Homo sapiens
gctccccctgcca

SEQ ID NO: 476338 - DNA, 15 bp, Homo sapiens
gctccccctgccagc

SEQ ID NO: 476339 - DNA, 16 bp, Homo sapiens
gctccccctgccagca

SEQ ID NO: 476340 - DNA, 17 bp, Homo sapiens
gctccccctgccagcaa

SEQ ID NO: 476341 - DNA, 16 bp, Homo sapiens
gctccggcagaggcag

SEQ ID NO: 476342 - DNA, 17 bp, Homo sapiens
gctccggcagaggcagg

SEQ ID NO: 476343 - DNA, 21 bp, Homo sapiens
gctccggcagaggcagggccc

SEQ ID NO: 476344 - DNA, 14 bp, Homo sapiens
gctccgggtgcgtg

SEQ ID NO: 476345 - DNA, 22 bp, Homo sapiens
gctccgggtgcgtgaccggccc

SEQ ID NO: 476346 - DNA, 14 bp, Homo sapiens
gctcctcccggtgc

SEQ ID NO: 476347 - DNA, 16 bp, Homo sapiens
gctcctctgcagcctg

SEQ ID NO: 476348 - DNA, 18 bp, Homo sapiens
gctcctctgcagcctgag

SEQ ID NO: 476349 - DNA, 20 bp, Homo sapiens
gctcctctgcagcctgagct

SEQ ID NO: 476350 - DNA, 15 bp, Homo sapiens
gctcctctgccttgg

SEQ ID NO: 476351 - DNA, 20 bp, Homo sapiens
gctcctctgccttggacacc

SEQ ID NO: 476352 - DNA, 13 bp, Homo sapiens
gctcctgcatgca

SEQ ID NO: 476353 - DNA, 13 bp, Homo sapiens
gctcggacacagt

SEQ ID NO: 476354 - DNA, 20 bp, Homo sapiens
gctctacagctaatcagcat

SEQ ID NO: 476355 - DNA, 20 bp, Homo sapiens
gctctgccctccctccttcc

SEQ ID NO: 476356 - DNA, 21 bp, Homo sapiens
gctctggggggttgcctcgag

SEQ ID NO: 476357 - DNA, 17 bp, Homo sapiens
gctcttctcctttcaca

SEQ ID NO: 476358 - DNA, 23 bp, Homo sapiens
gctcttctcctttcacaaccttc

SEQ ID NO: 476359 - DNA, 22 bp, Homo sapiens
gctgaagtctccccgcagccct

SEQ ID NO: 476360 - DNA, 14 bp, Homo sapiens
gctgacagcctcct

SEQ ID NO: 476361 - DNA, 16 bp, Homo sapiens
gctgacagcctcctag

SEQ ID NO: 476362 - DNA, 18 bp, Homo sapiens
gctgacagcctcctaggc

SEQ ID NO: 476363 - DNA, 18 bp, Homo sapiens
gctgactgtactcctccc

SEQ ID NO: 476364 - DNA, 16 bp, Homo sapiens
gctgaggacggggcag

SEQ ID NO: 476365 - DNA, 20 bp, Homo sapiens
gctgaggacggggcagagct

SEQ ID NO: 476366 - DNA, 21 bp, Homo sapiens
gctgaggacggggcagagctg

SEQ ID NO: 476367 - DNA, 23 bp, Homo sapiens
gctgaggacggggcagagctgag

SEQ ID NO: 476368 - DNA, 15 bp, Homo sapiens
gctgagggcagggtt

SEQ ID NO: 476369 - DNA, 17 bp, Homo sapiens
gctgccacacttcaggc

SEQ ID NO: 476370 - DNA, 19 bp, Homo sapiens
gctgcccacgctcctgccc

SEQ ID NO: 476371 - DNA, 13 bp, Homo sapiens
gctgccctggtgc

SEQ ID NO: 476372 - DNA, 14 bp, Homo sapiens
gctgccctggtgct

SEQ ID NO: 476373 - DNA, 18 bp, Homo sapiens
gctgccctggtgctgcca

SEQ ID NO: 476374 - DNA, 23 bp, Homo sapiens
gctgccctggtgctgccacactt

SEQ ID NO: 476375 - DNA, 14 bp, Homo sapiens
gctgccgctgcacc

SEQ ID NO: 476376 - DNA, 15 bp, Homo sapiens
gctgccgctgcacca

SEQ ID NO: 476377 - DNA, 14 bp, Homo sapiens
gctgcctctgaaaa

SEQ ID NO: 476378 - DNA, 11 bp, Homo sapiens
gctgcctggcg

SEQ ID NO: 476379 - DNA, 20 bp, Homo sapiens
ggcccctgggatgggaccag

SEQ ID NO: 476380 - DNA, 15 bp, Homo sapiens
ggcccgacagcctgg

SEQ ID NO: 476381 - DNA, 22 bp, Homo sapiens
ggcccgagcgcgtgccttcccc

SEQ ID NO: 476382 - DNA, 17 bp, Homo sapiens
ggcccgctcaacctctc

SEQ ID NO: 476383 - DNA, 18 bp, Homo sapiens
ggcccgctcaacctctca

SEQ ID NO: 476384 - DNA, 19 bp, Homo sapiens
ggcccgctcaacctctcag

SEQ ID NO: 476385 - DNA, 22 bp, Homo sapiens
ggcccgctcaacctctcagatc

SEQ ID NO: 476386 - DNA, 16 bp, Homo sapiens
ggcccggcccacgcag

SEQ ID NO: 476387 - DNA, 19 bp, Homo sapiens
ggcccggcccacgcagagc

SEQ ID NO: 476388 - DNA, 13 bp, Homo sapiens
ggccctccctgac

SEQ ID NO: 476389 - DNA, 23 bp, Homo sapiens
ggccctccctgactccctgtggg

SEQ ID NO: 476390 - DNA, 11 bp, Homo sapiens
ggccctgccct

SEQ ID NO: 476391 - DNA, 16 bp, Homo sapiens
ggccctgccctccccc

SEQ ID NO: 476392 - DNA, 17 bp, Homo sapiens
ggccctgccctccccca

SEQ ID NO: 476393 - DNA, 15 bp, Homo sapiens
ggccctgggcctcag

SEQ ID NO: 476394 - DNA, 12 bp, Homo sapiens
ggccctggggtc

SEQ ID NO: 476395 - DNA, 15 bp, Homo sapiens
ggcccttcctctcca

SEQ ID NO: 476396 - DNA, 18 bp, Homo sapiens
ggcccttcctctccactg

SEQ ID NO: 476397 - DNA, 18 bp, Homo sapiens
ggccgcagggcgctccgg

SEQ ID NO: 476398 - DNA, 16 bp, Homo sapiens
ggccgcctcctccaga

SEQ ID NO: 476399 - DNA, 12 bp, Homo sapiens
ggccggctggcc

SEQ ID NO: 476400 - DNA, 15 bp, Homo sapiens
ggccgggcaggtcct

SEQ ID NO: 476401 - DNA, 20 bp, Homo sapiens
ggccgggcaggtcctgccca

SEQ ID NO: 476402 - DNA, 13 bp, Homo sapiens
ggcctcagccctc

SEQ ID NO: 476403 - DNA, 19 bp, Homo sapiens
ggcctccaggctggggcct

SEQ ID NO: 476404 - DNA, 20 bp, Homo sapiens
ggcctcgtgccatgatctgt

SEQ ID NO: 476405 - DNA, 16 bp, Homo sapiens
ggcctgagggaagccc

SEQ ID NO: 476406 - DNA, 22 bp, Homo sapiens
ggcctgagggaagcccacccgc

SEQ ID NO: 476407 - DNA, 14 bp, Homo sapiens
ggcctgcagcccag

SEQ ID NO: 476408 - DNA, 12 bp, Homo sapiens
ggcctgcccccc

SEQ ID NO: 476409 - DNA, 22 bp, Homo sapiens
ggcctgccccccttcccacccc

SEQ ID NO: 476410 - DNA, 23 bp, Homo sapiens
ggcctgccccccttcccacccct

SEQ ID NO: 476411 - DNA, 16 bp, Homo sapiens
ggcctggtctggagcc

SEQ ID NO: 476412 - DNA, 19 bp, Homo sapiens
ggccttggttcctccagca

SEQ ID NO: 476413 - DNA, 13 bp, Homo sapiens
ggcgcccacctgc

SEQ ID NO: 476414 - DNA, 15 bp, Homo sapiens
ggcgcccacctgccc

SEQ ID NO: 476415 - DNA, 17 bp, Homo sapiens
ggcgcccacctgcccag

SEQ ID NO: 476416 - DNA, 14 bp, Homo sapiens
ggcgcctgcgctcc

SEQ ID NO: 476417 - DNA, 17 bp, Homo sapiens
ggcgcctgcgctcctct

SEQ ID NO: 476418 - DNA, 21 bp, Homo sapiens
ggcgcctgcgctcctctgcag

SEQ ID NO: 476419 - DNA, 15 bp, Homo sapiens
ggcgcgcaccgccca

SEQ ID NO: 476420 - DNA, 20 bp, Homo sapiens
ggcgcgcaccgcccaacccc

SEQ ID NO: 476421 - DNA, 22 bp, Homo sapiens
ggcgctcagaggccgctctggg

SEQ ID NO: 476422 - DNA, 18 bp, Homo sapiens
ggcgctccggcagaggca

SEQ ID NO: 476423 - DNA, 19 bp, Homo sapiens
ggcgctccggcagaggcag

SEQ ID NO: 476424 - DNA, 15 bp, Homo sapiens
ggcgctgagggcagg

SEQ ID NO: 476425 - DNA, 21 bp, Homo sapiens
ggcggaggggcttggagcaga

SEQ ID NO: 476426 - DNA, 19 bp, Homo sapiens
ggcgtgggatccagagaga

SEQ ID NO: 476427 - DNA, 22 bp, Homo sapiens
ggcgtgggatccagagagaagc

SEQ ID NO: 476428 - DNA, 14 bp, Homo sapiens
ggctaactggcccc

SEQ ID NO: 476429 - DNA, 18 bp, Homo sapiens
ggctaactggccccaggc

SEQ ID NO: 476430 - DNA, 20 bp, Homo sapiens
ggctcccacaggcccttcct

SEQ ID NO: 476431 - DNA, 14 bp, Homo sapiens
ggctccccctgcca

SEQ ID NO: 476432 - DNA, 17 bp, Homo sapiens
ggctccccctgccagca

SEQ ID NO: 476433 - DNA, 19 bp, Homo sapiens
ggctccccctgccagcaac

SEQ ID NO: 476434 - DNA, 13 bp, Homo sapiens
ggctcctttccca

SEQ ID NO: 476435 - DNA, 12 bp, Homo sapiens
ggctcttctcct

SEQ ID NO: 476436 - DNA, 14 bp, Homo sapiens
ggctcttctccttt

SEQ ID NO: 476437 - DNA, 11 bp, Homo sapiens
ggctgagcccc

SEQ ID NO: 476438 - DNA, 12 bp, Homo sapiens
ggctgagcccct

SEQ ID NO: 476439 - DNA, 13 bp, Homo sapiens
ggctgagcccctc

SEQ ID NO: 476440 - DNA, 14 bp, Homo sapiens
ggctgagcccctcc

SEQ ID NO: 476441 - DNA, 19 bp, Homo sapiens
ggctgaggacggggcagag

SEQ ID NO: 476442 - DNA, 20 bp, Homo sapiens
ggctgaggacggggcagagc

SEQ ID NO: 476443 - DNA, 22 bp, Homo sapiens
ggctgaggacggggcagagctg

SEQ ID NO: 476444 - DNA, 19 bp, Homo sapiens
ggctgcccacgctcctgcc

SEQ ID NO: 476445 - DNA, 16 bp, Homo sapiens
ggctgccctggtgctg

SEQ ID NO: 476446 - DNA, 19 bp, Homo sapiens
ggctgccctggtgctgcca

SEQ ID NO: 476447 - DNA, 14 bp, Homo sapiens
ggctgcgcctgccc

SEQ ID NO: 476448 - DNA, 19 bp, Homo sapiens
ggctgcgcctgcccgcccg

SEQ ID NO: 476449 - DNA, 10 bp, Homo sapiens
ggctggccct

SEQ ID NO: 476450 - DNA, 15 bp, Homo sapiens
ggctggccctgccct

SEQ ID NO: 476451 - DNA, 17 bp, Homo sapiens
ggctggccctgccctcc

SEQ ID NO: 476452 - DNA, 21 bp, Homo sapiens
ggctggccctgccctccccca

SEQ ID NO: 476453 - DNA, 15 bp, Homo sapiens
ggctgggcagggccg

SEQ ID NO: 476454 - DNA, 18 bp, Homo sapiens
ggctgggcagggccgcag

SEQ ID NO: 476455 - DNA, 19 bp, Homo sapiens
ggctgggcagggccgcagg

SEQ ID NO: 476456 - DNA, 21 bp, Homo sapiens
ggctgggcccctgggatggga

SEQ ID NO: 476457 - DNA, 13 bp, Homo sapiens
ggctggggcctgg

SEQ ID NO: 476458 - DNA, 14 bp, Homo sapiens
ggctggggcctggc

SEQ ID NO: 476459 - DNA, 15 bp, Homo sapiens
ggctggggcctggcc

SEQ ID NO: 476460 - DNA, 16 bp, Homo sapiens
ggctggggcctggcct

SEQ ID NO: 476461 - DNA, 19 bp, Homo sapiens
ggctggggcctggcctatt

SEQ ID NO: 476462 - DNA, 16 bp, Homo sapiens
ggctgggtcgcccctc

SEQ ID NO: 476463 - DNA, 19 bp, Homo sapiens
ggctgggtttgggcagtgg

SEQ ID NO: 476464 - DNA, 14 bp, Homo sapiens
ggctgtattttctt

SEQ ID NO: 476465 - DNA, 13 bp, Homo sapiens
ggctgtggcccct

SEQ ID NO: 476466 - DNA, 17 bp, Homo sapiens
ggcttccatggtggttt

SEQ ID NO: 476467 - DNA, 18 bp, Homo sapiens
ggcttcccgctcagccct

SEQ ID NO: 476468 - DNA, 13 bp, Homo sapiens
ggcttggagcaga

SEQ ID NO: 476469 - DNA, 16 bp, Homo sapiens
ggcttggagcagagac

SEQ ID NO: 476470 - DNA, 12 bp, Homo sapiens
ggctttctattg

SEQ ID NO: 476471 - DNA, 13 bp, Homo sapiens
gggaagcccaccc

SEQ ID NO: 476472 - DNA, 23 bp, Homo sapiens
gggaagcccacccgccccagaga

SEQ ID NO: 476473 - DNA, 12 bp, Homo sapiens
gggaaggcctga

SEQ ID NO: 476474 - DNA, 13 bp, Homo sapiens
gggaaggcctgag

SEQ ID NO: 476475 - DNA, 14 bp, Homo sapiens
gggaaggcctgagg

SEQ ID NO: 476476 - DNA, 21 bp, Homo sapiens
gggaaggcctgagggaagccc

SEQ ID NO: 476477 - DNA, 20 bp, Homo sapiens
gtacttacactgaaatccaa

SEQ ID NO: 476478 - DNA, 21 bp, Homo sapiens
gtacttacactgaaatccaaa

SEQ ID NO: 476479 - DNA, 23 bp, Homo sapiens
gtacttcttcatccatagacaca

SEQ ID NO: 476480 - DNA, 20 bp, Homo sapiens
gtacttgctcaataaaggtc

SEQ ID NO: 476481 - DNA, 14 bp, Homo sapiens
gtagaactgttcat

SEQ ID NO: 476482 - DNA, 16 bp, Homo sapiens
gtagaactgttcattt

SEQ ID NO: 476483 - DNA, 15 bp, Homo sapiens
gtaggctgtattttc

SEQ ID NO: 476484 - DNA, 19 bp, Homo sapiens
gtaggctgtattttctttt

SEQ ID NO: 476485 - DNA, 22 bp, Homo sapiens
gtaggctgtattttcttttata

SEQ ID NO: 476486 - DNA, 16 bp, Homo sapiens
gtagggtgaggcgtgg

SEQ ID NO: 476487 - DNA, 16 bp, Homo sapiens
gtaggtctgaaggcct

SEQ ID NO: 476488 - DNA, 20 bp, Homo sapiens
gtagtggcaaaaaagaacag

SEQ ID NO: 476489 - DNA, 18 bp, Homo sapiens
gtataacaagccaaacat

SEQ ID NO: 476490 - DNA, 19 bp, Homo sapiens
gtataacaagccaaacatt

SEQ ID NO: 476491 - DNA, 21 bp, Homo sapiens
gtataacaagccaaacattct

SEQ ID NO: 476492 - DNA, 14 bp, Homo sapiens
gtatatatttatta

SEQ ID NO: 476493 - DNA, 19 bp, Homo sapiens
gtatctgctgcctctgaaa

SEQ ID NO: 476494 - DNA, 18 bp, Homo sapiens
gtatgctggccagcaccc

SEQ ID NO: 476495 - DNA, 23 bp, Homo sapiens
gtatgctggccagcaccctctcc

SEQ ID NO: 476496 - DNA, 17 bp, Homo sapiens
gtattaaacttgtcaga

SEQ ID NO: 476497 - DNA, 14 bp, Homo sapiens
gtattatgcaaagt

SEQ ID NO: 476498 - DNA, 17 bp, Homo sapiens
gtattcctgcctttgat

SEQ ID NO: 476499 - DNA, 15 bp, Homo sapiens
gtatttccaacaaac

SEQ ID NO: 476500 - DNA, 15 bp, Homo sapiens
gtattttaataaaga

SEQ ID NO: 476501 - DNA, 16 bp, Homo sapiens
gtcaaacagtgtggct

SEQ ID NO: 476502 - DNA, 23 bp, Homo sapiens
gtcaaactttcacctcagatttt

SEQ ID NO: 476503 - DNA, 19 bp, Homo sapiens
gtcacagccgtttgaatat

SEQ ID NO: 476504 - DNA, 22 bp, Homo sapiens
gtcacagttcttggtgactgtc

SEQ ID NO: 476505 - DNA, 16 bp, Homo sapiens
gtcacttatttcataa

SEQ ID NO: 476506 - DNA, 15 bp, Homo sapiens
gtcagcttgaatgtc

SEQ ID NO: 476507 - DNA, 18 bp, Homo sapiens
gtcagtgaagcccaggag

SEQ ID NO: 476508 - DNA, 23 bp, Homo sapiens
gtcagtgaagcccaggaggacct

SEQ ID NO: 476509 - DNA, 19 bp, Homo sapiens
gtcatcggaggctgggccc

SEQ ID NO: 476510 - DNA, 14 bp, Homo sapiens
gtcatctctctggg

SEQ ID NO: 476511 - DNA, 17 bp, Homo sapiens
gtcatctctctggggcc

SEQ ID NO: 476512 - DNA, 23 bp, Homo sapiens
gtcatctctctggggccctgggc

SEQ ID NO: 476513 - DNA, 18 bp, Homo sapiens
gtcattcaagcctgtgaa

SEQ ID NO: 476514 - DNA, 21 bp, Homo sapiens
gtcattggttacaaattttta

SEQ ID NO: 476515 - DNA, 16 bp, Homo sapiens
gtccactttcctctct

SEQ ID NO: 476516 - DNA, 13 bp, Homo sapiens
gtccattgcaaaa

SEQ ID NO: 476517 - DNA, 19 bp, Homo sapiens
gtcccacaaaatatttcta

SEQ ID NO: 476518 - DNA, 22 bp, Homo sapiens
gtcccacaaaatatttctaagc

SEQ ID NO: 476519 - DNA, 17 bp, Homo sapiens
gtcccagcacctggcac

SEQ ID NO: 476520 - DNA, 19 bp, Homo sapiens
gtccccagggtgcaggcgc

SEQ ID NO: 476521 - DNA, 13 bp, Homo sapiens
gtccccccacccc

SEQ ID NO: 476522 - DNA, 15 bp, Homo sapiens
gtccccccacccctc

SEQ ID NO: 476523 - DNA, 10 bp, Homo sapiens
gtccccggac

SEQ ID NO: 476524 - DNA, 17 bp, Homo sapiens
gtcccctcactctgtca

SEQ ID NO: 476525 - DNA, 18 bp, Homo sapiens
gtcccctcactctgtcag

SEQ ID NO: 476526 - DNA, 21 bp, Homo sapiens
gtcccggccccgcgcgtgccc

SEQ ID NO: 476527 - DNA, 21 bp, Homo sapiens
gtccctaccgagtctcttctc

SEQ ID NO: 476528 - DNA, 13 bp, Homo sapiens
gtcccttcctgtc

SEQ ID NO: 476529 - DNA, 15 bp, Homo sapiens
gtccctttccctgca

SEQ ID NO: 476530 - DNA, 16 bp, Homo sapiens
gtccgcccgcccaccc

SEQ ID NO: 476531 - DNA, 18 bp, Homo sapiens
gtccggcctgcagcccag

SEQ ID NO: 476532 - DNA, 19 bp, Homo sapiens
gtccgtccgcccgcccacc

SEQ ID NO: 476533 - DNA, 13 bp, Homo sapiens
gtcctccagggcg

SEQ ID NO: 476534 - DNA, 13 bp, Homo sapiens
gtcctctcgagcc

SEQ ID NO: 476535 - DNA, 14 bp, Homo sapiens
gtcctgcccatgtg

SEQ ID NO: 476536 - DNA, 16 bp, Homo sapiens
gtcctgcccatgtgtc

SEQ ID NO: 476537 - DNA, 21 bp, Homo sapiens
gtcctgcccatgtgtcccctc

SEQ ID NO: 476538 - DNA, 13 bp, Homo sapiens
gtcctgctcacgt

SEQ ID NO: 476539 - DNA, 11 bp, Homo sapiens
gtcctgctgct

SEQ ID NO: 476540 - DNA, 13 bp, Homo sapiens
gtcgccccaggcc

SEQ ID NO: 476541 - DNA, 14 bp, Homo sapiens
gtcgccccaggccc

SEQ ID NO: 476542 - DNA, 15 bp, Homo sapiens
gtcgccccaggccct

SEQ ID NO: 476543 - DNA, 22 bp, Homo sapiens
gtcgccccaggccctccctgac

SEQ ID NO: 476544 - DNA, 11 bp, Homo sapiens
gtcgcccctcc

SEQ ID NO: 476545 - DNA, 14 bp, Homo sapiens
gtcgcccctcctcg

SEQ ID NO: 476546 - DNA, 11 bp, Homo sapiens
gtcggctgggc

SEQ ID NO: 476547 - DNA, 12 bp, Homo sapiens
gtcgggggagga

SEQ ID NO: 476548 - DNA, 17 bp, Homo sapiens
gtcgggggaggagcacc

SEQ ID NO: 476549 - DNA, 21 bp, Homo sapiens
gtcgggggaggagcaccccca

SEQ ID NO: 476550 - DNA, 20 bp, Homo sapiens
gtctcaagagggcactggtg

SEQ ID NO: 476551 - DNA, 18 bp, Homo sapiens
gtctcaccttcgcctttg

SEQ ID NO: 476552 - DNA, 17 bp, Homo sapiens
gtctccccgcagccctc

SEQ ID NO: 476553 - DNA, 14 bp, Homo sapiens
gtctcctcctccag

SEQ ID NO: 476554 - DNA, 14 bp, Homo sapiens
gtctcttctccact

SEQ ID NO: 476555 - DNA, 14 bp, Homo sapiens
gtctgaaggagagg

SEQ ID NO: 476556 - DNA, 16 bp, Homo sapiens
gtctgaaggagaggag

SEQ ID NO: 476557 - DNA, 17 bp, Homo sapiens
gtctgaagtcactgcac

SEQ ID NO: 476558 - DNA, 12 bp, Homo sapiens
gtctgagccctg

SEQ ID NO: 476559 - DNA, 12 bp, Homo sapiens
gtctgattctat

SEQ ID NO: 476560 - DNA, 13 bp, Homo sapiens
gtctgattctatg

SEQ ID NO: 476561 - DNA, 9 bp, Homo sapiens
gtctgcccc

SEQ ID NO: 476562 - DNA, 11 bp, Homo sapiens
gtctgcccctt

SEQ ID NO: 476563 - DNA, 19 bp, Homo sapiens
gtctgccccttgaccccac

SEQ ID NO: 476564 - DNA, 14 bp, Homo sapiens
gtctggctgtggcc

SEQ ID NO: 476565 - DNA, 21 bp, Homo sapiens
gtctggctgtggcccctcctt

SEQ ID NO: 476566 - DNA, 22 bp, Homo sapiens
gtctggctgtggcccctccttc

SEQ ID NO: 476567 - DNA, 11 bp, Homo sapiens
gtctgtacttc

SEQ ID NO: 476568 - DNA, 17 bp, Homo sapiens
gtctgtgagtctgtcct

SEQ ID NO: 476569 - DNA, 12 bp, Homo sapiens
gtctgtgggact

SEQ ID NO: 476570 - DNA, 18 bp, Homo sapiens
gtctgtgggactggccca

SEQ ID NO: 476571 - DNA, 22 bp, Homo sapiens
gtctgtttcaatgacctgtatt

SEQ ID NO: 476572 - DNA, 14 bp, Homo sapiens
gtcttcctgtagtg

SEQ ID NO: 476573 - DNA, 14 bp, Homo sapiens
gtcttgagatgtat

SEQ ID NO: 476574 - DNA, 14 bp, Homo sapiens
gtcttggagaggag

SEQ ID NO: 476575 - DNA, 12 bp, Homo sapiens
taacaatgcctt

SEQ ID NO: 476576 - DNA, 13 bp, Homo sapiens
taacaatgccttg

SEQ ID NO: 476577 - DNA, 18 bp, Homo sapiens
taacactagtagctgttt

SEQ ID NO: 476578 - DNA, 14 bp, Homo sapiens
taacataaacttgt

SEQ ID NO: 476579 - DNA, 12 bp, Homo sapiens
taacatattctt

SEQ ID NO: 476580 - DNA, 16 bp, Homo sapiens
taacatctgaaaagaa

SEQ ID NO: 476581 - DNA, 17 bp, Homo sapiens
taacatctgaaaagaaa

SEQ ID NO: 476582 - DNA, 22 bp, Homo sapiens
taaccatatgattgaaaagaag

SEQ ID NO: 476583 - DNA, 22 bp, Homo sapiens
taacctgggttgttgcagagta

SEQ ID NO: 476584 - DNA, 16 bp, Homo sapiens
taactactaagaataa

SEQ ID NO: 476585 - DNA, 16 bp, Homo sapiens
taactctgcatagaca

SEQ ID NO: 476586 - DNA, 22 bp, Homo sapiens
taactctgcatagacaaaggcc

SEQ ID NO: 476587 - DNA, 11 bp, Homo sapiens
taactggcccc

SEQ ID NO: 476588 - DNA, 16 bp, Homo sapiens
taactggccccaggcg

SEQ ID NO: 476589 - DNA, 15 bp, Homo sapiens
taactgtgcactata

SEQ ID NO: 476590 - DNA, 15 bp, Homo sapiens
taactgttaacccag

SEQ ID NO: 476591 - DNA, 20 bp, Homo sapiens
taactgttaacccagtgttc

SEQ ID NO: 476592 - DNA, 14 bp, Homo sapiens
taacttaaaagaac

SEQ ID NO: 476593 - DNA, 15 bp, Homo sapiens
taacttaaaagaaca

SEQ ID NO: 476594 - DNA, 16 bp, Homo sapiens
taagaaatgagaaatt

SEQ ID NO: 476595 - DNA, 22 bp, Homo sapiens
taagaaatgagaaattgtgcca

SEQ ID NO: 476596 - DNA, 17 bp, Homo sapiens
taagaataaataaagaa

SEQ ID NO: 476597 - DNA, 22 bp, Homo sapiens
taagatgggcatagggtttgga

SEQ ID NO: 476598 - DNA, 17 bp, Homo sapiens
taagccactggtatctg

SEQ ID NO: 476599 - DNA, 20 bp, Homo sapiens
taagccatatgacaatttca

SEQ ID NO: 476600 - DNA, 12 bp, Homo sapiens
taagccctgaga

SEQ ID NO: 476601 - DNA, 17 bp, Homo sapiens
taaggaaaagagaaaca

SEQ ID NO: 476602 - DNA, 13 bp, Homo sapiens
taaggttcttgct

SEQ ID NO: 476603 - DNA, 21 bp, Homo sapiens
taagtagactttaattcttct

SEQ ID NO: 476604 - DNA, 23 bp, Homo sapiens
taagttgacctttatttattaaa

SEQ ID NO: 476605 - DNA, 18 bp, Homo sapiens
taatatggaaccttccct

SEQ ID NO: 476606 - DNA, 19 bp, Homo sapiens
taatcatttatcttatcta

SEQ ID NO: 476607 - DNA, 15 bp, Homo sapiens
taatctctaaaattc

SEQ ID NO: 476608 - DNA, 19 bp, Homo sapiens
taatctctaaaattctagt

SEQ ID NO: 476609 - DNA, 16 bp, Homo sapiens
taatctttgtgacagg

SEQ ID NO: 476610 - DNA, 14 bp, Homo sapiens
taatgattcaatgt

SEQ ID NO: 476611 - DNA, 18 bp, Homo sapiens
taatgcttaacataaact

SEQ ID NO: 476612 - DNA, 22 bp, Homo sapiens
taatgcttaacataaacttgta

SEQ ID NO: 476613 - DNA, 15 bp, Homo sapiens
taatggaattatgta

SEQ ID NO: 476614 - DNA, 20 bp, Homo sapiens
taatggccaagtgtacattt

SEQ ID NO: 476615 - DNA, 19 bp, Homo sapiens
taatgtaatcatttatctt

SEQ ID NO: 476616 - DNA, 22 bp, Homo sapiens
taatgtgccaaaatgtcaattt

SEQ ID NO: 476617 - DNA, 20 bp, Homo sapiens
taatgttctgaataatttct

SEQ ID NO: 476618 - DNA, 14 bp, Homo sapiens
taattacttttgaa

SEQ ID NO: 476619 - DNA, 11 bp, Homo sapiens
taattatgttt

SEQ ID NO: 476620 - DNA, 17 bp, Homo sapiens
taatttatgaagatagt

SEQ ID NO: 476621 - DNA, 13 bp, Homo sapiens
taatttcataaat

SEQ ID NO: 476622 - DNA, 14 bp, Homo sapiens
taatttcataaatt

SEQ ID NO: 476623 - DNA, 16 bp, Homo sapiens
taatttcataaattgg

SEQ ID NO: 476624 - DNA, 19 bp, Homo sapiens
taatttcttactaaacatt

SEQ ID NO: 476625 - DNA, 16 bp, Homo sapiens
taatttgccagacaga

SEQ ID NO: 476626 - DNA, 12 bp, Homo sapiens
tacaaagctgtc

SEQ ID NO: 476627 - DNA, 19 bp, Homo sapiens
tacaaatttttactcaggc

SEQ ID NO: 476628 - DNA, 18 bp, Homo sapiens
tacaataaaagagcttta

SEQ ID NO: 476629 - DNA, 16 bp, Homo sapiens
tacactgtatctaaaa

SEQ ID NO: 476630 - DNA, 17 bp, Homo sapiens
tacactgtatctaaaaa

SEQ ID NO: 476631 - DNA, 23 bp, Homo sapiens
tacactgtatctaaaaaataact

SEQ ID NO: 476632 - DNA, 20 bp, Homo sapiens
tacacttctcaaatgctact

SEQ ID NO: 476633 - DNA, 18 bp, Homo sapiens
tacagaaccagcactccc

SEQ ID NO: 476634 - DNA, 22 bp, Homo sapiens
tacagaaccagcactcccaggg

SEQ ID NO: 476635 - DNA, 14 bp, Homo sapiens
tacagacagaatat

SEQ ID NO: 476636 - DNA, 13 bp, Homo sapiens
tacagacctccag

SEQ ID NO: 476637 - DNA, 19 bp, Homo sapiens
tacagatttagtttaccaa

SEQ ID NO: 476638 - DNA, 21 bp, Homo sapiens
tacagcctggtttttaagtac

SEQ ID NO: 476639 - DNA, 20 bp, Homo sapiens
tacagctgaaagacagtaaa

SEQ ID NO: 476640 - DNA, 17 bp, Homo sapiens
tacagggcaggagctgc

SEQ ID NO: 476641 - DNA, 16 bp, Homo sapiens
tacagtatataagctt

SEQ ID NO: 476642 - DNA, 14 bp, Homo sapiens
tacataattaaatt

SEQ ID NO: 476643 - DNA, 17 bp, Homo sapiens
tacataattaaatttta

SEQ ID NO: 476644 - DNA, 20 bp, Homo sapiens
tacatagtctttgtttacat

SEQ ID NO: 476645 - DNA, 22 bp, Homo sapiens
tacatctgaaatctacaacata

SEQ ID NO: 476646 - DNA, 20 bp, Homo sapiens
tacatgaagttgtaagaaaa

SEQ ID NO: 476647 - DNA, 13 bp, Homo sapiens
tacatgagttcaa

SEQ ID NO: 476648 - DNA, 19 bp, Homo sapiens
tacattagcagtttgcttt

SEQ ID NO: 476649 - DNA, 22 bp, Homo sapiens
taccaactaagttgtattttaa

SEQ ID NO: 476650 - DNA, 20 bp, Homo sapiens
taccaatcaacagcatgtct

SEQ ID NO: 476651 - DNA, 14 bp, Homo sapiens
taccatcccactga

SEQ ID NO: 476652 - DNA, 23 bp, Homo sapiens
taccctaggtctccacccctcaa

SEQ ID NO: 476653 - DNA, 17 bp, Homo sapiens
taccctccctgtcccct

SEQ ID NO: 476654 - DNA, 22 bp, Homo sapiens
taccctcttctcagctccactc

SEQ ID NO: 476655 - DNA, 16 bp, Homo sapiens
taccgagacccaccat

SEQ ID NO: 476656 - DNA, 18 bp, Homo sapiens
tacctcactggtgcattt

SEQ ID NO: 476657 - DNA, 15 bp, Homo sapiens
tacctctaataacct

SEQ ID NO: 476658 - DNA, 20 bp, Homo sapiens
tacctggcttagcgttctgt

SEQ ID NO: 476659 - DNA, 16 bp, Homo sapiens
tacctgtagtgagaaa

SEQ ID NO: 476660 - DNA, 14 bp, Homo sapiens
tacctttccaccca

SEQ ID NO: 476661 - DNA, 20 bp, Homo sapiens
tacctttccacccagaccct

SEQ ID NO: 476662 - DNA, 13 bp, Homo sapiens
tactaagaataaa

SEQ ID NO: 476663 - DNA, 18 bp, Homo sapiens
tactattaactctgcata

SEQ ID NO: 476664 - DNA, 15 bp, Homo sapiens
tactatttgaaaaaa

SEQ ID NO: 476665 - DNA, 15 bp, Homo sapiens
tactcaccaaaatat

SEQ ID NO: 476666 - DNA, 15 bp, Homo sapiens
tactcaggctttcta

SEQ ID NO: 476667 - DNA, 22 bp, Homo sapiens
tactgaattgttatgtaaacat

SEQ ID NO: 476668 - DNA, 19 bp, Homo sapiens
tactgtttgtaatatacag

SEQ ID NO: 476669 - DNA, 20 bp, Homo sapiens
tactgtttgtaatatacagt

SEQ ID NO: 476670 - DNA, 14 bp, Homo sapiens
tactgttttgtgcg

SEQ ID NO: 476671 - DNA, 19 bp, Homo sapiens
tacttcagttctcatcttg

SEQ ID NO: 476672 - DNA, 14 bp, Homo sapiens
tacttcctggattt

SEQ ID NO: 476673 - DNA, 14 bp, Homo sapiens
tacttctttttcat

SEQ ID NO: 476674 - DNA, 15 bp, Homo sapiens
tacttgctcaataaa

SEQ ID NO: 476675 - DNA, 19 bp, Homo sapiens
tacttgctcaataaaggtc

SEQ ID NO: 476676 - DNA, 19 bp, Homo sapiens
tacttgctccttgaataag

SEQ ID NO: 476677 - DNA, 12 bp, Homo sapiens
tactttaaatta

SEQ ID NO: 476678 - DNA, 22 bp, Homo sapiens
tactttaaattatatgatatgc

SEQ ID NO: 476679 - DNA, 23 bp, Homo sapiens
tactttgatattttcaacgcagc

SEQ ID NO: 476680 - DNA, 16 bp, Homo sapiens
tacttttgtgtattct

SEQ ID NO: 476681 - DNA, 14 bp, Homo sapiens
tagaaatgtatcct

SEQ ID NO: 476682 - DNA, 13 bp, Homo sapiens
tagaaattctata

SEQ ID NO: 476683 - DNA, 23 bp, Homo sapiens
tagaaattttatctcttcttcct

SEQ ID NO: 476684 - DNA, 12 bp, Homo sapiens
tagaactgttca

SEQ ID NO: 476685 - DNA, 19 bp, Homo sapiens
tagaatccaaattctctga

SEQ ID NO: 476686 - DNA, 18 bp, Homo sapiens
tagaattaggtaatggat

SEQ ID NO: 476687 - DNA, 13 bp, Homo sapiens
tagacaaaggcct

SEQ ID NO: 476688 - DNA, 14 bp, Homo sapiens
tagacaaaggcctt

SEQ ID NO: 476689 - DNA, 19 bp, Homo sapiens
tagacaaccatagaactgt

SEQ ID NO: 476690 - DNA, 12 bp, Homo sapiens
tagacaagtgtt

SEQ ID NO: 476691 - DNA, 13 bp, Homo sapiens
tagagaaggaccc

SEQ ID NO: 476692 - DNA, 17 bp, Homo sapiens
tagagcattctggggtg

SEQ ID NO: 476693 - DNA, 17 bp, Homo sapiens
tagagctaccaattgtt

SEQ ID NO: 476694 - DNA, 22 bp, Homo sapiens
tagagtgagtttccagctgctc

SEQ ID NO: 476695 - DNA, 13 bp, Homo sapiens
tagatttctttga

SEQ ID NO: 476696 - DNA, 18 bp, Homo sapiens
tagcaaacagatgtttgt

SEQ ID NO: 476697 - DNA, 19 bp, Homo sapiens
tagcacaaggagtgcccgc

SEQ ID NO: 476698 - DNA, 20 bp, Homo sapiens
tagcactggtttgtttctca

SEQ ID NO: 476699 - DNA, 21 bp, Homo sapiens
tagcactggtttgtttctcaa

SEQ ID NO: 476700 - DNA, 14 bp, Homo sapiens
tagcatataaatgt

SEQ ID NO: 476701 - DNA, 15 bp, Homo sapiens
tagcatcctgattat

SEQ ID NO: 476702 - DNA, 20 bp, Homo sapiens
tagcatcctgattattgaat

SEQ ID NO: 476703 - DNA, 23 bp, Homo sapiens
tagcatcctgattattgaatgtt

SEQ ID NO: 476704 - DNA, 13 bp, Homo sapiens
tagcatttcttga

SEQ ID NO: 476705 - DNA, 16 bp, Homo sapiens
tagcatttcttgatgt

SEQ ID NO: 476706 - DNA, 18 bp, Homo sapiens
tagccaacttaaacctgt

SEQ ID NO: 476707 - DNA, 13 bp, Homo sapiens
tagccattcattt

SEQ ID NO: 476708 - DNA, 22 bp, Homo sapiens
taggaatatacatagtctttgt

SEQ ID NO: 476709 - DNA, 19 bp, Homo sapiens
taggagcttccagatgggt

SEQ ID NO: 476710 - DNA, 16 bp, Homo sapiens
taggaggacagaacca

SEQ ID NO: 476711 - DNA, 14 bp, Homo sapiens
taggagttctcctg

SEQ ID NO: 476712 - DNA, 19 bp, Homo sapiens
tagggaaatccaactccag

SEQ ID NO: 476713 - DNA, 14 bp, Homo sapiens
taggggtgggggag

SEQ ID NO: 476714 - DNA, 18 bp, Homo sapiens
tagggtttggaagaaagg

SEQ ID NO: 476715 - DNA, 18 bp, Homo sapiens
tagtcaactgctgtttta

SEQ ID NO: 476716 - DNA, 21 bp, Homo sapiens
tagtcatgtttctgcagtatt

SEQ ID NO: 476717 - DNA, 14 bp, Homo sapiens
tagtcctattctat

SEQ ID NO: 476718 - DNA, 22 bp, Homo sapiens
tagtcctattctattgcagtta

SEQ ID NO: 476719 - DNA, 19 bp, Homo sapiens
tagtctctgatttgcaaat

SEQ ID NO: 476720 - DNA, 13 bp, Homo sapiens
tagtctgtacttc

SEQ ID NO: 476721 - DNA, 22 bp, Homo sapiens
tagtgcctgtgatcgtgtgttg

SEQ ID NO: 476722 - DNA, 17 bp, Homo sapiens
tagtggcaaaaaagaac

SEQ ID NO: 476723 - DNA, 19 bp, Homo sapiens
tagtggcaaaaaagaacag

SEQ ID NO: 476724 - DNA, 17 bp, Homo sapiens
tagtgtgctcggacaca

SEQ ID NO: 476725 - DNA, 15 bp, Homo sapiens
tagttaaattggctt

SEQ ID NO: 476726 - DNA, 18 bp, Homo sapiens
tagttaattgtggcttta

SEQ ID NO: 476727 - DNA, 18 bp, Homo sapiens
tagttctatttctatctg

SEQ ID NO: 476728 - DNA, 23 bp, Homo sapiens
tagttctatttctatctgcaaat

SEQ ID NO: 476729 - DNA, 17 bp, Homo sapiens
tagttgaacaagatttc

SEQ ID NO: 476730 - DNA, 23 bp, Homo sapiens
tagttgaacaagatttccctaaa

SEQ ID NO: 476731 - DNA, 14 bp, Homo sapiens
tagtttataaaaga

SEQ ID NO: 476732 - DNA, 22 bp, Homo sapiens
tataaaaaagaaaacttgtgtt

SEQ ID NO: 476733 - DNA, 13 bp, Homo sapiens
tataaaactcagt

SEQ ID NO: 476734 - DNA, 21 bp, Homo sapiens
tataaaactcagttaaaatgt

SEQ ID NO: 476735 - DNA, 17 bp, Homo sapiens
tataacaagccaaacat

SEQ ID NO: 476736 - DNA, 18 bp, Homo sapiens
tataagagacaaagtttg

SEQ ID NO: 476737 - DNA, 20 bp, Homo sapiens
tataagagacaaagtttgga

SEQ ID NO: 476738 - DNA, 21 bp, Homo sapiens
tataagggagtaggctgtatt

SEQ ID NO: 476739 - DNA, 14 bp, Homo sapiens
tataagttgacctt

SEQ ID NO: 476740 - DNA, 22 bp, Homo sapiens
tataatgtttccctcaagaaca

SEQ ID NO: 476741 - DNA, 23 bp, Homo sapiens
tataatttgccagacagagatca

SEQ ID NO: 476742 - DNA, 21 bp, Homo sapiens
tatacaaagctgtcactcaca

SEQ ID NO: 476743 - DNA, 16 bp, Homo sapiens
tatacatagtctttgt

SEQ ID NO: 476744 - DNA, 16 bp, Homo sapiens
tatactgtttgtaata

SEQ ID NO: 476745 - DNA, 20 bp, Homo sapiens
tatactgtttgtaatataca

SEQ ID NO: 476746 - DNA, 20 bp, Homo sapiens
tatacttcacactgaactca

SEQ ID NO: 476747 - DNA, 14 bp, Homo sapiens
tatagtctgtactt

SEQ ID NO: 476748 - DNA, 15 bp, Homo sapiens
tatagtctgtacttc

SEQ ID NO: 476749 - DNA, 18 bp, Homo sapiens
tatatataaatatctatt

SEQ ID NO: 476750 - DNA, 19 bp, Homo sapiens
tatatatgaataattatgt

SEQ ID NO: 476751 - DNA, 13 bp, Homo sapiens
tatatcagcagac

SEQ ID NO: 476752 - DNA, 13 bp, Homo sapiens
tatatcagctcta

SEQ ID NO: 476753 - DNA, 14 bp, Homo sapiens
tatattaaagaagt

SEQ ID NO: 476754 - DNA, 14 bp, Homo sapiens
tatattataagttg

SEQ ID NO: 476755 - DNA, 13 bp, Homo sapiens
tatattatatata

SEQ ID NO: 476756 - DNA, 15 bp, Homo sapiens
tatatttcatattga

SEQ ID NO: 476757 - DNA, 14 bp, Homo sapiens
tatattttatcttg

SEQ ID NO: 476758 - DNA, 20 bp, Homo sapiens
tatcagaactcctttctaag

SEQ ID NO: 476759 - DNA, 17 bp, Homo sapiens
tatcagctctaaagcag

SEQ ID NO: 476760 - DNA, 20 bp, Homo sapiens
tatcagggcccaaataacag

SEQ ID NO: 476761 - DNA, 20 bp, Homo sapiens
tatccacagaacctttgtca

SEQ ID NO: 476762 - DNA, 18 bp, Homo sapiens
tatccacatgaaaataaa

SEQ ID NO: 476763 - DNA, 16 bp, Homo sapiens
tatcctggtgtctagt

SEQ ID NO: 476764 - DNA, 15 bp, Homo sapiens
tatctaaaaaataac

SEQ ID NO: 476765 - DNA, 16 bp, Homo sapiens
tatctaaaaaataact

SEQ ID NO: 476766 - DNA, 23 bp, Homo sapiens
tatctactatttgaaaaaagaag

SEQ ID NO: 476767 - DNA, 19 bp, Homo sapiens
tatctagcaagaagattct

SEQ ID NO: 476768 - DNA, 15 bp, Homo sapiens
tatctatttatctgt

SEQ ID NO: 476769 - DNA, 22 bp, Homo sapiens
tcccgcagcaccagcctgagcc

SEQ ID NO: 476770 - DNA, 23 bp, Homo sapiens
tcccgccttcaggttcctcctag

SEQ ID NO: 476771 - DNA, 19 bp, Homo sapiens
tcccgcgggaagccagccc

SEQ ID NO: 476772 - DNA, 15 bp, Homo sapiens
tcccgctcagccctc

SEQ ID NO: 476773 - DNA, 12 bp, Homo sapiens
tccctaacttct

SEQ ID NO: 476774 - DNA, 17 bp, Homo sapiens
tccctaccctcttctca

SEQ ID NO: 476775 - DNA, 19 bp, Homo sapiens
tccctaccgagtctcttct

SEQ ID NO: 476776 - DNA, 21 bp, Homo sapiens
tccctaccgagtctcttctcc

SEQ ID NO: 476777 - DNA, 13 bp, Homo sapiens
tccctagttcttt

SEQ ID NO: 476778 - DNA, 20 bp, Homo sapiens
tccctataccgagacccacc

SEQ ID NO: 476779 - DNA, 9 bp, Homo sapiens
tccctccac

SEQ ID NO: 476780 - DNA, 12 bp, Homo sapiens
tccctccacacc

SEQ ID NO: 476781 - DNA, 18 bp, Homo sapiens
tccctccactcctcccaa

SEQ ID NO: 476782 - DNA, 14 bp, Homo sapiens
tccctccctccaca

SEQ ID NO: 476783 - DNA, 17 bp, Homo sapiens
tccctccctccacacct

SEQ ID NO: 476784 - DNA, 15 bp, Homo sapiens
tccctcggccccacc

SEQ ID NO: 476785 - DNA, 16 bp, Homo sapiens
tccctgactccctgtg

SEQ ID NO: 476786 - DNA, 19 bp, Homo sapiens
tccctgactccctgtgggg

SEQ ID NO: 476787 - DNA, 18 bp, Homo sapiens
tccctgacttcccagctg

SEQ ID NO: 476788 - DNA, 22 bp, Homo sapiens
tccctgacttcccagctggcag

SEQ ID NO: 476789 - DNA, 21 bp, Homo sapiens
tccctgaggtacctttccacc

SEQ ID NO: 476790 - DNA, 18 bp, Homo sapiens
tccctgcccctcccttca

SEQ ID NO: 476791 - DNA, 16 bp, Homo sapiens
tccctgggcccctcca

SEQ ID NO: 476792 - DNA, 18 bp, Homo sapiens
tccctgggcccctccacg

SEQ ID NO: 476793 - DNA, 11 bp, Homo sapiens
tccctgtcccc

SEQ ID NO: 476794 - DNA, 12 bp, Homo sapiens
tccctgtggggg

SEQ ID NO: 476795 - DNA, 21 bp, Homo sapiens
tccctgtgggggtggccatcc

SEQ ID NO: 476796 - DNA, 22 bp, Homo sapiens
tccctgtgggggtggccatccc

SEQ ID NO: 476797 - DNA, 21 bp, Homo sapiens
tcccttcaaccattccccatg

SEQ ID NO: 476798 - DNA, 14 bp, Homo sapiens
tccgagaagctctc

SEQ ID NO: 476799 - DNA, 13 bp, Homo sapiens
tccgcccagcctc

SEQ ID NO: 476800 - DNA, 17 bp, Homo sapiens
tccgcccgcccaccccg

SEQ ID NO: 476801 - DNA, 20 bp, Homo sapiens
tccgcccgcccaccccgctg

SEQ ID NO: 476802 - DNA, 21 bp, Homo sapiens
tccgctgtcgccccaggccct

SEQ ID NO: 476803 - DNA, 21 bp, Homo sapiens
tccggaacagccaaagaaact

SEQ ID NO: 476804 - DNA, 22 bp, Homo sapiens
tccgggtgcgtgaccggcccgc

SEQ ID NO: 476805 - DNA, 15 bp, Homo sapiens
tccgggtgtggcctc

SEQ ID NO: 476806 - DNA, 13 bp, Homo sapiens
tccgtccccaggg

SEQ ID NO: 476807 - DNA, 14 bp, Homo sapiens
tccgtccccagggt

SEQ ID NO: 476808 - DNA, 21 bp, Homo sapiens
tccgtccccagggtgcaggcg

SEQ ID NO: 476809 - DNA, 12 bp, Homo sapiens
tccgtccgcccg

SEQ ID NO: 476810 - DNA, 13 bp, Homo sapiens
tccgtccgcccgc

SEQ ID NO: 476811 - DNA, 18 bp, Homo sapiens
tccgtccgcccgcccacc

SEQ ID NO: 476812 - DNA, 16 bp, Homo sapiens
tccgttcatctgagga

SEQ ID NO: 476813 - DNA, 15 bp, Homo sapiens
tcctaagctgttgga

SEQ ID NO: 476814 - DNA, 17 bp, Homo sapiens
tcctaggcgctcagagg

SEQ ID NO: 476815 - DNA, 20 bp, Homo sapiens
tcctaggcgctcagaggccg

SEQ ID NO: 476816 - DNA, 21 bp, Homo sapiens
tcctaggcgctcagaggccgc

SEQ ID NO: 476817 - DNA, 22 bp, Homo sapiens
tcctaggcgctcagaggccgct

SEQ ID NO: 476818 - DNA, 19 bp, Homo sapiens
tcctaggctccctgaggta

SEQ ID NO: 476819 - DNA, 18 bp, Homo sapiens
tcctcagtctttggggga

SEQ ID NO: 476820 - DNA, 20 bp, Homo sapiens
tcctccaggaggactgttct

SEQ ID NO: 476821 - DNA, 21 bp, Homo sapiens
tcctccaggaggactgttcta

SEQ ID NO: 476822 - DNA, 18 bp, Homo sapiens
tcctcccaactctggcct

SEQ ID NO: 476823 - DNA, 22 bp, Homo sapiens
tcctcccaactctggccttggt

SEQ ID NO: 476824 - DNA, 19 bp, Homo sapiens
tcctcccaggcgccccttc

SEQ ID NO: 476825 - DNA, 20 bp, Homo sapiens
tcctcctcagtcttctcagt

SEQ ID NO: 476826 - DNA, 18 bp, Homo sapiens
tcctcgggcgcctgcgct

SEQ ID NO: 476827 - DNA, 16 bp, Homo sapiens
tcctcgtccggcctgc

SEQ ID NO: 476828 - DNA, 19 bp, Homo sapiens
tcctcgtccggcctgcagc

SEQ ID NO: 476829 - DNA, 23 bp, Homo sapiens
tcctcgtccggcctgcagcccag

SEQ ID NO: 476830 - DNA, 16 bp, Homo sapiens
tcctctccactgcctt

SEQ ID NO: 476831 - DNA, 18 bp, Homo sapiens
tcctctccactgccttcg

SEQ ID NO: 476832 - DNA, 14 bp, Homo sapiens
tcctctcctcgtcc

SEQ ID NO: 476833 - DNA, 17 bp, Homo sapiens
tcctctcgagcccagat

SEQ ID NO: 476834 - DNA, 19 bp, Homo sapiens
tcctctctctccctccact

SEQ ID NO: 476835 - DNA, 15 bp, Homo sapiens
tcctctctctctctc

SEQ ID NO: 476836 - DNA, 21 bp, Homo sapiens
tcctctctctctctctctctg

SEQ ID NO: 476837 - DNA, 14 bp, Homo sapiens
tcctctgcagcctg

SEQ ID NO: 476838 - DNA, 15 bp, Homo sapiens
tcctctgcagcctga

SEQ ID NO: 476839 - DNA, 11 bp, Homo sapiens
tcctctgcccc

SEQ ID NO: 476840 - DNA, 16 bp, Homo sapiens
tcctctgccccctccc

SEQ ID NO: 476841 - DNA, 18 bp, Homo sapiens
tcctctgccccctccccc

SEQ ID NO: 476842 - DNA, 22 bp, Homo sapiens
tcctctgccccctcccccgcag

SEQ ID NO: 476843 - DNA, 23 bp, Homo sapiens
tcctctgccccctcccccgcaga

SEQ ID NO: 476844 - DNA, 11 bp, Homo sapiens
tcctctgcctt

SEQ ID NO: 476845 - DNA, 23 bp, Homo sapiens
tcctcttacctgtaatagcctca

SEQ ID NO: 476846 - DNA, 14 bp, Homo sapiens
tcctgagcctgtct

SEQ ID NO: 476847 - DNA, 17 bp, Homo sapiens
tcctgagcctgtctctc

SEQ ID NO: 476848 - DNA, 18 bp, Homo sapiens
tcctgagcctgtctctcc

SEQ ID NO: 476849 - DNA, 13 bp, Homo sapiens
tcctgcccatgtg

SEQ ID NO: 476850 - DNA, 17 bp, Homo sapiens
tcctgcccatgtgtccc

SEQ ID NO: 476851 - DNA, 16 bp, Homo sapiens
tcctgctagctgtaga

SEQ ID NO: 476852 - DNA, 20 bp, Homo sapiens
tcctgctcacgtctgtgagt

SEQ ID NO: 476853 - DNA, 19 bp, Homo sapiens
tcctgctgctcgggaaggc

SEQ ID NO: 476854 - DNA, 23 bp, Homo sapiens
tcctgctgctcgggaaggcctga

SEQ ID NO: 476855 - DNA, 14 bp, Homo sapiens
tcctggattttctt

SEQ ID NO: 476856 - DNA, 18 bp, Homo sapiens
tcctggccagacgctgcc

SEQ ID NO: 476857 - DNA, 13 bp, Homo sapiens
tcctgggggtggc

SEQ ID NO: 476858 - DNA, 19 bp, Homo sapiens
tcctggggtggttggaggc

SEQ ID NO: 476859 - DNA, 22 bp, Homo sapiens
tcctggggtggttggaggcctg

SEQ ID NO: 476860 - DNA, 16 bp, Homo sapiens
tcctggtgtctagttt

SEQ ID NO: 476861 - DNA, 21 bp, Homo sapiens
tcctgtagtggcaaaaaagaa

SEQ ID NO: 476862 - DNA, 23 bp, Homo sapiens
tcctgtagtggcaaaaaagaaca

SEQ ID NO: 476863 - DNA, 16 bp, Homo sapiens
tcctgtcctgctcacg

SEQ ID NO: 476864 - DNA, 15 bp, Homo sapiens
tccttcactccctgt

SEQ ID NO: 476865 - DNA, 22 bp, Homo sapiens
tccttcactccctgtcatagtt

SEQ ID NO: 476866 - DNA, 21 bp, Homo sapiens
tgagcaaactgaagcccacag

SEQ ID NO: 476867 - DNA, 13 bp, Homo sapiens
tgagcaaggcaag

SEQ ID NO: 476868 - DNA, 16 bp, Homo sapiens
tgagcaaggcaagaag

SEQ ID NO: 476869 - DNA, 20 bp, Homo sapiens
tgagcaaggcaagaagtggg

SEQ ID NO: 476870 - DNA, 21 bp, Homo sapiens
tgagcaaggcaagaagtggga

SEQ ID NO: 476871 - DNA, 15 bp, Homo sapiens
tgagccacagtgggg

SEQ ID NO: 476872 - DNA, 23 bp, Homo sapiens
tgagccacagtggggcccatggc

SEQ ID NO: 476873 - DNA, 12 bp, Homo sapiens
tgagcccactcc

SEQ ID NO: 476874 - DNA, 20 bp, Homo sapiens
tgagcccagaaaaaaggact

SEQ ID NO: 476875 - DNA, 13 bp, Homo sapiens
tgagccctgccct

SEQ ID NO: 476876 - DNA, 15 bp, Homo sapiens
tgagccctgccctca

SEQ ID NO: 476877 - DNA, 12 bp, Homo sapiens
tgagcctgtctc

SEQ ID NO: 476878 - DNA, 15 bp, Homo sapiens
tgagcttctcctctg

SEQ ID NO: 476879 - DNA, 16 bp, Homo sapiens
tgagcttctcctctgc

SEQ ID NO: 476880 - DNA, 19 bp, Homo sapiens
tgagcttctcctctgctcc

SEQ ID NO: 476881 - DNA, 15 bp, Homo sapiens
tgaggacctttctga

SEQ ID NO: 476882 - DNA, 19 bp, Homo sapiens
tgaggacggggcagagctg

SEQ ID NO: 476883 - DNA, 20 bp, Homo sapiens
tgaggacggggcagagctga

SEQ ID NO: 476884 - DNA, 16 bp, Homo sapiens
tgaggcccactctgtt

SEQ ID NO: 476885 - DNA, 12 bp, Homo sapiens
tgaggcccccgg

SEQ ID NO: 476886 - DNA, 20 bp, Homo sapiens
tgagggaagcccacccgccc

SEQ ID NO: 476887 - DNA, 21 bp, Homo sapiens
tgagggcagggttctagaagg

SEQ ID NO: 476888 - DNA, 21 bp, Homo sapiens
tgaggtacctttccacccaga

SEQ ID NO: 476889 - DNA, 18 bp, Homo sapiens
tgaggttaaggggatcta

SEQ ID NO: 476890 - DNA, 16 bp, Homo sapiens
tgagtaaataaactct

SEQ ID NO: 476891 - DNA, 13 bp, Homo sapiens
tgagtccagctcc

SEQ ID NO: 476892 - DNA, 14 bp, Homo sapiens
tgagtccagctccc

SEQ ID NO: 476893 - DNA, 19 bp, Homo sapiens
tgagtcggctgggcagggc

SEQ ID NO: 476894 - DNA, 21 bp, Homo sapiens
tgagtcggctgggcagggccg

SEQ ID NO: 476895 - DNA, 12 bp, Homo sapiens
tgagtgggcccc

SEQ ID NO: 476896 - DNA, 15 bp, Homo sapiens
tgagtgggccccctc

SEQ ID NO: 476897 - DNA, 16 bp, Homo sapiens
tgagtgggccccctct

SEQ ID NO: 476898 - DNA, 21 bp, Homo sapiens
tgataaacattaaacactgta

SEQ ID NO: 476899 - DNA, 22 bp, Homo sapiens
tgataaacattaaacactgtaa

SEQ ID NO: 476900 - DNA, 15 bp, Homo sapiens
tgatacactgtatct

SEQ ID NO: 476901 - DNA, 19 bp, Homo sapiens
tgatacactgtatctaaaa

SEQ ID NO: 476902 - DNA, 21 bp, Homo sapiens
tgatacactgtatctaaaaaa

SEQ ID NO: 476903 - DNA, 15 bp, Homo sapiens
tgatagcactggttt

SEQ ID NO: 476904 - DNA, 23 bp, Homo sapiens
tgatagcactggtttgtttctca

SEQ ID NO: 476905 - DNA, 18 bp, Homo sapiens
tgatatcacgggcccgct

SEQ ID NO: 476906 - DNA, 10 bp, Homo sapiens
tgatatgcat

SEQ ID NO: 476907 - DNA, 12 bp, Homo sapiens
tgatatgcatgt

SEQ ID NO: 476908 - DNA, 23 bp, Homo sapiens
tgatattttcaacgcagccctgc

SEQ ID NO: 476909 - DNA, 17 bp, Homo sapiens
tgatcgatgttaaacgt

SEQ ID NO: 476910 - DNA, 19 bp, Homo sapiens
tgatctggtgcgtgtggcc

SEQ ID NO: 476911 - DNA, 15 bp, Homo sapiens
tgatctgtatttaat

SEQ ID NO: 476912 - DNA, 22 bp, Homo sapiens
tgatctgtatttaatggttttt

SEQ ID NO: 476913 - DNA, 23 bp, Homo sapiens
tgatctgtatttaatggttttta

SEQ ID NO: 476914 - DNA, 14 bp, Homo sapiens
tgatgatgatataa

SEQ ID NO: 476915 - DNA, 16 bp, Homo sapiens
tgatgggtcctgctgc

SEQ ID NO: 476916 - DNA, 14 bp, Homo sapiens
tgatggttcccctg

SEQ ID NO: 476917 - DNA, 13 bp, Homo sapiens
tgattcaatgtga

SEQ ID NO: 476918 - DNA, 22 bp, Homo sapiens
tgattctatgcctgtatttcca

SEQ ID NO: 476919 - DNA, 16 bp, Homo sapiens
tgattctcctctccca

SEQ ID NO: 476920 - DNA, 22 bp, Homo sapiens
tgattgaaaatagtaaatgctt

SEQ ID NO: 476921 - DNA, 18 bp, Homo sapiens
tgattggcagcttcaaaa

SEQ ID NO: 476922 - DNA, 16 bp, Homo sapiens
tgatttgatatacaga

SEQ ID NO: 476923 - DNA, 16 bp, Homo sapiens
tgattttagatttctt

SEQ ID NO: 476924 - DNA, 19 bp, Homo sapiens
tgattttagatttctttga

SEQ ID NO: 476925 - DNA, 12 bp, Homo sapiens
tgcaaaaagata

SEQ ID NO: 476926 - DNA, 18 bp, Homo sapiens
tgcaaaaggttaagccat

SEQ ID NO: 476927 - DNA, 22 bp, Homo sapiens
tgcaaagtaccaactgagccaa

SEQ ID NO: 476928 - DNA, 15 bp, Homo sapiens
tgcaaatagtttcaa

SEQ ID NO: 476929 - DNA, 15 bp, Homo sapiens
tgcaaatgcacattt

SEQ ID NO: 476930 - DNA, 19 bp, Homo sapiens
tgcaaatgcacatttgtca

SEQ ID NO: 476931 - DNA, 12 bp, Homo sapiens
tgcaaattattc

SEQ ID NO: 476932 - DNA, 16 bp, Homo sapiens
tgcaataacagtttta

SEQ ID NO: 476933 - DNA, 14 bp, Homo sapiens
tgcaatcttatgtt

SEQ ID NO: 476934 - DNA, 16 bp, Homo sapiens
tgcacagtgcatctca

SEQ ID NO: 476935 - DNA, 18 bp, Homo sapiens
tgcacagtgcatctcagc

SEQ ID NO: 476936 - DNA, 22 bp, Homo sapiens
tgcacagtttgcaatcttatgt

SEQ ID NO: 476937 - DNA, 22 bp, Homo sapiens
tgcaccacggcgtttttttaca

SEQ ID NO: 476938 - DNA, 12 bp, Homo sapiens
tgcaccaggaga

SEQ ID NO: 476939 - DNA, 15 bp, Homo sapiens
tgcaccaggagacag

SEQ ID NO: 476940 - DNA, 23 bp, Homo sapiens
tgcaccctctgctatgtctgtga

SEQ ID NO: 476941 - DNA, 24 bp, Homo sapiens
tgcaccctctgctatgtctgtgat

SEQ ID NO: 476942 - DNA, 16 bp, Homo sapiens
tgcactgtatccaagt

SEQ ID NO: 476943 - DNA, 15 bp, Homo sapiens
tgcacttctgttatc

SEQ ID NO: 476944 - DNA, 18 bp, Homo sapiens
tgcacttctgttatcagg

SEQ ID NO: 476945 - DNA, 17 bp, Homo sapiens
tgcagaaaaagagcttc

SEQ ID NO: 476946 - DNA, 17 bp, Homo sapiens
tgcagatgactggaaac

SEQ ID NO: 476947 - DNA, 22 bp, Homo sapiens
tgcagcagtaccatcccactga

SEQ ID NO: 476948 - DNA, 21 bp, Homo sapiens
tgcagcctgagctccaccctc

SEQ ID NO: 476949 - DNA, 21 bp, Homo sapiens
tgcaggcgcgcaccgcccaac

SEQ ID NO: 476950 - DNA, 16 bp, Homo sapiens
tgcaggctgtgttttc

SEQ ID NO: 476951 - DNA, 14 bp, Homo sapiens
tgcagtattctgta

SEQ ID NO: 476952 - DNA, 14 bp, Homo sapiens
tgcagttttaactt

SEQ ID NO: 476953 - DNA, 15 bp, Homo sapiens
tgcataaatgttata

SEQ ID NO: 476954 - DNA, 20 bp, Homo sapiens
tgcataagattatatacaaa

SEQ ID NO: 476955 - DNA, 21 bp, Homo sapiens
tgcatacaataaaagagcttt

SEQ ID NO: 476956 - DNA, 22 bp, Homo sapiens
tgcatacttcctggattttctt

SEQ ID NO: 476957 - DNA, 14 bp, Homo sapiens
tgcatagacaaagg

SEQ ID NO: 476958 - DNA, 13 bp, Homo sapiens
tgcatagacaagt

SEQ ID NO: 476959 - DNA, 20 bp, Homo sapiens
tgcatatcctggtgtctagt

SEQ ID NO: 476960 - DNA, 18 bp, Homo sapiens
tgcatcccttggcccctc

SEQ ID NO: 476961 - DNA, 15 bp, Homo sapiens
tgcatgatattgtat

SEQ ID NO: 476962 - DNA, 20 bp, Homo sapiens
tgcatgtagcatataaatgt

SEQ ID NO: 476963 - DNA, 16 bp, Homo sapiens
tgggatccagagagaa

SEQ ID NO: 476964 - DNA, 18 bp, Homo sapiens
tgggatccagagagaagc

SEQ ID NO: 476965 - DNA, 15 bp, Homo sapiens
tgggatgggaccagg

SEQ ID NO: 476966 - DNA, 18 bp, Homo sapiens
tgggattcaggaatgggc

SEQ ID NO: 476967 - DNA, 20 bp, Homo sapiens
tgggcagggccgcagggcgc

SEQ ID NO: 476968 - DNA, 14 bp, Homo sapiens
tgggccaagccagg

SEQ ID NO: 476969 - DNA, 15 bp, Homo sapiens
tgggccaagccaggg

SEQ ID NO: 476970 - DNA, 22 bp, Homo sapiens
tgggccaagccagggttccaga

SEQ ID NO: 476971 - DNA, 23 bp, Homo sapiens
tgggccaagccagggttccagac

SEQ ID NO: 476972 - DNA, 20 bp, Homo sapiens
tgggcccagccggggtgggg

SEQ ID NO: 476973 - DNA, 18 bp, Homo sapiens
tgggccccctctcttacc

SEQ ID NO: 476974 - DNA, 12 bp, Homo sapiens
tgggctccagag

SEQ ID NO: 476975 - DNA, 15 bp, Homo sapiens
tgggctccagagtag

SEQ ID NO: 476976 - DNA, 15 bp, Homo sapiens
tgggctgccctggtg

SEQ ID NO: 476977 - DNA, 20 bp, Homo sapiens
tgggctgccctggtgctgcc

SEQ ID NO: 476978 - DNA, 14 bp, Homo sapiens
tggggagggtgggc

SEQ ID NO: 476979 - DNA, 17 bp, Homo sapiens
tggggagggtgggcgtg

SEQ ID NO: 476980 - DNA, 19 bp, Homo sapiens
tggggcccatggccccagc

SEQ ID NO: 476981 - DNA, 20 bp, Homo sapiens
tggggcccatggccccagct

SEQ ID NO: 476982 - DNA, 16 bp, Homo sapiens
tggggccctgggcctc

SEQ ID NO: 476983 - DNA, 22 bp, Homo sapiens
tggggcctggcctatttaagcc

SEQ ID NO: 476984 - DNA, 20 bp, Homo sapiens
tggggcttagaatggggctt

SEQ ID NO: 476985 - DNA, 15 bp, Homo sapiens
tggggcttggaaggg

SEQ ID NO: 476986 - DNA, 21 bp, Homo sapiens
tgggggatgggccagggttta

SEQ ID NO: 476987 - DNA, 17 bp, Homo sapiens
tgggggattcaaatgca

SEQ ID NO: 476988 - DNA, 20 bp, Homo sapiens
tggggggccgggcaggtcct

SEQ ID NO: 476989 - DNA, 20 bp, Homo sapiens
tgggggggcttggggtagag

SEQ ID NO: 476990 - DNA, 17 bp, Homo sapiens
tggggtagagaggacag

SEQ ID NO: 476991 - DNA, 16 bp, Homo sapiens
tggggtctctgagcag

SEQ ID NO: 476992 - DNA, 12 bp, Homo sapiens
tggggtgcctga

SEQ ID NO: 476993 - DNA, 11 bp, Homo sapiens
tgggtcctgct

SEQ ID NO: 476994 - DNA, 14 bp, Homo sapiens
tgggtcgcccctcc

SEQ ID NO: 476995 - DNA, 15 bp, Homo sapiens
tgggtcgcccctcct

SEQ ID NO: 476996 - DNA, 17 bp, Homo sapiens
tgggtcgcccctcctcg

SEQ ID NO: 476997 - DNA, 12 bp, Homo sapiens
tgggttccagac

SEQ ID NO: 476998 - DNA, 13 bp, Homo sapiens
tgggttccagaca

SEQ ID NO: 476999 - DNA, 15 bp, Homo sapiens
tgggttccagacaga

SEQ ID NO: 477000 - DNA, 19 bp, Homo sapiens
tgggttccagacagagtgg

SEQ ID NO: 477001 - DNA, 21 bp, Homo sapiens
tgggttccagacagagtggat

SEQ ID NO: 477002 - DNA, 15 bp, Homo sapiens
tgggtttgggcagtg

SEQ ID NO: 477003 - DNA, 16 bp, Homo sapiens
tgggttttagaaattc

SEQ ID NO: 477004 - DNA, 18 bp, Homo sapiens
tgggttttagaaattcta

SEQ ID NO: 477005 - DNA, 21 bp, Homo sapiens
tgggttttagaaattctataa

SEQ ID NO: 477006 - DNA, 17 bp, Homo sapiens
tggtatgctggccagca

SEQ ID NO: 477007 - DNA, 22 bp, Homo sapiens
tggtcagtgaagcccaggagga

SEQ ID NO: 477008 - DNA, 15 bp, Homo sapiens
tggtccttctgaccc

SEQ ID NO: 477009 - DNA, 19 bp, Homo sapiens
tggtctaattcaactctgt

SEQ ID NO: 477010 - DNA, 14 bp, Homo sapiens
tggtctggagcccc

SEQ ID NO: 477011 - DNA, 20 bp, Homo sapiens
tggtctggagcccctatcct

SEQ ID NO: 477012 - DNA, 12 bp, Homo sapiens
tggtcttggaga

SEQ ID NO: 477013 - DNA, 15 bp, Homo sapiens
tggtcttggagagga

SEQ ID NO: 477014 - DNA, 16 bp, Homo sapiens
tggtcttggagaggag

SEQ ID NO: 477015 - DNA, 18 bp, Homo sapiens
tggtgagcatacagagtg

SEQ ID NO: 477016 - DNA, 14 bp, Homo sapiens
tggtgcagtgaaga

SEQ ID NO: 477017 - DNA, 14 bp, Homo sapiens
tggtgcgctgtgct

SEQ ID NO: 477018 - DNA, 17 bp, Homo sapiens
tggtgcgtgtggccctg

SEQ ID NO: 477019 - DNA, 21 bp, Homo sapiens
tggtgcgtgtggccctgtggg

SEQ ID NO: 477020 - DNA, 16 bp, Homo sapiens
tggtggtttcagaaag

SEQ ID NO: 477021 - DNA, 18 bp, Homo sapiens
tggtggtttcagaaaggg

SEQ ID NO: 477022 - DNA, 18 bp, Homo sapiens
tggtgtgaggcccccgga

SEQ ID NO: 477023 - DNA, 21 bp, Homo sapiens
tggttatagttgatatgtaac

SEQ ID NO: 477024 - DNA, 11 bp, Homo sapiens
tggttcccctg

SEQ ID NO: 477025 - DNA, 19 bp, Homo sapiens
tggttcccctgttcactct

SEQ ID NO: 477026 - DNA, 13 bp, Homo sapiens
tggttcctccagc

SEQ ID NO: 477027 - DNA, 14 bp, Homo sapiens
tggttggaggcctg

SEQ ID NO: 477028 - DNA, 18 bp, Homo sapiens
tggtttttgctctacttt

SEQ ID NO: 477029 - DNA, 19 bp, Homo sapiens
tgtaacagttggtgatttt

SEQ ID NO: 477030 - DNA, 22 bp, Homo sapiens
tgtaacagttggtgattttaga

SEQ ID NO: 477031 - DNA, 23 bp, Homo sapiens
tgtaaccatatgattgaaaagaa

SEQ ID NO: 477032 - DNA, 13 bp, Homo sapiens
tgtaatcatttat

SEQ ID NO: 477033 - DNA, 19 bp, Homo sapiens
tgtaatctctgattaaatt

SEQ ID NO: 477034 - DNA, 16 bp, Homo sapiens
tgtacatttgatttga

SEQ ID NO: 477035 - DNA, 20 bp, Homo sapiens
tgtaccgaaacaccccgctc

SEQ ID NO: 477036 - DNA, 21 bp, Homo sapiens
tgtaccgggctggcctgtgcc

SEQ ID NO: 477037 - DNA, 13 bp, Homo sapiens
tgtactcctccca

SEQ ID NO: 477038 - DNA, 17 bp, Homo sapiens
tgtacttcagttctcat

SEQ ID NO: 477039 - DNA, 21 bp, Homo sapiens
tgtagaactgttcatttccac

SEQ ID NO: 477040 - DNA, 22 bp, Homo sapiens
tgtagaactgttcatttccacc

SEQ ID NO: 477041 - DNA, 13 bp, Homo sapiens
tgtagcatataaa

SEQ ID NO: 477042 - DNA, 14 bp, Homo sapiens
tgtagcatataaat

SEQ ID NO: 477043 - DNA, 16 bp, Homo sapiens
tgtagtgagaaactga

SEQ ID NO: 477044 - DNA, 23 bp, Homo sapiens
tgtataacaagccaaacattctt

SEQ ID NO: 477045 - DNA, 21 bp, Homo sapiens
tgtatagttttataaaactca

SEQ ID NO: 477046 - DNA, 11 bp, Homo sapiens
tgtatatcagc

SEQ ID NO: 477047 - DNA, 15 bp, Homo sapiens
tgtatatcagctcta

SEQ ID NO: 477048 - DNA, 13 bp, Homo sapiens
tgtatatgttatt

SEQ ID NO: 477049 - DNA, 20 bp, Homo sapiens
tgtatctaaaaaataactgt

SEQ ID NO: 477050 - DNA, 18 bp, Homo sapiens
tgtattttaataaagatt

SEQ ID NO: 477051 - DNA, 21 bp, Homo sapiens
tgtcaacttcagttgaaaaga

SEQ ID NO: 477052 - DNA, 20 bp, Homo sapiens
tgtcacagggtgttggaaga

SEQ ID NO: 477053 - DNA, 12 bp, Homo sapiens
tgtcacagttct

SEQ ID NO: 477054 - DNA, 18 bp, Homo sapiens
tgtcagaatttctttgtc

SEQ ID NO: 477055 - DNA, 14 bp, Homo sapiens
tgtcagagaatatg

SEQ ID NO: 477056 - DNA, 15 bp, Homo sapiens
tgtcagccagccgcc

SEQ ID NO: 477057 - DNA, 18 bp, Homo sapiens
tgtcagccagccgccctg

SEQ ID NO: 477058 - DNA, 19 bp, Homo sapiens
tgtcagccagccgccctgg

SEQ ID NO: 477059 - DNA, 20 bp, Homo sapiens
tgtcagccagccgccctggg

SEQ ID NO: 477060 - DNA, 17 bp, Homo sapiens
tgtcagctacatgaagt

SEQ ID NO: 477061 - DNA, 18 bp, Homo sapiens
ttatttcataaacaactt

SEQ ID NO: 477062 - DNA, 19 bp, Homo sapiens
ttatttctcgggtgcattt

SEQ ID NO: 477063 - DNA, 23 bp, Homo sapiens
ttattttagacaaccatagaact

SEQ ID NO: 477064 - DNA, 13 bp, Homo sapiens
ttattttcatata

SEQ ID NO: 477065 - DNA, 13 bp, Homo sapiens
ttattttctatat

SEQ ID NO: 477066 - DNA, 15 bp, Homo sapiens
ttcaaaatacttctt

SEQ ID NO: 477067 - DNA, 13 bp, Homo sapiens
ttcaaaatgcatg

SEQ ID NO: 477068 - DNA, 17 bp, Homo sapiens
ttcaaaatgcatgtgat

SEQ ID NO: 477069 - DNA, 21 bp, Homo sapiens
ttcaaaatgcatgtgattggc

SEQ ID NO: 477070 - DNA, 21 bp, Homo sapiens
ttcaacacttattttctgaat

SEQ ID NO: 477071 - DNA, 22 bp, Homo sapiens
ttcaacctggtggcaccagatg

SEQ ID NO: 477072 - DNA, 14 bp, Homo sapiens
ttcaacgcagccct

SEQ ID NO: 477073 - DNA, 19 bp, Homo sapiens
ttcaacgcagccctgcttt

SEQ ID NO: 477074 - DNA, 23 bp, Homo sapiens
ttcaactaatacatggtttaaag

SEQ ID NO: 477075 - DNA, 19 bp, Homo sapiens
ttcaatgcatacaataaaa

SEQ ID NO: 477076 - DNA, 23 bp, Homo sapiens
ttcaatgcatacaataaaagagc

SEQ ID NO: 477077 - DNA, 18 bp, Homo sapiens
ttcacaaatatagttgaa

SEQ ID NO: 477078 - DNA, 21 bp, Homo sapiens
ttcacaaccttctgtggctca

SEQ ID NO: 477079 - DNA, 13 bp, Homo sapiens
ttcacactgaact

SEQ ID NO: 477080 - DNA, 13 bp, Homo sapiens
ttcactgctggct

SEQ ID NO: 477081 - DNA, 18 bp, Homo sapiens
ttcactgctggctgcctt

SEQ ID NO: 477082 - DNA, 19 bp, Homo sapiens
ttcagcaaccctacagtat

SEQ ID NO: 477083 - DNA, 19 bp, Homo sapiens
ttcagttctcatcttgtaa

SEQ ID NO: 477084 - DNA, 16 bp, Homo sapiens
ttcatccatagacaca

SEQ ID NO: 477085 - DNA, 19 bp, Homo sapiens
ttcatctgaggagtccaaa

SEQ ID NO: 477086 - DNA, 21 bp, Homo sapiens
ttcatctgaggagtccaaaat

SEQ ID NO: 477087 - DNA, 14 bp, Homo sapiens
ttcatttccaccaa

SEQ ID NO: 477088 - DNA, 16 bp, Homo sapiens
ttccaagtgtgtgtgc

SEQ ID NO: 477089 - DNA, 23 bp, Homo sapiens
ttccaataccctagaagaaaacc

SEQ ID NO: 477090 - DNA, 21 bp, Homo sapiens
ttccacaggacacgaaggctg

SEQ ID NO: 477091 - DNA, 20 bp, Homo sapiens
ttccagacagggtggggctt

SEQ ID NO: 477092 - DNA, 21 bp, Homo sapiens
ttccagagagtggctcctccc

SEQ ID NO: 477093 - DNA, 14 bp, Homo sapiens
ttccatatgctctt

SEQ ID NO: 477094 - DNA, 14 bp, Homo sapiens
ttccatcctgagga

SEQ ID NO: 477095 - DNA, 15 bp, Homo sapiens
ttccatctaaaatac

SEQ ID NO: 477096 - DNA, 12 bp, Homo sapiens
ttccattctatg

SEQ ID NO: 477097 - DNA, 13 bp, Homo sapiens
ttccccaccccat

SEQ ID NO: 477098 - DNA, 12 bp, Homo sapiens
ttccccactccc

SEQ ID NO: 477099 - DNA, 10 bp, Homo sapiens
ttcccccttc

SEQ ID NO: 477100 - DNA, 13 bp, Homo sapiens
ttcccccttcccc

SEQ ID NO: 477101 - DNA, 17 bp, Homo sapiens
ttcccctgcgccctccc

SEQ ID NO: 477102 - DNA, 21 bp, Homo sapiens
ttcccctgcgccctccctccc

SEQ ID NO: 477103 - DNA, 15 bp, Homo sapiens
ttcccgcagcaccag

SEQ ID NO: 477104 - DNA, 22 bp, Homo sapiens
ttcccgcagcaccagcctgagc

SEQ ID NO: 477105 - DNA, 18 bp, Homo sapiens
ttcccgccttcaggttcc

SEQ ID NO: 477106 - DNA, 15 bp, Homo sapiens
ttcccgctcagccct

SEQ ID NO: 477107 - DNA, 17 bp, Homo sapiens
ttccctagttctttgca

SEQ ID NO: 477108 - DNA, 16 bp, Homo sapiens
ttccctgcatcccttg

SEQ ID NO: 477109 - DNA, 22 bp, Homo sapiens
ttccgctgtcgccccaggccct

SEQ ID NO: 477110 - DNA, 17 bp, Homo sapiens
ttccgtgagacacaaga

SEQ ID NO: 477111 - DNA, 13 bp, Homo sapiens
ttccgttcatctg

SEQ ID NO: 477112 - DNA, 15 bp, Homo sapiens
ttcctctccactgcc

SEQ ID NO: 477113 - DNA, 16 bp, Homo sapiens
ttcctctccactgcct

SEQ ID NO: 477114 - DNA, 20 bp, Homo sapiens
ttcctggattttctttctat

SEQ ID NO: 477115 - DNA, 22 bp, Homo sapiens
ttcctggattttctttctatgt

SEQ ID NO: 477116 - DNA, 16 bp, Homo sapiens
ttcctttgacctctca

SEQ ID NO: 477117 - DNA, 18 bp, Homo sapiens
ttcgcacattctcctgat

SEQ ID NO: 477118 - DNA, 16 bp, Homo sapiens
ttcgcatccaccgcca

SEQ ID NO: 477119 - DNA, 20 bp, Homo sapiens
ttcgcatccaccgccacccc

SEQ ID NO: 477120 - DNA, 22 bp, Homo sapiens
ttcggcaccttcccctgaggac

SEQ ID NO: 477121 - DNA, 21 bp, Homo sapiens
ttctagaaggggcgaggcttt

SEQ ID NO: 477122 - DNA, 22 bp, Homo sapiens
ttctagctataacaactctatt

SEQ ID NO: 477123 - DNA, 23 bp, Homo sapiens
ttctagctataacaactctattt

SEQ ID NO: 477124 - DNA, 20 bp, Homo sapiens
ttctagtcaactgctgtttt

SEQ ID NO: 477125 - DNA, 14 bp, Homo sapiens
ttctagtctctgat

SEQ ID NO: 477126 - DNA, 12 bp, Homo sapiens
ttctatactgtt

SEQ ID NO: 477127 - DNA, 14 bp, Homo sapiens
ttctatatgtttaa

SEQ ID NO: 477128 - DNA, 14 bp, Homo sapiens
ttctatatttcata

SEQ ID NO: 477129 - DNA, 16 bp, Homo sapiens
ttctatatttggattc

SEQ ID NO: 477130 - DNA, 23 bp, Homo sapiens
ttctatatttggattcacagcct

SEQ ID NO: 477131 - DNA, 19 bp, Homo sapiens
ttctatgcctgtatttcca

SEQ ID NO: 477132 - DNA, 15 bp, Homo sapiens
ttctatggattcact

SEQ ID NO: 477133 - DNA, 18 bp, Homo sapiens
ttctatggattcacttct

SEQ ID NO: 477134 - DNA, 19 bp, Homo sapiens
ttctatggattcacttcta

SEQ ID NO: 477135 - DNA, 20 bp, Homo sapiens
ttctatggattcacttctat

SEQ ID NO: 477136 - DNA, 13 bp, Homo sapiens
ttctattatctgg

SEQ ID NO: 477137 - DNA, 17 bp, Homo sapiens
ttctattatctgggttt

SEQ ID NO: 477138 - DNA, 19 bp, Homo sapiens
ttctattggcatggatttc

SEQ ID NO: 477139 - DNA, 13 bp, Homo sapiens
ttctatttctatc

SEQ ID NO: 477140 - DNA, 23 bp, Homo sapiens
ttctcactccctttgtggacttt

SEQ ID NO: 477141 - DNA, 16 bp, Homo sapiens
ttctcactcctacctg

SEQ ID NO: 477142 - DNA, 16 bp, Homo sapiens
ttctcatagccccggt

SEQ ID NO: 477143 - DNA, 16 bp, Homo sapiens
ttctcatcttgtaaat

SEQ ID NO: 477144 - DNA, 12 bp, Homo sapiens
ttctccactgga

SEQ ID NO: 477145 - DNA, 19 bp, Homo sapiens
ttctcccctccagacccct

SEQ ID NO: 477146 - DNA, 12 bp, Homo sapiens
ttctcctctccc

SEQ ID NO: 477147 - DNA, 18 bp, Homo sapiens
ttctcctttcacaacctt

SEQ ID NO: 477148 - DNA, 22 bp, Homo sapiens
ttctcctttcacaaccttctgt

SEQ ID NO: 477149 - DNA, 11 bp, Homo sapiens
ttctctctgtg

SEQ ID NO: 477150 - DNA, 16 bp, Homo sapiens
ttctgaactttggaag

SEQ ID NO: 477151 - DNA, 13 bp, Homo sapiens
ttctgaattcata

SEQ ID NO: 477152 - DNA, 17 bp, Homo sapiens
ttctgaattcataaaaa

SEQ ID NO: 477153 - DNA, 11 bp, Homo sapiens
ttctgcaataa

SEQ ID NO: 477154 - DNA, 15 bp, Homo sapiens
ttctgcaataacagt

SEQ ID NO: 477155 - DNA, 22 bp, Homo sapiens
ttctgcaataacagttttaaga

SEQ ID NO: 477156 - DNA, 16 bp, Homo sapiens
ttctgcagtattctgt

SEQ ID NO: 477157 - DNA, 17 bp, Homo sapiens
ttctgcagtattctgta

SEQ ID NO: 477158 - DNA, 14 bp, Homo sapiens
ttctgctaatttat

SEQ ID NO: 477159 - DNA, 13 bp, Homo sapiens
caataaagcaatg

SEQ ID NO: 477160 - DNA, 17 bp, Homo sapiens
tagccagaggctctaat

SEQ ID NO: 477161 - DNA, 22 bp, Homo sapiens
aaaaaatttgagaaagccttca

SEQ ID NO: 477162 - DNA, 17 bp, Homo sapiens
aaaaactaaaaactaga

SEQ ID NO: 477163 - DNA, 18 bp, Homo sapiens
aaaaagaagcaacctcag

SEQ ID NO: 477164 - DNA, 18 bp, Homo sapiens
aaaaagcgaaaaaatcag

SEQ ID NO: 477165 - DNA, 19 bp, Homo sapiens
aaaaagcttaaaactttga

SEQ ID NO: 477166 - DNA, 20 bp, Homo sapiens
aaaaagcttaaaactttgaa

SEQ ID NO: 477167 - DNA, 16 bp, Homo sapiens
aaaaataagaagaatg

SEQ ID NO: 477168 - DNA, 23 bp, Homo sapiens
aaaaatagtttggatatgtaaaa

SEQ ID NO: 477169 - DNA, 16 bp, Homo sapiens
aaaaattatctttaaa

SEQ ID NO: 477170 - DNA, 20 bp, Homo sapiens
aaaaattatctttaaaactt

SEQ ID NO: 477171 - DNA, 13 bp, Homo sapiens
aaaacatttattt

SEQ ID NO: 477172 - DNA, 17 bp, Homo sapiens
aaaaccattctgcttgg

SEQ ID NO: 477173 - DNA, 16 bp, Homo sapiens
aaaactaaaaactaga

SEQ ID NO: 477174 - DNA, 22 bp, Homo sapiens
aaaactagaggtgagaaattta

SEQ ID NO: 477175 - DNA, 16 bp, Homo sapiens
aaaactgactccttag

SEQ ID NO: 477176 - DNA, 12 bp, Homo sapiens
aaaagaagaagt

SEQ ID NO: 477177 - DNA, 14 bp, Homo sapiens
aaaagaagaagttt

SEQ ID NO: 477178 - DNA, 16 bp, Homo sapiens
aaaagcaaaaaagaaa

SEQ ID NO: 477179 - DNA, 19 bp, Homo sapiens
aaaaggtttatgaaaaaga

SEQ ID NO: 477180 - DNA, 20 bp, Homo sapiens
aaaaggtttatgaaaaagaa

SEQ ID NO: 477181 - DNA, 10 bp, Homo sapiens
aaaatacatg

SEQ ID NO: 477182 - DNA, 20 bp, Homo sapiens
aaaatagctaaatacctcaa

SEQ ID NO: 477183 - DNA, 15 bp, Homo sapiens
aaaatagctataaat

SEQ ID NO: 477184 - DNA, 16 bp, Homo sapiens
aaaatagctataaata

SEQ ID NO: 477185 - DNA, 16 bp, Homo sapiens
aaaatagtttggatat

SEQ ID NO: 477186 - DNA, 19 bp, Homo sapiens
aaaatagtttggatatgta

SEQ ID NO: 477187 - DNA, 18 bp, Homo sapiens
aaaatccttgccttcaaa

SEQ ID NO: 477188 - DNA, 19 bp, Homo sapiens
aaaatgtgtgcttggaaaa

SEQ ID NO: 477189 - DNA, 14 bp, Homo sapiens
aaaatgttctgaca

SEQ ID NO: 477190 - DNA, 12 bp, Homo sapiens
aaaattgaatgc

SEQ ID NO: 477191 - DNA, 19 bp, Homo sapiens
aaaattttattgaatataa

SEQ ID NO: 477192 - DNA, 20 bp, Homo sapiens
aaacaaactcgttttttaca

SEQ ID NO: 477193 - DNA, 18 bp, Homo sapiens
aaacaaagagttcaagaa

SEQ ID NO: 477194 - DNA, 16 bp, Homo sapiens
aaacaaggttttcagt

SEQ ID NO: 477195 - DNA, 19 bp, Homo sapiens
aaacatcattcatttttgt

SEQ ID NO: 477196 - DNA, 20 bp, Homo sapiens
aaacatttattttgacataa

SEQ ID NO: 477197 - DNA, 14 bp, Homo sapiens
aaaccgctaaaaga

SEQ ID NO: 477198 - DNA, 23 bp, Homo sapiens
aaaccgctaaaagaaactttctt

SEQ ID NO: 477199 - DNA, 12 bp, Homo sapiens
aaacttttttat

SEQ ID NO: 477200 - DNA, 17 bp, Homo sapiens
aaacttttttatttaaa

SEQ ID NO: 477201 - DNA, 13 bp, Homo sapiens
aaagaaaaacaaa

SEQ ID NO: 477202 - DNA, 15 bp, Homo sapiens
aaagaagtaaaagca

SEQ ID NO: 477203 - DNA, 20 bp, Homo sapiens
aaagagttcaagaaataagt

SEQ ID NO: 477204 - DNA, 22 bp, Homo sapiens
aaagattttttaataatttaga

SEQ ID NO: 477205 - DNA, 14 bp, Homo sapiens
aaagcaaaaaagaa

SEQ ID NO: 477206 - DNA, 22 bp, Homo sapiens
aaagcaagcattcagaagaaaa

SEQ ID NO: 477207 - DNA, 14 bp, Homo sapiens
aaagctagaattga

SEQ ID NO: 477208 - DNA, 20 bp, Homo sapiens
aaagctagaattgagtgttt

SEQ ID NO: 477209 - DNA, 15 bp, Homo sapiens
aaagctggtttaatg

SEQ ID NO: 477210 - DNA, 18 bp, Homo sapiens
aaagctggtttaatgttt

SEQ ID NO: 477211 - DNA, 20 bp, Homo sapiens
aaagttgataaagatttttt

SEQ ID NO: 477212 - DNA, 12 bp, Homo sapiens
aaagtttaataa

SEQ ID NO: 477213 - DNA, 18 bp, Homo sapiens
aaataaagaatagcaatt

SEQ ID NO: 477214 - DNA, 12 bp, Homo sapiens
aaataagaaact

SEQ ID NO: 477215 - DNA, 21 bp, Homo sapiens
aaataagaaacttttttattt

SEQ ID NO: 477216 - DNA, 16 bp, Homo sapiens
aaatagcaaaagaaga

SEQ ID NO: 477217 - DNA, 17 bp, Homo sapiens
aaatagcaaaagaagaa

SEQ ID NO: 477218 - DNA, 20 bp, Homo sapiens
aaatagctataaatagtgaa

SEQ ID NO: 477219 - DNA, 12 bp, Homo sapiens
aaatataaaaat

SEQ ID NO: 477220 - DNA, 15 bp, Homo sapiens
aaatatgatgttaaa

SEQ ID NO: 477221 - DNA, 19 bp, Homo sapiens
aaatattttaaagaattgt

SEQ ID NO: 477222 - DNA, 14 bp, Homo sapiens
aaatcattttgcaa

SEQ ID NO: 477223 - DNA, 20 bp, Homo sapiens
aaatcttggttgatgccaaa

SEQ ID NO: 477224 - DNA, 22 bp, Homo sapiens
aaatcttggttgatgccaaaaa

SEQ ID NO: 477225 - DNA, 17 bp, Homo sapiens
aaatgatatgtctttaa

SEQ ID NO: 477226 - DNA, 14 bp, Homo sapiens
aaatgattgtagta

SEQ ID NO: 477227 - DNA, 18 bp, Homo sapiens
aaatgtgtgcttggaaaa

SEQ ID NO: 477228 - DNA, 16 bp, Homo sapiens
aaattaacttctattt

SEQ ID NO: 477229 - DNA, 17 bp, Homo sapiens
aaattaacttctatttt

SEQ ID NO: 477230 - DNA, 19 bp, Homo sapiens
aaattaccagagttgttct

SEQ ID NO: 477231 - DNA, 12 bp, Homo sapiens
aaattatttaaa

SEQ ID NO: 477232 - DNA, 15 bp, Homo sapiens
aaattgaatgcaaac

SEQ ID NO: 477233 - DNA, 19 bp, Homo sapiens
aaattttattgaatataat

SEQ ID NO: 477234 - DNA, 17 bp, Homo sapiens
aacaaagagttcaagaa

SEQ ID NO: 477235 - DNA, 19 bp, Homo sapiens
aacagacaccatcttttgt

SEQ ID NO: 477236 - DNA, 18 bp, Homo sapiens
aacagcctgacaacattt

SEQ ID NO: 477237 - DNA, 13 bp, Homo sapiens
aacaggtctcctc

SEQ ID NO: 477238 - DNA, 19 bp, Homo sapiens
aacaggtctcctcttaaaa

SEQ ID NO: 477239 - DNA, 20 bp, Homo sapiens
aacaggtctcctcttaaaaa

SEQ ID NO: 477240 - DNA, 14 bp, Homo sapiens
aacataaaaatgat

SEQ ID NO: 477241 - DNA, 19 bp, Homo sapiens
aacatagacagaagaaaca

SEQ ID NO: 477242 - DNA, 21 bp, Homo sapiens
aacatagacagaagaaacaag

SEQ ID NO: 477243 - DNA, 22 bp, Homo sapiens
aacatttctatagccaaaaata

SEQ ID NO: 477244 - DNA, 14 bp, Homo sapiens
aacctcagtaattt

SEQ ID NO: 477245 - DNA, 17 bp, Homo sapiens
aacgatcatatctgtat

SEQ ID NO: 477246 - DNA, 22 bp, Homo sapiens
aactagcaaaaggatgatttaa

SEQ ID NO: 477247 - DNA, 14 bp, Homo sapiens
aactcagagcctcc

SEQ ID NO: 477248 - DNA, 15 bp, Homo sapiens
aactcgttttttaca

SEQ ID NO: 477249 - DNA, 20 bp, Homo sapiens
aactctgtgttgtgaatgtc

SEQ ID NO: 477250 - DNA, 13 bp, Homo sapiens
aactgaaaattat

SEQ ID NO: 477251 - DNA, 15 bp, Homo sapiens
aacttgctgtgaaat

SEQ ID NO: 477252 - DNA, 21 bp, Homo sapiens
aacttggttttgctacataat

SEQ ID NO: 477253 - DNA, 22 bp, Homo sapiens
aacttggttttgctacataatt

SEQ ID NO: 477254 - DNA, 19 bp, Homo sapiens
aactttaaagcgtttgcac

SEQ ID NO: 477255 - DNA, 15 bp, Homo sapiens
aactttgaagttagc

SEQ ID NO: 477256 - DNA, 16 bp, Homo sapiens
aagaaacaaggttttc

SEQ ID NO: 477257 - DNA, 11 bp, Homo sapiens
aagaaactttc

SEQ ID NO: 477258 - DNA, 14 bp, Homo sapiens
aagaaactttttta

SEQ ID NO: 477259 - DNA, 15 bp, Homo sapiens
aagaaataagttttt

SEQ ID NO: 477260 - DNA, 15 bp, Homo sapiens
aagaagtttcatcat

SEQ ID NO: 477261 - DNA, 16 bp, Homo sapiens
aagaatacttctcatt

SEQ ID NO: 477262 - DNA, 22 bp, Homo sapiens
aagaatacttctcattttttaa

SEQ ID NO: 477263 - DNA, 13 bp, Homo sapiens
aagaatgcttaat

SEQ ID NO: 477264 - DNA, 14 bp, Homo sapiens
aagagctacataat

SEQ ID NO: 477265 - DNA, 17 bp, Homo sapiens
aagattttttaataatt

SEQ ID NO: 477266 - DNA, 22 bp, Homo sapiens
aagcaacctcagtaatttagaa

SEQ ID NO: 477267 - DNA, 15 bp, Homo sapiens
aagcatggctatttt

SEQ ID NO: 477268 - DNA, 16 bp, Homo sapiens
aagcattgaatggcta

SEQ ID NO: 477269 - DNA, 13 bp, Homo sapiens
aagcattttgtaa

SEQ ID NO: 477270 - DNA, 23 bp, Homo sapiens
aagcattttgtaagttgaagcaa

SEQ ID NO: 477271 - DNA, 22 bp, Homo sapiens
aagcgctcatctggcttttcgc

SEQ ID NO: 477272 - DNA, 19 bp, Homo sapiens
aagctagaattgagtgttt

SEQ ID NO: 477273 - DNA, 23 bp, Homo sapiens
aagctcaggaggcgaataaatgt

SEQ ID NO: 477274 - DNA, 15 bp, Homo sapiens
aagcttaaaactttg

SEQ ID NO: 477275 - DNA, 19 bp, Homo sapiens
aagcttaatggctgataat

SEQ ID NO: 477276 - DNA, 18 bp, Homo sapiens
aaggagatggggagggcg

SEQ ID NO: 477277 - DNA, 19 bp, Homo sapiens
aaggagtgtagcaactaca

SEQ ID NO: 477278 - DNA, 21 bp, Homo sapiens
aaggcaaaaatagtttggata

SEQ ID NO: 477279 - DNA, 18 bp, Homo sapiens
aaggtacaagaagcattt

SEQ ID NO: 477280 - DNA, 19 bp, Homo sapiens
aaggtacaagaagcatttt

SEQ ID NO: 477281 - DNA, 15 bp, Homo sapiens
aagtagaaatcatag

SEQ ID NO: 477282 - DNA, 23 bp, Homo sapiens
aagtaggactttcctaaatgttt

SEQ ID NO: 477283 - DNA, 20 bp, Homo sapiens
aagtatttgttaatttagaa

SEQ ID NO: 477284 - DNA, 21 bp, Homo sapiens
aagtatttgttaatttagaaa

SEQ ID NO: 477285 - DNA, 16 bp, Homo sapiens
aagttcaacatgttat

SEQ ID NO: 477286 - DNA, 15 bp, Homo sapiens
aagttgtcctttctg

SEQ ID NO: 477287 - DNA, 14 bp, Homo sapiens
aagtttaataaatt

SEQ ID NO: 477288 - DNA, 15 bp, Homo sapiens
aagtttcatcatttt

SEQ ID NO: 477289 - DNA, 24 bp, Homo sapiens
aataaaaatagctataaatagtga

SEQ ID NO: 477290 - DNA, 17 bp, Homo sapiens
aataaatgttcaaactg

SEQ ID NO: 477291 - DNA, 20 bp, Homo sapiens
aataagtttttgtttcacag

SEQ ID NO: 477292 - DNA, 12 bp, Homo sapiens
aataatttagac

SEQ ID NO: 477293 - DNA, 14 bp, Homo sapiens
aatacttctcattt

SEQ ID NO: 477294 - DNA, 16 bp, Homo sapiens
aatacttctcattttt

SEQ ID NO: 477295 - DNA, 15 bp, Homo sapiens
aatacttgacaacat

SEQ ID NO: 477296 - DNA, 19 bp, Homo sapiens
aatacttgacaacattttt

SEQ ID NO: 477297 - DNA, 22 bp, Homo sapiens
aatagatgtttgatagattttc

SEQ ID NO: 477298 - DNA, 19 bp, Homo sapiens
aatagcaaaagaagaagtt

SEQ ID NO: 477299 - DNA, 20 bp, Homo sapiens
aatagcaaaagaagaagttt

SEQ ID NO: 477300 - DNA, 21 bp, Homo sapiens
aatagctaaatacctcaatca

SEQ ID NO: 477301 - DNA, 13 bp, Homo sapiens
aatagtgaaaatt

SEQ ID NO: 477302 - DNA, 20 bp, Homo sapiens
aatataatggcctcttaaaa

SEQ ID NO: 477303 - DNA, 15 bp, Homo sapiens
aatatgagattggaa

SEQ ID NO: 477304 - DNA, 16 bp, Homo sapiens
aatattttaaagaatt

SEQ ID NO: 477305 - DNA, 13 bp, Homo sapiens
aatcaaaaaatta

SEQ ID NO: 477306 - DNA, 15 bp, Homo sapiens
aatcacgctttttga

SEQ ID NO: 477307 - DNA, 17 bp, Homo sapiens
aatcacgctttttgaaa

SEQ ID NO: 477308 - DNA, 14 bp, Homo sapiens
aatcagatagatat

SEQ ID NO: 477309 - DNA, 15 bp, Homo sapiens
aatccatgcttgggt

SEQ ID NO: 477310 - DNA, 23 bp, Homo sapiens
aatccctggttttaagtatcaat

SEQ ID NO: 477311 - DNA, 16 bp, Homo sapiens
aatccttgccttcaaa

SEQ ID NO: 477312 - DNA, 14 bp, Homo sapiens
aatctaaattaact

SEQ ID NO: 477313 - DNA, 17 bp, Homo sapiens
aatctcatctcagtgaa

SEQ ID NO: 477314 - DNA, 16 bp, Homo sapiens
aatctgcattattgga

SEQ ID NO: 477315 - DNA, 19 bp, Homo sapiens
aatcttggttgatgccaaa

SEQ ID NO: 477316 - DNA, 22 bp, Homo sapiens
aatgaaatacttgacaacattt

SEQ ID NO: 477317 - DNA, 12 bp, Homo sapiens
aatgaacagaac

SEQ ID NO: 477318 - DNA, 16 bp, Homo sapiens
aatgatatgtctttaa

SEQ ID NO: 477319 - DNA, 19 bp, Homo sapiens
aatgattcacttttattgt

SEQ ID NO: 477320 - DNA, 15 bp, Homo sapiens
aatgattgtagtaat

SEQ ID NO: 477321 - DNA, 22 bp, Homo sapiens
aatgcttaatcagatagatatt

SEQ ID NO: 477322 - DNA, 15 bp, Homo sapiens
aatggcctcttaaaa

SEQ ID NO: 477323 - DNA, 14 bp, Homo sapiens
aatggctatgtttt

SEQ ID NO: 477324 - DNA, 20 bp, Homo sapiens
aatggctatgtttttaatgt

SEQ ID NO: 477325 - DNA, 15 bp, Homo sapiens
aatggctgataattt

SEQ ID NO: 477326 - DNA, 19 bp, Homo sapiens
aatgtcattttggtacttt

SEQ ID NO: 477327 - DNA, 15 bp, Homo sapiens
aatgtttaaaccttt

SEQ ID NO: 477328 - DNA, 14 bp, Homo sapiens
aattaaatgaaata

SEQ ID NO: 477329 - DNA, 16 bp, Homo sapiens
aattaaatgaaatact

SEQ ID NO: 477330 - DNA, 17 bp, Homo sapiens
aattaaatgaaatactt

SEQ ID NO: 477331 - DNA, 13 bp, Homo sapiens
aattatctttaaa

SEQ ID NO: 477332 - DNA, 16 bp, Homo sapiens
aattatctttaaaact

SEQ ID NO: 477333 - DNA, 20 bp, Homo sapiens
aattatgaagccctaagtaa

SEQ ID NO: 477334 - DNA, 22 bp, Homo sapiens
aattcaaagctgtgtgtttgga

SEQ ID NO: 477335 - DNA, 13 bp, Homo sapiens
aattcaattcaaa

SEQ ID NO: 477336 - DNA, 15 bp, Homo sapiens
aattcaattcaaagc

SEQ ID NO: 477337 - DNA, 14 bp, Homo sapiens
aattctaaaatgat

SEQ ID NO: 477338 - DNA, 18 bp, Homo sapiens
aattgagtgtttaaagtt

SEQ ID NO: 477339 - DNA, 14 bp, Homo sapiens
aattgcttctctaa

SEQ ID NO: 477340 - DNA, 20 bp, Homo sapiens
aattgcttctctaaaacagc

SEQ ID NO: 477341 - DNA, 22 bp, Homo sapiens
aattgttttatctgaattttta

SEQ ID NO: 477342 - DNA, 16 bp, Homo sapiens
aatttagaaaacttta

SEQ ID NO: 477343 - DNA, 14 bp, Homo sapiens
aatttagaaatcat

SEQ ID NO: 477344 - DNA, 20 bp, Homo sapiens
aatttagaaatcattttgca

SEQ ID NO: 477345 - DNA, 21 bp, Homo sapiens
aatttagaaatcattttgcaa

SEQ ID NO: 477346 - DNA, 12 bp, Homo sapiens
aatttagtttca

SEQ ID NO: 477347 - DNA, 14 bp, Homo sapiens
aatttagtttcata

SEQ ID NO: 477348 - DNA, 13 bp, Homo sapiens
aatttattttctt

SEQ ID NO: 477349 - DNA, 20 bp, Homo sapiens
aatttctagatatgagaaat

SEQ ID NO: 477350 - DNA, 18 bp, Homo sapiens
aatttgaaaataattgtt

SEQ ID NO: 477351 - DNA, 15 bp, Homo sapiens
aatttttaaacaagt

SEQ ID NO: 477352 - DNA, 13 bp, Homo sapiens
aatttttgatact

SEQ ID NO: 477353 - DNA, 22 bp, Homo sapiens
acaaaatgtgtgcttggaaaat

SEQ ID NO: 477354 - DNA, 18 bp, Homo sapiens
acaaagagttcaagaaat

SEQ ID NO: 477355 - DNA, 21 bp, Homo sapiens
acaaagagttcaagaaataag

SEQ ID NO: 477356 - DNA, 15 bp, Homo sapiens
acaaagcccttttat

SEQ ID NO: 477357 - DNA, 23 bp, Homo sapiens
acaaatgatttcgtgactgtagt

SEQ ID NO: 477358 - DNA, 14 bp, Homo sapiens
acaaattccttccc

SEQ ID NO: 477359 - DNA, 14 bp, Homo sapiens
acaacatttctata

SEQ ID NO: 477360 - DNA, 17 bp, Homo sapiens
acaagaagcattttgta

SEQ ID NO: 477361 - DNA, 24 bp, Homo sapiens
acaagccttactcacctctctcta

SEQ ID NO: 477362 - DNA, 23 bp, Homo sapiens
acaagctcaggaggcgaataaat

SEQ ID NO: 477363 - DNA, 17 bp, Homo sapiens
acaagtatttgttaatt

SEQ ID NO: 477364 - DNA, 20 bp, Homo sapiens
acaagtatttgttaatttag

SEQ ID NO: 477365 - DNA, 17 bp, Homo sapiens
acaatcatctattgagt

SEQ ID NO: 477366 - DNA, 12 bp, Homo sapiens
acaattctaaaa

SEQ ID NO: 477367 - DNA, 14 bp, Homo sapiens
acaattctaaaatg

SEQ ID NO: 477368 - DNA, 17 bp, Homo sapiens
acaccaacataaaaatg

SEQ ID NO: 477369 - DNA, 17 bp, Homo sapiens
acactacacactgtgta

SEQ ID NO: 477370 - DNA, 16 bp, Homo sapiens
acactcatcaggtaaa

SEQ ID NO: 477371 - DNA, 21 bp, Homo sapiens
acagagtaaatagcattctct

SEQ ID NO: 477372 - DNA, 22 bp, Homo sapiens
acaggcatccgctgcgctccca

SEQ ID NO: 477373 - DNA, 18 bp, Homo sapiens
acaggtctcctcttaaaa

SEQ ID NO: 477374 - DNA, 19 bp, Homo sapiens
acataaaaatgatctaaac

SEQ ID NO: 477375 - DNA, 15 bp, Homo sapiens
acatcattcattttt

SEQ ID NO: 477376 - DNA, 18 bp, Homo sapiens
acatctctgtaaaaagca

SEQ ID NO: 477377 - DNA, 17 bp, Homo sapiens
acatgctaagagaagta

SEQ ID NO: 477378 - DNA, 19 bp, Homo sapiens
acatgctaagagaagtaga

SEQ ID NO: 477379 - DNA, 20 bp, Homo sapiens
aggctagagtgcagtggcat

SEQ ID NO: 477380 - DNA, 17 bp, Homo sapiens
aggctgcagtgagccaa

SEQ ID NO: 477381 - DNA, 11 bp, Homo sapiens
aggggaggctg

SEQ ID NO: 477382 - DNA, 12 bp, Homo sapiens
aggggaggctga

SEQ ID NO: 477383 - DNA, 20 bp, Homo sapiens
aggtcagtgttataaaatct

SEQ ID NO: 477384 - DNA, 14 bp, Homo sapiens
aggtcccttgtttc

SEQ ID NO: 477385 - DNA, 17 bp, Homo sapiens
agtaaatctaaattaac

SEQ ID NO: 477386 - DNA, 12 bp, Homo sapiens
agtaatttagaa

SEQ ID NO: 477387 - DNA, 17 bp, Homo sapiens
agtaatttagaaatcat

SEQ ID NO: 477388 - DNA, 23 bp, Homo sapiens
agtaatttagaaatcattttgca

SEQ ID NO: 477389 - DNA, 22 bp, Homo sapiens
agtagcagtgattgtcttaata

SEQ ID NO: 477390 - DNA, 13 bp, Homo sapiens
agtatttgttaat

SEQ ID NO: 477391 - DNA, 18 bp, Homo sapiens
agtatttgttaatttaga

SEQ ID NO: 477392 - DNA, 20 bp, Homo sapiens
agtcagccattcctgttctc

SEQ ID NO: 477393 - DNA, 21 bp, Homo sapiens
agtctaaagctggtttaatgt

SEQ ID NO: 477394 - DNA, 19 bp, Homo sapiens
agtgaaaaagacttcaaat

SEQ ID NO: 477395 - DNA, 15 bp, Homo sapiens
agtgagttttttagt

SEQ ID NO: 477396 - DNA, 13 bp, Homo sapiens
agttcaacatgtt

SEQ ID NO: 477397 - DNA, 21 bp, Homo sapiens
agttgataaagattttttaat

SEQ ID NO: 477398 - DNA, 15 bp, Homo sapiens
agttgtatctctttt

SEQ ID NO: 477399 - DNA, 22 bp, Homo sapiens
agttgtatctcttttgaatcca

SEQ ID NO: 477400 - DNA, 17 bp, Homo sapiens
agtttaataaatttatt

SEQ ID NO: 477401 - DNA, 14 bp, Homo sapiens
agtttggatatgta

SEQ ID NO: 477402 - DNA, 15 bp, Homo sapiens
ataaaatctgtattg

SEQ ID NO: 477403 - DNA, 11 bp, Homo sapiens
ataaatgttca

SEQ ID NO: 477404 - DNA, 17 bp, Homo sapiens
ataaatgttcaaactgt

SEQ ID NO: 477405 - DNA, 12 bp, Homo sapiens
ataacattgtaa

SEQ ID NO: 477406 - DNA, 21 bp, Homo sapiens
ataactgaaaattatttaaac

SEQ ID NO: 477407 - DNA, 13 bp, Homo sapiens
ataagaaactttt

SEQ ID NO: 477408 - DNA, 16 bp, Homo sapiens
ataagcaagaaggcaa

SEQ ID NO: 477409 - DNA, 23 bp, Homo sapiens
ataagcaagaaggcaaaaatagt

SEQ ID NO: 477410 - DNA, 16 bp, Homo sapiens
ataatggcctcttaaa

SEQ ID NO: 477411 - DNA, 17 bp, Homo sapiens
ataatggcctcttaaaa

SEQ ID NO: 477412 - DNA, 23 bp, Homo sapiens
ataatggcctcttaaaaattatc

SEQ ID NO: 477413 - DNA, 21 bp, Homo sapiens
ataattaaaacaaaatccttg

SEQ ID NO: 477414 - DNA, 16 bp, Homo sapiens
ataattaaatgaaata

SEQ ID NO: 477415 - DNA, 21 bp, Homo sapiens
ataattgttttatctgaattt

SEQ ID NO: 477416 - DNA, 17 bp, Homo sapiens
ataatttagtttcatat

SEQ ID NO: 477417 - DNA, 22 bp, Homo sapiens
atacatgctaagagaagtagaa

SEQ ID NO: 477418 - DNA, 15 bp, Homo sapiens
ataccattttgaaat

SEQ ID NO: 477419 - DNA, 21 bp, Homo sapiens
atactaagcattgaatggcta

SEQ ID NO: 477420 - DNA, 13 bp, Homo sapiens
atagacagaagaa

SEQ ID NO: 477421 - DNA, 18 bp, Homo sapiens
atagataccattttgaaa

SEQ ID NO: 477422 - DNA, 17 bp, Homo sapiens
atagcaaaagaagaagt

SEQ ID NO: 477423 - DNA, 18 bp, Homo sapiens
atagcaaaagaagaagtt

SEQ ID NO: 477424 - DNA, 19 bp, Homo sapiens
atagcaaaagaagaagttt

SEQ ID NO: 477425 - DNA, 13 bp, Homo sapiens
atagcaaagaatt

SEQ ID NO: 477426 - DNA, 14 bp, Homo sapiens
atagcacaggctaa

SEQ ID NO: 477427 - DNA, 13 bp, Homo sapiens
atagccaaaaata

SEQ ID NO: 477428 - DNA, 15 bp, Homo sapiens
atagccaaaaatagc

SEQ ID NO: 477429 - DNA, 18 bp, Homo sapiens
atagctataaatagtgaa

SEQ ID NO: 477430 - DNA, 16 bp, Homo sapiens
ataggatttatttaaa

SEQ ID NO: 477431 - DNA, 19 bp, Homo sapiens
atagtaaatcacgcttttt

SEQ ID NO: 477432 - DNA, 12 bp, Homo sapiens
atagtgaaaatt

SEQ ID NO: 477433 - DNA, 20 bp, Homo sapiens
atataaaaataattaaaaca

SEQ ID NO: 477434 - DNA, 24 bp, Homo sapiens
atataaagtatcatcagtgtagaa

SEQ ID NO: 477435 - DNA, 18 bp, Homo sapiens
atataatggcctcttaaa

SEQ ID NO: 477436 - DNA, 18 bp, Homo sapiens
atatattttgaaaggaga

SEQ ID NO: 477437 - DNA, 15 bp, Homo sapiens
atatcctaaacatca

SEQ ID NO: 477438 - DNA, 22 bp, Homo sapiens
atatctcctgaaaaggtttatg

SEQ ID NO: 477439 - DNA, 13 bp, Homo sapiens
atatgtaaaacat

SEQ ID NO: 477440 - DNA, 16 bp, Homo sapiens
atatgtaaaacattta

SEQ ID NO: 477441 - DNA, 13 bp, Homo sapiens
atatgtctttaaa

SEQ ID NO: 477442 - DNA, 21 bp, Homo sapiens
atattatgtatttatattttg

SEQ ID NO: 477443 - DNA, 17 bp, Homo sapiens
atattattcattcattt

SEQ ID NO: 477444 - DNA, 17 bp, Homo sapiens
atattcctattgtgcaa

SEQ ID NO: 477445 - DNA, 19 bp, Homo sapiens
atattgtgggtgttaattt

SEQ ID NO: 477446 - DNA, 14 bp, Homo sapiens
atattttaaagaat

SEQ ID NO: 477447 - DNA, 16 bp, Homo sapiens
atattttaaagaattg

SEQ ID NO: 477448 - DNA, 12 bp, Homo sapiens
atattttgaaag

SEQ ID NO: 477449 - DNA, 22 bp, Homo sapiens
atcaaacaccaacataaaaatg

SEQ ID NO: 477450 - DNA, 23 bp, Homo sapiens
atcaaacaccaacataaaaatga

SEQ ID NO: 477451 - DNA, 21 bp, Homo sapiens
atcaacttaccaggcaccaaa

SEQ ID NO: 477452 - DNA, 16 bp, Homo sapiens
atcaatccttgttcag

SEQ ID NO: 477453 - DNA, 16 bp, Homo sapiens
atcagtctcagaatgt

SEQ ID NO: 477454 - DNA, 17 bp, Homo sapiens
atcagttttatccacag

SEQ ID NO: 477455 - DNA, 16 bp, Homo sapiens
atcatatctgtatgcc

SEQ ID NO: 477456 - DNA, 19 bp, Homo sapiens
atcatctattgagtgtaca

SEQ ID NO: 477457 - DNA, 16 bp, Homo sapiens
atcattatgtaatgtc

SEQ ID NO: 477458 - DNA, 19 bp, Homo sapiens
atccatcggtttatactat

SEQ ID NO: 477459 - DNA, 21 bp, Homo sapiens
atccatttcatctatttctga

SEQ ID NO: 477460 - DNA, 22 bp, Homo sapiens
atccatttcatctatttctgag

SEQ ID NO: 477461 - DNA, 23 bp, Homo sapiens
atccatttcatctatttctgaga

SEQ ID NO: 477462 - DNA, 21 bp, Homo sapiens
atcccttaatatcctaaacat

SEQ ID NO: 477463 - DNA, 20 bp, Homo sapiens
atcgcagaccttttttagga

SEQ ID NO: 477464 - DNA, 19 bp, Homo sapiens
atctaaattaacttctatt

SEQ ID NO: 477465 - DNA, 20 bp, Homo sapiens
atctcagtgaagaatacttc

SEQ ID NO: 477466 - DNA, 19 bp, Homo sapiens
atctcatctcagtgaagaa

SEQ ID NO: 477467 - DNA, 12 bp, Homo sapiens
atctgaattttt

SEQ ID NO: 477468 - DNA, 19 bp, Homo sapiens
atctgaatttttaaacaag

SEQ ID NO: 477469 - DNA, 13 bp, Homo sapiens
atctgtatgcctc

SEQ ID NO: 477470 - DNA, 23 bp, Homo sapiens
atcttttgtgagatgtaattgtt

SEQ ID NO: 477471 - DNA, 15 bp, Homo sapiens
atgaaaaagaagaat

SEQ ID NO: 477472 - DNA, 13 bp, Homo sapiens
atgaaaagctaga

SEQ ID NO: 477473 - DNA, 22 bp, Homo sapiens
atgaactcaggtttccggctac

SEQ ID NO: 477474 - DNA, 21 bp, Homo sapiens
atgaagccctaagtaaatcta

SEQ ID NO: 477475 - DNA, 17 bp, Homo sapiens
atgactgtgattttcag

SEQ ID NO: 477476 - DNA, 12 bp, Homo sapiens
atgagattggaa

SEQ ID NO: 477477 - DNA, 22 bp, Homo sapiens
atgagattggaaaaaattagac

SEQ ID NO: 477478 - DNA, 15 bp, Homo sapiens
atgatatgtctttaa

SEQ ID NO: 477479 - DNA, 21 bp, Homo sapiens
atgatgttaaaaaaataagaa

SEQ ID NO: 477480 - DNA, 17 bp, Homo sapiens
atgattcacttttattg

SEQ ID NO: 477481 - DNA, 13 bp, Homo sapiens
atgatttaacatt

SEQ ID NO: 477482 - DNA, 16 bp, Homo sapiens
atgcacctaaagaaaa

SEQ ID NO: 477483 - DNA, 23 bp, Homo sapiens
atgcacctaaagaaaaacaaact

SEQ ID NO: 477484 - DNA, 18 bp, Homo sapiens
atgccaaaaaaaaataca

SEQ ID NO: 477485 - DNA, 13 bp, Homo sapiens
atgccaatgtcca

SEQ ID NO: 477486 - DNA, 16 bp, Homo sapiens
atgcctcattttattc

SEQ ID NO: 477487 - DNA, 22 bp, Homo sapiens
atgcctttctagcaattgcttc

SEQ ID NO: 477488 - DNA, 15 bp, Homo sapiens
atgctaagagaagta

SEQ ID NO: 477489 - DNA, 16 bp, Homo sapiens
atgctaagagaagtag

SEQ ID NO: 477490 - DNA, 22 bp, Homo sapiens
atgctaagagaagtagaaatca

SEQ ID NO: 477491 - DNA, 18 bp, Homo sapiens
atgctacaaaatgtgtgc

SEQ ID NO: 477492 - DNA, 12 bp, Homo sapiens
atggattctaaa

SEQ ID NO: 477493 - DNA, 13 bp, Homo sapiens
atggccaggcctc

SEQ ID NO: 477494 - DNA, 19 bp, Homo sapiens
atggcctcttaaaaattat

SEQ ID NO: 477495 - DNA, 16 bp, Homo sapiens
caggcctcagggacca

SEQ ID NO: 477496 - DNA, 14 bp, Homo sapiens
cagggaccaaggag

SEQ ID NO: 477497 - DNA, 13 bp, Homo sapiens
caggggaggctga

SEQ ID NO: 477498 - DNA, 14 bp, Homo sapiens
caggggaggctgag

SEQ ID NO: 477499 - DNA, 13 bp, Homo sapiens
caggtcacaggca

SEQ ID NO: 477500 - DNA, 17 bp, Homo sapiens
caggtctcctcttaaaa

SEQ ID NO: 477501 - DNA, 14 bp, Homo sapiens
cagtaatttagaaa

SEQ ID NO: 477502 - DNA, 20 bp, Homo sapiens
cagtgattgtcttaatattg

SEQ ID NO: 477503 - DNA, 18 bp, Homo sapiens
cagttttatccacagaaa

SEQ ID NO: 477504 - DNA, 22 bp, Homo sapiens
catactcatttttcatgataat

SEQ ID NO: 477505 - DNA, 15 bp, Homo sapiens
catagacagaagaaa

SEQ ID NO: 477506 - DNA, 12 bp, Homo sapiens
catagataccat

SEQ ID NO: 477507 - DNA, 18 bp, Homo sapiens
catagataccattttgaa

SEQ ID NO: 477508 - DNA, 22 bp, Homo sapiens
catagataccattttgaaatat

SEQ ID NO: 477509 - DNA, 12 bp, Homo sapiens
catataaagtat

SEQ ID NO: 477510 - DNA, 19 bp, Homo sapiens
catccatttcatctatttc

SEQ ID NO: 477511 - DNA, 15 bp, Homo sapiens
catctatttctgaga

SEQ ID NO: 477512 - DNA, 22 bp, Homo sapiens
catctcagtgaagaatacttct

SEQ ID NO: 477513 - DNA, 11 bp, Homo sapiens
catctggcctg

SEQ ID NO: 477514 - DNA, 14 bp, Homo sapiens
catctggcctgggg

SEQ ID NO: 477515 - DNA, 21 bp, Homo sapiens
catcttttgtgagatgtaatt

SEQ ID NO: 477516 - DNA, 15 bp, Homo sapiens
catgatctcggctta

SEQ ID NO: 477517 - DNA, 18 bp, Homo sapiens
catgccaatgtccaggtc

SEQ ID NO: 477518 - DNA, 22 bp, Homo sapiens
catgcccagtcgatatctcact

SEQ ID NO: 477519 - DNA, 16 bp, Homo sapiens
catgctaagagaagta

SEQ ID NO: 477520 - DNA, 19 bp, Homo sapiens
catgctaagagaagtagaa

SEQ ID NO: 477521 - DNA, 21 bp, Homo sapiens
catgctaagagaagtagaaat

SEQ ID NO: 477522 - DNA, 19 bp, Homo sapiens
catgtccttgtgtgttttg

SEQ ID NO: 477523 - DNA, 23 bp, Homo sapiens
catgttatttgtaatagatgttt

SEQ ID NO: 477524 - DNA, 18 bp, Homo sapiens
cattattggaatataatt

SEQ ID NO: 477525 - DNA, 17 bp, Homo sapiens
cattcagaagaaaaaga

SEQ ID NO: 477526 - DNA, 18 bp, Homo sapiens
cattcagaagaaaaagaa

SEQ ID NO: 477527 - DNA, 23 bp, Homo sapiens
cattcctgttctctttgccttga

SEQ ID NO: 477528 - DNA, 22 bp, Homo sapiens
cattgaatggctatgtttttaa

SEQ ID NO: 477529 - DNA, 14 bp, Homo sapiens
catttcatctattt

SEQ ID NO: 477530 - DNA, 15 bp, Homo sapiens
catttcatctatttc

SEQ ID NO: 477531 - DNA, 23 bp, Homo sapiens
catttctatagccaaaaatagct

SEQ ID NO: 477532 - DNA, 14 bp, Homo sapiens
ccaaaacaatgttt

SEQ ID NO: 477533 - DNA, 18 bp, Homo sapiens
ccaagatacttaagtgct

SEQ ID NO: 477534 - DNA, 14 bp, Homo sapiens
ccaatttatgcaga

SEQ ID NO: 477535 - DNA, 22 bp, Homo sapiens
ccacaagccttactcacctctc

SEQ ID NO: 477536 - DNA, 18 bp, Homo sapiens
ccacagataactgaaaat

SEQ ID NO: 477537 - DNA, 24 bp, Homo sapiens
ccaggctaatttttttgtatttta

SEQ ID NO: 477538 - DNA, 15 bp, Homo sapiens
ccaggtcacaggcat

SEQ ID NO: 477539 - DNA, 18 bp, Homo sapiens
ccagtcgatatctcactt

SEQ ID NO: 477540 - DNA, 14 bp, Homo sapiens
ccagtctaaaaata

SEQ ID NO: 477541 - DNA, 23 bp, Homo sapiens
ccatcttgggattcctcccctgg

SEQ ID NO: 477542 - DNA, 17 bp, Homo sapiens
ccatgccaatgtccagg

SEQ ID NO: 477543 - DNA, 23 bp, Homo sapiens
cccaagagctacgtatttaatag

SEQ ID NO: 477544 - DNA, 21 bp, Homo sapiens
cccagctacaggggaggctga

SEQ ID NO: 477545 - DNA, 14 bp, Homo sapiens
cccatgccaatgtc

SEQ ID NO: 477546 - DNA, 19 bp, Homo sapiens
ccccatgccaatgtccagg

SEQ ID NO: 477547 - DNA, 14 bp, Homo sapiens
ccccggcctgatgg

SEQ ID NO: 477548 - DNA, 18 bp, Homo sapiens
ccctctgttgccaggcta

SEQ ID NO: 477549 - DNA, 14 bp, Homo sapiens
ccgctaaaagaaac

SEQ ID NO: 477550 - DNA, 19 bp, Homo sapiens
cctaagtaaatctaaatta

SEQ ID NO: 477551 - DNA, 21 bp, Homo sapiens
cctattgctgtaaataaaaat

SEQ ID NO: 477552 - DNA, 16 bp, Homo sapiens
cctcacctgagagcca

SEQ ID NO: 477553 - DNA, 17 bp, Homo sapiens
cctcagggaccaaggag

SEQ ID NO: 477554 - DNA, 14 bp, Homo sapiens
cctcccctggaagt

SEQ ID NO: 477555 - DNA, 17 bp, Homo sapiens
cctcctgggcatgtttg

SEQ ID NO: 477556 - DNA, 20 bp, Homo sapiens
cctcctgggcatgtttgtct

SEQ ID NO: 477557 - DNA, 13 bp, Homo sapiens
cctctctctaagt

SEQ ID NO: 477558 - DNA, 22 bp, Homo sapiens
cctgaagtcaaaccttaagata

SEQ ID NO: 477559 - DNA, 19 bp, Homo sapiens
cctgaatttattattgttc

SEQ ID NO: 477560 - DNA, 15 bp, Homo sapiens
cctgatggccaggcc

SEQ ID NO: 477561 - DNA, 23 bp, Homo sapiens
cctgatggccaggcctcagggac

SEQ ID NO: 477562 - DNA, 21 bp, Homo sapiens
cctgggcaacagagtgagacc

SEQ ID NO: 477563 - DNA, 15 bp, Homo sapiens
ccttactcacctctc

SEQ ID NO: 477564 - DNA, 16 bp, Homo sapiens
ccttactcacctctct

SEQ ID NO: 477565 - DNA, 13 bp, Homo sapiens
ccttctgtgcatc

SEQ ID NO: 477566 - DNA, 21 bp, Homo sapiens
ccttctgtgcatctggcctgg

SEQ ID NO: 477567 - DNA, 23 bp, Homo sapiens
ccttctgtgcatctggcctgggg

SEQ ID NO: 477568 - DNA, 17 bp, Homo sapiens
ccttgatgttgtgttgt

SEQ ID NO: 477569 - DNA, 19 bp, Homo sapiens
cgaataaatgttcaaactg

SEQ ID NO: 477570 - DNA, 21 bp, Homo sapiens
cgcctccatttttgttgttat

SEQ ID NO: 477571 - DNA, 14 bp, Homo sapiens
cgcttgcttctgca

SEQ ID NO: 477572 - DNA, 17 bp, Homo sapiens
cgcttgcttctgcagca

SEQ ID NO: 477573 - DNA, 22 bp, Homo sapiens
cgcttgcttctgcagcaactcc

SEQ ID NO: 477574 - DNA, 23 bp, Homo sapiens
cgcttttgtacgttaattaaaca

SEQ ID NO: 477575 - DNA, 16 bp, Homo sapiens
cgctttttgaaaaagc

SEQ ID NO: 477576 - DNA, 19 bp, Homo sapiens
cggcctgatggccaggcct

SEQ ID NO: 477577 - DNA, 21 bp, Homo sapiens
cgggcacccccggacgccccc

SEQ ID NO: 477578 - DNA, 21 bp, Homo sapiens
cgtatttaatagcaaagaatt

SEQ ID NO: 477579 - DNA, 17 bp, Homo sapiens
cgtggcaactgtggaag

SEQ ID NO: 477580 - DNA, 17 bp, Homo sapiens
cgtttaagccaaaacaa

SEQ ID NO: 477581 - DNA, 18 bp, Homo sapiens
cgtttaagccaaaacaat

SEQ ID NO: 477582 - DNA, 22 bp, Homo sapiens
cgtttaagccaaaacaatgttt

SEQ ID NO: 477583 - DNA, 14 bp, Homo sapiens
ctaaaagaaacttt

SEQ ID NO: 477584 - DNA, 20 bp, Homo sapiens
ctaaagaaaaacaaactcgt

SEQ ID NO: 477585 - DNA, 19 bp, Homo sapiens
ctaaatacctcaatcagtc

SEQ ID NO: 477586 - DNA, 13 bp, Homo sapiens
ctaaattaacttc

SEQ ID NO: 477587 - DNA, 18 bp, Homo sapiens
ctaaattaacttctattt

SEQ ID NO: 477588 - DNA, 13 bp, Homo sapiens
ctaagagaagtag

SEQ ID NO: 477589 - DNA, 15 bp, Homo sapiens
ctaagagaagtagaa

SEQ ID NO: 477590 - DNA, 19 bp, Homo sapiens
ctaagagaagtagaaatca

SEQ ID NO: 477591 - DNA, 17 bp, Homo sapiens
ctaagtaaatctaaatt

SEQ ID NO: 477592 - DNA, 18 bp, Homo sapiens
ctaagtttagaagcgctc

SEQ ID NO: 477593 - DNA, 16 bp, Homo sapiens
ctacaaaatgtgtgct

SEQ ID NO: 477594 - DNA, 16 bp, Homo sapiens
ctacaggggaggctga

SEQ ID NO: 477595 - DNA, 16 bp, Homo sapiens
ctagaattgagtgttt

SEQ ID NO: 477596 - DNA, 21 bp, Homo sapiens
ctagaattgagtgtttaaagt

SEQ ID NO: 477597 - DNA, 15 bp, Homo sapiens
ctagaggtgagaaat

SEQ ID NO: 477598 - DNA, 17 bp, Homo sapiens
ctagaggtgagaaattt

SEQ ID NO: 477599 - DNA, 22 bp, Homo sapiens
ctaggacatctctgtaaaaagc

SEQ ID NO: 477600 - DNA, 22 bp, Homo sapiens
ctataagcaagaaggcaaaaat

SEQ ID NO: 477601 - DNA, 18 bp, Homo sapiens
ctatcaatatataaattt

SEQ ID NO: 477602 - DNA, 18 bp, Homo sapiens
ctatcttactatttcaca

SEQ ID NO: 477603 - DNA, 16 bp, Homo sapiens
ctatgaaaagctagaa

SEQ ID NO: 477604 - DNA, 15 bp, Homo sapiens
ctatgtttttaatgt

SEQ ID NO: 477605 - DNA, 13 bp, Homo sapiens
ctattgctgtaaa

SEQ ID NO: 477606 - DNA, 22 bp, Homo sapiens
ctattgctgtaaataaaaatag

SEQ ID NO: 477607 - DNA, 22 bp, Homo sapiens
ctattgtgcaatgtaaatattt

SEQ ID NO: 477608 - DNA, 23 bp, Homo sapiens
ctatttctgagaaggtccttaat

SEQ ID NO: 477609 - DNA, 12 bp, Homo sapiens
ctcaaggctgca

SEQ ID NO: 477610 - DNA, 21 bp, Homo sapiens
ctcaaggctgcagtgagccaa

SEQ ID NO: 477611 - DNA, 19 bp, Homo sapiens
ctcagaagtgaaaaagact

SEQ ID NO: 477612 - DNA, 15 bp, Homo sapiens
ctcagaggagaggag

SEQ ID NO: 477613 - DNA, 17 bp, Homo sapiens
ctcagaggagaggagca

SEQ ID NO: 477614 - DNA, 13 bp, Homo sapiens
ctcaggaggcgaa

SEQ ID NO: 477615 - DNA, 22 bp, Homo sapiens
ctcaggaggcgaataaatgttc

SEQ ID NO: 477616 - DNA, 19 bp, Homo sapiens
ctcagtaatttagaaatca

SEQ ID NO: 477617 - DNA, 18 bp, Homo sapiens
ctcatctcagtgaagaat

SEQ ID NO: 477618 - DNA, 19 bp, Homo sapiens
ctcctcttaaaaaataaaa

SEQ ID NO: 477619 - DNA, 20 bp, Homo sapiens
ctcctcttaaaaaataaaaa

SEQ ID NO: 477620 - DNA, 23 bp, Homo sapiens
ctcctcttaaaaaataaaaactg

SEQ ID NO: 477621 - DNA, 21 bp, Homo sapiens
ctcctgggcatgtttgtctgt

SEQ ID NO: 477622 - DNA, 20 bp, Homo sapiens
ctccttagagacatcaaaat

SEQ ID NO: 477623 - DNA, 13 bp, Homo sapiens
ctcggacaccatc

SEQ ID NO: 477624 - DNA, 14 bp, Homo sapiens
ctcgtgcatgtaat

SEQ ID NO: 477625 - DNA, 17 bp, Homo sapiens
ctctaggtaaactagca

SEQ ID NO: 477626 - DNA, 16 bp, Homo sapiens
ctctctaagtttagaa

SEQ ID NO: 477627 - DNA, 15 bp, Homo sapiens
ctctctctctttcct

SEQ ID NO: 477628 - DNA, 19 bp, Homo sapiens
ctcttaaaaaataaaaact

SEQ ID NO: 477629 - DNA, 17 bp, Homo sapiens
ctgaaaaggtttatgaa

SEQ ID NO: 477630 - DNA, 21 bp, Homo sapiens
ctgaagtcaaaccttaagata

SEQ ID NO: 477631 - DNA, 11 bp, Homo sapiens
ctgaattttta

SEQ ID NO: 477632 - DNA, 15 bp, Homo sapiens
ctgactccttagaga

SEQ ID NO: 477633 - DNA, 23 bp, Homo sapiens
ctgagaaggtccttaatgatccg

SEQ ID NO: 477634 - DNA, 13 bp, Homo sapiens
ctgatcctctctt

SEQ ID NO: 477635 - DNA, 12 bp, Homo sapiens
ctgatggccagg

SEQ ID NO: 477636 - DNA, 13 bp, Homo sapiens
ctgcagcaactcc

SEQ ID NO: 477637 - DNA, 17 bp, Homo sapiens
ctgcagcaactcccacg

SEQ ID NO: 477638 - DNA, 18 bp, Homo sapiens
ctgcagcctccttctcct

SEQ ID NO: 477639 - DNA, 22 bp, Homo sapiens
ctgcctggaggagaaggaggaa

SEQ ID NO: 477640 - DNA, 22 bp, Homo sapiens
ctgctatgctgttcattgatga

SEQ ID NO: 477641 - DNA, 17 bp, Homo sapiens
ctggaaaaaaaaaaata

SEQ ID NO: 477642 - DNA, 18 bp, Homo sapiens
ctggaaaaaaaaaaatat

SEQ ID NO: 477643 - DNA, 19 bp, Homo sapiens
ctggaggagaaggaggaac

SEQ ID NO: 477644 - DNA, 22 bp, Homo sapiens
ctggcagtttatatttaactct

SEQ ID NO: 477645 - DNA, 21 bp, Homo sapiens
ctgggcatgtttgtctgtgtg

SEQ ID NO: 477646 - DNA, 18 bp, Homo sapiens
ctgggtaatgaaacaaag

SEQ ID NO: 477647 - DNA, 20 bp, Homo sapiens
ctgtctctacaaaaaaaatc

SEQ ID NO: 477648 - DNA, 15 bp, Homo sapiens
ctgtgcatctggcct

SEQ ID NO: 477649 - DNA, 23 bp, Homo sapiens
ctgttatcaaacaccaacataaa

SEQ ID NO: 477650 - DNA, 12 bp, Homo sapiens
cttaaaactttg

SEQ ID NO: 477651 - DNA, 13 bp, Homo sapiens
cttaaataagaaa

SEQ ID NO: 477652 - DNA, 13 bp, Homo sapiens
cttactcacctct

SEQ ID NO: 477653 - DNA, 15 bp, Homo sapiens
cttactcacctctct

SEQ ID NO: 477654 - DNA, 19 bp, Homo sapiens
cttactcacctctctctaa

SEQ ID NO: 477655 - DNA, 15 bp, Homo sapiens
cttcaaagtttaata

SEQ ID NO: 477656 - DNA, 16 bp, Homo sapiens
cttcaaagtttaataa

SEQ ID NO: 477657 - DNA, 20 bp, Homo sapiens
cttcaacaattctaaaatga

SEQ ID NO: 477658 - DNA, 20 bp, Homo sapiens
cttctcattttttaaaaaag

SEQ ID NO: 477659 - DNA, 16 bp, Homo sapiens
cttctctaaaacagca

SEQ ID NO: 477660 - DNA, 16 bp, Homo sapiens
cttctgcagcaactcc

SEQ ID NO: 477661 - DNA, 22 bp, Homo sapiens
cttctgcagcaactcccacgac

SEQ ID NO: 477662 - DNA, 19 bp, Homo sapiens
cttctgtgcatctggcctg

SEQ ID NO: 477663 - DNA, 11 bp, Homo sapiens
cttgcttctgc

SEQ ID NO: 477664 - DNA, 14 bp, Homo sapiens
cttgcttctgcagc

SEQ ID NO: 477665 - DNA, 23 bp, Homo sapiens
cttgcttctgcagcaactcccac

SEQ ID NO: 477666 - DNA, 21 bp, Homo sapiens
cttgggattcctcccctggaa

SEQ ID NO: 477667 - DNA, 21 bp, Homo sapiens
cttggttttgctacataatta

SEQ ID NO: 477668 - DNA, 23 bp, Homo sapiens
ctttaaaatgattcacttttatt

SEQ ID NO: 477669 - DNA, 15 bp, Homo sapiens
ctttaacttaaatag

SEQ ID NO: 477670 - DNA, 15 bp, Homo sapiens
ctttcctaaatgttt

SEQ ID NO: 477671 - DNA, 17 bp, Homo sapiens
ctttctcactaaatctt

SEQ ID NO: 477672 - DNA, 14 bp, Homo sapiens
ctttgggaggctga

SEQ ID NO: 477673 - DNA, 20 bp, Homo sapiens
cttttagttgtatctctttt

SEQ ID NO: 477674 - DNA, 21 bp, Homo sapiens
cttttagttgtatctcttttg

SEQ ID NO: 477675 - DNA, 17 bp, Homo sapiens
cttttattgtataatta

SEQ ID NO: 477676 - DNA, 18 bp, Homo sapiens
cttttcccaaaatgttga

SEQ ID NO: 477677 - DNA, 24 bp, Homo sapiens
cttttcgcttgcttctgcagcaac

SEQ ID NO: 477678 - DNA, 20 bp, Homo sapiens
cttttgaatccatgcttggg

SEQ ID NO: 477679 - DNA, 23 bp, Homo sapiens
gaaaaacaaactcgttttttaca

SEQ ID NO: 477680 - DNA, 12 bp, Homo sapiens
gaaaaagaagca

SEQ ID NO: 477681 - DNA, 16 bp, Homo sapiens
gaaaactttaaagcgt

SEQ ID NO: 477682 - DNA, 23 bp, Homo sapiens
gaaaagctagaattgagtgttta

SEQ ID NO: 477683 - DNA, 17 bp, Homo sapiens
gaaaataattgttccaa

SEQ ID NO: 477684 - DNA, 19 bp, Homo sapiens
gaaaattttattgaatata

SEQ ID NO: 477685 - DNA, 18 bp, Homo sapiens
gaaacttttttatttaaa

SEQ ID NO: 477686 - DNA, 16 bp, Homo sapiens
gaacaagcattctcct

SEQ ID NO: 477687 - DNA, 22 bp, Homo sapiens
gaacacgtccagaatttttcat

SEQ ID NO: 477688 - DNA, 16 bp, Homo sapiens
gaacatagacagaaga

SEQ ID NO: 477689 - DNA, 20 bp, Homo sapiens
gaagaaacaaggttttcagt

SEQ ID NO: 477690 - DNA, 23 bp, Homo sapiens
gaagactatcttactatttcaca

SEQ ID NO: 477691 - DNA, 17 bp, Homo sapiens
gaagcaaatcgaatgaa

SEQ ID NO: 477692 - DNA, 22 bp, Homo sapiens
gaagcaacctcagtaatttaga

SEQ ID NO: 477693 - DNA, 15 bp, Homo sapiens
gaagctcaaggctgc

SEQ ID NO: 477694 - DNA, 19 bp, Homo sapiens
gaagttagctttaacttaa

SEQ ID NO: 477695 - DNA, 11 bp, Homo sapiens
gaagtttcatc

SEQ ID NO: 477696 - DNA, 13 bp, Homo sapiens
gaataaatgttca

SEQ ID NO: 477697 - DNA, 23 bp, Homo sapiens
gaataaggtacaagaagcatttt

SEQ ID NO: 477698 - DNA, 23 bp, Homo sapiens
gacacgctcttctattttattcc

SEQ ID NO: 477699 - DNA, 13 bp, Homo sapiens
gacatctctgtaa

SEQ ID NO: 477700 - DNA, 18 bp, Homo sapiens
gactgttgtacaagctca

SEQ ID NO: 477701 - DNA, 16 bp, Homo sapiens
gactttcctaaatgtt

SEQ ID NO: 477702 - DNA, 16 bp, Homo sapiens
gactttcctatgacac

SEQ ID NO: 477703 - DNA, 15 bp, Homo sapiens
gagaaggtccttaat

SEQ ID NO: 477704 - DNA, 16 bp, Homo sapiens
gagatgtaattgtttt

SEQ ID NO: 477705 - DNA, 15 bp, Homo sapiens
gagctacataattta

SEQ ID NO: 477706 - DNA, 14 bp, Homo sapiens
gaggaacccccatg

SEQ ID NO: 477707 - DNA, 13 bp, Homo sapiens
gaggcgaataaat

SEQ ID NO: 477708 - DNA, 14 bp, Homo sapiens
gaggcgaataaatg

SEQ ID NO: 477709 - DNA, 19 bp, Homo sapiens
gagtagctgggactacagg

SEQ ID NO: 477710 - DNA, 15 bp, Homo sapiens
gagtcagccattcct

SEQ ID NO: 477711 - DNA, 20 bp, Homo sapiens
gataactgaaaattatttaa

SEQ ID NO: 477712 - DNA, 14 bp, Homo sapiens
gataatgaacagaa

SEQ ID NO: 477713 - DNA, 18 bp, Homo sapiens
gataatggataatcttcg

SEQ ID NO: 477714 - DNA, 16 bp, Homo sapiens
gataccattttgaaat

SEQ ID NO: 477715 - DNA, 15 bp, Homo sapiens
gatatgtctttaaaa

SEQ ID NO: 477716 - DNA, 18 bp, Homo sapiens
gatatgtctttaaaatga

SEQ ID NO: 477717 - DNA, 17 bp, Homo sapiens
tattattttttccacat

SEQ ID NO: 477718 - DNA, 14 bp, Homo sapiens
tattcctattgtgc

SEQ ID NO: 477719 - DNA, 14 bp, Homo sapiens
tattgagtgtacat

SEQ ID NO: 477720 - DNA, 20 bp, Homo sapiens
tatttaaaaaactaaaaact

SEQ ID NO: 477721 - DNA, 19 bp, Homo sapiens
tatttaaaccgctaaaaga

SEQ ID NO: 477722 - DNA, 16 bp, Homo sapiens
tatttaactctcttta

SEQ ID NO: 477723 - DNA, 15 bp, Homo sapiens
tatttataacattgt

SEQ ID NO: 477724 - DNA, 17 bp, Homo sapiens
tatttataacattgtaa

SEQ ID NO: 477725 - DNA, 21 bp, Homo sapiens
tatttataacattgtaaatga

SEQ ID NO: 477726 - DNA, 21 bp, Homo sapiens
tatttctgagaaggtccttaa

SEQ ID NO: 477727 - DNA, 22 bp, Homo sapiens
tatttggtaacttgctgtgaaa

SEQ ID NO: 477728 - DNA, 14 bp, Homo sapiens
tattttaaagaatt

SEQ ID NO: 477729 - DNA, 16 bp, Homo sapiens
tattttaaagaattgt

SEQ ID NO: 477730 - DNA, 17 bp, Homo sapiens
tattttgacataaagtt

SEQ ID NO: 477731 - DNA, 19 bp, Homo sapiens
tcaaagcaagcattcagaa

SEQ ID NO: 477732 - DNA, 19 bp, Homo sapiens
tcaaagctgtgtgtttgga

SEQ ID NO: 477733 - DNA, 17 bp, Homo sapiens
tcaacaattctaaaatg

SEQ ID NO: 477734 - DNA, 17 bp, Homo sapiens
tcaagaaataagttttt

SEQ ID NO: 477735 - DNA, 15 bp, Homo sapiens
tcaagcgattcttct

SEQ ID NO: 477736 - DNA, 13 bp, Homo sapiens
tcaaggctgcagt

SEQ ID NO: 477737 - DNA, 19 bp, Homo sapiens
tcaatcagtctcagaatgt

SEQ ID NO: 477738 - DNA, 15 bp, Homo sapiens
tcaatccttgttcag

SEQ ID NO: 477739 - DNA, 16 bp, Homo sapiens
tcaatgctacaaaatg

SEQ ID NO: 477740 - DNA, 22 bp, Homo sapiens
tcacacccaacttggttttgct

SEQ ID NO: 477741 - DNA, 13 bp, Homo sapiens
tcacagtctcaca

SEQ ID NO: 477742 - DNA, 13 bp, Homo sapiens
tcacctctctcta

SEQ ID NO: 477743 - DNA, 23 bp, Homo sapiens
tcacctctctctaagtttagaag

SEQ ID NO: 477744 - DNA, 15 bp, Homo sapiens
tcaccttctgtgcat

SEQ ID NO: 477745 - DNA, 12 bp, Homo sapiens
tcactaaatctt

SEQ ID NO: 477746 - DNA, 22 bp, Homo sapiens
tcactgcagcctccttctcctg

SEQ ID NO: 477747 - DNA, 17 bp, Homo sapiens
tcagaagaaaaagaagc

SEQ ID NO: 477748 - DNA, 18 bp, Homo sapiens
tcagaagtgaaaaagact

SEQ ID NO: 477749 - DNA, 14 bp, Homo sapiens
tcagaatgtcattt

SEQ ID NO: 477750 - DNA, 16 bp, Homo sapiens
tcagaggagaggagca

SEQ ID NO: 477751 - DNA, 18 bp, Homo sapiens
tcagccattcctgttctc

SEQ ID NO: 477752 - DNA, 20 bp, Homo sapiens
tcagcctcctgagtagctgg

SEQ ID NO: 477753 - DNA, 18 bp, Homo sapiens
tcaggaaaattgaatgca

SEQ ID NO: 477754 - DNA, 19 bp, Homo sapiens
tcagggaccaaggagatgg

SEQ ID NO: 477755 - DNA, 15 bp, Homo sapiens
tcaggtaaactgatg

SEQ ID NO: 477756 - DNA, 21 bp, Homo sapiens
tcaggtttccggctactgaca

SEQ ID NO: 477757 - DNA, 18 bp, Homo sapiens
tcagtaatttagaaatca

SEQ ID NO: 477758 - DNA, 13 bp, Homo sapiens
tcagtgttataaa

SEQ ID NO: 477759 - DNA, 15 bp, Homo sapiens
tcatagataccattt

SEQ ID NO: 477760 - DNA, 18 bp, Homo sapiens
tcatataaagtatcatca

SEQ ID NO: 477761 - DNA, 23 bp, Homo sapiens
tcatatctgtatgcctcatttta

SEQ ID NO: 477762 - DNA, 16 bp, Homo sapiens
tcatctatttctgaga

SEQ ID NO: 477763 - DNA, 18 bp, Homo sapiens
tcatctatttctgagaag

SEQ ID NO: 477764 - DNA, 22 bp, Homo sapiens
tcatctcagtgaagaatacttc

SEQ ID NO: 477765 - DNA, 20 bp, Homo sapiens
tcatctggcttttcgcttgc

SEQ ID NO: 477766 - DNA, 17 bp, Homo sapiens
tcatgttggccaggctg

SEQ ID NO: 477767 - DNA, 23 bp, Homo sapiens
tcattaaggtattattttttcca

SEQ ID NO: 477768 - DNA, 18 bp, Homo sapiens
tccacaatcatctattga

SEQ ID NO: 477769 - DNA, 16 bp, Homo sapiens
tccaggtcacaggcat

SEQ ID NO: 477770 - DNA, 23 bp, Homo sapiens
tccaggtcacaggcatccgctgc

SEQ ID NO: 477771 - DNA, 22 bp, Homo sapiens
tccagtgtggtcttgtttaata

SEQ ID NO: 477772 - DNA, 23 bp, Homo sapiens
tccatttcatctatttctgagaa

SEQ ID NO: 477773 - DNA, 20 bp, Homo sapiens
tcccaaaatgttgaaatatg

SEQ ID NO: 477774 - DNA, 17 bp, Homo sapiens
tcccacctcggacacca

SEQ ID NO: 477775 - DNA, 22 bp, Homo sapiens
tcccacgactgttgtacaagct

SEQ ID NO: 477776 - DNA, 23 bp, Homo sapiens
tcccacgactgttgtacaagctc

SEQ ID NO: 477777 - DNA, 24 bp, Homo sapiens
tcccacgactgttgtacaagctca

SEQ ID NO: 477778 - DNA, 20 bp, Homo sapiens
tcccctggaagttgtccttt

SEQ ID NO: 477779 - DNA, 18 bp, Homo sapiens
tccgctgcgctcccacct

SEQ ID NO: 477780 - DNA, 14 bp, Homo sapiens
tcctcccctggaag

SEQ ID NO: 477781 - DNA, 15 bp, Homo sapiens
tcctcccctggaagt

SEQ ID NO: 477782 - DNA, 15 bp, Homo sapiens
tccttgccttcaaac

SEQ ID NO: 477783 - DNA, 17 bp, Homo sapiens
tcgaatgaaattaactg

SEQ ID NO: 477784 - DNA, 22 bp, Homo sapiens
tcgcccacaagccttactcacc

SEQ ID NO: 477785 - DNA, 15 bp, Homo sapiens
tcgcttgcttctgca

SEQ ID NO: 477786 - DNA, 12 bp, Homo sapiens
tgtttaaagttc

SEQ ID NO: 477787 - DNA, 13 bp, Homo sapiens
tgtttgatagatt

SEQ ID NO: 477788 - DNA, 19 bp, Homo sapiens
tgtttgtctgtgtgctgta

SEQ ID NO: 477789 - DNA, 21 bp, Homo sapiens
ttaaaaaagcttaaaactttg

SEQ ID NO: 477790 - DNA, 20 bp, Homo sapiens
ttaaaaattatctttaaaac

SEQ ID NO: 477791 - DNA, 15 bp, Homo sapiens
ttaaataagaaactt

SEQ ID NO: 477792 - DNA, 17 bp, Homo sapiens
ttaaataagaaactttt

SEQ ID NO: 477793 - DNA, 15 bp, Homo sapiens
ttaacttaaatagta

SEQ ID NO: 477794 - DNA, 17 bp, Homo sapiens
ttaacttctattttcaa

SEQ ID NO: 477795 - DNA, 19 bp, Homo sapiens
ttaataatttagacttcaa

SEQ ID NO: 477796 - DNA, 15 bp, Homo sapiens
ttaatagcaaagaat

SEQ ID NO: 477797 - DNA, 16 bp, Homo sapiens
ttaatagcaaagaatt

SEQ ID NO: 477798 - DNA, 20 bp, Homo sapiens
ttaatagcaaagaattgact

SEQ ID NO: 477799 - DNA, 17 bp, Homo sapiens
ttaatcagatagatatt

SEQ ID NO: 477800 - DNA, 16 bp, Homo sapiens
ttaatttagaaaactt

SEQ ID NO: 477801 - DNA, 20 bp, Homo sapiens
ttacaaatgatttcgtgact

SEQ ID NO: 477802 - DNA, 22 bp, Homo sapiens
ttacactacacactgtgtactg

SEQ ID NO: 477803 - DNA, 17 bp, Homo sapiens
ttacctattgctgtaaa

SEQ ID NO: 477804 - DNA, 14 bp, Homo sapiens
ttactcacctctct

SEQ ID NO: 477805 - DNA, 13 bp, Homo sapiens
ttagctttaactt

SEQ ID NO: 477806 - DNA, 20 bp, Homo sapiens
ttagttgtatctcttttgaa

SEQ ID NO: 477807 - DNA, 13 bp, Homo sapiens
ttataatgggtaa

SEQ ID NO: 477808 - DNA, 20 bp, Homo sapiens
ttatagttgtgggtgggaga

SEQ ID NO: 477809 - DNA, 20 bp, Homo sapiens
ttatctgaatttttaaacaa

SEQ ID NO: 477810 - DNA, 19 bp, Homo sapiens
ttatgaaaaagaagaatct

SEQ ID NO: 477811 - DNA, 20 bp, Homo sapiens
ttatgcagagtcagccattc

SEQ ID NO: 477812 - DNA, 13 bp, Homo sapiens
ttattcaataact

SEQ ID NO: 477813 - DNA, 17 bp, Homo sapiens
ttatttaaaaaactaaa

SEQ ID NO: 477814 - DNA, 18 bp, Homo sapiens
ttatttgtaatagatgtt

SEQ ID NO: 477815 - DNA, 15 bp, Homo sapiens
ttattttgacataaa

SEQ ID NO: 477816 - DNA, 17 bp, Homo sapiens
ttattttgacataaagt

SEQ ID NO: 477817 - DNA, 15 bp, Homo sapiens
ttcaacaattctaaa

SEQ ID NO: 477818 - DNA, 16 bp, Homo sapiens
ttcaccttctgtgcat

SEQ ID NO: 477819 - DNA, 22 bp, Homo sapiens
ttcactgaagaaaccttcagat

SEQ ID NO: 477820 - DNA, 16 bp, Homo sapiens
ttcacttttattgtat

SEQ ID NO: 477821 - DNA, 14 bp, Homo sapiens
ttcagaagaaaaag

SEQ ID NO: 477822 - DNA, 13 bp, Homo sapiens
ttcaggaaaattg

SEQ ID NO: 477823 - DNA, 23 bp, Homo sapiens
ttcatagataccattttgaaata

SEQ ID NO: 477824 - DNA, 16 bp, Homo sapiens
ttcatataaagtatca

SEQ ID NO: 477825 - DNA, 19 bp, Homo sapiens
ttcccaaaatgttgaaata

SEQ ID NO: 477826 - DNA, 15 bp, Homo sapiens
ttctaaaatgattgt

SEQ ID NO: 477827 - DNA, 16 bp, Homo sapiens
ttctagatatgagaaa

SEQ ID NO: 477828 - DNA, 14 bp, Homo sapiens
ttctagcaattgct

SEQ ID NO: 477829 - DNA, 16 bp, Homo sapiens
ttctctttgccttgat

SEQ ID NO: 477830 - DNA, 14 bp, Homo sapiens
ttctgcagcaactc

SEQ ID NO: 477831 - DNA, 16 bp, Homo sapiens
ttctgcagcaactccc

SEQ ID NO: 477832 - DNA, 14 bp, Homo sapiens
ttctgtgcatctgg

SEQ ID NO: 477833 - DNA, 17 bp, Homo sapiens
ttctgtgcatctggcct

SEQ ID NO: 477834 - DNA, 11 bp, Homo sapiens
ttcttaaataa

SEQ ID NO: 477835 - DNA, 13 bp, Homo sapiens
ttcttttcccatt

SEQ ID NO: 477836 - DNA, 13 bp, Homo sapiens
ttgaaaaagcgaa

SEQ ID NO: 477837 - DNA, 20 bp, Homo sapiens
ttgaaaggagaaaaaaaaag

SEQ ID NO: 477838 - DNA, 23 bp, Homo sapiens
ttgaaaggagaaaaaaaaagcca

SEQ ID NO: 477839 - DNA, 13 bp, Homo sapiens
ttgagtgtttaaa

SEQ ID NO: 477840 - DNA, 14 bp, Homo sapiens
ttgataaagatttt

SEQ ID NO: 477841 - DNA, 17 bp, Homo sapiens
ttgataaagatttttta

SEQ ID NO: 477842 - DNA, 20 bp, Homo sapiens
ttgataaagattttttaata

SEQ ID NO: 477843 - DNA, 13 bp, Homo sapiens
ttgctacataatt

SEQ ID NO: 477844 - DNA, 15 bp, Homo sapiens
ttgctggcatttgct

SEQ ID NO: 477845 - DNA, 23 bp, Homo sapiens
ttgctgtaaataaaaatagctat

SEQ ID NO: 477846 - DNA, 12 bp, Homo sapiens
ttgctgtgaaat

SEQ ID NO: 477847 - DNA, 22 bp, Homo sapiens
ttggaaaatgttctgacagcat

SEQ ID NO: 477848 - DNA, 15 bp, Homo sapiens
ttggaatataattgt

SEQ ID NO: 477849 - DNA, 16 bp, Homo sapiens
ttggaggcctttagat

SEQ ID NO: 477850 - DNA, 22 bp, Homo sapiens
ttgggattcctcccctggaagt

SEQ ID NO: 477851 - DNA, 19 bp, Homo sapiens
ttgggtgtaacaggtctcc

SEQ ID NO: 477852 - DNA, 21 bp, Homo sapiens
ttgggtgtaacaggtctcctc

SEQ ID NO: 477853 - DNA, 14 bp, Homo sapiens
ttgtacaagctcag

SEQ ID NO: 477854 - DNA, 13 bp, Homo sapiens
ttgtatctctttt

SEQ ID NO: 477855 - DNA, 20 bp, Homo sapiens
ttgtatctcttttgaatcca

SEQ ID NO: 477856 - DNA, 15 bp, Homo sapiens
ttgtctgtgtgctgt

SEQ ID NO: 477857 - DNA, 21 bp, Homo sapiens
ttgttaatttagaaaacttta

SEQ ID NO: 477858 - DNA, 18 bp, Homo sapiens
ttgttcaccttctgtgca

SEQ ID NO: 477859 - DNA, 20 bp, Homo sapiens
ttgttgttattttttgagaa

SEQ ID NO: 477860 - DNA, 15 bp, Homo sapiens
ttgtttcttaaataa

SEQ ID NO: 477861 - DNA, 23 bp, Homo sapiens
ttgtttcttaaataagaaacttt

SEQ ID NO: 477862 - DNA, 21 bp, Homo sapiens
tttaaaaaagcttaaaacttt

SEQ ID NO: 477863 - DNA, 15 bp, Homo sapiens
tttaaacaagtattt

SEQ ID NO: 477864 - DNA, 20 bp, Homo sapiens
tttaaaccgctaaaagaaac

SEQ ID NO: 477865 - DNA, 18 bp, Homo sapiens
tttaagccaaaacaatgt

SEQ ID NO: 477866 - DNA, 20 bp, Homo sapiens
tttaatgtatagtaaatcac

SEQ ID NO: 477867 - DNA, 14 bp, Homo sapiens
tttagaaaacttta

SEQ ID NO: 477868 - DNA, 16 bp, Homo sapiens
tttagaaatcattttg

SEQ ID NO: 477869 - DNA, 22 bp, Homo sapiens
tttagtagcagtgattgtctta

SEQ ID NO: 477870 - DNA, 19 bp, Homo sapiens
tttatgaaaaagaagaatc

SEQ ID NO: 477871 - DNA, 14 bp, Homo sapiens
tttattttgacata

SEQ ID NO: 477872 - DNA, 23 bp, Homo sapiens
tttcacaacagcctgacaacatt

SEQ ID NO: 477873 - DNA, 20 bp, Homo sapiens
tttcatagataccattttga

SEQ ID NO: 477874 - DNA, 13 bp, Homo sapiens
tttcatataaagt

SEQ ID NO: 477875 - DNA, 13 bp, Homo sapiens
tttcatctatttc

SEQ ID NO: 477876 - DNA, 19 bp, Homo sapiens
tttcatgataatgaacaga

SEQ ID NO: 477877 - DNA, 14 bp, Homo sapiens
tttcctaaatgttt

SEQ ID NO: 477878 - DNA, 14 bp, Homo sapiens
tttcctcctgggca

SEQ ID NO: 477879 - DNA, 17 bp, Homo sapiens
tttcgcttgcttctgca

SEQ ID NO: 477880 - DNA, 15 bp, Homo sapiens
tttctagcaattgct

SEQ ID NO: 477881 - DNA, 12 bp, Homo sapiens
tttcttaaataa

SEQ ID NO: 477882 - DNA, 19 bp, Homo sapiens
tttcttaaataagaaactt

SEQ ID NO: 477883 - DNA, 18 bp, Homo sapiens
tttcttcaccaaatcttg

SEQ ID NO: 477884 - DNA, 20 bp, Homo sapiens
tttgaaaaagcgaaaaaatc

SEQ ID NO: 477885 - DNA, 16 bp, Homo sapiens
tttgaagtacaattgt

SEQ ID NO: 477886 - DNA, 23 bp, Homo sapiens
tttgaagttagctttaacttaaa

SEQ ID NO: 477887 - DNA, 18 bp, Homo sapiens
tttgatactaagcattga

SEQ ID NO: 477888 - DNA, 20 bp, Homo sapiens
tttgtaagttgaagcaaatc

SEQ ID NO: 477889 - DNA, 20 bp, Homo sapiens
tttgtacgttaattaaacaa

SEQ ID NO: 477890 - DNA, 23 bp, Homo sapiens
tttgtgctatcagactgtaggat

SEQ ID NO: 477891 - DNA, 22 bp, Homo sapiens
tttgttaatttagaaaacttta

SEQ ID NO: 477892 - DNA, 23 bp, Homo sapiens
tttgttaatttagaaaactttaa

SEQ ID NO: 477893 - DNA, 17 bp, Homo sapiens
ttttaaaaaagcttaaa

SEQ ID NO: 477894 - DNA, 21 bp, Homo sapiens
ttttaaaaaagcttaaaactt

SEQ ID NO: 477895 - DNA, 18 bp, Homo sapiens
ttttcccaaaatgttgaa

SEQ ID NO: 477896 - DNA, 20 bp, Homo sapiens
ttttcgcttgcttctgcagc

SEQ ID NO: 477897 - DNA, 15 bp, Homo sapiens
ttttgacataaagtt

SEQ ID NO: 477898 - DNA, 18 bp, Homo sapiens
ttttgatactaagcattg

SEQ ID NO: 477899 - DNA, 20 bp, Homo sapiens
tttttaggaagcaagcttaa

SEQ ID NO: 477900 - DNA, 16 bp, Homo sapiens
tttttcatgataatga

SEQ ID NO: 477901 - DNA, 22 bp, Homo sapiens
tttttccttcaaagtttaataa

SEQ ID NO: 477902 - DNA, 15 bp, Homo sapiens
tttttgatactaagc

SEQ ID NO: 477903 - DNA, 22 bp, Homo sapiens
tttttgttcaccttctgtgcat

SEQ ID NO: 477904 - DNA, 23 bp, Homo sapiens
gaaacaaagagttcaagaaataa

SEQ ID NO: 477905 - DNA, 13 bp, Homo sapiens
gaaacattttcat

SEQ ID NO: 477906 - DNA, 20 bp, Homo sapiens
gaaatacttgacaacatttt

SEQ ID NO: 477907 - DNA, 16 bp, Homo sapiens
gaaatataaaaataat

SEQ ID NO: 477908 - DNA, 19 bp, Homo sapiens
gaaatataaaaataattaa

SEQ ID NO: 477909 - DNA, 17 bp, Homo sapiens
gaaatattcacaaggtt

SEQ ID NO: 477910 - DNA, 20 bp, Homo sapiens
gaaattaccagagttgttct

SEQ ID NO: 477911 - DNA, 13 bp, Homo sapiens
gaaatttaaacta

SEQ ID NO: 477912 - DNA, 19 bp, Homo sapiens
gaacctaattcaattcaaa

SEQ ID NO: 477913 - DNA, 14 bp, Homo sapiens
gaagaaaaagaagc

SEQ ID NO: 477914 - DNA, 23 bp, Homo sapiens
gaagaatacttctcattttttaa

SEQ ID NO: 477915 - DNA, 23 bp, Homo sapiens
gaagaccaatctcttgaatccca

SEQ ID NO: 477916 - DNA, 16 bp, Homo sapiens
gaagcaagcttaatgg

SEQ ID NO: 477917 - DNA, 19 bp, Homo sapiens
gaagccctaagtaaatcta

SEQ ID NO: 477918 - DNA, 18 bp, Homo sapiens
gaagctcaaggctgcagt

SEQ ID NO: 477919 - DNA, 21 bp, Homo sapiens
gaaggactatgaaaagctaga

SEQ ID NO: 477920 - DNA, 16 bp, Homo sapiens
gaaggcacactgagca

SEQ ID NO: 477921 - DNA, 19 bp, Homo sapiens
gaagtaaaagcaaaaaaga

SEQ ID NO: 477922 - DNA, 14 bp, Homo sapiens
gaataaatgttcaa

SEQ ID NO: 477923 - DNA, 15 bp, Homo sapiens
gaataaatgttcaaa

SEQ ID NO: 477924 - DNA, 17 bp, Homo sapiens
gaataaggtacaagaag

SEQ ID NO: 477925 - DNA, 19 bp, Homo sapiens
gaatataattgttttatct

SEQ ID NO: 477926 - DNA, 13 bp, Homo sapiens
gaatccatgcttg

SEQ ID NO: 477927 - DNA, 14 bp, Homo sapiens
gaatccatgcttgg

SEQ ID NO: 477928 - DNA, 19 bp, Homo sapiens
gaatggctatgtttttaat

SEQ ID NO: 477929 - DNA, 19 bp, Homo sapiens
gaattgagtgtttaaagtt

SEQ ID NO: 477930 - DNA, 22 bp, Homo sapiens
gacaatttatatttaataaaat

SEQ ID NO: 477931 - DNA, 19 bp, Homo sapiens
gacacatactcatttttca

SEQ ID NO: 477932 - DNA, 17 bp, Homo sapiens
gacataaagttgataaa

SEQ ID NO: 477933 - DNA, 22 bp, Homo sapiens
gacataaagttgataaagattt

SEQ ID NO: 477934 - DNA, 20 bp, Homo sapiens
gacctccctgtctctacaaa

SEQ ID NO: 477935 - DNA, 17 bp, Homo sapiens
gacggggtttcaccatg

SEQ ID NO: 477936 - DNA, 13 bp, Homo sapiens
gactttgtgatcc

SEQ ID NO: 477937 - DNA, 15 bp, Homo sapiens
gagagtatattatgt

SEQ ID NO: 477938 - DNA, 20 bp, Homo sapiens
gagctgtggactttgttcac

SEQ ID NO: 477939 - DNA, 14 bp, Homo sapiens
gaggagaaggagga

SEQ ID NO: 477940 - DNA, 21 bp, Homo sapiens
gataactgaaaattatttaaa

SEQ ID NO: 477941 - DNA, 18 bp, Homo sapiens
gataatcttcggccaatt

SEQ ID NO: 477942 - DNA, 14 bp, Homo sapiens
gataattaaatgaa

SEQ ID NO: 477943 - DNA, 17 bp, Homo sapiens
gataattaaatgaaata

SEQ ID NO: 477944 - DNA, 18 bp, Homo sapiens
gataattttaaattctct

SEQ ID NO: 477945 - DNA, 22 bp, Homo sapiens
gatagattttctgctactttgc

SEQ ID NO: 477946 - DNA, 22 bp, Homo sapiens
gatatgagaaatataaaaataa

SEQ ID NO: 477947 - DNA, 17 bp, Homo sapiens
gatatgtaaaacattta

SEQ ID NO: 477948 - DNA, 22 bp, Homo sapiens
gatattcctattgtgcaatgta

SEQ ID NO: 477949 - DNA, 21 bp, Homo sapiens
gatcctctcttcttttcccat

SEQ ID NO: 477950 - DNA, 21 bp, Homo sapiens
gattatagttgtgggtgggag

SEQ ID NO: 477951 - DNA, 18 bp, Homo sapiens
gatttatttaaaatagca

SEQ ID NO: 477952 - DNA, 16 bp, Homo sapiens
gattttttaataattt

SEQ ID NO: 477953 - DNA, 23 bp, Homo sapiens
gattttttttttttggtaattat

SEQ ID NO: 477954 - DNA, 24 bp, Homo sapiens
gcaaatttctagatatgagaaata

SEQ ID NO: 477955 - DNA, 21 bp, Homo sapiens
gcaagaaggcaaaaatagttt

SEQ ID NO: 477956 - DNA, 17 bp, Homo sapiens
gcaagcattcagaagaa

SEQ ID NO: 477957 - DNA, 18 bp, Homo sapiens
gcaagcattcagaagaaa

SEQ ID NO: 477958 - DNA, 18 bp, Homo sapiens
gcaatgtaaatattttaa

SEQ ID NO: 477959 - DNA, 15 bp, Homo sapiens
gcacaggctaatttt

SEQ ID NO: 477960 - DNA, 16 bp, Homo sapiens
gcaccaaaagaagtaa

SEQ ID NO: 477961 - DNA, 11 bp, Homo sapiens
gcagcaactcc

SEQ ID NO: 477962 - DNA, 13 bp, Homo sapiens
gcagcaactccca

SEQ ID NO: 477963 - DNA, 17 bp, Homo sapiens
gttatttgtaatagatg

SEQ ID NO: 477964 - DNA, 16 bp, Homo sapiens
gttcaagaaataagtt

SEQ ID NO: 477965 - DNA, 20 bp, Homo sapiens
gttcaccttctgtgcatctg

SEQ ID NO: 477966 - DNA, 14 bp, Homo sapiens
gttgtacaagctca

SEQ ID NO: 477967 - DNA, 16 bp, Homo sapiens
gttgtgggtgggagag

SEQ ID NO: 477968 - DNA, 21 bp, Homo sapiens
gttgtgttgttatcatttaag

SEQ ID NO: 477969 - DNA, 20 bp, Homo sapiens
gtttaagccaaaacaatgtt

SEQ ID NO: 477970 - DNA, 18 bp, Homo sapiens
gtttttaatgtatagtaa

SEQ ID NO: 477971 - DNA, 18 bp, Homo sapiens
gtttttgttcaccttctg

SEQ ID NO: 477972 - DNA, 23 bp, Homo sapiens
gtttttgttcaccttctgtgcat

SEQ ID NO: 477973 - DNA, 15 bp, Homo sapiens
taaaaaaataagaag

SEQ ID NO: 477974 - DNA, 20 bp, Homo sapiens
taaaaaaataagaagaatgc

SEQ ID NO: 477975 - DNA, 21 bp, Homo sapiens
taaaaaactatctttttgctt

SEQ ID NO: 477976 - DNA, 20 bp, Homo sapiens
taaaaactagaggtgagaaa

SEQ ID NO: 477977 - DNA, 16 bp, Homo sapiens
taaaaactgactcctt

SEQ ID NO: 477978 - DNA, 16 bp, Homo sapiens
taaaaatagctataaa

SEQ ID NO: 477979 - DNA, 15 bp, Homo sapiens
taaaaatgatctaaa

SEQ ID NO: 477980 - DNA, 14 bp, Homo sapiens
taaaactttgaagt

SEQ ID NO: 477981 - DNA, 15 bp, Homo sapiens
taaaactttgaagtt

SEQ ID NO: 477982 - DNA, 12 bp, Homo sapiens
taaaagcaaaaa

SEQ ID NO: 477983 - DNA, 16 bp, Homo sapiens
taaaagcaaaaaagaa

SEQ ID NO: 477984 - DNA, 17 bp, Homo sapiens
taaaagcaaaaaagaaa

SEQ ID NO: 477985 - DNA, 20 bp, Homo sapiens
taaaagcaaaaaagaaaacc

SEQ ID NO: 477986 - DNA, 23 bp, Homo sapiens
taaaagcaaaaaagaaaaccttt

SEQ ID NO: 477987 - DNA, 13 bp, Homo sapiens
taaaatagcaaaa

SEQ ID NO: 477988 - DNA, 16 bp, Homo sapiens
taaaatagcaaaagaa

SEQ ID NO: 477989 - DNA, 17 bp, Homo sapiens
taaaatagcaaaagaag

SEQ ID NO: 477990 - DNA, 17 bp, Homo sapiens
taaaatctgtattgcta

SEQ ID NO: 477991 - DNA, 18 bp, Homo sapiens
taaaatctgtattgctaa

SEQ ID NO: 477992 - DNA, 14 bp, Homo sapiens
taaaatgattcact

SEQ ID NO: 477993 - DNA, 17 bp, Homo sapiens
taaacaaattccttccc

SEQ ID NO: 477994 - DNA, 15 bp, Homo sapiens
taaagaaaaacaaac

SEQ ID NO: 477995 - DNA, 12 bp, Homo sapiens
taaagatttttt

SEQ ID NO: 477996 - DNA, 16 bp, Homo sapiens
taaagattttttaata

SEQ ID NO: 477997 - DNA, 17 bp, Homo sapiens
taaagattttttaataa

SEQ ID NO: 477998 - DNA, 20 bp, Homo sapiens
taaagattttttaataattt

SEQ ID NO: 477999 - DNA, 21 bp, Homo sapiens
taaagattttttaataattta

SEQ ID NO: 478000 - DNA, 18 bp, Homo sapiens
taaagttcaacatgttat

SEQ ID NO: 478001 - DNA, 13 bp, Homo sapiens
taaataaaaatag

SEQ ID NO: 478002 - DNA, 13 bp, Homo sapiens
taaatagtatttc

SEQ ID NO: 478003 - DNA, 16 bp, Homo sapiens
taaatcacgctttttg

SEQ ID NO: 478004 - DNA, 18 bp, Homo sapiens
taaatcacgctttttgaa

SEQ ID NO: 478005 - DNA, 19 bp, Homo sapiens
taaatcacgctttttgaaa

SEQ ID NO: 478006 - DNA, 22 bp, Homo sapiens
taaatcacgctttttgaaaaag

SEQ ID NO: 478007 - DNA, 13 bp, Homo sapiens
taaatcttttata

SEQ ID NO: 478008 - DNA, 22 bp, Homo sapiens
taaatgaaatacttgacaacat

SEQ ID NO: 478009 - DNA, 14 bp, Homo sapiens
taaatgtatattga

SEQ ID NO: 478010 - DNA, 11 bp, Homo sapiens
taaatgttcaa

SEQ ID NO: 478011 - DNA, 15 bp, Homo sapiens
taaatttattttctt

SEQ ID NO: 478012 - DNA, 17 bp, Homo sapiens
taacgtttaagccaaaa

SEQ ID NO: 478013 - DNA, 19 bp, Homo sapiens
taactccagtgatgttctt

SEQ ID NO: 478014 - DNA, 20 bp, Homo sapiens
taactgaaaattatttaaac

SEQ ID NO: 478015 - DNA, 17 bp, Homo sapiens
taactgggtaatgaaac

SEQ ID NO: 478016 - DNA, 20 bp, Homo sapiens
taactgggtaatgaaacaaa

SEQ ID NO: 478017 - DNA, 16 bp, Homo sapiens
taacttaaatagtatt

SEQ ID NO: 478018 - DNA, 13 bp, Homo sapiens
taacttgctgtga

SEQ ID NO: 478019 - DNA, 14 bp, Homo sapiens
taacttgctgtgaa

SEQ ID NO: 478020 - DNA, 18 bp, Homo sapiens
taacttgctgtgaaatga

SEQ ID NO: 478021 - DNA, 20 bp, Homo sapiens
taagaaacttttttatttaa

SEQ ID NO: 478022 - DNA, 21 bp, Homo sapiens
taagaagaatgcttaatcaga

SEQ ID NO: 478023 - DNA, 18 bp, Homo sapiens
taagagaagtagaaatca

SEQ ID NO: 478024 - DNA, 17 bp, Homo sapiens
taagataattaaatgaa

SEQ ID NO: 478025 - DNA, 22 bp, Homo sapiens
taagcattgaatggctatgttt

SEQ ID NO: 478026 - DNA, 19 bp, Homo sapiens
taaggtcagtgttataaaa

SEQ ID NO: 478027 - DNA, 14 bp, Homo sapiens
taatagatgtttga

SEQ ID NO: 478028 - DNA, 23 bp, Homo sapiens
ttttaaaaaagcttaaaactttg

SEQ ID NO: 478029 - DNA, 13 bp, Homo sapiens
ttttaaagaattg

SEQ ID NO: 478030 - DNA, 18 bp, Homo sapiens
ttttaggaagcaagctta

SEQ ID NO: 478031 - DNA, 19 bp, Homo sapiens
ttttgtaagttgaagcaaa

SEQ ID NO: 478032 - DNA, 21 bp, Homo sapiens
ttttgttgtttcttaaataag

SEQ ID NO: 478033 - DNA, 23 bp, Homo sapiens
tttttaaaaaagcttaaaacttt

SEQ ID NO: 478034 - DNA, 16 bp, Homo sapiens
tttttaaacaagtatt

SEQ ID NO: 478035 - DNA, 17 bp, Homo sapiens
tttttgaaaaagcgaaa

SEQ ID NO: 478036 - DNA, 23 bp, Homo sapiens
tttttgaaaaagcgaaaaaatca

SEQ ID NO: 478037 - DNA, 13 bp, Homo sapiens
tttttgatactaa

SEQ ID NO: 478038 - DNA, 13 bp, Homo sapiens
ttttttaaaaaag

SEQ ID NO: 478039 - DNA, 13 bp, Homo sapiens
aaaaaaaaatatg

SEQ ID NO: 478040 - DNA, 12 bp, Homo sapiens
aaaaaaaataca

SEQ ID NO: 478041 - DNA, 12 bp, Homo sapiens
aaaaaaatatga

SEQ ID NO: 478042 - DNA, 11 bp, Homo sapiens
aaaaaaatcaa

SEQ ID NO: 478043 - DNA, 15 bp, Homo sapiens
aaaaagcttaaaact

SEQ ID NO: 478044 - DNA, 21 bp, Homo sapiens
aaaaataaaaactgactcctt

SEQ ID NO: 478045 - DNA, 14 bp, Homo sapiens
aaaaataagaagaa

SEQ ID NO: 478046 - DNA, 14 bp, Homo sapiens
aaaaatagtttgga

SEQ ID NO: 478047 - DNA, 18 bp, Homo sapiens
aaaaatcaaaaaattatc

SEQ ID NO: 478048 - DNA, 15 bp, Homo sapiens
aaaaattatctttaa

SEQ ID NO: 478049 - DNA, 23 bp, Homo sapiens
aaaacaaaatccttgccttcaaa

SEQ ID NO: 478050 - DNA, 22 bp, Homo sapiens
aaaacatttattttgacataaa

SEQ ID NO: 478051 - DNA, 11 bp, Homo sapiens
aaaagaagtaa

SEQ ID NO: 478052 - DNA, 13 bp, Homo sapiens
aaaagacttcaaa

SEQ ID NO: 478053 - DNA, 20 bp, Homo sapiens
aaaataaagaatagcaatta

SEQ ID NO: 478054 - DNA, 17 bp, Homo sapiens
aaaatagcaaaagaaga

SEQ ID NO: 478055 - DNA, 21 bp, Homo sapiens
aaaatcaggtggcttttgcgg

SEQ ID NO: 478056 - DNA, 14 bp, Homo sapiens
aaaattatctttaa

SEQ ID NO: 478057 - DNA, 16 bp, Homo sapiens
aaaattatctttaaaa

SEQ ID NO: 478058 - DNA, 22 bp, Homo sapiens
aaaattatctttaaaacttact

SEQ ID NO: 478059 - DNA, 14 bp, Homo sapiens
aaaattgaatgcaa

SEQ ID NO: 478060 - DNA, 22 bp, Homo sapiens
aaacaaaatccttgccttcaaa

SEQ ID NO: 478061 - DNA, 13 bp, Homo sapiens
aaacaagtatttg

SEQ ID NO: 478062 - DNA, 22 bp, Homo sapiens
aaacaagtatttgttaatttag

SEQ ID NO: 478063 - DNA, 14 bp, Homo sapiens
aaacaatgtttaaa

SEQ ID NO: 478064 - DNA, 15 bp, Homo sapiens
aaacaccaacataaa

SEQ ID NO: 478065 - DNA, 14 bp, Homo sapiens
aaacatttattttg

SEQ ID NO: 478066 - DNA, 19 bp, Homo sapiens
aaaccttgctgctatgctg

SEQ ID NO: 478067 - DNA, 22 bp, Homo sapiens
aaactagaggtgagaaatttaa

SEQ ID NO: 478068 - DNA, 22 bp, Homo sapiens
aaactataagcaagaaggcaaa

SEQ ID NO: 478069 - DNA, 16 bp, Homo sapiens
aaactcgttttttaca

SEQ ID NO: 478070 - DNA, 17 bp, Homo sapiens
aaactgatgctttcaga

SEQ ID NO: 478071 - DNA, 22 bp, Homo sapiens
aaacttactatggtatatattt

SEQ ID NO: 478072 - DNA, 23 bp, Homo sapiens
aaacttactatggtatatatttt

SEQ ID NO: 478073 - DNA, 12 bp, Homo sapiens
aaagaaactttc

SEQ ID NO: 478074 - DNA, 18 bp, Homo sapiens
aaagacttcaaatgttat

SEQ ID NO: 478075 - DNA, 16 bp, Homo sapiens
aaagagttcaagaaat

SEQ ID NO: 478076 - DNA, 14 bp, Homo sapiens
aaagattttttaat

SEQ ID NO: 478077 - DNA, 16 bp, Homo sapiens
aaagcaaaaaagaaaa

SEQ ID NO: 478078 - DNA, 14 bp, Homo sapiens
aaagcgtttgcaca

SEQ ID NO: 478079 - DNA, 13 bp, Homo sapiens
aaagctagaattg

SEQ ID NO: 478080 - DNA, 16 bp, Homo sapiens
aaaggtttatgaaaaa

SEQ ID NO: 478081 - DNA, 23 bp, Homo sapiens
aaagttgataaagattttttaat

SEQ ID NO: 478082 - DNA, 14 bp, Homo sapiens
aaataagaaacttt

SEQ ID NO: 478083 - DNA, 15 bp, Homo sapiens
aaataagaaactttt

SEQ ID NO: 478084 - DNA, 16 bp, Homo sapiens
aaataagtttttgttt

SEQ ID NO: 478085 - DNA, 15 bp, Homo sapiens
aaataattaaaacaa

SEQ ID NO: 478086 - DNA, 13 bp, Homo sapiens
aaatacatgctaa

SEQ ID NO: 478087 - DNA, 13 bp, Homo sapiens
aaatagctataaa

SEQ ID NO: 478088 - DNA, 12 bp, Homo sapiens
aaatagtatttc

SEQ ID NO: 478089 - DNA, 14 bp, Homo sapiens
aaatagtttggata

SEQ ID NO: 478090 - DNA, 15 bp, Homo sapiens
aaatattttaaagaa

SEQ ID NO: 478091 - DNA, 13 bp, Homo sapiens
aaatcgaatgaaa

SEQ ID NO: 478092 - DNA, 17 bp, Homo sapiens
aaatgaaatacttgaca

SEQ ID NO: 478093 - DNA, 18 bp, Homo sapiens
aaatgatatgtctttaaa

SEQ ID NO: 478094 - DNA, 19 bp, Homo sapiens
aaatgatatgtctttaaaa

SEQ ID NO: 478095 - DNA, 13 bp, Homo sapiens
aaatgatctaaac

SEQ ID NO: 478096 - DNA, 22 bp, Homo sapiens
aaatgattcacttttattgtat

SEQ ID NO: 478097 - DNA, 16 bp, Homo sapiens
aaatgccttttcccaa

SEQ ID NO: 478098 - DNA, 18 bp, Homo sapiens
aaatgttattcaataact

SEQ ID NO: 478099 - DNA, 23 bp, Homo sapiens
aaatgttgaaatatgatgttaaa

SEQ ID NO: 478100 - DNA, 20 bp, Homo sapiens
aaattaactgggtaatgaaa

SEQ ID NO: 478101 - DNA, 21 bp, Homo sapiens
aaattaactgggtaatgaaac

SEQ ID NO: 478102 - DNA, 13 bp, Homo sapiens
aaattatctttaa

SEQ ID NO: 478103 - DNA, 14 bp, Homo sapiens
aaattatctttaaa

SEQ ID NO: 478104 - DNA, 19 bp, Homo sapiens
aaatttaaactataagcaa

SEQ ID NO: 478105 - DNA, 20 bp, Homo sapiens
aaatttctagatatgagaaa

SEQ ID NO: 478106 - DNA, 16 bp, Homo sapiens
aaattttattgaatat

SEQ ID NO: 478107 - DNA, 16 bp, Homo sapiens
aacaaactcgtttttt

SEQ ID NO: 478108 - DNA, 19 bp, Homo sapiens
aacaaagagttcaagaaat

SEQ ID NO: 478109 - DNA, 23 bp, Homo sapiens
aacaagtatttgttaatttagaa

SEQ ID NO: 478110 - DNA, 14 bp, Homo sapiens
aacaattctaaaat

SEQ ID NO: 478111 - DNA, 15 bp, Homo sapiens
aacaccaacataaaa

SEQ ID NO: 478112 - DNA, 15 bp, Homo sapiens
aagcattcagaagaa

SEQ ID NO: 478113 - DNA, 13 bp, Homo sapiens
aagcattgaatgg

SEQ ID NO: 478114 - DNA, 17 bp, Homo sapiens
aagccttactcacctct

SEQ ID NO: 478115 - DNA, 17 bp, Homo sapiens
aagcttaaaactttgaa

SEQ ID NO: 478116 - DNA, 21 bp, Homo sapiens
aagcttaatggctgataattt

SEQ ID NO: 478117 - DNA, 21 bp, Homo sapiens
aaggactatgaaaagctagaa

SEQ ID NO: 478118 - DNA, 22 bp, Homo sapiens
aaggtcagtgttataaaatctg

SEQ ID NO: 478119 - DNA, 17 bp, Homo sapiens
aaggtttatgaaaaaga

SEQ ID NO: 478120 - DNA, 21 bp, Homo sapiens
aagtaaaagcaaaaaagaaaa

SEQ ID NO: 478121 - DNA, 19 bp, Homo sapiens
aagtatttgttaatttaga

SEQ ID NO: 478122 - DNA, 12 bp, Homo sapiens
aagtgaaaaaga

SEQ ID NO: 478123 - DNA, 16 bp, Homo sapiens
aagtgtaatagattat

SEQ ID NO: 478124 - DNA, 16 bp, Homo sapiens
aagttagctttaactt

SEQ ID NO: 478125 - DNA, 12 bp, Homo sapiens
aataaatgttca

SEQ ID NO: 478126 - DNA, 13 bp, Homo sapiens
aataaatgttcaa

SEQ ID NO: 478127 - DNA, 18 bp, Homo sapiens
aataaatgttcaaactgt

SEQ ID NO: 478128 - DNA, 22 bp, Homo sapiens
aataacgtttaagccaaaacaa

SEQ ID NO: 478129 - DNA, 12 bp, Homo sapiens
aataattaaaac

SEQ ID NO: 478130 - DNA, 21 bp, Homo sapiens
aataattaaaacaaaatcctt

SEQ ID NO: 478131 - DNA, 23 bp, Homo sapiens
aatacatgctaagagaagtagaa

SEQ ID NO: 478132 - DNA, 18 bp, Homo sapiens
aatagcaaagaattgact

SEQ ID NO: 478133 - DNA, 16 bp, Homo sapiens
aatataaaaataatta

SEQ ID NO: 478134 - DNA, 15 bp, Homo sapiens
aatatcctaaacatc

SEQ ID NO: 478135 - DNA, 16 bp, Homo sapiens
aatatcctaaacatca

SEQ ID NO: 478136 - DNA, 18 bp, Homo sapiens
aatatcctaaacatcatt

SEQ ID NO: 478137 - DNA, 15 bp, Homo sapiens
aatattttaaagaat

SEQ ID NO: 478138 - DNA, 16 bp, Homo sapiens
aatcacgctttttgaa

SEQ ID NO: 478139 - DNA, 16 bp, Homo sapiens
aatcaggtggcttttg

SEQ ID NO: 478140 - DNA, 12 bp, Homo sapiens
aatcatctattg

SEQ ID NO: 478141 - DNA, 15 bp, Homo sapiens
aatcatctattgagt

SEQ ID NO: 478142 - DNA, 12 bp, Homo sapiens
aatctaaattaa

SEQ ID NO: 478143 - DNA, 18 bp, Homo sapiens
aatctgcattattggaat

SEQ ID NO: 478144 - DNA, 15 bp, Homo sapiens
aatcttcggccaatt

SEQ ID NO: 478145 - DNA, 23 bp, Homo sapiens
aatgaaacaaagagttcaagaaa

SEQ ID NO: 478146 - DNA, 14 bp, Homo sapiens
aatgaaattaactg

SEQ ID NO: 478147 - DNA, 14 bp, Homo sapiens
aatgaacagaacat

SEQ ID NO: 478148 - DNA, 15 bp, Homo sapiens
aatgcacctaaagaa

SEQ ID NO: 478149 - DNA, 20 bp, Homo sapiens
aatgctacaaaatgtgtgct

SEQ ID NO: 478150 - DNA, 14 bp, Homo sapiens
aatgcttaatcaga

SEQ ID NO: 478151 - DNA, 16 bp, Homo sapiens
aatggcctcttaaaaa

SEQ ID NO: 478152 - DNA, 18 bp, Homo sapiens
aatggctgataattttaa

SEQ ID NO: 478153 - DNA, 19 bp, Homo sapiens
aatggctgataattttaaa

SEQ ID NO: 478154 - DNA, 17 bp, Homo sapiens
aatgtaaatattttaaa

SEQ ID NO: 478155 - DNA, 22 bp, Homo sapiens
aatgtaaatattttaaagaatt

SEQ ID NO: 478156 - DNA, 22 bp, Homo sapiens
aatgttgaaatatgatgttaaa

SEQ ID NO: 478157 - DNA, 19 bp, Homo sapiens
aattaaacaaattccttcc

SEQ ID NO: 478158 - DNA, 22 bp, Homo sapiens
aattaactgggtaatgaaacaa

SEQ ID NO: 478159 - DNA, 15 bp, Homo sapiens
aattatctttaaaac

SEQ ID NO: 478160 - DNA, 22 bp, Homo sapiens
aattgcacgcggagtgagtttt

SEQ ID NO: 478161 - DNA, 21 bp, Homo sapiens
aattgcttctctaaaacagca

SEQ ID NO: 478162 - DNA, 15 bp, Homo sapiens
aatttagaaaacttt

SEQ ID NO: 478163 - DNA, 15 bp, Homo sapiens
aatttagaaatcatt

SEQ ID NO: 478164 - DNA, 17 bp, Homo sapiens
aatttagacttcaagca

SEQ ID NO: 478165 - DNA, 21 bp, Homo sapiens
aatttagtttcatataaagta

SEQ ID NO: 478166 - DNA, 16 bp, Homo sapiens
aatttattattgttct

SEQ ID NO: 478167 - DNA, 21 bp, Homo sapiens
aattttctgtgttctgaagtc

SEQ ID NO: 478168 - DNA, 20 bp, Homo sapiens
acaaaatccttgccttcaaa

SEQ ID NO: 478169 - DNA, 21 bp, Homo sapiens
acaaaatgtgtgcttggaaaa

SEQ ID NO: 478170 - DNA, 22 bp, Homo sapiens
acaacatttctatagccaaaaa

SEQ ID NO: 478171 - DNA, 15 bp, Homo sapiens
acaagaagcattttg

SEQ ID NO: 478172 - DNA, 17 bp, Homo sapiens
acaagccttactcacct

SEQ ID NO: 478173 - DNA, 22 bp, Homo sapiens
acaagtatttgttaatttagaa

SEQ ID NO: 478174 - DNA, 14 bp, Homo sapiens
acaccatcttttgt

SEQ ID NO: 478175 - DNA, 18 bp, Homo sapiens
acactgtgtactgcagtt

SEQ ID NO: 478176 - DNA, 14 bp, Homo sapiens
acaggggaggctga

SEQ ID NO: 478177 - DNA, 12 bp, Homo sapiens
acagtctaaagc

SEQ ID NO: 478178 - DNA, 17 bp, Homo sapiens
acataattatccaggaa

SEQ ID NO: 478179 - DNA, 21 bp, Homo sapiens
acataatttagtttcatataa

SEQ ID NO: 478180 - DNA, 17 bp, Homo sapiens
acatagacagaagaaac

SEQ ID NO: 478181 - DNA, 23 bp, Homo sapiens
acatctctgtaaaaagcaggtga

SEQ ID NO: 478182 - DNA, 14 bp, Homo sapiens
acatgttatttgta

SEQ ID NO: 478183 - DNA, 14 bp, Homo sapiens
acatttatgtgtga

SEQ ID NO: 478184 - DNA, 13 bp, Homo sapiens
accaaaagaagta

SEQ ID NO: 478185 - DNA, 14 bp, Homo sapiens
accaaaagaagtaa

SEQ ID NO: 478186 - DNA, 15 bp, Homo sapiens
accaagatacttaag

SEQ ID NO: 478187 - DNA, 20 bp, Homo sapiens
accaagatacttaagtgctg

SEQ ID NO: 478188 - DNA, 17 bp, Homo sapiens
accaggcaccaaaagaa

SEQ ID NO: 478189 - DNA, 19 bp, Homo sapiens
accaggcaccaaaagaagt

SEQ ID NO: 478190 - DNA, 21 bp, Homo sapiens
accaggcaccaaaagaagtaa

SEQ ID NO: 478191 - DNA, 20 bp, Homo sapiens
acccaggctggagtacagtg

SEQ ID NO: 478192 - DNA, 12 bp, Homo sapiens
acctaaagaaaa

SEQ ID NO: 478193 - DNA, 13 bp, Homo sapiens
acctaaagaaaaa

SEQ ID NO: 478194 - DNA, 17 bp, Homo sapiens
acctcagtaatttagaa

SEQ ID NO: 478195 - DNA, 16 bp, Homo sapiens
acctcggacaccatct

SEQ ID NO: 478196 - DNA, 23 bp, Homo sapiens
accttctgtgcatctggcctggg

SEQ ID NO: 478197 - DNA, 10 bp, Homo sapiens
acggaggctc

SEQ ID NO: 478198 - DNA, 13 bp, Homo sapiens
actaaatctttta

SEQ ID NO: 478199 - DNA, 17 bp, Homo sapiens
actacagtctaaagctg

SEQ ID NO: 478200 - DNA, 14 bp, Homo sapiens
actagaggtgagaa

SEQ ID NO: 478201 - DNA, 20 bp, Homo sapiens
actagttgtgtctggcagtt

SEQ ID NO: 478202 - DNA, 20 bp, Homo sapiens
actataagcaagaaggcaaa

SEQ ID NO: 478203 - DNA, 18 bp, Homo sapiens
actatggtatatattttg

SEQ ID NO: 478204 - DNA, 12 bp, Homo sapiens
actcacctctct

SEQ ID NO: 478205 - DNA, 19 bp, Homo sapiens
actcatttttcatgataat

SEQ ID NO: 478206 - DNA, 20 bp, Homo sapiens
actcatttttcatgataatg

SEQ ID NO: 478207 - DNA, 20 bp, Homo sapiens
actccagtgatgttcttcaa

SEQ ID NO: 478208 - DNA, 20 bp, Homo sapiens
actccttcaacaattctaaa

SEQ ID NO: 478209 - DNA, 14 bp, Homo sapiens
actcgttttttaca

SEQ ID NO: 478210 - DNA, 19 bp, Homo sapiens
actgccatttcctcctggg

SEQ ID NO: 478211 - DNA, 15 bp, Homo sapiens
actggcctcaaagca

SEQ ID NO: 478212 - DNA, 22 bp, Homo sapiens
actggcctcaaagcaagcattc

SEQ ID NO: 478213 - DNA, 14 bp, Homo sapiens
acttactatggtat

SEQ ID NO: 478214 - DNA, 17 bp, Homo sapiens
acttatttataacattg

SEQ ID NO: 478215 - DNA, 23 bp, Homo sapiens
acttatttataacattgtaaatg

SEQ ID NO: 478216 - DNA, 12 bp, Homo sapiens
acttgctgtgaa

SEQ ID NO: 478217 - DNA, 23 bp, Homo sapiens
acttttttatttaaaaaactaaa

SEQ ID NO: 478218 - DNA, 16 bp, Homo sapiens
agaaaacctttcttca

SEQ ID NO: 478219 - DNA, 15 bp, Homo sapiens
agaaacttttttatt

SEQ ID NO: 478220 - DNA, 13 bp, Homo sapiens
agaaataagtttt

SEQ ID NO: 478221 - DNA, 22 bp, Homo sapiens
agaaatcattttgcaatccctt

SEQ ID NO: 478222 - DNA, 20 bp, Homo sapiens
agaaatttaaactataagca

SEQ ID NO: 478223 - DNA, 14 bp, Homo sapiens
agaacctaattcaa

SEQ ID NO: 478224 - DNA, 22 bp, Homo sapiens
agaagaatctcatctcagtgaa

SEQ ID NO: 478225 - DNA, 19 bp, Homo sapiens
agaaggcaaaaatagtttg

SEQ ID NO: 478226 - DNA, 14 bp, Homo sapiens
agaaggtccttaat

SEQ ID NO: 478227 - DNA, 22 bp, Homo sapiens
agaagtaaaagcaaaaaagaaa

SEQ ID NO: 478228 - DNA, 14 bp, Homo sapiens
agaagtgaaaaaga

SEQ ID NO: 478229 - DNA, 19 bp, Homo sapiens
agaagtttcatcatttttt

SEQ ID NO: 478230 - DNA, 23 bp, Homo sapiens
agaatgtcattttggtactttgg

SEQ ID NO: 478231 - DNA, 16 bp, Homo sapiens
agacacatactcattt

SEQ ID NO: 478232 - DNA, 16 bp, Homo sapiens
agacacgctcttctat

SEQ ID NO: 478233 - DNA, 14 bp, Homo sapiens
agaccttttttagg

SEQ ID NO: 478234 - DNA, 19 bp, Homo sapiens
agacttcaagcatggctat

SEQ ID NO: 478235 - DNA, 14 bp, Homo sapiens
agagctacataatt

SEQ ID NO: 478236 - DNA, 16 bp, Homo sapiens
agagctacgtatttaa

SEQ ID NO: 478237 - DNA, 20 bp, Homo sapiens
agagtcagccattcctgttc

SEQ ID NO: 478238 - DNA, 22 bp, Homo sapiens
agataactgaaaattatttaaa

SEQ ID NO: 478239 - DNA, 22 bp, Homo sapiens
agataattaaatgaaatacttg

SEQ ID NO: 478240 - DNA, 23 bp, Homo sapiens
agatatgagaaatataaaaataa

SEQ ID NO: 478241 - DNA, 18 bp, Homo sapiens
agatattcctattgtgca

SEQ ID NO: 478242 - DNA, 14 bp, Homo sapiens
agattttttaataa

SEQ ID NO: 478243 - DNA, 14 bp, Homo sapiens
agcaaaaaagaaaa

SEQ ID NO: 478244 - DNA, 15 bp, Homo sapiens
agcaaatcgaatgaa

SEQ ID NO: 478245 - DNA, 15 bp, Homo sapiens
agcaacctcagtaat

SEQ ID NO: 478246 - DNA, 11 bp, Homo sapiens
agcaactccca

SEQ ID NO: 478247 - DNA, 14 bp, Homo sapiens
agcaactcccacga

SEQ ID NO: 478248 - DNA, 16 bp, Homo sapiens
agcacaggctaatttt

SEQ ID NO: 478249 - DNA, 18 bp, Homo sapiens
agcactttgggaggctga

SEQ ID NO: 478250 - DNA, 18 bp, Homo sapiens
agcatggctattttatat

SEQ ID NO: 478251 - DNA, 17 bp, Homo sapiens
agcattcagaagaaaaa

SEQ ID NO: 478252 - DNA, 15 bp, Homo sapiens
agcattgaatggcta

SEQ ID NO: 478253 - DNA, 14 bp, Homo sapiens
agccaaaaatagct

SEQ ID NO: 478254 - DNA, 22 bp, Homo sapiens
agccaaaaatagctaaatacct

SEQ ID NO: 478255 - DNA, 16 bp, Homo sapiens
agccattcctgttctc

SEQ ID NO: 478256 - DNA, 14 bp, Homo sapiens
agccctaaacatca

SEQ ID NO: 478257 - DNA, 22 bp, Homo sapiens
agccctaagtaaatctaaatta

SEQ ID NO: 478258 - DNA, 17 bp, Homo sapiens
agcctcccaagtagctg

SEQ ID NO: 478259 - DNA, 12 bp, Homo sapiens
agctataaatag

SEQ ID NO: 478260 - DNA, 14 bp, Homo sapiens
agctcaaggctgca

SEQ ID NO: 478261 - DNA, 15 bp, Homo sapiens
agctcaaggctgcag

SEQ ID NO: 478262 - DNA, 17 bp, Homo sapiens
agctcagaggagaggag

SEQ ID NO: 478263 - DNA, 19 bp, Homo sapiens
agctgtggactttgttcac

SEQ ID NO: 478264 - DNA, 18 bp, Homo sapiens
agctttaacttaaatagt

SEQ ID NO: 478265 - DNA, 16 bp, Homo sapiens
agctttctgatactta

SEQ ID NO: 478266 - DNA, 16 bp, Homo sapiens
aggaaaattgaatgca

SEQ ID NO: 478267 - DNA, 17 bp, Homo sapiens
aggagatggggagggcg

SEQ ID NO: 478268 - DNA, 13 bp, Homo sapiens
aggagcaaacagg

SEQ ID NO: 478269 - DNA, 18 bp, Homo sapiens
aggaggcgaataaatgtt

SEQ ID NO: 478270 - DNA, 19 bp, Homo sapiens
aggaggcgaataaatgttc

SEQ ID NO: 478271 - DNA, 17 bp, Homo sapiens
aggcaccaaaagaagta

SEQ ID NO: 478272 - DNA, 16 bp, Homo sapiens
aggcgaataaatgttc

SEQ ID NO: 478273 - DNA, 19 bp, Homo sapiens
aggctgagacgcaaggatc

SEQ ID NO: 478274 - DNA, 11 bp, Homo sapiens
aggtctcctct

SEQ ID NO: 478275 - DNA, 12 bp, Homo sapiens
aggtctcctctt

SEQ ID NO: 478276 - DNA, 14 bp, Homo sapiens
aggtctcctcttaa

SEQ ID NO: 478277 - DNA, 15 bp, Homo sapiens
aggtctcctcttaaa

SEQ ID NO: 478278 - DNA, 13 bp, Homo sapiens
aggtgagaaattt

SEQ ID NO: 478279 - DNA, 18 bp, Homo sapiens
aggttgctggcatttgct

SEQ ID NO: 478280 - DNA, 12 bp, Homo sapiens
agtaaaagcaaa

SEQ ID NO: 478281 - DNA, 19 bp, Homo sapiens
agtaaatcacgctttttga

SEQ ID NO: 478282 - DNA, 20 bp, Homo sapiens
agtaaatcacgctttttgaa

SEQ ID NO: 478283 - DNA, 12 bp, Homo sapiens
agtagaaatcat

SEQ ID NO: 478284 - DNA, 17 bp, Homo sapiens
agtatattatgtattta

SEQ ID NO: 478285 - DNA, 19 bp, Homo sapiens
agtatcaatccttgttcag

SEQ ID NO: 478286 - DNA, 14 bp, Homo sapiens
agtatttgttaatt

SEQ ID NO: 478287 - DNA, 22 bp, Homo sapiens
agtcaaatttgaaaataattgt

SEQ ID NO: 478288 - DNA, 19 bp, Homo sapiens
agtctcagaatgtcatttt

SEQ ID NO: 478289 - DNA, 20 bp, Homo sapiens
agtgaaaaagacttcaaatg

SEQ ID NO: 478290 - DNA, 14 bp, Homo sapiens
agtgaagaatactt

SEQ ID NO: 478291 - DNA, 23 bp, Homo sapiens
agtgagacctccctgtctctaca

SEQ ID NO: 478292 - DNA, 15 bp, Homo sapiens
agtgattgtcttaat

SEQ ID NO: 478293 - DNA, 22 bp, Homo sapiens
agtgctgggattacaggcatga

SEQ ID NO: 478294 - DNA, 15 bp, Homo sapiens
agtgttataaaatct

SEQ ID NO: 478295 - DNA, 19 bp, Homo sapiens
agtgttataaaatctgtat

SEQ ID NO: 478296 - DNA, 20 bp, Homo sapiens
agttagctttaacttaaata

SEQ ID NO: 478297 - DNA, 21 bp, Homo sapiens
agttagctttaacttaaatag

SEQ ID NO: 478298 - DNA, 22 bp, Homo sapiens
agttagctttaacttaaatagt

SEQ ID NO: 478299 - DNA, 19 bp, Homo sapiens
agttcaagaaataagtttt

SEQ ID NO: 478300 - DNA, 23 bp, Homo sapiens
agttgataaagattttttaataa

SEQ ID NO: 478301 - DNA, 14 bp, Homo sapiens
agttgtatctcttt

SEQ ID NO: 478302 - DNA, 18 bp, Homo sapiens
agtttatatttaactctc

SEQ ID NO: 478303 - DNA, 17 bp, Homo sapiens
agtttggatatgtaaaa

SEQ ID NO: 478304 - DNA, 13 bp, Homo sapiens
ataaaaataatta

SEQ ID NO: 478305 - DNA, 17 bp, Homo sapiens
ataaaaatgatctaaac

SEQ ID NO: 478306 - DNA, 16 bp, Homo sapiens
ataaagattttttaat

SEQ ID NO: 478307 - DNA, 13 bp, Homo sapiens
ataaagtgtaata

SEQ ID NO: 478308 - DNA, 16 bp, Homo sapiens
ataaagttgataaaga

SEQ ID NO: 478309 - DNA, 10 bp, Homo sapiens
ataaatgttc

SEQ ID NO: 478310 - DNA, 17 bp, Homo sapiens
ataacattgtaaatgat

SEQ ID NO: 478311 - DNA, 20 bp, Homo sapiens
ataacgtttaagccaaaaca

SEQ ID NO: 478312 - DNA, 22 bp, Homo sapiens
ataacgtttaagccaaaacaat

SEQ ID NO: 478313 - DNA, 17 bp, Homo sapiens
ataactgaaaattattt

SEQ ID NO: 478314 - DNA, 22 bp, Homo sapiens
ataagaaacttttttatttaaa

SEQ ID NO: 478315 - DNA, 19 bp, Homo sapiens
ataagaagaatgcttaatc

SEQ ID NO: 478316 - DNA, 20 bp, Homo sapiens
ataatttagtttcatataaa

SEQ ID NO: 478317 - DNA, 18 bp, Homo sapiens
atacatgctaagagaagt

SEQ ID NO: 478318 - DNA, 17 bp, Homo sapiens
ataccattttgaaatat

SEQ ID NO: 478319 - DNA, 19 bp, Homo sapiens
atactatttattaaaacca

SEQ ID NO: 478320 - DNA, 17 bp, Homo sapiens
atactcatttttcatga

SEQ ID NO: 478321 - DNA, 14 bp, Homo sapiens
atagacagaagaaa

SEQ ID NO: 478322 - DNA, 16 bp, Homo sapiens
atagacagaagaaaca

SEQ ID NO: 478323 - DNA, 18 bp, Homo sapiens
atagacagaagaaacaag

SEQ ID NO: 478324 - DNA, 22 bp, Homo sapiens
atagataccattttgaaatatt

SEQ ID NO: 478325 - DNA, 15 bp, Homo sapiens
atagcaaaagaagaa

SEQ ID NO: 478326 - DNA, 14 bp, Homo sapiens
atagcaaagaattg

SEQ ID NO: 478327 - DNA, 15 bp, Homo sapiens
atagcaaagaattga

SEQ ID NO: 478328 - DNA, 17 bp, Homo sapiens
atagcacaggctaattt

SEQ ID NO: 478329 - DNA, 14 bp, Homo sapiens
atagccaaaaatag

SEQ ID NO: 478330 - DNA, 16 bp, Homo sapiens
atagccaaaaatagct

SEQ ID NO: 478331 - DNA, 23 bp, Homo sapiens
ataggatttatttaaaatagcaa

SEQ ID NO: 478332 - DNA, 19 bp, Homo sapiens
atagtgaaaattttattga

SEQ ID NO: 478333 - DNA, 18 bp, Homo sapiens
atagtttggatatgtaaa

SEQ ID NO: 478334 - DNA, 12 bp, Homo sapiens
atataaaaataa

SEQ ID NO: 478335 - DNA, 13 bp, Homo sapiens
atataaaaataat

SEQ ID NO: 478336 - DNA, 22 bp, Homo sapiens
atataaaaataattaaaacaaa

SEQ ID NO: 478337 - DNA, 18 bp, Homo sapiens
atataattgttttatctg

SEQ ID NO: 478338 - DNA, 14 bp, Homo sapiens
atatcaaaaagact

SEQ ID NO: 478339 - DNA, 22 bp, Homo sapiens
atatcctaaacatcattcattt

SEQ ID NO: 478340 - DNA, 18 bp, Homo sapiens
atatgagattggaaaaaa

SEQ ID NO: 478341 - DNA, 12 bp, Homo sapiens
atatgtaaaaca

SEQ ID NO: 478342 - DNA, 14 bp, Homo sapiens
atatgtaaaacatt

SEQ ID NO: 478343 - DNA, 22 bp, Homo sapiens
atattcctattgtgcaatgtaa

SEQ ID NO: 478344 - DNA, 18 bp, Homo sapiens
atattgatgtaactgtgt

SEQ ID NO: 478345 - DNA, 21 bp, Homo sapiens
atattgtgggtgttaattttt

SEQ ID NO: 478346 - DNA, 19 bp, Homo sapiens
atatttaactctctttatg

SEQ ID NO: 478347 - DNA, 18 bp, Homo sapiens
atcacgctttttgaaaaa

SEQ ID NO: 478348 - DNA, 18 bp, Homo sapiens
atcaggtaaactgatgct

SEQ ID NO: 478349 - DNA, 15 bp, Homo sapiens
atcatcagtgtagaa

SEQ ID NO: 478350 - DNA, 22 bp, Homo sapiens
atcattttgcaatcccttaata

SEQ ID NO: 478351 - DNA, 18 bp, Homo sapiens
atccatttcatctatttc

SEQ ID NO: 478352 - DNA, 20 bp, Homo sapiens
atccatttcatctatttctg

SEQ ID NO: 478353 - DNA, 13 bp, Homo sapiens
atcctgaggctga

SEQ ID NO: 478354 - DNA, 15 bp, Homo sapiens
atctatttctgagaa

SEQ ID NO: 478355 - DNA, 14 bp, Homo sapiens
atctcagtgaagaa

SEQ ID NO: 478356 - DNA, 22 bp, Homo sapiens
atctcttttgaatccatgcttg

SEQ ID NO: 478357 - DNA, 14 bp, Homo sapiens
atctgaatttttaa

SEQ ID NO: 478358 - DNA, 20 bp, Homo sapiens
atctggaaaaaaaaaaatat

SEQ ID NO: 478359 - DNA, 16 bp, Homo sapiens
atctggcctgggggct

SEQ ID NO: 478360 - DNA, 17 bp, Homo sapiens
atctgtgataattttct

SEQ ID NO: 478361 - DNA, 16 bp, Homo sapiens
atcttgactcactgca

SEQ ID NO: 478362 - DNA, 20 bp, Homo sapiens
atcttggttgatgccaaaaa

SEQ ID NO: 478363 - DNA, 21 bp, Homo sapiens
atcttggttgatgccaaaaaa

SEQ ID NO: 478364 - DNA, 14 bp, Homo sapiens
atgaaaaagaagaa

SEQ ID NO: 478365 - DNA, 17 bp, Homo sapiens
atgaaaaagaagaatct

SEQ ID NO: 478366 - DNA, 21 bp, Homo sapiens
atgaacagaacatagacagaa

SEQ ID NO: 478367 - DNA, 20 bp, Homo sapiens
atgaagccctaagtaaatct

SEQ ID NO: 478368 - DNA, 16 bp, Homo sapiens
atgagaaatataaaaa

SEQ ID NO: 478369 - DNA, 19 bp, Homo sapiens
atgagattggaaaaaatta

SEQ ID NO: 478370 - DNA, 12 bp, Homo sapiens
atgataatgaac

SEQ ID NO: 478371 - DNA, 14 bp, Homo sapiens
atgatgttaaaaaa

SEQ ID NO: 478372 - DNA, 15 bp, Homo sapiens
atgcacctaaagaaa

SEQ ID NO: 478373 - DNA, 17 bp, Homo sapiens
atgcactcttttgagca

SEQ ID NO: 478374 - DNA, 18 bp, Homo sapiens
atgcatgcactcttttga

SEQ ID NO: 478375 - DNA, 17 bp, Homo sapiens
atgccaatgtccaggtc

SEQ ID NO: 478376 - DNA, 23 bp, Homo sapiens
atgccaatgtccaggtcacaggc

SEQ ID NO: 478377 - DNA, 21 bp, Homo sapiens
atgccttttcccaaaatgttg

SEQ ID NO: 478378 - DNA, 17 bp, Homo sapiens
atgctaagagaagtaga

SEQ ID NO: 478379 - DNA, 18 bp, Homo sapiens
atgctaagagaagtagaa

SEQ ID NO: 478380 - DNA, 16 bp, Homo sapiens
atgctacaaaatgtgt

SEQ ID NO: 478381 - DNA, 14 bp, Homo sapiens
atgctgttcattga

SEQ ID NO: 478382 - DNA, 14 bp, Homo sapiens
atggataatcttcg

SEQ ID NO: 478383 - DNA, 13 bp, Homo sapiens
atggattctaaaa

SEQ ID NO: 478384 - DNA, 14 bp, Homo sapiens
atggattctaaaat

SEQ ID NO: 478385 - DNA, 19 bp, Homo sapiens
atggctatgtttttaatgt

SEQ ID NO: 478386 - DNA, 20 bp, Homo sapiens
atggctgataattttaaatt

SEQ ID NO: 478387 - DNA, 13 bp, Homo sapiens
atggtatatattt

SEQ ID NO: 478388 - DNA, 17 bp, Homo sapiens
atggtatatattttgaa

SEQ ID NO: 478389 - DNA, 13 bp, Homo sapiens
atgtaaatatttt

SEQ ID NO: 478390 - DNA, 15 bp, Homo sapiens
atgtaaatattttaa

SEQ ID NO: 478391 - DNA, 21 bp, Homo sapiens
atgtaaatattttaaagaatt

SEQ ID NO: 478392 - DNA, 15 bp, Homo sapiens
atgtctttaaaatga

SEQ ID NO: 478393 - DNA, 19 bp, Homo sapiens
atgttatttgtaatagatg

SEQ ID NO: 478394 - DNA, 22 bp, Homo sapiens
atgttgaaatatgatgttaaaa

SEQ ID NO: 478395 - DNA, 21 bp, Homo sapiens
atgtttgtctgtgtgctgtaa

SEQ ID NO: 478396 - DNA, 16 bp, Homo sapiens
atgtttttaatgtata

SEQ ID NO: 478397 - DNA, 13 bp, Homo sapiens
attaaaacaaaat

SEQ ID NO: 478398 - DNA, 13 bp, Homo sapiens
attaaatgaaata

SEQ ID NO: 478399 - DNA, 17 bp, Homo sapiens
attaaatgaaatacttg

SEQ ID NO: 478400 - DNA, 18 bp, Homo sapiens
attaactgggtaatgaaa

SEQ ID NO: 478401 - DNA, 22 bp, Homo sapiens
attaactgggtaatgaaacaaa

SEQ ID NO: 478402 - DNA, 22 bp, Homo sapiens
attatttaaaccgctaaaagaa

SEQ ID NO: 478403 - DNA, 14 bp, Homo sapiens
attcacttttattg

SEQ ID NO: 478404 - DNA, 16 bp, Homo sapiens
attcagaagaaaaaga

SEQ ID NO: 478405 - DNA, 14 bp, Homo sapiens
attcctcccctgga

SEQ ID NO: 478406 - DNA, 16 bp, Homo sapiens
attctaaaatgattgt

SEQ ID NO: 478407 - DNA, 15 bp, Homo sapiens
attctaaaatgcctt

SEQ ID NO: 478408 - DNA, 16 bp, Homo sapiens
attctgaacaattctc

SEQ ID NO: 478409 - DNA, 22 bp, Homo sapiens
attgaatggctatgtttttaat

SEQ ID NO: 478410 - DNA, 13 bp, Homo sapiens
attgagtgtacat

SEQ ID NO: 478411 - DNA, 14 bp, Homo sapiens
attgctgtaaataa

SEQ ID NO: 478412 - DNA, 18 bp, Homo sapiens
attgctgtaaataaaaat

SEQ ID NO: 478413 - DNA, 14 bp, Homo sapiens
attgcttctctaaa

SEQ ID NO: 478414 - DNA, 17 bp, Homo sapiens
attgtgcaatgtaaata

SEQ ID NO: 478415 - DNA, 18 bp, Homo sapiens
attgtgcaatgtaaatat

SEQ ID NO: 478416 - DNA, 16 bp, Homo sapiens
attgtgggtgttaatt

SEQ ID NO: 478417 - DNA, 19 bp, Homo sapiens
attgttttatctgaatttt

SEQ ID NO: 478418 - DNA, 12 bp, Homo sapiens
atttaaactata

SEQ ID NO: 478419 - DNA, 13 bp, Homo sapiens
atttaactctctt

SEQ ID NO: 478420 - DNA, 14 bp, Homo sapiens
atttatttaaaata

SEQ ID NO: 478421 - DNA, 21 bp, Homo sapiens
atttattttgacataaagttg

SEQ ID NO: 478422 - DNA, 18 bp, Homo sapiens
atttcagctgtgagcttt

SEQ ID NO: 478423 - DNA, 20 bp, Homo sapiens
atttcatctatttctgagaa

SEQ ID NO: 478424 - DNA, 17 bp, Homo sapiens
atttctgagaaggtcct

SEQ ID NO: 478425 - DNA, 23 bp, Homo sapiens
atttctgagaaggtccttaatga

SEQ ID NO: 478426 - DNA, 17 bp, Homo sapiens
atttgaaaataattgtt

SEQ ID NO: 478427 - DNA, 22 bp, Homo sapiens
atttgtaatagatgtttgatag

SEQ ID NO: 478428 - DNA, 13 bp, Homo sapiens
attttaaagaatt

SEQ ID NO: 478429 - DNA, 18 bp, Homo sapiens
attttatattacactaca

SEQ ID NO: 478430 - DNA, 16 bp, Homo sapiens
attttattgaatataa

SEQ ID NO: 478431 - DNA, 20 bp, Homo sapiens
attttcaagtggaaaccttg

SEQ ID NO: 478432 - DNA, 15 bp, Homo sapiens
attttctgctacttt

SEQ ID NO: 478433 - DNA, 19 bp, Homo sapiens
atttttgatactaagcatt

SEQ ID NO: 478434 - DNA, 14 bp, Homo sapiens
attttttaaaaaag

SEQ ID NO: 478435 - DNA, 18 bp, Homo sapiens
attttttaaaaaagctta

SEQ ID NO: 478436 - DNA, 14 bp, Homo sapiens
caaaacaatgttta

SEQ ID NO: 478437 - DNA, 15 bp, Homo sapiens
caaaagaagaagttt

SEQ ID NO: 478438 - DNA, 20 bp, Homo sapiens
caaaagaagaagtttcatca

SEQ ID NO: 478439 - DNA, 18 bp, Homo sapiens
caaaagaagtaaaagcaa

SEQ ID NO: 478440 - DNA, 19 bp, Homo sapiens
caaaagaagtaaaagcaaa

SEQ ID NO: 478441 - DNA, 14 bp, Homo sapiens
caaaataaagaata

SEQ ID NO: 478442 - DNA, 15 bp, Homo sapiens
caaacaggaaaatga

SEQ ID NO: 478443 - DNA, 21 bp, Homo sapiens
caaaccttaagataatggata

SEQ ID NO: 478444 - DNA, 15 bp, Homo sapiens
caaagagttcaagaa

SEQ ID NO: 478445 - DNA, 22 bp, Homo sapiens
caaagcaagcattcagaagaaa

SEQ ID NO: 478446 - DNA, 23 bp, Homo sapiens
caaagcaagcattcagaagaaaa

SEQ ID NO: 478447 - DNA, 21 bp, Homo sapiens
caaatgttattcaataactat

SEQ ID NO: 478448 - DNA, 15 bp, Homo sapiens
caacctcagtaattt

SEQ ID NO: 478449 - DNA, 18 bp, Homo sapiens
caacctcagtaatttaga

SEQ ID NO: 478450 - DNA, 15 bp, Homo sapiens
caactacagtctaaa

SEQ ID NO: 478451 - DNA, 13 bp, Homo sapiens
caagcattctcct

SEQ ID NO: 478452 - DNA, 14 bp, Homo sapiens
caagccttactcac

SEQ ID NO: 478453 - DNA, 18 bp, Homo sapiens
caagccttactcacctct

SEQ ID NO: 478454 - DNA, 19 bp, Homo sapiens
caagccttactcacctctc

SEQ ID NO: 478455 - DNA, 17 bp, Homo sapiens
caagctctagtgggaag

SEQ ID NO: 478456 - DNA, 20 bp, Homo sapiens
caagcttaatggctgataat

SEQ ID NO: 478457 - DNA, 19 bp, Homo sapiens
caagtatttgttaatttag

SEQ ID NO: 478458 - DNA, 23 bp, Homo sapiens
caatgcacctaaagaaaaacaaa

SEQ ID NO: 478459 - DNA, 17 bp, Homo sapiens
caatgtaaatattttaa

SEQ ID NO: 478460 - DNA, 19 bp, Homo sapiens
caatgtaaatattttaaag

SEQ ID NO: 478461 - DNA, 12 bp, Homo sapiens
caatgtccaggt

SEQ ID NO: 478462 - DNA, 17 bp, Homo sapiens
cacaagccttactcacc

SEQ ID NO: 478463 - DNA, 17 bp, Homo sapiens
cacacagtattaagtga

SEQ ID NO: 478464 - DNA, 14 bp, Homo sapiens
cacagagagagtca

SEQ ID NO: 478465 - DNA, 17 bp, Homo sapiens
cacctaaagaaaaacaa

SEQ ID NO: 478466 - DNA, 23 bp, Homo sapiens
caccttctgtgcatctggcctgg

SEQ ID NO: 478467 - DNA, 22 bp, Homo sapiens
cacgactgttgtacaagctcag

SEQ ID NO: 478468 - DNA, 20 bp, Homo sapiens
cactgcaatctccacctccc

SEQ ID NO: 478469 - DNA, 18 bp, Homo sapiens
ctcagtgaagaatacttc

SEQ ID NO: 478470 - DNA, 20 bp, Homo sapiens
ctccaagagctacataattt

SEQ ID NO: 478471 - DNA, 13 bp, Homo sapiens
ctcccctggaagt

SEQ ID NO: 478472 - DNA, 23 bp, Homo sapiens
ctcctgggcatgtttgtctgtgt

SEQ ID NO: 478473 - DNA, 21 bp, Homo sapiens
ctccttcaacaattctaaaat

SEQ ID NO: 478474 - DNA, 22 bp, Homo sapiens
ctcttaaaaattatctttaaaa

SEQ ID NO: 478475 - DNA, 18 bp, Homo sapiens
ctgaatttttaaacaagt

SEQ ID NO: 478476 - DNA, 22 bp, Homo sapiens
ctgaatttttaaacaagtattt

SEQ ID NO: 478477 - DNA, 22 bp, Homo sapiens
ctgacaacatttctatagccaa

SEQ ID NO: 478478 - DNA, 15 bp, Homo sapiens
ctgataattttaaat

SEQ ID NO: 478479 - DNA, 21 bp, Homo sapiens
ctgatacttatttataacatt

SEQ ID NO: 478480 - DNA, 15 bp, Homo sapiens
ctgatggccaggcct

SEQ ID NO: 478481 - DNA, 12 bp, Homo sapiens
ctgcagcaactc

SEQ ID NO: 478482 - DNA, 14 bp, Homo sapiens
ctgcagcaactccc

SEQ ID NO: 478483 - DNA, 18 bp, Homo sapiens
ctgcagcaactcccacga

SEQ ID NO: 478484 - DNA, 23 bp, Homo sapiens
ctgcattattggaatataattgt

SEQ ID NO: 478485 - DNA, 19 bp, Homo sapiens
ctgcctggaggagaaggag

SEQ ID NO: 478486 - DNA, 20 bp, Homo sapiens
ctggaaaattcctattgatt

SEQ ID NO: 478487 - DNA, 15 bp, Homo sapiens
ctggaggagaaggag

SEQ ID NO: 478488 - DNA, 17 bp, Homo sapiens
ctggaggagaaggagga

SEQ ID NO: 478489 - DNA, 21 bp, Homo sapiens
ctggcctcaaagcaagcattc

SEQ ID NO: 478490 - DNA, 15 bp, Homo sapiens
ctggcttttcgcttg

SEQ ID NO: 478491 - DNA, 20 bp, Homo sapiens
ctggttcacactgaccaaga

SEQ ID NO: 478492 - DNA, 16 bp, Homo sapiens
ctgtaaataaaaatag

SEQ ID NO: 478493 - DNA, 17 bp, Homo sapiens
ctgtaacctgaagtcaa

SEQ ID NO: 478494 - DNA, 15 bp, Homo sapiens
ctgtgtactgcagtt

SEQ ID NO: 478495 - DNA, 14 bp, Homo sapiens
ctgttgtacaagct

SEQ ID NO: 478496 - DNA, 16 bp, Homo sapiens
cttaaataagaaactt

SEQ ID NO: 478497 - DNA, 17 bp, Homo sapiens
cttaaataagaaacttt

SEQ ID NO: 478498 - DNA, 16 bp, Homo sapiens
cttaagtgctgcaatt

SEQ ID NO: 478499 - DNA, 19 bp, Homo sapiens
cttaccaggcaccaaaaga

SEQ ID NO: 478500 - DNA, 20 bp, Homo sapiens
cttaccaggcaccaaaagaa

SEQ ID NO: 478501 - DNA, 18 bp, Homo sapiens
cttactcacctctctcta

SEQ ID NO: 478502 - DNA, 16 bp, Homo sapiens
cttcaaacgaaatggc

SEQ ID NO: 478503 - DNA, 13 bp, Homo sapiens
cttctattttcaa

SEQ ID NO: 478504 - DNA, 18 bp, Homo sapiens
cttctgcagcaactccca

SEQ ID NO: 478505 - DNA, 20 bp, Homo sapiens
cttctgcagcaactcccacg

SEQ ID NO: 478506 - DNA, 14 bp, Homo sapiens
cttctgtgcatctg

SEQ ID NO: 478507 - DNA, 20 bp, Homo sapiens
cttctgtgcatctggcctgg

SEQ ID NO: 478508 - DNA, 12 bp, Homo sapiens
cttgcttctgca

SEQ ID NO: 478509 - DNA, 20 bp, Homo sapiens
cttgcttctgcagcaactcc

SEQ ID NO: 478510 - DNA, 12 bp, Homo sapiens
cttggaaaatgt

SEQ ID NO: 478511 - DNA, 16 bp, Homo sapiens
cttgggattcctcccc

SEQ ID NO: 478512 - DNA, 22 bp, Homo sapiens
cttgggtgtaacaggtctcctc

SEQ ID NO: 478513 - DNA, 21 bp, Homo sapiens
ctttatgtctgtggatttttt

SEQ ID NO: 478514 - DNA, 22 bp, Homo sapiens
ctttctcactaaatcttttata

SEQ ID NO: 478515 - DNA, 21 bp, Homo sapiens
ctttgaagttagctttaactt

SEQ ID NO: 478516 - DNA, 21 bp, Homo sapiens
ctttgccttgatgttgtgttg

SEQ ID NO: 478517 - DNA, 13 bp, Homo sapiens
ctttgggaggctg

SEQ ID NO: 478518 - DNA, 19 bp, Homo sapiens
cttttagttgtatctcttt

SEQ ID NO: 478519 - DNA, 19 bp, Homo sapiens
cttttgaatccatgcttgg

SEQ ID NO: 478520 - DNA, 23 bp, Homo sapiens
cttttgaatccatgcttgggtgt

SEQ ID NO: 478521 - DNA, 23 bp, Homo sapiens
cttttgcggttcaggaaaattga

SEQ ID NO: 478522 - DNA, 14 bp, Homo sapiens
gaaaaagaagaatc

SEQ ID NO: 478523 - DNA, 13 bp, Homo sapiens
gaaaaagcgaaaa

SEQ ID NO: 478524 - DNA, 11 bp, Homo sapiens
gaaaacctttc

SEQ ID NO: 478525 - DNA, 13 bp, Homo sapiens
gaaaataattgtt

SEQ ID NO: 478526 - DNA, 13 bp, Homo sapiens
gaaaattatttaa

SEQ ID NO: 478527 - DNA, 16 bp, Homo sapiens
gaaactttctttctca

SEQ ID NO: 478528 - DNA, 17 bp, Homo sapiens
gaaacttttttatttaa

SEQ ID NO: 478529 - DNA, 14 bp, Homo sapiens
gaaatttaaactat

SEQ ID NO: 478530 - DNA, 23 bp, Homo sapiens
gaaatttaaactataagcaagaa

SEQ ID NO: 478531 - DNA, 14 bp, Homo sapiens
gaagcgctcatctg

SEQ ID NO: 478532 - DNA, 15 bp, Homo sapiens
gaagcgctcatctgg

SEQ ID NO: 478533 - DNA, 22 bp, Homo sapiens
gaagggaataaggtacaagaag

SEQ ID NO: 478534 - DNA, 17 bp, Homo sapiens
gaagttagctttaactt

SEQ ID NO: 478535 - DNA, 16 bp, Homo sapiens
gaagttgtcctttctg

SEQ ID NO: 478536 - DNA, 11 bp, Homo sapiens
gaataaatgtt

SEQ ID NO: 478537 - DNA, 12 bp, Homo sapiens
gaataaatgttc

SEQ ID NO: 478538 - DNA, 17 bp, Homo sapiens
gaatttattattgttct

SEQ ID NO: 478539 - DNA, 17 bp, Homo sapiens
gaatttttaaacaagta

SEQ ID NO: 478540 - DNA, 18 bp, Homo sapiens
gaatttttaaacaagtat

SEQ ID NO: 478541 - DNA, 15 bp, Homo sapiens
gaccaaggagatggg

SEQ ID NO: 478542 - DNA, 17 bp, Homo sapiens
gactatcttactatttc

SEQ ID NO: 478543 - DNA, 19 bp, Homo sapiens
gactatcttactatttcac

SEQ ID NO: 478544 - DNA, 15 bp, Homo sapiens
gactatgaaaagcta

SEQ ID NO: 478545 - DNA, 21 bp, Homo sapiens
gacttcaagcatggctatttt

SEQ ID NO: 478546 - DNA, 12 bp, Homo sapiens
gactttgttcac

SEQ ID NO: 478547 - DNA, 14 bp, Homo sapiens
gagaaggaggaacc

SEQ ID NO: 478548 - DNA, 9 bp, Homo sapiens
gagacagag

SEQ ID NO: 478549 - DNA, 14 bp, Homo sapiens
gagatgtaattgtt

SEQ ID NO: 478550 - DNA, 17 bp, Homo sapiens
gagattggaaaaaatta

SEQ ID NO: 478551 - DNA, 19 bp, Homo sapiens
gagattggaaaaaattaga

SEQ ID NO: 478552 - DNA, 21 bp, Homo sapiens
gagcccagaagctcaaggctg

SEQ ID NO: 478553 - DNA, 15 bp, Homo sapiens
gagctacgtatttaa

SEQ ID NO: 478554 - DNA, 21 bp, Homo sapiens
gaggagcaaacaggaaaatga

SEQ ID NO: 478555 - DNA, 16 bp, Homo sapiens
gaggcgaataaatgtt

SEQ ID NO: 478556 - DNA, 17 bp, Homo sapiens
gaggctcgtgcatgtaa

SEQ ID NO: 478557 - DNA, 15 bp, Homo sapiens
gagggcgcttttgta

SEQ ID NO: 478558 - DNA, 17 bp, Homo sapiens
gataaagattttttaat

SEQ ID NO: 478559 - DNA, 15 bp, Homo sapiens
gataatcttcggcca

SEQ ID NO: 478560 - DNA, 18 bp, Homo sapiens
gataattaaatgaaatac

SEQ ID NO: 478561 - DNA, 19 bp, Homo sapiens
gataattaaatgaaatact

SEQ ID NO: 478562 - DNA, 12 bp, Homo sapiens
gataattttaaa

SEQ ID NO: 478563 - DNA, 17 bp, Homo sapiens
gataccattttgaaata

SEQ ID NO: 478564 - DNA, 19 bp, Homo sapiens
gatatgtaaaacatttatt

SEQ ID NO: 478565 - DNA, 12 bp, Homo sapiens
gatggccaggcc

SEQ ID NO: 478566 - DNA, 14 bp, Homo sapiens
gatggccaggcctc

SEQ ID NO: 478567 - DNA, 22 bp, Homo sapiens
gatgttaaaaaaataagaagaa

SEQ ID NO: 478568 - DNA, 18 bp, Homo sapiens
gattcctcccctggaagt

SEQ ID NO: 478569 - DNA, 12 bp, Homo sapiens
gatttatttaaa

SEQ ID NO: 478570 - DNA, 17 bp, Homo sapiens
gattttttaataattta

SEQ ID NO: 478571 - DNA, 21 bp, Homo sapiens
gattttttccttcaaagttta

SEQ ID NO: 478572 - DNA, 14 bp, Homo sapiens
gcaaaaaagaaaac

SEQ ID NO: 478573 - DNA, 15 bp, Homo sapiens
gcaaaaaagaaaacc

SEQ ID NO: 478574 - DNA, 17 bp, Homo sapiens
gcaaaaaagaaaacctt

SEQ ID NO: 478575 - DNA, 23 bp, Homo sapiens
gcaaaaatagtttggatatgtaa

SEQ ID NO: 478576 - DNA, 11 bp, Homo sapiens
gcaaaagaaga

SEQ ID NO: 478577 - DNA, 15 bp, Homo sapiens
gcaaaagaagaagtt

SEQ ID NO: 478578 - DNA, 22 bp, Homo sapiens
gcaaatcgaatgaaattaactg

SEQ ID NO: 478579 - DNA, 17 bp, Homo sapiens
gcaactcccacgactgt

SEQ ID NO: 478580 - DNA, 16 bp, Homo sapiens
gcaagaaggcaaaaat

SEQ ID NO: 478581 - DNA, 11 bp, Homo sapiens
gcaaggatcac

SEQ ID NO: 478582 - DNA, 23 bp, Homo sapiens
gcaatgtaaatattttaaagaat

SEQ ID NO: 478583 - DNA, 14 bp, Homo sapiens
gcaccaaaagaagt

SEQ ID NO: 478584 - DNA, 15 bp, Homo sapiens
gcacccccggacgcc

SEQ ID NO: 478585 - DNA, 14 bp, Homo sapiens
gcacctaaagaaaa

SEQ ID NO: 478586 - DNA, 17 bp, Homo sapiens
gcactttgggaggctga

SEQ ID NO: 478587 - DNA, 15 bp, Homo sapiens
gcagcaactcccacg

SEQ ID NO: 478588 - DNA, 23 bp, Homo sapiens
gcaggaaggactatgaaaagcta

SEQ ID NO: 478589 - DNA, 18 bp, Homo sapiens
gcagtttatatttaactc

SEQ ID NO: 478590 - DNA, 17 bp, Homo sapiens
gcatctggcctgggggc

SEQ ID NO: 478591 - DNA, 15 bp, Homo sapiens
gcatggctattttat

SEQ ID NO: 478592 - DNA, 13 bp, Homo sapiens
gccaaaaatagct

SEQ ID NO: 478593 - DNA, 19 bp, Homo sapiens
gccaatgcacctaaagaaa

SEQ ID NO: 478594 - DNA, 18 bp, Homo sapiens
gccaggcctcagggacca

SEQ ID NO: 478595 - DNA, 23 bp, Homo sapiens
gcccaacagacaccatcttttgt

SEQ ID NO: 478596 - DNA, 16 bp, Homo sapiens
gcccagccctaaacat

SEQ ID NO: 478597 - DNA, 21 bp, Homo sapiens
gcctcagggaccaaggagatg

SEQ ID NO: 478598 - DNA, 13 bp, Homo sapiens
gcctgatggccag

SEQ ID NO: 478599 - DNA, 21 bp, Homo sapiens
gcctggaggagaaggaggaac

SEQ ID NO: 478600 - DNA, 11 bp, Homo sapiens
gcgaataaatg

SEQ ID NO: 478601 - DNA, 12 bp, Homo sapiens
gcgaataaatgt

SEQ ID NO: 478602 - DNA, 17 bp, Homo sapiens
gcgaataaatgttcaaa

SEQ ID NO: 478603 - DNA, 11 bp, Homo sapiens
gcgtgcagatg

SEQ ID NO: 478604 - DNA, 16 bp, Homo sapiens
gctaaaagaaactttc

SEQ ID NO: 478605 - DNA, 16 bp, Homo sapiens
gctacaaaatgtgtgc

SEQ ID NO: 478606 - DNA, 23 bp, Homo sapiens
gctactttgctgctatggttttc

SEQ ID NO: 478607 - DNA, 18 bp, Homo sapiens
gctatgtttttaatgtat

SEQ ID NO: 478608 - DNA, 15 bp, Homo sapiens
gctcccacctcggac

SEQ ID NO: 478609 - DNA, 14 bp, Homo sapiens
gctctagtgggaag

SEQ ID NO: 478610 - DNA, 19 bp, Homo sapiens
gctgagatgggaggatcac

SEQ ID NO: 478611 - DNA, 19 bp, Homo sapiens
gctgataattttaaattct

SEQ ID NO: 478612 - DNA, 14 bp, Homo sapiens
gctgcatttcaagt

SEQ ID NO: 478613 - DNA, 23 bp, Homo sapiens
gctgcgctcccacctcggacacc

SEQ ID NO: 478614 - DNA, 14 bp, Homo sapiens
gctgctatgctgtt

SEQ ID NO: 478615 - DNA, 20 bp, Homo sapiens
gctggagttcagtggtgtga

SEQ ID NO: 478616 - DNA, 16 bp, Homo sapiens
gctgttcattgatgac

SEQ ID NO: 478617 - DNA, 13 bp, Homo sapiens
gcttaaaactttg

SEQ ID NO: 478618 - DNA, 13 bp, Homo sapiens
gcttgcttctgca

SEQ ID NO: 478619 - DNA, 20 bp, Homo sapiens
gcttttgtacgttaattaaa

SEQ ID NO: 478620 - DNA, 21 bp, Homo sapiens
ggacgccccccggcctgatgg

SEQ ID NO: 478621 - DNA, 19 bp, Homo sapiens
ggactatgaaaagctagaa

SEQ ID NO: 478622 - DNA, 20 bp, Homo sapiens
ggactttcctaaatgtttaa

SEQ ID NO: 478623 - DNA, 13 bp, Homo sapiens
ggagaaggaggaa

SEQ ID NO: 478624 - DNA, 14 bp, Homo sapiens
ggagaaggaggaac

SEQ ID NO: 478625 - DNA, 20 bp, Homo sapiens
ggagatggggagggcgcttt

SEQ ID NO: 478626 - DNA, 17 bp, Homo sapiens
ggaggcgaataaatgtt

SEQ ID NO: 478627 - DNA, 20 bp, Homo sapiens
ggagttcagtggtgtgatct

SEQ ID NO: 478628 - DNA, 16 bp, Homo sapiens
ggatatgtaaaacatt

SEQ ID NO: 478629 - DNA, 17 bp, Homo sapiens
ggattcctcccctggaa

SEQ ID NO: 478630 - DNA, 14 bp, Homo sapiens
ggcaactgtggaag

SEQ ID NO: 478631 - DNA, 23 bp, Homo sapiens
ggcatgtttgtctgtgtgctgta

SEQ ID NO: 478632 - DNA, 18 bp, Homo sapiens
ggcctgatggccaggcct

SEQ ID NO: 478633 - DNA, 18 bp, Homo sapiens
ggcgaataaatgttcaaa

SEQ ID NO: 478634 - DNA, 20 bp, Homo sapiens
ggctagagtgcggtggcgcg

SEQ ID NO: 478635 - DNA, 11 bp, Homo sapiens
gggaggctgag

SEQ ID NO: 478636 - DNA, 17 bp, Homo sapiens
gggctgttagctcagag

SEQ ID NO: 478637 - DNA, 20 bp, Homo sapiens
gggctgttagctcagaggag

SEQ ID NO: 478638 - DNA, 12 bp, Homo sapiens
ggggagggcgct

SEQ ID NO: 478639 - DNA, 22 bp, Homo sapiens
ggggctgttagctcagaggaga

SEQ ID NO: 478640 - DNA, 19 bp, Homo sapiens
gggtgtaacaggtctcctc

SEQ ID NO: 478641 - DNA, 20 bp, Homo sapiens
gggtttcgtcatgttggcca

SEQ ID NO: 478642 - DNA, 21 bp, Homo sapiens
ggtaaactgatgctttcagat

SEQ ID NO: 478643 - DNA, 17 bp, Homo sapiens
ggtaattattttgagtg

SEQ ID NO: 478644 - DNA, 19 bp, Homo sapiens
ggtcagtgttataaaatct

SEQ ID NO: 478645 - DNA, 22 bp, Homo sapiens
ggtcccagctacaggggaggct

SEQ ID NO: 478646 - DNA, 13 bp, Homo sapiens
ggtttaatgtttt

SEQ ID NO: 478647 - DNA, 11 bp, Homo sapiens
gtaaaacattt

SEQ ID NO: 478648 - DNA, 15 bp, Homo sapiens
gtaaataaaaatagc

SEQ ID NO: 478649 - DNA, 14 bp, Homo sapiens
gtaaatattttaaa

SEQ ID NO: 478650 - DNA, 14 bp, Homo sapiens
gtaacaggtctcct

SEQ ID NO: 478651 - DNA, 19 bp, Homo sapiens
gtaacttgctgtgaaatga

SEQ ID NO: 478652 - DNA, 21 bp, Homo sapiens
gtacaagaagcattttgtaag

SEQ ID NO: 478653 - DNA, 15 bp, Homo sapiens
gtacatttatgtgtg

SEQ ID NO: 478654 - DNA, 17 bp, Homo sapiens
gtagagtcctaggacat

SEQ ID NO: 478655 - DNA, 13 bp, Homo sapiens
gtataattatgaa

SEQ ID NO: 478656 - DNA, 22 bp, Homo sapiens
gtatttgttaatttagaaaact

SEQ ID NO: 478657 - DNA, 23 bp, Homo sapiens
gtatttgttaatttagaaaactt

SEQ ID NO: 478658 - DNA, 18 bp, Homo sapiens
gtcattttggtactttgg

SEQ ID NO: 478659 - DNA, 23 bp, Homo sapiens
gtcccagctacaggggaggctga

SEQ ID NO: 478660 - DNA, 17 bp, Homo sapiens
gtcccttgtttccagct

SEQ ID NO: 478661 - DNA, 13 bp, Homo sapiens
gtcgccaggctag

SEQ ID NO: 478662 - DNA, 13 bp, Homo sapiens
gtctgtggatttt

SEQ ID NO: 478663 - DNA, 16 bp, Homo sapiens
gtctgtggattttttc

SEQ ID NO: 478664 - DNA, 14 bp, Homo sapiens
gtctttaaaatgat

SEQ ID NO: 478665 - DNA, 22 bp, Homo sapiens
gtgcaatgtaaatattttaaag

SEQ ID NO: 478666 - DNA, 13 bp, Homo sapiens
gtggcaactgtgg

SEQ ID NO: 478667 - DNA, 17 bp, Homo sapiens
gtgtacatttatgtgtg

SEQ ID NO: 478668 - DNA, 19 bp, Homo sapiens
gtgtcaggattgaggatga

SEQ ID NO: 478669 - DNA, 11 bp, Homo sapiens
gtgtgctgtaa

SEQ ID NO: 478670 - DNA, 20 bp, Homo sapiens
gtgttataatgggtaatata

SEQ ID NO: 478671 - DNA, 19 bp, Homo sapiens
gttaatttagaaaacttta

SEQ ID NO: 478672 - DNA, 21 bp, Homo sapiens
gttataaaatctgtattgcta

SEQ ID NO: 478673 - DNA, 16 bp, Homo sapiens
gttcaccttctgtgca

SEQ ID NO: 478674 - DNA, 18 bp, Homo sapiens
gttgaagcaaatcgaatg

SEQ ID NO: 478675 - DNA, 23 bp, Homo sapiens
gttgaagcaaatcgaatgaaatt

SEQ ID NO: 478676 - DNA, 18 bp, Homo sapiens
gttgtacaagctcaggag

SEQ ID NO: 478677 - DNA, 16 bp, Homo sapiens
gttgtcctttctgatc

SEQ ID NO: 478678 - DNA, 15 bp, Homo sapiens
gttgtgggtgggaga

SEQ ID NO: 478679 - DNA, 17 bp, Homo sapiens
gtttaagccaaaacaat

SEQ ID NO: 478680 - DNA, 13 bp, Homo sapiens
gtttaatgttttg

SEQ ID NO: 478681 - DNA, 15 bp, Homo sapiens
gtttagaagcgctca

SEQ ID NO: 478682 - DNA, 18 bp, Homo sapiens
gtttatgaaaaagaagaa

SEQ ID NO: 478683 - DNA, 23 bp, Homo sapiens
gtttcacagcctataaccagaca

SEQ ID NO: 478684 - DNA, 16 bp, Homo sapiens
gtttcccaagagctac

SEQ ID NO: 478685 - DNA, 22 bp, Homo sapiens
gtttcttaaataagaaactttt

SEQ ID NO: 478686 - DNA, 16 bp, Homo sapiens
gtttgatagattttct

SEQ ID NO: 478687 - DNA, 18 bp, Homo sapiens
gttttctccaagagctac

SEQ ID NO: 478688 - DNA, 13 bp, Homo sapiens
gtttttaatgtat

SEQ ID NO: 478689 - DNA, 17 bp, Homo sapiens
taaaaaactaaaaacta

SEQ ID NO: 478690 - DNA, 17 bp, Homo sapiens
taaaaaagcttaaaact

SEQ ID NO: 478691 - DNA, 19 bp, Homo sapiens
taaaaaagcttaaaacttt

SEQ ID NO: 478692 - DNA, 17 bp, Homo sapiens
taaaaactgactcctta

SEQ ID NO: 478693 - DNA, 21 bp, Homo sapiens
taaaaatagctataaatagtg

SEQ ID NO: 478694 - DNA, 17 bp, Homo sapiens
taaaaattatctttaaa

SEQ ID NO: 478695 - DNA, 18 bp, Homo sapiens
taaaaattatctttaaaa

SEQ ID NO: 478696 - DNA, 20 bp, Homo sapiens
taaaacatttattttgacat

SEQ ID NO: 478697 - DNA, 13 bp, Homo sapiens
taaaagaaacttt

SEQ ID NO: 478698 - DNA, 17 bp, Homo sapiens
taaaagaaactttcttt

SEQ ID NO: 478699 - DNA, 23 bp, Homo sapiens
taaacaagtatttgttaatttag

SEQ ID NO: 478700 - DNA, 17 bp, Homo sapiens
taaaccgctaaaagaaa

SEQ ID NO: 478701 - DNA, 15 bp, Homo sapiens
taaactataagcaag

SEQ ID NO: 478702 - DNA, 17 bp, Homo sapiens
taaactataagcaagaa

SEQ ID NO: 478703 - DNA, 19 bp, Homo sapiens
taaagacagggtttcacca

SEQ ID NO: 478704 - DNA, 21 bp, Homo sapiens
taaagcgtttgcacagatcaa

SEQ ID NO: 478705 - DNA, 15 bp, Homo sapiens
taaagctggtttaat

SEQ ID NO: 478706 - DNA, 15 bp, Homo sapiens
taaataaaaatagct

SEQ ID NO: 478707 - DNA, 16 bp, Homo sapiens
cactttgggaggctga

SEQ ID NO: 478708 - DNA, 16 bp, Homo sapiens
cagaacatagacagaa

SEQ ID NO: 478709 - DNA, 21 bp, Homo sapiens
cagaacatagacagaagaaac

SEQ ID NO: 478710 - DNA, 14 bp, Homo sapiens
cagaagaaacaagg

SEQ ID NO: 478711 - DNA, 22 bp, Homo sapiens
cagaggagaggagcaaacagga

SEQ ID NO: 478712 - DNA, 22 bp, Homo sapiens
cagagtcagccattcctgttct

SEQ ID NO: 478713 - DNA, 19 bp, Homo sapiens
cagataactgaaaattatt

SEQ ID NO: 478714 - DNA, 22 bp, Homo sapiens
cagataactgaaaattatttaa

SEQ ID NO: 478715 - DNA, 13 bp, Homo sapiens
cagccattcctgt

SEQ ID NO: 478716 - DNA, 19 bp, Homo sapiens
cagctacaggggaggctga

SEQ ID NO: 478717 - DNA, 23 bp, Homo sapiens
cagctagaaataagcccaacaga

SEQ ID NO: 478718 - DNA, 15 bp, Homo sapiens
cagcttttgcttcat

SEQ ID NO: 478719 - DNA, 20 bp, Homo sapiens
caggctggtctcgaactcct

SEQ ID NO: 478720 - DNA, 16 bp, Homo sapiens
caggggaggctgagac

SEQ ID NO: 478721 - DNA, 13 bp, Homo sapiens
caggtctcctctt

SEQ ID NO: 478722 - DNA, 17 bp, Homo sapiens
cagtaaatgtatattga

SEQ ID NO: 478723 - DNA, 22 bp, Homo sapiens
cagtctaaagctggtttaatgt

SEQ ID NO: 478724 - DNA, 19 bp, Homo sapiens
cagtctcagaatgtcattt

SEQ ID NO: 478725 - DNA, 23 bp, Homo sapiens
cagtgctattttgtgcccactgt

SEQ ID NO: 478726 - DNA, 14 bp, Homo sapiens
cagtttatatttaa

SEQ ID NO: 478727 - DNA, 17 bp, Homo sapiens
cagtttatatttaactc

SEQ ID NO: 478728 - DNA, 15 bp, Homo sapiens
cataaaaatgatcta

SEQ ID NO: 478729 - DNA, 22 bp, Homo sapiens
cataatttagtttcatataaag

SEQ ID NO: 478730 - DNA, 20 bp, Homo sapiens
catagacagaagaaacaagg

SEQ ID NO: 478731 - DNA, 20 bp, Homo sapiens
catagataccattttgaaat

SEQ ID NO: 478732 - DNA, 19 bp, Homo sapiens
catcaagaaggtagcttga

SEQ ID NO: 478733 - DNA, 20 bp, Homo sapiens
catccatttcatctatttct

SEQ ID NO: 478734 - DNA, 12 bp, Homo sapiens
catctctgtaaa

SEQ ID NO: 478735 - DNA, 12 bp, Homo sapiens
catctggcctgg

SEQ ID NO: 478736 - DNA, 16 bp, Homo sapiens
catctggcctgggggc

SEQ ID NO: 478737 - DNA, 16 bp, Homo sapiens
catcttttgtgagatg

SEQ ID NO: 478738 - DNA, 16 bp, Homo sapiens
catgccaatgtccagg

SEQ ID NO: 478739 - DNA, 18 bp, Homo sapiens
catgccaggctaattttt

SEQ ID NO: 478740 - DNA, 15 bp, Homo sapiens
catggctattttata

SEQ ID NO: 478741 - DNA, 18 bp, Homo sapiens
catgtttgtctgtgtgct

SEQ ID NO: 478742 - DNA, 23 bp, Homo sapiens
catgtttgtctgtgtgctgtaac

SEQ ID NO: 478743 - DNA, 18 bp, Homo sapiens
cattcctgttctctttgc

SEQ ID NO: 478744 - DNA, 14 bp, Homo sapiens
catttattttgaca

SEQ ID NO: 478745 - DNA, 16 bp, Homo sapiens
catttcatctatttct

SEQ ID NO: 478746 - DNA, 17 bp, Homo sapiens
catttcatctatttctg

SEQ ID NO: 478747 - DNA, 20 bp, Homo sapiens
catttcatctatttctgaga

SEQ ID NO: 478748 - DNA, 21 bp, Homo sapiens
catttgctgcatttcaagtta

SEQ ID NO: 478749 - DNA, 16 bp, Homo sapiens
catttttcatgataat

SEQ ID NO: 478750 - DNA, 17 bp, Homo sapiens
ccaaaatgttgaaatat

SEQ ID NO: 478751 - DNA, 18 bp, Homo sapiens
ccaatgcacctaaagaaa

SEQ ID NO: 478752 - DNA, 17 bp, Homo sapiens
ccaatgtccaggtcaca

SEQ ID NO: 478753 - DNA, 22 bp, Homo sapiens
ccaatgtccaggtcacaggcat

SEQ ID NO: 478754 - DNA, 16 bp, Homo sapiens
ccaccatgccaggcta

SEQ ID NO: 478755 - DNA, 14 bp, Homo sapiens
ccacctcggacacc

SEQ ID NO: 478756 - DNA, 18 bp, Homo sapiens
ccacgactgttgtacaag

SEQ ID NO: 478757 - DNA, 18 bp, Homo sapiens
ccagaagctcaaggctgc

SEQ ID NO: 478758 - DNA, 20 bp, Homo sapiens
ccagaagctcaaggctgcag

SEQ ID NO: 478759 - DNA, 17 bp, Homo sapiens
ccaggcaccaaaagaag

SEQ ID NO: 478760 - DNA, 14 bp, Homo sapiens
ccaggtcacaggca

SEQ ID NO: 478761 - DNA, 20 bp, Homo sapiens
ccatgttggccaggatggtc

SEQ ID NO: 478762 - DNA, 14 bp, Homo sapiens
ccattcctgttctc

SEQ ID NO: 478763 - DNA, 20 bp, Homo sapiens
cccacaagccttactcacct

SEQ ID NO: 478764 - DNA, 20 bp, Homo sapiens
cccacgactgttgtacaagc

SEQ ID NO: 478765 - DNA, 21 bp, Homo sapiens
cccagagctgtggactttgtt

SEQ ID NO: 478766 - DNA, 12 bp, Homo sapiens
cccccggacgcc

SEQ ID NO: 478767 - DNA, 16 bp, Homo sapiens
cccggcctgatggcca

SEQ ID NO: 478768 - DNA, 18 bp, Homo sapiens
ccctggaagttgtccttt

SEQ ID NO: 478769 - DNA, 23 bp, Homo sapiens
ccctggaagttgtcctttctgat

SEQ ID NO: 478770 - DNA, 20 bp, Homo sapiens
cctaattcaattcaaagctg

SEQ ID NO: 478771 - DNA, 23 bp, Homo sapiens
cctattgctgtaaataaaaatag

SEQ ID NO: 478772 - DNA, 21 bp, Homo sapiens
cctcaaagcaagcattcagaa

SEQ ID NO: 478773 - DNA, 23 bp, Homo sapiens
cctcagggaccaaggagatgggg

SEQ ID NO: 478774 - DNA, 22 bp, Homo sapiens
cctcctgggcatgtttgtctgt

SEQ ID NO: 478775 - DNA, 18 bp, Homo sapiens
cctctaggtaaactagca

SEQ ID NO: 478776 - DNA, 19 bp, Homo sapiens
cctctctctaagtttagaa

SEQ ID NO: 478777 - DNA, 17 bp, Homo sapiens
cctcttaaaaaataaaa

SEQ ID NO: 478778 - DNA, 18 bp, Homo sapiens
cctcttaaaaaataaaaa

SEQ ID NO: 478779 - DNA, 19 bp, Homo sapiens
cctcttaaaaaataaaaac

SEQ ID NO: 478780 - DNA, 23 bp, Homo sapiens
cctgcctggaggagaaggaggaa

SEQ ID NO: 478781 - DNA, 15 bp, Homo sapiens
cctggaggagaagga

SEQ ID NO: 478782 - DNA, 19 bp, Homo sapiens
cctggaggagaaggaggaa

SEQ ID NO: 478783 - DNA, 22 bp, Homo sapiens
cctgggcatgtttgtctgtgtg

SEQ ID NO: 478784 - DNA, 14 bp, Homo sapiens
ccttactcacctct

SEQ ID NO: 478785 - DNA, 16 bp, Homo sapiens
ccttagagacatcaaa

SEQ ID NO: 478786 - DNA, 16 bp, Homo sapiens
cctttctagcaattgc

SEQ ID NO: 478787 - DNA, 23 bp, Homo sapiens
ccttttcccaaaatgttgaaata

SEQ ID NO: 478788 - DNA, 13 bp, Homo sapiens
cgaataaatgttc

SEQ ID NO: 478789 - DNA, 15 bp, Homo sapiens
cgaataaatgttcaa

SEQ ID NO: 478790 - DNA, 16 bp, Homo sapiens
cgaataaatgttcaaa

SEQ ID NO: 478791 - DNA, 18 bp, Homo sapiens
cgatcatatctgtatgcc

SEQ ID NO: 478792 - DNA, 11 bp, Homo sapiens
cgctcatctgg

SEQ ID NO: 478793 - DNA, 13 bp, Homo sapiens
cgctcatctggct

SEQ ID NO: 478794 - DNA, 16 bp, Homo sapiens
cgcttgcttctgcagc

SEQ ID NO: 478795 - DNA, 21 bp, Homo sapiens
cgcttgcttctgcagcaactc

SEQ ID NO: 478796 - DNA, 11 bp, Homo sapiens
cgctttttgaa

SEQ ID NO: 478797 - DNA, 19 bp, Homo sapiens
cggccaggcacggaggctc

SEQ ID NO: 478798 - DNA, 20 bp, Homo sapiens
cggttcaggaaaattgaatg

SEQ ID NO: 478799 - DNA, 23 bp, Homo sapiens
cgtatttaatagcaaagaattga

SEQ ID NO: 478800 - DNA, 13 bp, Homo sapiens
cgttaattaaaca

SEQ ID NO: 478801 - DNA, 13 bp, Homo sapiens
ctaaacatcattc

SEQ ID NO: 478802 - DNA, 17 bp, Homo sapiens
ctaaagaaaaacaaact

SEQ ID NO: 478803 - DNA, 17 bp, Homo sapiens
ctaaagctggtttaatg

SEQ ID NO: 478804 - DNA, 18 bp, Homo sapiens
ctaaagctggtttaatgt

SEQ ID NO: 478805 - DNA, 20 bp, Homo sapiens
ctaatttttgtatttttcgt

SEQ ID NO: 478806 - DNA, 21 bp, Homo sapiens
ctaatttttttgtattttagc

SEQ ID NO: 478807 - DNA, 19 bp, Homo sapiens
ctagaggtgagaaatttaa

SEQ ID NO: 478808 - DNA, 15 bp, Homo sapiens
ctagatatgagaaat

SEQ ID NO: 478809 - DNA, 17 bp, Homo sapiens
ctataaatagtgaaaat

SEQ ID NO: 478810 - DNA, 19 bp, Homo sapiens
ctataaatagtgaaaattt

SEQ ID NO: 478811 - DNA, 13 bp, Homo sapiens
ctatagccaaaaa

SEQ ID NO: 478812 - DNA, 14 bp, Homo sapiens
ctatctggaaaaaa

SEQ ID NO: 478813 - DNA, 20 bp, Homo sapiens
ctatctggaaaaaaaaaaat

SEQ ID NO: 478814 - DNA, 22 bp, Homo sapiens
ctatctggaaaaaaaaaaatat

SEQ ID NO: 478815 - DNA, 18 bp, Homo sapiens
ctatgacactcatcaggt

SEQ ID NO: 478816 - DNA, 19 bp, Homo sapiens
ctcaaagcaagcattcaga

SEQ ID NO: 478817 - DNA, 15 bp, Homo sapiens
ctcagaagtgaaaaa

SEQ ID NO: 478818 - DNA, 21 bp, Homo sapiens
ctcaggaggcgaataaatgtt

SEQ ID NO: 478819 - DNA, 17 bp, Homo sapiens
ctcagggaccaaggaga

SEQ ID NO: 478820 - DNA, 23 bp, Homo sapiens
ctcagggaccaaggagatgggga

SEQ ID NO: 478821 - DNA, 18 bp, Homo sapiens
ctcagtaatttagaaatc

SEQ ID NO: 478822 - DNA, 22 bp, Homo sapiens
ctcagtaatttagaaatcattt

SEQ ID NO: 478823 - DNA, 15 bp, Homo sapiens
ctcagtgaagaatac

SEQ ID NO: 478824 - DNA, 15 bp, Homo sapiens
taaataagaaacttt

SEQ ID NO: 478825 - DNA, 15 bp, Homo sapiens
taaatagcattctct

SEQ ID NO: 478826 - DNA, 14 bp, Homo sapiens
taaatagtgaaaat

SEQ ID NO: 478827 - DNA, 15 bp, Homo sapiens
taaatattttaaaga

SEQ ID NO: 478828 - DNA, 12 bp, Homo sapiens
taaatgttcaaa

SEQ ID NO: 478829 - DNA, 22 bp, Homo sapiens
taaattctctctcttgcaggaa

SEQ ID NO: 478830 - DNA, 15 bp, Homo sapiens
taacaggtctcctct

SEQ ID NO: 478831 - DNA, 20 bp, Homo sapiens
taaccagacacatactcatt

SEQ ID NO: 478832 - DNA, 17 bp, Homo sapiens
taacttaaatagtattt

SEQ ID NO: 478833 - DNA, 20 bp, Homo sapiens
taacttgctgtgaaatgact

SEQ ID NO: 478834 - DNA, 19 bp, Homo sapiens
taagaaacttttttattta

SEQ ID NO: 478835 - DNA, 20 bp, Homo sapiens
taagataattaaatgaaata

SEQ ID NO: 478836 - DNA, 22 bp, Homo sapiens
taagataattaaatgaaatact

SEQ ID NO: 478837 - DNA, 18 bp, Homo sapiens
taaggtacaagaagcatt

SEQ ID NO: 478838 - DNA, 16 bp, Homo sapiens
taatagatgtttgata

SEQ ID NO: 478839 - DNA, 13 bp, Homo sapiens
taatagcaaagaa

SEQ ID NO: 478840 - DNA, 12 bp, Homo sapiens
taatatcctaaa

SEQ ID NO: 478841 - DNA, 14 bp, Homo sapiens
taatatcctaaaca

SEQ ID NO: 478842 - DNA, 14 bp, Homo sapiens
taattatccaggaa

SEQ ID NO: 478843 - DNA, 19 bp, Homo sapiens
taattcaattcaaagctgt

SEQ ID NO: 478844 - DNA, 16 bp, Homo sapiens
taatttagaaaacttt

SEQ ID NO: 478845 - DNA, 17 bp, Homo sapiens
taatttagtttcatata

SEQ ID NO: 478846 - DNA, 21 bp, Homo sapiens
taatttttgatactaagcatt

SEQ ID NO: 478847 - DNA, 14 bp, Homo sapiens
tacaaaatgtgtgc

SEQ ID NO: 478848 - DNA, 15 bp, Homo sapiens
tacaagaagcatttt

SEQ ID NO: 478849 - DNA, 19 bp, Homo sapiens
tacaagaagcattttgtaa

SEQ ID NO: 478850 - DNA, 19 bp, Homo sapiens
tacatgctaagagaagtag

SEQ ID NO: 478851 - DNA, 14 bp, Homo sapiens
taccaaatgccttt

SEQ ID NO: 478852 - DNA, 18 bp, Homo sapiens
taccaggcaccaaaagaa

SEQ ID NO: 478853 - DNA, 16 bp, Homo sapiens
taccattttgaaatat

SEQ ID NO: 478854 - DNA, 12 bp, Homo sapiens
tactatttcaca

SEQ ID NO: 478855 - DNA, 20 bp, Homo sapiens
tactcattcatttattcatt

SEQ ID NO: 478856 - DNA, 14 bp, Homo sapiens
tactcatttttcat

SEQ ID NO: 478857 - DNA, 16 bp, Homo sapiens
tactcatttttcatga

SEQ ID NO: 478858 - DNA, 20 bp, Homo sapiens
tacttatttataacattgta

SEQ ID NO: 478859 - DNA, 20 bp, Homo sapiens
tacttctcattttttaaaaa

SEQ ID NO: 478860 - DNA, 15 bp, Homo sapiens
tagaacctaattcaa

SEQ ID NO: 478861 - DNA, 17 bp, Homo sapiens
tagaattgagtgtttaa

SEQ ID NO: 478862 - DNA, 17 bp, Homo sapiens
tagataccattttgaaa

SEQ ID NO: 478863 - DNA, 13 bp, Homo sapiens
tagattttctgct

SEQ ID NO: 478864 - DNA, 22 bp, Homo sapiens
tagcaactacagtctaaagctg

SEQ ID NO: 478865 - DNA, 21 bp, Homo sapiens
tagcaattgcttctctaaaac

SEQ ID NO: 478866 - DNA, 21 bp, Homo sapiens
tagccaaaaatagctaaatac

SEQ ID NO: 478867 - DNA, 17 bp, Homo sapiens
taggacatctctgtaaa

SEQ ID NO: 478868 - DNA, 22 bp, Homo sapiens
taggacatctctgtaaaaagca

SEQ ID NO: 478869 - DNA, 21 bp, Homo sapiens
taggatttatttaaaatagca

SEQ ID NO: 478870 - DNA, 22 bp, Homo sapiens
taggatttatttaaaatagcaa

SEQ ID NO: 478871 - DNA, 18 bp, Homo sapiens
tagtaaatcacgcttttt

SEQ ID NO: 478872 - DNA, 14 bp, Homo sapiens
tagtaatctgcatt

SEQ ID NO: 478873 - DNA, 20 bp, Homo sapiens
tagtagcagtgattgtctta

SEQ ID NO: 478874 - DNA, 12 bp, Homo sapiens
tagttgtgtctg

SEQ ID NO: 478875 - DNA, 19 bp, Homo sapiens
tagtttcatataaagtatc

SEQ ID NO: 478876 - DNA, 11 bp, Homo sapiens
tagtttggata

SEQ ID NO: 478877 - DNA, 20 bp, Homo sapiens
tataaaaataattaaaacaa

SEQ ID NO: 478878 - DNA, 18 bp, Homo sapiens
tataatggcctcttaaaa

SEQ ID NO: 478879 - DNA, 18 bp, Homo sapiens
tataattgttttatctga

SEQ ID NO: 478880 - DNA, 23 bp, Homo sapiens
tatactatttattaaaaccattc

SEQ ID NO: 478881 - DNA, 19 bp, Homo sapiens
tatcaaacaccaacataaa

SEQ ID NO: 478882 - DNA, 23 bp, Homo sapiens
tatcaaacaccaacataaaaatg

SEQ ID NO: 478883 - DNA, 17 bp, Homo sapiens
tatcaatccttgttcag

SEQ ID NO: 478884 - DNA, 11 bp, Homo sapiens
tatccagtcta

SEQ ID NO: 478885 - DNA, 16 bp, Homo sapiens
tatctacccagaatta

SEQ ID NO: 478886 - DNA, 22 bp, Homo sapiens
tatctcttttgaatccatgctt

SEQ ID NO: 478887 - DNA, 23 bp, Homo sapiens
tatctcttttgaatccatgcttg

SEQ ID NO: 478888 - DNA, 20 bp, Homo sapiens
tatctgaatttttaaacaag

SEQ ID NO: 478889 - DNA, 22 bp, Homo sapiens
tatctggaaaaaaaaaaatatg

SEQ ID NO: 478890 - DNA, 17 bp, Homo sapiens
tatcttactatttcaca

SEQ ID NO: 478891 - DNA, 18 bp, Homo sapiens
tatcttactatttcacaa

SEQ ID NO: 478892 - DNA, 15 bp, Homo sapiens
tatctttaaaactta

SEQ ID NO: 478893 - DNA, 15 bp, Homo sapiens
tatgaaaaagaagaa

SEQ ID NO: 478894 - DNA, 23 bp, Homo sapiens
tatgaagccctaagtaaatctaa

SEQ ID NO: 478895 - DNA, 20 bp, Homo sapiens
tatgagaaatataaaaataa

SEQ ID NO: 478896 - DNA, 23 bp, Homo sapiens
tatgagattggaaaaaattagac

SEQ ID NO: 478897 - DNA, 14 bp, Homo sapiens
tatgatgttaaaaa

SEQ ID NO: 478898 - DNA, 13 bp, Homo sapiens
tatggattctaaa

SEQ ID NO: 478899 - DNA, 15 bp, Homo sapiens
tatggattctaaaat

SEQ ID NO: 478900 - DNA, 14 bp, Homo sapiens
tattgaatataatg

SEQ ID NO: 478901 - DNA, 14 bp, Homo sapiens
tattgctgtaaata

SEQ ID NO: 478902 - DNA, 21 bp, Homo sapiens
tattgctgtaaataaaaatag

SEQ ID NO: 478903 - DNA, 17 bp, Homo sapiens
tattgtgcaatgtaaat

SEQ ID NO: 478904 - DNA, 15 bp, Homo sapiens
tatttaaaatagcaa

SEQ ID NO: 478905 - DNA, 18 bp, Homo sapiens
tatttaatagcaaagaat

SEQ ID NO: 478906 - DNA, 15 bp, Homo sapiens
tatttcacaacagcc

SEQ ID NO: 478907 - DNA, 15 bp, Homo sapiens
tatttgtaatagatg

SEQ ID NO: 478908 - DNA, 20 bp, Homo sapiens
tatttgtaatagatgtttga

SEQ ID NO: 478909 - DNA, 13 bp, Homo sapiens
tattttaaagaat

SEQ ID NO: 478910 - DNA, 13 bp, Homo sapiens
tattttcttggat

SEQ ID NO: 478911 - DNA, 14 bp, Homo sapiens
tcaaagtttaataa

SEQ ID NO: 478912 - DNA, 16 bp, Homo sapiens
tcacctatctggaaaa

SEQ ID NO: 478913 - DNA, 18 bp, Homo sapiens
tcagaagaaaaagaagca

SEQ ID NO: 478914 - DNA, 17 bp, Homo sapiens
tcagaagtgaaaaagac

SEQ ID NO: 478915 - DNA, 14 bp, Homo sapiens
tcagaggagaggag

SEQ ID NO: 478916 - DNA, 14 bp, Homo sapiens
tcagccattcctgt

SEQ ID NO: 478917 - DNA, 20 bp, Homo sapiens
tcagcctcccaagtagctgg

SEQ ID NO: 478918 - DNA, 19 bp, Homo sapiens
tcaggaggcgaataaatgt

SEQ ID NO: 478919 - DNA, 20 bp, Homo sapiens
tcaggaggcgaataaatgtt

SEQ ID NO: 478920 - DNA, 21 bp, Homo sapiens
tcaggaggcgaataaatgttc

SEQ ID NO: 478921 - DNA, 23 bp, Homo sapiens
tcaggaggcgaataaatgttcaa

SEQ ID NO: 478922 - DNA, 13 bp, Homo sapiens
tcatataaagtat

SEQ ID NO: 478923 - DNA, 16 bp, Homo sapiens
tcatataaagtatcat

SEQ ID NO: 478924 - DNA, 14 bp, Homo sapiens
tcatctatttctga

SEQ ID NO: 478925 - DNA, 17 bp, Homo sapiens
tcatctatttctgagaa

SEQ ID NO: 478926 - DNA, 17 bp, Homo sapiens
tcatgataatgaacaga

SEQ ID NO: 478927 - DNA, 21 bp, Homo sapiens
tcatgataatgaacagaacat

SEQ ID NO: 478928 - DNA, 14 bp, Homo sapiens
tcattcatttttgt

SEQ ID NO: 478929 - DNA, 12 bp, Homo sapiens
tcatttaagatt

SEQ ID NO: 478930 - DNA, 21 bp, Homo sapiens
tcattttattctgtcaatgaa

SEQ ID NO: 478931 - DNA, 20 bp, Homo sapiens
tccaaatgaatgttgtctgt

SEQ ID NO: 478932 - DNA, 14 bp, Homo sapiens
tccaggtcacaggc

SEQ ID NO: 478933 - DNA, 15 bp, Homo sapiens
tccaggtcacaggca

SEQ ID NO: 478934 - DNA, 21 bp, Homo sapiens
tccatttcatctatttctgag

SEQ ID NO: 478935 - DNA, 14 bp, Homo sapiens
tcccagctacaggg

SEQ ID NO: 478936 - DNA, 17 bp, Homo sapiens
tcccttaatatcctaaa

SEQ ID NO: 478937 - DNA, 21 bp, Homo sapiens
tcccttaatatcctaaacatc

SEQ ID NO: 478938 - DNA, 21 bp, Homo sapiens
tcctgaaaaggtttatgaaaa

SEQ ID NO: 478939 - DNA, 22 bp, Homo sapiens
tcctgaatttattattgttctt

SEQ ID NO: 478940 - DNA, 13 bp, Homo sapiens
tcctgagtagctg

SEQ ID NO: 478941 - DNA, 21 bp, Homo sapiens
tcctgggcaacagagtgagac

SEQ ID NO: 478942 - DNA, 20 bp, Homo sapiens
tcctgggcatgtttgtctgt

SEQ ID NO: 478943 - DNA, 18 bp, Homo sapiens
tccttcaacaattctaaa

SEQ ID NO: 478944 - DNA, 20 bp, Homo sapiens
tccttcaacaattctaaaat

SEQ ID NO: 478945 - DNA, 12 bp, Homo sapiens
tcgaatgaaatt

SEQ ID NO: 478946 - DNA, 17 bp, Homo sapiens
tcgcccacaagccttac

SEQ ID NO: 478947 - DNA, 23 bp, Homo sapiens
tcgcccacaagccttactcacct

SEQ ID NO: 478948 - DNA, 21 bp, Homo sapiens
tcgtcatgttggccaggctgg

SEQ ID NO: 478949 - DNA, 13 bp, Homo sapiens
tcgtgcatgtaat

SEQ ID NO: 478950 - DNA, 14 bp, Homo sapiens
tcgttttttacaaa

SEQ ID NO: 478951 - DNA, 20 bp, Homo sapiens
tctatagccaaaaatagcta

SEQ ID NO: 478952 - DNA, 13 bp, Homo sapiens
tctatttctgaga

SEQ ID NO: 478953 - DNA, 15 bp, Homo sapiens
tctatttctgagaag

SEQ ID NO: 478954 - DNA, 19 bp, Homo sapiens
tctcagaagtgaaaaagac

SEQ ID NO: 478955 - DNA, 14 bp, Homo sapiens
tctcctcttaaaaa

SEQ ID NO: 478956 - DNA, 20 bp, Homo sapiens
tctctgatgtgatatccact

SEQ ID NO: 478957 - DNA, 20 bp, Homo sapiens
tctctgtaaaaagcaggtga

SEQ ID NO: 478958 - DNA, 20 bp, Homo sapiens
tctcttttgaatccatgctt

SEQ ID NO: 478959 - DNA, 15 bp, Homo sapiens
tctgaatttttaaac

SEQ ID NO: 478960 - DNA, 16 bp, Homo sapiens
tctgaatttttaaaca

SEQ ID NO: 478961 - DNA, 17 bp, Homo sapiens
tctgaatttttaaacaa

SEQ ID NO: 478962 - DNA, 17 bp, Homo sapiens
tctgagaaggtccttaa

SEQ ID NO: 478963 - DNA, 21 bp, Homo sapiens
tctgatacttatttataacat

SEQ ID NO: 478964 - DNA, 17 bp, Homo sapiens
tctgcagcaactcccac

SEQ ID NO: 478965 - DNA, 18 bp, Homo sapiens
tctggaaaaaaaaaaata

SEQ ID NO: 478966 - DNA, 18 bp, Homo sapiens
tctgtaaaaagcaggtga

SEQ ID NO: 478967 - DNA, 17 bp, Homo sapiens
tctgtcacccaggctgg

SEQ ID NO: 478968 - DNA, 13 bp, Homo sapiens
tcttaaaaattat

SEQ ID NO: 478969 - DNA, 15 bp, Homo sapiens
tcttaaataagaaac

SEQ ID NO: 478970 - DNA, 18 bp, Homo sapiens
tcttaaataagaaacttt

SEQ ID NO: 478971 - DNA, 19 bp, Homo sapiens
tcttaaataagaaactttt

SEQ ID NO: 478972 - DNA, 15 bp, Homo sapiens
tcttcttttcccatt

SEQ ID NO: 478973 - DNA, 23 bp, Homo sapiens
tcttgggattcctcccctggaag

SEQ ID NO: 478974 - DNA, 14 bp, Homo sapiens
tcttttataggatt

SEQ ID NO: 478975 - DNA, 19 bp, Homo sapiens
tcttttgaatccatgcttg

SEQ ID NO: 478976 - DNA, 13 bp, Homo sapiens
tgaaaaagaagaa

SEQ ID NO: 478977 - DNA, 21 bp, Homo sapiens
tgaaaaggtttatgaaaaaga

SEQ ID NO: 478978 - DNA, 22 bp, Homo sapiens
tgaaaaggtttatgaaaaagaa

SEQ ID NO: 478979 - DNA, 13 bp, Homo sapiens
tgaaaattattta

SEQ ID NO: 478980 - DNA, 14 bp, Homo sapiens
tgaaaattatttaa

SEQ ID NO: 478981 - DNA, 18 bp, Homo sapiens
tgaaaattttattgaata

SEQ ID NO: 478982 - DNA, 20 bp, Homo sapiens
tgaagaatacttctcatttt

SEQ ID NO: 478983 - DNA, 21 bp, Homo sapiens
tgaagaatacttctcattttt

SEQ ID NO: 478984 - DNA, 20 bp, Homo sapiens
tgaagcaaatcgaatgaaat

SEQ ID NO: 478985 - DNA, 20 bp, Homo sapiens
tgaagtcaaaccttaagata

SEQ ID NO: 478986 - DNA, 18 bp, Homo sapiens
tgaagttagctttaactt

SEQ ID NO: 478987 - DNA, 16 bp, Homo sapiens
tgaatgtcattcacaa

SEQ ID NO: 478988 - DNA, 17 bp, Homo sapiens
tgaatttttaaacaagt

SEQ ID NO: 478989 - DNA, 16 bp, Homo sapiens
tgacaacatttctata

SEQ ID NO: 478990 - DNA, 12 bp, Homo sapiens
tgacaacatttt

SEQ ID NO: 478991 - DNA, 15 bp, Homo sapiens
tgaccaagatactta

SEQ ID NO: 478992 - DNA, 13 bp, Homo sapiens
tgagaaatttaaa

SEQ ID NO: 478993 - DNA, 18 bp, Homo sapiens
tgagaaatttaaactata

SEQ ID NO: 478994 - DNA, 20 bp, Homo sapiens
tgagattggaaaaaattaga

SEQ ID NO: 478995 - DNA, 14 bp, Homo sapiens
tgagcaattctcct

SEQ ID NO: 478996 - DNA, 20 bp, Homo sapiens
tgataaagattttttaataa

SEQ ID NO: 478997 - DNA, 13 bp, Homo sapiens
tgataattttaaa

SEQ ID NO: 478998 - DNA, 14 bp, Homo sapiens
tgatagattttctg

SEQ ID NO: 478999 - DNA, 14 bp, Homo sapiens
tgatgccaaaaaaa

SEQ ID NO: 479000 - DNA, 15 bp, Homo sapiens
tgatggccaggcctc

SEQ ID NO: 479001 - DNA, 13 bp, Homo sapiens
tgatgttaaaaaa

SEQ ID NO: 479002 - DNA, 17 bp, Homo sapiens
tgatgttgtgttgttat

SEQ ID NO: 479003 - DNA, 13 bp, Homo sapiens
tgattgtcttaat

SEQ ID NO: 479004 - DNA, 15 bp, Homo sapiens
tgcacctaaagaaaa

SEQ ID NO: 479005 - DNA, 16 bp, Homo sapiens
tgcacctaaagaaaaa

SEQ ID NO: 479006 - DNA, 18 bp, Homo sapiens
tgcactcttttgagcagt

SEQ ID NO: 479007 - DNA, 14 bp, Homo sapiens
tgcagcaactccca

SEQ ID NO: 479008 - DNA, 15 bp, Homo sapiens
tgcagcaactcccac

SEQ ID NO: 479009 - DNA, 19 bp, Homo sapiens
tgcagcaactcccacgact

SEQ ID NO: 479010 - DNA, 15 bp, Homo sapiens
tgccaatgtccaggt

SEQ ID NO: 479011 - DNA, 16 bp, Homo sapiens
tgccaggctaattttt

SEQ ID NO: 479012 - DNA, 17 bp, Homo sapiens
tgcccactgtctctcct

SEQ ID NO: 479013 - DNA, 13 bp, Homo sapiens
tgcccagctctcg

SEQ ID NO: 479014 - DNA, 22 bp, Homo sapiens
tgcctggaggagaaggaggaac

SEQ ID NO: 479015 - DNA, 21 bp, Homo sapiens
tgccttgatgttgtgttgtta

SEQ ID NO: 479016 - DNA, 23 bp, Homo sapiens
tgcggttcaggaaaattgaatgc

SEQ ID NO: 479017 - DNA, 18 bp, Homo sapiens
tgctatgctgttcattga

SEQ ID NO: 479018 - DNA, 17 bp, Homo sapiens
tgctatggttttctcca

SEQ ID NO: 479019 - DNA, 20 bp, Homo sapiens
tgctgtaaataaaaatagct

SEQ ID NO: 479020 - DNA, 15 bp, Homo sapiens
tgctgtgtttgagct

SEQ ID NO: 479021 - DNA, 13 bp, Homo sapiens
tgctgttcattga

SEQ ID NO: 479022 - DNA, 13 bp, Homo sapiens
tgcttctgcagca

SEQ ID NO: 479023 - DNA, 16 bp, Homo sapiens
tgcttctgcagcaact

SEQ ID NO: 479024 - DNA, 18 bp, Homo sapiens
tgcttctgcagcaactcc

SEQ ID NO: 479025 - DNA, 17 bp, Homo sapiens
tggaaaaaaaaaaatat

SEQ ID NO: 479026 - DNA, 14 bp, Homo sapiens
tggaagttgtcctt

SEQ ID NO: 479027 - DNA, 20 bp, Homo sapiens
tggaagttgtcctttctgat

SEQ ID NO: 479028 - DNA, 14 bp, Homo sapiens
tggactttgttcac

SEQ ID NO: 479029 - DNA, 23 bp, Homo sapiens
tggataatcttcggccaatttat

SEQ ID NO: 479030 - DNA, 23 bp, Homo sapiens
tggattttttccttcaaagttta

SEQ ID NO: 479031 - DNA, 20 bp, Homo sapiens
tggcagtttatatttaactc

SEQ ID NO: 479032 - DNA, 20 bp, Homo sapiens
tggccaggctggtctcgaac

SEQ ID NO: 479033 - DNA, 13 bp, Homo sapiens
tggcctgggggct

SEQ ID NO: 479034 - DNA, 18 bp, Homo sapiens
tggctatgtttttaatgt

SEQ ID NO: 479035 - DNA, 18 bp, Homo sapiens
tggtttcccaagagctac

SEQ ID NO: 479036 - DNA, 17 bp, Homo sapiens
tgtaaataaaaatagct

SEQ ID NO: 479037 - DNA, 14 bp, Homo sapiens
tgtaaatattttaa

SEQ ID NO: 479038 - DNA, 16 bp, Homo sapiens
tgtaaatgatatgtct

SEQ ID NO: 479039 - DNA, 22 bp, Homo sapiens
tgtaaatgatatgtctttaaaa

SEQ ID NO: 479040 - DNA, 20 bp, Homo sapiens
tgtaacaggtctcctcttaa

SEQ ID NO: 479041 - DNA, 18 bp, Homo sapiens
tgtaatagatgtttgata

SEQ ID NO: 479042 - DNA, 21 bp, Homo sapiens
tgtagtttttgttcaccttct

SEQ ID NO: 479043 - DNA, 15 bp, Homo sapiens
tgtatagtaaatcac

SEQ ID NO: 479044 - DNA, 17 bp, Homo sapiens
tgtccaggtcacaggca

SEQ ID NO: 479045 - DNA, 18 bp, Homo sapiens
tgtccaggtcacaggcat

SEQ ID NO: 479046 - DNA, 22 bp, Homo sapiens
tgtctaaggtcacacagtatta

SEQ ID NO: 479047 - DNA, 16 bp, Homo sapiens
tgtctgtgtgctgtaa

SEQ ID NO: 479048 - DNA, 15 bp, Homo sapiens
tgtctttaaaatgat

SEQ ID NO: 479049 - DNA, 17 bp, Homo sapiens
tgtgcaatgtaaatatt

SEQ ID NO: 479050 - DNA, 15 bp, Homo sapiens
tgtgcatctggcctg

SEQ ID NO: 479051 - DNA, 19 bp, Homo sapiens
tgtgctgtaacctgaagtc

SEQ ID NO: 479052 - DNA, 22 bp, Homo sapiens
tgtggattttttccttcaaagt

SEQ ID NO: 479053 - DNA, 13 bp, Homo sapiens
tgtgtgtttggaa

SEQ ID NO: 479054 - DNA, 20 bp, Homo sapiens
tgttaaaaaaataagaagaa

SEQ ID NO: 479055 - DNA, 16 bp, Homo sapiens
tgttaatttttgatac

SEQ ID NO: 479056 - DNA, 24 bp, Homo sapiens
tgttagctcagaggagaggagcaa

SEQ ID NO: 479057 - DNA, 14 bp, Homo sapiens
tgttataaaatctg

SEQ ID NO: 479058 - DNA, 17 bp, Homo sapiens
tgttataaaatctgtat

SEQ ID NO: 479059 - DNA, 20 bp, Homo sapiens
tgttataaaatctgtattgc

SEQ ID NO: 479060 - DNA, 19 bp, Homo sapiens
tgttattcaataactattg

SEQ ID NO: 479061 - DNA, 16 bp, Homo sapiens
tgttctgacagcattt

SEQ ID NO: 479062 - DNA, 13 bp, Homo sapiens
tgttgtacaagct

SEQ ID NO: 479063 - DNA, 15 bp, Homo sapiens
tgttgtacaagctca

SEQ ID NO: 479064 - DNA, 15 bp, Homo sapiens
tgttgtttcttaaat

SEQ ID NO: 479065 - DNA, 16 bp, Homo sapiens
tgttgtttcttaaata

SEQ ID NO: 479066 - DNA, 18 bp, Homo sapiens
tgtttagtagcagtgatt

SEQ ID NO: 479067 - DNA, 12 bp, Homo sapiens
ttaaaaaaataa

SEQ ID NO: 479068 - DNA, 19 bp, Homo sapiens
ttaaaaaagcttaaaactt

SEQ ID NO: 479069 - DNA, 13 bp, Homo sapiens
ttaaaacaaaatc

SEQ ID NO: 479070 - DNA, 19 bp, Homo sapiens
ttaaaatagcaaaagaaga

SEQ ID NO: 479071 - DNA, 21 bp, Homo sapiens
ttaaaatagcaaaagaagaag

SEQ ID NO: 479072 - DNA, 14 bp, Homo sapiens
ttaaaccttttttg

SEQ ID NO: 479073 - DNA, 13 bp, Homo sapiens
ttaaatgaaatac

SEQ ID NO: 479074 - DNA, 15 bp, Homo sapiens
ttaaatgaaatactt

SEQ ID NO: 479075 - DNA, 23 bp, Homo sapiens
ttaaattctctctcttgcaggaa

SEQ ID NO: 479076 - DNA, 15 bp, Homo sapiens
ttaactctctttatg

SEQ ID NO: 479077 - DNA, 12 bp, Homo sapiens
ttaatttttgat

SEQ ID NO: 479078 - DNA, 23 bp, Homo sapiens
ttaccaggcaccaaaagaagtaa

SEQ ID NO: 479079 - DNA, 16 bp, Homo sapiens
ttagaaaactttaaag

SEQ ID NO: 479080 - DNA, 18 bp, Homo sapiens
ttaggaagcaagcttaat

SEQ ID NO: 479081 - DNA, 12 bp, Homo sapiens
ttataaaatctg

SEQ ID NO: 479082 - DNA, 15 bp, Homo sapiens
ttataacattgtaaa

SEQ ID NO: 479083 - DNA, 19 bp, Homo sapiens
ttatactatttattaaaac

SEQ ID NO: 479084 - DNA, 13 bp, Homo sapiens
ttatatttaactc

SEQ ID NO: 479085 - DNA, 19 bp, Homo sapiens
ttatccacagaaacatttt

SEQ ID NO: 479086 - DNA, 14 bp, Homo sapiens
ttatgaaaaagaag

SEQ ID NO: 479087 - DNA, 17 bp, Homo sapiens
ttatgtctgtggatttt

SEQ ID NO: 479088 - DNA, 21 bp, Homo sapiens
ttatttaaaatagcaaaagaa

SEQ ID NO: 479089 - DNA, 12 bp, Homo sapiens
ttatttgtaata

SEQ ID NO: 479090 - DNA, 20 bp, Homo sapiens
ttcaaagctgtgtgtttgga

SEQ ID NO: 479091 - DNA, 14 bp, Homo sapiens
ttcaaagtttaata

SEQ ID NO: 479092 - DNA, 21 bp, Homo sapiens
ttcaacatgttatttgtaata

SEQ ID NO: 479093 - DNA, 15 bp, Homo sapiens
ttcaattcaaagctg

SEQ ID NO: 479094 - DNA, 14 bp, Homo sapiens
ttcatcatttttta

SEQ ID NO: 479095 - DNA, 18 bp, Homo sapiens
ttcatctatttctgagaa

SEQ ID NO: 479096 - DNA, 12 bp, Homo sapiens
ttcatgataatg

SEQ ID NO: 479097 - DNA, 18 bp, Homo sapiens
ttcatgataatgaacaga

SEQ ID NO: 479098 - DNA, 16 bp, Homo sapiens
ttccacatataaagct

SEQ ID NO: 479099 - DNA, 18 bp, Homo sapiens
ttccagtctctgcatgta

SEQ ID NO: 479100 - DNA, 23 bp, Homo sapiens
ttcctcccctggaagttgtcctt

SEQ ID NO: 479101 - DNA, 16 bp, Homo sapiens
ttcgcttgcttctgca

SEQ ID NO: 479102 - DNA, 17 bp, Homo sapiens
ttctatagccaaaaata

SEQ ID NO: 479103 - DNA, 18 bp, Homo sapiens
agttgccgtggcaactgt

SEQ ID NO: 479104 - DNA, 15 bp, Homo sapiens
agttgtcctttctga

SEQ ID NO: 479105 - DNA, 19 bp, Homo sapiens
agttgtcctttctgatcct

SEQ ID NO: 479106 - DNA, 17 bp, Homo sapiens
agttgtgggtgggagag

SEQ ID NO: 479107 - DNA, 20 bp, Homo sapiens
agtttagaagcgctcatctg

SEQ ID NO: 479108 - DNA, 15 bp, Homo sapiens
agtttatatttaact

SEQ ID NO: 479109 - DNA, 16 bp, Homo sapiens
agtttatatttaactc

SEQ ID NO: 479110 - DNA, 16 bp, Homo sapiens
agtttcatataaagta

SEQ ID NO: 479111 - DNA, 16 bp, Homo sapiens
agtttggatatgtaaa

SEQ ID NO: 479112 - DNA, 20 bp, Homo sapiens
agtttggatatgtaaaacat

SEQ ID NO: 479113 - DNA, 21 bp, Homo sapiens
agtttttgttcaccttctgtg

SEQ ID NO: 479114 - DNA, 13 bp, Homo sapiens
ataaagatttttt

SEQ ID NO: 479115 - DNA, 18 bp, Homo sapiens
ataaagattttttaataa

SEQ ID NO: 479116 - DNA, 21 bp, Homo sapiens
ataaagattttttaataattt

SEQ ID NO: 479117 - DNA, 14 bp, Homo sapiens
ataaagtatcatca

SEQ ID NO: 479118 - DNA, 15 bp, Homo sapiens
ataaagtatcatcag

SEQ ID NO: 479119 - DNA, 20 bp, Homo sapiens
ataaagttgataaagatttt

SEQ ID NO: 479120 - DNA, 22 bp, Homo sapiens
ataaatagtgaaaattttattg

SEQ ID NO: 479121 - DNA, 13 bp, Homo sapiens
ataacattgtaaa

SEQ ID NO: 479122 - DNA, 18 bp, Homo sapiens
ataacgtttaagccaaaa

SEQ ID NO: 479123 - DNA, 13 bp, Homo sapiens
ataactattgctg

SEQ ID NO: 479124 - DNA, 14 bp, Homo sapiens
ataactgaaaatta

SEQ ID NO: 479125 - DNA, 20 bp, Homo sapiens
ataactgaaaattatttaaa

SEQ ID NO: 479126 - DNA, 14 bp, Homo sapiens
ataagaaacttttt

SEQ ID NO: 479127 - DNA, 13 bp, Homo sapiens
ataagaagaatgc

SEQ ID NO: 479128 - DNA, 15 bp, Homo sapiens
ataagaagaatgctt

SEQ ID NO: 479129 - DNA, 20 bp, Homo sapiens
ataagaagaatgcttaatca

SEQ ID NO: 479130 - DNA, 19 bp, Homo sapiens
ataatggcctcttaaaaat

SEQ ID NO: 479131 - DNA, 14 bp, Homo sapiens
ataattaaaacaaa

SEQ ID NO: 479132 - DNA, 15 bp, Homo sapiens
ataattaaatgaaat

SEQ ID NO: 479133 - DNA, 14 bp, Homo sapiens
ataattttaaattc

SEQ ID NO: 479134 - DNA, 17 bp, Homo sapiens
atactaagcattgaatg

SEQ ID NO: 479135 - DNA, 16 bp, Homo sapiens
atactatttattaaaa

SEQ ID NO: 479136 - DNA, 17 bp, Homo sapiens
atactatttattaaaac

SEQ ID NO: 479137 - DNA, 20 bp, Homo sapiens
atacttatttataacattgt

SEQ ID NO: 479138 - DNA, 17 bp, Homo sapiens
atagacagaagaaacaa

SEQ ID NO: 479139 - DNA, 19 bp, Homo sapiens
atagacagaagaaacaagg

SEQ ID NO: 479140 - DNA, 20 bp, Homo sapiens
atagataccattttgaaata

SEQ ID NO: 479141 - DNA, 16 bp, Homo sapiens
atagcattctctatca

SEQ ID NO: 479142 - DNA, 14 bp, Homo sapiens
atagctataaatag

SEQ ID NO: 479143 - DNA, 17 bp, Homo sapiens
atagctataaatagtga

SEQ ID NO: 479144 - DNA, 21 bp, Homo sapiens
ataggatttatttaaaatagc

SEQ ID NO: 479145 - DNA, 22 bp, Homo sapiens
ataggatttatttaaaatagca

SEQ ID NO: 479146 - DNA, 13 bp, Homo sapiens
atagtaaatcacg

SEQ ID NO: 479147 - DNA, 23 bp, Homo sapiens
atagtttggatatgtaaaacatt

SEQ ID NO: 479148 - DNA, 13 bp, Homo sapiens
atatattttgaaa

SEQ ID NO: 479149 - DNA, 13 bp, Homo sapiens
atatctcctgaaa

SEQ ID NO: 479150 - DNA, 15 bp, Homo sapiens
atatctcctgaaaag

SEQ ID NO: 479151 - DNA, 23 bp, Homo sapiens
atatctcctgaaaaggtttatga

SEQ ID NO: 479152 - DNA, 19 bp, Homo sapiens
atatgagaaatataaaaat

SEQ ID NO: 479153 - DNA, 22 bp, Homo sapiens
atatgagaaatataaaaataat

SEQ ID NO: 479154 - DNA, 14 bp, Homo sapiens
atatgagattggaa

SEQ ID NO: 479155 - DNA, 22 bp, Homo sapiens
atatgagattggaaaaaattag

SEQ ID NO: 479156 - DNA, 24 bp, Homo sapiens
atatgtaaaacatttattttgaca

SEQ ID NO: 479157 - DNA, 15 bp, Homo sapiens
atattacactacaca

SEQ ID NO: 479158 - DNA, 23 bp, Homo sapiens
atattcctattgtgcaatgtaaa

SEQ ID NO: 479159 - DNA, 15 bp, Homo sapiens
atattttaaagaatt

SEQ ID NO: 479160 - DNA, 20 bp, Homo sapiens
atattttaaagaattgtgtc

SEQ ID NO: 479161 - DNA, 13 bp, Homo sapiens
atcatatctgtat

SEQ ID NO: 479162 - DNA, 15 bp, Homo sapiens
atcattcatttttgt

SEQ ID NO: 479163 - DNA, 20 bp, Homo sapiens
atcccttaatatcctaaaca

SEQ ID NO: 479164 - DNA, 14 bp, Homo sapiens
atcctaaacatcat

SEQ ID NO: 479165 - DNA, 23 bp, Homo sapiens
atcctagcactttgggaggctga

SEQ ID NO: 479166 - DNA, 21 bp, Homo sapiens
atcctctcttcttttcccatt

SEQ ID NO: 479167 - DNA, 13 bp, Homo sapiens
atcgaatgaaatt

SEQ ID NO: 479168 - DNA, 14 bp, Homo sapiens
atcgaatgaaatta

SEQ ID NO: 479169 - DNA, 16 bp, Homo sapiens
atctaaattaacttct

SEQ ID NO: 479170 - DNA, 14 bp, Homo sapiens
atctatttctgaga

SEQ ID NO: 479171 - DNA, 17 bp, Homo sapiens
atctcagtgaagaatac

SEQ ID NO: 479172 - DNA, 12 bp, Homo sapiens
atctcctgaaaa

SEQ ID NO: 479173 - DNA, 18 bp, Homo sapiens
atctgaatttttaaacaa

SEQ ID NO: 479174 - DNA, 20 bp, Homo sapiens
atctgaatttttaaacaagt

SEQ ID NO: 479175 - DNA, 15 bp, Homo sapiens
atcttggctcactgc

SEQ ID NO: 479176 - DNA, 23 bp, Homo sapiens
atcttgggattcctcccctggaa

SEQ ID NO: 479177 - DNA, 14 bp, Homo sapiens
atcttttgtgagat

SEQ ID NO: 479178 - DNA, 15 bp, Homo sapiens
atgataatgaacaga

SEQ ID NO: 479179 - DNA, 16 bp, Homo sapiens
atgatatgtctttaaa

SEQ ID NO: 479180 - DNA, 18 bp, Homo sapiens
atgattcacttttattgt

SEQ ID NO: 479181 - DNA, 21 bp, Homo sapiens
atgcaaaataatacctgtcca

SEQ ID NO: 479182 - DNA, 18 bp, Homo sapiens
atgcacctaaagaaaaac

SEQ ID NO: 479183 - DNA, 23 bp, Homo sapiens
atgccttttcccaaaatgttgaa

SEQ ID NO: 479184 - DNA, 21 bp, Homo sapiens
atgctttgaagtacaattgtg

SEQ ID NO: 479185 - DNA, 15 bp, Homo sapiens
atggattctaaaatg

SEQ ID NO: 479186 - DNA, 18 bp, Homo sapiens
atggattctaaaatgcct

SEQ ID NO: 479187 - DNA, 13 bp, Homo sapiens
atggctattttat

SEQ ID NO: 479188 - DNA, 20 bp, Homo sapiens
atggttttctccaagagcta

SEQ ID NO: 479189 - DNA, 21 bp, Homo sapiens
atggttttctccaagagctac

SEQ ID NO: 479190 - DNA, 15 bp, Homo sapiens
atgtaaaacatttat

SEQ ID NO: 479191 - DNA, 21 bp, Homo sapiens
atgtaaaacatttattttgac

SEQ ID NO: 479192 - DNA, 11 bp, Homo sapiens
atgtaattgtt

SEQ ID NO: 479193 - DNA, 14 bp, Homo sapiens
atgtctgtggattt

SEQ ID NO: 479194 - DNA, 13 bp, Homo sapiens
atgtctttaaaat

SEQ ID NO: 479195 - DNA, 16 bp, Homo sapiens
atgtctttaaaatgat

SEQ ID NO: 479196 - DNA, 19 bp, Homo sapiens
atgttaaaaaaataagaag

SEQ ID NO: 479197 - DNA, 16 bp, Homo sapiens
atgttattcaataact

SEQ ID NO: 479198 - DNA, 17 bp, Homo sapiens
atgttgtgttgttatca

SEQ ID NO: 479199 - DNA, 13 bp, Homo sapiens
atgtttttaatgt

SEQ ID NO: 479200 - DNA, 14 bp, Homo sapiens
attaaatgaaatac

SEQ ID NO: 479201 - DNA, 19 bp, Homo sapiens
attaactgggtaatgaaac

SEQ ID NO: 479202 - DNA, 15 bp, Homo sapiens
attatctttaaaact

SEQ ID NO: 479203 - DNA, 18 bp, Homo sapiens
attcaataactattgctg

SEQ ID NO: 479204 - DNA, 14 bp, Homo sapiens
attcagaagaaaaa

SEQ ID NO: 479205 - DNA, 22 bp, Homo sapiens
attcccaagctctagtgggaag

SEQ ID NO: 479206 - DNA, 13 bp, Homo sapiens
attcctcccctgg

SEQ ID NO: 479207 - DNA, 17 bp, Homo sapiens
attcctcccctggaagt

SEQ ID NO: 479208 - DNA, 14 bp, Homo sapiens
attcttctgcctca

SEQ ID NO: 479209 - DNA, 23 bp, Homo sapiens
attgaatggctatgtttttaatg

SEQ ID NO: 479210 - DNA, 22 bp, Homo sapiens
attgagttggttacctattgct

SEQ ID NO: 479211 - DNA, 17 bp, Homo sapiens
attgcttctctaaaaca

SEQ ID NO: 479212 - DNA, 15 bp, Homo sapiens
attgtgcaatgtaaa

SEQ ID NO: 479213 - DNA, 20 bp, Homo sapiens
attgtgcaatgtaaatattt

SEQ ID NO: 479214 - DNA, 18 bp, Homo sapiens
attgttccaaatgaatgt

SEQ ID NO: 479215 - DNA, 13 bp, Homo sapiens
atttaaaatagca

SEQ ID NO: 479216 - DNA, 18 bp, Homo sapiens
atttaaaatagcaaaaga

SEQ ID NO: 479217 - DNA, 20 bp, Homo sapiens
atttaaaatagcaaaagaag

SEQ ID NO: 479218 - DNA, 21 bp, Homo sapiens
atttaaaatagcaaaagaaga

SEQ ID NO: 479219 - DNA, 23 bp, Homo sapiens
atttaaaatagcaaaagaagaag

SEQ ID NO: 479220 - DNA, 21 bp, Homo sapiens
cttttgtacgttaattaaaca

SEQ ID NO: 479221 - DNA, 21 bp, Homo sapiens
gaaaaacaaactcgtttttta

SEQ ID NO: 479222 - DNA, 23 bp, Homo sapiens
gaaaaggtttatgaaaaagaaga

SEQ ID NO: 479223 - DNA, 23 bp, Homo sapiens
gaaaattatttaaaccgctaaaa

SEQ ID NO: 479224 - DNA, 21 bp, Homo sapiens
gaaataagtttttgtttcaca

SEQ ID NO: 479225 - DNA, 20 bp, Homo sapiens
gaaatttaaactataagcaa

SEQ ID NO: 479226 - DNA, 23 bp, Homo sapiens
gaacagaacatagacagaagaaa

SEQ ID NO: 479227 - DNA, 13 bp, Homo sapiens
gaagaaaaagaag

SEQ ID NO: 479228 - DNA, 19 bp, Homo sapiens
gaagaagtttcatcatttt

SEQ ID NO: 479229 - DNA, 21 bp, Homo sapiens
gaagaatctcatctcagtgaa

SEQ ID NO: 479230 - DNA, 24 bp, Homo sapiens
gaagaatgcttaatcagatagata

SEQ ID NO: 479231 - DNA, 20 bp, Homo sapiens
gaagcaacctcagtaattta

SEQ ID NO: 479232 - DNA, 17 bp, Homo sapiens
gaagggaataaggtaca

SEQ ID NO: 479233 - DNA, 19 bp, Homo sapiens
gaagtcaaaccttaagata

SEQ ID NO: 479234 - DNA, 18 bp, Homo sapiens
gaataaatgttcaaactg

SEQ ID NO: 479235 - DNA, 19 bp, Homo sapiens
gaataaggtacaagaagca

SEQ ID NO: 479236 - DNA, 20 bp, Homo sapiens
gaataaggtacaagaagcat

SEQ ID NO: 479237 - DNA, 19 bp, Homo sapiens
gaatataatggcctcttaa

SEQ ID NO: 479238 - DNA, 20 bp, Homo sapiens
gaatataattgttttatctg

SEQ ID NO: 479239 - DNA, 17 bp, Homo sapiens
gaatggctatgttttta

SEQ ID NO: 479240 - DNA, 17 bp, Homo sapiens
gaattaactccattcca

SEQ ID NO: 479241 - DNA, 15 bp, Homo sapiens
gaattgagtgtttaa

SEQ ID NO: 479242 - DNA, 22 bp, Homo sapiens
gacaacatttctatagccaaaa

SEQ ID NO: 479243 - DNA, 22 bp, Homo sapiens
gacaccatcttttgtgagatgt

SEQ ID NO: 479244 - DNA, 19 bp, Homo sapiens
gacataaagttgataaaga

SEQ ID NO: 479245 - DNA, 20 bp, Homo sapiens
gacataaagttgataaagat

SEQ ID NO: 479246 - DNA, 13 bp, Homo sapiens
gaccttgtgatct

SEQ ID NO: 479247 - DNA, 24 bp, Homo sapiens
gagaaaaaaaaagccactaaggtc

SEQ ID NO: 479248 - DNA, 12 bp, Homo sapiens
gagaaggaggaa

SEQ ID NO: 479249 - DNA, 21 bp, Homo sapiens
gagatggggagggcgcttttg

SEQ ID NO: 479250 - DNA, 20 bp, Homo sapiens
gagctacgtatttaatagca

SEQ ID NO: 479251 - DNA, 15 bp, Homo sapiens
gaggcgaataaatgt

SEQ ID NO: 479252 - DNA, 17 bp, Homo sapiens
gaggcgaataaatgttc

SEQ ID NO: 479253 - DNA, 20 bp, Homo sapiens
gaggcgaataaatgttcaaa

SEQ ID NO: 479254 - DNA, 18 bp, Homo sapiens
gagtgtagcaactacagt

SEQ ID NO: 479255 - DNA, 19 bp, Homo sapiens
gataaagattttttaataa

SEQ ID NO: 479256 - DNA, 13 bp, Homo sapiens
gataatgaacaga

SEQ ID NO: 479257 - DNA, 20 bp, Homo sapiens
gatacttaagtgctgcaatt

SEQ ID NO: 479258 - DNA, 20 bp, Homo sapiens
gatatgagaaatataaaaat

SEQ ID NO: 479259 - DNA, 16 bp, Homo sapiens
gatatgtaaaacattt

SEQ ID NO: 479260 - DNA, 18 bp, Homo sapiens
gatatgtaaaacatttat

SEQ ID NO: 479261 - DNA, 13 bp, Homo sapiens
gatatgtctttaa

SEQ ID NO: 479262 - DNA, 19 bp, Homo sapiens
gatgccaaaaaaaaataca

SEQ ID NO: 479263 - DNA, 21 bp, Homo sapiens
gatggccaggcctcagggacc

SEQ ID NO: 479264 - DNA, 14 bp, Homo sapiens
gatggggagggcgc

SEQ ID NO: 479265 - DNA, 18 bp, Homo sapiens
gattttttccttcaaagt

SEQ ID NO: 479266 - DNA, 22 bp, Homo sapiens
gcaaatttctagatatgagaaa

SEQ ID NO: 479267 - DNA, 19 bp, Homo sapiens
gcaacctcagtaatttaga

SEQ ID NO: 479268 - DNA, 23 bp, Homo sapiens
gcaagaaggcaaaaatagtttgg

SEQ ID NO: 479269 - DNA, 21 bp, Homo sapiens
gcaataacgtttaagccaaaa

SEQ ID NO: 479270 - DNA, 21 bp, Homo sapiens
gcaattgcttctctaaaacag

SEQ ID NO: 479271 - DNA, 20 bp, Homo sapiens
gcacacaactgtggtcccag

SEQ ID NO: 479272 - DNA, 16 bp, Homo sapiens
gcacaggctaattttt

SEQ ID NO: 479273 - DNA, 15 bp, Homo sapiens
gcaccaaaagaagta

SEQ ID NO: 479274 - DNA, 18 bp, Homo sapiens
gcaccaaaagaagtaaaa

SEQ ID NO: 479275 - DNA, 17 bp, Homo sapiens
gcacctaaagaaaaaca

SEQ ID NO: 479276 - DNA, 20 bp, Homo sapiens
gcacgcggagtgagtttttt

SEQ ID NO: 479277 - DNA, 19 bp, Homo sapiens
gcactcttttgagcagtaa

SEQ ID NO: 479278 - DNA, 22 bp, Homo sapiens
gcagagtcagccattcctgttc

SEQ ID NO: 479279 - DNA, 12 bp, Homo sapiens
gcagcaactccc

SEQ ID NO: 479280 - DNA, 14 bp, Homo sapiens
gcagcaactcccac

SEQ ID NO: 479281 - DNA, 15 bp, Homo sapiens
gcagtttatatttaa

SEQ ID NO: 479282 - DNA, 12 bp, Homo sapiens
gcatctggcctg

SEQ ID NO: 479283 - DNA, 14 bp, Homo sapiens
gcatctggcctggg

SEQ ID NO: 479284 - DNA, 16 bp, Homo sapiens
gcatctggcctggggg

SEQ ID NO: 479285 - DNA, 23 bp, Homo sapiens
gcatgtttgtctgtgtgctgtaa

SEQ ID NO: 479286 - DNA, 18 bp, Homo sapiens
gcattcagaagaaaaaga

SEQ ID NO: 479287 - DNA, 21 bp, Homo sapiens
gcattgaatggctatgttttt

SEQ ID NO: 479288 - DNA, 14 bp, Homo sapiens
gcatttcagctgtg

SEQ ID NO: 479289 - DNA, 22 bp, Homo sapiens
gcattttgtaagttgaagcaaa

SEQ ID NO: 479290 - DNA, 21 bp, Homo sapiens
gccaatgcacctaaagaaaaa

SEQ ID NO: 479291 - DNA, 15 bp, Homo sapiens
gccaatgtccaggtc

SEQ ID NO: 479292 - DNA, 17 bp, Homo sapiens
gccccccggcctgatgg

SEQ ID NO: 479293 - DNA, 22 bp, Homo sapiens
gcctggaggagaaggaggaacc

SEQ ID NO: 479294 - DNA, 22 bp, Homo sapiens
gcgaaaaaatcaggtggctttt

SEQ ID NO: 479295 - DNA, 16 bp, Homo sapiens
gcgaataaatgttcaa

SEQ ID NO: 479296 - DNA, 15 bp, Homo sapiens
gcgctcatctggctt

SEQ ID NO: 479297 - DNA, 14 bp, Homo sapiens
gctaagagaagtag

SEQ ID NO: 479298 - DNA, 16 bp, Homo sapiens
gctacaggggaggctg

SEQ ID NO: 479299 - DNA, 16 bp, Homo sapiens
gctactttgctgctat

SEQ ID NO: 479300 - DNA, 17 bp, Homo sapiens
gctatgctgttcattga

SEQ ID NO: 479301 - DNA, 17 bp, Homo sapiens
gctcaaggctgcagtga

SEQ ID NO: 479302 - DNA, 14 bp, Homo sapiens
gctcagaggagagg

SEQ ID NO: 479303 - DNA, 13 bp, Homo sapiens
gctcaggaggcga

SEQ ID NO: 479304 - DNA, 19 bp, Homo sapiens
gctcaggaggcgaataaat

SEQ ID NO: 479305 - DNA, 20 bp, Homo sapiens
gctcaggaggcgaataaatg

SEQ ID NO: 479306 - DNA, 22 bp, Homo sapiens
gctcggccaggcacggaggctc

SEQ ID NO: 479307 - DNA, 14 bp, Homo sapiens
gctcgtgcatgtaa

SEQ ID NO: 479308 - DNA, 23 bp, Homo sapiens
gctgagacgcaaggatcacttga

SEQ ID NO: 479309 - DNA, 23 bp, Homo sapiens
gctgagatgggaggatcacttga

SEQ ID NO: 479310 - DNA, 12 bp, Homo sapiens
gctgataatttt

SEQ ID NO: 479311 - DNA, 13 bp, Homo sapiens
gctgataatttta

SEQ ID NO: 479312 - DNA, 20 bp, Homo sapiens
gctgcgctcccacctcggac

SEQ ID NO: 479313 - DNA, 17 bp, Homo sapiens
gcttaatcagatagata

SEQ ID NO: 479314 - DNA, 15 bp, Homo sapiens
gcttctgcagcaact

SEQ ID NO: 479315 - DNA, 17 bp, Homo sapiens
gcttctgcagcaactcc

SEQ ID NO: 479316 - DNA, 18 bp, Homo sapiens
gcttctgcagcaactccc

SEQ ID NO: 479317 - DNA, 20 bp, Homo sapiens
gcttctgcagcaactcccac

SEQ ID NO: 479318 - DNA, 23 bp, Homo sapiens
gcttctgcagcaactcccacgac

SEQ ID NO: 479319 - DNA, 20 bp, Homo sapiens
gcttttcgcttgcttctgca

SEQ ID NO: 479320 - DNA, 18 bp, Homo sapiens
ggaccaaggagatgggga

SEQ ID NO: 479321 - DNA, 21 bp, Homo sapiens
ggagaggagcaaacaggaaaa

SEQ ID NO: 479322 - DNA, 18 bp, Homo sapiens
ggaggcgaataaatgttc

SEQ ID NO: 479323 - DNA, 12 bp, Homo sapiens
ggaggctgagat

SEQ ID NO: 479324 - DNA, 14 bp, Homo sapiens
ggatgatttaacat

SEQ ID NO: 479325 - DNA, 14 bp, Homo sapiens
ggattcctcccctg

SEQ ID NO: 479326 - DNA, 14 bp, Homo sapiens
ggcacactgagcaa

SEQ ID NO: 479327 - DNA, 22 bp, Homo sapiens
ggcctcagggaccaaggagatg

SEQ ID NO: 479328 - DNA, 17 bp, Homo sapiens
ggcctgatggccaggcc

SEQ ID NO: 479329 - DNA, 23 bp, Homo sapiens
ggcctgggggctgttagctcaga

SEQ ID NO: 479330 - DNA, 11 bp, Homo sapiens
ggcgaataaat

SEQ ID NO: 479331 - DNA, 12 bp, Homo sapiens
ggcgaataaatg

SEQ ID NO: 479332 - DNA, 14 bp, Homo sapiens
ggctgcagtgagcc

SEQ ID NO: 479333 - DNA, 20 bp, Homo sapiens
ggcttttcgcttgcttctgc

SEQ ID NO: 479334 - DNA, 22 bp, Homo sapiens
ggcttttcgcttgcttctgcag

SEQ ID NO: 479335 - DNA, 21 bp, Homo sapiens
tgaatttttaaacaagtattt

SEQ ID NO: 479336 - DNA, 20 bp, Homo sapiens
tgacagcatttcagctgtga

SEQ ID NO: 479337 - DNA, 14 bp, Homo sapiens
tgacataaagttga

SEQ ID NO: 479338 - DNA, 16 bp, Homo sapiens
tgactgtagtttttgt

SEQ ID NO: 479339 - DNA, 18 bp, Homo sapiens
tgagattggaaaaaatta

SEQ ID NO: 479340 - DNA, 23 bp, Homo sapiens
tgagcccagaagctcaaggctgc

SEQ ID NO: 479341 - DNA, 21 bp, Homo sapiens
tgagttggttacctattgctg

SEQ ID NO: 479342 - DNA, 18 bp, Homo sapiens
tgataaagattttttaat

SEQ ID NO: 479343 - DNA, 19 bp, Homo sapiens
tgataaagattttttaata

SEQ ID NO: 479344 - DNA, 15 bp, Homo sapiens
tgataatgaacagaa

SEQ ID NO: 479345 - DNA, 18 bp, Homo sapiens
tgataatgaacagaacat

SEQ ID NO: 479346 - DNA, 20 bp, Homo sapiens
tgataatgaacagaacatag

SEQ ID NO: 479347 - DNA, 14 bp, Homo sapiens
tgatactaagcatt

SEQ ID NO: 479348 - DNA, 21 bp, Homo sapiens
tgatacttatttataacattg

SEQ ID NO: 479349 - DNA, 14 bp, Homo sapiens
tgatatgtctttaa

SEQ ID NO: 479350 - DNA, 22 bp, Homo sapiens
tgatccgttccattgcaagctt

SEQ ID NO: 479351 - DNA, 18 bp, Homo sapiens
tgatgccaaaaaaaaata

SEQ ID NO: 479352 - DNA, 12 bp, Homo sapiens
tgatgttaaaaa

SEQ ID NO: 479353 - DNA, 14 bp, Homo sapiens
tgatgttaaaaaaa

SEQ ID NO: 479354 - DNA, 23 bp, Homo sapiens
tgatgttaaaaaaataagaagaa

SEQ ID NO: 479355 - DNA, 12 bp, Homo sapiens
tgatttaacatt

SEQ ID NO: 479356 - DNA, 13 bp, Homo sapiens
tgatttaacatta

SEQ ID NO: 479357 - DNA, 22 bp, Homo sapiens
tgcaatgtaaatattttaaaga

SEQ ID NO: 479358 - DNA, 19 bp, Homo sapiens
tgcacctaaagaaaaacaa

SEQ ID NO: 479359 - DNA, 18 bp, Homo sapiens
tgcagatggtgagagata

SEQ ID NO: 479360 - DNA, 16 bp, Homo sapiens
tgcagcaactcccacg

SEQ ID NO: 479361 - DNA, 20 bp, Homo sapiens
tgcagcaactcccacgactg

SEQ ID NO: 479362 - DNA, 21 bp, Homo sapiens
tgccaatgtccaggtcacagg

SEQ ID NO: 479363 - DNA, 17 bp, Homo sapiens
tgccaggctaatttttt

SEQ ID NO: 479364 - DNA, 17 bp, Homo sapiens
tgccatttcctcctggg

SEQ ID NO: 479365 - DNA, 23 bp, Homo sapiens
tgccatttcctcctgggcaacag

SEQ ID NO: 479366 - DNA, 19 bp, Homo sapiens
tgcccagccctaaacatca

SEQ ID NO: 479367 - DNA, 22 bp, Homo sapiens
tgctaagagaagtagaaatcat

SEQ ID NO: 479368 - DNA, 16 bp, Homo sapiens
tgctacaaaatgtgtg

SEQ ID NO: 479369 - DNA, 14 bp, Homo sapiens
tgctacacagtata

SEQ ID NO: 479370 - DNA, 13 bp, Homo sapiens
tgctcacagtctc

SEQ ID NO: 479371 - DNA, 16 bp, Homo sapiens
tgctgtgaaatgactg

SEQ ID NO: 479372 - DNA, 19 bp, Homo sapiens
tgcttctgcagcaactccc

SEQ ID NO: 479373 - DNA, 20 bp, Homo sapiens
tgcttctgcagcaactccca

SEQ ID NO: 479374 - DNA, 13 bp, Homo sapiens
tggaggagaagga

SEQ ID NO: 479375 - DNA, 14 bp, Homo sapiens
tggaggagaaggag

SEQ ID NO: 479376 - DNA, 17 bp, Homo sapiens
tggaggagaaggaggaa

SEQ ID NO: 479377 - DNA, 15 bp, Homo sapiens
tggattctaaaatgc

SEQ ID NO: 479378 - DNA, 15 bp, Homo sapiens
tggcctcaaagcaag

SEQ ID NO: 479379 - DNA, 12 bp, Homo sapiens
tggctattttat

SEQ ID NO: 479380 - DNA, 19 bp, Homo sapiens
tggctgataattttaaatt

SEQ ID NO: 479381 - DNA, 22 bp, Homo sapiens
tggcttttcgcttgcttctgca

SEQ ID NO: 479382 - DNA, 20 bp, Homo sapiens
tggcttttgcggttcaggaa

SEQ ID NO: 479383 - DNA, 16 bp, Homo sapiens
tgggattcctcccctg

SEQ ID NO: 479384 - DNA, 20 bp, Homo sapiens
tgggattcctcccctggaag

SEQ ID NO: 479385 - DNA, 21 bp, Homo sapiens
tgggattcctcccctggaagt

SEQ ID NO: 479386 - DNA, 17 bp, Homo sapiens
tggggagggcgcttttg

SEQ ID NO: 479387 - DNA, 22 bp, Homo sapiens
tgggggctgttagctcagagga

SEQ ID NO: 479388 - DNA, 18 bp, Homo sapiens
tgggtaatgaaacaaaga

SEQ ID NO: 479389 - DNA, 16 bp, Homo sapiens
tggtaacttgctgtga

SEQ ID NO: 479390 - DNA, 16 bp, Homo sapiens
tggttacctattgctg

SEQ ID NO: 479391 - DNA, 19 bp, Homo sapiens
tggttacctattgctgtaa

SEQ ID NO: 479392 - DNA, 14 bp, Homo sapiens
tggttgatgccaaa

SEQ ID NO: 479393 - DNA, 13 bp, Homo sapiens
tggtttcccaaga

SEQ ID NO: 479394 - DNA, 20 bp, Homo sapiens
tggttttctccaagagctac

SEQ ID NO: 479395 - DNA, 19 bp, Homo sapiens
tgtaaaacatttattttga

SEQ ID NO: 479396 - DNA, 15 bp, Homo sapiens
tgtaaataaaaatag

SEQ ID NO: 479397 - DNA, 17 bp, Homo sapiens
tgtaaatattttaaaga

SEQ ID NO: 479398 - DNA, 22 bp, Homo sapiens
tgtaaatattttaaagaattgt

SEQ ID NO: 479399 - DNA, 21 bp, Homo sapiens
tgtaaatgatatgtctttaaa

SEQ ID NO: 479400 - DNA, 22 bp, Homo sapiens
tgtaacaggtctcctcttaaaa

SEQ ID NO: 479401 - DNA, 14 bp, Homo sapiens
tgtaatcagtttta

SEQ ID NO: 479402 - DNA, 17 bp, Homo sapiens
tgtacatttatgtgtga

SEQ ID NO: 479403 - DNA, 21 bp, Homo sapiens
tgtctctacaaaaaaaatcaa

SEQ ID NO: 479404 - DNA, 15 bp, Homo sapiens
tgtctgtggattttt

SEQ ID NO: 479405 - DNA, 15 bp, Homo sapiens
tgtctgtgtgctgta

SEQ ID NO: 479406 - DNA, 16 bp, Homo sapiens
tgtctgtttgttctct

SEQ ID NO: 479407 - DNA, 11 bp, Homo sapiens
tgtctttaaaa

SEQ ID NO: 479408 - DNA, 18 bp, Homo sapiens
tgtgcaatgtaaatattt

SEQ ID NO: 479409 - DNA, 22 bp, Homo sapiens
tgtgggtgttaatttttgatac

SEQ ID NO: 479410 - DNA, 17 bp, Homo sapiens
tgtgtttggaagactat

SEQ ID NO: 479411 - DNA, 15 bp, Homo sapiens
tgttaatttttgata

SEQ ID NO: 479412 - DNA, 15 bp, Homo sapiens
tgttagctcagagga

SEQ ID NO: 479413 - DNA, 21 bp, Homo sapiens
tgttattcaataactattgct

SEQ ID NO: 479414 - DNA, 17 bp, Homo sapiens
tgttcaccttctgtgca

SEQ ID NO: 479415 - DNA, 19 bp, Homo sapiens
tgttcaccttctgtgcatc

SEQ ID NO: 479416 - DNA, 17 bp, Homo sapiens
tgttccaaatgaatgtt

SEQ ID NO: 479417 - DNA, 13 bp, Homo sapiens
tgttgtgaatgtc

SEQ ID NO: 479418 - DNA, 21 bp, Homo sapiens
tgttgttatcatttaagattt

SEQ ID NO: 479419 - DNA, 17 bp, Homo sapiens
tgttgtttcttaaataa

SEQ ID NO: 479420 - DNA, 21 bp, Homo sapiens
tgttgtttcttaaataagaaa

SEQ ID NO: 479421 - DNA, 14 bp, Homo sapiens
tgtttaaacctttt

SEQ ID NO: 479422 - DNA, 13 bp, Homo sapiens
ttaaaaaactaaa

SEQ ID NO: 479423 - DNA, 12 bp, Homo sapiens
ttaaaaaagctt

SEQ ID NO: 479424 - DNA, 23 bp, Homo sapiens
ttaaaatagcaaaagaagaagtt

SEQ ID NO: 479425 - DNA, 23 bp, Homo sapiens
ttaaaatgattcacttttattgt

SEQ ID NO: 479426 - DNA, 19 bp, Homo sapiens
ttaaaccgctaaaagaaac

SEQ ID NO: 479427 - DNA, 12 bp, Homo sapiens
ttaaatgaaata

SEQ ID NO: 479428 - DNA, 17 bp, Homo sapiens
ttaactctctttatgtc

SEQ ID NO: 479429 - DNA, 17 bp, Homo sapiens
ttaactgggtaatgaaa

SEQ ID NO: 479430 - DNA, 21 bp, Homo sapiens
ttaactgggtaatgaaacaaa

SEQ ID NO: 479431 - DNA, 16 bp, Homo sapiens
ttaagccaaaacaatg

SEQ ID NO: 479432 - DNA, 18 bp, Homo sapiens
ttaatagcaaagaattga

SEQ ID NO: 479433 - DNA, 17 bp, Homo sapiens
ttaatatcctaaacatc

SEQ ID NO: 479434 - DNA, 19 bp, Homo sapiens
ttaatatcctaaacatcat

SEQ ID NO: 479435 - DNA, 19 bp, Homo sapiens
ttaatgtatagtaaatcac

SEQ ID NO: 479436 - DNA, 15 bp, Homo sapiens
ttaatttagaaaact

SEQ ID NO: 479437 - DNA, 13 bp, Homo sapiens
ttaatttttgata

SEQ ID NO: 479438 - DNA, 18 bp, Homo sapiens
ttacaaagcccttttata

SEQ ID NO: 479439 - DNA, 20 bp, Homo sapiens
ttacagaacacgctttcaca

SEQ ID NO: 479440 - DNA, 14 bp, Homo sapiens
ttagaaaactttaa

SEQ ID NO: 479441 - DNA, 13 bp, Homo sapiens
ttagaaatcattt

SEQ ID NO: 479442 - DNA, 15 bp, Homo sapiens
ttataaaatctgtat

SEQ ID NO: 479443 - DNA, 24 bp, Homo sapiens
ttataggatttatttaaaatagca

SEQ ID NO: 479444 - DNA, 15 bp, Homo sapiens
ttatcatttaagatt

SEQ ID NO: 479445 - DNA, 17 bp, Homo sapiens
ttatctgaatttttaaa

SEQ ID NO: 479446 - DNA, 21 bp, Homo sapiens
ttatctgaatttttaaacaag

SEQ ID NO: 479447 - DNA, 12 bp, Homo sapiens
ttatctttaaaa

SEQ ID NO: 479448 - DNA, 16 bp, Homo sapiens
ttatttaaaatagcaa

SEQ ID NO: 479449 - DNA, 22 bp, Homo sapiens
ttatttaaaatagcaaaagaag

SEQ ID NO: 479450 - DNA, 15 bp, Homo sapiens
ttatttataacattg

SEQ ID NO: 479451 - DNA, 13 bp, Homo sapiens
gctaagagaagta

SEQ ID NO: 479452 - DNA, 22 bp, Homo sapiens
gctaagataattaaatgaaata

SEQ ID NO: 479453 - DNA, 19 bp, Homo sapiens
gctaatttttttgtatttt

SEQ ID NO: 479454 - DNA, 21 bp, Homo sapiens
gctaatttttttgtattttag

SEQ ID NO: 479455 - DNA, 17 bp, Homo sapiens
gctacaggggaggctga

SEQ ID NO: 479456 - DNA, 21 bp, Homo sapiens
gctagaattgagtgtttaaag

SEQ ID NO: 479457 - DNA, 18 bp, Homo sapiens
gctataaatagtgaaaat

SEQ ID NO: 479458 - DNA, 16 bp, Homo sapiens
gctatgtttttaatgt

SEQ ID NO: 479459 - DNA, 23 bp, Homo sapiens
gctattttatattacactacaca

SEQ ID NO: 479460 - DNA, 16 bp, Homo sapiens
gctcagaggagaggag

SEQ ID NO: 479461 - DNA, 23 bp, Homo sapiens
gctcaggaggcgaataaatgttc

SEQ ID NO: 479462 - DNA, 14 bp, Homo sapiens
gctgataattttaa

SEQ ID NO: 479463 - DNA, 15 bp, Homo sapiens
gctgataattttaaa

SEQ ID NO: 479464 - DNA, 17 bp, Homo sapiens
gctgcgctcccacctcg

SEQ ID NO: 479465 - DNA, 15 bp, Homo sapiens
gctggtttaatgttt

SEQ ID NO: 479466 - DNA, 16 bp, Homo sapiens
gctgtaaataaaaata

SEQ ID NO: 479467 - DNA, 19 bp, Homo sapiens
gctgtaaataaaaatagct

SEQ ID NO: 479468 - DNA, 20 bp, Homo sapiens
gctgtgaaatgactgcatca

SEQ ID NO: 479469 - DNA, 12 bp, Homo sapiens
gcttaaaacttt

SEQ ID NO: 479470 - DNA, 12 bp, Homo sapiens
gcttctgcagca

SEQ ID NO: 479471 - DNA, 19 bp, Homo sapiens
gcttctgcagcaactccca

SEQ ID NO: 479472 - DNA, 21 bp, Homo sapiens
gcttctgcagcaactcccacg

SEQ ID NO: 479473 - DNA, 23 bp, Homo sapiens
gcttcttttagttgtatctcttt

SEQ ID NO: 479474 - DNA, 14 bp, Homo sapiens
gcttgcttctgcag

SEQ ID NO: 479475 - DNA, 21 bp, Homo sapiens
gcttgcttctgcagcaactcc

SEQ ID NO: 479476 - DNA, 19 bp, Homo sapiens
gcttgggtgtaacaggtct

SEQ ID NO: 479477 - DNA, 22 bp, Homo sapiens
gcttgggtgtaacaggtctcct

SEQ ID NO: 479478 - DNA, 23 bp, Homo sapiens
gcttgggtgtaacaggtctcctc

SEQ ID NO: 479479 - DNA, 19 bp, Homo sapiens
ggaaggtcccttgtttcca

SEQ ID NO: 479480 - DNA, 15 bp, Homo sapiens
ggagcaaacaggaaa

SEQ ID NO: 479481 - DNA, 21 bp, Homo sapiens
ggagcttctctgatgtgatat

SEQ ID NO: 479482 - DNA, 20 bp, Homo sapiens
ggaggctgagatgggaggat

SEQ ID NO: 479483 - DNA, 17 bp, Homo sapiens
ggatcacttgagcccag

SEQ ID NO: 479484 - DNA, 14 bp, Homo sapiens
ggattgaggatgaa

SEQ ID NO: 479485 - DNA, 14 bp, Homo sapiens
ggatttatttaaaa

SEQ ID NO: 479486 - DNA, 13 bp, Homo sapiens
ggcacggaggctc

SEQ ID NO: 479487 - DNA, 22 bp, Homo sapiens
ggccaatgcacctaaagaaaaa

SEQ ID NO: 479488 - DNA, 23 bp, Homo sapiens
ggcctcaaagcaagcattcagaa

SEQ ID NO: 479489 - DNA, 16 bp, Homo sapiens
ggcctcagggaccaag

SEQ ID NO: 479490 - DNA, 13 bp, Homo sapiens
ggcctgatggcca

SEQ ID NO: 479491 - DNA, 20 bp, Homo sapiens
ggctagagtgcagtggcatg

SEQ ID NO: 479492 - DNA, 15 bp, Homo sapiens
ggctgttagctcaga

SEQ ID NO: 479493 - DNA, 19 bp, Homo sapiens
ggcttttcgcttgcttctg

SEQ ID NO: 479494 - DNA, 12 bp, Homo sapiens
ggggaggctgag

SEQ ID NO: 479495 - DNA, 16 bp, Homo sapiens
ggggaggctgagacgc

SEQ ID NO: 479496 - DNA, 19 bp, Homo sapiens
ggtttaatgttttggccaa

SEQ ID NO: 479497 - DNA, 19 bp, Homo sapiens
ggtttcaccatgttggcca

SEQ ID NO: 479498 - DNA, 20 bp, Homo sapiens
ggtttcaccatgttggccag

SEQ ID NO: 479499 - DNA, 18 bp, Homo sapiens
gtaaaacatttattttga

SEQ ID NO: 479500 - DNA, 20 bp, Homo sapiens
gtaaaacatttattttgaca

SEQ ID NO: 479501 - DNA, 19 bp, Homo sapiens
gtaaaagcaaaaaagaaaa

SEQ ID NO: 479502 - DNA, 13 bp, Homo sapiens
gtaaatattttaa

SEQ ID NO: 479503 - DNA, 21 bp, Homo sapiens
gtaaatcacgctttttgaaaa

SEQ ID NO: 479504 - DNA, 20 bp, Homo sapiens
gtaacaggtctcctcttaaa

SEQ ID NO: 479505 - DNA, 16 bp, Homo sapiens
gtacgttaattaaaca

SEQ ID NO: 479506 - DNA, 19 bp, Homo sapiens
gtagacacgctcttctatt

SEQ ID NO: 479507 - DNA, 20 bp, Homo sapiens
gtatttggtaacttgctgtg

SEQ ID NO: 479508 - DNA, 18 bp, Homo sapiens
gtatttgttaatttagaa

SEQ ID NO: 479509 - DNA, 20 bp, Homo sapiens
gtcattttggtactttggtg

SEQ ID NO: 479510 - DNA, 14 bp, Homo sapiens
gtccaggtcacagg

SEQ ID NO: 479511 - DNA, 20 bp, Homo sapiens
gtcctttctgatcctctctt

SEQ ID NO: 479512 - DNA, 21 bp, Homo sapiens
gtctaaagctggtttaatgtt

SEQ ID NO: 479513 - DNA, 22 bp, Homo sapiens
gtctcctcttaaaaaataaaaa

SEQ ID NO: 479514 - DNA, 23 bp, Homo sapiens
gtctcctcttaaaaaataaaaac

SEQ ID NO: 479515 - DNA, 19 bp, Homo sapiens
gtctggcagtttatattta

SEQ ID NO: 479516 - DNA, 14 bp, Homo sapiens
gtctgtgtgctgta

SEQ ID NO: 479517 - DNA, 17 bp, Homo sapiens
gtgaaaattttattgaa

SEQ ID NO: 479518 - DNA, 13 bp, Homo sapiens
gtgcatctggcct

SEQ ID NO: 479519 - DNA, 15 bp, Homo sapiens
gtgcatctggcctgg

SEQ ID NO: 479520 - DNA, 16 bp, Homo sapiens
gtgcatctggcctggg

SEQ ID NO: 479521 - DNA, 17 bp, Homo sapiens
gtgcatctggcctgggg

SEQ ID NO: 479522 - DNA, 19 bp, Homo sapiens
gtgcatctggcctgggggc

SEQ ID NO: 479523 - DNA, 20 bp, Homo sapiens
gtgctgggattacaggtgta

SEQ ID NO: 479524 - DNA, 19 bp, Homo sapiens
gtgtaacaggtctcctctt

SEQ ID NO: 479525 - DNA, 21 bp, Homo sapiens
gtgttgttatcatttaagatt

SEQ ID NO: 479526 - DNA, 21 bp, Homo sapiens
gtgtttaaagttcaacatgtt

SEQ ID NO: 479527 - DNA, 14 bp, Homo sapiens
tatttaaaaaacta

SEQ ID NO: 479528 - DNA, 16 bp, Homo sapiens
tatttaaaaaactaaa

SEQ ID NO: 479529 - DNA, 21 bp, Homo sapiens
tatttaaaccgctaaaagaaa

SEQ ID NO: 479530 - DNA, 23 bp, Homo sapiens
tatttaactctctttatgtctgt

SEQ ID NO: 479531 - DNA, 13 bp, Homo sapiens
tatttaatagcaa

SEQ ID NO: 479532 - DNA, 19 bp, Homo sapiens
tatttaatagcaaagaatt

SEQ ID NO: 479533 - DNA, 22 bp, Homo sapiens
tatttaatagcaaagaattgac

SEQ ID NO: 479534 - DNA, 16 bp, Homo sapiens
tatttctgagaaggtc

SEQ ID NO: 479535 - DNA, 12 bp, Homo sapiens
tattttaaagaa

SEQ ID NO: 479536 - DNA, 15 bp, Homo sapiens
tcaaaccttaagata

SEQ ID NO: 479537 - DNA, 20 bp, Homo sapiens
tcaaaccttaagataatgga

SEQ ID NO: 479538 - DNA, 13 bp, Homo sapiens
tcaaagcaagcat

SEQ ID NO: 479539 - DNA, 13 bp, Homo sapiens
tcaaagtttaata

SEQ ID NO: 479540 - DNA, 14 bp, Homo sapiens
tcaacaattctaaa

SEQ ID NO: 479541 - DNA, 14 bp, Homo sapiens
tcaagaaataagtt

SEQ ID NO: 479542 - DNA, 17 bp, Homo sapiens
tcaagatttcaggatta

SEQ ID NO: 479543 - DNA, 15 bp, Homo sapiens
tcaaggctgcagtga

SEQ ID NO: 479544 - DNA, 16 bp, Homo sapiens
tcaagtggaaaccttg

SEQ ID NO: 479545 - DNA, 15 bp, Homo sapiens
tcaataactattgct

SEQ ID NO: 479546 - DNA, 22 bp, Homo sapiens
tcaatcagtctcagaatgtcat

SEQ ID NO: 479547 - DNA, 15 bp, Homo sapiens
tcaatgctacaaaat

SEQ ID NO: 479548 - DNA, 17 bp, Homo sapiens
tcaattcaaagctgtgt

SEQ ID NO: 479549 - DNA, 22 bp, Homo sapiens
tcacaacagcctgacaacattt

SEQ ID NO: 479550 - DNA, 17 bp, Homo sapiens
tcacaccactgccattt

SEQ ID NO: 479551 - DNA, 22 bp, Homo sapiens
tcacagttaccctaaactctct

SEQ ID NO: 479552 - DNA, 16 bp, Homo sapiens
tcagaagaaaaagaag

SEQ ID NO: 479553 - DNA, 14 bp, Homo sapiens
tcagactgtttagt

SEQ ID NO: 479554 - DNA, 20 bp, Homo sapiens
tcagcctcccgagtagctgg

SEQ ID NO: 479555 - DNA, 16 bp, Homo sapiens
tcagcttttgcttcat

SEQ ID NO: 479556 - DNA, 23 bp, Homo sapiens
tcaggattgaggatgaactcagg

SEQ ID NO: 479557 - DNA, 18 bp, Homo sapiens
tcagtccccacagataac

SEQ ID NO: 479558 - DNA, 19 bp, Homo sapiens
tcagtctcagaatgtcatt

SEQ ID NO: 479559 - DNA, 18 bp, Homo sapiens
tcagtgttataaaatctg

SEQ ID NO: 479560 - DNA, 12 bp, Homo sapiens
tcatatctgtat

SEQ ID NO: 479561 - DNA, 11 bp, Homo sapiens
tcatctatttc

SEQ ID NO: 479562 - DNA, 15 bp, Homo sapiens
tcatctatttctgag

SEQ ID NO: 479563 - DNA, 14 bp, Homo sapiens
tcattttggtactt

SEQ ID NO: 479564 - DNA, 21 bp, Homo sapiens
tccaagagctacataatttag

SEQ ID NO: 479565 - DNA, 20 bp, Homo sapiens
tccacagaaacattttcatt

SEQ ID NO: 479566 - DNA, 22 bp, Homo sapiens
tccaggtcacaggcatccgctg

SEQ ID NO: 479567 - DNA, 13 bp, Homo sapiens
tcccaagagctac

SEQ ID NO: 479568 - DNA, 18 bp, Homo sapiens
tcccacaggttcaggcga

SEQ ID NO: 479569 - DNA, 22 bp, Homo sapiens
tcccagctacaggggaggctga

SEQ ID NO: 479570 - DNA, 16 bp, Homo sapiens
tcccatttatcgcaga

SEQ ID NO: 479571 - DNA, 14 bp, Homo sapiens
tcccttaatatcct

SEQ ID NO: 479572 - DNA, 21 bp, Homo sapiens
tcctaaacatcattcattttt

SEQ ID NO: 479573 - DNA, 23 bp, Homo sapiens
tcctgaaaaggtttatgaaaaag

SEQ ID NO: 479574 - DNA, 21 bp, Homo sapiens
tcctgaatttattattgttct

SEQ ID NO: 479575 - DNA, 16 bp, Homo sapiens
tgccaaaaaaaaatac

SEQ ID NO: 479576 - DNA, 20 bp, Homo sapiens
tgccaggctagagtgcagtg

SEQ ID NO: 479577 - DNA, 21 bp, Homo sapiens
tgcctggaggagaaggaggaa

SEQ ID NO: 479578 - DNA, 15 bp, Homo sapiens
tgcctttctagcaat

SEQ ID NO: 479579 - DNA, 13 bp, Homo sapiens
tgctaagagaagt

SEQ ID NO: 479580 - DNA, 18 bp, Homo sapiens
tgctgtaaataaaaatag

SEQ ID NO: 479581 - DNA, 17 bp, Homo sapiens
tgctgtaacctgaagtc

SEQ ID NO: 479582 - DNA, 16 bp, Homo sapiens
tgcttctctaaaacag

SEQ ID NO: 479583 - DNA, 14 bp, Homo sapiens
tgcttctgcagcaa

SEQ ID NO: 479584 - DNA, 17 bp, Homo sapiens
tgcttctgcagcaactc

SEQ ID NO: 479585 - DNA, 14 bp, Homo sapiens
tggaatataattgt

SEQ ID NO: 479586 - DNA, 20 bp, Homo sapiens
tggaggagaaggaggaaccc

SEQ ID NO: 479587 - DNA, 16 bp, Homo sapiens
tggatatgtaaaacat

SEQ ID NO: 479588 - DNA, 17 bp, Homo sapiens
tggatatgtaaaacatt

SEQ ID NO: 479589 - DNA, 21 bp, Homo sapiens
tggatatgtaaaacatttatt

SEQ ID NO: 479590 - DNA, 13 bp, Homo sapiens
tggattctaaaat

SEQ ID NO: 479591 - DNA, 15 bp, Homo sapiens
tggcaaaataaagaa

SEQ ID NO: 479592 - DNA, 17 bp, Homo sapiens
tggctatgtttttaatg

SEQ ID NO: 479593 - DNA, 19 bp, Homo sapiens
tggggtatggattctaaaa

SEQ ID NO: 479594 - DNA, 12 bp, Homo sapiens
tgggtgggagag

SEQ ID NO: 479595 - DNA, 22 bp, Homo sapiens
tgggtgtaacaggtctcctctt

SEQ ID NO: 479596 - DNA, 23 bp, Homo sapiens
tgggtgtaacaggtctcctctta

SEQ ID NO: 479597 - DNA, 10 bp, Homo sapiens
tggtaattat

SEQ ID NO: 479598 - DNA, 19 bp, Homo sapiens
tggtcttgtttaatatttg

SEQ ID NO: 479599 - DNA, 22 bp, Homo sapiens
tggttccacaatcatctattga

SEQ ID NO: 479600 - DNA, 20 bp, Homo sapiens
tgtaaatgatatgtctttaa

SEQ ID NO: 479601 - DNA, 18 bp, Homo sapiens
tgtaacaggtctcctctt

SEQ ID NO: 479602 - DNA, 16 bp, Homo sapiens
tgtaagttgaagcaaa

SEQ ID NO: 479603 - DNA, 18 bp, Homo sapiens
tgtacatttatgtgtgaa

SEQ ID NO: 479604 - DNA, 17 bp, Homo sapiens
tgtacgttaattaaaca

SEQ ID NO: 479605 - DNA, 20 bp, Homo sapiens
tgtatcctgaggctgagaga

SEQ ID NO: 479606 - DNA, 16 bp, Homo sapiens
tgtattttagcagaga

SEQ ID NO: 479607 - DNA, 13 bp, Homo sapiens
tgtcattttggta

SEQ ID NO: 479608 - DNA, 16 bp, Homo sapiens
tgtccaattctcttta

SEQ ID NO: 479609 - DNA, 13 bp, Homo sapiens
tgtccaggtcaca

SEQ ID NO: 479610 - DNA, 14 bp, Homo sapiens
tgtgcatctggcct

SEQ ID NO: 479611 - DNA, 18 bp, Homo sapiens
tgtgcatctggcctgggg

SEQ ID NO: 479612 - DNA, 16 bp, Homo sapiens
tgtggactttgttcac

SEQ ID NO: 479613 - DNA, 14 bp, Homo sapiens
tgtgggtgttaatt

SEQ ID NO: 479614 - DNA, 22 bp, Homo sapiens
tgttaaaaaaataagaagaatg

SEQ ID NO: 479615 - DNA, 18 bp, Homo sapiens
tgttaatttagaaaactt

SEQ ID NO: 479616 - DNA, 20 bp, Homo sapiens
tgttaatttagaaaacttta

SEQ ID NO: 479617 - DNA, 22 bp, Homo sapiens
tgttaatttagaaaactttaaa

SEQ ID NO: 479618 - DNA, 18 bp, Homo sapiens
tgttcaccttctgtgcat

SEQ ID NO: 479619 - DNA, 13 bp, Homo sapiens
tgttgagacagag

SEQ ID NO: 479620 - DNA, 17 bp, Homo sapiens
tgttgtctgtttgttct

SEQ ID NO: 479621 - DNA, 13 bp, Homo sapiens
tgtttaaagttca

SEQ ID NO: 479622 - DNA, 23 bp, Homo sapiens
tgtttaaagttcaacatgttatt

SEQ ID NO: 479623 - DNA, 16 bp, Homo sapiens
tgtttagtagcagtga

SEQ ID NO: 479624 - DNA, 15 bp, Homo sapiens
ttaaaactttgaagt

SEQ ID NO: 479625 - DNA, 22 bp, Homo sapiens
ttaaaatagcaaaagaagaagt

SEQ ID NO: 479626 - DNA, 16 bp, Homo sapiens
ttaaaccgctaaaaga

SEQ ID NO: 479627 - DNA, 19 bp, Homo sapiens
ttaactctctttatgtctg

SEQ ID NO: 479628 - DNA, 13 bp, Homo sapiens
ttaacttaaatag

SEQ ID NO: 479629 - DNA, 13 bp, Homo sapiens
ttaagtgaatgtc

SEQ ID NO: 479630 - DNA, 14 bp, Homo sapiens
ttggtggccacata

SEQ ID NO: 479631 - DNA, 16 bp, Homo sapiens
ttggttttgctacata

SEQ ID NO: 479632 - DNA, 18 bp, Homo sapiens
ttgtacgttaattaaaca

SEQ ID NO: 479633 - DNA, 15 bp, Homo sapiens
ttgtataattatgaa

SEQ ID NO: 479634 - DNA, 14 bp, Homo sapiens
ttgtatctcttttg

SEQ ID NO: 479635 - DNA, 17 bp, Homo sapiens
ttgtctgtgtgctgtaa

SEQ ID NO: 479636 - DNA, 12 bp, Homo sapiens
ttgtcttaatat

SEQ ID NO: 479637 - DNA, 23 bp, Homo sapiens
ttgtgcaatgtaaatattttaaa

SEQ ID NO: 479638 - DNA, 19 bp, Homo sapiens
ttgttaatttagaaaactt

SEQ ID NO: 479639 - DNA, 18 bp, Homo sapiens
ttgttatcatttaagatt

SEQ ID NO: 479640 - DNA, 14 bp, Homo sapiens
ttgtttcttaaata

SEQ ID NO: 479641 - DNA, 14 bp, Homo sapiens
tttaaaaaactaaa

SEQ ID NO: 479642 - DNA, 13 bp, Homo sapiens
tttaaaaaagctt

SEQ ID NO: 479643 - DNA, 14 bp, Homo sapiens
tttaaaaaagctta

SEQ ID NO: 479644 - DNA, 15 bp, Homo sapiens
tttaaactataagca

SEQ ID NO: 479645 - DNA, 12 bp, Homo sapiens
tttaaagaattg

SEQ ID NO: 479646 - DNA, 13 bp, Homo sapiens
tttaaagaattgt

SEQ ID NO: 479647 - DNA, 18 bp, Homo sapiens
tttaggaagcaagcttaa

SEQ ID NO: 479648 - DNA, 21 bp, Homo sapiens
tttagtagcagtgattgtctt

SEQ ID NO: 479649 - DNA, 17 bp, Homo sapiens
tttagttgtatctcttt

SEQ ID NO: 479650 - DNA, 15 bp, Homo sapiens
tttataacattgtaa

SEQ ID NO: 479651 - DNA, 20 bp, Homo sapiens
tttataacattgtaaatgat

SEQ ID NO: 479652 - DNA, 16 bp, Homo sapiens
tttatattacactaca

SEQ ID NO: 479653 - DNA, 19 bp, Homo sapiens
tttatgtctgtggattttt

SEQ ID NO: 479654 - DNA, 17 bp, Homo sapiens
tttattaaaaccattct

SEQ ID NO: 479655 - DNA, 21 bp, Homo sapiens
tttattctgtcaatgaaaagc

SEQ ID NO: 479656 - DNA, 18 bp, Homo sapiens
tttcagtccccacagata

SEQ ID NO: 479657 - DNA, 21 bp, Homo sapiens
tttcatagataccattttgaa

SEQ ID NO: 479658 - DNA, 12 bp, Homo sapiens
tttcgcttgctt

SEQ ID NO: 479659 - DNA, 21 bp, Homo sapiens
tttctccaagagctacataat

SEQ ID NO: 479660 - DNA, 16 bp, Homo sapiens
tttctgagaaggtcct

SEQ ID NO: 479661 - DNA, 18 bp, Homo sapiens
tttcttaaataagaaact

SEQ ID NO: 479662 - DNA, 23 bp, Homo sapiens
tttgaaaaagcgaaaaaatcagg

SEQ ID NO: 479663 - DNA, 17 bp, Homo sapiens
tttgatactaagcattg

SEQ ID NO: 479664 - DNA, 15 bp, Homo sapiens
tttggatatgtaaaa

SEQ ID NO: 479665 - DNA, 19 bp, Homo sapiens
tttggtttcccaagagcta

SEQ ID NO: 479666 - DNA, 21 bp, Homo sapiens
tttgtacgttaattaaacaaa

SEQ ID NO: 479667 - DNA, 19 bp, Homo sapiens
tttgtctgtgtgctgtaac

SEQ ID NO: 479668 - DNA, 15 bp, Homo sapiens
tttgttcaccttctg

SEQ ID NO: 479669 - DNA, 19 bp, Homo sapiens
tttgttcaccttctgtgca

SEQ ID NO: 479670 - DNA, 21 bp, Homo sapiens
tttgttcaccttctgtgcatc

SEQ ID NO: 479671 - DNA, 14 bp, Homo sapiens
ttttaaaaaagctt

SEQ ID NO: 479672 - DNA, 22 bp, Homo sapiens
ttttaaaaaagcttaaaacttt

SEQ ID NO: 479673 - DNA, 12 bp, Homo sapiens
ttttaaagaatt

SEQ ID NO: 479674 - DNA, 12 bp, Homo sapiens
ttttacaaagcc

SEQ ID NO: 479675 - DNA, 23 bp, Homo sapiens
ttttatctgaatttttaaacaag

SEQ ID NO: 479676 - DNA, 16 bp, Homo sapiens
ttttccttcaaagttt

SEQ ID NO: 479677 - DNA, 18 bp, Homo sapiens
ttttgcaatcccttaata

SEQ ID NO: 479678 - DNA, 13 bp, Homo sapiens
ttttgtgagatgt

SEQ ID NO: 479679 - DNA, 21 bp, Homo sapiens
ttttgttcaccttctgtgcat

SEQ ID NO: 479680 - DNA, 22 bp, Homo sapiens
tttttaaaaaagcttaaaactt

SEQ ID NO: 479681 - DNA, 14 bp, Homo sapiens
tttttaataattta

SEQ ID NO: 479682 - DNA, 15 bp, Homo sapiens
tttttacaaagccct

SEQ ID NO: 479683 - DNA, 13 bp, Homo sapiens
tttttatttaaaa

SEQ ID NO: 479684 - DNA, 23 bp, Homo sapiens
tttttgttcaccttctgtgcatc

SEQ ID NO: 479685 - DNA, 12 bp, Homo sapiens
tttttttgagat

SEQ ID NO: 479686 - DNA, 14 bp, Homo sapiens
aagatacttaagtg

SEQ ID NO: 479687 - DNA, 16 bp, Homo sapiens
aagattttttaataat

SEQ ID NO: 479688 - DNA, 20 bp, Homo sapiens
aagcaaatttctagatatga

SEQ ID NO: 479689 - DNA, 15 bp, Homo sapiens
aagcaagcattcaga

SEQ ID NO: 479690 - DNA, 21 bp, Homo sapiens
aagcattcagaagaaaaagaa

SEQ ID NO: 479691 - DNA, 19 bp, Homo sapiens
aagcattttgtaagttgaa

SEQ ID NO: 479692 - DNA, 18 bp, Homo sapiens
aagccaaaacaatgttta

SEQ ID NO: 479693 - DNA, 15 bp, Homo sapiens
aagccttactcacct

SEQ ID NO: 479694 - DNA, 16 bp, Homo sapiens
aagccttactcacctc

SEQ ID NO: 479695 - DNA, 19 bp, Homo sapiens
aagccttactcacctctct

SEQ ID NO: 479696 - DNA, 13 bp, Homo sapiens
aagcgctcatctg

SEQ ID NO: 479697 - DNA, 19 bp, Homo sapiens
aagctcaaggctgcagtga

SEQ ID NO: 479698 - DNA, 16 bp, Homo sapiens
aagctggtttaatgtt

SEQ ID NO: 479699 - DNA, 13 bp, Homo sapiens
aagcttaaaactt

SEQ ID NO: 479700 - DNA, 14 bp, Homo sapiens
aagcttaaaacttt

SEQ ID NO: 479701 - DNA, 12 bp, Homo sapiens
aaggagaaaaaa

SEQ ID NO: 479702 - DNA, 13 bp, Homo sapiens
aaggcaaaaatag

SEQ ID NO: 479703 - DNA, 18 bp, Homo sapiens
aaggtcagtgttataaaa

SEQ ID NO: 479704 - DNA, 22 bp, Homo sapiens
aagtaggactttcctaaatgtt

SEQ ID NO: 479705 - DNA, 19 bp, Homo sapiens
aagtatcatcagtgtagaa

SEQ ID NO: 479706 - DNA, 20 bp, Homo sapiens
aagtgaaaaagacttcaaat

SEQ ID NO: 479707 - DNA, 11 bp, Homo sapiens
aataaaaatag

SEQ ID NO: 479708 - DNA, 11 bp, Homo sapiens
aataaatgttc

SEQ ID NO: 479709 - DNA, 20 bp, Homo sapiens
aataaatttattttcttgga

SEQ ID NO: 479710 - DNA, 13 bp, Homo sapiens
aataactattgct

SEQ ID NO: 479711 - DNA, 19 bp, Homo sapiens
aataaggtacaagaagcat

SEQ ID NO: 479712 - DNA, 21 bp, Homo sapiens
aataatttagacttcaagcat

SEQ ID NO: 479713 - DNA, 11 bp, Homo sapiens
aatagatgttt

SEQ ID NO: 479714 - DNA, 19 bp, Homo sapiens
aatagatgtttgatagatt

SEQ ID NO: 479715 - DNA, 14 bp, Homo sapiens
aatagcaaagaatt

SEQ ID NO: 479716 - DNA, 18 bp, Homo sapiens
aatagctataaatagtga

SEQ ID NO: 479717 - DNA, 16 bp, Homo sapiens
aatagtatttcccatt

SEQ ID NO: 479718 - DNA, 21 bp, Homo sapiens
aatagtgaaaattttattgaa

SEQ ID NO: 479719 - DNA, 14 bp, Homo sapiens
aatatcctaaacat

SEQ ID NO: 479720 - DNA, 17 bp, Homo sapiens
aatatcctaaacatcat

SEQ ID NO: 479721 - DNA, 11 bp, Homo sapiens
aatattttaaa

SEQ ID NO: 479722 - DNA, 13 bp, Homo sapiens
aatattttaaaga

SEQ ID NO: 479723 - DNA, 14 bp, Homo sapiens
aatcacgctttttg

SEQ ID NO: 479724 - DNA, 18 bp, Homo sapiens
aatcacgctttttgaaaa

SEQ ID NO: 479725 - DNA, 20 bp, Homo sapiens
aatcacgctttttgaaaaag

SEQ ID NO: 479726 - DNA, 21 bp, Homo sapiens
aatcagatagatattcctatt

SEQ ID NO: 479727 - DNA, 17 bp, Homo sapiens
aatcagtctcagaatgt

SEQ ID NO: 479728 - DNA, 24 bp, Homo sapiens
aatcagtctcagaatgtcattttg

SEQ ID NO: 479729 - DNA, 16 bp, Homo sapiens
aatcttttataggatt

SEQ ID NO: 479730 - DNA, 16 bp, Homo sapiens
aatgaaacaaagagtt

SEQ ID NO: 479731 - DNA, 12 bp, Homo sapiens
aatgaaatactt

SEQ ID NO: 479732 - DNA, 15 bp, Homo sapiens
aatgaacagaacata

SEQ ID NO: 479733 - DNA, 22 bp, Homo sapiens
aatgaacagaacatagacagaa

SEQ ID NO: 479734 - DNA, 17 bp, Homo sapiens
aatgatatgtctttaaa

SEQ ID NO: 479735 - DNA, 19 bp, Homo sapiens
aatggcctcttaaaaatta

SEQ ID NO: 479736 - DNA, 20 bp, Homo sapiens
aatggcctcttaaaaattat

SEQ ID NO: 479737 - DNA, 17 bp, Homo sapiens
aatggctgataatttta

SEQ ID NO: 479738 - DNA, 12 bp, Homo sapiens
aatgggtaatat

SEQ ID NO: 479739 - DNA, 20 bp, Homo sapiens
aatgtaaatattttaaagaa

SEQ ID NO: 479740 - DNA, 17 bp, Homo sapiens
aatgtatattgatgtaa

SEQ ID NO: 479741 - DNA, 14 bp, Homo sapiens
aatgtcattttggt

SEQ ID NO: 479742 - DNA, 19 bp, Homo sapiens
aatgtccaggtcacaggca

SEQ ID NO: 479743 - DNA, 20 bp, Homo sapiens
aatgtccaggtcacaggcat

SEQ ID NO: 479744 - DNA, 15 bp, Homo sapiens
aatgttgaaatatga

SEQ ID NO: 479745 - DNA, 20 bp, Homo sapiens
aattaaacaaattccttccc

SEQ ID NO: 479746 - DNA, 15 bp, Homo sapiens
aattaaatgaaatac

SEQ ID NO: 479747 - DNA, 23 bp, Homo sapiens
aattattttgagtggcaaaataa

SEQ ID NO: 479748 - DNA, 12 bp, Homo sapiens
aattctaaaatg

SEQ ID NO: 479749 - DNA, 17 bp, Homo sapiens
aattctcagaagtgaaa

SEQ ID NO: 479750 - DNA, 17 bp, Homo sapiens
aatttagaaatcatttt

SEQ ID NO: 479751 - DNA, 19 bp, Homo sapiens
aatttgaaaataattgttc

SEQ ID NO: 479752 - DNA, 13 bp, Homo sapiens
aatttttaaacaa

SEQ ID NO: 479753 - DNA, 19 bp, Homo sapiens
aatttttaaacaagtattt

SEQ ID NO: 479754 - DNA, 21 bp, Homo sapiens
acaaactcgttttttacaaag

SEQ ID NO: 479755 - DNA, 19 bp, Homo sapiens
acaaagagttcaagaaata

SEQ ID NO: 479756 - DNA, 16 bp, Homo sapiens
acaaagcccttttata

SEQ ID NO: 479757 - DNA, 20 bp, Homo sapiens
acaacatttctatagccaaa

SEQ ID NO: 479758 - DNA, 18 bp, Homo sapiens
acaagccttactcacctc

SEQ ID NO: 479759 - DNA, 21 bp, Homo sapiens
acaagccttactcacctctct

SEQ ID NO: 479760 - DNA, 17 bp, Homo sapiens
acaatgtttaaaccttt

SEQ ID NO: 479761 - DNA, 23 bp, Homo sapiens
acaattctaaaatgattgtagta

SEQ ID NO: 479762 - DNA, 19 bp, Homo sapiens
acacatactcatttttcat

SEQ ID NO: 479763 - DNA, 18 bp, Homo sapiens
acaccaacataaaaatga

SEQ ID NO: 479764 - DNA, 12 bp, Homo sapiens
acagaagaaaca

SEQ ID NO: 479765 - DNA, 18 bp, Homo sapiens
acagcatttcagctgtga

SEQ ID NO: 479766 - DNA, 20 bp, Homo sapiens
acagcctgacaacatttcta

SEQ ID NO: 479767 - DNA, 16 bp, Homo sapiens
acaggggaggctgaga

SEQ ID NO: 479768 - DNA, 19 bp, Homo sapiens
acaggtctcctcttaaaaa

SEQ ID NO: 479769 - DNA, 14 bp, Homo sapiens
acagtctaaagctg

SEQ ID NO: 479770 - DNA, 15 bp, Homo sapiens
acataaagttgataa

SEQ ID NO: 479771 - DNA, 18 bp, Homo sapiens
acataagccattattcac

SEQ ID NO: 479772 - DNA, 23 bp, Homo sapiens
acataattatccaggaagggaat

SEQ ID NO: 479773 - DNA, 16 bp, Homo sapiens
acatactcatttttca

SEQ ID NO: 479774 - DNA, 18 bp, Homo sapiens
acatagacagaagaaaca

SEQ ID NO: 479775 - DNA, 15 bp, Homo sapiens
acatcattcttgaga

SEQ ID NO: 479776 - DNA, 20 bp, Homo sapiens
acatccatttcatctatttc

SEQ ID NO: 479777 - DNA, 24 bp, Homo sapiens
acatgctaagagaagtagaaatca

SEQ ID NO: 479778 - DNA, 16 bp, Homo sapiens
acatgtccttgtgtgt

SEQ ID NO: 479779 - DNA, 14 bp, Homo sapiens
accaacataaaaat

SEQ ID NO: 479780 - DNA, 21 bp, Homo sapiens
accaagatacttaagtgctgc

SEQ ID NO: 479781 - DNA, 20 bp, Homo sapiens
accaggcaccaaaagaagta

SEQ ID NO: 479782 - DNA, 22 bp, Homo sapiens
accatagcacaggctaattttt

SEQ ID NO: 479783 - DNA, 23 bp, Homo sapiens
accatcttgggattcctcccctg

SEQ ID NO: 479784 - DNA, 20 bp, Homo sapiens
accatgccaggctaattttt

SEQ ID NO: 479785 - DNA, 15 bp, Homo sapiens
acccccatgccaatg

SEQ ID NO: 479786 - DNA, 15 bp, Homo sapiens
accgctaaaagaaac

SEQ ID NO: 479787 - DNA, 16 bp, Homo sapiens
accgctaaaagaaact

SEQ ID NO: 479788 - DNA, 22 bp, Homo sapiens
acctattgctgtaaataaaaat

SEQ ID NO: 479789 - DNA, 21 bp, Homo sapiens
acctcagtaatttagaaatca

SEQ ID NO: 479790 - DNA, 20 bp, Homo sapiens
acctccctgtctctacaaaa

SEQ ID NO: 479791 - DNA, 18 bp, Homo sapiens
acgtccagaatttttcat

SEQ ID NO: 479792 - DNA, 19 bp, Homo sapiens
acgtttaagccaaaacaat

SEQ ID NO: 479793 - DNA, 23 bp, Homo sapiens
acgtttaagccaaaacaatgttt

SEQ ID NO: 479794 - DNA, 15 bp, Homo sapiens
actaaatcttttata

SEQ ID NO: 479795 - DNA, 20 bp, Homo sapiens
actatcttactatttcacaa

SEQ ID NO: 479796 - DNA, 22 bp, Homo sapiens
actatctttttgcttacagttt

SEQ ID NO: 479797 - DNA, 19 bp, Homo sapiens
actatgaaaagctagaatt

SEQ ID NO: 479798 - DNA, 21 bp, Homo sapiens
actcggcctcccaaagtgctg

SEQ ID NO: 479799 - DNA, 16 bp, Homo sapiens
acttaaatagtatttc

SEQ ID NO: 479800 - DNA, 18 bp, Homo sapiens
acttaccaggcaccaaaa

SEQ ID NO: 479801 - DNA, 21 bp, Homo sapiens
acttaccaggcaccaaaagaa

SEQ ID NO: 479802 - DNA, 21 bp, Homo sapiens
atttaaaatgtgtttcttaca

SEQ ID NO: 479803 - DNA, 23 bp, Homo sapiens
atttaaaccgctaaaagaaactt

SEQ ID NO: 479804 - DNA, 24 bp, Homo sapiens
atttaaaccgctaaaagaaacttt

SEQ ID NO: 479805 - DNA, 20 bp, Homo sapiens
atttaaactataagcaagaa

SEQ ID NO: 479806 - DNA, 20 bp, Homo sapiens
atttaatagcaaagaattga

SEQ ID NO: 479807 - DNA, 16 bp, Homo sapiens
atttataacattgtaa

SEQ ID NO: 479808 - DNA, 17 bp, Homo sapiens
atttataacattgtaaa

SEQ ID NO: 479809 - DNA, 15 bp, Homo sapiens
atttatgtgtgaagc

SEQ ID NO: 479810 - DNA, 16 bp, Homo sapiens
atttatttaaaatagc

SEQ ID NO: 479811 - DNA, 12 bp, Homo sapiens
atttattttgac

SEQ ID NO: 479812 - DNA, 18 bp, Homo sapiens
atttcatctatttctgag

SEQ ID NO: 479813 - DNA, 19 bp, Homo sapiens
atttcatctatttctgaga

SEQ ID NO: 479814 - DNA, 13 bp, Homo sapiens
attttagcagaga

SEQ ID NO: 479815 - DNA, 15 bp, Homo sapiens
attttatattacact

SEQ ID NO: 479816 - DNA, 15 bp, Homo sapiens
attttattgaatata

SEQ ID NO: 479817 - DNA, 16 bp, Homo sapiens
attttcaagtggaaac

SEQ ID NO: 479818 - DNA, 19 bp, Homo sapiens
attttgaaaggagaaaaaa

SEQ ID NO: 479819 - DNA, 17 bp, Homo sapiens
attttgacataaagttg

SEQ ID NO: 479820 - DNA, 18 bp, Homo sapiens
attttgagtggcaaaata

SEQ ID NO: 479821 - DNA, 21 bp, Homo sapiens
attttgcaatcccttaatatc

SEQ ID NO: 479822 - DNA, 12 bp, Homo sapiens
attttgtaagtt

SEQ ID NO: 479823 - DNA, 14 bp, Homo sapiens
atttttaaacaagt

SEQ ID NO: 479824 - DNA, 17 bp, Homo sapiens
attttttaaaaaagctt

SEQ ID NO: 479825 - DNA, 19 bp, Homo sapiens
attttttaaaaaagcttaa

SEQ ID NO: 479826 - DNA, 14 bp, Homo sapiens
caaaaaaaaataca

SEQ ID NO: 479827 - DNA, 14 bp, Homo sapiens
caaaagaagaagtt

SEQ ID NO: 479828 - DNA, 12 bp, Homo sapiens
caaaagaagtaa

SEQ ID NO: 479829 - DNA, 19 bp, Homo sapiens
caaaataaagaatagcaat

SEQ ID NO: 479830 - DNA, 20 bp, Homo sapiens
caaaataaagaatagcaatt

SEQ ID NO: 479831 - DNA, 22 bp, Homo sapiens
caaaatgttgaaatatgatgtt

SEQ ID NO: 479832 - DNA, 14 bp, Homo sapiens
caaacgaaatggct

SEQ ID NO: 479833 - DNA, 14 bp, Homo sapiens
caaatcgaatgaaa

SEQ ID NO: 479834 - DNA, 22 bp, Homo sapiens
caaatcttggttgatgccaaaa

SEQ ID NO: 479835 - DNA, 22 bp, Homo sapiens
caaatgaatgttgtctgtttgt

SEQ ID NO: 479836 - DNA, 19 bp, Homo sapiens
caaatttgaaaataattgt

SEQ ID NO: 479837 - DNA, 23 bp, Homo sapiens
caacatgttatttgtaatagatg

SEQ ID NO: 479838 - DNA, 22 bp, Homo sapiens
caacatttctatagccaaaaat

SEQ ID NO: 479839 - DNA, 18 bp, Homo sapiens
caagaaataagtttttgt

SEQ ID NO: 479840 - DNA, 16 bp, Homo sapiens
caagaaggcaaaaata

SEQ ID NO: 479841 - DNA, 22 bp, Homo sapiens
caagcattcagaagaaaaagaa

SEQ ID NO: 479842 - DNA, 15 bp, Homo sapiens
caagcattctcctgt

SEQ ID NO: 479843 - DNA, 16 bp, Homo sapiens
caagccttactcacct

SEQ ID NO: 479844 - DNA, 20 bp, Homo sapiens
caagtatttgttaatttaga

SEQ ID NO: 479845 - DNA, 22 bp, Homo sapiens
caagtatttgttaatttagaaa

SEQ ID NO: 479846 - DNA, 15 bp, Homo sapiens
caagtctagtggaac

SEQ ID NO: 479847 - DNA, 15 bp, Homo sapiens
caataacgtttaagc

SEQ ID NO: 479848 - DNA, 23 bp, Homo sapiens
caataacgtttaagccaaaacaa

SEQ ID NO: 479849 - DNA, 14 bp, Homo sapiens
caatgtccaggtca

SEQ ID NO: 479850 - DNA, 13 bp, Homo sapiens
caattcaaagctg

SEQ ID NO: 479851 - DNA, 21 bp, Homo sapiens
caattgcacgcggagtgagtt

SEQ ID NO: 479852 - DNA, 21 bp, Homo sapiens
caatttatatttaataaaatt

SEQ ID NO: 479853 - DNA, 22 bp, Homo sapiens
cacaagccttactcacctctct

SEQ ID NO: 479854 - DNA, 19 bp, Homo sapiens
cacagataactgaaaatta

SEQ ID NO: 479855 - DNA, 22 bp, Homo sapiens
cacagataactgaaaattattt

SEQ ID NO: 479856 - DNA, 18 bp, Homo sapiens
cacatactcatttttcat

SEQ ID NO: 479857 - DNA, 21 bp, Homo sapiens
cacatccatttcatctatttc

SEQ ID NO: 479858 - DNA, 21 bp, Homo sapiens
caccatgccaggctaattttt

SEQ ID NO: 479859 - DNA, 20 bp, Homo sapiens
cacccaggctggagtacagt

SEQ ID NO: 479860 - DNA, 24 bp, Homo sapiens
caccgtgcccagccctaaacatca

SEQ ID NO: 479861 - DNA, 13 bp, Homo sapiens
cacctaaagaaaa

SEQ ID NO: 479862 - DNA, 22 bp, Homo sapiens
caccttctgtgcatctggcctg

SEQ ID NO: 479863 - DNA, 20 bp, Homo sapiens
cacgactgttgtacaagctc

SEQ ID NO: 479864 - DNA, 21 bp, Homo sapiens
cacgactgttgtacaagctca

SEQ ID NO: 479865 - DNA, 19 bp, Homo sapiens
cactgaagaaaccttcaga

SEQ ID NO: 479866 - DNA, 18 bp, Homo sapiens
cagaagctcaaggctgca

SEQ ID NO: 479867 - DNA, 14 bp, Homo sapiens
cagaagtgaaaaag

SEQ ID NO: 479868 - DNA, 18 bp, Homo sapiens
cagactgcatgtagttgg

SEQ ID NO: 479869 - DNA, 10 bp, Homo sapiens
cagcaactcc

SEQ ID NO: 479870 - DNA, 11 bp, Homo sapiens
cagcaactccc

SEQ ID NO: 479871 - DNA, 15 bp, Homo sapiens
cagcaactcccacga

SEQ ID NO: 479872 - DNA, 16 bp, Homo sapiens
cagccctaaacatcat

SEQ ID NO: 479873 - DNA, 16 bp, Homo sapiens
caggaaggactatgaa

SEQ ID NO: 479874 - DNA, 16 bp, Homo sapiens
caggaggcgaataaat

SEQ ID NO: 479875 - DNA, 17 bp, Homo sapiens
caggaggcgaataaatg

SEQ ID NO: 479876 - DNA, 15 bp, Homo sapiens
caggcaccaaaagaa

SEQ ID NO: 479877 - DNA, 16 bp, Homo sapiens
caggcaccaaaagaag

SEQ ID NO: 479878 - DNA, 20 bp, Homo sapiens
caggcatccgctgcgctccc

SEQ ID NO: 479879 - DNA, 23 bp, Homo sapiens
caggcctcagggaccaaggagat

SEQ ID NO: 479880 - DNA, 22 bp, Homo sapiens
caggctaatttttttgtatttt

SEQ ID NO: 479881 - DNA, 16 bp, Homo sapiens
caggctagagtgcagt

SEQ ID NO: 479882 - DNA, 15 bp, Homo sapiens
cagggaccaaggaga

SEQ ID NO: 479883 - DNA, 19 bp, Homo sapiens
cagggaccaaggagatggg

SEQ ID NO: 479884 - DNA, 23 bp, Homo sapiens
caggtaaactgatgctttcagat

SEQ ID NO: 479885 - DNA, 22 bp, Homo sapiens
caggtctcctcttaaaaaataa

SEQ ID NO: 479886 - DNA, 21 bp, Homo sapiens
cagtctcagaatgtcattttg

SEQ ID NO: 479887 - DNA, 16 bp, Homo sapiens
cagtgattgtcttaat

SEQ ID NO: 479888 - DNA, 19 bp, Homo sapiens
catagacagaagaaacaag

SEQ ID NO: 479889 - DNA, 21 bp, Homo sapiens
catagataccattttgaaata

SEQ ID NO: 479890 - DNA, 14 bp, Homo sapiens
catcattttttact

SEQ ID NO: 479891 - DNA, 23 bp, Homo sapiens
catccatttcatctatttctgag

SEQ ID NO: 479892 - DNA, 13 bp, Homo sapiens
catctatttctga

SEQ ID NO: 479893 - DNA, 17 bp, Homo sapiens
catctctgtaaaaagca

SEQ ID NO: 479894 - DNA, 17 bp, Homo sapiens
catctggcctgggggct

SEQ ID NO: 479895 - DNA, 16 bp, Homo sapiens
catgagcaattctcct

SEQ ID NO: 479896 - DNA, 18 bp, Homo sapiens
catgataatgaacagaac

SEQ ID NO: 479897 - DNA, 17 bp, Homo sapiens
catgctaagagaagtag

SEQ ID NO: 479898 - DNA, 14 bp, Homo sapiens
catgtaatcagttt

SEQ ID NO: 479899 - DNA, 20 bp, Homo sapiens
catgtttgtctgtgtgctgt

SEQ ID NO: 479900 - DNA, 21 bp, Homo sapiens
catgtttgtctgtgtgctgta

SEQ ID NO: 479901 - DNA, 17 bp, Homo sapiens
cattcatttttgttgtt

SEQ ID NO: 479902 - DNA, 13 bp, Homo sapiens
catttatgtgtga

SEQ ID NO: 479903 - DNA, 18 bp, Homo sapiens
catttcatctatttctga

SEQ ID NO: 479904 - DNA, 14 bp, Homo sapiens
cattttggtacttt

SEQ ID NO: 479905 - DNA, 22 bp, Homo sapiens
ccaagagctacgtatttaatag

SEQ ID NO: 479906 - DNA, 18 bp, Homo sapiens
ccaagctctagtgggaag

SEQ ID NO: 479907 - DNA, 18 bp, Homo sapiens
ccacaagccttactcacc

SEQ ID NO: 479908 - DNA, 20 bp, Homo sapiens
ccacaagccttactcacctc

SEQ ID NO: 479909 - DNA, 21 bp, Homo sapiens
ccacaagccttactcacctct

SEQ ID NO: 479910 - DNA, 16 bp, Homo sapiens
ccacagataactgaaa

SEQ ID NO: 479911 - DNA, 17 bp, Homo sapiens
ccaccatgcccagtcga

SEQ ID NO: 479912 - DNA, 17 bp, Homo sapiens
ccacctcggacaccatc

SEQ ID NO: 479913 - DNA, 18 bp, Homo sapiens
ccaggcacggaggctcgt

SEQ ID NO: 479914 - DNA, 17 bp, Homo sapiens
ccatttcatctatttct

SEQ ID NO: 479915 - DNA, 21 bp, Homo sapiens
ccatttcatctatttctgaga

SEQ ID NO: 479916 - DNA, 14 bp, Homo sapiens
ccattttgaaatat

SEQ ID NO: 479917 - DNA, 22 bp, Homo sapiens
cccacaagccttactcacctct

SEQ ID NO: 479918 - DNA, 14 bp, Homo sapiens
gggcgtgttgtttt

SEQ ID NO: 479919 - DNA, 18 bp, Homo sapiens
gggtgtaacaggtctcct

SEQ ID NO: 479920 - DNA, 17 bp, Homo sapiens
ggtaacttgctgtgaaa

SEQ ID NO: 479921 - DNA, 11 bp, Homo sapiens
ggtcacaggca

SEQ ID NO: 479922 - DNA, 14 bp, Homo sapiens
ggtggcttttgcgg

SEQ ID NO: 479923 - DNA, 23 bp, Homo sapiens
ggtggcttttgcggttcaggaaa

SEQ ID NO: 479924 - DNA, 18 bp, Homo sapiens
gtaaaagcaaaaaagaaa

SEQ ID NO: 479925 - DNA, 14 bp, Homo sapiens
gtaaataaaaatag

SEQ ID NO: 479926 - DNA, 16 bp, Homo sapiens
gtaacaggtctcctct

SEQ ID NO: 479927 - DNA, 18 bp, Homo sapiens
gtaatttagaaatcattt

SEQ ID NO: 479928 - DNA, 21 bp, Homo sapiens
gtacatttatgtgtgaagcaa

SEQ ID NO: 479929 - DNA, 18 bp, Homo sapiens
gtagacacgctcttctat

SEQ ID NO: 479930 - DNA, 19 bp, Homo sapiens
gtaggactttcctaaatgt

SEQ ID NO: 479931 - DNA, 14 bp, Homo sapiens
gtatatattttgaa

SEQ ID NO: 479932 - DNA, 21 bp, Homo sapiens
gtatattgatgtaactgtgtc

SEQ ID NO: 479933 - DNA, 18 bp, Homo sapiens
gtatcaatccttgttcag

SEQ ID NO: 479934 - DNA, 17 bp, Homo sapiens
gtatttgttaatttaga

SEQ ID NO: 479935 - DNA, 13 bp, Homo sapiens
gtcaatgaaaagc

SEQ ID NO: 479936 - DNA, 20 bp, Homo sapiens
gtcacccaggctggagtaca

SEQ ID NO: 479937 - DNA, 20 bp, Homo sapiens
gtcccttgtttccagctaga

SEQ ID NO: 479938 - DNA, 20 bp, Homo sapiens
gtctctacaaaaaaaatcaa

SEQ ID NO: 479939 - DNA, 15 bp, Homo sapiens
gtctgtgtgctgtaa

SEQ ID NO: 479940 - DNA, 18 bp, Homo sapiens
gtcttgtttaatatttgt

SEQ ID NO: 479941 - DNA, 14 bp, Homo sapiens
gtgaagaatacttc

SEQ ID NO: 479942 - DNA, 15 bp, Homo sapiens
gtgagaaatttaaac

SEQ ID NO: 479943 - DNA, 17 bp, Homo sapiens
gtgcaatgtaaatattt

SEQ ID NO: 479944 - DNA, 14 bp, Homo sapiens
gtgcatctggcctg

SEQ ID NO: 479945 - DNA, 17 bp, Homo sapiens
gtgtaacaggtctcctc

SEQ ID NO: 479946 - DNA, 21 bp, Homo sapiens
gtgtgttttgagagtatatta

SEQ ID NO: 479947 - DNA, 12 bp, Homo sapiens
gtgttaattttt

SEQ ID NO: 479948 - DNA, 13 bp, Homo sapiens
gttaattaaacaa

SEQ ID NO: 479949 - DNA, 16 bp, Homo sapiens
gttatttgtaatagat

SEQ ID NO: 479950 - DNA, 18 bp, Homo sapiens
gttcaatgctacaaaatg

SEQ ID NO: 479951 - DNA, 21 bp, Homo sapiens
gttcaatgctacaaaatgtgt

SEQ ID NO: 479952 - DNA, 15 bp, Homo sapiens
gttccaaatgaatgt

SEQ ID NO: 479953 - DNA, 19 bp, Homo sapiens
gttccaaatgaatgttgtc

SEQ ID NO: 479954 - DNA, 12 bp, Homo sapiens
gttgagacagag

SEQ ID NO: 479955 - DNA, 13 bp, Homo sapiens
gttgtcctttctg

SEQ ID NO: 479956 - DNA, 19 bp, Homo sapiens
gttgttatcatttaagatt

SEQ ID NO: 479957 - DNA, 20 bp, Homo sapiens
gtttggatatgtaaaacatt

SEQ ID NO: 479958 - DNA, 21 bp, Homo sapiens
gtttggatatgtaaaacattt

SEQ ID NO: 479959 - DNA, 13 bp, Homo sapiens
gtttgtctgtgtg

SEQ ID NO: 479960 - DNA, 17 bp, Homo sapiens
gttttgctacataatta

SEQ ID NO: 479961 - DNA, 12 bp, Homo sapiens
gtttttaatgta

SEQ ID NO: 479962 - DNA, 22 bp, Homo sapiens
gtttttgttcaccttctgtgca

SEQ ID NO: 479963 - DNA, 22 bp, Homo sapiens
taaaaaaataagaagaatgctt

SEQ ID NO: 479964 - DNA, 19 bp, Homo sapiens
taaaaaactaaaaactaga

SEQ ID NO: 479965 - DNA, 12 bp, Homo sapiens
taaaacaaaatc

SEQ ID NO: 479966 - DNA, 17 bp, Homo sapiens
taaaacttactatggta

SEQ ID NO: 479967 - DNA, 21 bp, Homo sapiens
taaaactttgaagttagcttt

SEQ ID NO: 479968 - DNA, 18 bp, Homo sapiens
taaaagcaaaaaagaaaa

SEQ ID NO: 479969 - DNA, 19 bp, Homo sapiens
taaaagcaaaaaagaaaac

SEQ ID NO: 479970 - DNA, 22 bp, Homo sapiens
taaaagcaaaaaagaaaacctt

SEQ ID NO: 479971 - DNA, 16 bp, Homo sapiens
taaaatgattgtagta

SEQ ID NO: 479972 - DNA, 13 bp, Homo sapiens
taaacaagtattt

SEQ ID NO: 479973 - DNA, 12 bp, Homo sapiens
taaactagcaaa

SEQ ID NO: 479974 - DNA, 22 bp, Homo sapiens
taaagattttttaataatttag

SEQ ID NO: 479975 - DNA, 19 bp, Homo sapiens
taaagctggtttaatgttt

SEQ ID NO: 479976 - DNA, 15 bp, Homo sapiens
taaagttcaacatgt

SEQ ID NO: 479977 - DNA, 16 bp, Homo sapiens
taaagttgataaagat

SEQ ID NO: 479978 - DNA, 13 bp, Homo sapiens
taaataagaaact

SEQ ID NO: 479979 - DNA, 21 bp, Homo sapiens
taaatatatctatattattgt

SEQ ID NO: 479980 - DNA, 14 bp, Homo sapiens
taaatattttaaag

SEQ ID NO: 479981 - DNA, 17 bp, Homo sapiens
taaatattttaaagaat

SEQ ID NO: 479982 - DNA, 18 bp, Homo sapiens
taaatattttaaagaatt

SEQ ID NO: 479983 - DNA, 21 bp, Homo sapiens
taaatcacgctttttgaaaaa

SEQ ID NO: 479984 - DNA, 21 bp, Homo sapiens
taaatctaaattaacttctat

SEQ ID NO: 479985 - DNA, 23 bp, Homo sapiens
taaatcttttataggatttattt

SEQ ID NO: 479986 - DNA, 12 bp, Homo sapiens
taaatgaaatac

SEQ ID NO: 479987 - DNA, 15 bp, Homo sapiens
taaatgaaatacttg

SEQ ID NO: 479988 - DNA, 16 bp, Homo sapiens
taaatgttcaaactgt

SEQ ID NO: 479989 - DNA, 13 bp, Homo sapiens
taacaaagtgaga

SEQ ID NO: 479990 - DNA, 14 bp, Homo sapiens
taacacatgtcctt

SEQ ID NO: 479991 - DNA, 14 bp, Homo sapiens
taacaggtctcctc

SEQ ID NO: 479992 - DNA, 18 bp, Homo sapiens
taacaggtctcctcttaa

SEQ ID NO: 479993 - DNA, 12 bp, Homo sapiens
taacattgtaaa

SEQ ID NO: 479994 - DNA, 15 bp, Homo sapiens
taacattgtaaatga

SEQ ID NO: 479995 - DNA, 17 bp, Homo sapiens
taacattgtaaatgata

SEQ ID NO: 479996 - DNA, 20 bp, Homo sapiens
taacgtttaagccaaaacaa

SEQ ID NO: 479997 - DNA, 14 bp, Homo sapiens
taacttaaatagta

SEQ ID NO: 479998 - DNA, 16 bp, Homo sapiens
taacttgctgtgaaat

SEQ ID NO: 479999 - DNA, 19 bp, Homo sapiens
taacttgctgtgaaatgac

SEQ ID NO: 480000 - DNA, 21 bp, Homo sapiens
taagaaacttttttatttaaa

SEQ ID NO: 480001 - DNA, 14 bp, Homo sapiens
taagagaagtagaa

SEQ ID NO: 480002 - DNA, 17 bp, Homo sapiens
taagatctatagcctct

SEQ ID NO: 480003 - DNA, 14 bp, Homo sapiens
taagcaagaaggca

SEQ ID NO: 480004 - DNA, 22 bp, Homo sapiens
taaggtcagtgttataaaatct

SEQ ID NO: 480005 - DNA, 16 bp, Homo sapiens
taagtttagaagcgct

SEQ ID NO: 480006 - DNA, 16 bp, Homo sapiens
taatgaaacaaagagt

SEQ ID NO: 480007 - DNA, 17 bp, Homo sapiens
taatgaaacaaagagtt

SEQ ID NO: 480008 - DNA, 22 bp, Homo sapiens
taatggctgataattttaaatt

SEQ ID NO: 480009 - DNA, 15 bp, Homo sapiens
taattaaatgaaata

SEQ ID NO: 480010 - DNA, 16 bp, Homo sapiens
taattcaattcaaagc

SEQ ID NO: 480011 - DNA, 15 bp, Homo sapiens
taatttagaaaactt

SEQ ID NO: 480012 - DNA, 13 bp, Homo sapiens
taattttaaattc

SEQ ID NO: 480013 - DNA, 23 bp, Homo sapiens
taatttttgatactaagcattga

SEQ ID NO: 480014 - DNA, 22 bp, Homo sapiens
tacaaaaaaaatcaaaaaatta

SEQ ID NO: 480015 - DNA, 21 bp, Homo sapiens
tacaagaagcattttgtaagt

SEQ ID NO: 480016 - DNA, 19 bp, Homo sapiens
tacagaacacgctttcaca

SEQ ID NO: 480017 - DNA, 14 bp, Homo sapiens
tacagtctaaagct

SEQ ID NO: 480018 - DNA, 15 bp, Homo sapiens
tacagtctaaagctg

SEQ ID NO: 480019 - DNA, 17 bp, Homo sapiens
tacatgctaagagaagt

SEQ ID NO: 480020 - DNA, 21 bp, Homo sapiens
taccaggcaccaaaagaagta

SEQ ID NO: 480021 - DNA, 11 bp, Homo sapiens
tactcattttt

SEQ ID NO: 480022 - DNA, 16 bp, Homo sapiens
tagaaaactttaaagc

SEQ ID NO: 480023 - DNA, 13 bp, Homo sapiens
tagaaatcatttt

SEQ ID NO: 480024 - DNA, 16 bp, Homo sapiens
tagaagcgctcatctg

SEQ ID NO: 480025 - DNA, 17 bp, Homo sapiens
tagaggtgagaaattta

SEQ ID NO: 480026 - DNA, 16 bp, Homo sapiens
tagatatgagaaatat

SEQ ID NO: 480027 - DNA, 14 bp, Homo sapiens
tagcaaaagaagaa

SEQ ID NO: 480028 - DNA, 23 bp, Homo sapiens
tagcaaaaggatgatttaacatt

SEQ ID NO: 480029 - DNA, 16 bp, Homo sapiens
tagccaaaaatagcta

SEQ ID NO: 480030 - DNA, 15 bp, Homo sapiens
tagctataaatagtg

SEQ ID NO: 480031 - DNA, 22 bp, Homo sapiens
tagctttaacttaaatagtatt

SEQ ID NO: 480032 - DNA, 18 bp, Homo sapiens
taggacatctctgtaaaa

SEQ ID NO: 480033 - DNA, 18 bp, Homo sapiens
tagtgaaaattttattga

SEQ ID NO: 480034 - DNA, 22 bp, Homo sapiens
tagtttttgttcaccttctgtg

SEQ ID NO: 480035 - DNA, 23 bp, Homo sapiens
ttcaaagctgtgtgtttggaaga

SEQ ID NO: 480036 - DNA, 19 bp, Homo sapiens
ttcaaagtttaataaattt

SEQ ID NO: 480037 - DNA, 14 bp, Homo sapiens
ttcaacaattctaa

SEQ ID NO: 480038 - DNA, 18 bp, Homo sapiens
ttcaacaattctaaaatg

SEQ ID NO: 480039 - DNA, 19 bp, Homo sapiens
ttcaacaattctaaaatga

SEQ ID NO: 480040 - DNA, 17 bp, Homo sapiens
ttcaacatgttatttgt

SEQ ID NO: 480041 - DNA, 19 bp, Homo sapiens
ttcacagcctataaccaga

SEQ ID NO: 480042 - DNA, 15 bp, Homo sapiens
ttcaccttctgtgca

SEQ ID NO: 480043 - DNA, 21 bp, Homo sapiens
ttcaccttctgtgcatctggc

SEQ ID NO: 480044 - DNA, 12 bp, Homo sapiens
ttcagaagaaaa

SEQ ID NO: 480045 - DNA, 14 bp, Homo sapiens
ttcatataaagtat

SEQ ID NO: 480046 - DNA, 16 bp, Homo sapiens
ttcatctatttctgag

SEQ ID NO: 480047 - DNA, 17 bp, Homo sapiens
ttccaaatgaatgttgt

SEQ ID NO: 480048 - DNA, 21 bp, Homo sapiens
ttccaaatgaatgttgtctgt

SEQ ID NO: 480049 - DNA, 15 bp, Homo sapiens
ttcctcccctggaag

SEQ ID NO: 480050 - DNA, 18 bp, Homo sapiens
ttcgcttgcttctgcagc

SEQ ID NO: 480051 - DNA, 21 bp, Homo sapiens
ttcggccaatttatgcagagt

SEQ ID NO: 480052 - DNA, 14 bp, Homo sapiens
ttctaaaatgcctt

SEQ ID NO: 480053 - DNA, 20 bp, Homo sapiens
ttctacttcttgtgctttac

SEQ ID NO: 480054 - DNA, 15 bp, Homo sapiens
ttctatagccaaaaa

SEQ ID NO: 480055 - DNA, 15 bp, Homo sapiens
ttctcagaagtgaaa

SEQ ID NO: 480056 - DNA, 21 bp, Homo sapiens
ttctcagaagtgaaaaagact

SEQ ID NO: 480057 - DNA, 22 bp, Homo sapiens
ttctcagaagtgaaaaagactt

SEQ ID NO: 480058 - DNA, 18 bp, Homo sapiens
ttcttaaataagaaactt

SEQ ID NO: 480059 - DNA, 13 bp, Homo sapiens
ttcttacagactg

SEQ ID NO: 480060 - DNA, 14 bp, Homo sapiens
ttcttttcccattt

SEQ ID NO: 480061 - DNA, 20 bp, Homo sapiens
ttgaagcaaatcgaatgaaa

SEQ ID NO: 480062 - DNA, 20 bp, Homo sapiens
ttgaatggctatgtttttaa

SEQ ID NO: 480063 - DNA, 15 bp, Homo sapiens
ttgatactaagcatt

SEQ ID NO: 480064 - DNA, 14 bp, Homo sapiens
ttgatgccaaaaaa

SEQ ID NO: 480065 - DNA, 17 bp, Homo sapiens
ttgccttgatgttgtgt

SEQ ID NO: 480066 - DNA, 22 bp, Homo sapiens
ttgctaagataattaaatgaaa

SEQ ID NO: 480067 - DNA, 16 bp, Homo sapiens
ttgctacataattatc

SEQ ID NO: 480068 - DNA, 14 bp, Homo sapiens
ttgctctggctgag

SEQ ID NO: 480069 - DNA, 15 bp, Homo sapiens
ttgctgtaaataaaa

SEQ ID NO: 480070 - DNA, 19 bp, Homo sapiens
ttggatatgtaaaacattt

SEQ ID NO: 480071 - DNA, 20 bp, Homo sapiens
ttggatatgtaaaacattta

SEQ ID NO: 480072 - DNA, 20 bp, Homo sapiens
ttgggtgtaacaggtctcct

SEQ ID NO: 480073 - DNA, 23 bp, Homo sapiens
ttgggtgtaacaggtctcctctt

SEQ ID NO: 480074 - DNA, 17 bp, Homo sapiens
ttggtaacttgctgtga

SEQ ID NO: 480075 - DNA, 15 bp, Homo sapiens
ttgtacaagctcagg

SEQ ID NO: 480076 - DNA, 16 bp, Homo sapiens
ttgtacgttaattaaa

SEQ ID NO: 480077 - DNA, 18 bp, Homo sapiens
ttgtcctttctgatcctc

SEQ ID NO: 480078 - DNA, 17 bp, Homo sapiens
ttgtcttaatattgtgg

SEQ ID NO: 480079 - DNA, 18 bp, Homo sapiens
ttgtgcaatgtaaatatt

SEQ ID NO: 480080 - DNA, 17 bp, Homo sapiens
ttgtgcccactgtctct

SEQ ID NO: 480081 - DNA, 13 bp, Homo sapiens
ttgtgggtgggag

SEQ ID NO: 480082 - DNA, 20 bp, Homo sapiens
ttgttaatttagaaaacttt

SEQ ID NO: 480083 - DNA, 15 bp, Homo sapiens
ttgttcaccttctgt

SEQ ID NO: 480084 - DNA, 16 bp, Homo sapiens
ttgttgtttttaagat

SEQ ID NO: 480085 - DNA, 15 bp, Homo sapiens
tttaaaaaactaaaa

SEQ ID NO: 480086 - DNA, 21 bp, Homo sapiens
tttaaaaaactaaaaactaga

SEQ ID NO: 480087 - DNA, 17 bp, Homo sapiens
tttaaaaaagcttaaaa

SEQ ID NO: 480088 - DNA, 20 bp, Homo sapiens
tttaaaaaagcttaaaactt

SEQ ID NO: 480089 - DNA, 21 bp, Homo sapiens
tttaaaccgctaaaagaaact

SEQ ID NO: 480090 - DNA, 22 bp, Homo sapiens
tttaaaccgctaaaagaaactt

SEQ ID NO: 480091 - DNA, 11 bp, Homo sapiens
tttaaaccttt

SEQ ID NO: 480092 - DNA, 13 bp, Homo sapiens
tttaacttaaata

SEQ ID NO: 480093 - DNA, 14 bp, Homo sapiens
tttaacttaaatag

SEQ ID NO: 480094 - DNA, 12 bp, Homo sapiens
tttaagccaaaa

SEQ ID NO: 480095 - DNA, 14 bp, Homo sapiens
tttaataaatttat

SEQ ID NO: 480096 - DNA, 11 bp, Homo sapiens
tttaataattt

SEQ ID NO: 480097 - DNA, 18 bp, Homo sapiens
tttaatagcaaagaattg

SEQ ID NO: 480098 - DNA, 12 bp, Homo sapiens
tttagaaaactt

SEQ ID NO: 480099 - DNA, 13 bp, Homo sapiens
tttagaaaacttt

SEQ ID NO: 480100 - DNA, 15 bp, Homo sapiens
tttagaaaactttaa

SEQ ID NO: 480101 - DNA, 16 bp, Homo sapiens
tttatcgcagaccttt

SEQ ID NO: 480102 - DNA, 16 bp, Homo sapiens
tttatctgaattttta

SEQ ID NO: 480103 - DNA, 20 bp, Homo sapiens
tttcaaactcctgactttgt

SEQ ID NO: 480104 - DNA, 23 bp, Homo sapiens
tttcaacaagtagctaaagtctg

SEQ ID NO: 480105 - DNA, 15 bp, Homo sapiens
tttcaccacattcgt

SEQ ID NO: 480106 - DNA, 16 bp, Homo sapiens
tttcacctatctggaa

SEQ ID NO: 480107 - DNA, 13 bp, Homo sapiens
tttcatcattttt

SEQ ID NO: 480108 - DNA, 13 bp, Homo sapiens
tttcctaaatgtt

SEQ ID NO: 480109 - DNA, 18 bp, Homo sapiens
tttccttcaaagtttaat

SEQ ID NO: 480110 - DNA, 15 bp, Homo sapiens
tttcgcttgcttctg

SEQ ID NO: 480111 - DNA, 15 bp, Homo sapiens
tttctccaagagcta

SEQ ID NO: 480112 - DNA, 19 bp, Homo sapiens
tttctgagaaggtccttaa

SEQ ID NO: 480113 - DNA, 20 bp, Homo sapiens
tttcttaaataagaaacttt

SEQ ID NO: 480114 - DNA, 16 bp, Homo sapiens
tttgaagttagcttta

SEQ ID NO: 480115 - DNA, 16 bp, Homo sapiens
tttgatactaagcatt

SEQ ID NO: 480116 - DNA, 23 bp, Homo sapiens
tttggccaatgcacctaaagaaa

SEQ ID NO: 480117 - DNA, 16 bp, Homo sapiens
tttgtaagttgaagca

SEQ ID NO: 480118 - DNA, 20 bp, Homo sapiens
tttgttcaccttctgtgcat

SEQ ID NO: 480119 - DNA, 15 bp, Homo sapiens
ttttaaaaaagctta

SEQ ID NO: 480120 - DNA, 20 bp, Homo sapiens
ttttaaaaaagcttaaaact

SEQ ID NO: 480121 - DNA, 13 bp, Homo sapiens
ttttatttaaaaa

SEQ ID NO: 480122 - DNA, 21 bp, Homo sapiens
ttttcgcttgcttctgcagca

SEQ ID NO: 480123 - DNA, 16 bp, Homo sapiens
ttttgaatccatgctt

SEQ ID NO: 480124 - DNA, 21 bp, Homo sapiens
ttttgcggttcaggaaaattg

SEQ ID NO: 480125 - DNA, 18 bp, Homo sapiens
ttttgtacgttaattaaa

SEQ ID NO: 480126 - DNA, 19 bp, Homo sapiens
ttttgtacgttaattaaac

SEQ ID NO: 480127 - DNA, 17 bp, Homo sapiens
ttttgttcaccttctgt

SEQ ID NO: 480128 - DNA, 19 bp, Homo sapiens
ttttgttgtttcttaaata

SEQ ID NO: 480129 - DNA, 15 bp, Homo sapiens
tttttaaaaaagctt

SEQ ID NO: 480130 - DNA, 17 bp, Homo sapiens
tttttaaaaaagcttaa

SEQ ID NO: 480131 - DNA, 18 bp, Homo sapiens
tttttaatgtatagtaaa

SEQ ID NO: 480132 - DNA, 18 bp, Homo sapiens
tttttccttcaaagttta

SEQ ID NO: 480133 - DNA, 19 bp, Homo sapiens
tttttccttcaaagtttaa

SEQ ID NO: 480134 - DNA, 14 bp, Homo sapiens
tttttggtaattat

SEQ ID NO: 480135 - DNA, 14 bp, Homo sapiens
ttttttggtaatta

SEQ ID NO: 480136 - DNA, 19 bp, Homo sapiens
ccaaaaaaaaatacatgct

SEQ ID NO: 480137 - DNA, 12 bp, Homo sapiens
ccaaaaatagct

SEQ ID NO: 480138 - DNA, 13 bp, Homo sapiens
ccaaaaatagcta

SEQ ID NO: 480139 - DNA, 15 bp, Homo sapiens
ccaacataaaaatga

SEQ ID NO: 480140 - DNA, 19 bp, Homo sapiens
ccaacgatcatatctgtat

SEQ ID NO: 480141 - DNA, 19 bp, Homo sapiens
ccaatgtccaggtcacagg

SEQ ID NO: 480142 - DNA, 16 bp, Homo sapiens
ccacaagccttactca

SEQ ID NO: 480143 - DNA, 19 bp, Homo sapiens
ccagaagctcaaggctgca

SEQ ID NO: 480144 - DNA, 20 bp, Homo sapiens
ccagctacaggggaggctga

SEQ ID NO: 480145 - DNA, 12 bp, Homo sapiens
ccatcttgggat

SEQ ID NO: 480146 - DNA, 13 bp, Homo sapiens
ccatgccaatgtc

SEQ ID NO: 480147 - DNA, 15 bp, Homo sapiens
ccatgcttgggtgta

SEQ ID NO: 480148 - DNA, 15 bp, Homo sapiens
ccattcctgttctct

SEQ ID NO: 480149 - DNA, 16 bp, Homo sapiens
ccatttcatctatttc

SEQ ID NO: 480150 - DNA, 15 bp, Homo sapiens
ccatttcctcctggg

SEQ ID NO: 480151 - DNA, 21 bp, Homo sapiens
cccacaagccttactcacctc

SEQ ID NO: 480152 - DNA, 14 bp, Homo sapiens
cccagctaattttt

SEQ ID NO: 480153 - DNA, 15 bp, Homo sapiens
cccatgccaatgtcc

SEQ ID NO: 480154 - DNA, 16 bp, Homo sapiens
cccatgccaatgtcca

SEQ ID NO: 480155 - DNA, 21 bp, Homo sapiens
ccccggcctgatggccaggcc

SEQ ID NO: 480156 - DNA, 19 bp, Homo sapiens
cccggcctgatggccaggc

SEQ ID NO: 480157 - DNA, 18 bp, Homo sapiens
ccgctaaaagaaactttc

SEQ ID NO: 480158 - DNA, 16 bp, Homo sapiens
cctaaagaaaaacaaa

SEQ ID NO: 480159 - DNA, 24 bp, Homo sapiens
cctattgctgtaaataaaaatagc

SEQ ID NO: 480160 - DNA, 19 bp, Homo sapiens
cctattgtgcaatgtaaat

SEQ ID NO: 480161 - DNA, 22 bp, Homo sapiens
cctgaaaaggtttatgaaaaag

SEQ ID NO: 480162 - DNA, 20 bp, Homo sapiens
cctgagagaaactgaggtca

SEQ ID NO: 480163 - DNA, 16 bp, Homo sapiens
cctgatgctcatatca

SEQ ID NO: 480164 - DNA, 16 bp, Homo sapiens
cctgatggccaggcct

SEQ ID NO: 480165 - DNA, 19 bp, Homo sapiens
cctgcctggaggagaagga

SEQ ID NO: 480166 - DNA, 20 bp, Homo sapiens
cctgggggctgttagctcag

SEQ ID NO: 480167 - DNA, 22 bp, Homo sapiens
cctgggggctgttagctcagag

SEQ ID NO: 480168 - DNA, 21 bp, Homo sapiens
cctgggtaacaaagtgagacc

SEQ ID NO: 480169 - DNA, 21 bp, Homo sapiens
ccttactcacctctctctaag

SEQ ID NO: 480170 - DNA, 14 bp, Homo sapiens
cgaataaatgttca

SEQ ID NO: 480171 - DNA, 21 bp, Homo sapiens
cgactgttgtacaagctcagg

SEQ ID NO: 480172 - DNA, 22 bp, Homo sapiens
cgcccacaagccttactcacct

SEQ ID NO: 480173 - DNA, 13 bp, Homo sapiens
cgcttgcttctgc

SEQ ID NO: 480174 - DNA, 15 bp, Homo sapiens
cgcttgcttctgcag

SEQ ID NO: 480175 - DNA, 14 bp, Homo sapiens
cgttaattaaacaa

SEQ ID NO: 480176 - DNA, 13 bp, Homo sapiens
ctaaaagaaactt

SEQ ID NO: 480177 - DNA, 23 bp, Homo sapiens
ctaaacatcattcatttttgttg

SEQ ID NO: 480178 - DNA, 13 bp, Homo sapiens
ctaaagaaaaaca

SEQ ID NO: 480179 - DNA, 17 bp, Homo sapiens
ctaagagaagtagaaat

SEQ ID NO: 480180 - DNA, 22 bp, Homo sapiens
ctaagataattaaatgaaatac

SEQ ID NO: 480181 - DNA, 23 bp, Homo sapiens
ctaaggagtgtagcaactacagt

SEQ ID NO: 480182 - DNA, 21 bp, Homo sapiens
ctaaggtcagtgttataaaat

SEQ ID NO: 480183 - DNA, 18 bp, Homo sapiens
ctaagtaaatctaaatta

SEQ ID NO: 480184 - DNA, 16 bp, Homo sapiens
ctaattttttgttgtt

SEQ ID NO: 480185 - DNA, 16 bp, Homo sapiens
ctaatttttttgtatt

SEQ ID NO: 480186 - DNA, 23 bp, Homo sapiens
ctacaaaaaaaatcaaaaaatta

SEQ ID NO: 480187 - DNA, 21 bp, Homo sapiens
ctactgtaagcaagaaaaata

SEQ ID NO: 480188 - DNA, 19 bp, Homo sapiens
ctagaattgagtgtttaaa

SEQ ID NO: 480189 - DNA, 16 bp, Homo sapiens
ctagatatgagaaata

SEQ ID NO: 480190 - DNA, 20 bp, Homo sapiens
ctagcactttgggaggctga

SEQ ID NO: 480191 - DNA, 21 bp, Homo sapiens
ctatgaaaagctagaattgag

SEQ ID NO: 480192 - DNA, 20 bp, Homo sapiens
ctattgctgtaaataaaaat

SEQ ID NO: 480193 - DNA, 13 bp, Homo sapiens
ctatttctgagaa

SEQ ID NO: 480194 - DNA, 16 bp, Homo sapiens
ctcaatcagtctcaga

SEQ ID NO: 480195 - DNA, 14 bp, Homo sapiens
ctcacctctctcta

SEQ ID NO: 480196 - DNA, 18 bp, Homo sapiens
ctcagaggagaggagcaa

SEQ ID NO: 480197 - DNA, 18 bp, Homo sapiens
ctcaggaggcgaataaat

SEQ ID NO: 480198 - DNA, 19 bp, Homo sapiens
ctcaggaggcgaataaatg

SEQ ID NO: 480199 - DNA, 23 bp, Homo sapiens
ctcaggaggcgaataaatgttca

SEQ ID NO: 480200 - DNA, 13 bp, Homo sapiens
ctcagtaatttag

SEQ ID NO: 480201 - DNA, 11 bp, Homo sapiens
ctcatctcagt

SEQ ID NO: 480202 - DNA, 15 bp, Homo sapiens
ctccattccagtctc

SEQ ID NO: 480203 - DNA, 14 bp, Homo sapiens
ctcccaccaggcta

SEQ ID NO: 480204 - DNA, 15 bp, Homo sapiens
ctctaagtttagaag

SEQ ID NO: 480205 - DNA, 23 bp, Homo sapiens
ctctctggggcagggttattcct

SEQ ID NO: 480206 - DNA, 16 bp, Homo sapiens
ctcttaaaaaataaaa

SEQ ID NO: 480207 - DNA, 16 bp, Homo sapiens
ctcttcttttcccatt

SEQ ID NO: 480208 - DNA, 20 bp, Homo sapiens
ctctttgccttgatgttgtg

SEQ ID NO: 480209 - DNA, 20 bp, Homo sapiens
ctcttttgaatccatgcttg

SEQ ID NO: 480210 - DNA, 17 bp, Homo sapiens
ctgaaaattatttaaac

SEQ ID NO: 480211 - DNA, 13 bp, Homo sapiens
ctgactccttaga

SEQ ID NO: 480212 - DNA, 17 bp, Homo sapiens
ctgagaaggtccttaat

SEQ ID NO: 480213 - DNA, 17 bp, Homo sapiens
ctgataattttaaattc

SEQ ID NO: 480214 - DNA, 18 bp, Homo sapiens
ctgataattttaaattct

SEQ ID NO: 480215 - DNA, 15 bp, Homo sapiens
ctgcagcaactccca

SEQ ID NO: 480216 - DNA, 16 bp, Homo sapiens
ctggaagttgtccttt

SEQ ID NO: 480217 - DNA, 18 bp, Homo sapiens
ctggaggagaaggaggaa

SEQ ID NO: 480218 - DNA, 20 bp, Homo sapiens
ctggcagtttatatttaact

SEQ ID NO: 480219 - DNA, 14 bp, Homo sapiens
ctggcctgggggct

SEQ ID NO: 480220 - DNA, 20 bp, Homo sapiens
ctgggattacaggcatgagc

SEQ ID NO: 480221 - DNA, 13 bp, Homo sapiens
ctgggcatgtttg

SEQ ID NO: 480222 - DNA, 14 bp, Homo sapiens
ctggtttaatgttt

SEQ ID NO: 480223 - DNA, 17 bp, Homo sapiens
ctgtaaataaaaatagc

SEQ ID NO: 480224 - DNA, 20 bp, Homo sapiens
ctgtcacccaggctggagta

SEQ ID NO: 480225 - DNA, 22 bp, Homo sapiens
ctgtctctacaaaaaaaatcaa

SEQ ID NO: 480226 - DNA, 16 bp, Homo sapiens
ctgtgcatctggcctg

SEQ ID NO: 480227 - DNA, 23 bp, Homo sapiens
ctgtggattttttccttcaaagt

SEQ ID NO: 480228 - DNA, 17 bp, Homo sapiens
ctgttagctcagaggag

SEQ ID NO: 480229 - DNA, 12 bp, Homo sapiens
ctgttgtacaag

SEQ ID NO: 480230 - DNA, 21 bp, Homo sapiens
cttaatcagatagatattcct

SEQ ID NO: 480231 - DNA, 21 bp, Homo sapiens
cttaatgatccgttccattgc

SEQ ID NO: 480232 - DNA, 18 bp, Homo sapiens
cttatatgtgtattgcta

SEQ ID NO: 480233 - DNA, 18 bp, Homo sapiens
cttcagatttgtgttata

SEQ ID NO: 480234 - DNA, 15 bp, Homo sapiens
cttctgcagcaactc

SEQ ID NO: 480235 - DNA, 23 bp, Homo sapiens
cttctgcagcaactcccacgact

SEQ ID NO: 480236 - DNA, 12 bp, Homo sapiens
cttctgtgcatc

SEQ ID NO: 480237 - DNA, 21 bp, Homo sapiens
cttgcttctgcagcaactccc

SEQ ID NO: 480238 - DNA, 22 bp, Homo sapiens
cttgcttctgcagcaactccca

SEQ ID NO: 480239 - DNA, 19 bp, Homo sapiens
cttgtgtgttttgagagta

SEQ ID NO: 480240 - DNA, 16 bp, Homo sapiens
ctttaaaacttactat

SEQ ID NO: 480241 - DNA, 18 bp, Homo sapiens
ctttgccttgatgttgtg

SEQ ID NO: 480242 - DNA, 18 bp, Homo sapiens
cttttagttgtatctctt

SEQ ID NO: 480243 - DNA, 21 bp, Homo sapiens
cttttataggatttatttaaa

SEQ ID NO: 480244 - DNA, 22 bp, Homo sapiens
cttttcccaaaatgttgaaata

SEQ ID NO: 480245 - DNA, 21 bp, Homo sapiens
cttttcgcttgcttctgcagc

SEQ ID NO: 480246 - DNA, 21 bp, Homo sapiens
cttttgaatccatgcttgggt

SEQ ID NO: 480247 - DNA, 22 bp, Homo sapiens
cttttgtacgttaattaaacaa

SEQ ID NO: 480248 - DNA, 11 bp, Homo sapiens
gaaaaaattag

SEQ ID NO: 480249 - DNA, 15 bp, Homo sapiens
gaaaacctttcttca

SEQ ID NO: 480250 - DNA, 12 bp, Homo sapiens
gaaaactttaaa

SEQ ID NO: 480251 - DNA, 17 bp, Homo sapiens
gaaaaggtttatgaaaa

SEQ ID NO: 480252 - DNA, 22 bp, Homo sapiens
gaaaaggtttatgaaaaagaag

SEQ ID NO: 480253 - DNA, 21 bp, Homo sapiens
gaaaattcctattgattttct

SEQ ID NO: 480254 - DNA, 19 bp, Homo sapiens
tcggcctcccaaagtgctg

SEQ ID NO: 480255 - DNA, 20 bp, Homo sapiens
tctacaaaaaaaatcaaaaa

SEQ ID NO: 480256 - DNA, 12 bp, Homo sapiens
tctagtgggaag

SEQ ID NO: 480257 - DNA, 20 bp, Homo sapiens
tctcagaagtgaaaaagact

SEQ ID NO: 480258 - DNA, 16 bp, Homo sapiens
tctcagtgaagaatac

SEQ ID NO: 480259 - DNA, 19 bp, Homo sapiens
tctcatctcagtgaagaat

SEQ ID NO: 480260 - DNA, 13 bp, Homo sapiens
tctcgatctcctg

SEQ ID NO: 480261 - DNA, 21 bp, Homo sapiens
tctctctaagtttagaagcgc

SEQ ID NO: 480262 - DNA, 15 bp, Homo sapiens
tctctgtaaaaagca

SEQ ID NO: 480263 - DNA, 19 bp, Homo sapiens
tctctttatgtctgtggat

SEQ ID NO: 480264 - DNA, 15 bp, Homo sapiens
tctgaacaattctct

SEQ ID NO: 480265 - DNA, 15 bp, Homo sapiens
tctgcagcaactccc

SEQ ID NO: 480266 - DNA, 21 bp, Homo sapiens
tctgcagcaactcccacgact

SEQ ID NO: 480267 - DNA, 19 bp, Homo sapiens
tctggaaaaaaaaaaatat

SEQ ID NO: 480268 - DNA, 22 bp, Homo sapiens
tctgtgcatctggcctgggggc

SEQ ID NO: 480269 - DNA, 15 bp, Homo sapiens
tctgttgccaggcta

SEQ ID NO: 480270 - DNA, 18 bp, Homo sapiens
tcttaaaaaataaaaact

SEQ ID NO: 480271 - DNA, 18 bp, Homo sapiens
tcttaaaaattatcttta

SEQ ID NO: 480272 - DNA, 20 bp, Homo sapiens
tcttaaaaattatctttaaa

SEQ ID NO: 480273 - DNA, 23 bp, Homo sapiens
tcttaacacatgtccttgtgtgt

SEQ ID NO: 480274 - DNA, 22 bp, Homo sapiens
tcttcggccaatttatgcagag

SEQ ID NO: 480275 - DNA, 15 bp, Homo sapiens
tcttctacttcttgt

SEQ ID NO: 480276 - DNA, 13 bp, Homo sapiens
tcttggctcactg

SEQ ID NO: 480277 - DNA, 14 bp, Homo sapiens
tcttgggattcctc

SEQ ID NO: 480278 - DNA, 18 bp, Homo sapiens
tctttctcactaaatctt

SEQ ID NO: 480279 - DNA, 17 bp, Homo sapiens
tctttgccttgatgttg

SEQ ID NO: 480280 - DNA, 21 bp, Homo sapiens
tcttttcccatttacaaatga

SEQ ID NO: 480281 - DNA, 18 bp, Homo sapiens
tgaaaaagacttcaaatg

SEQ ID NO: 480282 - DNA, 13 bp, Homo sapiens
tgaaaaagcgaaa

SEQ ID NO: 480283 - DNA, 14 bp, Homo sapiens
tgaaacaaagagtt

SEQ ID NO: 480284 - DNA, 22 bp, Homo sapiens
tgaaattaactgggtaatgaaa

SEQ ID NO: 480285 - DNA, 15 bp, Homo sapiens
tgaatgcaaaccata

SEQ ID NO: 480286 - DNA, 21 bp, Homo sapiens
tgaatggctatgtttttaatg

SEQ ID NO: 480287 - DNA, 21 bp, Homo sapiens
tgaatgttgtctgtttgttct

SEQ ID NO: 480288 - DNA, 15 bp, Homo sapiens
tgaatttattattgt

SEQ ID NO: 480289 - DNA, 23 bp, Homo sapiens
tgacaacatttctatagccaaaa

SEQ ID NO: 480290 - DNA, 18 bp, Homo sapiens
tgacactcatcaggtaaa

SEQ ID NO: 480291 - DNA, 18 bp, Homo sapiens
tgacctcgtgatccaccc

SEQ ID NO: 480292 - DNA, 23 bp, Homo sapiens
tgactgtagtttttgttcacctt

SEQ ID NO: 480293 - DNA, 16 bp, Homo sapiens
tgactttcctatgaca

SEQ ID NO: 480294 - DNA, 15 bp, Homo sapiens
tgagaaatataaaaa

SEQ ID NO: 480295 - DNA, 18 bp, Homo sapiens
tgagaaatataaaaataa

SEQ ID NO: 480296 - DNA, 15 bp, Homo sapiens
tgagaaatttaaact

SEQ ID NO: 480297 - DNA, 19 bp, Homo sapiens
tgagagtatattatgtatt

SEQ ID NO: 480298 - DNA, 22 bp, Homo sapiens
tgagtgtacatttatgtgtgaa

SEQ ID NO: 480299 - DNA, 19 bp, Homo sapiens
tgagttggttacctattgc

SEQ ID NO: 480300 - DNA, 14 bp, Homo sapiens
tgataattttaaat

SEQ ID NO: 480301 - DNA, 16 bp, Homo sapiens
tgatactaagcattga

SEQ ID NO: 480302 - DNA, 16 bp, Homo sapiens
tgatatgtctttaaaa

SEQ ID NO: 480303 - DNA, 13 bp, Homo sapiens
tgatggccaggcc

SEQ ID NO: 480304 - DNA, 14 bp, Homo sapiens
tgatggccaggcct

SEQ ID NO: 480305 - DNA, 14 bp, Homo sapiens
tgattcacttttat

SEQ ID NO: 480306 - DNA, 20 bp, Homo sapiens
tgattgtagtaatctgcatt

SEQ ID NO: 480307 - DNA, 14 bp, Homo sapiens
tgattgtcttaata

SEQ ID NO: 480308 - DNA, 18 bp, Homo sapiens
tgattgtcttaatattgt

SEQ ID NO: 480309 - DNA, 13 bp, Homo sapiens
tgcacctaaagaa

SEQ ID NO: 480310 - DNA, 21 bp, Homo sapiens
tgcacctaaagaaaaacaaac

SEQ ID NO: 480311 - DNA, 21 bp, Homo sapiens
tgcactcttttgagcagtaaa

SEQ ID NO: 480312 - DNA, 15 bp, Homo sapiens
tgcatctggcctggg

SEQ ID NO: 480313 - DNA, 23 bp, Homo sapiens
tgccaatgtccaggtcacaggca

SEQ ID NO: 480314 - DNA, 21 bp, Homo sapiens
tgcccagtcgatatctcactt

SEQ ID NO: 480315 - DNA, 14 bp, Homo sapiens
tgccgtggcaactg

SEQ ID NO: 480316 - DNA, 16 bp, Homo sapiens
tgctaagagaagtaga

SEQ ID NO: 480317 - DNA, 15 bp, Homo sapiens
tgctacaaaatgtgt

SEQ ID NO: 480318 - DNA, 14 bp, Homo sapiens
tgctatggttttct

SEQ ID NO: 480319 - DNA, 16 bp, Homo sapiens
tgctgtaaataaaaat

SEQ ID NO: 480320 - DNA, 15 bp, Homo sapiens
tgctgtgaaatgact

SEQ ID NO: 480321 - DNA, 21 bp, Homo sapiens
tgcttctgcagcaactcccac

SEQ ID NO: 480322 - DNA, 21 bp, Homo sapiens
tggaaaatgttctgacagcat

SEQ ID NO: 480323 - DNA, 22 bp, Homo sapiens
tggaatataattgttttatctg

SEQ ID NO: 480324 - DNA, 15 bp, Homo sapiens
tggaggagaaggagg

SEQ ID NO: 480325 - DNA, 14 bp, Homo sapiens
tggcaactgtggaa

SEQ ID NO: 480326 - DNA, 16 bp, Homo sapiens
tggcagtttatattta

SEQ ID NO: 480327 - DNA, 22 bp, Homo sapiens
tggccaatgcacctaaagaaaa

SEQ ID NO: 480328 - DNA, 16 bp, Homo sapiens
tggccaggcctcaggg

SEQ ID NO: 480329 - DNA, 13 bp, Homo sapiens
tggctatgttttt

SEQ ID NO: 480330 - DNA, 14 bp, Homo sapiens
tggctgataatttt

SEQ ID NO: 480331 - DNA, 21 bp, Homo sapiens
tggcttttcgcttgcttctgc

SEQ ID NO: 480332 - DNA, 20 bp, Homo sapiens
tggggtatggattctaaaat

SEQ ID NO: 480333 - DNA, 14 bp, Homo sapiens
tgggtgttaatttt

SEQ ID NO: 480334 - DNA, 15 bp, Homo sapiens
tggttacctattgct

SEQ ID NO: 480335 - DNA, 15 bp, Homo sapiens
tggttcacactgacc

SEQ ID NO: 480336 - DNA, 18 bp, Homo sapiens
tggttgatgccaaaaaaa

SEQ ID NO: 480337 - DNA, 17 bp, Homo sapiens
tggtttcccaagagcta

SEQ ID NO: 480338 - DNA, 19 bp, Homo sapiens
tggttttctccaagagcta

SEQ ID NO: 480339 - DNA, 19 bp, Homo sapiens
tgtaaataaaaatagctat

SEQ ID NO: 480340 - DNA, 18 bp, Homo sapiens
tgtaaatattttaaagaa

SEQ ID NO: 480341 - DNA, 20 bp, Homo sapiens
tgtaaatattttaaagaatt

SEQ ID NO: 480342 - DNA, 21 bp, Homo sapiens
tgtaacaggtctcctcttaaa

SEQ ID NO: 480343 - DNA, 16 bp, Homo sapiens
tgtacatttatgtgtg

SEQ ID NO: 480344 - DNA, 20 bp, Homo sapiens
tgtacatttatgtgtgaagc

SEQ ID NO: 480345 - DNA, 17 bp, Homo sapiens
tgtagaacctaattcaa

SEQ ID NO: 480346 - DNA, 20 bp, Homo sapiens
tgtagcaactacagtctaaa

SEQ ID NO: 480347 - DNA, 19 bp, Homo sapiens
tgtagtaatctgcattatt

SEQ ID NO: 480348 - DNA, 21 bp, Homo sapiens
tgtatattgatgtaactgtgt

SEQ ID NO: 480349 - DNA, 21 bp, Homo sapiens
tgtatttatattttgtgctat

SEQ ID NO: 480350 - DNA, 18 bp, Homo sapiens
tgtcagcttttgcttcat

SEQ ID NO: 480351 - DNA, 15 bp, Homo sapiens
tgtccttgtgtgttt

SEQ ID NO: 480352 - DNA, 20 bp, Homo sapiens
tgtctctacaaaaaaaatca

SEQ ID NO: 480353 - DNA, 14 bp, Homo sapiens
tgtctgtgtgctgt

SEQ ID NO: 480354 - DNA, 14 bp, Homo sapiens
tgtgagatgtaatt

SEQ ID NO: 480355 - DNA, 17 bp, Homo sapiens
tgtgatgctttgaagta

SEQ ID NO: 480356 - DNA, 16 bp, Homo sapiens
tgtgcatctggcctgg

SEQ ID NO: 480357 - DNA, 20 bp, Homo sapiens
tgtgcatctggcctgggggc

SEQ ID NO: 480358 - DNA, 21 bp, Homo sapiens
tgtgcatctggcctgggggct

SEQ ID NO: 480359 - DNA, 22 bp, Homo sapiens
tgtggaaggcacactgagcaag

SEQ ID NO: 480360 - DNA, 13 bp, Homo sapiens
tgtgggtgggaga

SEQ ID NO: 480361 - DNA, 19 bp, Homo sapiens
tgttaaaaaaataagaaga

SEQ ID NO: 480362 - DNA, 23 bp, Homo sapiens
tgttaaaaaaataagaagaatgc

SEQ ID NO: 480363 - DNA, 15 bp, Homo sapiens
tgttaatttagaaaa

SEQ ID NO: 480364 - DNA, 17 bp, Homo sapiens
tgttaatttagaaaact

SEQ ID NO: 480365 - DNA, 13 bp, Homo sapiens
tgttaatttttga

SEQ ID NO: 480366 - DNA, 13 bp, Homo sapiens
tgttataaaatct

SEQ ID NO: 480367 - DNA, 21 bp, Homo sapiens
tgttataaaatctgtattgct

SEQ ID NO: 480368 - DNA, 22 bp, Homo sapiens
tgttatcaaacaccaacataaa

SEQ ID NO: 480369 - DNA, 20 bp, Homo sapiens
tgttattcaataactattgc

SEQ ID NO: 480370 - DNA, 17 bp, Homo sapiens
tgttatttgtaatagat

SEQ ID NO: 480371 - DNA, 15 bp, Homo sapiens
tgttcaccttctgtg

SEQ ID NO: 480372 - DNA, 16 bp, Homo sapiens
ggcaacagagtgagac

SEQ ID NO: 480373 - DNA, 14 bp, Homo sapiens
ggcctgatggccag

SEQ ID NO: 480374 - DNA, 19 bp, Homo sapiens
ggcctgatggccaggcctc

SEQ ID NO: 480375 - DNA, 15 bp, Homo sapiens
ggcgaataaatgttc

SEQ ID NO: 480376 - DNA, 16 bp, Homo sapiens
ggcgaataaatgttca

SEQ ID NO: 480377 - DNA, 17 bp, Homo sapiens
ggcgaataaatgttcaa

SEQ ID NO: 480378 - DNA, 15 bp, Homo sapiens
ggctgataattttaa

SEQ ID NO: 480379 - DNA, 20 bp, Homo sapiens
ggctggagttcagtggtgtg

SEQ ID NO: 480380 - DNA, 20 bp, Homo sapiens
ggctgttagctcagaggaga

SEQ ID NO: 480381 - DNA, 21 bp, Homo sapiens
ggcttttcgcttgcttctgca

SEQ ID NO: 480382 - DNA, 12 bp, Homo sapiens
gggaggctgaga

SEQ ID NO: 480383 - DNA, 15 bp, Homo sapiens
gggatgactgtgatt

SEQ ID NO: 480384 - DNA, 20 bp, Homo sapiens
gggattcctcccctggaagt

SEQ ID NO: 480385 - DNA, 23 bp, Homo sapiens
gggcatgtttgtctgtgtgctgt

SEQ ID NO: 480386 - DNA, 18 bp, Homo sapiens
gggctgttagctcagagg

SEQ ID NO: 480387 - DNA, 23 bp, Homo sapiens
gggggctgttagctcagaggaga

SEQ ID NO: 480388 - DNA, 17 bp, Homo sapiens
gggtaacaaagtgagac

SEQ ID NO: 480389 - DNA, 20 bp, Homo sapiens
gggtttcaccatgttggcca

SEQ ID NO: 480390 - DNA, 13 bp, Homo sapiens
ggtgagaaattta

SEQ ID NO: 480391 - DNA, 15 bp, Homo sapiens
ggtgagaaatttaaa

SEQ ID NO: 480392 - DNA, 14 bp, Homo sapiens
ggtgttaatttttg

SEQ ID NO: 480393 - DNA, 12 bp, Homo sapiens
gtaaaagcaaaa

SEQ ID NO: 480394 - DNA, 23 bp, Homo sapiens
gtaaatattttaaagaattgtgt

SEQ ID NO: 480395 - DNA, 15 bp, Homo sapiens
gtaaatgatatgtct

SEQ ID NO: 480396 - DNA, 21 bp, Homo sapiens
gtaacaggtctcctcttaaaa

SEQ ID NO: 480397 - DNA, 21 bp, Homo sapiens
gtaacttgctgtgaaatgact

SEQ ID NO: 480398 - DNA, 17 bp, Homo sapiens
gtaatagattatagttg

SEQ ID NO: 480399 - DNA, 15 bp, Homo sapiens
gtacaagaagcattt

SEQ ID NO: 480400 - DNA, 15 bp, Homo sapiens
gtacaagctcaggag

SEQ ID NO: 480401 - DNA, 14 bp, Homo sapiens
gtacatttatgtgt

SEQ ID NO: 480402 - DNA, 17 bp, Homo sapiens
gtagctgggactacagg

SEQ ID NO: 480403 - DNA, 21 bp, Homo sapiens
gtagtttttgttcaccttctg

SEQ ID NO: 480404 - DNA, 18 bp, Homo sapiens
gtatatattttgaaagga

SEQ ID NO: 480405 - DNA, 16 bp, Homo sapiens
gtatattatgtattta

SEQ ID NO: 480406 - DNA, 21 bp, Homo sapiens
gtatattatgtatttatattt

SEQ ID NO: 480407 - DNA, 23 bp, Homo sapiens
gtatattatgtatttatattttg

SEQ ID NO: 480408 - DNA, 13 bp, Homo sapiens
gtatcatcagtgt

SEQ ID NO: 480409 - DNA, 15 bp, Homo sapiens
gtccaggtcacaggc

SEQ ID NO: 480410 - DNA, 16 bp, Homo sapiens
gtccaggtcacaggca

SEQ ID NO: 480411 - DNA, 20 bp, Homo sapiens
gtccttaatgatccgttcca

SEQ ID NO: 480412 - DNA, 14 bp, Homo sapiens
gtctcctcttaaaa

SEQ ID NO: 480413 - DNA, 15 bp, Homo sapiens
gtgagatgtaattgt

SEQ ID NO: 480414 - DNA, 13 bp, Homo sapiens
gtgcaatgtaaat

SEQ ID NO: 480415 - DNA, 20 bp, Homo sapiens
gtgcaatgtaaatattttaa

SEQ ID NO: 480416 - DNA, 19 bp, Homo sapiens
gtgctgtaacctgaagtca

SEQ ID NO: 480417 - DNA, 17 bp, Homo sapiens
gtggcacacaactgtgg

SEQ ID NO: 480418 - DNA, 18 bp, Homo sapiens
gtgtacatttatgtgtga

SEQ ID NO: 480419 - DNA, 16 bp, Homo sapiens
gtgtagcaactacagt

SEQ ID NO: 480420 - DNA, 20 bp, Homo sapiens
gtgtgttttgagagtatatt

SEQ ID NO: 480421 - DNA, 15 bp, Homo sapiens
gtgttaatttttgat

SEQ ID NO: 480422 - DNA, 12 bp, Homo sapiens
gttaatttttga

SEQ ID NO: 480423 - DNA, 11 bp, Homo sapiens
gttagctcaga

SEQ ID NO: 480424 - DNA, 13 bp, Homo sapiens
gttagctcagagg

SEQ ID NO: 480425 - DNA, 21 bp, Homo sapiens
gttagctcagaggagaggagc

SEQ ID NO: 480426 - DNA, 14 bp, Homo sapiens
attctaaaatgatt

SEQ ID NO: 480427 - DNA, 20 bp, Homo sapiens
attctaaaatgattgtagta

SEQ ID NO: 480428 - DNA, 19 bp, Homo sapiens
attctcagaagtgaaaaag

SEQ ID NO: 480429 - DNA, 17 bp, Homo sapiens
attctgaagccattgtc

SEQ ID NO: 480430 - DNA, 17 bp, Homo sapiens
attctgtcaatgaaaag

SEQ ID NO: 480431 - DNA, 15 bp, Homo sapiens
attgtctccttgagt

SEQ ID NO: 480432 - DNA, 16 bp, Homo sapiens
attgtcttaatattgt

SEQ ID NO: 480433 - DNA, 22 bp, Homo sapiens
atttaaaaaactaaaaactaga

SEQ ID NO: 480434 - DNA, 22 bp, Homo sapiens
atttaaaatagcaaaagaagaa

SEQ ID NO: 480435 - DNA, 19 bp, Homo sapiens
atttaaaccgctaaaagaa

SEQ ID NO: 480436 - DNA, 20 bp, Homo sapiens
atttaaaccgctaaaagaaa

SEQ ID NO: 480437 - DNA, 22 bp, Homo sapiens
atttaaaccgctaaaagaaact

SEQ ID NO: 480438 - DNA, 22 bp, Homo sapiens
atttactcattcatttattcat

SEQ ID NO: 480439 - DNA, 14 bp, Homo sapiens
atttagaaaacttt

SEQ ID NO: 480440 - DNA, 17 bp, Homo sapiens
atttagaaaactttaaa

SEQ ID NO: 480441 - DNA, 18 bp, Homo sapiens
atttagaaaactttaaag

SEQ ID NO: 480442 - DNA, 15 bp, Homo sapiens
atttataacattgta

SEQ ID NO: 480443 - DNA, 12 bp, Homo sapiens
atttatgtgtga

SEQ ID NO: 480444 - DNA, 13 bp, Homo sapiens
atttattttgaca

SEQ ID NO: 480445 - DNA, 15 bp, Homo sapiens
atttcatctatttct

SEQ ID NO: 480446 - DNA, 16 bp, Homo sapiens
atttcatctatttctg

SEQ ID NO: 480447 - DNA, 23 bp, Homo sapiens
atttctagatatgagaaatataa

SEQ ID NO: 480448 - DNA, 17 bp, Homo sapiens
atttctatagccaaaaa

SEQ ID NO: 480449 - DNA, 18 bp, Homo sapiens
atttgaaaataattgttc

SEQ ID NO: 480450 - DNA, 17 bp, Homo sapiens
atttgtaatagatgttt

SEQ ID NO: 480451 - DNA, 19 bp, Homo sapiens
atttgttaatttagaaaac

SEQ ID NO: 480452 - DNA, 23 bp, Homo sapiens
atttgttaatttagaaaacttta

SEQ ID NO: 480453 - DNA, 12 bp, Homo sapiens
attttaaagaat

SEQ ID NO: 480454 - DNA, 13 bp, Homo sapiens
attttattgaata

SEQ ID NO: 480455 - DNA, 12 bp, Homo sapiens
attttgaaatat

SEQ ID NO: 480456 - DNA, 15 bp, Homo sapiens
atttttaaacaagta

SEQ ID NO: 480457 - DNA, 16 bp, Homo sapiens
atttttagtaaagaca

SEQ ID NO: 480458 - DNA, 21 bp, Homo sapiens
atttttgatactaagcattga

SEQ ID NO: 480459 - DNA, 14 bp, Homo sapiens
attttttaataatt

SEQ ID NO: 480460 - DNA, 20 bp, Homo sapiens
attttttccttcaaagttta

SEQ ID NO: 480461 - DNA, 22 bp, Homo sapiens
attttttttttttggtaattat

SEQ ID NO: 480462 - DNA, 12 bp, Homo sapiens
caaaaaagaaaa

SEQ ID NO: 480463 - DNA, 14 bp, Homo sapiens
caaaaaagaaaacc

SEQ ID NO: 480464 - DNA, 16 bp, Homo sapiens
caaaacaatgtttaaa

SEQ ID NO: 480465 - DNA, 18 bp, Homo sapiens
caaaacaatgtttaaacc

SEQ ID NO: 480466 - DNA, 17 bp, Homo sapiens
caaaagaagtaaaagca

SEQ ID NO: 480467 - DNA, 19 bp, Homo sapiens
caaaatgtgtgcttggaaa

SEQ ID NO: 480468 - DNA, 16 bp, Homo sapiens
caaacaccaacataaa

SEQ ID NO: 480469 - DNA, 18 bp, Homo sapiens
caaacaccaacataaaaa

SEQ ID NO: 480470 - DNA, 16 bp, Homo sapiens
caaagagttcaagaaa

SEQ ID NO: 480471 - DNA, 16 bp, Homo sapiens
caaatgatttcgtgac

SEQ ID NO: 480472 - DNA, 19 bp, Homo sapiens
caactacagtctaaagctg

SEQ ID NO: 480473 - DNA, 22 bp, Homo sapiens
caagagctacgtatttaatagc

SEQ ID NO: 480474 - DNA, 21 bp, Homo sapiens
caagcatggctattttatatt

SEQ ID NO: 480475 - DNA, 16 bp, Homo sapiens
caagcattcagaagaa

SEQ ID NO: 480476 - DNA, 17 bp, Homo sapiens
caagcattcagaagaaa

SEQ ID NO: 480477 - DNA, 17 bp, Homo sapiens
caagccttactcacctc

SEQ ID NO: 480478 - DNA, 16 bp, Homo sapiens
caagtatttgttaatt

SEQ ID NO: 480479 - DNA, 22 bp, Homo sapiens
caatcccttaatatcctaaaca

SEQ ID NO: 480480 - DNA, 20 bp, Homo sapiens
caatgctacaaaatgtgtgc

SEQ ID NO: 480481 - DNA, 14 bp, Homo sapiens
caatgtaaatattt

SEQ ID NO: 480482 - DNA, 20 bp, Homo sapiens
caatgtccaggtcacaggca

SEQ ID NO: 480483 - DNA, 17 bp, Homo sapiens
caattctctttagttct

SEQ ID NO: 480484 - DNA, 23 bp, Homo sapiens
caattgcacgcggagtgagtttt

SEQ ID NO: 480485 - DNA, 13 bp, Homo sapiens
caatttatgcaga

SEQ ID NO: 480486 - DNA, 20 bp, Homo sapiens
cacaagccttactcacctct

SEQ ID NO: 480487 - DNA, 21 bp, Homo sapiens
cacacagtattaagtgacagt

SEQ ID NO: 480488 - DNA, 18 bp, Homo sapiens
cacacatggctaattttt

SEQ ID NO: 480489 - DNA, 23 bp, Homo sapiens
cacatccatttcatctatttctg

SEQ ID NO: 480490 - DNA, 17 bp, Homo sapiens
cacatgtccttgtgtgt

SEQ ID NO: 480491 - DNA, 22 bp, Homo sapiens
cacattcttaacacatgtcctt

SEQ ID NO: 480492 - DNA, 12 bp, Homo sapiens
cacctaaagaaa

SEQ ID NO: 480493 - DNA, 15 bp, Homo sapiens
caccttctgtgcatc

SEQ ID NO: 480494 - DNA, 19 bp, Homo sapiens
cacgacctcggctcactgc

SEQ ID NO: 480495 - DNA, 20 bp, Homo sapiens
cactgccatttcctcctggg

SEQ ID NO: 480496 - DNA, 19 bp, Homo sapiens
cacttttattgtataatta

SEQ ID NO: 480497 - DNA, 21 bp, Homo sapiens
ttctatagccaaaaatagcta

SEQ ID NO: 480498 - DNA, 23 bp, Homo sapiens
ttctatagccaaaaatagctaaa

SEQ ID NO: 480499 - DNA, 16 bp, Homo sapiens
ttctcagaagtgaaaa

SEQ ID NO: 480500 - DNA, 22 bp, Homo sapiens
ttctcattttttaaaaaagctt

SEQ ID NO: 480501 - DNA, 16 bp, Homo sapiens
ttctccaagagctaca

SEQ ID NO: 480502 - DNA, 16 bp, Homo sapiens
ttctgatcctctcttc

SEQ ID NO: 480503 - DNA, 17 bp, Homo sapiens
ttctgcagcaactccca

SEQ ID NO: 480504 - DNA, 20 bp, Homo sapiens
ttctgcagcaactcccacga

SEQ ID NO: 480505 - DNA, 14 bp, Homo sapiens
ttctgtcaatgaaa

SEQ ID NO: 480506 - DNA, 18 bp, Homo sapiens
ttctgtgcatctggcctg

SEQ ID NO: 480507 - DNA, 23 bp, Homo sapiens
ttctgtgcatctggcctgggggc

SEQ ID NO: 480508 - DNA, 21 bp, Homo sapiens
ttctttaagaattacaggttg

SEQ ID NO: 480509 - DNA, 15 bp, Homo sapiens
ttctttctcactaaa

SEQ ID NO: 480510 - DNA, 22 bp, Homo sapiens
ttctttggtttcccaagagcta

SEQ ID NO: 480511 - DNA, 19 bp, Homo sapiens
ttgaagttagctttaactt

SEQ ID NO: 480512 - DNA, 23 bp, Homo sapiens
ttgaagttagctttaacttaaat

SEQ ID NO: 480513 - DNA, 15 bp, Homo sapiens
ttgaatgcaaaccat

SEQ ID NO: 480514 - DNA, 16 bp, Homo sapiens
ttgaatgcaaaccata

SEQ ID NO: 480515 - DNA, 16 bp, Homo sapiens
ttgaatggctatgttt

SEQ ID NO: 480516 - DNA, 19 bp, Homo sapiens
ttgacataaagttgataaa

SEQ ID NO: 480517 - DNA, 22 bp, Homo sapiens
ttgataaagattttttaataat

SEQ ID NO: 480518 - DNA, 22 bp, Homo sapiens
ttgatgccaaaaaaaaatacat

SEQ ID NO: 480519 - DNA, 23 bp, Homo sapiens
ttgctaagataattaaatgaaat

SEQ ID NO: 480520 - DNA, 17 bp, Homo sapiens
ttgctgtgaaatgactg

SEQ ID NO: 480521 - DNA, 14 bp, Homo sapiens
ttgcttctgcagca

SEQ ID NO: 480522 - DNA, 22 bp, Homo sapiens
ttgcttctgcagcaactcccac

SEQ ID NO: 480523 - DNA, 22 bp, Homo sapiens
ttggccaatgcacctaaagaaa

SEQ ID NO: 480524 - DNA, 23 bp, Homo sapiens
ttggccaatgcacctaaagaaaa

SEQ ID NO: 480525 - DNA, 12 bp, Homo sapiens
ttgggaggctga

SEQ ID NO: 480526 - DNA, 15 bp, Homo sapiens
ttgggatatctcctg

SEQ ID NO: 480527 - DNA, 20 bp, Homo sapiens
ttgggattcctcccctggaa

SEQ ID NO: 480528 - DNA, 23 bp, Homo sapiens
ttggttccacaatcatctattga

SEQ ID NO: 480529 - DNA, 21 bp, Homo sapiens
ttggttttgctacataattat

SEQ ID NO: 480530 - DNA, 21 bp, Homo sapiens
ttgtaatagatgtttgataga

SEQ ID NO: 480531 - DNA, 17 bp, Homo sapiens
ttgtgcaatgtaaatat

SEQ ID NO: 480532 - DNA, 22 bp, Homo sapiens
ttgtgcaatgtaaatattttaa

SEQ ID NO: 480533 - DNA, 19 bp, Homo sapiens
ttgtgtctggcagtttata

SEQ ID NO: 480534 - DNA, 22 bp, Homo sapiens
ttgttaatttagaaaactttaa

SEQ ID NO: 480535 - DNA, 14 bp, Homo sapiens
ttgttatcatttaa

SEQ ID NO: 480536 - DNA, 12 bp, Homo sapiens
ttgtttcttaaa

SEQ ID NO: 480537 - DNA, 23 bp, Homo sapiens
tttaaaaaagcttaaaactttga

SEQ ID NO: 480538 - DNA, 12 bp, Homo sapiens
tttaaaatagca

SEQ ID NO: 480539 - DNA, 17 bp, Homo sapiens
tttaaaccgctaaaaga

SEQ ID NO: 480540 - DNA, 23 bp, Homo sapiens
tttaaaccgctaaaagaaacttt

SEQ ID NO: 480541 - DNA, 17 bp, Homo sapiens
tttaaagcgtttgcaca

SEQ ID NO: 480542 - DNA, 20 bp, Homo sapiens
tttaagccaaaacaatgttt

SEQ ID NO: 480543 - DNA, 17 bp, Homo sapiens
tttaatagcaaagaatt

SEQ ID NO: 480544 - DNA, 18 bp, Homo sapiens
tttaatgtatagtaaatc

SEQ ID NO: 480545 - DNA, 23 bp, Homo sapiens
tttacaaatgatttcgtgactgt

SEQ ID NO: 480546 - DNA, 16 bp, Homo sapiens
tttagaaaactttaaa

SEQ ID NO: 480547 - DNA, 13 bp, Homo sapiens
tttagaaatcatt

SEQ ID NO: 480548 - DNA, 18 bp, Homo sapiens
tttagaaatcattttgca

SEQ ID NO: 480549 - DNA, 15 bp, Homo sapiens
tttagacttcaagca

SEQ ID NO: 480550 - DNA, 20 bp, Homo sapiens
tttagttgtatctcttttga

SEQ ID NO: 480551 - DNA, 22 bp, Homo sapiens
tttatttaaaaaactaaaaact

SEQ ID NO: 480552 - DNA, 16 bp, Homo sapiens
tttcatctatttctga

SEQ ID NO: 480553 - DNA, 18 bp, Homo sapiens
tttcatctatttctgaga

SEQ ID NO: 480554 - DNA, 22 bp, Homo sapiens
tttcatgataatgaacagaaca

SEQ ID NO: 480555 - DNA, 18 bp, Homo sapiens
tttcgcttgcttctgcag

SEQ ID NO: 480556 - DNA, 16 bp, Homo sapiens
tttctagcaattgctt

SEQ ID NO: 480557 - DNA, 18 bp, Homo sapiens
tttctatagccaaaaata

SEQ ID NO: 480558 - DNA, 22 bp, Homo sapiens
tttctatagccaaaaatagcta

SEQ ID NO: 480559 - DNA, 16 bp, Homo sapiens
tttctcactaaatctt

SEQ ID NO: 480560 - DNA, 20 bp, Homo sapiens
tttctgaccaatcactgagt

SEQ ID NO: 480561 - DNA, 13 bp, Homo sapiens
tttcttaaataag

SEQ ID NO: 480562 - DNA, 21 bp, Homo sapiens
tttcttaaataagaaactttt

SEQ ID NO: 480563 - DNA, 15 bp, Homo sapiens
tttgaaaaagcgaaa

SEQ ID NO: 480564 - DNA, 17 bp, Homo sapiens
tttgaagttagctttaa

SEQ ID NO: 480565 - DNA, 17 bp, Homo sapiens
tttgaatccatgcttgg

SEQ ID NO: 480566 - DNA, 19 bp, Homo sapiens
tttgagaccaacctgggta

SEQ ID NO: 480567 - DNA, 21 bp, Homo sapiens
tttgatactaagcattgaatg

SEQ ID NO: 480568 - DNA, 19 bp, Homo sapiens
tttggatatgtaaaacatt

SEQ ID NO: 480569 - DNA, 21 bp, Homo sapiens
tttggtttcccaagagctacg

SEQ ID NO: 480570 - DNA, 17 bp, Homo sapiens
tttgtacgttaattaaa

SEQ ID NO: 480571 - DNA, 12 bp, Homo sapiens
tttgttaattta

SEQ ID NO: 480572 - DNA, 21 bp, Homo sapiens
tttgttaatttagaaaacttt

SEQ ID NO: 480573 - DNA, 17 bp, Homo sapiens
tttgttcaccttctgtg

SEQ ID NO: 480574 - DNA, 13 bp, Homo sapiens
aaaaaatatgaga

SEQ ID NO: 480575 - DNA, 14 bp, Homo sapiens
aaaaactaaaaact

SEQ ID NO: 480576 - DNA, 14 bp, Homo sapiens
aaaaagacttcaaa

SEQ ID NO: 480577 - DNA, 21 bp, Homo sapiens
aaaaatagctaaatacctcaa

SEQ ID NO: 480578 - DNA, 14 bp, Homo sapiens
aaaacaaaatcctt

SEQ ID NO: 480579 - DNA, 12 bp, Homo sapiens
aaaacatttatt

SEQ ID NO: 480580 - DNA, 13 bp, Homo sapiens
aaaactttaaagc

SEQ ID NO: 480581 - DNA, 19 bp, Homo sapiens
aaaagcggggttcaatgct

SEQ ID NO: 480582 - DNA, 13 bp, Homo sapiens
aaaatagtttgga

SEQ ID NO: 480583 - DNA, 20 bp, Homo sapiens
aaaatagtttggatatgtaa

SEQ ID NO: 480584 - DNA, 22 bp, Homo sapiens
aaaatagtttggatatgtaaaa

SEQ ID NO: 480585 - DNA, 15 bp, Homo sapiens
aaaatgtgtgcttgg

SEQ ID NO: 480586 - DNA, 18 bp, Homo sapiens
aaaatgtgtgcttggaaa

SEQ ID NO: 480587 - DNA, 13 bp, Homo sapiens
aaaatgttgaaat

SEQ ID NO: 480588 - DNA, 13 bp, Homo sapiens
aaaattatttaaa

SEQ ID NO: 480589 - DNA, 20 bp, Homo sapiens
aaaatttcaacaagtagcta

SEQ ID NO: 480590 - DNA, 12 bp, Homo sapiens
aaacaagtattt

SEQ ID NO: 480591 - DNA, 23 bp, Homo sapiens
aaacaagtatttgttaatttaga

SEQ ID NO: 480592 - DNA, 17 bp, Homo sapiens
aaacatttattttgaca

SEQ ID NO: 480593 - DNA, 21 bp, Homo sapiens
aaacatttattttgacataaa

SEQ ID NO: 480594 - DNA, 16 bp, Homo sapiens
aaaccgctaaaagaaa

SEQ ID NO: 480595 - DNA, 14 bp, Homo sapiens
aaactaaaaactag

SEQ ID NO: 480596 - DNA, 13 bp, Homo sapiens
aaagattttttaa

SEQ ID NO: 480597 - DNA, 20 bp, Homo sapiens
aaagattttttaataattta

SEQ ID NO: 480598 - DNA, 21 bp, Homo sapiens
aaagattttttaataatttag

SEQ ID NO: 480599 - DNA, 15 bp, Homo sapiens
aaagcaaaaaagaaa

SEQ ID NO: 480600 - DNA, 16 bp, Homo sapiens
aaagcgaaaaaatcag

SEQ ID NO: 480601 - DNA, 16 bp, Homo sapiens
aaagctggtttaatgt

SEQ ID NO: 480602 - DNA, 16 bp, Homo sapiens
aaaggatgatttaaca

SEQ ID NO: 480603 - DNA, 19 bp, Homo sapiens
aaaggtttatgaaaaagaa

SEQ ID NO: 480604 - DNA, 17 bp, Homo sapiens
aaagttgataaagattt

SEQ ID NO: 480605 - DNA, 15 bp, Homo sapiens
aaataagaagaatgc

SEQ ID NO: 480606 - DNA, 20 bp, Homo sapiens
aaataagaagaatgcttaat

SEQ ID NO: 480607 - DNA, 13 bp, Homo sapiens
aaataagtttttg

SEQ ID NO: 480608 - DNA, 13 bp, Homo sapiens
aaataattaaaac

SEQ ID NO: 480609 - DNA, 18 bp, Homo sapiens
aaatacatgctaagagaa

SEQ ID NO: 480610 - DNA, 14 bp, Homo sapiens
aaatagctataaat

SEQ ID NO: 480611 - DNA, 18 bp, Homo sapiens
aaatagctataaatagtg

SEQ ID NO: 480612 - DNA, 20 bp, Homo sapiens
aaatagtttggatatgtaaa

SEQ ID NO: 480613 - DNA, 21 bp, Homo sapiens
aaatagtttggatatgtaaaa

SEQ ID NO: 480614 - DNA, 15 bp, Homo sapiens
aaatataaaaataat

SEQ ID NO: 480615 - DNA, 16 bp, Homo sapiens
aaatattttaaagaat

SEQ ID NO: 480616 - DNA, 17 bp, Homo sapiens
aaatattttaaagaatt

SEQ ID NO: 480617 - DNA, 18 bp, Homo sapiens
aaatattttaaagaattg

SEQ ID NO: 480618 - DNA, 23 bp, Homo sapiens
aaatattttaaagaattgtgtca

SEQ ID NO: 480619 - DNA, 20 bp, Homo sapiens
aaatcacgctttttgaaaaa

SEQ ID NO: 480620 - DNA, 20 bp, Homo sapiens
aaatcgaatgaaattaactg

SEQ ID NO: 480621 - DNA, 15 bp, Homo sapiens
aaatctaaattaact

SEQ ID NO: 480622 - DNA, 15 bp, Homo sapiens
aaatgaatgttgtct

SEQ ID NO: 480623 - DNA, 20 bp, Homo sapiens
aaatgatatgtctttaaaat

SEQ ID NO: 480624 - DNA, 13 bp, Homo sapiens
aaatgattcactt

SEQ ID NO: 480625 - DNA, 21 bp, Homo sapiens
aaatgccttttcccaaaatgt

SEQ ID NO: 480626 - DNA, 17 bp, Homo sapiens
aaatgtgtgcttggaaa

SEQ ID NO: 480627 - DNA, 15 bp, Homo sapiens
aaatgttcaaactgt

SEQ ID NO: 480628 - DNA, 20 bp, Homo sapiens
aaattaacttctattttcaa

SEQ ID NO: 480629 - DNA, 15 bp, Homo sapiens
aaattatctttaaaa

SEQ ID NO: 480630 - DNA, 17 bp, Homo sapiens
aaattatctttaaaact

SEQ ID NO: 480631 - DNA, 13 bp, Homo sapiens
aaattatttaaac

SEQ ID NO: 480632 - DNA, 13 bp, Homo sapiens
aaattgaatgcaa

SEQ ID NO: 480633 - DNA, 14 bp, Homo sapiens
aaattgaatgcaaa

SEQ ID NO: 480634 - DNA, 12 bp, Homo sapiens
aacaagtatttg

SEQ ID NO: 480635 - DNA, 20 bp, Homo sapiens
aacaagtatttgttaattta

SEQ ID NO: 480636 - DNA, 21 bp, Homo sapiens
aacacgtccagaatttttcat

SEQ ID NO: 480637 - DNA, 18 bp, Homo sapiens
aacctcagtaatttagaa

SEQ ID NO: 480638 - DNA, 18 bp, Homo sapiens
aacctttcttcaccaaat

SEQ ID NO: 480639 - DNA, 20 bp, Homo sapiens
aactagaggtgagaaattta

SEQ ID NO: 480640 - DNA, 21 bp, Homo sapiens
aactagaggtgagaaatttaa

SEQ ID NO: 480641 - DNA, 14 bp, Homo sapiens
aactgatgctttca

SEQ ID NO: 480642 - DNA, 21 bp, Homo sapiens
aacttaccaggcaccaaaaga

SEQ ID NO: 480643 - DNA, 20 bp, Homo sapiens
aacttactatggtatatatt

SEQ ID NO: 480644 - DNA, 20 bp, Homo sapiens
aagaaaaacaaactcgtttt

SEQ ID NO: 480645 - DNA, 23 bp, Homo sapiens
aagaaactttctttctcactaaa

SEQ ID NO: 480646 - DNA, 12 bp, Homo sapiens
aagaatacttct

SEQ ID NO: 480647 - DNA, 12 bp, Homo sapiens
aagaatctcatc

SEQ ID NO: 480648 - DNA, 22 bp, Homo sapiens
aagactatcttactatttcaca

SEQ ID NO: 480649 - DNA, 22 bp, Homo sapiens
aagacttcaaatgttattcaat

SEQ ID NO: 480650 - DNA, 20 bp, Homo sapiens
aagagctacgtatttaatag

SEQ ID NO: 480651 - DNA, 20 bp, Homo sapiens
aagataatggataatcttcg

SEQ ID NO: 480652 - DNA, 19 bp, Homo sapiens
aagataattaaatgaaata

SEQ ID NO: 480653 - DNA, 21 bp, Homo sapiens
aagataattaaatgaaatact

SEQ ID NO: 480654 - DNA, 22 bp, Homo sapiens
acttaccaggcaccaaaagaag

SEQ ID NO: 480655 - DNA, 19 bp, Homo sapiens
acttcaagcatggctattt

SEQ ID NO: 480656 - DNA, 19 bp, Homo sapiens
acttctcattttttaaaaa

SEQ ID NO: 480657 - DNA, 16 bp, Homo sapiens
acttgctgtgaaatga

SEQ ID NO: 480658 - DNA, 12 bp, Homo sapiens
actttaaagcgt

SEQ ID NO: 480659 - DNA, 13 bp, Homo sapiens
actttctttctca

SEQ ID NO: 480660 - DNA, 16 bp, Homo sapiens
actttctttctcacta

SEQ ID NO: 480661 - DNA, 22 bp, Homo sapiens
actttctttctcactaaatctt

SEQ ID NO: 480662 - DNA, 17 bp, Homo sapiens
actttgaagttagcttt

SEQ ID NO: 480663 - DNA, 14 bp, Homo sapiens
agaaaaagaagcaa

SEQ ID NO: 480664 - DNA, 14 bp, Homo sapiens
agaaataagttttt

SEQ ID NO: 480665 - DNA, 16 bp, Homo sapiens
agaaataagtttttgt

SEQ ID NO: 480666 - DNA, 17 bp, Homo sapiens
agaaatataaaaataat

SEQ ID NO: 480667 - DNA, 17 bp, Homo sapiens
agaaatcattttgcaat

SEQ ID NO: 480668 - DNA, 19 bp, Homo sapiens
agaacatagacagaagaaa

SEQ ID NO: 480669 - DNA, 21 bp, Homo sapiens
agaacatagacagaagaaaca

SEQ ID NO: 480670 - DNA, 15 bp, Homo sapiens
agaacctaattcaat

SEQ ID NO: 480671 - DNA, 19 bp, Homo sapiens
agaacctaattcaattcaa

SEQ ID NO: 480672 - DNA, 13 bp, Homo sapiens
agaagaaacaagg

SEQ ID NO: 480673 - DNA, 23 bp, Homo sapiens
agaagcaacctcagtaatttaga

SEQ ID NO: 480674 - DNA, 16 bp, Homo sapiens
agaagcgctcatctgg

SEQ ID NO: 480675 - DNA, 14 bp, Homo sapiens
agaaggaggaaccc

SEQ ID NO: 480676 - DNA, 15 bp, Homo sapiens
agaagtaaaagcaaa

SEQ ID NO: 480677 - DNA, 17 bp, Homo sapiens
agaagtagaaatcatag

SEQ ID NO: 480678 - DNA, 16 bp, Homo sapiens
agaagtgaaaaagact

SEQ ID NO: 480679 - DNA, 15 bp, Homo sapiens
agaatacttctcatt

SEQ ID NO: 480680 - DNA, 20 bp, Homo sapiens
agaatgcttaatcagataga

SEQ ID NO: 480681 - DNA, 16 bp, Homo sapiens
agaatgtcattttggt

SEQ ID NO: 480682 - DNA, 14 bp, Homo sapiens
agaattgagtgttt

SEQ ID NO: 480683 - DNA, 17 bp, Homo sapiens
agaattgagtgtttaaa

SEQ ID NO: 480684 - DNA, 19 bp, Homo sapiens
agaattgtgtcagactgtt

SEQ ID NO: 480685 - DNA, 20 bp, Homo sapiens
agaattgtgtcagactgttt

SEQ ID NO: 480686 - DNA, 21 bp, Homo sapiens
agacaagtctagtggaaccaa

SEQ ID NO: 480687 - DNA, 21 bp, Homo sapiens
agacaccatcttttgtgagat

SEQ ID NO: 480688 - DNA, 12 bp, Homo sapiens
agacagaagaaa

SEQ ID NO: 480689 - DNA, 16 bp, Homo sapiens
agaccttttttaggaa

SEQ ID NO: 480690 - DNA, 11 bp, Homo sapiens
agagctacata

SEQ ID NO: 480691 - DNA, 16 bp, Homo sapiens
agagctacataattta

SEQ ID NO: 480692 - DNA, 18 bp, Homo sapiens
agagctacataatttagt

SEQ ID NO: 480693 - DNA, 14 bp, Homo sapiens
agagctacgtattt

SEQ ID NO: 480694 - DNA, 18 bp, Homo sapiens
agaggagcaaacaggaaa

SEQ ID NO: 480695 - DNA, 15 bp, Homo sapiens
agagttcaagaaata

SEQ ID NO: 480696 - DNA, 18 bp, Homo sapiens
agataatggataatcttc

SEQ ID NO: 480697 - DNA, 18 bp, Homo sapiens
agataattaaatgaaata

SEQ ID NO: 480698 - DNA, 20 bp, Homo sapiens
agataattaaatgaaatact

SEQ ID NO: 480699 - DNA, 18 bp, Homo sapiens
agataccattttgaaata

SEQ ID NO: 480700 - DNA, 20 bp, Homo sapiens
agataccattttgaaatatt

SEQ ID NO: 480701 - DNA, 16 bp, Homo sapiens
agatacttaagtgctg

SEQ ID NO: 480702 - DNA, 14 bp, Homo sapiens
agatggggagggcg

SEQ ID NO: 480703 - DNA, 18 bp, Homo sapiens
agatggggagggcgcttt

SEQ ID NO: 480704 - DNA, 20 bp, Homo sapiens
agatggggagggcgcttttg

SEQ ID NO: 480705 - DNA, 18 bp, Homo sapiens
agattggaaaaaattaga

SEQ ID NO: 480706 - DNA, 16 bp, Homo sapiens
agattttttaataatt

SEQ ID NO: 480707 - DNA, 21 bp, Homo sapiens
agcaaatttctagatatgaga

SEQ ID NO: 480708 - DNA, 19 bp, Homo sapiens
agcaagaaggcaaaaatag

SEQ ID NO: 480709 - DNA, 15 bp, Homo sapiens
agcaagcattcagaa

SEQ ID NO: 480710 - DNA, 18 bp, Homo sapiens
agcaagcattcagaagaa

SEQ ID NO: 480711 - DNA, 12 bp, Homo sapiens
agcacaggctaa

SEQ ID NO: 480712 - DNA, 20 bp, Homo sapiens
agcactatcgaggtatttgg

SEQ ID NO: 480713 - DNA, 15 bp, Homo sapiens
agcatggctatttta

SEQ ID NO: 480714 - DNA, 19 bp, Homo sapiens
agcattcagaagaaaaaga

SEQ ID NO: 480715 - DNA, 21 bp, Homo sapiens
agcattcagaagaaaaagaag

SEQ ID NO: 480716 - DNA, 15 bp, Homo sapiens
agccaaaaatagcta

SEQ ID NO: 480717 - DNA, 18 bp, Homo sapiens
agccaaaaatagctaaat

SEQ ID NO: 480718 - DNA, 17 bp, Homo sapiens
agccattcctgttctct

SEQ ID NO: 480719 - DNA, 21 bp, Homo sapiens
agcccagaagctcaaggctgc

SEQ ID NO: 480720 - DNA, 23 bp, Homo sapiens
agccccaaagtcaattaaaggct

SEQ ID NO: 480721 - DNA, 15 bp, Homo sapiens
agccctaaacatcat

SEQ ID NO: 480722 - DNA, 21 bp, Homo sapiens
agccctaaacatcattcttga

SEQ ID NO: 480723 - DNA, 18 bp, Homo sapiens
agccctaagtaaatctaa

SEQ ID NO: 480724 - DNA, 17 bp, Homo sapiens
agcctgacaacatttct

SEQ ID NO: 480725 - DNA, 16 bp, Homo sapiens
agccttactcacctct

SEQ ID NO: 480726 - DNA, 15 bp, Homo sapiens
agctacataatttag

SEQ ID NO: 480727 - DNA, 16 bp, Homo sapiens
agctacgtatttaata

SEQ ID NO: 480728 - DNA, 22 bp, Homo sapiens
agctcaggaggcgaataaatgt

SEQ ID NO: 480729 - DNA, 20 bp, Homo sapiens
agctggtttaatgttttggc

SEQ ID NO: 480730 - DNA, 12 bp, Homo sapiens
agcttaaaactt

SEQ ID NO: 480731 - DNA, 14 bp, Homo sapiens
agcttaaaactttg

SEQ ID NO: 480732 - DNA, 22 bp, Homo sapiens
agcttaatggctgataatttta

SEQ ID NO: 480733 - DNA, 15 bp, Homo sapiens
agcttgagcctgaaa

SEQ ID NO: 480734 - DNA, 15 bp, Homo sapiens
aggaagcaagcttaa

SEQ ID NO: 480735 - DNA, 21 bp, Homo sapiens
aggactttcctaaatgtttaa

SEQ ID NO: 480736 - DNA, 13 bp, Homo sapiens
aggagcttctctg

SEQ ID NO: 480737 - DNA, 15 bp, Homo sapiens
aggaggcgaataaat

SEQ ID NO: 480738 - DNA, 19 bp, Homo sapiens
aggatcacttgagcccaga

SEQ ID NO: 480739 - DNA, 21 bp, Homo sapiens
aggccaagagtttgagaccaa

SEQ ID NO: 480740 - DNA, 18 bp, Homo sapiens
aggcctcagggaccaagg

SEQ ID NO: 480741 - DNA, 21 bp, Homo sapiens
aggcctcagggaccaaggaga

SEQ ID NO: 480742 - DNA, 21 bp, Homo sapiens
aggcctttagatattattcat

SEQ ID NO: 480743 - DNA, 12 bp, Homo sapiens
aggcgaataaat

SEQ ID NO: 480744 - DNA, 15 bp, Homo sapiens
aggcgaataaatgtt

SEQ ID NO: 480745 - DNA, 19 bp, Homo sapiens
aggcgaataaatgttcaaa

SEQ ID NO: 480746 - DNA, 21 bp, Homo sapiens
aggcgaataaatgttcaaact

SEQ ID NO: 480747 - DNA, 19 bp, Homo sapiens
agggaataaggtacaagaa

SEQ ID NO: 480748 - DNA, 16 bp, Homo sapiens
aggtaaactgatgctt

SEQ ID NO: 480749 - DNA, 19 bp, Homo sapiens
aggtaaactgatgctttca

SEQ ID NO: 480750 - DNA, 13 bp, Homo sapiens
aggtctcctctta

SEQ ID NO: 480751 - DNA, 14 bp, Homo sapiens
aggtttatgaaaaa

SEQ ID NO: 480752 - DNA, 16 bp, Homo sapiens
aggtttatgaaaaaga

SEQ ID NO: 480753 - DNA, 21 bp, Homo sapiens
aggtttatgaaaaagaagaat

SEQ ID NO: 480754 - DNA, 10 bp, Homo sapiens
aggttttcag

SEQ ID NO: 480755 - DNA, 16 bp, Homo sapiens
agtaaaagcaaaaaag

SEQ ID NO: 480756 - DNA, 18 bp, Homo sapiens
agtaaatctaaattaact

SEQ ID NO: 480757 - DNA, 16 bp, Homo sapiens
agtaaatgtatattga

SEQ ID NO: 480758 - DNA, 13 bp, Homo sapiens
agtaatctgcatt

SEQ ID NO: 480759 - DNA, 14 bp, Homo sapiens
agtaatttagaaat

SEQ ID NO: 480760 - DNA, 14 bp, Homo sapiens
agtatattatgtat

SEQ ID NO: 480761 - DNA, 15 bp, Homo sapiens
agtatattatgtatt

SEQ ID NO: 480762 - DNA, 15 bp, Homo sapiens
agtatttgttaattt

SEQ ID NO: 480763 - DNA, 23 bp, Homo sapiens
agtgaaaaagacttcaaatgtta

SEQ ID NO: 480764 - DNA, 19 bp, Homo sapiens
agtgagttttttagtgcgt

SEQ ID NO: 480765 - DNA, 17 bp, Homo sapiens
agtgattgtcttaatat

SEQ ID NO: 480766 - DNA, 22 bp, Homo sapiens
agtggactggcctcaaagcaag

SEQ ID NO: 480767 - DNA, 20 bp, Homo sapiens
agtggtagagtcctaggaca

SEQ ID NO: 480768 - DNA, 15 bp, Homo sapiens
agttaagtgaatgtc

SEQ ID NO: 480769 - DNA, 13 bp, Homo sapiens
agttcaagaaata

SEQ ID NO: 480770 - DNA, 17 bp, Homo sapiens
agttgataaagattttt

SEQ ID NO: 480771 - DNA, 20 bp, Homo sapiens
cccagaagctcaaggctgca

SEQ ID NO: 480772 - DNA, 20 bp, Homo sapiens
ccccatgccaatgtccaggt

SEQ ID NO: 480773 - DNA, 17 bp, Homo sapiens
ccccggcctgatggcca

SEQ ID NO: 480774 - DNA, 18 bp, Homo sapiens
cccctggaagttgtcctt

SEQ ID NO: 480775 - DNA, 12 bp, Homo sapiens
cccggcctgatg

SEQ ID NO: 480776 - DNA, 15 bp, Homo sapiens
cccggcctgatggcc

SEQ ID NO: 480777 - DNA, 20 bp, Homo sapiens
ccggcctgatggccaggcct

SEQ ID NO: 480778 - DNA, 16 bp, Homo sapiens
cctaattcaattcaaa

SEQ ID NO: 480779 - DNA, 21 bp, Homo sapiens
cctagcactttgggaggctga

SEQ ID NO: 480780 - DNA, 23 bp, Homo sapiens
cctatctggaaaaaaaaaaatat

SEQ ID NO: 480781 - DNA, 20 bp, Homo sapiens
cctcggacaccatcttggga

SEQ ID NO: 480782 - DNA, 23 bp, Homo sapiens
cctctaggtaaactagcaaaagg

SEQ ID NO: 480783 - DNA, 20 bp, Homo sapiens
cctggaagttgtcctttctg

SEQ ID NO: 480784 - DNA, 22 bp, Homo sapiens
cctggaagttgtcctttctgat

SEQ ID NO: 480785 - DNA, 21 bp, Homo sapiens
cctgtctctacaaaaaaaatc

SEQ ID NO: 480786 - DNA, 12 bp, Homo sapiens
ccttactcacct

SEQ ID NO: 480787 - DNA, 22 bp, Homo sapiens
ccttcaacaattctaaaatgat

SEQ ID NO: 480788 - DNA, 17 bp, Homo sapiens
ccttctgtgcatctggc

SEQ ID NO: 480789 - DNA, 20 bp, Homo sapiens
ccttctgtgcatctggcctg

SEQ ID NO: 480790 - DNA, 22 bp, Homo sapiens
ccttctgtgcatctggcctggg

SEQ ID NO: 480791 - DNA, 22 bp, Homo sapiens
ccttttttaggaagcaagctta

SEQ ID NO: 480792 - DNA, 12 bp, Homo sapiens
cgaataaatgtt

SEQ ID NO: 480793 - DNA, 22 bp, Homo sapiens
cgcaaggatcacttgagcccag

SEQ ID NO: 480794 - DNA, 13 bp, Homo sapiens
cgctaaaagaaac

SEQ ID NO: 480795 - DNA, 15 bp, Homo sapiens
cgctaaaagaaactt

SEQ ID NO: 480796 - DNA, 24 bp, Homo sapiens
cgctcatctggcttttcgcttgct

SEQ ID NO: 480797 - DNA, 14 bp, Homo sapiens
cgctgcgctcccac

SEQ ID NO: 480798 - DNA, 23 bp, Homo sapiens
cgcttgcttctgcagcaactccc

SEQ ID NO: 480799 - DNA, 14 bp, Homo sapiens
cggacgccccccgg

SEQ ID NO: 480800 - DNA, 18 bp, Homo sapiens
cggagtgagttttttagt

SEQ ID NO: 480801 - DNA, 15 bp, Homo sapiens
cgtatttaatagcaa

SEQ ID NO: 480802 - DNA, 20 bp, Homo sapiens
ctaaatcttttataggattt

SEQ ID NO: 480803 - DNA, 17 bp, Homo sapiens
ctaagataattaaatga

SEQ ID NO: 480804 - DNA, 23 bp, Homo sapiens
ctaagtttagaagcgctcatctg

SEQ ID NO: 480805 - DNA, 15 bp, Homo sapiens
ctaattcaattcaaa

SEQ ID NO: 480806 - DNA, 14 bp, Homo sapiens
ctaattttttgttg

SEQ ID NO: 480807 - DNA, 20 bp, Homo sapiens
ctaatttttttgtattttag

SEQ ID NO: 480808 - DNA, 15 bp, Homo sapiens
ctacaaaatgtgtgc

SEQ ID NO: 480809 - DNA, 15 bp, Homo sapiens
ctacataatttagtt

SEQ ID NO: 480810 - DNA, 14 bp, Homo sapiens
ctacgtatttaata

SEQ ID NO: 480811 - DNA, 18 bp, Homo sapiens
ctactttgtctaaaaata

SEQ ID NO: 480812 - DNA, 13 bp, Homo sapiens
ctagcaaaaggat

SEQ ID NO: 480813 - DNA, 16 bp, Homo sapiens
ctataaccagacacat

SEQ ID NO: 480814 - DNA, 14 bp, Homo sapiens
ctatagccaaaaat

SEQ ID NO: 480815 - DNA, 19 bp, Homo sapiens
ctatagccaaaaatagcta

SEQ ID NO: 480816 - DNA, 12 bp, Homo sapiens
ctatctggaaaa

SEQ ID NO: 480817 - DNA, 15 bp, Homo sapiens
ctatgctgttcattg

SEQ ID NO: 480818 - DNA, 14 bp, Homo sapiens
ctatgtttttaatg

SEQ ID NO: 480819 - DNA, 16 bp, Homo sapiens
ctatgtttttaatgta

SEQ ID NO: 480820 - DNA, 15 bp, Homo sapiens
ctattgctgtaaata

SEQ ID NO: 480821 - DNA, 14 bp, Homo sapiens
ctatttattaaaac

SEQ ID NO: 480822 - DNA, 15 bp, Homo sapiens
ctcacctctctctaa

SEQ ID NO: 480823 - DNA, 16 bp, Homo sapiens
ctcacctctctctaag

SEQ ID NO: 480824 - DNA, 22 bp, Homo sapiens
ctcagaagtgaaaaagacttca

SEQ ID NO: 480825 - DNA, 20 bp, Homo sapiens
ctcaggaggcgaataaatgt

SEQ ID NO: 480826 - DNA, 16 bp, Homo sapiens
ctcagggaccaaggag

SEQ ID NO: 480827 - DNA, 21 bp, Homo sapiens
ctcatcaggtaaactgatgct

SEQ ID NO: 480828 - DNA, 12 bp, Homo sapiens
ctcattttattc

SEQ ID NO: 480829 - DNA, 13 bp, Homo sapiens
ctcattttttaaa

SEQ ID NO: 480830 - DNA, 14 bp, Homo sapiens
ctccaagagctaca

SEQ ID NO: 480831 - DNA, 18 bp, Homo sapiens
ctcccacctcggacacca

SEQ ID NO: 480832 - DNA, 23 bp, Homo sapiens
ctcccacgactgttgtacaagct

SEQ ID NO: 480833 - DNA, 21 bp, Homo sapiens
ctcctcttaaaaaataaaaac

SEQ ID NO: 480834 - DNA, 22 bp, Homo sapiens
ctcctgaaaaggtttatgaaaa

SEQ ID NO: 480835 - DNA, 21 bp, Homo sapiens
ctccttagagacatcaaaatc

SEQ ID NO: 480836 - DNA, 15 bp, Homo sapiens
ctctacaaaaaaaat

SEQ ID NO: 480837 - DNA, 20 bp, Homo sapiens
ctctgtgttgtgaatgtcat

SEQ ID NO: 480838 - DNA, 17 bp, Homo sapiens
ctcttaaaaaataaaaa

SEQ ID NO: 480839 - DNA, 18 bp, Homo sapiens
ctcttaaaaaataaaaac

SEQ ID NO: 480840 - DNA, 19 bp, Homo sapiens
ctctttgccttgatgttgt

SEQ ID NO: 480841 - DNA, 16 bp, Homo sapiens
ctgaacaattctctct

SEQ ID NO: 480842 - DNA, 14 bp, Homo sapiens
ctgaagccattgtc

SEQ ID NO: 480843 - DNA, 16 bp, Homo sapiens
ctgaagtcaaacctta

SEQ ID NO: 480844 - DNA, 12 bp, Homo sapiens
ctgaatttttaa

SEQ ID NO: 480845 - DNA, 21 bp, Homo sapiens
ctgaatttttaaacaagtatt

SEQ ID NO: 480846 - DNA, 17 bp, Homo sapiens
ctgagacgcaaggatca

SEQ ID NO: 480847 - DNA, 17 bp, Homo sapiens
ctgagatgggaggatca

SEQ ID NO: 480848 - DNA, 16 bp, Homo sapiens
ctgcagcaactcccac

SEQ ID NO: 480849 - DNA, 19 bp, Homo sapiens
ctgcgctcccacctcggac

SEQ ID NO: 480850 - DNA, 21 bp, Homo sapiens
ctgctatggttttctccaaga

SEQ ID NO: 480851 - DNA, 14 bp, Homo sapiens
ctggaggagaagga

SEQ ID NO: 480852 - DNA, 16 bp, Homo sapiens
ctggcctcaaagcaag

SEQ ID NO: 480853 - DNA, 22 bp, Homo sapiens
ctggcttttcgcttgcttctgc

SEQ ID NO: 480854 - DNA, 23 bp, Homo sapiens
ctggcttttcgcttgcttctgca

SEQ ID NO: 480855 - DNA, 18 bp, Homo sapiens
ctgtaaataaaaatagct

SEQ ID NO: 480856 - DNA, 20 bp, Homo sapiens
ctgtagtttttgttcacctt

SEQ ID NO: 480857 - DNA, 22 bp, Homo sapiens
ctgtagtttttgttcaccttct

SEQ ID NO: 480858 - DNA, 11 bp, Homo sapiens
ctgtattgcta

SEQ ID NO: 480859 - DNA, 16 bp, Homo sapiens
ctgtgaaatgactgca

SEQ ID NO: 480860 - DNA, 18 bp, Homo sapiens
ctgtgatgctttgaagta

SEQ ID NO: 480861 - DNA, 17 bp, Homo sapiens
ctgtgcatctggcctgg

SEQ ID NO: 480862 - DNA, 23 bp, Homo sapiens
ctgtgcatctggcctgggggctg

SEQ ID NO: 480863 - DNA, 13 bp, Homo sapiens
ctgtgtgctgtaa

SEQ ID NO: 480864 - DNA, 17 bp, Homo sapiens
ctgtttagtagcagtga

SEQ ID NO: 480865 - DNA, 20 bp, Homo sapiens
ctgtttagtagcagtgattg

SEQ ID NO: 480866 - DNA, 17 bp, Homo sapiens
cttaaaaaataaaaact

SEQ ID NO: 480867 - DNA, 20 bp, Homo sapiens
cttaaaaattatctttaaaa

SEQ ID NO: 480868 - DNA, 23 bp, Homo sapiens
cttaagataatggataatcttcg

SEQ ID NO: 480869 - DNA, 20 bp, Homo sapiens
cttaatggctgataatttta

SEQ ID NO: 480870 - DNA, 22 bp, Homo sapiens
cttaatggctgataattttaaa

SEQ ID NO: 480871 - DNA, 18 bp, Homo sapiens
cttacagttttaaattct

SEQ ID NO: 480872 - DNA, 22 bp, Homo sapiens
cttcaagcatggctattttata

SEQ ID NO: 480873 - DNA, 14 bp, Homo sapiens
cttctgcagcaact

SEQ ID NO: 480874 - DNA, 17 bp, Homo sapiens
cttctgcagcaactccc

SEQ ID NO: 480875 - DNA, 19 bp, Homo sapiens
cttctgcagcaactcccac

SEQ ID NO: 480876 - DNA, 21 bp, Homo sapiens
cttctgcagcaactcccacga

SEQ ID NO: 480877 - DNA, 18 bp, Homo sapiens
cttctgtgcatctggcct

SEQ ID NO: 480878 - DNA, 14 bp, Homo sapiens
cttcttttcccatt

SEQ ID NO: 480879 - DNA, 23 bp, Homo sapiens
cttgcaggaaggactatgaaaag

SEQ ID NO: 480880 - DNA, 18 bp, Homo sapiens
cttgctgtgaaatgactg

SEQ ID NO: 480881 - DNA, 15 bp, Homo sapiens
cttgcttctgcagca

SEQ ID NO: 480882 - DNA, 16 bp, Homo sapiens
cttgcttctgcagcaa

SEQ ID NO: 480883 - DNA, 21 bp, Homo sapiens
cttgggtgtaacaggtctcct

SEQ ID NO: 480884 - DNA, 18 bp, Homo sapiens
cttttcgcttgcttctgc

SEQ ID NO: 480885 - DNA, 20 bp, Homo sapiens
cttttcgcttgcttctgcag

SEQ ID NO: 480886 - DNA, 15 bp, Homo sapiens
cttttgagcagtaaa

SEQ ID NO: 480887 - DNA, 11 bp, Homo sapiens
tataaaaataa

SEQ ID NO: 480888 - DNA, 19 bp, Homo sapiens
tataacattgtaaatgata

SEQ ID NO: 480889 - DNA, 16 bp, Homo sapiens
tataaccagacacata

SEQ ID NO: 480890 - DNA, 17 bp, Homo sapiens
tataatggcctcttaaa

SEQ ID NO: 480891 - DNA, 22 bp, Homo sapiens
tataattgttttatctgaattt

SEQ ID NO: 480892 - DNA, 22 bp, Homo sapiens
tatagccaaaaatagctaaata

SEQ ID NO: 480893 - DNA, 21 bp, Homo sapiens
tataggatttatttaaaatag

SEQ ID NO: 480894 - DNA, 14 bp, Homo sapiens
tatatattttgaaa

SEQ ID NO: 480895 - DNA, 14 bp, Homo sapiens
tatatctttttcca

SEQ ID NO: 480896 - DNA, 15 bp, Homo sapiens
tatattttgaaagga

SEQ ID NO: 480897 - DNA, 21 bp, Homo sapiens
tatccacagaaacattttcat

SEQ ID NO: 480898 - DNA, 22 bp, Homo sapiens
tatctttttgcttacagtttta

SEQ ID NO: 480899 - DNA, 18 bp, Homo sapiens
tatgagaaatataaaaat

SEQ ID NO: 480900 - DNA, 20 bp, Homo sapiens
tatgagattggaaaaaatta

SEQ ID NO: 480901 - DNA, 22 bp, Homo sapiens
tatgagattggaaaaaattaga

SEQ ID NO: 480902 - DNA, 15 bp, Homo sapiens
tatgctgttcattga

SEQ ID NO: 480903 - DNA, 14 bp, Homo sapiens
tatggattctaaaa

SEQ ID NO: 480904 - DNA, 16 bp, Homo sapiens
tatggattctaaaatg

SEQ ID NO: 480905 - DNA, 14 bp, Homo sapiens
tatggtatatattt

SEQ ID NO: 480906 - DNA, 13 bp, Homo sapiens
tatgtaaaacatt

SEQ ID NO: 480907 - DNA, 15 bp, Homo sapiens
tatgtaaaacattta

SEQ ID NO: 480908 - DNA, 12 bp, Homo sapiens
tattattgttct

SEQ ID NO: 480909 - DNA, 20 bp, Homo sapiens
tattgctgtaaataaaaata

SEQ ID NO: 480910 - DNA, 16 bp, Homo sapiens
tattggaatataattg

SEQ ID NO: 480911 - DNA, 21 bp, Homo sapiens
tatttaaaaaactaaaaacta

SEQ ID NO: 480912 - DNA, 14 bp, Homo sapiens
tatttaaaatagca

SEQ ID NO: 480913 - DNA, 21 bp, Homo sapiens
tatttaaaatagcaaaagaag

SEQ ID NO: 480914 - DNA, 23 bp, Homo sapiens
tatttaaaatagcaaaagaagaa

SEQ ID NO: 480915 - DNA, 20 bp, Homo sapiens
tatttaatagcaaagaattg

SEQ ID NO: 480916 - DNA, 11 bp, Homo sapiens
tatttctgaga

SEQ ID NO: 480917 - DNA, 14 bp, Homo sapiens
tatttgtaatagat

SEQ ID NO: 480918 - DNA, 18 bp, Homo sapiens
tattttgacataaagttg

SEQ ID NO: 480919 - DNA, 21 bp, Homo sapiens
tcaaacaccaacataaaaatg

SEQ ID NO: 480920 - DNA, 15 bp, Homo sapiens
tcaaacgaaatggct

SEQ ID NO: 480921 - DNA, 15 bp, Homo sapiens
tcaaagcaagcattc

SEQ ID NO: 480922 - DNA, 21 bp, Homo sapiens
tcaaagcaagcattcagaaga

SEQ ID NO: 480923 - DNA, 22 bp, Homo sapiens
tcaaagcaagcattcagaagaa

SEQ ID NO: 480924 - DNA, 18 bp, Homo sapiens
tcaaatgttattcaataa

SEQ ID NO: 480925 - DNA, 15 bp, Homo sapiens
tcaacaattctaaaa

SEQ ID NO: 480926 - DNA, 22 bp, Homo sapiens
tcaactttcttttgattagtgt

SEQ ID NO: 480927 - DNA, 16 bp, Homo sapiens
tcaataactattgctg

SEQ ID NO: 480928 - DNA, 21 bp, Homo sapiens
tcaatcagtctcagaatgtca

SEQ ID NO: 480929 - DNA, 15 bp, Homo sapiens
tcaattcaaagctgt

SEQ ID NO: 480930 - DNA, 22 bp, Homo sapiens
tcaattcaaagctgtgtgtttg

SEQ ID NO: 480931 - DNA, 14 bp, Homo sapiens
tcacaacagcctga

SEQ ID NO: 480932 - DNA, 14 bp, Homo sapiens
tcaccttctgtgca

SEQ ID NO: 480933 - DNA, 16 bp, Homo sapiens
tcaccttctgtgcatc

SEQ ID NO: 480934 - DNA, 16 bp, Homo sapiens
tcacgctttttgaaaa

SEQ ID NO: 480935 - DNA, 17 bp, Homo sapiens
tcactaaatcttttata

SEQ ID NO: 480936 - DNA, 16 bp, Homo sapiens
tcacttttattgtata

SEQ ID NO: 480937 - DNA, 13 bp, Homo sapiens
tcagaagaaaaag

SEQ ID NO: 480938 - DNA, 14 bp, Homo sapiens
tcagaagtgaaaaa

SEQ ID NO: 480939 - DNA, 19 bp, Homo sapiens
tcagccattcctgttctct

SEQ ID NO: 480940 - DNA, 21 bp, Homo sapiens
tcagcctcccgagtagctgag

SEQ ID NO: 480941 - DNA, 12 bp, Homo sapiens
tcaggaaaattg

SEQ ID NO: 480942 - DNA, 17 bp, Homo sapiens
tcaggaggcgaataaat

SEQ ID NO: 480943 - DNA, 14 bp, Homo sapiens
tcagggaccaagga

SEQ ID NO: 480944 - DNA, 15 bp, Homo sapiens
tcagggaccaaggag

SEQ ID NO: 480945 - DNA, 19 bp, Homo sapiens
tcagtaatttagaaatcat

SEQ ID NO: 480946 - DNA, 20 bp, Homo sapiens
tcagtaatttagaaatcatt

SEQ ID NO: 480947 - DNA, 18 bp, Homo sapiens
tcagtctcagaatgtcat

SEQ ID NO: 480948 - DNA, 22 bp, Homo sapiens
tcagtgtagaacctaattcaat

SEQ ID NO: 480949 - DNA, 15 bp, Homo sapiens
tcagtgttataaaat

SEQ ID NO: 480950 - DNA, 14 bp, Homo sapiens
tcatagataccatt

SEQ ID NO: 480951 - DNA, 20 bp, Homo sapiens
tcatagataccattttgaaa

SEQ ID NO: 480952 - DNA, 22 bp, Homo sapiens
tcatagataccattttgaaata

SEQ ID NO: 480953 - DNA, 16 bp, Homo sapiens
tcattcatttattcat

SEQ ID NO: 480954 - DNA, 16 bp, Homo sapiens
tcattttttaaaaaag

SEQ ID NO: 480955 - DNA, 13 bp, Homo sapiens
tcccaaagtgctg

SEQ ID NO: 480956 - DNA, 22 bp, Homo sapiens
tcctagcactttgggaggctga

SEQ ID NO: 480957 - DNA, 19 bp, Homo sapiens
tcctaggacatctctgtaa

SEQ ID NO: 480958 - DNA, 21 bp, Homo sapiens
tcctattgtgcaatgtaaata

SEQ ID NO: 480959 - DNA, 20 bp, Homo sapiens
tcctcttaaaaaataaaaac

SEQ ID NO: 480960 - DNA, 13 bp, Homo sapiens
tcctgaggctgag

SEQ ID NO: 480961 - DNA, 22 bp, Homo sapiens
tcctgggcatgtttgtctgtgt

SEQ ID NO: 480962 - DNA, 16 bp, Homo sapiens
tcctgttctctttgcc

SEQ ID NO: 480963 - DNA, 19 bp, Homo sapiens
tccttagagacatcaaaat

SEQ ID NO: 480964 - DNA, 20 bp, Homo sapiens
tcgcccacaagccttactca

SEQ ID NO: 480965 - DNA, 13 bp, Homo sapiens
tcgcttgcttctg

SEQ ID NO: 480966 - DNA, 19 bp, Homo sapiens
tcggacaccatcttgggat

SEQ ID NO: 480967 - DNA, 19 bp, Homo sapiens
tctaaagctggtttaatgt

SEQ ID NO: 480968 - DNA, 17 bp, Homo sapiens
tctatagccaaaaatag

SEQ ID NO: 480969 - DNA, 19 bp, Homo sapiens
tctatagccaaaaatagct

SEQ ID NO: 480970 - DNA, 12 bp, Homo sapiens
tctatttctgag

SEQ ID NO: 480971 - DNA, 20 bp, Homo sapiens
tctatttctgagaaggtcct

SEQ ID NO: 480972 - DNA, 18 bp, Homo sapiens
tctcagaatgtcattttg

SEQ ID NO: 480973 - DNA, 20 bp, Homo sapiens
tctcatctcagtgaagaata

SEQ ID NO: 480974 - DNA, 22 bp, Homo sapiens
tctcctcttaaaaaataaaaac

SEQ ID NO: 480975 - DNA, 23 bp, Homo sapiens
tctcctcttaaaaaataaaaact

SEQ ID NO: 480976 - DNA, 14 bp, Homo sapiens
tctctaaaacagca

SEQ ID NO: 480977 - DNA, 22 bp, Homo sapiens
tctctaagtttagaagcgctca

SEQ ID NO: 480978 - DNA, 11 bp, Homo sapiens
tctctctttcc

SEQ ID NO: 480979 - DNA, 22 bp, Homo sapiens
tctgacagcatttcagctgtga

SEQ ID NO: 480980 - DNA, 16 bp, Homo sapiens
tctgcagcaactccca

SEQ ID NO: 480981 - DNA, 16 bp, Homo sapiens
tctgctactttgctgc

SEQ ID NO: 480982 - DNA, 15 bp, Homo sapiens
tctggggcagggtta

SEQ ID NO: 480983 - DNA, 13 bp, Homo sapiens
tctgtattgctaa

SEQ ID NO: 480984 - DNA, 14 bp, Homo sapiens
tctgtcaatgaaaa

SEQ ID NO: 480985 - DNA, 16 bp, Homo sapiens
tctgtcacccaggctg

SEQ ID NO: 480986 - DNA, 18 bp, Homo sapiens
tctgtgcatctggcctgg

SEQ ID NO: 480987 - DNA, 19 bp, Homo sapiens
tctgtgcatctggcctggg

SEQ ID NO: 480988 - DNA, 16 bp, Homo sapiens
tcttaaataagaaact

SEQ ID NO: 480989 - DNA, 15 bp, Homo sapiens
tcttactatttcaca

SEQ ID NO: 480990 - DNA, 18 bp, Homo sapiens
tcttcttttcccatttac

SEQ ID NO: 480991 - DNA, 13 bp, Homo sapiens
tcttgaatcccat

SEQ ID NO: 480992 - DNA, 23 bp, Homo sapiens
tctttaaaatgattcacttttat

SEQ ID NO: 480993 - DNA, 17 bp, Homo sapiens
tgaaaagctagaattga

SEQ ID NO: 480994 - DNA, 20 bp, Homo sapiens
tgaaatatgatgttaaaaaa

SEQ ID NO: 480995 - DNA, 13 bp, Homo sapiens
tgaacaattctct

SEQ ID NO: 480996 - DNA, 21 bp, Homo sapiens
tgaagaaaccttcagatttgt

SEQ ID NO: 480997 - DNA, 16 bp, Homo sapiens
tgaagaatacttctca

SEQ ID NO: 480998 - DNA, 22 bp, Homo sapiens
tgaagtcaaaccttaagataat

SEQ ID NO: 480999 - DNA, 23 bp, Homo sapiens
tgaagttagctttaacttaaata

SEQ ID NO: 481000 - DNA, 19 bp, Homo sapiens
tgaatgcaaaccatagcac

SEQ ID NO: 481001 - DNA, 20 bp, Homo sapiens
tgaatggctatgtttttaat

SEQ ID NO: 481002 - DNA, 20 bp, Homo sapiens
tgaatgtctaaggtcacaca

SEQ ID NO: 481003 - DNA, 18 bp, Homo sapiens
aacagaacatagacagaa

SEQ ID NO: 481004 - DNA, 15 bp, Homo sapiens
aacaggtctcctctt

SEQ ID NO: 481005 - DNA, 18 bp, Homo sapiens
aacaggtctcctcttaaa

SEQ ID NO: 481006 - DNA, 16 bp, Homo sapiens
aacatagacagaagaa

SEQ ID NO: 481007 - DNA, 20 bp, Homo sapiens
aacatgttatttgtaataga

SEQ ID NO: 481008 - DNA, 22 bp, Homo sapiens
aaccatagcacaggctaatttt

SEQ ID NO: 481009 - DNA, 16 bp, Homo sapiens
aaccgctaaaagaaac

SEQ ID NO: 481010 - DNA, 20 bp, Homo sapiens
aaccttaagataatggataa

SEQ ID NO: 481011 - DNA, 16 bp, Homo sapiens
aacctttcttcaccaa

SEQ ID NO: 481012 - DNA, 14 bp, Homo sapiens
aactacagtctaaa

SEQ ID NO: 481013 - DNA, 14 bp, Homo sapiens
aacttgctgtgaaa

SEQ ID NO: 481014 - DNA, 15 bp, Homo sapiens
aagaaggcaaaaata

SEQ ID NO: 481015 - DNA, 22 bp, Homo sapiens
aagaagtaaaagcaaaaaagaa

SEQ ID NO: 481016 - DNA, 18 bp, Homo sapiens
aagaagtttcatcatttt

SEQ ID NO: 481017 - DNA, 17 bp, Homo sapiens
aagaatacttctcattt

SEQ ID NO: 481018 - DNA, 20 bp, Homo sapiens
aagaatctcatctcagtgaa

SEQ ID NO: 481019 - DNA, 13 bp, Homo sapiens
aagacttcaaatg

SEQ ID NO: 481020 - DNA, 18 bp, Homo sapiens
aagagctacgtatttaat

SEQ ID NO: 481021 - DNA, 16 bp, Homo sapiens
aagagttcaagaaata

SEQ ID NO: 481022 - DNA, 22 bp, Homo sapiens
aagataatggataatcttcggc

SEQ ID NO: 481023 - DNA, 13 bp, Homo sapiens
aagattttttaat

SEQ ID NO: 481024 - DNA, 17 bp, Homo sapiens
aagcaaatcgaatgaaa

SEQ ID NO: 481025 - DNA, 18 bp, Homo sapiens
aagcaaatcgaatgaaat

SEQ ID NO: 481026 - DNA, 18 bp, Homo sapiens
aagcaacctcagtaattt

SEQ ID NO: 481027 - DNA, 19 bp, Homo sapiens
aagcaagcattcagaagaa

SEQ ID NO: 481028 - DNA, 21 bp, Homo sapiens
aagcaagcattcagaagaaaa

SEQ ID NO: 481029 - DNA, 13 bp, Homo sapiens
aagcagagcttcc

SEQ ID NO: 481030 - DNA, 16 bp, Homo sapiens
acatttattttgacat

SEQ ID NO: 481031 - DNA, 21 bp, Homo sapiens
accaaaagaagtaaaagcaaa

SEQ ID NO: 481032 - DNA, 21 bp, Homo sapiens
accatcttgggattcctcccc

SEQ ID NO: 481033 - DNA, 18 bp, Homo sapiens
accatgagcaattctcct

SEQ ID NO: 481034 - DNA, 22 bp, Homo sapiens
accattttgaaatattcacaag

SEQ ID NO: 481035 - DNA, 19 bp, Homo sapiens
acccccatgccaatgtcca

SEQ ID NO: 481036 - DNA, 13 bp, Homo sapiens
accgctaaaagaa

SEQ ID NO: 481037 - DNA, 19 bp, Homo sapiens
acctcaatcagtctcagaa

SEQ ID NO: 481038 - DNA, 21 bp, Homo sapiens
acctcaatcagtctcagaatg

SEQ ID NO: 481039 - DNA, 20 bp, Homo sapiens
acctctctctaagtttagaa

SEQ ID NO: 481040 - DNA, 15 bp, Homo sapiens
acctgaagtcaaacc

SEQ ID NO: 481041 - DNA, 19 bp, Homo sapiens
accttgcatctcattgctc

SEQ ID NO: 481042 - DNA, 20 bp, Homo sapiens
acctttcttcaccaaatctt

SEQ ID NO: 481043 - DNA, 22 bp, Homo sapiens
acgcaccaccatgccaggctaa

SEQ ID NO: 481044 - DNA, 15 bp, Homo sapiens
acggggtttcaccat

SEQ ID NO: 481045 - DNA, 14 bp, Homo sapiens
acgttaattaaaca

SEQ ID NO: 481046 - DNA, 17 bp, Homo sapiens
acgtttaagccaaaaca

SEQ ID NO: 481047 - DNA, 18 bp, Homo sapiens
actagaggtgagaaattt

SEQ ID NO: 481048 - DNA, 20 bp, Homo sapiens
actatgaaaagctagaattg

SEQ ID NO: 481049 - DNA, 21 bp, Homo sapiens
actatgaaaagctagaattga

SEQ ID NO: 481050 - DNA, 22 bp, Homo sapiens
actatggtatatattttgaaag

SEQ ID NO: 481051 - DNA, 18 bp, Homo sapiens
actatttattaaaaccat

SEQ ID NO: 481052 - DNA, 15 bp, Homo sapiens
actcacctctctcta

SEQ ID NO: 481053 - DNA, 23 bp, Homo sapiens
actcaggtttccggctactgaca

SEQ ID NO: 481054 - DNA, 22 bp, Homo sapiens
actccttcaacaattctaaaat

SEQ ID NO: 481055 - DNA, 14 bp, Homo sapiens
actgactccttaga

SEQ ID NO: 481056 - DNA, 22 bp, Homo sapiens
actgaggccaaaagaggcctga

SEQ ID NO: 481057 - DNA, 17 bp, Homo sapiens
actggcctcaaagcaag

SEQ ID NO: 481058 - DNA, 20 bp, Homo sapiens
actgggtaatgaaacaaaga

SEQ ID NO: 481059 - DNA, 23 bp, Homo sapiens
actgtagtttttgttcaccttct

SEQ ID NO: 481060 - DNA, 15 bp, Homo sapiens
actgttgtacaagct

SEQ ID NO: 481061 - DNA, 23 bp, Homo sapiens
acttcaagcatggctattttata

SEQ ID NO: 481062 - DNA, 22 bp, Homo sapiens
acttctattttcaagtggaaac

SEQ ID NO: 481063 - DNA, 16 bp, Homo sapiens
acttcttgtgctttac

SEQ ID NO: 481064 - DNA, 18 bp, Homo sapiens
acttgctgtgaaatgact

SEQ ID NO: 481065 - DNA, 14 bp, Homo sapiens
actttcctatgaca

SEQ ID NO: 481066 - DNA, 23 bp, Homo sapiens
agaaaaacaaactcgttttttac

SEQ ID NO: 481067 - DNA, 15 bp, Homo sapiens
agaaactttctttct

SEQ ID NO: 481068 - DNA, 23 bp, Homo sapiens
agaaataagtttttgtttcacag

SEQ ID NO: 481069 - DNA, 16 bp, Homo sapiens
agaaatataaaaataa

SEQ ID NO: 481070 - DNA, 14 bp, Homo sapiens
agaaatcatagctg

SEQ ID NO: 481071 - DNA, 24 bp, Homo sapiens
agaaatttaaactataagcaagaa

SEQ ID NO: 481072 - DNA, 15 bp, Homo sapiens
agaagaaaaagaagc

SEQ ID NO: 481073 - DNA, 21 bp, Homo sapiens
agaagaaacaaggttttcagt

SEQ ID NO: 481074 - DNA, 22 bp, Homo sapiens
agaagaagtttcatcatttttt

SEQ ID NO: 481075 - DNA, 19 bp, Homo sapiens
agaagaatgcttaatcaga

SEQ ID NO: 481076 - DNA, 21 bp, Homo sapiens
agaagcaacctcagtaattta

SEQ ID NO: 481077 - DNA, 18 bp, Homo sapiens
agaagcgctcatctggct

SEQ ID NO: 481078 - DNA, 21 bp, Homo sapiens
agaaggtccttaatgatccgt

SEQ ID NO: 481079 - DNA, 21 bp, Homo sapiens
agaagtgaaaaagacttcaaa

SEQ ID NO: 481080 - DNA, 21 bp, Homo sapiens
agaagtttcatcattttttac

SEQ ID NO: 481081 - DNA, 23 bp, Homo sapiens
agaagtttcatcattttttactt

SEQ ID NO: 481082 - DNA, 19 bp, Homo sapiens
agaatacttctcatttttt

SEQ ID NO: 481083 - DNA, 14 bp, Homo sapiens
agaatgcttaatca

SEQ ID NO: 481084 - DNA, 20 bp, Homo sapiens
agaatgtcattttggtactt

SEQ ID NO: 481085 - DNA, 18 bp, Homo sapiens
agacaagtctagtggaac

SEQ ID NO: 481086 - DNA, 16 bp, Homo sapiens
agacagaagaaacaag

SEQ ID NO: 481087 - DNA, 17 bp, Homo sapiens
agacagaagaaacaagg

SEQ ID NO: 481088 - DNA, 17 bp, Homo sapiens
agactatcttactattt

SEQ ID NO: 481089 - DNA, 20 bp, Homo sapiens
agactatcttactatttcac

SEQ ID NO: 481090 - DNA, 16 bp, Homo sapiens
agagaagtagaaatca

SEQ ID NO: 481091 - DNA, 17 bp, Homo sapiens
agagctacgtatttaat

SEQ ID NO: 481092 - DNA, 18 bp, Homo sapiens
agagtatattatgtattt

SEQ ID NO: 481093 - DNA, 18 bp, Homo sapiens
agagttcaagaaataagt

SEQ ID NO: 481094 - DNA, 15 bp, Homo sapiens
agataactgaaaatt

SEQ ID NO: 481095 - DNA, 15 bp, Homo sapiens
agataccattttgaa

SEQ ID NO: 481096 - DNA, 23 bp, Homo sapiens
agatccatcggtttatactattt

SEQ ID NO: 481097 - DNA, 13 bp, Homo sapiens
agatttgtgttat

SEQ ID NO: 481098 - DNA, 16 bp, Homo sapiens
agattttctgctactt

SEQ ID NO: 481099 - DNA, 19 bp, Homo sapiens
agattttctgctactttgc

SEQ ID NO: 481100 - DNA, 13 bp, Homo sapiens
agattttttaata

SEQ ID NO: 481101 - DNA, 17 bp, Homo sapiens
agcaaatcgaatgaaat

SEQ ID NO: 481102 - DNA, 21 bp, Homo sapiens
agcaactacagtctaaagctg

SEQ ID NO: 481103 - DNA, 21 bp, Homo sapiens
agcaagcattcagaagaaaaa

SEQ ID NO: 481104 - DNA, 22 bp, Homo sapiens
agcaagcattcagaagaaaaag

SEQ ID NO: 481105 - DNA, 17 bp, Homo sapiens
agcacaggctaattttt

SEQ ID NO: 481106 - DNA, 21 bp, Homo sapiens
agcagtaaatgtatattgatg

SEQ ID NO: 481107 - DNA, 19 bp, Homo sapiens
agcagtgattgtcttaata

SEQ ID NO: 481108 - DNA, 17 bp, Homo sapiens
agcatggctattttata

SEQ ID NO: 481109 - DNA, 14 bp, Homo sapiens
agcattcagaagaa

SEQ ID NO: 481110 - DNA, 17 bp, Homo sapiens
agcattttgtaagttga

SEQ ID NO: 481111 - DNA, 12 bp, Homo sapiens
agccaactccat

SEQ ID NO: 481112 - DNA, 14 bp, Homo sapiens
agccattcctgttc

SEQ ID NO: 481113 - DNA, 22 bp, Homo sapiens
agccattcctgttctctttgcc

SEQ ID NO: 481114 - DNA, 23 bp, Homo sapiens
agcccaacagacaccatcttttg

SEQ ID NO: 481115 - DNA, 13 bp, Homo sapiens
agccctaaacatc

SEQ ID NO: 481116 - DNA, 22 bp, Homo sapiens
agcctctgcagcggaatctgtt

SEQ ID NO: 481117 - DNA, 23 bp, Homo sapiens
agcgaaaaaatcaggtggctttt

SEQ ID NO: 481118 - DNA, 17 bp, Homo sapiens
agctacaggggaggctg

SEQ ID NO: 481119 - DNA, 18 bp, Homo sapiens
agctacaggggaggctga

SEQ ID NO: 481120 - DNA, 13 bp, Homo sapiens
agctcaggaggcg

SEQ ID NO: 481121 - DNA, 20 bp, Homo sapiens
agctcaggaggcgaataaat

SEQ ID NO: 481122 - DNA, 13 bp, Homo sapiens
agcttaaaacttt

SEQ ID NO: 481123 - DNA, 16 bp, Homo sapiens
agcttaaaactttgaa

SEQ ID NO: 481124 - DNA, 22 bp, Homo sapiens
agcttaaaactttgaagttagc

SEQ ID NO: 481125 - DNA, 19 bp, Homo sapiens
agcttaatggctgataatt

SEQ ID NO: 481126 - DNA, 14 bp, Homo sapiens
aggaaaattgaatg

SEQ ID NO: 481127 - DNA, 16 bp, Homo sapiens
aggaaggactatgaaa

SEQ ID NO: 481128 - DNA, 14 bp, Homo sapiens
aggagaaggaggaa

SEQ ID NO: 481129 - DNA, 19 bp, Homo sapiens
aggcacactgagcaagttt

SEQ ID NO: 481130 - DNA, 20 bp, Homo sapiens
aggcaccaaaagaagtaaaa

SEQ ID NO: 481131 - DNA, 13 bp, Homo sapiens
aggcgaataaatg

SEQ ID NO: 481132 - DNA, 14 bp, Homo sapiens
aggcgaataaatgt

SEQ ID NO: 481133 - DNA, 23 bp, Homo sapiens
aggctaatttttttgtattttag

SEQ ID NO: 481134 - DNA, 18 bp, Homo sapiens
atgggtaatataaagtgt

SEQ ID NO: 481135 - DNA, 22 bp, Homo sapiens
atggtggtaaacattctctcag

SEQ ID NO: 481136 - DNA, 13 bp, Homo sapiens
atgtaaaacattt

SEQ ID NO: 481137 - DNA, 20 bp, Homo sapiens
atgtaaaacatttattttga

SEQ ID NO: 481138 - DNA, 19 bp, Homo sapiens
atgtaaatattttaaagaa

SEQ ID NO: 481139 - DNA, 20 bp, Homo sapiens
atgtaaatattttaaagaat

SEQ ID NO: 481140 - DNA, 23 bp, Homo sapiens
atgtaaatattttaaagaattgt

SEQ ID NO: 481141 - DNA, 12 bp, Homo sapiens
atgtatagtaaa

SEQ ID NO: 481142 - DNA, 15 bp, Homo sapiens
atgtatagtaaatca

SEQ ID NO: 481143 - DNA, 18 bp, Homo sapiens
atgtccaggtcacaggca

SEQ ID NO: 481144 - DNA, 15 bp, Homo sapiens
atgttatttgtaata

SEQ ID NO: 481145 - DNA, 19 bp, Homo sapiens
atgttgtgttgttatcatt

SEQ ID NO: 481146 - DNA, 19 bp, Homo sapiens
atgtttgtctgtgtgctgt

SEQ ID NO: 481147 - DNA, 23 bp, Homo sapiens
atgttttggccaatgcacctaaa

SEQ ID NO: 481148 - DNA, 14 bp, Homo sapiens
atgtttttaatgta

SEQ ID NO: 481149 - DNA, 19 bp, Homo sapiens
atgtttttaatgtatagta

SEQ ID NO: 481150 - DNA, 15 bp, Homo sapiens
attatctgatccttg

SEQ ID NO: 481151 - DNA, 14 bp, Homo sapiens
attattcactagta

SEQ ID NO: 481152 - DNA, 20 bp, Homo sapiens
attattggaatataattgtt

SEQ ID NO: 481153 - DNA, 17 bp, Homo sapiens
attcagaagaaaaagaa

SEQ ID NO: 481154 - DNA, 22 bp, Homo sapiens
attcctattgtgcaatgtaaat

SEQ ID NO: 481155 - DNA, 14 bp, Homo sapiens
attctaaaatgcct

SEQ ID NO: 481156 - DNA, 14 bp, Homo sapiens
attctcctgcctca

SEQ ID NO: 481157 - DNA, 21 bp, Homo sapiens
attgaatggctatgtttttaa

SEQ ID NO: 481158 - DNA, 20 bp, Homo sapiens
attgctgtaaataaaaatag

SEQ ID NO: 481159 - DNA, 21 bp, Homo sapiens
attgctgtaaataaaaatagc

SEQ ID NO: 481160 - DNA, 22 bp, Homo sapiens
attgctgtaaataaaaatagct

SEQ ID NO: 481161 - DNA, 15 bp, Homo sapiens
attggaaaaaattag

SEQ ID NO: 481162 - DNA, 13 bp, Homo sapiens
attgtagtaatct

SEQ ID NO: 481163 - DNA, 14 bp, Homo sapiens
attgtatcctgagg

SEQ ID NO: 481164 - DNA, 17 bp, Homo sapiens
attgtgtcagactgttt

SEQ ID NO: 481165 - DNA, 13 bp, Homo sapiens
atttaaaaaacta

SEQ ID NO: 481166 - DNA, 17 bp, Homo sapiens
atttaaaaaactaaaaa

SEQ ID NO: 481167 - DNA, 15 bp, Homo sapiens
atttaaaatagcaaa

SEQ ID NO: 481168 - DNA, 18 bp, Homo sapiens
atttaaaccgctaaaaga

SEQ ID NO: 481169 - DNA, 21 bp, Homo sapiens
atttaaaccgctaaaagaaac

SEQ ID NO: 481170 - DNA, 19 bp, Homo sapiens
atttaaactataagcaaga

SEQ ID NO: 481171 - DNA, 17 bp, Homo sapiens
atttaatagcaaagaat

SEQ ID NO: 481172 - DNA, 18 bp, Homo sapiens
atttaatagcaaagaatt

SEQ ID NO: 481173 - DNA, 13 bp, Homo sapiens
atttagaaaactt

SEQ ID NO: 481174 - DNA, 17 bp, Homo sapiens
atttatcgcagaccttt

SEQ ID NO: 481175 - DNA, 14 bp, Homo sapiens
atttattttgacat

SEQ ID NO: 481176 - DNA, 23 bp, Homo sapiens
atttcaacaagtagctaaagtct

SEQ ID NO: 481177 - DNA, 19 bp, Homo sapiens
atttcacaacagcctgaca

SEQ ID NO: 481178 - DNA, 14 bp, Homo sapiens
atttcatctatttc

SEQ ID NO: 481179 - DNA, 23 bp, Homo sapiens
atttctatagccaaaaatagcta

SEQ ID NO: 481180 - DNA, 11 bp, Homo sapiens
atttctgagaa

SEQ ID NO: 481181 - DNA, 15 bp, Homo sapiens
atttgctgcatttca

SEQ ID NO: 481182 - DNA, 15 bp, Homo sapiens
atttgtccaattctc

SEQ ID NO: 481183 - DNA, 17 bp, Homo sapiens
attttaaagaattgtgt

SEQ ID NO: 481184 - DNA, 23 bp, Homo sapiens
attttattgaatataatggcctc

SEQ ID NO: 481185 - DNA, 24 bp, Homo sapiens
attttgacataaagttgataaaga

SEQ ID NO: 481186 - DNA, 13 bp, Homo sapiens
atttttaaacaag

SEQ ID NO: 481187 - DNA, 18 bp, Homo sapiens
atttttcatgataatgaa

SEQ ID NO: 481188 - DNA, 20 bp, Homo sapiens
attttttaaaaaagcttaaa

SEQ ID NO: 481189 - DNA, 21 bp, Homo sapiens
attttttccttcaaagtttaa

SEQ ID NO: 481190 - DNA, 23 bp, Homo sapiens
attttttccttcaaagtttaata

SEQ ID NO: 481191 - DNA, 14 bp, Homo sapiens
caaaaatagctaaa

SEQ ID NO: 481192 - DNA, 14 bp, Homo sapiens
caaaaggatgattt

SEQ ID NO: 481193 - DNA, 21 bp, Homo sapiens
caaaaggatgatttaacatta

SEQ ID NO: 481194 - DNA, 23 bp, Homo sapiens
caaaatattatgcaaactactgt

SEQ ID NO: 481195 - DNA, 17 bp, Homo sapiens
caaagagttcaagaaat

SEQ ID NO: 481196 - DNA, 21 bp, Homo sapiens
caaagagttcaagaaataagt

SEQ ID NO: 481197 - DNA, 15 bp, Homo sapiens
caaagcccttttata

SEQ ID NO: 481198 - DNA, 13 bp, Homo sapiens
caaagtttaataa

SEQ ID NO: 481199 - DNA, 20 bp, Homo sapiens
caaagtttaataaatttatt

SEQ ID NO: 481200 - DNA, 13 bp, Homo sapiens
caaattccttccc

SEQ ID NO: 481201 - DNA, 13 bp, Homo sapiens
caacaattctaaa

SEQ ID NO: 481202 - DNA, 15 bp, Homo sapiens
caacatgttatttgt

SEQ ID NO: 481203 - DNA, 22 bp, Homo sapiens
caacatgttatttgtaatagat

SEQ ID NO: 481204 - DNA, 13 bp, Homo sapiens
caactcccacgac

SEQ ID NO: 481205 - DNA, 17 bp, Homo sapiens
caactcccacgactgtt

SEQ ID NO: 481206 - DNA, 23 bp, Homo sapiens
caactgtggtcccagctacaggg

SEQ ID NO: 481207 - DNA, 17 bp, Homo sapiens
caagaagcattttgtaa

SEQ ID NO: 481208 - DNA, 23 bp, Homo sapiens
caagaagcattttgtaagttgaa

SEQ ID NO: 481209 - DNA, 19 bp, Homo sapiens
caagagctacataatttag

SEQ ID NO: 481210 - DNA, 18 bp, Homo sapiens
caagcatggctattttat

SEQ ID NO: 481211 - DNA, 20 bp, Homo sapiens
caagccttactcacctctct

SEQ ID NO: 481212 - DNA, 23 bp, Homo sapiens
caagccttactcacctctctcta

SEQ ID NO: 481213 - DNA, 22 bp, Homo sapiens
caagctcaggaggcgaataaat

SEQ ID NO: 481214 - DNA, 13 bp, Homo sapiens
caagcttctttta

SEQ ID NO: 481215 - DNA, 14 bp, Homo sapiens
caatccttgttcag

SEQ ID NO: 481216 - DNA, 17 bp, Homo sapiens
caatgcacctaaagaaa

SEQ ID NO: 481217 - DNA, 18 bp, Homo sapiens
caatgcacctaaagaaaa

SEQ ID NO: 481218 - DNA, 23 bp, Homo sapiens
cacaacagcctgacaacatttct

SEQ ID NO: 481219 - DNA, 18 bp, Homo sapiens
cacaagccttactcacct

SEQ ID NO: 481220 - DNA, 19 bp, Homo sapiens
cacaagccttactcacctc

SEQ ID NO: 481221 - DNA, 21 bp, Homo sapiens
cacaagccttactcacctctc

SEQ ID NO: 481222 - DNA, 19 bp, Homo sapiens
cacatactcatttttcatg

SEQ ID NO: 481223 - DNA, 15 bp, Homo sapiens
caccaaaagaagtaa

SEQ ID NO: 481224 - DNA, 19 bp, Homo sapiens
caccttctgtgcatctggc

SEQ ID NO: 481225 - DNA, 21 bp, Homo sapiens
caccttctgtgcatctggcct

SEQ ID NO: 481226 - DNA, 21 bp, Homo sapiens
cacggaggctcgtgcatgtaa

SEQ ID NO: 481227 - DNA, 16 bp, Homo sapiens
cacgtccagaattttt

SEQ ID NO: 481228 - DNA, 19 bp, Homo sapiens
cagaacatagacagaagaa

SEQ ID NO: 481229 - DNA, 17 bp, Homo sapiens
cagaagtgaaaaagact

SEQ ID NO: 481230 - DNA, 21 bp, Homo sapiens
cagaatgtcattttggtactt

SEQ ID NO: 481231 - DNA, 15 bp, Homo sapiens
cagaattaactccat

SEQ ID NO: 481232 - DNA, 23 bp, Homo sapiens
cagactccttcaacaattctaaa

SEQ ID NO: 481233 - DNA, 22 bp, Homo sapiens
cagagctgtggactttgttcac

SEQ ID NO: 481234 - DNA, 13 bp, Homo sapiens
cagaggagaggag

SEQ ID NO: 481235 - DNA, 14 bp, Homo sapiens
cagatttgtgttat

SEQ ID NO: 481236 - DNA, 13 bp, Homo sapiens
cagcaactcccac

SEQ ID NO: 481237 - DNA, 19 bp, Homo sapiens
cagccattcctgttctctt

SEQ ID NO: 481238 - DNA, 19 bp, Homo sapiens
cagcctcccaagtagctgg

SEQ ID NO: 481239 - DNA, 17 bp, Homo sapiens
caggaaaattgaatgca

SEQ ID NO: 481240 - DNA, 19 bp, Homo sapiens
caggaggcgaataaatgtt

SEQ ID NO: 481241 - DNA, 19 bp, Homo sapiens
caggcaccaaaagaagtaa

SEQ ID NO: 481242 - DNA, 16 bp, Homo sapiens
caggcacggaggctcg

SEQ ID NO: 481243 - DNA, 13 bp, Homo sapiens
caggcctcaggga

SEQ ID NO: 481244 - DNA, 14 bp, Homo sapiens
caggcctcagggac

SEQ ID NO: 481245 - DNA, 15 bp, Homo sapiens
gattgtcttaatatt

SEQ ID NO: 481246 - DNA, 20 bp, Homo sapiens
gattttctgctactttgctg

SEQ ID NO: 481247 - DNA, 19 bp, Homo sapiens
gattttttaataatttaga

SEQ ID NO: 481248 - DNA, 13 bp, Homo sapiens
gcaaaaaagaaaa

SEQ ID NO: 481249 - DNA, 18 bp, Homo sapiens
gcaaaaaagaaaaccttt

SEQ ID NO: 481250 - DNA, 21 bp, Homo sapiens
gcaaaataaagaatagcaatt

SEQ ID NO: 481251 - DNA, 14 bp, Homo sapiens
gcaaagaattgact

SEQ ID NO: 481252 - DNA, 20 bp, Homo sapiens
gcaagaaggcaaaaatagtt

SEQ ID NO: 481253 - DNA, 23 bp, Homo sapiens
gcaagcttaatggctgataattt

SEQ ID NO: 481254 - DNA, 13 bp, Homo sapiens
gcaatgtaaatat

SEQ ID NO: 481255 - DNA, 15 bp, Homo sapiens
gcaatgtaaatattt

SEQ ID NO: 481256 - DNA, 19 bp, Homo sapiens
gcaatgtaaatattttaaa

SEQ ID NO: 481257 - DNA, 19 bp, Homo sapiens
gcaccaccatgccaggcta

SEQ ID NO: 481258 - DNA, 16 bp, Homo sapiens
gcactttgggaggctg

SEQ ID NO: 481259 - DNA, 17 bp, Homo sapiens
gcagaccttttttagga

SEQ ID NO: 481260 - DNA, 18 bp, Homo sapiens
gcatccgctgcgctccca

SEQ ID NO: 481261 - DNA, 21 bp, Homo sapiens
gcatgtttgtctgtgtgctgt

SEQ ID NO: 481262 - DNA, 23 bp, Homo sapiens
gcattattggaatataattgttt

SEQ ID NO: 481263 - DNA, 19 bp, Homo sapiens
gcattgaatggctatgttt

SEQ ID NO: 481264 - DNA, 23 bp, Homo sapiens
gccaaaacaatgtttaaaccttt

SEQ ID NO: 481265 - DNA, 14 bp, Homo sapiens
gccaatgtccaggt

SEQ ID NO: 481266 - DNA, 16 bp, Homo sapiens
gccattcctgttctct

SEQ ID NO: 481267 - DNA, 20 bp, Homo sapiens
gcccacaagccttactcacc

SEQ ID NO: 481268 - DNA, 22 bp, Homo sapiens
gcccacaagccttactcacctc

SEQ ID NO: 481269 - DNA, 23 bp, Homo sapiens
gcccacaagccttactcacctct

SEQ ID NO: 481270 - DNA, 15 bp, Homo sapiens
gcctcagggaccaag

SEQ ID NO: 481271 - DNA, 13 bp, Homo sapiens
gcctcttaaaaat

SEQ ID NO: 481272 - DNA, 14 bp, Homo sapiens
gcctcttaaaaatt

SEQ ID NO: 481273 - DNA, 14 bp, Homo sapiens
gcctgatggccagg

SEQ ID NO: 481274 - DNA, 19 bp, Homo sapiens
gcctggaggagaaggagga

SEQ ID NO: 481275 - DNA, 16 bp, Homo sapiens
gccttactcacctctc

SEQ ID NO: 481276 - DNA, 14 bp, Homo sapiens
gcgaataaatgttc

SEQ ID NO: 481277 - DNA, 15 bp, Homo sapiens
gcgaataaatgttca

SEQ ID NO: 481278 - DNA, 12 bp, Homo sapiens
gcggttcaggaa

SEQ ID NO: 481279 - DNA, 15 bp, Homo sapiens
gctaaaagaaacttt

SEQ ID NO: 481280 - DNA, 20 bp, Homo sapiens
gttaattctcagaagtgaaa

SEQ ID NO: 481281 - DNA, 14 bp, Homo sapiens
gttaatttttgata

SEQ ID NO: 481282 - DNA, 13 bp, Homo sapiens
gttataaaatctg

SEQ ID NO: 481283 - DNA, 21 bp, Homo sapiens
gttattcaataactattgctg

SEQ ID NO: 481284 - DNA, 24 bp, Homo sapiens
gttcaatgctacaaaatgtgtgct

SEQ ID NO: 481285 - DNA, 14 bp, Homo sapiens
gttcaccttctgtg

SEQ ID NO: 481286 - DNA, 17 bp, Homo sapiens
gttcaccttctgtgcat

SEQ ID NO: 481287 - DNA, 22 bp, Homo sapiens
gttctctttgccttgatgttgt

SEQ ID NO: 481288 - DNA, 16 bp, Homo sapiens
gttgaaatatgatgtt

SEQ ID NO: 481289 - DNA, 18 bp, Homo sapiens
gttggttacctattgctg

SEQ ID NO: 481290 - DNA, 21 bp, Homo sapiens
gtttcttaaataagaaacttt

SEQ ID NO: 481291 - DNA, 18 bp, Homo sapiens
taaaaaagcttaaaactt

SEQ ID NO: 481292 - DNA, 20 bp, Homo sapiens
taaaaaagcttaaaactttg

SEQ ID NO: 481293 - DNA, 14 bp, Homo sapiens
taaaacatttattt

SEQ ID NO: 481294 - DNA, 18 bp, Homo sapiens
taaaacttactatggtat

SEQ ID NO: 481295 - DNA, 14 bp, Homo sapiens
taaaagaaactttc

SEQ ID NO: 481296 - DNA, 21 bp, Homo sapiens
taaaatagcaaaagaagaagt

SEQ ID NO: 481297 - DNA, 22 bp, Homo sapiens
taaaatagcaaaagaagaagtt

SEQ ID NO: 481298 - DNA, 23 bp, Homo sapiens
taaaatgattcacttttattgta

SEQ ID NO: 481299 - DNA, 13 bp, Homo sapiens
taaaatttcaaca

SEQ ID NO: 481300 - DNA, 18 bp, Homo sapiens
taaacaagtatttgttaa

SEQ ID NO: 481301 - DNA, 22 bp, Homo sapiens
taaacaagtatttgttaattta

SEQ ID NO: 481302 - DNA, 15 bp, Homo sapiens
taaacatcattcatt

SEQ ID NO: 481303 - DNA, 17 bp, Homo sapiens
taaacatcattcatttt

SEQ ID NO: 481304 - DNA, 13 bp, Homo sapiens
taaaccttttttg

SEQ ID NO: 481305 - DNA, 14 bp, Homo sapiens
taaagaaaaacaaa

SEQ ID NO: 481306 - DNA, 15 bp, Homo sapiens
taaagcgtttgcaca

SEQ ID NO: 481307 - DNA, 20 bp, Homo sapiens
taaagttgataaagattttt

SEQ ID NO: 481308 - DNA, 17 bp, Homo sapiens
taaataaaaatagctat

SEQ ID NO: 481309 - DNA, 11 bp, Homo sapiens
taaataagaaa

SEQ ID NO: 481310 - DNA, 16 bp, Homo sapiens
taaataagaaactttt

SEQ ID NO: 481311 - DNA, 12 bp, Homo sapiens
taaatagtattt

SEQ ID NO: 481312 - DNA, 16 bp, Homo sapiens
taaatctaaattaact

SEQ ID NO: 481313 - DNA, 17 bp, Homo sapiens
taaatctaaattaactt

SEQ ID NO: 481314 - DNA, 19 bp, Homo sapiens
taaatcttttataggattt

SEQ ID NO: 481315 - DNA, 13 bp, Homo sapiens
taaatgaaatact

SEQ ID NO: 481316 - DNA, 14 bp, Homo sapiens
taaatgaaatactt

SEQ ID NO: 481317 - DNA, 19 bp, Homo sapiens
taaatgatatgtctttaaa

SEQ ID NO: 481318 - DNA, 19 bp, Homo sapiens
taaatgtatattgatgtaa

SEQ ID NO: 481319 - DNA, 15 bp, Homo sapiens
taaattaacttctat

SEQ ID NO: 481320 - DNA, 13 bp, Homo sapiens
taacaggtctcct

SEQ ID NO: 481321 - DNA, 16 bp, Homo sapiens
taacaggtctcctctt

SEQ ID NO: 481322 - DNA, 19 bp, Homo sapiens
taacaggtctcctcttaaa

SEQ ID NO: 481323 - DNA, 22 bp, Homo sapiens
taaccagacacatactcatttt

SEQ ID NO: 481324 - DNA, 14 bp, Homo sapiens
taactctctttatg

SEQ ID NO: 481325 - DNA, 19 bp, Homo sapiens
taactgggtaatgaaacaa

SEQ ID NO: 481326 - DNA, 15 bp, Homo sapiens
taacttgctgtgaaa

SEQ ID NO: 481327 - DNA, 12 bp, Homo sapiens
taagagaagtag

SEQ ID NO: 481328 - DNA, 20 bp, Homo sapiens
taagagaagtagaaatcata

SEQ ID NO: 481329 - DNA, 21 bp, Homo sapiens
taagataatggataatcttcg

SEQ ID NO: 481330 - DNA, 18 bp, Homo sapiens
taagataattaaatgaaa

SEQ ID NO: 481331 - DNA, 21 bp, Homo sapiens
taagataattaaatgaaatac

SEQ ID NO: 481332 - DNA, 16 bp, Homo sapiens
taagccaaaacaatgt

SEQ ID NO: 481333 - DNA, 19 bp, Homo sapiens
taaggtacaagaagcattt

SEQ ID NO: 481334 - DNA, 22 bp, Homo sapiens
taataatttagacttcaagcat

SEQ ID NO: 481335 - DNA, 21 bp, Homo sapiens
taatagatgtttgatagattt

SEQ ID NO: 481336 - DNA, 15 bp, Homo sapiens
taatagcaaagaatt

SEQ ID NO: 481337 - DNA, 15 bp, Homo sapiens
taatatcctaaacat

SEQ ID NO: 481338 - DNA, 23 bp, Homo sapiens
taatgaaacaaagagttcaagaa

SEQ ID NO: 481339 - DNA, 12 bp, Homo sapiens
taattaaatgaa

SEQ ID NO: 481340 - DNA, 22 bp, Homo sapiens
taattaaatgaaatacttgaca

SEQ ID NO: 481341 - DNA, 21 bp, Homo sapiens
taatttagaaaactttaaagc

SEQ ID NO: 481342 - DNA, 15 bp, Homo sapiens
taatttagaaatcat

SEQ ID NO: 481343 - DNA, 16 bp, Homo sapiens
taatttagtttcatat

SEQ ID NO: 481344 - DNA, 15 bp, Homo sapiens
tacaaaaaaaatcaa

SEQ ID NO: 481345 - DNA, 21 bp, Homo sapiens
tacaaaatgtgtgcttggaaa

SEQ ID NO: 481346 - DNA, 14 bp, Homo sapiens
tacaagaagcattt

SEQ ID NO: 481347 - DNA, 18 bp, Homo sapiens
tacatgctaagagaagta

SEQ ID NO: 481348 - DNA, 15 bp, Homo sapiens
tacatttatgtgtga

SEQ ID NO: 481349 - DNA, 17 bp, Homo sapiens
taccaggcaccaaaaga

SEQ ID NO: 481350 - DNA, 15 bp, Homo sapiens
taccattttgaaata

SEQ ID NO: 481351 - DNA, 18 bp, Homo sapiens
tacctattgctgtaaata

SEQ ID NO: 481352 - DNA, 16 bp, Homo sapiens
tacgtatttaatagca

SEQ ID NO: 481353 - DNA, 20 bp, Homo sapiens
tactaagcattgaatggcta

SEQ ID NO: 481354 - DNA, 13 bp, Homo sapiens
tactatttcacaa

SEQ ID NO: 481355 - DNA, 13 bp, Homo sapiens
tactcacctctct

SEQ ID NO: 481356 - DNA, 18 bp, Homo sapiens
tactcacctctctctaag

SEQ ID NO: 481357 - DNA, 17 bp, Homo sapiens
tacttatttataacatt

SEQ ID NO: 481358 - DNA, 11 bp, Homo sapiens
tagaaaacttt

SEQ ID NO: 481359 - DNA, 11 bp, Homo sapiens
tagaaatcata

SEQ ID NO: 481360 - DNA, 17 bp, Homo sapiens
tagaaatcattttgcaa

SEQ ID NO: 481361 - DNA, 19 bp, Homo sapiens
tagaattgagtgtttaaag

SEQ ID NO: 481362 - DNA, 22 bp, Homo sapiens
tagacttcaagcatggctattt

SEQ ID NO: 481363 - DNA, 19 bp, Homo sapiens
tagagacggggtttcacca

SEQ ID NO: 481364 - DNA, 12 bp, Homo sapiens
tagcaaagaatt

SEQ ID NO: 481365 - DNA, 14 bp, Homo sapiens
tagcaaagaattga

SEQ ID NO: 481366 - DNA, 19 bp, Homo sapiens
tagcactttgggaggctga

SEQ ID NO: 481367 - DNA, 18 bp, Homo sapiens
tagctcagaggagaggag

SEQ ID NO: 481368 - DNA, 19 bp, Homo sapiens
tagctggaactacaggctc

SEQ ID NO: 481369 - DNA, 14 bp, Homo sapiens
tagctgggactaca

SEQ ID NO: 481370 - DNA, 16 bp, Homo sapiens
tagctttaacttaaat

SEQ ID NO: 481371 - DNA, 16 bp, Homo sapiens
taggatttatttaaaa

SEQ ID NO: 481372 - DNA, 17 bp, Homo sapiens
taggatttatttaaaat

SEQ ID NO: 481373 - DNA, 22 bp, Homo sapiens
tagtaaatcacgctttttgaaa

SEQ ID NO: 481374 - DNA, 17 bp, Homo sapiens
tagtaatctgcattatt

SEQ ID NO: 481375 - DNA, 19 bp, Homo sapiens
tagtgaaaattttattgaa

SEQ ID NO: 481376 - DNA, 20 bp, Homo sapiens
tagtttcatataaagtatca

SEQ ID NO: 481377 - DNA, 22 bp, Homo sapiens
tataatggcctcttaaaaatta

SEQ ID NO: 481378 - DNA, 18 bp, Homo sapiens
tatacatgtttagtatta

SEQ ID NO: 481379 - DNA, 19 bp, Homo sapiens
tatagccaaaaatagctaa

SEQ ID NO: 481380 - DNA, 17 bp, Homo sapiens
tatatattttgaaagga

SEQ ID NO: 481381 - DNA, 19 bp, Homo sapiens
tatatattttgaaaggaga

SEQ ID NO: 481382 - DNA, 19 bp, Homo sapiens
tatatttaactctctttat

SEQ ID NO: 481383 - DNA, 23 bp, Homo sapiens
tatcatcagtgtagaacctaatt

SEQ ID NO: 481384 - DNA, 19 bp, Homo sapiens
tatctgaatttttaaacaa

SEQ ID NO: 481385 - DNA, 14 bp, Homo sapiens
tatgaaaaagaaga

SEQ ID NO: 481386 - DNA, 18 bp, Homo sapiens
tatgatgttaaaaaaata

SEQ ID NO: 481387 - DNA, 12 bp, Homo sapiens
tatgtctttaaa

SEQ ID NO: 481388 - DNA, 23 bp, Homo sapiens
tattcccaagctctagtgggaag

SEQ ID NO: 481389 - DNA, 19 bp, Homo sapiens
tattgctgtaaataaaaat

SEQ ID NO: 481390 - DNA, 22 bp, Homo sapiens
tattgctgtaaataaaaatagc

SEQ ID NO: 481391 - DNA, 19 bp, Homo sapiens
tattgtgcaatgtaaatat

SEQ ID NO: 481392 - DNA, 14 bp, Homo sapiens
tccttaatgatccg

SEQ ID NO: 481393 - DNA, 21 bp, Homo sapiens
tccttcaaagtttaataaatt

SEQ ID NO: 481394 - DNA, 17 bp, Homo sapiens
tcctttctgatcctctc

SEQ ID NO: 481395 - DNA, 14 bp, Homo sapiens
tcgcttgcttctgc

SEQ ID NO: 481396 - DNA, 16 bp, Homo sapiens
tcgcttgcttctgcag

SEQ ID NO: 481397 - DNA, 19 bp, Homo sapiens
tcgcttgcttctgcagcaa

SEQ ID NO: 481398 - DNA, 21 bp, Homo sapiens
tctaaagctggtttaatgttt

SEQ ID NO: 481399 - DNA, 21 bp, Homo sapiens
tctaagtttagaagcgctcat

SEQ ID NO: 481400 - DNA, 15 bp, Homo sapiens
tctagatatgagaaa

SEQ ID NO: 481401 - DNA, 17 bp, Homo sapiens
tctagatatgagaaata

SEQ ID NO: 481402 - DNA, 14 bp, Homo sapiens
tctcactaaatctt

SEQ ID NO: 481403 - DNA, 20 bp, Homo sapiens
tctcattttttaaaaaagct

SEQ ID NO: 481404 - DNA, 12 bp, Homo sapiens
tctcctcttaaa

SEQ ID NO: 481405 - DNA, 22 bp, Homo sapiens
tctcttttgaatccatgcttgg

SEQ ID NO: 481406 - DNA, 23 bp, Homo sapiens
tctcttttgaatccatgcttggg

SEQ ID NO: 481407 - DNA, 19 bp, Homo sapiens
tctgaatttttaaacaagt

SEQ ID NO: 481408 - DNA, 18 bp, Homo sapiens
tctgagaaggtccttaat

SEQ ID NO: 481409 - DNA, 20 bp, Homo sapiens
tctgagaaggtccttaatga

SEQ ID NO: 481410 - DNA, 14 bp, Homo sapiens
tctgatcctctctt

SEQ ID NO: 481411 - DNA, 14 bp, Homo sapiens
tctgcagcaactcc

SEQ ID NO: 481412 - DNA, 19 bp, Homo sapiens
tctgcagcaactcccacga

SEQ ID NO: 481413 - DNA, 23 bp, Homo sapiens
tctggcttttcgcttgcttctgc

SEQ ID NO: 481414 - DNA, 15 bp, Homo sapiens
tctgtgcatctggcc

SEQ ID NO: 481415 - DNA, 17 bp, Homo sapiens
tctgtgcatctggcctg

SEQ ID NO: 481416 - DNA, 16 bp, Homo sapiens
tcttcaccaaatcttg

SEQ ID NO: 481417 - DNA, 23 bp, Homo sapiens
tcttgcaggaaggactatgaaaa

SEQ ID NO: 481418 - DNA, 17 bp, Homo sapiens
tctttctcactaaatct

SEQ ID NO: 481419 - DNA, 20 bp, Homo sapiens
tcttttgaatccatgcttgg

SEQ ID NO: 481420 - DNA, 19 bp, Homo sapiens
tgaaaaggtttatgaaaaa

SEQ ID NO: 481421 - DNA, 13 bp, Homo sapiens
tgaaaataattgt

SEQ ID NO: 481422 - DNA, 17 bp, Homo sapiens
tgaaaattatttaaacc

SEQ ID NO: 481423 - DNA, 23 bp, Homo sapiens
tgaaacaaagagttcaagaaata

SEQ ID NO: 481424 - DNA, 16 bp, Homo sapiens
tgaaatatgatgttaa

SEQ ID NO: 481425 - DNA, 13 bp, Homo sapiens
tgaacagaacata

SEQ ID NO: 481426 - DNA, 19 bp, Homo sapiens
tgaagaatacttctcattt

SEQ ID NO: 481427 - DNA, 16 bp, Homo sapiens
tgaagaggtgagagta

SEQ ID NO: 481428 - DNA, 15 bp, Homo sapiens
tgaagccctaagtaa

SEQ ID NO: 481429 - DNA, 19 bp, Homo sapiens
tgaagtcaaaccttaagat

SEQ ID NO: 481430 - DNA, 14 bp, Homo sapiens
tgaatccatgcttg

SEQ ID NO: 481431 - DNA, 17 bp, Homo sapiens
tgaatccatgcttgggt

SEQ ID NO: 481432 - DNA, 18 bp, Homo sapiens
tgaatttattattgttct

SEQ ID NO: 481433 - DNA, 19 bp, Homo sapiens
tgaatttttaaacaagtat

SEQ ID NO: 481434 - DNA, 23 bp, Homo sapiens
tgaatttttaaacaagtatttgt

SEQ ID NO: 481435 - DNA, 14 bp, Homo sapiens
tgacagactctcgt

SEQ ID NO: 481436 - DNA, 21 bp, Homo sapiens
tgacagcatttcagctgtgag

SEQ ID NO: 481437 - DNA, 16 bp, Homo sapiens
tgacataaagttgata

SEQ ID NO: 481438 - DNA, 22 bp, Homo sapiens
tgactccttagagacatcaaaa

SEQ ID NO: 481439 - DNA, 14 bp, Homo sapiens
tgagaaatttaaac

SEQ ID NO: 481440 - DNA, 17 bp, Homo sapiens
tgagaaatttaaactat

SEQ ID NO: 481441 - DNA, 16 bp, Homo sapiens
tgagaaggtccttaat

SEQ ID NO: 481442 - DNA, 18 bp, Homo sapiens
tgagatggagtctcactc

SEQ ID NO: 481443 - DNA, 21 bp, Homo sapiens
tgagcagtaaatgtatattga

SEQ ID NO: 481444 - DNA, 16 bp, Homo sapiens
tgataatgaacagaac

SEQ ID NO: 481445 - DNA, 15 bp, Homo sapiens
tgatatgtctttaaa

SEQ ID NO: 481446 - DNA, 20 bp, Homo sapiens
tgatatgtctttaaaatgat

SEQ ID NO: 481447 - DNA, 21 bp, Homo sapiens
tgatgccaaaaaaaaatacat

SEQ ID NO: 481448 - DNA, 16 bp, Homo sapiens
tgatgttgtgttgtta

SEQ ID NO: 481449 - DNA, 15 bp, Homo sapiens
tgcaatcccttaata

SEQ ID NO: 481450 - DNA, 14 bp, Homo sapiens
tgcacctaaagaaa

SEQ ID NO: 481451 - DNA, 12 bp, Homo sapiens
tgcagcaactcc

SEQ ID NO: 481452 - DNA, 13 bp, Homo sapiens
tgcagcaactccc

SEQ ID NO: 481453 - DNA, 17 bp, Homo sapiens
tgcagcaactcccacga

SEQ ID NO: 481454 - DNA, 13 bp, Homo sapiens
tgcatctggcctg

SEQ ID NO: 481455 - DNA, 14 bp, Homo sapiens
tgcatctggcctgg

SEQ ID NO: 481456 - DNA, 14 bp, Homo sapiens
ttaatatcctaaac

SEQ ID NO: 481457 - DNA, 16 bp, Homo sapiens
ttaatggctgataatt

SEQ ID NO: 481458 - DNA, 18 bp, Homo sapiens
ttaatggctgataatttt

SEQ ID NO: 481459 - DNA, 15 bp, Homo sapiens
ttaattaaacaaatt

SEQ ID NO: 481460 - DNA, 21 bp, Homo sapiens
ttaccaggcaccaaaagaagt

SEQ ID NO: 481461 - DNA, 21 bp, Homo sapiens
ttagctcagaggagaggagca

SEQ ID NO: 481462 - DNA, 14 bp, Homo sapiens
ttataacattgtaa

SEQ ID NO: 481463 - DNA, 17 bp, Homo sapiens
ttataacattgtaaatg

SEQ ID NO: 481464 - DNA, 18 bp, Homo sapiens
ttataggatttatttaaa

SEQ ID NO: 481465 - DNA, 18 bp, Homo sapiens
ttatctgaatttttaaac

SEQ ID NO: 481466 - DNA, 17 bp, Homo sapiens
ttatgaaaaagaagaat

SEQ ID NO: 481467 - DNA, 18 bp, Homo sapiens
ttatgaaaaagaagaatc

SEQ ID NO: 481468 - DNA, 15 bp, Homo sapiens
ttatttaaaatagca

SEQ ID NO: 481469 - DNA, 23 bp, Homo sapiens
ttatttaaaccgctaaaagaaac

SEQ ID NO: 481470 - DNA, 16 bp, Homo sapiens
ttatttgtaatagatg

SEQ ID NO: 481471 - DNA, 17 bp, Homo sapiens
ttatttgtaatagatgt

SEQ ID NO: 481472 - DNA, 23 bp, Homo sapiens
ttattttgccatggatgagagtc

SEQ ID NO: 481473 - DNA, 16 bp, Homo sapiens
ttcaatgctacaaaat

SEQ ID NO: 481474 - DNA, 22 bp, Homo sapiens
ttcacaacagcctgacaacatt

SEQ ID NO: 481475 - DNA, 14 bp, Homo sapiens
ttcaccaaatcttg

SEQ ID NO: 481476 - DNA, 17 bp, Homo sapiens
ttcaccttctgtgcatc

SEQ ID NO: 481477 - DNA, 18 bp, Homo sapiens
ttcaggaaaattgaatgc

SEQ ID NO: 481478 - DNA, 17 bp, Homo sapiens
ttcatctatttctgaga

SEQ ID NO: 481479 - DNA, 15 bp, Homo sapiens
ttcatgataatgaac

SEQ ID NO: 481480 - DNA, 22 bp, Homo sapiens
ttcccaaaatgttgaaatatga

SEQ ID NO: 481481 - DNA, 14 bp, Homo sapiens
ttcctcatgaatta

SEQ ID NO: 481482 - DNA, 12 bp, Homo sapiens
ttcctcccctgg

SEQ ID NO: 481483 - DNA, 15 bp, Homo sapiens
ttcgcttgcttctgc

SEQ ID NO: 481484 - DNA, 17 bp, Homo sapiens
ttcgcttgcttctgcag

SEQ ID NO: 481485 - DNA, 14 bp, Homo sapiens
ttctatagccaaaa

SEQ ID NO: 481486 - DNA, 15 bp, Homo sapiens
ttctcactaaatctt

SEQ ID NO: 481487 - DNA, 17 bp, Homo sapiens
ttctcattttttaaaaa

SEQ ID NO: 481488 - DNA, 23 bp, Homo sapiens
ttctcattttttaaaaaagctta

SEQ ID NO: 481489 - DNA, 12 bp, Homo sapiens
ttctctaaaaca

SEQ ID NO: 481490 - DNA, 18 bp, Homo sapiens
ttctcttctacttcttgt

SEQ ID NO: 481491 - DNA, 17 bp, Homo sapiens
ttctctttgccttgatg

SEQ ID NO: 481492 - DNA, 18 bp, Homo sapiens
ttctgaagtctactttgt

SEQ ID NO: 481493 - DNA, 18 bp, Homo sapiens
ttctgagaaggtccttaa

SEQ ID NO: 481494 - DNA, 15 bp, Homo sapiens
ttctgatcctctctt

SEQ ID NO: 481495 - DNA, 15 bp, Homo sapiens
ttctgcagcaactcc

SEQ ID NO: 481496 - DNA, 18 bp, Homo sapiens
ttctgcagcaactcccac

SEQ ID NO: 481497 - DNA, 21 bp, Homo sapiens
ttctgcagcaactcccacgac

SEQ ID NO: 481498 - DNA, 21 bp, Homo sapiens
ttctgctactttgctgctatg

SEQ ID NO: 481499 - DNA, 14 bp, Homo sapiens
ttctgtctttagat

SEQ ID NO: 481500 - DNA, 19 bp, Homo sapiens
ttcttaaataagaaacttt

SEQ ID NO: 481501 - DNA, 16 bp, Homo sapiens
ttcttcaccaaatctt

SEQ ID NO: 481502 - DNA, 17 bp, Homo sapiens
ttgaatccatgcttggg

SEQ ID NO: 481503 - DNA, 19 bp, Homo sapiens
ttgaatccatgcttgggtg

SEQ ID NO: 481504 - DNA, 15 bp, Homo sapiens
ttgacataaagttga

SEQ ID NO: 481505 - DNA, 22 bp, Homo sapiens
ttgagcagtaaatgtatattga

SEQ ID NO: 481506 - DNA, 18 bp, Homo sapiens
ttgcaatcccttaatatc

SEQ ID NO: 481507 - DNA, 12 bp, Homo sapiens
ttgccaggctag

SEQ ID NO: 481508 - DNA, 14 bp, Homo sapiens
ttgcggttcaggaa

SEQ ID NO: 481509 - DNA, 19 bp, Homo sapiens
ttgctaagataattaaatg

SEQ ID NO: 481510 - DNA, 13 bp, Homo sapiens
ttgcttctgcagc

SEQ ID NO: 481511 - DNA, 24 bp, Homo sapiens
ttgcttctgcagcaactcccacga

SEQ ID NO: 481512 - DNA, 11 bp, Homo sapiens
ttgggaggctg

SEQ ID NO: 481513 - DNA, 19 bp, Homo sapiens
ttggtaacttgctgtgaaa

SEQ ID NO: 481514 - DNA, 13 bp, Homo sapiens
aaaaaaaatatga

SEQ ID NO: 481515 - DNA, 14 bp, Homo sapiens
aaaaaaatatgaga

SEQ ID NO: 481516 - DNA, 12 bp, Homo sapiens
aaaaaaatcaaa

SEQ ID NO: 481517 - DNA, 14 bp, Homo sapiens
aaaaagaagaatct

SEQ ID NO: 481518 - DNA, 12 bp, Homo sapiens
aaaaagcttaaa

SEQ ID NO: 481519 - DNA, 17 bp, Homo sapiens
aaaaagcttaaaacttt

SEQ ID NO: 481520 - DNA, 22 bp, Homo sapiens
aaaaataagaagaatgcttaat

SEQ ID NO: 481521 - DNA, 18 bp, Homo sapiens
aaaaatagctataaatag

SEQ ID NO: 481522 - DNA, 14 bp, Homo sapiens
aaaaatgatctaaa

SEQ ID NO: 481523 - DNA, 23 bp, Homo sapiens
aaaaatggaaacatttattcctt

SEQ ID NO: 481524 - DNA, 16 bp, Homo sapiens
aaaacatttattttga

SEQ ID NO: 481525 - DNA, 13 bp, Homo sapiens
aaaactaaaaact

SEQ ID NO: 481526 - DNA, 12 bp, Homo sapiens
aaaagaaacttt

SEQ ID NO: 481527 - DNA, 14 bp, Homo sapiens
aaaagctagaattg

SEQ ID NO: 481528 - DNA, 14 bp, Homo sapiens
aaaaggtttatgaa

SEQ ID NO: 481529 - DNA, 23 bp, Homo sapiens
aaaaggtttatgaaaaagaagaa

SEQ ID NO: 481530 - DNA, 19 bp, Homo sapiens
aaaatatgagattggaaaa

SEQ ID NO: 481531 - DNA, 17 bp, Homo sapiens
aaaatgttgaaatatga

SEQ ID NO: 481532 - DNA, 21 bp, Homo sapiens
aaaattgaatgcaaaccatag

SEQ ID NO: 481533 - DNA, 15 bp, Homo sapiens
aaacaaattccttcc

SEQ ID NO: 481534 - DNA, 19 bp, Homo sapiens
aaacaccaacataaaaatg

SEQ ID NO: 481535 - DNA, 18 bp, Homo sapiens
aaacatttattttgacat

SEQ ID NO: 481536 - DNA, 15 bp, Homo sapiens
aaaccgctaaaagaa

SEQ ID NO: 481537 - DNA, 18 bp, Homo sapiens
aaaccgctaaaagaaact

SEQ ID NO: 481538 - DNA, 21 bp, Homo sapiens
aaaccgctaaaagaaactttc

SEQ ID NO: 481539 - DNA, 17 bp, Homo sapiens
aaacctttcttcaccaa

SEQ ID NO: 481540 - DNA, 13 bp, Homo sapiens
aaactgatgcttt

SEQ ID NO: 481541 - DNA, 22 bp, Homo sapiens
aaactttaaagcgtttgcacag

SEQ ID NO: 481542 - DNA, 16 bp, Homo sapiens
aaactttgaagttagc

SEQ ID NO: 481543 - DNA, 19 bp, Homo sapiens
aaacttttttatttaaaaa

SEQ ID NO: 481544 - DNA, 13 bp, Homo sapiens
aaagaaaaccttt

SEQ ID NO: 481545 - DNA, 14 bp, Homo sapiens
aaagagttcaagaa

SEQ ID NO: 481546 - DNA, 19 bp, Homo sapiens
aaagattttttaataattt

SEQ ID NO: 481547 - DNA, 21 bp, Homo sapiens
aaagcaaaaaagaaaaccttt

SEQ ID NO: 481548 - DNA, 20 bp, Homo sapiens
aaagcaagcattcagaagaa

SEQ ID NO: 481549 - DNA, 12 bp, Homo sapiens
aaagcgaaaaaa

SEQ ID NO: 481550 - DNA, 18 bp, Homo sapiens
aaagctgtgtgtttggaa

SEQ ID NO: 481551 - DNA, 14 bp, Homo sapiens
aaagcttaaaactt

SEQ ID NO: 481552 - DNA, 15 bp, Homo sapiens
aaagcttaaaacttt

SEQ ID NO: 481553 - DNA, 16 bp, Homo sapiens
aaagcttaaaactttg

SEQ ID NO: 481554 - DNA, 19 bp, Homo sapiens
aaagcttaaaactttgaag

SEQ ID NO: 481555 - DNA, 18 bp, Homo sapiens
aaaggtttatgaaaaaga

SEQ ID NO: 481556 - DNA, 22 bp, Homo sapiens
aaaggtttatgaaaaagaagaa

SEQ ID NO: 481557 - DNA, 18 bp, Homo sapiens
aaagttcaacatgttatt

SEQ ID NO: 481558 - DNA, 18 bp, Homo sapiens
aaagttgataaagatttt

SEQ ID NO: 481559 - DNA, 15 bp, Homo sapiens
aaagtttaataaatt

SEQ ID NO: 481560 - DNA, 14 bp, Homo sapiens
aaataagaagaatg

SEQ ID NO: 481561 - DNA, 13 bp, Homo sapiens
aaatacttgacaa

SEQ ID NO: 481562 - DNA, 21 bp, Homo sapiens
aaatagctataaatagtgaaa

SEQ ID NO: 481563 - DNA, 13 bp, Homo sapiens
aaatagtgaaaat

SEQ ID NO: 481564 - DNA, 17 bp, Homo sapiens
aaatatgagattggaaa

SEQ ID NO: 481565 - DNA, 21 bp, Homo sapiens
aaatatgatgttaaaaaaata

SEQ ID NO: 481566 - DNA, 14 bp, Homo sapiens
aaatattttaaaga

SEQ ID NO: 481567 - DNA, 17 bp, Homo sapiens
aaatcacgctttttgaa

SEQ ID NO: 481568 - DNA, 17 bp, Homo sapiens
aaatccttgccttcaaa

SEQ ID NO: 481569 - DNA, 22 bp, Homo sapiens
aaatctaaattaacttctattt

SEQ ID NO: 481570 - DNA, 15 bp, Homo sapiens
aaatctgtattgcta

SEQ ID NO: 481571 - DNA, 18 bp, Homo sapiens
aaatcttttataggattt

SEQ ID NO: 481572 - DNA, 12 bp, Homo sapiens
aaatgaaatact

SEQ ID NO: 481573 - DNA, 13 bp, Homo sapiens
aaatgaaatactt

SEQ ID NO: 481574 - DNA, 21 bp, Homo sapiens
aaatgattcacttttattgta

SEQ ID NO: 481575 - DNA, 14 bp, Homo sapiens
aaatttaaactata

SEQ ID NO: 481576 - DNA, 12 bp, Homo sapiens
aaattttattga

SEQ ID NO: 481577 - DNA, 21 bp, Homo sapiens
aacaaaatccttgccttcaaa

SEQ ID NO: 481578 - DNA, 20 bp, Homo sapiens
aacaaactcgttttttacaa

SEQ ID NO: 481579 - DNA, 23 bp, Homo sapiens
aacaaagagttcaagaaataagt

SEQ ID NO: 481580 - DNA, 12 bp, Homo sapiens
aacaattctaaa

SEQ ID NO: 481581 - DNA, 19 bp, Homo sapiens
aacaattctaaaatgattg

SEQ ID NO: 481582 - DNA, 22 bp, Homo sapiens
aacaattctaaaatgattgtag

SEQ ID NO: 481583 - DNA, 17 bp, Homo sapiens
aacaggtctcctcttaa

SEQ ID NO: 481584 - DNA, 13 bp, Homo sapiens
aacataaaaatga

SEQ ID NO: 481585 - DNA, 15 bp, Homo sapiens
aacatagacagaaga

SEQ ID NO: 481586 - DNA, 15 bp, Homo sapiens
aacatttattttgac

SEQ ID NO: 481587 - DNA, 17 bp, Homo sapiens
aacatttattttgacat

SEQ ID NO: 481588 - DNA, 19 bp, Homo sapiens
aacatttattttgacataa

SEQ ID NO: 481589 - DNA, 20 bp, Homo sapiens
aacgtttaagccaaaacaat

SEQ ID NO: 481590 - DNA, 22 bp, Homo sapiens
aactagaggtgagaaatttaaa

SEQ ID NO: 481591 - DNA, 12 bp, Homo sapiens
aactgaaaatta

SEQ ID NO: 481592 - DNA, 17 bp, Homo sapiens
aactgaaaattatttaa

SEQ ID NO: 481593 - DNA, 16 bp, Homo sapiens
aactgatgctttcaga

SEQ ID NO: 481594 - DNA, 18 bp, Homo sapiens
aactgggtaatgaaacaa

SEQ ID NO: 481595 - DNA, 12 bp, Homo sapiens
aacttgctgtga

SEQ ID NO: 481596 - DNA, 16 bp, Homo sapiens
aacttggttttgctac

SEQ ID NO: 481597 - DNA, 23 bp, Homo sapiens
aacttttttatttaaaaaactaa

SEQ ID NO: 481598 - DNA, 15 bp, Homo sapiens
aagaaaaagaagcaa

SEQ ID NO: 481599 - DNA, 21 bp, Homo sapiens
aagaagcaacctcagtaattt

SEQ ID NO: 481600 - DNA, 22 bp, Homo sapiens
aagaagcattttgtaagttgaa

SEQ ID NO: 481601 - DNA, 19 bp, Homo sapiens
aagaaggcaaaaatagttt

SEQ ID NO: 481602 - DNA, 14 bp, Homo sapiens
aagaagtaaaagca

SEQ ID NO: 481603 - DNA, 17 bp, Homo sapiens
aagaatgcttaatcaga

SEQ ID NO: 481604 - DNA, 13 bp, Homo sapiens
aagagaagtagaa

SEQ ID NO: 481605 - DNA, 16 bp, Homo sapiens
aagagctacataattt

SEQ ID NO: 481606 - DNA, 22 bp, Homo sapiens
aagaggagagaggaagctctct

SEQ ID NO: 481607 - DNA, 14 bp, Homo sapiens
aagagttcaagaaa

SEQ ID NO: 481608 - DNA, 22 bp, Homo sapiens
aagataattaaatgaaatactt

SEQ ID NO: 481609 - DNA, 17 bp, Homo sapiens
aagatacttaagtgctg

SEQ ID NO: 481610 - DNA, 14 bp, Homo sapiens
aagattttttaata

SEQ ID NO: 481611 - DNA, 15 bp, Homo sapiens
aagcaaaaaagaaaa

SEQ ID NO: 481612 - DNA, 15 bp, Homo sapiens
aagcaacctcagtaa

SEQ ID NO: 481613 - DNA, 19 bp, Homo sapiens
aagcaacctcagtaattta

SEQ ID NO: 481614 - DNA, 20 bp, Homo sapiens
aagcaacctcagtaatttag

SEQ ID NO: 481615 - DNA, 21 bp, Homo sapiens
aagcaacctcagtaatttaga

SEQ ID NO: 481616 - DNA, 13 bp, Homo sapiens
aagcaagcttaat

SEQ ID NO: 481617 - DNA, 12 bp, Homo sapiens
aagccaaaacaa

SEQ ID NO: 481618 - DNA, 18 bp, Homo sapiens
aagccttactcacctctc

SEQ ID NO: 481619 - DNA, 15 bp, Homo sapiens
aagcgaaaaaatcag

SEQ ID NO: 481620 - DNA, 15 bp, Homo sapiens
aagctcaaggctgca

SEQ ID NO: 481621 - DNA, 16 bp, Homo sapiens
aagctctagtgggaag

SEQ ID NO: 481622 - DNA, 22 bp, Homo sapiens
aaggagatggggagggcgcttt

SEQ ID NO: 481623 - DNA, 13 bp, Homo sapiens
aagtaaaagcaaa

SEQ ID NO: 481624 - DNA, 18 bp, Homo sapiens
aagtaaaagcaaaaaaga

SEQ ID NO: 481625 - DNA, 13 bp, Homo sapiens
aagtagaaatcat

SEQ ID NO: 481626 - DNA, 17 bp, Homo sapiens
aagtttaataaatttat

SEQ ID NO: 481627 - DNA, 19 bp, Homo sapiens
aataaaaactgactcctta

SEQ ID NO: 481628 - DNA, 21 bp, Homo sapiens
aataaaaactgactccttaga

SEQ ID NO: 481629 - DNA, 13 bp, Homo sapiens
aataaaaatagct

SEQ ID NO: 481630 - DNA, 13 bp, Homo sapiens
aataagaaacttt

SEQ ID NO: 481631 - DNA, 15 bp, Homo sapiens
aataaggtacaagaa

SEQ ID NO: 481632 - DNA, 21 bp, Homo sapiens
aatacatgctaagagaagtag

SEQ ID NO: 481633 - DNA, 22 bp, Homo sapiens
aatacatgctaagagaagtaga

SEQ ID NO: 481634 - DNA, 22 bp, Homo sapiens
aatacttctcattttttaaaaa

SEQ ID NO: 481635 - DNA, 15 bp, Homo sapiens
aatagattatagttg

SEQ ID NO: 481636 - DNA, 13 bp, Homo sapiens
aatagcaaaagaa

SEQ ID NO: 481637 - DNA, 16 bp, Homo sapiens
aatagcaaaagaagaa

SEQ ID NO: 481638 - DNA, 15 bp, Homo sapiens
aatagcaaagaattg

SEQ ID NO: 481639 - DNA, 22 bp, Homo sapiens
aatagctataaatagtgaaaat

SEQ ID NO: 481640 - DNA, 15 bp, Homo sapiens
aatagtatttcccat

SEQ ID NO: 481641 - DNA, 19 bp, Homo sapiens
aatagtgaaaattttattg

SEQ ID NO: 481642 - DNA, 14 bp, Homo sapiens
aatagtttggatat

SEQ ID NO: 481643 - DNA, 17 bp, Homo sapiens
aatataaaaataattaa

SEQ ID NO: 481644 - DNA, 15 bp, Homo sapiens
aatataattgtttta

SEQ ID NO: 481645 - DNA, 16 bp, Homo sapiens
aatatgatgttaaaaa

SEQ ID NO: 481646 - DNA, 14 bp, Homo sapiens
aatcaaaaaattat

SEQ ID NO: 481647 - DNA, 16 bp, Homo sapiens
aatcaaaaaattatct

SEQ ID NO: 481648 - DNA, 16 bp, Homo sapiens
aatcagatagatattc

SEQ ID NO: 481649 - DNA, 20 bp, Homo sapiens
aatcatagctggttcacact

SEQ ID NO: 481650 - DNA, 13 bp, Homo sapiens
aatcattttgcaa

SEQ ID NO: 481651 - DNA, 21 bp, Homo sapiens
aatcccttaatatcctaaaca

SEQ ID NO: 481652 - DNA, 17 bp, Homo sapiens
aatctgcattattggaa

SEQ ID NO: 481653 - DNA, 16 bp, Homo sapiens
aatgaaatacttgaca

SEQ ID NO: 481654 - DNA, 18 bp, Homo sapiens
aatgatatgtctttaaaa

SEQ ID NO: 481655 - DNA, 21 bp, Homo sapiens
aatgatatgtctttaaaatga

SEQ ID NO: 481656 - DNA, 16 bp, Homo sapiens
aatgcacctaaagaaa

SEQ ID NO: 481657 - DNA, 21 bp, Homo sapiens
aatgcctttctagcaattgct

SEQ ID NO: 481658 - DNA, 15 bp, Homo sapiens
aatgccttttcccaa

SEQ ID NO: 481659 - DNA, 13 bp, Homo sapiens
aatggcctcttaa

SEQ ID NO: 481660 - DNA, 14 bp, Homo sapiens
aatggcctcttaaa

SEQ ID NO: 481661 - DNA, 16 bp, Homo sapiens
aatggctatgttttta

SEQ ID NO: 481662 - DNA, 16 bp, Homo sapiens
aatggctgataatttt

SEQ ID NO: 481663 - DNA, 16 bp, Homo sapiens
aatgtaaatattttaa

SEQ ID NO: 481664 - DNA, 19 bp, Homo sapiens
aatgtaaatattttaaaga

SEQ ID NO: 481665 - DNA, 21 bp, Homo sapiens
aatgtaaatattttaaagaat

SEQ ID NO: 481666 - DNA, 13 bp, Homo sapiens
aatgtatagtaaa

SEQ ID NO: 481667 - DNA, 17 bp, Homo sapiens
aatgtccaggtcacagg

SEQ ID NO: 481668 - DNA, 16 bp, Homo sapiens
aatgtgtgcttggaaa

SEQ ID NO: 481669 - DNA, 17 bp, Homo sapiens
aattaaaacaaaatcct

SEQ ID NO: 481670 - DNA, 18 bp, Homo sapiens
aattaactgggtaatgaa

SEQ ID NO: 481671 - DNA, 21 bp, Homo sapiens
aattaactgggtaatgaaaca

SEQ ID NO: 481672 - DNA, 18 bp, Homo sapiens
aattaacttctattttca

SEQ ID NO: 481673 - DNA, 13 bp, Homo sapiens
aattatccaggaa

SEQ ID NO: 481674 - DNA, 12 bp, Homo sapiens
aattatctttaa

SEQ ID NO: 481675 - DNA, 22 bp, Homo sapiens
aattatttaaaccgctaaaaga

SEQ ID NO: 481676 - DNA, 18 bp, Homo sapiens
aattgaatgcaaaccata

SEQ ID NO: 481677 - DNA, 15 bp, Homo sapiens
aattgcttctctaaa

SEQ ID NO: 481678 - DNA, 19 bp, Homo sapiens
aattgttttatctgaattt

SEQ ID NO: 481679 - DNA, 22 bp, Homo sapiens
aatttaaactataagcaagaag

SEQ ID NO: 481680 - DNA, 22 bp, Homo sapiens
aatttagtttcatataaagtat

SEQ ID NO: 481681 - DNA, 18 bp, Homo sapiens
aatttttttgtattttag

SEQ ID NO: 481682 - DNA, 23 bp, Homo sapiens
acaaaatgtgtgcttggaaaatg

SEQ ID NO: 481683 - DNA, 20 bp, Homo sapiens
acaaactcgttttttacaaa

SEQ ID NO: 481684 - DNA, 16 bp, Homo sapiens
acaaagagttcaagaa

SEQ ID NO: 481685 - DNA, 22 bp, Homo sapiens
acaaagagttcaagaaataagt

SEQ ID NO: 481686 - DNA, 18 bp, Homo sapiens
acaagaagcattttgtaa

SEQ ID NO: 481687 - DNA, 20 bp, Homo sapiens
acaagccttactcacctctc

SEQ ID NO: 481688 - DNA, 22 bp, Homo sapiens
acaaggttgctggcatttgctg

SEQ ID NO: 481689 - DNA, 14 bp, Homo sapiens
acaagtatttgtta

SEQ ID NO: 481690 - DNA, 15 bp, Homo sapiens
acaatcatctattga

SEQ ID NO: 481691 - DNA, 17 bp, Homo sapiens
acaattctaaaatgatt

SEQ ID NO: 481692 - DNA, 24 bp, Homo sapiens
acaattctaaaatgattgtagtaa

SEQ ID NO: 481693 - DNA, 16 bp, Homo sapiens
gcagcaactcccacga

SEQ ID NO: 481694 - DNA, 13 bp, Homo sapiens
gcatctggcctgg

SEQ ID NO: 481695 - DNA, 18 bp, Homo sapiens
gcatgtttgtctgtgtgc

SEQ ID NO: 481696 - DNA, 22 bp, Homo sapiens
gcattattggaatataattgtt

SEQ ID NO: 481697 - DNA, 16 bp, Homo sapiens
gcattcagaagaaaaa

SEQ ID NO: 481698 - DNA, 16 bp, Homo sapiens
gccaaaaaaaaataca

SEQ ID NO: 481699 - DNA, 21 bp, Homo sapiens
gccaatgtccaggtcacaggc

SEQ ID NO: 481700 - DNA, 14 bp, Homo sapiens
gccactaaggtcag

SEQ ID NO: 481701 - DNA, 17 bp, Homo sapiens
gccaggcacggaggctc

SEQ ID NO: 481702 - DNA, 20 bp, Homo sapiens
gccaggcctcagggaccaag

SEQ ID NO: 481703 - DNA, 15 bp, Homo sapiens
gccaggctaattttt

SEQ ID NO: 481704 - DNA, 15 bp, Homo sapiens
gccattcctgttctc

SEQ ID NO: 481705 - DNA, 21 bp, Homo sapiens
gccattcctgttctctttgcc

SEQ ID NO: 481706 - DNA, 22 bp, Homo sapiens
gcctcaaagcaagcattcagaa

SEQ ID NO: 481707 - DNA, 22 bp, Homo sapiens
gcctcttaaaaattatctttaa

SEQ ID NO: 481708 - DNA, 13 bp, Homo sapiens
gcctggaggagaa

SEQ ID NO: 481709 - DNA, 16 bp, Homo sapiens
gcctggaggagaagga

SEQ ID NO: 481710 - DNA, 15 bp, Homo sapiens
gccttactcacctct

SEQ ID NO: 481711 - DNA, 17 bp, Homo sapiens
gccttactcacctctct

SEQ ID NO: 481712 - DNA, 16 bp, Homo sapiens
gccttgatgttgtgtt

SEQ ID NO: 481713 - DNA, 21 bp, Homo sapiens
gcgaataaatgttcaaactgt

SEQ ID NO: 481714 - DNA, 12 bp, Homo sapiens
gctaaaagaaac

SEQ ID NO: 481715 - DNA, 23 bp, Homo sapiens
gctaagataattaaatgaaatac

SEQ ID NO: 481716 - DNA, 20 bp, Homo sapiens
gctaattttttgttgtttct

SEQ ID NO: 481717 - DNA, 13 bp, Homo sapiens
gctacataattta

SEQ ID NO: 481718 - DNA, 14 bp, Homo sapiens
gctacgtatttaat

SEQ ID NO: 481719 - DNA, 16 bp, Homo sapiens
gctataaatagtgaaa

SEQ ID NO: 481720 - DNA, 13 bp, Homo sapiens
gctatggttttct

SEQ ID NO: 481721 - DNA, 18 bp, Homo sapiens
gctattttatattacact

SEQ ID NO: 481722 - DNA, 13 bp, Homo sapiens
gctcagaggagag

SEQ ID NO: 481723 - DNA, 21 bp, Homo sapiens
gctcaggaggcgaataaatgt

SEQ ID NO: 481724 - DNA, 22 bp, Homo sapiens
gctcaggaggcgaataaatgtt

SEQ ID NO: 481725 - DNA, 21 bp, Homo sapiens
gctcggccaggcacggaggct

SEQ ID NO: 481726 - DNA, 13 bp, Homo sapiens
gctcgtgcatgta

SEQ ID NO: 481727 - DNA, 14 bp, Homo sapiens
gctgggactacagg

SEQ ID NO: 481728 - DNA, 17 bp, Homo sapiens
gctgtaaataaaaatag

SEQ ID NO: 481729 - DNA, 14 bp, Homo sapiens
gctgtgaaatgact

SEQ ID NO: 481730 - DNA, 14 bp, Homo sapiens
gctgttagctcaga

SEQ ID NO: 481731 - DNA, 18 bp, Homo sapiens
gcttaaaactttgaagtt

SEQ ID NO: 481732 - DNA, 20 bp, Homo sapiens
gcttaatggctgataatttt

SEQ ID NO: 481733 - DNA, 12 bp, Homo sapiens
gcttgcttctgc

SEQ ID NO: 481734 - DNA, 15 bp, Homo sapiens
gcttgcttctgcagc

SEQ ID NO: 481735 - DNA, 16 bp, Homo sapiens
gcttgcttctgcagca

SEQ ID NO: 481736 - DNA, 23 bp, Homo sapiens
gcttggaaaatgttctgacagca

SEQ ID NO: 481737 - DNA, 21 bp, Homo sapiens
gcttgggtgtaacaggtctcc

SEQ ID NO: 481738 - DNA, 18 bp, Homo sapiens
gctttaacttaaatagta

SEQ ID NO: 481739 - DNA, 21 bp, Homo sapiens
gctttactctgaatttccagt

SEQ ID NO: 481740 - DNA, 23 bp, Homo sapiens
gcttttgcggttcaggaaaattg

SEQ ID NO: 481741 - DNA, 19 bp, Homo sapiens
gcttttgtacgttaattaa

SEQ ID NO: 481742 - DNA, 22 bp, Homo sapiens
gcttttgtacgttaattaaaca

SEQ ID NO: 481743 - DNA, 19 bp, Homo sapiens
ggaataaggtacaagaagc

SEQ ID NO: 481744 - DNA, 15 bp, Homo sapiens
ggaatataattgttt

SEQ ID NO: 481745 - DNA, 17 bp, Homo sapiens
ggaggagaaggaggaac

SEQ ID NO: 481746 - DNA, 19 bp, Homo sapiens
ggaggagaaggaggaaccc

SEQ ID NO: 481747 - DNA, 21 bp, Homo sapiens
ggaggctgagacgcaaggatc

SEQ ID NO: 481748 - DNA, 13 bp, Homo sapiens
ggagggcgctttt

SEQ ID NO: 481749 - DNA, 21 bp, Homo sapiens
ggatggggtatggattctaaa

SEQ ID NO: 481750 - DNA, 22 bp, Homo sapiens
ggattaatggtcctgtgatgct

SEQ ID NO: 481751 - DNA, 19 bp, Homo sapiens
ggatttatttaaaatagca

SEQ ID NO: 481752 - DNA, 19 bp, Homo sapiens
cagaagctcaaggctgcag

SEQ ID NO: 481753 - DNA, 15 bp, Homo sapiens
cagaccttttttagg

SEQ ID NO: 481754 - DNA, 18 bp, Homo sapiens
cagactccttcaacaatt

SEQ ID NO: 481755 - DNA, 13 bp, Homo sapiens
cagatccatcggt

SEQ ID NO: 481756 - DNA, 12 bp, Homo sapiens
cagcaactccca

SEQ ID NO: 481757 - DNA, 14 bp, Homo sapiens
cagcaactcccacg

SEQ ID NO: 481758 - DNA, 17 bp, Homo sapiens
cagccattcctgttctc

SEQ ID NO: 481759 - DNA, 20 bp, Homo sapiens
cagccattcctgttctcttt

SEQ ID NO: 481760 - DNA, 14 bp, Homo sapiens
cagccctaaacatc

SEQ ID NO: 481761 - DNA, 19 bp, Homo sapiens
cagcctcccgagtagctgg

SEQ ID NO: 481762 - DNA, 20 bp, Homo sapiens
cagctacaggggaggctgag

SEQ ID NO: 481763 - DNA, 14 bp, Homo sapiens
cagctgtgagcttt

SEQ ID NO: 481764 - DNA, 11 bp, Homo sapiens
caggaaaatga

SEQ ID NO: 481765 - DNA, 13 bp, Homo sapiens
caggaaaattgaa

SEQ ID NO: 481766 - DNA, 19 bp, Homo sapiens
caggaaggactatgaaaag

SEQ ID NO: 481767 - DNA, 18 bp, Homo sapiens
caggaggcgaataaatgt

SEQ ID NO: 481768 - DNA, 20 bp, Homo sapiens
caggaggcgaataaatgttc

SEQ ID NO: 481769 - DNA, 23 bp, Homo sapiens
caggatggggtatggattctaaa

SEQ ID NO: 481770 - DNA, 15 bp, Homo sapiens
caggcacggaggctc

SEQ ID NO: 481771 - DNA, 13 bp, Homo sapiens
caggctaattttt

SEQ ID NO: 481772 - DNA, 12 bp, Homo sapiens
caggggaggctg

SEQ ID NO: 481773 - DNA, 19 bp, Homo sapiens
caggggaggctgagacgca

SEQ ID NO: 481774 - DNA, 11 bp, Homo sapiens
caggtctcctc

SEQ ID NO: 481775 - DNA, 14 bp, Homo sapiens
caggtctcctctta

SEQ ID NO: 481776 - DNA, 15 bp, Homo sapiens
caggtctcctcttaa

SEQ ID NO: 481777 - DNA, 14 bp, Homo sapiens
cagtaaatgtatat

SEQ ID NO: 481778 - DNA, 16 bp, Homo sapiens
cagtgttataaaatct

SEQ ID NO: 481779 - DNA, 19 bp, Homo sapiens
cagtttatatttaactctc

SEQ ID NO: 481780 - DNA, 21 bp, Homo sapiens
cataaagttgataaagatttt

SEQ ID NO: 481781 - DNA, 21 bp, Homo sapiens
cataattatccaggaagggaa

SEQ ID NO: 481782 - DNA, 18 bp, Homo sapiens
catccgctgcgctcccac

SEQ ID NO: 481783 - DNA, 14 bp, Homo sapiens
catctatttctgag

SEQ ID NO: 481784 - DNA, 16 bp, Homo sapiens
catctatttctgagaa

SEQ ID NO: 481785 - DNA, 21 bp, Homo sapiens
catctcagtgaagaatacttc

SEQ ID NO: 481786 - DNA, 21 bp, Homo sapiens
catcttgggattcctcccctg

SEQ ID NO: 481787 - DNA, 14 bp, Homo sapiens
catcttttgtgaga

SEQ ID NO: 481788 - DNA, 16 bp, Homo sapiens
catgccaggctaattt

SEQ ID NO: 481789 - DNA, 13 bp, Homo sapiens
catgctaagagaa

SEQ ID NO: 481790 - DNA, 15 bp, Homo sapiens
catggatgagagtcc

SEQ ID NO: 481791 - DNA, 14 bp, Homo sapiens
catggctattttat

SEQ ID NO: 481792 - DNA, 17 bp, Homo sapiens
catggctattttatatt

SEQ ID NO: 481793 - DNA, 22 bp, Homo sapiens
catgtccttgtgtgttttgaga

SEQ ID NO: 481794 - DNA, 14 bp, Homo sapiens
catgttatttgtaa

SEQ ID NO: 481795 - DNA, 13 bp, Homo sapiens
cattcagaagaaa

SEQ ID NO: 481796 - DNA, 14 bp, Homo sapiens
cattcctgttctct

SEQ ID NO: 481797 - DNA, 22 bp, Homo sapiens
catttatgtgtgaagcaaattt

SEQ ID NO: 481798 - DNA, 15 bp, Homo sapiens
cattttgaaatattc

SEQ ID NO: 481799 - DNA, 16 bp, Homo sapiens
cattttggtactttgg

SEQ ID NO: 481800 - DNA, 14 bp, Homo sapiens
agggaccaaggaga

SEQ ID NO: 481801 - DNA, 16 bp, Homo sapiens
aggtacaagaagcatt

SEQ ID NO: 481802 - DNA, 21 bp, Homo sapiens
aggtcagtgttataaaatctg

SEQ ID NO: 481803 - DNA, 17 bp, Homo sapiens
aggtctcctcttaaaaa

SEQ ID NO: 481804 - DNA, 23 bp, Homo sapiens
aggtctcctcttaaaaaataaaa

SEQ ID NO: 481805 - DNA, 23 bp, Homo sapiens
agtaatctgcattattggaatat

SEQ ID NO: 481806 - DNA, 14 bp, Homo sapiens
agtagcagtgattg

SEQ ID NO: 481807 - DNA, 22 bp, Homo sapiens
agtccccacagataactgaaaa

SEQ ID NO: 481808 - DNA, 20 bp, Homo sapiens
agtctaaagctggtttaatg

SEQ ID NO: 481809 - DNA, 12 bp, Homo sapiens
agtgaagaatac

SEQ ID NO: 481810 - DNA, 22 bp, Homo sapiens
agtgaagaatacttctcatttt

SEQ ID NO: 481811 - DNA, 20 bp, Homo sapiens
agtgctgggattacaggcat

SEQ ID NO: 481812 - DNA, 20 bp, Homo sapiens
agtgctgggattacaggtgt

SEQ ID NO: 481813 - DNA, 15 bp, Homo sapiens
agtgtagaacctaat

SEQ ID NO: 481814 - DNA, 20 bp, Homo sapiens
agtgtagaacctaattcaat

SEQ ID NO: 481815 - DNA, 22 bp, Homo sapiens
agtgtgcttctgttatcaaaca

SEQ ID NO: 481816 - DNA, 17 bp, Homo sapiens
agtgttataaaatctgt

SEQ ID NO: 481817 - DNA, 23 bp, Homo sapiens
agtgttataaaatctgtattgct

SEQ ID NO: 481818 - DNA, 15 bp, Homo sapiens
agttagctttaactt

SEQ ID NO: 481819 - DNA, 14 bp, Homo sapiens
agttgaagcaaatc

SEQ ID NO: 481820 - DNA, 19 bp, Homo sapiens
agttggttacctattgctg

SEQ ID NO: 481821 - DNA, 16 bp, Homo sapiens
agttgtatctcttttg

SEQ ID NO: 481822 - DNA, 17 bp, Homo sapiens
agttgtatctcttttga

SEQ ID NO: 481823 - DNA, 17 bp, Homo sapiens
agttgtcctttctgatc

SEQ ID NO: 481824 - DNA, 21 bp, Homo sapiens
agttgtgtctggcagtttata

SEQ ID NO: 481825 - DNA, 16 bp, Homo sapiens
agtttagaagcgctca

SEQ ID NO: 481826 - DNA, 21 bp, Homo sapiens
agtttagaagcgctcatctgg

SEQ ID NO: 481827 - DNA, 22 bp, Homo sapiens
agtttggatatgtaaaacattt

SEQ ID NO: 481828 - DNA, 16 bp, Homo sapiens
ataaaaataattaaaa

SEQ ID NO: 481829 - DNA, 16 bp, Homo sapiens
ataaaaatgatctaaa

SEQ ID NO: 481830 - DNA, 17 bp, Homo sapiens
ataaagattttttaata

SEQ ID NO: 481831 - DNA, 17 bp, Homo sapiens
ataaagttgataaagat

SEQ ID NO: 481832 - DNA, 21 bp, Homo sapiens
ataaagttgataaagattttt

SEQ ID NO: 481833 - DNA, 12 bp, Homo sapiens
ataaatgttcaa

SEQ ID NO: 481834 - DNA, 13 bp, Homo sapiens
ataaatgttcaaa

SEQ ID NO: 481835 - DNA, 17 bp, Homo sapiens
ataacgtttaagccaaa

SEQ ID NO: 481836 - DNA, 21 bp, Homo sapiens
ataagaaacttttttatttaa

SEQ ID NO: 481837 - DNA, 11 bp, Homo sapiens
ataagaagaat

SEQ ID NO: 481838 - DNA, 21 bp, Homo sapiens
ataagcaagaaggcaaaaata

SEQ ID NO: 481839 - DNA, 13 bp, Homo sapiens
ataatgaacagaa

SEQ ID NO: 481840 - DNA, 17 bp, Homo sapiens
ataatgaacagaacata

SEQ ID NO: 481841 - DNA, 12 bp, Homo sapiens
ataattaaaaca

SEQ ID NO: 481842 - DNA, 13 bp, Homo sapiens
ataattaaaacaa

SEQ ID NO: 481843 - DNA, 14 bp, Homo sapiens
ataattaaatgaaa

SEQ ID NO: 481844 - DNA, 18 bp, Homo sapiens
ataattaaatgaaatact

SEQ ID NO: 481845 - DNA, 14 bp, Homo sapiens
ataccattttgaaa

SEQ ID NO: 481846 - DNA, 16 bp, Homo sapiens
ataccattttgaaata

SEQ ID NO: 481847 - DNA, 16 bp, Homo sapiens
atacttctcatttttt

SEQ ID NO: 481848 - DNA, 18 bp, Homo sapiens
atacttgacaacattttt

SEQ ID NO: 481849 - DNA, 17 bp, Homo sapiens
atagataccattttgaa

SEQ ID NO: 481850 - DNA, 12 bp, Homo sapiens
atagatgtttga

SEQ ID NO: 481851 - DNA, 16 bp, Homo sapiens
atagcaaaagaagaag

SEQ ID NO: 481852 - DNA, 18 bp, Homo sapiens
atagccaaaaatagctaa

SEQ ID NO: 481853 - DNA, 13 bp, Homo sapiens
atagctaaatacc

SEQ ID NO: 481854 - DNA, 18 bp, Homo sapiens
atagttgtgggtgggaga

SEQ ID NO: 481855 - DNA, 19 bp, Homo sapiens
atagtttggatatgtaaaa

SEQ ID NO: 481856 - DNA, 21 bp, Homo sapiens
atataatggcctcttaaaaat

SEQ ID NO: 481857 - DNA, 13 bp, Homo sapiens
atatcctaaacat

SEQ ID NO: 481858 - DNA, 16 bp, Homo sapiens
atatgagattggaaaa

SEQ ID NO: 481859 - DNA, 15 bp, Homo sapiens
atatgatgttaaaaa

SEQ ID NO: 481860 - DNA, 21 bp, Homo sapiens
atatgatgttaaaaaaataag

SEQ ID NO: 481861 - DNA, 15 bp, Homo sapiens
atatgtaaaacattt

SEQ ID NO: 481862 - DNA, 18 bp, Homo sapiens
atatgtaaaacatttatt

SEQ ID NO: 481863 - DNA, 14 bp, Homo sapiens
atatgtctttaaaa

SEQ ID NO: 481864 - DNA, 14 bp, Homo sapiens
atattgatgtaact

SEQ ID NO: 481865 - DNA, 16 bp, Homo sapiens
atcatcagtgtagaac

SEQ ID NO: 481866 - DNA, 14 bp, Homo sapiens
atcattttttactt

SEQ ID NO: 481867 - DNA, 15 bp, Homo sapiens
atctcagtgaagaat

SEQ ID NO: 481868 - DNA, 20 bp, Homo sapiens
atctcatctcagtgaagaat

SEQ ID NO: 481869 - DNA, 12 bp, Homo sapiens
atctctgtaaaa

SEQ ID NO: 481870 - DNA, 23 bp, Homo sapiens
atctggcttttcgcttgcttctg

SEQ ID NO: 481871 - DNA, 16 bp, Homo sapiens
atcttactatttcaca

SEQ ID NO: 481872 - DNA, 20 bp, Homo sapiens
atcttgggattcctcccctg

SEQ ID NO: 481873 - DNA, 16 bp, Homo sapiens
atgaaaaagaagaatc

SEQ ID NO: 481874 - DNA, 18 bp, Homo sapiens
atgaaaagctagaattga

SEQ ID NO: 481875 - DNA, 19 bp, Homo sapiens
atgaaatacttgacaacat

SEQ ID NO: 481876 - DNA, 16 bp, Homo sapiens
atgaacagaacataga

SEQ ID NO: 481877 - DNA, 16 bp, Homo sapiens
atgaatcttttccact

SEQ ID NO: 481878 - DNA, 19 bp, Homo sapiens
atgagaaatataaaaataa

SEQ ID NO: 481879 - DNA, 20 bp, Homo sapiens
atgatatgtctttaaaatga

SEQ ID NO: 481880 - DNA, 22 bp, Homo sapiens
atgatgttaaaaaaataagaag

SEQ ID NO: 481881 - DNA, 21 bp, Homo sapiens
atgattcacttttattgtata

SEQ ID NO: 481882 - DNA, 12 bp, Homo sapiens
atgatttaacat

SEQ ID NO: 481883 - DNA, 17 bp, Homo sapiens
atgatttcgtgactgta

SEQ ID NO: 481884 - DNA, 14 bp, Homo sapiens
atgcaaaccatagc

SEQ ID NO: 481885 - DNA, 14 bp, Homo sapiens
atgcacctaaagaa

SEQ ID NO: 481886 - DNA, 17 bp, Homo sapiens
atgccaaaaaaaaatac

SEQ ID NO: 481887 - DNA, 19 bp, Homo sapiens
atgccaaaaaaaaatacat

SEQ ID NO: 481888 - DNA, 16 bp, Homo sapiens
atgccaatgtccaggt

SEQ ID NO: 481889 - DNA, 19 bp, Homo sapiens
atgcctttctagcaattgc

SEQ ID NO: 481890 - DNA, 15 bp, Homo sapiens
atgctcacagtctca

SEQ ID NO: 481891 - DNA, 18 bp, Homo sapiens
atggccaggcctcaggga

SEQ ID NO: 481892 - DNA, 14 bp, Homo sapiens
atggttttctccaa

SEQ ID NO: 481893 - DNA, 14 bp, Homo sapiens
atgtaaaacattta

SEQ ID NO: 481894 - DNA, 16 bp, Homo sapiens
atgtatagtaaatcac

SEQ ID NO: 481895 - DNA, 14 bp, Homo sapiens
atgtatttatattt

SEQ ID NO: 481896 - DNA, 16 bp, Homo sapiens
atgtccaggtcacagg

SEQ ID NO: 481897 - DNA, 14 bp, Homo sapiens
atgtcccttctcat

SEQ ID NO: 481898 - DNA, 15 bp, Homo sapiens
atgttaaaaaaataa

SEQ ID NO: 481899 - DNA, 21 bp, Homo sapiens
atgttaaaaaaataagaagaa

SEQ ID NO: 481900 - DNA, 22 bp, Homo sapiens
atgttaaaaaaataagaagaat

SEQ ID NO: 481901 - DNA, 19 bp, Homo sapiens
atgttctgacagcatttca

SEQ ID NO: 481902 - DNA, 14 bp, Homo sapiens
atgtttaaaccttt

SEQ ID NO: 481903 - DNA, 21 bp, Homo sapiens
atgtttgatagattttctgct

SEQ ID NO: 481904 - DNA, 12 bp, Homo sapiens
atgtttttaatg

SEQ ID NO: 481905 - DNA, 16 bp, Homo sapiens
attaaaacaaaatcct

SEQ ID NO: 481906 - DNA, 15 bp, Homo sapiens
attaaatgaaatact

SEQ ID NO: 481907 - DNA, 23 bp, Homo sapiens
attaaatgaaatacttgacaaca

SEQ ID NO: 481908 - DNA, 18 bp, Homo sapiens
attaacttctattttcaa

SEQ ID NO: 481909 - DNA, 20 bp, Homo sapiens
attaacttctattttcaagt

SEQ ID NO: 481910 - DNA, 17 bp, Homo sapiens
attaccagagttgttct

SEQ ID NO: 481911 - DNA, 22 bp, Homo sapiens
attcaataactattgctgcttt

SEQ ID NO: 481912 - DNA, 16 bp, Homo sapiens
attcaattcaaagctg

SEQ ID NO: 481913 - DNA, 15 bp, Homo sapiens
attcacttttattgt

SEQ ID NO: 481914 - DNA, 17 bp, Homo sapiens
attcacttttattgtat

SEQ ID NO: 481915 - DNA, 18 bp, Homo sapiens
attcacttttattgtata

SEQ ID NO: 481916 - DNA, 18 bp, Homo sapiens
attcagaagaaaaagaag

SEQ ID NO: 481917 - DNA, 13 bp, Homo sapiens
attcctgttctct

SEQ ID NO: 481918 - DNA, 14 bp, Homo sapiens
attcctgttctctt

SEQ ID NO: 481919 - DNA, 22 bp, Homo sapiens
acacatactcatttttcatgat

SEQ ID NO: 481920 - DNA, 14 bp, Homo sapiens
acagaaacattttc

SEQ ID NO: 481921 - DNA, 16 bp, Homo sapiens
acagaacatagacaga

SEQ ID NO: 481922 - DNA, 14 bp, Homo sapiens
acagaagaaacaag

SEQ ID NO: 481923 - DNA, 14 bp, Homo sapiens
acagataactgaaa

SEQ ID NO: 481924 - DNA, 18 bp, Homo sapiens
acagataactgaaaatta

SEQ ID NO: 481925 - DNA, 19 bp, Homo sapiens
acagcatttcagctgtgag

SEQ ID NO: 481926 - DNA, 17 bp, Homo sapiens
acagcctgacaacattt

SEQ ID NO: 481927 - DNA, 21 bp, Homo sapiens
acagcctgacaacatttctat

SEQ ID NO: 481928 - DNA, 14 bp, Homo sapiens
acaggtctcctctt

SEQ ID NO: 481929 - DNA, 15 bp, Homo sapiens
acagtctaaagctgg

SEQ ID NO: 481930 - DNA, 12 bp, Homo sapiens
acataaagttga

SEQ ID NO: 481931 - DNA, 15 bp, Homo sapiens
acataagccattatt

SEQ ID NO: 481932 - DNA, 12 bp, Homo sapiens
acatactcattt

SEQ ID NO: 481933 - DNA, 13 bp, Homo sapiens
acatactcatttt

SEQ ID NO: 481934 - DNA, 14 bp, Homo sapiens
acatactcattttt

SEQ ID NO: 481935 - DNA, 17 bp, Homo sapiens
acatactcatttttcat

SEQ ID NO: 481936 - DNA, 16 bp, Homo sapiens
acatagacagaagaaa

SEQ ID NO: 481937 - DNA, 13 bp, Homo sapiens
acatctctgtaaa

SEQ ID NO: 481938 - DNA, 18 bp, Homo sapiens
acatgctaagagaagtag

SEQ ID NO: 481939 - DNA, 21 bp, Homo sapiens
acatgtccttgtgtgttttga

SEQ ID NO: 481940 - DNA, 20 bp, Homo sapiens
acatttctatagccaaaaat

SEQ ID NO: 481941 - DNA, 12 bp, Homo sapiens
acattttcattt

SEQ ID NO: 481942 - DNA, 15 bp, Homo sapiens
accaacataaaaatg

SEQ ID NO: 481943 - DNA, 23 bp, Homo sapiens
accaacataaaaatgatctaaac

SEQ ID NO: 481944 - DNA, 19 bp, Homo sapiens
accatgccaggctaatttt

SEQ ID NO: 481945 - DNA, 15 bp, Homo sapiens
accattttgaaatat

SEQ ID NO: 481946 - DNA, 17 bp, Homo sapiens
acctaaagaaaaacaaa

SEQ ID NO: 481947 - DNA, 19 bp, Homo sapiens
acctcaagtttttgttttg

SEQ ID NO: 481948 - DNA, 15 bp, Homo sapiens
acctcagtaatttag

SEQ ID NO: 481949 - DNA, 22 bp, Homo sapiens
accttctgtgcatctggcctgg

SEQ ID NO: 481950 - DNA, 19 bp, Homo sapiens
acgactgttgtacaagctc

SEQ ID NO: 481951 - DNA, 18 bp, Homo sapiens
acgccccccggcctgatg

SEQ ID NO: 481952 - DNA, 17 bp, Homo sapiens
acgctttttgaaaaagc

SEQ ID NO: 481953 - DNA, 13 bp, Homo sapiens
acgtatttaatag

SEQ ID NO: 481954 - DNA, 15 bp, Homo sapiens
acgtatttaatagca

SEQ ID NO: 481955 - DNA, 16 bp, Homo sapiens
acgtatttaatagcaa

SEQ ID NO: 481956 - DNA, 21 bp, Homo sapiens
acgtatttaatagcaaagaat

SEQ ID NO: 481957 - DNA, 13 bp, Homo sapiens
acgttaattaaac

SEQ ID NO: 481958 - DNA, 22 bp, Homo sapiens
actacacactgtgtactgcagt

SEQ ID NO: 481959 - DNA, 16 bp, Homo sapiens
actacagtctaaagct

SEQ ID NO: 481960 - DNA, 21 bp, Homo sapiens
actagaggtgagaaatttaaa

SEQ ID NO: 481961 - DNA, 16 bp, Homo sapiens
actatgaaaagctaga

SEQ ID NO: 481962 - DNA, 20 bp, Homo sapiens
actatggtatatattttgaa

SEQ ID NO: 481963 - DNA, 17 bp, Homo sapiens
actcacctctctctaag

SEQ ID NO: 481964 - DNA, 23 bp, Homo sapiens
actcatttttcatgataatgaac

SEQ ID NO: 481965 - DNA, 12 bp, Homo sapiens
actccttagaga

SEQ ID NO: 481966 - DNA, 22 bp, Homo sapiens
actcggcctcccaaagtgctgg

SEQ ID NO: 481967 - DNA, 18 bp, Homo sapiens
actcttttgagcagtaaa

SEQ ID NO: 481968 - DNA, 23 bp, Homo sapiens
actcttttgagcagtaaatgtat

SEQ ID NO: 481969 - DNA, 17 bp, Homo sapiens
actgaaaattatttaaa

SEQ ID NO: 481970 - DNA, 14 bp, Homo sapiens
actgggtaatgaaa

SEQ ID NO: 481971 - DNA, 22 bp, Homo sapiens
actgtagtttttgttcaccttc

SEQ ID NO: 481972 - DNA, 15 bp, Homo sapiens
actgtctctcctgat

SEQ ID NO: 481973 - DNA, 21 bp, Homo sapiens
actgtggtcccagctacaggg

SEQ ID NO: 481974 - DNA, 20 bp, Homo sapiens
acttctcattttttaaaaaa

SEQ ID NO: 481975 - DNA, 14 bp, Homo sapiens
acttggttttgcta

SEQ ID NO: 481976 - DNA, 14 bp, Homo sapiens
actttgaagttagc

SEQ ID NO: 481977 - DNA, 14 bp, Homo sapiens
actttgggaggctg

SEQ ID NO: 481978 - DNA, 11 bp, Homo sapiens
actttgttcac

SEQ ID NO: 481979 - DNA, 15 bp, Homo sapiens
acttttattgtataa

SEQ ID NO: 481980 - DNA, 22 bp, Homo sapiens
acttttattgtataattatgaa

SEQ ID NO: 481981 - DNA, 15 bp, Homo sapiens
acttttttatttaaa

SEQ ID NO: 481982 - DNA, 18 bp, Homo sapiens
agaaacaaggttttcagt

SEQ ID NO: 481983 - DNA, 19 bp, Homo sapiens
agaaacttttttatttaaa

SEQ ID NO: 481984 - DNA, 13 bp, Homo sapiens
agaaatttaaact

SEQ ID NO: 481985 - DNA, 16 bp, Homo sapiens
agaaatttaaactata

SEQ ID NO: 481986 - DNA, 14 bp, Homo sapiens
agaacacgctttca

SEQ ID NO: 481987 - DNA, 13 bp, Homo sapiens
agaagaaaaagaa

SEQ ID NO: 481988 - DNA, 19 bp, Homo sapiens
agaagcattttgtaagttg

SEQ ID NO: 481989 - DNA, 16 bp, Homo sapiens
agaaggcaaaaatagt

SEQ ID NO: 481990 - DNA, 20 bp, Homo sapiens
agaaggtccttaatgatccg

SEQ ID NO: 481991 - DNA, 23 bp, Homo sapiens
agaattgtgtcagactgtttagt

SEQ ID NO: 481992 - DNA, 14 bp, Homo sapiens
agacagaagaaaca

SEQ ID NO: 481993 - DNA, 15 bp, Homo sapiens
agacagaagaaacaa

SEQ ID NO: 481994 - DNA, 17 bp, Homo sapiens
agactccttcaacaatt

SEQ ID NO: 481995 - DNA, 21 bp, Homo sapiens
agactccttcaacaattctaa

SEQ ID NO: 481996 - DNA, 22 bp, Homo sapiens
agacttcaagcatggctatttt

SEQ ID NO: 481997 - DNA, 14 bp, Homo sapiens
agaggagcaaacag

SEQ ID NO: 481998 - DNA, 16 bp, Homo sapiens
agaggtgagaaattta

SEQ ID NO: 481999 - DNA, 17 bp, Homo sapiens
agaggtgagaaatttaa

SEQ ID NO: 482000 - DNA, 14 bp, Homo sapiens
agagttcaagaaat

SEQ ID NO: 482001 - DNA, 21 bp, Homo sapiens
agagttcaagaaataagtttt

SEQ ID NO: 482002 - DNA, 18 bp, Homo sapiens
agataactgaaaattatt

SEQ ID NO: 482003 - DNA, 19 bp, Homo sapiens
agataatggataatcttcg

SEQ ID NO: 482004 - DNA, 15 bp, Homo sapiens
agataattaaatgaa

SEQ ID NO: 482005 - DNA, 21 bp, Homo sapiens
agatatgagaaatataaaaat

SEQ ID NO: 482006 - DNA, 17 bp, Homo sapiens
agatgtttgatagattt

SEQ ID NO: 482007 - DNA, 19 bp, Homo sapiens
agatgtttgatagattttc

SEQ ID NO: 482008 - DNA, 12 bp, Homo sapiens
agcaaaaaagaa

SEQ ID NO: 482009 - DNA, 14 bp, Homo sapiens
agcaaaagaagaag

SEQ ID NO: 482010 - DNA, 13 bp, Homo sapiens
agcaaaaggatga

SEQ ID NO: 482011 - DNA, 20 bp, Homo sapiens
agcaaatcgaatgaaattaa

SEQ ID NO: 482012 - DNA, 22 bp, Homo sapiens
agcaaatcgaatgaaattaact

SEQ ID NO: 482013 - DNA, 12 bp, Homo sapiens
agcaactcccac

SEQ ID NO: 482014 - DNA, 17 bp, Homo sapiens
agcaagcttaatggctg

SEQ ID NO: 482015 - DNA, 16 bp, Homo sapiens
agcagagcttcctcag

SEQ ID NO: 482016 - DNA, 16 bp, Homo sapiens
agcagtaaatgtatat

SEQ ID NO: 482017 - DNA, 15 bp, Homo sapiens
agcattcagaagaaa

SEQ ID NO: 482018 - DNA, 17 bp, Homo sapiens
agcctcccgagtagctg

SEQ ID NO: 482019 - DNA, 14 bp, Homo sapiens
agccttactcacct

SEQ ID NO: 482020 - DNA, 20 bp, Homo sapiens
agctaaatacctcaatcagt

SEQ ID NO: 482021 - DNA, 14 bp, Homo sapiens
agctagaattgagt

SEQ ID NO: 482022 - DNA, 20 bp, Homo sapiens
agctagaattgagtgtttaa

SEQ ID NO: 482023 - DNA, 23 bp, Homo sapiens
agctcaggaggcgaataaatgtt

SEQ ID NO: 482024 - DNA, 22 bp, Homo sapiens
agctgtgtgtttggaagactat

SEQ ID NO: 482025 - DNA, 13 bp, Homo sapiens
agcttgagcctga

SEQ ID NO: 482026 - DNA, 17 bp, Homo sapiens
aggaagcaagcttaatg

SEQ ID NO: 482027 - DNA, 16 bp, Homo sapiens
aggaagctctctttcc

SEQ ID NO: 482028 - DNA, 16 bp, Homo sapiens
aggacatctctgtaaa

SEQ ID NO: 482029 - DNA, 17 bp, Homo sapiens
aggaggcgaataaatgt

SEQ ID NO: 482030 - DNA, 17 bp, Homo sapiens
aggatttatttaaaata

SEQ ID NO: 482031 - DNA, 18 bp, Homo sapiens
aggcaccaaaagaagtaa

SEQ ID NO: 482032 - DNA, 16 bp, Homo sapiens
aggcctcagggaccaa

SEQ ID NO: 482033 - DNA, 22 bp, Homo sapiens
aggcctcagggaccaaggagat

SEQ ID NO: 482034 - DNA, 18 bp, Homo sapiens
aggcgaataaatgttcaa

SEQ ID NO: 482035 - DNA, 12 bp, Homo sapiens
aggctaattttt

SEQ ID NO: 482036 - DNA, 22 bp, Homo sapiens
aggctaatttttttgtatttta

SEQ ID NO: 482037 - DNA, 13 bp, Homo sapiens
agggaccaaggag

SEQ ID NO: 482038 - DNA, 22 bp, Homo sapiens
taatagatgtttgatagatttt

SEQ ID NO: 482039 - DNA, 17 bp, Homo sapiens
taatatcctaaacatca

SEQ ID NO: 482040 - DNA, 13 bp, Homo sapiens
taatgaaacaaag

SEQ ID NO: 482041 - DNA, 21 bp, Homo sapiens
taatggctgataattttaaat

SEQ ID NO: 482042 - DNA, 21 bp, Homo sapiens
taattaaacaaattccttccc

SEQ ID NO: 482043 - DNA, 16 bp, Homo sapiens
taattaaatgaaatac

SEQ ID NO: 482044 - DNA, 18 bp, Homo sapiens
taattaaatgaaatactt

SEQ ID NO: 482045 - DNA, 23 bp, Homo sapiens
taattctcagaagtgaaaaagac

SEQ ID NO: 482046 - DNA, 14 bp, Homo sapiens
taatttagaaaact

SEQ ID NO: 482047 - DNA, 17 bp, Homo sapiens
taatttagaaaacttta

SEQ ID NO: 482048 - DNA, 14 bp, Homo sapiens
taatttagaaatca

SEQ ID NO: 482049 - DNA, 21 bp, Homo sapiens
taatttagacttcaagcatgg

SEQ ID NO: 482050 - DNA, 20 bp, Homo sapiens
taatttttgatactaagcat

SEQ ID NO: 482051 - DNA, 17 bp, Homo sapiens
tacaaagcccttttata

SEQ ID NO: 482052 - DNA, 15 bp, Homo sapiens
tacaggggaggctga

SEQ ID NO: 482053 - DNA, 20 bp, Homo sapiens
tacatttatgtgtgaagcaa

SEQ ID NO: 482054 - DNA, 15 bp, Homo sapiens
tacgttaattaaaca

SEQ ID NO: 482055 - DNA, 20 bp, Homo sapiens
tactatggtatatattttga

SEQ ID NO: 482056 - DNA, 22 bp, Homo sapiens
tactttggtggccacataagcc

SEQ ID NO: 482057 - DNA, 15 bp, Homo sapiens
tagaaaactttaaag

SEQ ID NO: 482058 - DNA, 16 bp, Homo sapiens
tagaaatcattttgca

SEQ ID NO: 482059 - DNA, 22 bp, Homo sapiens
tagaaattaccagagttgttct

SEQ ID NO: 482060 - DNA, 23 bp, Homo sapiens
tagaacctaattcaattcaaagc

SEQ ID NO: 482061 - DNA, 19 bp, Homo sapiens
tagaagcgctcatctggct

SEQ ID NO: 482062 - DNA, 20 bp, Homo sapiens
tagaattgagtgtttaaagt

SEQ ID NO: 482063 - DNA, 12 bp, Homo sapiens
tagacagaagaa

SEQ ID NO: 482064 - DNA, 14 bp, Homo sapiens
tagacagaagaaac

SEQ ID NO: 482065 - DNA, 15 bp, Homo sapiens
tagacagaagaaaca

SEQ ID NO: 482066 - DNA, 16 bp, Homo sapiens
tagaggtgagaaattt

SEQ ID NO: 482067 - DNA, 19 bp, Homo sapiens
tagataccattttgaaata

SEQ ID NO: 482068 - DNA, 20 bp, Homo sapiens
tagataccattttgaaatat

SEQ ID NO: 482069 - DNA, 14 bp, Homo sapiens
tagatattattcat

SEQ ID NO: 482070 - DNA, 16 bp, Homo sapiens
tagcaaaagaagaagt

SEQ ID NO: 482071 - DNA, 21 bp, Homo sapiens
tagcaactacagtctaaagct

SEQ ID NO: 482072 - DNA, 23 bp, Homo sapiens
taggacatctctgtaaaaagcag

SEQ ID NO: 482073 - DNA, 21 bp, Homo sapiens
tagtaaatcacgctttttgaa

SEQ ID NO: 482074 - DNA, 17 bp, Homo sapiens
tagttgtgggtgggaga

SEQ ID NO: 482075 - DNA, 14 bp, Homo sapiens
tataaaatctgtat

SEQ ID NO: 482076 - DNA, 17 bp, Homo sapiens
tataacattgtaaatga

SEQ ID NO: 482077 - DNA, 22 bp, Homo sapiens
tataagcaagaaggcaaaaata

SEQ ID NO: 482078 - DNA, 18 bp, Homo sapiens
tatagccaaaaatagcta

SEQ ID NO: 482079 - DNA, 19 bp, Homo sapiens
tataggatttatttaaaat

SEQ ID NO: 482080 - DNA, 22 bp, Homo sapiens
tatattacactacacactgtgt

SEQ ID NO: 482081 - DNA, 16 bp, Homo sapiens
tatcctaaacatcatt

SEQ ID NO: 482082 - DNA, 14 bp, Homo sapiens
tatgaaaagctaga

SEQ ID NO: 482083 - DNA, 19 bp, Homo sapiens
tatgaaaagctagaattga

SEQ ID NO: 482084 - DNA, 16 bp, Homo sapiens
tatgtctttaaaatga

SEQ ID NO: 482085 - DNA, 13 bp, Homo sapiens
tatgtttttaatg

SEQ ID NO: 482086 - DNA, 21 bp, Homo sapiens
atattgacaagtttaaaggct

SEQ ID NO: 482087 - DNA, 13 bp, Homo sapiens
atatttaaagtct

SEQ ID NO: 482088 - DNA, 19 bp, Homo sapiens
atattttctgagtagcata

SEQ ID NO: 482089 - DNA, 19 bp, Homo sapiens
atcattggtatctgatatc

SEQ ID NO: 482090 - DNA, 20 bp, Homo sapiens
atcattggtatctgatatct

SEQ ID NO: 482091 - DNA, 19 bp, Homo sapiens
atctactagaaccttctaa

SEQ ID NO: 482092 - DNA, 15 bp, Homo sapiens
atctgtttgcttcta

SEQ ID NO: 482093 - DNA, 16 bp, Homo sapiens
atgaaagtcagtttaa

SEQ ID NO: 482094 - DNA, 20 bp, Homo sapiens
atgaatacgtaaactgcgta

SEQ ID NO: 482095 - DNA, 21 bp, Homo sapiens
atgctatctcgctagccatat

SEQ ID NO: 482096 - DNA, 23 bp, Homo sapiens
atggattgggtatcaaaatgaat

SEQ ID NO: 482097 - DNA, 19 bp, Homo sapiens
atgttaattgatagaataa

SEQ ID NO: 482098 - DNA, 17 bp, Homo sapiens
attagggctctaatttc

SEQ ID NO: 482099 - DNA, 18 bp, Homo sapiens
attcccttcaatgcaaaa

SEQ ID NO: 482100 - DNA, 21 bp, Homo sapiens
atttccatggattcccctgga

SEQ ID NO: 482101 - DNA, 15 bp, Homo sapiens
atttctcttaagtac

SEQ ID NO: 482102 - DNA, 18 bp, Homo sapiens
atttctgtgtcctgtttt

SEQ ID NO: 482103 - DNA, 15 bp, Homo sapiens
attttagctaattta

SEQ ID NO: 482104 - DNA, 16 bp, Homo sapiens
attttagctaatttag

SEQ ID NO: 482105 - DNA, 18 bp, Homo sapiens
atttttctactgctcttt

SEQ ID NO: 482106 - DNA, 13 bp, Homo sapiens
caaacctaagttg

SEQ ID NO: 482107 - DNA, 22 bp, Homo sapiens
caaagaatcacctaattaattt

SEQ ID NO: 482108 - DNA, 21 bp, Homo sapiens
caaagttaaacgtgatgtgct

SEQ ID NO: 482109 - DNA, 17 bp, Homo sapiens
caacttacatatgtctt

SEQ ID NO: 482110 - DNA, 14 bp, Homo sapiens
caagctcacttgct

SEQ ID NO: 482111 - DNA, 12 bp, Homo sapiens
caagtctgtgaa

SEQ ID NO: 482112 - DNA, 20 bp, Homo sapiens
caagtgaatgagtttccagc

SEQ ID NO: 482113 - DNA, 14 bp, Homo sapiens
cactgaagagtatg

SEQ ID NO: 482114 - DNA, 18 bp, Homo sapiens
cagctaagcctgatgatg

SEQ ID NO: 482115 - DNA, 19 bp, Homo sapiens
cagctaagcctgatgatgg

SEQ ID NO: 482116 - DNA, 15 bp, Homo sapiens
cagctgagctggcct

SEQ ID NO: 482117 - DNA, 15 bp, Homo sapiens
caggaaaggaagatg

SEQ ID NO: 482118 - DNA, 22 bp, Homo sapiens
cagttgtaacattctatttcaa

SEQ ID NO: 482119 - DNA, 16 bp, Homo sapiens
catgatgatttcagaa

SEQ ID NO: 482120 - DNA, 17 bp, Homo sapiens
catggtagactgtgaca

SEQ ID NO: 482121 - DNA, 17 bp, Homo sapiens
catttcttggtatgatc

SEQ ID NO: 482122 - DNA, 16 bp, Homo sapiens
cattttagctaattta

SEQ ID NO: 482123 - DNA, 14 bp, Homo sapiens
ccacttatttccat

SEQ ID NO: 482124 - DNA, 22 bp, Homo sapiens
ccagagaaatgaaagtcagttt

SEQ ID NO: 482125 - DNA, 16 bp, Homo sapiens
ccatggattcccctgg

SEQ ID NO: 482126 - DNA, 18 bp, Homo sapiens
ccatggtagactgtgaca

SEQ ID NO: 482127 - DNA, 14 bp, Homo sapiens
cctaattaatttca

SEQ ID NO: 482128 - DNA, 15 bp, Homo sapiens
cctatcatcagttag

SEQ ID NO: 482129 - DNA, 23 bp, Homo sapiens
cctatcatcagttaggattaggt

SEQ ID NO: 482130 - DNA, 16 bp, Homo sapiens
cctatgaccataaaat

SEQ ID NO: 482131 - DNA, 16 bp, Homo sapiens
cctccagttctgatga

SEQ ID NO: 482132 - DNA, 21 bp, Homo sapiens
cctcctccagttctgatgagg

SEQ ID NO: 482133 - DNA, 14 bp, Homo sapiens
ccttatcataaatt

SEQ ID NO: 482134 - DNA, 16 bp, Homo sapiens
ccttatcataaattca

SEQ ID NO: 482135 - DNA, 22 bp, Homo sapiens
ccttctaatccatgtgctgctg

SEQ ID NO: 482136 - DNA, 12 bp, Homo sapiens
ccttctccacag

SEQ ID NO: 482137 - DNA, 12 bp, Homo sapiens
ccttctcccctc

SEQ ID NO: 482138 - DNA, 20 bp, Homo sapiens
ccttgtgatcactttctgaa

SEQ ID NO: 482139 - DNA, 15 bp, Homo sapiens
catgtgctgctgtgg

SEQ ID NO: 482140 - DNA, 18 bp, Homo sapiens
catgttaattgatagaat

SEQ ID NO: 482141 - DNA, 17 bp, Homo sapiens
cattgggccatgtttaa

SEQ ID NO: 482142 - DNA, 10 bp, Homo sapiens
ccaatttctc

SEQ ID NO: 482143 - DNA, 13 bp, Homo sapiens
ccagttctgatga

SEQ ID NO: 482144 - DNA, 15 bp, Homo sapiens
ccatggtagactgtg

SEQ ID NO: 482145 - DNA, 16 bp, Homo sapiens
ccatggtagactgtga

SEQ ID NO: 482146 - DNA, 17 bp, Homo sapiens
ccatggtagactgtgac

SEQ ID NO: 482147 - DNA, 12 bp, Homo sapiens
ccatgtgctgct

SEQ ID NO: 482148 - DNA, 15 bp, Homo sapiens
ccatgtgctgctgtg

SEQ ID NO: 482149 - DNA, 17 bp, Homo sapiens
cctaattaatttcagta

SEQ ID NO: 482150 - DNA, 16 bp, Homo sapiens
cctggacatattccca

SEQ ID NO: 482151 - DNA, 18 bp, Homo sapiens
ccttgtgatcactttctg

SEQ ID NO: 482152 - DNA, 13 bp, Homo sapiens
ctaattaatttca

SEQ ID NO: 482153 - DNA, 13 bp, Homo sapiens
ctagccatatatt

SEQ ID NO: 482154 - DNA, 17 bp, Homo sapiens
ctagccatatattttct

SEQ ID NO: 482155 - DNA, 14 bp, Homo sapiens
ctatgtgtgtgctt

SEQ ID NO: 482156 - DNA, 21 bp, Homo sapiens
ctattagcttactgattaact

SEQ ID NO: 482157 - DNA, 20 bp, Homo sapiens
ctcatcagaaacaatttctg

SEQ ID NO: 482158 - DNA, 18 bp, Homo sapiens
ctccagccacttatttcc

SEQ ID NO: 482159 - DNA, 20 bp, Homo sapiens
ctgatatctgtttgcttcta

SEQ ID NO: 482160 - DNA, 14 bp, Homo sapiens
ctgctgtggcatca

SEQ ID NO: 482161 - DNA, 15 bp, Homo sapiens
aaaacgatttaattt

SEQ ID NO: 482162 - DNA, 12 bp, Homo sapiens
aaaatacttctt

SEQ ID NO: 482163 - DNA, 13 bp, Homo sapiens
aaacaattcaaag

SEQ ID NO: 482164 - DNA, 18 bp, Homo sapiens
aaactgcgtaggagagaa

SEQ ID NO: 482165 - DNA, 14 bp, Homo sapiens
aaagacatgaaatt

SEQ ID NO: 482166 - DNA, 19 bp, Homo sapiens
aaaggtttcactgttcatg

SEQ ID NO: 482167 - DNA, 17 bp, Homo sapiens
aaagtctcctgtatcat

SEQ ID NO: 482168 - DNA, 18 bp, Homo sapiens
aaagtcttgaatgttgaa

SEQ ID NO: 482169 - DNA, 21 bp, Homo sapiens
aaattagggctctaatttcct

SEQ ID NO: 482170 - DNA, 22 bp, Homo sapiens
aacaaagcatttgactttctgt

SEQ ID NO: 482171 - DNA, 20 bp, Homo sapiens
aacaattcaaagaatcacct

SEQ ID NO: 482172 - DNA, 14 bp, Homo sapiens
aacagtaatcagtt

SEQ ID NO: 482173 - DNA, 16 bp, Homo sapiens
aacttcatctgtctgt

SEQ ID NO: 482174 - DNA, 16 bp, Homo sapiens
aagctccatcttattt

SEQ ID NO: 482175 - DNA, 15 bp, Homo sapiens
aaggggaattaacaa

SEQ ID NO: 482176 - DNA, 16 bp, Homo sapiens
aaggtttcactgttca

SEQ ID NO: 482177 - DNA, 20 bp, Homo sapiens
aatcaagtctgtgaaagtct

SEQ ID NO: 482178 - DNA, 13 bp, Homo sapiens
aatgctgatttaa

SEQ ID NO: 482179 - DNA, 22 bp, Homo sapiens
aatggtgaactgtcattacaga

SEQ ID NO: 482180 - DNA, 16 bp, Homo sapiens
aatgttgaagaactca

SEQ ID NO: 482181 - DNA, 20 bp, Homo sapiens
aattagggctctaatttcct

SEQ ID NO: 482182 - DNA, 13 bp, Homo sapiens
aattcaaacctaa

SEQ ID NO: 482183 - DNA, 16 bp, Homo sapiens
aatttcagtaagatca

SEQ ID NO: 482184 - DNA, 13 bp, Homo sapiens
acaatttctgtgt

SEQ ID NO: 482185 - DNA, 14 bp, Homo sapiens
acacagtctggtgc

SEQ ID NO: 482186 - DNA, 17 bp, Homo sapiens
acactcaccgagaggaa

SEQ ID NO: 482187 - DNA, 19 bp, Homo sapiens
gtttccagctaagcctgat

SEQ ID NO: 482188 - DNA, 13 bp, Homo sapiens
gtttgcttctaaa

SEQ ID NO: 482189 - DNA, 19 bp, Homo sapiens
gtttgcttctaaaggtttc

SEQ ID NO: 482190 - DNA, 21 bp, Homo sapiens
taaagcaagctcacttgcttt

SEQ ID NO: 482191 - DNA, 15 bp, Homo sapiens
taacattctatttca

SEQ ID NO: 482192 - DNA, 17 bp, Homo sapiens
taactacctttggctta

SEQ ID NO: 482193 - DNA, 22 bp, Homo sapiens
taaggggaattaacaattgcca

SEQ ID NO: 482194 - DNA, 16 bp, Homo sapiens
taatccatgtgctgct

SEQ ID NO: 482195 - DNA, 14 bp, Homo sapiens
taattaatttcagt

SEQ ID NO: 482196 - DNA, 15 bp, Homo sapiens
tacatatgataaatt

SEQ ID NO: 482197 - DNA, 17 bp, Homo sapiens
tacatgatgatttcaga

SEQ ID NO: 482198 - DNA, 22 bp, Homo sapiens
tacatgatgatttcagaaacaa

SEQ ID NO: 482199 - DNA, 18 bp, Homo sapiens
tacctctgcataaatatt

SEQ ID NO: 482200 - DNA, 23 bp, Homo sapiens
taggtttagaatcaagtctgtga

SEQ ID NO: 482201 - DNA, 13 bp, Homo sapiens
tagtgtgtccatg

SEQ ID NO: 482202 - DNA, 18 bp, Homo sapiens
tataattttattgctgga

SEQ ID NO: 482203 - DNA, 17 bp, Homo sapiens
tatctcgctagccatat

SEQ ID NO: 482204 - DNA, 23 bp, Homo sapiens
tattcccatggtagactgtgaca

SEQ ID NO: 482205 - DNA, 11 bp, Homo sapiens
tatttccatgg

SEQ ID NO: 482206 - DNA, 22 bp, Homo sapiens
tattttctgagtagcatatata

SEQ ID NO: 482207 - DNA, 19 bp, Homo sapiens
tattttggacgtgtgagga

SEQ ID NO: 482208 - DNA, 14 bp, Homo sapiens
tcaacttcaggaaa

SEQ ID NO: 482209 - DNA, 11 bp, Homo sapiens
tcaagtctgtg

SEQ ID NO: 482210 - DNA, 14 bp, Homo sapiens
tcaagtctgtgaaa

SEQ ID NO: 482211 - DNA, 16 bp, Homo sapiens
tcagactgctttgaga

SEQ ID NO: 482212 - DNA, 22 bp, Homo sapiens
tcaggaaaggaagatgtaagaa

SEQ ID NO: 482213 - DNA, 17 bp, Homo sapiens
tcagtgctagcttattt

SEQ ID NO: 482214 - DNA, 22 bp, Homo sapiens
tcagttaggattaggtttagaa

SEQ ID NO: 482215 - DNA, 13 bp, Homo sapiens
tcataaattcaaa

SEQ ID NO: 482216 - DNA, 18 bp, Homo sapiens
tcatgttaattgatagaa

SEQ ID NO: 482217 - DNA, 22 bp, Homo sapiens
tctccacagggacacagtctgg

SEQ ID NO: 482218 - DNA, 15 bp, Homo sapiens
tctcctgtatcattt

SEQ ID NO: 482219 - DNA, 16 bp, Homo sapiens
tgaaaactaagttctc

SEQ ID NO: 482220 - DNA, 20 bp, Homo sapiens
tgaaagtctcctgtatcatt

SEQ ID NO: 482221 - DNA, 22 bp, Homo sapiens
tgaatgagtttccagctaagcc

SEQ ID NO: 482222 - DNA, 17 bp, Homo sapiens
tgaggacataaatcttc

SEQ ID NO: 482223 - DNA, 18 bp, Homo sapiens
tgagtttccagctaagcc

SEQ ID NO: 482224 - DNA, 19 bp, Homo sapiens
tgatatctgtttgcttcta

SEQ ID NO: 482225 - DNA, 15 bp, Homo sapiens
tgatgatttcagaaa

SEQ ID NO: 482226 - DNA, 13 bp, Homo sapiens
tgctgcctcagga

SEQ ID NO: 482227 - DNA, 14 bp, Homo sapiens
tggattcccctgga

SEQ ID NO: 482228 - DNA, 23 bp, Homo sapiens
tggcctattttggacgtgtgagg

SEQ ID NO: 482229 - DNA, 23 bp, Homo sapiens
tgggaaatgctgatttaaacttc

SEQ ID NO: 482230 - DNA, 17 bp, Homo sapiens
tgtaacattctatttca

SEQ ID NO: 482231 - DNA, 16 bp, Homo sapiens
tgtctgtcccagttaa

SEQ ID NO: 482232 - DNA, 15 bp, Homo sapiens
tgtgaaagtctcctg

SEQ ID NO: 482233 - DNA, 23 bp, Homo sapiens
tgtggatggaggtgatgaaaacc

SEQ ID NO: 482234 - DNA, 17 bp, Homo sapiens
tgtggcatcaggaaagg

SEQ ID NO: 482235 - DNA, 20 bp, Homo sapiens
ttagaatcaagtctgtgaaa

SEQ ID NO: 482236 - DNA, 12 bp, Homo sapiens
ttagtgtgattg

SEQ ID NO: 482237 - DNA, 16 bp, Homo sapiens
ttctaattagattaac

SEQ ID NO: 482238 - DNA, 13 bp, Homo sapiens
ttgagtcatttta

SEQ ID NO: 482239 - DNA, 19 bp, Homo sapiens
ttggaacagtaatcagttt

SEQ ID NO: 482240 - DNA, 20 bp, Homo sapiens
ttggaacagtaatcagtttg

SEQ ID NO: 482241 - DNA, 23 bp, Homo sapiens
tttgtcagtgtagatcaactcat

SEQ ID NO: 482242 - DNA, 17 bp, Homo sapiens
tttgttaataaagtgca

SEQ ID NO: 482243 - DNA, 21 bp, Homo sapiens
aagaaattagggctctaattt

SEQ ID NO: 482244 - DNA, 13 bp, Homo sapiens
aaggcttctccac

SEQ ID NO: 482245 - DNA, 14 bp, Homo sapiens
aagggccttctcca

SEQ ID NO: 482246 - DNA, 15 bp, Homo sapiens
aagtctcctgtatca

SEQ ID NO: 482247 - DNA, 15 bp, Homo sapiens
aagtgtactggattt

SEQ ID NO: 482248 - DNA, 20 bp, Homo sapiens
aatcacctaattaatttcag

SEQ ID NO: 482249 - DNA, 15 bp, Homo sapiens
aatccatgtgctgct

SEQ ID NO: 482250 - DNA, 19 bp, Homo sapiens
aatccatgtgctgctgtgg

SEQ ID NO: 482251 - DNA, 15 bp, Homo sapiens
aatctactagaacct

SEQ ID NO: 482252 - DNA, 20 bp, Homo sapiens
aatgagtttccagctaagcc

SEQ ID NO: 482253 - DNA, 12 bp, Homo sapiens
aattaatttcag

SEQ ID NO: 482254 - DNA, 13 bp, Homo sapiens
aattaatttcagt

SEQ ID NO: 482255 - DNA, 19 bp, Homo sapiens
aattagggctctaatttcc

SEQ ID NO: 482256 - DNA, 16 bp, Homo sapiens
aattcaaacctaagtt

SEQ ID NO: 482257 - DNA, 20 bp, Homo sapiens
acagggacacagtctggtgc

SEQ ID NO: 482258 - DNA, 13 bp, Homo sapiens
acagtaatcagtt

SEQ ID NO: 482259 - DNA, 22 bp, Homo sapiens
acatattcccatggtagactgt

SEQ ID NO: 482260 - DNA, 14 bp, Homo sapiens
acctaattaatttc

SEQ ID NO: 482261 - DNA, 15 bp, Homo sapiens
acctaattaatttca

SEQ ID NO: 482262 - DNA, 17 bp, Homo sapiens
acgtgaagataccataa

SEQ ID NO: 482263 - DNA, 12 bp, Homo sapiens
acgtgtgaggat

SEQ ID NO: 482264 - DNA, 17 bp, Homo sapiens
actgtaaaatacttctt

SEQ ID NO: 482265 - DNA, 20 bp, Homo sapiens
actgttcatgaatacgtaaa

SEQ ID NO: 482266 - DNA, 16 bp, Homo sapiens
actttggatcaggaaa

SEQ ID NO: 482267 - DNA, 15 bp, Homo sapiens
agaaacaatttctgt

SEQ ID NO: 482268 - DNA, 13 bp, Homo sapiens
agaaattagggct

SEQ ID NO: 482269 - DNA, 22 bp, Homo sapiens
agaaattagggctctaatttcc

SEQ ID NO: 482270 - DNA, 15 bp, Homo sapiens
agaactcatgtgatt

SEQ ID NO: 482271 - DNA, 18 bp, Homo sapiens
agaactcatgtgatttac

SEQ ID NO: 482272 - DNA, 23 bp, Homo sapiens
agaataaagccttgtgatcactt

SEQ ID NO: 482273 - DNA, 14 bp, Homo sapiens
agaatcaagtctgt

SEQ ID NO: 482274 - DNA, 19 bp, Homo sapiens
agaatcacctaattaattt

SEQ ID NO: 482275 - DNA, 23 bp, Homo sapiens
agaatgttgaaactgacttgctg

SEQ ID NO: 482276 - DNA, 12 bp, Homo sapiens
agagaaatgaaa

SEQ ID NO: 482277 - DNA, 11 bp, Homo sapiens
agcatatataa

SEQ ID NO: 482278 - DNA, 17 bp, Homo sapiens
agcatttgactttctgt

SEQ ID NO: 482279 - DNA, 17 bp, Homo sapiens
agcctgatgatggaagg

SEQ ID NO: 482280 - DNA, 21 bp, Homo sapiens
aggactctcacgatatgcaag

SEQ ID NO: 482281 - DNA, 20 bp, Homo sapiens
aggtttagaatcaagtctgt

SEQ ID NO: 482282 - DNA, 16 bp, Homo sapiens
aggtttcactgttcat

SEQ ID NO: 482283 - DNA, 12 bp, Homo sapiens
agttctgatgag

SEQ ID NO: 482284 - DNA, 19 bp, Homo sapiens
agtttccagctaagcctga

SEQ ID NO: 482285 - DNA, 17 bp, Homo sapiens
agttttcttttaatttt

SEQ ID NO: 482286 - DNA, 18 bp, Homo sapiens
ataaatcttccaaagttt

SEQ ID NO: 482287 - DNA, 19 bp, Homo sapiens
atacatgatgatttcagaa

SEQ ID NO: 482288 - DNA, 16 bp, Homo sapiens
atatgaaaactaagtt

SEQ ID NO: 482289 - DNA, 14 bp, Homo sapiens
atcaagtctgtgaa

SEQ ID NO: 482290 - DNA, 22 bp, Homo sapiens
atcaggaaaggaagatgtaaga

SEQ ID NO: 482291 - DNA, 17 bp, Homo sapiens
atccatgtgctgctgtg

SEQ ID NO: 482292 - DNA, 16 bp, Homo sapiens
atctgtttgcttctaa

SEQ ID NO: 482293 - DNA, 20 bp, Homo sapiens
atgaggcacgcctgccttct

SEQ ID NO: 482294 - DNA, 20 bp, Homo sapiens
atgagtttccagctaagcct

SEQ ID NO: 482295 - DNA, 14 bp, Homo sapiens
atgatgatttcaga

SEQ ID NO: 482296 - DNA, 22 bp, Homo sapiens
atgatggaagggccttctccac

SEQ ID NO: 482297 - DNA, 13 bp, Homo sapiens
atgatttcagaaa

SEQ ID NO: 482298 - DNA, 14 bp, Homo sapiens
atgatttcagaaac

SEQ ID NO: 482299 - DNA, 19 bp, Homo sapiens
atgctatctcgctagccat

SEQ ID NO: 482300 - DNA, 17 bp, Homo sapiens
atggaggagagtgttta

SEQ ID NO: 482301 - DNA, 18 bp, Homo sapiens
atggattcccctggacat

SEQ ID NO: 482302 - DNA, 16 bp, Homo sapiens
atggtagactgtgaca

SEQ ID NO: 482303 - DNA, 16 bp, Homo sapiens
atggtgaactgtcatt

SEQ ID NO: 482304 - DNA, 21 bp, Homo sapiens
atggttacctctgcataaata

SEQ ID NO: 482305 - DNA, 16 bp, Homo sapiens
atgtgctcatcagaaa

SEQ ID NO: 482306 - DNA, 14 bp, Homo sapiens
atgtgctgctgtgg

SEQ ID NO: 482307 - DNA, 16 bp, Homo sapiens
attaggtttagaatca

SEQ ID NO: 482308 - DNA, 20 bp, Homo sapiens
attcccatggtagactgtga

SEQ ID NO: 482309 - DNA, 22 bp, Homo sapiens
attcccatggtagactgtgaca

SEQ ID NO: 482310 - DNA, 12 bp, Homo sapiens
attctatttcaa

SEQ ID NO: 482311 - DNA, 21 bp, Homo sapiens
attctatttcaacttcaggaa

SEQ ID NO: 482312 - DNA, 14 bp, Homo sapiens
attgacaagtttaa

SEQ ID NO: 482313 - DNA, 14 bp, Homo sapiens
atttattctaatta

SEQ ID NO: 482314 - DNA, 21 bp, Homo sapiens
atttcagtaagatcaagctcc

SEQ ID NO: 482315 - DNA, 18 bp, Homo sapiens
atttgactttctgtctgt

SEQ ID NO: 482316 - DNA, 23 bp, Homo sapiens
attttaaaacttcatctgtctgt

SEQ ID NO: 482317 - DNA, 20 bp, Homo sapiens
caaagcatttgactttctgt

SEQ ID NO: 482318 - DNA, 16 bp, Homo sapiens
caaggcctccagccac

SEQ ID NO: 482319 - DNA, 11 bp, Homo sapiens
caagtctgtga

SEQ ID NO: 482320 - DNA, 18 bp, Homo sapiens
cacaacctcctcctccag

SEQ ID NO: 482321 - DNA, 17 bp, Homo sapiens
cacagctgagctggcct

SEQ ID NO: 482322 - DNA, 14 bp, Homo sapiens
cacttatttccatg

SEQ ID NO: 482323 - DNA, 21 bp, Homo sapiens
cagcagttttcttttaatttt

SEQ ID NO: 482324 - DNA, 15 bp, Homo sapiens
cagctaagcctgatg

SEQ ID NO: 482325 - DNA, 13 bp, Homo sapiens
cagttctgatgag

SEQ ID NO: 482326 - DNA, 17 bp, Homo sapiens
catgtgctgctgtggca

SEQ ID NO: 482327 - DNA, 20 bp, Homo sapiens
ccacaagggtgcccacctct

SEQ ID NO: 482328 - DNA, 17 bp, Homo sapiens
ccacttatttccatgga

SEQ ID NO: 482329 - DNA, 23 bp, Homo sapiens
ccagagaaatgaaagtcagttta

SEQ ID NO: 482330 - DNA, 20 bp, Homo sapiens
ccatggattcccctggacat

SEQ ID NO: 482331 - DNA, 17 bp, Homo sapiens
cccatggtagactgtga

SEQ ID NO: 482332 - DNA, 20 bp, Homo sapiens
cctattttggacgtgtgagg

SEQ ID NO: 482333 - DNA, 20 bp, Homo sapiens
cctccagccacttatttcca

SEQ ID NO: 482334 - DNA, 18 bp, Homo sapiens
ctaatccatgtgctgctg

SEQ ID NO: 482335 - DNA, 19 bp, Homo sapiens
ctatctcgctagccatata

SEQ ID NO: 482336 - DNA, 19 bp, Homo sapiens
ctgccttctcccctccaag

SEQ ID NO: 482337 - DNA, 16 bp, Homo sapiens
ctgctgcctcaggaat

SEQ ID NO: 482338 - DNA, 12 bp, Homo sapiens
ctgtaactgtcc

SEQ ID NO: 482339 - DNA, 21 bp, Homo sapiens
ctgtgaaagtctcctgtatca

SEQ ID NO: 482340 - DNA, 17 bp, Homo sapiens
ctgtgacacagctgagc

SEQ ID NO: 482341 - DNA, 21 bp, Homo sapiens
ctgttaaggcatccacttcac

SEQ ID NO: 482342 - DNA, 15 bp, Homo sapiens
cttactgattaactc

SEQ ID NO: 482343 - DNA, 21 bp, Homo sapiens
cttctaatccatgtgctgctg

SEQ ID NO: 482344 - DNA, 16 bp, Homo sapiens
gaaactgacttgctgt

SEQ ID NO: 482345 - DNA, 22 bp, Homo sapiens
gaaatgctgatttaaacttctt

SEQ ID NO: 482346 - DNA, 14 bp, Homo sapiens
gaagagtatggatt

SEQ ID NO: 482347 - DNA, 19 bp, Homo sapiens
gacacagctgagctggcct

SEQ ID NO: 482348 - DNA, 21 bp, Homo sapiens
gagctggcctattttggacgt

SEQ ID NO: 482349 - DNA, 18 bp, Homo sapiens
gcaaaatacatgatgatt

SEQ ID NO: 482350 - DNA, 15 bp, Homo sapiens
gcacgcctgccttct

SEQ ID NO: 482351 - DNA, 16 bp, Homo sapiens
gcctatcctaagagct

SEQ ID NO: 482352 - DNA, 15 bp, Homo sapiens
ggaaaacgatttaat

SEQ ID NO: 482353 - DNA, 19 bp, Homo sapiens
ggtctgctgcctcaggaat

SEQ ID NO: 482354 - DNA, 17 bp, Homo sapiens
gtaacattctatttcaa

SEQ ID NO: 482355 - DNA, 19 bp, Homo sapiens
gtctgtcccagttaactgt

SEQ ID NO: 482356 - DNA, 21 bp, Homo sapiens
gtctgtgaaagtctcctgtat

SEQ ID NO: 482357 - DNA, 17 bp, Homo sapiens
gttaattgatagaataa

SEQ ID NO: 482358 - DNA, 21 bp, Homo sapiens
gtttagaatcaagtctgtgaa

SEQ ID NO: 482359 - DNA, 15 bp, Homo sapiens
gtttcactgttcatg

SEQ ID NO: 482360 - DNA, 13 bp, Homo sapiens
taaaatacttctt

SEQ ID NO: 482361 - DNA, 15 bp, Homo sapiens
tacatgatgatttca

SEQ ID NO: 482362 - DNA, 16 bp, Homo sapiens
tactagaaccttctaa

SEQ ID NO: 482363 - DNA, 18 bp, Homo sapiens
tagaatcaagtctgtgaa

SEQ ID NO: 482364 - DNA, 22 bp, Homo sapiens
tagatcaactcatgttaattga

SEQ ID NO: 482365 - DNA, 16 bp, Homo sapiens
tagggctctaatttcc

SEQ ID NO: 482366 - DNA, 17 bp, Homo sapiens
tagggctctaatttcct

SEQ ID NO: 482367 - DNA, 14 bp, Homo sapiens
tagttgttaagttt

SEQ ID NO: 482368 - DNA, 19 bp, Homo sapiens
tataattttattgctggaa

SEQ ID NO: 482369 - DNA, 14 bp, Homo sapiens
tatatgaaaactaa

SEQ ID NO: 482370 - DNA, 13 bp, Homo sapiens
tatgataaatttg

SEQ ID NO: 482371 - DNA, 23 bp, Homo sapiens
tatggaggagagtgtttaactga

SEQ ID NO: 482372 - DNA, 21 bp, Homo sapiens
tattcccatggtagactgtga

SEQ ID NO: 482373 - DNA, 20 bp, Homo sapiens
tatttgtcagtgtagatcaa

SEQ ID NO: 482374 - DNA, 18 bp, Homo sapiens
tcaagctccatcttattt

SEQ ID NO: 482375 - DNA, 23 bp, Homo sapiens
tcaccgagaggaaaaaggcttct

SEQ ID NO: 482376 - DNA, 24 bp, Homo sapiens
tcagaaacaaagcatttgactttc

SEQ ID NO: 482377 - DNA, 24 bp, Homo sapiens
tcataaattcaaacctaagttgct

SEQ ID NO: 482378 - DNA, 22 bp, Homo sapiens
tcattgggccatgtttaagtgt

SEQ ID NO: 482379 - DNA, 16 bp, Homo sapiens
tccaaaggtttcaact

SEQ ID NO: 482380 - DNA, 14 bp, Homo sapiens
tccagttctgatga

SEQ ID NO: 482381 - DNA, 17 bp, Homo sapiens
tccagttctgatgaggc

SEQ ID NO: 482382 - DNA, 13 bp, Homo sapiens
tccttgtcagttg

SEQ ID NO: 482383 - DNA, 18 bp, Homo sapiens
tctattagcttactgatt

SEQ ID NO: 482384 - DNA, 20 bp, Homo sapiens
tctattagcttactgattaa

SEQ ID NO: 482385 - DNA, 16 bp, Homo sapiens
tctccacaacctcctc

SEQ ID NO: 482386 - DNA, 18 bp, Homo sapiens
tctgtcccagttaactgt

SEQ ID NO: 482387 - DNA, 22 bp, Homo sapiens
tctgtgaaagtctcctgtatca

SEQ ID NO: 482388 - DNA, 14 bp, Homo sapiens
tgaaagtcagttta

SEQ ID NO: 482389 - DNA, 21 bp, Homo sapiens
tgaaagtcagtttaagaggct

SEQ ID NO: 482390 - DNA, 12 bp, Homo sapiens
tgagtagcatat

SEQ ID NO: 482391 - DNA, 16 bp, Homo sapiens
tgatgatttcagaaac

SEQ ID NO: 482392 - DNA, 18 bp, Homo sapiens
tgatgtgctcatcagaaa

SEQ ID NO: 482393 - DNA, 21 bp, Homo sapiens
tgatttaaacttcttaactgg

SEQ ID NO: 482394 - DNA, 13 bp, Homo sapiens
tgatttcagaaac

SEQ ID NO: 482395 - DNA, 23 bp, Homo sapiens
tgcaaaatacatgatgatttcag

SEQ ID NO: 482396 - DNA, 14 bp, Homo sapiens
tgcagaccctcaga

SEQ ID NO: 482397 - DNA, 17 bp, Homo sapiens
tgctatctcgctagcca

SEQ ID NO: 482398 - DNA, 15 bp, Homo sapiens
tgctgcctcaggaat

SEQ ID NO: 482399 - DNA, 13 bp, Homo sapiens
tgctgctgtggca

SEQ ID NO: 482400 - DNA, 13 bp, Homo sapiens
tgctgtggcatca

SEQ ID NO: 482401 - DNA, 18 bp, Homo sapiens
tggaagggccttctccac

SEQ ID NO: 482402 - DNA, 18 bp, Homo sapiens
tggatccttgtcagttgt

SEQ ID NO: 482403 - DNA, 17 bp, Homo sapiens
tggatggaggtgatgaa

SEQ ID NO: 482404 - DNA, 22 bp, Homo sapiens
tgtaagaagctaaaatgaaaaa

SEQ ID NO: 482405 - DNA, 20 bp, Homo sapiens
tgtagatcaactcatgttaa

SEQ ID NO: 482406 - DNA, 15 bp, Homo sapiens
tgtgctgctgtggca

SEQ ID NO: 482407 - DNA, 14 bp, Homo sapiens
ttaaaacttcatct

SEQ ID NO: 482408 - DNA, 17 bp, Homo sapiens
ttaattgatagaataaa

SEQ ID NO: 482409 - DNA, 14 bp, Homo sapiens
ttaatttcagtaag

SEQ ID NO: 482410 - DNA, 18 bp, Homo sapiens
ttagaatcaagtctgtga

SEQ ID NO: 482411 - DNA, 13 bp, Homo sapiens
ttagaatgttgaa

SEQ ID NO: 482412 - DNA, 12 bp, Homo sapiens
ttattctaatta

SEQ ID NO: 482413 - DNA, 15 bp, Homo sapiens
ttatttgtcagtgta

SEQ ID NO: 482414 - DNA, 13 bp, Homo sapiens
ttcaaagaatcac

SEQ ID NO: 482415 - DNA, 20 bp, Homo sapiens
ttcccatggtagactgtgac

SEQ ID NO: 482416 - DNA, 16 bp, Homo sapiens
ttctcccctccaagtg

SEQ ID NO: 482417 - DNA, 16 bp, Homo sapiens
ttcttggtatgatcat

SEQ ID NO: 482418 - DNA, 19 bp, Homo sapiens
ttgctggaatctactagaa

SEQ ID NO: 482419 - DNA, 20 bp, Homo sapiens
ttggaaaacgatttaattta

SEQ ID NO: 482420 - DNA, 21 bp, Homo sapiens
ttgtaacattctatttcaact

SEQ ID NO: 482421 - DNA, 18 bp, Homo sapiens
tttaaacttcttaactgg

SEQ ID NO: 482422 - DNA, 18 bp, Homo sapiens
tttaagtgtactggattt

SEQ ID NO: 482423 - DNA, 20 bp, Homo sapiens
tttccagctaagcctgatga

SEQ ID NO: 482424 - DNA, 22 bp, Homo sapiens
tttctgagtagcatatataatt

SEQ ID NO: 482425 - DNA, 21 bp, Homo sapiens
tttggaaaacgatttaattta

SEQ ID NO: 482426 - DNA, 15 bp, Homo sapiens
ttttcttttaatttt

SEQ ID NO: 482427 - DNA, 22 bp, Homo sapiens
ttttggaaaacgatttaattta

SEQ ID NO: 482428 - DNA, 16 bp, Homo sapiens
aaaacgatttaattta

SEQ ID NO: 482429 - DNA, 20 bp, Homo sapiens
aaagttaaacgtgatgtgct

SEQ ID NO: 482430 - DNA, 14 bp, Homo sapiens
aaatacatgatgat

SEQ ID NO: 482431 - DNA, 20 bp, Homo sapiens
aaatacatgatgatttcaga

SEQ ID NO: 482432 - DNA, 14 bp, Homo sapiens
ctaattaatttcag

SEQ ID NO: 482433 - DNA, 15 bp, Homo sapiens
ctaattaatttcagt

SEQ ID NO: 482434 - DNA, 20 bp, Homo sapiens
ctacctttggcttaattcca

SEQ ID NO: 482435 - DNA, 18 bp, Homo sapiens
ctatttcaacttcaggaa

SEQ ID NO: 482436 - DNA, 14 bp, Homo sapiens
ctcaaggcctccag

SEQ ID NO: 482437 - DNA, 13 bp, Homo sapiens
ctcccctccaagt

SEQ ID NO: 482438 - DNA, 20 bp, Homo sapiens
ctcctccagttctgatgagg

SEQ ID NO: 482439 - DNA, 11 bp, Homo sapiens
ctctaatttcc

SEQ ID NO: 482440 - DNA, 22 bp, Homo sapiens
ctgatatctgtttgcttctaaa

SEQ ID NO: 482441 - DNA, 14 bp, Homo sapiens
ctggacatattccc

SEQ ID NO: 482442 - DNA, 19 bp, Homo sapiens
ctgtctgtcccagttaact

SEQ ID NO: 482443 - DNA, 21 bp, Homo sapiens
cttcaggaaagcagcagtttt

SEQ ID NO: 482444 - DNA, 20 bp, Homo sapiens
cttgcattttagctaattta

SEQ ID NO: 482445 - DNA, 15 bp, Homo sapiens
cttgctgtgacttat

SEQ ID NO: 482446 - DNA, 11 bp, Homo sapiens
cttttaatttt

SEQ ID NO: 482447 - DNA, 15 bp, Homo sapiens
cttttgggaaatgct

SEQ ID NO: 482448 - DNA, 18 bp, Homo sapiens
gaaaacgatttaatttat

SEQ ID NO: 482449 - DNA, 21 bp, Homo sapiens
gaaaggaagatgtaagaagct

SEQ ID NO: 482450 - DNA, 19 bp, Homo sapiens
gaacttggtgcctaatgtt

SEQ ID NO: 482451 - DNA, 16 bp, Homo sapiens
gaatcaagtctgtgaa

SEQ ID NO: 482452 - DNA, 18 bp, Homo sapiens
gaatcacctaattaattt

SEQ ID NO: 482453 - DNA, 20 bp, Homo sapiens
gatatctgtttgcttctaaa

SEQ ID NO: 482454 - DNA, 14 bp, Homo sapiens
gatcactttctgaa

SEQ ID NO: 482455 - DNA, 12 bp, Homo sapiens
gatgatttcaga

SEQ ID NO: 482456 - DNA, 12 bp, Homo sapiens
gatttcagaaac

SEQ ID NO: 482457 - DNA, 21 bp, Homo sapiens
gcaaaatacatgatgatttca

SEQ ID NO: 482458 - DNA, 12 bp, Homo sapiens
gcgtaggagaga

SEQ ID NO: 482459 - DNA, 14 bp, Homo sapiens
gctagccatatatt

SEQ ID NO: 482460 - DNA, 15 bp, Homo sapiens
gctgctgtggcatca

SEQ ID NO: 482461 - DNA, 13 bp, Homo sapiens
gcttaattccaat

SEQ ID NO: 482462 - DNA, 18 bp, Homo sapiens
gggaaatgctgatttaaa

SEQ ID NO: 482463 - DNA, 21 bp, Homo sapiens
ggtgcccagactcaaggcctc

SEQ ID NO: 482464 - DNA, 19 bp, Homo sapiens
ggtgtgaggacataaatct

SEQ ID NO: 482465 - DNA, 13 bp, Homo sapiens
gtagcatatataa

SEQ ID NO: 482466 - DNA, 23 bp, Homo sapiens
gtatctgatatctgtttgcttct

SEQ ID NO: 482467 - DNA, 15 bp, Homo sapiens
gtctcctgtatcatt

SEQ ID NO: 482468 - DNA, 21 bp, Homo sapiens
gtgaacttggtgcctaatgtt

SEQ ID NO: 482469 - DNA, 14 bp, Homo sapiens
gtgatcactttctg

SEQ ID NO: 482470 - DNA, 22 bp, Homo sapiens
gtgctcatcagaaacaatttct

SEQ ID NO: 482471 - DNA, 13 bp, Homo sapiens
aaaactaagttct

SEQ ID NO: 482472 - DNA, 22 bp, Homo sapiens
aaagaatcacctaattaatttc

SEQ ID NO: 482473 - DNA, 17 bp, Homo sapiens
aaagcatgccaatttct

SEQ ID NO: 482474 - DNA, 14 bp, Homo sapiens
aaagtctcctgtat

SEQ ID NO: 482475 - DNA, 14 bp, Homo sapiens
aaatattagcaaag

SEQ ID NO: 482476 - DNA, 14 bp, Homo sapiens
aaatctcatcccta

SEQ ID NO: 482477 - DNA, 18 bp, Homo sapiens
aaattagggctctaattt

SEQ ID NO: 482478 - DNA, 19 bp, Homo sapiens
aaattagggctctaatttc

SEQ ID NO: 482479 - DNA, 16 bp, Homo sapiens
aaattcacaaagttaa

SEQ ID NO: 482480 - DNA, 14 bp, Homo sapiens
aacattctatttca

SEQ ID NO: 482481 - DNA, 15 bp, Homo sapiens
aacattctatttcaa

SEQ ID NO: 482482 - DNA, 15 bp, Homo sapiens
aacgatttaatttat

SEQ ID NO: 482483 - DNA, 12 bp, Homo sapiens
aacttcaggaaa

SEQ ID NO: 482484 - DNA, 14 bp, Homo sapiens
ctgtatcatttctt

SEQ ID NO: 482485 - DNA, 18 bp, Homo sapiens
ctgtgaaagtctcctgta

SEQ ID NO: 482486 - DNA, 13 bp, Homo sapiens
ctgtttgcttcta

SEQ ID NO: 482487 - DNA, 23 bp, Homo sapiens
cttaggcaatggtgaactgtcat

SEQ ID NO: 482488 - DNA, 18 bp, Homo sapiens
cttatttgtatttttcct

SEQ ID NO: 482489 - DNA, 23 bp, Homo sapiens
cttctaaaggtttcactgttcat

SEQ ID NO: 482490 - DNA, 16 bp, Homo sapiens
cttgcattttagctaa

SEQ ID NO: 482491 - DNA, 16 bp, Homo sapiens
ctttggcttaattcca

SEQ ID NO: 482492 - DNA, 21 bp, Homo sapiens
ctttggcttaattccaatcat

SEQ ID NO: 482493 - DNA, 24 bp, Homo sapiens
gaaacaaagcatttgactttctgt

SEQ ID NO: 482494 - DNA, 14 bp, Homo sapiens
gaaacaatttctgt

SEQ ID NO: 482495 - DNA, 17 bp, Homo sapiens
gaagaactcatgtgatt

SEQ ID NO: 482496 - DNA, 19 bp, Homo sapiens
gaatcacctaattaatttc

SEQ ID NO: 482497 - DNA, 20 bp, Homo sapiens
gaatcacctaattaatttca

SEQ ID NO: 482498 - DNA, 15 bp, Homo sapiens
gacatattcccatgg

SEQ ID NO: 482499 - DNA, 20 bp, Homo sapiens
gatcattggtatctgatatc

SEQ ID NO: 482500 - DNA, 15 bp, Homo sapiens
gccaagaattagatt

SEQ ID NO: 482501 - DNA, 20 bp, Homo sapiens
gccaatttctcttaagtact

SEQ ID NO: 482502 - DNA, 16 bp, Homo sapiens
gccacttatttccatg

SEQ ID NO: 482503 - DNA, 13 bp, Homo sapiens
gccttctcccctc

SEQ ID NO: 482504 - DNA, 14 bp, Homo sapiens
gccttctcccctcc

SEQ ID NO: 482505 - DNA, 15 bp, Homo sapiens
gctcatcagaaacaa

SEQ ID NO: 482506 - DNA, 14 bp, Homo sapiens
gctgagctggccta

SEQ ID NO: 482507 - DNA, 18 bp, Homo sapiens
gctgtggcatcaggaaag

SEQ ID NO: 482508 - DNA, 19 bp, Homo sapiens
gctgtggcatcaggaaagg

SEQ ID NO: 482509 - DNA, 13 bp, Homo sapiens
ggaaaaaggcttc

SEQ ID NO: 482510 - DNA, 16 bp, Homo sapiens
ggattcccctggacat

SEQ ID NO: 482511 - DNA, 15 bp, Homo sapiens
ggcatccacttcaca

SEQ ID NO: 482512 - DNA, 21 bp, Homo sapiens
gggatgctatctcgctagcca

SEQ ID NO: 482513 - DNA, 14 bp, Homo sapiens
gtactggatttaac

SEQ ID NO: 482514 - DNA, 13 bp, Homo sapiens
gtagactgtgaca

SEQ ID NO: 482515 - DNA, 16 bp, Homo sapiens
gtcagtgtagatcaac

SEQ ID NO: 482516 - DNA, 20 bp, Homo sapiens
gtgacacagctgagctggcc

SEQ ID NO: 482517 - DNA, 15 bp, Homo sapiens
gtgctcatcagaaac

SEQ ID NO: 482518 - DNA, 17 bp, Homo sapiens
gtgctgctgtggcatca

SEQ ID NO: 482519 - DNA, 12 bp, Homo sapiens
gtgtttaactga

SEQ ID NO: 482520 - DNA, 19 bp, Homo sapiens
gttaggattaggtttagaa

SEQ ID NO: 482521 - DNA, 22 bp, Homo sapiens
gttaggattaggtttagaatca

SEQ ID NO: 482522 - DNA, 16 bp, Homo sapiens
gttttcttttaatttt

SEQ ID NO: 482523 - DNA, 19 bp, Homo sapiens
taaagcaagctcacttgct

SEQ ID NO: 482524 - DNA, 15 bp, Homo sapiens
taaattcaaacctaa

SEQ ID NO: 482525 - DNA, 19 bp, Homo sapiens
taacattctatttcaactt

SEQ ID NO: 482526 - DNA, 17 bp, Homo sapiens
taaccttatcataaatt

SEQ ID NO: 482527 - DNA, 13 bp, Homo sapiens
taagcctgatgat

SEQ ID NO: 482528 - DNA, 18 bp, Homo sapiens
taaggggaattaacaatt

SEQ ID NO: 482529 - DNA, 20 bp, Homo sapiens
taatccatgtgctgctgtgg

SEQ ID NO: 482530 - DNA, 11 bp, Homo sapiens
taattaatttc

SEQ ID NO: 482531 - DNA, 13 bp, Homo sapiens
taattaatttcag

SEQ ID NO: 482532 - DNA, 17 bp, Homo sapiens
taatttccttaaagcaa

SEQ ID NO: 482533 - DNA, 11 bp, Homo sapiens
taatttttcct

SEQ ID NO: 482534 - DNA, 17 bp, Homo sapiens
tagaatcaagtctgtga

SEQ ID NO: 482535 - DNA, 21 bp, Homo sapiens
taggtttagaatcaagtctgt

SEQ ID NO: 482536 - DNA, 15 bp, Homo sapiens
tatatcagactgctt

SEQ ID NO: 482537 - DNA, 21 bp, Homo sapiens
tatatcagactgctttgagaa

SEQ ID NO: 482538 - DNA, 20 bp, Homo sapiens
tatctcgctagccatatatt

SEQ ID NO: 482539 - DNA, 15 bp, Homo sapiens
tatctgatatctgtt

SEQ ID NO: 482540 - DNA, 17 bp, Homo sapiens
tatctgtttgcttctaa

SEQ ID NO: 482541 - DNA, 23 bp, Homo sapiens
tcaaagaatcacctaattaattt

SEQ ID NO: 482542 - DNA, 16 bp, Homo sapiens
tcacctaattaatttc

SEQ ID NO: 482543 - DNA, 17 bp, Homo sapiens
tcacctaattaatttca

SEQ ID NO: 482544 - DNA, 22 bp, Homo sapiens
tcagaaacaaagcatttgactt

SEQ ID NO: 482545 - DNA, 16 bp, Homo sapiens
tcagaaacaatttctg

SEQ ID NO: 482546 - DNA, 15 bp, Homo sapiens
tcattgttaaagtaa

SEQ ID NO: 482547 - DNA, 21 bp, Homo sapiens
tccacagggacacagtctggt

SEQ ID NO: 482548 - DNA, 23 bp, Homo sapiens
tccacagggacacagtctggtgc

SEQ ID NO: 482549 - DNA, 19 bp, Homo sapiens
tccagctaagcctgatgat

SEQ ID NO: 482550 - DNA, 22 bp, Homo sapiens
tccagctaagcctgatgatgga

SEQ ID NO: 482551 - DNA, 17 bp, Homo sapiens
tcccatggtagactgtg

SEQ ID NO: 482552 - DNA, 23 bp, Homo sapiens
tcccatggtagactgtgacacag

SEQ ID NO: 482553 - DNA, 22 bp, Homo sapiens
tctaaaggtttcactgttcatg

SEQ ID NO: 482554 - DNA, 14 bp, Homo sapiens
tctcctgtatcatt

SEQ ID NO: 482555 - DNA, 22 bp, Homo sapiens
tcttgaatgttgaagaactcat

SEQ ID NO: 482556 - DNA, 20 bp, Homo sapiens
tgaaaaatagtgtgtccatg

SEQ ID NO: 482557 - DNA, 17 bp, Homo sapiens
tgaaactgacttgctgt

SEQ ID NO: 482558 - DNA, 14 bp, Homo sapiens
tgaaattcacaaag

SEQ ID NO: 482559 - DNA, 18 bp, Homo sapiens
tgaaattcacaaagttaa

SEQ ID NO: 482560 - DNA, 13 bp, Homo sapiens
tgaccataaaatt

SEQ ID NO: 482561 - DNA, 15 bp, Homo sapiens
tgagtagcatatata

SEQ ID NO: 482562 - DNA, 24 bp, Homo sapiens
tgatcactttctgaaattcacaaa

SEQ ID NO: 482563 - DNA, 14 bp, Homo sapiens
tgatgatggaaggg

SEQ ID NO: 482564 - DNA, 15 bp, Homo sapiens
tgatggaagggcctt

SEQ ID NO: 482565 - DNA, 19 bp, Homo sapiens
tgatgtgctcatcagaaac

SEQ ID NO: 482566 - DNA, 17 bp, Homo sapiens
tgattaactcagtcctg

SEQ ID NO: 482567 - DNA, 18 bp, Homo sapiens
tggaatctactagaacct

SEQ ID NO: 482568 - DNA, 14 bp, Homo sapiens
tggacgtgtgagga

SEQ ID NO: 482569 - DNA, 21 bp, Homo sapiens
tggagctgaggactctcacga

SEQ ID NO: 482570 - DNA, 12 bp, Homo sapiens
tggaggtgatga

SEQ ID NO: 482571 - DNA, 12 bp, Homo sapiens
tggatcaggaaa

SEQ ID NO: 482572 - DNA, 22 bp, Homo sapiens
tggtgcccagactcaaggcctc

SEQ ID NO: 482573 - DNA, 21 bp, Homo sapiens
tgtatttttcctctttcactt

SEQ ID NO: 482574 - DNA, 14 bp, Homo sapiens
tgtgaactatgttt

SEQ ID NO: 482575 - DNA, 16 bp, Homo sapiens
tgtgctcatcagaaac

SEQ ID NO: 482576 - DNA, 15 bp, Homo sapiens
tgttaaataaggcct

SEQ ID NO: 482577 - DNA, 15 bp, Homo sapiens
ttagggctctaattt

SEQ ID NO: 482578 - DNA, 22 bp, Homo sapiens
ttatatcagactgctttgagaa

SEQ ID NO: 482579 - DNA, 19 bp, Homo sapiens
ttcaggaaagcagcagttt

SEQ ID NO: 482580 - DNA, 19 bp, Homo sapiens
ttccagctaagcctgatga

SEQ ID NO: 482581 - DNA, 18 bp, Homo sapiens
ttctaaaggtttcactgt

SEQ ID NO: 482582 - DNA, 14 bp, Homo sapiens
ttctaatccatgtg

SEQ ID NO: 482583 - DNA, 13 bp, Homo sapiens
ttcttttaatttt

SEQ ID NO: 482584 - DNA, 20 bp, Homo sapiens
ttgactgttatttgttgaga

SEQ ID NO: 482585 - DNA, 20 bp, Homo sapiens
tttaaaagccctttccaaag

SEQ ID NO: 482586 - DNA, 19 bp, Homo sapiens
tttagaatcaagtctgtga

SEQ ID NO: 482587 - DNA, 16 bp, Homo sapiens
tttcagtaagatcaag

SEQ ID NO: 482588 - DNA, 21 bp, Homo sapiens
tttctgagtagcatatataat

SEQ ID NO: 482589 - DNA, 17 bp, Homo sapiens
tttcttggtatgatcat

SEQ ID NO: 482590 - DNA, 16 bp, Homo sapiens
tttggacgtgtgagga

SEQ ID NO: 482591 - DNA, 17 bp, Homo sapiens
aaaacgatttaatttat

SEQ ID NO: 482592 - DNA, 22 bp, Homo sapiens
aaagaaattagggctctaattt

SEQ ID NO: 482593 - DNA, 13 bp, Homo sapiens
aaaggcttctcca

SEQ ID NO: 482594 - DNA, 14 bp, Homo sapiens
aaaggcttctccac

SEQ ID NO: 482595 - DNA, 22 bp, Homo sapiens
aaaggtttcactgttcatgaat

SEQ ID NO: 482596 - DNA, 13 bp, Homo sapiens
aaagttttgccta

SEQ ID NO: 482597 - DNA, 21 bp, Homo sapiens
aaatgctgatttaaacttctt

SEQ ID NO: 482598 - DNA, 20 bp, Homo sapiens
aaattagggctctaatttcc

SEQ ID NO: 482599 - DNA, 23 bp, Homo sapiens
aacgtgatgtgctcatcagaaac

SEQ ID NO: 482600 - DNA, 15 bp, Homo sapiens
aactgtaaaatactt

SEQ ID NO: 482601 - DNA, 15 bp, Homo sapiens
aactgtcattacaga

SEQ ID NO: 482602 - DNA, 19 bp, Homo sapiens
aagaagctaaaatgaaaaa

SEQ ID NO: 482603 - DNA, 21 bp, Homo sapiens
aagaatcacctaattaatttc

SEQ ID NO: 482604 - DNA, 15 bp, Homo sapiens
aagatgtaagaagct

SEQ ID NO: 482605 - DNA, 19 bp, Homo sapiens
aagcatgccaatttctctt

SEQ ID NO: 482606 - DNA, 17 bp, Homo sapiens
aagctaaaatgaaaaat

SEQ ID NO: 482607 - DNA, 19 bp, Homo sapiens
aatcacctaattaatttca

SEQ ID NO: 482608 - DNA, 13 bp, Homo sapiens
aattagattttaa

SEQ ID NO: 482609 - DNA, 18 bp, Homo sapiens
aattagggctctaatttc

SEQ ID NO: 482610 - DNA, 14 bp, Homo sapiens
aattcaaagaatca

SEQ ID NO: 482611 - DNA, 15 bp, Homo sapiens
aattcacaaagttaa

SEQ ID NO: 482612 - DNA, 19 bp, Homo sapiens
acaattcaaagaatcacct

SEQ ID NO: 482613 - DNA, 21 bp, Homo sapiens
acacagctgagctggcctatt

SEQ ID NO: 482614 - DNA, 17 bp, Homo sapiens
acagggacacagtctgg

SEQ ID NO: 482615 - DNA, 16 bp, Homo sapiens
acatgatgatttcaga

SEQ ID NO: 482616 - DNA, 21 bp, Homo sapiens
accgagaggaaaaaggcttct

SEQ ID NO: 482617 - DNA, 21 bp, Homo sapiens
acgtgatgtgctcatcagaaa

SEQ ID NO: 482618 - DNA, 19 bp, Homo sapiens
actacctttggcttaattc

SEQ ID NO: 482619 - DNA, 13 bp, Homo sapiens
actcatgtgattt

SEQ ID NO: 482620 - DNA, 14 bp, Homo sapiens
actcatgttaattg

SEQ ID NO: 482621 - DNA, 19 bp, Homo sapiens
actgagttagaatgttgaa

SEQ ID NO: 482622 - DNA, 13 bp, Homo sapiens
agaaacaatttct

SEQ ID NO: 482623 - DNA, 14 bp, Homo sapiens
agaaacaatttctg

SEQ ID NO: 482624 - DNA, 21 bp, Homo sapiens
agaaattagggctctaatttc

SEQ ID NO: 482625 - DNA, 23 bp, Homo sapiens
agaaattagggctctaatttcct

SEQ ID NO: 482626 - DNA, 13 bp, Homo sapiens
agaacagggatgc

SEQ ID NO: 482627 - DNA, 13 bp, Homo sapiens
agaaccttctaat

SEQ ID NO: 482628 - DNA, 21 bp, Homo sapiens
agactcaaggcctccagccac

SEQ ID NO: 482629 - DNA, 19 bp, Homo sapiens
agccacttatttccatgga

SEQ ID NO: 482630 - DNA, 23 bp, Homo sapiens
agccttgtgatcactttctgaaa

SEQ ID NO: 482631 - DNA, 13 bp, Homo sapiens
agctgagctggcc

SEQ ID NO: 482632 - DNA, 12 bp, Homo sapiens
aggcttctccac

SEQ ID NO: 482633 - DNA, 22 bp, Homo sapiens
aggtttagaatcaagtctgtga

SEQ ID NO: 482634 - DNA, 19 bp, Homo sapiens
aggtttcactgttcatgaa

SEQ ID NO: 482635 - DNA, 16 bp, Homo sapiens
agtctcctgtatcatt

SEQ ID NO: 482636 - DNA, 20 bp, Homo sapiens
agtgaatgagtttccagcta

SEQ ID NO: 482637 - DNA, 16 bp, Homo sapiens
agtgtactggatttaa

SEQ ID NO: 482638 - DNA, 22 bp, Homo sapiens
agttgccgcatattatatcaga

SEQ ID NO: 482639 - DNA, 16 bp, Homo sapiens
agttttcttttaattt

SEQ ID NO: 482640 - DNA, 16 bp, Homo sapiens
atacatgatgatttca

SEQ ID NO: 482641 - DNA, 14 bp, Homo sapiens
atagtgtgtccatg

SEQ ID NO: 482642 - DNA, 14 bp, Homo sapiens
atattcccatggta

SEQ ID NO: 482643 - DNA, 13 bp, Homo sapiens
atcaactcatgtt

SEQ ID NO: 482644 - DNA, 13 bp, Homo sapiens
atcaagtctgtga

SEQ ID NO: 482645 - DNA, 20 bp, Homo sapiens
atcacctaattaatttcagt

SEQ ID NO: 482646 - DNA, 22 bp, Homo sapiens
atcattggtatctgatatctgt

SEQ ID NO: 482647 - DNA, 19 bp, Homo sapiens
atccatgtgctgctgtggc

SEQ ID NO: 482648 - DNA, 15 bp, Homo sapiens
atccttgtcagttgt

SEQ ID NO: 482649 - DNA, 14 bp, Homo sapiens
atctactagaacct

SEQ ID NO: 482650 - DNA, 13 bp, Homo sapiens
atctcgctagcca

SEQ ID NO: 482651 - DNA, 14 bp, Homo sapiens
atctgtttgcttct

SEQ ID NO: 482652 - DNA, 17 bp, Homo sapiens
atctgtttgcttctaaa

SEQ ID NO: 482653 - DNA, 19 bp, Homo sapiens
atcttggccctgttaaggc

SEQ ID NO: 482654 - DNA, 15 bp, Homo sapiens
atgatttcagaaaca

SEQ ID NO: 482655 - DNA, 16 bp, Homo sapiens
atgatttcagaaacaa

SEQ ID NO: 482656 - DNA, 18 bp, Homo sapiens
atgctatctcgctagcca

SEQ ID NO: 482657 - DNA, 19 bp, Homo sapiens
atggaagggccttctccac

SEQ ID NO: 482658 - DNA, 15 bp, Homo sapiens
atggtagactgtgac

SEQ ID NO: 482659 - DNA, 21 bp, Homo sapiens
attcaaagaatcacctaatta

SEQ ID NO: 482660 - DNA, 21 bp, Homo sapiens
attcccatggtagactgtgac

SEQ ID NO: 482661 - DNA, 12 bp, Homo sapiens
attgacaagttt

SEQ ID NO: 482662 - DNA, 17 bp, Homo sapiens
attttctgagtagcata

SEQ ID NO: 482663 - DNA, 18 bp, Homo sapiens
attttctgagtagcatat

SEQ ID NO: 482664 - DNA, 22 bp, Homo sapiens
caaaatacatgatgatttcaga

SEQ ID NO: 482665 - DNA, 18 bp, Homo sapiens
caagctcacttgctttag

SEQ ID NO: 482666 - DNA, 13 bp, Homo sapiens
caagtctgtgaaa

SEQ ID NO: 482667 - DNA, 23 bp, Homo sapiens
caatggtgaactgtcattacaga

SEQ ID NO: 482668 - DNA, 18 bp, Homo sapiens
cacagctgagctggccta

SEQ ID NO: 482669 - DNA, 22 bp, Homo sapiens
caccgagaggaaaaaggcttct

SEQ ID NO: 482670 - DNA, 13 bp, Homo sapiens
cacttatttccat

SEQ ID NO: 482671 - DNA, 17 bp, Homo sapiens
cagctaagcctgatgat

SEQ ID NO: 482672 - DNA, 19 bp, Homo sapiens
cagggatgctatctcgcta

SEQ ID NO: 482673 - DNA, 16 bp, Homo sapiens
cataagctttttctct

SEQ ID NO: 482674 - DNA, 14 bp, Homo sapiens
catattatatcaga

SEQ ID NO: 482675 - DNA, 16 bp, Homo sapiens
catattatatcagact

SEQ ID NO: 482676 - DNA, 23 bp, Homo sapiens
catattatatcagactgctttga

SEQ ID NO: 482677 - DNA, 22 bp, Homo sapiens
ctgtgaaagtctcctgtatcat

SEQ ID NO: 482678 - DNA, 16 bp, Homo sapiens
ctgtgacacagctgag

SEQ ID NO: 482679 - DNA, 18 bp, Homo sapiens
ctgtgacacagctgagct

SEQ ID NO: 482680 - DNA, 20 bp, Homo sapiens
cttctaatccatgtgctgct

SEQ ID NO: 482681 - DNA, 19 bp, Homo sapiens
cttggtgcctaatgttcca

SEQ ID NO: 482682 - DNA, 12 bp, Homo sapiens
gaaaactaagtt

SEQ ID NO: 482683 - DNA, 23 bp, Homo sapiens
gaatcacctaattaatttcagta

SEQ ID NO: 482684 - DNA, 15 bp, Homo sapiens
gagagaacagggatg

SEQ ID NO: 482685 - DNA, 15 bp, Homo sapiens
gagaggaaaaaggct

SEQ ID NO: 482686 - DNA, 19 bp, Homo sapiens
gatgtggatggaggtgatg

SEQ ID NO: 482687 - DNA, 21 bp, Homo sapiens
gcaaagcatgccaatttctct

SEQ ID NO: 482688 - DNA, 19 bp, Homo sapiens
gccatatattttctgagta

SEQ ID NO: 482689 - DNA, 16 bp, Homo sapiens
gctaagcctgatgatg

SEQ ID NO: 482690 - DNA, 22 bp, Homo sapiens
gctcatcagaaacaatttctgt

SEQ ID NO: 482691 - DNA, 14 bp, Homo sapiens
gctccatcttattt

SEQ ID NO: 482692 - DNA, 23 bp, Homo sapiens
gcttctccacaacctcctcctcc

SEQ ID NO: 482693 - DNA, 14 bp, Homo sapiens
ggaaatgctgattt

SEQ ID NO: 482694 - DNA, 15 bp, Homo sapiens
ggcatcaggaaagga

SEQ ID NO: 482695 - DNA, 13 bp, Homo sapiens
ggctctaatttcc

SEQ ID NO: 482696 - DNA, 12 bp, Homo sapiens
ggtatgatcatt

SEQ ID NO: 482697 - DNA, 18 bp, Homo sapiens
gtctcctgtatcatttct

SEQ ID NO: 482698 - DNA, 23 bp, Homo sapiens
gtgatcactttctgaaattcaca

SEQ ID NO: 482699 - DNA, 12 bp, Homo sapiens
gttcatgaatac

SEQ ID NO: 482700 - DNA, 18 bp, Homo sapiens
acattctatttcaacttc

SEQ ID NO: 482701 - DNA, 12 bp, Homo sapiens
acctcttgtttt

SEQ ID NO: 482702 - DNA, 20 bp, Homo sapiens
accttctaatccatgtgctg

SEQ ID NO: 482703 - DNA, 23 bp, Homo sapiens
accttctaatccatgtgctgctg

SEQ ID NO: 482704 - DNA, 13 bp, Homo sapiens
acgatttaattta

SEQ ID NO: 482705 - DNA, 14 bp, Homo sapiens
actgctttgagaaa

SEQ ID NO: 482706 - DNA, 17 bp, Homo sapiens
actgtgacacagctgag

SEQ ID NO: 482707 - DNA, 13 bp, Homo sapiens
acttatttccatg

SEQ ID NO: 482708 - DNA, 14 bp, Homo sapiens
acttgctgtgactt

SEQ ID NO: 482709 - DNA, 19 bp, Homo sapiens
agaaattagggctctaatt

SEQ ID NO: 482710 - DNA, 20 bp, Homo sapiens
agaaattagggctctaattt

SEQ ID NO: 482711 - DNA, 16 bp, Homo sapiens
agaatcaagtctgtga

SEQ ID NO: 482712 - DNA, 17 bp, Homo sapiens
agatgtaagaagctaaa

SEQ ID NO: 482713 - DNA, 20 bp, Homo sapiens
agcaaagcatgccaatttct

SEQ ID NO: 482714 - DNA, 17 bp, Homo sapiens
agcatgccaatttctct

SEQ ID NO: 482715 - DNA, 23 bp, Homo sapiens
agcctccactttggatcaggaaa

SEQ ID NO: 482716 - DNA, 17 bp, Homo sapiens
agctaagcctgatgatg

SEQ ID NO: 482717 - DNA, 14 bp, Homo sapiens
agctgagctggcct

SEQ ID NO: 482718 - DNA, 16 bp, Homo sapiens
aggatgtggatggagg

SEQ ID NO: 482719 - DNA, 19 bp, Homo sapiens
aggattaggtttagaatca

SEQ ID NO: 482720 - DNA, 17 bp, Homo sapiens
aggtttcactgttcatg

SEQ ID NO: 482721 - DNA, 21 bp, Homo sapiens
agtctcagtgctagcttattt

SEQ ID NO: 482722 - DNA, 14 bp, Homo sapiens
agtctcctgtatca

SEQ ID NO: 482723 - DNA, 21 bp, Homo sapiens
agttgtaacattctatttcaa

SEQ ID NO: 482724 - DNA, 16 bp, Homo sapiens
ataaggcctcatcctc

SEQ ID NO: 482725 - DNA, 17 bp, Homo sapiens
ataattttattgctgga

SEQ ID NO: 482726 - DNA, 19 bp, Homo sapiens
atatatgaaaactaagttc

SEQ ID NO: 482727 - DNA, 17 bp, Homo sapiens
atcacctaattaatttc

SEQ ID NO: 482728 - DNA, 21 bp, Homo sapiens
atgaaaaatagtgtgtccatg

SEQ ID NO: 482729 - DNA, 19 bp, Homo sapiens
atgaaaaccaccctatcat

SEQ ID NO: 482730 - DNA, 20 bp, Homo sapiens
atgaccataaaattagacat

SEQ ID NO: 482731 - DNA, 20 bp, Homo sapiens
atgccagtccagatgtgcct

SEQ ID NO: 482732 - DNA, 18 bp, Homo sapiens
atggaggtgatgaaaacc

SEQ ID NO: 482733 - DNA, 17 bp, Homo sapiens
atgtgctcatcagaaac

SEQ ID NO: 482734 - DNA, 16 bp, Homo sapiens
atgtgctgctgtggca

SEQ ID NO: 482735 - DNA, 18 bp, Homo sapiens
atgtggatggaggtgatg

SEQ ID NO: 482736 - DNA, 20 bp, Homo sapiens
attagattttaaaacttcat

SEQ ID NO: 482737 - DNA, 18 bp, Homo sapiens
attatatcagactgcttt

SEQ ID NO: 482738 - DNA, 15 bp, Homo sapiens
attcaaacctaagtt

SEQ ID NO: 482739 - DNA, 14 bp, Homo sapiens
attcaaagaatcac

SEQ ID NO: 482740 - DNA, 22 bp, Homo sapiens
attgagtcattttatatatgaa

SEQ ID NO: 482741 - DNA, 13 bp, Homo sapiens
attgatagaataa

SEQ ID NO: 482742 - DNA, 19 bp, Homo sapiens
atttcttggtatgatcatt

SEQ ID NO: 482743 - DNA, 15 bp, Homo sapiens
atttgactgttattt

SEQ ID NO: 482744 - DNA, 22 bp, Homo sapiens
atttgtcagtgtagatcaactc

SEQ ID NO: 482745 - DNA, 16 bp, Homo sapiens
attttggacgtgtgag

SEQ ID NO: 482746 - DNA, 18 bp, Homo sapiens
attttggacgtgtgagga

SEQ ID NO: 482747 - DNA, 19 bp, Homo sapiens
caaaatacatgatgatttc

SEQ ID NO: 482748 - DNA, 15 bp, Homo sapiens
cacctaattaatttc

SEQ ID NO: 482749 - DNA, 16 bp, Homo sapiens
cataaatcttccaaag

SEQ ID NO: 482750 - DNA, 21 bp, Homo sapiens
catgaatacgtaaactgcgta

SEQ ID NO: 482751 - DNA, 15 bp, Homo sapiens
catggtagactgtga

SEQ ID NO: 482752 - DNA, 14 bp, Homo sapiens
ccagttctgatgag

SEQ ID NO: 482753 - DNA, 19 bp, Homo sapiens
cccaggaggactccctgct

SEQ ID NO: 482754 - DNA, 19 bp, Homo sapiens
cctccagttctgatgaggc

SEQ ID NO: 482755 - DNA, 16 bp, Homo sapiens
cctctgcataaatatt

SEQ ID NO: 482756 - DNA, 21 bp, Homo sapiens
ccttgcattttagctaattta

SEQ ID NO: 482757 - DNA, 17 bp, Homo sapiens
ctaattaatttcagtaa

SEQ ID NO: 482758 - DNA, 21 bp, Homo sapiens
ctacctttggcttaattccaa

SEQ ID NO: 482759 - DNA, 14 bp, Homo sapiens
ctcatgtgatttac

SEQ ID NO: 482760 - DNA, 23 bp, Homo sapiens
ctccacagggacacagtctggtg

SEQ ID NO: 482761 - DNA, 13 bp, Homo sapiens
ctcctcctccagt

SEQ ID NO: 482762 - DNA, 13 bp, Homo sapiens
ctgagctggccta

SEQ ID NO: 482763 - DNA, 19 bp, Homo sapiens
ctgatatctgtttgcttct

SEQ ID NO: 482764 - DNA, 15 bp, Homo sapiens
ctgatgatggaaggg

SEQ ID NO: 482765 - DNA, 18 bp, Homo sapiens
ctgcgtaggagagaacag

SEQ ID NO: 482766 - DNA, 23 bp, Homo sapiens
ctgctgtggcatcaggaaaggaa

SEQ ID NO: 482767 - DNA, 16 bp, Homo sapiens
ctggaatctactagaa

SEQ ID NO: 482768 - DNA, 12 bp, Homo sapiens
ctggatttaact

SEQ ID NO: 482769 - DNA, 18 bp, Homo sapiens
aaatagtgtgtccatgca

SEQ ID NO: 482770 - DNA, 14 bp, Homo sapiens
aaatgctgatttaa

SEQ ID NO: 482771 - DNA, 23 bp, Homo sapiens
aaattagggctctaatttcctta

SEQ ID NO: 482772 - DNA, 13 bp, Homo sapiens
aactgacttgctg

SEQ ID NO: 482773 - DNA, 19 bp, Homo sapiens
aagaggaaaatattgacaa

SEQ ID NO: 482774 - DNA, 16 bp, Homo sapiens
aagcatgccaatttct

SEQ ID NO: 482775 - DNA, 16 bp, Homo sapiens
aagctcacttgcttta

SEQ ID NO: 482776 - DNA, 17 bp, Homo sapiens
aaggtttcactgttcat

SEQ ID NO: 482777 - DNA, 21 bp, Homo sapiens
aataaagccttgtgatcactt

SEQ ID NO: 482778 - DNA, 17 bp, Homo sapiens
aatacatgatgatttca

SEQ ID NO: 482779 - DNA, 14 bp, Homo sapiens
aatacttcttttta

SEQ ID NO: 482780 - DNA, 18 bp, Homo sapiens
aatcaagtctgtgaaagt

SEQ ID NO: 482781 - DNA, 23 bp, Homo sapiens
aatgttgaagaactcatgtgatt

SEQ ID NO: 482782 - DNA, 21 bp, Homo sapiens
aattagattttaaaacttcat

SEQ ID NO: 482783 - DNA, 23 bp, Homo sapiens
aatttctcttaagtactgaaata

SEQ ID NO: 482784 - DNA, 13 bp, Homo sapiens
aattttattgctg

SEQ ID NO: 482785 - DNA, 15 bp, Homo sapiens
acacgttggagtata

SEQ ID NO: 482786 - DNA, 20 bp, Homo sapiens
acatggttacctctgcataa

SEQ ID NO: 482787 - DNA, 23 bp, Homo sapiens
accaccctatcatcagttaggat

SEQ ID NO: 482788 - DNA, 14 bp, Homo sapiens
accctatcatcagt

SEQ ID NO: 482789 - DNA, 21 bp, Homo sapiens
accttgcattttagctaattt

SEQ ID NO: 482790 - DNA, 15 bp, Homo sapiens
acctttggcttaatt

SEQ ID NO: 482791 - DNA, 18 bp, Homo sapiens
acctttggcttaattcca

SEQ ID NO: 482792 - DNA, 14 bp, Homo sapiens
acgatttaatttat

SEQ ID NO: 482793 - DNA, 13 bp, Homo sapiens
actcaaggcctcc

SEQ ID NO: 482794 - DNA, 20 bp, Homo sapiens
actgtgacacagctgagctg

SEQ ID NO: 482795 - DNA, 19 bp, Homo sapiens
actttctgaaattcacaaa

SEQ ID NO: 482796 - DNA, 22 bp, Homo sapiens
agaatcacctaattaatttcag

SEQ ID NO: 482797 - DNA, 16 bp, Homo sapiens
agactgctttgagaaa

SEQ ID NO: 482798 - DNA, 15 bp, Homo sapiens
agagtatggattgaa

SEQ ID NO: 482799 - DNA, 15 bp, Homo sapiens
agatcaactcatgtt

SEQ ID NO: 482800 - DNA, 20 bp, Homo sapiens
agattttaaaacttcatctg

SEQ ID NO: 482801 - DNA, 20 bp, Homo sapiens
agcagttttcttttaatttt

SEQ ID NO: 482802 - DNA, 16 bp, Homo sapiens
agcatttgactttctg

SEQ ID NO: 482803 - DNA, 21 bp, Homo sapiens
agcatttgactttctgtctgt

SEQ ID NO: 482804 - DNA, 20 bp, Homo sapiens
agccatatattttctgagta

SEQ ID NO: 482805 - DNA, 15 bp, Homo sapiens
agctaagcctgatga

SEQ ID NO: 482806 - DNA, 22 bp, Homo sapiens
aggatgtggatggaggtgatga

SEQ ID NO: 482807 - DNA, 22 bp, Homo sapiens
agggatgctatctcgctagcca

SEQ ID NO: 482808 - DNA, 23 bp, Homo sapiens
agggatgctatctcgctagccat

SEQ ID NO: 482809 - DNA, 17 bp, Homo sapiens
atatctgtttgcttcta

SEQ ID NO: 482810 - DNA, 13 bp, Homo sapiens
atattatatcaga

SEQ ID NO: 482811 - DNA, 22 bp, Homo sapiens
gtttccagctaagcctgatgat

SEQ ID NO: 482812 - DNA, 22 bp, Homo sapiens
taaaatacttctttttacaatg

SEQ ID NO: 482813 - DNA, 21 bp, Homo sapiens
taaaggtttcactgttcatga

SEQ ID NO: 482814 - DNA, 21 bp, Homo sapiens
taactacctttggcttaattc

SEQ ID NO: 482815 - DNA, 22 bp, Homo sapiens
taactacctttggcttaattcc

SEQ ID NO: 482816 - DNA, 23 bp, Homo sapiens
taactgtcctttttcttccctta

SEQ ID NO: 482817 - DNA, 22 bp, Homo sapiens
taatccatgtgctgctgtggca

SEQ ID NO: 482818 - DNA, 20 bp, Homo sapiens
taatttaggagttttgagaa

SEQ ID NO: 482819 - DNA, 22 bp, Homo sapiens
tactagaaccttctaatccatg

SEQ ID NO: 482820 - DNA, 13 bp, Homo sapiens
tagaaccttctaa

SEQ ID NO: 482821 - DNA, 15 bp, Homo sapiens
tagaatcaagtctgt

SEQ ID NO: 482822 - DNA, 18 bp, Homo sapiens
tagcatatataattttat

SEQ ID NO: 482823 - DNA, 18 bp, Homo sapiens
tatataattttattgctg

SEQ ID NO: 482824 - DNA, 18 bp, Homo sapiens
tattgctggaatctacta

SEQ ID NO: 482825 - DNA, 12 bp, Homo sapiens
tcaagtctgtga

SEQ ID NO: 482826 - DNA, 14 bp, Homo sapiens
tcactgttcatgaa

SEQ ID NO: 482827 - DNA, 22 bp, Homo sapiens
tcattaaccttatcataaattc

SEQ ID NO: 482828 - DNA, 22 bp, Homo sapiens
tcattttatatatgaaaactaa

SEQ ID NO: 482829 - DNA, 17 bp, Homo sapiens
tccacaacctcctcctc

SEQ ID NO: 482830 - DNA, 15 bp, Homo sapiens
tccagttctgatgag

SEQ ID NO: 482831 - DNA, 17 bp, Homo sapiens
tccatgtgctgctgtgg

SEQ ID NO: 482832 - DNA, 20 bp, Homo sapiens
tcccatggtagactgtgaca

SEQ ID NO: 482833 - DNA, 16 bp, Homo sapiens
tctaatccatgtgctg

SEQ ID NO: 482834 - DNA, 21 bp, Homo sapiens
tctgtgaaagtctcctgtatc

SEQ ID NO: 482835 - DNA, 23 bp, Homo sapiens
tctgtgaaagtctcctgtatcat

SEQ ID NO: 482836 - DNA, 15 bp, Homo sapiens
tcttggtatgatcat

SEQ ID NO: 482837 - DNA, 22 bp, Homo sapiens
tgaaatacatatgataaatttg

SEQ ID NO: 482838 - DNA, 17 bp, Homo sapiens
tgacaagtttaaaggct

SEQ ID NO: 482839 - DNA, 17 bp, Homo sapiens
tgataaatttgactgtt

SEQ ID NO: 482840 - DNA, 15 bp, Homo sapiens
tgatatctgtttgct

SEQ ID NO: 482841 - DNA, 13 bp, Homo sapiens
tgatttaaacttc

SEQ ID NO: 482842 - DNA, 11 bp, Homo sapiens
tggcttaattc

SEQ ID NO: 482843 - DNA, 19 bp, Homo sapiens
tgtgaggatgtggatggag

SEQ ID NO: 482844 - DNA, 18 bp, Homo sapiens
tgtgctgctgtggcatca

SEQ ID NO: 482845 - DNA, 22 bp, Homo sapiens
tgttaataaagtgcactgccac

SEQ ID NO: 482846 - DNA, 15 bp, Homo sapiens
ttaggagttttgaga

SEQ ID NO: 482847 - DNA, 17 bp, Homo sapiens
ttatatcagactgcttt

SEQ ID NO: 482848 - DNA, 16 bp, Homo sapiens
ttcaacttcaggaaag

SEQ ID NO: 482849 - DNA, 22 bp, Homo sapiens
ttcagaaacaaagcatttgact

SEQ ID NO: 482850 - DNA, 21 bp, Homo sapiens
ttccagctaagcctgatgatg

SEQ ID NO: 482851 - DNA, 19 bp, Homo sapiens
ttcccatggtagactgtga

SEQ ID NO: 482852 - DNA, 14 bp, Homo sapiens
ttcttggtatgatc

SEQ ID NO: 482853 - DNA, 19 bp, Homo sapiens
ttgtttgttaataaagtgc

SEQ ID NO: 482854 - DNA, 19 bp, Homo sapiens
tttaaaagccctttccaaa

SEQ ID NO: 482855 - DNA, 13 bp, Homo sapiens
ttttattgctgga

SEQ ID NO: 482856 - DNA, 21 bp, Homo sapiens
ttttgggaaatgctgatttaa

SEQ ID NO: 482857 - DNA, 22 bp, Homo sapiens
tttttcctatgaccataaaatt

SEQ ID NO: 482858 - DNA, 13 bp, Homo sapiens
aaaaaattttata

SEQ ID NO: 482859 - DNA, 14 bp, Homo sapiens
aaaaagtataaaat

SEQ ID NO: 482860 - DNA, 17 bp, Homo sapiens
aaaacagtaaatgaaca

SEQ ID NO: 482861 - DNA, 18 bp, Homo sapiens
aaaactcaggcaaagaaa

SEQ ID NO: 482862 - DNA, 21 bp, Homo sapiens
aaaagagcagtggtaagaata

SEQ ID NO: 482863 - DNA, 12 bp, Homo sapiens
aaaatatatctt

SEQ ID NO: 482864 - DNA, 18 bp, Homo sapiens
aaaatatatttataagga

SEQ ID NO: 482865 - DNA, 14 bp, Homo sapiens
aaaatgaaatgcat

SEQ ID NO: 482866 - DNA, 16 bp, Homo sapiens
aaaatgaaatgcatat

SEQ ID NO: 482867 - DNA, 15 bp, Homo sapiens
aaaatgtctcaatgg

SEQ ID NO: 482868 - DNA, 17 bp, Homo sapiens
aaaatgtctgtaataat

SEQ ID NO: 482869 - DNA, 21 bp, Homo sapiens
aaacacagattgtattctatg

SEQ ID NO: 482870 - DNA, 18 bp, Homo sapiens
aaacagtataatttgaca

SEQ ID NO: 482871 - DNA, 19 bp, Homo sapiens
aaactcaggcaaagaaaat

SEQ ID NO: 482872 - DNA, 13 bp, Homo sapiens
aaagaaaatgaaa

SEQ ID NO: 482873 - DNA, 16 bp, Homo sapiens
aaagacgcatgttatg

SEQ ID NO: 482874 - DNA, 23 bp, Homo sapiens
aaagtctgctctcatataagaca

SEQ ID NO: 482875 - DNA, 22 bp, Homo sapiens
aaagttagttcagtagcttatc

SEQ ID NO: 482876 - DNA, 14 bp, Homo sapiens
aaataaaatatatc

SEQ ID NO: 482877 - DNA, 22 bp, Homo sapiens
aaataaaccaaaggaaaatgtc

SEQ ID NO: 482878 - DNA, 19 bp, Homo sapiens
aaatacatgcatataatga

SEQ ID NO: 482879 - DNA, 16 bp, Homo sapiens
aaatattcctttgcat

SEQ ID NO: 482880 - DNA, 15 bp, Homo sapiens
aaatcccaacaaaaa

SEQ ID NO: 482881 - DNA, 14 bp, Homo sapiens
aaatgaaatgcata

SEQ ID NO: 482882 - DNA, 22 bp, Homo sapiens
aaatggaggatctctaaagagc

SEQ ID NO: 482883 - DNA, 18 bp, Homo sapiens
aaatgtatacaccaagtg

SEQ ID NO: 482884 - DNA, 13 bp, Homo sapiens
aaatttgtaaact

SEQ ID NO: 482885 - DNA, 21 bp, Homo sapiens
aaattttacaagggcataaag

SEQ ID NO: 482886 - DNA, 15 bp, Homo sapiens
aacaaggggtcaatg

SEQ ID NO: 482887 - DNA, 12 bp, Homo sapiens
aacataaatgca

SEQ ID NO: 482888 - DNA, 16 bp, Homo sapiens
aaccaaaggaaaatgt

SEQ ID NO: 482889 - DNA, 14 bp, Homo sapiens
aaccacattgaaga

SEQ ID NO: 482890 - DNA, 22 bp, Homo sapiens
aaccactttctcaggcttctca

SEQ ID NO: 482891 - DNA, 21 bp, Homo sapiens
aacgtacgggaatgtgctttc

SEQ ID NO: 482892 - DNA, 22 bp, Homo sapiens
aactattgtgctcagagacact

SEQ ID NO: 482893 - DNA, 14 bp, Homo sapiens
aactcaggcaaaga

SEQ ID NO: 482894 - DNA, 18 bp, Homo sapiens
aactcaggcaaagaaaat

SEQ ID NO: 482895 - DNA, 14 bp, Homo sapiens
aacttagaaaccaa

SEQ ID NO: 482896 - DNA, 23 bp, Homo sapiens
aacttccaaataaataattttca

SEQ ID NO: 482897 - DNA, 13 bp, Homo sapiens
aactttgcttctc

SEQ ID NO: 482898 - DNA, 16 bp, Homo sapiens
aagaaaatgaaatgca

SEQ ID NO: 482899 - DNA, 17 bp, Homo sapiens
aagaaataaaccaaagg

SEQ ID NO: 482900 - DNA, 15 bp, Homo sapiens
aagaagagctatcag

SEQ ID NO: 482901 - DNA, 13 bp, Homo sapiens
aagaccaaagact

SEQ ID NO: 482902 - DNA, 12 bp, Homo sapiens
aagactaaaagt

SEQ ID NO: 482903 - DNA, 14 bp, Homo sapiens
aagatgaaaaaaat

SEQ ID NO: 482904 - DNA, 15 bp, Homo sapiens
aagattggtttaaaa

SEQ ID NO: 482905 - DNA, 21 bp, Homo sapiens
aagattggtttaaaaagaaaa

SEQ ID NO: 482906 - DNA, 13 bp, Homo sapiens
aagcaatggttga

SEQ ID NO: 482907 - DNA, 16 bp, Homo sapiens
aagccttcattgcctt

SEQ ID NO: 482908 - DNA, 15 bp, Homo sapiens
aagctaccttgtcat

SEQ ID NO: 482909 - DNA, 17 bp, Homo sapiens
aagctaccttgtcatat

SEQ ID NO: 482910 - DNA, 21 bp, Homo sapiens
aagcttggttctgtgaacaag

SEQ ID NO: 482911 - DNA, 13 bp, Homo sapiens
aaggaaattttac

SEQ ID NO: 482912 - DNA, 13 bp, Homo sapiens
aaggataaagaag

SEQ ID NO: 482913 - DNA, 19 bp, Homo sapiens
aaggccaagaggctgttcc

SEQ ID NO: 482914 - DNA, 15 bp, Homo sapiens
aaggtcaacaataaa

SEQ ID NO: 482915 - DNA, 21 bp, Homo sapiens
aagtaaatttgtataaataag

SEQ ID NO: 482916 - DNA, 18 bp, Homo sapiens
aagtactaggttgtccat

SEQ ID NO: 482917 - DNA, 21 bp, Homo sapiens
aagtatgtatattaaaaaaga

SEQ ID NO: 482918 - DNA, 21 bp, Homo sapiens
aagtcacacattacaaagtta

SEQ ID NO: 482919 - DNA, 12 bp, Homo sapiens
aagttagttcag

SEQ ID NO: 482920 - DNA, 22 bp, Homo sapiens
aagttatctttgaatatgtagt

SEQ ID NO: 482921 - DNA, 15 bp, Homo sapiens
aataaaatatatctt

SEQ ID NO: 482922 - DNA, 20 bp, Homo sapiens
aataaaatatatcttataaa

SEQ ID NO: 482923 - DNA, 13 bp, Homo sapiens
aataatagactgt

SEQ ID NO: 482924 - DNA, 13 bp, Homo sapiens
aatacaattcaaa

SEQ ID NO: 482925 - DNA, 14 bp, Homo sapiens
aatacaattcaaat

SEQ ID NO: 482926 - DNA, 15 bp, Homo sapiens
aatacaattcaaatg

SEQ ID NO: 482927 - DNA, 16 bp, Homo sapiens
aatacaattcaaatgc

SEQ ID NO: 482928 - DNA, 15 bp, Homo sapiens
aatacatgcatataa

SEQ ID NO: 482929 - DNA, 20 bp, Homo sapiens
aatacattacatgtaaatta

SEQ ID NO: 482930 - DNA, 23 bp, Homo sapiens
aatacattacatgtaaattaagt

SEQ ID NO: 482931 - DNA, 22 bp, Homo sapiens
aatagtagatgtggcctttgaa

SEQ ID NO: 482932 - DNA, 14 bp, Homo sapiens
aatagtatgaaaat

SEQ ID NO: 482933 - DNA, 21 bp, Homo sapiens
aatatatcttataaagtggaa

SEQ ID NO: 482934 - DNA, 21 bp, Homo sapiens
aatatcaaagtcattaaagac

SEQ ID NO: 482935 - DNA, 12 bp, Homo sapiens
aatatgtacaca

SEQ ID NO: 482936 - DNA, 20 bp, Homo sapiens
aatatttcaggttcttcaga

SEQ ID NO: 482937 - DNA, 16 bp, Homo sapiens
aatcccgattcaccct

SEQ ID NO: 482938 - DNA, 15 bp, Homo sapiens
aatctgtacatgtct

SEQ ID NO: 482939 - DNA, 17 bp, Homo sapiens
aatgcatatttgcaaag

SEQ ID NO: 482940 - DNA, 18 bp, Homo sapiens
aatgcatatttgcaaagt

SEQ ID NO: 482941 - DNA, 22 bp, Homo sapiens
aatgctttttgttttatttttt

SEQ ID NO: 482942 - DNA, 17 bp, Homo sapiens
aatggtgctataataaa

SEQ ID NO: 482943 - DNA, 14 bp, Homo sapiens
aatgtatacaccaa

SEQ ID NO: 482944 - DNA, 17 bp, Homo sapiens
aatgtctgtaataatag

SEQ ID NO: 482945 - DNA, 19 bp, Homo sapiens
aatgtctgtaataatagac

SEQ ID NO: 482946 - DNA, 23 bp, Homo sapiens
aatgtctgtaataatagactgta

SEQ ID NO: 482947 - DNA, 14 bp, Homo sapiens
aatgtgagggtttg

SEQ ID NO: 482948 - DNA, 18 bp, Homo sapiens
aatgtgagggtttgtaat

SEQ ID NO: 482949 - DNA, 19 bp, Homo sapiens
aatgtgagggtttgtaatg

SEQ ID NO: 482950 - DNA, 21 bp, Homo sapiens
aatgtgagggtttgtaatggt

SEQ ID NO: 482951 - DNA, 22 bp, Homo sapiens
aattacaagtattcagttccaa

SEQ ID NO: 482952 - DNA, 14 bp, Homo sapiens
aattatttgattat

SEQ ID NO: 482953 - DNA, 13 bp, Homo sapiens
aattcaaatgctt

SEQ ID NO: 482954 - DNA, 15 bp, Homo sapiens
aatttcaaaatgtct

SEQ ID NO: 482955 - DNA, 19 bp, Homo sapiens
aatttcaatcaaccaaagt

SEQ ID NO: 482956 - DNA, 21 bp, Homo sapiens
aattttcacttttggcaatga

SEQ ID NO: 482957 - DNA, 17 bp, Homo sapiens
acaacttagaaaccaaa

SEQ ID NO: 482958 - DNA, 15 bp, Homo sapiens
acaaggggtcaatgt

SEQ ID NO: 482959 - DNA, 16 bp, Homo sapiens
acaataaaaaccaaat

SEQ ID NO: 482960 - DNA, 20 bp, Homo sapiens
acacaacttagaaaccaaat

SEQ ID NO: 482961 - DNA, 15 bp, Homo sapiens
acacagaaatgaatg

SEQ ID NO: 482962 - DNA, 19 bp, Homo sapiens
acaccaagtggtaatgaaa

SEQ ID NO: 482963 - DNA, 16 bp, Homo sapiens
acactaacgaaatatc

SEQ ID NO: 482964 - DNA, 17 bp, Homo sapiens
acactgttgataaaaac

SEQ ID NO: 482965 - DNA, 19 bp, Homo sapiens
acactgttgataaaaactc

SEQ ID NO: 482966 - DNA, 12 bp, Homo sapiens
acagcatgtgca

SEQ ID NO: 482967 - DNA, 15 bp, Homo sapiens
acagcttcagccagg

SEQ ID NO: 482968 - DNA, 13 bp, Homo sapiens
acagtgggagcca

SEQ ID NO: 482969 - DNA, 16 bp, Homo sapiens
acagtgggagccaggg

SEQ ID NO: 482970 - DNA, 14 bp, Homo sapiens
acataaaagaaata

SEQ ID NO: 482971 - DNA, 15 bp, Homo sapiens
acataaaagaaataa

SEQ ID NO: 482972 - DNA, 23 bp, Homo sapiens
acatgcatataatgaataaatca

SEQ ID NO: 482973 - DNA, 16 bp, Homo sapiens
acatgtaaattaagtg

SEQ ID NO: 482974 - DNA, 22 bp, Homo sapiens
acattacaaagttaaaattgtt

SEQ ID NO: 482975 - DNA, 17 bp, Homo sapiens
acattacatgtaaatta

SEQ ID NO: 482976 - DNA, 11 bp, Homo sapiens
accaaagcaag

SEQ ID NO: 482977 - DNA, 16 bp, Homo sapiens
accaaagcaaggtaca

SEQ ID NO: 482978 - DNA, 19 bp, Homo sapiens
accaaagttagttcagtag

SEQ ID NO: 482979 - DNA, 17 bp, Homo sapiens
accaaataattaaaaga

SEQ ID NO: 482980 - DNA, 20 bp, Homo sapiens
accaaatacaattcaaatgc

SEQ ID NO: 482981 - DNA, 21 bp, Homo sapiens
accaaatacaattcaaatgct

SEQ ID NO: 482982 - DNA, 16 bp, Homo sapiens
accaaattacaagtat

SEQ ID NO: 482983 - DNA, 19 bp, Homo sapiens
accaggctgctcagggctg

SEQ ID NO: 482984 - DNA, 16 bp, Homo sapiens
accagtgcaagtgacc

SEQ ID NO: 482985 - DNA, 19 bp, Homo sapiens
accagtgcatccttcatca

SEQ ID NO: 482986 - DNA, 20 bp, Homo sapiens
acccttcccttgagccctct

SEQ ID NO: 482987 - DNA, 16 bp, Homo sapiens
acctagctaattattt

SEQ ID NO: 482988 - DNA, 22 bp, Homo sapiens
acctatttggtgctagtaaatt

SEQ ID NO: 482989 - DNA, 13 bp, Homo sapiens
acctgtctcacca

SEQ ID NO: 482990 - DNA, 13 bp, Homo sapiens
atttcaaaatgtc

SEQ ID NO: 482991 - DNA, 15 bp, Homo sapiens
atttcaaaatgtctc

SEQ ID NO: 482992 - DNA, 22 bp, Homo sapiens
attttacaagggcataaagtaa

SEQ ID NO: 482993 - DNA, 11 bp, Homo sapiens
attttcaaact

SEQ ID NO: 482994 - DNA, 15 bp, Homo sapiens
attttctaaagactt

SEQ ID NO: 482995 - DNA, 17 bp, Homo sapiens
atttttttaccaattcc

SEQ ID NO: 482996 - DNA, 18 bp, Homo sapiens
atttttttaccaattcca

SEQ ID NO: 482997 - DNA, 19 bp, Homo sapiens
atttttttaccaattccaa

SEQ ID NO: 482998 - DNA, 22 bp, Homo sapiens
caaactctatctgaaatcccaa

SEQ ID NO: 482999 - DNA, 14 bp, Homo sapiens
caaagaaaatgaaa

SEQ ID NO: 483000 - DNA, 16 bp, Homo sapiens
caaagaaaatgaaatg

SEQ ID NO: 483001 - DNA, 14 bp, Homo sapiens
caaagttagttcag

SEQ ID NO: 483002 - DNA, 15 bp, Homo sapiens
caaagttagttcagt

SEQ ID NO: 483003 - DNA, 14 bp, Homo sapiens
caaataattaaaag

SEQ ID NO: 483004 - DNA, 21 bp, Homo sapiens
caaatacaattcaaatgcttt

SEQ ID NO: 483005 - DNA, 22 bp, Homo sapiens
caaatgctttttgttttatttt

SEQ ID NO: 483006 - DNA, 14 bp, Homo sapiens
caaattacaagtat

SEQ ID NO: 483007 - DNA, 13 bp, Homo sapiens
caaatttgtaaac

SEQ ID NO: 483008 - DNA, 16 bp, Homo sapiens
caacaaggggtcaatg

SEQ ID NO: 483009 - DNA, 21 bp, Homo sapiens
caacaaggggtcaatgtcata

SEQ ID NO: 483010 - DNA, 10 bp, Homo sapiens
caaccaaagt

SEQ ID NO: 483011 - DNA, 23 bp, Homo sapiens
caaccactttctcaggcttctca

SEQ ID NO: 483012 - DNA, 14 bp, Homo sapiens
caacgtggcccaga

SEQ ID NO: 483013 - DNA, 20 bp, Homo sapiens
caacgtggcccagagaagcc

SEQ ID NO: 483014 - DNA, 21 bp, Homo sapiens
caactgcttgtaaaggtgctc

SEQ ID NO: 483015 - DNA, 17 bp, Homo sapiens
caacttagaaaccaaat

SEQ ID NO: 483016 - DNA, 17 bp, Homo sapiens
caagcttgtccaacccg

SEQ ID NO: 483017 - DNA, 24 bp, Homo sapiens
caagtattcagttccaatacttca

SEQ ID NO: 483018 - DNA, 16 bp, Homo sapiens
caagtgaccgacaaaa

SEQ ID NO: 483019 - DNA, 22 bp, Homo sapiens
caagtgaccgacaaaattccag

SEQ ID NO: 483020 - DNA, 18 bp, Homo sapiens
caatcaaccaaagttagt

SEQ ID NO: 483021 - DNA, 19 bp, Homo sapiens
caatgagagcataatttaa

SEQ ID NO: 483022 - DNA, 14 bp, Homo sapiens
caattcaaatgctt

SEQ ID NO: 483023 - DNA, 18 bp, Homo sapiens
caattccaatttcaaaat

SEQ ID NO: 483024 - DNA, 14 bp, Homo sapiens
caatttcaaaatgt

SEQ ID NO: 483025 - DNA, 16 bp, Homo sapiens
caatttcaaaatgtct

SEQ ID NO: 483026 - DNA, 13 bp, Homo sapiens
cacacgtgcatag

SEQ ID NO: 483027 - DNA, 16 bp, Homo sapiens
cacagcatgtgcaata

SEQ ID NO: 483028 - DNA, 14 bp, Homo sapiens
cacagcttcagcca

SEQ ID NO: 483029 - DNA, 14 bp, Homo sapiens
cacagtgggagcca

SEQ ID NO: 483030 - DNA, 19 bp, Homo sapiens
cacagtgggagccagggct

SEQ ID NO: 483031 - DNA, 23 bp, Homo sapiens
cacattgaagaatgttagagtaa

SEQ ID NO: 483032 - DNA, 20 bp, Homo sapiens
caccaaatacaattcaaatg

SEQ ID NO: 483033 - DNA, 22 bp, Homo sapiens
caccaaatacaattcaaatgct

SEQ ID NO: 483034 - DNA, 19 bp, Homo sapiens
caccatccagagaccaaat

SEQ ID NO: 483035 - DNA, 20 bp, Homo sapiens
caccatccagagaccaaata

SEQ ID NO: 483036 - DNA, 23 bp, Homo sapiens
cactattctttgtattaccaaag

SEQ ID NO: 483037 - DNA, 19 bp, Homo sapiens
cactttctcaggcttctca

SEQ ID NO: 483038 - DNA, 16 bp, Homo sapiens
cagaagatgaaaaaaa

SEQ ID NO: 483039 - DNA, 19 bp, Homo sapiens
cagacactaacgaaatatc

SEQ ID NO: 483040 - DNA, 21 bp, Homo sapiens
cagagacactgttgataaaaa

SEQ ID NO: 483041 - DNA, 13 bp, Homo sapiens
cagagaccaaata

SEQ ID NO: 483042 - DNA, 23 bp, Homo sapiens
cagagaccaaataattaaaagaa

SEQ ID NO: 483043 - DNA, 18 bp, Homo sapiens
cagatcacagcttcagcc

SEQ ID NO: 483044 - DNA, 11 bp, Homo sapiens
cagccaggagc

SEQ ID NO: 483045 - DNA, 17 bp, Homo sapiens
cagcttcagccaggagc

SEQ ID NO: 483046 - DNA, 15 bp, Homo sapiens
caggagctgggcaga

SEQ ID NO: 483047 - DNA, 17 bp, Homo sapiens
caggctgctcagggctg

SEQ ID NO: 483048 - DNA, 20 bp, Homo sapiens
cagtaagttatctttgaata

SEQ ID NO: 483049 - DNA, 14 bp, Homo sapiens
cagtataatttgac

SEQ ID NO: 483050 - DNA, 23 bp, Homo sapiens
cagtataatttgacaaagaaaaa

SEQ ID NO: 483051 - DNA, 14 bp, Homo sapiens
cagtgcatccttca

SEQ ID NO: 483052 - DNA, 16 bp, Homo sapiens
cagttccaatacttca

SEQ ID NO: 483053 - DNA, 16 bp, Homo sapiens
cagtttgtcttggata

SEQ ID NO: 483054 - DNA, 12 bp, Homo sapiens
cataaattattt

SEQ ID NO: 483055 - DNA, 17 bp, Homo sapiens
cataaattatttgatta

SEQ ID NO: 483056 - DNA, 22 bp, Homo sapiens
cataaattatttgattatttaa

SEQ ID NO: 483057 - DNA, 18 bp, Homo sapiens
catataagacaaatattc

SEQ ID NO: 483058 - DNA, 23 bp, Homo sapiens
catatcataggtacaatctttca

SEQ ID NO: 483059 - DNA, 22 bp, Homo sapiens
catattataaaggataaagaag

SEQ ID NO: 483060 - DNA, 16 bp, Homo sapiens
catccagagaccaaat

SEQ ID NO: 483061 - DNA, 20 bp, Homo sapiens
catgcatataatgaataaat

SEQ ID NO: 483062 - DNA, 16 bp, Homo sapiens
catgcggcccaggatg

SEQ ID NO: 483063 - DNA, 23 bp, Homo sapiens
catggcatccctttttcataaat

SEQ ID NO: 483064 - DNA, 19 bp, Homo sapiens
catgtaaattaagtgtgtg

SEQ ID NO: 483065 - DNA, 16 bp, Homo sapiens
cattacatgtaaatta

SEQ ID NO: 483066 - DNA, 14 bp, Homo sapiens
cattctcaagccct

SEQ ID NO: 483067 - DNA, 17 bp, Homo sapiens
cattctcaagccctgca

SEQ ID NO: 483068 - DNA, 13 bp, Homo sapiens
cattgaaacattt

SEQ ID NO: 483069 - DNA, 15 bp, Homo sapiens
cattgaaacatttat

SEQ ID NO: 483070 - DNA, 22 bp, Homo sapiens
cattgaagaatgttagagtaat

SEQ ID NO: 483071 - DNA, 17 bp, Homo sapiens
cattgccttaactggag

SEQ ID NO: 483072 - DNA, 16 bp, Homo sapiens
ccaaagttagttcagt

SEQ ID NO: 483073 - DNA, 12 bp, Homo sapiens
ccaaataaataa

SEQ ID NO: 483074 - DNA, 21 bp, Homo sapiens
ccaaattacaagtattcagtt

SEQ ID NO: 483075 - DNA, 17 bp, Homo sapiens
ccaacccgaggcccgca

SEQ ID NO: 483076 - DNA, 16 bp, Homo sapiens
ccaagtaaatttgtat

SEQ ID NO: 483077 - DNA, 23 bp, Homo sapiens
ccaagtggtaatgaaatttcggt

SEQ ID NO: 483078 - DNA, 20 bp, Homo sapiens
ccaattccaatttcaaaatg

SEQ ID NO: 483079 - DNA, 20 bp, Homo sapiens
ccagaggatcaccagtgcat

SEQ ID NO: 483080 - DNA, 16 bp, Homo sapiens
ccaggagctgggcaga

SEQ ID NO: 483081 - DNA, 13 bp, Homo sapiens
ccaggctgctcag

SEQ ID NO: 483082 - DNA, 19 bp, Homo sapiens
ccagttatttatttccaaa

SEQ ID NO: 483083 - DNA, 19 bp, Homo sapiens
ccatacataaaagaaataa

SEQ ID NO: 483084 - DNA, 18 bp, Homo sapiens
ccattctcaagccctgca

SEQ ID NO: 483085 - DNA, 21 bp, Homo sapiens
cccctgagacaaatggaggcc

SEQ ID NO: 483086 - DNA, 13 bp, Homo sapiens
cccgaggcccgca

SEQ ID NO: 483087 - DNA, 14 bp, Homo sapiens
ccctccgccattct

SEQ ID NO: 483088 - DNA, 17 bp, Homo sapiens
ccctgagacaaatggag

SEQ ID NO: 483089 - DNA, 15 bp, Homo sapiens
ccgacaaaattccag

SEQ ID NO: 483090 - DNA, 19 bp, Homo sapiens
ccggaggctaaataaagtc

SEQ ID NO: 483091 - DNA, 18 bp, Homo sapiens
cctcagtggccagaggat

SEQ ID NO: 483092 - DNA, 16 bp, Homo sapiens
cctgacctgtctcacc

SEQ ID NO: 483093 - DNA, 19 bp, Homo sapiens
cctgagacaaatggaggcc

SEQ ID NO: 483094 - DNA, 13 bp, Homo sapiens
cctggatttaaat

SEQ ID NO: 483095 - DNA, 16 bp, Homo sapiens
taaatacatgcatata

SEQ ID NO: 483096 - DNA, 20 bp, Homo sapiens
taaatacatgcatataatga

SEQ ID NO: 483097 - DNA, 14 bp, Homo sapiens
taaatcctgaagag

SEQ ID NO: 483098 - DNA, 15 bp, Homo sapiens
taaatgcactgtaat

SEQ ID NO: 483099 - DNA, 16 bp, Homo sapiens
atttgattatttaaga

SEQ ID NO: 483100 - DNA, 19 bp, Homo sapiens
atttggtgctagtaaattt

SEQ ID NO: 483101 - DNA, 14 bp, Homo sapiens
attttcaaactaga

SEQ ID NO: 483102 - DNA, 22 bp, Homo sapiens
attttcacttttggcaatgact

SEQ ID NO: 483103 - DNA, 14 bp, Homo sapiens
attttctaaagact

SEQ ID NO: 483104 - DNA, 20 bp, Homo sapiens
atttttttaccaattccaat

SEQ ID NO: 483105 - DNA, 19 bp, Homo sapiens
caaaatctgtacatgtctc

SEQ ID NO: 483106 - DNA, 18 bp, Homo sapiens
caaaattccagttattta

SEQ ID NO: 483107 - DNA, 13 bp, Homo sapiens
caaactagattta

SEQ ID NO: 483108 - DNA, 18 bp, Homo sapiens
caaagaaaatgaaatgca

SEQ ID NO: 483109 - DNA, 15 bp, Homo sapiens
caaagcaaggtacag

SEQ ID NO: 483110 - DNA, 17 bp, Homo sapiens
caaaggaaaatgtctgt

SEQ ID NO: 483111 - DNA, 12 bp, Homo sapiens
caaagtcattaa

SEQ ID NO: 483112 - DNA, 17 bp, Homo sapiens
caaagtcattaaagaca

SEQ ID NO: 483113 - DNA, 23 bp, Homo sapiens
caaagtctgctctcatataagac

SEQ ID NO: 483114 - DNA, 17 bp, Homo sapiens
caaagttaaaattgtta

SEQ ID NO: 483115 - DNA, 13 bp, Homo sapiens
caaattacaagta

SEQ ID NO: 483116 - DNA, 21 bp, Homo sapiens
caaattacaagtattcagttc

SEQ ID NO: 483117 - DNA, 18 bp, Homo sapiens
caaccaaagttagttcag

SEQ ID NO: 483118 - DNA, 15 bp, Homo sapiens
caaccactttctcag

SEQ ID NO: 483119 - DNA, 16 bp, Homo sapiens
caacccgaggcccgca

SEQ ID NO: 483120 - DNA, 17 bp, Homo sapiens
caagtattcagttccaa

SEQ ID NO: 483121 - DNA, 17 bp, Homo sapiens
caagtgaccgacaaaat

SEQ ID NO: 483122 - DNA, 14 bp, Homo sapiens
caatcaaccaaagt

SEQ ID NO: 483123 - DNA, 16 bp, Homo sapiens
caatcaaccaaagtta

SEQ ID NO: 483124 - DNA, 19 bp, Homo sapiens
caatcaaccaaagttagtt

SEQ ID NO: 483125 - DNA, 15 bp, Homo sapiens
caatcagaatcatca

SEQ ID NO: 483126 - DNA, 15 bp, Homo sapiens
caatgactcaaagtc

SEQ ID NO: 483127 - DNA, 21 bp, Homo sapiens
caatgctttgcccctgagaca

SEQ ID NO: 483128 - DNA, 19 bp, Homo sapiens
caatggtgctataataaat

SEQ ID NO: 483129 - DNA, 23 bp, Homo sapiens
cacaattattttaatattggata

SEQ ID NO: 483130 - DNA, 22 bp, Homo sapiens
cacagacactaacgaaatatca

SEQ ID NO: 483131 - DNA, 19 bp, Homo sapiens
cacagatcacagcttcagc

SEQ ID NO: 483132 - DNA, 21 bp, Homo sapiens
cacagcatgtgcaatatgcca

SEQ ID NO: 483133 - DNA, 18 bp, Homo sapiens
cacagcttcagccaggag

SEQ ID NO: 483134 - DNA, 19 bp, Homo sapiens
caccaaatacaattcaaat

SEQ ID NO: 483135 - DNA, 13 bp, Homo sapiens
caccaagtaaatt

SEQ ID NO: 483136 - DNA, 14 bp, Homo sapiens
caccaggctgctca

SEQ ID NO: 483137 - DNA, 14 bp, Homo sapiens
caccagtgcatcct

SEQ ID NO: 483138 - DNA, 23 bp, Homo sapiens
caccctgtccaaactgcctaagc

SEQ ID NO: 483139 - DNA, 22 bp, Homo sapiens
cactagcatagagaatgtgttg

SEQ ID NO: 483140 - DNA, 13 bp, Homo sapiens
cactgttgataaa

SEQ ID NO: 483141 - DNA, 16 bp, Homo sapiens
cactgttgataaaaac

SEQ ID NO: 483142 - DNA, 17 bp, Homo sapiens
cactgttgataaaaact

SEQ ID NO: 483143 - DNA, 15 bp, Homo sapiens
cagaagatgaaaaaa

SEQ ID NO: 483144 - DNA, 23 bp, Homo sapiens
cagacttgggcccaggctcaaat

SEQ ID NO: 483145 - DNA, 22 bp, Homo sapiens
cagagacactgttgataaaaac

SEQ ID NO: 483146 - DNA, 15 bp, Homo sapiens
cagccaggagctggg

SEQ ID NO: 483147 - DNA, 23 bp, Homo sapiens
caggagctgggcagaaggccaag

SEQ ID NO: 483148 - DNA, 18 bp, Homo sapiens
caggctgctcagggctgg

SEQ ID NO: 483149 - DNA, 15 bp, Homo sapiens
cagtaagttatcttt

SEQ ID NO: 483150 - DNA, 17 bp, Homo sapiens
cagtgggagccagggct

SEQ ID NO: 483151 - DNA, 18 bp, Homo sapiens
cagtgggagccagggctg

SEQ ID NO: 483152 - DNA, 16 bp, Homo sapiens
cagtggtaagaatagt

SEQ ID NO: 483153 - DNA, 22 bp, Homo sapiens
cagttatgagtataatacatta

SEQ ID NO: 483154 - DNA, 15 bp, Homo sapiens
cataataaaatatca

SEQ ID NO: 483155 - DNA, 14 bp, Homo sapiens
cataatttaaaaat

SEQ ID NO: 483156 - DNA, 15 bp, Homo sapiens
cataatttaaaaata

SEQ ID NO: 483157 - DNA, 14 bp, Homo sapiens
catacataaaagaa

SEQ ID NO: 483158 - DNA, 11 bp, Homo sapiens
catataagaca

SEQ ID NO: 483159 - DNA, 20 bp, Homo sapiens
catataagacaaatattcct

SEQ ID NO: 483160 - DNA, 16 bp, Homo sapiens
catataatgaataaat

SEQ ID NO: 483161 - DNA, 15 bp, Homo sapiens
catcacagcatgtgc

SEQ ID NO: 483162 - DNA, 19 bp, Homo sapiens
catcacagcatgtgcaata

SEQ ID NO: 483163 - DNA, 14 bp, Homo sapiens
catcagacagatgg

SEQ ID NO: 483164 - DNA, 17 bp, Homo sapiens
catccagagaccaaata

SEQ ID NO: 483165 - DNA, 21 bp, Homo sapiens
catcctgtaaaggtcaacaat

SEQ ID NO: 483166 - DNA, 13 bp, Homo sapiens
catgaaataaaat

SEQ ID NO: 483167 - DNA, 18 bp, Homo sapiens
catgcatataatgaataa

SEQ ID NO: 483168 - DNA, 21 bp, Homo sapiens
catgcatataatgaataaatc

SEQ ID NO: 483169 - DNA, 15 bp, Homo sapiens
catgtaaattaagtg

SEQ ID NO: 483170 - DNA, 18 bp, Homo sapiens
catgtaaattaagtgtgt

SEQ ID NO: 483171 - DNA, 21 bp, Homo sapiens
catgtaaattaagtgtgtgta

SEQ ID NO: 483172 - DNA, 23 bp, Homo sapiens
cattaatttcaatcaaccaaagt

SEQ ID NO: 483173 - DNA, 12 bp, Homo sapiens
cattacatgtaa

SEQ ID NO: 483174 - DNA, 15 bp, Homo sapiens
cattcctgtcaacaa

SEQ ID NO: 483175 - DNA, 16 bp, Homo sapiens
cattctcaagccctgc

SEQ ID NO: 483176 - DNA, 19 bp, Homo sapiens
cattcttactaaaaagtat

SEQ ID NO: 483177 - DNA, 20 bp, Homo sapiens
cattgaaacatttataaact

SEQ ID NO: 483178 - DNA, 18 bp, Homo sapiens
cattttaaccctatttta

SEQ ID NO: 483179 - DNA, 14 bp, Homo sapiens
ccaaaggaaaatgt

SEQ ID NO: 483180 - DNA, 15 bp, Homo sapiens
ccaaagttagttcag

SEQ ID NO: 483181 - DNA, 21 bp, Homo sapiens
ccaaagttagttcagtagctt

SEQ ID NO: 483182 - DNA, 16 bp, Homo sapiens
ccaaatacaagtacta

SEQ ID NO: 483183 - DNA, 17 bp, Homo sapiens
ccaaatacaattcaaat

SEQ ID NO: 483184 - DNA, 19 bp, Homo sapiens
ccaaatacaattcaaatgc

SEQ ID NO: 483185 - DNA, 20 bp, Homo sapiens
ccaaattacaagtattcagt

SEQ ID NO: 483186 - DNA, 22 bp, Homo sapiens
ccaaattacaagtattcagttc

SEQ ID NO: 483187 - DNA, 15 bp, Homo sapiens
ccaacccgaggcccg

SEQ ID NO: 483188 - DNA, 16 bp, Homo sapiens
ccacattgaagaatgt

SEQ ID NO: 483189 - DNA, 20 bp, Homo sapiens
ccaccaggctgctcagggct

SEQ ID NO: 483190 - DNA, 18 bp, Homo sapiens
ccactttctcaggcttct

SEQ ID NO: 483191 - DNA, 14 bp, Homo sapiens
ccagagaccaaata

SEQ ID NO: 483192 - DNA, 17 bp, Homo sapiens
ccaggctgctcagggct

SEQ ID NO: 483193 - DNA, 15 bp, Homo sapiens
ccatccttccagcaa

SEQ ID NO: 483194 - DNA, 17 bp, Homo sapiens
cccaccaggctgctcag

SEQ ID NO: 483195 - DNA, 21 bp, Homo sapiens
cccatctgcagagcaatgact

SEQ ID NO: 483196 - DNA, 18 bp, Homo sapiens
cccattagaccaagcttg

SEQ ID NO: 483197 - DNA, 17 bp, Homo sapiens
cccttgagccctctatg

SEQ ID NO: 483198 - DNA, 16 bp, Homo sapiens
ccgcatgcggcccagg

SEQ ID NO: 483199 - DNA, 17 bp, Homo sapiens
ccgcatgcggcccagga

SEQ ID NO: 483200 - DNA, 21 bp, Homo sapiens
ccgccattctcaagccctgca

SEQ ID NO: 483201 - DNA, 14 bp, Homo sapiens
cctatttggtgcta

SEQ ID NO: 483202 - DNA, 14 bp, Homo sapiens
cctgacctgtctca

SEQ ID NO: 483203 - DNA, 15 bp, Homo sapiens
cctgagacaaatgga

SEQ ID NO: 483204 - DNA, 21 bp, Homo sapiens
cctgagacaaatggaggcctg

SEQ ID NO: 483205 - DNA, 15 bp, Homo sapiens
cctgcagtcacagct

SEQ ID NO: 483206 - DNA, 19 bp, Homo sapiens
cctgtccaaactgcctaag

SEQ ID NO: 483207 - DNA, 14 bp, Homo sapiens
ccttaactggagcc

SEQ ID NO: 483208 - DNA, 23 bp, Homo sapiens
ccttcattgccttaactggagcc

SEQ ID NO: 483209 - DNA, 13 bp, Homo sapiens
cgaggcccgcatg

SEQ ID NO: 483210 - DNA, 13 bp, Homo sapiens
cgcatcagacaga

SEQ ID NO: 483211 - DNA, 21 bp, Homo sapiens
cgctaatcccgattcaccctg

SEQ ID NO: 483212 - DNA, 15 bp, Homo sapiens
ctaaaaagtataaaa

SEQ ID NO: 483213 - DNA, 22 bp, Homo sapiens
ctaatatttgggaaggctttaa

SEQ ID NO: 483214 - DNA, 14 bp, Homo sapiens
ctaccctagttcaa

SEQ ID NO: 483215 - DNA, 15 bp, Homo sapiens
ctagatttataaatg

SEQ ID NO: 483216 - DNA, 14 bp, Homo sapiens
ctagtaaattttca

SEQ ID NO: 483217 - DNA, 14 bp, Homo sapiens
ctataataaataaa

SEQ ID NO: 483218 - DNA, 16 bp, Homo sapiens
ctatctgaaatcccaa

SEQ ID NO: 483219 - DNA, 13 bp, Homo sapiens
ctatttggtgcta

SEQ ID NO: 483220 - DNA, 12 bp, Homo sapiens
aaattacaagta

SEQ ID NO: 483221 - DNA, 19 bp, Homo sapiens
aaattgttatcaaaatagt

SEQ ID NO: 483222 - DNA, 22 bp, Homo sapiens
aaatttgtaaactttgcttctc

SEQ ID NO: 483223 - DNA, 23 bp, Homo sapiens
aaatttgtaaactttgcttctcc

SEQ ID NO: 483224 - DNA, 18 bp, Homo sapiens
aaccaaagttagttcagt

SEQ ID NO: 483225 - DNA, 16 bp, Homo sapiens
aaccacattgaagaat

SEQ ID NO: 483226 - DNA, 16 bp, Homo sapiens
aacccgaggcccgcat

SEQ ID NO: 483227 - DNA, 21 bp, Homo sapiens
aactattgtgctcagagacac

SEQ ID NO: 483228 - DNA, 24 bp, Homo sapiens
aactattgtgctcagagacactgt

SEQ ID NO: 483229 - DNA, 15 bp, Homo sapiens
aactcaggcaaagaa

SEQ ID NO: 483230 - DNA, 16 bp, Homo sapiens
aactccatatgtgttc

SEQ ID NO: 483231 - DNA, 16 bp, Homo sapiens
aacttagaaaccaaat

SEQ ID NO: 483232 - DNA, 21 bp, Homo sapiens
aacttagaaaccaaattacaa

SEQ ID NO: 483233 - DNA, 23 bp, Homo sapiens
aagaactattgtgctcagagaca

SEQ ID NO: 483234 - DNA, 14 bp, Homo sapiens
aagaaggatgatgt

SEQ ID NO: 483235 - DNA, 17 bp, Homo sapiens
aagaaggatgatgtctt

SEQ ID NO: 483236 - DNA, 18 bp, Homo sapiens
aagagcagtggtaagaat

SEQ ID NO: 483237 - DNA, 19 bp, Homo sapiens
aaggatgatgtctttttat

SEQ ID NO: 483238 - DNA, 14 bp, Homo sapiens
aagggcataaagta

SEQ ID NO: 483239 - DNA, 21 bp, Homo sapiens
aagggcataaagtaaatacat

SEQ ID NO: 483240 - DNA, 18 bp, Homo sapiens
aagtaaatacatgcatat

SEQ ID NO: 483241 - DNA, 19 bp, Homo sapiens
aagtatgtatattaaaaaa

SEQ ID NO: 483242 - DNA, 15 bp, Homo sapiens
aagtcattaaagaca

SEQ ID NO: 483243 - DNA, 22 bp, Homo sapiens
aagtgcggggtaggggaagaag

SEQ ID NO: 483244 - DNA, 20 bp, Homo sapiens
aagtgtgtgtatactgtaat

SEQ ID NO: 483245 - DNA, 20 bp, Homo sapiens
agtataatacattacatgta

SEQ ID NO: 483246 - DNA, 16 bp, Homo sapiens
agtataatttgacaaa

SEQ ID NO: 483247 - DNA, 20 bp, Homo sapiens
agtatgcttggactgaaggg

SEQ ID NO: 483248 - DNA, 18 bp, Homo sapiens
agtatgtatattaaaaaa

SEQ ID NO: 483249 - DNA, 18 bp, Homo sapiens
agtcacacattacaaagt

SEQ ID NO: 483250 - DNA, 21 bp, Homo sapiens
agtcccagaagatgaaaaaaa

SEQ ID NO: 483251 - DNA, 18 bp, Homo sapiens
agtctaaggccatggcat

SEQ ID NO: 483252 - DNA, 16 bp, Homo sapiens
agtgcatccttcatca

SEQ ID NO: 483253 - DNA, 21 bp, Homo sapiens
agtggaagtatgtatattaaa

SEQ ID NO: 483254 - DNA, 17 bp, Homo sapiens
agtgtgtgtatactgta

SEQ ID NO: 483255 - DNA, 14 bp, Homo sapiens
agttgcattttaac

SEQ ID NO: 483256 - DNA, 16 bp, Homo sapiens
ataaactagaataata

SEQ ID NO: 483257 - DNA, 16 bp, Homo sapiens
ataaagtaaatacatg

SEQ ID NO: 483258 - DNA, 22 bp, Homo sapiens
ataaagtggaagtatgtatatt

SEQ ID NO: 483259 - DNA, 15 bp, Homo sapiens
ataaatgtcacaata

SEQ ID NO: 483260 - DNA, 20 bp, Homo sapiens
ataaatgtcacaataaaaca

SEQ ID NO: 483261 - DNA, 16 bp, Homo sapiens
ataacaacactgtgtt

SEQ ID NO: 483262 - DNA, 19 bp, Homo sapiens
ataataaaaatatattttc

SEQ ID NO: 483263 - DNA, 14 bp, Homo sapiens
ataataaaatatca

SEQ ID NO: 483264 - DNA, 17 bp, Homo sapiens
ataatacattacatgta

SEQ ID NO: 483265 - DNA, 13 bp, Homo sapiens
ataatagactgta

SEQ ID NO: 483266 - DNA, 13 bp, Homo sapiens
ataatgaataaat

SEQ ID NO: 483267 - DNA, 18 bp, Homo sapiens
ataatgcccttaatgtga

SEQ ID NO: 483268 - DNA, 14 bp, Homo sapiens
atacaattcaaatg

SEQ ID NO: 483269 - DNA, 18 bp, Homo sapiens
atacataaaagaaataaa

SEQ ID NO: 483270 - DNA, 20 bp, Homo sapiens
atacatgcatataatgaata

SEQ ID NO: 483271 - DNA, 20 bp, Homo sapiens
atacattacatgtaaattaa

SEQ ID NO: 483272 - DNA, 16 bp, Homo sapiens
atactgtaatcgtgct

SEQ ID NO: 483273 - DNA, 18 bp, Homo sapiens
atactgtaatcgtgctat

SEQ ID NO: 483274 - DNA, 15 bp, Homo sapiens
atagcatgaaataaa

SEQ ID NO: 483275 - DNA, 17 bp, Homo sapiens
ataggctattttctaaa

SEQ ID NO: 483276 - DNA, 18 bp, Homo sapiens
ataggctattttctaaag

SEQ ID NO: 483277 - DNA, 20 bp, Homo sapiens
ataggctattttctaaagac

SEQ ID NO: 483278 - DNA, 13 bp, Homo sapiens
atataggctattt

SEQ ID NO: 483279 - DNA, 15 bp, Homo sapiens
atatgtagtatctat

SEQ ID NO: 483280 - DNA, 17 bp, Homo sapiens
atattaaaaaagagaca

SEQ ID NO: 483281 - DNA, 23 bp, Homo sapiens
atattataaaggataaagaagga

SEQ ID NO: 483282 - DNA, 20 bp, Homo sapiens
atatttcaggttcttcagaa

SEQ ID NO: 483283 - DNA, 19 bp, Homo sapiens
atcaaagtcattaaagaca

SEQ ID NO: 483284 - DNA, 22 bp, Homo sapiens
atcaaagtcattaaagacagga

SEQ ID NO: 483285 - DNA, 11 bp, Homo sapiens
atcaaccaaag

SEQ ID NO: 483286 - DNA, 18 bp, Homo sapiens
atcaagggaagaactatt

SEQ ID NO: 483287 - DNA, 22 bp, Homo sapiens
atcacagcttcagccaggagct

SEQ ID NO: 483288 - DNA, 18 bp, Homo sapiens
atcataggtacaatcttt

SEQ ID NO: 483289 - DNA, 14 bp, Homo sapiens
atcattcttactaa

SEQ ID NO: 483290 - DNA, 17 bp, Homo sapiens
atcattgaaacatttat

SEQ ID NO: 483291 - DNA, 22 bp, Homo sapiens
atccttcatcacagcatgtgca

SEQ ID NO: 483292 - DNA, 24 bp, Homo sapiens
atcttataaagtggaagtatgtat

SEQ ID NO: 483293 - DNA, 14 bp, Homo sapiens
atctttcaccaagt

SEQ ID NO: 483294 - DNA, 12 bp, Homo sapiens
atgaaaatggaa

SEQ ID NO: 483295 - DNA, 16 bp, Homo sapiens
atgagagcataattta

SEQ ID NO: 483296 - DNA, 19 bp, Homo sapiens
atgatgtctttttattaaa

SEQ ID NO: 483297 - DNA, 21 bp, Homo sapiens
atgcactgtaatatgtacaca

SEQ ID NO: 483298 - DNA, 15 bp, Homo sapiens
atgcatataatgaat

SEQ ID NO: 483299 - DNA, 12 bp, Homo sapiens
atgcatatttgc

SEQ ID NO: 483300 - DNA, 17 bp, Homo sapiens
atgccatccttccagca

SEQ ID NO: 483301 - DNA, 19 bp, Homo sapiens
atgcctttttttctctgca

SEQ ID NO: 483302 - DNA, 19 bp, Homo sapiens
atggaggatctctaaagag

SEQ ID NO: 483303 - DNA, 17 bp, Homo sapiens
atggcatccctttttca

SEQ ID NO: 483304 - DNA, 22 bp, Homo sapiens
atggtgcttattaagaccaaag

SEQ ID NO: 483305 - DNA, 23 bp, Homo sapiens
atggtgcttattaagaccaaaga

SEQ ID NO: 483306 - DNA, 14 bp, Homo sapiens
atgtaaattaagtg

SEQ ID NO: 483307 - DNA, 14 bp, Homo sapiens
atgtatacaccaag

SEQ ID NO: 483308 - DNA, 22 bp, Homo sapiens
atgtatattaaaaaagagacat

SEQ ID NO: 483309 - DNA, 21 bp, Homo sapiens
atgtcacaataaaacaatctc

SEQ ID NO: 483310 - DNA, 12 bp, Homo sapiens
atgtcataaatg

SEQ ID NO: 483311 - DNA, 18 bp, Homo sapiens
atgtcataaatgtcacaa

SEQ ID NO: 483312 - DNA, 20 bp, Homo sapiens
atgtcataaatgtcacaata

SEQ ID NO: 483313 - DNA, 15 bp, Homo sapiens
atgtgagggtttgta

SEQ ID NO: 483314 - DNA, 22 bp, Homo sapiens
atgtgttcctcttgttctaatc

SEQ ID NO: 483315 - DNA, 16 bp, Homo sapiens
atgttgtttataataa

SEQ ID NO: 483316 - DNA, 13 bp, Homo sapiens
attaagaccaaag

SEQ ID NO: 483317 - DNA, 16 bp, Homo sapiens
attaagaccaaagact

SEQ ID NO: 483318 - DNA, 23 bp, Homo sapiens
attaagtgtgtgtatactgtaat

SEQ ID NO: 483319 - DNA, 13 bp, Homo sapiens
attacaaagttaa

SEQ ID NO: 483320 - DNA, 18 bp, Homo sapiens
attacaagtattcagttc

SEQ ID NO: 483321 - DNA, 14 bp, Homo sapiens
attatttaagacta

SEQ ID NO: 483322 - DNA, 15 bp, Homo sapiens
attatttaattgtcc

SEQ ID NO: 483323 - DNA, 15 bp, Homo sapiens
attatttgattattt

SEQ ID NO: 483324 - DNA, 16 bp, Homo sapiens
attatttgattattta

SEQ ID NO: 483325 - DNA, 18 bp, Homo sapiens
attatttgattatttaag

SEQ ID NO: 483326 - DNA, 22 bp, Homo sapiens
attatttgattatttaagacta

SEQ ID NO: 483327 - DNA, 16 bp, Homo sapiens
attcagttccaatact

SEQ ID NO: 483328 - DNA, 16 bp, Homo sapiens
attccaatttcaaaat

SEQ ID NO: 483329 - DNA, 17 bp, Homo sapiens
attccaatttcaaaatg

SEQ ID NO: 483330 - DNA, 18 bp, Homo sapiens
attccaatttcaaaatgt

SEQ ID NO: 483331 - DNA, 19 bp, Homo sapiens
attccaatttcaaaatgtc

SEQ ID NO: 483332 - DNA, 22 bp, Homo sapiens
attccggaggctaaataaagtc

SEQ ID NO: 483333 - DNA, 16 bp, Homo sapiens
attcctgtcaacaagg

SEQ ID NO: 483334 - DNA, 16 bp, Homo sapiens
attctcaagccctgca

SEQ ID NO: 483335 - DNA, 13 bp, Homo sapiens
attcttactaaaa

SEQ ID NO: 483336 - DNA, 22 bp, Homo sapiens
attcttactaaaaagtataaaa

SEQ ID NO: 483337 - DNA, 14 bp, Homo sapiens
attgtccagtttgt

SEQ ID NO: 483338 - DNA, 23 bp, Homo sapiens
attgtccagtttgtcttggatat

SEQ ID NO: 483339 - DNA, 12 bp, Homo sapiens
attgttatcaaa

SEQ ID NO: 483340 - DNA, 14 bp, Homo sapiens
atttataaactaga

SEQ ID NO: 483341 - DNA, 12 bp, Homo sapiens
atttatggtacc

SEQ ID NO: 483342 - DNA, 14 bp, Homo sapiens
atttcaaaatgtct

SEQ ID NO: 483343 - DNA, 17 bp, Homo sapiens
atttcaatcaaccaaag

SEQ ID NO: 483344 - DNA, 18 bp, Homo sapiens
atttcaatcaaccaaagt

SEQ ID NO: 483345 - DNA, 15 bp, Homo sapiens
gcatgaaataaaata

SEQ ID NO: 483346 - DNA, 18 bp, Homo sapiens
gcatgaaataaaatatat

SEQ ID NO: 483347 - DNA, 13 bp, Homo sapiens
gcatttaaaaaaa

SEQ ID NO: 483348 - DNA, 15 bp, Homo sapiens
gccagaggatcacca

SEQ ID NO: 483349 - DNA, 23 bp, Homo sapiens
gccaggagctgggcagaaggcca

SEQ ID NO: 483350 - DNA, 17 bp, Homo sapiens
gccccatcagctccagc

SEQ ID NO: 483351 - DNA, 19 bp, Homo sapiens
gcccgcatgcggcccagga

SEQ ID NO: 483352 - DNA, 23 bp, Homo sapiens
gccctccgccattctcaagccct

SEQ ID NO: 483353 - DNA, 12 bp, Homo sapiens
tcatataagaca

SEQ ID NO: 483354 - DNA, 12 bp, Homo sapiens
aaaaagagacat

SEQ ID NO: 483355 - DNA, 15 bp, Homo sapiens
aaaaagagacatcca

SEQ ID NO: 483356 - DNA, 11 bp, Homo sapiens
aaaaatatatt

SEQ ID NO: 483357 - DNA, 11 bp, Homo sapiens
aaaaattgtta

SEQ ID NO: 483358 - DNA, 11 bp, Homo sapiens
aaaacaaccac

SEQ ID NO: 483359 - DNA, 23 bp, Homo sapiens
aaaactcaggcaaagaaaatgaa

SEQ ID NO: 483360 - DNA, 14 bp, Homo sapiens
aaaacttataaatt

SEQ ID NO: 483361 - DNA, 16 bp, Homo sapiens
aaaagtataaaatagt

SEQ ID NO: 483362 - DNA, 13 bp, Homo sapiens
aaaatggaaattt

SEQ ID NO: 483363 - DNA, 18 bp, Homo sapiens
aaaatgtctgtaataata

SEQ ID NO: 483364 - DNA, 13 bp, Homo sapiens
aaaattgttattt

SEQ ID NO: 483365 - DNA, 18 bp, Homo sapiens
aaaccaaattacaagtat

SEQ ID NO: 483366 - DNA, 15 bp, Homo sapiens
aaactttgcttctcc

SEQ ID NO: 483367 - DNA, 13 bp, Homo sapiens
aaagaaataaacc

SEQ ID NO: 483368 - DNA, 17 bp, Homo sapiens
aaagacttgttaaatgt

SEQ ID NO: 483369 - DNA, 14 bp, Homo sapiens
aaagcaaggtacag

SEQ ID NO: 483370 - DNA, 23 bp, Homo sapiens
aaagccacaattattttaatatt

SEQ ID NO: 483371 - DNA, 17 bp, Homo sapiens
aaagtcattaaagacag

SEQ ID NO: 483372 - DNA, 18 bp, Homo sapiens
aaatagtcaaatacgaaa

SEQ ID NO: 483373 - DNA, 22 bp, Homo sapiens
aaatatcaaagtcattaaagac

SEQ ID NO: 483374 - DNA, 15 bp, Homo sapiens
aaatatcatattaaa

SEQ ID NO: 483375 - DNA, 17 bp, Homo sapiens
aaatcctgaagagcatt

SEQ ID NO: 483376 - DNA, 12 bp, Homo sapiens
aaatgaaatgca

SEQ ID NO: 483377 - DNA, 19 bp, Homo sapiens
aaatgcactgtaatatgta

SEQ ID NO: 483378 - DNA, 21 bp, Homo sapiens
aaatgtctcaatggtgctata

SEQ ID NO: 483379 - DNA, 18 bp, Homo sapiens
aaatgtctgtaataatag

SEQ ID NO: 483380 - DNA, 17 bp, Homo sapiens
aaattatttgattattt

SEQ ID NO: 483381 - DNA, 21 bp, Homo sapiens
aaccaaagttagttcagtagc

SEQ ID NO: 483382 - DNA, 22 bp, Homo sapiens
aaccacattgaagaatgttaga

SEQ ID NO: 483383 - DNA, 15 bp, Homo sapiens
aacccgaggcccgca

SEQ ID NO: 483384 - DNA, 23 bp, Homo sapiens
aacctttctttctgaaatagtca

SEQ ID NO: 483385 - DNA, 16 bp, Homo sapiens
aacgaaatatcaaagt

SEQ ID NO: 483386 - DNA, 13 bp, Homo sapiens
aacgtggcccaga

SEQ ID NO: 483387 - DNA, 17 bp, Homo sapiens
aactcaggcaaagaaaa

SEQ ID NO: 483388 - DNA, 17 bp, Homo sapiens
aactccatatgtgttcc

SEQ ID NO: 483389 - DNA, 17 bp, Homo sapiens
aacttagaaaccaaatt

SEQ ID NO: 483390 - DNA, 16 bp, Homo sapiens
aacttccaaataaata

SEQ ID NO: 483391 - DNA, 15 bp, Homo sapiens
aagaatgttagagta

SEQ ID NO: 483392 - DNA, 21 bp, Homo sapiens
aagaatgttagagtaatgaaa

SEQ ID NO: 483393 - DNA, 20 bp, Homo sapiens
aagacaaatattcctttgca

SEQ ID NO: 483394 - DNA, 14 bp, Homo sapiens
aagacaggagacaa

SEQ ID NO: 483395 - DNA, 14 bp, Homo sapiens
aagaccaaagactt

SEQ ID NO: 483396 - DNA, 16 bp, Homo sapiens
aagcttggttctgtga

SEQ ID NO: 483397 - DNA, 17 bp, Homo sapiens
aagcttggttctgtgaa

SEQ ID NO: 483398 - DNA, 20 bp, Homo sapiens
aagtataaaatagtatgaaa

SEQ ID NO: 483399 - DNA, 20 bp, Homo sapiens
aagtatgtatattaaaaaag

SEQ ID NO: 483400 - DNA, 22 bp, Homo sapiens
aagtatgtatattaaaaaagag

SEQ ID NO: 483401 - DNA, 22 bp, Homo sapiens
aagtctgctctcatataagaca

SEQ ID NO: 483402 - DNA, 21 bp, Homo sapiens
aagtgaccgacaaaattccag

SEQ ID NO: 483403 - DNA, 19 bp, Homo sapiens
aagtgtttatgttgtttat

SEQ ID NO: 483404 - DNA, 13 bp, Homo sapiens
aagttatctttga

SEQ ID NO: 483405 - DNA, 15 bp, Homo sapiens
aataaaaatatattt

SEQ ID NO: 483406 - DNA, 18 bp, Homo sapiens
aataattttcattttgca

SEQ ID NO: 483407 - DNA, 22 bp, Homo sapiens
aatacttcattaatttcaatca

SEQ ID NO: 483408 - DNA, 17 bp, Homo sapiens
aatcaaccaaagttagt

SEQ ID NO: 483409 - DNA, 22 bp, Homo sapiens
aatcaaccaaagttagttcagt

SEQ ID NO: 483410 - DNA, 17 bp, Homo sapiens
aatcattcttactaaaa

SEQ ID NO: 483411 - DNA, 21 bp, Homo sapiens
aatctttcaccaagtaaattt

SEQ ID NO: 483412 - DNA, 23 bp, Homo sapiens
aatctttcaccaagtaaatttgt

SEQ ID NO: 483413 - DNA, 15 bp, Homo sapiens
aatgactcaaagtct

SEQ ID NO: 483414 - DNA, 16 bp, Homo sapiens
aatgcccttaatgtga

SEQ ID NO: 483415 - DNA, 19 bp, Homo sapiens
aatggtgctataataaata

SEQ ID NO: 483416 - DNA, 13 bp, Homo sapiens
aatggtgcttatt

SEQ ID NO: 483417 - DNA, 18 bp, Homo sapiens
aatggtgcttattaagac

SEQ ID NO: 483418 - DNA, 19 bp, Homo sapiens
aatgtatacaccaagtggt

SEQ ID NO: 483419 - DNA, 14 bp, Homo sapiens
aatgtctcaatggt

SEQ ID NO: 483420 - DNA, 16 bp, Homo sapiens
aatgtctgtaataata

SEQ ID NO: 483421 - DNA, 22 bp, Homo sapiens
aatgtgagggtttgtaatggtg

SEQ ID NO: 483422 - DNA, 20 bp, Homo sapiens
aatgttagagtaatgaaatg

SEQ ID NO: 483423 - DNA, 20 bp, Homo sapiens
aattaagtgtgtgtatactg

SEQ ID NO: 483424 - DNA, 21 bp, Homo sapiens
aattacaagtattcagttcca

SEQ ID NO: 483425 - DNA, 23 bp, Homo sapiens
aattacaagtattcagttccaat

SEQ ID NO: 483426 - DNA, 16 bp, Homo sapiens
aattatttaattgtcc

SEQ ID NO: 483427 - DNA, 14 bp, Homo sapiens
aattccaatttcaa

SEQ ID NO: 483428 - DNA, 15 bp, Homo sapiens
aattccaatttcaaa

SEQ ID NO: 483429 - DNA, 15 bp, Homo sapiens
aattctgtttaattt

SEQ ID NO: 483430 - DNA, 11 bp, Homo sapiens
acaaaagcaat

SEQ ID NO: 483431 - DNA, 12 bp, Homo sapiens
acaaaattccag

SEQ ID NO: 483432 - DNA, 16 bp, Homo sapiens
acaaatggaggcctgt

SEQ ID NO: 483433 - DNA, 18 bp, Homo sapiens
acaacttagaaaccaaat

SEQ ID NO: 483434 - DNA, 16 bp, Homo sapiens
acaagcttcagtaagt

SEQ ID NO: 483435 - DNA, 15 bp, Homo sapiens
acaatctttcaccaa

SEQ ID NO: 483436 - DNA, 13 bp, Homo sapiens
acaattcaaatgc

SEQ ID NO: 483437 - DNA, 14 bp, Homo sapiens
acacattacaaagt

SEQ ID NO: 483438 - DNA, 22 bp, Homo sapiens
acacattacaaagttaaaattg

SEQ ID NO: 483439 - DNA, 23 bp, Homo sapiens
acacattacaaagttaaaattgt

SEQ ID NO: 483440 - DNA, 21 bp, Homo sapiens
acagcttcagccaggagctgg

SEQ ID NO: 483441 - DNA, 15 bp, Homo sapiens
acaggagacaaaaga

SEQ ID NO: 483442 - DNA, 23 bp, Homo sapiens
acaggtgactaccctagttcaaa

SEQ ID NO: 483443 - DNA, 18 bp, Homo sapiens
acagtataatttgacaaa

SEQ ID NO: 483444 - DNA, 14 bp, Homo sapiens
acagtgggagccag

SEQ ID NO: 483445 - DNA, 15 bp, Homo sapiens
acagtgggagccagg

SEQ ID NO: 483446 - DNA, 17 bp, Homo sapiens
acagtgggagccagggc

SEQ ID NO: 483447 - DNA, 22 bp, Homo sapiens
acatagcttgataaagggccaa

SEQ ID NO: 483448 - DNA, 13 bp, Homo sapiens
acatgcatataat

SEQ ID NO: 483449 - DNA, 23 bp, Homo sapiens
acatggagtccaagtaatgaatt

SEQ ID NO: 483450 - DNA, 15 bp, Homo sapiens
acattacatgtaaat

SEQ ID NO: 483451 - DNA, 14 bp, Homo sapiens
accaaagcaaggta

SEQ ID NO: 483452 - DNA, 12 bp, Homo sapiens
accaaatacaat

SEQ ID NO: 483453 - DNA, 15 bp, Homo sapiens
accaagtggtaatga

SEQ ID NO: 483454 - DNA, 12 bp, Homo sapiens
accaattccaat

SEQ ID NO: 483455 - DNA, 15 bp, Homo sapiens
accacattgaagaat

SEQ ID NO: 483456 - DNA, 14 bp, Homo sapiens
accatgtacatagc

SEQ ID NO: 483457 - DNA, 19 bp, Homo sapiens
accctgtccaaactgccta

SEQ ID NO: 483458 - DNA, 15 bp, Homo sapiens
acgtggcccagagaa

SEQ ID NO: 483459 - DNA, 17 bp, Homo sapiens
actaaaaagtataaaat

SEQ ID NO: 483460 - DNA, 22 bp, Homo sapiens
actaacgaaatatcaaagtcat

SEQ ID NO: 483461 - DNA, 23 bp, Homo sapiens
actattctttgtattaccaaagc

SEQ ID NO: 483462 - DNA, 23 bp, Homo sapiens
actattgtgctcagagacactgt

SEQ ID NO: 483463 - DNA, 15 bp, Homo sapiens
actccatatgtgttc

SEQ ID NO: 483464 - DNA, 15 bp, Homo sapiens
actgaggatattcag

SEQ ID NO: 483465 - DNA, 11 bp, Homo sapiens
actggagcccc

SEQ ID NO: 483466 - DNA, 17 bp, Homo sapiens
actggcccacacgtgca

SEQ ID NO: 483467 - DNA, 15 bp, Homo sapiens
actgtaatatgtaca

SEQ ID NO: 483468 - DNA, 15 bp, Homo sapiens
actgttgataaaaac

SEQ ID NO: 483469 - DNA, 15 bp, Homo sapiens
acttagaaaccaaat

SEQ ID NO: 483470 - DNA, 19 bp, Homo sapiens
acttcattaatttcaatca

SEQ ID NO: 483471 - DNA, 13 bp, Homo sapiens
acttgttaaatgt

SEQ ID NO: 483472 - DNA, 18 bp, Homo sapiens
actttctcaggcttctca

SEQ ID NO: 483473 - DNA, 12 bp, Homo sapiens
agaaaccaaatt

SEQ ID NO: 483474 - DNA, 13 bp, Homo sapiens
agaaataaaccaa

SEQ ID NO: 483475 - DNA, 13 bp, Homo sapiens
agaaggccaagag

SEQ ID NO: 483476 - DNA, 17 bp, Homo sapiens
agaaggccaagaggctg

SEQ ID NO: 483477 - DNA, 15 bp, Homo sapiens
agacaggagacaaaa

SEQ ID NO: 483478 - DNA, 22 bp, Homo sapiens
agacatccaaatttttttttaa

SEQ ID NO: 483479 - DNA, 22 bp, Homo sapiens
agaccaaagacttgttaaatgt

SEQ ID NO: 483480 - DNA, 14 bp, Homo sapiens
agagaccaaataat

SEQ ID NO: 483481 - DNA, 23 bp, Homo sapiens
agagcataatttaaaaatatatt

SEQ ID NO: 483482 - DNA, 13 bp, Homo sapiens
agagccatacata

SEQ ID NO: 483483 - DNA, 21 bp, Homo sapiens
agatttataaatgcactgtaa

SEQ ID NO: 483484 - DNA, 16 bp, Homo sapiens
agcataatttaaaaat

SEQ ID NO: 483485 - DNA, 21 bp, Homo sapiens
agcataatttaaaaatatatt

SEQ ID NO: 483486 - DNA, 17 bp, Homo sapiens
agcatgaaataaaatat

SEQ ID NO: 483487 - DNA, 13 bp, Homo sapiens
agcatgtgcaata

SEQ ID NO: 483488 - DNA, 14 bp, Homo sapiens
agccaggagctggg

SEQ ID NO: 483489 - DNA, 16 bp, Homo sapiens
agccatacataaaaga

SEQ ID NO: 483490 - DNA, 18 bp, Homo sapiens
agccatacataaaagaaa

SEQ ID NO: 483491 - DNA, 17 bp, Homo sapiens
agcttcagccaggagct

SEQ ID NO: 483492 - DNA, 18 bp, Homo sapiens
agcttgataaagggccaa

SEQ ID NO: 483493 - DNA, 14 bp, Homo sapiens
aggaaaatgtctgt

SEQ ID NO: 483494 - DNA, 12 bp, Homo sapiens
aggacccttccc

SEQ ID NO: 483495 - DNA, 20 bp, Homo sapiens
aggacccttcccttgagccc

SEQ ID NO: 483496 - DNA, 22 bp, Homo sapiens
aggacccttcccttgagccctc

SEQ ID NO: 483497 - DNA, 19 bp, Homo sapiens
aggatattcagatgtatgt

SEQ ID NO: 483498 - DNA, 14 bp, Homo sapiens
aggatctctaaaga

SEQ ID NO: 483499 - DNA, 19 bp, Homo sapiens
aggcccgcatgcggcccag

SEQ ID NO: 483500 - DNA, 18 bp, Homo sapiens
aggctattttctaaagac

SEQ ID NO: 483501 - DNA, 19 bp, Homo sapiens
aggctattttctaaagact

SEQ ID NO: 483502 - DNA, 14 bp, Homo sapiens
agggaagaactatt

SEQ ID NO: 483503 - DNA, 19 bp, Homo sapiens
agggcataaagtaaataca

SEQ ID NO: 483504 - DNA, 19 bp, Homo sapiens
agggtttgtaatggtgctt

SEQ ID NO: 483505 - DNA, 15 bp, Homo sapiens
aggtacaatctttca

SEQ ID NO: 483506 - DNA, 20 bp, Homo sapiens
aggtgctcctcttttttctt

SEQ ID NO: 483507 - DNA, 13 bp, Homo sapiens
agtaaattttcaa

SEQ ID NO: 483508 - DNA, 17 bp, Homo sapiens
agtactaggttgtccat

SEQ ID NO: 483509 - DNA, 14 bp, Homo sapiens
agtagcttatctca

SEQ ID NO: 483510 - DNA, 22 bp, Homo sapiens
agtataaaatagtatgaaaatg

SEQ ID NO: 483511 - DNA, 22 bp, Homo sapiens
agtatgtatattaaaaaagaga

SEQ ID NO: 483512 - DNA, 23 bp, Homo sapiens
agtatgtatattaaaaaagagac

SEQ ID NO: 483513 - DNA, 16 bp, Homo sapiens
agtattcagttccaat

SEQ ID NO: 483514 - DNA, 22 bp, Homo sapiens
agtggaagtatgtatattaaaa

SEQ ID NO: 483515 - DNA, 18 bp, Homo sapiens
agtgtttatgttgtttat

SEQ ID NO: 483516 - DNA, 20 bp, Homo sapiens
agttaaaattgttatcaaaa

SEQ ID NO: 483517 - DNA, 11 bp, Homo sapiens
agttagttcag

SEQ ID NO: 483518 - DNA, 21 bp, Homo sapiens
agttagttcagtagcttatct

SEQ ID NO: 483519 - DNA, 17 bp, Homo sapiens
agttatttatttccaaa

SEQ ID NO: 483520 - DNA, 18 bp, Homo sapiens
agttatttatttccaaaa

SEQ ID NO: 483521 - DNA, 23 bp, Homo sapiens
agttgcattttaaccctatttta

SEQ ID NO: 483522 - DNA, 23 bp, Homo sapiens
ataaagaaggatgatgtcttttt

SEQ ID NO: 483523 - DNA, 14 bp, Homo sapiens
ataaaggataaaga

SEQ ID NO: 483524 - DNA, 17 bp, Homo sapiens
ataaataaacttcaaca

SEQ ID NO: 483525 - DNA, 15 bp, Homo sapiens
ataaatgcactgtaa

SEQ ID NO: 483526 - DNA, 16 bp, Homo sapiens
ataaatgcactgtaat

SEQ ID NO: 483527 - DNA, 12 bp, Homo sapiens
ataaggaaattt

SEQ ID NO: 483528 - DNA, 15 bp, Homo sapiens
ataataaaaatatat

SEQ ID NO: 483529 - DNA, 20 bp, Homo sapiens
ataataatgcccttaatgtg

SEQ ID NO: 483530 - DNA, 22 bp, Homo sapiens
ataatacattacatgtaaatta

SEQ ID NO: 483531 - DNA, 16 bp, Homo sapiens
ataatgcccttaatgt

SEQ ID NO: 483532 - DNA, 13 bp, Homo sapiens
ataatttgacaaa

SEQ ID NO: 483533 - DNA, 18 bp, Homo sapiens
ataatttgacaaagaaaa

SEQ ID NO: 483534 - DNA, 13 bp, Homo sapiens
atacatgcatata

SEQ ID NO: 483535 - DNA, 18 bp, Homo sapiens
atacttcattaatttcaa

SEQ ID NO: 483536 - DNA, 14 bp, Homo sapiens
atacttctcttttt

SEQ ID NO: 483537 - DNA, 20 bp, Homo sapiens
atacttctctttttttgctg

SEQ ID NO: 483538 - DNA, 13 bp, Homo sapiens
atagcatgaaata

SEQ ID NO: 483539 - DNA, 22 bp, Homo sapiens
ataggctattttctaaagactt

SEQ ID NO: 483540 - DNA, 22 bp, Homo sapiens
atataggctattttctaaagac

SEQ ID NO: 483541 - DNA, 19 bp, Homo sapiens
atatatcttataaagtgga

SEQ ID NO: 483542 - DNA, 21 bp, Homo sapiens
atatcataggtacaatctttc

SEQ ID NO: 483543 - DNA, 19 bp, Homo sapiens
atattataaaggataaaga

SEQ ID NO: 483544 - DNA, 12 bp, Homo sapiens
atattcctttgc

SEQ ID NO: 483545 - DNA, 14 bp, Homo sapiens
atcaaaatagtcta

SEQ ID NO: 483546 - DNA, 13 bp, Homo sapiens
atcaaccaaagtt

SEQ ID NO: 483547 - DNA, 21 bp, Homo sapiens
atcaaccaaagttagttcagt

SEQ ID NO: 483548 - DNA, 16 bp, Homo sapiens
atcaagggaagaacta

SEQ ID NO: 483549 - DNA, 15 bp, Homo sapiens
atcacagcatgtgca

SEQ ID NO: 483550 - DNA, 22 bp, Homo sapiens
atcaccagtgcatccttcatca

SEQ ID NO: 483551 - DNA, 14 bp, Homo sapiens
atcataggtacaat

SEQ ID NO: 483552 - DNA, 14 bp, Homo sapiens
atcattgaaacatt

SEQ ID NO: 483553 - DNA, 12 bp, Homo sapiens
cattcctgtcaa

SEQ ID NO: 483554 - DNA, 12 bp, Homo sapiens
cattcttactaa

SEQ ID NO: 483555 - DNA, 18 bp, Homo sapiens
cattcttactaaaaagta

SEQ ID NO: 483556 - DNA, 18 bp, Homo sapiens
cattgaaacatttataaa

SEQ ID NO: 483557 - DNA, 21 bp, Homo sapiens
cattgaaacatttataaacta

SEQ ID NO: 483558 - DNA, 21 bp, Homo sapiens
cattgccttaactggagcccc

SEQ ID NO: 483559 - DNA, 23 bp, Homo sapiens
agaaatatttttaaagccacaat

SEQ ID NO: 483560 - DNA, 17 bp, Homo sapiens
agaagccaaaagattgg

SEQ ID NO: 483561 - DNA, 20 bp, Homo sapiens
agacactaacgaaatatcaa

SEQ ID NO: 483562 - DNA, 18 bp, Homo sapiens
agacactgttgataaaaa

SEQ ID NO: 483563 - DNA, 19 bp, Homo sapiens
agacactgttgataaaaac

SEQ ID NO: 483564 - DNA, 16 bp, Homo sapiens
agaccaagcttgtcca

SEQ ID NO: 483565 - DNA, 16 bp, Homo sapiens
agactaaaagttgcat

SEQ ID NO: 483566 - DNA, 22 bp, Homo sapiens
agactgtaacttccaaataaat

SEQ ID NO: 483567 - DNA, 15 bp, Homo sapiens
agacttgttaaatgt

SEQ ID NO: 483568 - DNA, 16 bp, Homo sapiens
agacttgttaaatgta

SEQ ID NO: 483569 - DNA, 22 bp, Homo sapiens
agagaccaaataattaaaagaa

SEQ ID NO: 483570 - DNA, 19 bp, Homo sapiens
agagccatacataaaagaa

SEQ ID NO: 483571 - DNA, 21 bp, Homo sapiens
agagccatacataaaagaaat

SEQ ID NO: 483572 - DNA, 17 bp, Homo sapiens
agagctatcaggagaaa

SEQ ID NO: 483573 - DNA, 15 bp, Homo sapiens
agatttataaatgca

SEQ ID NO: 483574 - DNA, 22 bp, Homo sapiens
agcaaacgtacgggaatgtgct

SEQ ID NO: 483575 - DNA, 23 bp, Homo sapiens
agcactattctttgtattaccaa

SEQ ID NO: 483576 - DNA, 17 bp, Homo sapiens
agcataatttaaaaata

SEQ ID NO: 483577 - DNA, 22 bp, Homo sapiens
agccatacataaaagaaataaa

SEQ ID NO: 483578 - DNA, 23 bp, Homo sapiens
agccatacataaaagaaataaac

SEQ ID NO: 483579 - DNA, 24 bp, Homo sapiens
agccctccgccattctcaagccct

SEQ ID NO: 483580 - DNA, 18 bp, Homo sapiens
agctgggcagaaggccaa

SEQ ID NO: 483581 - DNA, 12 bp, Homo sapiens
agcttatctcag

SEQ ID NO: 483582 - DNA, 18 bp, Homo sapiens
agcttatctcagttatga

SEQ ID NO: 483583 - DNA, 22 bp, Homo sapiens
agcttgtccaacccgaggcccg

SEQ ID NO: 483584 - DNA, 20 bp, Homo sapiens
aggaaaatgtctgtaataat

SEQ ID NO: 483585 - DNA, 13 bp, Homo sapiens
aggacccttccct

SEQ ID NO: 483586 - DNA, 13 bp, Homo sapiens
aggagacaaaaga

SEQ ID NO: 483587 - DNA, 17 bp, Homo sapiens
aggatctctaaagagca

SEQ ID NO: 483588 - DNA, 19 bp, Homo sapiens
aggatctctaaagagcatc

SEQ ID NO: 483589 - DNA, 23 bp, Homo sapiens
aggatgatgtctttttattaaaa

SEQ ID NO: 483590 - DNA, 18 bp, Homo sapiens
aggatggctttgaatgcg

SEQ ID NO: 483591 - DNA, 17 bp, Homo sapiens
aggcaaagaaaatgaaa

SEQ ID NO: 483592 - DNA, 14 bp, Homo sapiens
aggccaagaggctg

SEQ ID NO: 483593 - DNA, 14 bp, Homo sapiens
aggctattttctaa

SEQ ID NO: 483594 - DNA, 15 bp, Homo sapiens
aggctgctcagggct

SEQ ID NO: 483595 - DNA, 21 bp, Homo sapiens
aggtacaatctttcaccaagt

SEQ ID NO: 483596 - DNA, 22 bp, Homo sapiens
aggtacaatctttcaccaagta

SEQ ID NO: 483597 - DNA, 21 bp, Homo sapiens
agtataatacattacatgtaa

SEQ ID NO: 483598 - DNA, 14 bp, Homo sapiens
agtataatttgaca

SEQ ID NO: 483599 - DNA, 19 bp, Homo sapiens
agtatgaaaatggaaattt

SEQ ID NO: 483600 - DNA, 20 bp, Homo sapiens
agtatgtatattaaaaaaga

SEQ ID NO: 483601 - DNA, 15 bp, Homo sapiens
agtattcagttccaa

SEQ ID NO: 483602 - DNA, 22 bp, Homo sapiens
agtattcagttccaatacttca

SEQ ID NO: 483603 - DNA, 14 bp, Homo sapiens
agtcattaaagaca

SEQ ID NO: 483604 - DNA, 23 bp, Homo sapiens
agtcattaaagacaggagacaaa

SEQ ID NO: 483605 - DNA, 20 bp, Homo sapiens
agtgaccgacaaaattccag

SEQ ID NO: 483606 - DNA, 23 bp, Homo sapiens
agtgcatccttcatcacagcatg

SEQ ID NO: 483607 - DNA, 14 bp, Homo sapiens
agtgcctattgata

SEQ ID NO: 483608 - DNA, 20 bp, Homo sapiens
agtggaagtatgtatattaa

SEQ ID NO: 483609 - DNA, 17 bp, Homo sapiens
agtgtattaggaagtgt

SEQ ID NO: 483610 - DNA, 22 bp, Homo sapiens
agttaaaattgttatcaaaata

SEQ ID NO: 483611 - DNA, 15 bp, Homo sapiens
agttatttatttcca

SEQ ID NO: 483612 - DNA, 12 bp, Homo sapiens
ataaaaatatat

SEQ ID NO: 483613 - DNA, 13 bp, Homo sapiens
ataaaaatatatt

SEQ ID NO: 483614 - DNA, 18 bp, Homo sapiens
ataaaacttataaatttc

SEQ ID NO: 483615 - DNA, 17 bp, Homo sapiens
ataaaatatatcttata

SEQ ID NO: 483616 - DNA, 18 bp, Homo sapiens
ataaagtaaatacatgca

SEQ ID NO: 483617 - DNA, 12 bp, Homo sapiens
ataaataatttt

SEQ ID NO: 483618 - DNA, 17 bp, Homo sapiens
ataaattatttgattat

SEQ ID NO: 483619 - DNA, 19 bp, Homo sapiens
ataaattatttgattattt

SEQ ID NO: 483620 - DNA, 23 bp, Homo sapiens
ataagacaaatattcctttgcat

SEQ ID NO: 483621 - DNA, 19 bp, Homo sapiens
ataataatgcccttaatgt

SEQ ID NO: 483622 - DNA, 16 bp, Homo sapiens
ataatacattacatgt

SEQ ID NO: 483623 - DNA, 14 bp, Homo sapiens
ataatgaataaatc

SEQ ID NO: 483624 - DNA, 17 bp, Homo sapiens
ataatttaaaaatatat

SEQ ID NO: 483625 - DNA, 19 bp, Homo sapiens
ataatttaaaaatatattt

SEQ ID NO: 483626 - DNA, 16 bp, Homo sapiens
atacaattcaaatgct

SEQ ID NO: 483627 - DNA, 17 bp, Homo sapiens
atacaattcaaatgctt

SEQ ID NO: 483628 - DNA, 14 bp, Homo sapiens
atacataaaagaaa

SEQ ID NO: 483629 - DNA, 20 bp, Homo sapiens
atacataaaagaaataaacc

SEQ ID NO: 483630 - DNA, 21 bp, Homo sapiens
atacatgcatataatgaataa

SEQ ID NO: 483631 - DNA, 17 bp, Homo sapiens
atactgtaatcgtgcta

SEQ ID NO: 483632 - DNA, 20 bp, Homo sapiens
atacttcattaatttcaatc

SEQ ID NO: 483633 - DNA, 21 bp, Homo sapiens
ataggctattttctaaagact

SEQ ID NO: 483634 - DNA, 22 bp, Homo sapiens
atagtagatgtggcctttgaat

SEQ ID NO: 483635 - DNA, 19 bp, Homo sapiens
atataatgaataaatcatt

SEQ ID NO: 483636 - DNA, 13 bp, Homo sapiens
atatcaaagtcat

SEQ ID NO: 483637 - DNA, 21 bp, Homo sapiens
atatcaaagtcattaaagaca

SEQ ID NO: 483638 - DNA, 16 bp, Homo sapiens
atatcataggtacaat

SEQ ID NO: 483639 - DNA, 20 bp, Homo sapiens
atattataaaggataaagaa

SEQ ID NO: 483640 - DNA, 16 bp, Homo sapiens
atattcagatgtatgt

SEQ ID NO: 483641 - DNA, 23 bp, Homo sapiens
atattcctttgcatattataaag

SEQ ID NO: 483642 - DNA, 20 bp, Homo sapiens
atatttgcaaagtgtattag

SEQ ID NO: 483643 - DNA, 20 bp, Homo sapiens
atcaaccaaagttagttcag

SEQ ID NO: 483644 - DNA, 14 bp, Homo sapiens
atcacagcttcagc

SEQ ID NO: 483645 - DNA, 21 bp, Homo sapiens
atcacagcttcagccaggagc

SEQ ID NO: 483646 - DNA, 23 bp, Homo sapiens
atcaggagaaagcttggttctgt

SEQ ID NO: 483647 - DNA, 17 bp, Homo sapiens
atcatatcataggtaca

SEQ ID NO: 483648 - DNA, 18 bp, Homo sapiens
atcatatcataggtacaa

SEQ ID NO: 483649 - DNA, 18 bp, Homo sapiens
atcattcttactaaaaag

SEQ ID NO: 483650 - DNA, 23 bp, Homo sapiens
atcattcttactaaaaagtataa

SEQ ID NO: 483651 - DNA, 15 bp, Homo sapiens
atcccgattcaccct

SEQ ID NO: 483652 - DNA, 15 bp, Homo sapiens
atctctaaagagcat

SEQ ID NO: 483653 - DNA, 15 bp, Homo sapiens
atctttgaatatgta

SEQ ID NO: 483654 - DNA, 16 bp, Homo sapiens
atgaaataaaatatat

SEQ ID NO: 483655 - DNA, 22 bp, Homo sapiens
atgactatgcgtggctggaacc

SEQ ID NO: 483656 - DNA, 21 bp, Homo sapiens
atgcatataatgaataaatca

SEQ ID NO: 483657 - DNA, 17 bp, Homo sapiens
atgcatatttgcaaagt

SEQ ID NO: 483658 - DNA, 21 bp, Homo sapiens
atgcatatttgcaaagtgtat

SEQ ID NO: 483659 - DNA, 14 bp, Homo sapiens
atgcccttaatgtg

SEQ ID NO: 483660 - DNA, 15 bp, Homo sapiens
atggaggcctgtcct

SEQ ID NO: 483661 - DNA, 13 bp, Homo sapiens
atggtgcttatta

SEQ ID NO: 483662 - DNA, 17 bp, Homo sapiens
atgtaaattaagtgtgt

SEQ ID NO: 483663 - DNA, 19 bp, Homo sapiens
atgtatacaccaagtggta

SEQ ID NO: 483664 - DNA, 16 bp, Homo sapiens
atgtatattaaaaaag

SEQ ID NO: 483665 - DNA, 13 bp, Homo sapiens
atgtcataaatgt

SEQ ID NO: 483666 - DNA, 17 bp, Homo sapiens
atgtcataaatgtcaca

SEQ ID NO: 483667 - DNA, 19 bp, Homo sapiens
atgtcataaatgtcacaat

SEQ ID NO: 483668 - DNA, 15 bp, Homo sapiens
atgtctttttattaa

SEQ ID NO: 483669 - DNA, 20 bp, Homo sapiens
atgtggcctttgaattctgt

SEQ ID NO: 483670 - DNA, 22 bp, Homo sapiens
atgtgttgattcttgaaaactg

SEQ ID NO: 483671 - DNA, 14 bp, Homo sapiens
atgttagagtaatg

SEQ ID NO: 483672 - DNA, 22 bp, Homo sapiens
atgttgtttataataaaaatat

SEQ ID NO: 483673 - DNA, 22 bp, Homo sapiens
attaaaaaagagacatccaaat

SEQ ID NO: 483674 - DNA, 16 bp, Homo sapiens
attaaaagaaaaacaa

SEQ ID NO: 483675 - DNA, 12 bp, Homo sapiens
attaaaatattt

SEQ ID NO: 483676 - DNA, 20 bp, Homo sapiens
ggcccacacgtgcatagagg

SEQ ID NO: 483677 - DNA, 16 bp, Homo sapiens
ggctaaataaagtctc

SEQ ID NO: 483678 - DNA, 20 bp, Homo sapiens
ggctattttctaaagacttg

SEQ ID NO: 483679 - DNA, 19 bp, Homo sapiens
gggtttgtaatggtgctta

SEQ ID NO: 483680 - DNA, 19 bp, Homo sapiens
ggtaagaatagtagatgtg

SEQ ID NO: 483681 - DNA, 20 bp, Homo sapiens
ggtacaatctttcaccaagt

SEQ ID NO: 483682 - DNA, 19 bp, Homo sapiens
ggtcattcctgtcaacaag

SEQ ID NO: 483683 - DNA, 21 bp, Homo sapiens
ggtgcttattaagaccaaaga

SEQ ID NO: 483684 - DNA, 22 bp, Homo sapiens
gtaaactttgcttctccaaata

SEQ ID NO: 483685 - DNA, 17 bp, Homo sapiens
gtaaatacatgcatata

SEQ ID NO: 483686 - DNA, 19 bp, Homo sapiens
gtaacttccaaataaataa

SEQ ID NO: 483687 - DNA, 13 bp, Homo sapiens
gtaataatagact

SEQ ID NO: 483688 - DNA, 16 bp, Homo sapiens
gtaataatagactgta

SEQ ID NO: 483689 - DNA, 23 bp, Homo sapiens
gtacacaacttagaaaccaaatt

SEQ ID NO: 483690 - DNA, 17 bp, Homo sapiens
gtacctatttggtgcta

SEQ ID NO: 483691 - DNA, 20 bp, Homo sapiens
gtatagcatgaaataaaata

SEQ ID NO: 483692 - DNA, 19 bp, Homo sapiens
gtatattaaaaaagagaca

SEQ ID NO: 483693 - DNA, 14 bp, Homo sapiens
gtattaccaaagca

SEQ ID NO: 483694 - DNA, 17 bp, Homo sapiens
gtcataaatgtcacaat

SEQ ID NO: 483695 - DNA, 20 bp, Homo sapiens
gtccaacccgaggcccgcat

SEQ ID NO: 483696 - DNA, 20 bp, Homo sapiens
gtcttctttgcccacaatgc

SEQ ID NO: 483697 - DNA, 15 bp, Homo sapiens
gtcttggatatatag

SEQ ID NO: 483698 - DNA, 23 bp, Homo sapiens
gtgctattttttatcattgaaac

SEQ ID NO: 483699 - DNA, 19 bp, Homo sapiens
gtgcttattaagaccaaag

SEQ ID NO: 483700 - DNA, 23 bp, Homo sapiens
gtgcttattaagaccaaagactt

SEQ ID NO: 483701 - DNA, 14 bp, Homo sapiens
gtgtatactgtaat

SEQ ID NO: 483702 - DNA, 14 bp, Homo sapiens
gtgttcttgcatgg

SEQ ID NO: 483703 - DNA, 23 bp, Homo sapiens
gttcaaaacaaccactttctcag

SEQ ID NO: 483704 - DNA, 14 bp, Homo sapiens
gttcagtagcttat

SEQ ID NO: 483705 - DNA, 16 bp, Homo sapiens
gttccaccaaatacaa

SEQ ID NO: 483706 - DNA, 20 bp, Homo sapiens
gtttgtcttggatatatagg

SEQ ID NO: 483707 - DNA, 12 bp, Homo sapiens
taaaaattgtta

SEQ ID NO: 483708 - DNA, 14 bp, Homo sapiens
taaaagaaataaac

SEQ ID NO: 483709 - DNA, 16 bp, Homo sapiens
taaaagaaataaacca

SEQ ID NO: 483710 - DNA, 19 bp, Homo sapiens
taaaagataacctttcttt

SEQ ID NO: 483711 - DNA, 17 bp, Homo sapiens
taaaagttgcattttaa

SEQ ID NO: 483712 - DNA, 21 bp, Homo sapiens
taaactctagatcagaattgt

SEQ ID NO: 483713 - DNA, 16 bp, Homo sapiens
taaactttgcttctcc

SEQ ID NO: 483714 - DNA, 23 bp, Homo sapiens
taaagacaggagacaaaagagca

SEQ ID NO: 483715 - DNA, 13 bp, Homo sapiens
taaagtaaataca

SEQ ID NO: 483716 - DNA, 22 bp, Homo sapiens
taaagtctcctggatttaaatt

SEQ ID NO: 483717 - DNA, 22 bp, Homo sapiens
taaataaagtctcctggattta

SEQ ID NO: 483718 - DNA, 17 bp, Homo sapiens
taaatcattcttactaa

SEQ ID NO: 483719 - DNA, 18 bp, Homo sapiens
taaatcctgaagagcatt

SEQ ID NO: 483720 - DNA, 18 bp, Homo sapiens
taactggagccccatcag

SEQ ID NO: 483721 - DNA, 19 bp, Homo sapiens
taacttccaaataaataat

SEQ ID NO: 483722 - DNA, 19 bp, Homo sapiens
taagacaaatattcctttg

SEQ ID NO: 483723 - DNA, 13 bp, Homo sapiens
taagaccaaagac

SEQ ID NO: 483724 - DNA, 14 bp, Homo sapiens
taagaccaaagact

SEQ ID NO: 483725 - DNA, 20 bp, Homo sapiens
taagtgtgtgtatactgtaa

SEQ ID NO: 483726 - DNA, 13 bp, Homo sapiens
taagttatctttg

SEQ ID NO: 483727 - DNA, 16 bp, Homo sapiens
taataaataaacttca

SEQ ID NO: 483728 - DNA, 19 bp, Homo sapiens
taataatgcccttaatgtg

SEQ ID NO: 483729 - DNA, 20 bp, Homo sapiens
taataatgcccttaatgtga

SEQ ID NO: 483730 - DNA, 22 bp, Homo sapiens
taatacattacatgtaaattaa

SEQ ID NO: 483731 - DNA, 18 bp, Homo sapiens
taatcgtgctatttttta

SEQ ID NO: 483732 - DNA, 19 bp, Homo sapiens
taatcttgtcaaccagtgc

SEQ ID NO: 483733 - DNA, 13 bp, Homo sapiens
taatgaaatggag

SEQ ID NO: 483734 - DNA, 15 bp, Homo sapiens
taatgaaatggagga

SEQ ID NO: 483735 - DNA, 17 bp, Homo sapiens
taatgcccttaatgtga

SEQ ID NO: 483736 - DNA, 14 bp, Homo sapiens
tacaagtattcagt

SEQ ID NO: 483737 - DNA, 18 bp, Homo sapiens
tacaatctttcaccaagt

SEQ ID NO: 483738 - DNA, 20 bp, Homo sapiens
tacaatctttcaccaagtaa

SEQ ID NO: 483739 - DNA, 12 bp, Homo sapiens
tacaattcaaat

SEQ ID NO: 483740 - DNA, 16 bp, Homo sapiens
tacaattcaaatgctt

SEQ ID NO: 483741 - DNA, 14 bp, Homo sapiens
tacatgcatataat

SEQ ID NO: 483742 - DNA, 16 bp, Homo sapiens
tacatgtggcccaaca

SEQ ID NO: 483743 - DNA, 15 bp, Homo sapiens
tacattacatgtaaa

SEQ ID NO: 483744 - DNA, 14 bp, Homo sapiens
taccctagttcaaa

SEQ ID NO: 483745 - DNA, 16 bp, Homo sapiens
tacctatttggtgcta

SEQ ID NO: 483746 - DNA, 21 bp, Homo sapiens
tactaaaaagtataaaatagt

SEQ ID NO: 483747 - DNA, 18 bp, Homo sapiens
tactgtaatcgtgctatt

SEQ ID NO: 483748 - DNA, 18 bp, Homo sapiens
tacttcattaatttcaat

SEQ ID NO: 483749 - DNA, 15 bp, Homo sapiens
tagagaatgtgttga

SEQ ID NO: 483750 - DNA, 12 bp, Homo sapiens
tagagtaatgaa

SEQ ID NO: 483751 - DNA, 15 bp, Homo sapiens
tagcatgaaataaaa

SEQ ID NO: 483752 - DNA, 13 bp, Homo sapiens
tagctaattattt

SEQ ID NO: 483753 - DNA, 20 bp, Homo sapiens
taggctattttctaaagact

SEQ ID NO: 483754 - DNA, 19 bp, Homo sapiens
tagttcaaaacaaccactt

SEQ ID NO: 483755 - DNA, 19 bp, Homo sapiens
tataaagtggaagtatgta

SEQ ID NO: 483756 - DNA, 12 bp, Homo sapiens
tataataaaaat

SEQ ID NO: 483757 - DNA, 14 bp, Homo sapiens
tataataaaaatat

SEQ ID NO: 483758 - DNA, 15 bp, Homo sapiens
tataatgaataaatc

SEQ ID NO: 483759 - DNA, 21 bp, Homo sapiens
tatacaccaagtggtaatgaa

SEQ ID NO: 483760 - DNA, 11 bp, Homo sapiens
tatactgtaat

SEQ ID NO: 483761 - DNA, 16 bp, Homo sapiens
tatagcatgaaataaa

SEQ ID NO: 483762 - DNA, 20 bp, Homo sapiens
tatagcatgaaataaaatat

SEQ ID NO: 483763 - DNA, 21 bp, Homo sapiens
tataggctattttctaaagac

SEQ ID NO: 483764 - DNA, 18 bp, Homo sapiens
tatattaaaaaagagaca

SEQ ID NO: 483765 - DNA, 15 bp, Homo sapiens
tatatttataaggaa

SEQ ID NO: 483766 - DNA, 14 bp, Homo sapiens
tatcaaaatagtct

SEQ ID NO: 483767 - DNA, 18 bp, Homo sapiens
tatcaaagtcattaaaga

SEQ ID NO: 483768 - DNA, 20 bp, Homo sapiens
tatcaaagtcattaaagaca

SEQ ID NO: 483769 - DNA, 16 bp, Homo sapiens
tatcaactgcttgtaa

SEQ ID NO: 483770 - DNA, 19 bp, Homo sapiens
tatcattgaaacatttata

SEQ ID NO: 483771 - DNA, 15 bp, Homo sapiens
tatctttgaatatgt

SEQ ID NO: 483772 - DNA, 14 bp, Homo sapiens
tatgaaaatggaaa

SEQ ID NO: 483773 - DNA, 22 bp, Homo sapiens
tatgagtataatacattacatg

SEQ ID NO: 483774 - DNA, 18 bp, Homo sapiens
tatgtagtatctatatga

SEQ ID NO: 483775 - DNA, 21 bp, Homo sapiens
tatgtgttgattcttgaaaac

SEQ ID NO: 483776 - DNA, 20 bp, Homo sapiens
tatgttgtttataataaaaa

SEQ ID NO: 483777 - DNA, 17 bp, Homo sapiens
tattaaaatatttcagg

SEQ ID NO: 483778 - DNA, 21 bp, Homo sapiens
tattctttgtattaccaaagc

SEQ ID NO: 483779 - DNA, 21 bp, Homo sapiens
tatttaaatcctgaagagcat

SEQ ID NO: 483780 - DNA, 15 bp, Homo sapiens
tatttatttccaaaa

SEQ ID NO: 483781 - DNA, 13 bp, Homo sapiens
tatttgattattt

SEQ ID NO: 483782 - DNA, 14 bp, Homo sapiens
tatttggtgctagt

SEQ ID NO: 483783 - DNA, 18 bp, Homo sapiens
tcaaactagatttataaa

SEQ ID NO: 483784 - DNA, 19 bp, Homo sapiens
tcaaccaaagttagttcag

SEQ ID NO: 483785 - DNA, 23 bp, Homo sapiens
tcaatcaaccaaagttagttcag

SEQ ID NO: 483786 - DNA, 14 bp, Homo sapiens
tcaatgagagcata

SEQ ID NO: 483787 - DNA, 15 bp, Homo sapiens
tcaatgtcataaatg

SEQ ID NO: 483788 - DNA, 16 bp, Homo sapiens
tcaatgtcataaatgt

SEQ ID NO: 483789 - DNA, 21 bp, Homo sapiens
tcaatgtcataaatgtcacaa

SEQ ID NO: 483790 - DNA, 20 bp, Homo sapiens
tcacttttggcaatgactca

SEQ ID NO: 483791 - DNA, 12 bp, Homo sapiens
tcagccaggagc

SEQ ID NO: 483792 - DNA, 13 bp, Homo sapiens
tcagccaggagct

SEQ ID NO: 483793 - DNA, 12 bp, Homo sapiens
tcagctccagct

SEQ ID NO: 483794 - DNA, 21 bp, Homo sapiens
agccatacataaaagaaataa

SEQ ID NO: 483795 - DNA, 23 bp, Homo sapiens
agccctccgccattctcaagccc

SEQ ID NO: 483796 - DNA, 19 bp, Homo sapiens
agctaagctaccttgtcat

SEQ ID NO: 483797 - DNA, 12 bp, Homo sapiens
agctaattattt

SEQ ID NO: 483798 - DNA, 16 bp, Homo sapiens
agctgctctgtcttct

SEQ ID NO: 483799 - DNA, 16 bp, Homo sapiens
agctgggcagaaggcc

SEQ ID NO: 483800 - DNA, 15 bp, Homo sapiens
agcttcagccaggag

SEQ ID NO: 483801 - DNA, 19 bp, Homo sapiens
agcttcagccaggagctgg

SEQ ID NO: 483802 - DNA, 20 bp, Homo sapiens
agcttcagccaggagctggg

SEQ ID NO: 483803 - DNA, 22 bp, Homo sapiens
agcttcagtaagttatctttga

SEQ ID NO: 483804 - DNA, 17 bp, Homo sapiens
agcttggaaaggaccag

SEQ ID NO: 483805 - DNA, 23 bp, Homo sapiens
agcttgtccaacccgaggcccgc

SEQ ID NO: 483806 - DNA, 23 bp, Homo sapiens
aggaaaatgtctgtaataataga

SEQ ID NO: 483807 - DNA, 14 bp, Homo sapiens
aggaagtgtttatg

SEQ ID NO: 483808 - DNA, 16 bp, Homo sapiens
aggagacaaaagagca

SEQ ID NO: 483809 - DNA, 22 bp, Homo sapiens
aggcctgtcctgacctgtctca

SEQ ID NO: 483810 - DNA, 17 bp, Homo sapiens
aggctgctcagggctgg

SEQ ID NO: 483811 - DNA, 14 bp, Homo sapiens
agggcataaagtaa

SEQ ID NO: 483812 - DNA, 20 bp, Homo sapiens
agggcataaagtaaatacat

SEQ ID NO: 483813 - DNA, 15 bp, Homo sapiens
aggttcttcagaagt

SEQ ID NO: 483814 - DNA, 16 bp, Homo sapiens
agtaagttatctttga

SEQ ID NO: 483815 - DNA, 20 bp, Homo sapiens
agtaagttatctttgaatat

SEQ ID NO: 483816 - DNA, 15 bp, Homo sapiens
agtaatgaaatggag

SEQ ID NO: 483817 - DNA, 20 bp, Homo sapiens
agtagatgtggcctttgaat

SEQ ID NO: 483818 - DNA, 21 bp, Homo sapiens
agtagatgtggcctttgaatt

SEQ ID NO: 483819 - DNA, 20 bp, Homo sapiens
agtagcttatctcagttatg

SEQ ID NO: 483820 - DNA, 13 bp, Homo sapiens
agtataaaatagt

SEQ ID NO: 483821 - DNA, 15 bp, Homo sapiens
agtatgtatattaaa

SEQ ID NO: 483822 - DNA, 18 bp, Homo sapiens
agtctcctggatttaaat

SEQ ID NO: 483823 - DNA, 21 bp, Homo sapiens
agtgagcttggaaaggaccag

SEQ ID NO: 483824 - DNA, 14 bp, Homo sapiens
agtgggagccaggg

SEQ ID NO: 483825 - DNA, 19 bp, Homo sapiens
agtgtgtgtatactgtaat

SEQ ID NO: 483826 - DNA, 13 bp, Homo sapiens
agttagttcagta

SEQ ID NO: 483827 - DNA, 18 bp, Homo sapiens
agttagttcagtagctta

SEQ ID NO: 483828 - DNA, 18 bp, Homo sapiens
agttatctttgaatatgt

SEQ ID NO: 483829 - DNA, 20 bp, Homo sapiens
agtttaccccttggctttgt

SEQ ID NO: 483830 - DNA, 21 bp, Homo sapiens
ataaaaactcaggcaaagaaa

SEQ ID NO: 483831 - DNA, 13 bp, Homo sapiens
ataaaagaaataa

SEQ ID NO: 483832 - DNA, 18 bp, Homo sapiens
ataaaatagtatgaaaat

SEQ ID NO: 483833 - DNA, 19 bp, Homo sapiens
ataaatcattcttactaaa

SEQ ID NO: 483834 - DNA, 20 bp, Homo sapiens
ataaatcattcttactaaaa

SEQ ID NO: 483835 - DNA, 21 bp, Homo sapiens
ataaatcattcttactaaaaa

SEQ ID NO: 483836 - DNA, 11 bp, Homo sapiens
ataataaaaat

SEQ ID NO: 483837 - DNA, 13 bp, Homo sapiens
ataataaaaatat

SEQ ID NO: 483838 - DNA, 18 bp, Homo sapiens
ataataaataaacttcaa

SEQ ID NO: 483839 - DNA, 22 bp, Homo sapiens
ataataatgcccttaatgtgag

SEQ ID NO: 483840 - DNA, 21 bp, Homo sapiens
ataatttaaaaatatatttat

SEQ ID NO: 483841 - DNA, 11 bp, Homo sapiens
atacaccaagt

SEQ ID NO: 483842 - DNA, 16 bp, Homo sapiens
atacataaaagaaata

SEQ ID NO: 483843 - DNA, 15 bp, Homo sapiens
atacatgcatataat

SEQ ID NO: 483844 - DNA, 10 bp, Homo sapiens
atactgtaat

SEQ ID NO: 483845 - DNA, 20 bp, Homo sapiens
atactgtaatcgtgctattt

SEQ ID NO: 483846 - DNA, 21 bp, Homo sapiens
atacttcattaatttcaatca

SEQ ID NO: 483847 - DNA, 19 bp, Homo sapiens
atagactgtaacttccaaa

SEQ ID NO: 483848 - DNA, 16 bp, Homo sapiens
atagcatgaaataaaa

SEQ ID NO: 483849 - DNA, 23 bp, Homo sapiens
ataggtacaatctttcaccaagt

SEQ ID NO: 483850 - DNA, 13 bp, Homo sapiens
atataagacaaat

SEQ ID NO: 483851 - DNA, 20 bp, Homo sapiens
atatataggctattttctaa

SEQ ID NO: 483852 - DNA, 13 bp, Homo sapiens
atattataaagga

SEQ ID NO: 483853 - DNA, 17 bp, Homo sapiens
atatttgcaaagtgtat

SEQ ID NO: 483854 - DNA, 12 bp, Homo sapiens
atcaaccaaagt

SEQ ID NO: 483855 - DNA, 17 bp, Homo sapiens
atcacagcatgtgcaat

SEQ ID NO: 483856 - DNA, 18 bp, Homo sapiens
atcacagcttcagccagg

SEQ ID NO: 483857 - DNA, 20 bp, Homo sapiens
atcaccagtgcatccttcat

SEQ ID NO: 483858 - DNA, 16 bp, Homo sapiens
atcattgaaacattta

SEQ ID NO: 483859 - DNA, 22 bp, Homo sapiens
atcattgaaacatttataaact

SEQ ID NO: 483860 - DNA, 22 bp, Homo sapiens
atccaaatttttttttaaagca

SEQ ID NO: 483861 - DNA, 15 bp, Homo sapiens
atccagagaccaaat

SEQ ID NO: 483862 - DNA, 17 bp, Homo sapiens
atccagagaccaaataa

SEQ ID NO: 483863 - DNA, 22 bp, Homo sapiens
atccctttttcataaattattt

SEQ ID NO: 483864 - DNA, 13 bp, Homo sapiens
atcctgaagagca

SEQ ID NO: 483865 - DNA, 15 bp, Homo sapiens
atcctgtaaaggtca

SEQ ID NO: 483866 - DNA, 21 bp, Homo sapiens
atcggccatcaagggaagaac

SEQ ID NO: 483867 - DNA, 14 bp, Homo sapiens
atgactcaaagtct

SEQ ID NO: 483868 - DNA, 18 bp, Homo sapiens
atgcatataatgaataaa

SEQ ID NO: 483869 - DNA, 16 bp, Homo sapiens
atgcggcccaggatgg

SEQ ID NO: 483870 - DNA, 21 bp, Homo sapiens
atggaggatctctaaagagca

SEQ ID NO: 483871 - DNA, 21 bp, Homo sapiens
atggcatccctttttcataaa

SEQ ID NO: 483872 - DNA, 20 bp, Homo sapiens
atggtacctatttggtgcta

SEQ ID NO: 483873 - DNA, 16 bp, Homo sapiens
atgtaaattaagtgtg

SEQ ID NO: 483874 - DNA, 14 bp, Homo sapiens
atgtatattaaaaa

SEQ ID NO: 483875 - DNA, 17 bp, Homo sapiens
atgtatattaaaaaaga

SEQ ID NO: 483876 - DNA, 21 bp, Homo sapiens
atgtatattaaaaaagagaca

SEQ ID NO: 483877 - DNA, 15 bp, Homo sapiens
gcctattgatacttg

SEQ ID NO: 483878 - DNA, 11 bp, Homo sapiens
gctaagctacc

SEQ ID NO: 483879 - DNA, 12 bp, Homo sapiens
gctagtaaattt

SEQ ID NO: 483880 - DNA, 18 bp, Homo sapiens
gctattttctaaagactt

SEQ ID NO: 483881 - DNA, 18 bp, Homo sapiens
gctattttttatcattga

SEQ ID NO: 483882 - DNA, 21 bp, Homo sapiens
gcttgtccaacccgaggcccg

SEQ ID NO: 483883 - DNA, 21 bp, Homo sapiens
ggacccttcccttgagccctc

SEQ ID NO: 483884 - DNA, 13 bp, Homo sapiens
ggagccagggctg

SEQ ID NO: 483885 - DNA, 14 bp, Homo sapiens
ggcccacacgtgca

SEQ ID NO: 483886 - DNA, 15 bp, Homo sapiens
ggcccagagaagcca

SEQ ID NO: 483887 - DNA, 24 bp, Homo sapiens
gggtaggggaagaagagctatcag

SEQ ID NO: 483888 - DNA, 20 bp, Homo sapiens
ggtaatacttccagaagtgc

SEQ ID NO: 483889 - DNA, 13 bp, Homo sapiens
ggtgctagtaaat

SEQ ID NO: 483890 - DNA, 17 bp, Homo sapiens
gtaaactttgcttctcc

SEQ ID NO: 483891 - DNA, 17 bp, Homo sapiens
gtaaaggtcaacaataa

SEQ ID NO: 483892 - DNA, 19 bp, Homo sapiens
gtaaaggtcaacaataaaa

SEQ ID NO: 483893 - DNA, 19 bp, Homo sapiens
gtaaattaagtgtgtgtat

SEQ ID NO: 483894 - DNA, 12 bp, Homo sapiens
gtaatggtgctt

SEQ ID NO: 483895 - DNA, 20 bp, Homo sapiens
gtaatggtgcttattaagac

SEQ ID NO: 483896 - DNA, 14 bp, Homo sapiens
gtacaatctttcac

SEQ ID NO: 483897 - DNA, 23 bp, Homo sapiens
gtacaatctttcaccaagtaaat

SEQ ID NO: 483898 - DNA, 20 bp, Homo sapiens
gtataatacattacatgtaa

SEQ ID NO: 483899 - DNA, 13 bp, Homo sapiens
gtatattaaaaaa

SEQ ID NO: 483900 - DNA, 19 bp, Homo sapiens
gtattcccattagaccaag

SEQ ID NO: 483901 - DNA, 19 bp, Homo sapiens
gtcaatgtcataaatgtca

SEQ ID NO: 483902 - DNA, 15 bp, Homo sapiens
gtcataaatgtcaca

SEQ ID NO: 483903 - DNA, 16 bp, Homo sapiens
gtcataaatgtcacaa

SEQ ID NO: 483904 - DNA, 14 bp, Homo sapiens
gtcattcctgtcaa

SEQ ID NO: 483905 - DNA, 20 bp, Homo sapiens
gtgcttattaagaccaaaga

SEQ ID NO: 483906 - DNA, 24 bp, Homo sapiens
gtggctggaaccacattgaagaat

SEQ ID NO: 483907 - DNA, 18 bp, Homo sapiens
gtggctgggtttacacgc

SEQ ID NO: 483908 - DNA, 20 bp, Homo sapiens
gtgtatactgtaatcgtgct

SEQ ID NO: 483909 - DNA, 18 bp, Homo sapiens
gttagttcagtagcttat

SEQ ID NO: 483910 - DNA, 17 bp, Homo sapiens
gttatcaaaatagtcta

SEQ ID NO: 483911 - DNA, 21 bp, Homo sapiens
gttccaccaaatacaattcaa

SEQ ID NO: 483912 - DNA, 19 bp, Homo sapiens
gttcccaccaggctgctca

SEQ ID NO: 483913 - DNA, 23 bp, Homo sapiens
gttctaatcttgtcaaccagtgc

SEQ ID NO: 483914 - DNA, 16 bp, Homo sapiens
gttgtttataataaaa

SEQ ID NO: 483915 - DNA, 19 bp, Homo sapiens
gtttgtaatggtgcttatt

SEQ ID NO: 483916 - DNA, 13 bp, Homo sapiens
taaaaagtataaa

SEQ ID NO: 483917 - DNA, 16 bp, Homo sapiens
taaaatagtatgaaaa

SEQ ID NO: 483918 - DNA, 12 bp, Homo sapiens
taaaattgttat

SEQ ID NO: 483919 - DNA, 16 bp, Homo sapiens
taaagaaggatgatgt

SEQ ID NO: 483920 - DNA, 20 bp, Homo sapiens
taaagagcatctgattcttg

SEQ ID NO: 483921 - DNA, 13 bp, Homo sapiens
taaatgcactgta

SEQ ID NO: 483922 - DNA, 22 bp, Homo sapiens
taaatgcactgtaatatgtaca

SEQ ID NO: 483923 - DNA, 14 bp, Homo sapiens
taaattaagtgtgt

SEQ ID NO: 483924 - DNA, 23 bp, Homo sapiens
taaattatttgattatttaagac

SEQ ID NO: 483925 - DNA, 21 bp, Homo sapiens
taaattttcaaactagattta

SEQ ID NO: 483926 - DNA, 18 bp, Homo sapiens
taagaatagtagatgtgg

SEQ ID NO: 483927 - DNA, 18 bp, Homo sapiens
taagctaccttgtcatat

SEQ ID NO: 483928 - DNA, 13 bp, Homo sapiens
taataaaatatca

SEQ ID NO: 483929 - DNA, 17 bp, Homo sapiens
taataatgcccttaatg

SEQ ID NO: 483930 - DNA, 16 bp, Homo sapiens
taatacattacatgta

SEQ ID NO: 483931 - DNA, 22 bp, Homo sapiens
taatagactgtaacttccaaat

SEQ ID NO: 483932 - DNA, 11 bp, Homo sapiens
taatggtgctt

SEQ ID NO: 483933 - DNA, 19 bp, Homo sapiens
taatggtgcttattaagac

SEQ ID NO: 483934 - DNA, 23 bp, Homo sapiens
taatggtgcttattaagaccaaa

SEQ ID NO: 483935 - DNA, 19 bp, Homo sapiens
taatgtgagggtttgtaat

SEQ ID NO: 483936 - DNA, 19 bp, Homo sapiens
taatttcaatcaaccaaag

SEQ ID NO: 483937 - DNA, 20 bp, Homo sapiens
taatttcaatcaaccaaagt

SEQ ID NO: 483938 - DNA, 17 bp, Homo sapiens
tacaaagttaaaattgt

SEQ ID NO: 483939 - DNA, 18 bp, Homo sapiens
tacaaagttaaaattgtt

SEQ ID NO: 483940 - DNA, 18 bp, Homo sapiens
tacaagggcataaagtaa

SEQ ID NO: 483941 - DNA, 19 bp, Homo sapiens
tacaatctttcaccaagta

SEQ ID NO: 483942 - DNA, 15 bp, Homo sapiens
tacaattcaaatgct

SEQ ID NO: 483943 - DNA, 10 bp, Homo sapiens
tacaccaagt

SEQ ID NO: 483944 - DNA, 13 bp, Homo sapiens
tacatgtaaatta

SEQ ID NO: 483945 - DNA, 13 bp, Homo sapiens
tacattacatgta

SEQ ID NO: 483946 - DNA, 23 bp, Homo sapiens
taccaattccaatttcaaaatgt

SEQ ID NO: 483947 - DNA, 17 bp, Homo sapiens
tacctagctaattattt

SEQ ID NO: 483948 - DNA, 15 bp, Homo sapiens
tactaaaaagtataa

SEQ ID NO: 483949 - DNA, 16 bp, Homo sapiens
tactaaaaagtataaa

SEQ ID NO: 483950 - DNA, 18 bp, Homo sapiens
tactaaaaagtataaaat

SEQ ID NO: 483951 - DNA, 19 bp, Homo sapiens
tactaaaaagtataaaata

SEQ ID NO: 483952 - DNA, 17 bp, Homo sapiens
tactgtaatcgtgctat

SEQ ID NO: 483953 - DNA, 19 bp, Homo sapiens
tagcttgataaagggccaa

SEQ ID NO: 483954 - DNA, 17 bp, Homo sapiens
tagtaaattttcaaact

SEQ ID NO: 483955 - DNA, 17 bp, Homo sapiens
tataaatgcactgtaat

SEQ ID NO: 483956 - DNA, 16 bp, Homo sapiens
tataatgaataaatca

SEQ ID NO: 483957 - DNA, 23 bp, Homo sapiens
tatactgtaatcgtgctattttt

SEQ ID NO: 483958 - DNA, 14 bp, Homo sapiens
tatataggctattt

SEQ ID NO: 483959 - DNA, 18 bp, Homo sapiens
tatataggctattttcta

SEQ ID NO: 483960 - DNA, 12 bp, Homo sapiens
tatcaaagtcat

SEQ ID NO: 483961 - DNA, 14 bp, Homo sapiens
tatcataggtacaa

SEQ ID NO: 483962 - DNA, 13 bp, Homo sapiens
tatcattgaaaca

SEQ ID NO: 483963 - DNA, 17 bp, Homo sapiens
tatcattgaaacattta

SEQ ID NO: 483964 - DNA, 22 bp, Homo sapiens
tatcttataaagtggaagtatg

SEQ ID NO: 483965 - DNA, 17 bp, Homo sapiens
tatgagtataatacatt

SEQ ID NO: 483966 - DNA, 21 bp, Homo sapiens
tatgataacaacactgtgtta

SEQ ID NO: 483967 - DNA, 15 bp, Homo sapiens
tattaagaccaaaga

SEQ ID NO: 483968 - DNA, 18 bp, Homo sapiens
tattataaaggataaaga

SEQ ID NO: 483969 - DNA, 20 bp, Homo sapiens
tattataaaggataaagaag

SEQ ID NO: 483970 - DNA, 17 bp, Homo sapiens
tattcagttccaatact

SEQ ID NO: 483971 - DNA, 14 bp, Homo sapiens
tatttatttccaaa

SEQ ID NO: 483972 - DNA, 13 bp, Homo sapiens
tatttggtgctag

SEQ ID NO: 483973 - DNA, 20 bp, Homo sapiens
tattttttatcattgaaaca

SEQ ID NO: 483974 - DNA, 24 bp, Homo sapiens
tattttttgcaaatttgtaaactt

SEQ ID NO: 483975 - DNA, 17 bp, Homo sapiens
tcaaagtcattaaagac

SEQ ID NO: 483976 - DNA, 21 bp, Homo sapiens
tcaaagtctgctctcatataa

SEQ ID NO: 483977 - DNA, 12 bp, Homo sapiens
tcaagccctgca

SEQ ID NO: 483978 - DNA, 13 bp, Homo sapiens
tcaagccctgcag

SEQ ID NO: 483979 - DNA, 19 bp, Homo sapiens
tcaatgagagcataattta

SEQ ID NO: 483980 - DNA, 21 bp, Homo sapiens
tcacactagcatagagaatgt

SEQ ID NO: 483981 - DNA, 16 bp, Homo sapiens
tcacagcatgtgcaat

SEQ ID NO: 483982 - DNA, 17 bp, Homo sapiens
tcacagcatgtgcaata

SEQ ID NO: 483983 - DNA, 22 bp, Homo sapiens
tcaccatccagagaccaaataa

SEQ ID NO: 483984 - DNA, 13 bp, Homo sapiens
tcaccctgtccaa

SEQ ID NO: 483985 - DNA, 12 bp, Homo sapiens
tcagagacactg

SEQ ID NO: 483986 - DNA, 19 bp, Homo sapiens
tcagccaggagctgggcag

SEQ ID NO: 483987 - DNA, 12 bp, Homo sapiens
tcaggcttctca

SEQ ID NO: 483988 - DNA, 17 bp, Homo sapiens
tcagttatgagtataat

SEQ ID NO: 483989 - DNA, 16 bp, Homo sapiens
tcataaatgtcacaat

SEQ ID NO: 483990 - DNA, 16 bp, Homo sapiens
atccagagaccaaata

SEQ ID NO: 483991 - DNA, 15 bp, Homo sapiens
atcccaacaaaaaaa

SEQ ID NO: 483992 - DNA, 20 bp, Homo sapiens
atcccgattcaccctgtcca

SEQ ID NO: 483993 - DNA, 18 bp, Homo sapiens
atctgcagagcaatgact

SEQ ID NO: 483994 - DNA, 13 bp, Homo sapiens
atctttcaccaag

SEQ ID NO: 483995 - DNA, 18 bp, Homo sapiens
atgaaatgcatatttgca

SEQ ID NO: 483996 - DNA, 13 bp, Homo sapiens
atgagagcataat

SEQ ID NO: 483997 - DNA, 20 bp, Homo sapiens
atgagagcataatttaaaaa

SEQ ID NO: 483998 - DNA, 12 bp, Homo sapiens
atgcactgtaat

SEQ ID NO: 483999 - DNA, 19 bp, Homo sapiens
atgcatataatgaataaat

SEQ ID NO: 484000 - DNA, 20 bp, Homo sapiens
atgcggcccaggatggcttt

SEQ ID NO: 484001 - DNA, 12 bp, Homo sapiens
atggaggcctgt

SEQ ID NO: 484002 - DNA, 22 bp, Homo sapiens
atggcatccctttttcataaat

SEQ ID NO: 484003 - DNA, 17 bp, Homo sapiens
atggttgatgatacttc

SEQ ID NO: 484004 - DNA, 15 bp, Homo sapiens
atgtaaattaagtgt

SEQ ID NO: 484005 - DNA, 14 bp, Homo sapiens
atgtagtatctata

SEQ ID NO: 484006 - DNA, 19 bp, Homo sapiens
atgtagtatctatatgact

SEQ ID NO: 484007 - DNA, 20 bp, Homo sapiens
atgtatattaaaaaagagac

SEQ ID NO: 484008 - DNA, 14 bp, Homo sapiens
atgtcataaatgtc

SEQ ID NO: 484009 - DNA, 18 bp, Homo sapiens
atgttgtttataataaaa

SEQ ID NO: 484010 - DNA, 14 bp, Homo sapiens
attaagtgtgtgta

SEQ ID NO: 484011 - DNA, 21 bp, Homo sapiens
attaatttcaatcaaccaaag

SEQ ID NO: 484012 - DNA, 23 bp, Homo sapiens
attacaaagttaaaattgttatc

SEQ ID NO: 484013 - DNA, 24 bp, Homo sapiens
attacaaagttaaaattgttatca

SEQ ID NO: 484014 - DNA, 11 bp, Homo sapiens
attacatgtaa

SEQ ID NO: 484015 - DNA, 22 bp, Homo sapiens
attacatgtaaattaagtgtgt

SEQ ID NO: 484016 - DNA, 21 bp, Homo sapiens
attatttgattatttaagact

SEQ ID NO: 484017 - DNA, 14 bp, Homo sapiens
attcagaacataaa

SEQ ID NO: 484018 - DNA, 17 bp, Homo sapiens
attcagaacataaatgc

SEQ ID NO: 484019 - DNA, 19 bp, Homo sapiens
attcagaacataaatgcac

SEQ ID NO: 484020 - DNA, 20 bp, Homo sapiens
attccaatttcaaaatgtct

SEQ ID NO: 484021 - DNA, 13 bp, Homo sapiens
attcctgtcaaca

SEQ ID NO: 484022 - DNA, 22 bp, Homo sapiens
attcttcttccaacgtggccca

SEQ ID NO: 484023 - DNA, 20 bp, Homo sapiens
attcttgttgctgtacaaaa

SEQ ID NO: 484024 - DNA, 18 bp, Homo sapiens
attgccttaactggagcc

SEQ ID NO: 484025 - DNA, 15 bp, Homo sapiens
atttaaaaatatatt

SEQ ID NO: 484026 - DNA, 20 bp, Homo sapiens
atttaaatcctgaagagcat

SEQ ID NO: 484027 - DNA, 15 bp, Homo sapiens
atttataaatgcact

SEQ ID NO: 484028 - DNA, 15 bp, Homo sapiens
atttcaatcaaccaa

SEQ ID NO: 484029 - DNA, 15 bp, Homo sapiens
atttccaaaatgttt

SEQ ID NO: 484030 - DNA, 19 bp, Homo sapiens
attttacctagctaattat

SEQ ID NO: 484031 - DNA, 22 bp, Homo sapiens
attttacctagctaattattta

SEQ ID NO: 484032 - DNA, 19 bp, Homo sapiens
caaacctcatatgtgaaat

SEQ ID NO: 484033 - DNA, 23 bp, Homo sapiens
caaactgcctaagccctccgcca

SEQ ID NO: 484034 - DNA, 17 bp, Homo sapiens
caaagacttgttaaatg

SEQ ID NO: 484035 - DNA, 16 bp, Homo sapiens
caaagtcattaaagac

SEQ ID NO: 484036 - DNA, 20 bp, Homo sapiens
caaagtctgctctcatataa

SEQ ID NO: 484037 - DNA, 22 bp, Homo sapiens
caaagtgtattaggaagtgttt

SEQ ID NO: 484038 - DNA, 16 bp, Homo sapiens
caaagttagttcagta

SEQ ID NO: 484039 - DNA, 17 bp, Homo sapiens
caaagttagttcagtag

SEQ ID NO: 484040 - DNA, 17 bp, Homo sapiens
caaataaataattttca

SEQ ID NO: 484041 - DNA, 14 bp, Homo sapiens
caaatacaattcaa

SEQ ID NO: 484042 - DNA, 16 bp, Homo sapiens
caaattcgcaaacttt

SEQ ID NO: 484043 - DNA, 23 bp, Homo sapiens
caacaaaaaaaatttaactccat

SEQ ID NO: 484044 - DNA, 18 bp, Homo sapiens
caacaaggggtcaatgtc

SEQ ID NO: 484045 - DNA, 13 bp, Homo sapiens
caacgtggcccag

SEQ ID NO: 484046 - DNA, 21 bp, Homo sapiens
caagaatttaaagaaatattt

SEQ ID NO: 484047 - DNA, 13 bp, Homo sapiens
caagtattcagtt

SEQ ID NO: 484048 - DNA, 21 bp, Homo sapiens
caagtgaccgacaaaattcca

SEQ ID NO: 484049 - DNA, 13 bp, Homo sapiens
caattgatggact

SEQ ID NO: 484050 - DNA, 15 bp, Homo sapiens
cacacagagctgaat

SEQ ID NO: 484051 - DNA, 14 bp, Homo sapiens
cacagatcacagct

SEQ ID NO: 484052 - DNA, 22 bp, Homo sapiens
cacagatcacagcttcagccag

SEQ ID NO: 484053 - DNA, 19 bp, Homo sapiens
cacagcttcagccaggagc

SEQ ID NO: 484054 - DNA, 22 bp, Homo sapiens
cacagcttcagccaggagctgg

SEQ ID NO: 484055 - DNA, 18 bp, Homo sapiens
caccaaatacaattcaaa

SEQ ID NO: 484056 - DNA, 18 bp, Homo sapiens
caccatgtacatagcttg

SEQ ID NO: 484057 - DNA, 22 bp, Homo sapiens
cacgctaatcccgattcaccct

SEQ ID NO: 484058 - DNA, 16 bp, Homo sapiens
cacttattgaatatat

SEQ ID NO: 484059 - DNA, 13 bp, Homo sapiens
cagaaggccaaga

SEQ ID NO: 484060 - DNA, 14 bp, Homo sapiens
cagaaggccaagag

SEQ ID NO: 484061 - DNA, 20 bp, Homo sapiens
cagaagtcacacattacaaa

SEQ ID NO: 484062 - DNA, 22 bp, Homo sapiens
cagaagtcacacattacaaagt

SEQ ID NO: 484063 - DNA, 24 bp, Homo sapiens
cagaatcatcatatcataggtaca

SEQ ID NO: 484064 - DNA, 21 bp, Homo sapiens
cagacagatggaaaagggaga

SEQ ID NO: 484065 - DNA, 12 bp, Homo sapiens
cagagaccaaat

SEQ ID NO: 484066 - DNA, 14 bp, Homo sapiens
cagagaccaaataa

SEQ ID NO: 484067 - DNA, 19 bp, Homo sapiens
cagagcaatgactgtgctc

SEQ ID NO: 484068 - DNA, 14 bp, Homo sapiens
cagccaggagctgg

SEQ ID NO: 484069 - DNA, 22 bp, Homo sapiens
cagccaggagctgggcagaagg

SEQ ID NO: 484070 - DNA, 14 bp, Homo sapiens
cagctccagctgct

SEQ ID NO: 484071 - DNA, 13 bp, Homo sapiens
caggagacaaaag

SEQ ID NO: 484072 - DNA, 12 bp, Homo sapiens
caggagctgggc

SEQ ID NO: 484073 - DNA, 17 bp, Homo sapiens
caggcaaagaaaatgaa

SEQ ID NO: 484074 - DNA, 14 bp, Homo sapiens
cagggaggtggctg

SEQ ID NO: 484075 - DNA, 17 bp, Homo sapiens
cagggaggtggctgggt

SEQ ID NO: 484076 - DNA, 22 bp, Homo sapiens
caggtgactaccctagttcaaa

SEQ ID NO: 484077 - DNA, 15 bp, Homo sapiens
cagtaaaagataacc

SEQ ID NO: 484078 - DNA, 18 bp, Homo sapiens
cagtaaaagataaccttt

SEQ ID NO: 484079 - DNA, 22 bp, Homo sapiens
cagtgagcttggaaaggaccag

SEQ ID NO: 484080 - DNA, 13 bp, Homo sapiens
cagtgggagccag

SEQ ID NO: 484081 - DNA, 17 bp, Homo sapiens
cagtggtaagaatagta

SEQ ID NO: 484082 - DNA, 20 bp, Homo sapiens
cagttatgagtataatacat

SEQ ID NO: 484083 - DNA, 16 bp, Homo sapiens
cataaaagaaataaac

SEQ ID NO: 484084 - DNA, 15 bp, Homo sapiens
cataaagtaaataca

SEQ ID NO: 484085 - DNA, 22 bp, Homo sapiens
cataaagtaaatacatgcatat

SEQ ID NO: 484086 - DNA, 15 bp, Homo sapiens
cataaatgtcacaat

SEQ ID NO: 484087 - DNA, 13 bp, Homo sapiens
cataatttaaaaa

SEQ ID NO: 484088 - DNA, 18 bp, Homo sapiens
cataatttaaaaatatat

SEQ ID NO: 484089 - DNA, 20 bp, Homo sapiens
cataatttaaaaatatattt

SEQ ID NO: 484090 - DNA, 13 bp, Homo sapiens
catacataaaaga

SEQ ID NO: 484091 - DNA, 18 bp, Homo sapiens
catacataaaagaaataa

SEQ ID NO: 484092 - DNA, 21 bp, Homo sapiens
catattataaaggataaagaa

SEQ ID NO: 484093 - DNA, 17 bp, Homo sapiens
catcacagcatgtgcaa

SEQ ID NO: 484094 - DNA, 14 bp, Homo sapiens
catcagctccagct

SEQ ID NO: 484095 - DNA, 18 bp, Homo sapiens
catcatatcataggtaca

SEQ ID NO: 484096 - DNA, 19 bp, Homo sapiens
catccagagaccaaataat

SEQ ID NO: 484097 - DNA, 14 bp, Homo sapiens
catccttccagcaa

SEQ ID NO: 484098 - DNA, 14 bp, Homo sapiens
catgaaataaaata

SEQ ID NO: 484099 - DNA, 18 bp, Homo sapiens
catgaaataaaatatatc

SEQ ID NO: 484100 - DNA, 14 bp, Homo sapiens
catgcatataatga

SEQ ID NO: 484101 - DNA, 17 bp, Homo sapiens
catggcatccctttttc

SEQ ID NO: 484102 - DNA, 17 bp, Homo sapiens
catgtaaattaagtgtg

SEQ ID NO: 484103 - DNA, 18 bp, Homo sapiens
cattagaccaagcttgtc

SEQ ID NO: 484104 - DNA, 20 bp, Homo sapiens
gcctgtcctgacctgtctca

SEQ ID NO: 484105 - DNA, 15 bp, Homo sapiens
gctataataaataaa

SEQ ID NO: 484106 - DNA, 17 bp, Homo sapiens
gctattttctaaagact

SEQ ID NO: 484107 - DNA, 22 bp, Homo sapiens
gctattttctaaagacttgtat

SEQ ID NO: 484108 - DNA, 20 bp, Homo sapiens
gctccagctgctctgtcttc

SEQ ID NO: 484109 - DNA, 20 bp, Homo sapiens
gcttatctcagttatgagta

SEQ ID NO: 484110 - DNA, 14 bp, Homo sapiens
gcttcagccaggag

SEQ ID NO: 484111 - DNA, 15 bp, Homo sapiens
gcttcagccaggagc

SEQ ID NO: 484112 - DNA, 22 bp, Homo sapiens
gcttctcatgtgtgtagctaag

SEQ ID NO: 484113 - DNA, 18 bp, Homo sapiens
ggaagtatgtatattaaa

SEQ ID NO: 484114 - DNA, 15 bp, Homo sapiens
ggagacaaaagagca

SEQ ID NO: 484115 - DNA, 14 bp, Homo sapiens
ggagattcagactg

SEQ ID NO: 484116 - DNA, 18 bp, Homo sapiens
ggagctgggcagaaggcc

SEQ ID NO: 484117 - DNA, 19 bp, Homo sapiens
ggagctgggcagaaggcca

SEQ ID NO: 484118 - DNA, 13 bp, Homo sapiens
ggaggtggctggg

SEQ ID NO: 484119 - DNA, 21 bp, Homo sapiens
ggatacgcatcagacagatgg

SEQ ID NO: 484120 - DNA, 23 bp, Homo sapiens
ggatgatgtctttttattaaaat

SEQ ID NO: 484121 - DNA, 23 bp, Homo sapiens
ggcccaacacaattcttcttcca

SEQ ID NO: 484122 - DNA, 18 bp, Homo sapiens
ggctattttctaaagact

SEQ ID NO: 484123 - DNA, 15 bp, Homo sapiens
ggctgctcagggctg

SEQ ID NO: 484124 - DNA, 18 bp, Homo sapiens
gggtcaatgtcataaatg

SEQ ID NO: 484125 - DNA, 15 bp, Homo sapiens
gggttctcacagtgg

SEQ ID NO: 484126 - DNA, 20 bp, Homo sapiens
ggtgcttattaagaccaaag

SEQ ID NO: 484127 - DNA, 23 bp, Homo sapiens
ggttctcacagtgggagccaggg

SEQ ID NO: 484128 - DNA, 17 bp, Homo sapiens
gtaaatttgtataaata

SEQ ID NO: 484129 - DNA, 18 bp, Homo sapiens
gtaacttccaaataaata

SEQ ID NO: 484130 - DNA, 22 bp, Homo sapiens
gtacacaacttagaaaccaaat

SEQ ID NO: 484131 - DNA, 18 bp, Homo sapiens
gtacctatttggtgctag

SEQ ID NO: 484132 - DNA, 15 bp, Homo sapiens
gtacgggaatgtgct

SEQ ID NO: 484133 - DNA, 19 bp, Homo sapiens
gtataatacattacatgta

SEQ ID NO: 484134 - DNA, 15 bp, Homo sapiens
gtataatttgacaaa

SEQ ID NO: 484135 - DNA, 19 bp, Homo sapiens
gtatactgtaatcgtgcta

SEQ ID NO: 484136 - DNA, 13 bp, Homo sapiens
gtattaccaaagc

SEQ ID NO: 484137 - DNA, 19 bp, Homo sapiens
gtcaacaaggggtcaatgt

SEQ ID NO: 484138 - DNA, 22 bp, Homo sapiens
gtcaacaaggggtcaatgtcat

SEQ ID NO: 484139 - DNA, 21 bp, Homo sapiens
gtcatatgtgttgattcttga

SEQ ID NO: 484140 - DNA, 15 bp, Homo sapiens
gtcattcctgtcaac

SEQ ID NO: 484141 - DNA, 16 bp, Homo sapiens
gtcctgacctgtctca

SEQ ID NO: 484142 - DNA, 15 bp, Homo sapiens
gtctcaatggtgcta

SEQ ID NO: 484143 - DNA, 17 bp, Homo sapiens
gtcttctttgcccacaa

SEQ ID NO: 484144 - DNA, 13 bp, Homo sapiens
gtgctagtaaatt

SEQ ID NO: 484145 - DNA, 15 bp, Homo sapiens
gttatttatttccaa

SEQ ID NO: 484146 - DNA, 18 bp, Homo sapiens
gttcagtagcttatctca

SEQ ID NO: 484147 - DNA, 15 bp, Homo sapiens
gttccaatacttcat

SEQ ID NO: 484148 - DNA, 15 bp, Homo sapiens
gttgtttataataaa

SEQ ID NO: 484149 - DNA, 18 bp, Homo sapiens
gttgtttataataaaaat

SEQ ID NO: 484150 - DNA, 16 bp, Homo sapiens
gtttgtaatggtgctt

SEQ ID NO: 484151 - DNA, 18 bp, Homo sapiens
taaaacttataaatttca

SEQ ID NO: 484152 - DNA, 16 bp, Homo sapiens
taaaattgttatcaaa

SEQ ID NO: 484153 - DNA, 17 bp, Homo sapiens
taaaggtcaacaataaa

SEQ ID NO: 484154 - DNA, 15 bp, Homo sapiens
taaatacatgcatat

SEQ ID NO: 484155 - DNA, 21 bp, Homo sapiens
taaatacatgcatataatgaa

SEQ ID NO: 484156 - DNA, 16 bp, Homo sapiens
taaatcctgaagagca

SEQ ID NO: 484157 - DNA, 10 bp, Homo sapiens
taaattattt

SEQ ID NO: 484158 - DNA, 22 bp, Homo sapiens
taaattatttgattatttaaga

SEQ ID NO: 484159 - DNA, 12 bp, Homo sapiens
taagaccaaaga

SEQ ID NO: 484160 - DNA, 15 bp, Homo sapiens
taagaccaaagactt

SEQ ID NO: 484161 - DNA, 21 bp, Homo sapiens
taataatgcccttaatgtgag

SEQ ID NO: 484162 - DNA, 14 bp, Homo sapiens
taatggtgcttatt

SEQ ID NO: 484163 - DNA, 18 bp, Homo sapiens
taatggtgcttattaaga

SEQ ID NO: 484164 - DNA, 14 bp, Homo sapiens
taatttaaaaatat

SEQ ID NO: 484165 - DNA, 15 bp, Homo sapiens
tacaatctttcacca

SEQ ID NO: 484166 - DNA, 16 bp, Homo sapiens
tacaatctttcaccaa

SEQ ID NO: 484167 - DNA, 14 bp, Homo sapiens
tacaattcaaatgc

SEQ ID NO: 484168 - DNA, 20 bp, Homo sapiens
tacacaacttagaaaccaaa

SEQ ID NO: 484169 - DNA, 14 bp, Homo sapiens
tacatgtaaattaa

SEQ ID NO: 484170 - DNA, 14 bp, Homo sapiens
tacattacatgtaa

SEQ ID NO: 484171 - DNA, 13 bp, Homo sapiens
taccaattccaat

SEQ ID NO: 484172 - DNA, 13 bp, Homo sapiens
taccctagttcaa

SEQ ID NO: 484173 - DNA, 14 bp, Homo sapiens
tacgggaatgtgct

SEQ ID NO: 484174 - DNA, 15 bp, Homo sapiens
tactgtaatcgtgct

SEQ ID NO: 484175 - DNA, 16 bp, Homo sapiens
tactgtaatcgtgcta

SEQ ID NO: 484176 - DNA, 14 bp, Homo sapiens
tagaaaccaaatta

SEQ ID NO: 484177 - DNA, 22 bp, Homo sapiens
tagatttataaatgcactgtaa

SEQ ID NO: 484178 - DNA, 16 bp, Homo sapiens
tagcatgaaataaaat

SEQ ID NO: 484179 - DNA, 17 bp, Homo sapiens
taggttgtccatttatg

SEQ ID NO: 484180 - DNA, 16 bp, Homo sapiens
tagtatctatatgact

SEQ ID NO: 484181 - DNA, 13 bp, Homo sapiens
tagtatgaaaatg

SEQ ID NO: 484182 - DNA, 20 bp, Homo sapiens
tagttcaaaacaaccacttt

SEQ ID NO: 484183 - DNA, 15 bp, Homo sapiens
tagttcagtagctta

SEQ ID NO: 484184 - DNA, 13 bp, Homo sapiens
tataataaaaata

SEQ ID NO: 484185 - DNA, 17 bp, Homo sapiens
tataatacattacatgt

SEQ ID NO: 484186 - DNA, 13 bp, Homo sapiens
tataatgaataaa

SEQ ID NO: 484187 - DNA, 15 bp, Homo sapiens
tatagataggtagaa

SEQ ID NO: 484188 - DNA, 13 bp, Homo sapiens
tataggctatttt

SEQ ID NO: 484189 - DNA, 15 bp, Homo sapiens
tatctgaaatcccaa

SEQ ID NO: 484190 - DNA, 23 bp, Homo sapiens
tatcttataaagtggaagtatgt

SEQ ID NO: 484191 - DNA, 19 bp, Homo sapiens
tatgagtataatacattac

SEQ ID NO: 484192 - DNA, 19 bp, Homo sapiens
tatggtacctatttggtgc

SEQ ID NO: 484193 - DNA, 14 bp, Homo sapiens
tatgtggttgttga

SEQ ID NO: 484194 - DNA, 20 bp, Homo sapiens
tatgtgttcctcttgttcta

SEQ ID NO: 484195 - DNA, 18 bp, Homo sapiens
tatgttgtttataataaa

SEQ ID NO: 484196 - DNA, 16 bp, Homo sapiens
tattaaaatatttcag

SEQ ID NO: 484197 - DNA, 13 bp, Homo sapiens
tattaagaccaaa

SEQ ID NO: 484198 - DNA, 19 bp, Homo sapiens
tattaggaagtgtttatgt

SEQ ID NO: 484199 - DNA, 16 bp, Homo sapiens
tattataaaggataaa

SEQ ID NO: 484200 - DNA, 15 bp, Homo sapiens
tattcagatgtatgt

SEQ ID NO: 484201 - DNA, 17 bp, Homo sapiens
tattgtgctcagagaca

SEQ ID NO: 484202 - DNA, 14 bp, Homo sapiens
tatttccaaaatgt

SEQ ID NO: 484203 - DNA, 18 bp, Homo sapiens
tatttggtgctagtaaat

SEQ ID NO: 484204 - DNA, 15 bp, Homo sapiens
tattttctaaagact

SEQ ID NO: 484205 - DNA, 21 bp, Homo sapiens
tattttttatcattgaaacat

SEQ ID NO: 484206 - DNA, 20 bp, Homo sapiens
tatttttttaccaattccaa

SEQ ID NO: 484207 - DNA, 22 bp, Homo sapiens
tcaaaacaaccactttctcagg

SEQ ID NO: 484208 - DNA, 21 bp, Homo sapiens
tcaaactagatttataaatgc

SEQ ID NO: 484209 - DNA, 12 bp, Homo sapiens
tcaaatgctttt

SEQ ID NO: 484210 - DNA, 17 bp, Homo sapiens
tcaaatgctttttgttt

SEQ ID NO: 484211 - DNA, 19 bp, Homo sapiens
tcaacaaggggtcaatgtc

SEQ ID NO: 484212 - DNA, 11 bp, Homo sapiens
tcaaccaaagt

SEQ ID NO: 484213 - DNA, 17 bp, Homo sapiens
tcaactggtcagaaaca

SEQ ID NO: 484214 - DNA, 16 bp, Homo sapiens
tcaatcaaccaaagtt

SEQ ID NO: 484215 - DNA, 24 bp, Homo sapiens
tcaatcaaccaaagttagttcagt

SEQ ID NO: 484216 - DNA, 20 bp, Homo sapiens
tcaatgtcataaatgtcaca

SEQ ID NO: 484217 - DNA, 14 bp, Homo sapiens
tcacacagacacta

SEQ ID NO: 484218 - DNA, 15 bp, Homo sapiens
tcacagcttcagcca

SEQ ID NO: 484219 - DNA, 19 bp, Homo sapiens
tcacagcttcagccaggag

SEQ ID NO: 484220 - DNA, 17 bp, Homo sapiens
tcacagtgggagccagg

SEQ ID NO: 484221 - DNA, 18 bp, Homo sapiens
tcacagtgggagccaggg

SEQ ID NO: 484222 - DNA, 16 bp, Homo sapiens
tcagaacataaatgca

SEQ ID NO: 484223 - DNA, 23 bp, Homo sapiens
tcagaacataaatgcacaaaatc

SEQ ID NO: 484224 - DNA, 19 bp, Homo sapiens
tcagttccaatacttcatt

SEQ ID NO: 484225 - DNA, 22 bp, Homo sapiens
tcataaattatttgattattta

SEQ ID NO: 484226 - DNA, 23 bp, Homo sapiens
tcataggtacaatctttcaccaa

SEQ ID NO: 484227 - DNA, 18 bp, Homo sapiens
tcatcacagcatgtgcaa

SEQ ID NO: 484228 - DNA, 13 bp, Homo sapiens
tcattcctgtcaa

SEQ ID NO: 484229 - DNA, 16 bp, Homo sapiens
tcattcctgtcaacaa

SEQ ID NO: 484230 - DNA, 16 bp, Homo sapiens
tcattgaaacatttat

SEQ ID NO: 484231 - DNA, 10 bp, Homo sapiens
tccaaaatgt

SEQ ID NO: 484232 - DNA, 20 bp, Homo sapiens
tccaaactgcctaagccctc

SEQ ID NO: 484233 - DNA, 16 bp, Homo sapiens
tccaatttcaaaatgt

SEQ ID NO: 484234 - DNA, 18 bp, Homo sapiens
tccaatttcaaaatgtct

SEQ ID NO: 484235 - DNA, 14 bp, Homo sapiens
tccaccaaatacaa

SEQ ID NO: 484236 - DNA, 15 bp, Homo sapiens
tccaccaaatacaat

SEQ ID NO: 484237 - DNA, 14 bp, Homo sapiens
tccagagaccaaat

SEQ ID NO: 484238 - DNA, 17 bp, Homo sapiens
tccagtttgtcttggat

SEQ ID NO: 484239 - DNA, 16 bp, Homo sapiens
tcccaacaaaaaaaat

SEQ ID NO: 484240 - DNA, 16 bp, Homo sapiens
tcctggatttaaatta

SEQ ID NO: 484241 - DNA, 13 bp, Homo sapiens
tctcaagccctgc

SEQ ID NO: 484242 - DNA, 22 bp, Homo sapiens
tctcacagtgggagccagggct

SEQ ID NO: 484243 - DNA, 12 bp, Homo sapiens
tctccaaataca

SEQ ID NO: 484244 - DNA, 15 bp, Homo sapiens
tctgaaatcccaaca

SEQ ID NO: 484245 - DNA, 19 bp, Homo sapiens
tctgtgaacaagcttcagt

SEQ ID NO: 484246 - DNA, 16 bp, Homo sapiens
tcttactaaaaagtat

SEQ ID NO: 484247 - DNA, 21 bp, Homo sapiens
tcttgaaaactgggacgtgta

SEQ ID NO: 484248 - DNA, 17 bp, Homo sapiens
tctttgtattaccaaag

SEQ ID NO: 484249 - DNA, 11 bp, Homo sapiens
tgaaaatggaa

SEQ ID NO: 484250 - DNA, 18 bp, Homo sapiens
tgaaatcccaacaaaaaa

SEQ ID NO: 484251 - DNA, 17 bp, Homo sapiens
tgaacaagcttcagtaa

SEQ ID NO: 484252 - DNA, 13 bp, Homo sapiens
tgaatgcggccca

SEQ ID NO: 484253 - DNA, 17 bp, Homo sapiens
tgacaaagaaaaatgat

SEQ ID NO: 484254 - DNA, 18 bp, Homo sapiens
tgaccgacaaaattccag

SEQ ID NO: 484255 - DNA, 17 bp, Homo sapiens
tgactaccctagttcaa

SEQ ID NO: 484256 - DNA, 14 bp, Homo sapiens
tgactcaaagtctg

SEQ ID NO: 484257 - DNA, 19 bp, Homo sapiens
tgactggcccacacgtgca

SEQ ID NO: 484258 - DNA, 13 bp, Homo sapiens
tgataaaaactca

SEQ ID NO: 484259 - DNA, 19 bp, Homo sapiens
tgatcccttgagatatgga

SEQ ID NO: 484260 - DNA, 20 bp, Homo sapiens
tgatggactactctattttt

SEQ ID NO: 484261 - DNA, 22 bp, Homo sapiens
tgattatttaagactaaaagtt

SEQ ID NO: 484262 - DNA, 22 bp, Homo sapiens
tgcaaatttgtaaactttgctt

SEQ ID NO: 484263 - DNA, 16 bp, Homo sapiens
tgcactgtaatatgta

SEQ ID NO: 484264 - DNA, 17 bp, Homo sapiens
tgcatataatgaataaa

SEQ ID NO: 484265 - DNA, 23 bp, Homo sapiens
tgcatattataaaggataaagaa

SEQ ID NO: 484266 - DNA, 19 bp, Homo sapiens
tgcattttaaccctatttt

SEQ ID NO: 484267 - DNA, 22 bp, Homo sapiens
tgccaagattaccctcggtcat

SEQ ID NO: 484268 - DNA, 13 bp, Homo sapiens
tgctagtaaattt

SEQ ID NO: 484269 - DNA, 21 bp, Homo sapiens
tgctagtaaattttcaaacta

SEQ ID NO: 484270 - DNA, 13 bp, Homo sapiens
tgctataataaat

SEQ ID NO: 484271 - DNA, 17 bp, Homo sapiens
tgcttattaagaccaaa

SEQ ID NO: 484272 - DNA, 15 bp, Homo sapiens
tgctttgcccctgag

SEQ ID NO: 484273 - DNA, 19 bp, Homo sapiens
tggaaccacattgaagaat

SEQ ID NO: 484274 - DNA, 22 bp, Homo sapiens
tggaagattggtttaaaaagaa

SEQ ID NO: 484275 - DNA, 22 bp, Homo sapiens
tggaagtatgtatattaaaaaa

SEQ ID NO: 484276 - DNA, 21 bp, Homo sapiens
tggcccacacgtgcatagagg

SEQ ID NO: 484277 - DNA, 17 bp, Homo sapiens
tgggcagaaggccaaga

SEQ ID NO: 484278 - DNA, 13 bp, Homo sapiens
tggttctgtgaac

SEQ ID NO: 484279 - DNA, 18 bp, Homo sapiens
tgtaaactttgcttctcc

SEQ ID NO: 484280 - DNA, 23 bp, Homo sapiens
tgtaaactttgcttctccaaata

SEQ ID NO: 484281 - DNA, 14 bp, Homo sapiens
tgtaaattaagtgt

SEQ ID NO: 484282 - DNA, 21 bp, Homo sapiens
tgtaaattaagtgtgtgtata

SEQ ID NO: 484283 - DNA, 20 bp, Homo sapiens
tgtaacttccaaataaataa

SEQ ID NO: 484284 - DNA, 16 bp, Homo sapiens
tgtaatcgtgctattt

SEQ ID NO: 484285 - DNA, 19 bp, Homo sapiens
tgtaatggtgcttattaag

SEQ ID NO: 484286 - DNA, 13 bp, Homo sapiens
tgtacaaaagcaa

SEQ ID NO: 484287 - DNA, 13 bp, Homo sapiens
tgtatacaccaag

SEQ ID NO: 484288 - DNA, 13 bp, Homo sapiens
tgtatagcatgaa

SEQ ID NO: 484289 - DNA, 15 bp, Homo sapiens
tgtccaaactgccta

SEQ ID NO: 484290 - DNA, 17 bp, Homo sapiens
tgtgagggtttgtaatg

SEQ ID NO: 484291 - DNA, 20 bp, Homo sapiens
tgtgagggtttgtaatggtg

SEQ ID NO: 484292 - DNA, 17 bp, Homo sapiens
tgtgtgtatactgtaat

SEQ ID NO: 484293 - DNA, 16 bp, Homo sapiens
tgttccaccaaataca

SEQ ID NO: 484294 - DNA, 20 bp, Homo sapiens
tgttcccaccaggctgctca

SEQ ID NO: 484295 - DNA, 15 bp, Homo sapiens
tgttgtttataataa

SEQ ID NO: 484296 - DNA, 16 bp, Homo sapiens
tgtttataataaaaat

SEQ ID NO: 484297 - DNA, 18 bp, Homo sapiens
tgtttatgttgtttataa

SEQ ID NO: 484298 - DNA, 13 bp, Homo sapiens
ttaaaaaagagac

SEQ ID NO: 484299 - DNA, 13 bp, Homo sapiens
ttaaatgtataca

SEQ ID NO: 484300 - DNA, 21 bp, Homo sapiens
ttaatgtgagggtttgtaatg

SEQ ID NO: 484301 - DNA, 12 bp, Homo sapiens
ttaattttcact

SEQ ID NO: 484302 - DNA, 21 bp, Homo sapiens
ttacaaagttaaaattgttat

SEQ ID NO: 484303 - DNA, 20 bp, Homo sapiens
ttacaagggcataaagtaaa

SEQ ID NO: 484304 - DNA, 14 bp, Homo sapiens
ttaccaattccaat

SEQ ID NO: 484305 - DNA, 20 bp, Homo sapiens
ttatcaaaatagtctaaggc

SEQ ID NO: 484306 - DNA, 23 bp, Homo sapiens
ttattaagaccaaagacttgtta

SEQ ID NO: 484307 - DNA, 19 bp, Homo sapiens
ttatttgattatttaagac

SEQ ID NO: 484308 - DNA, 20 bp, Homo sapiens
ttatttgattatttaagact

SEQ ID NO: 484309 - DNA, 18 bp, Homo sapiens
ttcaaatgctttttgttt

SEQ ID NO: 484310 - DNA, 15 bp, Homo sapiens
ttcaatcaaccaaag

SEQ ID NO: 484311 - DNA, 16 bp, Homo sapiens
ttcaatcaaccaaagt

SEQ ID NO: 484312 - DNA, 13 bp, Homo sapiens
ttcagatgtatgt

SEQ ID NO: 484313 - DNA, 17 bp, Homo sapiens
ttcagtagcttatctca

SEQ ID NO: 484314 - DNA, 21 bp, Homo sapiens
ttcattgccttaactggagcc

SEQ ID NO: 484315 - DNA, 14 bp, Homo sapiens
ttccaaataaataa

SEQ ID NO: 484316 - DNA, 15 bp, Homo sapiens
ttccaatttcaaaat

SEQ ID NO: 484317 - DNA, 16 bp, Homo sapiens
ttccagttatttattt

SEQ ID NO: 484318 - DNA, 23 bp, Homo sapiens
ttccagttatttatttccaaaat

SEQ ID NO: 484319 - DNA, 15 bp, Homo sapiens
ttctcaggcttctca

SEQ ID NO: 484320 - DNA, 18 bp, Homo sapiens
ttctttgtattaccaaag

SEQ ID NO: 484321 - DNA, 17 bp, Homo sapiens
ttgaaacatttataaac

SEQ ID NO: 484322 - DNA, 19 bp, Homo sapiens
ttgcatattataaaggata

SEQ ID NO: 484323 - DNA, 16 bp, Homo sapiens
ttgccttaactggagc

SEQ ID NO: 484324 - DNA, 17 bp, Homo sapiens
ttgctgtacaaaagcaa

SEQ ID NO: 484325 - DNA, 14 bp, Homo sapiens
ttggaaaggaccag

SEQ ID NO: 484326 - DNA, 21 bp, Homo sapiens
ttggcaatgactcaaagtctg

SEQ ID NO: 484327 - DNA, 18 bp, Homo sapiens
ttggcacttattgaatat

SEQ ID NO: 484328 - DNA, 21 bp, Homo sapiens
ttgggagagccatacataaaa

SEQ ID NO: 484329 - DNA, 14 bp, Homo sapiens
ttggttctgtgaac

SEQ ID NO: 484330 - DNA, 21 bp, Homo sapiens
ttgtaatggtgcttattaaga

SEQ ID NO: 484331 - DNA, 22 bp, Homo sapiens
ttgtatagcatgaaataaaata

SEQ ID NO: 484332 - DNA, 13 bp, Homo sapiens
ttgtcatatgtgt

SEQ ID NO: 484333 - DNA, 21 bp, Homo sapiens
ttgtccaacccgaggcccgca

SEQ ID NO: 484334 - DNA, 14 bp, Homo sapiens
ttgtccatttatgg

SEQ ID NO: 484335 - DNA, 15 bp, Homo sapiens
ttgtttataataaaa

SEQ ID NO: 484336 - DNA, 15 bp, Homo sapiens
tttaaaaattgttat

SEQ ID NO: 484337 - DNA, 20 bp, Homo sapiens
tttacaagggcataaagtaa

SEQ ID NO: 484338 - DNA, 14 bp, Homo sapiens
tttaccaattccaa

SEQ ID NO: 484339 - DNA, 14 bp, Homo sapiens
tttataataaaaat

SEQ ID NO: 484340 - DNA, 19 bp, Homo sapiens
tttataataaaaatatatt

SEQ ID NO: 484341 - DNA, 14 bp, Homo sapiens
tttattaaaatatt

SEQ ID NO: 484342 - DNA, 19 bp, Homo sapiens
tttcataaattatttgatt

SEQ ID NO: 484343 - DNA, 14 bp, Homo sapiens
tttgacaaagaaaa

SEQ ID NO: 484344 - DNA, 18 bp, Homo sapiens
tttgcactgaggatattc

SEQ ID NO: 484345 - DNA, 12 bp, Homo sapiens
tttgcttctcca

SEQ ID NO: 484346 - DNA, 12 bp, Homo sapiens
catttaaaaaaa

SEQ ID NO: 484347 - DNA, 12 bp, Homo sapiens
ccaaactgccta

SEQ ID NO: 484348 - DNA, 14 bp, Homo sapiens
ccaaagacttgtta

SEQ ID NO: 484349 - DNA, 16 bp, Homo sapiens
ccaaagcaaggtacag

SEQ ID NO: 484350 - DNA, 14 bp, Homo sapiens
ccaaagttagttca

SEQ ID NO: 484351 - DNA, 18 bp, Homo sapiens
ccaaatacaattcaaatg

SEQ ID NO: 484352 - DNA, 23 bp, Homo sapiens
ccaaattacaagtattcagttcc

SEQ ID NO: 484353 - DNA, 21 bp, Homo sapiens
ccaagaggctgttcccaccag

SEQ ID NO: 484354 - DNA, 19 bp, Homo sapiens
ccaatacttcattaatttc

SEQ ID NO: 484355 - DNA, 13 bp, Homo sapiens
ccaatttcaaaat

SEQ ID NO: 484356 - DNA, 20 bp, Homo sapiens
ccaccaaatacaattcaaat

SEQ ID NO: 484357 - DNA, 16 bp, Homo sapiens
ccagaagatgaaaaaa

SEQ ID NO: 484358 - DNA, 21 bp, Homo sapiens
ccaggagctgggcagaaggcc

SEQ ID NO: 484359 - DNA, 23 bp, Homo sapiens
ccaggagctgggcagaaggccaa

SEQ ID NO: 484360 - DNA, 14 bp, Homo sapiens
ccagtgcaagtgac

SEQ ID NO: 484361 - DNA, 19 bp, Homo sapiens
ccatccagagaccaaataa

SEQ ID NO: 484362 - DNA, 14 bp, Homo sapiens
ccatttatggtacc

SEQ ID NO: 484363 - DNA, 16 bp, Homo sapiens
cccaccaggctgctca

SEQ ID NO: 484364 - DNA, 12 bp, Homo sapiens
cccgaggcccgc

SEQ ID NO: 484365 - DNA, 17 bp, Homo sapiens
ccctagttcaaaacaac

SEQ ID NO: 484366 - DNA, 16 bp, Homo sapiens
ccctgagacaaatgga

SEQ ID NO: 484367 - DNA, 20 bp, Homo sapiens
ccctgagacaaatggaggcc

SEQ ID NO: 484368 - DNA, 14 bp, Homo sapiens
ccctgtccaaactg

SEQ ID NO: 484369 - DNA, 17 bp, Homo sapiens
cccttcccttgagccct

SEQ ID NO: 484370 - DNA, 13 bp, Homo sapiens
ccgattcaccctg

SEQ ID NO: 484371 - DNA, 15 bp, Homo sapiens
cctagctaattattt

SEQ ID NO: 484372 - DNA, 21 bp, Homo sapiens
cctagttcaaaacaaccactt

SEQ ID NO: 484373 - DNA, 23 bp, Homo sapiens
cctccgccattctcaagccctgc

SEQ ID NO: 484374 - DNA, 21 bp, Homo sapiens
cctgtcaacaaggggtcaatg

SEQ ID NO: 484375 - DNA, 19 bp, Homo sapiens
cctgtcctgacctgtctca

SEQ ID NO: 484376 - DNA, 23 bp, Homo sapiens
ccttaactggagccccatcagct

SEQ ID NO: 484377 - DNA, 14 bp, Homo sapiens
cgacaaaattccag

SEQ ID NO: 484378 - DNA, 18 bp, Homo sapiens
cgccattctcaagccctg

SEQ ID NO: 484379 - DNA, 20 bp, Homo sapiens
cgtacgggaatgtgctttca

SEQ ID NO: 484380 - DNA, 22 bp, Homo sapiens
cgtgctattttttatcattgaa

SEQ ID NO: 484381 - DNA, 15 bp, Homo sapiens
cgtggcccagagaag

SEQ ID NO: 484382 - DNA, 23 bp, Homo sapiens
ctaaggccatggcatcccttttt

SEQ ID NO: 484383 - DNA, 13 bp, Homo sapiens
ctagatttataaa

SEQ ID NO: 484384 - DNA, 15 bp, Homo sapiens
ctagctaattattta

SEQ ID NO: 484385 - DNA, 16 bp, Homo sapiens
ctagctaattatttaa

SEQ ID NO: 484386 - DNA, 23 bp, Homo sapiens
ctaggttgtccatttatggtacc

SEQ ID NO: 484387 - DNA, 15 bp, Homo sapiens
ctagtaaattttcaa

SEQ ID NO: 484388 - DNA, 20 bp, Homo sapiens
ctagttcaaaacaaccactt

SEQ ID NO: 484389 - DNA, 15 bp, Homo sapiens
ctataataaataaac

SEQ ID NO: 484390 - DNA, 12 bp, Homo sapiens
ctcaagccctgc

SEQ ID NO: 484391 - DNA, 16 bp, Homo sapiens
ctcaatggtgctataa

SEQ ID NO: 484392 - DNA, 19 bp, Homo sapiens
ctcacagtgggagccaggg

SEQ ID NO: 484393 - DNA, 17 bp, Homo sapiens
ctcagtggccagaggat

SEQ ID NO: 484394 - DNA, 13 bp, Homo sapiens
ctcatataagaca

SEQ ID NO: 484395 - DNA, 14 bp, Homo sapiens
ctctaaagagcatc

SEQ ID NO: 484396 - DNA, 21 bp, Homo sapiens
ctcttcttttttttagtttac

SEQ ID NO: 484397 - DNA, 21 bp, Homo sapiens
ctgaaggggttctcacagtgg

SEQ ID NO: 484398 - DNA, 13 bp, Homo sapiens
ctgcagtcacagc

SEQ ID NO: 484399 - DNA, 17 bp, Homo sapiens
ctggaaccacattgaag

SEQ ID NO: 484400 - DNA, 16 bp, Homo sapiens
ctgggcagaaggccaa

SEQ ID NO: 484401 - DNA, 20 bp, Homo sapiens
ctgtaacttccaaataaata

SEQ ID NO: 484402 - DNA, 15 bp, Homo sapiens
ctgtaatcgtgctat

SEQ ID NO: 484403 - DNA, 21 bp, Homo sapiens
ctgtgaacaagcttcagtaag

SEQ ID NO: 484404 - DNA, 18 bp, Homo sapiens
ctgttccaccaaatacaa

SEQ ID NO: 484405 - DNA, 19 bp, Homo sapiens
ctgttccaccaaatacaat

SEQ ID NO: 484406 - DNA, 18 bp, Homo sapiens
ctgttgataaaaactcag

SEQ ID NO: 484407 - DNA, 17 bp, Homo sapiens
ctgtttttcagggaggt

SEQ ID NO: 484408 - DNA, 21 bp, Homo sapiens
ctgtttttcagggaggtggct

SEQ ID NO: 484409 - DNA, 22 bp, Homo sapiens
cttacagacacccataataaaa

SEQ ID NO: 484410 - DNA, 13 bp, Homo sapiens
cttactaaaaagt

SEQ ID NO: 484411 - DNA, 14 bp, Homo sapiens
cttagaaaccaaat

SEQ ID NO: 484412 - DNA, 18 bp, Homo sapiens
cttagaaaccaaattaca

SEQ ID NO: 484413 - DNA, 16 bp, Homo sapiens
cttattaagaccaaag

SEQ ID NO: 484414 - DNA, 19 bp, Homo sapiens
cttattaagaccaaagact

SEQ ID NO: 484415 - DNA, 13 bp, Homo sapiens
cttattgaatata

SEQ ID NO: 484416 - DNA, 14 bp, Homo sapiens
cttcacacagacac

SEQ ID NO: 484417 - DNA, 19 bp, Homo sapiens
cttcatcctgtaaaggtca

SEQ ID NO: 484418 - DNA, 23 bp, Homo sapiens
cttcattaatttcaatcaaccaa

SEQ ID NO: 484419 - DNA, 16 bp, Homo sapiens
cttcccttgagccctc

SEQ ID NO: 484420 - DNA, 14 bp, Homo sapiens
cttctccaaataca

SEQ ID NO: 484421 - DNA, 18 bp, Homo sapiens
cttggcacttattgaata

SEQ ID NO: 484422 - DNA, 20 bp, Homo sapiens
cttggcacttattgaatata

SEQ ID NO: 484423 - DNA, 18 bp, Homo sapiens
cttgtcatatgtgttgat

SEQ ID NO: 484424 - DNA, 15 bp, Homo sapiens
cttgttctaatcttg

SEQ ID NO: 484425 - DNA, 17 bp, Homo sapiens
ctttctcaggcttctca

SEQ ID NO: 484426 - DNA, 22 bp, Homo sapiens
ctttctcaggcttctcatgtgt

SEQ ID NO: 484427 - DNA, 16 bp, Homo sapiens
ctttgaatgcggccca

SEQ ID NO: 484428 - DNA, 15 bp, Homo sapiens
ctttgcatattataa

SEQ ID NO: 484429 - DNA, 23 bp, Homo sapiens
cttttggcaatgactcaaagtct

SEQ ID NO: 484430 - DNA, 18 bp, Homo sapiens
ctttttaaaaattgttat

SEQ ID NO: 484431 - DNA, 15 bp, Homo sapiens
gaaacatttataaac

SEQ ID NO: 484432 - DNA, 16 bp, Homo sapiens
gaaataaaatatatct

SEQ ID NO: 484433 - DNA, 17 bp, Homo sapiens
gaaatagtcaaatacga

SEQ ID NO: 484434 - DNA, 16 bp, Homo sapiens
gaaatatcaaagtcat

SEQ ID NO: 484435 - DNA, 23 bp, Homo sapiens
gaatgttagagtaatgaaatgga

SEQ ID NO: 484436 - DNA, 19 bp, Homo sapiens
gaattctgtttaattttca

SEQ ID NO: 484437 - DNA, 13 bp, Homo sapiens
gacaaaattccag

SEQ ID NO: 484438 - DNA, 20 bp, Homo sapiens
gactatgcgtggctggaacc

SEQ ID NO: 484439 - DNA, 16 bp, Homo sapiens
gagacaaatggaggcc

SEQ ID NO: 484440 - DNA, 12 bp, Homo sapiens
gagagcataatt

SEQ ID NO: 484441 - DNA, 12 bp, Homo sapiens
gagcataattta

SEQ ID NO: 484442 - DNA, 16 bp, Homo sapiens
gaggctaaataaagtc

SEQ ID NO: 484443 - DNA, 20 bp, Homo sapiens
gagggtttgtaatggtgctt

SEQ ID NO: 484444 - DNA, 22 bp, Homo sapiens
gagtataatacattacatgtaa

SEQ ID NO: 484445 - DNA, 23 bp, Homo sapiens
gagtataatacattacatgtaaa

SEQ ID NO: 484446 - DNA, 16 bp, Homo sapiens
gatacgcatcagacag

SEQ ID NO: 484447 - DNA, 19 bp, Homo sapiens
gatacttcccacaccacaa

SEQ ID NO: 484448 - DNA, 19 bp, Homo sapiens
gatatataggctattttct

SEQ ID NO: 484449 - DNA, 19 bp, Homo sapiens
gatcacagcttcagccagg

SEQ ID NO: 484450 - DNA, 20 bp, Homo sapiens
gatcaccagtgcatccttca

SEQ ID NO: 484451 - DNA, 16 bp, Homo sapiens
gatgtctttttattaa

SEQ ID NO: 484452 - DNA, 19 bp, Homo sapiens
gatgtctttttattaaaat

SEQ ID NO: 484453 - DNA, 22 bp, Homo sapiens
gattggatacgcatcagacaga

SEQ ID NO: 484454 - DNA, 13 bp, Homo sapiens
gatttataaatgc

SEQ ID NO: 484455 - DNA, 18 bp, Homo sapiens
gattttacatgtggccca

SEQ ID NO: 484456 - DNA, 10 bp, Homo sapiens
gcactgtaat

SEQ ID NO: 484457 - DNA, 17 bp, Homo sapiens
gcacttattgaatatat

SEQ ID NO: 484458 - DNA, 19 bp, Homo sapiens
gcataatttaaaaatatat

SEQ ID NO: 484459 - DNA, 17 bp, Homo sapiens
gcatataatgaataaat

SEQ ID NO: 484460 - DNA, 16 bp, Homo sapiens
gcatattataaaggat

SEQ ID NO: 484461 - DNA, 22 bp, Homo sapiens
gcatccctttttcataaattat

SEQ ID NO: 484462 - DNA, 14 bp, Homo sapiens
gcatgaaataaaat

SEQ ID NO: 484463 - DNA, 16 bp, Homo sapiens
gccaagattaccctcg

SEQ ID NO: 484464 - DNA, 13 bp, Homo sapiens
gccaggagctggg

SEQ ID NO: 484465 - DNA, 18 bp, Homo sapiens
gccattctcaagccctgc

SEQ ID NO: 484466 - DNA, 13 bp, Homo sapiens
gcccagagaagcc

SEQ ID NO: 484467 - DNA, 17 bp, Homo sapiens
tttgtaaactttgcttc

SEQ ID NO: 484468 - DNA, 16 bp, Homo sapiens
tttgtaatggtgctta

SEQ ID NO: 484469 - DNA, 15 bp, Homo sapiens
ttttaccaattccaa

SEQ ID NO: 484470 - DNA, 16 bp, Homo sapiens
ttttaccaattccaat

SEQ ID NO: 484471 - DNA, 17 bp, Homo sapiens
ttttatcattgaaacat

SEQ ID NO: 484472 - DNA, 21 bp, Homo sapiens
aaactgggacgtgtatttcca

SEQ ID NO: 484473 - DNA, 22 bp, Homo sapiens
aaactttgcttctccaaataca

SEQ ID NO: 484474 - DNA, 14 bp, Homo sapiens
aaagacttgttaaa

SEQ ID NO: 484475 - DNA, 20 bp, Homo sapiens
aaagacttgttaaatgtata

SEQ ID NO: 484476 - DNA, 18 bp, Homo sapiens
aaagcttggttctgtgaa

SEQ ID NO: 484477 - DNA, 16 bp, Homo sapiens
aaaggaaaatgtctgt

SEQ ID NO: 484478 - DNA, 22 bp, Homo sapiens
aaaggataaagaaggatgatgt

SEQ ID NO: 484479 - DNA, 18 bp, Homo sapiens
aaagtaaatacatgcata

SEQ ID NO: 484480 - DNA, 16 bp, Homo sapiens
aaagtcattaaagaca

SEQ ID NO: 484481 - DNA, 17 bp, Homo sapiens
aaagttaaaattgttat

SEQ ID NO: 484482 - DNA, 11 bp, Homo sapiens
aaataaataat

SEQ ID NO: 484483 - DNA, 17 bp, Homo sapiens
aaatatatcttataaag

SEQ ID NO: 484484 - DNA, 12 bp, Homo sapiens
aaatatcaaagt

SEQ ID NO: 484485 - DNA, 14 bp, Homo sapiens
aaatatcaaagtca

SEQ ID NO: 484486 - DNA, 19 bp, Homo sapiens
aaatattcctttgcatatt

SEQ ID NO: 484487 - DNA, 19 bp, Homo sapiens
aaatcattcttactaaaaa

SEQ ID NO: 484488 - DNA, 21 bp, Homo sapiens
aaatcattcttactaaaaagt

SEQ ID NO: 484489 - DNA, 14 bp, Homo sapiens
aaatcccaacaaaa

SEQ ID NO: 484490 - DNA, 15 bp, Homo sapiens
aaatcctgaagagca

SEQ ID NO: 484491 - DNA, 15 bp, Homo sapiens
aaatgaaatgcatat

SEQ ID NO: 484492 - DNA, 12 bp, Homo sapiens
aaatggaaattt

SEQ ID NO: 484493 - DNA, 20 bp, Homo sapiens
aaatggaggatctctaaaga

SEQ ID NO: 484494 - DNA, 15 bp, Homo sapiens
aaatgtatacaccaa

SEQ ID NO: 484495 - DNA, 17 bp, Homo sapiens
aaatgtatacaccaagt

SEQ ID NO: 484496 - DNA, 13 bp, Homo sapiens
aaattaagtgtgt

SEQ ID NO: 484497 - DNA, 19 bp, Homo sapiens
aaattccagttatttattt

SEQ ID NO: 484498 - DNA, 22 bp, Homo sapiens
aaattccagttatttatttcca

SEQ ID NO: 484499 - DNA, 16 bp, Homo sapiens
aaattgttatcaaaat

SEQ ID NO: 484500 - DNA, 16 bp, Homo sapiens
aaatttgtaaactttg

SEQ ID NO: 484501 - DNA, 16 bp, Homo sapiens
aaatttgtataaataa

SEQ ID NO: 484502 - DNA, 19 bp, Homo sapiens
aaatttttttttaaagcag

SEQ ID NO: 484503 - DNA, 15 bp, Homo sapiens
aacaacactgtgtta

SEQ ID NO: 484504 - DNA, 12 bp, Homo sapiens
aacaagcttcag

SEQ ID NO: 484505 - DNA, 14 bp, Homo sapiens
aacaagcttcagta

SEQ ID NO: 484506 - DNA, 19 bp, Homo sapiens
aactctatctgaaatccca

SEQ ID NO: 484507 - DNA, 12 bp, Homo sapiens
aactggagcccc

SEQ ID NO: 484508 - DNA, 15 bp, Homo sapiens
aactgggacgtgtat

SEQ ID NO: 484509 - DNA, 21 bp, Homo sapiens
aactgggacgtgtatttccat

SEQ ID NO: 484510 - DNA, 16 bp, Homo sapiens
aacttataaatttcat

SEQ ID NO: 484511 - DNA, 22 bp, Homo sapiens
aactttgcttctccaaatacaa

SEQ ID NO: 484512 - DNA, 20 bp, Homo sapiens
aagaagagctatcaggagaa

SEQ ID NO: 484513 - DNA, 16 bp, Homo sapiens
aagaatgttagagtaa

SEQ ID NO: 484514 - DNA, 20 bp, Homo sapiens
aagaatgttagagtaatgaa

SEQ ID NO: 484515 - DNA, 13 bp, Homo sapiens
aagacaaatattc

SEQ ID NO: 484516 - DNA, 18 bp, Homo sapiens
aagacaggagacaaaaga

SEQ ID NO: 484517 - DNA, 11 bp, Homo sapiens
aagaccaaaga

SEQ ID NO: 484518 - DNA, 15 bp, Homo sapiens
aagagacatccaaat

SEQ ID NO: 484519 - DNA, 14 bp, Homo sapiens
aagagcatctgatt

SEQ ID NO: 484520 - DNA, 12 bp, Homo sapiens
aaggataaagaa

SEQ ID NO: 484521 - DNA, 15 bp, Homo sapiens
aagggcataaagtaa

SEQ ID NO: 484522 - DNA, 22 bp, Homo sapiens
aagtataaaatagtatgaaaat

SEQ ID NO: 484523 - DNA, 16 bp, Homo sapiens
aagtggaagtatgtat

SEQ ID NO: 484524 - DNA, 15 bp, Homo sapiens
aagtgtttatgttgt

SEQ ID NO: 484525 - DNA, 14 bp, Homo sapiens
aataaaaatatatt

SEQ ID NO: 484526 - DNA, 16 bp, Homo sapiens
aataaataattttcat

SEQ ID NO: 484527 - DNA, 21 bp, Homo sapiens
aataaatcattcttactaaaa

SEQ ID NO: 484528 - DNA, 17 bp, Homo sapiens
aatacaattcaaatgct

SEQ ID NO: 484529 - DNA, 14 bp, Homo sapiens
aatacttccagaag

SEQ ID NO: 484530 - DNA, 15 bp, Homo sapiens
aatacttccagaagt

SEQ ID NO: 484531 - DNA, 18 bp, Homo sapiens
aatagtatgaaaatggaa

SEQ ID NO: 484532 - DNA, 21 bp, Homo sapiens
aatatatttataaggaaattt

SEQ ID NO: 484533 - DNA, 20 bp, Homo sapiens
aatattcctttgcatattat

SEQ ID NO: 484534 - DNA, 13 bp, Homo sapiens
aatcaaccaaagt

SEQ ID NO: 484535 - DNA, 15 bp, Homo sapiens
aatgactgtgctcac

SEQ ID NO: 484536 - DNA, 12 bp, Homo sapiens
aatgagagcata

SEQ ID NO: 484537 - DNA, 23 bp, Homo sapiens
aatgcatatttgcaaagtgtatt

SEQ ID NO: 484538 - DNA, 20 bp, Homo sapiens
aatggaggatctctaaagag

SEQ ID NO: 484539 - DNA, 10 bp, Homo sapiens
aatggtgctt

SEQ ID NO: 484540 - DNA, 17 bp, Homo sapiens
aatggttgatgatactt

SEQ ID NO: 484541 - DNA, 19 bp, Homo sapiens
aatgtcataaatgtcacaa

SEQ ID NO: 484542 - DNA, 19 bp, Homo sapiens
aatgtctcaatggtgctat

SEQ ID NO: 484543 - DNA, 18 bp, Homo sapiens
aatgtctgtaataataga

SEQ ID NO: 484544 - DNA, 12 bp, Homo sapiens
aatgttagagta

SEQ ID NO: 484545 - DNA, 17 bp, Homo sapiens
aattacaagtattcagt

SEQ ID NO: 484546 - DNA, 19 bp, Homo sapiens
aattacaagtattcagttc

SEQ ID NO: 484547 - DNA, 19 bp, Homo sapiens
aattccaatttcaaaatgt

SEQ ID NO: 484548 - DNA, 17 bp, Homo sapiens
aatttaaaaatatattt

SEQ ID NO: 484549 - DNA, 20 bp, Homo sapiens
aatttcaatcaaccaaagtt

SEQ ID NO: 484550 - DNA, 12 bp, Homo sapiens
aatttgtaaact

SEQ ID NO: 484551 - DNA, 23 bp, Homo sapiens
aattttacaagggcataaagtaa

SEQ ID NO: 484552 - DNA, 18 bp, Homo sapiens
acaattattttaatattg

SEQ ID NO: 484553 - DNA, 21 bp, Homo sapiens
acacagacactaacgaaatat

SEQ ID NO: 484554 - DNA, 17 bp, Homo sapiens
acactaacgaaatatca

SEQ ID NO: 484555 - DNA, 22 bp, Homo sapiens
acactagcatagagaatgtgtt

SEQ ID NO: 484556 - DNA, 19 bp, Homo sapiens
acagacacccataataaaa

SEQ ID NO: 484557 - DNA, 20 bp, Homo sapiens
acagacacccataataaaat

SEQ ID NO: 484558 - DNA, 13 bp, Homo sapiens
acagctacacaga

SEQ ID NO: 484559 - DNA, 17 bp, Homo sapiens
acagcttcagccaggag

SEQ ID NO: 484560 - DNA, 18 bp, Homo sapiens
acagcttcagccaggagc

SEQ ID NO: 484561 - DNA, 22 bp, Homo sapiens
acagcttcagccaggagctggg

SEQ ID NO: 484562 - DNA, 18 bp, Homo sapiens
acaggagacaaaagagca

SEQ ID NO: 484563 - DNA, 13 bp, Homo sapiens
acagtataatttg

SEQ ID NO: 484564 - DNA, 19 bp, Homo sapiens
acatgccatccttccagca

SEQ ID NO: 484565 - DNA, 17 bp, Homo sapiens
acatggtctgtcaatga

SEQ ID NO: 484566 - DNA, 17 bp, Homo sapiens
acatgtaaattaagtgt

SEQ ID NO: 484567 - DNA, 13 bp, Homo sapiens
acattacatgtaa

SEQ ID NO: 484568 - DNA, 20 bp, Homo sapiens
accaaagacttgttaaatgt

SEQ ID NO: 484569 - DNA, 19 bp, Homo sapiens
accaaaggaaaatgtctgt

SEQ ID NO: 484570 - DNA, 16 bp, Homo sapiens
accaaagttagttcag

SEQ ID NO: 484571 - DNA, 14 bp, Homo sapiens
accaaattacaagt

SEQ ID NO: 484572 - DNA, 13 bp, Homo sapiens
accaagtaaattt

SEQ ID NO: 484573 - DNA, 11 bp, Homo sapiens
accaattccaa

SEQ ID NO: 484574 - DNA, 22 bp, Homo sapiens
accaattccaatttcaaaatgt

SEQ ID NO: 484575 - DNA, 21 bp, Homo sapiens
accactttctcaggcttctca

SEQ ID NO: 484576 - DNA, 18 bp, Homo sapiens
accatccagagaccaaat

SEQ ID NO: 484577 - DNA, 19 bp, Homo sapiens
accatccagagaccaaata

SEQ ID NO: 484578 - DNA, 19 bp, Homo sapiens
acccttcccttgagccctc

SEQ ID NO: 484579 - DNA, 15 bp, Homo sapiens
accgacaaaattcca

SEQ ID NO: 484580 - DNA, 17 bp, Homo sapiens
acgaaatatcaaagtca

SEQ ID NO: 484581 - DNA, 21 bp, Homo sapiens
actaaaaagtataaaatagta

SEQ ID NO: 484582 - DNA, 15 bp, Homo sapiens
actaccctagttcaa

SEQ ID NO: 484583 - DNA, 16 bp, Homo sapiens
actaccctagttcaaa

SEQ ID NO: 484584 - DNA, 23 bp, Homo sapiens
actagatttataaatgcactgta

SEQ ID NO: 484585 - DNA, 23 bp, Homo sapiens
actatgcgtggctggaaccacat

SEQ ID NO: 484586 - DNA, 22 bp, Homo sapiens
actgtaacttccaaataaataa

SEQ ID NO: 484587 - DNA, 16 bp, Homo sapiens
acttagaaaccaaatt

SEQ ID NO: 484588 - DNA, 20 bp, Homo sapiens
acttcattaatttcaatcaa

SEQ ID NO: 484589 - DNA, 16 bp, Homo sapiens
actttctcaggcttct

SEQ ID NO: 484590 - DNA, 17 bp, Homo sapiens
actttctcaggcttctc

SEQ ID NO: 484591 - DNA, 18 bp, Homo sapiens
ccacacgtgcatagaggt

SEQ ID NO: 484592 - DNA, 22 bp, Homo sapiens
ccaccaggctgctcagggctgg

SEQ ID NO: 484593 - DNA, 13 bp, Homo sapiens
ccagagaccaaat

SEQ ID NO: 484594 - DNA, 19 bp, Homo sapiens
ccaggctgctcagggctgg

SEQ ID NO: 484595 - DNA, 17 bp, Homo sapiens
ccattctcaagccctgc

SEQ ID NO: 484596 - DNA, 13 bp, Homo sapiens
cccaccaggctgc

SEQ ID NO: 484597 - DNA, 22 bp, Homo sapiens
cccaccaggctgctcagggctg

SEQ ID NO: 484598 - DNA, 13 bp, Homo sapiens
cccagagaagcca

SEQ ID NO: 484599 - DNA, 18 bp, Homo sapiens
cccatcagctccagctgc

SEQ ID NO: 484600 - DNA, 15 bp, Homo sapiens
cccgaggcccgcatg

SEQ ID NO: 484601 - DNA, 11 bp, Homo sapiens
ccctagttcaa

SEQ ID NO: 484602 - DNA, 23 bp, Homo sapiens
ccctgagacaaatggaggcctgt

SEQ ID NO: 484603 - DNA, 21 bp, Homo sapiens
ccctgtccaaactgcctaagc

SEQ ID NO: 484604 - DNA, 19 bp, Homo sapiens
cccttcccttgagccctct

SEQ ID NO: 484605 - DNA, 20 bp, Homo sapiens
ccgccattctcaagccctgc

SEQ ID NO: 484606 - DNA, 13 bp, Homo sapiens
cctgaagagcatt

SEQ ID NO: 484607 - DNA, 20 bp, Homo sapiens
cctgagacaaatggaggcct

SEQ ID NO: 484608 - DNA, 23 bp, Homo sapiens
cctgtccaaactgcctaagccct

SEQ ID NO: 484609 - DNA, 20 bp, Homo sapiens
ccttcattgccttaactgga

SEQ ID NO: 484610 - DNA, 16 bp, Homo sapiens
ccttcccttgagccct

SEQ ID NO: 484611 - DNA, 15 bp, Homo sapiens
ccttgtcatatgtgt

SEQ ID NO: 484612 - DNA, 15 bp, Homo sapiens
cgaaatatcaaagtc

SEQ ID NO: 484613 - DNA, 13 bp, Homo sapiens
cgacaaaattcca

SEQ ID NO: 484614 - DNA, 16 bp, Homo sapiens
cgattcaccctgtcca

SEQ ID NO: 484615 - DNA, 21 bp, Homo sapiens
cgattcaccctgtccaaactg

SEQ ID NO: 484616 - DNA, 16 bp, Homo sapiens
cgcatgcggcccagga

SEQ ID NO: 484617 - DNA, 19 bp, Homo sapiens
cggtcattcctgtcaacaa

SEQ ID NO: 484618 - DNA, 16 bp, Homo sapiens
cgtacgggaatgtgct

SEQ ID NO: 484619 - DNA, 16 bp, Homo sapiens
cgtggcccagagaagc

SEQ ID NO: 484620 - DNA, 16 bp, Homo sapiens
ctaaaaagtataaaat

SEQ ID NO: 484621 - DNA, 12 bp, Homo sapiens
ctaaataaagtc

SEQ ID NO: 484622 - DNA, 19 bp, Homo sapiens
ctaagctaccttgtcatat

SEQ ID NO: 484623 - DNA, 18 bp, Homo sapiens
ctaattatttaattgtcc

SEQ ID NO: 484624 - DNA, 14 bp, Homo sapiens
ctagctaattattt

SEQ ID NO: 484625 - DNA, 22 bp, Homo sapiens
ctattctttgtattaccaaagc

SEQ ID NO: 484626 - DNA, 22 bp, Homo sapiens
ctattttttatcattgaaacat

SEQ ID NO: 484627 - DNA, 18 bp, Homo sapiens
ctcacagtgggagccagg

SEQ ID NO: 484628 - DNA, 15 bp, Homo sapiens
ctcacttgtttttct

SEQ ID NO: 484629 - DNA, 18 bp, Homo sapiens
ctctatctgaaatcccaa

SEQ ID NO: 484630 - DNA, 22 bp, Homo sapiens
ctctttatgataacaacactgt

SEQ ID NO: 484631 - DNA, 12 bp, Homo sapiens
ctgaagagcatt

SEQ ID NO: 484632 - DNA, 17 bp, Homo sapiens
ctgagacaaatggaggc

SEQ ID NO: 484633 - DNA, 22 bp, Homo sapiens
ctgaggatattcagatgtatgt

SEQ ID NO: 484634 - DNA, 14 bp, Homo sapiens
ctgcagtcacagct

SEQ ID NO: 484635 - DNA, 13 bp, Homo sapiens
ctgcctaagccct

SEQ ID NO: 484636 - DNA, 13 bp, Homo sapiens
ctggagccccatc

SEQ ID NO: 484637 - DNA, 19 bp, Homo sapiens
ctgtaacttccaaataaat

SEQ ID NO: 484638 - DNA, 12 bp, Homo sapiens
ctgtaataatag

SEQ ID NO: 484639 - DNA, 14 bp, Homo sapiens
ctgtaatatgtaca

SEQ ID NO: 484640 - DNA, 15 bp, Homo sapiens
ctgtccaaactgcct

SEQ ID NO: 484641 - DNA, 18 bp, Homo sapiens
ctgtcctgacctgtctca

SEQ ID NO: 484642 - DNA, 20 bp, Homo sapiens
ctgttccaccaaatacaatt

SEQ ID NO: 484643 - DNA, 15 bp, Homo sapiens
ctgttgataaaaact

SEQ ID NO: 484644 - DNA, 15 bp, Homo sapiens
cttactaaaaagtat

SEQ ID NO: 484645 - DNA, 17 bp, Homo sapiens
cttcagccaggagctgg

SEQ ID NO: 484646 - DNA, 18 bp, Homo sapiens
cttcagccaggagctggg

SEQ ID NO: 484647 - DNA, 15 bp, Homo sapiens
cttcattaatttcaa

SEQ ID NO: 484648 - DNA, 14 bp, Homo sapiens
cttccaaataaata

SEQ ID NO: 484649 - DNA, 15 bp, Homo sapiens
cttcccttgagccct

SEQ ID NO: 484650 - DNA, 22 bp, Homo sapiens
cttgtatgtggttgttgatctt

SEQ ID NO: 484651 - DNA, 20 bp, Homo sapiens
cttgtccaacccgaggcccg

SEQ ID NO: 484652 - DNA, 16 bp, Homo sapiens
ctttctgaaatagtca

SEQ ID NO: 484653 - DNA, 23 bp, Homo sapiens
ctttgaatatgtagtatctatat

SEQ ID NO: 484654 - DNA, 13 bp, Homo sapiens
ctttgcatattat

SEQ ID NO: 484655 - DNA, 14 bp, Homo sapiens
ctttgcccacaatg

SEQ ID NO: 484656 - DNA, 23 bp, Homo sapiens
ctttgcttctccaaatacaagta

SEQ ID NO: 484657 - DNA, 18 bp, Homo sapiens
ctttttattaaaatattt

SEQ ID NO: 484658 - DNA, 18 bp, Homo sapiens
ctttttcataaattattt

SEQ ID NO: 484659 - DNA, 22 bp, Homo sapiens
ctttttttctctgcatttaaaa

SEQ ID NO: 484660 - DNA, 14 bp, Homo sapiens
gaaaatgaaatgca

SEQ ID NO: 484661 - DNA, 19 bp, Homo sapiens
gaaacagtataatttgaca

SEQ ID NO: 484662 - DNA, 24 bp, Homo sapiens
gaaatggaggatctctaaagagca

SEQ ID NO: 484663 - DNA, 18 bp, Homo sapiens
gaacaagcttcagtaagt

SEQ ID NO: 484664 - DNA, 19 bp, Homo sapiens
gaatatgtagtatctatat

SEQ ID NO: 484665 - DNA, 14 bp, Homo sapiens
gacaaaattccagt

SEQ ID NO: 484666 - DNA, 17 bp, Homo sapiens
gacactgttgataaaaa

SEQ ID NO: 484667 - DNA, 19 bp, Homo sapiens
gacccttcccttgagccct

SEQ ID NO: 484668 - DNA, 22 bp, Homo sapiens
gacttgtatagcatgaaataaa

SEQ ID NO: 484669 - DNA, 18 bp, Homo sapiens
gagaagccaaaagattgg

SEQ ID NO: 484670 - DNA, 20 bp, Homo sapiens
gagacactgttgataaaaac

SEQ ID NO: 484671 - DNA, 10 bp, Homo sapiens
gagaccaaat

SEQ ID NO: 484672 - DNA, 16 bp, Homo sapiens
gagagccatacataaa

SEQ ID NO: 484673 - DNA, 20 bp, Homo sapiens
gagcataatttaaaaatata

SEQ ID NO: 484674 - DNA, 18 bp, Homo sapiens
gagccccatcagctccag

SEQ ID NO: 484675 - DNA, 12 bp, Homo sapiens
gaggctaaataa

SEQ ID NO: 484676 - DNA, 17 bp, Homo sapiens
gaggctgttcccaccag

SEQ ID NO: 484677 - DNA, 21 bp, Homo sapiens
gatatataggctattttctaa

SEQ ID NO: 484678 - DNA, 15 bp, Homo sapiens
gatattcagatgtat

SEQ ID NO: 484679 - DNA, 22 bp, Homo sapiens
gatcggccatcaagggaagaac

SEQ ID NO: 484680 - DNA, 23 bp, Homo sapiens
gatgtctttttattaaaatattt

SEQ ID NO: 484681 - DNA, 17 bp, Homo sapiens
gatttataaatgcactg

SEQ ID NO: 484682 - DNA, 18 bp, Homo sapiens
gatttataaatgcactgt

SEQ ID NO: 484683 - DNA, 21 bp, Homo sapiens
gatttataaatgcactgtaat

SEQ ID NO: 484684 - DNA, 22 bp, Homo sapiens
gcaagtgaccgacaaaattcca

SEQ ID NO: 484685 - DNA, 18 bp, Homo sapiens
gcatataatgaataaatc

SEQ ID NO: 484686 - DNA, 23 bp, Homo sapiens
gcatattataaaggataaagaag

SEQ ID NO: 484687 - DNA, 18 bp, Homo sapiens
gcatccttcatcacagca

SEQ ID NO: 484688 - DNA, 15 bp, Homo sapiens
gcatgcggcccagga

SEQ ID NO: 484689 - DNA, 17 bp, Homo sapiens
gcattcagaacataaat

SEQ ID NO: 484690 - DNA, 22 bp, Homo sapiens
gccaggagctgggcagaaggcc

SEQ ID NO: 484691 - DNA, 19 bp, Homo sapiens
gccatacataaaagaaata

SEQ ID NO: 484692 - DNA, 16 bp, Homo sapiens
gccattctcaagccct

SEQ ID NO: 484693 - DNA, 15 bp, Homo sapiens
gcccaggatggcttt

SEQ ID NO: 484694 - DNA, 15 bp, Homo sapiens
gccccatcagctcca

SEQ ID NO: 484695 - DNA, 16 bp, Homo sapiens
gccccatcagctccag

SEQ ID NO: 484696 - DNA, 17 bp, Homo sapiens
gcctcagtggccagagg

SEQ ID NO: 484697 - DNA, 16 bp, Homo sapiens
gctagtaaattttcaa

SEQ ID NO: 484698 - DNA, 16 bp, Homo sapiens
gctatcaggagaaagc

SEQ ID NO: 484699 - DNA, 21 bp, Homo sapiens
gctccagctgctctgtcttct

SEQ ID NO: 484700 - DNA, 16 bp, Homo sapiens
gctgttccaccaaata

SEQ ID NO: 484701 - DNA, 19 bp, Homo sapiens
gcttcagccaggagctggg

SEQ ID NO: 484702 - DNA, 13 bp, Homo sapiens
gcttctccaaata

SEQ ID NO: 484703 - DNA, 20 bp, Homo sapiens
gcttctccaaatacaagtac

SEQ ID NO: 484704 - DNA, 15 bp, Homo sapiens
gcttggttctgtgaa

SEQ ID NO: 484705 - DNA, 21 bp, Homo sapiens
ggagagccatacataaaagaa

SEQ ID NO: 484706 - DNA, 19 bp, Homo sapiens
ggatatataggctattttc

SEQ ID NO: 484707 - DNA, 22 bp, Homo sapiens
ggcatccctttttcataaatta

SEQ ID NO: 484708 - DNA, 13 bp, Homo sapiens
ggccaagaggctg

SEQ ID NO: 484709 - DNA, 22 bp, Homo sapiens
tttcaattgatggactactcta

SEQ ID NO: 484710 - DNA, 19 bp, Homo sapiens
tttcagggaggtggctggg

SEQ ID NO: 484711 - DNA, 22 bp, Homo sapiens
tttcagggaggtggctgggttt

SEQ ID NO: 484712 - DNA, 18 bp, Homo sapiens
tttcataaattatttgat

SEQ ID NO: 484713 - DNA, 17 bp, Homo sapiens
tttcattgattaatctc

SEQ ID NO: 484714 - DNA, 12 bp, Homo sapiens
tttctaaagact

SEQ ID NO: 484715 - DNA, 15 bp, Homo sapiens
tttctgaaatagtca

SEQ ID NO: 484716 - DNA, 14 bp, Homo sapiens
tttgaatatgtagt

SEQ ID NO: 484717 - DNA, 11 bp, Homo sapiens
tttgcttctcc

SEQ ID NO: 484718 - DNA, 24 bp, Homo sapiens
tttggaaacagtataatttgacaa

SEQ ID NO: 484719 - DNA, 24 bp, Homo sapiens
tttgttttatttttttaccaattc

SEQ ID NO: 484720 - DNA, 14 bp, Homo sapiens
ttttaccaattcca

SEQ ID NO: 484721 - DNA, 21 bp, Homo sapiens
ttttatcattgaaacatttat

SEQ ID NO: 484722 - DNA, 19 bp, Homo sapiens
ttttattaaaatatttcag

SEQ ID NO: 484723 - DNA, 18 bp, Homo sapiens
ttttatttttttaccaat

SEQ ID NO: 484724 - DNA, 23 bp, Homo sapiens
ttttcataaattatttgattatt

SEQ ID NO: 484725 - DNA, 20 bp, Homo sapiens
ttttctctgcatttaaaaaa

SEQ ID NO: 484726 - DNA, 22 bp, Homo sapiens
ttttggcaatgactcaaagtct

SEQ ID NO: 484727 - DNA, 22 bp, Homo sapiens
ttttttgcaaatttgtaaactt

SEQ ID NO: 484728 - DNA, 12 bp, Homo sapiens
aaaaaagagaca

SEQ ID NO: 484729 - DNA, 15 bp, Homo sapiens
aaaagcaatggttga

SEQ ID NO: 484730 - DNA, 17 bp, Homo sapiens
aaaagttgcattttaac

SEQ ID NO: 484731 - DNA, 17 bp, Homo sapiens
aaaatcccccagcactt

SEQ ID NO: 484732 - DNA, 22 bp, Homo sapiens
aaaatgtctcaatggtgctata

SEQ ID NO: 484733 - DNA, 14 bp, Homo sapiens
aaacagtataattt

SEQ ID NO: 484734 - DNA, 22 bp, Homo sapiens
aaaccaaattacaagtattcag

SEQ ID NO: 484735 - DNA, 18 bp, Homo sapiens
aaactagatttataaatg

SEQ ID NO: 484736 - DNA, 13 bp, Homo sapiens
aaaggataaagaa

SEQ ID NO: 484737 - DNA, 14 bp, Homo sapiens
aaaggataaagaag

SEQ ID NO: 484738 - DNA, 15 bp, Homo sapiens
aaagtggaagtatgt

SEQ ID NO: 484739 - DNA, 14 bp, Homo sapiens
aaataaataatttt

SEQ ID NO: 484740 - DNA, 12 bp, Homo sapiens
aaataagcacta

SEQ ID NO: 484741 - DNA, 19 bp, Homo sapiens
aaatacaattcaaatgctt

SEQ ID NO: 484742 - DNA, 16 bp, Homo sapiens
aaatagtatgaaaatg

SEQ ID NO: 484743 - DNA, 19 bp, Homo sapiens
aaatagtatgaaaatggaa

SEQ ID NO: 484744 - DNA, 21 bp, Homo sapiens
aaatatcaaagtcattaaaga

SEQ ID NO: 484745 - DNA, 14 bp, Homo sapiens
aaatgcactgtaat

SEQ ID NO: 484746 - DNA, 14 bp, Homo sapiens
aaatgctttttgtt

SEQ ID NO: 484747 - DNA, 23 bp, Homo sapiens
aaatggaggatctctaaagagca

SEQ ID NO: 484748 - DNA, 13 bp, Homo sapiens
aagttaaaattgt

SEQ ID NO: 484749 - DNA, 21 bp, Homo sapiens
aagttagttcagtagcttatc

SEQ ID NO: 484750 - DNA, 14 bp, Homo sapiens
aagttatctttgaa

SEQ ID NO: 484751 - DNA, 15 bp, Homo sapiens
aagttatctttgaat

SEQ ID NO: 484752 - DNA, 11 bp, Homo sapiens
aataaaaatat

SEQ ID NO: 484753 - DNA, 20 bp, Homo sapiens
aataaaaatatattttcaac

SEQ ID NO: 484754 - DNA, 18 bp, Homo sapiens
aataaaccaaaggaaaat

SEQ ID NO: 484755 - DNA, 14 bp, Homo sapiens
aataatagactgta

SEQ ID NO: 484756 - DNA, 18 bp, Homo sapiens
aataatgcccttaatgtg

SEQ ID NO: 484757 - DNA, 18 bp, Homo sapiens
aatacattacatgtaaat

SEQ ID NO: 484758 - DNA, 12 bp, Homo sapiens
aatacttccaga

SEQ ID NO: 484759 - DNA, 21 bp, Homo sapiens
aatagactgtaacttccaaat

SEQ ID NO: 484760 - DNA, 13 bp, Homo sapiens
aatagtagatgtg

SEQ ID NO: 484761 - DNA, 17 bp, Homo sapiens
aatagtatgaaaatgga

SEQ ID NO: 484762 - DNA, 14 bp, Homo sapiens
aatatcaaagtcat

SEQ ID NO: 484763 - DNA, 20 bp, Homo sapiens
aatatcaaagtcattaaaga

SEQ ID NO: 484764 - DNA, 19 bp, Homo sapiens
aatatgtacacaacttaga

SEQ ID NO: 484765 - DNA, 16 bp, Homo sapiens
aatatgtagtatctat

SEQ ID NO: 484766 - DNA, 21 bp, Homo sapiens
aatattcctttgcatattata

SEQ ID NO: 484767 - DNA, 12 bp, Homo sapiens
aatcaaccaaag

SEQ ID NO: 484768 - DNA, 20 bp, Homo sapiens
aatcaaccaaagttagttca

SEQ ID NO: 484769 - DNA, 18 bp, Homo sapiens
aatcattcttactaaaaa

SEQ ID NO: 484770 - DNA, 13 bp, Homo sapiens
aatctttcaccaa

SEQ ID NO: 484771 - DNA, 14 bp, Homo sapiens
aatgaaatgcatat

SEQ ID NO: 484772 - DNA, 16 bp, Homo sapiens
aatgactcaaagtctg

SEQ ID NO: 484773 - DNA, 13 bp, Homo sapiens
aatgcactgtaat

SEQ ID NO: 484774 - DNA, 14 bp, Homo sapiens
aatgcatatttgca

SEQ ID NO: 484775 - DNA, 19 bp, Homo sapiens
aatggaggatctctaaaga

SEQ ID NO: 484776 - DNA, 23 bp, Homo sapiens
aatggtgcttattaagaccaaag

SEQ ID NO: 484777 - DNA, 20 bp, Homo sapiens
aattatttgattatttaaga

SEQ ID NO: 484778 - DNA, 17 bp, Homo sapiens
aattccaatttcaaaat

SEQ ID NO: 484779 - DNA, 23 bp, Homo sapiens
aattccagttatttatttccaaa

SEQ ID NO: 484780 - DNA, 13 bp, Homo sapiens
aattgatggacta

SEQ ID NO: 484781 - DNA, 14 bp, Homo sapiens
aatttaaaaatata

SEQ ID NO: 484782 - DNA, 15 bp, Homo sapiens
aatttaaaaatatat

SEQ ID NO: 484783 - DNA, 14 bp, Homo sapiens
aatttcaaaatgtc

SEQ ID NO: 484784 - DNA, 16 bp, Homo sapiens
aatttcaatcaaccaa

SEQ ID NO: 484785 - DNA, 18 bp, Homo sapiens
aattttcacttttggcaa

SEQ ID NO: 484786 - DNA, 19 bp, Homo sapiens
aattttcattttgcactga

SEQ ID NO: 484787 - DNA, 13 bp, Homo sapiens
acaaaagagcagt

SEQ ID NO: 484788 - DNA, 18 bp, Homo sapiens
acaaagttaaaattgtta

SEQ ID NO: 484789 - DNA, 19 bp, Homo sapiens
acaacttagaaaccaaatt

SEQ ID NO: 484790 - DNA, 19 bp, Homo sapiens
acaagcttcagtaagttat

SEQ ID NO: 484791 - DNA, 13 bp, Homo sapiens
acaagtattcagt

SEQ ID NO: 484792 - DNA, 19 bp, Homo sapiens
acaagtattcagttccaat

SEQ ID NO: 484793 - DNA, 18 bp, Homo sapiens
acacattacaaagttaaa

SEQ ID NO: 484794 - DNA, 21 bp, Homo sapiens
acactaacgaaatatcaaagt

SEQ ID NO: 484795 - DNA, 22 bp, Homo sapiens
acagacactaacgaaatatcaa

SEQ ID NO: 484796 - DNA, 14 bp, Homo sapiens
acagcatgtgcaat

SEQ ID NO: 484797 - DNA, 23 bp, Homo sapiens
acagtgagcttggaaaggaccag

SEQ ID NO: 484798 - DNA, 17 bp, Homo sapiens
acataaaagaaataaac

SEQ ID NO: 484799 - DNA, 16 bp, Homo sapiens
acatgcatataatgaa

SEQ ID NO: 484800 - DNA, 18 bp, Homo sapiens
acatgcatataatgaata

SEQ ID NO: 484801 - DNA, 15 bp, Homo sapiens
acatgtaaattaagt

SEQ ID NO: 484802 - DNA, 23 bp, Homo sapiens
acatgtaaattaagtgtgtgtat

SEQ ID NO: 484803 - DNA, 16 bp, Homo sapiens
acattacatgtaaatt

SEQ ID NO: 484804 - DNA, 12 bp, Homo sapiens
acattgaagaat

SEQ ID NO: 484805 - DNA, 17 bp, Homo sapiens
accaagtaaatttgtat

SEQ ID NO: 484806 - DNA, 21 bp, Homo sapiens
accaattccaatttcaaaatg

SEQ ID NO: 484807 - DNA, 14 bp, Homo sapiens
acccgaggcccgca

SEQ ID NO: 484808 - DNA, 13 bp, Homo sapiens
accctagttcaaa

SEQ ID NO: 484809 - DNA, 16 bp, Homo sapiens
accctcggtcattcct

SEQ ID NO: 484810 - DNA, 16 bp, Homo sapiens
accgacaaaattccag

SEQ ID NO: 484811 - DNA, 17 bp, Homo sapiens
accttgtcatatgtgtt

SEQ ID NO: 484812 - DNA, 20 bp, Homo sapiens
actaaaaagtataaaatagt

SEQ ID NO: 484813 - DNA, 16 bp, Homo sapiens
actccatatgtgttcc

SEQ ID NO: 484814 - DNA, 23 bp, Homo sapiens
actgaggatattcagatgtatgt

SEQ ID NO: 484815 - DNA, 14 bp, Homo sapiens
actgcctaagccct

SEQ ID NO: 484816 - DNA, 20 bp, Homo sapiens
actgtaacttccaaataaat

SEQ ID NO: 484817 - DNA, 13 bp, Homo sapiens
acttattgaatat

SEQ ID NO: 484818 - DNA, 15 bp, Homo sapiens
acttattgaatatat

SEQ ID NO: 484819 - DNA, 17 bp, Homo sapiens
acttattgaatatatga

SEQ ID NO: 484820 - DNA, 18 bp, Homo sapiens
acttattgaatatatgat

SEQ ID NO: 484821 - DNA, 18 bp, Homo sapiens
acttcattaatttcaatc

SEQ ID NO: 484822 - DNA, 13 bp, Homo sapiens
actttgcttctcc

SEQ ID NO: 484823 - DNA, 17 bp, Homo sapiens
agaaaatgaaatgcata

SEQ ID NO: 484824 - DNA, 21 bp, Homo sapiens
agaaaatgaaatgcatatttg

SEQ ID NO: 484825 - DNA, 15 bp, Homo sapiens
agaactatattttcc

SEQ ID NO: 484826 - DNA, 13 bp, Homo sapiens
agaaggatgatgt

SEQ ID NO: 484827 - DNA, 15 bp, Homo sapiens
agaatgttagagtaa

SEQ ID NO: 484828 - DNA, 14 bp, Homo sapiens
agacactgttgata

SEQ ID NO: 484829 - DNA, 17 bp, Homo sapiens
agacactgttgataaaa

SEQ ID NO: 484830 - DNA, 19 bp, Homo sapiens
agaccaaataattaaaaga

SEQ ID NO: 484831 - DNA, 13 bp, Homo sapiens
agaccaagcttgt

SEQ ID NO: 484832 - DNA, 21 bp, Homo sapiens
agactgtaacttccaaataaa

SEQ ID NO: 484833 - DNA, 23 bp, Homo sapiens
agactgtttttcagggaggtggc

SEQ ID NO: 484834 - DNA, 17 bp, Homo sapiens
agagcagtggtaagaat

SEQ ID NO: 484835 - DNA, 20 bp, Homo sapiens
agagcataatttaaaaatat

SEQ ID NO: 484836 - DNA, 15 bp, Homo sapiens
agagccatacataaa

SEQ ID NO: 484837 - DNA, 16 bp, Homo sapiens
agagccatacataaaa

SEQ ID NO: 484838 - DNA, 20 bp, Homo sapiens
agagccatacataaaagaaa

SEQ ID NO: 484839 - DNA, 22 bp, Homo sapiens
agaggctgttcccaccaggctg

SEQ ID NO: 484840 - DNA, 20 bp, Homo sapiens
agattgtgatcccttgagat

SEQ ID NO: 484841 - DNA, 18 bp, Homo sapiens
agcataatttaaaaatat

SEQ ID NO: 484842 - DNA, 20 bp, Homo sapiens
agcataatttaaaaatatat

SEQ ID NO: 484843 - DNA, 18 bp, Homo sapiens
agccaggagctgggcaga

SEQ ID NO: 484844 - DNA, 15 bp, Homo sapiens
ctattttctaaagac

SEQ ID NO: 484845 - DNA, 14 bp, Homo sapiens
ctattttttatcat

SEQ ID NO: 484846 - DNA, 13 bp, Homo sapiens
ctcaagccctgca

SEQ ID NO: 484847 - DNA, 22 bp, Homo sapiens
ctcaatggtgctataataaata

SEQ ID NO: 484848 - DNA, 22 bp, Homo sapiens
ctcacagtgggagccagggctg

SEQ ID NO: 484849 - DNA, 22 bp, Homo sapiens
ctcagagacactgttgataaaa

SEQ ID NO: 484850 - DNA, 13 bp, Homo sapiens
ctcaggcttctca

SEQ ID NO: 484851 - DNA, 20 bp, Homo sapiens
ctccagctgctctgtcttct

SEQ ID NO: 484852 - DNA, 15 bp, Homo sapiens
ctcctggttgttcct

SEQ ID NO: 484853 - DNA, 17 bp, Homo sapiens
ctctgcatttaaaaaaa

SEQ ID NO: 484854 - DNA, 17 bp, Homo sapiens
agccatacataaaagaa

SEQ ID NO: 484855 - DNA, 17 bp, Homo sapiens
agccccatcagctccag

SEQ ID NO: 484856 - DNA, 18 bp, Homo sapiens
agcctcagtggccagagg

SEQ ID NO: 484857 - DNA, 20 bp, Homo sapiens
agcttatctcagttatgagt

SEQ ID NO: 484858 - DNA, 21 bp, Homo sapiens
agcttcagtaagttatctttg

SEQ ID NO: 484859 - DNA, 18 bp, Homo sapiens
agcttggttctgtgaaca

SEQ ID NO: 484860 - DNA, 19 bp, Homo sapiens
aggaccaggaaacagcctc

SEQ ID NO: 484861 - DNA, 20 bp, Homo sapiens
aggagctgggcagaaggcca

SEQ ID NO: 484862 - DNA, 15 bp, Homo sapiens
aggatcaccagtgca

SEQ ID NO: 484863 - DNA, 22 bp, Homo sapiens
aggccatggcatccctttttca

SEQ ID NO: 484864 - DNA, 15 bp, Homo sapiens
aggctaaataaagtc

SEQ ID NO: 484865 - DNA, 17 bp, Homo sapiens
aggctattttctaaaga

SEQ ID NO: 484866 - DNA, 16 bp, Homo sapiens
aggctgctcagggctg

SEQ ID NO: 484867 - DNA, 15 bp, Homo sapiens
agggaagaactattg

SEQ ID NO: 484868 - DNA, 13 bp, Homo sapiens
agggcataaagta

SEQ ID NO: 484869 - DNA, 15 bp, Homo sapiens
agggcataaagtaaa

SEQ ID NO: 484870 - DNA, 18 bp, Homo sapiens
agggtttgtaatggtgct

SEQ ID NO: 484871 - DNA, 20 bp, Homo sapiens
aggtgactaccctagttcaa

SEQ ID NO: 484872 - DNA, 20 bp, Homo sapiens
agtaaatttgtataaataag

SEQ ID NO: 484873 - DNA, 18 bp, Homo sapiens
agtagatgtggcctttga

SEQ ID NO: 484874 - DNA, 19 bp, Homo sapiens
tcatcacagcatgtgcaat

SEQ ID NO: 484875 - DNA, 21 bp, Homo sapiens
tcattgaaacatttataaact

SEQ ID NO: 484876 - DNA, 17 bp, Homo sapiens
tcattgccttaactgga

SEQ ID NO: 484877 - DNA, 23 bp, Homo sapiens
tcattgccttaactggagcccca

SEQ ID NO: 484878 - DNA, 16 bp, Homo sapiens
tccaacgtggcccaga

SEQ ID NO: 484879 - DNA, 19 bp, Homo sapiens
tccagttatttatttccaa

SEQ ID NO: 484880 - DNA, 21 bp, Homo sapiens
tccagttatttatttccaaaa

SEQ ID NO: 484881 - DNA, 22 bp, Homo sapiens
tcccaccaggctgctcagggct

SEQ ID NO: 484882 - DNA, 19 bp, Homo sapiens
tcccgattcaccctgtcca

SEQ ID NO: 484883 - DNA, 13 bp, Homo sapiens
tctaaagagcatc

SEQ ID NO: 484884 - DNA, 21 bp, Homo sapiens
tctcaatggtgctataataaa

SEQ ID NO: 484885 - DNA, 12 bp, Homo sapiens
tctcacagtggg

SEQ ID NO: 484886 - DNA, 21 bp, Homo sapiens
tctcacagtgggagccagggc

SEQ ID NO: 484887 - DNA, 20 bp, Homo sapiens
tctctgcatttaaaaaaatc

SEQ ID NO: 484888 - DNA, 12 bp, Homo sapiens
tctgtaataata

SEQ ID NO: 484889 - DNA, 15 bp, Homo sapiens
tctgtaataatagac

SEQ ID NO: 484890 - DNA, 18 bp, Homo sapiens
tctgtttaattttcactt

SEQ ID NO: 484891 - DNA, 20 bp, Homo sapiens
tcttaaaacattatgagttt

SEQ ID NO: 484892 - DNA, 17 bp, Homo sapiens
tcttactaaaaagtata

SEQ ID NO: 484893 - DNA, 21 bp, Homo sapiens
tcttataaagtggaagtatgt

SEQ ID NO: 484894 - DNA, 20 bp, Homo sapiens
tctttttaaaaattgttatt

SEQ ID NO: 484895 - DNA, 20 bp, Homo sapiens
tgactggcccacacgtgcat

SEQ ID NO: 484896 - DNA, 13 bp, Homo sapiens
tgagagcataatt

SEQ ID NO: 484897 - DNA, 15 bp, Homo sapiens
tgagagcataattta

SEQ ID NO: 484898 - DNA, 18 bp, Homo sapiens
tgaggatattcagatgta

SEQ ID NO: 484899 - DNA, 15 bp, Homo sapiens
tgagggtttgtaatg

SEQ ID NO: 484900 - DNA, 21 bp, Homo sapiens
tgagggtttgtaatggtgctt

SEQ ID NO: 484901 - DNA, 22 bp, Homo sapiens
tgagtataatacattacatgta

SEQ ID NO: 484902 - DNA, 15 bp, Homo sapiens
tgattcttgaaaact

SEQ ID NO: 484903 - DNA, 11 bp, Homo sapiens
tgcactgtaat

SEQ ID NO: 484904 - DNA, 20 bp, Homo sapiens
tgcatataatgaataaatca

SEQ ID NO: 484905 - DNA, 13 bp, Homo sapiens
tgcatattataaa

SEQ ID NO: 484906 - DNA, 16 bp, Homo sapiens
tgcatattataaagga

SEQ ID NO: 484907 - DNA, 20 bp, Homo sapiens
tgcatattataaaggataaa

SEQ ID NO: 484908 - DNA, 20 bp, Homo sapiens
tgcatccttcatcacagcat

SEQ ID NO: 484909 - DNA, 23 bp, Homo sapiens
tgctcaccagtaaaagataacct

SEQ ID NO: 484910 - DNA, 22 bp, Homo sapiens
tgctctgtcttctttgcccaca

SEQ ID NO: 484911 - DNA, 18 bp, Homo sapiens
tgcttattaagaccaaag

SEQ ID NO: 484912 - DNA, 19 bp, Homo sapiens
tgcttattaagaccaaaga

SEQ ID NO: 484913 - DNA, 17 bp, Homo sapiens
tggaaccacattgaaga

SEQ ID NO: 484914 - DNA, 14 bp, Homo sapiens
tggagccccatcag

SEQ ID NO: 484915 - DNA, 18 bp, Homo sapiens
tggcccacacgtgcatag

SEQ ID NO: 484916 - DNA, 16 bp, Homo sapiens
tgggagagccatacat

SEQ ID NO: 484917 - DNA, 12 bp, Homo sapiens
tgggagccaggg

SEQ ID NO: 484918 - DNA, 16 bp, Homo sapiens
tggtgcttattaagac

SEQ ID NO: 484919 - DNA, 15 bp, Homo sapiens
tgtaacttccaaata

SEQ ID NO: 484920 - DNA, 19 bp, Homo sapiens
tgtaacttccaaataaata

SEQ ID NO: 484921 - DNA, 21 bp, Homo sapiens
tgtaacttccaaataaataat

SEQ ID NO: 484922 - DNA, 12 bp, Homo sapiens
tgtaatggtgct

SEQ ID NO: 484923 - DNA, 16 bp, Homo sapiens
tgtaatggtgcttatt

SEQ ID NO: 484924 - DNA, 21 bp, Homo sapiens
tgtatactgtaatcgtgctat

SEQ ID NO: 484925 - DNA, 14 bp, Homo sapiens
tgtattaccaaagc

SEQ ID NO: 484926 - DNA, 13 bp, Homo sapiens
tgtcataaatgtc

SEQ ID NO: 484927 - DNA, 23 bp, Homo sapiens
tgtgaacaagcttcagtaagtta

SEQ ID NO: 484928 - DNA, 15 bp, Homo sapiens
tgtgtatactgtaat

SEQ ID NO: 484929 - DNA, 21 bp, Homo sapiens
tgttcccaccaggctgctcag

SEQ ID NO: 484930 - DNA, 21 bp, Homo sapiens
tgttgtttataataaaaatat

SEQ ID NO: 484931 - DNA, 22 bp, Homo sapiens
tgtttatgttgtttataataaa

SEQ ID NO: 484932 - DNA, 16 bp, Homo sapiens
ttaaaagaaaaacaaa

SEQ ID NO: 484933 - DNA, 12 bp, Homo sapiens
ttaagaccaaag

SEQ ID NO: 484934 - DNA, 13 bp, Homo sapiens
ttaagaccaaaga

SEQ ID NO: 484935 - DNA, 15 bp, Homo sapiens
ttaagtgtgtgtata

SEQ ID NO: 484936 - DNA, 18 bp, Homo sapiens
ttaagtgtgtgtatactg

SEQ ID NO: 484937 - DNA, 14 bp, Homo sapiens
ttacatgtaaatta

SEQ ID NO: 484938 - DNA, 13 bp, Homo sapiens
ttaccaattccaa

SEQ ID NO: 484939 - DNA, 19 bp, Homo sapiens
ttaccaattccaatttcaa

SEQ ID NO: 484940 - DNA, 21 bp, Homo sapiens
ttacctagctaattatttaat

SEQ ID NO: 484941 - DNA, 17 bp, Homo sapiens
ttactaaaaagtataaa

SEQ ID NO: 484942 - DNA, 12 bp, Homo sapiens
ttagaaaccaaa

SEQ ID NO: 484943 - DNA, 17 bp, Homo sapiens
ttataaggaaattttac

SEQ ID NO: 484944 - DNA, 23 bp, Homo sapiens
ttatcaaaatagtctaaggccat

SEQ ID NO: 484945 - DNA, 14 bp, Homo sapiens
ttatcattgaaaca

SEQ ID NO: 484946 - DNA, 14 bp, Homo sapiens
ttatctttgaatat

SEQ ID NO: 484947 - DNA, 18 bp, Homo sapiens
ttattaagaccaaagact

SEQ ID NO: 484948 - DNA, 16 bp, Homo sapiens
ttattgaatatatgat

SEQ ID NO: 484949 - DNA, 14 bp, Homo sapiens
ttatttaagactaa

SEQ ID NO: 484950 - DNA, 13 bp, Homo sapiens
ttatttatttcca

SEQ ID NO: 484951 - DNA, 14 bp, Homo sapiens
ttatttatttccaa

SEQ ID NO: 484952 - DNA, 14 bp, Homo sapiens
ttcaatcaaccaaa

SEQ ID NO: 484953 - DNA, 21 bp, Homo sapiens
ttcaccatccagagaccaaat

SEQ ID NO: 484954 - DNA, 22 bp, Homo sapiens
ttcaccctgtccaaactgccta

SEQ ID NO: 484955 - DNA, 17 bp, Homo sapiens
ttcagaagtcacacatt

SEQ ID NO: 484956 - DNA, 22 bp, Homo sapiens
ttcattttgcactgaggatatt

SEQ ID NO: 484957 - DNA, 13 bp, Homo sapiens
ttccaaaatgttt

SEQ ID NO: 484958 - DNA, 13 bp, Homo sapiens
ttccaatttcaaa

SEQ ID NO: 484959 - DNA, 22 bp, Homo sapiens
ttccagttatttatttccaaaa

SEQ ID NO: 484960 - DNA, 14 bp, Homo sapiens
ttcctttgcatatt

SEQ ID NO: 484961 - DNA, 19 bp, Homo sapiens
ttcctttgcatattataaa

SEQ ID NO: 484962 - DNA, 21 bp, Homo sapiens
ttctcacagtgggagccaggg

SEQ ID NO: 484963 - DNA, 19 bp, Homo sapiens
ttctgtttaattttcactt

SEQ ID NO: 484964 - DNA, 15 bp, Homo sapiens
ttcttactaaaaagt

SEQ ID NO: 484965 - DNA, 22 bp, Homo sapiens
ttcttcttccaacgtggcccag

SEQ ID NO: 484966 - DNA, 20 bp, Homo sapiens
ttcttgaaaactgggacgtg

SEQ ID NO: 484967 - DNA, 19 bp, Homo sapiens
ttctttgtattaccaaagc

SEQ ID NO: 484968 - DNA, 13 bp, Homo sapiens
ttgaatatatgat

SEQ ID NO: 484969 - DNA, 13 bp, Homo sapiens
ttgctgtacaaaa

SEQ ID NO: 484970 - DNA, 15 bp, Homo sapiens
ttgcttctccaaata

SEQ ID NO: 484971 - DNA, 21 bp, Homo sapiens
ttggccatttatgctgacatg

SEQ ID NO: 484972 - DNA, 15 bp, Homo sapiens
ttggttctgtgaaca

SEQ ID NO: 484973 - DNA, 16 bp, Homo sapiens
ttgttatcaaaatagt

SEQ ID NO: 484974 - DNA, 18 bp, Homo sapiens
ttgtttataataaaaata

SEQ ID NO: 484975 - DNA, 12 bp, Homo sapiens
tttaaaaattgt

SEQ ID NO: 484976 - DNA, 11 bp, Homo sapiens
tttaaagaaat

SEQ ID NO: 484977 - DNA, 20 bp, Homo sapiens
tttaattgtccagtttgtct

SEQ ID NO: 484978 - DNA, 16 bp, Homo sapiens
tttataataaaaatat

SEQ ID NO: 484979 - DNA, 19 bp, Homo sapiens
tttatcattgaaacattta

SEQ ID NO: 484980 - DNA, 20 bp, Homo sapiens
tttatcattgaaacatttat

SEQ ID NO: 484981 - DNA, 19 bp, Homo sapiens
tttattaaaatatttcagg

SEQ ID NO: 484982 - DNA, 12 bp, Homo sapiens
tttatttccaaa

SEQ ID NO: 484983 - DNA, 17 bp, Homo sapiens
tttcaccaagtaaattt

SEQ ID NO: 484984 - DNA, 16 bp, Homo sapiens
tttctcaggcttctca

SEQ ID NO: 484985 - DNA, 17 bp, Homo sapiens
tttctcaggcttctcat

SEQ ID NO: 484986 - DNA, 22 bp, Homo sapiens
tttctctgcatttaaaaaaatc

SEQ ID NO: 484987 - DNA, 15 bp, Homo sapiens
tttgacaaagaaaaa

SEQ ID NO: 484988 - DNA, 17 bp, Homo sapiens
tttgattatttaagact

SEQ ID NO: 484989 - DNA, 13 bp, Homo sapiens
tttgtaatggtgc

SEQ ID NO: 484990 - DNA, 17 bp, Homo sapiens
tttgtaatggtgcttat

SEQ ID NO: 484991 - DNA, 21 bp, Homo sapiens
tttgttttatttttttaccaa

SEQ ID NO: 484992 - DNA, 21 bp, Homo sapiens
ttttgcactgaggatattcag

SEQ ID NO: 484993 - DNA, 13 bp, Homo sapiens
ttttgctgttcca

SEQ ID NO: 484994 - DNA, 17 bp, Homo sapiens
tttttaccaattccaat

SEQ ID NO: 484995 - DNA, 19 bp, Homo sapiens
tttttatcattgaaacatt

SEQ ID NO: 484996 - DNA, 18 bp, Homo sapiens
tttttttaccaattccaa

SEQ ID NO: 484997 - DNA, 23 bp, Homo sapiens
aaaaatttaactccatatgtgtt

SEQ ID NO: 484998 - DNA, 18 bp, Homo sapiens
aaaatgaaatgcatattt

SEQ ID NO: 484999 - DNA, 20 bp, Homo sapiens
aaacagtataatttgacaaa

SEQ ID NO: 485000 - DNA, 15 bp, Homo sapiens
aaacatttataaact

SEQ ID NO: 485001 - DNA, 20 bp, Homo sapiens
aaactagatttataaatgca

SEQ ID NO: 485002 - DNA, 17 bp, Homo sapiens
aaactcaggcaaagaaa

SEQ ID NO: 485003 - DNA, 22 bp, Homo sapiens
attaaagacaggagacaaaaga

SEQ ID NO: 485004 - DNA, 14 bp, Homo sapiens
attaagaccaaaga

SEQ ID NO: 485005 - DNA, 17 bp, Homo sapiens
attaagaccaaagactt

SEQ ID NO: 485006 - DNA, 21 bp, Homo sapiens
attaagaccaaagacttgtta

SEQ ID NO: 485007 - DNA, 16 bp, Homo sapiens
attacaagtattcagt

SEQ ID NO: 485008 - DNA, 22 bp, Homo sapiens
attacaagtattcagttccaat

SEQ ID NO: 485009 - DNA, 11 bp, Homo sapiens
attaccaaagc

SEQ ID NO: 485010 - DNA, 19 bp, Homo sapiens
attaccctcggtcattcct

SEQ ID NO: 485011 - DNA, 15 bp, Homo sapiens
attaggaagtgttta

SEQ ID NO: 485012 - DNA, 18 bp, Homo sapiens
attataaaggataaagaa

SEQ ID NO: 485013 - DNA, 18 bp, Homo sapiens
attatggggctgcttttg

SEQ ID NO: 485014 - DNA, 15 bp, Homo sapiens
attcaaatgcttttt

SEQ ID NO: 485015 - DNA, 12 bp, Homo sapiens
attcagatgtat

SEQ ID NO: 485016 - DNA, 14 bp, Homo sapiens
attcagttccaata

SEQ ID NO: 485017 - DNA, 20 bp, Homo sapiens
attcagttccaatacttcat

SEQ ID NO: 485018 - DNA, 22 bp, Homo sapiens
attcagttccaatacttcatta

SEQ ID NO: 485019 - DNA, 22 bp, Homo sapiens
attccagttatttatttccaaa

SEQ ID NO: 485020 - DNA, 23 bp, Homo sapiens
attccagttatttatttccaaaa

SEQ ID NO: 485021 - DNA, 18 bp, Homo sapiens
attccggaggctaaataa

SEQ ID NO: 485022 - DNA, 14 bp, Homo sapiens
attcctttgcatat

SEQ ID NO: 485023 - DNA, 19 bp, Homo sapiens
attcttgttgctgtacaaa

SEQ ID NO: 485024 - DNA, 21 bp, Homo sapiens
attcttgttgctgtacaaaag

SEQ ID NO: 485025 - DNA, 22 bp, Homo sapiens
attcttgttgctgtacaaaagc

SEQ ID NO: 485026 - DNA, 10 bp, Homo sapiens
attgaagaat

SEQ ID NO: 485027 - DNA, 16 bp, Homo sapiens
attgaagaatgttaga

SEQ ID NO: 485028 - DNA, 21 bp, Homo sapiens
attgggggttggccatttatg

SEQ ID NO: 485029 - DNA, 15 bp, Homo sapiens
attgtgctcagagac

SEQ ID NO: 485030 - DNA, 12 bp, Homo sapiens
atttaactccat

SEQ ID NO: 485031 - DNA, 14 bp, Homo sapiens
atttataaatgcac

SEQ ID NO: 485032 - DNA, 16 bp, Homo sapiens
atttataaggaaattt

SEQ ID NO: 485033 - DNA, 15 bp, Homo sapiens
atttatggtacctat

SEQ ID NO: 485034 - DNA, 17 bp, Homo sapiens
atttatttccaaaatgt

SEQ ID NO: 485035 - DNA, 13 bp, Homo sapiens
atttccaaaatgt

SEQ ID NO: 485036 - DNA, 19 bp, Homo sapiens
atttgattatttaagacta

SEQ ID NO: 485037 - DNA, 21 bp, Homo sapiens
atttgtaaactttgcttctcc

SEQ ID NO: 485038 - DNA, 23 bp, Homo sapiens
atttgtaaactttgcttctccaa

SEQ ID NO: 485039 - DNA, 19 bp, Homo sapiens
atttgtataaataagcact

SEQ ID NO: 485040 - DNA, 17 bp, Homo sapiens
attttacctagctaatt

SEQ ID NO: 485041 - DNA, 17 bp, Homo sapiens
caaactgcctaagccct

SEQ ID NO: 485042 - DNA, 18 bp, Homo sapiens
caaactgcctaagccctc

SEQ ID NO: 485043 - DNA, 21 bp, Homo sapiens
caaagaaaatgaaatgcatat

SEQ ID NO: 485044 - DNA, 21 bp, Homo sapiens
caaagacttgttaaatgtata

SEQ ID NO: 485045 - DNA, 18 bp, Homo sapiens
caaatgctttttgtttta

SEQ ID NO: 485046 - DNA, 20 bp, Homo sapiens
caaattacaagtattcagtt

SEQ ID NO: 485047 - DNA, 17 bp, Homo sapiens
caacgtggcccagagaa

SEQ ID NO: 485048 - DNA, 19 bp, Homo sapiens
caacgtggcccagagaagc

SEQ ID NO: 485049 - DNA, 21 bp, Homo sapiens
caacgtggcccagagaagcca

SEQ ID NO: 485050 - DNA, 15 bp, Homo sapiens
caacttagaaaccaa

SEQ ID NO: 485051 - DNA, 20 bp, Homo sapiens
caagaggctgttcccaccag

SEQ ID NO: 485052 - DNA, 17 bp, Homo sapiens
caagattactaatattt

SEQ ID NO: 485053 - DNA, 16 bp, Homo sapiens
caagggcataaagtaa

SEQ ID NO: 485054 - DNA, 21 bp, Homo sapiens
caagtaaatttgtataaataa

SEQ ID NO: 485055 - DNA, 22 bp, Homo sapiens
caagtattcagttccaatactt

SEQ ID NO: 485056 - DNA, 23 bp, Homo sapiens
caatcaaccaaagttagttcagt

SEQ ID NO: 485057 - DNA, 13 bp, Homo sapiens
caatgagagcata

SEQ ID NO: 485058 - DNA, 15 bp, Homo sapiens
caatgtcataaatgt

SEQ ID NO: 485059 - DNA, 13 bp, Homo sapiens
caattcaaatgct

SEQ ID NO: 485060 - DNA, 22 bp, Homo sapiens
caattccaatttcaaaatgtct

SEQ ID NO: 485061 - DNA, 19 bp, Homo sapiens
cacaacttagaaaccaaat

SEQ ID NO: 485062 - DNA, 23 bp, Homo sapiens
cacactagcatagagaatgtgtt

SEQ ID NO: 485063 - DNA, 17 bp, Homo sapiens
cacagcttcagccagga

SEQ ID NO: 485064 - DNA, 18 bp, Homo sapiens
cacagtgggagccagggc

SEQ ID NO: 485065 - DNA, 13 bp, Homo sapiens
cacattgaagaat

SEQ ID NO: 485066 - DNA, 21 bp, Homo sapiens
caccaggctgctcagggctgg

SEQ ID NO: 485067 - DNA, 22 bp, Homo sapiens
caccatccagagaccaaataat

SEQ ID NO: 485068 - DNA, 20 bp, Homo sapiens
caccctgtccaaactgccta

SEQ ID NO: 485069 - DNA, 16 bp, Homo sapiens
cactaacgaaatatca

SEQ ID NO: 485070 - DNA, 14 bp, Homo sapiens
cactgttgataaaa

SEQ ID NO: 485071 - DNA, 15 bp, Homo sapiens
cacttattgaatata

SEQ ID NO: 485072 - DNA, 17 bp, Homo sapiens
cacttattgaatatatg

SEQ ID NO: 485073 - DNA, 12 bp, Homo sapiens
cagaacataaat

SEQ ID NO: 485074 - DNA, 18 bp, Homo sapiens
cagaaggccaagaggctg

SEQ ID NO: 485075 - DNA, 20 bp, Homo sapiens
cagagaagccaaaagattgg

SEQ ID NO: 485076 - DNA, 23 bp, Homo sapiens
cagagacactgttgataaaaact

SEQ ID NO: 485077 - DNA, 19 bp, Homo sapiens
cagaggatcaccagtgcat

SEQ ID NO: 485078 - DNA, 22 bp, Homo sapiens
cagatcacagcttcagccagga

SEQ ID NO: 485079 - DNA, 12 bp, Homo sapiens
cagccaggagct

SEQ ID NO: 485080 - DNA, 16 bp, Homo sapiens
cagccaggagctgggc

SEQ ID NO: 485081 - DNA, 19 bp, Homo sapiens
cagcctcagtggccagagg

SEQ ID NO: 485082 - DNA, 15 bp, Homo sapiens
cagcttcagccagga

SEQ ID NO: 485083 - DNA, 21 bp, Homo sapiens
caggtgactaccctagttcaa

SEQ ID NO: 485084 - DNA, 17 bp, Homo sapiens
cagtgcatccttcatca

SEQ ID NO: 485085 - DNA, 15 bp, Homo sapiens
cagtgcctattgata

SEQ ID NO: 485086 - DNA, 18 bp, Homo sapiens
cagttatttatttccaaa

SEQ ID NO: 485087 - DNA, 17 bp, Homo sapiens
cagttccaatacttcat

SEQ ID NO: 485088 - DNA, 14 bp, Homo sapiens
cataaagtaaatac

SEQ ID NO: 485089 - DNA, 17 bp, Homo sapiens
cataaatgtcacaataa

SEQ ID NO: 485090 - DNA, 22 bp, Homo sapiens
cataaatgtcacaataaaacaa

SEQ ID NO: 485091 - DNA, 15 bp, Homo sapiens
catacataaaagaaa

SEQ ID NO: 485092 - DNA, 20 bp, Homo sapiens
catacataaaagaaataaac

SEQ ID NO: 485093 - DNA, 20 bp, Homo sapiens
catagcttgataaagggcca

SEQ ID NO: 485094 - DNA, 21 bp, Homo sapiens
catagcttgataaagggccaa

SEQ ID NO: 485095 - DNA, 14 bp, Homo sapiens
catataatgaataa

SEQ ID NO: 485096 - DNA, 16 bp, Homo sapiens
catatcataggtacaa

SEQ ID NO: 485097 - DNA, 18 bp, Homo sapiens
catatcataggtacaatc

SEQ ID NO: 485098 - DNA, 17 bp, Homo sapiens
catattataaaggataa

SEQ ID NO: 485099 - DNA, 21 bp, Homo sapiens
catgaaataaaatatatctta

SEQ ID NO: 485100 - DNA, 12 bp, Homo sapiens
catgcatataat

SEQ ID NO: 485101 - DNA, 22 bp, Homo sapiens
catgcatataatgaataaatca

SEQ ID NO: 485102 - DNA, 13 bp, Homo sapiens
cattaatttcaat

SEQ ID NO: 485103 - DNA, 22 bp, Homo sapiens
cattaatttcaatcaaccaaag

SEQ ID NO: 485104 - DNA, 14 bp, Homo sapiens
cattcctgtcaaca

SEQ ID NO: 485105 - DNA, 22 bp, Homo sapiens
cattcttactaaaaagtataaa

SEQ ID NO: 485106 - DNA, 19 bp, Homo sapiens
cattgaaacatttataaac

SEQ ID NO: 485107 - DNA, 21 bp, Homo sapiens
cattgaagaatgttagagtaa

SEQ ID NO: 485108 - DNA, 16 bp, Homo sapiens
cattgctggtcaagat

SEQ ID NO: 485109 - DNA, 17 bp, Homo sapiens
catttggggtaatactt

SEQ ID NO: 485110 - DNA, 14 bp, Homo sapiens
ccaaactgcctaag

SEQ ID NO: 485111 - DNA, 19 bp, Homo sapiens
ccaaactgcctaagccctc

SEQ ID NO: 485112 - DNA, 20 bp, Homo sapiens
ccaaaggaaaatgtctgtaa

SEQ ID NO: 485113 - DNA, 17 bp, Homo sapiens
ccaaagttagttcagta

SEQ ID NO: 485114 - DNA, 19 bp, Homo sapiens
ccaaagttagttcagtagc

SEQ ID NO: 485115 - DNA, 20 bp, Homo sapiens
ccaaatacaattcaaatgct

SEQ ID NO: 485116 - DNA, 23 bp, Homo sapiens
ccaagcttgtccaacccgaggcc

SEQ ID NO: 485117 - DNA, 10 bp, Homo sapiens
ccaattccaa

SEQ ID NO: 485118 - DNA, 15 bp, Homo sapiens
ccaatttcaaaatgt

SEQ ID NO: 485119 - DNA, 17 bp, Homo sapiens
ccaatttcaaaatgtct

SEQ ID NO: 485120 - DNA, 16 bp, Homo sapiens
tcaggcaaagaaaatg

SEQ ID NO: 485121 - DNA, 14 bp, Homo sapiens
tcagtaagttatct

SEQ ID NO: 485122 - DNA, 23 bp, Homo sapiens
tcagtaagttatctttgaatatg

SEQ ID NO: 485123 - DNA, 14 bp, Homo sapiens
tcagtagcttatct

SEQ ID NO: 485124 - DNA, 18 bp, Homo sapiens
tcagtagcttatctcagt

SEQ ID NO: 485125 - DNA, 22 bp, Homo sapiens
tcagttatgagtataatacatt

SEQ ID NO: 485126 - DNA, 12 bp, Homo sapiens
tcataggtacaa

SEQ ID NO: 485127 - DNA, 18 bp, Homo sapiens
tcatatcataggtacaat

SEQ ID NO: 485128 - DNA, 20 bp, Homo sapiens
tcatcacagcatgtgcaata

SEQ ID NO: 485129 - DNA, 23 bp, Homo sapiens
tcattaatttcaatcaaccaaag

SEQ ID NO: 485130 - DNA, 15 bp, Homo sapiens
tcattcctgtcaaca

SEQ ID NO: 485131 - DNA, 15 bp, Homo sapiens
tcattcttactaaaa

SEQ ID NO: 485132 - DNA, 20 bp, Homo sapiens
tcattcttactaaaaagtat

SEQ ID NO: 485133 - DNA, 13 bp, Homo sapiens
tcattgaaacatt

SEQ ID NO: 485134 - DNA, 18 bp, Homo sapiens
tcattgaaacatttataa

SEQ ID NO: 485135 - DNA, 22 bp, Homo sapiens
tcattgaaacatttataaacta

SEQ ID NO: 485136 - DNA, 21 bp, Homo sapiens
tccaaatttttttttaaagca

SEQ ID NO: 485137 - DNA, 16 bp, Homo sapiens
tccaacccgaggcccg

SEQ ID NO: 485138 - DNA, 18 bp, Homo sapiens
tccagagaccaaataatt

SEQ ID NO: 485139 - DNA, 17 bp, Homo sapiens
tcccaccaggctgctca

SEQ ID NO: 485140 - DNA, 20 bp, Homo sapiens
tcccagaagatgaaaaaaat

SEQ ID NO: 485141 - DNA, 14 bp, Homo sapiens
tcccttgagccctc

SEQ ID NO: 485142 - DNA, 20 bp, Homo sapiens
tccctttttcataaattatt

SEQ ID NO: 485143 - DNA, 15 bp, Homo sapiens
tcctgacctgtctca

SEQ ID NO: 485144 - DNA, 20 bp, Homo sapiens
tcctgacctgtctcaccatg

SEQ ID NO: 485145 - DNA, 12 bp, Homo sapiens
tctaaagagcat

SEQ ID NO: 485146 - DNA, 14 bp, Homo sapiens
tctaaagagcatct

SEQ ID NO: 485147 - DNA, 23 bp, Homo sapiens
tctcaatggtgctataataaata

SEQ ID NO: 485148 - DNA, 23 bp, Homo sapiens
tctcacagtgggagccagggctg

SEQ ID NO: 485149 - DNA, 18 bp, Homo sapiens
tctccaaatacaagtact

SEQ ID NO: 485150 - DNA, 15 bp, Homo sapiens
tctgcatttaaaaaa

SEQ ID NO: 485151 - DNA, 13 bp, Homo sapiens
tctgtaataatag

SEQ ID NO: 485152 - DNA, 16 bp, Homo sapiens
tctgtaataatagact

SEQ ID NO: 485153 - DNA, 19 bp, Homo sapiens
tctgtaataatagactgta

SEQ ID NO: 485154 - DNA, 19 bp, Homo sapiens
tctttcaccaagtaaattt

SEQ ID NO: 485155 - DNA, 23 bp, Homo sapiens
tctttctgaaatagtcaaatacg

SEQ ID NO: 485156 - DNA, 19 bp, Homo sapiens
tctttttttgctgttccac

SEQ ID NO: 485157 - DNA, 14 bp, Homo sapiens
tgaaataaaatata

SEQ ID NO: 485158 - DNA, 13 bp, Homo sapiens
tgaaatgcatatt

SEQ ID NO: 485159 - DNA, 23 bp, Homo sapiens
tgaagaatgttagagtaatgaaa

SEQ ID NO: 485160 - DNA, 20 bp, Homo sapiens
tgagggtttgtaatggtgct

SEQ ID NO: 485161 - DNA, 23 bp, Homo sapiens
tgagggtttgtaatggtgcttat

SEQ ID NO: 485162 - DNA, 14 bp, Homo sapiens
tgataaaaactcag

SEQ ID NO: 485163 - DNA, 17 bp, Homo sapiens
tgatcccttgagatatg

SEQ ID NO: 485164 - DNA, 17 bp, Homo sapiens
tgatgtctttttattaa

SEQ ID NO: 485165 - DNA, 16 bp, Homo sapiens
tgcaaatttgtaaact

SEQ ID NO: 485166 - DNA, 16 bp, Homo sapiens
tgcatataatgaataa

SEQ ID NO: 485167 - DNA, 19 bp, Homo sapiens
tgcatatttgcaaagtgta

SEQ ID NO: 485168 - DNA, 13 bp, Homo sapiens
tgcctaagccctc

SEQ ID NO: 485169 - DNA, 17 bp, Homo sapiens
tgctattttttatcatt

SEQ ID NO: 485170 - DNA, 22 bp, Homo sapiens
tgctattttttatcattgaaac

SEQ ID NO: 485171 - DNA, 14 bp, Homo sapiens
tgctgtacaaaagc

SEQ ID NO: 485172 - DNA, 15 bp, Homo sapiens
tgcttattaagacca

SEQ ID NO: 485173 - DNA, 16 bp, Homo sapiens
tgcttattaagaccaa

SEQ ID NO: 485174 - DNA, 16 bp, Homo sapiens
tgggcagaaggccaag

SEQ ID NO: 485175 - DNA, 18 bp, Homo sapiens
tgggcagaaggccaagag

SEQ ID NO: 485176 - DNA, 16 bp, Homo sapiens
tggtgctagtaaattt

SEQ ID NO: 485177 - DNA, 15 bp, Homo sapiens
tgtaaattaagtgtg

SEQ ID NO: 485178 - DNA, 14 bp, Homo sapiens
tgtaataatagact

SEQ ID NO: 485179 - DNA, 13 bp, Homo sapiens
tgtaatatgtaca

SEQ ID NO: 485180 - DNA, 15 bp, Homo sapiens
tgtaatcgtgctatt

SEQ ID NO: 485181 - DNA, 13 bp, Homo sapiens
tgtaatggtgctt

SEQ ID NO: 485182 - DNA, 11 bp, Homo sapiens
tgtacaaaagc

SEQ ID NO: 485183 - DNA, 22 bp, Homo sapiens
tgtatactgtaatcgtgctatt

SEQ ID NO: 485184 - DNA, 23 bp, Homo sapiens
tgtcaacaaggggtcaatgtcat

SEQ ID NO: 485185 - DNA, 18 bp, Homo sapiens
tgtcataaatgtcacaat

SEQ ID NO: 485186 - DNA, 19 bp, Homo sapiens
tgtcataaatgtcacaata

SEQ ID NO: 485187 - DNA, 16 bp, Homo sapiens
tgtcattgctggtcaa

SEQ ID NO: 485188 - DNA, 18 bp, Homo sapiens
tgtccaacccgaggcccg

SEQ ID NO: 485189 - DNA, 17 bp, Homo sapiens
tgtcctgacctgtctca

SEQ ID NO: 485190 - DNA, 15 bp, Homo sapiens
tgtgctcagagacac

SEQ ID NO: 485191 - DNA, 22 bp, Homo sapiens
tgtggcaaagccttcattgcct

SEQ ID NO: 485192 - DNA, 22 bp, Homo sapiens
tgtgtatactgtaatcgtgcta

SEQ ID NO: 485193 - DNA, 19 bp, Homo sapiens
tgtgttgattcttgaaaac

SEQ ID NO: 485194 - DNA, 15 bp, Homo sapiens
ttaaaaaagagacat

SEQ ID NO: 485195 - DNA, 14 bp, Homo sapiens
ttaaaaattgttat

SEQ ID NO: 485196 - DNA, 21 bp, Homo sapiens
ttaagtgtgtgtatactgtaa

SEQ ID NO: 485197 - DNA, 22 bp, Homo sapiens
ttacaagtattcagttccaata

SEQ ID NO: 485198 - DNA, 14 bp, Homo sapiens
ttagaaaccaaatt

SEQ ID NO: 485199 - DNA, 20 bp, Homo sapiens
ttaggaagtgtttatgttgt

SEQ ID NO: 485200 - DNA, 12 bp, Homo sapiens
ttagttcagtag

SEQ ID NO: 485201 - DNA, 19 bp, Homo sapiens
ttataaagtggaagtatgt

SEQ ID NO: 485202 - DNA, 21 bp, Homo sapiens
ttatggtacctatttggtgct

SEQ ID NO: 485203 - DNA, 12 bp, Homo sapiens
ttatttccaaaa

SEQ ID NO: 485204 - DNA, 16 bp, Homo sapiens
ttatttttttaccaat

SEQ ID NO: 485205 - DNA, 12 bp, Homo sapiens
ttcagccaggag

SEQ ID NO: 485206 - DNA, 13 bp, Homo sapiens
ttcagccaggagc

SEQ ID NO: 485207 - DNA, 17 bp, Homo sapiens
ttcagccaggagctggg

SEQ ID NO: 485208 - DNA, 20 bp, Homo sapiens
ttcagtaagttatctttgaa

SEQ ID NO: 485209 - DNA, 16 bp, Homo sapiens
ttcagttccaatactt

SEQ ID NO: 485210 - DNA, 19 bp, Homo sapiens
ttcagttccaatacttcat

SEQ ID NO: 485211 - DNA, 17 bp, Homo sapiens
ttccaatacttcattaa

SEQ ID NO: 485212 - DNA, 17 bp, Homo sapiens
ttccaatttcaaaatgt

SEQ ID NO: 485213 - DNA, 19 bp, Homo sapiens
ttccaatttcaaaatgtct

SEQ ID NO: 485214 - DNA, 22 bp, Homo sapiens
ttccagcaaacgtacgggaatg

SEQ ID NO: 485215 - DNA, 15 bp, Homo sapiens
ttcccttgagccctc

SEQ ID NO: 485216 - DNA, 14 bp, Homo sapiens
ttctcaagccctgc

SEQ ID NO: 485217 - DNA, 15 bp, Homo sapiens
ttctcaagccctgca

SEQ ID NO: 485218 - DNA, 19 bp, Homo sapiens
ttctcacagtgggagccag

SEQ ID NO: 485219 - DNA, 14 bp, Homo sapiens
ttctgtttaatttt

SEQ ID NO: 485220 - DNA, 20 bp, Homo sapiens
ttcttactaaaaagtataaa

SEQ ID NO: 485221 - DNA, 18 bp, Homo sapiens
ttcttcacacagacacta

SEQ ID NO: 485222 - DNA, 12 bp, Homo sapiens
ttgaaacattta

SEQ ID NO: 485223 - DNA, 13 bp, Homo sapiens
ttgaaacatttat

SEQ ID NO: 485224 - DNA, 16 bp, Homo sapiens
ttgacttgcattcaga

SEQ ID NO: 485225 - DNA, 19 bp, Homo sapiens
ttgattcttgaaaactggg

SEQ ID NO: 485226 - DNA, 13 bp, Homo sapiens
ttgcaaagtgtat

SEQ ID NO: 485227 - DNA, 17 bp, Homo sapiens
ttgcaaatttgtaaact

SEQ ID NO: 485228 - DNA, 13 bp, Homo sapiens
ttgcccctgagac

SEQ ID NO: 485229 - DNA, 14 bp, Homo sapiens
ttgtaatggtgctt

SEQ ID NO: 485230 - DNA, 15 bp, Homo sapiens
ttgtattaccaaagc

SEQ ID NO: 485231 - DNA, 16 bp, Homo sapiens
ttgtcaaccagtgcaa

SEQ ID NO: 485232 - DNA, 16 bp, Homo sapiens
ttgtttataataaaaa

SEQ ID NO: 485233 - DNA, 11 bp, Homo sapiens
tttaaaaatat

SEQ ID NO: 485234 - DNA, 19 bp, Homo sapiens
tttaaatcctgaagagcat

SEQ ID NO: 485235 - DNA, 14 bp, Homo sapiens
tttaattttcactt

SEQ ID NO: 485236 - DNA, 19 bp, Homo sapiens
tttataaatgcactgtaat

SEQ ID NO: 485237 - DNA, 21 bp, Homo sapiens
tttattaaaatatttcaggtt

SEQ ID NO: 485238 - DNA, 13 bp, Homo sapiens
tttcaaaatgtct

SEQ ID NO: 485239 - DNA, 21 bp, Homo sapiens
acgtacgggaatgtgctttca

SEQ ID NO: 485240 - DNA, 15 bp, Homo sapiens
actagattgtgatcc

SEQ ID NO: 485241 - DNA, 17 bp, Homo sapiens
actagatttataaatgc

SEQ ID NO: 485242 - DNA, 20 bp, Homo sapiens
actagcatagagaatgtgtt

SEQ ID NO: 485243 - DNA, 19 bp, Homo sapiens
actatgcgtggctggaacc

SEQ ID NO: 485244 - DNA, 15 bp, Homo sapiens
actgcctaagccctc

SEQ ID NO: 485245 - DNA, 16 bp, Homo sapiens
actgtaatcgtgctat

SEQ ID NO: 485246 - DNA, 23 bp, Homo sapiens
actgtttttcagggaggtggctg

SEQ ID NO: 485247 - DNA, 15 bp, Homo sapiens
acttataaatttcat

SEQ ID NO: 485248 - DNA, 15 bp, Homo sapiens
acttgttaaatgtat

SEQ ID NO: 485249 - DNA, 15 bp, Homo sapiens
actttctcaggcttc

SEQ ID NO: 485250 - DNA, 21 bp, Homo sapiens
agaaaagtgtaatgcaagaat

SEQ ID NO: 485251 - DNA, 11 bp, Homo sapiens
agaaaccaaat

SEQ ID NO: 485252 - DNA, 14 bp, Homo sapiens
agaaataaaccaaa

SEQ ID NO: 485253 - DNA, 23 bp, Homo sapiens
agaaataaaccaaaggaaaatgt

SEQ ID NO: 485254 - DNA, 21 bp, Homo sapiens
agaactattgtgctcagagac

SEQ ID NO: 485255 - DNA, 23 bp, Homo sapiens
agaactattgtgctcagagacac

SEQ ID NO: 485256 - DNA, 16 bp, Homo sapiens
agaatgttagagtaat

SEQ ID NO: 485257 - DNA, 15 bp, Homo sapiens
agacaaaagagcagt

SEQ ID NO: 485258 - DNA, 12 bp, Homo sapiens
agacaaatattc

SEQ ID NO: 485259 - DNA, 22 bp, Homo sapiens
agacaaatattcctttgcatat

SEQ ID NO: 485260 - DNA, 23 bp, Homo sapiens
agaccaaagacttgttaaatgta

SEQ ID NO: 485261 - DNA, 21 bp, Homo sapiens
agacttgtatagcatgaaata

SEQ ID NO: 485262 - DNA, 20 bp, Homo sapiens
agagacactgttgataaaaa

SEQ ID NO: 485263 - DNA, 22 bp, Homo sapiens
agagacactgttgataaaaact

SEQ ID NO: 485264 - DNA, 12 bp, Homo sapiens
agagaccaaata

SEQ ID NO: 485265 - DNA, 19 bp, Homo sapiens
agagcagtggtaagaatag

SEQ ID NO: 485266 - DNA, 14 bp, Homo sapiens
agagcataatttaa

SEQ ID NO: 485267 - DNA, 18 bp, Homo sapiens
agagcataatttaaaaat

SEQ ID NO: 485268 - DNA, 21 bp, Homo sapiens
agagcataatttaaaaatata

SEQ ID NO: 485269 - DNA, 18 bp, Homo sapiens
agagccatacataaaaga

SEQ ID NO: 485270 - DNA, 17 bp, Homo sapiens
agaggatcaccagtgca

SEQ ID NO: 485271 - DNA, 22 bp, Homo sapiens
agatttataaatgcactgtaat

SEQ ID NO: 485272 - DNA, 23 bp, Homo sapiens
agcaaacgtacgggaatgtgctt

SEQ ID NO: 485273 - DNA, 22 bp, Homo sapiens
agcataatttaaaaatatattt

SEQ ID NO: 485274 - DNA, 19 bp, Homo sapiens
agcatgaaataaaatatat

SEQ ID NO: 485275 - DNA, 12 bp, Homo sapiens
agcatgtgcaat

SEQ ID NO: 485276 - DNA, 17 bp, Homo sapiens
atgtcacaataaaacaa

SEQ ID NO: 485277 - DNA, 16 bp, Homo sapiens
atgtcataaatgtcac

SEQ ID NO: 485278 - DNA, 22 bp, Homo sapiens
atgtctttttattaaaatattt

SEQ ID NO: 485279 - DNA, 16 bp, Homo sapiens
atgtggcctttgaatt

SEQ ID NO: 485280 - DNA, 17 bp, Homo sapiens
atgttgtttataataaa

SEQ ID NO: 485281 - DNA, 20 bp, Homo sapiens
atgttgtttataataaaaat

SEQ ID NO: 485282 - DNA, 13 bp, Homo sapiens
attaaaaaagaga

SEQ ID NO: 485283 - DNA, 16 bp, Homo sapiens
attaaaaaagagacat

SEQ ID NO: 485284 - DNA, 13 bp, Homo sapiens
attaaaatatttc

SEQ ID NO: 485285 - DNA, 14 bp, Homo sapiens
attaaaatatttca

SEQ ID NO: 485286 - DNA, 17 bp, Homo sapiens
attaaaatatttcaggt

SEQ ID NO: 485287 - DNA, 22 bp, Homo sapiens
attaagtgtgtgtatactgtaa

SEQ ID NO: 485288 - DNA, 15 bp, Homo sapiens
attacaaagttaaaa

SEQ ID NO: 485289 - DNA, 13 bp, Homo sapiens
attacatgtaaat

SEQ ID NO: 485290 - DNA, 15 bp, Homo sapiens
attacatgtaaatta

SEQ ID NO: 485291 - DNA, 19 bp, Homo sapiens
attaccaaagcaaggtaca

SEQ ID NO: 485292 - DNA, 22 bp, Homo sapiens
attataaaggataaagaaggat

SEQ ID NO: 485293 - DNA, 19 bp, Homo sapiens
attatttaagactaaaagt

SEQ ID NO: 485294 - DNA, 19 bp, Homo sapiens
attatttgattatttaaga

SEQ ID NO: 485295 - DNA, 18 bp, Homo sapiens
attcagaacataaatgca

SEQ ID NO: 485296 - DNA, 14 bp, Homo sapiens
attcagatgtatgt

SEQ ID NO: 485297 - DNA, 18 bp, Homo sapiens
attcagttccaatacttc

SEQ ID NO: 485298 - DNA, 21 bp, Homo sapiens
attcagttccaatacttcatt

SEQ ID NO: 485299 - DNA, 14 bp, Homo sapiens
attccaatttcaaa

SEQ ID NO: 485300 - DNA, 15 bp, Homo sapiens
attcctgtcaacaag

SEQ ID NO: 485301 - DNA, 15 bp, Homo sapiens
attctcaagccctgc

SEQ ID NO: 485302 - DNA, 17 bp, Homo sapiens
attcttactaaaaagta

SEQ ID NO: 485303 - DNA, 20 bp, Homo sapiens
attctttgtattaccaaagc

SEQ ID NO: 485304 - DNA, 12 bp, Homo sapiens
atttataaacta

SEQ ID NO: 485305 - DNA, 20 bp, Homo sapiens
atttataaatgcactgtaat

SEQ ID NO: 485306 - DNA, 14 bp, Homo sapiens
atttatttccaaaa

SEQ ID NO: 485307 - DNA, 17 bp, Homo sapiens
cctgtccaaactgccta

SEQ ID NO: 485308 - DNA, 17 bp, Homo sapiens
ccttaactggagcccca

SEQ ID NO: 485309 - DNA, 22 bp, Homo sapiens
ccttaatgtgagggtttgtaat

SEQ ID NO: 485310 - DNA, 19 bp, Homo sapiens
cctttttcataaattattt

SEQ ID NO: 485311 - DNA, 17 bp, Homo sapiens
cgaaatatcaaagtcat

SEQ ID NO: 485312 - DNA, 14 bp, Homo sapiens
cgcatgcggcccag

SEQ ID NO: 485313 - DNA, 17 bp, Homo sapiens
cggcccaggatggcttt

SEQ ID NO: 485314 - DNA, 13 bp, Homo sapiens
ctaaaaagtataa

SEQ ID NO: 485315 - DNA, 17 bp, Homo sapiens
ctaaaaagtataaaata

SEQ ID NO: 485316 - DNA, 20 bp, Homo sapiens
ctaacgaaatatcaaagtca

SEQ ID NO: 485317 - DNA, 18 bp, Homo sapiens
ctaatcccgattcaccct

SEQ ID NO: 485318 - DNA, 14 bp, Homo sapiens
ctaattatttaatt

SEQ ID NO: 485319 - DNA, 13 bp, Homo sapiens
ctaccttgtcata

SEQ ID NO: 485320 - DNA, 16 bp, Homo sapiens
ctagatttataaatgc

SEQ ID NO: 485321 - DNA, 13 bp, Homo sapiens
ctattctttgtat

SEQ ID NO: 485322 - DNA, 21 bp, Homo sapiens
ctattttttatcattgaaaca

SEQ ID NO: 485323 - DNA, 23 bp, Homo sapiens
ctcaacccaagaacctgtttcct

SEQ ID NO: 485324 - DNA, 22 bp, Homo sapiens
ctcaagccctgcagtcacagct

SEQ ID NO: 485325 - DNA, 23 bp, Homo sapiens
ctccgccattctcaagccctgca

SEQ ID NO: 485326 - DNA, 23 bp, Homo sapiens
ctctgtcttctttgcccacaatg

SEQ ID NO: 485327 - DNA, 18 bp, Homo sapiens
ctgaaatcccaacaaaaa

SEQ ID NO: 485328 - DNA, 17 bp, Homo sapiens
ctgaaggggttctcaca

SEQ ID NO: 485329 - DNA, 22 bp, Homo sapiens
ctgacatgccatccttccagca

SEQ ID NO: 485330 - DNA, 22 bp, Homo sapiens
ctgattcttgttgctgtacaaa

SEQ ID NO: 485331 - DNA, 15 bp, Homo sapiens
ctgcatttaaaaaaa

SEQ ID NO: 485332 - DNA, 17 bp, Homo sapiens
ctgctctcatataagac

SEQ ID NO: 485333 - DNA, 22 bp, Homo sapiens
ctggcccacacgtgcatagagg

SEQ ID NO: 485334 - DNA, 13 bp, Homo sapiens
ctgggcagaaggc

SEQ ID NO: 485335 - DNA, 17 bp, Homo sapiens
ctgggcagaaggccaag

SEQ ID NO: 485336 - DNA, 19 bp, Homo sapiens
ctgtaaaggtcaacaataa

SEQ ID NO: 485337 - DNA, 21 bp, Homo sapiens
ctgtaaaggtcaacaataaaa

SEQ ID NO: 485338 - DNA, 16 bp, Homo sapiens
ctgtaacttccaaata

SEQ ID NO: 485339 - DNA, 15 bp, Homo sapiens
ctgtacaaaagcaat

SEQ ID NO: 485340 - DNA, 16 bp, Homo sapiens
ctgtcaatgagagcat

SEQ ID NO: 485341 - DNA, 22 bp, Homo sapiens
ctgtcaatgagagcataattta

SEQ ID NO: 485342 - DNA, 20 bp, Homo sapiens
ctgtccaaactgcctaagcc

SEQ ID NO: 485343 - DNA, 20 bp, Homo sapiens
ctgtgaacaagcttcagtaa

SEQ ID NO: 485344 - DNA, 22 bp, Homo sapiens
ctgttccaccaaatacaattca

SEQ ID NO: 485345 - DNA, 21 bp, Homo sapiens
cttacagacacccataataaa

SEQ ID NO: 485346 - DNA, 17 bp, Homo sapiens
cttactaaaaagtataa

SEQ ID NO: 485347 - DNA, 21 bp, Homo sapiens
cttactaaaaagtataaaata

SEQ ID NO: 485348 - DNA, 15 bp, Homo sapiens
cttagaaaccaaatt

SEQ ID NO: 485349 - DNA, 20 bp, Homo sapiens
cttataaagtggaagtatgt

SEQ ID NO: 485350 - DNA, 13 bp, Homo sapiens
cttataaatttca

SEQ ID NO: 485351 - DNA, 15 bp, Homo sapiens
cttattaagaccaaa

SEQ ID NO: 485352 - DNA, 17 bp, Homo sapiens
cttattaagaccaaaga

SEQ ID NO: 485353 - DNA, 15 bp, Homo sapiens
cttcagccaggagct

SEQ ID NO: 485354 - DNA, 19 bp, Homo sapiens
cttcagccaggagctgggc

SEQ ID NO: 485355 - DNA, 14 bp, Homo sapiens
cttcatcacagcat

SEQ ID NO: 485356 - DNA, 19 bp, Homo sapiens
cttcattaatttcaatcaa

SEQ ID NO: 485357 - DNA, 15 bp, Homo sapiens
cttccaaataaataa

SEQ ID NO: 485358 - DNA, 16 bp, Homo sapiens
cttgataaagggccaa

SEQ ID NO: 485359 - DNA, 16 bp, Homo sapiens
cttggttctgtgaaca

SEQ ID NO: 485360 - DNA, 13 bp, Homo sapiens
cttgttaaatgta

SEQ ID NO: 485361 - DNA, 14 bp, Homo sapiens
cttgttctaatctt

SEQ ID NO: 485362 - DNA, 20 bp, Homo sapiens
ctttatgataacaacactgt

SEQ ID NO: 485363 - DNA, 19 bp, Homo sapiens
ctttcaccaagtaaatttg

SEQ ID NO: 485364 - DNA, 16 bp, Homo sapiens
ctttcacttttaaact

SEQ ID NO: 485365 - DNA, 23 bp, Homo sapiens
ctttgcatattataaaggataaa

SEQ ID NO: 485366 - DNA, 12 bp, Homo sapiens
ctttgcttctcc

SEQ ID NO: 485367 - DNA, 17 bp, Homo sapiens
ctttgtattaccaaagc

SEQ ID NO: 485368 - DNA, 21 bp, Homo sapiens
ctttttaaaaattgttattta

SEQ ID NO: 485369 - DNA, 17 bp, Homo sapiens
ctttttttttttttcct

SEQ ID NO: 485370 - DNA, 21 bp, Homo sapiens
gaaaagggagattcagactgt

SEQ ID NO: 485371 - DNA, 17 bp, Homo sapiens
gaaaatgtctgtaataa

SEQ ID NO: 485372 - DNA, 22 bp, Homo sapiens
gaaaatgtctgtaataatagac

SEQ ID NO: 485373 - DNA, 19 bp, Homo sapiens
gaaataaaccaaaggaaaa

SEQ ID NO: 485374 - DNA, 23 bp, Homo sapiens
gaaatatcaaagtcattaaagac

SEQ ID NO: 485375 - DNA, 21 bp, Homo sapiens
gaaatggaggatctctaaaga

SEQ ID NO: 485376 - DNA, 23 bp, Homo sapiens
gaaatttgggagagccatacata

SEQ ID NO: 485377 - DNA, 13 bp, Homo sapiens
gaacaagcttcag

SEQ ID NO: 485378 - DNA, 19 bp, Homo sapiens
gaaccacattgaagaatgt

SEQ ID NO: 485379 - DNA, 15 bp, Homo sapiens
gaactatattttccc

SEQ ID NO: 485380 - DNA, 18 bp, Homo sapiens
gaactatattttccccca

SEQ ID NO: 485381 - DNA, 20 bp, Homo sapiens
gaactattgtgctcagagac

SEQ ID NO: 485382 - DNA, 22 bp, Homo sapiens
gaagaaccgccgttcccttgaa

SEQ ID NO: 485383 - DNA, 21 bp, Homo sapiens
gaaggatgatgtctttttatt

SEQ ID NO: 485384 - DNA, 18 bp, Homo sapiens
gacactgttgataaaaac

SEQ ID NO: 485385 - DNA, 21 bp, Homo sapiens
gaccaaagacttgttaaatgt

SEQ ID NO: 485386 - DNA, 22 bp, Homo sapiens
gaccaaagacttgttaaatgta

SEQ ID NO: 485387 - DNA, 16 bp, Homo sapiens
gaccaaataattaaaa

SEQ ID NO: 485388 - DNA, 18 bp, Homo sapiens
gaccaaataattaaaaga

SEQ ID NO: 485389 - DNA, 11 bp, Homo sapiens
gagaccaaata

SEQ ID NO: 485390 - DNA, 17 bp, Homo sapiens
gagaccaaataattaaa

SEQ ID NO: 485391 - DNA, 16 bp, Homo sapiens
gagagcataatttaaa

SEQ ID NO: 485392 - DNA, 17 bp, Homo sapiens
gagcataatttaaaaat

SEQ ID NO: 485393 - DNA, 14 bp, Homo sapiens
gagccatacataaa

SEQ ID NO: 485394 - DNA, 19 bp, Homo sapiens
gagctgggcagaaggccaa

SEQ ID NO: 485395 - DNA, 16 bp, Homo sapiens
gaggatcaccagtgca

SEQ ID NO: 485396 - DNA, 20 bp, Homo sapiens
gaggcccgcatgcggcccag

SEQ ID NO: 485397 - DNA, 17 bp, Homo sapiens
gatattcagatgtatgt

SEQ ID NO: 485398 - DNA, 21 bp, Homo sapiens
gatcacagcttcagccaggag

SEQ ID NO: 485399 - DNA, 17 bp, Homo sapiens
gattatttaagactaaa

SEQ ID NO: 485400 - DNA, 21 bp, Homo sapiens
gattcaccctgtccaaactgc

SEQ ID NO: 485401 - DNA, 14 bp, Homo sapiens
gatttataaatgca

SEQ ID NO: 485402 - DNA, 18 bp, Homo sapiens
gcaaacgtacgggaatgt

SEQ ID NO: 485403 - DNA, 12 bp, Homo sapiens
gcaaagaaaatg

SEQ ID NO: 485404 - DNA, 18 bp, Homo sapiens
gcacttattgaatatatg

SEQ ID NO: 485405 - DNA, 20 bp, Homo sapiens
gcacttattgaatatatgat

SEQ ID NO: 485406 - DNA, 13 bp, Homo sapiens
gcataaagtaaat

SEQ ID NO: 485407 - DNA, 16 bp, Homo sapiens
gcataaagtaaataca

SEQ ID NO: 485408 - DNA, 16 bp, Homo sapiens
gcataatttaaaaata

SEQ ID NO: 485409 - DNA, 20 bp, Homo sapiens
gcataatttaaaaatatatt

SEQ ID NO: 485410 - DNA, 19 bp, Homo sapiens
gcatatttgcaaagtgtat

SEQ ID NO: 485411 - DNA, 21 bp, Homo sapiens
gcatccttcatcacagcatgt

SEQ ID NO: 485412 - DNA, 20 bp, Homo sapiens
ctgagacaaatggaggcctg

SEQ ID NO: 485413 - DNA, 20 bp, Homo sapiens
ctggaaccacattgaagaat

SEQ ID NO: 485414 - DNA, 14 bp, Homo sapiens
ctgggcagaaggcc

SEQ ID NO: 485415 - DNA, 14 bp, Homo sapiens
ctgttgataaaaac

SEQ ID NO: 485416 - DNA, 16 bp, Homo sapiens
cttaactggagcccca

SEQ ID NO: 485417 - DNA, 18 bp, Homo sapiens
cttactaaaaagtataaa

SEQ ID NO: 485418 - DNA, 18 bp, Homo sapiens
cttataaagtggaagtat

SEQ ID NO: 485419 - DNA, 24 bp, Homo sapiens
cttataaagtggaagtatgtatat

SEQ ID NO: 485420 - DNA, 19 bp, Homo sapiens
cttatctcagttatgagta

SEQ ID NO: 485421 - DNA, 18 bp, Homo sapiens
cttcattaatttcaatca

SEQ ID NO: 485422 - DNA, 19 bp, Homo sapiens
cttcattgccttaactgga

SEQ ID NO: 485423 - DNA, 15 bp, Homo sapiens
cttggaaaggaccag

SEQ ID NO: 485424 - DNA, 22 bp, Homo sapiens
cttggatatataggctattttc

SEQ ID NO: 485425 - DNA, 21 bp, Homo sapiens
cttgtatagcatgaaataaaa

SEQ ID NO: 485426 - DNA, 15 bp, Homo sapiens
cttgtcatatgtgtt

SEQ ID NO: 485427 - DNA, 17 bp, Homo sapiens
cttgtcatatgtgttga

SEQ ID NO: 485428 - DNA, 17 bp, Homo sapiens
cttttaggacccttccc

SEQ ID NO: 485429 - DNA, 13 bp, Homo sapiens
ctttttattaaaa

SEQ ID NO: 485430 - DNA, 16 bp, Homo sapiens
ctttttattaaaatat

SEQ ID NO: 485431 - DNA, 17 bp, Homo sapiens
gaaaatgaaatgcatat

SEQ ID NO: 485432 - DNA, 18 bp, Homo sapiens
gaaaatgaaatgcatatt

SEQ ID NO: 485433 - DNA, 16 bp, Homo sapiens
gaaatcccaacaaaaa

SEQ ID NO: 485434 - DNA, 19 bp, Homo sapiens
gaagaatgttagagtaatg

SEQ ID NO: 485435 - DNA, 21 bp, Homo sapiens
gaagtatgtatattaaaaaag

SEQ ID NO: 485436 - DNA, 22 bp, Homo sapiens
gaagtgcggggtaggggaagaa

SEQ ID NO: 485437 - DNA, 16 bp, Homo sapiens
gaagtgtttatgttgt

SEQ ID NO: 485438 - DNA, 23 bp, Homo sapiens
gaatatgtagtatctatatgact

SEQ ID NO: 485439 - DNA, 11 bp, Homo sapiens
gacaaatattc

SEQ ID NO: 485440 - DNA, 22 bp, Homo sapiens
gacaaatattcctttgcatatt

SEQ ID NO: 485441 - DNA, 16 bp, Homo sapiens
gactaccctagttcaa

SEQ ID NO: 485442 - DNA, 23 bp, Homo sapiens
gacttgtatagcatgaaataaaa

SEQ ID NO: 485443 - DNA, 15 bp, Homo sapiens
gacttgttaaatgta

SEQ ID NO: 485444 - DNA, 16 bp, Homo sapiens
gagacactgttgataa

SEQ ID NO: 485445 - DNA, 14 bp, Homo sapiens
gagattcagactgt

SEQ ID NO: 485446 - DNA, 17 bp, Homo sapiens
gagctgggcagaaggcc

SEQ ID NO: 485447 - DNA, 21 bp, Homo sapiens
gaggaccaggaaacagcctca

SEQ ID NO: 485448 - DNA, 14 bp, Homo sapiens
gaggtggctgggtt

SEQ ID NO: 485449 - DNA, 13 bp, Homo sapiens
gatcaccagtgca

SEQ ID NO: 485450 - DNA, 21 bp, Homo sapiens
gatggctttgaatgcggccca

SEQ ID NO: 485451 - DNA, 18 bp, Homo sapiens
gcaagtgaccgacaaaat

SEQ ID NO: 485452 - DNA, 23 bp, Homo sapiens
gcaagtgaccgacaaaattccag

SEQ ID NO: 485453 - DNA, 22 bp, Homo sapiens
gcactattctttgtattaccaa

SEQ ID NO: 485454 - DNA, 15 bp, Homo sapiens
gcagaagcatttgaa

SEQ ID NO: 485455 - DNA, 17 bp, Homo sapiens
gcataatttaaaaatat

SEQ ID NO: 485456 - DNA, 19 bp, Homo sapiens
gcatataatgaataaatca

SEQ ID NO: 485457 - DNA, 16 bp, Homo sapiens
gcattcagaacataaa

SEQ ID NO: 485458 - DNA, 15 bp, Homo sapiens
gcccagagaagccaa

SEQ ID NO: 485459 - DNA, 22 bp, Homo sapiens
gcccctgagacaaatggaggcc

SEQ ID NO: 485460 - DNA, 17 bp, Homo sapiens
gcccgcatgcggcccag

SEQ ID NO: 485461 - DNA, 16 bp, Homo sapiens
gctacacagatcacag

SEQ ID NO: 485462 - DNA, 15 bp, Homo sapiens
gctagtaaattttca

SEQ ID NO: 485463 - DNA, 13 bp, Homo sapiens
gctgggcagaagg

SEQ ID NO: 485464 - DNA, 19 bp, Homo sapiens
gctgggcagaaggccaaga

SEQ ID NO: 485465 - DNA, 17 bp, Homo sapiens
gcttattaagaccaaag

SEQ ID NO: 485466 - DNA, 18 bp, Homo sapiens
gcttattaagaccaaaga

SEQ ID NO: 485467 - DNA, 14 bp, Homo sapiens
ggaaacagcctcag

SEQ ID NO: 485468 - DNA, 23 bp, Homo sapiens
ggaaattttacaagggcataaag

SEQ ID NO: 485469 - DNA, 24 bp, Homo sapiens
ggagaaagcttggttctgtgaaca

SEQ ID NO: 485470 - DNA, 16 bp, Homo sapiens
ggcagaaggccaagag

SEQ ID NO: 485471 - DNA, 12 bp, Homo sapiens
ggcataaagtaa

SEQ ID NO: 485472 - DNA, 21 bp, Homo sapiens
ggccagaggatcaccagtgca

SEQ ID NO: 485473 - DNA, 15 bp, Homo sapiens
gggaatgtgctttca

SEQ ID NO: 485474 - DNA, 12 bp, Homo sapiens
gggagccagggc

SEQ ID NO: 485475 - DNA, 14 bp, Homo sapiens
gggaggtggctggg

SEQ ID NO: 485476 - DNA, 14 bp, Homo sapiens
gggcataaagtaaa

SEQ ID NO: 485477 - DNA, 12 bp, Homo sapiens
gggtttgtaatg

SEQ ID NO: 485478 - DNA, 17 bp, Homo sapiens
ggtacaatctttcacca

SEQ ID NO: 485479 - DNA, 22 bp, Homo sapiens
ggtcaacaataaaaaccaaatt

SEQ ID NO: 485480 - DNA, 19 bp, Homo sapiens
ggtgctagtaaattttcaa

SEQ ID NO: 485481 - DNA, 16 bp, Homo sapiens
ggtttgtaatggtgct

SEQ ID NO: 485482 - DNA, 17 bp, Homo sapiens
ggtttgtaatggtgctt

SEQ ID NO: 485483 - DNA, 16 bp, Homo sapiens
gtaaatacatgcatat

SEQ ID NO: 485484 - DNA, 16 bp, Homo sapiens
gtaagttatctttgaa

SEQ ID NO: 485485 - DNA, 17 bp, Homo sapiens
gtaatacttccagaagt

SEQ ID NO: 485486 - DNA, 20 bp, Homo sapiens
gtacaatctttcaccaagta

SEQ ID NO: 485487 - DNA, 15 bp, Homo sapiens
gtataaataagcact

SEQ ID NO: 485488 - DNA, 14 bp, Homo sapiens
gtataatacattac

SEQ ID NO: 485489 - DNA, 12 bp, Homo sapiens
gtatactgtaat

SEQ ID NO: 485490 - DNA, 23 bp, Homo sapiens
gtatgtatattaaaaaagagaca

SEQ ID NO: 485491 - DNA, 17 bp, Homo sapiens
gtcaacaataaaaacca

SEQ ID NO: 485492 - DNA, 17 bp, Homo sapiens
gtcacaataaaacaatc

SEQ ID NO: 485493 - DNA, 19 bp, Homo sapiens
gtcacacattacaaagtta

SEQ ID NO: 485494 - DNA, 12 bp, Homo sapiens
gtcatatgtgtt

SEQ ID NO: 485495 - DNA, 17 bp, Homo sapiens
gtcattcctgtcaacaa

SEQ ID NO: 485496 - DNA, 14 bp, Homo sapiens
gtccaaactgccta

SEQ ID NO: 485497 - DNA, 21 bp, Homo sapiens
gtccaaactgcctaagccctc

SEQ ID NO: 485498 - DNA, 15 bp, Homo sapiens
gtcctgacctgtctc

SEQ ID NO: 485499 - DNA, 24 bp, Homo sapiens
gtcttttaggacccttcccttgag

SEQ ID NO: 485500 - DNA, 14 bp, Homo sapiens
gtgctagtaaattt

SEQ ID NO: 485501 - DNA, 22 bp, Homo sapiens
gtggcaaagccttcattgcctt

SEQ ID NO: 485502 - DNA, 22 bp, Homo sapiens
gtggctggaaccacattgaaga

SEQ ID NO: 485503 - DNA, 13 bp, Homo sapiens
gtgtatactgtaa

SEQ ID NO: 485504 - DNA, 14 bp, Homo sapiens
gtgtgtatactgta

SEQ ID NO: 485505 - DNA, 16 bp, Homo sapiens
gtgtgtatactgtaat

SEQ ID NO: 485506 - DNA, 20 bp, Homo sapiens
gttatgagtataatacatta

SEQ ID NO: 485507 - DNA, 16 bp, Homo sapiens
gttatttatttccaaa

SEQ ID NO: 485508 - DNA, 12 bp, Homo sapiens
gttgataaaaac

SEQ ID NO: 485509 - DNA, 23 bp, Homo sapiens
gttgcattttaaccctattttac

SEQ ID NO: 485510 - DNA, 13 bp, Homo sapiens
gtttataataaaa

SEQ ID NO: 485511 - DNA, 14 bp, Homo sapiens
gtttataataaaaa

SEQ ID NO: 485512 - DNA, 15 bp, Homo sapiens
gtttataataaaaat

SEQ ID NO: 485513 - DNA, 13 bp, Homo sapiens
taaaaaagagaca

SEQ ID NO: 485514 - DNA, 20 bp, Homo sapiens
taaaaactcaggcaaagaaa

SEQ ID NO: 485515 - DNA, 19 bp, Homo sapiens
taaaaagtataaaatagta

SEQ ID NO: 485516 - DNA, 20 bp, Homo sapiens
taaaacttataaatttcatt

SEQ ID NO: 485517 - DNA, 15 bp, Homo sapiens
taaaattgttatcaa

SEQ ID NO: 485518 - DNA, 15 bp, Homo sapiens
taaagacaggagaca

SEQ ID NO: 485519 - DNA, 22 bp, Homo sapiens
taaagacttgtatagcatgaaa

SEQ ID NO: 485520 - DNA, 14 bp, Homo sapiens
taaaggataaagaa

SEQ ID NO: 485521 - DNA, 16 bp, Homo sapiens
taaataaagtctcctg

SEQ ID NO: 485522 - DNA, 13 bp, Homo sapiens
taaataagcacta

SEQ ID NO: 485523 - DNA, 12 bp, Homo sapiens
taaattaagtgt

SEQ ID NO: 485524 - DNA, 20 bp, Homo sapiens
taaattatttgattatttaa

SEQ ID NO: 485525 - DNA, 20 bp, Homo sapiens
taaatttgtataaataagca

SEQ ID NO: 485526 - DNA, 15 bp, Homo sapiens
taacttccaaataaa

SEQ ID NO: 485527 - DNA, 19 bp, Homo sapiens
taagaccaaagacttgtta

SEQ ID NO: 485528 - DNA, 16 bp, Homo sapiens
taagctaccttgtcat

SEQ ID NO: 485529 - DNA, 19 bp, Homo sapiens
taagtgtgtgtatactgta

SEQ ID NO: 485530 - DNA, 21 bp, Homo sapiens
taagtgtgtgtatactgtaat

SEQ ID NO: 485531 - DNA, 15 bp, Homo sapiens
taatacattacatgt

SEQ ID NO: 485532 - DNA, 17 bp, Homo sapiens
taatacattacatgtaa

SEQ ID NO: 485533 - DNA, 17 bp, Homo sapiens
taatcccgattcaccct

SEQ ID NO: 485534 - DNA, 18 bp, Homo sapiens
taatgtgagggtttgtaa

SEQ ID NO: 485535 - DNA, 22 bp, Homo sapiens
taatttaaaaatatatttataa

SEQ ID NO: 485536 - DNA, 18 bp, Homo sapiens
taatttcaatcaaccaaa

SEQ ID NO: 485537 - DNA, 19 bp, Homo sapiens
tacaagggcataaagtaaa

SEQ ID NO: 485538 - DNA, 21 bp, Homo sapiens
tacacaacttagaaaccaaat

SEQ ID NO: 485539 - DNA, 22 bp, Homo sapiens
tacacagatcacagcttcagcc

SEQ ID NO: 485540 - DNA, 23 bp, Homo sapiens
tacaggtgactaccctagttcaa

SEQ ID NO: 485541 - DNA, 13 bp, Homo sapiens
tacataaaagaaa

SEQ ID NO: 485542 - DNA, 17 bp, Homo sapiens
tacataaaagaaataaa

SEQ ID NO: 485543 - DNA, 20 bp, Homo sapiens
tacatgcatataatgaataa

SEQ ID NO: 485544 - DNA, 16 bp, Homo sapiens
tacatgtaaattaagt

SEQ ID NO: 485545 - DNA, 16 bp, Homo sapiens
tacattacatgtaaat

SEQ ID NO: 485546 - DNA, 17 bp, Homo sapiens
tacattacatgtaaatt

SEQ ID NO: 485547 - DNA, 18 bp, Homo sapiens
tacattacatgtaaatta

SEQ ID NO: 485548 - DNA, 12 bp, Homo sapiens
taccaattccaa

SEQ ID NO: 485549 - DNA, 22 bp, Homo sapiens
taccctcggtcattcctgtcaa

SEQ ID NO: 485550 - DNA, 18 bp, Homo sapiens
tacctagctaattattta

SEQ ID NO: 485551 - DNA, 12 bp, Homo sapiens
tagaaaccaaat

SEQ ID NO: 485552 - DNA, 20 bp, Homo sapiens
tagaactatattttccccca

SEQ ID NO: 485553 - DNA, 14 bp, Homo sapiens
tagaccaagcttgt

SEQ ID NO: 485554 - DNA, 18 bp, Homo sapiens
tagaccaagcttgtccaa

SEQ ID NO: 485555 - DNA, 14 bp, Homo sapiens
tagagtaatgaaat

SEQ ID NO: 485556 - DNA, 15 bp, Homo sapiens
tagagtaatgaaatg

SEQ ID NO: 485557 - DNA, 17 bp, Homo sapiens
tagagtaatgaaatgga

SEQ ID NO: 485558 - DNA, 13 bp, Homo sapiens
taggacccttccc

SEQ ID NO: 485559 - DNA, 15 bp, Homo sapiens
tagtatctatatgac

SEQ ID NO: 485560 - DNA, 16 bp, Homo sapiens
tataaaggataaagaa

SEQ ID NO: 485561 - DNA, 21 bp, Homo sapiens
tataaatgcactgtaatatgt

SEQ ID NO: 485562 - DNA, 18 bp, Homo sapiens
tataataaaaatatattt

SEQ ID NO: 485563 - DNA, 19 bp, Homo sapiens
tataataaataaacttcaa

SEQ ID NO: 485564 - DNA, 16 bp, Homo sapiens
tataatacattacatg

SEQ ID NO: 485565 - DNA, 18 bp, Homo sapiens
tataatacattacatgta

SEQ ID NO: 485566 - DNA, 17 bp, Homo sapiens
tataggctattttctaa

SEQ ID NO: 485567 - DNA, 23 bp, Homo sapiens
tatataggctattttctaaagac

SEQ ID NO: 485568 - DNA, 15 bp, Homo sapiens
tatcataggtacaat

SEQ ID NO: 485569 - DNA, 15 bp, Homo sapiens
tatcattgaaacatt

SEQ ID NO: 485570 - DNA, 16 bp, Homo sapiens
tatcattgaaacattt

SEQ ID NO: 485571 - DNA, 18 bp, Homo sapiens
tatcattgaaacatttat

SEQ ID NO: 485572 - DNA, 17 bp, Homo sapiens
tatgataacaacactgt

SEQ ID NO: 485573 - DNA, 21 bp, Homo sapiens
tatgtacacaacttagaaacc

SEQ ID NO: 485574 - DNA, 19 bp, Homo sapiens
tatgtagtatctatatgac

SEQ ID NO: 485575 - DNA, 18 bp, Homo sapiens
tatgtatattaaaaaaga

SEQ ID NO: 485576 - DNA, 17 bp, Homo sapiens
tattaaaaaagagacat

SEQ ID NO: 485577 - DNA, 23 bp, Homo sapiens
tattaaaaaagagacatccaaat

SEQ ID NO: 485578 - DNA, 18 bp, Homo sapiens
tattaagaccaaagactt

SEQ ID NO: 485579 - DNA, 20 bp, Homo sapiens
tattcagttccaatacttca

SEQ ID NO: 485580 - DNA, 14 bp, Homo sapiens
tatttaagactaaa

SEQ ID NO: 485581 - DNA, 18 bp, Homo sapiens
tatttatttccaaaatgt

SEQ ID NO: 485582 - DNA, 14 bp, Homo sapiens
tatttgattattta

SEQ ID NO: 485583 - DNA, 20 bp, Homo sapiens
tatttggtgctagtaaattt

SEQ ID NO: 485584 - DNA, 19 bp, Homo sapiens
tatttttttaccaattcca

SEQ ID NO: 485585 - DNA, 13 bp, Homo sapiens
tcaaagtcattaa

SEQ ID NO: 485586 - DNA, 18 bp, Homo sapiens
tcaaagtcattaaagaca

SEQ ID NO: 485587 - DNA, 14 bp, Homo sapiens
tcaacaataaaaac

SEQ ID NO: 485588 - DNA, 14 bp, Homo sapiens
tcaatcaaccaaag

SEQ ID NO: 485589 - DNA, 15 bp, Homo sapiens
tcaatcaaccaaagt

SEQ ID NO: 485590 - DNA, 20 bp, Homo sapiens
tcaatcaaccaaagttagtt

SEQ ID NO: 485591 - DNA, 13 bp, Homo sapiens
tcaatgagagcat

SEQ ID NO: 485592 - DNA, 23 bp, Homo sapiens
tcaatggtgctataataaataaa

SEQ ID NO: 485593 - DNA, 14 bp, Homo sapiens
tcacagcatgtgca

SEQ ID NO: 485594 - DNA, 16 bp, Homo sapiens
tcacagcttcagccag

SEQ ID NO: 485595 - DNA, 17 bp, Homo sapiens
tcacagcttcagccagg

SEQ ID NO: 485596 - DNA, 16 bp, Homo sapiens
tcaccaagtaaatttg

SEQ ID NO: 485597 - DNA, 19 bp, Homo sapiens
tcaccagtgcatccttcat

SEQ ID NO: 485598 - DNA, 20 bp, Homo sapiens
tcaccatccagagaccaaat

SEQ ID NO: 485599 - DNA, 21 bp, Homo sapiens
tcaccatccagagaccaaata

SEQ ID NO: 485600 - DNA, 23 bp, Homo sapiens
tcaccatccagagaccaaataat

SEQ ID NO: 485601 - DNA, 21 bp, Homo sapiens
tcaccctgtccaaactgccta

SEQ ID NO: 485602 - DNA, 13 bp, Homo sapiens
tcagctccagctg

SEQ ID NO: 485603 - DNA, 19 bp, Homo sapiens
tcagtagcttatctcagtt

SEQ ID NO: 485604 - DNA, 17 bp, Homo sapiens
tcataaatgtcacaata

SEQ ID NO: 485605 - DNA, 11 bp, Homo sapiens
tcataaattat

SEQ ID NO: 485606 - DNA, 13 bp, Homo sapiens
tcataaattattt

SEQ ID NO: 485607 - DNA, 17 bp, Homo sapiens
tcatatcataggtacaa

SEQ ID NO: 485608 - DNA, 21 bp, Homo sapiens
tcatatcataggtacaatctt

SEQ ID NO: 485609 - DNA, 12 bp, Homo sapiens
tcatgtgtgtag

SEQ ID NO: 485610 - DNA, 15 bp, Homo sapiens
tcattaaagacagga

SEQ ID NO: 485611 - DNA, 12 bp, Homo sapiens
tcattcctgtca

SEQ ID NO: 485612 - DNA, 15 bp, Homo sapiens
tcattgaaacattta

SEQ ID NO: 485613 - DNA, 20 bp, Homo sapiens
tcattgccttaactggagcc

SEQ ID NO: 485614 - DNA, 14 bp, Homo sapiens
tccaacgtggccca

SEQ ID NO: 485615 - DNA, 19 bp, Homo sapiens
tccaccaaatacaattcaa

SEQ ID NO: 485616 - DNA, 21 bp, Homo sapiens
tccaccaaatacaattcaaat

SEQ ID NO: 485617 - DNA, 15 bp, Homo sapiens
tccagagaccaaata

SEQ ID NO: 485618 - DNA, 15 bp, Homo sapiens
tccagttatttattt

SEQ ID NO: 485619 - DNA, 23 bp, Homo sapiens
tccttacagacacccataataaa

SEQ ID NO: 485620 - DNA, 15 bp, Homo sapiens
tccttcatcacagca

SEQ ID NO: 485621 - DNA, 17 bp, Homo sapiens
tctactagattgtgatc

SEQ ID NO: 485622 - DNA, 19 bp, Homo sapiens
tctcacagtgggagccagg

SEQ ID NO: 485623 - DNA, 22 bp, Homo sapiens
tcttgaaaactgggacgtgtat

SEQ ID NO: 485624 - DNA, 15 bp, Homo sapiens
tcttgcatggatttg

SEQ ID NO: 485625 - DNA, 18 bp, Homo sapiens
tcttgttgctgtacaaaa

SEQ ID NO: 485626 - DNA, 16 bp, Homo sapiens
tctttgaatatgtagt

SEQ ID NO: 485627 - DNA, 18 bp, Homo sapiens
tctttgtattaccaaagc

SEQ ID NO: 485628 - DNA, 16 bp, Homo sapiens
tctttttttgctgttc

SEQ ID NO: 485629 - DNA, 21 bp, Homo sapiens
tctttttttgctgttccacca

SEQ ID NO: 485630 - DNA, 15 bp, Homo sapiens
tgaaacatttataaa

SEQ ID NO: 485631 - DNA, 12 bp, Homo sapiens
tgaaataaaata

SEQ ID NO: 485632 - DNA, 12 bp, Homo sapiens
tgaatatatgat

SEQ ID NO: 485633 - DNA, 23 bp, Homo sapiens
tgaatatgtagtatctatatgac

SEQ ID NO: 485634 - DNA, 17 bp, Homo sapiens
tgaccgacaaaattcca

SEQ ID NO: 485635 - DNA, 20 bp, Homo sapiens
tgactatgcgtggctggaac

SEQ ID NO: 485636 - DNA, 18 bp, Homo sapiens
tgagacaaatggaggcct

SEQ ID NO: 485637 - DNA, 23 bp, Homo sapiens
tgagtataatacattacatgtaa

SEQ ID NO: 485638 - DNA, 24 bp, Homo sapiens
tgagtataatacattacatgtaaa

SEQ ID NO: 485639 - DNA, 15 bp, Homo sapiens
tgcatccttcatcac

SEQ ID NO: 485640 - DNA, 16 bp, Homo sapiens
tgccttaactggagcc

SEQ ID NO: 485641 - DNA, 21 bp, Homo sapiens
tgctattttttatcattgaaa

SEQ ID NO: 485642 - DNA, 23 bp, Homo sapiens
tgctgttccaccaaatacaattc

SEQ ID NO: 485643 - DNA, 22 bp, Homo sapiens
tgcttattaagaccaaagactt

SEQ ID NO: 485644 - DNA, 15 bp, Homo sapiens
tgcttctccaaatac

SEQ ID NO: 485645 - DNA, 19 bp, Homo sapiens
tggatatataggctatttt

SEQ ID NO: 485646 - DNA, 21 bp, Homo sapiens
tggcaaagccttcattgcctt

SEQ ID NO: 485647 - DNA, 19 bp, Homo sapiens
tggcaatgactcaaagtct

SEQ ID NO: 485648 - DNA, 15 bp, Homo sapiens
tgggcagaaggccaa

SEQ ID NO: 485649 - DNA, 19 bp, Homo sapiens
tggtacctatttggtgcta

SEQ ID NO: 485650 - DNA, 16 bp, Homo sapiens
tggtgtggcaaagcct

SEQ ID NO: 485651 - DNA, 17 bp, Homo sapiens
tgtaacttccaaataaa

SEQ ID NO: 485652 - DNA, 15 bp, Homo sapiens
tgtacaaaagcaatg

SEQ ID NO: 485653 - DNA, 13 bp, Homo sapiens
tgtatactgtaat

SEQ ID NO: 485654 - DNA, 19 bp, Homo sapiens
tgtatagcatgaaataaaa

SEQ ID NO: 485655 - DNA, 22 bp, Homo sapiens
tgtcaacaaggggtcaatgtca

SEQ ID NO: 485656 - DNA, 17 bp, Homo sapiens
tgtcaatgagagcataa

SEQ ID NO: 485657 - DNA, 21 bp, Homo sapiens
tgtcataaatgtcacaataaa

SEQ ID NO: 485658 - DNA, 17 bp, Homo sapiens
tgtccaaactgcctaag

SEQ ID NO: 485659 - DNA, 22 bp, Homo sapiens
tgtccaaactgcctaagccctc

SEQ ID NO: 485660 - DNA, 21 bp, Homo sapiens
tgtctttttattaaaatattt

SEQ ID NO: 485661 - DNA, 14 bp, Homo sapiens
tgtgtatactgtaa

SEQ ID NO: 485662 - DNA, 19 bp, Homo sapiens
tgttaaatgtatacaccaa

SEQ ID NO: 485663 - DNA, 13 bp, Homo sapiens
tgttatcaaaata

SEQ ID NO: 485664 - DNA, 22 bp, Homo sapiens
tgttccaccaaatacaattcaa

SEQ ID NO: 485665 - DNA, 19 bp, Homo sapiens
tgttgctgtacaaaagcaa

SEQ ID NO: 485666 - DNA, 20 bp, Homo sapiens
tgttgtttataataaaaata

SEQ ID NO: 485667 - DNA, 20 bp, Homo sapiens
tgttttatttttttaccaat

SEQ ID NO: 485668 - DNA, 18 bp, Homo sapiens
ttaaagacaggagacaaa

SEQ ID NO: 485669 - DNA, 16 bp, Homo sapiens
ttaagaccaaagactt

SEQ ID NO: 485670 - DNA, 18 bp, Homo sapiens
ttaagaccaaagacttgt

SEQ ID NO: 485671 - DNA, 15 bp, Homo sapiens
ttacatgtaaattaa

SEQ ID NO: 485672 - DNA, 16 bp, Homo sapiens
ttacatgtaaattaag

SEQ ID NO: 485673 - DNA, 12 bp, Homo sapiens
ttaccaattcca

SEQ ID NO: 485674 - DNA, 18 bp, Homo sapiens
ttacctagctaattattt

SEQ ID NO: 485675 - DNA, 15 bp, Homo sapiens
ttactaaaaagtata

SEQ ID NO: 485676 - DNA, 13 bp, Homo sapiens
ttagaaaccaaat

SEQ ID NO: 485677 - DNA, 17 bp, Homo sapiens
ttataaatgcactgtaa

SEQ ID NO: 485678 - DNA, 22 bp, Homo sapiens
ttataaatgcactgtaatatgt

SEQ ID NO: 485679 - DNA, 20 bp, Homo sapiens
ttatcattgaaacatttata

SEQ ID NO: 485680 - DNA, 15 bp, Homo sapiens
ttatctcagttatga

SEQ ID NO: 485681 - DNA, 19 bp, Homo sapiens
ttatgttgtttataataaa

SEQ ID NO: 485682 - DNA, 15 bp, Homo sapiens
ttattaagaccaaag

SEQ ID NO: 485683 - DNA, 19 bp, Homo sapiens
ttattaagaccaaagactt

SEQ ID NO: 485684 - DNA, 15 bp, Homo sapiens
ttatttaagactaaa

SEQ ID NO: 485685 - DNA, 20 bp, Homo sapiens
ttcaaaacaaccactttctc

SEQ ID NO: 485686 - DNA, 16 bp, Homo sapiens
ttcaccaagtaaattt

SEQ ID NO: 485687 - DNA, 22 bp, Homo sapiens
ttcaccatccagagaccaaata

SEQ ID NO: 485688 - DNA, 22 bp, Homo sapiens
ttcagaagtcacacattacaaa

SEQ ID NO: 485689 - DNA, 16 bp, Homo sapiens
ttcagtagcttatctc

SEQ ID NO: 485690 - DNA, 18 bp, Homo sapiens
ttcagttccaatacttca

SEQ ID NO: 485691 - DNA, 14 bp, Homo sapiens
ttcataaattattt

SEQ ID NO: 485692 - DNA, 20 bp, Homo sapiens
ttcataaattatttgattat

SEQ ID NO: 485693 - DNA, 16 bp, Homo sapiens
ttccaaataaataatt

SEQ ID NO: 485694 - DNA, 21 bp, Homo sapiens
ttccaatacttcattaatttc

SEQ ID NO: 485695 - DNA, 22 bp, Homo sapiens
ttccaccaaatacaattcaaat

SEQ ID NO: 485696 - DNA, 20 bp, Homo sapiens
ttccagttatttatttccaa

SEQ ID NO: 485697 - DNA, 18 bp, Homo sapiens
ttcccaccaggctgctca

SEQ ID NO: 485698 - DNA, 14 bp, Homo sapiens
ttcccttgagccct

SEQ ID NO: 485699 - DNA, 22 bp, Homo sapiens
ttctcacagtgggagccagggc

SEQ ID NO: 485700 - DNA, 18 bp, Homo sapiens
ttcttactaaaaagtata

SEQ ID NO: 485701 - DNA, 23 bp, Homo sapiens
ttggaaacagtataatttgacaa

SEQ ID NO: 485702 - DNA, 14 bp, Homo sapiens
ttggccatttatgc

SEQ ID NO: 485703 - DNA, 17 bp, Homo sapiens
ttggtttaaaaagaaaa

SEQ ID NO: 485704 - DNA, 16 bp, Homo sapiens
ttgtaatggtgcttat

SEQ ID NO: 485705 - DNA, 18 bp, Homo sapiens
ttgtaatggtgcttatta

SEQ ID NO: 485706 - DNA, 22 bp, Homo sapiens
ttgtaatggtgcttattaagac

SEQ ID NO: 485707 - DNA, 20 bp, Homo sapiens
ttgtatagcatgaaataaaa

SEQ ID NO: 485708 - DNA, 16 bp, Homo sapiens
ttgtgctcagagacac

SEQ ID NO: 485709 - DNA, 11 bp, Homo sapiens
ttgttaaatgt

SEQ ID NO: 485710 - DNA, 19 bp, Homo sapiens
ttgttaaatgtatacacca

SEQ ID NO: 485711 - DNA, 12 bp, Homo sapiens
ttgttatcaaaa

SEQ ID NO: 485712 - DNA, 14 bp, Homo sapiens
ttgttatcaaaata

SEQ ID NO: 485713 - DNA, 18 bp, Homo sapiens
tttattaaaatatttcag

SEQ ID NO: 485714 - DNA, 13 bp, Homo sapiens
tttatttccaaaa

SEQ ID NO: 485715 - DNA, 18 bp, Homo sapiens
tttatttttttaccaatt

SEQ ID NO: 485716 - DNA, 16 bp, Homo sapiens
tttcaatcaaccaaag

SEQ ID NO: 485717 - DNA, 19 bp, Homo sapiens
tttcaatcaaccaaagtta

SEQ ID NO: 485718 - DNA, 19 bp, Homo sapiens
tttctcaggcttctcatgt

SEQ ID NO: 485719 - DNA, 19 bp, Homo sapiens
tttgaatatgtagtatcta

SEQ ID NO: 485720 - DNA, 18 bp, Homo sapiens
tttgcaaagtgtattagg

SEQ ID NO: 485721 - DNA, 11 bp, Homo sapiens
tttgtaaactt

SEQ ID NO: 485722 - DNA, 12 bp, Homo sapiens
tttgtaaacttt

SEQ ID NO: 485723 - DNA, 20 bp, Homo sapiens
tttgtaaactttgcttctcc

SEQ ID NO: 485724 - DNA, 14 bp, Homo sapiens
tttgtaatggtgct

SEQ ID NO: 485725 - DNA, 23 bp, Homo sapiens
ttttaactacctcaactggtcag

SEQ ID NO: 485726 - DNA, 19 bp, Homo sapiens
ttttacctagctaattatt

SEQ ID NO: 485727 - DNA, 18 bp, Homo sapiens
ttttatcattgaaacatt

SEQ ID NO: 485728 - DNA, 22 bp, Homo sapiens
ttttattaaaatatttcaggtt

SEQ ID NO: 485729 - DNA, 23 bp, Homo sapiens
ttttggcaatgactcaaagtctg

SEQ ID NO: 485730 - DNA, 14 bp, Homo sapiens
tttttattaaaata

SEQ ID NO: 485731 - DNA, 23 bp, Homo sapiens
tttttattaaaatatttcaggtt

SEQ ID NO: 485732 - DNA, 19 bp, Homo sapiens
ttttaaaaattgttattta

SEQ ID NO: 485733 - DNA, 14 bp, Homo sapiens
ttttctaaagactt

SEQ ID NO: 485734 - DNA, 18 bp, Homo sapiens
atctaggtttatgacagt

SEQ ID NO: 485735 - DNA, 22 bp, Homo sapiens
atctaggtttatgacagtaatt

SEQ ID NO: 485736 - DNA, 22 bp, Homo sapiens
atctagttcccctgtttattca

SEQ ID NO: 485737 - DNA, 19 bp, Homo sapiens
atctcttcttaatgtacat

SEQ ID NO: 485738 - DNA, 20 bp, Homo sapiens
atctcttcttaatgtacata

SEQ ID NO: 485739 - DNA, 14 bp, Homo sapiens
atctgtttgagaaa

SEQ ID NO: 485740 - DNA, 21 bp, Homo sapiens
atcttgcagtatcggcactgt

SEQ ID NO: 485741 - DNA, 18 bp, Homo sapiens
atgaacttgtaaaggaat

SEQ ID NO: 485742 - DNA, 21 bp, Homo sapiens
atgaagacctttttctgcact

SEQ ID NO: 485743 - DNA, 22 bp, Homo sapiens
atgaagacctttttctgcacta

SEQ ID NO: 485744 - DNA, 12 bp, Homo sapiens
atgacagtaatt

SEQ ID NO: 485745 - DNA, 22 bp, Homo sapiens
atgacagtaattgtgtttacat

SEQ ID NO: 485746 - DNA, 13 bp, Homo sapiens
atgatcaaatgtt

SEQ ID NO: 485747 - DNA, 16 bp, Homo sapiens
atgatcaaatgtttaa

SEQ ID NO: 485748 - DNA, 17 bp, Homo sapiens
aaaaatcttccaattta

SEQ ID NO: 485749 - DNA, 21 bp, Homo sapiens
aaaacatgcagaacaaatgaa

SEQ ID NO: 485750 - DNA, 23 bp, Homo sapiens
aaaacatgcagaacaaatgaaga

SEQ ID NO: 485751 - DNA, 11 bp, Homo sapiens
aaaacctgttc

SEQ ID NO: 485752 - DNA, 20 bp, Homo sapiens
aaaatacttgtctgttttaa

SEQ ID NO: 485753 - DNA, 17 bp, Homo sapiens
aaaatgctcttatttca

SEQ ID NO: 485754 - DNA, 22 bp, Homo sapiens
aaaattacttagtattgcaaag

SEQ ID NO: 485755 - DNA, 12 bp, Homo sapiens
aaacaatacctg

SEQ ID NO: 485756 - DNA, 20 bp, Homo sapiens
aaacagggtaactaactaaa

SEQ ID NO: 485757 - DNA, 16 bp, Homo sapiens
aaacagttgcacagca

SEQ ID NO: 485758 - DNA, 18 bp, Homo sapiens
aaacagttgcacagcatc

SEQ ID NO: 485759 - DNA, 16 bp, Homo sapiens
aaacatgcagaacaaa

SEQ ID NO: 485760 - DNA, 21 bp, Homo sapiens
aaagcaggttgataaatcatt

SEQ ID NO: 485761 - DNA, 18 bp, Homo sapiens
aaatatatgctaagtctt

SEQ ID NO: 485762 - DNA, 15 bp, Homo sapiens
aaatcattttatgtc

SEQ ID NO: 485763 - DNA, 17 bp, Homo sapiens
aaatcttataatttaaa

SEQ ID NO: 485764 - DNA, 17 bp, Homo sapiens
aaatgtctcactgagca

SEQ ID NO: 485765 - DNA, 13 bp, Homo sapiens
aaatgtttaatca

SEQ ID NO: 485766 - DNA, 18 bp, Homo sapiens
aaattacttagtattgca

SEQ ID NO: 485767 - DNA, 18 bp, Homo sapiens
aaattagccagtaatcct

SEQ ID NO: 485768 - DNA, 18 bp, Homo sapiens
aaatttcagcagctgcag

SEQ ID NO: 485769 - DNA, 16 bp, Homo sapiens
aacaaagccactttca

SEQ ID NO: 485770 - DNA, 17 bp, Homo sapiens
aacaagatgaaattcca

SEQ ID NO: 485771 - DNA, 12 bp, Homo sapiens
aacaatacctga

SEQ ID NO: 485772 - DNA, 19 bp, Homo sapiens
aacagatgtccatcagatg

SEQ ID NO: 485773 - DNA, 17 bp, Homo sapiens
aacagttgcacagcatc

SEQ ID NO: 485774 - DNA, 18 bp, Homo sapiens
aacagttgcacagcatct

SEQ ID NO: 485775 - DNA, 20 bp, Homo sapiens
aacagttgcacagcatctca

SEQ ID NO: 485776 - DNA, 14 bp, Homo sapiens
aacatgaagacctt

SEQ ID NO: 485777 - DNA, 18 bp, Homo sapiens
aacatgaagacctttttc

SEQ ID NO: 485778 - DNA, 18 bp, Homo sapiens
aacccttaaacagttgca

SEQ ID NO: 485779 - DNA, 23 bp, Homo sapiens
aacgcatctagttcccctgttta

SEQ ID NO: 485780 - DNA, 19 bp, Homo sapiens
aactgacaagctccattta

SEQ ID NO: 485781 - DNA, 20 bp, Homo sapiens
aactgacaagctccatttaa

SEQ ID NO: 485782 - DNA, 18 bp, Homo sapiens
aacttgcaaaatcagttt

SEQ ID NO: 485783 - DNA, 15 bp, Homo sapiens
aagaaaggctgctgt

SEQ ID NO: 485784 - DNA, 22 bp, Homo sapiens
aagaaagtgagcagtgttagct

SEQ ID NO: 485785 - DNA, 18 bp, Homo sapiens
aagaagtggggcagcagc

SEQ ID NO: 485786 - DNA, 13 bp, Homo sapiens
aagaattcaaatt

SEQ ID NO: 485787 - DNA, 18 bp, Homo sapiens
aagaattcaaattttatc

SEQ ID NO: 485788 - DNA, 21 bp, Homo sapiens
aagacaaaacatacattttgt

SEQ ID NO: 485789 - DNA, 21 bp, Homo sapiens
aagacaaggaaaaaataacaa

SEQ ID NO: 485790 - DNA, 23 bp, Homo sapiens
aagacagtgaaagaaaataacaa

SEQ ID NO: 485791 - DNA, 15 bp, Homo sapiens
aagacctttttctgc

SEQ ID NO: 485792 - DNA, 20 bp, Homo sapiens
aagacctttttctgcactat

SEQ ID NO: 485793 - DNA, 15 bp, Homo sapiens
aagattcagctagtg

SEQ ID NO: 485794 - DNA, 19 bp, Homo sapiens
aagcaggttgataaatcat

SEQ ID NO: 485795 - DNA, 13 bp, Homo sapiens
aaggataatgaat

SEQ ID NO: 485796 - DNA, 15 bp, Homo sapiens
aaggtactgtatgat

SEQ ID NO: 485797 - DNA, 13 bp, Homo sapiens
aagtagttatcat

SEQ ID NO: 485798 - DNA, 15 bp, Homo sapiens
aagtagttatcatgt

SEQ ID NO: 485799 - DNA, 16 bp, Homo sapiens
aagtctttcacattta

SEQ ID NO: 485800 - DNA, 14 bp, Homo sapiens
aagtgtaatgaata

SEQ ID NO: 485801 - DNA, 17 bp, Homo sapiens
aatacaagtttcatcca

SEQ ID NO: 485802 - DNA, 17 bp, Homo sapiens
aatacctgaatgctctg

SEQ ID NO: 485803 - DNA, 19 bp, Homo sapiens
aataccttagtgcagttat

SEQ ID NO: 485804 - DNA, 15 bp, Homo sapiens
aatacttgtctgttt

SEQ ID NO: 485805 - DNA, 14 bp, Homo sapiens
aatagaatgtaaat

SEQ ID NO: 485806 - DNA, 17 bp, Homo sapiens
aatcatataaatagaat

SEQ ID NO: 485807 - DNA, 15 bp, Homo sapiens
aatccaatgaaatga

SEQ ID NO: 485808 - DNA, 15 bp, Homo sapiens
aatccttgaaggtat

SEQ ID NO: 485809 - DNA, 13 bp, Homo sapiens
aatcctttgtgaa

SEQ ID NO: 485810 - DNA, 16 bp, Homo sapiens
aatcttataatttaaa

SEQ ID NO: 485811 - DNA, 15 bp, Homo sapiens
aatcttccaatttag

SEQ ID NO: 485812 - DNA, 13 bp, Homo sapiens
aatgaatacctta

SEQ ID NO: 485813 - DNA, 14 bp, Homo sapiens
aatgaatgcttaaa

SEQ ID NO: 485814 - DNA, 24 bp, Homo sapiens
aatgtaaatgtctcactgagcact

SEQ ID NO: 485815 - DNA, 21 bp, Homo sapiens
aatgtacatagtgctaacatg

SEQ ID NO: 485816 - DNA, 16 bp, Homo sapiens
aatgtctcactgagca

SEQ ID NO: 485817 - DNA, 22 bp, Homo sapiens
aatgtctcactgagcactgttt

SEQ ID NO: 485818 - DNA, 14 bp, Homo sapiens
aatgtttaatcata

SEQ ID NO: 485819 - DNA, 16 bp, Homo sapiens
aatgtttaatcatata

SEQ ID NO: 485820 - DNA, 17 bp, Homo sapiens
aatgtttaatcatataa

SEQ ID NO: 485821 - DNA, 18 bp, Homo sapiens
aatgtttaatcatataaa

SEQ ID NO: 485822 - DNA, 20 bp, Homo sapiens
aatgtttaatcatataaata

SEQ ID NO: 485823 - DNA, 23 bp, Homo sapiens
aatgtttaatcatataaatagaa

SEQ ID NO: 485824 - DNA, 14 bp, Homo sapiens
aatgtttgcatata

SEQ ID NO: 485825 - DNA, 17 bp, Homo sapiens
aattacttagtattgca

SEQ ID NO: 485826 - DNA, 12 bp, Homo sapiens
aattagccagta

SEQ ID NO: 485827 - DNA, 17 bp, Homo sapiens
aattagccagtaatcct

SEQ ID NO: 485828 - DNA, 23 bp, Homo sapiens
aattatagctctaatgtttgcat

SEQ ID NO: 485829 - DNA, 18 bp, Homo sapiens
aattccaagtgattgaaa

SEQ ID NO: 485830 - DNA, 20 bp, Homo sapiens
aattgtgtttacattttatg

SEQ ID NO: 485831 - DNA, 16 bp, Homo sapiens
aatttagttgttgtag

SEQ ID NO: 485832 - DNA, 22 bp, Homo sapiens
aatttgatgtggtgaaaagcag

SEQ ID NO: 485833 - DNA, 23 bp, Homo sapiens
aatttggatctcttcttaatgta

SEQ ID NO: 485834 - DNA, 14 bp, Homo sapiens
aattttcactgtgt

SEQ ID NO: 485835 - DNA, 19 bp, Homo sapiens
acaaaaaaatcttccaatt

SEQ ID NO: 485836 - DNA, 14 bp, Homo sapiens
acaaacaatacctg

SEQ ID NO: 485837 - DNA, 22 bp, Homo sapiens
acaaactgcaccagttgctgct

SEQ ID NO: 485838 - DNA, 18 bp, Homo sapiens
acaaagccactttcaatc

SEQ ID NO: 485839 - DNA, 13 bp, Homo sapiens
acaagtgtaatga

SEQ ID NO: 485840 - DNA, 20 bp, Homo sapiens
acaagtgtaatgaatacctt

SEQ ID NO: 485841 - DNA, 14 bp, Homo sapiens
acagatgtccatca

SEQ ID NO: 485842 - DNA, 21 bp, Homo sapiens
acagatgtccatcagatgaca

SEQ ID NO: 485843 - DNA, 15 bp, Homo sapiens
acagcatctcagctc

SEQ ID NO: 485844 - DNA, 18 bp, Homo sapiens
acagtaattgtgtttaca

SEQ ID NO: 485845 - DNA, 20 bp, Homo sapiens
acagtgaaagaaaataacaa

SEQ ID NO: 485846 - DNA, 20 bp, Homo sapiens
acatgactccatagaccttt

SEQ ID NO: 485847 - DNA, 13 bp, Homo sapiens
accattgtgcatt

SEQ ID NO: 485848 - DNA, 15 bp, Homo sapiens
acccatttgttcata

SEQ ID NO: 485849 - DNA, 12 bp, Homo sapiens
acctctaatagt

SEQ ID NO: 485850 - DNA, 16 bp, Homo sapiens
acctgaatgctctgta

SEQ ID NO: 485851 - DNA, 20 bp, Homo sapiens
accttccatgtcaagattca

SEQ ID NO: 485852 - DNA, 21 bp, Homo sapiens
acgagaacctgaaggggaagg

SEQ ID NO: 485853 - DNA, 22 bp, Homo sapiens
acgtgattagtgaaaggaagat

SEQ ID NO: 485854 - DNA, 22 bp, Homo sapiens
acgtttagctgacaaaatactt

SEQ ID NO: 485855 - DNA, 19 bp, Homo sapiens
actaaaacaaagccacttt

SEQ ID NO: 485856 - DNA, 22 bp, Homo sapiens
actaaccttccaaaaattactt

SEQ ID NO: 485857 - DNA, 22 bp, Homo sapiens
actaactaaaacaaagccactt

SEQ ID NO: 485858 - DNA, 13 bp, Homo sapiens
actactcagcatg

SEQ ID NO: 485859 - DNA, 17 bp, Homo sapiens
actgacaagctccattt

SEQ ID NO: 485860 - DNA, 20 bp, Homo sapiens
actgacaagctccatttaaa

SEQ ID NO: 485861 - DNA, 17 bp, Homo sapiens
actgtaaaataataact

SEQ ID NO: 485862 - DNA, 22 bp, Homo sapiens
actgtacaaaaaaatcttccaa

SEQ ID NO: 485863 - DNA, 15 bp, Homo sapiens
actgtatgatcaaat

SEQ ID NO: 485864 - DNA, 17 bp, Homo sapiens
actgtatgatcaaatgt

SEQ ID NO: 485865 - DNA, 20 bp, Homo sapiens
actgtatgatcaaatgttta

SEQ ID NO: 485866 - DNA, 22 bp, Homo sapiens
actgtgctgttgttatgatgtg

SEQ ID NO: 485867 - DNA, 20 bp, Homo sapiens
actgttttctagtgtatcaa

SEQ ID NO: 485868 - DNA, 16 bp, Homo sapiens
acttagtattgcaaag

SEQ ID NO: 485869 - DNA, 19 bp, Homo sapiens
acttagtattgcaaagtca

SEQ ID NO: 485870 - DNA, 20 bp, Homo sapiens
acttagtattgcaaagtcag

SEQ ID NO: 485871 - DNA, 19 bp, Homo sapiens
acttcactgtgctgttgtt

SEQ ID NO: 485872 - DNA, 18 bp, Homo sapiens
acttcgtttaatgaatgc

SEQ ID NO: 485873 - DNA, 16 bp, Homo sapiens
acttgcaaaatcagtt

SEQ ID NO: 485874 - DNA, 19 bp, Homo sapiens
acttgtaaaggaatttaaa

SEQ ID NO: 485875 - DNA, 11 bp, Homo sapiens
actttcaatct

SEQ ID NO: 485876 - DNA, 14 bp, Homo sapiens
agaaaataacaata

SEQ ID NO: 485877 - DNA, 14 bp, Homo sapiens
agaaagtgagcagt

SEQ ID NO: 485878 - DNA, 12 bp, Homo sapiens
agaacaaatgaa

SEQ ID NO: 485879 - DNA, 15 bp, Homo sapiens
agaacaaatgaagac

SEQ ID NO: 485880 - DNA, 23 bp, Homo sapiens
agaagctgctcaacttgcaaaat

SEQ ID NO: 485881 - DNA, 16 bp, Homo sapiens
agaatgatctgattga

SEQ ID NO: 485882 - DNA, 14 bp, Homo sapiens
agaatgtaaatgtc

SEQ ID NO: 485883 - DNA, 12 bp, Homo sapiens
agaattcaaatt

SEQ ID NO: 485884 - DNA, 17 bp, Homo sapiens
agaattcaaattttatc

SEQ ID NO: 485885 - DNA, 19 bp, Homo sapiens
agacaaggaaaaaataaca

SEQ ID NO: 485886 - DNA, 15 bp, Homo sapiens
agacttacagcaaat

SEQ ID NO: 485887 - DNA, 18 bp, Homo sapiens
agacttacagcaaatcct

SEQ ID NO: 485888 - DNA, 20 bp, Homo sapiens
agacttacagcaaatccttt

SEQ ID NO: 485889 - DNA, 20 bp, Homo sapiens
agatagataggtcagtgcaa

SEQ ID NO: 485890 - DNA, 18 bp, Homo sapiens
agatgacaagaaaggctg

SEQ ID NO: 485891 - DNA, 21 bp, Homo sapiens
agatgtccatcagatgacaag

SEQ ID NO: 485892 - DNA, 23 bp, Homo sapiens
agatgtccatcagatgacaagaa

SEQ ID NO: 485893 - DNA, 14 bp, Homo sapiens
agatgtctatattg

SEQ ID NO: 485894 - DNA, 17 bp, Homo sapiens
agcagtgttagcttagt

SEQ ID NO: 485895 - DNA, 22 bp, Homo sapiens
tcatatttcccatgatttcatg

SEQ ID NO: 485896 - DNA, 13 bp, Homo sapiens
tcatcttcactgc

SEQ ID NO: 485897 - DNA, 17 bp, Homo sapiens
tcatgttagtaatacct

SEQ ID NO: 485898 - DNA, 19 bp, Homo sapiens
tcatgttagtaatacctct

SEQ ID NO: 485899 - DNA, 21 bp, Homo sapiens
tcatgttagtaatacctctaa

SEQ ID NO: 485900 - DNA, 16 bp, Homo sapiens
tcattcacttcactgt

SEQ ID NO: 485901 - DNA, 19 bp, Homo sapiens
tcattcacttcactgtgct

SEQ ID NO: 485902 - DNA, 23 bp, Homo sapiens
tcatttgtgggtttttatttcct

SEQ ID NO: 485903 - DNA, 14 bp, Homo sapiens
tccaaacatcctct

SEQ ID NO: 485904 - DNA, 20 bp, Homo sapiens
tccaattagcttatgttaac

SEQ ID NO: 485905 - DNA, 19 bp, Homo sapiens
tccatatggatccactggc

SEQ ID NO: 485906 - DNA, 21 bp, Homo sapiens
tccatatggatccactggctg

SEQ ID NO: 485907 - DNA, 20 bp, Homo sapiens
tccatgggccatatgaaaag

SEQ ID NO: 485908 - DNA, 14 bp, Homo sapiens
tccatgtcaagatt

SEQ ID NO: 485909 - DNA, 16 bp, Homo sapiens
tccatgtcaagattca

SEQ ID NO: 485910 - DNA, 23 bp, Homo sapiens
tccatgtcaagattcagctagtg

SEQ ID NO: 485911 - DNA, 14 bp, Homo sapiens
tccatttaaacaga

SEQ ID NO: 485912 - DNA, 14 bp, Homo sapiens
tcccatgatttcat

SEQ ID NO: 485913 - DNA, 13 bp, Homo sapiens
tccttgaaggtat

SEQ ID NO: 485914 - DNA, 20 bp, Homo sapiens
tctaaagccattgtagtcct

SEQ ID NO: 485915 - DNA, 12 bp, Homo sapiens
tctaatagtata

SEQ ID NO: 485916 - DNA, 13 bp, Homo sapiens
tctaatgtttgca

SEQ ID NO: 485917 - DNA, 15 bp, Homo sapiens
tctaatgtttgcata

SEQ ID NO: 485918 - DNA, 17 bp, Homo sapiens
tctaatgtttgcatata

SEQ ID NO: 485919 - DNA, 19 bp, Homo sapiens
tctaatgtttgcatataag

SEQ ID NO: 485920 - DNA, 17 bp, Homo sapiens
tctaccaacctgttcaa

SEQ ID NO: 485921 - DNA, 14 bp, Homo sapiens
tctagtgtatcaaa

SEQ ID NO: 485922 - DNA, 21 bp, Homo sapiens
tctcaataaaattatagctct

SEQ ID NO: 485923 - DNA, 22 bp, Homo sapiens
tctcaataaaattatagctcta

SEQ ID NO: 485924 - DNA, 23 bp, Homo sapiens
tctcaataaaattatagctctaa

SEQ ID NO: 485925 - DNA, 16 bp, Homo sapiens
tctcagctcatcttca

SEQ ID NO: 485926 - DNA, 18 bp, Homo sapiens
tctgcactatatgcaaac

SEQ ID NO: 485927 - DNA, 13 bp, Homo sapiens
tctgcatctccac

SEQ ID NO: 485928 - DNA, 15 bp, Homo sapiens
tctgtactgattcaa

SEQ ID NO: 485929 - DNA, 16 bp, Homo sapiens
tctgtactgattcaat

SEQ ID NO: 485930 - DNA, 16 bp, Homo sapiens
tctgttttaaaaacct

SEQ ID NO: 485931 - DNA, 13 bp, Homo sapiens
tcttataatttaa

SEQ ID NO: 485932 - DNA, 14 bp, Homo sapiens
tcttataatttaaa

SEQ ID NO: 485933 - DNA, 14 bp, Homo sapiens
tcttcgactgttgt

SEQ ID NO: 485934 - DNA, 22 bp, Homo sapiens
tcttcgactgttgttatctgtt

SEQ ID NO: 485935 - DNA, 15 bp, Homo sapiens
atgtactgcattatt

SEQ ID NO: 485936 - DNA, 20 bp, Homo sapiens
atgtactgcattatttgaga

SEQ ID NO: 485937 - DNA, 20 bp, Homo sapiens
atgtagtatgctatgattaa

SEQ ID NO: 485938 - DNA, 16 bp, Homo sapiens
atgtcaagattcagct

SEQ ID NO: 485939 - DNA, 17 bp, Homo sapiens
atgtcaagattcagcta

SEQ ID NO: 485940 - DNA, 23 bp, Homo sapiens
atgtcaagggcagctttgctcat

SEQ ID NO: 485941 - DNA, 19 bp, Homo sapiens
atgtctcactgagcactgt

SEQ ID NO: 485942 - DNA, 22 bp, Homo sapiens
atgtctcactgagcactgtttt

SEQ ID NO: 485943 - DNA, 21 bp, Homo sapiens
atgtgcttaacagggaacgtg

SEQ ID NO: 485944 - DNA, 15 bp, Homo sapiens
atgttagtaatacct

SEQ ID NO: 485945 - DNA, 21 bp, Homo sapiens
atgttagtaatacctctaata

SEQ ID NO: 485946 - DNA, 14 bp, Homo sapiens
atgtttaatcatat

SEQ ID NO: 485947 - DNA, 15 bp, Homo sapiens
atgtttaatcatata

SEQ ID NO: 485948 - DNA, 14 bp, Homo sapiens
attaaacatgactc

SEQ ID NO: 485949 - DNA, 14 bp, Homo sapiens
attaagaatgatct

SEQ ID NO: 485950 - DNA, 14 bp, Homo sapiens
attagccagtaatc

SEQ ID NO: 485951 - DNA, 19 bp, Homo sapiens
ccttaaacagttgcacagc

SEQ ID NO: 485952 - DNA, 15 bp, Homo sapiens
ccttagtgcagttat

SEQ ID NO: 485953 - DNA, 14 bp, Homo sapiens
ccttgtccccatga

SEQ ID NO: 485954 - DNA, 15 bp, Homo sapiens
cctttttctgcacta

SEQ ID NO: 485955 - DNA, 17 bp, Homo sapiens
cctttttctgcactata

SEQ ID NO: 485956 - DNA, 21 bp, Homo sapiens
cctttttctgcactatatgca

SEQ ID NO: 485957 - DNA, 17 bp, Homo sapiens
cgttggctagattaacc

SEQ ID NO: 485958 - DNA, 14 bp, Homo sapiens
cgtttaatgaatgc

SEQ ID NO: 485959 - DNA, 18 bp, Homo sapiens
cgtttaatgaatgcttaa

SEQ ID NO: 485960 - DNA, 18 bp, Homo sapiens
cgtttagctgacaaaata

SEQ ID NO: 485961 - DNA, 13 bp, Homo sapiens
ctaactaaaacaa

SEQ ID NO: 485962 - DNA, 12 bp, Homo sapiens
ctaggtttatga

SEQ ID NO: 485963 - DNA, 17 bp, Homo sapiens
ctagtattgacaaaatg

SEQ ID NO: 485964 - DNA, 19 bp, Homo sapiens
ctagtattgacaaaatgtt

SEQ ID NO: 485965 - DNA, 16 bp, Homo sapiens
ctagttcccctgttta

SEQ ID NO: 485966 - DNA, 18 bp, Homo sapiens
ctagttcccctgtttatt

SEQ ID NO: 485967 - DNA, 20 bp, Homo sapiens
ctagttcccctgtttattca

SEQ ID NO: 485968 - DNA, 13 bp, Homo sapiens
ctataatttaaat

SEQ ID NO: 485969 - DNA, 16 bp, Homo sapiens
ctatgatgtatactgc

SEQ ID NO: 485970 - DNA, 17 bp, Homo sapiens
ctcactgagcactgttt

SEQ ID NO: 485971 - DNA, 12 bp, Homo sapiens
ctcatatttccc

SEQ ID NO: 485972 - DNA, 19 bp, Homo sapiens
ctccatagaccttttcatt

SEQ ID NO: 485973 - DNA, 17 bp, Homo sapiens
ctcgaggtcgggcagca

SEQ ID NO: 485974 - DNA, 21 bp, Homo sapiens
ctcgaggtcgggcagcacaag

SEQ ID NO: 485975 - DNA, 18 bp, Homo sapiens
ctcggtatagttttgtca

SEQ ID NO: 485976 - DNA, 17 bp, Homo sapiens
ctctaatgtttgcatat

SEQ ID NO: 485977 - DNA, 13 bp, Homo sapiens
ctctgtagcctaa

SEQ ID NO: 485978 - DNA, 23 bp, Homo sapiens
ctcttcttaatgtacatagtgct

SEQ ID NO: 485979 - DNA, 14 bp, Homo sapiens
ctgaatgctctgta

SEQ ID NO: 485980 - DNA, 18 bp, Homo sapiens
ctgacaagctccatttaa

SEQ ID NO: 485981 - DNA, 13 bp, Homo sapiens
ctgagcactgttt

SEQ ID NO: 485982 - DNA, 14 bp, Homo sapiens
ctgagcactgtttt

SEQ ID NO: 485983 - DNA, 21 bp, Homo sapiens
ctgagcactgttttctagtgt

SEQ ID NO: 485984 - DNA, 23 bp, Homo sapiens
ctgagcactgttttctagtgtat

SEQ ID NO: 485985 - DNA, 17 bp, Homo sapiens
ctgattcaatttgatgt

SEQ ID NO: 485986 - DNA, 16 bp, Homo sapiens
ctgcctctcttgtaat

SEQ ID NO: 485987 - DNA, 13 bp, Homo sapiens
ctgctgtactgaa

SEQ ID NO: 485988 - DNA, 23 bp, Homo sapiens
ctggaataatcctaaacatatga

SEQ ID NO: 485989 - DNA, 19 bp, Homo sapiens
ctgtactgaagtaaaacaa

SEQ ID NO: 485990 - DNA, 20 bp, Homo sapiens
ctgtactgaagtaaaacaaa

SEQ ID NO: 485991 - DNA, 13 bp, Homo sapiens
ctgtactgattca

SEQ ID NO: 485992 - DNA, 14 bp, Homo sapiens
ctgtactgattcaa

SEQ ID NO: 485993 - DNA, 19 bp, Homo sapiens
ctgtaggaaggtactgtat

SEQ ID NO: 485994 - DNA, 13 bp, Homo sapiens
ctgtatgatcaaa

SEQ ID NO: 485995 - DNA, 16 bp, Homo sapiens
ctgtatgatcaaatgt

SEQ ID NO: 485996 - DNA, 17 bp, Homo sapiens
ctgtatgatcaaatgtt

SEQ ID NO: 485997 - DNA, 19 bp, Homo sapiens
ctgtatgatcaaatgttta

SEQ ID NO: 485998 - DNA, 13 bp, Homo sapiens
ctgttgttatctg

SEQ ID NO: 485999 - DNA, 19 bp, Homo sapiens
ctgttgttatgatgtgctt

SEQ ID NO: 486000 - DNA, 21 bp, Homo sapiens
ctgtttattcatatgcatatt

SEQ ID NO: 486001 - DNA, 18 bp, Homo sapiens
cttaaagaattcaaattt

SEQ ID NO: 486002 - DNA, 16 bp, Homo sapiens
cttaaatacagctttt

SEQ ID NO: 486003 - DNA, 15 bp, Homo sapiens
cttaatgtacatagt

SEQ ID NO: 486004 - DNA, 21 bp, Homo sapiens
cttagcattttctgcatctcc

SEQ ID NO: 486005 - DNA, 13 bp, Homo sapiens
cttataatttaaa

SEQ ID NO: 486006 - DNA, 14 bp, Homo sapiens
cttatattgttcac

SEQ ID NO: 486007 - DNA, 16 bp, Homo sapiens
cttatattgttcactt

SEQ ID NO: 486008 - DNA, 18 bp, Homo sapiens
cttatttcatcattcact

SEQ ID NO: 486009 - DNA, 23 bp, Homo sapiens
cttcgactgttgttatctgtttg

SEQ ID NO: 486010 - DNA, 13 bp, Homo sapiens
cttctcacattta

SEQ ID NO: 486011 - DNA, 20 bp, Homo sapiens
cttcttaatgtacatagtgc

SEQ ID NO: 486012 - DNA, 19 bp, Homo sapiens
cttgagtttaaattgtaat

SEQ ID NO: 486013 - DNA, 22 bp, Homo sapiens
cttgctgaaacgcatctagttc

SEQ ID NO: 486014 - DNA, 16 bp, Homo sapiens
ctttgtcactgtttca

SEQ ID NO: 486015 - DNA, 15 bp, Homo sapiens
cttttagttcctgtg

SEQ ID NO: 486016 - DNA, 19 bp, Homo sapiens
cttttggattggacaaaat

SEQ ID NO: 486017 - DNA, 13 bp, Homo sapiens
ctttttctgcact

SEQ ID NO: 486018 - DNA, 14 bp, Homo sapiens
ctttttctgcacta

SEQ ID NO: 486019 - DNA, 14 bp, Homo sapiens
gaaaacatgcagaa

SEQ ID NO: 486020 - DNA, 19 bp, Homo sapiens
gaaaataacgataaaagac

SEQ ID NO: 486021 - DNA, 18 bp, Homo sapiens
gaaattgtattacaaatc

SEQ ID NO: 486022 - DNA, 13 bp, Homo sapiens
gaacaaatgaaga

SEQ ID NO: 486023 - DNA, 19 bp, Homo sapiens
gaagacaaaacatacattt

SEQ ID NO: 486024 - DNA, 21 bp, Homo sapiens
gaagataaacgtggatgttac

SEQ ID NO: 486025 - DNA, 17 bp, Homo sapiens
gaagtagttatcatgtt

SEQ ID NO: 486026 - DNA, 18 bp, Homo sapiens
gaagtagttatcatgtta

SEQ ID NO: 486027 - DNA, 21 bp, Homo sapiens
gaagtagttatcatgttagta

SEQ ID NO: 486028 - DNA, 20 bp, Homo sapiens
gaataatcctaaacatatga

SEQ ID NO: 486029 - DNA, 14 bp, Homo sapiens
gaatgtaaatgtct

SEQ ID NO: 486030 - DNA, 12 bp, Homo sapiens
gacaaaatgtta

SEQ ID NO: 486031 - DNA, 16 bp, Homo sapiens
gacaaaatgttatttc

SEQ ID NO: 486032 - DNA, 16 bp, Homo sapiens
gacaaggaaaaaataa

SEQ ID NO: 486033 - DNA, 23 bp, Homo sapiens
gacctgatttctgagcatttaat

SEQ ID NO: 486034 - DNA, 20 bp, Homo sapiens
gactgttgttatctgtttga

SEQ ID NO: 486035 - DNA, 22 bp, Homo sapiens
gagaagctgctcaacttgcaaa

SEQ ID NO: 486036 - DNA, 16 bp, Homo sapiens
gagatgcagtgccagg

SEQ ID NO: 486037 - DNA, 13 bp, Homo sapiens
gagctacaaatgc

SEQ ID NO: 486038 - DNA, 21 bp, Homo sapiens
gagttgaaaatcttataattt

SEQ ID NO: 486039 - DNA, 14 bp, Homo sapiens
gatcaaatgtttaa

SEQ ID NO: 486040 - DNA, 23 bp, Homo sapiens
gatctgattgaccgtgttggtct

SEQ ID NO: 486041 - DNA, 13 bp, Homo sapiens
gatgtgcttaaca

SEQ ID NO: 486042 - DNA, 19 bp, Homo sapiens
gattagctttgtcactgtt

SEQ ID NO: 486043 - DNA, 24 bp, Homo sapiens
gattgaccgtgttggtctgtactg

SEQ ID NO: 486044 - DNA, 13 bp, Homo sapiens
taatcatataaat

SEQ ID NO: 486045 - DNA, 17 bp, Homo sapiens
taatcatataaatagaa

SEQ ID NO: 486046 - DNA, 19 bp, Homo sapiens
taatcatataaatagaatg

SEQ ID NO: 486047 - DNA, 18 bp, Homo sapiens
taatcctgtaggaaggta

SEQ ID NO: 486048 - DNA, 22 bp, Homo sapiens
taatcctgtaggaaggtactgt

SEQ ID NO: 486049 - DNA, 23 bp, Homo sapiens
taatcctgtaggaaggtactgta

SEQ ID NO: 486050 - DNA, 18 bp, Homo sapiens
taatgaatgcttaaagaa

SEQ ID NO: 486051 - DNA, 20 bp, Homo sapiens
taatgaatgcttaaagaatt

SEQ ID NO: 486052 - DNA, 15 bp, Homo sapiens
taatgtttgcatata

SEQ ID NO: 486053 - DNA, 16 bp, Homo sapiens
taatgtttgcatataa

SEQ ID NO: 486054 - DNA, 22 bp, Homo sapiens
taattccgtaggttattttcag

SEQ ID NO: 486055 - DNA, 14 bp, Homo sapiens
taattgtgtttaca

SEQ ID NO: 486056 - DNA, 17 bp, Homo sapiens
taattgtgtttacattt

SEQ ID NO: 486057 - DNA, 20 bp, Homo sapiens
taattgtgtttacattttat

SEQ ID NO: 486058 - DNA, 23 bp, Homo sapiens
taatttggatctcttcttaatgt

SEQ ID NO: 486059 - DNA, 14 bp, Homo sapiens
tacaagtttcatcc

SEQ ID NO: 486060 - DNA, 15 bp, Homo sapiens
tacaagtttcatcca

SEQ ID NO: 486061 - DNA, 13 bp, Homo sapiens
tacagaattttat

SEQ ID NO: 486062 - DNA, 21 bp, Homo sapiens
tacatagtgctaacatgaaga

SEQ ID NO: 486063 - DNA, 23 bp, Homo sapiens
tacatagtgctaacatgaagacc

SEQ ID NO: 486064 - DNA, 12 bp, Homo sapiens
tacattaaacat

SEQ ID NO: 486065 - DNA, 20 bp, Homo sapiens
tacattaaacatgactccat

SEQ ID NO: 486066 - DNA, 17 bp, Homo sapiens
tacattcttcaagatcc

SEQ ID NO: 486067 - DNA, 21 bp, Homo sapiens
tacattcttcaagatcccatt

SEQ ID NO: 486068 - DNA, 16 bp, Homo sapiens
tacattttgtaccaac

SEQ ID NO: 486069 - DNA, 17 bp, Homo sapiens
tacattttgtaccaacc

SEQ ID NO: 486070 - DNA, 14 bp, Homo sapiens
taccacctgacatt

SEQ ID NO: 486071 - DNA, 16 bp, Homo sapiens
tacctctaatagtata

SEQ ID NO: 486072 - DNA, 17 bp, Homo sapiens
tacctctaatagtataa

SEQ ID NO: 486073 - DNA, 22 bp, Homo sapiens
taccttagtgcagttatttgct

SEQ ID NO: 486074 - DNA, 19 bp, Homo sapiens
tactccaaaacttcgttta

SEQ ID NO: 486075 - DNA, 17 bp, Homo sapiens
tactgaagtaaaacaaa

SEQ ID NO: 486076 - DNA, 16 bp, Homo sapiens
tactgcattatttgag

SEQ ID NO: 486077 - DNA, 18 bp, Homo sapiens
tactgtatgatcaaatgt

SEQ ID NO: 486078 - DNA, 15 bp, Homo sapiens
caggttgataaatca

SEQ ID NO: 486079 - DNA, 23 bp, Homo sapiens
cagtaatcctgtaggaaggtact

SEQ ID NO: 486080 - DNA, 17 bp, Homo sapiens
cagtaattgtgtttaca

SEQ ID NO: 486081 - DNA, 13 bp, Homo sapiens
cagtgttagctta

SEQ ID NO: 486082 - DNA, 16 bp, Homo sapiens
cagttgcacagcatct

SEQ ID NO: 486083 - DNA, 17 bp, Homo sapiens
cagttgcacagcatctc

SEQ ID NO: 486084 - DNA, 18 bp, Homo sapiens
cagttgctgcttcaattt

SEQ ID NO: 486085 - DNA, 13 bp, Homo sapiens
catataaatagaa

SEQ ID NO: 486086 - DNA, 21 bp, Homo sapiens
catataaatagaatgtaaatg

SEQ ID NO: 486087 - DNA, 18 bp, Homo sapiens
catcattcacttcactgt

SEQ ID NO: 486088 - DNA, 16 bp, Homo sapiens
catccaattagcttat

SEQ ID NO: 486089 - DNA, 20 bp, Homo sapiens
catcctcttccatatggatc

SEQ ID NO: 486090 - DNA, 14 bp, Homo sapiens
catgatttcatgta

SEQ ID NO: 486091 - DNA, 20 bp, Homo sapiens
catgatttcatgtactgcat

SEQ ID NO: 486092 - DNA, 16 bp, Homo sapiens
catgtactgcattatt

SEQ ID NO: 486093 - DNA, 17 bp, Homo sapiens
catgtcaagattcagct

SEQ ID NO: 486094 - DNA, 14 bp, Homo sapiens
catgttagtaatac

SEQ ID NO: 486095 - DNA, 18 bp, Homo sapiens
catgttagtaatacctct

SEQ ID NO: 486096 - DNA, 15 bp, Homo sapiens
cattaaacatgactc

SEQ ID NO: 486097 - DNA, 14 bp, Homo sapiens
cattatttgagaag

SEQ ID NO: 486098 - DNA, 22 bp, Homo sapiens
cattatttgagaagctgctcaa

SEQ ID NO: 486099 - DNA, 23 bp, Homo sapiens
aaaacctgttcaagtctaccaac

SEQ ID NO: 486100 - DNA, 22 bp, Homo sapiens
aaaaccttccatgtcaagattc

SEQ ID NO: 486101 - DNA, 20 bp, Homo sapiens
aaaagacaaggaaaaaataa

SEQ ID NO: 486102 - DNA, 22 bp, Homo sapiens
aaaagctccatttttagtgaaa

SEQ ID NO: 486103 - DNA, 20 bp, Homo sapiens
aaaatgctcttatttcatca

SEQ ID NO: 486104 - DNA, 23 bp, Homo sapiens
aaaattacttagtattgcaaagt

SEQ ID NO: 486105 - DNA, 19 bp, Homo sapiens
aaaattagccagtaatcct

SEQ ID NO: 486106 - DNA, 19 bp, Homo sapiens
aaaattatagctctaatgt

SEQ ID NO: 486107 - DNA, 17 bp, Homo sapiens
aaacatcctcttccata

SEQ ID NO: 486108 - DNA, 20 bp, Homo sapiens
aaacatgcagaacaaatgaa

SEQ ID NO: 486109 - DNA, 20 bp, Homo sapiens
aaaccccaccccaaaattag

SEQ ID NO: 486110 - DNA, 13 bp, Homo sapiens
aaacgcatctagt

SEQ ID NO: 486111 - DNA, 14 bp, Homo sapiens
aaacttcgtttaat

SEQ ID NO: 486112 - DNA, 15 bp, Homo sapiens
aaagaattcaaattt

SEQ ID NO: 486113 - DNA, 16 bp, Homo sapiens
aaagaattcaaatttt

SEQ ID NO: 486114 - DNA, 15 bp, Homo sapiens
aaagtcaggaatcat

SEQ ID NO: 486115 - DNA, 19 bp, Homo sapiens
aaataaaaaaaaaaaagag

SEQ ID NO: 486116 - DNA, 14 bp, Homo sapiens
aaatagaatgtaaa

SEQ ID NO: 486117 - DNA, 17 bp, Homo sapiens
aaatagaatgtaaatgt

SEQ ID NO: 486118 - DNA, 23 bp, Homo sapiens
aaatagcttgggtagcgcactct

SEQ ID NO: 486119 - DNA, 14 bp, Homo sapiens
aaatcttccaattt

SEQ ID NO: 486120 - DNA, 19 bp, Homo sapiens
aaatgctcttatttcatca

SEQ ID NO: 486121 - DNA, 14 bp, Homo sapiens
aaatgttatttccc

SEQ ID NO: 486122 - DNA, 19 bp, Homo sapiens
aaatgtttaatcatataaa

SEQ ID NO: 486123 - DNA, 22 bp, Homo sapiens
aaattagccagtaatcctgtag

SEQ ID NO: 486124 - DNA, 18 bp, Homo sapiens
aaattatagctctaatgt

SEQ ID NO: 486125 - DNA, 21 bp, Homo sapiens
aaattatagctctaatgtttg

SEQ ID NO: 486126 - DNA, 17 bp, Homo sapiens
aaattgtattacaaatc

SEQ ID NO: 486127 - DNA, 15 bp, Homo sapiens
aacaaacaatacctg

SEQ ID NO: 486128 - DNA, 12 bp, Homo sapiens
aacaaatgaaga

SEQ ID NO: 486129 - DNA, 21 bp, Homo sapiens
aacaatacctgaatgctctgt

SEQ ID NO: 486130 - DNA, 14 bp, Homo sapiens
aacagttgcacagc

SEQ ID NO: 486131 - DNA, 15 bp, Homo sapiens
aacagttgcacagca

SEQ ID NO: 486132 - DNA, 16 bp, Homo sapiens
aacatacattttgtac

SEQ ID NO: 486133 - DNA, 22 bp, Homo sapiens
aacatgaagacctttttctgca

SEQ ID NO: 486134 - DNA, 16 bp, Homo sapiens
aaccattgtgcattct

SEQ ID NO: 486135 - DNA, 13 bp, Homo sapiens
aactaaaacaaag

SEQ ID NO: 486136 - DNA, 20 bp, Homo sapiens
aactgcaatacaagtttcat

SEQ ID NO: 486137 - DNA, 20 bp, Homo sapiens
aactgcaccagttgctgctt

SEQ ID NO: 486138 - DNA, 23 bp, Homo sapiens
aacttagcattttctgcatctcc

SEQ ID NO: 486139 - DNA, 14 bp, Homo sapiens
aacttgcaaaatca

SEQ ID NO: 486140 - DNA, 19 bp, Homo sapiens
aagaatgatctgattgacc

SEQ ID NO: 486141 - DNA, 17 bp, Homo sapiens
aagaattcaaattttat

SEQ ID NO: 486142 - DNA, 21 bp, Homo sapiens
aagaattcaaattttatctgc

SEQ ID NO: 486143 - DNA, 16 bp, Homo sapiens
aagacctttttctgca

SEQ ID NO: 486144 - DNA, 13 bp, Homo sapiens
aagattcagctag

SEQ ID NO: 486145 - DNA, 16 bp, Homo sapiens
aagcactaaacaaaga

SEQ ID NO: 486146 - DNA, 15 bp, Homo sapiens
aagcaggttgataaa

SEQ ID NO: 486147 - DNA, 23 bp, Homo sapiens
aaggctctgttccacatatattt

SEQ ID NO: 486148 - DNA, 20 bp, Homo sapiens
aagggaagtagttatcatgt

SEQ ID NO: 486149 - DNA, 20 bp, Homo sapiens
aagggcagctttgctcatat

SEQ ID NO: 486150 - DNA, 20 bp, Homo sapiens
aaggtactgtatgatcaaat

SEQ ID NO: 486151 - DNA, 21 bp, Homo sapiens
aaggtactgtatgatcaaatg

SEQ ID NO: 486152 - DNA, 22 bp, Homo sapiens
aaggtactgtatgatcaaatgt

SEQ ID NO: 486153 - DNA, 22 bp, Homo sapiens
aaggtatatctaggtttatgac

SEQ ID NO: 486154 - DNA, 23 bp, Homo sapiens
aaggtatatctaggtttatgaca

SEQ ID NO: 486155 - DNA, 17 bp, Homo sapiens
aagtaaaacaaacaata

SEQ ID NO: 486156 - DNA, 17 bp, Homo sapiens
aagtagttatcatgtta

SEQ ID NO: 486157 - DNA, 18 bp, Homo sapiens
aagtagttatcatgttag

SEQ ID NO: 486158 - DNA, 15 bp, Homo sapiens
aagtcaacttagcat

SEQ ID NO: 486159 - DNA, 22 bp, Homo sapiens
aagtcttatatattgtagataa

SEQ ID NO: 486160 - DNA, 12 bp, Homo sapiens
aataaaaataat

SEQ ID NO: 486161 - DNA, 15 bp, Homo sapiens
aataacgataaaaga

SEQ ID NO: 486162 - DNA, 21 bp, Homo sapiens
aataatcctaaacatatgaat

SEQ ID NO: 486163 - DNA, 18 bp, Homo sapiens
aatacctgaatgctctgt

SEQ ID NO: 486164 - DNA, 16 bp, Homo sapiens
aatagaatgtaaatgt

SEQ ID NO: 486165 - DNA, 15 bp, Homo sapiens
aatcatcaagtcttt

SEQ ID NO: 486166 - DNA, 13 bp, Homo sapiens
aatcattttatgt

SEQ ID NO: 486167 - DNA, 22 bp, Homo sapiens
aatcctgtaggaaggtactgta

SEQ ID NO: 486168 - DNA, 23 bp, Homo sapiens
aatcctgtaggaaggtactgtat

SEQ ID NO: 486169 - DNA, 14 bp, Homo sapiens
aatgctcttatttc

SEQ ID NO: 486170 - DNA, 21 bp, Homo sapiens
aatgcttaaagaattcaaatt

SEQ ID NO: 486171 - DNA, 19 bp, Homo sapiens
aatggacttttgtacatag

SEQ ID NO: 486172 - DNA, 16 bp, Homo sapiens
aatgtaaatgtctcac

SEQ ID NO: 486173 - DNA, 19 bp, Homo sapiens
aatgtctcactgagcactg

SEQ ID NO: 486174 - DNA, 13 bp, Homo sapiens
aatgtttgcatat

SEQ ID NO: 486175 - DNA, 19 bp, Homo sapiens
aattagccagtaatcctgt

SEQ ID NO: 486176 - DNA, 20 bp, Homo sapiens
aattagccagtaatcctgta

SEQ ID NO: 486177 - DNA, 22 bp, Homo sapiens
aattagcttatgttaactgaca

SEQ ID NO: 486178 - DNA, 17 bp, Homo sapiens
aattatagctctaatgt

SEQ ID NO: 486179 - DNA, 18 bp, Homo sapiens
aattatagctctaatgtt

SEQ ID NO: 486180 - DNA, 20 bp, Homo sapiens
aattatagctctaatgtttg

SEQ ID NO: 486181 - DNA, 21 bp, Homo sapiens
aattcttgccaaatataaata

SEQ ID NO: 486182 - DNA, 11 bp, Homo sapiens
aattgtaatag

SEQ ID NO: 486183 - DNA, 21 bp, Homo sapiens
aattgtgtttacattttatgg

SEQ ID NO: 486184 - DNA, 20 bp, Homo sapiens
aatttatacctcaattttca

SEQ ID NO: 486185 - DNA, 14 bp, Homo sapiens
acaaaaaaatcttc

SEQ ID NO: 486186 - DNA, 22 bp, Homo sapiens
acaagaaaggctgctgtactga

SEQ ID NO: 486187 - DNA, 22 bp, Homo sapiens
acagatgtccatcagatgacaa

SEQ ID NO: 486188 - DNA, 22 bp, Homo sapiens
acagggaacgtgattagtgaaa

SEQ ID NO: 486189 - DNA, 15 bp, Homo sapiens
acagtaattgtgttt

SEQ ID NO: 486190 - DNA, 22 bp, Homo sapiens
acagttcggtgagctacaaatg

SEQ ID NO: 486191 - DNA, 23 bp, Homo sapiens
acagttcggtgagctacaaatgc

SEQ ID NO: 486192 - DNA, 15 bp, Homo sapiens
acagttgcacagcat

SEQ ID NO: 486193 - DNA, 14 bp, Homo sapiens
acatacattttgta

SEQ ID NO: 486194 - DNA, 20 bp, Homo sapiens
acatagtgctaacatgaaga

SEQ ID NO: 486195 - DNA, 13 bp, Homo sapiens
acatgaagacctt

SEQ ID NO: 486196 - DNA, 20 bp, Homo sapiens
acatgaagacctttttctgc

SEQ ID NO: 486197 - DNA, 14 bp, Homo sapiens
acattccttgctga

SEQ ID NO: 486198 - DNA, 14 bp, Homo sapiens
acccatttgttcat

SEQ ID NO: 486199 - DNA, 22 bp, Homo sapiens
accccaaaattagccagtaatc

SEQ ID NO: 486200 - DNA, 23 bp, Homo sapiens
accccaaaattagccagtaatcc

SEQ ID NO: 486201 - DNA, 23 bp, Homo sapiens
acccttaaacagttgcacagcat

SEQ ID NO: 486202 - DNA, 20 bp, Homo sapiens
acctcaattttcactgtgtc

SEQ ID NO: 486203 - DNA, 20 bp, Homo sapiens
acctctaatagtataaaccc

SEQ ID NO: 486204 - DNA, 14 bp, Homo sapiens
acgcttaaatacag

SEQ ID NO: 486205 - DNA, 16 bp, Homo sapiens
tcttcttaatgtacat

SEQ ID NO: 486206 - DNA, 18 bp, Homo sapiens
tcttgagtttttcaggta

SEQ ID NO: 486207 - DNA, 12 bp, Homo sapiens
tctttgccaagt

SEQ ID NO: 486208 - DNA, 22 bp, Homo sapiens
tgaaaagcaggttgataaatca

SEQ ID NO: 486209 - DNA, 16 bp, Homo sapiens
tgaaattccatttgta

SEQ ID NO: 486210 - DNA, 15 bp, Homo sapiens
tgaagacctttttct

SEQ ID NO: 486211 - DNA, 23 bp, Homo sapiens
tgaagacttacagcaaatccttt

SEQ ID NO: 486212 - DNA, 22 bp, Homo sapiens
tgaagtaaaacaaacaatacct

SEQ ID NO: 486213 - DNA, 12 bp, Homo sapiens
tgacaaaatgtt

SEQ ID NO: 486214 - DNA, 22 bp, Homo sapiens
tgacaagaaaggctgctgtact

SEQ ID NO: 486215 - DNA, 18 bp, Homo sapiens
tgacaagctccatttaaa

SEQ ID NO: 486216 - DNA, 15 bp, Homo sapiens
tgacagtaattgtgt

SEQ ID NO: 486217 - DNA, 22 bp, Homo sapiens
tgacagtaattgtgtttacatt

SEQ ID NO: 486218 - DNA, 15 bp, Homo sapiens
tgacattccttgctg

SEQ ID NO: 486219 - DNA, 19 bp, Homo sapiens
tgactaaaccattgtgcat

SEQ ID NO: 486220 - DNA, 17 bp, Homo sapiens
tgactccatagaccttt

SEQ ID NO: 486221 - DNA, 14 bp, Homo sapiens
tgagctacaaatgc

SEQ ID NO: 486222 - DNA, 17 bp, Homo sapiens
tgatcaaatgtttaatc

SEQ ID NO: 486223 - DNA, 13 bp, Homo sapiens
tgatgatccatta

SEQ ID NO: 486224 - DNA, 20 bp, Homo sapiens
tgatgctacaggatttgaaa

SEQ ID NO: 486225 - DNA, 13 bp, Homo sapiens
tgattatatgtca

SEQ ID NO: 486226 - DNA, 19 bp, Homo sapiens
tgattcaatttgatgtggt

SEQ ID NO: 486227 - DNA, 21 bp, Homo sapiens
tgattgaccgtgttggtctgt

SEQ ID NO: 486228 - DNA, 17 bp, Homo sapiens
tgatttcatgtactgca

SEQ ID NO: 486229 - DNA, 22 bp, Homo sapiens
tgatttttttttttttcctgtc

SEQ ID NO: 486230 - DNA, 14 bp, Homo sapiens
tgcaaaatcagttt

SEQ ID NO: 486231 - DNA, 22 bp, Homo sapiens
tgcaagaagtggggcagcagca

SEQ ID NO: 486232 - DNA, 23 bp, Homo sapiens
tgcaatacaagtttcatccagaa

SEQ ID NO: 486233 - DNA, 14 bp, Homo sapiens
tgcactatatgcaa

SEQ ID NO: 486234 - DNA, 18 bp, Homo sapiens
tgcactatatgcaaacag

SEQ ID NO: 486235 - DNA, 18 bp, Homo sapiens
tgcagaacaaatgaagac

SEQ ID NO: 486236 - DNA, 16 bp, Homo sapiens
tgcattatttgagaag

SEQ ID NO: 486237 - DNA, 17 bp, Homo sapiens
tgccaaatataaataaa

SEQ ID NO: 486238 - DNA, 19 bp, Homo sapiens
tgccaaatataaataaaaa

SEQ ID NO: 486239 - DNA, 22 bp, Homo sapiens
tgccaaatataaataaaaataa

SEQ ID NO: 486240 - DNA, 19 bp, Homo sapiens
tgccactaaccttccaaaa

SEQ ID NO: 486241 - DNA, 19 bp, Homo sapiens
tgccaggaacccttaaaca

SEQ ID NO: 486242 - DNA, 16 bp, Homo sapiens
tgcctagtattgacaa

SEQ ID NO: 486243 - DNA, 17 bp, Homo sapiens
tgcctagtattgacaaa

SEQ ID NO: 486244 - DNA, 21 bp, Homo sapiens
tgcctagtattgacaaaatgt

SEQ ID NO: 486245 - DNA, 22 bp, Homo sapiens
tgcctagtattgacaaaatgtt

SEQ ID NO: 486246 - DNA, 16 bp, Homo sapiens
tgccttttagttcctg

SEQ ID NO: 486247 - DNA, 18 bp, Homo sapiens
tgccttttagttcctgtg

SEQ ID NO: 486248 - DNA, 13 bp, Homo sapiens
tgctcaacttgca

SEQ ID NO: 486249 - DNA, 22 bp, Homo sapiens
tgctcatatttcccatgatttc

SEQ ID NO: 486250 - DNA, 13 bp, Homo sapiens
tgctcttatttca

SEQ ID NO: 486251 - DNA, 14 bp, Homo sapiens
tgctcttatttcat

SEQ ID NO: 486252 - DNA, 21 bp, Homo sapiens
tgctgtactgaagtaaaacaa

SEQ ID NO: 486253 - DNA, 17 bp, Homo sapiens
tgctgttgttatgatgt

SEQ ID NO: 486254 - DNA, 19 bp, Homo sapiens
tgcttaaagaattcaaatt

SEQ ID NO: 486255 - DNA, 22 bp, Homo sapiens
tgcttaacagggaacgtgatta

SEQ ID NO: 486256 - DNA, 17 bp, Homo sapiens
tgctttcggttccagtt

SEQ ID NO: 486257 - DNA, 18 bp, Homo sapiens
tggacgagaaaacaataa

SEQ ID NO: 486258 - DNA, 22 bp, Homo sapiens
tggatctcttcttaatgtacat

SEQ ID NO: 486259 - DNA, 18 bp, Homo sapiens
tgggaaacaaaaggataa

SEQ ID NO: 486260 - DNA, 22 bp, Homo sapiens
tggtgaaaagcaggttgataaa

SEQ ID NO: 486261 - DNA, 22 bp, Homo sapiens
tggtgcctagtattgacaaaat

SEQ ID NO: 486262 - DNA, 24 bp, Homo sapiens
tggtgcctagtattgacaaaatgt

SEQ ID NO: 486263 - DNA, 16 bp, Homo sapiens
tgtaaatgtctcactg

SEQ ID NO: 486264 - DNA, 20 bp, Homo sapiens
tgtaaatgtctcactgagca

SEQ ID NO: 486265 - DNA, 15 bp, Homo sapiens
tgtaatgaatacctt

SEQ ID NO: 486266 - DNA, 19 bp, Homo sapiens
tgtacatagtgctaacatg

SEQ ID NO: 486267 - DNA, 16 bp, Homo sapiens
tgtactgattcaattt

SEQ ID NO: 486268 - DNA, 17 bp, Homo sapiens
tgtactgattcaatttg

SEQ ID NO: 486269 - DNA, 19 bp, Homo sapiens
tgtaggaaggtactgtatg

SEQ ID NO: 486270 - DNA, 20 bp, Homo sapiens
tgtaggaaggtactgtatga

SEQ ID NO: 486271 - DNA, 15 bp, Homo sapiens
tgtatactgccacta

SEQ ID NO: 486272 - DNA, 18 bp, Homo sapiens
tgtatcaaaatgctctta

SEQ ID NO: 486273 - DNA, 12 bp, Homo sapiens
tgtatgatcaaa

SEQ ID NO: 486274 - DNA, 14 bp, Homo sapiens
tgtatgatcaaatg

SEQ ID NO: 486275 - DNA, 23 bp, Homo sapiens
tgtatgatcaaatgtttaatcat

SEQ ID NO: 486276 - DNA, 13 bp, Homo sapiens
tgtattacaaatc

SEQ ID NO: 486277 - DNA, 21 bp, Homo sapiens
tgtcaagggcagctttgctca

SEQ ID NO: 486278 - DNA, 22 bp, Homo sapiens
tgtcaagggcagctttgctcat

SEQ ID NO: 486279 - DNA, 14 bp, Homo sapiens
tgtccatcagatga

SEQ ID NO: 486280 - DNA, 16 bp, Homo sapiens
tgtgctgttgttatga

SEQ ID NO: 486281 - DNA, 19 bp, Homo sapiens
tgtgcttaacagggaacgt

SEQ ID NO: 486282 - DNA, 15 bp, Homo sapiens
tgtgggtttttattt

SEQ ID NO: 486283 - DNA, 16 bp, Homo sapiens
tgttagtaatacctct

SEQ ID NO: 486284 - DNA, 14 bp, Homo sapiens
tgttatgatgtgct

SEQ ID NO: 486285 - DNA, 19 bp, Homo sapiens
tgttatgatgtgcttaaca

SEQ ID NO: 486286 - DNA, 22 bp, Homo sapiens
tgttatgatgtgcttaacaggg

SEQ ID NO: 486287 - DNA, 17 bp, Homo sapiens
tgttgtagagaaaacat

SEQ ID NO: 486288 - DNA, 23 bp, Homo sapiens
tgttgtagagaaaacatgcagaa

SEQ ID NO: 486289 - DNA, 14 bp, Homo sapiens
tgttgttatgatgt

SEQ ID NO: 486290 - DNA, 15 bp, Homo sapiens
tgtttaatcatataa

SEQ ID NO: 486291 - DNA, 16 bp, Homo sapiens
tgtttaatcatataaa

SEQ ID NO: 486292 - DNA, 20 bp, Homo sapiens
tgtttaatcatataaataga

SEQ ID NO: 486293 - DNA, 23 bp, Homo sapiens
tgtttaatcatataaatagaatg

SEQ ID NO: 486294 - DNA, 24 bp, Homo sapiens
tgtttaatcatataaatagaatgt

SEQ ID NO: 486295 - DNA, 20 bp, Homo sapiens
tgtttacattttatggtgcc

SEQ ID NO: 486296 - DNA, 16 bp, Homo sapiens
tgtttattcatatgca

SEQ ID NO: 486297 - DNA, 18 bp, Homo sapiens
tgtttattcatatgcata

SEQ ID NO: 486298 - DNA, 17 bp, Homo sapiens
tgtttcactactcagca

SEQ ID NO: 486299 - DNA, 21 bp, Homo sapiens
ttaaaaacctgttcaagtcta

SEQ ID NO: 486300 - DNA, 16 bp, Homo sapiens
ttaaacagatgtccat

SEQ ID NO: 486301 - DNA, 23 bp, Homo sapiens
ttaaacagttgcacagcatctca

SEQ ID NO: 486302 - DNA, 14 bp, Homo sapiens
ttaaagaattcaaa

SEQ ID NO: 486303 - DNA, 13 bp, Homo sapiens
ttaatcatataaa

SEQ ID NO: 486304 - DNA, 15 bp, Homo sapiens
ttaatcatataaata

SEQ ID NO: 486305 - DNA, 13 bp, Homo sapiens
ttaatgaatgctt

SEQ ID NO: 486306 - DNA, 21 bp, Homo sapiens
ttaatgaatgcttaaagaatt

SEQ ID NO: 486307 - DNA, 22 bp, Homo sapiens
ttaatgtcaattcttgccaaat

SEQ ID NO: 486308 - DNA, 15 bp, Homo sapiens
ttacagcaaatcctt

SEQ ID NO: 486309 - DNA, 23 bp, Homo sapiens
ttacattttatggtgcctagtat

SEQ ID NO: 486310 - DNA, 17 bp, Homo sapiens
ttacccatttgttcata

SEQ ID NO: 486311 - DNA, 19 bp, Homo sapiens
ttacccatttgttcatatt

SEQ ID NO: 486312 - DNA, 15 bp, Homo sapiens
ttacttagtattgca

SEQ ID NO: 486313 - DNA, 15 bp, Homo sapiens
ttagccagtaatcct

SEQ ID NO: 486314 - DNA, 21 bp, Homo sapiens
ttagccagtaatcctgtagga

SEQ ID NO: 486315 - DNA, 17 bp, Homo sapiens
ttagcttatgttaactg

SEQ ID NO: 486316 - DNA, 12 bp, Homo sapiens
ttagctttgtca

SEQ ID NO: 486317 - DNA, 16 bp, Homo sapiens
ttagctttgtcactgt

SEQ ID NO: 486318 - DNA, 13 bp, Homo sapiens
ttagtattgcaaa

SEQ ID NO: 486319 - DNA, 15 bp, Homo sapiens
ttagtgactaaacca

SEQ ID NO: 486320 - DNA, 18 bp, Homo sapiens
ttagttcctgtgcacagc

SEQ ID NO: 486321 - DNA, 22 bp, Homo sapiens
ttataagggcaaattggagaaa

SEQ ID NO: 486322 - DNA, 12 bp, Homo sapiens
ttataatttaaa

SEQ ID NO: 486323 - DNA, 12 bp, Homo sapiens
ttatagctctaa

SEQ ID NO: 486324 - DNA, 15 bp, Homo sapiens
ttatagctctaatgt

SEQ ID NO: 486325 - DNA, 23 bp, Homo sapiens
attagccagtaatcctgtaggaa

SEQ ID NO: 486326 - DNA, 16 bp, Homo sapiens
attatagctctaatgt

SEQ ID NO: 486327 - DNA, 21 bp, Homo sapiens
attatagctctaatgtttgca

SEQ ID NO: 486328 - DNA, 22 bp, Homo sapiens
attatagctctaatgtttgcat

SEQ ID NO: 486329 - DNA, 23 bp, Homo sapiens
attatagctctaatgtttgcata

SEQ ID NO: 486330 - DNA, 20 bp, Homo sapiens
attatatggcttgagtttaa

SEQ ID NO: 486331 - DNA, 21 bp, Homo sapiens
attcaatttgatgtggtgaaa

SEQ ID NO: 486332 - DNA, 18 bp, Homo sapiens
attcacttcactgtgctg

SEQ ID NO: 486333 - DNA, 13 bp, Homo sapiens
attcatatgcata

SEQ ID NO: 486334 - DNA, 15 bp, Homo sapiens
attgacaaaatgtta

SEQ ID NO: 486335 - DNA, 19 bp, Homo sapiens
attgacaaaatgttatttc

SEQ ID NO: 486336 - DNA, 14 bp, Homo sapiens
attgatgatccatt

SEQ ID NO: 486337 - DNA, 15 bp, Homo sapiens
attgtgcattctaga

SEQ ID NO: 486338 - DNA, 19 bp, Homo sapiens
atttagttgttgtagagaa

SEQ ID NO: 486339 - DNA, 20 bp, Homo sapiens
atttagttgttgtagagaaa

SEQ ID NO: 486340 - DNA, 16 bp, Homo sapiens
atttcagcagctgcag

SEQ ID NO: 486341 - DNA, 15 bp, Homo sapiens
atttccctacattaa

SEQ ID NO: 486342 - DNA, 15 bp, Homo sapiens
atttcctatgatgta

SEQ ID NO: 486343 - DNA, 17 bp, Homo sapiens
atttgcatacattcttc

SEQ ID NO: 486344 - DNA, 20 bp, Homo sapiens
atttggatctcttcttaatg

SEQ ID NO: 486345 - DNA, 17 bp, Homo sapiens
attttatagctactaat

SEQ ID NO: 486346 - DNA, 14 bp, Homo sapiens
attttcactgtgtc

SEQ ID NO: 486347 - DNA, 14 bp, Homo sapiens
attttctataattt

SEQ ID NO: 486348 - DNA, 15 bp, Homo sapiens
attttctgcatctcc

SEQ ID NO: 486349 - DNA, 20 bp, Homo sapiens
atttttttttttttcctgtc

SEQ ID NO: 486350 - DNA, 21 bp, Homo sapiens
caaaaggataatgaatacttt

SEQ ID NO: 486351 - DNA, 12 bp, Homo sapiens
caaaatcagttt

SEQ ID NO: 486352 - DNA, 22 bp, Homo sapiens
caaaatgctcttatttcatcat

SEQ ID NO: 486353 - DNA, 16 bp, Homo sapiens
caaaatgttatttccc

SEQ ID NO: 486354 - DNA, 17 bp, Homo sapiens
caaaatgttatttccct

SEQ ID NO: 486355 - DNA, 13 bp, Homo sapiens
caaaattagccag

SEQ ID NO: 486356 - DNA, 20 bp, Homo sapiens
caaaattagccagtaatcct

SEQ ID NO: 486357 - DNA, 13 bp, Homo sapiens
caaacaatacctg

SEQ ID NO: 486358 - DNA, 15 bp, Homo sapiens
caaacaatacctgaa

SEQ ID NO: 486359 - DNA, 19 bp, Homo sapiens
caaatgaagacaaaacata

SEQ ID NO: 486360 - DNA, 19 bp, Homo sapiens
caaatgtttaatcatataa

SEQ ID NO: 486361 - DNA, 20 bp, Homo sapiens
caaatgtttaatcatataaa

SEQ ID NO: 486362 - DNA, 15 bp, Homo sapiens
caaattttatctgcc

SEQ ID NO: 486363 - DNA, 19 bp, Homo sapiens
caacttgcaaaatcagttt

SEQ ID NO: 486364 - DNA, 20 bp, Homo sapiens
caagaaaggctgctgtactg

SEQ ID NO: 486365 - DNA, 13 bp, Homo sapiens
caagatcccattt

SEQ ID NO: 486366 - DNA, 15 bp, Homo sapiens
caagatcccatttga

SEQ ID NO: 486367 - DNA, 18 bp, Homo sapiens
caagatgaaattccattt

SEQ ID NO: 486368 - DNA, 13 bp, Homo sapiens
caagattcagcta

SEQ ID NO: 486369 - DNA, 20 bp, Homo sapiens
caaggaaaaaataacaatga

SEQ ID NO: 486370 - DNA, 14 bp, Homo sapiens
caagggcagctttg

SEQ ID NO: 486371 - DNA, 12 bp, Homo sapiens
caagtgtaatga

SEQ ID NO: 486372 - DNA, 20 bp, Homo sapiens
caagtttcatccagaactac

SEQ ID NO: 486373 - DNA, 23 bp, Homo sapiens
caataaaattatagctctaatgt

SEQ ID NO: 486374 - DNA, 16 bp, Homo sapiens
caatacaagtttcatc

SEQ ID NO: 486375 - DNA, 15 bp, Homo sapiens
caattcttgccaaat

SEQ ID NO: 486376 - DNA, 14 bp, Homo sapiens
caattttcactgtg

SEQ ID NO: 486377 - DNA, 20 bp, Homo sapiens
caattttcactgtgtccagg

SEQ ID NO: 486378 - DNA, 15 bp, Homo sapiens
cacagcatctcagct

SEQ ID NO: 486379 - DNA, 15 bp, Homo sapiens
caccctggatttgca

SEQ ID NO: 486380 - DNA, 13 bp, Homo sapiens
cactactcagcat

SEQ ID NO: 486381 - DNA, 14 bp, Homo sapiens
cactactcagcatg

SEQ ID NO: 486382 - DNA, 16 bp, Homo sapiens
cactgagcactgtttt

SEQ ID NO: 486383 - DNA, 17 bp, Homo sapiens
cactgagcactgttttc

SEQ ID NO: 486384 - DNA, 18 bp, Homo sapiens
cactgagcactgttttct

SEQ ID NO: 486385 - DNA, 19 bp, Homo sapiens
cactgtgctgttgttatga

SEQ ID NO: 486386 - DNA, 23 bp, Homo sapiens
cactgtgctgttgttatgatgtg

SEQ ID NO: 486387 - DNA, 14 bp, Homo sapiens
cactgttttctagt

SEQ ID NO: 486388 - DNA, 21 bp, Homo sapiens
cactgttttctagtgtatcaa

SEQ ID NO: 486389 - DNA, 23 bp, Homo sapiens
cactgttttctagtgtatcaaaa

SEQ ID NO: 486390 - DNA, 23 bp, Homo sapiens
cagatgacaagaaaggctgctgt

SEQ ID NO: 486391 - DNA, 15 bp, Homo sapiens
cagatgtctatattg

SEQ ID NO: 486392 - DNA, 18 bp, Homo sapiens
cagcaaatcctttgtgaa

SEQ ID NO: 486393 - DNA, 13 bp, Homo sapiens
cagcatctcagct

SEQ ID NO: 486394 - DNA, 21 bp, Homo sapiens
cagctttgctcatatttccca

SEQ ID NO: 486395 - DNA, 15 bp, Homo sapiens
caggaacgtttagct

SEQ ID NO: 486396 - DNA, 12 bp, Homo sapiens
cagtaatcctgt

SEQ ID NO: 486397 - DNA, 16 bp, Homo sapiens
cagtaatcctgtagga

SEQ ID NO: 486398 - DNA, 20 bp, Homo sapiens
cagtaattgtgtttacattt

SEQ ID NO: 486399 - DNA, 15 bp, Homo sapiens
cagtatcggcactgt

SEQ ID NO: 486400 - DNA, 16 bp, Homo sapiens
cagtatcggcactgta

SEQ ID NO: 486401 - DNA, 19 bp, Homo sapiens
cagtatcggcactgtacaa

SEQ ID NO: 486402 - DNA, 20 bp, Homo sapiens
cagtgaaagaaaataacaat

SEQ ID NO: 486403 - DNA, 17 bp, Homo sapiens
cagttattatatttaca

SEQ ID NO: 486404 - DNA, 22 bp, Homo sapiens
cagttattatatttacaaatgg

SEQ ID NO: 486405 - DNA, 21 bp, Homo sapiens
cagttgcacagcatctcagct

SEQ ID NO: 486406 - DNA, 19 bp, Homo sapiens
cagttgctgcttcaattta

SEQ ID NO: 486407 - DNA, 19 bp, Homo sapiens
catactttgttaggaaggg

SEQ ID NO: 486408 - DNA, 16 bp, Homo sapiens
cataggtttaataatt

SEQ ID NO: 486409 - DNA, 17 bp, Homo sapiens
catataaatagaatgta

SEQ ID NO: 486410 - DNA, 19 bp, Homo sapiens
catataagggaagtagtta

SEQ ID NO: 486411 - DNA, 20 bp, Homo sapiens
catatgcatattttttttct

SEQ ID NO: 486412 - DNA, 19 bp, Homo sapiens
catcattcacttcactgtg

SEQ ID NO: 486413 - DNA, 20 bp, Homo sapiens
catctagttcccctgtttat

SEQ ID NO: 486414 - DNA, 23 bp, Homo sapiens
catctagttcccctgtttattca

SEQ ID NO: 486415 - DNA, 20 bp, Homo sapiens
catgaagacctttttctgca

SEQ ID NO: 486416 - DNA, 22 bp, Homo sapiens
catgaagacctttttctgcact

SEQ ID NO: 486417 - DNA, 16 bp, Homo sapiens
catgatttcatgtact

SEQ ID NO: 486418 - DNA, 19 bp, Homo sapiens
catgatttcatgtactgca

SEQ ID NO: 486419 - DNA, 15 bp, Homo sapiens
catgtactgcattat

SEQ ID NO: 486420 - DNA, 14 bp, Homo sapiens
catgtcaagattca

SEQ ID NO: 486421 - DNA, 17 bp, Homo sapiens
catgttagtaatacctc

SEQ ID NO: 486422 - DNA, 20 bp, Homo sapiens
catgttagtaatacctctaa

SEQ ID NO: 486423 - DNA, 19 bp, Homo sapiens
gatttcatgtactgcatta

SEQ ID NO: 486424 - DNA, 13 bp, Homo sapiens
gcaaaatcagttt

SEQ ID NO: 486425 - DNA, 15 bp, Homo sapiens
gcaaaatcagttttc

SEQ ID NO: 486426 - DNA, 17 bp, Homo sapiens
gcaatacaagtttcatc

SEQ ID NO: 486427 - DNA, 17 bp, Homo sapiens
gcacaagtgtaatgaat

SEQ ID NO: 486428 - DNA, 18 bp, Homo sapiens
gcacacagaggggagtca

SEQ ID NO: 486429 - DNA, 21 bp, Homo sapiens
gcactgtacaaaaaaatcttc

SEQ ID NO: 486430 - DNA, 18 bp, Homo sapiens
gcagcacaagtgtaatga

SEQ ID NO: 486431 - DNA, 14 bp, Homo sapiens
gcagctttgctcat

SEQ ID NO: 486432 - DNA, 16 bp, Homo sapiens
gcaggttgataaatca

SEQ ID NO: 486433 - DNA, 22 bp, Homo sapiens
gcagtatcggcactgtacaaaa

SEQ ID NO: 486434 - DNA, 13 bp, Homo sapiens
gcagtgttagctt

SEQ ID NO: 486435 - DNA, 23 bp, Homo sapiens
gcatataagggaagtagttatca

SEQ ID NO: 486436 - DNA, 15 bp, Homo sapiens
gcatattttttttct

SEQ ID NO: 486437 - DNA, 20 bp, Homo sapiens
gcatctagttcccctgttta

SEQ ID NO: 486438 - DNA, 14 bp, Homo sapiens
gcatctcagctcat

SEQ ID NO: 486439 - DNA, 18 bp, Homo sapiens
gcattttctgcatctcca

SEQ ID NO: 486440 - DNA, 17 bp, Homo sapiens
gccacacgagaacctga

SEQ ID NO: 486441 - DNA, 19 bp, Homo sapiens
gccagtaatcctgtaggaa

SEQ ID NO: 486442 - DNA, 16 bp, Homo sapiens
gccttttagttcctgt

SEQ ID NO: 486443 - DNA, 20 bp, Homo sapiens
gccttttagttcctgtgcac

SEQ ID NO: 486444 - DNA, 23 bp, Homo sapiens
gctccatttaaacagatgtccat

SEQ ID NO: 486445 - DNA, 14 bp, Homo sapiens
gctcttatttcatc

SEQ ID NO: 486446 - DNA, 15 bp, Homo sapiens
gctcttatttcatca

SEQ ID NO: 486447 - DNA, 18 bp, Homo sapiens
gctgaaacgcatctagtt

SEQ ID NO: 486448 - DNA, 19 bp, Homo sapiens
gctgtactgaagtaaaaca

SEQ ID NO: 486449 - DNA, 14 bp, Homo sapiens
gctgttgttatgat

SEQ ID NO: 486450 - DNA, 16 bp, Homo sapiens
ggaaaaaataacaatg

SEQ ID NO: 486451 - DNA, 17 bp, Homo sapiens
agcatgtcgtcaaagct

SEQ ID NO: 486452 - DNA, 20 bp, Homo sapiens
agcatgtcgtcaaagctgaa

SEQ ID NO: 486453 - DNA, 20 bp, Homo sapiens
agcattttctgcatctccac

SEQ ID NO: 486454 - DNA, 13 bp, Homo sapiens
agccagtaatcct

SEQ ID NO: 486455 - DNA, 22 bp, Homo sapiens
agcccctaagtcaacttagcat

SEQ ID NO: 486456 - DNA, 22 bp, Homo sapiens
agctctaatgtttgcatataag

SEQ ID NO: 486457 - DNA, 16 bp, Homo sapiens
agctgacaaaatactt

SEQ ID NO: 486458 - DNA, 21 bp, Homo sapiens
agctgacaaaatacttgtctg

SEQ ID NO: 486459 - DNA, 19 bp, Homo sapiens
agctttgctcatatttccc

SEQ ID NO: 486460 - DNA, 20 bp, Homo sapiens
agctttgctcatatttccca

SEQ ID NO: 486461 - DNA, 17 bp, Homo sapiens
aggaaggtactgtatga

SEQ ID NO: 486462 - DNA, 20 bp, Homo sapiens
aggaatcatcaggaacgttt

SEQ ID NO: 486463 - DNA, 22 bp, Homo sapiens
aggctgctgtactgaagtaaaa

SEQ ID NO: 486464 - DNA, 13 bp, Homo sapiens
agggaaatttcag

SEQ ID NO: 486465 - DNA, 17 bp, Homo sapiens
agggaagtagttatcat

SEQ ID NO: 486466 - DNA, 17 bp, Homo sapiens
agggcagctttgctcat

SEQ ID NO: 486467 - DNA, 20 bp, Homo sapiens
aggtaaaagcatcacatgaa

SEQ ID NO: 486468 - DNA, 15 bp, Homo sapiens
aggtcagtgcaaata

SEQ ID NO: 486469 - DNA, 21 bp, Homo sapiens
agtaatacctctaatagtata

SEQ ID NO: 486470 - DNA, 22 bp, Homo sapiens
agtaatacctctaatagtataa

SEQ ID NO: 486471 - DNA, 23 bp, Homo sapiens
agtaatacctctaatagtataaa

SEQ ID NO: 486472 - DNA, 23 bp, Homo sapiens
agtaattgtgtttacattttatg

SEQ ID NO: 486473 - DNA, 16 bp, Homo sapiens
agtatcggcactgtac

SEQ ID NO: 486474 - DNA, 19 bp, Homo sapiens
agtatcggcactgtacaaa

SEQ ID NO: 486475 - DNA, 16 bp, Homo sapiens
agtattgacaaaatgt

SEQ ID NO: 486476 - DNA, 17 bp, Homo sapiens
agtattgacaaaatgtt

SEQ ID NO: 486477 - DNA, 16 bp, Homo sapiens
agtattgcaaagtcag

SEQ ID NO: 486478 - DNA, 16 bp, Homo sapiens
agtcagattcttgcat

SEQ ID NO: 486479 - DNA, 16 bp, Homo sapiens
agtctttcacatttaa

SEQ ID NO: 486480 - DNA, 18 bp, Homo sapiens
agtctttcacatttaaat

SEQ ID NO: 486481 - DNA, 15 bp, Homo sapiens
agtgcagttatttgc

SEQ ID NO: 486482 - DNA, 17 bp, Homo sapiens
agtgctaacatgaagac

SEQ ID NO: 486483 - DNA, 21 bp, Homo sapiens
agtggccaagagatgcagtgc

SEQ ID NO: 486484 - DNA, 14 bp, Homo sapiens
agtgtaatgaatac

SEQ ID NO: 486485 - DNA, 22 bp, Homo sapiens
agtgtaatgaataccttagtgc

SEQ ID NO: 486486 - DNA, 18 bp, Homo sapiens
agttatcatgttagtaat

SEQ ID NO: 486487 - DNA, 20 bp, Homo sapiens
agttattatatttacaaatg

SEQ ID NO: 486488 - DNA, 19 bp, Homo sapiens
agttcccctgtttattcat

SEQ ID NO: 486489 - DNA, 14 bp, Homo sapiens
agttcctgtgcaca

SEQ ID NO: 486490 - DNA, 16 bp, Homo sapiens
agttcctgtgcacagc

SEQ ID NO: 486491 - DNA, 15 bp, Homo sapiens
agttcttcgactgtt

SEQ ID NO: 486492 - DNA, 18 bp, Homo sapiens
agttcttcgactgttgtt

SEQ ID NO: 486493 - DNA, 22 bp, Homo sapiens
agttgaaaatcttataatttaa

SEQ ID NO: 486494 - DNA, 23 bp, Homo sapiens
agttgaaaatcttataatttaaa

SEQ ID NO: 486495 - DNA, 11 bp, Homo sapiens
agttgcacagc

SEQ ID NO: 486496 - DNA, 15 bp, Homo sapiens
agttgcacagcatct

SEQ ID NO: 486497 - DNA, 20 bp, Homo sapiens
agttgcacagcatctcagct

SEQ ID NO: 486498 - DNA, 15 bp, Homo sapiens
ataaaagacagtgaa

SEQ ID NO: 486499 - DNA, 12 bp, Homo sapiens
ataaaattatag

SEQ ID NO: 486500 - DNA, 19 bp, Homo sapiens
ataaaattatagctctaat

SEQ ID NO: 486501 - DNA, 18 bp, Homo sapiens
ataaaggattaatgtcaa

SEQ ID NO: 486502 - DNA, 14 bp, Homo sapiens
ataaataaaaataa

SEQ ID NO: 486503 - DNA, 14 bp, Homo sapiens
ataaatcattttat

SEQ ID NO: 486504 - DNA, 18 bp, Homo sapiens
ataaatcattttatgtca

SEQ ID NO: 486505 - DNA, 12 bp, Homo sapiens
ataagggaagta

SEQ ID NO: 486506 - DNA, 22 bp, Homo sapiens
ataagggaagtagttatcatgt

SEQ ID NO: 486507 - DNA, 14 bp, Homo sapiens
atacaagtttcatc

SEQ ID NO: 486508 - DNA, 21 bp, Homo sapiens
atacagttcggtgagctacaa

SEQ ID NO: 486509 - DNA, 20 bp, Homo sapiens
atacctcaattttcactgtg

SEQ ID NO: 486510 - DNA, 17 bp, Homo sapiens
atactgccactaacctt

SEQ ID NO: 486511 - DNA, 13 bp, Homo sapiens
atacttgtctgtt

SEQ ID NO: 486512 - DNA, 16 bp, Homo sapiens
atacttgtctgtttta

SEQ ID NO: 486513 - DNA, 13 bp, Homo sapiens
atagaagtaaaaa

SEQ ID NO: 486514 - DNA, 14 bp, Homo sapiens
atagctactaattt

SEQ ID NO: 486515 - DNA, 21 bp, Homo sapiens
atagctctaatgtttgcatat

SEQ ID NO: 486516 - DNA, 22 bp, Homo sapiens
atagctctaatgtttgcatata

SEQ ID NO: 486517 - DNA, 21 bp, Homo sapiens
atataaatagaatgtaaatgt

SEQ ID NO: 486518 - DNA, 22 bp, Homo sapiens
atataaatagaatgtaaatgtc

SEQ ID NO: 486519 - DNA, 17 bp, Homo sapiens
atatctaggtttatgac

SEQ ID NO: 486520 - DNA, 22 bp, Homo sapiens
atatctaggtttatgacagtaa

SEQ ID NO: 486521 - DNA, 14 bp, Homo sapiens
atattaagaatgat

SEQ ID NO: 486522 - DNA, 17 bp, Homo sapiens
atattaagaatgatctg

SEQ ID NO: 486523 - DNA, 15 bp, Homo sapiens
atcaaaatgctctta

SEQ ID NO: 486524 - DNA, 21 bp, Homo sapiens
atcaaaatgctcttatttcat

SEQ ID NO: 486525 - DNA, 12 bp, Homo sapiens
atcaaatgttta

SEQ ID NO: 486526 - DNA, 13 bp, Homo sapiens
atcaggaacgttt

SEQ ID NO: 486527 - DNA, 18 bp, Homo sapiens
atcatataaatagaatgt

SEQ ID NO: 486528 - DNA, 19 bp, Homo sapiens
atcatataaatagaatgta

SEQ ID NO: 486529 - DNA, 24 bp, Homo sapiens
atcatataaatagaatgtaaatgt

SEQ ID NO: 486530 - DNA, 19 bp, Homo sapiens
atcatgttagtaatacctc

SEQ ID NO: 486531 - DNA, 14 bp, Homo sapiens
atcattttatgtca

SEQ ID NO: 486532 - DNA, 20 bp, Homo sapiens
atccaattagcttatgttaa

SEQ ID NO: 486533 - DNA, 22 bp, Homo sapiens
atcctgtaggaaggtactgtat

SEQ ID NO: 486534 - DNA, 21 bp, Homo sapiens
atctaggtttatgacagtaat

SEQ ID NO: 486535 - DNA, 23 bp, Homo sapiens
atctaggtttatgacagtaattg

SEQ ID NO: 486536 - DNA, 23 bp, Homo sapiens
atctagttcccctgtttattcat

SEQ ID NO: 486537 - DNA, 18 bp, Homo sapiens
atctcttcttaatgtaca

SEQ ID NO: 486538 - DNA, 19 bp, Homo sapiens
atctgtttgagaaagtcag

SEQ ID NO: 486539 - DNA, 22 bp, Homo sapiens
atcttataatttaaaatatgct

SEQ ID NO: 486540 - DNA, 22 bp, Homo sapiens
atcttgcagtatcggcactgta

SEQ ID NO: 486541 - DNA, 24 bp, Homo sapiens
atcttgcagtatcggcactgtaca

SEQ ID NO: 486542 - DNA, 21 bp, Homo sapiens
atgacagtaattgtgtttaca

SEQ ID NO: 486543 - DNA, 15 bp, Homo sapiens
atgatcaaatgttta

SEQ ID NO: 486544 - DNA, 19 bp, Homo sapiens
atgatcaaatgtttaatca

SEQ ID NO: 486545 - DNA, 11 bp, Homo sapiens
atgatgtgctt

SEQ ID NO: 486546 - DNA, 16 bp, Homo sapiens
atgatttcatgtactg

SEQ ID NO: 486547 - DNA, 18 bp, Homo sapiens
atgcagaacaaatgaaga

SEQ ID NO: 486548 - DNA, 19 bp, Homo sapiens
atgcagaacaaatgaagac

SEQ ID NO: 486549 - DNA, 13 bp, Homo sapiens
atgcagtgccagg

SEQ ID NO: 486550 - DNA, 19 bp, Homo sapiens
atgcttaaagaattcaaat

SEQ ID NO: 486551 - DNA, 21 bp, Homo sapiens
atgcttaaagaattcaaattt

SEQ ID NO: 486552 - DNA, 20 bp, Homo sapiens
atgcttatattgttcacttc

SEQ ID NO: 486553 - DNA, 20 bp, Homo sapiens
atggtgcctagtattgacaa

SEQ ID NO: 486554 - DNA, 17 bp, Homo sapiens
atcaaatgtttaatcat

SEQ ID NO: 486555 - DNA, 18 bp, Homo sapiens
atcaaatgtttaatcata

SEQ ID NO: 486556 - DNA, 21 bp, Homo sapiens
atcaaatgtttaatcatataa

SEQ ID NO: 486557 - DNA, 21 bp, Homo sapiens
atcatgttagtaatacctcta

SEQ ID NO: 486558 - DNA, 23 bp, Homo sapiens
atcattttatgtcaagggcagct

SEQ ID NO: 486559 - DNA, 20 bp, Homo sapiens
atcctgtaggaaggtactgt

SEQ ID NO: 486560 - DNA, 15 bp, Homo sapiens
atccttgaaggtata

SEQ ID NO: 486561 - DNA, 16 bp, Homo sapiens
atccttgaaggtatat

SEQ ID NO: 486562 - DNA, 12 bp, Homo sapiens
atctcagctcat

SEQ ID NO: 486563 - DNA, 16 bp, Homo sapiens
atctcagctcatcttc

SEQ ID NO: 486564 - DNA, 13 bp, Homo sapiens
atctcttcttaat

SEQ ID NO: 486565 - DNA, 22 bp, Homo sapiens
atctcttcttaatgtacatagt

SEQ ID NO: 486566 - DNA, 13 bp, Homo sapiens
atctgtttgagaa

SEQ ID NO: 486567 - DNA, 15 bp, Homo sapiens
atctgtttgagaaag

SEQ ID NO: 486568 - DNA, 14 bp, Homo sapiens
atcttataatttaa

SEQ ID NO: 486569 - DNA, 15 bp, Homo sapiens
atcttataatttaaa

SEQ ID NO: 486570 - DNA, 14 bp, Homo sapiens
atcttcaatccttg

SEQ ID NO: 486571 - DNA, 22 bp, Homo sapiens
atcttccaatttagttgttgta

SEQ ID NO: 486572 - DNA, 13 bp, Homo sapiens
atgaaattccatt

SEQ ID NO: 486573 - DNA, 12 bp, Homo sapiens
atgaatgcttaa

SEQ ID NO: 486574 - DNA, 15 bp, Homo sapiens
atgaatgcttaaaga

SEQ ID NO: 486575 - DNA, 20 bp, Homo sapiens
atgaatgcttaaagaattca

SEQ ID NO: 486576 - DNA, 12 bp, Homo sapiens
atgatcaaatgt

SEQ ID NO: 486577 - DNA, 14 bp, Homo sapiens
atgatcaaatgttt

SEQ ID NO: 486578 - DNA, 20 bp, Homo sapiens
atgatcaaatgtttaatcat

SEQ ID NO: 486579 - DNA, 13 bp, Homo sapiens
atgatctgattga

SEQ ID NO: 486580 - DNA, 13 bp, Homo sapiens
atgatgtgcttaa

SEQ ID NO: 486581 - DNA, 18 bp, Homo sapiens
atgctcttatttcatcat

SEQ ID NO: 486582 - DNA, 18 bp, Homo sapiens
atgcttaaagaattcaaa

SEQ ID NO: 486583 - DNA, 20 bp, Homo sapiens
atgcttaaagaattcaaatt

SEQ ID NO: 486584 - DNA, 22 bp, Homo sapiens
atggaaacaagatgaaattcca

SEQ ID NO: 486585 - DNA, 23 bp, Homo sapiens
atgtaaatgtctcactgagcact

SEQ ID NO: 486586 - DNA, 15 bp, Homo sapiens
atgtcaagattcagc

SEQ ID NO: 486587 - DNA, 18 bp, Homo sapiens
atgtcaagattcagctag

SEQ ID NO: 486588 - DNA, 14 bp, Homo sapiens
atgtcaagggcagc

SEQ ID NO: 486589 - DNA, 21 bp, Homo sapiens
atgtcaagggcagctttgctc

SEQ ID NO: 486590 - DNA, 14 bp, Homo sapiens
atgtctcactgagc

SEQ ID NO: 486591 - DNA, 18 bp, Homo sapiens
atgtctcactgagcactg

SEQ ID NO: 486592 - DNA, 20 bp, Homo sapiens
atgtctcactgagcactgtt

SEQ ID NO: 486593 - DNA, 20 bp, Homo sapiens
atgtggtgaaaagcaggttg

SEQ ID NO: 486594 - DNA, 23 bp, Homo sapiens
atgttaactgacaagctccattt

SEQ ID NO: 486595 - DNA, 17 bp, Homo sapiens
atgtttaatcatataaa

SEQ ID NO: 486596 - DNA, 14 bp, Homo sapiens
atgtttgcatataa

SEQ ID NO: 486597 - DNA, 15 bp, Homo sapiens
atgtttgcatataag

SEQ ID NO: 486598 - DNA, 15 bp, Homo sapiens
attaagaatgatctg

SEQ ID NO: 486599 - DNA, 16 bp, Homo sapiens
attaagaatgatctga

SEQ ID NO: 486600 - DNA, 18 bp, Homo sapiens
attacttagtattgcaaa

SEQ ID NO: 486601 - DNA, 22 bp, Homo sapiens
attacttagtattgcaaagtca

SEQ ID NO: 486602 - DNA, 12 bp, Homo sapiens
attagccagtaa

SEQ ID NO: 486603 - DNA, 16 bp, Homo sapiens
attagccagtaatcct

SEQ ID NO: 486604 - DNA, 15 bp, Homo sapiens
attatatttacaaat

SEQ ID NO: 486605 - DNA, 16 bp, Homo sapiens
attcacttcactgtgc

SEQ ID NO: 486606 - DNA, 14 bp, Homo sapiens
attcatatgcatat

SEQ ID NO: 486607 - DNA, 15 bp, Homo sapiens
attcatatgcatatt

SEQ ID NO: 486608 - DNA, 16 bp, Homo sapiens
attgacaaaatgttat

SEQ ID NO: 486609 - DNA, 21 bp, Homo sapiens
attgaccgtgttggtctgtac

SEQ ID NO: 486610 - DNA, 23 bp, Homo sapiens
attgtaataggcgtaactaattt

SEQ ID NO: 486611 - DNA, 16 bp, Homo sapiens
attgtagtcctgtaat

SEQ ID NO: 486612 - DNA, 15 bp, Homo sapiens
attgtgtttacattt

SEQ ID NO: 486613 - DNA, 23 bp, Homo sapiens
attgtgtttacattttatggtgc

SEQ ID NO: 486614 - DNA, 20 bp, Homo sapiens
atttcctatgatgtatactg

SEQ ID NO: 486615 - DNA, 18 bp, Homo sapiens
atttgagaagctgctcaa

SEQ ID NO: 486616 - DNA, 21 bp, Homo sapiens
attttatctgcctctcttgta

SEQ ID NO: 486617 - DNA, 22 bp, Homo sapiens
attttatctgcctctcttgtaa

SEQ ID NO: 486618 - DNA, 22 bp, Homo sapiens
attttatggtgcctagtattga

SEQ ID NO: 486619 - DNA, 15 bp, Homo sapiens
attttctataattta

SEQ ID NO: 486620 - DNA, 17 bp, Homo sapiens
attttctataatttaaa

SEQ ID NO: 486621 - DNA, 19 bp, Homo sapiens
attttctataatttaaata

SEQ ID NO: 486622 - DNA, 21 bp, Homo sapiens
caaaacttcgtttaatgaatg

SEQ ID NO: 486623 - DNA, 20 bp, Homo sapiens
caaaatacttgtctgtttta

SEQ ID NO: 486624 - DNA, 21 bp, Homo sapiens
caaaatacttgtctgttttaa

SEQ ID NO: 486625 - DNA, 21 bp, Homo sapiens
caaaattagccagtaatcctg

SEQ ID NO: 486626 - DNA, 22 bp, Homo sapiens
caaacaatacctgaatgctctg

SEQ ID NO: 486627 - DNA, 13 bp, Homo sapiens
caaatgtttaatc

SEQ ID NO: 486628 - DNA, 16 bp, Homo sapiens
caaatgtttaatcata

SEQ ID NO: 486629 - DNA, 17 bp, Homo sapiens
caaatgtttaatcatat

SEQ ID NO: 486630 - DNA, 18 bp, Homo sapiens
caagggcagctttgctca

SEQ ID NO: 486631 - DNA, 14 bp, Homo sapiens
caagtctaccaatt

SEQ ID NO: 486632 - DNA, 19 bp, Homo sapiens
caagtgtaatgaatacctt

SEQ ID NO: 486633 - DNA, 14 bp, Homo sapiens
caatcttcaatcct

SEQ ID NO: 486634 - DNA, 16 bp, Homo sapiens
caattagcttatgtta

SEQ ID NO: 486635 - DNA, 13 bp, Homo sapiens
caatttgatgtgg

SEQ ID NO: 486636 - DNA, 15 bp, Homo sapiens
cacaagtgtaatgaa

SEQ ID NO: 486637 - DNA, 12 bp, Homo sapiens
cacagcatctca

SEQ ID NO: 486638 - DNA, 13 bp, Homo sapiens
cacagcatctcag

SEQ ID NO: 486639 - DNA, 15 bp, Homo sapiens
caccagttgctgctt

SEQ ID NO: 486640 - DNA, 13 bp, Homo sapiens
cactaaacaaaga

SEQ ID NO: 486641 - DNA, 14 bp, Homo sapiens
cactcttcatggtg

SEQ ID NO: 486642 - DNA, 19 bp, Homo sapiens
cactgagcactgttttcta

SEQ ID NO: 486643 - DNA, 22 bp, Homo sapiens
cactgagcactgttttctagtg

SEQ ID NO: 486644 - DNA, 14 bp, Homo sapiens
cactgtgctgttgt

SEQ ID NO: 486645 - DNA, 21 bp, Homo sapiens
cactgtttcactactcagcat

SEQ ID NO: 486646 - DNA, 16 bp, Homo sapiens
cactgttttctagtgt

SEQ ID NO: 486647 - DNA, 17 bp, Homo sapiens
cactgttttctagtgta

SEQ ID NO: 486648 - DNA, 15 bp, Homo sapiens
cacttcactgtgctg

SEQ ID NO: 486649 - DNA, 12 bp, Homo sapiens
cagaacaaatga

SEQ ID NO: 486650 - DNA, 14 bp, Homo sapiens
cagaacaaatgaag

SEQ ID NO: 486651 - DNA, 14 bp, Homo sapiens
cagacattgtgcta

SEQ ID NO: 486652 - DNA, 19 bp, Homo sapiens
cagatgtccatcagatgac

SEQ ID NO: 486653 - DNA, 21 bp, Homo sapiens
cagatgtccatcagatgacaa

SEQ ID NO: 486654 - DNA, 23 bp, Homo sapiens
cagcttttggattggacaaaatg

SEQ ID NO: 486655 - DNA, 18 bp, Homo sapiens
cagggaacgtgattagtg

SEQ ID NO: 486656 - DNA, 19 bp, Homo sapiens
cagggaacgtgattagtga

SEQ ID NO: 486657 - DNA, 12 bp, Homo sapiens
cagggtaactaa

SEQ ID NO: 486658 - DNA, 19 bp, Homo sapiens
cagggtaactaactaaaac

SEQ ID NO: 486659 - DNA, 13 bp, Homo sapiens
cagtaatcctgta

SEQ ID NO: 486660 - DNA, 17 bp, Homo sapiens
cagtaatcctgtaggaa

SEQ ID NO: 486661 - DNA, 18 bp, Homo sapiens
cagtaattgtgtttacat

SEQ ID NO: 486662 - DNA, 14 bp, Homo sapiens
cagtatcggcactg

SEQ ID NO: 486663 - DNA, 16 bp, Homo sapiens
cagtgaaagaaaataa

SEQ ID NO: 486664 - DNA, 18 bp, Homo sapiens
cagtgccaggaaccctta

SEQ ID NO: 486665 - DNA, 14 bp, Homo sapiens
cagtgttagcttag

SEQ ID NO: 486666 - DNA, 12 bp, Homo sapiens
cagttacacatg

SEQ ID NO: 486667 - DNA, 21 bp, Homo sapiens
cagttattatatttacaaatg

SEQ ID NO: 486668 - DNA, 22 bp, Homo sapiens
cagttcggtgagctacaaatgc

SEQ ID NO: 486669 - DNA, 19 bp, Homo sapiens
cagttcttcgactgttgtt

SEQ ID NO: 486670 - DNA, 15 bp, Homo sapiens
cagttgcacagcatc

SEQ ID NO: 486671 - DNA, 21 bp, Homo sapiens
catacattcttcaagatccca

SEQ ID NO: 486672 - DNA, 17 bp, Homo sapiens
catacattttgtaccaa

SEQ ID NO: 486673 - DNA, 12 bp, Homo sapiens
tacattttatgg

SEQ ID NO: 486674 - DNA, 14 bp, Homo sapiens
tacattttgtacca

SEQ ID NO: 486675 - DNA, 14 bp, Homo sapiens
tacccatttgttca

SEQ ID NO: 486676 - DNA, 22 bp, Homo sapiens
tacccatttgttcatattaaga

SEQ ID NO: 486677 - DNA, 18 bp, Homo sapiens
tacctcaattttcactgt

SEQ ID NO: 486678 - DNA, 14 bp, Homo sapiens
tacctgaatgctct

SEQ ID NO: 486679 - DNA, 18 bp, Homo sapiens
taccttagtgcagttatt

SEQ ID NO: 486680 - DNA, 20 bp, Homo sapiens
taccttagtgcagttatttg

SEQ ID NO: 486681 - DNA, 23 bp, Homo sapiens
tactcaagagtggtatcttgcag

SEQ ID NO: 486682 - DNA, 22 bp, Homo sapiens
tactccaaaacttcgtttaatg

SEQ ID NO: 486683 - DNA, 16 bp, Homo sapiens
tactgaagtaaaacaa

SEQ ID NO: 486684 - DNA, 20 bp, Homo sapiens
tactgattcaatttgatgtg

SEQ ID NO: 486685 - DNA, 14 bp, Homo sapiens
tactgtatgatcaa

SEQ ID NO: 486686 - DNA, 19 bp, Homo sapiens
tactgtatgatcaaatgtt

SEQ ID NO: 486687 - DNA, 21 bp, Homo sapiens
tactgtatgatcaaatgttta

SEQ ID NO: 486688 - DNA, 15 bp, Homo sapiens
tacttgtctgtttta

SEQ ID NO: 486689 - DNA, 20 bp, Homo sapiens
tacttgtctgttttaaaaac

SEQ ID NO: 486690 - DNA, 16 bp, Homo sapiens
tagaatgtaaatgtct

SEQ ID NO: 486691 - DNA, 18 bp, Homo sapiens
tagaatgtaaatgtctca

SEQ ID NO: 486692 - DNA, 18 bp, Homo sapiens
tagcatgtcgtcaaagct

SEQ ID NO: 486693 - DNA, 21 bp, Homo sapiens
tagcatgtcgtcaaagctgaa

SEQ ID NO: 486694 - DNA, 16 bp, Homo sapiens
tagcgcactcttcatg

SEQ ID NO: 486695 - DNA, 16 bp, Homo sapiens
tagctactaattttaa

SEQ ID NO: 486696 - DNA, 18 bp, Homo sapiens
tagctctaatgtttgcat

SEQ ID NO: 486697 - DNA, 20 bp, Homo sapiens
tagctctaatgtttgcatat

SEQ ID NO: 486698 - DNA, 14 bp, Homo sapiens
taggaaggtactgt

SEQ ID NO: 486699 - DNA, 15 bp, Homo sapiens
taggaaggtactgta

SEQ ID NO: 486700 - DNA, 17 bp, Homo sapiens
taggtttatgacagtaa

SEQ ID NO: 486701 - DNA, 20 bp, Homo sapiens
taggtttatgacagtaattg

SEQ ID NO: 486702 - DNA, 12 bp, Homo sapiens
tagtaatacctc

SEQ ID NO: 486703 - DNA, 13 bp, Homo sapiens
tagtattgacaaa

SEQ ID NO: 486704 - DNA, 12 bp, Homo sapiens
tagttatcatgt

SEQ ID NO: 486705 - DNA, 17 bp, Homo sapiens
tagttcctgtgcacagc

SEQ ID NO: 486706 - DNA, 24 bp, Homo sapiens
tataagggaagtagttatcatgtt

SEQ ID NO: 486707 - DNA, 22 bp, Homo sapiens
tataagggcaaattggagaaaa

SEQ ID NO: 486708 - DNA, 23 bp, Homo sapiens
tatagctctaatgtttgcatata

SEQ ID NO: 486709 - DNA, 22 bp, Homo sapiens
tatatctaggtttatgacagta

SEQ ID NO: 486710 - DNA, 17 bp, Homo sapiens
tatattgttcacttctt

SEQ ID NO: 486711 - DNA, 15 bp, Homo sapiens
tatatttacaaatgg

SEQ ID NO: 486712 - DNA, 14 bp, Homo sapiens
tatattttgcctgt

SEQ ID NO: 486713 - DNA, 22 bp, Homo sapiens
tatcaaaatgctcttatttcat

SEQ ID NO: 486714 - DNA, 15 bp, Homo sapiens
tatcagttacacatg

SEQ ID NO: 486715 - DNA, 16 bp, Homo sapiens
tatcatgttagtaata

SEQ ID NO: 486716 - DNA, 13 bp, Homo sapiens
tatcggcactgta

SEQ ID NO: 486717 - DNA, 17 bp, Homo sapiens
tatcggcactgtacaaa

SEQ ID NO: 486718 - DNA, 15 bp, Homo sapiens
tatctaggtttatga

SEQ ID NO: 486719 - DNA, 21 bp, Homo sapiens
tatctaggtttatgacagtaa

SEQ ID NO: 486720 - DNA, 20 bp, Homo sapiens
tatctgcctctcttgtaatt

SEQ ID NO: 486721 - DNA, 21 bp, Homo sapiens
tatctgcctctcttgtaattt

SEQ ID NO: 486722 - DNA, 16 bp, Homo sapiens
tatctgtttgagaaag

SEQ ID NO: 486723 - DNA, 23 bp, Homo sapiens
tatcttgcagtatcggcactgta

SEQ ID NO: 486724 - DNA, 17 bp, Homo sapiens
tatgacagtaattgtgt

SEQ ID NO: 486725 - DNA, 13 bp, Homo sapiens
tatgatcaaatgt

SEQ ID NO: 486726 - DNA, 15 bp, Homo sapiens
tatgatcaaatgttt

SEQ ID NO: 486727 - DNA, 20 bp, Homo sapiens
tatgatcaaatgtttaatca

SEQ ID NO: 486728 - DNA, 22 bp, Homo sapiens
tatgatcaaatgtttaatcata

SEQ ID NO: 486729 - DNA, 19 bp, Homo sapiens
tatgatgtatactgccact

SEQ ID NO: 486730 - DNA, 14 bp, Homo sapiens
tatgatgtgcttaa

SEQ ID NO: 486731 - DNA, 21 bp, Homo sapiens
tatgattagctttgtcactgt

SEQ ID NO: 486732 - DNA, 20 bp, Homo sapiens
tatgcttatattgttcactt

SEQ ID NO: 486733 - DNA, 20 bp, Homo sapiens
tattgcaaagtcaggaatca

SEQ ID NO: 486734 - DNA, 19 bp, Homo sapiens
tatttcatcattcacttca

SEQ ID NO: 486735 - DNA, 15 bp, Homo sapiens
tatttcccatgattt

SEQ ID NO: 486736 - DNA, 16 bp, Homo sapiens
tatttcccatgatttc

SEQ ID NO: 486737 - DNA, 15 bp, Homo sapiens
tatttccctacatta

SEQ ID NO: 486738 - DNA, 14 bp, Homo sapiens
tcaaaatgctctta

SEQ ID NO: 486739 - DNA, 20 bp, Homo sapiens
tcaaaatgctcttatttcat

SEQ ID NO: 486740 - DNA, 14 bp, Homo sapiens
tcaaatgtttaatc

SEQ ID NO: 486741 - DNA, 17 bp, Homo sapiens
tcaaatgtttaatcata

SEQ ID NO: 486742 - DNA, 21 bp, Homo sapiens
tcaaatgtttaatcatataaa

SEQ ID NO: 486743 - DNA, 19 bp, Homo sapiens
tcaactcttgagtttttca

SEQ ID NO: 486744 - DNA, 19 bp, Homo sapiens
tcaacttgcaaaatcagtt

SEQ ID NO: 486745 - DNA, 13 bp, Homo sapiens
tcaagattcagct

SEQ ID NO: 486746 - DNA, 15 bp, Homo sapiens
tcaagtctaccaacc

SEQ ID NO: 486747 - DNA, 15 bp, Homo sapiens
tcaattcttgccaaa

SEQ ID NO: 486748 - DNA, 16 bp, Homo sapiens
tcaatttgatgtggtg

SEQ ID NO: 486749 - DNA, 15 bp, Homo sapiens
tcactgagcactgtt

SEQ ID NO: 486750 - DNA, 22 bp, Homo sapiens
tcactgagcactgttttctagt

SEQ ID NO: 486751 - DNA, 19 bp, Homo sapiens
tcactgtgctgttgttatg

SEQ ID NO: 486752 - DNA, 15 bp, Homo sapiens
tcactgtttcactac

SEQ ID NO: 486753 - DNA, 14 bp, Homo sapiens
tcacttcactgtgc

SEQ ID NO: 486754 - DNA, 13 bp, Homo sapiens
tcagattcttgca

SEQ ID NO: 486755 - DNA, 14 bp, Homo sapiens
tcagattcttgcat

SEQ ID NO: 486756 - DNA, 21 bp, Homo sapiens
tcatataaatagaatgtaaat

SEQ ID NO: 486757 - DNA, 14 bp, Homo sapiens
tcatattaagaatg

SEQ ID NO: 486758 - DNA, 17 bp, Homo sapiens
tcatattaagaatgatc

SEQ ID NO: 486759 - DNA, 17 bp, Homo sapiens
tcatcattcacttcact

SEQ ID NO: 486760 - DNA, 21 bp, Homo sapiens
tcatcattcacttcactgtgc

SEQ ID NO: 486761 - DNA, 20 bp, Homo sapiens
tcattcacttcactgtgctg

SEQ ID NO: 486762 - DNA, 18 bp, Homo sapiens
tccaatttagttgttgta

SEQ ID NO: 486763 - DNA, 21 bp, Homo sapiens
tccagttcttcgactgttgtt

SEQ ID NO: 486764 - DNA, 16 bp, Homo sapiens
tccatatggatccact

SEQ ID NO: 486765 - DNA, 20 bp, Homo sapiens
tccatgtcaagattcagcta

SEQ ID NO: 486766 - DNA, 22 bp, Homo sapiens
tcccatgatttcatgtactgca

SEQ ID NO: 486767 - DNA, 14 bp, Homo sapiens
tcccattcaagatt

SEQ ID NO: 486768 - DNA, 16 bp, Homo sapiens
tcccattcaagattcc

SEQ ID NO: 486769 - DNA, 16 bp, Homo sapiens
tccctacattaaacat

SEQ ID NO: 486770 - DNA, 15 bp, Homo sapiens
tcctatgatgtatac

SEQ ID NO: 486771 - DNA, 16 bp, Homo sapiens
tcctatgatgtatact

SEQ ID NO: 486772 - DNA, 20 bp, Homo sapiens
tcctgtaggaaggtactgta

SEQ ID NO: 486773 - DNA, 13 bp, Homo sapiens
tcctgtgcacagc

SEQ ID NO: 486774 - DNA, 14 bp, Homo sapiens
tcctttgtgaaaaa

SEQ ID NO: 486775 - DNA, 15 bp, Homo sapiens
tcggcactgtacaaa

SEQ ID NO: 486776 - DNA, 14 bp, Homo sapiens
tcgtttaatgaatg

SEQ ID NO: 486777 - DNA, 18 bp, Homo sapiens
tctaatgtttgcatataa

SEQ ID NO: 486778 - DNA, 17 bp, Homo sapiens
tctaggtttatgacagt

SEQ ID NO: 486779 - DNA, 13 bp, Homo sapiens
tctagtgtatcaa

SEQ ID NO: 486780 - DNA, 16 bp, Homo sapiens
tctagtgtatcaaaat

SEQ ID NO: 486781 - DNA, 20 bp, Homo sapiens
tctcagctcatcttcactgc

SEQ ID NO: 486782 - DNA, 15 bp, Homo sapiens
tctctgtccgagtgt

SEQ ID NO: 486783 - DNA, 18 bp, Homo sapiens
tctcttgtaatttggatc

SEQ ID NO: 486784 - DNA, 17 bp, Homo sapiens
tctgtccgagtgtgcca

SEQ ID NO: 486785 - DNA, 12 bp, Homo sapiens
tctgttccacat

SEQ ID NO: 486786 - DNA, 14 bp, Homo sapiens
tcttaatgtacata

SEQ ID NO: 486787 - DNA, 17 bp, Homo sapiens
tcttcatggtgacactc

SEQ ID NO: 486788 - DNA, 21 bp, Homo sapiens
tcttccaatttagttgttgta

SEQ ID NO: 486789 - DNA, 22 bp, Homo sapiens
tcttccatatggatccactggc

SEQ ID NO: 486790 - DNA, 19 bp, Homo sapiens
tcttgccaaatataaataa

SEQ ID NO: 486791 - DNA, 22 bp, Homo sapiens
ttgcatacattcttcaagatcc

SEQ ID NO: 486792 - DNA, 16 bp, Homo sapiens
ttgctcatatttccca

SEQ ID NO: 486793 - DNA, 21 bp, Homo sapiens
ttggattggacaaaatgactt

SEQ ID NO: 486794 - DNA, 16 bp, Homo sapiens
ttgtaaaggaatttaa

SEQ ID NO: 486795 - DNA, 20 bp, Homo sapiens
ttgtgggtttttatttccta

SEQ ID NO: 486796 - DNA, 12 bp, Homo sapiens
ttgtgtttacat

SEQ ID NO: 486797 - DNA, 13 bp, Homo sapiens
ttgtgtttacatt

SEQ ID NO: 486798 - DNA, 22 bp, Homo sapiens
ttgtgtttacattttatggtgc

SEQ ID NO: 486799 - DNA, 18 bp, Homo sapiens
tttaaaaaaattccaagt

SEQ ID NO: 486800 - DNA, 23 bp, Homo sapiens
tttaaacagatgtccatcagatg

SEQ ID NO: 486801 - DNA, 21 bp, Homo sapiens
tttaaatatatgctaagtctt

SEQ ID NO: 486802 - DNA, 19 bp, Homo sapiens
tttaactctataatgtgtt

SEQ ID NO: 486803 - DNA, 12 bp, Homo sapiens
tttaatcatata

SEQ ID NO: 486804 - DNA, 13 bp, Homo sapiens
tttaatcatataa

SEQ ID NO: 486805 - DNA, 14 bp, Homo sapiens
tttaatcatataaa

SEQ ID NO: 486806 - DNA, 23 bp, Homo sapiens
tttaatcatataaatagaatgta

SEQ ID NO: 486807 - DNA, 22 bp, Homo sapiens
tttaatgaatgcttaaagaatt

SEQ ID NO: 486808 - DNA, 17 bp, Homo sapiens
tttacattttatggtgc

SEQ ID NO: 486809 - DNA, 23 bp, Homo sapiens
tttacattttatggtgcctagta

SEQ ID NO: 486810 - DNA, 12 bp, Homo sapiens
tttagtgactaa

SEQ ID NO: 486811 - DNA, 21 bp, Homo sapiens
tttatctgcctctcttgtaat

SEQ ID NO: 486812 - DNA, 20 bp, Homo sapiens
tttatggcagacattgtgct

SEQ ID NO: 486813 - DNA, 21 bp, Homo sapiens
tttatggcagacattgtgcta

SEQ ID NO: 486814 - DNA, 24 bp, Homo sapiens
tttatggtgcctagtattgacaaa

SEQ ID NO: 486815 - DNA, 14 bp, Homo sapiens
tttattcatatgca

SEQ ID NO: 486816 - DNA, 17 bp, Homo sapiens
tttatttcctatgatgt

SEQ ID NO: 486817 - DNA, 22 bp, Homo sapiens
tttcatcattcacttcactgtg

SEQ ID NO: 486818 - DNA, 22 bp, Homo sapiens
tttcatgtactgcattatttga

SEQ ID NO: 486819 - DNA, 14 bp, Homo sapiens
tttcccatgatttc

SEQ ID NO: 486820 - DNA, 18 bp, Homo sapiens
tttcccatgatttcatgt

SEQ ID NO: 486821 - DNA, 18 bp, Homo sapiens
tttcctatgatgtatact

SEQ ID NO: 486822 - DNA, 23 bp, Homo sapiens
tttcctgccttttagttcctgtg

SEQ ID NO: 486823 - DNA, 21 bp, Homo sapiens
tttctagtgtatcaaaatgct

SEQ ID NO: 486824 - DNA, 15 bp, Homo sapiens
tttctgcatctccac

SEQ ID NO: 486825 - DNA, 16 bp, Homo sapiens
tttctgcatctccact

SEQ ID NO: 486826 - DNA, 23 bp, Homo sapiens
tttctttttacccatttgttcat

SEQ ID NO: 486827 - DNA, 21 bp, Homo sapiens
tttgaaattgtattacaaatc

SEQ ID NO: 486828 - DNA, 13 bp, Homo sapiens
tttgagaaagtca

SEQ ID NO: 486829 - DNA, 13 bp, Homo sapiens
tttgctcatattt

SEQ ID NO: 486830 - DNA, 17 bp, Homo sapiens
tttgctcatatttccca

SEQ ID NO: 486831 - DNA, 22 bp, Homo sapiens
tttggattggacaaaatgactt

SEQ ID NO: 486832 - DNA, 20 bp, Homo sapiens
tttgtgggtttttatttcct

SEQ ID NO: 486833 - DNA, 14 bp, Homo sapiens
tttgttcatattaa

SEQ ID NO: 486834 - DNA, 15 bp, Homo sapiens
tttgttcatattaag

SEQ ID NO: 486835 - DNA, 16 bp, Homo sapiens
ttttatttcctatgat

SEQ ID NO: 486836 - DNA, 12 bp, Homo sapiens
ttttctagtgta

SEQ ID NO: 486837 - DNA, 17 bp, Homo sapiens
ttttctagtgtatcaaa

SEQ ID NO: 486838 - DNA, 16 bp, Homo sapiens
ttttctataatttaaa

SEQ ID NO: 486839 - DNA, 16 bp, Homo sapiens
ttttggattggacaaa

SEQ ID NO: 486840 - DNA, 20 bp, Homo sapiens
tttttacccatttgttcata

SEQ ID NO: 486841 - DNA, 22 bp, Homo sapiens
tttttctgcactatatgcaaac

SEQ ID NO: 486842 - DNA, 15 bp, Homo sapiens
tttttgaagctgtat

SEQ ID NO: 486843 - DNA, 18 bp, Homo sapiens
aaaagcaggttgataaat

SEQ ID NO: 486844 - DNA, 22 bp, Homo sapiens
aaaagcaggttgataaatcatt

SEQ ID NO: 486845 - DNA, 15 bp, Homo sapiens
aaaatgttatttccc

SEQ ID NO: 486846 - DNA, 21 bp, Homo sapiens
aaaattacttagtattgcaaa

SEQ ID NO: 486847 - DNA, 24 bp, Homo sapiens
aaaattatagctctaatgtttgca

SEQ ID NO: 486848 - DNA, 20 bp, Homo sapiens
aaacaagcactaaacaaaga

SEQ ID NO: 486849 - DNA, 21 bp, Homo sapiens
aaacagttgcacagcatctca

SEQ ID NO: 486850 - DNA, 13 bp, Homo sapiens
aaaggaatttaaa

SEQ ID NO: 486851 - DNA, 14 bp, Homo sapiens
aaatacttgtctgt

SEQ ID NO: 486852 - DNA, 16 bp, Homo sapiens
aaatacttgtctgttt

SEQ ID NO: 486853 - DNA, 19 bp, Homo sapiens
aaatacttgtctgttttaa

SEQ ID NO: 486854 - DNA, 19 bp, Homo sapiens
aaatagaatgtaaatgtct

SEQ ID NO: 486855 - DNA, 14 bp, Homo sapiens
aaatatatactcaa

SEQ ID NO: 486856 - DNA, 14 bp, Homo sapiens
aaatcattttatgt

SEQ ID NO: 486857 - DNA, 17 bp, Homo sapiens
aaatcattttatgtcaa

SEQ ID NO: 486858 - DNA, 15 bp, Homo sapiens
aaatcctttgtgaaa

SEQ ID NO: 486859 - DNA, 14 bp, Homo sapiens
aaatgcatttctaa

SEQ ID NO: 486860 - DNA, 16 bp, Homo sapiens
aaatgtctcactgagc

SEQ ID NO: 486861 - DNA, 22 bp, Homo sapiens
aaatgttatttccctacattaa

SEQ ID NO: 486862 - DNA, 11 bp, Homo sapiens
aaatgtttaat

SEQ ID NO: 486863 - DNA, 15 bp, Homo sapiens
aaatgtttaatcata

SEQ ID NO: 486864 - DNA, 17 bp, Homo sapiens
aaatgtttaatcatata

SEQ ID NO: 486865 - DNA, 15 bp, Homo sapiens
aaattatagctctaa

SEQ ID NO: 486866 - DNA, 17 bp, Homo sapiens
aaattccaagtgattga

SEQ ID NO: 486867 - DNA, 12 bp, Homo sapiens
aaattggagaaa

SEQ ID NO: 486868 - DNA, 23 bp, Homo sapiens
aaattttatctgcctctcttgta

SEQ ID NO: 486869 - DNA, 14 bp, Homo sapiens
aacaaatgaagaca

SEQ ID NO: 486870 - DNA, 21 bp, Homo sapiens
aacaagcctccttttaaagta

SEQ ID NO: 486871 - DNA, 12 bp, Homo sapiens
aacaataaaaga

SEQ ID NO: 486872 - DNA, 19 bp, Homo sapiens
aacaataaaagtgtccatt

SEQ ID NO: 486873 - DNA, 22 bp, Homo sapiens
aacagttgcacagcatctcagc

SEQ ID NO: 486874 - DNA, 23 bp, Homo sapiens
aacatgaagacctttttctgcac

SEQ ID NO: 486875 - DNA, 12 bp, Homo sapiens
aacatgcagaac

SEQ ID NO: 486876 - DNA, 19 bp, Homo sapiens
aacatgcagaacaaatgaa

SEQ ID NO: 486877 - DNA, 22 bp, Homo sapiens
aaccactggaaagtttatggtt

SEQ ID NO: 486878 - DNA, 13 bp, Homo sapiens
aaccattgtgcat

SEQ ID NO: 486879 - DNA, 22 bp, Homo sapiens
aacccttaaacagttgcacagc

SEQ ID NO: 486880 - DNA, 23 bp, Homo sapiens
aacccttaaacagttgcacagca

SEQ ID NO: 486881 - DNA, 18 bp, Homo sapiens
aacgtttagctgacaaaa

SEQ ID NO: 486882 - DNA, 17 bp, Homo sapiens
aacttgcaaaatcagtt

SEQ ID NO: 486883 - DNA, 20 bp, Homo sapiens
aagaaaggctgctgtactga

SEQ ID NO: 486884 - DNA, 13 bp, Homo sapiens
aagaaatctattt

SEQ ID NO: 486885 - DNA, 19 bp, Homo sapiens
aagaagtggggcagcagca

SEQ ID NO: 486886 - DNA, 18 bp, Homo sapiens
aagacctttttctgcact

SEQ ID NO: 486887 - DNA, 14 bp, Homo sapiens
aagatcccatttga

SEQ ID NO: 486888 - DNA, 12 bp, Homo sapiens
aagctgctcaac

SEQ ID NO: 486889 - DNA, 20 bp, Homo sapiens
aagctgctcaacttgcaaaa

SEQ ID NO: 486890 - DNA, 16 bp, Homo sapiens
aaggaaaaaataacaa

SEQ ID NO: 486891 - DNA, 22 bp, Homo sapiens
aagggaagtagttatcatgtta

SEQ ID NO: 486892 - DNA, 17 bp, Homo sapiens
aaggtactgtatgatca

SEQ ID NO: 486893 - DNA, 20 bp, Homo sapiens
aagtaaaacaaacaatacct

SEQ ID NO: 486894 - DNA, 20 bp, Homo sapiens
aagtctaccaacctgttcaa

SEQ ID NO: 486895 - DNA, 20 bp, Homo sapiens
aagtggggcagcagcagtgg

SEQ ID NO: 486896 - DNA, 21 bp, Homo sapiens
aataacaatgaaagttgataa

SEQ ID NO: 486897 - DNA, 18 bp, Homo sapiens
aataggcgtaactaattt

SEQ ID NO: 486898 - DNA, 14 bp, Homo sapiens
aatcagttttcctc

SEQ ID NO: 486899 - DNA, 20 bp, Homo sapiens
aatcctgtaggaaggtactg

SEQ ID NO: 486900 - DNA, 20 bp, Homo sapiens
aatccttgaaggtatatcta

SEQ ID NO: 486901 - DNA, 19 bp, Homo sapiens
aatgaagacaaaacataca

SEQ ID NO: 486902 - DNA, 19 bp, Homo sapiens
aatgcttaaagaattcaaa

SEQ ID NO: 486903 - DNA, 14 bp, Homo sapiens
aatgtaaatgtctc

SEQ ID NO: 486904 - DNA, 18 bp, Homo sapiens
aatgtaaatgtctcactg

SEQ ID NO: 486905 - DNA, 14 bp, Homo sapiens
aatgttatttccct

SEQ ID NO: 486906 - DNA, 19 bp, Homo sapiens
aattatagctctaatgttt

SEQ ID NO: 486907 - DNA, 14 bp, Homo sapiens
aattgtgtttacat

SEQ ID NO: 486908 - DNA, 22 bp, Homo sapiens
aatttggatctcttcttaatgt

SEQ ID NO: 486909 - DNA, 13 bp, Homo sapiens
aattttatctgcc

SEQ ID NO: 486910 - DNA, 18 bp, Homo sapiens
acaaaaggataatgaata

SEQ ID NO: 486911 - DNA, 12 bp, Homo sapiens
acaaaatgttat

SEQ ID NO: 486912 - DNA, 21 bp, Homo sapiens
acaagaaaggctgctgtactg

SEQ ID NO: 486913 - DNA, 22 bp, Homo sapiens
acaataaaagtgtccattgaaa

SEQ ID NO: 486914 - DNA, 16 bp, Homo sapiens
acagatgtccatcaga

SEQ ID NO: 486915 - DNA, 22 bp, Homo sapiens
acagggtaactaactaaaacaa

SEQ ID NO: 486916 - DNA, 19 bp, Homo sapiens
acagttcggtgagctacaa

SEQ ID NO: 486917 - DNA, 13 bp, Homo sapiens
acagttgcacagc

SEQ ID NO: 486918 - DNA, 14 bp, Homo sapiens
acagttgcacagca

SEQ ID NO: 486919 - DNA, 19 bp, Homo sapiens
acagttgcacagcatctca

SEQ ID NO: 486920 - DNA, 23 bp, Homo sapiens
acagttgcacagcatctcagctc

SEQ ID NO: 486921 - DNA, 16 bp, Homo sapiens
acatcctcttccatat

SEQ ID NO: 486922 - DNA, 14 bp, Homo sapiens
acatgaagaccttt

SEQ ID NO: 486923 - DNA, 18 bp, Homo sapiens
acatgactccatagacct

SEQ ID NO: 486924 - DNA, 21 bp, Homo sapiens
acattccttgctgaaacgcat

SEQ ID NO: 486925 - DNA, 21 bp, Homo sapiens
acattcttcaagatcccattt

SEQ ID NO: 486926 - DNA, 23 bp, Homo sapiens
accaattataagggcaaattgga

SEQ ID NO: 486927 - DNA, 23 bp, Homo sapiens
accatttcttgaggtaaaagcat

SEQ ID NO: 486928 - DNA, 16 bp, Homo sapiens
accgtgttggtctgta

SEQ ID NO: 486929 - DNA, 22 bp, Homo sapiens
accgtgttggtctgtactgatt

SEQ ID NO: 486930 - DNA, 17 bp, Homo sapiens
acctctaatagtataaa

SEQ ID NO: 486931 - DNA, 19 bp, Homo sapiens
acctctaatagtataaacc

SEQ ID NO: 486932 - DNA, 22 bp, Homo sapiens
acgcatctagttcccctgttta

SEQ ID NO: 486933 - DNA, 17 bp, Homo sapiens
acgtttagctgacaaaa

SEQ ID NO: 486934 - DNA, 18 bp, Homo sapiens
actatatgcaaacagggt

SEQ ID NO: 486935 - DNA, 15 bp, Homo sapiens
actgagcactgtttt

SEQ ID NO: 486936 - DNA, 16 bp, Homo sapiens
actgagcactgttttc

SEQ ID NO: 486937 - DNA, 23 bp, Homo sapiens
actgagcactgttttctagtgta

SEQ ID NO: 486938 - DNA, 14 bp, Homo sapiens
actgattcaatttg

SEQ ID NO: 486939 - DNA, 19 bp, Homo sapiens
actgtacaaaaaaatcttc

SEQ ID NO: 486940 - DNA, 16 bp, Homo sapiens
actgtatgatcaaatg

SEQ ID NO: 486941 - DNA, 19 bp, Homo sapiens
actgtatgatcaaatgttt

SEQ ID NO: 486942 - DNA, 14 bp, Homo sapiens
actgtgctgttgtt

SEQ ID NO: 486943 - DNA, 18 bp, Homo sapiens
actgtgctgttgttatga

SEQ ID NO: 486944 - DNA, 24 bp, Homo sapiens
actgttttctagtgtatcaaaatg

SEQ ID NO: 486945 - DNA, 20 bp, Homo sapiens
acttagcattttctgcatct

SEQ ID NO: 486946 - DNA, 22 bp, Homo sapiens
acttagcattttctgcatctcc

SEQ ID NO: 486947 - DNA, 13 bp, Homo sapiens
acttcactgtgct

SEQ ID NO: 486948 - DNA, 14 bp, Homo sapiens
acttcactgtgctg

SEQ ID NO: 486949 - DNA, 20 bp, Homo sapiens
acttcactgtgctgttgtta

SEQ ID NO: 486950 - DNA, 18 bp, Homo sapiens
acttgtaaaggaatttaa

SEQ ID NO: 486951 - DNA, 20 bp, Homo sapiens
actttcaatcttcaatcctt

SEQ ID NO: 486952 - DNA, 16 bp, Homo sapiens
agaaagtgagcagtgt

SEQ ID NO: 486953 - DNA, 13 bp, Homo sapiens
agaaatctatttc

SEQ ID NO: 486954 - DNA, 18 bp, Homo sapiens
agaactaccacctgacat

SEQ ID NO: 486955 - DNA, 13 bp, Homo sapiens
agaagctgctcaa

SEQ ID NO: 486956 - DNA, 13 bp, Homo sapiens
agaatgtaaatgt

SEQ ID NO: 486957 - DNA, 19 bp, Homo sapiens
agaatgtaaatgtctcact

SEQ ID NO: 486958 - DNA, 19 bp, Homo sapiens
agacaaaacatacattttg

SEQ ID NO: 486959 - DNA, 20 bp, Homo sapiens
agacctttttctgcactata

SEQ ID NO: 486960 - DNA, 17 bp, Homo sapiens
agagaaaacatgcagaa

SEQ ID NO: 486961 - DNA, 21 bp, Homo sapiens
agataggtcagtgcaaatact

SEQ ID NO: 486962 - DNA, 17 bp, Homo sapiens
agatgaaattccatttg

SEQ ID NO: 486963 - DNA, 18 bp, Homo sapiens
agatgaaattccatttgt

SEQ ID NO: 486964 - DNA, 15 bp, Homo sapiens
agatgcagtgccagg

SEQ ID NO: 486965 - DNA, 12 bp, Homo sapiens
agattcttgcat

SEQ ID NO: 486966 - DNA, 12 bp, Homo sapiens
agcaaatccttt

SEQ ID NO: 486967 - DNA, 21 bp, Homo sapiens
agcacaagtgtaatgaatacc

SEQ ID NO: 486968 - DNA, 18 bp, Homo sapiens
agcactgttttctagtgt

SEQ ID NO: 486969 - DNA, 20 bp, Homo sapiens
agcactgttttctagtgtat

SEQ ID NO: 486970 - DNA, 15 bp, Homo sapiens
agcattttctgcatc

SEQ ID NO: 486971 - DNA, 18 bp, Homo sapiens
agcattttctgcatctcc

SEQ ID NO: 486972 - DNA, 19 bp, Homo sapiens
agcattttctgcatctcca

SEQ ID NO: 486973 - DNA, 23 bp, Homo sapiens
agccactttcaatcttcaatcct

SEQ ID NO: 486974 - DNA, 14 bp, Homo sapiens
agcgcactcttcat

SEQ ID NO: 486975 - DNA, 12 bp, Homo sapiens
agctacaaatgc

SEQ ID NO: 486976 - DNA, 19 bp, Homo sapiens
agctactaattttaaaatg

SEQ ID NO: 486977 - DNA, 19 bp, Homo sapiens
agctatggtgtcataggct

SEQ ID NO: 486978 - DNA, 16 bp, Homo sapiens
agctcatcttcactgc

SEQ ID NO: 486979 - DNA, 14 bp, Homo sapiens
agctccatttaaac

SEQ ID NO: 486980 - DNA, 18 bp, Homo sapiens
agctctaatgtttgcata

SEQ ID NO: 486981 - DNA, 20 bp, Homo sapiens
agcttatgttaactgacaag

SEQ ID NO: 486982 - DNA, 18 bp, Homo sapiens
agcttcactgtaaaataa

SEQ ID NO: 486983 - DNA, 22 bp, Homo sapiens
agctttgtcactgtttcactac

SEQ ID NO: 486984 - DNA, 18 bp, Homo sapiens
aggaaaaaataacaatga

SEQ ID NO: 486985 - DNA, 14 bp, Homo sapiens
aggaaggtactgta

SEQ ID NO: 486986 - DNA, 18 bp, Homo sapiens
aggaaggtactgtatgat

SEQ ID NO: 486987 - DNA, 11 bp, Homo sapiens
aggaatttaaa

SEQ ID NO: 486988 - DNA, 17 bp, Homo sapiens
agggcaaattggagaaa

SEQ ID NO: 486989 - DNA, 19 bp, Homo sapiens
aggtactgtatgatcaaat

SEQ ID NO: 486990 - DNA, 18 bp, Homo sapiens
aggttattatgattagct

SEQ ID NO: 486991 - DNA, 12 bp, Homo sapiens
aggttgataaat

SEQ ID NO: 486992 - DNA, 12 bp, Homo sapiens
aggtttatgaca

SEQ ID NO: 486993 - DNA, 19 bp, Homo sapiens
agtaaaacaaacaatacct

SEQ ID NO: 486994 - DNA, 13 bp, Homo sapiens
agtaaaatccaca

SEQ ID NO: 486995 - DNA, 23 bp, Homo sapiens
agtaaacaataaaagtgtccatt

SEQ ID NO: 486996 - DNA, 18 bp, Homo sapiens
agtaattgtgtttacatt

SEQ ID NO: 486997 - DNA, 21 bp, Homo sapiens
agtaattgtgtttacatttta

SEQ ID NO: 486998 - DNA, 12 bp, Homo sapiens
agtagttatcat

SEQ ID NO: 486999 - DNA, 14 bp, Homo sapiens
agtagttatcatgt

SEQ ID NO: 487000 - DNA, 16 bp, Homo sapiens
agtagttatcatgtta

SEQ ID NO: 487001 - DNA, 15 bp, Homo sapiens
agtatcggcactgta

SEQ ID NO: 487002 - DNA, 12 bp, Homo sapiens
agtattgacaaa

SEQ ID NO: 487003 - DNA, 13 bp, Homo sapiens
agtattgacaaaa

SEQ ID NO: 487004 - DNA, 14 bp, Homo sapiens
agtattgacaaaat

SEQ ID NO: 487005 - DNA, 15 bp, Homo sapiens
agtattgacaaaatg

SEQ ID NO: 487006 - DNA, 18 bp, Homo sapiens
agtattgacaaaatgtta

SEQ ID NO: 487007 - DNA, 19 bp, Homo sapiens
agtattgacaaaatgttat

SEQ ID NO: 487008 - DNA, 21 bp, Homo sapiens
agtattgacaaaatgttattt

SEQ ID NO: 487009 - DNA, 12 bp, Homo sapiens
agtattgcaaag

SEQ ID NO: 487010 - DNA, 12 bp, Homo sapiens
agtcctgtaatg

SEQ ID NO: 487011 - DNA, 16 bp, Homo sapiens
agtgactaaaccattg

SEQ ID NO: 487012 - DNA, 17 bp, Homo sapiens
agtgagcagtgttagct

SEQ ID NO: 487013 - DNA, 17 bp, Homo sapiens
agtgcagttatttgctt

SEQ ID NO: 487014 - DNA, 15 bp, Homo sapiens
agtggtatcttgcag

SEQ ID NO: 487015 - DNA, 13 bp, Homo sapiens
agtgtatcaaaat

SEQ ID NO: 487016 - DNA, 14 bp, Homo sapiens
agtgtatcaaaatg

SEQ ID NO: 487017 - DNA, 17 bp, Homo sapiens
agtgtatcaaaatgctc

SEQ ID NO: 487018 - DNA, 18 bp, Homo sapiens
agttacacatgatcataa

SEQ ID NO: 487019 - DNA, 15 bp, Homo sapiens
agttatcatgttagt

SEQ ID NO: 487020 - DNA, 19 bp, Homo sapiens
agttatcatgttagtaata

SEQ ID NO: 487021 - DNA, 18 bp, Homo sapiens
agttcccctgtttattca

SEQ ID NO: 487022 - DNA, 19 bp, Homo sapiens
agttcttcgactgttgtta

SEQ ID NO: 487023 - DNA, 14 bp, Homo sapiens
agttgcacagcatc

SEQ ID NO: 487024 - DNA, 16 bp, Homo sapiens
agttgcacagcatctc

SEQ ID NO: 487025 - DNA, 17 bp, Homo sapiens
agtttaaattgtaatag

SEQ ID NO: 487026 - DNA, 22 bp, Homo sapiens
ataaaccccaccccaaaattag

SEQ ID NO: 487027 - DNA, 14 bp, Homo sapiens
ataaatagaatgta

SEQ ID NO: 487028 - DNA, 16 bp, Homo sapiens
ataaatcattttatgt

SEQ ID NO: 487029 - DNA, 19 bp, Homo sapiens
ataaatcattttatgtcaa

SEQ ID NO: 487030 - DNA, 14 bp, Homo sapiens
ataacaatgaaagt

SEQ ID NO: 487031 - DNA, 13 bp, Homo sapiens
atacaagtttcat

SEQ ID NO: 487032 - DNA, 20 bp, Homo sapiens
atacattcttcaagatccca

SEQ ID NO: 487033 - DNA, 16 bp, Homo sapiens
atacattttgtaccaa

SEQ ID NO: 487034 - DNA, 14 bp, Homo sapiens
atacctctaatagt

SEQ ID NO: 487035 - DNA, 20 bp, Homo sapiens
atacctctaatagtataaac

SEQ ID NO: 487036 - DNA, 15 bp, Homo sapiens
atagaatgtaaatgt

SEQ ID NO: 487037 - DNA, 17 bp, Homo sapiens
atagaatgtaaatgtct

SEQ ID NO: 487038 - DNA, 23 bp, Homo sapiens
tatgacagtaattgtgtttacat

SEQ ID NO: 487039 - DNA, 14 bp, Homo sapiens
tatgatcaaatgtt

SEQ ID NO: 487040 - DNA, 16 bp, Homo sapiens
tatgatcaaatgttta

SEQ ID NO: 487041 - DNA, 21 bp, Homo sapiens
tatgatgtatactgccactaa

SEQ ID NO: 487042 - DNA, 22 bp, Homo sapiens
tatggtgcctagtattgacaaa

SEQ ID NO: 487043 - DNA, 23 bp, Homo sapiens
tatgtcaagggcagctttgctca

SEQ ID NO: 487044 - DNA, 13 bp, Homo sapiens
tattcatatgcat

SEQ ID NO: 487045 - DNA, 16 bp, Homo sapiens
tattgacaaaatgtta

SEQ ID NO: 487046 - DNA, 17 bp, Homo sapiens
tattgctgaatgcaaga

SEQ ID NO: 487047 - DNA, 21 bp, Homo sapiens
tatttcccatgatttcatgta

SEQ ID NO: 487048 - DNA, 21 bp, Homo sapiens
tatttttatcagttacacatg

SEQ ID NO: 487049 - DNA, 16 bp, Homo sapiens
tcaaaatgctcttatt

SEQ ID NO: 487050 - DNA, 15 bp, Homo sapiens
tcaaatgtttaatca

SEQ ID NO: 487051 - DNA, 15 bp, Homo sapiens
tcaagattcagctag

SEQ ID NO: 487052 - DNA, 19 bp, Homo sapiens
tcaagggcagctttgctca

SEQ ID NO: 487053 - DNA, 20 bp, Homo sapiens
tcaagggcagctttgctcat

SEQ ID NO: 487054 - DNA, 21 bp, Homo sapiens
tcaagggcagctttgctcata

SEQ ID NO: 487055 - DNA, 15 bp, Homo sapiens
tcaataaaattatag

SEQ ID NO: 487056 - DNA, 17 bp, Homo sapiens
tcaataaaattatagct

SEQ ID NO: 487057 - DNA, 16 bp, Homo sapiens
tcactgtgctgttgtt

SEQ ID NO: 487058 - DNA, 20 bp, Homo sapiens
tcactgtgctgttgttatga

SEQ ID NO: 487059 - DNA, 14 bp, Homo sapiens
tcactgtttcacta

SEQ ID NO: 487060 - DNA, 21 bp, Homo sapiens
tcactgtttcactactcagca

SEQ ID NO: 487061 - DNA, 21 bp, Homo sapiens
tcacttcactgtgctgttgtt

SEQ ID NO: 487062 - DNA, 18 bp, Homo sapiens
tcaggaacgtttagctga

SEQ ID NO: 487063 - DNA, 20 bp, Homo sapiens
tcagttttcctctcaataaa

SEQ ID NO: 487064 - DNA, 16 bp, Homo sapiens
tcataataagttgcat

SEQ ID NO: 487065 - DNA, 14 bp, Homo sapiens
tcatataaatagaa

SEQ ID NO: 487066 - DNA, 15 bp, Homo sapiens
tcatattaagaatga

SEQ ID NO: 487067 - DNA, 13 bp, Homo sapiens
tcatatttcccat

SEQ ID NO: 487068 - DNA, 19 bp, Homo sapiens
tcatatttcccatgatttc

SEQ ID NO: 487069 - DNA, 15 bp, Homo sapiens
tcatcaggaacgttt

SEQ ID NO: 487070 - DNA, 22 bp, Homo sapiens
tcatcattcacttcactgtgct

SEQ ID NO: 487071 - DNA, 23 bp, Homo sapiens
tcatcattcacttcactgtgctg

SEQ ID NO: 487072 - DNA, 16 bp, Homo sapiens
tcatgtactgcattat

SEQ ID NO: 487073 - DNA, 19 bp, Homo sapiens
tcatgtactgcattatttg

SEQ ID NO: 487074 - DNA, 14 bp, Homo sapiens
tcatgttagtaata

SEQ ID NO: 487075 - DNA, 17 bp, Homo sapiens
tcattcacttcactgtg

SEQ ID NO: 487076 - DNA, 18 bp, Homo sapiens
tcatttgtgggtttttat

SEQ ID NO: 487077 - DNA, 22 bp, Homo sapiens
tcatttgtgggtttttatttcc

SEQ ID NO: 487078 - DNA, 14 bp, Homo sapiens
tcattttatgtcaa

SEQ ID NO: 487079 - DNA, 17 bp, Homo sapiens
tccaattagcttatgtt

SEQ ID NO: 487080 - DNA, 23 bp, Homo sapiens
tccagttcttcgactgttgttat

SEQ ID NO: 487081 - DNA, 17 bp, Homo sapiens
tccatagaccttttcat

SEQ ID NO: 487082 - DNA, 16 bp, Homo sapiens
tccatcagatgacaag

SEQ ID NO: 487083 - DNA, 13 bp, Homo sapiens
tccatttaaacag

SEQ ID NO: 487084 - DNA, 18 bp, Homo sapiens
tccatttaaacagatgtc

SEQ ID NO: 487085 - DNA, 13 bp, Homo sapiens
tcccatgatttca

SEQ ID NO: 487086 - DNA, 16 bp, Homo sapiens
tcccatgatttcatgt

SEQ ID NO: 487087 - DNA, 13 bp, Homo sapiens
tccctacattaaa

SEQ ID NO: 487088 - DNA, 12 bp, Homo sapiens
tcctatgatgta

SEQ ID NO: 487089 - DNA, 22 bp, Homo sapiens
tcctatgatgtatactgccact

SEQ ID NO: 487090 - DNA, 13 bp, Homo sapiens
tcctctcaataaa

SEQ ID NO: 487091 - DNA, 21 bp, Homo sapiens
tcctgtaggaaggtactgtat

SEQ ID NO: 487092 - DNA, 14 bp, Homo sapiens
tcctgtgcacagcc

SEQ ID NO: 487093 - DNA, 23 bp, Homo sapiens
tccttgctgaaacgcatctagtt

SEQ ID NO: 487094 - DNA, 14 bp, Homo sapiens
tcgactgttgttat

SEQ ID NO: 487095 - DNA, 15 bp, Homo sapiens
tcgactgttgttatc

SEQ ID NO: 487096 - DNA, 22 bp, Homo sapiens
tcgggcagcacaagtgtaatga

SEQ ID NO: 487097 - DNA, 18 bp, Homo sapiens
tcgtttaatgaatgctta

SEQ ID NO: 487098 - DNA, 20 bp, Homo sapiens
tcgtttaatgaatgcttaaa

SEQ ID NO: 487099 - DNA, 14 bp, Homo sapiens
tctaatagtataaa

SEQ ID NO: 487100 - DNA, 17 bp, Homo sapiens
tctaatagtataaaccc

SEQ ID NO: 487101 - DNA, 16 bp, Homo sapiens
tctaatgtttgcatat

SEQ ID NO: 487102 - DNA, 22 bp, Homo sapiens
tctagtgtatcaaaatgctctt

SEQ ID NO: 487103 - DNA, 17 bp, Homo sapiens
tctagttcccctgttta

SEQ ID NO: 487104 - DNA, 21 bp, Homo sapiens
tctagttcccctgtttattca

SEQ ID NO: 487105 - DNA, 13 bp, Homo sapiens
tctataatttaaa

SEQ ID NO: 487106 - DNA, 16 bp, Homo sapiens
tctcactgagcactgt

SEQ ID NO: 487107 - DNA, 17 bp, Homo sapiens
tctcactgagcactgtt

SEQ ID NO: 487108 - DNA, 14 bp, Homo sapiens
tctcttcttaatgt

SEQ ID NO: 487109 - DNA, 11 bp, Homo sapiens
tctgcatctcc

SEQ ID NO: 487110 - DNA, 15 bp, Homo sapiens
tctgcctctcttgta

SEQ ID NO: 487111 - DNA, 17 bp, Homo sapiens
tctgtactgattcaatt

SEQ ID NO: 487112 - DNA, 23 bp, Homo sapiens
tctgtactgattcaatttgatgt

SEQ ID NO: 487113 - DNA, 15 bp, Homo sapiens
tctgtccgagtgtgc

SEQ ID NO: 487114 - DNA, 13 bp, Homo sapiens
tcttaatgtacat

SEQ ID NO: 487115 - DNA, 19 bp, Homo sapiens
tcttaatgtacatagtgct

SEQ ID NO: 487116 - DNA, 16 bp, Homo sapiens
tcttcaagatcccatt

SEQ ID NO: 487117 - DNA, 16 bp, Homo sapiens
tcttcatggtgacact

SEQ ID NO: 487118 - DNA, 17 bp, Homo sapiens
tcttcgactgttgttat

SEQ ID NO: 487119 - DNA, 17 bp, Homo sapiens
tcttcttaatgtacata

SEQ ID NO: 487120 - DNA, 20 bp, Homo sapiens
tcttgcagtatcggcactgt

SEQ ID NO: 487121 - DNA, 21 bp, Homo sapiens
tcttgcagtatcggcactgta

SEQ ID NO: 487122 - DNA, 17 bp, Homo sapiens
tctttcacatttaaata

SEQ ID NO: 487123 - DNA, 18 bp, Homo sapiens
tgaaaagcaggttgataa

SEQ ID NO: 487124 - DNA, 13 bp, Homo sapiens
tgaaagaaaataa

SEQ ID NO: 487125 - DNA, 18 bp, Homo sapiens
tgaagacctttttctgca

SEQ ID NO: 487126 - DNA, 15 bp, Homo sapiens
tgaaggtatatctag

SEQ ID NO: 487127 - DNA, 21 bp, Homo sapiens
tgaataccttagtgcagttat

SEQ ID NO: 487128 - DNA, 17 bp, Homo sapiens
tgaatgcttaaagaatt

SEQ ID NO: 487129 - DNA, 20 bp, Homo sapiens
tgacagtaattgtgtttaca

SEQ ID NO: 487130 - DNA, 14 bp, Homo sapiens
ccagtaatcctgta

SEQ ID NO: 487131 - DNA, 21 bp, Homo sapiens
ccagttgctgcttcaatttat

SEQ ID NO: 487132 - DNA, 16 bp, Homo sapiens
ccatatggatccactg

SEQ ID NO: 487133 - DNA, 21 bp, Homo sapiens
ccatgatttcatgtactgcat

SEQ ID NO: 487134 - DNA, 23 bp, Homo sapiens
ccatggaggaaggctctgttcca

SEQ ID NO: 487135 - DNA, 15 bp, Homo sapiens
ccatgtcaagattca

SEQ ID NO: 487136 - DNA, 20 bp, Homo sapiens
ccattaagtaaacaataaaa

SEQ ID NO: 487137 - DNA, 22 bp, Homo sapiens
ccatttgaattttttagtgact

SEQ ID NO: 487138 - DNA, 16 bp, Homo sapiens
cccatgatttcatgta

SEQ ID NO: 487139 - DNA, 17 bp, Homo sapiens
cccatgatttcatgtac

SEQ ID NO: 487140 - DNA, 15 bp, Homo sapiens
cccattcaagattcc

SEQ ID NO: 487141 - DNA, 13 bp, Homo sapiens
ccccaaaattagc

SEQ ID NO: 487142 - DNA, 19 bp, Homo sapiens
ccgtgttggtctgtactga

SEQ ID NO: 487143 - DNA, 13 bp, Homo sapiens
cctaaacatatga

SEQ ID NO: 487144 - DNA, 18 bp, Homo sapiens
cctatgatgtatactgcc

SEQ ID NO: 487145 - DNA, 17 bp, Homo sapiens
cctcaattttcactgtg

SEQ ID NO: 487146 - DNA, 16 bp, Homo sapiens
cctgaatgctctgtag

SEQ ID NO: 487147 - DNA, 22 bp, Homo sapiens
cctgccttttagttcctgtgca

SEQ ID NO: 487148 - DNA, 14 bp, Homo sapiens
cctggatttgcata

SEQ ID NO: 487149 - DNA, 20 bp, Homo sapiens
cctgtaggaaggtactgtat

SEQ ID NO: 487150 - DNA, 20 bp, Homo sapiens
ccttagtgcagttatttgct

SEQ ID NO: 487151 - DNA, 16 bp, Homo sapiens
ccttttagttcctgtg

SEQ ID NO: 487152 - DNA, 22 bp, Homo sapiens
ccttttagttcctgtgcacagc

SEQ ID NO: 487153 - DNA, 22 bp, Homo sapiens
cgaggtcgggcagcacaagtgt

SEQ ID NO: 487154 - DNA, 13 bp, Homo sapiens
cgtttaatgaatg

SEQ ID NO: 487155 - DNA, 15 bp, Homo sapiens
ctaaaccattgtgca

SEQ ID NO: 487156 - DNA, 21 bp, Homo sapiens
ctaagcttcactgtaaaataa

SEQ ID NO: 487157 - DNA, 17 bp, Homo sapiens
ctaagtcaacttagcat

SEQ ID NO: 487158 - DNA, 15 bp, Homo sapiens
ctaatgtttgcatat

SEQ ID NO: 487159 - DNA, 16 bp, Homo sapiens
ctaatgtttgcatata

SEQ ID NO: 487160 - DNA, 17 bp, Homo sapiens
ctaatgtttgcatataa

SEQ ID NO: 487161 - DNA, 18 bp, Homo sapiens
ctacattaaacatgactc

SEQ ID NO: 487162 - DNA, 14 bp, Homo sapiens
ctagtattgacaaa

SEQ ID NO: 487163 - DNA, 18 bp, Homo sapiens
ctagtattgacaaaatgt

SEQ ID NO: 487164 - DNA, 20 bp, Homo sapiens
ctagtattgacaaaatgtta

SEQ ID NO: 487165 - DNA, 15 bp, Homo sapiens
ctagtgtatcaaaat

SEQ ID NO: 487166 - DNA, 20 bp, Homo sapiens
ctatgatgtatactgccact

SEQ ID NO: 487167 - DNA, 20 bp, Homo sapiens
ctcaataaaattatagctct

SEQ ID NO: 487168 - DNA, 15 bp, Homo sapiens
ctcccattcaagatt

SEQ ID NO: 487169 - DNA, 15 bp, Homo sapiens
ctctaatgtttgcat

SEQ ID NO: 487170 - DNA, 13 bp, Homo sapiens
ctcttcttaatgt

SEQ ID NO: 487171 - DNA, 18 bp, Homo sapiens
ctcttcttaatgtacata

SEQ ID NO: 487172 - DNA, 16 bp, Homo sapiens
ctgacaaaatacttgt

SEQ ID NO: 487173 - DNA, 13 bp, Homo sapiens
ctgacaagctcca

SEQ ID NO: 487174 - DNA, 16 bp, Homo sapiens
ctgacattccttgctg

SEQ ID NO: 487175 - DNA, 15 bp, Homo sapiens
ctgagcactgttttc

SEQ ID NO: 487176 - DNA, 14 bp, Homo sapiens
ctgcactatatgca

SEQ ID NO: 487177 - DNA, 20 bp, Homo sapiens
ctgccttttagttcctgtgc

SEQ ID NO: 487178 - DNA, 21 bp, Homo sapiens
ctgccttttagttcctgtgca

SEQ ID NO: 487179 - DNA, 16 bp, Homo sapiens
ctgctcaacttgcaaa

SEQ ID NO: 487180 - DNA, 12 bp, Homo sapiens
ctgctgtactga

SEQ ID NO: 487181 - DNA, 14 bp, Homo sapiens
ctgctgtactgaag

SEQ ID NO: 487182 - DNA, 15 bp, Homo sapiens
ctgctgtactgaagt

SEQ ID NO: 487183 - DNA, 23 bp, Homo sapiens
ctgtacaaaaaaatcttccaatt

SEQ ID NO: 487184 - DNA, 17 bp, Homo sapiens
ctgtaggaaggtactgt

SEQ ID NO: 487185 - DNA, 18 bp, Homo sapiens
ctgtaggaaggtactgta

SEQ ID NO: 487186 - DNA, 20 bp, Homo sapiens
ctgtaggaaggtactgtatg

SEQ ID NO: 487187 - DNA, 14 bp, Homo sapiens
ctgtatgatcaaat

SEQ ID NO: 487188 - DNA, 15 bp, Homo sapiens
ctgtatgatcaaatg

SEQ ID NO: 487189 - DNA, 18 bp, Homo sapiens
ctgtatgatcaaatgttt

SEQ ID NO: 487190 - DNA, 13 bp, Homo sapiens
ctgtgcacagccc

SEQ ID NO: 487191 - DNA, 17 bp, Homo sapiens
ctgtgctgttgttatga

SEQ ID NO: 487192 - DNA, 19 bp, Homo sapiens
ctgtgctgttgttatgatg

SEQ ID NO: 487193 - DNA, 21 bp, Homo sapiens
ctgtgctgttgttatgatgtg

SEQ ID NO: 487194 - DNA, 15 bp, Homo sapiens
ctgttgttatgatgt

SEQ ID NO: 487195 - DNA, 16 bp, Homo sapiens
ctgttttaaaaacctg

SEQ ID NO: 487196 - DNA, 22 bp, Homo sapiens
ctgttttctagtgtatcaaaat

SEQ ID NO: 487197 - DNA, 19 bp, Homo sapiens
cttaaacagttgcacagca

SEQ ID NO: 487198 - DNA, 20 bp, Homo sapiens
cttaaacagttgcacagcat

SEQ ID NO: 487199 - DNA, 22 bp, Homo sapiens
cttaaacagttgcacagcatct

SEQ ID NO: 487200 - DNA, 15 bp, Homo sapiens
cttaaagaattcaaa

SEQ ID NO: 487201 - DNA, 17 bp, Homo sapiens
cttaaagaattcaaatt

SEQ ID NO: 487202 - DNA, 13 bp, Homo sapiens
cttaatgtacata

SEQ ID NO: 487203 - DNA, 18 bp, Homo sapiens
cttacagcaaatcctttg

SEQ ID NO: 487204 - DNA, 13 bp, Homo sapiens
cttagtattgcaa

SEQ ID NO: 487205 - DNA, 14 bp, Homo sapiens
cttataatttaaaa

SEQ ID NO: 487206 - DNA, 15 bp, Homo sapiens
cttatttcatcattc

SEQ ID NO: 487207 - DNA, 21 bp, Homo sapiens
cttcaatttatacctcaattt

SEQ ID NO: 487208 - DNA, 15 bp, Homo sapiens
cttcactgtaaaata

SEQ ID NO: 487209 - DNA, 14 bp, Homo sapiens
cttccaaaaattac

SEQ ID NO: 487210 - DNA, 14 bp, Homo sapiens
cttccatatggatc

SEQ ID NO: 487211 - DNA, 14 bp, Homo sapiens
cttcgactgttgtt

SEQ ID NO: 487212 - DNA, 15 bp, Homo sapiens
cttcttaatgtacat

SEQ ID NO: 487213 - DNA, 22 bp, Homo sapiens
cttgcaaaatcagttttcctct

SEQ ID NO: 487214 - DNA, 19 bp, Homo sapiens
cttgcagtatcggcactgt

SEQ ID NO: 487215 - DNA, 20 bp, Homo sapiens
cttgcttgattgtatggtgg

SEQ ID NO: 487216 - DNA, 19 bp, Homo sapiens
cttgtaaaggaatttaaaa

SEQ ID NO: 487217 - DNA, 17 bp, Homo sapiens
ctttgctcatatttccc

SEQ ID NO: 487218 - DNA, 21 bp, Homo sapiens
cttttagttcctgtgcacagc

SEQ ID NO: 487219 - DNA, 22 bp, Homo sapiens
cttttagttcctgtgcacagcc

SEQ ID NO: 487220 - DNA, 22 bp, Homo sapiens
ctttttctgcactatatgcaaa

SEQ ID NO: 487221 - DNA, 22 bp, Homo sapiens
gaaaacaataacgataaaagac

SEQ ID NO: 487222 - DNA, 18 bp, Homo sapiens
gaaaatcttataatttaa

SEQ ID NO: 487223 - DNA, 20 bp, Homo sapiens
gaaaatcttataatttaaaa

SEQ ID NO: 487224 - DNA, 18 bp, Homo sapiens
gaaaggctgctgtactga

SEQ ID NO: 487225 - DNA, 19 bp, Homo sapiens
gaaaggctgctgtactgaa

SEQ ID NO: 487226 - DNA, 22 bp, Homo sapiens
gaaagtgagcagtgttagctta

SEQ ID NO: 487227 - DNA, 16 bp, Homo sapiens
gaaattgtattacaaa

SEQ ID NO: 487228 - DNA, 22 bp, Homo sapiens
gaacttgtaaaggaatttaaaa

SEQ ID NO: 487229 - DNA, 14 bp, Homo sapiens
gaagacctttttct

SEQ ID NO: 487230 - DNA, 17 bp, Homo sapiens
gaagacctttttctgca

SEQ ID NO: 487231 - DNA, 21 bp, Homo sapiens
gaagacttacagcaaatcctt

SEQ ID NO: 487232 - DNA, 20 bp, Homo sapiens
gaagctgctcaacttgcaaa

SEQ ID NO: 487233 - DNA, 13 bp, Homo sapiens
gaagtagttatca

SEQ ID NO: 487234 - DNA, 15 bp, Homo sapiens
gaagtagttatcatg

SEQ ID NO: 487235 - DNA, 16 bp, Homo sapiens
gaagtagttatcatgt

SEQ ID NO: 487236 - DNA, 17 bp, Homo sapiens
gaataccttagtgcagt

SEQ ID NO: 487237 - DNA, 21 bp, Homo sapiens
gaataccttagtgcagttatt

SEQ ID NO: 487238 - DNA, 16 bp, Homo sapiens
gaatgtaaatgtctca

SEQ ID NO: 487239 - DNA, 16 bp, Homo sapiens
gaattcaaattttatc

SEQ ID NO: 487240 - DNA, 22 bp, Homo sapiens
gacaaaatacttgtctgtttta

SEQ ID NO: 487241 - DNA, 21 bp, Homo sapiens
gacactcgaggtcgggcagca

SEQ ID NO: 487242 - DNA, 18 bp, Homo sapiens
gacagtaattgtgtttac

SEQ ID NO: 487243 - DNA, 19 bp, Homo sapiens
gacagtaattgtgtttaca

SEQ ID NO: 487244 - DNA, 17 bp, Homo sapiens
gacctttttctgcacta

SEQ ID NO: 487245 - DNA, 17 bp, Homo sapiens
gagatacagaattttat

SEQ ID NO: 487246 - DNA, 12 bp, Homo sapiens
gagctacaaatg

SEQ ID NO: 487247 - DNA, 14 bp, Homo sapiens
gagctacaaatgca

SEQ ID NO: 487248 - DNA, 16 bp, Homo sapiens
gagtttaaattgtaat

SEQ ID NO: 487249 - DNA, 20 bp, Homo sapiens
gataaatcattttatgtcaa

SEQ ID NO: 487250 - DNA, 20 bp, Homo sapiens
gtaattgtgtttacatttta

SEQ ID NO: 487251 - DNA, 17 bp, Homo sapiens
gtaccaaccatccaatt

SEQ ID NO: 487252 - DNA, 14 bp, Homo sapiens
gtactgtatgatca

SEQ ID NO: 487253 - DNA, 18 bp, Homo sapiens
gtactgtatgatcaaatg

SEQ ID NO: 487254 - DNA, 17 bp, Homo sapiens
gtaggaaggtactgtat

SEQ ID NO: 487255 - DNA, 19 bp, Homo sapiens
gtaggaaggtactgtatga

SEQ ID NO: 487256 - DNA, 13 bp, Homo sapiens
gtagttatcatgt

SEQ ID NO: 487257 - DNA, 22 bp, Homo sapiens
gtatcaaaatgctcttatttca

SEQ ID NO: 487258 - DNA, 13 bp, Homo sapiens
gtatcggcactgt

SEQ ID NO: 487259 - DNA, 17 bp, Homo sapiens
gtatgatcaaatgttta

SEQ ID NO: 487260 - DNA, 11 bp, Homo sapiens
gtattgacaaa

SEQ ID NO: 487261 - DNA, 13 bp, Homo sapiens
gtattgacaaaat

SEQ ID NO: 487262 - DNA, 17 bp, Homo sapiens
gtattgacaaaatgtta

SEQ ID NO: 487263 - DNA, 15 bp, Homo sapiens
gtcaagattcagcta

SEQ ID NO: 487264 - DNA, 16 bp, Homo sapiens
gtctcactgagcactg

SEQ ID NO: 487265 - DNA, 16 bp, Homo sapiens
gtctgtactgattcaa

SEQ ID NO: 487266 - DNA, 13 bp, Homo sapiens
gtgattagtgaaa

SEQ ID NO: 487267 - DNA, 20 bp, Homo sapiens
gtgcctagtattgacaaaat

SEQ ID NO: 487268 - DNA, 20 bp, Homo sapiens
gtgctgttgttatgatgtgc

SEQ ID NO: 487269 - DNA, 16 bp, Homo sapiens
gtgtaatgaatacctt

SEQ ID NO: 487270 - DNA, 23 bp, Homo sapiens
gttatcatgttagtaatacctct

SEQ ID NO: 487271 - DNA, 14 bp, Homo sapiens
gttatgatgtgctt

SEQ ID NO: 487272 - DNA, 22 bp, Homo sapiens
gttatgatgtgcttaacaggga

SEQ ID NO: 487273 - DNA, 17 bp, Homo sapiens
gttcccctgtttattca

SEQ ID NO: 487274 - DNA, 19 bp, Homo sapiens
gttcttcgactgttgttat

SEQ ID NO: 487275 - DNA, 16 bp, Homo sapiens
gttgctgcttcaattt

SEQ ID NO: 487276 - DNA, 15 bp, Homo sapiens
gttggctagattaac

SEQ ID NO: 487277 - DNA, 17 bp, Homo sapiens
gttgttatctgtttgag

SEQ ID NO: 487278 - DNA, 17 bp, Homo sapiens
gtttaatcatataaata

SEQ ID NO: 487279 - DNA, 15 bp, Homo sapiens
gtttaatgaatgctt

SEQ ID NO: 487280 - DNA, 18 bp, Homo sapiens
gtttaatgaatgcttaaa

SEQ ID NO: 487281 - DNA, 15 bp, Homo sapiens
gtttatgacagtaat

SEQ ID NO: 487282 - DNA, 17 bp, Homo sapiens
gtttatgacagtaattg

SEQ ID NO: 487283 - DNA, 13 bp, Homo sapiens
gtttattcatatg

SEQ ID NO: 487284 - DNA, 19 bp, Homo sapiens
gtttattcatatgcatatt

SEQ ID NO: 487285 - DNA, 23 bp, Homo sapiens
gttttctagtgtatcaaaatgct

SEQ ID NO: 487286 - DNA, 23 bp, Homo sapiens
gtttttcaggtatatacctccat

SEQ ID NO: 487287 - DNA, 15 bp, Homo sapiens
taaaaacctgttcaa

SEQ ID NO: 487288 - DNA, 21 bp, Homo sapiens
taaacagatgtccatcagatg

SEQ ID NO: 487289 - DNA, 23 bp, Homo sapiens
taaacagatgtccatcagatgac

SEQ ID NO: 487290 - DNA, 17 bp, Homo sapiens
taaacagttgcacagca

SEQ ID NO: 487291 - DNA, 22 bp, Homo sapiens
taaacagttgcacagcatctca

SEQ ID NO: 487292 - DNA, 22 bp, Homo sapiens
taaacatgactccatagacctt

SEQ ID NO: 487293 - DNA, 22 bp, Homo sapiens
taaaccccaccccaaaattagc

SEQ ID NO: 487294 - DNA, 15 bp, Homo sapiens
taaagaattcaaatt

SEQ ID NO: 487295 - DNA, 14 bp, Homo sapiens
taaagtgtttgaaa

SEQ ID NO: 487296 - DNA, 16 bp, Homo sapiens
taaatagaatgtaaat

SEQ ID NO: 487297 - DNA, 15 bp, Homo sapiens
taacagggaacgtga

SEQ ID NO: 487298 - DNA, 15 bp, Homo sapiens
taacatgaagacctt

SEQ ID NO: 487299 - DNA, 16 bp, Homo sapiens
taactaactaaaacaa

SEQ ID NO: 487300 - DNA, 19 bp, Homo sapiens
taagggaagtagttatcat

SEQ ID NO: 487301 - DNA, 15 bp, Homo sapiens
taatacagctgagct

SEQ ID NO: 487302 - DNA, 21 bp, Homo sapiens
taatcatataaatagaatgta

SEQ ID NO: 487303 - DNA, 13 bp, Homo sapiens
taatgtacatagt

SEQ ID NO: 487304 - DNA, 18 bp, Homo sapiens
taattgtgtttacatttt

SEQ ID NO: 487305 - DNA, 21 bp, Homo sapiens
taattgtgtttacattttatg

SEQ ID NO: 487306 - DNA, 22 bp, Homo sapiens
taattgtgtttacattttatgg

SEQ ID NO: 487307 - DNA, 18 bp, Homo sapiens
tacaagtttcatccagaa

SEQ ID NO: 487308 - DNA, 23 bp, Homo sapiens
tacagttcggtgagctacaaatg

SEQ ID NO: 487309 - DNA, 22 bp, Homo sapiens
tacatagtgctaacatgaagac

SEQ ID NO: 487310 - DNA, 20 bp, Homo sapiens
tacattcttcaagatcccat

SEQ ID NO: 487311 - DNA, 15 bp, Homo sapiens
tacccatttgttcat

SEQ ID NO: 487312 - DNA, 21 bp, Homo sapiens
tacctcaattttcactgtgtc

SEQ ID NO: 487313 - DNA, 14 bp, Homo sapiens
taccttagtgcagt

SEQ ID NO: 487314 - DNA, 22 bp, Homo sapiens
tactcaagagtggtatcttgca

SEQ ID NO: 487315 - DNA, 17 bp, Homo sapiens
tactgattcaatttgat

SEQ ID NO: 487316 - DNA, 11 bp, Homo sapiens
tactgtatgat

SEQ ID NO: 487317 - DNA, 17 bp, Homo sapiens
ttgttcatattaagaat

SEQ ID NO: 487318 - DNA, 13 bp, Homo sapiens
tttagttcctgtg

SEQ ID NO: 487319 - DNA, 19 bp, Homo sapiens
tttagttcctgtgcacagc

SEQ ID NO: 487320 - DNA, 15 bp, Homo sapiens
tttatgacagtaatt

SEQ ID NO: 487321 - DNA, 16 bp, Homo sapiens
tttatgacagtaattg

SEQ ID NO: 487322 - DNA, 16 bp, Homo sapiens
actaaaacaaagccac

SEQ ID NO: 487323 - DNA, 15 bp, Homo sapiens
actaactaaaacaaa

SEQ ID NO: 487324 - DNA, 15 bp, Homo sapiens
actaattttaaaatg

SEQ ID NO: 487325 - DNA, 13 bp, Homo sapiens
actatatgcaaac

SEQ ID NO: 487326 - DNA, 14 bp, Homo sapiens
actatatgcaaaca

SEQ ID NO: 487327 - DNA, 20 bp, Homo sapiens
actgaagtaaaacaaacaat

SEQ ID NO: 487328 - DNA, 17 bp, Homo sapiens
actgagcactgttttct

SEQ ID NO: 487329 - DNA, 19 bp, Homo sapiens
actgcaccagttgctgctt

SEQ ID NO: 487330 - DNA, 17 bp, Homo sapiens
atgatcaaatgtttaat

SEQ ID NO: 487331 - DNA, 18 bp, Homo sapiens
atgatgtatactgccact

SEQ ID NO: 487332 - DNA, 13 bp, Homo sapiens
atgatttcatgta

SEQ ID NO: 487333 - DNA, 14 bp, Homo sapiens
atgatttcatgtac

SEQ ID NO: 487334 - DNA, 23 bp, Homo sapiens
atgcatattttttttctttttac

SEQ ID NO: 487335 - DNA, 18 bp, Homo sapiens
atgctacaggatttgaaa

SEQ ID NO: 487336 - DNA, 17 bp, Homo sapiens
atgctcttatttcatca

SEQ ID NO: 487337 - DNA, 19 bp, Homo sapiens
atgctcttatttcatcatt

SEQ ID NO: 487338 - DNA, 19 bp, Homo sapiens
atgtaaatgtctcactgag

SEQ ID NO: 487339 - DNA, 21 bp, Homo sapiens
atgtaaatgtctcactgagca

SEQ ID NO: 487340 - DNA, 15 bp, Homo sapiens
atgtacatagtgcta

SEQ ID NO: 487341 - DNA, 18 bp, Homo sapiens
atgtacatagtgctaaca

SEQ ID NO: 487342 - DNA, 13 bp, Homo sapiens
atgtactgcatta

SEQ ID NO: 487343 - DNA, 21 bp, Homo sapiens
atgtatactgccactaacctt

SEQ ID NO: 487344 - DNA, 18 bp, Homo sapiens
atgtccatcagatgacaa

SEQ ID NO: 487345 - DNA, 15 bp, Homo sapiens
atgtctcactgagca

SEQ ID NO: 487346 - DNA, 16 bp, Homo sapiens
atgtgcttaacaggga

SEQ ID NO: 487347 - DNA, 16 bp, Homo sapiens
atgtggtgaaaagcag

SEQ ID NO: 487348 - DNA, 16 bp, Homo sapiens
atgttagtaatacctc

SEQ ID NO: 487349 - DNA, 20 bp, Homo sapiens
atgttagtaatacctctaat

SEQ ID NO: 487350 - DNA, 12 bp, Homo sapiens
atgttatttccc

SEQ ID NO: 487351 - DNA, 16 bp, Homo sapiens
atgtttaatcatataa

SEQ ID NO: 487352 - DNA, 13 bp, Homo sapiens
atgtttgcatata

SEQ ID NO: 487353 - DNA, 23 bp, Homo sapiens
attaaacatgactccatagacct

SEQ ID NO: 487354 - DNA, 23 bp, Homo sapiens
attaagaatgatctgattgaccg

SEQ ID NO: 487355 - DNA, 15 bp, Homo sapiens
attacttagtattgc

SEQ ID NO: 487356 - DNA, 18 bp, Homo sapiens
attagccagtaatcctgt

SEQ ID NO: 487357 - DNA, 22 bp, Homo sapiens
attagcttatgttaactgacaa

SEQ ID NO: 487358 - DNA, 13 bp, Homo sapiens
attatagctctaa

SEQ ID NO: 487359 - DNA, 15 bp, Homo sapiens
attatagctctaatg

SEQ ID NO: 487360 - DNA, 17 bp, Homo sapiens
attatagctctaatgtt

SEQ ID NO: 487361 - DNA, 18 bp, Homo sapiens
attatagctctaatgttt

SEQ ID NO: 487362 - DNA, 16 bp, Homo sapiens
attatatttacaaatg

SEQ ID NO: 487363 - DNA, 15 bp, Homo sapiens
attatgattagcttt

SEQ ID NO: 487364 - DNA, 13 bp, Homo sapiens
attatttgagaag

SEQ ID NO: 487365 - DNA, 13 bp, Homo sapiens
attcaaattttat

SEQ ID NO: 487366 - DNA, 13 bp, Homo sapiens
attcaagattccc

SEQ ID NO: 487367 - DNA, 16 bp, Homo sapiens
attcaatttgatgtgg

SEQ ID NO: 487368 - DNA, 17 bp, Homo sapiens
attcacttcactgtgct

SEQ ID NO: 487369 - DNA, 23 bp, Homo sapiens
attcacttcactgtgctgttgtt

SEQ ID NO: 487370 - DNA, 12 bp, Homo sapiens
attccctcccca

SEQ ID NO: 487371 - DNA, 18 bp, Homo sapiens
attcttcaagatcccatt

SEQ ID NO: 487372 - DNA, 21 bp, Homo sapiens
attcttcaagatcccatttga

SEQ ID NO: 487373 - DNA, 17 bp, Homo sapiens
attcttgccaaatataa

SEQ ID NO: 487374 - DNA, 13 bp, Homo sapiens
attgacaaaatgt

SEQ ID NO: 487375 - DNA, 17 bp, Homo sapiens
attgacaaaatgttatt

SEQ ID NO: 487376 - DNA, 22 bp, Homo sapiens
attgacaaaatgttatttccct

SEQ ID NO: 487377 - DNA, 14 bp, Homo sapiens
attgtattacaaat

SEQ ID NO: 487378 - DNA, 12 bp, Homo sapiens
attgtgtttaca

SEQ ID NO: 487379 - DNA, 14 bp, Homo sapiens
attgtgtttacatt

SEQ ID NO: 487380 - DNA, 18 bp, Homo sapiens
attgtgtttacattttat

SEQ ID NO: 487381 - DNA, 11 bp, Homo sapiens
atttaaacaga

SEQ ID NO: 487382 - DNA, 12 bp, Homo sapiens
atttaaacagat

SEQ ID NO: 487383 - DNA, 18 bp, Homo sapiens
atttaaacagatgtccat

SEQ ID NO: 487384 - DNA, 15 bp, Homo sapiens
atttagttgttgtag

SEQ ID NO: 487385 - DNA, 23 bp, Homo sapiens
atttatacctcaattttcactgt

SEQ ID NO: 487386 - DNA, 20 bp, Homo sapiens
atttcatgtactgcattatt

SEQ ID NO: 487387 - DNA, 21 bp, Homo sapiens
atttcatgtactgcattattt

SEQ ID NO: 487388 - DNA, 18 bp, Homo sapiens
atttcccatgatttcatg

SEQ ID NO: 487389 - DNA, 17 bp, Homo sapiens
atttccctacattaaac

SEQ ID NO: 487390 - DNA, 20 bp, Homo sapiens
atttccctacattaaacatg

SEQ ID NO: 487391 - DNA, 16 bp, Homo sapiens
atttcctatgatgtat

SEQ ID NO: 487392 - DNA, 21 bp, Homo sapiens
atttcctatgatgtatactgc

SEQ ID NO: 487393 - DNA, 20 bp, Homo sapiens
atttgagaagctgctcaact

SEQ ID NO: 487394 - DNA, 22 bp, Homo sapiens
atttgtgggtttttatttccta

SEQ ID NO: 487395 - DNA, 13 bp, Homo sapiens
atttgttcatatt

SEQ ID NO: 487396 - DNA, 22 bp, Homo sapiens
attttcagttattatatttaca

SEQ ID NO: 487397 - DNA, 18 bp, Homo sapiens
attttctataatttaaat

SEQ ID NO: 487398 - DNA, 18 bp, Homo sapiens
caaaaaaatcttccaatt

SEQ ID NO: 487399 - DNA, 16 bp, Homo sapiens
caaaatcagttttcct

SEQ ID NO: 487400 - DNA, 23 bp, Homo sapiens
caaaattagccagtaatcctgta

SEQ ID NO: 487401 - DNA, 19 bp, Homo sapiens
caaacatcctcttccatat

SEQ ID NO: 487402 - DNA, 22 bp, Homo sapiens
caaagtcaggaatcatcaggaa

SEQ ID NO: 487403 - DNA, 15 bp, Homo sapiens
caaatgtttaatcat

SEQ ID NO: 487404 - DNA, 22 bp, Homo sapiens
caaatgtttaatcatataaata

SEQ ID NO: 487405 - DNA, 13 bp, Homo sapiens
caaattggagaaa

SEQ ID NO: 487406 - DNA, 14 bp, Homo sapiens
caaccatccaatta

SEQ ID NO: 487407 - DNA, 12 bp, Homo sapiens
caacttgcaaaa

SEQ ID NO: 487408 - DNA, 20 bp, Homo sapiens
caagatgaaattccatttgt

SEQ ID NO: 487409 - DNA, 18 bp, Homo sapiens
caaggaaaaaataacaat

SEQ ID NO: 487410 - DNA, 16 bp, Homo sapiens
caagtttcatccagaa

SEQ ID NO: 487411 - DNA, 20 bp, Homo sapiens
caataaaattatagctctaa

SEQ ID NO: 487412 - DNA, 21 bp, Homo sapiens
caatacaagtttcatccagaa

SEQ ID NO: 487413 - DNA, 19 bp, Homo sapiens
caatacctgaatgctctgt

SEQ ID NO: 487414 - DNA, 17 bp, Homo sapiens
caatttagttgttgtag

SEQ ID NO: 487415 - DNA, 22 bp, Homo sapiens
caatttatacctcaattttcac

SEQ ID NO: 487416 - DNA, 15 bp, Homo sapiens
caattttcactgtgt

SEQ ID NO: 487417 - DNA, 14 bp, Homo sapiens
cacagcatctcagc

SEQ ID NO: 487418 - DNA, 19 bp, Homo sapiens
cacagcatctcagctcatc

SEQ ID NO: 487419 - DNA, 22 bp, Homo sapiens
caccggccccatttacccaact

SEQ ID NO: 487420 - DNA, 13 bp, Homo sapiens
cactgagcactgt

SEQ ID NO: 487421 - DNA, 15 bp, Homo sapiens
cactgagcactgttt

SEQ ID NO: 487422 - DNA, 15 bp, Homo sapiens
cactgtgctgttgtt

SEQ ID NO: 487423 - DNA, 21 bp, Homo sapiens
cactgtgctgttgttatgatg

SEQ ID NO: 487424 - DNA, 12 bp, Homo sapiens
cacttcactgtg

SEQ ID NO: 487425 - DNA, 13 bp, Homo sapiens
cacttcactgtgc

SEQ ID NO: 487426 - DNA, 19 bp, Homo sapiens
cagaactaccacctgacat

SEQ ID NO: 487427 - DNA, 15 bp, Homo sapiens
cagattcttgcatcc

SEQ ID NO: 487428 - DNA, 14 bp, Homo sapiens
cagcatctcagctc

SEQ ID NO: 487429 - DNA, 21 bp, Homo sapiens
cagggtaactaactaaaacaa

SEQ ID NO: 487430 - DNA, 17 bp, Homo sapiens
cattcacttcactgtgc

SEQ ID NO: 487431 - DNA, 18 bp, Homo sapiens
cattcacttcactgtgct

SEQ ID NO: 487432 - DNA, 20 bp, Homo sapiens
cattcacttcactgtgctgt

SEQ ID NO: 487433 - DNA, 18 bp, Homo sapiens
cattcctcccattcaaga

SEQ ID NO: 487434 - DNA, 21 bp, Homo sapiens
catttaaacagatgtccatca

SEQ ID NO: 487435 - DNA, 14 bp, Homo sapiens
catttgttcatatt

SEQ ID NO: 487436 - DNA, 19 bp, Homo sapiens
catttgttcatattaagaa

SEQ ID NO: 487437 - DNA, 17 bp, Homo sapiens
cattttatggtgcctag

SEQ ID NO: 487438 - DNA, 14 bp, Homo sapiens
cattttctgcatct

SEQ ID NO: 487439 - DNA, 12 bp, Homo sapiens
cattttgtacca

SEQ ID NO: 487440 - DNA, 22 bp, Homo sapiens
cattttgtaccaaccatccaat

SEQ ID NO: 487441 - DNA, 23 bp, Homo sapiens
ccactggctggacaaactgcacc

SEQ ID NO: 487442 - DNA, 19 bp, Homo sapiens
ccagttcttcgactgttgt

SEQ ID NO: 487443 - DNA, 17 bp, Homo sapiens
ccatgtcaagattcagc

SEQ ID NO: 487444 - DNA, 19 bp, Homo sapiens
ccatgtcaagattcagcta

SEQ ID NO: 487445 - DNA, 17 bp, Homo sapiens
ccattgtgcattctaga

SEQ ID NO: 487446 - DNA, 20 bp, Homo sapiens
ccatttaaacagatgtccat

SEQ ID NO: 487447 - DNA, 13 bp, Homo sapiens
ccatttgttcata

SEQ ID NO: 487448 - DNA, 17 bp, Homo sapiens
ccccaccccaaaattag

SEQ ID NO: 487449 - DNA, 19 bp, Homo sapiens
cccctgtttattcatatgc

SEQ ID NO: 487450 - DNA, 20 bp, Homo sapiens
cccttaaacagttgcacagc

SEQ ID NO: 487451 - DNA, 21 bp, Homo sapiens
cccttaaacagttgcacagca

SEQ ID NO: 487452 - DNA, 16 bp, Homo sapiens
ccgtaggttattttca

SEQ ID NO: 487453 - DNA, 16 bp, Homo sapiens
cctcaattttcactgt

SEQ ID NO: 487454 - DNA, 15 bp, Homo sapiens
cctgaatgctctgta

SEQ ID NO: 487455 - DNA, 17 bp, Homo sapiens
cctgacattccttgctg

SEQ ID NO: 487456 - DNA, 18 bp, Homo sapiens
cctgacattccttgctga

SEQ ID NO: 487457 - DNA, 17 bp, Homo sapiens
cctgtcatactttgtta

SEQ ID NO: 487458 - DNA, 20 bp, Homo sapiens
ccttaaacagttgcacagca

SEQ ID NO: 487459 - DNA, 17 bp, Homo sapiens
cggtgagctacaaatgc

SEQ ID NO: 487460 - DNA, 23 bp, Homo sapiens
ctaaaaccttccatgtcaagatt

SEQ ID NO: 487461 - DNA, 19 bp, Homo sapiens
ctaaactccaaacatcctc

SEQ ID NO: 487462 - DNA, 15 bp, Homo sapiens
ctaacatgaagacct

SEQ ID NO: 487463 - DNA, 18 bp, Homo sapiens
ctaatgtttgcatataag

SEQ ID NO: 487464 - DNA, 19 bp, Homo sapiens
ctacataactaatacagct

SEQ ID NO: 487465 - DNA, 11 bp, Homo sapiens
ctactcagcat

SEQ ID NO: 487466 - DNA, 16 bp, Homo sapiens
ctaggtttatgacagt

SEQ ID NO: 487467 - DNA, 18 bp, Homo sapiens
ctagtgtatcaaaatgct

SEQ ID NO: 487468 - DNA, 13 bp, Homo sapiens
ctatgatgtatac

SEQ ID NO: 487469 - DNA, 15 bp, Homo sapiens
ctcaattttcactgt

SEQ ID NO: 487470 - DNA, 15 bp, Homo sapiens
ctcactgagcactgt

SEQ ID NO: 487471 - DNA, 19 bp, Homo sapiens
ctccaaaacttcgtttaat

SEQ ID NO: 487472 - DNA, 18 bp, Homo sapiens
ctccatttaaacagatgt

SEQ ID NO: 487473 - DNA, 18 bp, Homo sapiens
ctctaatgtttgcatata

SEQ ID NO: 487474 - DNA, 17 bp, Homo sapiens
ctctcaataaaattata

SEQ ID NO: 487475 - DNA, 14 bp, Homo sapiens
ctcttatttcatca

SEQ ID NO: 487476 - DNA, 22 bp, Homo sapiens
ctcttcttaatgtacatagtgc

SEQ ID NO: 487477 - DNA, 24 bp, Homo sapiens
ctcttcttaatgtacatagtgcta

SEQ ID NO: 487478 - DNA, 22 bp, Homo sapiens
ctgaaggggaaggaaatagctt

SEQ ID NO: 487479 - DNA, 21 bp, Homo sapiens
ctgaagtaaaacaaacaatac

SEQ ID NO: 487480 - DNA, 12 bp, Homo sapiens
ctgagcactgtt

SEQ ID NO: 487481 - DNA, 16 bp, Homo sapiens
ctgagctatgtagtat

SEQ ID NO: 487482 - DNA, 18 bp, Homo sapiens
ctgcaatacaagtttcat

SEQ ID NO: 487483 - DNA, 20 bp, Homo sapiens
ctgcaccctggatttgcata

SEQ ID NO: 487484 - DNA, 19 bp, Homo sapiens
ctgccttttagttcctgtg

SEQ ID NO: 487485 - DNA, 22 bp, Homo sapiens
ctgtagcctaaactccaaacat

SEQ ID NO: 487486 - DNA, 21 bp, Homo sapiens
ctgtaggaaggtactgtatga

SEQ ID NO: 487487 - DNA, 23 bp, Homo sapiens
ctgtatgatcaaatgtttaatca

SEQ ID NO: 487488 - DNA, 11 bp, Homo sapiens
ctgtgcacagc

SEQ ID NO: 487489 - DNA, 12 bp, Homo sapiens
ctgtgcacagcc

SEQ ID NO: 487490 - DNA, 14 bp, Homo sapiens
ctgttgttatgatg

SEQ ID NO: 487491 - DNA, 17 bp, Homo sapiens
ctgttgttatgatgtgc

SEQ ID NO: 487492 - DNA, 21 bp, Homo sapiens
ctgttgttatgatgtgcttaa

SEQ ID NO: 487493 - DNA, 23 bp, Homo sapiens
ctgttgttatgatgtgcttaaca

SEQ ID NO: 487494 - DNA, 16 bp, Homo sapiens
ctgtttattcatatgc

SEQ ID NO: 487495 - DNA, 17 bp, Homo sapiens
ctgtttattcatatgca

SEQ ID NO: 487496 - DNA, 13 bp, Homo sapiens
ctgtttgagaaag

SEQ ID NO: 487497 - DNA, 15 bp, Homo sapiens
ctgttttctagtgta

SEQ ID NO: 487498 - DNA, 17 bp, Homo sapiens
ctgttttctagtgtatc

SEQ ID NO: 487499 - DNA, 18 bp, Homo sapiens
ctgttttctagtgtatca

SEQ ID NO: 487500 - DNA, 20 bp, Homo sapiens
ctgttttctagtgtatcaaa

SEQ ID NO: 487501 - DNA, 18 bp, Homo sapiens
cttaaacagttgcacagc

SEQ ID NO: 487502 - DNA, 23 bp, Homo sapiens
cttaaagaattcaaattttatct

SEQ ID NO: 487503 - DNA, 19 bp, Homo sapiens
cttaacagggaacgtgatt

SEQ ID NO: 487504 - DNA, 16 bp, Homo sapiens
cttacagcaaatcctt

SEQ ID NO: 487505 - DNA, 19 bp, Homo sapiens
cttagcattttctgcatct

SEQ ID NO: 487506 - DNA, 17 bp, Homo sapiens
cttcaatccttgaaggt

SEQ ID NO: 487507 - DNA, 15 bp, Homo sapiens
cttcaatttatacct

SEQ ID NO: 487508 - DNA, 13 bp, Homo sapiens
cttcactgtgctg

SEQ ID NO: 487509 - DNA, 14 bp, Homo sapiens
cttcactgtgctgt

SEQ ID NO: 487510 - DNA, 22 bp, Homo sapiens
cttcgactgttgttatctgttt

SEQ ID NO: 487511 - DNA, 20 bp, Homo sapiens
cttctcacatttatattttt

SEQ ID NO: 487512 - DNA, 16 bp, Homo sapiens
cttcttaatgtacata

SEQ ID NO: 487513 - DNA, 18 bp, Homo sapiens
cttcttaatgtacatagt

SEQ ID NO: 487514 - DNA, 23 bp, Homo sapiens
cttgaaggtatatctaggtttat

SEQ ID NO: 487515 - DNA, 17 bp, Homo sapiens
cttgcaaaatcagtttt

SEQ ID NO: 487516 - DNA, 17 bp, Homo sapiens
cttgccaaatataaata

SEQ ID NO: 487517 - DNA, 21 bp, Homo sapiens
cttgctgaaacgcatctagtt

SEQ ID NO: 487518 - DNA, 16 bp, Homo sapiens
cttgggtagcgcactc

SEQ ID NO: 487519 - DNA, 17 bp, Homo sapiens
cttgtactttattttct

SEQ ID NO: 487520 - DNA, 23 bp, Homo sapiens
ctttatggcagacattgtgctag

SEQ ID NO: 487521 - DNA, 21 bp, Homo sapiens
ctttattttctataatttaaa

SEQ ID NO: 487522 - DNA, 16 bp, Homo sapiens
ctttttctgcactata

SEQ ID NO: 487523 - DNA, 19 bp, Homo sapiens
gaaaataacaataaaagac

SEQ ID NO: 487524 - DNA, 20 bp, Homo sapiens
gaaaggctgctgtactgaag

SEQ ID NO: 487525 - DNA, 23 bp, Homo sapiens
gaaaggctgctgtactgaagtaa

SEQ ID NO: 487526 - DNA, 19 bp, Homo sapiens
gaaagtcagattcttgcat

SEQ ID NO: 487527 - DNA, 15 bp, Homo sapiens
gaaagtgagcagtgt

SEQ ID NO: 487528 - DNA, 22 bp, Homo sapiens
gaacgtgattagtgaaaggaag

SEQ ID NO: 487529 - DNA, 23 bp, Homo sapiens
gaacgtttagctgacaaaatact

SEQ ID NO: 487530 - DNA, 21 bp, Homo sapiens
gaacttgtaaaggaatttaaa

SEQ ID NO: 487531 - DNA, 21 bp, Homo sapiens
gaagacctttttctgcactat

SEQ ID NO: 487532 - DNA, 20 bp, Homo sapiens
gaagacttacagcaaatcct

SEQ ID NO: 487533 - DNA, 20 bp, Homo sapiens
gaaggtatatctaggtttat

SEQ ID NO: 487534 - DNA, 16 bp, Homo sapiens
gaatgatctgattgac

SEQ ID NO: 487535 - DNA, 21 bp, Homo sapiens
gaatgcttaaagaattcaaat

SEQ ID NO: 487536 - DNA, 13 bp, Homo sapiens
gaatgtaaatgtc

SEQ ID NO: 487537 - DNA, 22 bp, Homo sapiens
gacaagaaaggctgctgtactg

SEQ ID NO: 487538 - DNA, 14 bp, Homo sapiens
gacagtgaaagaaa

SEQ ID NO: 487539 - DNA, 22 bp, Homo sapiens
gactaaaccattgtgcattcta

SEQ ID NO: 487540 - DNA, 19 bp, Homo sapiens
gactgttgttatctgtttg

SEQ ID NO: 487541 - DNA, 18 bp, Homo sapiens
gacttacagcaaatcctt

SEQ ID NO: 487542 - DNA, 16 bp, Homo sapiens
gacttgaagacttaca

SEQ ID NO: 487543 - DNA, 20 bp, Homo sapiens
gagaaaaagaaaaaatatat

SEQ ID NO: 487544 - DNA, 14 bp, Homo sapiens
gagcactgttttct

SEQ ID NO: 487545 - DNA, 22 bp, Homo sapiens
gagcactgttttctagtgtatc

SEQ ID NO: 487546 - DNA, 13 bp, Homo sapiens
gataaatcatttt

SEQ ID NO: 487547 - DNA, 14 bp, Homo sapiens
gataaatcatttta

SEQ ID NO: 487548 - DNA, 19 bp, Homo sapiens
gatccactggctggacaaa

SEQ ID NO: 487549 - DNA, 17 bp, Homo sapiens
ttatttcctatgatgta

SEQ ID NO: 487550 - DNA, 20 bp, Homo sapiens
ttcaagtctaccaattataa

SEQ ID NO: 487551 - DNA, 15 bp, Homo sapiens
ttcaatttgatgtgg

SEQ ID NO: 487552 - DNA, 22 bp, Homo sapiens
ttcaatttgatgtggtgaaaag

SEQ ID NO: 487553 - DNA, 14 bp, Homo sapiens
ttcactactcagca

SEQ ID NO: 487554 - DNA, 20 bp, Homo sapiens
ttcatcattcacttcactgt

SEQ ID NO: 487555 - DNA, 21 bp, Homo sapiens
ttccatatggatccactggct

SEQ ID NO: 487556 - DNA, 22 bp, Homo sapiens
ttcccatgatttcatgtactgc

SEQ ID NO: 487557 - DNA, 19 bp, Homo sapiens
ttcccctgtttattcatat

SEQ ID NO: 487558 - DNA, 14 bp, Homo sapiens
ttccctacattaaa

SEQ ID NO: 487559 - DNA, 21 bp, Homo sapiens
ttcctatgatgtatactgcca

SEQ ID NO: 487560 - DNA, 18 bp, Homo sapiens
ttcggtgagctacaaatg

SEQ ID NO: 487561 - DNA, 13 bp, Homo sapiens
ttctataatttaa

SEQ ID NO: 487562 - DNA, 16 bp, Homo sapiens
ttctgcatctccactt

SEQ ID NO: 487563 - DNA, 15 bp, Homo sapiens
ttcttaatgtacata

SEQ ID NO: 487564 - DNA, 22 bp, Homo sapiens
ttctttttacccatttgttcat

SEQ ID NO: 487565 - DNA, 17 bp, Homo sapiens
ttgaaattgtattacaa

SEQ ID NO: 487566 - DNA, 22 bp, Homo sapiens
ttgaccgtgttggtctgtactg

SEQ ID NO: 487567 - DNA, 15 bp, Homo sapiens
ttgagaagctgctca

SEQ ID NO: 487568 - DNA, 21 bp, Homo sapiens
ttgataaatcattttatgtca

SEQ ID NO: 487569 - DNA, 21 bp, Homo sapiens
ttgcaaaatcagttttcctct

SEQ ID NO: 487570 - DNA, 18 bp, Homo sapiens
ttgcacagcatctcagct

SEQ ID NO: 487571 - DNA, 23 bp, Homo sapiens
ttgcatataagggaagtagttat

SEQ ID NO: 487572 - DNA, 13 bp, Homo sapiens
ttggacaaaatga

SEQ ID NO: 487573 - DNA, 17 bp, Homo sapiens
ttggattggacaaaatg

SEQ ID NO: 487574 - DNA, 16 bp, Homo sapiens
ttggtctgtactgatt

SEQ ID NO: 487575 - DNA, 21 bp, Homo sapiens
ttgtagagaaaacatgcagaa

SEQ ID NO: 487576 - DNA, 14 bp, Homo sapiens
ttgtattacaaatc

SEQ ID NO: 487577 - DNA, 13 bp, Homo sapiens
ttgttatctgttt

SEQ ID NO: 487578 - DNA, 13 bp, Homo sapiens
ttgttatgatgtg

SEQ ID NO: 487579 - DNA, 17 bp, Homo sapiens
ttgttatgatgtgctta

SEQ ID NO: 487580 - DNA, 19 bp, Homo sapiens
ttgttcatattaagaatga

SEQ ID NO: 487581 - DNA, 18 bp, Homo sapiens
ttgttgtagagaaaacat

SEQ ID NO: 487582 - DNA, 18 bp, Homo sapiens
tttaatcatataaataga

SEQ ID NO: 487583 - DNA, 16 bp, Homo sapiens
tttaatgaatgcttaa

SEQ ID NO: 487584 - DNA, 13 bp, Homo sapiens
tttacattttatg

SEQ ID NO: 487585 - DNA, 22 bp, Homo sapiens
tttacattttatggtgcctagt

SEQ ID NO: 487586 - DNA, 15 bp, Homo sapiens
tttagctgacaaaat

SEQ ID NO: 487587 - DNA, 23 bp, Homo sapiens
tttagtgactaaaccattgtgca

SEQ ID NO: 487588 - DNA, 12 bp, Homo sapiens
tttagttcctgt

SEQ ID NO: 487589 - DNA, 14 bp, Homo sapiens
tttatctgcctctc

SEQ ID NO: 487590 - DNA, 20 bp, Homo sapiens
tttatctgcctctcttgtaa

SEQ ID NO: 487591 - DNA, 19 bp, Homo sapiens
tttatggtgcctagtattg

SEQ ID NO: 487592 - DNA, 16 bp, Homo sapiens
tttcactactcagcat

SEQ ID NO: 487593 - DNA, 16 bp, Homo sapiens
tttcatgtactgcatt

SEQ ID NO: 487594 - DNA, 15 bp, Homo sapiens
tttccacttcttcat

SEQ ID NO: 487595 - DNA, 14 bp, Homo sapiens
aaaaataacaatga

SEQ ID NO: 487596 - DNA, 16 bp, Homo sapiens
aaaaattacttagtat

SEQ ID NO: 487597 - DNA, 20 bp, Homo sapiens
aaaacttcgtttaatgaatg

SEQ ID NO: 487598 - DNA, 18 bp, Homo sapiens
aaaatgctcttatttcat

SEQ ID NO: 487599 - DNA, 16 bp, Homo sapiens
aaaatgttatttccct

SEQ ID NO: 487600 - DNA, 17 bp, Homo sapiens
aaaattagccagtaatc

SEQ ID NO: 487601 - DNA, 21 bp, Homo sapiens
aaaattagccagtaatcctgt

SEQ ID NO: 487602 - DNA, 15 bp, Homo sapiens
aaaattatagctcta

SEQ ID NO: 487603 - DNA, 14 bp, Homo sapiens
aaacagatgtccat

SEQ ID NO: 487604 - DNA, 22 bp, Homo sapiens
aaacagatgtccatcagatgac

SEQ ID NO: 487605 - DNA, 15 bp, Homo sapiens
aaacagttgcacagc

SEQ ID NO: 487606 - DNA, 17 bp, Homo sapiens
aaacagttgcacagcat

SEQ ID NO: 487607 - DNA, 19 bp, Homo sapiens
aaacagttgcacagcatct

SEQ ID NO: 487608 - DNA, 17 bp, Homo sapiens
aaacttcgtttaatgaa

SEQ ID NO: 487609 - DNA, 13 bp, Homo sapiens
aaagacagtgaaa

SEQ ID NO: 487610 - DNA, 18 bp, Homo sapiens
aaagtcagattcttgcat

SEQ ID NO: 487611 - DNA, 12 bp, Homo sapiens
aaataacaatga

SEQ ID NO: 487612 - DNA, 21 bp, Homo sapiens
aaatagaatgtaaatgtctca

SEQ ID NO: 487613 - DNA, 12 bp, Homo sapiens
aaatcttccaat

SEQ ID NO: 487614 - DNA, 23 bp, Homo sapiens
aaatgctcttatttcatcattca

SEQ ID NO: 487615 - DNA, 14 bp, Homo sapiens
aaatgtttaatcat

SEQ ID NO: 487616 - DNA, 18 bp, Homo sapiens
aaatgtttaatcatataa

SEQ ID NO: 487617 - DNA, 20 bp, Homo sapiens
aaattagccagtaatcctgt

SEQ ID NO: 487618 - DNA, 21 bp, Homo sapiens
aaattagccagtaatcctgta

SEQ ID NO: 487619 - DNA, 17 bp, Homo sapiens
aaatttcagcagctgca

SEQ ID NO: 487620 - DNA, 20 bp, Homo sapiens
aacaatacctgaatgctctg

SEQ ID NO: 487621 - DNA, 20 bp, Homo sapiens
aacagatgtccatcagatga

SEQ ID NO: 487622 - DNA, 19 bp, Homo sapiens
aacatacattttgtaccaa

SEQ ID NO: 487623 - DNA, 20 bp, Homo sapiens
aacatgactccatagacctt

SEQ ID NO: 487624 - DNA, 20 bp, Homo sapiens
aacatgcagaacaaatgaag

SEQ ID NO: 487625 - DNA, 22 bp, Homo sapiens
aacgcatctagttcccctgttt

SEQ ID NO: 487626 - DNA, 17 bp, Homo sapiens
aactaaaacaaagccac

SEQ ID NO: 487627 - DNA, 20 bp, Homo sapiens
aactaaaacaaagccacttt

SEQ ID NO: 487628 - DNA, 13 bp, Homo sapiens
aactaactaaaac

SEQ ID NO: 487629 - DNA, 17 bp, Homo sapiens
aactaccacctgacatt

SEQ ID NO: 487630 - DNA, 21 bp, Homo sapiens
aacttagcattttctgcatct

SEQ ID NO: 487631 - DNA, 19 bp, Homo sapiens
aacttgcaaaatcagtttt

SEQ ID NO: 487632 - DNA, 12 bp, Homo sapiens
aagaattcaaat

SEQ ID NO: 487633 - DNA, 21 bp, Homo sapiens
aagataaacgtggatgttact

SEQ ID NO: 487634 - DNA, 14 bp, Homo sapiens
aagattcagctagt

SEQ ID NO: 487635 - DNA, 14 bp, Homo sapiens
aagcaggttgataa

SEQ ID NO: 487636 - DNA, 23 bp, Homo sapiens
aagctgctcaacttgcaaaatca

SEQ ID NO: 487637 - DNA, 19 bp, Homo sapiens
aaggaaaaaataacaatga

SEQ ID NO: 487638 - DNA, 16 bp, Homo sapiens
aaggctgctgtactga

SEQ ID NO: 487639 - DNA, 18 bp, Homo sapiens
aagggcaaattggagaaa

SEQ ID NO: 487640 - DNA, 19 bp, Homo sapiens
aagggcagctttgctcata

SEQ ID NO: 487641 - DNA, 14 bp, Homo sapiens
aaggtactgtatga

SEQ ID NO: 487642 - DNA, 19 bp, Homo sapiens
aaggtactgtatgatcaaa

SEQ ID NO: 487643 - DNA, 19 bp, Homo sapiens
aagtagttatcatgttagt

SEQ ID NO: 487644 - DNA, 16 bp, Homo sapiens
aagtcaggaatcatca

SEQ ID NO: 487645 - DNA, 15 bp, Homo sapiens
aataacaataaaaga

SEQ ID NO: 487646 - DNA, 15 bp, Homo sapiens
aatacctctaatagt

SEQ ID NO: 487647 - DNA, 21 bp, Homo sapiens
aatatgcttatattgttcact

SEQ ID NO: 487648 - DNA, 12 bp, Homo sapiens
aatcatataaat

SEQ ID NO: 487649 - DNA, 18 bp, Homo sapiens
aatcatataaatagaatg

SEQ ID NO: 487650 - DNA, 20 bp, Homo sapiens
aatcatataaatagaatgta

SEQ ID NO: 487651 - DNA, 21 bp, Homo sapiens
aatcatataaatagaatgtaa

SEQ ID NO: 487652 - DNA, 22 bp, Homo sapiens
aatcatataaatagaatgtaaa

SEQ ID NO: 487653 - DNA, 20 bp, Homo sapiens
aatcctcagtttttgtgaaa

SEQ ID NO: 487654 - DNA, 18 bp, Homo sapiens
aatcctgtaggaaggtac

SEQ ID NO: 487655 - DNA, 14 bp, Homo sapiens
aatcttataattta

SEQ ID NO: 487656 - DNA, 19 bp, Homo sapiens
aatcttataatttaaaata

SEQ ID NO: 487657 - DNA, 23 bp, Homo sapiens
aatcttccaatttagttgttgta

SEQ ID NO: 487658 - DNA, 12 bp, Homo sapiens
aatgaatacctt

SEQ ID NO: 487659 - DNA, 20 bp, Homo sapiens
aatgaatactttataaagga

SEQ ID NO: 487660 - DNA, 21 bp, Homo sapiens
aatgatctgattgaccgtgtt

SEQ ID NO: 487661 - DNA, 16 bp, Homo sapiens
aatgctcttatttcat

SEQ ID NO: 487662 - DNA, 22 bp, Homo sapiens
aatgcttaaagaattcaaattt

SEQ ID NO: 487663 - DNA, 12 bp, Homo sapiens
aatgtaaatgtc

SEQ ID NO: 487664 - DNA, 13 bp, Homo sapiens
aatgtaaatgtct

SEQ ID NO: 487665 - DNA, 15 bp, Homo sapiens
aatgtaaatgtctca

SEQ ID NO: 487666 - DNA, 13 bp, Homo sapiens
aatgtttaatcat

SEQ ID NO: 487667 - DNA, 13 bp, Homo sapiens
aattacttagtat

SEQ ID NO: 487668 - DNA, 14 bp, Homo sapiens
aattagccagtaat

SEQ ID NO: 487669 - DNA, 18 bp, Homo sapiens
aattagccagtaatcctg

SEQ ID NO: 487670 - DNA, 16 bp, Homo sapiens
aattagcttatgttaa

SEQ ID NO: 487671 - DNA, 22 bp, Homo sapiens
aattatagctctaatgtttgca

SEQ ID NO: 487672 - DNA, 22 bp, Homo sapiens
aattcaaattttatctgcctct

SEQ ID NO: 487673 - DNA, 19 bp, Homo sapiens
aattgtgtttacattttat

SEQ ID NO: 487674 - DNA, 22 bp, Homo sapiens
aattgtgtttacattttatggt

SEQ ID NO: 487675 - DNA, 18 bp, Homo sapiens
aatttatacctcaatttt

SEQ ID NO: 487676 - DNA, 21 bp, Homo sapiens
aatttatacctcaattttcac

SEQ ID NO: 487677 - DNA, 12 bp, Homo sapiens
aatttgatgtgg

SEQ ID NO: 487678 - DNA, 11 bp, Homo sapiens
acaaaatgtta

SEQ ID NO: 487679 - DNA, 18 bp, Homo sapiens
acaagcactaaacaaaga

SEQ ID NO: 487680 - DNA, 17 bp, Homo sapiens
acaagctccatttaaac

SEQ ID NO: 487681 - DNA, 18 bp, Homo sapiens
acaagctccatttaaaca

SEQ ID NO: 487682 - DNA, 16 bp, Homo sapiens
acaagtgtaatgaata

SEQ ID NO: 487683 - DNA, 10 bp, Homo sapiens
acaatacctg

SEQ ID NO: 487684 - DNA, 21 bp, Homo sapiens
acaattagataaatgtccatt

SEQ ID NO: 487685 - DNA, 14 bp, Homo sapiens
acagcatctcagct

SEQ ID NO: 487686 - DNA, 21 bp, Homo sapiens
acagggaacgtgattagtgaa

SEQ ID NO: 487687 - DNA, 21 bp, Homo sapiens
acagggtaactaactaaaaca

SEQ ID NO: 487688 - DNA, 17 bp, Homo sapiens
acagtaattgtgtttac

SEQ ID NO: 487689 - DNA, 21 bp, Homo sapiens
acagtaattgtgtttacattt

SEQ ID NO: 487690 - DNA, 20 bp, Homo sapiens
acagttgcacagcatctcag

SEQ ID NO: 487691 - DNA, 21 bp, Homo sapiens
acatgaagacctttttctgca

SEQ ID NO: 487692 - DNA, 20 bp, Homo sapiens
acattttatggtgcctagta

SEQ ID NO: 487693 - DNA, 18 bp, Homo sapiens
gactaaaccattgtgcat

SEQ ID NO: 487694 - DNA, 19 bp, Homo sapiens
gactaaaccattgtgcatt

SEQ ID NO: 487695 - DNA, 14 bp, Homo sapiens
gactgttgttatct

SEQ ID NO: 487696 - DNA, 21 bp, Homo sapiens
gactgttgttatctgtttgag

SEQ ID NO: 487697 - DNA, 13 bp, Homo sapiens
gagaagctgctca

SEQ ID NO: 487698 - DNA, 17 bp, Homo sapiens
gataggtcagtgcaaat

SEQ ID NO: 487699 - DNA, 16 bp, Homo sapiens
gatcaaatgtttaatc

SEQ ID NO: 487700 - DNA, 17 bp, Homo sapiens
gatgaaattccatttgt

SEQ ID NO: 487701 - DNA, 22 bp, Homo sapiens
gatgacaagaaaggctgctgta

SEQ ID NO: 487702 - DNA, 22 bp, Homo sapiens
gatgggacaattagataaatgt

SEQ ID NO: 487703 - DNA, 14 bp, Homo sapiens
gatgtggtgaaaag

SEQ ID NO: 487704 - DNA, 16 bp, Homo sapiens
gattcaatttgatgtg

SEQ ID NO: 487705 - DNA, 13 bp, Homo sapiens
gatttcatgtact

SEQ ID NO: 487706 - DNA, 17 bp, Homo sapiens
gcaaatcctttgtgaaa

SEQ ID NO: 487707 - DNA, 14 bp, Homo sapiens
gcacaagtgtaatg

SEQ ID NO: 487708 - DNA, 14 bp, Homo sapiens
gcactatatgcaaa

SEQ ID NO: 487709 - DNA, 15 bp, Homo sapiens
gcactcttcatggtg

SEQ ID NO: 487710 - DNA, 21 bp, Homo sapiens
gcactgttttctagtgtatca

SEQ ID NO: 487711 - DNA, 22 bp, Homo sapiens
gcactgttttctagtgtatcaa

SEQ ID NO: 487712 - DNA, 14 bp, Homo sapiens
gcagaacaaatgaa

SEQ ID NO: 487713 - DNA, 12 bp, Homo sapiens
gcagttatttgc

SEQ ID NO: 487714 - DNA, 17 bp, Homo sapiens
gcataggtttaataatt

SEQ ID NO: 487715 - DNA, 20 bp, Homo sapiens
gcatctagcatgtcgtcaaa

SEQ ID NO: 487716 - DNA, 22 bp, Homo sapiens
gcatctagttcccctgtttatt

SEQ ID NO: 487717 - DNA, 22 bp, Homo sapiens
gcatctcagctcatcttcactg

SEQ ID NO: 487718 - DNA, 11 bp, Homo sapiens
gcattatttga

SEQ ID NO: 487719 - DNA, 15 bp, Homo sapiens
gcattatttgagaag

SEQ ID NO: 487720 - DNA, 14 bp, Homo sapiens
gcctagtattgaca

SEQ ID NO: 487721 - DNA, 16 bp, Homo sapiens
gcctagtattgacaaa

SEQ ID NO: 487722 - DNA, 15 bp, Homo sapiens
gctcaacttgcaaaa

SEQ ID NO: 487723 - DNA, 15 bp, Homo sapiens
gctcatatttcccat

SEQ ID NO: 487724 - DNA, 16 bp, Homo sapiens
gctccatttaaacaga

SEQ ID NO: 487725 - DNA, 15 bp, Homo sapiens
gctctaatgtttgca

SEQ ID NO: 487726 - DNA, 13 bp, Homo sapiens
gctcttatttcat

SEQ ID NO: 487727 - DNA, 16 bp, Homo sapiens
gctgctgtactgaagt

SEQ ID NO: 487728 - DNA, 20 bp, Homo sapiens
gctgtactgaagtaaaacaa

SEQ ID NO: 487729 - DNA, 13 bp, Homo sapiens
gctgttgttatga

SEQ ID NO: 487730 - DNA, 15 bp, Homo sapiens
gctgttgttatgatg

SEQ ID NO: 487731 - DNA, 17 bp, Homo sapiens
gctgttgttatgatgtg

SEQ ID NO: 487732 - DNA, 18 bp, Homo sapiens
gcttaaagaattcaaatt

SEQ ID NO: 487733 - DNA, 18 bp, Homo sapiens
gcttttggattggacaaa

SEQ ID NO: 487734 - DNA, 13 bp, Homo sapiens
ggaagtagttatc

SEQ ID NO: 487735 - DNA, 20 bp, Homo sapiens
ggatccacgacgcttaaata

SEQ ID NO: 487736 - DNA, 24 bp, Homo sapiens
ggcattagctaaaaccttccatgt

SEQ ID NO: 487737 - DNA, 22 bp, Homo sapiens
ggcttgagtttaaattgtaata

SEQ ID NO: 487738 - DNA, 16 bp, Homo sapiens
gggcaaattggagaaa

SEQ ID NO: 487739 - DNA, 19 bp, Homo sapiens
ggtatatctaggtttatga

SEQ ID NO: 487740 - DNA, 21 bp, Homo sapiens
ggtatatctaggtttatgaca

SEQ ID NO: 487741 - DNA, 21 bp, Homo sapiens
ggtttatgacagtaattgtgt

SEQ ID NO: 487742 - DNA, 17 bp, Homo sapiens
gtaaatgtctcactgag

SEQ ID NO: 487743 - DNA, 19 bp, Homo sapiens
gtaaatgtctcactgagca

SEQ ID NO: 487744 - DNA, 16 bp, Homo sapiens
gtaactaactaaaaca

SEQ ID NO: 487745 - DNA, 21 bp, Homo sapiens
gtaatacctctaatagtataa

SEQ ID NO: 487746 - DNA, 18 bp, Homo sapiens
gtaatttggatctcttct

SEQ ID NO: 487747 - DNA, 15 bp, Homo sapiens
gtactgattcaattt

SEQ ID NO: 487748 - DNA, 13 bp, Homo sapiens
gtactgcattatt

SEQ ID NO: 487749 - DNA, 15 bp, Homo sapiens
gtactgcattatttg

SEQ ID NO: 487750 - DNA, 22 bp, Homo sapiens
gtactgtatgatcaaatgttta

SEQ ID NO: 487751 - DNA, 15 bp, Homo sapiens
gtatgatcaaatgtt

SEQ ID NO: 487752 - DNA, 16 bp, Homo sapiens
gtatgatcaaatgttt

SEQ ID NO: 487753 - DNA, 22 bp, Homo sapiens
gtatgatcaaatgtttaatcat

SEQ ID NO: 487754 - DNA, 15 bp, Homo sapiens
gtattgacaaaatgt

SEQ ID NO: 487755 - DNA, 18 bp, Homo sapiens
gtattgacaaaatgttat

SEQ ID NO: 487756 - DNA, 19 bp, Homo sapiens
gtattgacaaaatgttatt

SEQ ID NO: 487757 - DNA, 16 bp, Homo sapiens
gtcaagattcagctag

SEQ ID NO: 487758 - DNA, 15 bp, Homo sapiens
gtcagattcttgcat

SEQ ID NO: 487759 - DNA, 18 bp, Homo sapiens
gtcgtcaaagctgaaatg

SEQ ID NO: 487760 - DNA, 20 bp, Homo sapiens
gtctgttttaaaaacctgtt

SEQ ID NO: 487761 - DNA, 19 bp, Homo sapiens
gtcttatatattgtagata

SEQ ID NO: 487762 - DNA, 19 bp, Homo sapiens
gtgaaagaaaataacaata

SEQ ID NO: 487763 - DNA, 23 bp, Homo sapiens
gtgatttttttttttttcctgtc

SEQ ID NO: 487764 - DNA, 14 bp, Homo sapiens
gtgctgttgttatg

SEQ ID NO: 487765 - DNA, 17 bp, Homo sapiens
gtgctgttgttatgatg

SEQ ID NO: 487766 - DNA, 14 bp, Homo sapiens
gtgttggtctgtac

SEQ ID NO: 487767 - DNA, 21 bp, Homo sapiens
gttactccaaaacttcgttta

SEQ ID NO: 487768 - DNA, 14 bp, Homo sapiens
gttagtaatacctc

SEQ ID NO: 487769 - DNA, 12 bp, Homo sapiens
gttatcatgtta

SEQ ID NO: 487770 - DNA, 22 bp, Homo sapiens
gttatcatgttagtaatacctc

SEQ ID NO: 487771 - DNA, 17 bp, Homo sapiens
gttatctgtttgagaaa

SEQ ID NO: 487772 - DNA, 20 bp, Homo sapiens
gttattatatttacaaatgg

SEQ ID NO: 487773 - DNA, 18 bp, Homo sapiens
gttattatgattagcttt

SEQ ID NO: 487774 - DNA, 15 bp, Homo sapiens
gttcctgtgcacagc

SEQ ID NO: 487775 - DNA, 10 bp, Homo sapiens
gttgcacagc

SEQ ID NO: 487776 - DNA, 16 bp, Homo sapiens
gttgcacagcatctca

SEQ ID NO: 487777 - DNA, 19 bp, Homo sapiens
gttgcacagcatctcagct

SEQ ID NO: 487778 - DNA, 14 bp, Homo sapiens
gttgttatctgttt

SEQ ID NO: 487779 - DNA, 15 bp, Homo sapiens
gttgttatgatgtgc

SEQ ID NO: 487780 - DNA, 15 bp, Homo sapiens
gtttacattttatgg

SEQ ID NO: 487781 - DNA, 15 bp, Homo sapiens
gtttagctgacaaaa

SEQ ID NO: 487782 - DNA, 17 bp, Homo sapiens
gttttaaaaacctgttc

SEQ ID NO: 487783 - DNA, 17 bp, Homo sapiens
gttttcctctcaataaa

SEQ ID NO: 487784 - DNA, 14 bp, Homo sapiens
gttttctagtgtat

SEQ ID NO: 487785 - DNA, 21 bp, Homo sapiens
gtttttatttcctatgatgta

SEQ ID NO: 487786 - DNA, 22 bp, Homo sapiens
taaaacaagcactaaacaaaga

SEQ ID NO: 487787 - DNA, 22 bp, Homo sapiens
taaaaccttccatgtcaagatt

SEQ ID NO: 487788 - DNA, 20 bp, Homo sapiens
taaaagacagtgaaagaaaa

SEQ ID NO: 487789 - DNA, 18 bp, Homo sapiens
taaaagtgtccattgaaa

SEQ ID NO: 487790 - DNA, 15 bp, Homo sapiens
taaaattatagctct

SEQ ID NO: 487791 - DNA, 18 bp, Homo sapiens
taaaattatagctctaat

SEQ ID NO: 487792 - DNA, 21 bp, Homo sapiens
taaaattatagctctaatgtt

SEQ ID NO: 487793 - DNA, 16 bp, Homo sapiens
taaacagatgtccatc

SEQ ID NO: 487794 - DNA, 14 bp, Homo sapiens
taaaccattgtgca

SEQ ID NO: 487795 - DNA, 12 bp, Homo sapiens
taaatcatttta

SEQ ID NO: 487796 - DNA, 15 bp, Homo sapiens
taaatcattttatgt

SEQ ID NO: 487797 - DNA, 19 bp, Homo sapiens
taaatcattttatgtcaag

SEQ ID NO: 487798 - DNA, 23 bp, Homo sapiens
taacagggaacgtgattagtgaa

SEQ ID NO: 487799 - DNA, 20 bp, Homo sapiens
taactaaaacaaagccactt

SEQ ID NO: 487800 - DNA, 11 bp, Homo sapiens
taactgacaag

SEQ ID NO: 487801 - DNA, 22 bp, Homo sapiens
taactgacaagctccatttaaa

SEQ ID NO: 487802 - DNA, 23 bp, Homo sapiens
taatacctctaatagtataaacc

SEQ ID NO: 487803 - DNA, 14 bp, Homo sapiens
taatagtataaacc

SEQ ID NO: 487804 - DNA, 12 bp, Homo sapiens
taatgaatacct

SEQ ID NO: 487805 - DNA, 13 bp, Homo sapiens
taatgaatacctt

SEQ ID NO: 487806 - DNA, 20 bp, Homo sapiens
taatgaataccttagtgcag

SEQ ID NO: 487807 - DNA, 13 bp, Homo sapiens
taattgtgtttac

SEQ ID NO: 487808 - DNA, 20 bp, Homo sapiens
tacagcaaatcctttgtgaa

SEQ ID NO: 487809 - DNA, 15 bp, Homo sapiens
tacagctgagctatg

SEQ ID NO: 487810 - DNA, 14 bp, Homo sapiens
tacaggatttgaaa

SEQ ID NO: 487811 - DNA, 16 bp, Homo sapiens
tacattcttcaagatc

SEQ ID NO: 487812 - DNA, 18 bp, Homo sapiens
atagataggtcagtgcaa

SEQ ID NO: 487813 - DNA, 17 bp, Homo sapiens
atagctactaattttaa

SEQ ID NO: 487814 - DNA, 20 bp, Homo sapiens
atagctctaatgtttgcata

SEQ ID NO: 487815 - DNA, 17 bp, Homo sapiens
ataggcgtaactaattt

SEQ ID NO: 487816 - DNA, 15 bp, Homo sapiens
ataggtttaataatt

SEQ ID NO: 487817 - DNA, 21 bp, Homo sapiens
atagtgctaacatgaagacct

SEQ ID NO: 487818 - DNA, 22 bp, Homo sapiens
atagtgctaacatgaagacctt

SEQ ID NO: 487819 - DNA, 14 bp, Homo sapiens
atataagggaagta

SEQ ID NO: 487820 - DNA, 18 bp, Homo sapiens
atatctaggtttatgaca

SEQ ID NO: 487821 - DNA, 21 bp, Homo sapiens
atatctaggtttatgacagta

SEQ ID NO: 487822 - DNA, 23 bp, Homo sapiens
atatctaggtttatgacagtaat

SEQ ID NO: 487823 - DNA, 20 bp, Homo sapiens
atatgcaaacagggtaacta

SEQ ID NO: 487824 - DNA, 13 bp, Homo sapiens
atattaagaatga

SEQ ID NO: 487825 - DNA, 18 bp, Homo sapiens
atattgctgaatgcaaga

SEQ ID NO: 487826 - DNA, 19 bp, Homo sapiens
atatttcccatgatttcat

SEQ ID NO: 487827 - DNA, 23 bp, Homo sapiens
atcaaaatgctcttatttcatca

SEQ ID NO: 487828 - DNA, 13 bp, Homo sapiens
atcaaatgtttaa

SEQ ID NO: 487829 - DNA, 12 bp, Homo sapiens
atcagatgacaa

SEQ ID NO: 487830 - DNA, 22 bp, Homo sapiens
atcatgttagtaatacctctaa

SEQ ID NO: 487831 - DNA, 22 bp, Homo sapiens
atcattcacttcactgtgctgt

SEQ ID NO: 487832 - DNA, 22 bp, Homo sapiens
atccaattagcttatgttaact

SEQ ID NO: 487833 - DNA, 22 bp, Homo sapiens
atcctcttccatatggatccac

SEQ ID NO: 487834 - DNA, 21 bp, Homo sapiens
atcctgtaggaaggtactgta

SEQ ID NO: 487835 - DNA, 14 bp, Homo sapiens
atccttgaaggtat

SEQ ID NO: 487836 - DNA, 23 bp, Homo sapiens
atccttgaaggtatatctaggtt

SEQ ID NO: 487837 - DNA, 14 bp, Homo sapiens
atctaggtttatga

SEQ ID NO: 487838 - DNA, 17 bp, Homo sapiens
atctagttcccctgttt

SEQ ID NO: 487839 - DNA, 19 bp, Homo sapiens
atctagttcccctgtttat

SEQ ID NO: 487840 - DNA, 20 bp, Homo sapiens
atctagttcccctgtttatt

SEQ ID NO: 487841 - DNA, 17 bp, Homo sapiens
atctcttcttaatgtac

SEQ ID NO: 487842 - DNA, 15 bp, Homo sapiens
atctgcctctcttgt

SEQ ID NO: 487843 - DNA, 18 bp, Homo sapiens
atctgcctctcttgtaat

SEQ ID NO: 487844 - DNA, 16 bp, Homo sapiens
atcttataatttaaaa

SEQ ID NO: 487845 - DNA, 19 bp, Homo sapiens
atgaagacctttttctgca

SEQ ID NO: 487846 - DNA, 24 bp, Homo sapiens
atgaagacctttttctgcactata

SEQ ID NO: 487847 - DNA, 24 bp, Homo sapiens
atgaataccttagtgcagttattt

SEQ ID NO: 487848 - DNA, 21 bp, Homo sapiens
atgaatgcttaaagaattcaa

SEQ ID NO: 487849 - DNA, 21 bp, Homo sapiens
atgacaagaaaggctgctgta

SEQ ID NO: 487850 - DNA, 20 bp, Homo sapiens
atgacagtaattgtgtttac

SEQ ID NO: 487851 - DNA, 17 bp, Homo sapiens
atgactccatagacctt

SEQ ID NO: 487852 - DNA, 15 bp, Homo sapiens
atgcagaacaaatga

SEQ ID NO: 487853 - DNA, 15 bp, Homo sapiens
atgctcttatttcat

SEQ ID NO: 487854 - DNA, 22 bp, Homo sapiens
atggatccactggctggacaaa

SEQ ID NO: 487855 - DNA, 16 bp, Homo sapiens
atggtgcctagtattg

SEQ ID NO: 487856 - DNA, 19 bp, Homo sapiens
atggtgcctagtattgaca

SEQ ID NO: 487857 - DNA, 21 bp, Homo sapiens
atggtgcctagtattgacaaa

SEQ ID NO: 487858 - DNA, 18 bp, Homo sapiens
atgtaaatgtctcactga

SEQ ID NO: 487859 - DNA, 17 bp, Homo sapiens
atgtacatagtgctaac

SEQ ID NO: 487860 - DNA, 15 bp, Homo sapiens
atgtatactgccact

SEQ ID NO: 487861 - DNA, 23 bp, Homo sapiens
atgtcgtcaaagctgaaatggac

SEQ ID NO: 487862 - DNA, 18 bp, Homo sapiens
attagataaatgtccatt

SEQ ID NO: 487863 - DNA, 17 bp, Homo sapiens
attagccagtaatcctg

SEQ ID NO: 487864 - DNA, 19 bp, Homo sapiens
attagccagtaatcctgta

SEQ ID NO: 487865 - DNA, 13 bp, Homo sapiens
attagcttatgtt

SEQ ID NO: 487866 - DNA, 21 bp, Homo sapiens
attagcttatgttaactgaca

SEQ ID NO: 487867 - DNA, 18 bp, Homo sapiens
attataagggcaaattgg

SEQ ID NO: 487868 - DNA, 23 bp, Homo sapiens
attataagggcaaattggagaaa

SEQ ID NO: 487869 - DNA, 12 bp, Homo sapiens
attatagctcta

SEQ ID NO: 487870 - DNA, 19 bp, Homo sapiens
attatagctctaatgtttg

SEQ ID NO: 487871 - DNA, 17 bp, Homo sapiens
attatatttacaaatgg

SEQ ID NO: 487872 - DNA, 21 bp, Homo sapiens
attatttgagaagctgctcaa

SEQ ID NO: 487873 - DNA, 12 bp, Homo sapiens
attcaagattcc

SEQ ID NO: 487874 - DNA, 15 bp, Homo sapiens
attcacttcactgtg

SEQ ID NO: 487875 - DNA, 20 bp, Homo sapiens
attcacttcactgtgctgtt

SEQ ID NO: 487876 - DNA, 16 bp, Homo sapiens
attcatatgcatattt

SEQ ID NO: 487877 - DNA, 18 bp, Homo sapiens
attcatatgcatattttt

SEQ ID NO: 487878 - DNA, 17 bp, Homo sapiens
attccaagtgattgaaa

SEQ ID NO: 487879 - DNA, 14 bp, Homo sapiens
attgacaaaatgtt

SEQ ID NO: 487880 - DNA, 19 bp, Homo sapiens
attggacagtaaaatccac

SEQ ID NO: 487881 - DNA, 15 bp, Homo sapiens
attgtattacaaatc

SEQ ID NO: 487882 - DNA, 13 bp, Homo sapiens
attgtgctagtgc

SEQ ID NO: 487883 - DNA, 19 bp, Homo sapiens
attgtgtttacattttatg

SEQ ID NO: 487884 - DNA, 22 bp, Homo sapiens
attgtgtttacattttatggtg

SEQ ID NO: 487885 - DNA, 16 bp, Homo sapiens
atttacaaatgggaaa

SEQ ID NO: 487886 - DNA, 19 bp, Homo sapiens
atttacccaactctgtaca

SEQ ID NO: 487887 - DNA, 18 bp, Homo sapiens
atttagttgttgtagaga

SEQ ID NO: 487888 - DNA, 12 bp, Homo sapiens
atttcatgtact

SEQ ID NO: 487889 - DNA, 16 bp, Homo sapiens
atttcatgtactgcat

SEQ ID NO: 487890 - DNA, 14 bp, Homo sapiens
atttcctatgatgt

SEQ ID NO: 487891 - DNA, 20 bp, Homo sapiens
atttcttgaggtaaaagcat

SEQ ID NO: 487892 - DNA, 20 bp, Homo sapiens
atttgatgtggtgaaaagca

SEQ ID NO: 487893 - DNA, 21 bp, Homo sapiens
atttgtgggtttttatttcct

SEQ ID NO: 487894 - DNA, 19 bp, Homo sapiens
attttatagctactaattt

SEQ ID NO: 487895 - DNA, 13 bp, Homo sapiens
attttcactgtgt

SEQ ID NO: 487896 - DNA, 16 bp, Homo sapiens
attttctgcatctcca

SEQ ID NO: 487897 - DNA, 19 bp, Homo sapiens
attttctgcatctccactt

SEQ ID NO: 487898 - DNA, 20 bp, Homo sapiens
atttttatcagttacacatg

SEQ ID NO: 487899 - DNA, 22 bp, Homo sapiens
atttttgtgattttgtgattga

SEQ ID NO: 487900 - DNA, 18 bp, Homo sapiens
caaaatgttatttcccta

SEQ ID NO: 487901 - DNA, 22 bp, Homo sapiens
caaaattagccagtaatcctgt

SEQ ID NO: 487902 - DNA, 18 bp, Homo sapiens
caaagtcaggaatcatca

SEQ ID NO: 487903 - DNA, 15 bp, Homo sapiens
caacttgcaaaatca

SEQ ID NO: 487904 - DNA, 18 bp, Homo sapiens
caacttgcaaaatcagtt

SEQ ID NO: 487905 - DNA, 20 bp, Homo sapiens
caacttgcaaaatcagtttt

SEQ ID NO: 487906 - DNA, 17 bp, Homo sapiens
caagcactaaacaaaga

SEQ ID NO: 487907 - DNA, 11 bp, Homo sapiens
caagggcagct

SEQ ID NO: 487908 - DNA, 15 bp, Homo sapiens
caagtgtaatgaata

SEQ ID NO: 487909 - DNA, 18 bp, Homo sapiens
caagtgtaatgaatacct

SEQ ID NO: 487910 - DNA, 13 bp, Homo sapiens
caagtttcatcca

SEQ ID NO: 487911 - DNA, 13 bp, Homo sapiens
caataaaattata

SEQ ID NO: 487912 - DNA, 17 bp, Homo sapiens
caatacctgaatgctct

SEQ ID NO: 487913 - DNA, 15 bp, Homo sapiens
caatcttcaatcctt

SEQ ID NO: 487914 - DNA, 18 bp, Homo sapiens
caatcttcaatccttgaa

SEQ ID NO: 487915 - DNA, 20 bp, Homo sapiens
caatttagttgttgtagaga

SEQ ID NO: 487916 - DNA, 13 bp, Homo sapiens
caatttatacctc

SEQ ID NO: 487917 - DNA, 14 bp, Homo sapiens
caatttatacctca

SEQ ID NO: 487918 - DNA, 17 bp, Homo sapiens
cacaagtgtaatgaata

SEQ ID NO: 487919 - DNA, 17 bp, Homo sapiens
cacacgagaacctgaag

SEQ ID NO: 487920 - DNA, 16 bp, Homo sapiens
cacagcatctcagctc

SEQ ID NO: 487921 - DNA, 19 bp, Homo sapiens
cactcgaggtcgggcagca

SEQ ID NO: 487922 - DNA, 17 bp, Homo sapiens
cactgtgctgttgttat

SEQ ID NO: 487923 - DNA, 20 bp, Homo sapiens
cactgtgctgttgttatgat

SEQ ID NO: 487924 - DNA, 22 bp, Homo sapiens
cactgtttcactactcagcatg

SEQ ID NO: 487925 - DNA, 21 bp, Homo sapiens
cactttcaatcttcaatcctt

SEQ ID NO: 487926 - DNA, 16 bp, Homo sapiens
cagaacaaatgaagac

SEQ ID NO: 487927 - DNA, 16 bp, Homo sapiens
cagatgtccatcagat

SEQ ID NO: 487928 - DNA, 16 bp, Homo sapiens
cagcaaatcctttgtg

SEQ ID NO: 487929 - DNA, 16 bp, Homo sapiens
cagctttgctcatatt

SEQ ID NO: 487930 - DNA, 22 bp, Homo sapiens
cagggtaactaactaaaacaaa

SEQ ID NO: 487931 - DNA, 13 bp, Homo sapiens
caggttgataaat

SEQ ID NO: 487932 - DNA, 18 bp, Homo sapiens
caggttgataaatcattt

SEQ ID NO: 487933 - DNA, 21 bp, Homo sapiens
cagtaatcctgtaggaaggta

SEQ ID NO: 487934 - DNA, 20 bp, Homo sapiens
cagtatcggcactgtacaaa

SEQ ID NO: 487935 - DNA, 18 bp, Homo sapiens
cagttcttcgactgttgt

SEQ ID NO: 487936 - DNA, 12 bp, Homo sapiens
cagttgcacagc

SEQ ID NO: 487937 - DNA, 13 bp, Homo sapiens
cagttgcacagca

SEQ ID NO: 487938 - DNA, 18 bp, Homo sapiens
cagttgcacagcatctca

SEQ ID NO: 487939 - DNA, 22 bp, Homo sapiens
cagttgcacagcatctcagctc

SEQ ID NO: 487940 - DNA, 17 bp, Homo sapiens
cataactaatacagctg

SEQ ID NO: 487941 - DNA, 22 bp, Homo sapiens
cataactaatacagctgagcta

SEQ ID NO: 487942 - DNA, 18 bp, Homo sapiens
catacattcttcaagatc

SEQ ID NO: 487943 - DNA, 17 bp, Homo sapiens
catagaccttttcattt

SEQ ID NO: 487944 - DNA, 20 bp, Homo sapiens
catagtgctaacatgaagac

SEQ ID NO: 487945 - DNA, 15 bp, Homo sapiens
catataaatagaatg

SEQ ID NO: 487946 - DNA, 20 bp, Homo sapiens
catataaatagaatgtaaat

SEQ ID NO: 487947 - DNA, 23 bp, Homo sapiens
catataagggaagtagttatcat

SEQ ID NO: 487948 - DNA, 17 bp, Homo sapiens
catatggatccactggc

SEQ ID NO: 487949 - DNA, 13 bp, Homo sapiens
catattaagaatg

SEQ ID NO: 487950 - DNA, 22 bp, Homo sapiens
catatttcccatgatttcatgt

SEQ ID NO: 487951 - DNA, 20 bp, Homo sapiens
catcattcacttcactgtgc

SEQ ID NO: 487952 - DNA, 21 bp, Homo sapiens
catctagttcccctgtttatt

SEQ ID NO: 487953 - DNA, 21 bp, Homo sapiens
catctcagctcatcttcactg

SEQ ID NO: 487954 - DNA, 17 bp, Homo sapiens
catgatttcatgtactg

SEQ ID NO: 487955 - DNA, 20 bp, Homo sapiens
catgcagaacaaatgaagac

SEQ ID NO: 487956 - DNA, 22 bp, Homo sapiens
catgtactgcattatttgagaa

SEQ ID NO: 487957 - DNA, 19 bp, Homo sapiens
catgtcaagattcagctag

SEQ ID NO: 487958 - DNA, 16 bp, Homo sapiens
catgttagtaatacct

SEQ ID NO: 487959 - DNA, 19 bp, Homo sapiens
catgttagtaatacctcta

SEQ ID NO: 487960 - DNA, 24 bp, Homo sapiens
catgttagtaatacctctaatagt

SEQ ID NO: 487961 - DNA, 15 bp, Homo sapiens
cattccttgctgaaa

SEQ ID NO: 487962 - DNA, 21 bp, Homo sapiens
cattctagagtgcatatattt

SEQ ID NO: 487963 - DNA, 16 bp, Homo sapiens
cattgtgcattctaga

SEQ ID NO: 487964 - DNA, 13 bp, Homo sapiens
catttgtaggtag

SEQ ID NO: 487965 - DNA, 17 bp, Homo sapiens
catttgtgggtttttat

SEQ ID NO: 487966 - DNA, 18 bp, Homo sapiens
catttgttcatattaaga

SEQ ID NO: 487967 - DNA, 20 bp, Homo sapiens
catttgttcatattaagaat

SEQ ID NO: 487968 - DNA, 16 bp, Homo sapiens
cattttctgcatctcc

SEQ ID NO: 487969 - DNA, 17 bp, Homo sapiens
ccacacgagaacctgaa

SEQ ID NO: 487970 - DNA, 16 bp, Homo sapiens
ccactggctggacaaa

SEQ ID NO: 487971 - DNA, 24 bp, Homo sapiens
ccactttcaatcttcaatccttga

SEQ ID NO: 487972 - DNA, 22 bp, Homo sapiens
ccagcaccggccccatttaccc

SEQ ID NO: 487973 - DNA, 13 bp, Homo sapiens
tactgtatgatca

SEQ ID NO: 487974 - DNA, 15 bp, Homo sapiens
tacttagtattgcaa

SEQ ID NO: 487975 - DNA, 20 bp, Homo sapiens
tacttagtattgcaaagtca

SEQ ID NO: 487976 - DNA, 15 bp, Homo sapiens
tagaatgtaaatgtc

SEQ ID NO: 487977 - DNA, 19 bp, Homo sapiens
tagagaaaacatgcagaac

SEQ ID NO: 487978 - DNA, 17 bp, Homo sapiens
tagccagtaatcctgta

SEQ ID NO: 487979 - DNA, 16 bp, Homo sapiens
taggtcagtgcaaata

SEQ ID NO: 487980 - DNA, 21 bp, Homo sapiens
taggtttatgacagtaattgt

SEQ ID NO: 487981 - DNA, 14 bp, Homo sapiens
tagtattgacaaaa

SEQ ID NO: 487982 - DNA, 17 bp, Homo sapiens
tagtattgacaaaatgt

SEQ ID NO: 487983 - DNA, 16 bp, Homo sapiens
tagtattgcaaagtca

SEQ ID NO: 487984 - DNA, 21 bp, Homo sapiens
tagtgaaaggaagataaacgt

SEQ ID NO: 487985 - DNA, 16 bp, Homo sapiens
tagtgcagttatttgc

SEQ ID NO: 487986 - DNA, 19 bp, Homo sapiens
tagtgtatcaaaatgctct

SEQ ID NO: 487987 - DNA, 11 bp, Homo sapiens
tagttatcatg

SEQ ID NO: 487988 - DNA, 23 bp, Homo sapiens
tagttatcatgttagtaatacct

SEQ ID NO: 487989 - DNA, 16 bp, Homo sapiens
tagttcccctgtttat

SEQ ID NO: 487990 - DNA, 19 bp, Homo sapiens
tagttcccctgtttattca

SEQ ID NO: 487991 - DNA, 14 bp, Homo sapiens
tataaatagaatgt

SEQ ID NO: 487992 - DNA, 16 bp, Homo sapiens
tataaatagaatgtaa

SEQ ID NO: 487993 - DNA, 22 bp, Homo sapiens
tataaatagaatgtaaatgtct

SEQ ID NO: 487994 - DNA, 21 bp, Homo sapiens
tataagggaagtagttatcat

SEQ ID NO: 487995 - DNA, 14 bp, Homo sapiens
tatagctctaatgt

SEQ ID NO: 487996 - DNA, 18 bp, Homo sapiens
tatagctctaatgtttgc

SEQ ID NO: 487997 - DNA, 20 bp, Homo sapiens
tatatactcaagagtggtat

SEQ ID NO: 487998 - DNA, 17 bp, Homo sapiens
tatctaggtttatgaca

SEQ ID NO: 487999 - DNA, 16 bp, Homo sapiens
tatctgcctctcttgt

SEQ ID NO: 488000 - DNA, 18 bp, Homo sapiens
tatgacagtaattgtgtt

SEQ ID NO: 488001 - DNA, 18 bp, Homo sapiens
gatcaaatgtttaatcat

SEQ ID NO: 488002 - DNA, 20 bp, Homo sapiens
gatcaaatgtttaatcatat

SEQ ID NO: 488003 - DNA, 13 bp, Homo sapiens
gatccactggctg

SEQ ID NO: 488004 - DNA, 21 bp, Homo sapiens
gatctcttcttaatgtacata

SEQ ID NO: 488005 - DNA, 22 bp, Homo sapiens
gatgcagtgccaggaaccctta

SEQ ID NO: 488006 - DNA, 17 bp, Homo sapiens
gatgttactccaaaact

SEQ ID NO: 488007 - DNA, 14 bp, Homo sapiens
gattggacaaaatg

SEQ ID NO: 488008 - DNA, 16 bp, Homo sapiens
gatttcatgtactgca

SEQ ID NO: 488009 - DNA, 21 bp, Homo sapiens
gatttcatgtactgcattatt

SEQ ID NO: 488010 - DNA, 21 bp, Homo sapiens
gatttttttttttttcctgtc

SEQ ID NO: 488011 - DNA, 18 bp, Homo sapiens
gcaaatcctttgtgaaaa

SEQ ID NO: 488012 - DNA, 15 bp, Homo sapiens
gcaaattggagaaaa

SEQ ID NO: 488013 - DNA, 19 bp, Homo sapiens
gcacaagtgtaatgaatac

SEQ ID NO: 488014 - DNA, 18 bp, Homo sapiens
gcacagcatctcagctca

SEQ ID NO: 488015 - DNA, 22 bp, Homo sapiens
gcaccagttgctgcttcaattt

SEQ ID NO: 488016 - DNA, 15 bp, Homo sapiens
gcactatatgcaaac

SEQ ID NO: 488017 - DNA, 19 bp, Homo sapiens
gcactgttttctagtgtat

SEQ ID NO: 488018 - DNA, 20 bp, Homo sapiens
gcactgttttctagtgtatc

SEQ ID NO: 488019 - DNA, 20 bp, Homo sapiens
gcagtatcggcactgtacaa

SEQ ID NO: 488020 - DNA, 15 bp, Homo sapiens
gcatataagggaagt

SEQ ID NO: 488021 - DNA, 15 bp, Homo sapiens
gcattagctaaaacc

SEQ ID NO: 488022 - DNA, 17 bp, Homo sapiens
gcattttctgcatctcc

SEQ ID NO: 488023 - DNA, 14 bp, Homo sapiens
gccagtaatcctgt

SEQ ID NO: 488024 - DNA, 13 bp, Homo sapiens
gctaacatgaaga

SEQ ID NO: 488025 - DNA, 22 bp, Homo sapiens
gctaacatgaagacctttttct

SEQ ID NO: 488026 - DNA, 19 bp, Homo sapiens
gctccatttaaacagatgt

SEQ ID NO: 488027 - DNA, 20 bp, Homo sapiens
gctccatttttagtgaaata

SEQ ID NO: 488028 - DNA, 17 bp, Homo sapiens
gctctaatgtttgcata

SEQ ID NO: 488029 - DNA, 19 bp, Homo sapiens
gctggacaaactgcaccag

SEQ ID NO: 488030 - DNA, 19 bp, Homo sapiens
gctgttgttatgatgtgct

SEQ ID NO: 488031 - DNA, 15 bp, Homo sapiens
gcttatattgttcac

SEQ ID NO: 488032 - DNA, 17 bp, Homo sapiens
ggaacggatcagatgtc

SEQ ID NO: 488033 - DNA, 19 bp, Homo sapiens
ggaaggtactgtatgatca

SEQ ID NO: 488034 - DNA, 19 bp, Homo sapiens
ggaagtagttatcatgtta

SEQ ID NO: 488035 - DNA, 11 bp, Homo sapiens
ggacaaactgc

SEQ ID NO: 488036 - DNA, 20 bp, Homo sapiens
ggcagacattgtgctagtgc

SEQ ID NO: 488037 - DNA, 15 bp, Homo sapiens
ggcagctttgctcat

SEQ ID NO: 488038 - DNA, 22 bp, Homo sapiens
ggccaagagatgcagtgccagg

SEQ ID NO: 488039 - DNA, 18 bp, Homo sapiens
gggaagtagttatcatgt

SEQ ID NO: 488040 - DNA, 20 bp, Homo sapiens
gggaagtagttatcatgtta

SEQ ID NO: 488041 - DNA, 16 bp, Homo sapiens
ggggcagcagcagtgg

SEQ ID NO: 488042 - DNA, 20 bp, Homo sapiens
ggtactgtatgatcaaatgt

SEQ ID NO: 488043 - DNA, 21 bp, Homo sapiens
ggtactgtatgatcaaatgtt

SEQ ID NO: 488044 - DNA, 14 bp, Homo sapiens
ggtcagtgcaaata

SEQ ID NO: 488045 - DNA, 17 bp, Homo sapiens
ggtgcctagtattgaca

SEQ ID NO: 488046 - DNA, 19 bp, Homo sapiens
gtaaaacaaacaatacctg

SEQ ID NO: 488047 - DNA, 22 bp, Homo sapiens
gtaatacctctaatagtataaa

SEQ ID NO: 488048 - DNA, 12 bp, Homo sapiens
gtaatcctgtag

SEQ ID NO: 488049 - DNA, 14 bp, Homo sapiens
gtaatgaatacctt

SEQ ID NO: 488050 - DNA, 13 bp, Homo sapiens
gtaattgtgttta

SEQ ID NO: 488051 - DNA, 15 bp, Homo sapiens
gtaattgtgtttaca

SEQ ID NO: 488052 - DNA, 17 bp, Homo sapiens
gtaattgtgtttacatt

SEQ ID NO: 488053 - DNA, 18 bp, Homo sapiens
gtaattgtgtttacattt

SEQ ID NO: 488054 - DNA, 15 bp, Homo sapiens
tgactaaaccattgt

SEQ ID NO: 488055 - DNA, 22 bp, Homo sapiens
tgacttgaagacttacagcaaa

SEQ ID NO: 488056 - DNA, 13 bp, Homo sapiens
tgagaagctgctc

SEQ ID NO: 488057 - DNA, 14 bp, Homo sapiens
tgagcactgttttc

SEQ ID NO: 488058 - DNA, 21 bp, Homo sapiens
tgagcactgttttctagtgta

SEQ ID NO: 488059 - DNA, 16 bp, Homo sapiens
tgagcagtgttagctt

SEQ ID NO: 488060 - DNA, 13 bp, Homo sapiens
tgagctacaaatg

SEQ ID NO: 488061 - DNA, 22 bp, Homo sapiens
tgagtaactgatttgtaacaag

SEQ ID NO: 488062 - DNA, 15 bp, Homo sapiens
tgatcaaatgtttaa

SEQ ID NO: 488063 - DNA, 16 bp, Homo sapiens
tgatcaaatgtttaat

SEQ ID NO: 488064 - DNA, 19 bp, Homo sapiens
tgattagctttgtcactgt

SEQ ID NO: 488065 - DNA, 13 bp, Homo sapiens
tgatttcatgtac

SEQ ID NO: 488066 - DNA, 16 bp, Homo sapiens
tgatttcatgtactgc

SEQ ID NO: 488067 - DNA, 15 bp, Homo sapiens
tgcaaaatcagtttt

SEQ ID NO: 488068 - DNA, 17 bp, Homo sapiens
tgcaatacaagtttcat

SEQ ID NO: 488069 - DNA, 24 bp, Homo sapiens
tgcacagcccctaagtcaacttag

SEQ ID NO: 488070 - DNA, 16 bp, Homo sapiens
tgcactatatgcaaac

SEQ ID NO: 488071 - DNA, 20 bp, Homo sapiens
tgcagtatcggcactgtaca

SEQ ID NO: 488072 - DNA, 14 bp, Homo sapiens
tgcagttatttgct

SEQ ID NO: 488073 - DNA, 20 bp, Homo sapiens
tgcatacattcttcaagatc

SEQ ID NO: 488074 - DNA, 18 bp, Homo sapiens
tgcctagtattgacaaaa

SEQ ID NO: 488075 - DNA, 16 bp, Homo sapiens
tgctcaacttgcaaaa

SEQ ID NO: 488076 - DNA, 20 bp, Homo sapiens
tgctcaacttgcaaaatcag

SEQ ID NO: 488077 - DNA, 14 bp, Homo sapiens
tgctcatatttccc

SEQ ID NO: 488078 - DNA, 14 bp, Homo sapiens
tgctctgtagccta

SEQ ID NO: 488079 - DNA, 16 bp, Homo sapiens
tgctgttgttatgatg

SEQ ID NO: 488080 - DNA, 22 bp, Homo sapiens
tgctgttgttatgatgtgctta

SEQ ID NO: 488081 - DNA, 18 bp, Homo sapiens
tgcttaaagaattcaaat

SEQ ID NO: 488082 - DNA, 14 bp, Homo sapiens
tggacaaaatgact

SEQ ID NO: 488083 - DNA, 14 bp, Homo sapiens
tggagttgaaaatc

SEQ ID NO: 488084 - DNA, 21 bp, Homo sapiens
tggatccactggctggacaaa

SEQ ID NO: 488085 - DNA, 20 bp, Homo sapiens
tggatctcttcttaatgtac

SEQ ID NO: 488086 - DNA, 13 bp, Homo sapiens
tggattggacaaa

SEQ ID NO: 488087 - DNA, 19 bp, Homo sapiens
tggattggacaaaatgact

SEQ ID NO: 488088 - DNA, 22 bp, Homo sapiens
tgggtttttatttcctatgatg

SEQ ID NO: 488089 - DNA, 15 bp, Homo sapiens
tggtgcctagtattg

SEQ ID NO: 488090 - DNA, 19 bp, Homo sapiens
tggtgcctagtattgacaa

SEQ ID NO: 488091 - DNA, 22 bp, Homo sapiens
tgtaaatgtctcactgagcact

SEQ ID NO: 488092 - DNA, 11 bp, Homo sapiens
tgtaatgaata

SEQ ID NO: 488093 - DNA, 17 bp, Homo sapiens
tgtacatagtgctaaca

SEQ ID NO: 488094 - DNA, 18 bp, Homo sapiens
tgtaccaaccatccaatt

SEQ ID NO: 488095 - DNA, 14 bp, Homo sapiens
tgtactgaagtaaa

SEQ ID NO: 488096 - DNA, 17 bp, Homo sapiens
tgtagagaaaacatgca

SEQ ID NO: 488097 - DNA, 22 bp, Homo sapiens
tgtaggttattatgattagctt

SEQ ID NO: 488098 - DNA, 13 bp, Homo sapiens
tgtatcaaaatgc

SEQ ID NO: 488099 - DNA, 14 bp, Homo sapiens
tgtatcaaaatgct

SEQ ID NO: 488100 - DNA, 15 bp, Homo sapiens
tgtatcaaaatgctc

SEQ ID NO: 488101 - DNA, 15 bp, Homo sapiens
tgtatgatcaaatgt

SEQ ID NO: 488102 - DNA, 16 bp, Homo sapiens
tgtatgatcaaatgtt

SEQ ID NO: 488103 - DNA, 19 bp, Homo sapiens
tgtatgatcaaatgtttaa

SEQ ID NO: 488104 - DNA, 16 bp, Homo sapiens
tgtcaagattcagcta

SEQ ID NO: 488105 - DNA, 16 bp, Homo sapiens
tgtccatcagatgaca

SEQ ID NO: 488106 - DNA, 14 bp, Homo sapiens
tgtctcactgagca

SEQ ID NO: 488107 - DNA, 14 bp, Homo sapiens
tgtgctgttgttat

SEQ ID NO: 488108 - DNA, 19 bp, Homo sapiens
tgtgctgttgttatgatgt

SEQ ID NO: 488109 - DNA, 20 bp, Homo sapiens
tgtgctgttgttatgatgtg

SEQ ID NO: 488110 - DNA, 20 bp, Homo sapiens
tgtgggtttttatttcctat

SEQ ID NO: 488111 - DNA, 21 bp, Homo sapiens
tgtgtttacattttatggtgc

SEQ ID NO: 488112 - DNA, 14 bp, Homo sapiens
tgttagtaatacct

SEQ ID NO: 488113 - DNA, 19 bp, Homo sapiens
tgttatctgtttgagaaag

SEQ ID NO: 488114 - DNA, 16 bp, Homo sapiens
tgttatgatgtgctta

SEQ ID NO: 488115 - DNA, 20 bp, Homo sapiens
tgttatttccctacattaaa

SEQ ID NO: 488116 - DNA, 23 bp, Homo sapiens
tgttatttccctacattaaacat

SEQ ID NO: 488117 - DNA, 16 bp, Homo sapiens
tgttggtctgtactga

SEQ ID NO: 488118 - DNA, 14 bp, Homo sapiens
tgttgtagagaaaa

SEQ ID NO: 488119 - DNA, 14 bp, Homo sapiens
tgtttaatcatata

SEQ ID NO: 488120 - DNA, 16 bp, Homo sapiens
tgttttctagtgtatc

SEQ ID NO: 488121 - DNA, 19 bp, Homo sapiens
tgttttctagtgtatcaaa

SEQ ID NO: 488122 - DNA, 20 bp, Homo sapiens
ttaaagaattcaaattttat

SEQ ID NO: 488123 - DNA, 17 bp, Homo sapiens
ttaatcatataaataga

SEQ ID NO: 488124 - DNA, 19 bp, Homo sapiens
ttaatcatataaatagaat

SEQ ID NO: 488125 - DNA, 20 bp, Homo sapiens
ttaatgaatgcttaaagaat

SEQ ID NO: 488126 - DNA, 14 bp, Homo sapiens
ttacattttatggt

SEQ ID NO: 488127 - DNA, 12 bp, Homo sapiens
ttagctgacaaa

SEQ ID NO: 488128 - DNA, 17 bp, Homo sapiens
ttagtaatacctctaat

SEQ ID NO: 488129 - DNA, 23 bp, Homo sapiens
ttagtgactaaaccattgtgcat

SEQ ID NO: 488130 - DNA, 18 bp, Homo sapiens
ttataagggcaaattgga

SEQ ID NO: 488131 - DNA, 14 bp, Homo sapiens
ttatacctcaattt

SEQ ID NO: 488132 - DNA, 17 bp, Homo sapiens
ttatagctctaatgttt

SEQ ID NO: 488133 - DNA, 17 bp, Homo sapiens
ttatattgttcacttct

SEQ ID NO: 488134 - DNA, 18 bp, Homo sapiens
ttatctgcctctcttgta

SEQ ID NO: 488135 - DNA, 21 bp, Homo sapiens
ttatctgcctctcttgtaatt

SEQ ID NO: 488136 - DNA, 15 bp, Homo sapiens
ttatgacagtaattg

SEQ ID NO: 488137 - DNA, 14 bp, Homo sapiens
ttatgatgtgctta

SEQ ID NO: 488138 - DNA, 15 bp, Homo sapiens
ttattcatatgcata

SEQ ID NO: 488139 - DNA, 16 bp, Homo sapiens
ttattcatatgcatat

SEQ ID NO: 488140 - DNA, 22 bp, Homo sapiens
ttatttcctatgatgtatactg

SEQ ID NO: 488141 - DNA, 18 bp, Homo sapiens
ttatttgagaagctgctc

SEQ ID NO: 488142 - DNA, 23 bp, Homo sapiens
ttattttttaaagaaatctattt

SEQ ID NO: 488143 - DNA, 11 bp, Homo sapiens
ttcaagattcc

SEQ ID NO: 488144 - DNA, 22 bp, Homo sapiens
ttcaatccttgaaggtatatct

SEQ ID NO: 488145 - DNA, 16 bp, Homo sapiens
ttcaatttatacctca

SEQ ID NO: 488146 - DNA, 15 bp, Homo sapiens
ttcactactcagcat

SEQ ID NO: 488147 - DNA, 12 bp, Homo sapiens
ttcactgtgctg

SEQ ID NO: 488148 - DNA, 23 bp, Homo sapiens
ttcagttattatatttacaaatg

SEQ ID NO: 488149 - DNA, 16 bp, Homo sapiens
ttcatattaagaatga

SEQ ID NO: 488150 - DNA, 22 bp, Homo sapiens
ttcatattaagaatgatctgat

SEQ ID NO: 488151 - DNA, 22 bp, Homo sapiens
ttccaaaaattacttagtattg

SEQ ID NO: 488152 - DNA, 17 bp, Homo sapiens
ttccaatttagttgttg

SEQ ID NO: 488153 - DNA, 22 bp, Homo sapiens
ttccatatggatccactggctg

SEQ ID NO: 488154 - DNA, 15 bp, Homo sapiens
ttccatgtcaagatt

SEQ ID NO: 488155 - DNA, 21 bp, Homo sapiens
ttccatgtcaagattcagcta

SEQ ID NO: 488156 - DNA, 13 bp, Homo sapiens
ttcccatgatttc

SEQ ID NO: 488157 - DNA, 18 bp, Homo sapiens
ttcccatgatttcatgta

SEQ ID NO: 488158 - DNA, 20 bp, Homo sapiens
ttcccatgatttcatgtact

SEQ ID NO: 488159 - DNA, 18 bp, Homo sapiens
ttcccctgtttattcata

SEQ ID NO: 488160 - DNA, 18 bp, Homo sapiens
ttcctcccattcaagatt

SEQ ID NO: 488161 - DNA, 16 bp, Homo sapiens
ttcgtttaatgaatgc

SEQ ID NO: 488162 - DNA, 14 bp, Homo sapiens
ttctataatttaaa

SEQ ID NO: 488163 - DNA, 21 bp, Homo sapiens
ttcttaatgtacatagtgcta

SEQ ID NO: 488164 - DNA, 12 bp, Homo sapiens
ttcttcaagatc

SEQ ID NO: 488165 - DNA, 14 bp, Homo sapiens
ttgacaaaatgtta

SEQ ID NO: 488166 - DNA, 21 bp, Homo sapiens
ttgacaaaatgttatttccct

SEQ ID NO: 488167 - DNA, 17 bp, Homo sapiens
ttgagaaagtcagattc

SEQ ID NO: 488168 - DNA, 13 bp, Homo sapiens
ttgagaagctgct

SEQ ID NO: 488169 - DNA, 16 bp, Homo sapiens
ttgagaagctgctcaa

SEQ ID NO: 488170 - DNA, 15 bp, Homo sapiens
ttgctgaatgcaaga

SEQ ID NO: 488171 - DNA, 23 bp, Homo sapiens
ttggatctcttcttaatgtacat

SEQ ID NO: 488172 - DNA, 14 bp, Homo sapiens
ttggtctgtactga

SEQ ID NO: 488173 - DNA, 18 bp, Homo sapiens
ttgtgtttacattttatg

SEQ ID NO: 488174 - DNA, 15 bp, Homo sapiens
ttgttatgatgtgct

SEQ ID NO: 488175 - DNA, 19 bp, Homo sapiens
tttatgacagtaattgtgt

SEQ ID NO: 488176 - DNA, 15 bp, Homo sapiens
tttattcatatgcat

SEQ ID NO: 488177 - DNA, 15 bp, Homo sapiens
tttcaatcttcaatc

SEQ ID NO: 488178 - DNA, 21 bp, Homo sapiens
tttcatcattcacttcactgt

SEQ ID NO: 488179 - DNA, 24 bp, Homo sapiens
tttcatcattcacttcactgtgct

SEQ ID NO: 488180 - DNA, 11 bp, Homo sapiens
tttcatgtact

SEQ ID NO: 488181 - DNA, 12 bp, Homo sapiens
tttcatgtactg

SEQ ID NO: 488182 - DNA, 15 bp, Homo sapiens
tttcatgtactgcat

SEQ ID NO: 488183 - DNA, 20 bp, Homo sapiens
tttcatgtactgcattattt

SEQ ID NO: 488184 - DNA, 16 bp, Homo sapiens
tttccacttcttcatt

SEQ ID NO: 488185 - DNA, 22 bp, Homo sapiens
tttcctgccttttagttcctgt

SEQ ID NO: 488186 - DNA, 16 bp, Homo sapiens
tttctagtgtatcaaa

SEQ ID NO: 488187 - DNA, 20 bp, Homo sapiens
tttctagtgtatcaaaatgc

SEQ ID NO: 488188 - DNA, 17 bp, Homo sapiens
tttctgcactatatgca

SEQ ID NO: 488189 - DNA, 20 bp, Homo sapiens
ttttacccatttgttcatat

SEQ ID NO: 488190 - DNA, 18 bp, Homo sapiens
ttttagttcctgtgcaca

SEQ ID NO: 488191 - DNA, 18 bp, Homo sapiens
ttttatttcctatgatgt

SEQ ID NO: 488192 - DNA, 13 bp, Homo sapiens
ttttctagtgtat

SEQ ID NO: 488193 - DNA, 18 bp, Homo sapiens
tttttctgcactatatgc

SEQ ID NO: 488194 - DNA, 15 bp, Homo sapiens
ttttttcctgtcata

SEQ ID NO: 488195 - DNA, 13 bp, Homo sapiens
ttttttttcctgt

SEQ ID NO: 488196 - DNA, 17 bp, Homo sapiens
actgcattatttgagaa

SEQ ID NO: 488197 - DNA, 13 bp, Homo sapiens
actgtatgatcaa

SEQ ID NO: 488198 - DNA, 21 bp, Homo sapiens
actgtatgatcaaatgtttaa

SEQ ID NO: 488199 - DNA, 22 bp, Homo sapiens
actgtatgatcaaatgtttaat

SEQ ID NO: 488200 - DNA, 23 bp, Homo sapiens
actgtgctgttgttatgatgtgc

SEQ ID NO: 488201 - DNA, 21 bp, Homo sapiens
actgtgtccaggtggtacttt

SEQ ID NO: 488202 - DNA, 17 bp, Homo sapiens
actgttttctagtgtat

SEQ ID NO: 488203 - DNA, 18 bp, Homo sapiens
actgttttctagtgtatc

SEQ ID NO: 488204 - DNA, 19 bp, Homo sapiens
actgttttctagtgtatca

SEQ ID NO: 488205 - DNA, 21 bp, Homo sapiens
actgttttctagtgtatcaaa

SEQ ID NO: 488206 - DNA, 21 bp, Homo sapiens
acttcactgtgctgttgttat

SEQ ID NO: 488207 - DNA, 22 bp, Homo sapiens
acttcactgtgctgttgttatg

SEQ ID NO: 488208 - DNA, 13 bp, Homo sapiens
acttgcaaaatca

SEQ ID NO: 488209 - DNA, 17 bp, Homo sapiens
acttgcaaaatcagttt

SEQ ID NO: 488210 - DNA, 18 bp, Homo sapiens
acttgcaaaatcagtttt

SEQ ID NO: 488211 - DNA, 20 bp, Homo sapiens
acttgtaaaggaatttaaaa

SEQ ID NO: 488212 - DNA, 12 bp, Homo sapiens
acttgtctgttt

SEQ ID NO: 488213 - DNA, 13 bp, Homo sapiens
acttgtctgtttt

SEQ ID NO: 488214 - DNA, 14 bp, Homo sapiens
agaatgatctgatt

SEQ ID NO: 488215 - DNA, 17 bp, Homo sapiens
agaatgatctgattgac

SEQ ID NO: 488216 - DNA, 23 bp, Homo sapiens
agagaaaacatgcagaacaaatg

SEQ ID NO: 488217 - DNA, 20 bp, Homo sapiens
agattaaccttctctgtccg

SEQ ID NO: 488218 - DNA, 15 bp, Homo sapiens
agcactgttttctag

SEQ ID NO: 488219 - DNA, 22 bp, Homo sapiens
agcactgttttctagtgtatca

SEQ ID NO: 488220 - DNA, 20 bp, Homo sapiens
agcatcacatgaacttgtaa

SEQ ID NO: 488221 - DNA, 20 bp, Homo sapiens
agccactttcaatcttcaat

SEQ ID NO: 488222 - DNA, 17 bp, Homo sapiens
agctcatcttcactgca

SEQ ID NO: 488223 - DNA, 15 bp, Homo sapiens
agctccatttaaaca

SEQ ID NO: 488224 - DNA, 14 bp, Homo sapiens
agctctaatgtttg

SEQ ID NO: 488225 - DNA, 20 bp, Homo sapiens
agctctaatgtttgcatata

SEQ ID NO: 488226 - DNA, 21 bp, Homo sapiens
agctctaatgtttgcatataa

SEQ ID NO: 488227 - DNA, 16 bp, Homo sapiens
agctgctcaacttgca

SEQ ID NO: 488228 - DNA, 13 bp, Homo sapiens
agctttgctcata

SEQ ID NO: 488229 - DNA, 17 bp, Homo sapiens
aggctctgttccacata

SEQ ID NO: 488230 - DNA, 18 bp, Homo sapiens
agggaacgtgattagtga

SEQ ID NO: 488231 - DNA, 18 bp, Homo sapiens
agggtaactaactaaaac

SEQ ID NO: 488232 - DNA, 15 bp, Homo sapiens
aggtactgtatgatc

SEQ ID NO: 488233 - DNA, 21 bp, Homo sapiens
aggtactgtatgatcaaatgt

SEQ ID NO: 488234 - DNA, 23 bp, Homo sapiens
aggtactgtatgatcaaatgttt

SEQ ID NO: 488235 - DNA, 19 bp, Homo sapiens
aggtatatctaggtttatg

SEQ ID NO: 488236 - DNA, 22 bp, Homo sapiens
aggtatatctaggtttatgaca

SEQ ID NO: 488237 - DNA, 22 bp, Homo sapiens
aggttgataaatcattttatgt

SEQ ID NO: 488238 - DNA, 20 bp, Homo sapiens
agtaatacctctaatagtat

SEQ ID NO: 488239 - DNA, 13 bp, Homo sapiens
agtagttatcatg

SEQ ID NO: 488240 - DNA, 17 bp, Homo sapiens
agtagttatcatgttag

SEQ ID NO: 488241 - DNA, 11 bp, Homo sapiens
agtctaccaat

SEQ ID NO: 488242 - DNA, 20 bp, Homo sapiens
agtgaaaggaagataaacgt

SEQ ID NO: 488243 - DNA, 19 bp, Homo sapiens
agtgctaacatgaagacct

SEQ ID NO: 488244 - DNA, 22 bp, Homo sapiens
agtgctaacatgaagacctttt

SEQ ID NO: 488245 - DNA, 23 bp, Homo sapiens
agtgctaacatgaagaccttttt

SEQ ID NO: 488246 - DNA, 16 bp, Homo sapiens
agtgtaatgaatacct

SEQ ID NO: 488247 - DNA, 15 bp, Homo sapiens
agtgtatcaaaatgc

SEQ ID NO: 488248 - DNA, 16 bp, Homo sapiens
agtgtatcaaaatgct

SEQ ID NO: 488249 - DNA, 18 bp, Homo sapiens
agtgtatcaaaatgctct

SEQ ID NO: 488250 - DNA, 12 bp, Homo sapiens
agttatcatgtt

SEQ ID NO: 488251 - DNA, 20 bp, Homo sapiens
agttcccctgtttattcata

SEQ ID NO: 488252 - DNA, 19 bp, Homo sapiens
agttcggtgagctacaaat

SEQ ID NO: 488253 - DNA, 20 bp, Homo sapiens
agttcggtgagctacaaatg

SEQ ID NO: 488254 - DNA, 17 bp, Homo sapiens
agttgcacagcatctca

SEQ ID NO: 488255 - DNA, 23 bp, Homo sapiens
agttgctgcttcaatttatacct

SEQ ID NO: 488256 - DNA, 20 bp, Homo sapiens
agtttaaattgtaataggcg

SEQ ID NO: 488257 - DNA, 16 bp, Homo sapiens
ataaaagacagtgaaa

SEQ ID NO: 488258 - DNA, 21 bp, Homo sapiens
ataaaattatagctctaatgt

SEQ ID NO: 488259 - DNA, 23 bp, Homo sapiens
ataaaccccaccccaaaattagc

SEQ ID NO: 488260 - DNA, 18 bp, Homo sapiens
ataaacgtggatgttact

SEQ ID NO: 488261 - DNA, 16 bp, Homo sapiens
ataaatagaatgtaaa

SEQ ID NO: 488262 - DNA, 15 bp, Homo sapiens
ataaatcattttatg

SEQ ID NO: 488263 - DNA, 22 bp, Homo sapiens
ataacgataaaagacagtgaaa

SEQ ID NO: 488264 - DNA, 23 bp, Homo sapiens
ataagggaagtagttatcatgtt

SEQ ID NO: 488265 - DNA, 14 bp, Homo sapiens
ataatgaatacttt

SEQ ID NO: 488266 - DNA, 23 bp, Homo sapiens
atactcaagagtggtatcttgca

SEQ ID NO: 488267 - DNA, 19 bp, Homo sapiens
atagaatgtaaatgtctca

SEQ ID NO: 488268 - DNA, 20 bp, Homo sapiens
atagaatgtaaatgtctcac

SEQ ID NO: 488269 - DNA, 17 bp, Homo sapiens
atagaccttttcatttg

SEQ ID NO: 488270 - DNA, 18 bp, Homo sapiens
atagctactaattttaaa

SEQ ID NO: 488271 - DNA, 15 bp, Homo sapiens
atagctctaatgttt

SEQ ID NO: 488272 - DNA, 16 bp, Homo sapiens
atagctctaatgtttg

SEQ ID NO: 488273 - DNA, 17 bp, Homo sapiens
atagctctaatgtttgc

SEQ ID NO: 488274 - DNA, 18 bp, Homo sapiens
atagctctaatgtttgca

SEQ ID NO: 488275 - DNA, 19 bp, Homo sapiens
atataaatagaatgtaaat

SEQ ID NO: 488276 - DNA, 23 bp, Homo sapiens
atataagggaagtagttatcatg

SEQ ID NO: 488277 - DNA, 19 bp, Homo sapiens
atatactcaagagtggtat

SEQ ID NO: 488278 - DNA, 13 bp, Homo sapiens
atatatgctaagt

SEQ ID NO: 488279 - DNA, 16 bp, Homo sapiens
atatctaggtttatga

SEQ ID NO: 488280 - DNA, 13 bp, Homo sapiens
atatttacaaatg

SEQ ID NO: 488281 - DNA, 18 bp, Homo sapiens
atatttcccatgatttca

SEQ ID NO: 488282 - DNA, 22 bp, Homo sapiens
atattttttttctttttaccca

SEQ ID NO: 488283 - DNA, 19 bp, Homo sapiens
atcaaaatgctcttatttc

SEQ ID NO: 488284 - DNA, 20 bp, Homo sapiens
atcaaaatgctcttatttca

SEQ ID NO: 488285 - DNA, 14 bp, Homo sapiens
atcaaatgtttaat

SEQ ID NO: 488286 - DNA, 22 bp, Homo sapiens
atcaaatgtttaatcatataaa

SEQ ID NO: 488287 - DNA, 23 bp, Homo sapiens
atcaggaacgtttagctgacaaa

SEQ ID NO: 488288 - DNA, 14 bp, Homo sapiens
atcatataaataga

SEQ ID NO: 488289 - DNA, 21 bp, Homo sapiens
atcatataaatagaatgtaaa

SEQ ID NO: 488290 - DNA, 22 bp, Homo sapiens
atcatataaatagaatgtaaat

SEQ ID NO: 488291 - DNA, 23 bp, Homo sapiens
atcatataaatagaatgtaaatg

SEQ ID NO: 488292 - DNA, 14 bp, Homo sapiens
atcatgttagtaat

SEQ ID NO: 488293 - DNA, 17 bp, Homo sapiens
atcattcacttcactgt

SEQ ID NO: 488294 - DNA, 19 bp, Homo sapiens
atcattcacttcactgtgc

SEQ ID NO: 488295 - DNA, 21 bp, Homo sapiens
atcattcacttcactgtgctg

SEQ ID NO: 488296 - DNA, 19 bp, Homo sapiens
atccctggctgggatccac

SEQ ID NO: 488297 - DNA, 19 bp, Homo sapiens
atcctcagtttttgtgaaa

SEQ ID NO: 488298 - DNA, 19 bp, Homo sapiens
atcctgtaggaaggtactg

SEQ ID NO: 488299 - DNA, 15 bp, Homo sapiens
atcctttgtgaaaaa

SEQ ID NO: 488300 - DNA, 15 bp, Homo sapiens
atctaggtttatgac

SEQ ID NO: 488301 - DNA, 20 bp, Homo sapiens
cattatttgagaagctgctc

SEQ ID NO: 488302 - DNA, 14 bp, Homo sapiens
cattcaagattccc

SEQ ID NO: 488303 - DNA, 19 bp, Homo sapiens
cattcctcccattcaagat

SEQ ID NO: 488304 - DNA, 13 bp, Homo sapiens
cattctggaataa

SEQ ID NO: 488305 - DNA, 13 bp, Homo sapiens
cattcttcaagat

SEQ ID NO: 488306 - DNA, 13 bp, Homo sapiens
catttaaacagat

SEQ ID NO: 488307 - DNA, 14 bp, Homo sapiens
catttaaacagatg

SEQ ID NO: 488308 - DNA, 16 bp, Homo sapiens
catttaaacagatgtc

SEQ ID NO: 488309 - DNA, 12 bp, Homo sapiens
cattttatggtg

SEQ ID NO: 488310 - DNA, 14 bp, Homo sapiens
cattttatggtgcc

SEQ ID NO: 488311 - DNA, 17 bp, Homo sapiens
cattttctgcatctcca

SEQ ID NO: 488312 - DNA, 23 bp, Homo sapiens
ccaaaattagccagtaatcctgt

SEQ ID NO: 488313 - DNA, 20 bp, Homo sapiens
ccaaacatcctcttccatat

SEQ ID NO: 488314 - DNA, 18 bp, Homo sapiens
ccaacctgttcaagtcta

SEQ ID NO: 488315 - DNA, 15 bp, Homo sapiens
ccatttgttcatatt

SEQ ID NO: 488316 - DNA, 16 bp, Homo sapiens
ccatttgttcatatta

SEQ ID NO: 488317 - DNA, 20 bp, Homo sapiens
ccatttgttcatattaagaa

SEQ ID NO: 488318 - DNA, 20 bp, Homo sapiens
cccaaaattagccagtaatc

SEQ ID NO: 488319 - DNA, 19 bp, Homo sapiens
cccatgatttcatgtactg

SEQ ID NO: 488320 - DNA, 11 bp, Homo sapiens
cctatgatgta

SEQ ID NO: 488321 - DNA, 14 bp, Homo sapiens
cctatgatgtatac

SEQ ID NO: 488322 - DNA, 15 bp, Homo sapiens
cctatgatgtatact

SEQ ID NO: 488323 - DNA, 13 bp, Homo sapiens
cctgtgcacagcc

SEQ ID NO: 488324 - DNA, 20 bp, Homo sapiens
ggaaaaaataacaatgaaag

SEQ ID NO: 488325 - DNA, 21 bp, Homo sapiens
ggatctcttcttaatgtacat

SEQ ID NO: 488326 - DNA, 22 bp, Homo sapiens
ggatctcttcttaatgtacata

SEQ ID NO: 488327 - DNA, 13 bp, Homo sapiens
ggcactgtacaaa

SEQ ID NO: 488328 - DNA, 22 bp, Homo sapiens
ggcagcacaagtgtaatgaata

SEQ ID NO: 488329 - DNA, 14 bp, Homo sapiens
ggcagctttgctca

SEQ ID NO: 488330 - DNA, 22 bp, Homo sapiens
gggaagtagttatcatgttagt

SEQ ID NO: 488331 - DNA, 17 bp, Homo sapiens
ggtactgtatgatcaaa

SEQ ID NO: 488332 - DNA, 16 bp, Homo sapiens
ggtgagaatagaatct

SEQ ID NO: 488333 - DNA, 19 bp, Homo sapiens
ggtgcctagtattgacaaa

SEQ ID NO: 488334 - DNA, 14 bp, Homo sapiens
ggtttttatttcct

SEQ ID NO: 488335 - DNA, 17 bp, Homo sapiens
gtaactaactaaaacaa

SEQ ID NO: 488336 - DNA, 20 bp, Homo sapiens
gtaataggcgtaactaattt

SEQ ID NO: 488337 - DNA, 21 bp, Homo sapiens
gtacaaaaaaatcttccaatt

SEQ ID NO: 488338 - DNA, 20 bp, Homo sapiens
gtactgtatgatcaaatgtt

SEQ ID NO: 488339 - DNA, 23 bp, Homo sapiens
gtactttattttctataatttaa

SEQ ID NO: 488340 - DNA, 22 bp, Homo sapiens
gtaggaaggtactgtatgatca

SEQ ID NO: 488341 - DNA, 20 bp, Homo sapiens
gtatatctaggtttatgaca

SEQ ID NO: 488342 - DNA, 23 bp, Homo sapiens
gtatatctaggtttatgacagta

SEQ ID NO: 488343 - DNA, 13 bp, Homo sapiens
gtatcaaaatgct

SEQ ID NO: 488344 - DNA, 14 bp, Homo sapiens
gtatcaaaatgctc

SEQ ID NO: 488345 - DNA, 14 bp, Homo sapiens
gtatcttgcagtat

SEQ ID NO: 488346 - DNA, 22 bp, Homo sapiens
gtatcttgcagtatcggcactg

SEQ ID NO: 488347 - DNA, 13 bp, Homo sapiens
gtatgatcaaatg

SEQ ID NO: 488348 - DNA, 16 bp, Homo sapiens
gtattgacaaaatgtt

SEQ ID NO: 488349 - DNA, 20 bp, Homo sapiens
gtattgacaaaatgttattt

SEQ ID NO: 488350 - DNA, 19 bp, Homo sapiens
gtcaagattcagctagtgg

SEQ ID NO: 488351 - DNA, 21 bp, Homo sapiens
gtcaagggcagctttgctcat

SEQ ID NO: 488352 - DNA, 17 bp, Homo sapiens
gtcagattcttgcatcc

SEQ ID NO: 488353 - DNA, 15 bp, Homo sapiens
gtctaccaattataa

SEQ ID NO: 488354 - DNA, 16 bp, Homo sapiens
gtctttcacatttaaa

SEQ ID NO: 488355 - DNA, 14 bp, Homo sapiens
gtgagctacaaatg

SEQ ID NO: 488356 - DNA, 11 bp, Homo sapiens
gtgcacagccc

SEQ ID NO: 488357 - DNA, 16 bp, Homo sapiens
gtgcagttatttgctt

SEQ ID NO: 488358 - DNA, 14 bp, Homo sapiens
gtgcctagtattga

SEQ ID NO: 488359 - DNA, 16 bp, Homo sapiens
gtgcctagtattgaca

SEQ ID NO: 488360 - DNA, 18 bp, Homo sapiens
gtgcctagtattgacaaa

SEQ ID NO: 488361 - DNA, 15 bp, Homo sapiens
gtgctgttgttatga

SEQ ID NO: 488362 - DNA, 22 bp, Homo sapiens
gtgctgttgttatgatgtgctt

SEQ ID NO: 488363 - DNA, 12 bp, Homo sapiens
gtggatgttact

SEQ ID NO: 488364 - DNA, 17 bp, Homo sapiens
gtgggtttttatttcct

SEQ ID NO: 488365 - DNA, 14 bp, Homo sapiens
gtggtatcttgcag

SEQ ID NO: 488366 - DNA, 15 bp, Homo sapiens
gtgtatcaaaatgct

SEQ ID NO: 488367 - DNA, 14 bp, Homo sapiens
gtgtttacatttta

SEQ ID NO: 488368 - DNA, 11 bp, Homo sapiens
gttatcatgtt

SEQ ID NO: 488369 - DNA, 17 bp, Homo sapiens
gttatgatgtgcttaac

SEQ ID NO: 488370 - DNA, 19 bp, Homo sapiens
gttattatatttacaaatg

SEQ ID NO: 488371 - DNA, 23 bp, Homo sapiens
gttatttccctacattaaacatg

SEQ ID NO: 488372 - DNA, 18 bp, Homo sapiens
gttcatattaagaatgat

SEQ ID NO: 488373 - DNA, 19 bp, Homo sapiens
gttcccctgtttattcata

SEQ ID NO: 488374 - DNA, 11 bp, Homo sapiens
gttgcacagca

SEQ ID NO: 488375 - DNA, 16 bp, Homo sapiens
gttggtctgtactgat

SEQ ID NO: 488376 - DNA, 14 bp, Homo sapiens
gttgttatgatgtg

SEQ ID NO: 488377 - DNA, 23 bp, Homo sapiens
gttgttatgatgtgcttaacagg

SEQ ID NO: 488378 - DNA, 19 bp, Homo sapiens
gtttaatcatataaataga

SEQ ID NO: 488379 - DNA, 14 bp, Homo sapiens
gtttagctgacaaa

SEQ ID NO: 488380 - DNA, 20 bp, Homo sapiens
gtttagctgacaaaatactt

SEQ ID NO: 488381 - DNA, 14 bp, Homo sapiens
gtttattcatatgc

SEQ ID NO: 488382 - DNA, 17 bp, Homo sapiens
gtttattcatatgcata

SEQ ID NO: 488383 - DNA, 18 bp, Homo sapiens
gtttattcatatgcatat

SEQ ID NO: 488384 - DNA, 23 bp, Homo sapiens
gtttgcatataagggaagtagtt

SEQ ID NO: 488385 - DNA, 14 bp, Homo sapiens
gtttttatttccta

SEQ ID NO: 488386 - DNA, 16 bp, Homo sapiens
gtttttatttcctatg

SEQ ID NO: 488387 - DNA, 19 bp, Homo sapiens
gtttttatttcctatgatg

SEQ ID NO: 488388 - DNA, 18 bp, Homo sapiens
taaaacaaacaatacctg

SEQ ID NO: 488389 - DNA, 14 bp, Homo sapiens
taaaacaaagccac

SEQ ID NO: 488390 - DNA, 22 bp, Homo sapiens
taaaacaaagccactttcaatc

SEQ ID NO: 488391 - DNA, 22 bp, Homo sapiens
taaacagatgtccatcagatga

SEQ ID NO: 488392 - DNA, 16 bp, Homo sapiens
taaacagttgcacagc

SEQ ID NO: 488393 - DNA, 18 bp, Homo sapiens
taaacagttgcacagcat

SEQ ID NO: 488394 - DNA, 19 bp, Homo sapiens
taaacagttgcacagcatc

SEQ ID NO: 488395 - DNA, 18 bp, Homo sapiens
taaacatgactccataga

SEQ ID NO: 488396 - DNA, 14 bp, Homo sapiens
taaacgtggatgtt

SEQ ID NO: 488397 - DNA, 17 bp, Homo sapiens
taaataaaaataatcct

SEQ ID NO: 488398 - DNA, 20 bp, Homo sapiens
taaatagaatgtaaatgtct

SEQ ID NO: 488399 - DNA, 13 bp, Homo sapiens
taaatcattttat

SEQ ID NO: 488400 - DNA, 15 bp, Homo sapiens
taaatgtccattctt

SEQ ID NO: 488401 - DNA, 15 bp, Homo sapiens
taaatgtctcactga

SEQ ID NO: 488402 - DNA, 17 bp, Homo sapiens
taaatgtctcactgagc

SEQ ID NO: 488403 - DNA, 22 bp, Homo sapiens
taacagggaacgtgattagtga

SEQ ID NO: 488404 - DNA, 20 bp, Homo sapiens
taacgataaaagacagtgaa

SEQ ID NO: 488405 - DNA, 17 bp, Homo sapiens
taactaaaacaaagcca

SEQ ID NO: 488406 - DNA, 20 bp, Homo sapiens
taactaatacagctgagcta

SEQ ID NO: 488407 - DNA, 13 bp, Homo sapiens
taagaatgatctg

SEQ ID NO: 488408 - DNA, 22 bp, Homo sapiens
taagggaagtagttatcatgtt

SEQ ID NO: 488409 - DNA, 16 bp, Homo sapiens
taagtcaacttagcat

SEQ ID NO: 488410 - DNA, 13 bp, Homo sapiens
tacttgtctgttt

SEQ ID NO: 488411 - DNA, 14 bp, Homo sapiens
tacttgtctgtttt

SEQ ID NO: 488412 - DNA, 17 bp, Homo sapiens
tagaatgtaaatgtctc

SEQ ID NO: 488413 - DNA, 17 bp, Homo sapiens
tagaccttttcatttgt

SEQ ID NO: 488414 - DNA, 22 bp, Homo sapiens
tagataggtcagtgcaaatact

SEQ ID NO: 488415 - DNA, 17 bp, Homo sapiens
tagcattttctgcatct

SEQ ID NO: 488416 - DNA, 22 bp, Homo sapiens
tagccagtaatcctgtaggaag

SEQ ID NO: 488417 - DNA, 19 bp, Homo sapiens
tagctctaatgtttgcata

SEQ ID NO: 488418 - DNA, 21 bp, Homo sapiens
tagctctaatgtttgcatata

SEQ ID NO: 488419 - DNA, 18 bp, Homo sapiens
tagctgacaaaatacttg

SEQ ID NO: 488420 - DNA, 14 bp, Homo sapiens
tagcttatgttaac

SEQ ID NO: 488421 - DNA, 18 bp, Homo sapiens
taggaaggtactgtatga

SEQ ID NO: 488422 - DNA, 20 bp, Homo sapiens
taggttattatgattagctt

SEQ ID NO: 488423 - DNA, 21 bp, Homo sapiens
tagtattgacaaaatgttatt

SEQ ID NO: 488424 - DNA, 22 bp, Homo sapiens
tagtgactaaaccattgtgcat

SEQ ID NO: 488425 - DNA, 23 bp, Homo sapiens
tagtgactaaaccattgtgcatt

SEQ ID NO: 488426 - DNA, 12 bp, Homo sapiens
tagtgtatcaaa

SEQ ID NO: 488427 - DNA, 14 bp, Homo sapiens
tagtgtatcaaaat

SEQ ID NO: 488428 - DNA, 17 bp, Homo sapiens
tagtgtatcaaaatgct

SEQ ID NO: 488429 - DNA, 13 bp, Homo sapiens
tagttatcatgtt

SEQ ID NO: 488430 - DNA, 16 bp, Homo sapiens
tagttatcatgttagt

SEQ ID NO: 488431 - DNA, 23 bp, Homo sapiens
tagttcccctgtttattcatatg

SEQ ID NO: 488432 - DNA, 17 bp, Homo sapiens
tagttgttgtagagaaa

SEQ ID NO: 488433 - DNA, 19 bp, Homo sapiens
tataaatagaatgtaaatg

SEQ ID NO: 488434 - DNA, 20 bp, Homo sapiens
tataaatagaatgtaaatgt

SEQ ID NO: 488435 - DNA, 16 bp, Homo sapiens
tatagctctaatgttt

SEQ ID NO: 488436 - DNA, 20 bp, Homo sapiens
tatagctctaatgtttgcat

SEQ ID NO: 488437 - DNA, 18 bp, Homo sapiens
tatatctaggtttatgac

SEQ ID NO: 488438 - DNA, 12 bp, Homo sapiens
tatatttacaaa

SEQ ID NO: 488439 - DNA, 14 bp, Homo sapiens
tatcaaaatgctct

SEQ ID NO: 488440 - DNA, 19 bp, Homo sapiens
tatcatgttagtaatacct

SEQ ID NO: 488441 - DNA, 20 bp, Homo sapiens
tatcatgttagtaatacctc

SEQ ID NO: 488442 - DNA, 15 bp, Homo sapiens
tatctgtttgagaaa

SEQ ID NO: 488443 - DNA, 19 bp, Homo sapiens
tatctgtttgagaaagtca

SEQ ID NO: 488444 - DNA, 22 bp, Homo sapiens
tatcttgcagtatcggcactgt

SEQ ID NO: 488445 - DNA, 21 bp, Homo sapiens
tatgatgtgcttaacagggaa

SEQ ID NO: 488446 - DNA, 16 bp, Homo sapiens
tatgcaaacagggtaa

SEQ ID NO: 488447 - DNA, 17 bp, Homo sapiens
tatggtgcctagtattg

SEQ ID NO: 488448 - DNA, 16 bp, Homo sapiens
tatgtcaagggcagct

SEQ ID NO: 488449 - DNA, 12 bp, Homo sapiens
tattaagaatga

SEQ ID NO: 488450 - DNA, 17 bp, Homo sapiens
tattatatttacaaatg

SEQ ID NO: 488451 - DNA, 14 bp, Homo sapiens
tattcatatgcata

SEQ ID NO: 488452 - DNA, 15 bp, Homo sapiens
tattcatatgcatat

SEQ ID NO: 488453 - DNA, 21 bp, Homo sapiens
tattgacaaaatgttatttcc

SEQ ID NO: 488454 - DNA, 14 bp, Homo sapiens
tattgcaaagtcag

SEQ ID NO: 488455 - DNA, 13 bp, Homo sapiens
tatttccacttct

SEQ ID NO: 488456 - DNA, 18 bp, Homo sapiens
tatttcccatgatttcat

SEQ ID NO: 488457 - DNA, 22 bp, Homo sapiens
tatttccctacattaaacatga

SEQ ID NO: 488458 - DNA, 15 bp, Homo sapiens
tatttcctatgatgt

SEQ ID NO: 488459 - DNA, 16 bp, Homo sapiens
tatttcctatgatgta

SEQ ID NO: 488460 - DNA, 19 bp, Homo sapiens
tatttgagaagctgctcaa

SEQ ID NO: 488461 - DNA, 19 bp, Homo sapiens
tcaaaatgctcttatttca

SEQ ID NO: 488462 - DNA, 21 bp, Homo sapiens
tcaaaatgctcttatttcatc

SEQ ID NO: 488463 - DNA, 22 bp, Homo sapiens
tcaaaatgctcttatttcatca

SEQ ID NO: 488464 - DNA, 14 bp, Homo sapiens
tcaaagctgaaatg

SEQ ID NO: 488465 - DNA, 12 bp, Homo sapiens
tcaaatgtttaa

SEQ ID NO: 488466 - DNA, 18 bp, Homo sapiens
tcaaatgtttaatcatat

SEQ ID NO: 488467 - DNA, 22 bp, Homo sapiens
tcaaattttatctgcctctctt

SEQ ID NO: 488468 - DNA, 16 bp, Homo sapiens
tcaacttgcaaaatca

SEQ ID NO: 488469 - DNA, 20 bp, Homo sapiens
tcaacttgcaaaatcagttt

SEQ ID NO: 488470 - DNA, 14 bp, Homo sapiens
tcaagattcagcta

SEQ ID NO: 488471 - DNA, 14 bp, Homo sapiens
tcaataaaattata

SEQ ID NO: 488472 - DNA, 19 bp, Homo sapiens
tcaataaaattatagctct

SEQ ID NO: 488473 - DNA, 17 bp, Homo sapiens
tcaatcttcaatccttg

SEQ ID NO: 488474 - DNA, 16 bp, Homo sapiens
tcaattttcactgtgt

SEQ ID NO: 488475 - DNA, 14 bp, Homo sapiens
tcactactcagcat

SEQ ID NO: 488476 - DNA, 15 bp, Homo sapiens
tcactactcagcatg

SEQ ID NO: 488477 - DNA, 18 bp, Homo sapiens
tcactgagcactgttttc

SEQ ID NO: 488478 - DNA, 23 bp, Homo sapiens
tcactgtgctgttgttatgatgt

SEQ ID NO: 488479 - DNA, 15 bp, Homo sapiens
tcactgtgtccaggt

SEQ ID NO: 488480 - DNA, 12 bp, Homo sapiens
tcacttcactgt

SEQ ID NO: 488481 - DNA, 15 bp, Homo sapiens
tcacttcactgtgct

SEQ ID NO: 488482 - DNA, 22 bp, Homo sapiens
tcaggaacgtttagctgacaaa

SEQ ID NO: 488483 - DNA, 15 bp, Homo sapiens
tcagtttttgtgaaa

SEQ ID NO: 488484 - DNA, 17 bp, Homo sapiens
tcagtttttgtgaaaag

SEQ ID NO: 488485 - DNA, 13 bp, Homo sapiens
tcatataaataga

SEQ ID NO: 488486 - DNA, 16 bp, Homo sapiens
tcatataaatagaatg

SEQ ID NO: 488487 - DNA, 18 bp, Homo sapiens
tcatataaatagaatgta

SEQ ID NO: 488488 - DNA, 22 bp, Homo sapiens
tcatataaatagaatgtaaatg

SEQ ID NO: 488489 - DNA, 22 bp, Homo sapiens
tcatattaagaatgatctgatt

SEQ ID NO: 488490 - DNA, 21 bp, Homo sapiens
tcatatttcccatgatttcat

SEQ ID NO: 488491 - DNA, 16 bp, Homo sapiens
ttatagctctaatgtt

SEQ ID NO: 488492 - DNA, 13 bp, Homo sapiens
ttatgacagtaat

SEQ ID NO: 488493 - DNA, 13 bp, Homo sapiens
ttatgatgtgctt

SEQ ID NO: 488494 - DNA, 14 bp, Homo sapiens
ttattcatatgcat

SEQ ID NO: 488495 - DNA, 11 bp, Homo sapiens
ttatttcctat

SEQ ID NO: 488496 - DNA, 20 bp, Homo sapiens
ttatttgagaagctgctcaa

SEQ ID NO: 488497 - DNA, 17 bp, Homo sapiens
ttcaaattttatctgcc

SEQ ID NO: 488498 - DNA, 17 bp, Homo sapiens
ttcaagatcccatttga

SEQ ID NO: 488499 - DNA, 20 bp, Homo sapiens
ttcaatcttcaatccttgaa

SEQ ID NO: 488500 - DNA, 16 bp, Homo sapiens
ttcaatttgatgtggt

SEQ ID NO: 488501 - DNA, 13 bp, Homo sapiens
ttcactgtgctgt

SEQ ID NO: 488502 - DNA, 18 bp, Homo sapiens
ttcactgtgctgttgtta

SEQ ID NO: 488503 - DNA, 12 bp, Homo sapiens
ttcacttcactg

SEQ ID NO: 488504 - DNA, 14 bp, Homo sapiens
ttcacttcactgtg

SEQ ID NO: 488505 - DNA, 16 bp, Homo sapiens
ttcacttcactgtgct

SEQ ID NO: 488506 - DNA, 12 bp, Homo sapiens
ttcatatgcata

SEQ ID NO: 488507 - DNA, 19 bp, Homo sapiens
ttcatcattcacttcactg

SEQ ID NO: 488508 - DNA, 18 bp, Homo sapiens
ttccatatggatccactg

SEQ ID NO: 488509 - DNA, 21 bp, Homo sapiens
ttcccatgatttcatgtactg

SEQ ID NO: 488510 - DNA, 19 bp, Homo sapiens
ttccgtaggttattttcag

SEQ ID NO: 488511 - DNA, 14 bp, Homo sapiens
ttcctatgatgtat

SEQ ID NO: 488512 - DNA, 14 bp, Homo sapiens
ttcctgtgcacagc

SEQ ID NO: 488513 - DNA, 15 bp, Homo sapiens
ttcctgtgcacagcc

SEQ ID NO: 488514 - DNA, 16 bp, Homo sapiens
ttcgactgttgttatc

SEQ ID NO: 488515 - DNA, 21 bp, Homo sapiens
ttcgactgttgttatctgttt

SEQ ID NO: 488516 - DNA, 14 bp, Homo sapiens
ttctgagcatttaa

SEQ ID NO: 488517 - DNA, 14 bp, Homo sapiens
ttcttaatgtacat

SEQ ID NO: 488518 - DNA, 17 bp, Homo sapiens
ttcttcaagatcccatt

SEQ ID NO: 488519 - DNA, 18 bp, Homo sapiens
ttcttcaagatcccattt

SEQ ID NO: 488520 - DNA, 16 bp, Homo sapiens
ttcttcgactgttgtt

SEQ ID NO: 488521 - DNA, 21 bp, Homo sapiens
ttgaaaatcttataatttaaa

SEQ ID NO: 488522 - DNA, 17 bp, Homo sapiens
ttgaagggaaatttcag

SEQ ID NO: 488523 - DNA, 15 bp, Homo sapiens
ttgataaatcatttt

SEQ ID NO: 488524 - DNA, 18 bp, Homo sapiens
ttgataaatcattttatg

SEQ ID NO: 488525 - DNA, 23 bp, Homo sapiens
ttgcagtatcggcactgtacaaa

SEQ ID NO: 488526 - DNA, 20 bp, Homo sapiens
ttggtctgtactgattcaat

SEQ ID NO: 488527 - DNA, 18 bp, Homo sapiens
ttgtgggtttttatttcc

SEQ ID NO: 488528 - DNA, 18 bp, Homo sapiens
ttgttatgatgtgcttaa

SEQ ID NO: 488529 - DNA, 12 bp, Homo sapiens
tttaaaatgtct

SEQ ID NO: 488530 - DNA, 14 bp, Homo sapiens
tttaaacagatgtc

SEQ ID NO: 488531 - DNA, 18 bp, Homo sapiens
tttaaatatatgctaagt

SEQ ID NO: 488532 - DNA, 22 bp, Homo sapiens
tttaatcatataaatagaatgt

SEQ ID NO: 488533 - DNA, 22 bp, Homo sapiens
tttatacctcaattttcactgt

SEQ ID NO: 488534 - DNA, 19 bp, Homo sapiens
tttatctgcctctcttgta

SEQ ID NO: 488535 - DNA, 14 bp, Homo sapiens
tttatgacagtaat

SEQ ID NO: 488536 - DNA, 16 bp, Homo sapiens
tttattcatatgcata

SEQ ID NO: 488537 - DNA, 13 bp, Homo sapiens
tttcaatcttcaa

SEQ ID NO: 488538 - DNA, 15 bp, Homo sapiens
tttcagcagctgcag

SEQ ID NO: 488539 - DNA, 20 bp, Homo sapiens
tttcatcattcacttcactg

SEQ ID NO: 488540 - DNA, 21 bp, Homo sapiens
tttcccatgatttcatgtact

SEQ ID NO: 488541 - DNA, 13 bp, Homo sapiens
tttctgcatctcc

SEQ ID NO: 488542 - DNA, 18 bp, Homo sapiens
tttgaatcatcaagtctt

SEQ ID NO: 488543 - DNA, 17 bp, Homo sapiens
tttgcatacattcttca

SEQ ID NO: 488544 - DNA, 18 bp, Homo sapiens
tttgcatacattcttcaa

SEQ ID NO: 488545 - DNA, 19 bp, Homo sapiens
tttgctttcggttccagtt

SEQ ID NO: 488546 - DNA, 21 bp, Homo sapiens
ttttaaagtaaccctacaaaa

SEQ ID NO: 488547 - DNA, 11 bp, Homo sapiens
ttttatttcct

SEQ ID NO: 488548 - DNA, 19 bp, Homo sapiens
ttttcctctcaataaaatt

SEQ ID NO: 488549 - DNA, 13 bp, Homo sapiens
ttttctgcactat

SEQ ID NO: 488550 - DNA, 19 bp, Homo sapiens
tttttatttcctatgatgt

SEQ ID NO: 488551 - DNA, 19 bp, Homo sapiens
tttttgtgaaaagctccat

SEQ ID NO: 488552 - DNA, 22 bp, Homo sapiens
tggaataatcctaaacatatga

SEQ ID NO: 488553 - DNA, 21 bp, Homo sapiens
tggatctcttcttaatgtaca

SEQ ID NO: 488554 - DNA, 23 bp, Homo sapiens
tggatctcttcttaatgtacata

SEQ ID NO: 488555 - DNA, 15 bp, Homo sapiens
tggattggacaaaat

SEQ ID NO: 488556 - DNA, 20 bp, Homo sapiens
tggattggacaaaatgactt

SEQ ID NO: 488557 - DNA, 22 bp, Homo sapiens
tgggacaattagataaatgtcc

SEQ ID NO: 488558 - DNA, 22 bp, Homo sapiens
tggtccatgggccatatgaaaa

SEQ ID NO: 488559 - DNA, 23 bp, Homo sapiens
tggtgaaaagcaggttgataaat

SEQ ID NO: 488560 - DNA, 16 bp, Homo sapiens
tgtaaaggaatttaaa

SEQ ID NO: 488561 - DNA, 21 bp, Homo sapiens
tgtacaaaaaaatcttccaat

SEQ ID NO: 488562 - DNA, 15 bp, Homo sapiens
tgtactgattcaatt

SEQ ID NO: 488563 - DNA, 19 bp, Homo sapiens
tgtagagaaaacatgcaga

SEQ ID NO: 488564 - DNA, 18 bp, Homo sapiens
tgtaggaaggtactgtat

SEQ ID NO: 488565 - DNA, 22 bp, Homo sapiens
tgtaggaaggtactgtatgatc

SEQ ID NO: 488566 - DNA, 23 bp, Homo sapiens
tgtatcaaaatgctcttatttca

SEQ ID NO: 488567 - DNA, 13 bp, Homo sapiens
tgtatgatcaaat

SEQ ID NO: 488568 - DNA, 23 bp, Homo sapiens
tgtcaagggcagctttgctcata

SEQ ID NO: 488569 - DNA, 17 bp, Homo sapiens
tgtccatcagatgacaa

SEQ ID NO: 488570 - DNA, 20 bp, Homo sapiens
tgtctcactgagcactgttt

SEQ ID NO: 488571 - DNA, 16 bp, Homo sapiens
tgtctgttttaaaaac

SEQ ID NO: 488572 - DNA, 23 bp, Homo sapiens
tgtgctgttgttatgatgtgctt

SEQ ID NO: 488573 - DNA, 15 bp, Homo sapiens
tgtgcttaacaggga

SEQ ID NO: 488574 - DNA, 17 bp, Homo sapiens
tgtggtgaaaagcaggt

SEQ ID NO: 488575 - DNA, 15 bp, Homo sapiens
tgttagtaatacctc

SEQ ID NO: 488576 - DNA, 14 bp, Homo sapiens
tgttatctgtttga

SEQ ID NO: 488577 - DNA, 12 bp, Homo sapiens
tgttatgatgtg

SEQ ID NO: 488578 - DNA, 17 bp, Homo sapiens
tgttatgatgtgcttaa

SEQ ID NO: 488579 - DNA, 17 bp, Homo sapiens
tgttcatattaagaatg

SEQ ID NO: 488580 - DNA, 18 bp, Homo sapiens
tgttcatattaagaatga

SEQ ID NO: 488581 - DNA, 23 bp, Homo sapiens
tgttcatattaagaatgatctga

SEQ ID NO: 488582 - DNA, 15 bp, Homo sapiens
tgttggtctgtactg

SEQ ID NO: 488583 - DNA, 15 bp, Homo sapiens
tgttgttatgatgtg

SEQ ID NO: 488584 - DNA, 17 bp, Homo sapiens
tgttgttatgatgtgct

SEQ ID NO: 488585 - DNA, 19 bp, Homo sapiens
tgttgttatgatgtgctta

SEQ ID NO: 488586 - DNA, 13 bp, Homo sapiens
tgtttattcatat

SEQ ID NO: 488587 - DNA, 17 bp, Homo sapiens
tgtttattcatatgcat

SEQ ID NO: 488588 - DNA, 19 bp, Homo sapiens
tgtttattcatatgcatat

SEQ ID NO: 488589 - DNA, 14 bp, Homo sapiens
tgtttgcatataag

SEQ ID NO: 488590 - DNA, 13 bp, Homo sapiens
tgttttctagtgt

SEQ ID NO: 488591 - DNA, 14 bp, Homo sapiens
tgttttctagtgta

SEQ ID NO: 488592 - DNA, 15 bp, Homo sapiens
tgttttctagtgtat

SEQ ID NO: 488593 - DNA, 20 bp, Homo sapiens
tgttttctagtgtatcaaaa

SEQ ID NO: 488594 - DNA, 21 bp, Homo sapiens
tgttttctagtgtatcaaaat

SEQ ID NO: 488595 - DNA, 13 bp, Homo sapiens
ttaaacagttgca

SEQ ID NO: 488596 - DNA, 17 bp, Homo sapiens
ttaaacagttgcacagc

SEQ ID NO: 488597 - DNA, 18 bp, Homo sapiens
ttaaacagttgcacagca

SEQ ID NO: 488598 - DNA, 19 bp, Homo sapiens
ttaaacagttgcacagcat

SEQ ID NO: 488599 - DNA, 21 bp, Homo sapiens
ttaaacagttgcacagcatct

SEQ ID NO: 488600 - DNA, 17 bp, Homo sapiens
ttaaagaattcaaattt

SEQ ID NO: 488601 - DNA, 19 bp, Homo sapiens
ttaagaatgatctgattga

SEQ ID NO: 488602 - DNA, 16 bp, Homo sapiens
ttaatcatataaatag

SEQ ID NO: 488603 - DNA, 17 bp, Homo sapiens
ttaatgtacatagtgct

SEQ ID NO: 488604 - DNA, 18 bp, Homo sapiens
ttaatgtacatagtgcta

SEQ ID NO: 488605 - DNA, 20 bp, Homo sapiens
ttagcattttctgcatctcc

SEQ ID NO: 488606 - DNA, 18 bp, Homo sapiens
ttagctgacaaaatactt

SEQ ID NO: 488607 - DNA, 14 bp, Homo sapiens
ttagtaatacctct

SEQ ID NO: 488608 - DNA, 11 bp, Homo sapiens
ttagtattgca

SEQ ID NO: 488609 - DNA, 17 bp, Homo sapiens
ttagtgactaaaccatt

SEQ ID NO: 488610 - DNA, 15 bp, Homo sapiens
ttagttcctgtgcac

SEQ ID NO: 488611 - DNA, 22 bp, Homo sapiens
ttatacctcaattttcactgtg

SEQ ID NO: 488612 - DNA, 18 bp, Homo sapiens
ttatagctctaatgtttg

SEQ ID NO: 488613 - DNA, 20 bp, Homo sapiens
ttatagctctaatgtttgca

SEQ ID NO: 488614 - DNA, 15 bp, Homo sapiens
ttatattgttcactt

SEQ ID NO: 488615 - DNA, 22 bp, Homo sapiens
ttatcatgttagtaatacctct

SEQ ID NO: 488616 - DNA, 23 bp, Homo sapiens
ttatcatgttagtaatacctcta

SEQ ID NO: 488617 - DNA, 20 bp, Homo sapiens
ttatctgtttgagaaagtca

SEQ ID NO: 488618 - DNA, 16 bp, Homo sapiens
ttatgacagtaattgt

SEQ ID NO: 488619 - DNA, 24 bp, Homo sapiens
ttatgacagtaattgtgtttacat

SEQ ID NO: 488620 - DNA, 16 bp, Homo sapiens
ttatgatgtgcttaac

SEQ ID NO: 488621 - DNA, 17 bp, Homo sapiens
ttatgatgtgcttaaca

SEQ ID NO: 488622 - DNA, 18 bp, Homo sapiens
ttatgatgtgcttaacag

SEQ ID NO: 488623 - DNA, 14 bp, Homo sapiens
ttattatatttaca

SEQ ID NO: 488624 - DNA, 15 bp, Homo sapiens
ttattatatttacaa

SEQ ID NO: 488625 - DNA, 22 bp, Homo sapiens
ttatttccctacattaaacatg

SEQ ID NO: 488626 - DNA, 15 bp, Homo sapiens
tttcccatgatttca

SEQ ID NO: 488627 - DNA, 14 bp, Homo sapiens
tttcctatgatgta

SEQ ID NO: 488628 - DNA, 19 bp, Homo sapiens
tttctagtgtatcaaaatg

SEQ ID NO: 488629 - DNA, 14 bp, Homo sapiens
tttctgcactatat

SEQ ID NO: 488630 - DNA, 16 bp, Homo sapiens
tttgctcatatttccc

SEQ ID NO: 488631 - DNA, 20 bp, Homo sapiens
ttttagttcctgtgcacagc

SEQ ID NO: 488632 - DNA, 18 bp, Homo sapiens
ttttatggtgcctagtat

SEQ ID NO: 488633 - DNA, 23 bp, Homo sapiens
ttttatggtgcctagtattgaca

SEQ ID NO: 488634 - DNA, 20 bp, Homo sapiens
ttttctagtgtatcaaaatg

SEQ ID NO: 488635 - DNA, 22 bp, Homo sapiens
ttttctagtgtatcaaaatgct

SEQ ID NO: 488636 - DNA, 12 bp, Homo sapiens
ttttctgcacta

SEQ ID NO: 488637 - DNA, 19 bp, Homo sapiens
ttttctgcactatatgcaa

SEQ ID NO: 488638 - DNA, 11 bp, Homo sapiens
tttttcctgtc

SEQ ID NO: 488639 - DNA, 13 bp, Homo sapiens
tttttctgcacta

SEQ ID NO: 488640 - DNA, 19 bp, Homo sapiens
gatctcttcttaatgtaca

SEQ ID NO: 488641 - DNA, 16 bp, Homo sapiens
gatctgattgaccgtg

SEQ ID NO: 488642 - DNA, 14 bp, Homo sapiens
gatgtgcttaacag

SEQ ID NO: 488643 - DNA, 15 bp, Homo sapiens
gattggacaaaatga

SEQ ID NO: 488644 - DNA, 12 bp, Homo sapiens
gatttcatgtac

SEQ ID NO: 488645 - DNA, 20 bp, Homo sapiens
gatttcatgtactgcattat

SEQ ID NO: 488646 - DNA, 14 bp, Homo sapiens
gcaaattggagaaa

SEQ ID NO: 488647 - DNA, 21 bp, Homo sapiens
gcacaagtgtaatgaatacct

SEQ ID NO: 488648 - DNA, 13 bp, Homo sapiens
gcacagcatctca

SEQ ID NO: 488649 - DNA, 18 bp, Homo sapiens
gcactatatgcaaacagg

SEQ ID NO: 488650 - DNA, 13 bp, Homo sapiens
gcactcttcatgg

SEQ ID NO: 488651 - DNA, 23 bp, Homo sapiens
gcactgttttctagtgtatcaaa

SEQ ID NO: 488652 - DNA, 15 bp, Homo sapiens
gcagaacaaatgaag

SEQ ID NO: 488653 - DNA, 13 bp, Homo sapiens
gcagctttgctca

SEQ ID NO: 488654 - DNA, 15 bp, Homo sapiens
gcagctttgctcata

SEQ ID NO: 488655 - DNA, 17 bp, Homo sapiens
gcaggttgataaatcat

SEQ ID NO: 488656 - DNA, 19 bp, Homo sapiens
gcaggttgataaatcattt

SEQ ID NO: 488657 - DNA, 14 bp, Homo sapiens
gcagtgttagctta

SEQ ID NO: 488658 - DNA, 13 bp, Homo sapiens
gcatagaagtaaa

SEQ ID NO: 488659 - DNA, 16 bp, Homo sapiens
gccatatgaaaaggct

SEQ ID NO: 488660 - DNA, 23 bp, Homo sapiens
gcctctcttgtaatttggatctc

SEQ ID NO: 488661 - DNA, 17 bp, Homo sapiens
gccttttagttcctgtg

SEQ ID NO: 488662 - DNA, 16 bp, Homo sapiens
gctctaatgtttgcat

SEQ ID NO: 488663 - DNA, 18 bp, Homo sapiens
gctctaatgtttgcatat

SEQ ID NO: 488664 - DNA, 14 bp, Homo sapiens
gctggacaaactgc

SEQ ID NO: 488665 - DNA, 19 bp, Homo sapiens
gcttaacagggaacgtgat

SEQ ID NO: 488666 - DNA, 12 bp, Homo sapiens
gcttatgttaac

SEQ ID NO: 488667 - DNA, 15 bp, Homo sapiens
gcttcaatttatacc

SEQ ID NO: 488668 - DNA, 14 bp, Homo sapiens
ggaacgtgattagt

SEQ ID NO: 488669 - DNA, 16 bp, Homo sapiens
ggaagtagttatcatg

SEQ ID NO: 488670 - DNA, 11 bp, Homo sapiens
ggacaaaatga

SEQ ID NO: 488671 - DNA, 20 bp, Homo sapiens
ggctaagcttcactgtaaaa

SEQ ID NO: 488672 - DNA, 19 bp, Homo sapiens
gggtaactaactaaaacaa

SEQ ID NO: 488673 - DNA, 23 bp, Homo sapiens
gggtttttatttcctatgatgta

SEQ ID NO: 488674 - DNA, 18 bp, Homo sapiens
ggtactgtatgatcaaat

SEQ ID NO: 488675 - DNA, 22 bp, Homo sapiens
ggtcgggcagcacaagtgtaat

SEQ ID NO: 488676 - DNA, 21 bp, Homo sapiens
ggttgataaatcattttatgt

SEQ ID NO: 488677 - DNA, 22 bp, Homo sapiens
gtacatagtgctaacatgaaga

SEQ ID NO: 488678 - DNA, 16 bp, Homo sapiens
gtactgattcaatttg

SEQ ID NO: 488679 - DNA, 17 bp, Homo sapiens
gtactgtatgatcaaat

SEQ ID NO: 488680 - DNA, 21 bp, Homo sapiens
gtactgtatgatcaaatgttt

SEQ ID NO: 488681 - DNA, 23 bp, Homo sapiens
gtactgtatgatcaaatgtttaa

SEQ ID NO: 488682 - DNA, 21 bp, Homo sapiens
gtaggttattatgattagctt

SEQ ID NO: 488683 - DNA, 12 bp, Homo sapiens
gtagttatcatg

SEQ ID NO: 488684 - DNA, 14 bp, Homo sapiens
gtagttatcatgtt

SEQ ID NO: 488685 - DNA, 15 bp, Homo sapiens
gtagttatcatgtta

SEQ ID NO: 488686 - DNA, 16 bp, Homo sapiens
gtagttatcatgttag

SEQ ID NO: 488687 - DNA, 19 bp, Homo sapiens
gtatatctaggtttatgac

SEQ ID NO: 488688 - DNA, 15 bp, Homo sapiens
gtatcggcactgtac

SEQ ID NO: 488689 - DNA, 16 bp, Homo sapiens
gtatcggcactgtaca

SEQ ID NO: 488690 - DNA, 18 bp, Homo sapiens
gtatcggcactgtacaaa

SEQ ID NO: 488691 - DNA, 14 bp, Homo sapiens
gtatgatcaaatgt

SEQ ID NO: 488692 - DNA, 16 bp, Homo sapiens
gtcagattcttgcatc

SEQ ID NO: 488693 - DNA, 22 bp, Homo sapiens
gtctacataactaatacagctg

SEQ ID NO: 488694 - DNA, 22 bp, Homo sapiens
gtctcactgagcactgttttct

SEQ ID NO: 488695 - DNA, 14 bp, Homo sapiens
gtgcacagccccta

SEQ ID NO: 488696 - DNA, 19 bp, Homo sapiens
gtgctgttgttatgatgtg

SEQ ID NO: 488697 - DNA, 23 bp, Homo sapiens
gtggtgaaaagcaggttgataaa

SEQ ID NO: 488698 - DNA, 16 bp, Homo sapiens
gttatgatgtgcttaa

SEQ ID NO: 488699 - DNA, 17 bp, Homo sapiens
gttattatatttacaaa

SEQ ID NO: 488700 - DNA, 21 bp, Homo sapiens
gttatttccctacattaaaca

SEQ ID NO: 488701 - DNA, 18 bp, Homo sapiens
gttcccctgtttattcat

SEQ ID NO: 488702 - DNA, 16 bp, Homo sapiens
gttcctgtgcacagcc

SEQ ID NO: 488703 - DNA, 15 bp, Homo sapiens
gttggtctgtactga

SEQ ID NO: 488704 - DNA, 20 bp, Homo sapiens
gttgtagagaaaacatgcag

SEQ ID NO: 488705 - DNA, 13 bp, Homo sapiens
gttgttatgatgt

SEQ ID NO: 488706 - DNA, 22 bp, Homo sapiens
gtttacattttatggtgcctag

SEQ ID NO: 488707 - DNA, 17 bp, Homo sapiens
gtttagctgacaaaata

SEQ ID NO: 488708 - DNA, 16 bp, Homo sapiens
gtttattcatatgcat

SEQ ID NO: 488709 - DNA, 20 bp, Homo sapiens
gtttttatttcctatgatgt

SEQ ID NO: 488710 - DNA, 16 bp, Homo sapiens
taaaagtgtccattga

SEQ ID NO: 488711 - DNA, 16 bp, Homo sapiens
taaaattatagctcta

SEQ ID NO: 488712 - DNA, 20 bp, Homo sapiens
taaaattatagctctaatgt

SEQ ID NO: 488713 - DNA, 18 bp, Homo sapiens
taaacgtggatgttactc

SEQ ID NO: 488714 - DNA, 14 bp, Homo sapiens
taaagaattcaaat

SEQ ID NO: 488715 - DNA, 14 bp, Homo sapiens
taaaggaatttaaa

SEQ ID NO: 488716 - DNA, 13 bp, Homo sapiens
taaatagaatgta

SEQ ID NO: 488717 - DNA, 18 bp, Homo sapiens
taaatagaatgtaaatgt

SEQ ID NO: 488718 - DNA, 18 bp, Homo sapiens
taaatatatgctaagtct

SEQ ID NO: 488719 - DNA, 21 bp, Homo sapiens
taatacctctaatagtataaa

SEQ ID NO: 488720 - DNA, 12 bp, Homo sapiens
taatcatataaa

SEQ ID NO: 488721 - DNA, 20 bp, Homo sapiens
taatcatataaatagaatgt

SEQ ID NO: 488722 - DNA, 14 bp, Homo sapiens
taatcctgtaggaa

SEQ ID NO: 488723 - DNA, 18 bp, Homo sapiens
taatgaataccttagtgc

SEQ ID NO: 488724 - DNA, 13 bp, Homo sapiens
taatgaatgctta

SEQ ID NO: 488725 - DNA, 23 bp, Homo sapiens
taatgaatgcttaaagaattcaa

SEQ ID NO: 488726 - DNA, 19 bp, Homo sapiens
taatgtacatagtgctaac

SEQ ID NO: 488727 - DNA, 14 bp, Homo sapiens
taatgtttgcatat

SEQ ID NO: 488728 - DNA, 16 bp, Homo sapiens
taattgtgtttacatt

SEQ ID NO: 488729 - DNA, 14 bp, Homo sapiens
tacagcaaatcctt

SEQ ID NO: 488730 - DNA, 16 bp, Homo sapiens
tacatagtgctaacat

SEQ ID NO: 488731 - DNA, 14 bp, Homo sapiens
tacattaaacatga

SEQ ID NO: 488732 - DNA, 20 bp, Homo sapiens
tacctcaattttcactgtgt

SEQ ID NO: 488733 - DNA, 18 bp, Homo sapiens
tacctctaatagtataaa

SEQ ID NO: 488734 - DNA, 19 bp, Homo sapiens
tacctctaatagtataaac

SEQ ID NO: 488735 - DNA, 16 bp, Homo sapiens
tacctgaatgctctgt

SEQ ID NO: 488736 - DNA, 16 bp, Homo sapiens
taccttagtgcagtta

SEQ ID NO: 488737 - DNA, 17 bp, Homo sapiens
taccttagtgcagttat

SEQ ID NO: 488738 - DNA, 19 bp, Homo sapiens
taccttagtgcagttattt

SEQ ID NO: 488739 - DNA, 14 bp, Homo sapiens
tactgattcaattt

SEQ ID NO: 488740 - DNA, 15 bp, Homo sapiens
tactgtatgatcaaa

SEQ ID NO: 488741 - DNA, 16 bp, Homo sapiens
tactgtatgatcaaat

SEQ ID NO: 488742 - DNA, 17 bp, Homo sapiens
tactgtatgatcaaatg

SEQ ID NO: 488743 - DNA, 22 bp, Homo sapiens
tactgtatgatcaaatgtttaa

SEQ ID NO: 488744 - DNA, 17 bp, Homo sapiens
tacttagtattgcaaag

SEQ ID NO: 488745 - DNA, 14 bp, Homo sapiens
tagaatgtaaatgt

SEQ ID NO: 488746 - DNA, 19 bp, Homo sapiens
tagcattttctgcatctcc

SEQ ID NO: 488747 - DNA, 15 bp, Homo sapiens
tagccagtaatcctg

SEQ ID NO: 488748 - DNA, 16 bp, Homo sapiens
tagccagtaatcctgt

SEQ ID NO: 488749 - DNA, 18 bp, Homo sapiens
tagccagtaatcctgtag

SEQ ID NO: 488750 - DNA, 17 bp, Homo sapiens
tagctctaatgtttgca

SEQ ID NO: 488751 - DNA, 16 bp, Homo sapiens
taggaaggtactgtat

SEQ ID NO: 488752 - DNA, 24 bp, Homo sapiens
taggaaggtactgtatgatcaaat

SEQ ID NO: 488753 - DNA, 22 bp, Homo sapiens
taggttattatgattagctttg

SEQ ID NO: 488754 - DNA, 19 bp, Homo sapiens
taggtttatgacagtaatt

SEQ ID NO: 488755 - DNA, 13 bp, Homo sapiens
tagtaatacctct

SEQ ID NO: 488756 - DNA, 15 bp, Homo sapiens
tagtaatacctctaa

SEQ ID NO: 488757 - DNA, 18 bp, Homo sapiens
tagtattgacaaaatgtt

SEQ ID NO: 488758 - DNA, 19 bp, Homo sapiens
tagtattgacaaaatgtta

SEQ ID NO: 488759 - DNA, 22 bp, Homo sapiens
tagtattgacaaaatgttattt

SEQ ID NO: 488760 - DNA, 15 bp, Homo sapiens
tagtgctaacatgaa

SEQ ID NO: 488761 - DNA, 14 bp, Homo sapiens
tagttatcatgtta

SEQ ID NO: 488762 - DNA, 15 bp, Homo sapiens
tagttatcatgttag

SEQ ID NO: 488763 - DNA, 15 bp, Homo sapiens
tagttcccctgttta

SEQ ID NO: 488764 - DNA, 21 bp, Homo sapiens
tatacctcaattttcactgtg

SEQ ID NO: 488765 - DNA, 22 bp, Homo sapiens
tatacctcaattttcactgtgt

SEQ ID NO: 488766 - DNA, 14 bp, Homo sapiens
tatatttacaaatg

SEQ ID NO: 488767 - DNA, 16 bp, Homo sapiens
tatatttccacttctt

SEQ ID NO: 488768 - DNA, 21 bp, Homo sapiens
tatcatgttagtaatacctct

SEQ ID NO: 488769 - DNA, 15 bp, Homo sapiens
tatgacagtaattgt

SEQ ID NO: 488770 - DNA, 22 bp, Homo sapiens
tatgacagtaattgtgtttaca

SEQ ID NO: 488771 - DNA, 12 bp, Homo sapiens
tatgatcaaatg

SEQ ID NO: 488772 - DNA, 18 bp, Homo sapiens
tatgatcaaatgtttaat

SEQ ID NO: 488773 - DNA, 17 bp, Homo sapiens
tatgatgtgcttaacag

SEQ ID NO: 488774 - DNA, 23 bp, Homo sapiens
tatggatccactggctggacaaa

SEQ ID NO: 488775 - DNA, 18 bp, Homo sapiens
tatggtgcctagtattga

SEQ ID NO: 488776 - DNA, 19 bp, Homo sapiens
tatggtgcctagtattgac

SEQ ID NO: 488777 - DNA, 14 bp, Homo sapiens
tattatgattagct

SEQ ID NO: 488778 - DNA, 16 bp, Homo sapiens
tattcatatgcatatt

SEQ ID NO: 488779 - DNA, 17 bp, Homo sapiens
tattcatatgcatattt

SEQ ID NO: 488780 - DNA, 12 bp, Homo sapiens
tattgacaaaat

SEQ ID NO: 488781 - DNA, 13 bp, Homo sapiens
tattgacaaaatg

SEQ ID NO: 488782 - DNA, 22 bp, Homo sapiens
tattgacaaaatgttatttccc

SEQ ID NO: 488783 - DNA, 16 bp, Homo sapiens
tatttccctacattaa

SEQ ID NO: 488784 - DNA, 17 bp, Homo sapiens
tatttccctacattaaa

SEQ ID NO: 488785 - DNA, 17 bp, Homo sapiens
tatttcctatgatgtat

SEQ ID NO: 488786 - DNA, 20 bp, Homo sapiens
tcaaatgtttaatcatataa

SEQ ID NO: 488787 - DNA, 14 bp, Homo sapiens
tcaaattttatctg

SEQ ID NO: 488788 - DNA, 13 bp, Homo sapiens
tcaacttgcaaaa

SEQ ID NO: 488789 - DNA, 14 bp, Homo sapiens
tcaacttgcaaaat

SEQ ID NO: 488790 - DNA, 18 bp, Homo sapiens
tcaagagtggtatcttgc

SEQ ID NO: 488791 - DNA, 23 bp, Homo sapiens
tcaagggcagctttgctcatatt

SEQ ID NO: 488792 - DNA, 22 bp, Homo sapiens
tcaagtctaccaacctgttcaa

SEQ ID NO: 488793 - DNA, 18 bp, Homo sapiens
tcaagtctaccaattata

SEQ ID NO: 488794 - DNA, 16 bp, Homo sapiens
tcaattcttgccaaat

SEQ ID NO: 488795 - DNA, 19 bp, Homo sapiens
tcaatttatacctcaattt

SEQ ID NO: 488796 - DNA, 15 bp, Homo sapiens
tcaattttcactgtg

SEQ ID NO: 488797 - DNA, 12 bp, Homo sapiens
tcacatttaaat

SEQ ID NO: 488798 - DNA, 14 bp, Homo sapiens
tcactgagcactgt

SEQ ID NO: 488799 - DNA, 16 bp, Homo sapiens
tcactgagcactgttt

SEQ ID NO: 488800 - DNA, 19 bp, Homo sapiens
tcactgagcactgttttct

SEQ ID NO: 488801 - DNA, 23 bp, Homo sapiens
tcaggaacgtttagctgacaaaa

SEQ ID NO: 488802 - DNA, 22 bp, Homo sapiens
tcaggaatcatcaggaacgttt

SEQ ID NO: 488803 - DNA, 13 bp, Homo sapiens
tcatatgcatatt

SEQ ID NO: 488804 - DNA, 18 bp, Homo sapiens
tcatattaagaatgatct

SEQ ID NO: 488805 - DNA, 19 bp, Homo sapiens
tcatcattcacttcactgt

SEQ ID NO: 488806 - DNA, 18 bp, Homo sapiens
tcatgttagtaatacctc

SEQ ID NO: 488807 - DNA, 19 bp, Homo sapiens
tccagttcttcgactgttg

SEQ ID NO: 488808 - DNA, 15 bp, Homo sapiens
tccatttaaacagat

SEQ ID NO: 488809 - DNA, 21 bp, Homo sapiens
tccatttaaacagatgtccat

SEQ ID NO: 488810 - DNA, 19 bp, Homo sapiens
tcccatgatttcatgtact

SEQ ID NO: 488811 - DNA, 17 bp, Homo sapiens
tccccagaatggaggca

SEQ ID NO: 488812 - DNA, 15 bp, Homo sapiens
tcccctgtttattca

SEQ ID NO: 488813 - DNA, 22 bp, Homo sapiens
tcctgtaggaaggtactgtatg

SEQ ID NO: 488814 - DNA, 17 bp, Homo sapiens
tccttgaaggtatatct

SEQ ID NO: 488815 - DNA, 17 bp, Homo sapiens
tcgactgttgttatctg

SEQ ID NO: 488816 - DNA, 21 bp, Homo sapiens
tcgggcagcacaagtgtaatg

SEQ ID NO: 488817 - DNA, 14 bp, Homo sapiens
tctaatgtttgcat

SEQ ID NO: 488818 - DNA, 12 bp, Homo sapiens
tctagtgtatca

SEQ ID NO: 488819 - DNA, 19 bp, Homo sapiens
tctagtgtatcaaaatgct

SEQ ID NO: 488820 - DNA, 16 bp, Homo sapiens
tctatttcataccatg

SEQ ID NO: 488821 - DNA, 11 bp, Homo sapiens
tctcactgagc

SEQ ID NO: 488822 - DNA, 18 bp, Homo sapiens
tctcactgagcactgttt

SEQ ID NO: 488823 - DNA, 18 bp, Homo sapiens
tctcttcttaatgtacat

SEQ ID NO: 488824 - DNA, 15 bp, Homo sapiens
tcttcgactgttgtt

SEQ ID NO: 488825 - DNA, 24 bp, Homo sapiens
tcttcttaatgtacatagtgctaa

SEQ ID NO: 488826 - DNA, 16 bp, Homo sapiens
tcttgtaatttggatc

SEQ ID NO: 488827 - DNA, 21 bp, Homo sapiens
tctttttacccatttgttcat

SEQ ID NO: 488828 - DNA, 19 bp, Homo sapiens
tgaaaagcaggttgataaa

SEQ ID NO: 488829 - DNA, 20 bp, Homo sapiens
tgaaaagctccatttttagt

SEQ ID NO: 488830 - DNA, 20 bp, Homo sapiens
tgaaaatcttataatttaaa

SEQ ID NO: 488831 - DNA, 15 bp, Homo sapiens
tgaaacgcatctagt

SEQ ID NO: 488832 - DNA, 19 bp, Homo sapiens
tgaaaggaagataaacgtg

SEQ ID NO: 488833 - DNA, 19 bp, Homo sapiens
tgaaatggacttttgtaca

SEQ ID NO: 488834 - DNA, 15 bp, Homo sapiens
tgaaattgtattaca

SEQ ID NO: 488835 - DNA, 22 bp, Homo sapiens
tgaacttgtaaaggaatttaaa

SEQ ID NO: 488836 - DNA, 19 bp, Homo sapiens
tgaagacctttttctgcac

SEQ ID NO: 488837 - DNA, 22 bp, Homo sapiens
tgaagacctttttctgcactat

SEQ ID NO: 488838 - DNA, 23 bp, Homo sapiens
tgaagacctttttctgcactata

SEQ ID NO: 488839 - DNA, 13 bp, Homo sapiens
tgaagtaaaacaa

SEQ ID NO: 488840 - DNA, 16 bp, Homo sapiens
tgaataccttagtgca

SEQ ID NO: 488841 - DNA, 22 bp, Homo sapiens
tgaataccttagtgcagttatt

SEQ ID NO: 488842 - DNA, 15 bp, Homo sapiens
tgaatactttataaa

SEQ ID NO: 488843 - DNA, 21 bp, Homo sapiens
tgaatgcttaaagaattcaaa

SEQ ID NO: 488844 - DNA, 22 bp, Homo sapiens
tgaatgcttaaagaattcaaat

SEQ ID NO: 488845 - DNA, 15 bp, Homo sapiens
tgacaaaatgttatt

SEQ ID NO: 488846 - DNA, 23 bp, Homo sapiens
tgacaagaaaggctgctgtactg

SEQ ID NO: 488847 - DNA, 21 bp, Homo sapiens
tgacaagctccatttaaacag

SEQ ID NO: 488848 - DNA, 19 bp, Homo sapiens
tgaccgtgttggtctgtac

SEQ ID NO: 488849 - DNA, 20 bp, Homo sapiens
tgaccgtgttggtctgtact

SEQ ID NO: 488850 - DNA, 21 bp, Homo sapiens
tgaccgtgttggtctgtactg

SEQ ID NO: 488851 - DNA, 21 bp, Homo sapiens
tgactccatagaccttttcat

SEQ ID NO: 488852 - DNA, 17 bp, Homo sapiens
tgagaagctgctcaact

SEQ ID NO: 488853 - DNA, 21 bp, Homo sapiens
tgagaagctgctcaacttgca

SEQ ID NO: 488854 - DNA, 15 bp, Homo sapiens
tgagcactgttttct

SEQ ID NO: 488855 - DNA, 16 bp, Homo sapiens
tgagctacaaatgcat

SEQ ID NO: 488856 - DNA, 18 bp, Homo sapiens
tgaggaacggatcagatg

SEQ ID NO: 488857 - DNA, 14 bp, Homo sapiens
tgataaatcatttt

SEQ ID NO: 488858 - DNA, 15 bp, Homo sapiens
tgataaatcatttta

SEQ ID NO: 488859 - DNA, 13 bp, Homo sapiens
tgatgtgcttaac

SEQ ID NO: 488860 - DNA, 17 bp, Homo sapiens
tgatgtgcttaacaggg

SEQ ID NO: 488861 - DNA, 14 bp, Homo sapiens
tgattcaatttgat

SEQ ID NO: 488862 - DNA, 15 bp, Homo sapiens
tgatttcatgtactg

SEQ ID NO: 488863 - DNA, 20 bp, Homo sapiens
tgcaaaatcagttttcctct

SEQ ID NO: 488864 - DNA, 17 bp, Homo sapiens
tgcaaagtcaggaatca

SEQ ID NO: 488865 - DNA, 18 bp, Homo sapiens
tgcaaagtcaggaatcat

SEQ ID NO: 488866 - DNA, 16 bp, Homo sapiens
tgcaatacaagtttca

SEQ ID NO: 488867 - DNA, 14 bp, Homo sapiens
tgcacagcatctca

SEQ ID NO: 488868 - DNA, 12 bp, Homo sapiens
tgcactatatgc

SEQ ID NO: 488869 - DNA, 14 bp, Homo sapiens
tgcagaacaaatga

SEQ ID NO: 488870 - DNA, 21 bp, Homo sapiens
tgcagtatcggcactgtacaa

SEQ ID NO: 488871 - DNA, 14 bp, Homo sapiens
tgcatccctggctg

SEQ ID NO: 488872 - DNA, 15 bp, Homo sapiens
tgcattatttgagaa

SEQ ID NO: 488873 - DNA, 19 bp, Homo sapiens
tgccacacgagaacctgaa

SEQ ID NO: 488874 - DNA, 17 bp, Homo sapiens
tgctcaacttgcaaaat

SEQ ID NO: 488875 - DNA, 24 bp, Homo sapiens
tgctcatatttcccatgatttcat

SEQ ID NO: 488876 - DNA, 13 bp, Homo sapiens
tgctgcttcaatt

SEQ ID NO: 488877 - DNA, 14 bp, Homo sapiens
tgctgcttcaattt

SEQ ID NO: 488878 - DNA, 23 bp, Homo sapiens
tgctgttgttatgatgtgcttaa

SEQ ID NO: 488879 - DNA, 16 bp, Homo sapiens
tgcttatattgttcac

SEQ ID NO: 488880 - DNA, 13 bp, Homo sapiens
tggaaacaagatg

SEQ ID NO: 488881 - DNA, 14 bp, Homo sapiens
accagttgctgctt

SEQ ID NO: 488882 - DNA, 21 bp, Homo sapiens
acccttaaacagttgcacagc

SEQ ID NO: 488883 - DNA, 18 bp, Homo sapiens
acctcaattttcactgtg

SEQ ID NO: 488884 - DNA, 16 bp, Homo sapiens
acctctaatagtataa

SEQ ID NO: 488885 - DNA, 17 bp, Homo sapiens
accttagtgcagttatt

SEQ ID NO: 488886 - DNA, 21 bp, Homo sapiens
accttagtgcagttatttgct

SEQ ID NO: 488887 - DNA, 14 bp, Homo sapiens
acgagaaaacaata

SEQ ID NO: 488888 - DNA, 14 bp, Homo sapiens
actaactaaaacaa

SEQ ID NO: 488889 - DNA, 17 bp, Homo sapiens
actaatacagctgagct

SEQ ID NO: 488890 - DNA, 12 bp, Homo sapiens
actactcagcat

SEQ ID NO: 488891 - DNA, 17 bp, Homo sapiens
actactcagcatggaaa

SEQ ID NO: 488892 - DNA, 14 bp, Homo sapiens
actagctatggtgt

SEQ ID NO: 488893 - DNA, 11 bp, Homo sapiens
actcagcatgg

SEQ ID NO: 488894 - DNA, 19 bp, Homo sapiens
actccatagaccttttcat

SEQ ID NO: 488895 - DNA, 13 bp, Homo sapiens
actgagcactgtt

SEQ ID NO: 488896 - DNA, 14 bp, Homo sapiens
actgcattatttga

SEQ ID NO: 488897 - DNA, 17 bp, Homo sapiens
actgtacaaaaaaatct

SEQ ID NO: 488898 - DNA, 14 bp, Homo sapiens
actgtatgatcaaa

SEQ ID NO: 488899 - DNA, 18 bp, Homo sapiens
actgtatgatcaaatgtt

SEQ ID NO: 488900 - DNA, 24 bp, Homo sapiens
actgtatgatcaaatgtttaatca

SEQ ID NO: 488901 - DNA, 13 bp, Homo sapiens
actgtgctgttgt

SEQ ID NO: 488902 - DNA, 17 bp, Homo sapiens
actgttgttatctgttt

SEQ ID NO: 488903 - DNA, 20 bp, Homo sapiens
actgtttcactactcagcat

SEQ ID NO: 488904 - DNA, 13 bp, Homo sapiens
actgttttctagt

SEQ ID NO: 488905 - DNA, 23 bp, Homo sapiens
actgttttctagtgtatcaaaat

SEQ ID NO: 488906 - DNA, 17 bp, Homo sapiens
acttacagcaaatcctt

SEQ ID NO: 488907 - DNA, 21 bp, Homo sapiens
acttagcattttctgcatctc

SEQ ID NO: 488908 - DNA, 17 bp, Homo sapiens
acttcactgtgctgttg

SEQ ID NO: 488909 - DNA, 24 bp, Homo sapiens
acttcactgtgctgttgttatgat

SEQ ID NO: 488910 - DNA, 17 bp, Homo sapiens
acttcgtttaatgaatg

SEQ ID NO: 488911 - DNA, 20 bp, Homo sapiens
acttcgtttaatgaatgctt

SEQ ID NO: 488912 - DNA, 22 bp, Homo sapiens
actttattttctataatttaaa

SEQ ID NO: 488913 - DNA, 20 bp, Homo sapiens
agaaaacatgcagaacaaat

SEQ ID NO: 488914 - DNA, 15 bp, Homo sapiens
agaaaggctgctgta

SEQ ID NO: 488915 - DNA, 20 bp, Homo sapiens
agaatccagcaccggcccca

SEQ ID NO: 488916 - DNA, 17 bp, Homo sapiens
agaatgtaaatgtctca

SEQ ID NO: 488917 - DNA, 22 bp, Homo sapiens
agaatgtaaatgtctcactgag

SEQ ID NO: 488918 - DNA, 14 bp, Homo sapiens
agacctttttctgc

SEQ ID NO: 488919 - DNA, 18 bp, Homo sapiens
agacctttttctgcacta

SEQ ID NO: 488920 - DNA, 16 bp, Homo sapiens
agagaaaacatgcaga

SEQ ID NO: 488921 - DNA, 20 bp, Homo sapiens
agataaacgtggatgttact

SEQ ID NO: 488922 - DNA, 15 bp, Homo sapiens
agatgaaattccatt

SEQ ID NO: 488923 - DNA, 16 bp, Homo sapiens
agatgggacaattaga

SEQ ID NO: 488924 - DNA, 13 bp, Homo sapiens
agattcagctagt

SEQ ID NO: 488925 - DNA, 20 bp, Homo sapiens
agcaaatcctttgtgaaaaa

SEQ ID NO: 488926 - DNA, 18 bp, Homo sapiens
agcaggttgataaatcat

SEQ ID NO: 488927 - DNA, 13 bp, Homo sapiens
agcagtgttagct

SEQ ID NO: 488928 - DNA, 15 bp, Homo sapiens
agcatctcagctcat

SEQ ID NO: 488929 - DNA, 14 bp, Homo sapiens
agccagtaatcctg

SEQ ID NO: 488930 - DNA, 15 bp, Homo sapiens
agccagtaatcctgt

SEQ ID NO: 488931 - DNA, 13 bp, Homo sapiens
agctacaaatgca

SEQ ID NO: 488932 - DNA, 18 bp, Homo sapiens
agctccatttaaacagat

SEQ ID NO: 488933 - DNA, 21 bp, Homo sapiens
agctccatttaaacagatgtc

SEQ ID NO: 488934 - DNA, 17 bp, Homo sapiens
agctctaatgtttgcat

SEQ ID NO: 488935 - DNA, 20 bp, Homo sapiens
agctgctcaacttgcaaaat

SEQ ID NO: 488936 - DNA, 21 bp, Homo sapiens
agctttgctcatatttcccat

SEQ ID NO: 488937 - DNA, 15 bp, Homo sapiens
aggaaggtactgtat

SEQ ID NO: 488938 - DNA, 15 bp, Homo sapiens
agggaagtagttatc

SEQ ID NO: 488939 - DNA, 20 bp, Homo sapiens
agggaagtagttatcatgtt

SEQ ID NO: 488940 - DNA, 16 bp, Homo sapiens
agggcagctttgctca

SEQ ID NO: 488941 - DNA, 11 bp, Homo sapiens
aggtactgtat

SEQ ID NO: 488942 - DNA, 22 bp, Homo sapiens
aggtactgtatgatcaaatgtt

SEQ ID NO: 488943 - DNA, 20 bp, Homo sapiens
aggttgataaatcattttat

SEQ ID NO: 488944 - DNA, 14 bp, Homo sapiens
aggtttatgacagt

SEQ ID NO: 488945 - DNA, 16 bp, Homo sapiens
aggtttatgacagtaa

SEQ ID NO: 488946 - DNA, 22 bp, Homo sapiens
aggtttatgacagtaattgtgt

SEQ ID NO: 488947 - DNA, 16 bp, Homo sapiens
agtaaaacaaacaata

SEQ ID NO: 488948 - DNA, 20 bp, Homo sapiens
agtaaaacaaacaatacctg

SEQ ID NO: 488949 - DNA, 12 bp, Homo sapiens
agtaatcctgta

SEQ ID NO: 488950 - DNA, 16 bp, Homo sapiens
agtaattgtgtttaca

SEQ ID NO: 488951 - DNA, 22 bp, Homo sapiens
agtaattgtgtttacattttat

SEQ ID NO: 488952 - DNA, 15 bp, Homo sapiens
agtagttatcatgtt

SEQ ID NO: 488953 - DNA, 23 bp, Homo sapiens
agtagttatcatgttagtaatac

SEQ ID NO: 488954 - DNA, 20 bp, Homo sapiens
agtattgacaaaatgttatt

SEQ ID NO: 488955 - DNA, 22 bp, Homo sapiens
agtattgacaaaatgttatttc

SEQ ID NO: 488956 - DNA, 17 bp, Homo sapiens
agtcagattcttgcatc

SEQ ID NO: 488957 - DNA, 21 bp, Homo sapiens
agtctaccaacctgttcaagt

SEQ ID NO: 488958 - DNA, 15 bp, Homo sapiens
agtgaaagaaaataa

SEQ ID NO: 488959 - DNA, 17 bp, Homo sapiens
agtgaaagaaaataaca

SEQ ID NO: 488960 - DNA, 17 bp, Homo sapiens
agtgactaaaccattgt

SEQ ID NO: 488961 - DNA, 22 bp, Homo sapiens
agtgactaaaccattgtgcatt

SEQ ID NO: 488962 - DNA, 16 bp, Homo sapiens
agtgctaacatgaaga

SEQ ID NO: 488963 - DNA, 13 bp, Homo sapiens
agttatcatgtta

SEQ ID NO: 488964 - DNA, 14 bp, Homo sapiens
agttatcatgttag

SEQ ID NO: 488965 - DNA, 17 bp, Homo sapiens
agttatcatgttagtaa

SEQ ID NO: 488966 - DNA, 22 bp, Homo sapiens
agttatcatgttagtaatacct

SEQ ID NO: 488967 - DNA, 17 bp, Homo sapiens
agttcctgtgcacagcc

SEQ ID NO: 488968 - DNA, 17 bp, Homo sapiens
agttcttcgactgttgt

SEQ ID NO: 488969 - DNA, 12 bp, Homo sapiens
agttgcacagca

SEQ ID NO: 488970 - DNA, 13 bp, Homo sapiens
agttgcacagcat

SEQ ID NO: 488971 - DNA, 22 bp, Homo sapiens
agttgcataggtttaataattt

SEQ ID NO: 488972 - DNA, 14 bp, Homo sapiens
agttgttgtagaga

SEQ ID NO: 488973 - DNA, 14 bp, Homo sapiens
agtttaaattgtaa

SEQ ID NO: 488974 - DNA, 17 bp, Homo sapiens
ataaaattatagctcta

SEQ ID NO: 488975 - DNA, 17 bp, Homo sapiens
ataaacgtggatgttac

SEQ ID NO: 488976 - DNA, 13 bp, Homo sapiens
ataaataaaaata

SEQ ID NO: 488977 - DNA, 19 bp, Homo sapiens
ataaatagaatgtaaatgt

SEQ ID NO: 488978 - DNA, 20 bp, Homo sapiens
ataaatagaatgtaaatgtc

SEQ ID NO: 488979 - DNA, 19 bp, Homo sapiens
ataagggcaaattggagaa

SEQ ID NO: 488980 - DNA, 18 bp, Homo sapiens
ataatcctaaacatatga

SEQ ID NO: 488981 - DNA, 16 bp, Homo sapiens
atacagcttttggatt

SEQ ID NO: 488982 - DNA, 18 bp, Homo sapiens
atacctctaatagtataa

SEQ ID NO: 488983 - DNA, 19 bp, Homo sapiens
atacctctaatagtataaa

SEQ ID NO: 488984 - DNA, 19 bp, Homo sapiens
atacctgaatgctctgtag

SEQ ID NO: 488985 - DNA, 18 bp, Homo sapiens
ataccttagtgcagttat

SEQ ID NO: 488986 - DNA, 14 bp, Homo sapiens
atagaatgtaaatg

SEQ ID NO: 488987 - DNA, 19 bp, Homo sapiens
atagctctaatgtttgcat

SEQ ID NO: 488988 - DNA, 12 bp, Homo sapiens
atagtataaacc

SEQ ID NO: 488989 - DNA, 14 bp, Homo sapiens
atagtgctaacatg

SEQ ID NO: 488990 - DNA, 19 bp, Homo sapiens
atagtgctaacatgaagac

SEQ ID NO: 488991 - DNA, 15 bp, Homo sapiens
atataaatagaatgt

SEQ ID NO: 488992 - DNA, 22 bp, Homo sapiens
atataagggaagtagttatcat

SEQ ID NO: 488993 - DNA, 19 bp, Homo sapiens
atatatactcaagagtggt

SEQ ID NO: 488994 - DNA, 19 bp, Homo sapiens
atatctaggtttatgacag

SEQ ID NO: 488995 - DNA, 21 bp, Homo sapiens
atatttcccatgatttcatgt

SEQ ID NO: 488996 - DNA, 22 bp, Homo sapiens
atatttcccatgatttcatgta

SEQ ID NO: 488997 - DNA, 15 bp, Homo sapiens
atcaaatgtttaatc

SEQ ID NO: 488998 - DNA, 16 bp, Homo sapiens
atcaaatgtttaatca

SEQ ID NO: 488999 - DNA, 18 bp, Homo sapiens
cataccatggaggaaggc

SEQ ID NO: 489000 - DNA, 18 bp, Homo sapiens
catagtgctaacatgaag

SEQ ID NO: 489001 - DNA, 19 bp, Homo sapiens
catagtgctaacatgaaga

SEQ ID NO: 489002 - DNA, 16 bp, Homo sapiens
catataaatagaatgt

SEQ ID NO: 489003 - DNA, 22 bp, Homo sapiens
catataaatagaatgtaaatgt

SEQ ID NO: 489004 - DNA, 18 bp, Homo sapiens
catatggatccactggct

SEQ ID NO: 489005 - DNA, 15 bp, Homo sapiens
catattaagaatgat

SEQ ID NO: 489006 - DNA, 19 bp, Homo sapiens
catattaagaatgatctga

SEQ ID NO: 489007 - DNA, 22 bp, Homo sapiens
catcaagtctttcacatttaaa

SEQ ID NO: 489008 - DNA, 16 bp, Homo sapiens
catcattcacttcact

SEQ ID NO: 489009 - DNA, 17 bp, Homo sapiens
catcattcacttcactg

SEQ ID NO: 489010 - DNA, 15 bp, Homo sapiens
catgaagaccttttt

SEQ ID NO: 489011 - DNA, 17 bp, Homo sapiens
catgaagacctttttct

SEQ ID NO: 489012 - DNA, 19 bp, Homo sapiens
catgaagacctttttctgc

SEQ ID NO: 489013 - DNA, 13 bp, Homo sapiens
catgatttcatgt

SEQ ID NO: 489014 - DNA, 19 bp, Homo sapiens
catgcagaacaaatgaaga

SEQ ID NO: 489015 - DNA, 23 bp, Homo sapiens
catggaaacaagatgaaattcca

SEQ ID NO: 489016 - DNA, 17 bp, Homo sapiens
catgtactgcattattt

SEQ ID NO: 489017 - DNA, 23 bp, Homo sapiens
catgtactgcattatttgagaag

SEQ ID NO: 489018 - DNA, 14 bp, Homo sapiens
cattcacttcactg

SEQ ID NO: 489019 - DNA, 19 bp, Homo sapiens
cattcacttcactgtgctg

SEQ ID NO: 489020 - DNA, 12 bp, Homo sapiens
cattcttcaaga

SEQ ID NO: 489021 - DNA, 17 bp, Homo sapiens
cattcttcaagatccca

SEQ ID NO: 489022 - DNA, 19 bp, Homo sapiens
catttaaacagatgtccat

SEQ ID NO: 489023 - DNA, 22 bp, Homo sapiens
catttgtgggtttttatttcct

SEQ ID NO: 489024 - DNA, 23 bp, Homo sapiens
catttgtgggtttttatttccta

SEQ ID NO: 489025 - DNA, 13 bp, Homo sapiens
catttgttcatat

SEQ ID NO: 489026 - DNA, 22 bp, Homo sapiens
ccaaaaattacttagtattgca

SEQ ID NO: 489027 - DNA, 20 bp, Homo sapiens
ccacctgacattccttgctg

SEQ ID NO: 489028 - DNA, 12 bp, Homo sapiens
ccacttggcatt

SEQ ID NO: 489029 - DNA, 12 bp, Homo sapiens
ccatcagatgac

SEQ ID NO: 489030 - DNA, 15 bp, Homo sapiens
ccatgatttcatgta

SEQ ID NO: 489031 - DNA, 18 bp, Homo sapiens
ccatgatttcatgtactg

SEQ ID NO: 489032 - DNA, 12 bp, Homo sapiens
ccattgtgcatt

SEQ ID NO: 489033 - DNA, 18 bp, Homo sapiens
ccgtgttggtctgtactg

SEQ ID NO: 489034 - DNA, 22 bp, Homo sapiens
cctatgatgtatactgccacta

SEQ ID NO: 489035 - DNA, 20 bp, Homo sapiens
cctgccttttagttcctgtg

SEQ ID NO: 489036 - DNA, 19 bp, Homo sapiens
cctgtaggaaggtactgta

SEQ ID NO: 489037 - DNA, 12 bp, Homo sapiens
cctgtgcacagc

SEQ ID NO: 489038 - DNA, 21 bp, Homo sapiens
cctgtttattcatatgcatat

SEQ ID NO: 489039 - DNA, 14 bp, Homo sapiens
ccttgaaggtatat

SEQ ID NO: 489040 - DNA, 13 bp, Homo sapiens
cctttgtgaaaaa

SEQ ID NO: 489041 - DNA, 14 bp, Homo sapiens
cctttttctgcact

SEQ ID NO: 489042 - DNA, 18 bp, Homo sapiens
cctttttctgcactatat

SEQ ID NO: 489043 - DNA, 11 bp, Homo sapiens
cgactgttgtt

SEQ ID NO: 489044 - DNA, 19 bp, Homo sapiens
cgactgttgttatctgttt

SEQ ID NO: 489045 - DNA, 22 bp, Homo sapiens
cgcatctagttcccctgtttat

SEQ ID NO: 489046 - DNA, 16 bp, Homo sapiens
cgtttagctgacaaaa

SEQ ID NO: 489047 - DNA, 20 bp, Homo sapiens
ctaaactccaaacatcctct

SEQ ID NO: 489048 - DNA, 16 bp, Homo sapiens
ctaacatgaagacctt

SEQ ID NO: 489049 - DNA, 20 bp, Homo sapiens
ctaactaaaacaaagccact

SEQ ID NO: 489050 - DNA, 14 bp, Homo sapiens
ctaatagtataaac

SEQ ID NO: 489051 - DNA, 23 bp, Homo sapiens
ctacacgagatacagaattttat

SEQ ID NO: 489052 - DNA, 16 bp, Homo sapiens
ctaccaacctgttcaa

SEQ ID NO: 489053 - DNA, 15 bp, Homo sapiens
ctagtattgacaaaa

SEQ ID NO: 489054 - DNA, 21 bp, Homo sapiens
ctagttcccctgtttattcat

SEQ ID NO: 489055 - DNA, 12 bp, Homo sapiens
ctataatttaaa

SEQ ID NO: 489056 - DNA, 20 bp, Homo sapiens
ctatattgctgaatgcaaga

SEQ ID NO: 489057 - DNA, 14 bp, Homo sapiens
ctatgatgtatact

SEQ ID NO: 489058 - DNA, 15 bp, Homo sapiens
ctcaataaaattata

SEQ ID NO: 489059 - DNA, 17 bp, Homo sapiens
ctcaattttcactgtgt

SEQ ID NO: 489060 - DNA, 13 bp, Homo sapiens
ctcacatttatat

SEQ ID NO: 489061 - DNA, 16 bp, Homo sapiens
ctcactgagcactgtt

SEQ ID NO: 489062 - DNA, 18 bp, Homo sapiens
ctcactgagcactgtttt

SEQ ID NO: 489063 - DNA, 18 bp, Homo sapiens
ctcattccctccccagaa

SEQ ID NO: 489064 - DNA, 17 bp, Homo sapiens
ctccacttggcattagc

SEQ ID NO: 489065 - DNA, 13 bp, Homo sapiens
ctcttatttcatc

SEQ ID NO: 489066 - DNA, 18 bp, Homo sapiens
ctgacattccttgctgaa

SEQ ID NO: 489067 - DNA, 16 bp, Homo sapiens
ctgattcaatttgatg

SEQ ID NO: 489068 - DNA, 23 bp, Homo sapiens
ctgattgaccgtgttggtctgta

SEQ ID NO: 489069 - DNA, 17 bp, Homo sapiens
ctgcaccagttgctgct

SEQ ID NO: 489070 - DNA, 17 bp, Homo sapiens
ctgcattatttgagaag

SEQ ID NO: 489071 - DNA, 24 bp, Homo sapiens
ctgcattatttgagaagctgctca

SEQ ID NO: 489072 - DNA, 17 bp, Homo sapiens
ctgccttttagttcctg

SEQ ID NO: 489073 - DNA, 23 bp, Homo sapiens
ctgccttttagttcctgtgcaca

SEQ ID NO: 489074 - DNA, 17 bp, Homo sapiens
ctgtactgattcaattt

SEQ ID NO: 489075 - DNA, 21 bp, Homo sapiens
ctgtactgattcaatttgatg

SEQ ID NO: 489076 - DNA, 21 bp, Homo sapiens
ctgtatgatcaaatgtttaat

SEQ ID NO: 489077 - DNA, 18 bp, Homo sapiens
ctgtccgagtgtgccaca

SEQ ID NO: 489078 - DNA, 13 bp, Homo sapiens
ctgtgctgttgtt

SEQ ID NO: 489079 - DNA, 22 bp, Homo sapiens
ctgttgttatctgtttgagaaa

SEQ ID NO: 489080 - DNA, 20 bp, Homo sapiens
ctgtttattcatatgcatat

SEQ ID NO: 489081 - DNA, 12 bp, Homo sapiens
ctgtttgagaaa

SEQ ID NO: 489082 - DNA, 19 bp, Homo sapiens
cttagtgcagttatttgct

SEQ ID NO: 489083 - DNA, 18 bp, Homo sapiens
cttcaagatcccatttga

SEQ ID NO: 489084 - DNA, 15 bp, Homo sapiens
cttcgtttaatgaat

SEQ ID NO: 489085 - DNA, 15 bp, Homo sapiens
cttgcaaaatcagtt

SEQ ID NO: 489086 - DNA, 16 bp, Homo sapiens
cttgcaaaatcagttt

SEQ ID NO: 489087 - DNA, 18 bp, Homo sapiens
cttgcagtatcggcactg

SEQ ID NO: 489088 - DNA, 20 bp, Homo sapiens
cttgcagtatcggcactgta

SEQ ID NO: 489089 - DNA, 18 bp, Homo sapiens
cttgtaaaggaatttaaa

SEQ ID NO: 489090 - DNA, 13 bp, Homo sapiens
cttttcatttgtg

SEQ ID NO: 489091 - DNA, 18 bp, Homo sapiens
cttttggattggacaaaa

SEQ ID NO: 489092 - DNA, 21 bp, Homo sapiens
cttttggattggacaaaatga

SEQ ID NO: 489093 - DNA, 23 bp, Homo sapiens
cttttggattggacaaaatgact

SEQ ID NO: 489094 - DNA, 22 bp, Homo sapiens
ctttttacccatttgttcatat

SEQ ID NO: 489095 - DNA, 20 bp, Homo sapiens
ctttttctgcactatatgca

SEQ ID NO: 489096 - DNA, 19 bp, Homo sapiens
gaaaatcttataatttaaa

SEQ ID NO: 489097 - DNA, 16 bp, Homo sapiens
gaaagtgagcagtgtt

SEQ ID NO: 489098 - DNA, 23 bp, Homo sapiens
gaacccttaaacagttgcacagc

SEQ ID NO: 489099 - DNA, 20 bp, Homo sapiens
gaacgtttagctgacaaaat

SEQ ID NO: 489100 - DNA, 23 bp, Homo sapiens
gaagacaaaacatacattttgta

SEQ ID NO: 489101 - DNA, 15 bp, Homo sapiens
gaagataaacgtgga

SEQ ID NO: 489102 - DNA, 14 bp, Homo sapiens
gaagctgctcaact

SEQ ID NO: 489103 - DNA, 13 bp, Homo sapiens
gaaggtactgtat

SEQ ID NO: 489104 - DNA, 14 bp, Homo sapiens
gaagtagttatcat

SEQ ID NO: 489105 - DNA, 19 bp, Homo sapiens
gaagtagttatcatgttag

SEQ ID NO: 489106 - DNA, 20 bp, Homo sapiens
gaataccttagtgcagttat

SEQ ID NO: 489107 - DNA, 14 bp, Homo sapiens
gaatactttataaa

SEQ ID NO: 489108 - DNA, 13 bp, Homo sapiens
gaatgatctgatt

SEQ ID NO: 489109 - DNA, 23 bp, Homo sapiens
gaatgcttaaagaattcaaattt

SEQ ID NO: 489110 - DNA, 18 bp, Homo sapiens
gaattcaaattttatctg

SEQ ID NO: 489111 - DNA, 13 bp, Homo sapiens
gacaaaatgttat

SEQ ID NO: 489112 - DNA, 22 bp, Homo sapiens
gacaattagataaatgtccatt

SEQ ID NO: 489113 - DNA, 15 bp, Homo sapiens
gacagtaattgtgtt

SEQ ID NO: 489114 - DNA, 20 bp, Homo sapiens
gacagtaattgtgtttacat

SEQ ID NO: 489115 - DNA, 22 bp, Homo sapiens
gacagtaattgtgtttacattt

SEQ ID NO: 489116 - DNA, 16 bp, Homo sapiens
gacattccttgctgaa

SEQ ID NO: 489117 - DNA, 15 bp, Homo sapiens
tgaaattccatttgt

SEQ ID NO: 489118 - DNA, 21 bp, Homo sapiens
tgaagacctttttctgcacta

SEQ ID NO: 489119 - DNA, 23 bp, Homo sapiens
tgaagtaaaacaaacaatacctg

SEQ ID NO: 489120 - DNA, 22 bp, Homo sapiens
tgacaaaatacttgtctgtttt

SEQ ID NO: 489121 - DNA, 13 bp, Homo sapiens
tgacaaaatgtta

SEQ ID NO: 489122 - DNA, 14 bp, Homo sapiens
tgacaaaatgttat

SEQ ID NO: 489123 - DNA, 20 bp, Homo sapiens
tgacaaaatgttatttccct

SEQ ID NO: 489124 - DNA, 14 bp, Homo sapiens
tgacagtaattgtg

SEQ ID NO: 489125 - DNA, 21 bp, Homo sapiens
tgacagtaattgtgtttacat

SEQ ID NO: 489126 - DNA, 20 bp, Homo sapiens
tgagaaagtcagattcttgc

SEQ ID NO: 489127 - DNA, 21 bp, Homo sapiens
tgagaaagtcagattcttgca

SEQ ID NO: 489128 - DNA, 14 bp, Homo sapiens
tgagaagctgctca

SEQ ID NO: 489129 - DNA, 16 bp, Homo sapiens
tgagaagctgctcaac

SEQ ID NO: 489130 - DNA, 13 bp, Homo sapiens
tgagcactgtttt

SEQ ID NO: 489131 - DNA, 22 bp, Homo sapiens
tgagcactgttttctagtgtat

SEQ ID NO: 489132 - DNA, 20 bp, Homo sapiens
tgataaatcattttatgtca

SEQ ID NO: 489133 - DNA, 13 bp, Homo sapiens
tgatcaaatgttt

SEQ ID NO: 489134 - DNA, 14 bp, Homo sapiens
tgatcaaatgttta

SEQ ID NO: 489135 - DNA, 18 bp, Homo sapiens
tgatcaaatgtttaatca

SEQ ID NO: 489136 - DNA, 19 bp, Homo sapiens
tgatcaaatgtttaatcat

SEQ ID NO: 489137 - DNA, 22 bp, Homo sapiens
tgatcaaatgtttaatcatata

SEQ ID NO: 489138 - DNA, 23 bp, Homo sapiens
tgatgctacaggatttgaaattg

SEQ ID NO: 489139 - DNA, 16 bp, Homo sapiens
tgatgtggtgaaaagc

SEQ ID NO: 489140 - DNA, 22 bp, Homo sapiens
tgattagtgaaaggaagataaa

SEQ ID NO: 489141 - DNA, 16 bp, Homo sapiens
tgattcaatttgatgt

SEQ ID NO: 489142 - DNA, 18 bp, Homo sapiens
tgatttcatgtactgcat

SEQ ID NO: 489143 - DNA, 18 bp, Homo sapiens
tgcaatacaagtttcatc

SEQ ID NO: 489144 - DNA, 15 bp, Homo sapiens
tgcacagcatctcag

SEQ ID NO: 489145 - DNA, 15 bp, Homo sapiens
tgcactatatgcaaa

SEQ ID NO: 489146 - DNA, 17 bp, Homo sapiens
tgcactatatgcaaaca

SEQ ID NO: 489147 - DNA, 20 bp, Homo sapiens
tgcactatatgcaaacaggg

SEQ ID NO: 489148 - DNA, 15 bp, Homo sapiens
tgcagaacaaatgaa

SEQ ID NO: 489149 - DNA, 21 bp, Homo sapiens
tgcatataagggaagtagtta

SEQ ID NO: 489150 - DNA, 22 bp, Homo sapiens
tgcatataagggaagtagttat

SEQ ID NO: 489151 - DNA, 23 bp, Homo sapiens
tgcatataagggaagtagttatc

SEQ ID NO: 489152 - DNA, 23 bp, Homo sapiens
tgcatctccacttggcattagct

SEQ ID NO: 489153 - DNA, 23 bp, Homo sapiens
tgcattatttgagaagctgctca

SEQ ID NO: 489154 - DNA, 18 bp, Homo sapiens
tgccaaatataaataaaa

SEQ ID NO: 489155 - DNA, 15 bp, Homo sapiens
tgcctagtattgaca

SEQ ID NO: 489156 - DNA, 17 bp, Homo sapiens
tgctaacatgaagacct

SEQ ID NO: 489157 - DNA, 19 bp, Homo sapiens
tgctaacatgaagaccttt

SEQ ID NO: 489158 - DNA, 15 bp, Homo sapiens
tgctcatatttccca

SEQ ID NO: 489159 - DNA, 20 bp, Homo sapiens
tgctgaaacgcatctagttc

SEQ ID NO: 489160 - DNA, 15 bp, Homo sapiens
tgctgttgttatgat

SEQ ID NO: 489161 - DNA, 18 bp, Homo sapiens
tgctgttgttatgatgtg

SEQ ID NO: 489162 - DNA, 19 bp, Homo sapiens
tgctgttgttatgatgtgc

SEQ ID NO: 489163 - DNA, 20 bp, Homo sapiens
tgctgttgttatgatgtgct

SEQ ID NO: 489164 - DNA, 20 bp, Homo sapiens
tgcttaaagaattcaaattt

SEQ ID NO: 489165 - DNA, 19 bp, Homo sapiens
tggatctcttcttaatgta

SEQ ID NO: 489166 - DNA, 23 bp, Homo sapiens
tggctagattaaccttctctgtc

SEQ ID NO: 489167 - DNA, 19 bp, Homo sapiens
tggctcgttggctagatta

SEQ ID NO: 489168 - DNA, 14 bp, Homo sapiens
tggctggacaaact

SEQ ID NO: 489169 - DNA, 21 bp, Homo sapiens
tggcttgagtttaaattgtaa

SEQ ID NO: 489170 - DNA, 14 bp, Homo sapiens
tgggagtacaaaag

SEQ ID NO: 489171 - DNA, 17 bp, Homo sapiens
tgtaaatgtctcactga

SEQ ID NO: 489172 - DNA, 14 bp, Homo sapiens
tgtaatgaatacct

SEQ ID NO: 489173 - DNA, 17 bp, Homo sapiens
tgtacaaaaaaatcttc

SEQ ID NO: 489174 - DNA, 22 bp, Homo sapiens
tgtacaaaaaaatcttccaatt

SEQ ID NO: 489175 - DNA, 14 bp, Homo sapiens
tgtacatagtgcta

SEQ ID NO: 489176 - DNA, 20 bp, Homo sapiens
tgtacatagtgctaacatga

SEQ ID NO: 489177 - DNA, 21 bp, Homo sapiens
tgtacatagtgctaacatgaa

SEQ ID NO: 489178 - DNA, 18 bp, Homo sapiens
tgtactgaagtaaaacaa

SEQ ID NO: 489179 - DNA, 17 bp, Homo sapiens
tgtagataatacagttc

SEQ ID NO: 489180 - DNA, 16 bp, Homo sapiens
tgtaggaaggtactgt

SEQ ID NO: 489181 - DNA, 18 bp, Homo sapiens
tgtatgatcaaatgttta

SEQ ID NO: 489182 - DNA, 20 bp, Homo sapiens
tgtatgatcaaatgtttaat

SEQ ID NO: 489183 - DNA, 22 bp, Homo sapiens
tgtattacaaatccaatgaaat

SEQ ID NO: 489184 - DNA, 15 bp, Homo sapiens
tgtcaagattcagct

SEQ ID NO: 489185 - DNA, 18 bp, Homo sapiens
tgtccatcagatgacaag

SEQ ID NO: 489186 - DNA, 17 bp, Homo sapiens
tgttatctgtttgagaa

SEQ ID NO: 489187 - DNA, 18 bp, Homo sapiens
tgttatctgtttgagaaa

SEQ ID NO: 489188 - DNA, 21 bp, Homo sapiens
tgttatttccctacattaaac

SEQ ID NO: 489189 - DNA, 14 bp, Homo sapiens
tgttggtctgtact

SEQ ID NO: 489190 - DNA, 21 bp, Homo sapiens
tgttgttatctgtttgagaaa

SEQ ID NO: 489191 - DNA, 13 bp, Homo sapiens
tgtttgcatataa

SEQ ID NO: 489192 - DNA, 17 bp, Homo sapiens
tgttttaaaaacctgtt

SEQ ID NO: 489193 - DNA, 18 bp, Homo sapiens
tgttttctagtgtatcaa

SEQ ID NO: 489194 - DNA, 18 bp, Homo sapiens
ttaaaaacctgttcaagt

SEQ ID NO: 489195 - DNA, 15 bp, Homo sapiens
ttaaagaattcaaat

SEQ ID NO: 489196 - DNA, 19 bp, Homo sapiens
ttaaagaattcaaatttta

SEQ ID NO: 489197 - DNA, 20 bp, Homo sapiens
ttaactgacaagctccattt

SEQ ID NO: 489198 - DNA, 15 bp, Homo sapiens
ttaagaatgatctga

SEQ ID NO: 489199 - DNA, 15 bp, Homo sapiens
ttaatgaatgcttaa

SEQ ID NO: 489200 - DNA, 17 bp, Homo sapiens
ttaatgaatgcttaaag

SEQ ID NO: 489201 - DNA, 24 bp, Homo sapiens
ttactccaaaacttcgtttaatga

SEQ ID NO: 489202 - DNA, 13 bp, Homo sapiens
ttacttagtattg

SEQ ID NO: 489203 - DNA, 19 bp, Homo sapiens
ttacttagtattgcaaagt

SEQ ID NO: 489204 - DNA, 15 bp, Homo sapiens
ttagctgacaaaata

SEQ ID NO: 489205 - DNA, 16 bp, Homo sapiens
ttagtaatacctctaa

SEQ ID NO: 489206 - DNA, 17 bp, Homo sapiens
ttagtattgcaaagtca

SEQ ID NO: 489207 - DNA, 12 bp, Homo sapiens
ttagttcctgtg

SEQ ID NO: 489208 - DNA, 21 bp, Homo sapiens
ttatacctcaattttcactgt

SEQ ID NO: 489209 - DNA, 16 bp, Homo sapiens
ttatatttacaaatgg

SEQ ID NO: 489210 - DNA, 11 bp, Homo sapiens
ttatcatgtta

SEQ ID NO: 489211 - DNA, 17 bp, Homo sapiens
ttatcatgttagtaata

SEQ ID NO: 489212 - DNA, 18 bp, Homo sapiens
ttatcatgttagtaatac

SEQ ID NO: 489213 - DNA, 16 bp, Homo sapiens
ttatctgtttgagaaa

SEQ ID NO: 489214 - DNA, 11 bp, Homo sapiens
ttatgatgtgc

SEQ ID NO: 489215 - DNA, 14 bp, Homo sapiens
ttatgattagcttt

SEQ ID NO: 489216 - DNA, 19 bp, Homo sapiens
ttatttccctacattaaac

SEQ ID NO: 489217 - DNA, 20 bp, Homo sapiens
ttatttcctatgatgtatac

SEQ ID NO: 489218 - DNA, 12 bp, Homo sapiens
ttatttgagaag

SEQ ID NO: 489219 - DNA, 15 bp, Homo sapiens
ttcaatttatacctc

SEQ ID NO: 489220 - DNA, 15 bp, Homo sapiens
ttcacttcactgtgc

SEQ ID NO: 489221 - DNA, 17 bp, Homo sapiens
ttccagttcttcgactg

SEQ ID NO: 489222 - DNA, 19 bp, Homo sapiens
ttccatatggatccactgg

SEQ ID NO: 489223 - DNA, 17 bp, Homo sapiens
ttccatgtcaagattca

SEQ ID NO: 489224 - DNA, 19 bp, Homo sapiens
ttccctacattaaacatga

SEQ ID NO: 489225 - DNA, 18 bp, Homo sapiens
ttcctatgatgtatactg

SEQ ID NO: 489226 - DNA, 16 bp, Homo sapiens
ttctgcactatatgca

SEQ ID NO: 489227 - DNA, 19 bp, Homo sapiens
ttcttcgactgttgttatc

SEQ ID NO: 489228 - DNA, 19 bp, Homo sapiens
ttgacaaaatgttatttcc

SEQ ID NO: 489229 - DNA, 20 bp, Homo sapiens
ttgacaaaatgttatttccc

SEQ ID NO: 489230 - DNA, 21 bp, Homo sapiens
ttgatgtggtgaaaagcaggt

SEQ ID NO: 489231 - DNA, 15 bp, Homo sapiens
ttgcaaaatcagttt

SEQ ID NO: 489232 - DNA, 16 bp, Homo sapiens
ttgcaaaatcagtttt

SEQ ID NO: 489233 - DNA, 15 bp, Homo sapiens
ttgcacagcatctca

SEQ ID NO: 489234 - DNA, 19 bp, Homo sapiens
ttgcacagcatctcagctc

SEQ ID NO: 489235 - DNA, 15 bp, Homo sapiens
acacaatatacgaaa

SEQ ID NO: 489236 - DNA, 19 bp, Homo sapiens
acaggtgccgccagctgcc

SEQ ID NO: 489237 - DNA, 14 bp, Homo sapiens
acatgtgccctcag

SEQ ID NO: 489238 - DNA, 17 bp, Homo sapiens
acccatgcagctgctcc

SEQ ID NO: 489239 - DNA, 18 bp, Homo sapiens
accccgctgatggagccc

SEQ ID NO: 489240 - DNA, 23 bp, Homo sapiens
accccgctgatggagccccacct

SEQ ID NO: 489241 - DNA, 12 bp, Homo sapiens
accttgtctgct

SEQ ID NO: 489242 - DNA, 21 bp, Homo sapiens
accttgtctgctaaataaaca

SEQ ID NO: 489243 - DNA, 22 bp, Homo sapiens
accttgtctgctaaataaacat

SEQ ID NO: 489244 - DNA, 17 bp, Homo sapiens
agctgccgcaccagccc

SEQ ID NO: 489245 - DNA, 16 bp, Homo sapiens
agctgctccccaggcc

SEQ ID NO: 489246 - DNA, 19 bp, Homo sapiens
aggccaccccgctgatgga

SEQ ID NO: 489247 - DNA, 19 bp, Homo sapiens
aggtgccgccagctgccgc

SEQ ID NO: 489248 - DNA, 20 bp, Homo sapiens
aggtgccgccagctgccgca

SEQ ID NO: 489249 - DNA, 17 bp, Homo sapiens
ataaacatgtgccctca

SEQ ID NO: 489250 - DNA, 12 bp, Homo sapiens
atacacaatata

SEQ ID NO: 489251 - DNA, 18 bp, Homo sapiens
atatacgaaaagccagct

SEQ ID NO: 489252 - DNA, 20 bp, Homo sapiens
atcatcctgaatctgatctt

SEQ ID NO: 489253 - DNA, 14 bp, Homo sapiens
atcccaccaaatca

SEQ ID NO: 489254 - DNA, 13 bp, Homo sapiens
atctttttataca

SEQ ID NO: 489255 - DNA, 18 bp, Homo sapiens
atctttttatacacaata

SEQ ID NO: 489256 - DNA, 17 bp, Homo sapiens
atgcagctgctccccag

SEQ ID NO: 489257 - DNA, 13 bp, Homo sapiens
caaatcatcctga

SEQ ID NO: 489258 - DNA, 14 bp, Homo sapiens
caaatcatcctgaa

SEQ ID NO: 489259 - DNA, 13 bp, Homo sapiens
caatatacgaaaa

SEQ ID NO: 489260 - DNA, 19 bp, Homo sapiens
cacaatatacgaaaagcca

SEQ ID NO: 489261 - DNA, 22 bp, Homo sapiens
cacaggtgccgccagctgccgc

SEQ ID NO: 489262 - DNA, 14 bp, Homo sapiens
cacagtgccaccca

SEQ ID NO: 489263 - DNA, 19 bp, Homo sapiens
caccaaatcatcctgaatc

SEQ ID NO: 489264 - DNA, 13 bp, Homo sapiens
caccttgtctgct

SEQ ID NO: 489265 - DNA, 15 bp, Homo sapiens
cactccggtcagccc

SEQ ID NO: 489266 - DNA, 12 bp, Homo sapiens
cagtgccaccca

SEQ ID NO: 489267 - DNA, 22 bp, Homo sapiens
catgcagctgctccccaggcca

SEQ ID NO: 489268 - DNA, 23 bp, Homo sapiens
catgcagctgctccccaggccac

SEQ ID NO: 489269 - DNA, 24 bp, Homo sapiens
catgcagctgctccccaggccacc

SEQ ID NO: 489270 - DNA, 18 bp, Homo sapiens
ccaaatcatcctgaatct

SEQ ID NO: 489271 - DNA, 17 bp, Homo sapiens
ccaccaaatcatcctga

SEQ ID NO: 489272 - DNA, 23 bp, Homo sapiens
ccagcaacactccggtcagcccc

SEQ ID NO: 489273 - DNA, 17 bp, Homo sapiens
ccatgcagctgctcccc

SEQ ID NO: 489274 - DNA, 15 bp, Homo sapiens
cccacagtgccaccc

SEQ ID NO: 489275 - DNA, 22 bp, Homo sapiens
cccagcaacactccggtcagcc

SEQ ID NO: 489276 - DNA, 15 bp, Homo sapiens
cccatgcagctgctc

SEQ ID NO: 489277 - DNA, 19 bp, Homo sapiens
cccatgcagctgctcccca

SEQ ID NO: 489278 - DNA, 16 bp, Homo sapiens
ccccacagtgccaccc

SEQ ID NO: 489279 - DNA, 13 bp, Homo sapiens
ccccaggccaccc

SEQ ID NO: 489280 - DNA, 17 bp, Homo sapiens
ccccgctgatggagccc

SEQ ID NO: 489281 - DNA, 20 bp, Homo sapiens
ccccgctgatggagccccac

SEQ ID NO: 489282 - DNA, 23 bp, Homo sapiens
cccctggcaatcccaccaaatca

SEQ ID NO: 489283 - DNA, 22 bp, Homo sapiens
cccgctgatggagccccacctt

SEQ ID NO: 489284 - DNA, 19 bp, Homo sapiens
ccgctgatggagccccacc

SEQ ID NO: 489285 - DNA, 14 bp, Homo sapiens
cgctgatggagccc

SEQ ID NO: 489286 - DNA, 16 bp, Homo sapiens
cgctgatggagcccca

SEQ ID NO: 489287 - DNA, 16 bp, Homo sapiens
ctgatctttttataca

SEQ ID NO: 489288 - DNA, 18 bp, Homo sapiens
ctgatggagccccacctt

SEQ ID NO: 489289 - DNA, 13 bp, Homo sapiens
ctgctaaataaac

SEQ ID NO: 489290 - DNA, 15 bp, Homo sapiens
ctgctaaataaacat

SEQ ID NO: 489291 - DNA, 18 bp, Homo sapiens
ctgctccccaggccaccc

SEQ ID NO: 489292 - DNA, 21 bp, Homo sapiens
aacactccggtcagcccctgg

SEQ ID NO: 489293 - DNA, 23 bp, Homo sapiens
aacactccggtcagcccctggca

SEQ ID NO: 489294 - DNA, 16 bp, Homo sapiens
aatatacgaaaagcca

SEQ ID NO: 489295 - DNA, 19 bp, Homo sapiens
aatatacgaaaagccagct

SEQ ID NO: 489296 - DNA, 22 bp, Homo sapiens
acaggtgccgccagctgccgca

SEQ ID NO: 489297 - DNA, 12 bp, Homo sapiens
acagtgccaccc

SEQ ID NO: 489298 - DNA, 15 bp, Homo sapiens
accaaatcatcctga

SEQ ID NO: 489299 - DNA, 18 bp, Homo sapiens
acccatgcagctgctccc

SEQ ID NO: 489300 - DNA, 11 bp, Homo sapiens
accctccccac

SEQ ID NO: 489301 - DNA, 22 bp, Homo sapiens
accctccccacagtgccaccca

SEQ ID NO: 489302 - DNA, 20 bp, Homo sapiens
actccggtcagcccctggca

SEQ ID NO: 489303 - DNA, 14 bp, Homo sapiens
agaccctccccaca

SEQ ID NO: 489304 - DNA, 15 bp, Homo sapiens
agaccctccccacag

SEQ ID NO: 489305 - DNA, 12 bp, Homo sapiens
agctgctcccca

SEQ ID NO: 489306 - DNA, 19 bp, Homo sapiens
agctgctccccaggccacc

SEQ ID NO: 489307 - DNA, 20 bp, Homo sapiens
agctgctccccaggccaccc

SEQ ID NO: 489308 - DNA, 18 bp, Homo sapiens
atctgatctttttataca

SEQ ID NO: 489309 - DNA, 13 bp, Homo sapiens
atggagccccacc

SEQ ID NO: 489310 - DNA, 16 bp, Homo sapiens
atggagccccaccttg

SEQ ID NO: 489311 - DNA, 15 bp, Homo sapiens
caatatacgaaaagc

SEQ ID NO: 489312 - DNA, 14 bp, Homo sapiens
caatcccaccaaat

SEQ ID NO: 489313 - DNA, 16 bp, Homo sapiens
caatcccaccaaatca

SEQ ID NO: 489314 - DNA, 18 bp, Homo sapiens
cacaggtgccgccagctg

SEQ ID NO: 489315 - DNA, 14 bp, Homo sapiens
caccaaatcatcct

SEQ ID NO: 489316 - DNA, 14 bp, Homo sapiens
cagcaacactccgg

SEQ ID NO: 489317 - DNA, 19 bp, Homo sapiens
cagcaacactccggtcagc

SEQ ID NO: 489318 - DNA, 13 bp, Homo sapiens
cagctgctcccca

SEQ ID NO: 489319 - DNA, 18 bp, Homo sapiens
caggccaccccgctgatg

SEQ ID NO: 489320 - DNA, 19 bp, Homo sapiens
caggccaccccgctgatgg

SEQ ID NO: 489321 - DNA, 13 bp, Homo sapiens
cagtgccacccat

SEQ ID NO: 489322 - DNA, 17 bp, Homo sapiens
catcctgaatctgatct

SEQ ID NO: 489323 - DNA, 16 bp, Homo sapiens
catgcagctgctcccc

SEQ ID NO: 489324 - DNA, 18 bp, Homo sapiens
catgcagctgctccccag

SEQ ID NO: 489325 - DNA, 15 bp, Homo sapiens
ccaaatcatcctgaa

SEQ ID NO: 489326 - DNA, 20 bp, Homo sapiens
ccacccatgcagctgctccc

SEQ ID NO: 489327 - DNA, 23 bp, Homo sapiens
ccacccatgcagctgctccccag

SEQ ID NO: 489328 - DNA, 22 bp, Homo sapiens
ccagcaacactccggtcagccc

SEQ ID NO: 489329 - DNA, 17 bp, Homo sapiens
ccagcccgaacaccatt

SEQ ID NO: 489330 - DNA, 15 bp, Homo sapiens
ccagctgccgcacca

SEQ ID NO: 489331 - DNA, 14 bp, Homo sapiens
ccatgcagctgctc

SEQ ID NO: 489332 - DNA, 18 bp, Homo sapiens
cccaccaaatcatcctga

SEQ ID NO: 489333 - DNA, 20 bp, Homo sapiens
cccgctgatggagccccacc

SEQ ID NO: 489334 - DNA, 19 bp, Homo sapiens
ccctccccacagtgccacc

SEQ ID NO: 489335 - DNA, 15 bp, Homo sapiens
ccgccagctgccgca

SEQ ID NO: 489336 - DNA, 17 bp, Homo sapiens
ccgccagctgccgcacc

SEQ ID NO: 489337 - DNA, 17 bp, Homo sapiens
ccgctgatggagcccca

SEQ ID NO: 489338 - DNA, 18 bp, Homo sapiens
ccgctgatggagccccac

SEQ ID NO: 489339 - DNA, 18 bp, Homo sapiens
cctccccacagtgccacc

SEQ ID NO: 489340 - DNA, 15 bp, Homo sapiens
cctgaatctgatctt

SEQ ID NO: 489341 - DNA, 14 bp, Homo sapiens
cgaaaagccagctt

SEQ ID NO: 489342 - DNA, 20 bp, Homo sapiens
cgcaccagcccgaacaccat

SEQ ID NO: 489343 - DNA, 20 bp, Homo sapiens
cgccagctgccgcaccagcc

SEQ ID NO: 489344 - DNA, 20 bp, Homo sapiens
cgctgatggagccccacctt

SEQ ID NO: 489345 - DNA, 14 bp, Homo sapiens
ctccccacagtgcc

SEQ ID NO: 489346 - DNA, 17 bp, Homo sapiens
ctccccacagtgccacc

SEQ ID NO: 489347 - DNA, 15 bp, Homo sapiens
ctccccaggccaccc

SEQ ID NO: 489348 - DNA, 16 bp, Homo sapiens
ctgctccccaggccac

SEQ ID NO: 489349 - DNA, 17 bp, Homo sapiens
ctgctccccaggccacc

SEQ ID NO: 489350 - DNA, 19 bp, Homo sapiens
ctgggagaccctccccaca

SEQ ID NO: 489351 - DNA, 22 bp, Homo sapiens
gaatctgatctttttatacaca

SEQ ID NO: 489352 - DNA, 11 bp, Homo sapiens
gagccccacct

SEQ ID NO: 489353 - DNA, 20 bp, Homo sapiens
gagccccaccttgtctgcta

SEQ ID NO: 489354 - DNA, 16 bp, Homo sapiens
gatggagccccacctt

SEQ ID NO: 489355 - DNA, 18 bp, Homo sapiens
gatggagccccaccttgt

SEQ ID NO: 489356 - DNA, 14 bp, Homo sapiens
aaatcatcctgaat

SEQ ID NO: 489357 - DNA, 13 bp, Homo sapiens
aatcatcctgaat

SEQ ID NO: 489358 - DNA, 21 bp, Homo sapiens
aatcccaccaaatcatcctga

SEQ ID NO: 489359 - DNA, 17 bp, Homo sapiens
accagcccgaacaccat

SEQ ID NO: 489360 - DNA, 21 bp, Homo sapiens
agaccctccccacagtgccac

SEQ ID NO: 489361 - DNA, 17 bp, Homo sapiens
agcccctggcaatccca

SEQ ID NO: 489362 - DNA, 20 bp, Homo sapiens
agctgggagaccctccccac

SEQ ID NO: 489363 - DNA, 21 bp, Homo sapiens
agctgggagaccctccccaca

SEQ ID NO: 489364 - DNA, 23 bp, Homo sapiens
aggccaccccgctgatggagccc

SEQ ID NO: 489365 - DNA, 22 bp, Homo sapiens
agtgccacccatgcagctgctc

SEQ ID NO: 489366 - DNA, 13 bp, Homo sapiens
atacgaaaagcca

SEQ ID NO: 489367 - DNA, 15 bp, Homo sapiens
atatacgaaaagcca

SEQ ID NO: 489368 - DNA, 20 bp, Homo sapiens
atcccaccaaatcatcctga

SEQ ID NO: 489369 - DNA, 20 bp, Homo sapiens
atctgatctttttatacaca

SEQ ID NO: 489370 - DNA, 23 bp, Homo sapiens
atctgatctttttatacacaata

SEQ ID NO: 489371 - DNA, 15 bp, Homo sapiens
atctttttatacaca

SEQ ID NO: 489372 - DNA, 14 bp, Homo sapiens
atggagccccacct

SEQ ID NO: 489373 - DNA, 15 bp, Homo sapiens
atggagccccacctt

SEQ ID NO: 489374 - DNA, 21 bp, Homo sapiens
atggagccccaccttgtctgc

SEQ ID NO: 489375 - DNA, 22 bp, Homo sapiens
atggagccccaccttgtctgct

SEQ ID NO: 489376 - DNA, 17 bp, Homo sapiens
caatatacgaaaagcca

SEQ ID NO: 489377 - DNA, 16 bp, Homo sapiens
caccaaatcatcctga

SEQ ID NO: 489378 - DNA, 14 bp, Homo sapiens
cacccatgcagctg

SEQ ID NO: 489379 - DNA, 17 bp, Homo sapiens
cacccatgcagctgctc

SEQ ID NO: 489380 - DNA, 19 bp, Homo sapiens
cacccatgcagctgctccc

SEQ ID NO: 489381 - DNA, 23 bp, Homo sapiens
caccccgctgatggagccccacc

SEQ ID NO: 489382 - DNA, 22 bp, Homo sapiens
caccttgtctgctaaataaaca

SEQ ID NO: 489383 - DNA, 20 bp, Homo sapiens
cactccggtcagcccctggc

SEQ ID NO: 489384 - DNA, 23 bp, Homo sapiens
cagcaacactccggtcagcccct

SEQ ID NO: 489385 - DNA, 13 bp, Homo sapiens
cagcccgaacacc

SEQ ID NO: 489386 - DNA, 17 bp, Homo sapiens
cagctgccgcaccagcc

SEQ ID NO: 489387 - DNA, 14 bp, Homo sapiens
cagctgctccccag

SEQ ID NO: 489388 - DNA, 20 bp, Homo sapiens
cagctgctccccaggccacc

SEQ ID NO: 489389 - DNA, 19 bp, Homo sapiens
caggtgccgccagctgccg

SEQ ID NO: 489390 - DNA, 22 bp, Homo sapiens
caggtgccgccagctgccgcac

SEQ ID NO: 489391 - DNA, 23 bp, Homo sapiens
caggtgccgccagctgccgcacc

SEQ ID NO: 489392 - DNA, 14 bp, Homo sapiens
cagtgccacccatg

SEQ ID NO: 489393 - DNA, 20 bp, Homo sapiens
cagtgccacccatgcagctg

SEQ ID NO: 489394 - DNA, 21 bp, Homo sapiens
cagtgccacccatgcagctgc

SEQ ID NO: 489395 - DNA, 19 bp, Homo sapiens
catcctgaatctgatcttt

SEQ ID NO: 489396 - DNA, 14 bp, Homo sapiens
catgcagctgctcc

SEQ ID NO: 489397 - DNA, 17 bp, Homo sapiens
catgcagctgctcccca

SEQ ID NO: 489398 - DNA, 13 bp, Homo sapiens
catgtgccctcag

SEQ ID NO: 489399 - DNA, 14 bp, Homo sapiens
ccaaatcatcctga

SEQ ID NO: 489400 - DNA, 16 bp, Homo sapiens
ccaaatcatcctgaat

SEQ ID NO: 489401 - DNA, 19 bp, Homo sapiens
ccaaatcatcctgaatctg

SEQ ID NO: 489402 - DNA, 16 bp, Homo sapiens
ccacagtgccacccat

SEQ ID NO: 489403 - DNA, 16 bp, Homo sapiens
ccacccatgcagctgc

SEQ ID NO: 489404 - DNA, 16 bp, Homo sapiens
ccaccccgctgatgga

SEQ ID NO: 489405 - DNA, 16 bp, Homo sapiens
ccagcccgaacaccat

SEQ ID NO: 489406 - DNA, 17 bp, Homo sapiens
ccagctgccgcaccagc

SEQ ID NO: 489407 - DNA, 18 bp, Homo sapiens
ccagctgccgcaccagcc

SEQ ID NO: 489408 - DNA, 15 bp, Homo sapiens
ccatgcagctgctcc

SEQ ID NO: 489409 - DNA, 14 bp, Homo sapiens
cccacagtgccacc

SEQ ID NO: 489410 - DNA, 23 bp, Homo sapiens
cccgctgatggagccccaccttg

SEQ ID NO: 489411 - DNA, 14 bp, Homo sapiens
ccctccccacagtg

SEQ ID NO: 489412 - DNA, 14 bp, Homo sapiens
ccgccagctgccgc

SEQ ID NO: 489413 - DNA, 22 bp, Homo sapiens
ccgccagctgccgcaccagccc

SEQ ID NO: 489414 - DNA, 11 bp, Homo sapiens
cctgaatctga

SEQ ID NO: 489415 - DNA, 14 bp, Homo sapiens
cctggcaatcccac

SEQ ID NO: 489416 - DNA, 21 bp, Homo sapiens
cctggcaatcccaccaaatca

SEQ ID NO: 489417 - DNA, 15 bp, Homo sapiens
cgctgatggagcccc

SEQ ID NO: 489418 - DNA, 18 bp, Homo sapiens
cgctgatggagccccacc

SEQ ID NO: 489419 - DNA, 22 bp, Homo sapiens
ctccccaggccaccccgctgat

SEQ ID NO: 489420 - DNA, 18 bp, Homo sapiens
ctgatctttttatacaca

SEQ ID NO: 489421 - DNA, 20 bp, Homo sapiens
ctgatctttttatacacaat

SEQ ID NO: 489422 - DNA, 15 bp, Homo sapiens
ctgatggagccccac

SEQ ID NO: 489423 - DNA, 16 bp, Homo sapiens
ctgatggagccccacc

SEQ ID NO: 489424 - DNA, 15 bp, Homo sapiens
ctggcaatcccacca

SEQ ID NO: 489425 - DNA, 12 bp, Homo sapiens
ctgggagaccct

SEQ ID NO: 489426 - DNA, 23 bp, Homo sapiens
gaatctgatctttttatacacaa

SEQ ID NO: 489427 - DNA, 22 bp, Homo sapiens
gaccctccccacagtgccaccc

SEQ ID NO: 489428 - DNA, 14 bp, Homo sapiens
gagaccctccccac

SEQ ID NO: 489429 - DNA, 20 bp, Homo sapiens
gagaccctccccacagtgcc

SEQ ID NO: 489430 - DNA, 20 bp, Homo sapiens
gagctgggagaccctcccca

SEQ ID NO: 489431 - DNA, 14 bp, Homo sapiens
gatggagccccacc

SEQ ID NO: 489432 - DNA, 15 bp, Homo sapiens
gatggagccccacct

SEQ ID NO: 489433 - DNA, 22 bp, Homo sapiens
gcaacactccggtcagcccctg

SEQ ID NO: 489434 - DNA, 19 bp, Homo sapiens
gcaccagcccgaacaccat

SEQ ID NO: 489435 - DNA, 22 bp, Homo sapiens
gcagctgctccccaggccaccc

SEQ ID NO: 489436 - DNA, 17 bp, Homo sapiens
gccagctgccgcaccag

SEQ ID NO: 489437 - DNA, 18 bp, Homo sapiens
gccagctgccgcaccagc

SEQ ID NO: 489438 - DNA, 13 bp, Homo sapiens
gccgcaccagccc

SEQ ID NO: 489439 - DNA, 11 bp, Homo sapiens
gccgccagctg

SEQ ID NO: 489440 - DNA, 17 bp, Homo sapiens
gccgccagctgccgcac

SEQ ID NO: 489441 - DNA, 22 bp, Homo sapiens
gctaaataaacatgtgccctca

SEQ ID NO: 489442 - DNA, 16 bp, Homo sapiens
gctccccaggccaccc

SEQ ID NO: 489443 - DNA, 17 bp, Homo sapiens
gctgatggagccccacc

SEQ ID NO: 489444 - DNA, 18 bp, Homo sapiens
gctgatggagccccacct

SEQ ID NO: 489445 - DNA, 19 bp, Homo sapiens
gctgatggagccccacctt

SEQ ID NO: 489446 - DNA, 16 bp, Homo sapiens
gctgccgcaccagccc

SEQ ID NO: 489447 - DNA, 19 bp, Homo sapiens
ggcaatcccaccaaatcat

SEQ ID NO: 489448 - DNA, 15 bp, Homo sapiens
gtgccgccagctgcc

SEQ ID NO: 489449 - DNA, 23 bp, Homo sapiens
tatacacaatatacgaaaagcca

SEQ ID NO: 489450 - DNA, 21 bp, Homo sapiens
tcccaccaaatcatcctgaat

SEQ ID NO: 489451 - DNA, 19 bp, Homo sapiens
tccccacagtgccacccat

SEQ ID NO: 489452 - DNA, 23 bp, Homo sapiens
tgaatctgatctttttatacaca

SEQ ID NO: 489453 - DNA, 16 bp, Homo sapiens
tgatggagccccacct

SEQ ID NO: 489454 - DNA, 22 bp, Homo sapiens
tgcacaggtgccgccagctgcc

SEQ ID NO: 489455 - DNA, 12 bp, Homo sapiens
tgccgcaccagc

SEQ ID NO: 489456 - DNA, 17 bp, Homo sapiens
tgccgccagctgccgca

SEQ ID NO: 489457 - DNA, 21 bp, Homo sapiens
tgccgccagctgccgcaccag

SEQ ID NO: 489458 - DNA, 13 bp, Homo sapiens
tgctaaataaaca

SEQ ID NO: 489459 - DNA, 15 bp, Homo sapiens
tgctccccaggccac

SEQ ID NO: 489460 - DNA, 13 bp, Homo sapiens
tggagccccacct

SEQ ID NO: 489461 - DNA, 22 bp, Homo sapiens
tggagccccaccttgtctgcta

SEQ ID NO: 489462 - DNA, 20 bp, Homo sapiens
ctggcaatcccaccaaatca

SEQ ID NO: 489463 - DNA, 21 bp, Homo sapiens
cttcccagcaacactccggtc

SEQ ID NO: 489464 - DNA, 14 bp, Homo sapiens
ctttttatacacaa

SEQ ID NO: 489465 - DNA, 21 bp, Homo sapiens
gaccctccccacagtgccacc

SEQ ID NO: 489466 - DNA, 14 bp, Homo sapiens
gagctgggagaccc

SEQ ID NO: 489467 - DNA, 18 bp, Homo sapiens
gatctttttatacacaat

SEQ ID NO: 489468 - DNA, 15 bp, Homo sapiens
gcagctgctccccag

SEQ ID NO: 489469 - DNA, 22 bp, Homo sapiens
gccacccatgcagctgctcccc

SEQ ID NO: 489470 - DNA, 14 bp, Homo sapiens
gccagctgccgcac

SEQ ID NO: 489471 - DNA, 19 bp, Homo sapiens
gccagctgccgcaccagcc

SEQ ID NO: 489472 - DNA, 13 bp, Homo sapiens
gctgatggagccc

SEQ ID NO: 489473 - DNA, 20 bp, Homo sapiens
gctgggagaccctccccaca

SEQ ID NO: 489474 - DNA, 12 bp, Homo sapiens
ggagctgggaga

SEQ ID NO: 489475 - DNA, 16 bp, Homo sapiens
gggagaccctccccac

SEQ ID NO: 489476 - DNA, 23 bp, Homo sapiens
gggagctgggagaccctccccac

SEQ ID NO: 489477 - DNA, 16 bp, Homo sapiens
gtctgctaaataaaca

SEQ ID NO: 489478 - DNA, 17 bp, Homo sapiens
gtctgctaaataaacat

SEQ ID NO: 489479 - DNA, 23 bp, Homo sapiens
gtgccacccatgcagctgctccc

SEQ ID NO: 489480 - DNA, 17 bp, Homo sapiens
tacacaatatacgaaaa

SEQ ID NO: 489481 - DNA, 21 bp, Homo sapiens
tacacaatatacgaaaagcca

SEQ ID NO: 489482 - DNA, 15 bp, Homo sapiens
tccccacagtgccac

SEQ ID NO: 489483 - DNA, 14 bp, Homo sapiens
tccccaggccaccc

SEQ ID NO: 489484 - DNA, 17 bp, Homo sapiens
tctgatctttttataca

SEQ ID NO: 489485 - DNA, 16 bp, Homo sapiens
tctgctaaataaacat

SEQ ID NO: 489486 - DNA, 14 bp, Homo sapiens
tctttttatacaca

SEQ ID NO: 489487 - DNA, 15 bp, Homo sapiens
tctttttatacacaa

SEQ ID NO: 489488 - DNA, 11 bp, Homo sapiens
tgatggagccc

SEQ ID NO: 489489 - DNA, 14 bp, Homo sapiens
tgatggagccccac

SEQ ID NO: 489490 - DNA, 22 bp, Homo sapiens
tgatggagccccaccttgtctg

SEQ ID NO: 489491 - DNA, 13 bp, Homo sapiens
tgcagctgctccc

SEQ ID NO: 489492 - DNA, 15 bp, Homo sapiens
tgcagctgctcccca

SEQ ID NO: 489493 - DNA, 20 bp, Homo sapiens
tgccgccagctgccgcacca

SEQ ID NO: 489494 - DNA, 16 bp, Homo sapiens
tgctccccaggccacc

SEQ ID NO: 489495 - DNA, 18 bp, Homo sapiens
tgctccccaggccacccc

SEQ ID NO: 489496 - DNA, 14 bp, Homo sapiens
tggagccccacctt

SEQ ID NO: 489497 - DNA, 23 bp, Homo sapiens
tggcaatcccaccaaatcatcct

SEQ ID NO: 489498 - DNA, 17 bp, Homo sapiens
tgtctgctaaataaaca

SEQ ID NO: 489499 - DNA, 18 bp, Homo sapiens
tgtctgctaaataaacat

SEQ ID NO: 489500 - DNA, 13 bp, Homo sapiens
tttttatacacaa

SEQ ID NO: 489501 - DNA, 14 bp, Homo sapiens
gcagctgctcccca

SEQ ID NO: 489502 - DNA, 22 bp, Homo sapiens
gccaccccgctgatggagcccc

SEQ ID NO: 489503 - DNA, 17 bp, Homo sapiens
gccccaccttgtctgct

SEQ ID NO: 489504 - DNA, 12 bp, Homo sapiens
gctaaataaaca

SEQ ID NO: 489505 - DNA, 15 bp, Homo sapiens
gctgccgcaccagcc

SEQ ID NO: 489506 - DNA, 13 bp, Homo sapiens
gctgctccccagg

SEQ ID NO: 489507 - DNA, 16 bp, Homo sapiens
gctgctccccaggcca

SEQ ID NO: 489508 - DNA, 12 bp, Homo sapiens
ggagccccacct

SEQ ID NO: 489509 - DNA, 15 bp, Homo sapiens
ggcaatcccaccaaa

SEQ ID NO: 489510 - DNA, 22 bp, Homo sapiens
tacacaatatacgaaaagccag

SEQ ID NO: 489511 - DNA, 14 bp, Homo sapiens
tatacgaaaagcca

SEQ ID NO: 489512 - DNA, 19 bp, Homo sapiens
tctgatctttttatacaca

SEQ ID NO: 489513 - DNA, 16 bp, Homo sapiens
tgatctttttatacac

SEQ ID NO: 489514 - DNA, 16 bp, Homo sapiens
tgcagctgctccccag

SEQ ID NO: 489515 - DNA, 18 bp, Homo sapiens
tgcagctgctccccaggc

SEQ ID NO: 489516 - DNA, 24 bp, Homo sapiens
tgctaaataaacatgtgccctcag

SEQ ID NO: 489517 - DNA, 14 bp, Homo sapiens
tgctccccaggcca

SEQ ID NO: 489518 - DNA, 18 bp, Homo sapiens
tggagccccaccttgtct

SEQ ID NO: 489519 - DNA, 19 bp, Homo sapiens
tggagccccaccttgtctg

SEQ ID NO: 489520 - DNA, 19 bp, Homo sapiens
tggcaatcccaccaaatca

SEQ ID NO: 489521 - DNA, 22 bp, Homo sapiens
ttgagggagctgggagaccctc

SEQ ID NO: 489522 - DNA, 17 bp, Homo sapiens
gcaacactccggtcagc

SEQ ID NO: 489523 - DNA, 13 bp, Homo sapiens
gcagctgctcccc

SEQ ID NO: 489524 - DNA, 21 bp, Homo sapiens
gccacccatgcagctgctccc

SEQ ID NO: 489525 - DNA, 13 bp, Homo sapiens
gccagctgccgca

SEQ ID NO: 489526 - DNA, 12 bp, Homo sapiens
gccgcaccagcc

SEQ ID NO: 489527 - DNA, 16 bp, Homo sapiens
gccgccagctgccgca

SEQ ID NO: 489528 - DNA, 13 bp, Homo sapiens
gctaaataaacat

SEQ ID NO: 489529 - DNA, 15 bp, Homo sapiens
gctgatggagcccca

SEQ ID NO: 489530 - DNA, 17 bp, Homo sapiens
gctgctccccaggccac

SEQ ID NO: 489531 - DNA, 13 bp, Homo sapiens
gctgggagaccct

SEQ ID NO: 489532 - DNA, 15 bp, Homo sapiens
ggagaccctccccac

SEQ ID NO: 489533 - DNA, 20 bp, Homo sapiens
ggagccccaccttgtctgct

SEQ ID NO: 489534 - DNA, 21 bp, Homo sapiens
ggagctgggagaccctcccca

SEQ ID NO: 489535 - DNA, 21 bp, Homo sapiens
gtgccacccatgcagctgctc

SEQ ID NO: 489536 - DNA, 19 bp, Homo sapiens
tatacgaaaagccagcttg

SEQ ID NO: 489537 - DNA, 15 bp, Homo sapiens
tcagcccctggcaat

SEQ ID NO: 489538 - DNA, 17 bp, Homo sapiens
tccccacagtgccaccc

SEQ ID NO: 489539 - DNA, 19 bp, Homo sapiens
tccttcccagcaacactcc

SEQ ID NO: 489540 - DNA, 20 bp, Homo sapiens
tctgatctttttatacacaa

SEQ ID NO: 489541 - DNA, 15 bp, Homo sapiens
tctgctaaataaaca

SEQ ID NO: 489542 - DNA, 20 bp, Homo sapiens
tgagggagctgggagaccct

SEQ ID NO: 489543 - DNA, 18 bp, Homo sapiens
tgatctttttatacacaa

SEQ ID NO: 489544 - DNA, 19 bp, Homo sapiens
tgatctttttatacacaat

SEQ ID NO: 489545 - DNA, 12 bp, Homo sapiens
tgcagctgctcc

SEQ ID NO: 489546 - DNA, 17 bp, Homo sapiens
tgccgcaccagcccgaa

SEQ ID NO: 489547 - DNA, 16 bp, Homo sapiens
tgccgccagctgccgc

SEQ ID NO: 489548 - DNA, 23 bp, Homo sapiens
tgccgccagctgccgcaccagcc

SEQ ID NO: 489549 - DNA, 21 bp, Homo sapiens
tggagccccaccttgtctgct

SEQ ID NO: 489550 - DNA, 20 bp, Homo sapiens
ttcccagcaacactccggtc

SEQ ID NO: 489551 - DNA, 18 bp, Homo sapiens
ttgagggagctgggagac

SEQ ID NO: 489552 - DNA, 20 bp, Homo sapiens
aaatcatcctgaatctgatc

SEQ ID NO: 489553 - DNA, 20 bp, Homo sapiens
aatcatcctgaatctgatct

SEQ ID NO: 489554 - DNA, 16 bp, Homo sapiens
aatcccaccaaatcat

SEQ ID NO: 489555 - DNA, 21 bp, Homo sapiens
aatctgatctttttatacaca

SEQ ID NO: 489556 - DNA, 21 bp, Homo sapiens
acacaatatacgaaaagccag

SEQ ID NO: 489557 - DNA, 20 bp, Homo sapiens
acaggtgccgccagctgccg

SEQ ID NO: 489558 - DNA, 17 bp, Homo sapiens
accaaatcatcctgaat

SEQ ID NO: 489559 - DNA, 16 bp, Homo sapiens
acccatgcagctgctc

SEQ ID NO: 489560 - DNA, 21 bp, Homo sapiens
accctccccacagtgccaccc

SEQ ID NO: 489561 - DNA, 11 bp, Homo sapiens
agccccacctt

SEQ ID NO: 489562 - DNA, 14 bp, Homo sapiens
agcccgaacaccat

SEQ ID NO: 489563 - DNA, 21 bp, Homo sapiens
agcccgaacaccattgaggga

SEQ ID NO: 489564 - DNA, 22 bp, Homo sapiens
agctgccgcaccagcccgaaca

SEQ ID NO: 489565 - DNA, 13 bp, Homo sapiens
agctgctccccag

SEQ ID NO: 489566 - DNA, 16 bp, Homo sapiens
atatacgaaaagccag

SEQ ID NO: 489567 - DNA, 19 bp, Homo sapiens
atcctgaatctgatctttt

SEQ ID NO: 489568 - DNA, 22 bp, Homo sapiens
atctgatctttttatacacaat

SEQ ID NO: 489569 - DNA, 16 bp, Homo sapiens
atctttttatacacaa

SEQ ID NO: 489570 - DNA, 16 bp, Homo sapiens
atgcagctgctcccca

SEQ ID NO: 489571 - DNA, 18 bp, Homo sapiens
caacactccggtcagccc

SEQ ID NO: 489572 - DNA, 22 bp, Homo sapiens
caacactccggtcagcccctgg

SEQ ID NO: 489573 - DNA, 23 bp, Homo sapiens
caacactccggtcagcccctggc

SEQ ID NO: 489574 - DNA, 23 bp, Homo sapiens
caatcccaccaaatcatcctgaa

SEQ ID NO: 489575 - DNA, 21 bp, Homo sapiens
cacaggtgccgccagctgccg

SEQ ID NO: 489576 - DNA, 23 bp, Homo sapiens
cacaggtgccgccagctgccgca

SEQ ID NO: 489577 - DNA, 13 bp, Homo sapiens
cacagtgccaccc

SEQ ID NO: 489578 - DNA, 18 bp, Homo sapiens
caccaaatcatcctgaat

SEQ ID NO: 489579 - DNA, 15 bp, Homo sapiens
caccccgctgatgga

SEQ ID NO: 489580 - DNA, 16 bp, Homo sapiens
cagcaacactccggtc

SEQ ID NO: 489581 - DNA, 16 bp, Homo sapiens
cagctgccgcaccagc

SEQ ID NO: 489582 - DNA, 18 bp, Homo sapiens
cagctgctccccaggcca

SEQ ID NO: 489583 - DNA, 16 bp, Homo sapiens
caggtgccgccagctg

SEQ ID NO: 489584 - DNA, 17 bp, Homo sapiens
caggtgccgccagctgc

SEQ ID NO: 489585 - DNA, 14 bp, Homo sapiens
ccacagtgccaccc

SEQ ID NO: 489586 - DNA, 14 bp, Homo sapiens
ccaccttgtctgct

SEQ ID NO: 489587 - DNA, 16 bp, Homo sapiens
ccatgcagctgctccc

SEQ ID NO: 489588 - DNA, 15 bp, Homo sapiens
ccccacagtgccacc

SEQ ID NO: 489589 - DNA, 15 bp, Homo sapiens
ccccaccttgtctgc

SEQ ID NO: 489590 - DNA, 16 bp, Homo sapiens
cccgctgatggagccc

SEQ ID NO: 489591 - DNA, 23 bp, Homo sapiens
ccctccccacagtgccacccatg

SEQ ID NO: 489592 - DNA, 22 bp, Homo sapiens
ccctggcaatcccaccaaatca

SEQ ID NO: 489593 - DNA, 21 bp, Homo sapiens
ccgcaccagcccgaacaccat

SEQ ID NO: 489594 - DNA, 14 bp, Homo sapiens
ccgctgatggagcc

SEQ ID NO: 489595 - DNA, 15 bp, Homo sapiens
ccgctgatggagccc

SEQ ID NO: 489596 - DNA, 14 bp, Homo sapiens
ccggtcagcccctg

SEQ ID NO: 489597 - DNA, 19 bp, Homo sapiens
cctccccacagtgccaccc

SEQ ID NO: 489598 - DNA, 16 bp, Homo sapiens
cctggcaatcccacca

SEQ ID NO: 489599 - DNA, 15 bp, Homo sapiens
cgccagctgccgcac

SEQ ID NO: 489600 - DNA, 23 bp, Homo sapiens
cgccagctgccgcaccagcccga

SEQ ID NO: 489601 - DNA, 16 bp, Homo sapiens
cggtcagcccctggca

SEQ ID NO: 489602 - DNA, 12 bp, Homo sapiens
ctaaataaacat

SEQ ID NO: 489603 - DNA, 17 bp, Homo sapiens
ctaaataaacatgtgcc

SEQ ID NO: 489604 - DNA, 18 bp, Homo sapiens
ctccccacagtgccaccc

SEQ ID NO: 489605 - DNA, 14 bp, Homo sapiens
ctccccaggccacc

SEQ ID NO: 489606 - DNA, 16 bp, Homo sapiens
ctccttcccagcaaca

SEQ ID NO: 489607 - DNA, 22 bp, Homo sapiens
ctccttcccagcaacactccgg

SEQ ID NO: 489608 - DNA, 19 bp, Homo sapiens
ctgatctttttatacacaa

SEQ ID NO: 489609 - DNA, 12 bp, Homo sapiens
ctgatggagccc

SEQ ID NO: 489610 - DNA, 17 bp, Homo sapiens
ctgatggagccccacct

SEQ ID NO: 489611 - DNA, 14 bp, Homo sapiens
ctgccgcaccagcc

SEQ ID NO: 489612 - DNA, 18 bp, Homo sapiens
ctgggagaccctccccac

SEQ ID NO: 489613 - DNA, 21 bp, Homo sapiens
gaatctgatctttttatacac

SEQ ID NO: 489614 - DNA, 23 bp, Homo sapiens
gagaccctccccacagtgccacc

SEQ ID NO: 489615 - DNA, 13 bp, Homo sapiens
gagggagctggga

SEQ ID NO: 489616 - DNA, 16 bp, Homo sapiens
gatctttttatacaca

SEQ ID NO: 489617 - DNA, 23 bp, Homo sapiens
gatggagccccaccttgtctgct

SEQ ID NO: 489618 - DNA, 13 bp, Homo sapiens
gcaacactccggt

SEQ ID NO: 489619 - DNA, 21 bp, Homo sapiens
gcaacactccggtcagcccct

SEQ ID NO: 489620 - DNA, 19 bp, Homo sapiens
gcaatcccaccaaatcatc

SEQ ID NO: 489621 - DNA, 13 bp, Homo sapiens
aaaaacatgtcat

SEQ ID NO: 489622 - DNA, 16 bp, Homo sapiens
aaaaagaaacatttgg

SEQ ID NO: 489623 - DNA, 16 bp, Homo sapiens
aaaaataaaatgcatt

SEQ ID NO: 489624 - DNA, 17 bp, Homo sapiens
aaaacaaggatgaatta

SEQ ID NO: 489625 - DNA, 23 bp, Homo sapiens
aaaacagcaatagtgaatgaatg

SEQ ID NO: 489626 - DNA, 20 bp, Homo sapiens
aaaacagtccttcaaacttc

SEQ ID NO: 489627 - DNA, 12 bp, Homo sapiens
aaaacatgtcat

SEQ ID NO: 489628 - DNA, 14 bp, Homo sapiens
aaaacatgtcatgt

SEQ ID NO: 489629 - DNA, 16 bp, Homo sapiens
aaaacattccatcctt

SEQ ID NO: 489630 - DNA, 17 bp, Homo sapiens
aaaacttctcttctgag

SEQ ID NO: 489631 - DNA, 21 bp, Homo sapiens
aaaagagagaaaacttatttg

SEQ ID NO: 489632 - DNA, 12 bp, Homo sapiens
aaaagttattaa

SEQ ID NO: 489633 - DNA, 16 bp, Homo sapiens
aaaataatttttatat

SEQ ID NO: 489634 - DNA, 17 bp, Homo sapiens
aaaataatttttatatt

SEQ ID NO: 489635 - DNA, 23 bp, Homo sapiens
aaaataatttttatatttgaaat

SEQ ID NO: 489636 - DNA, 14 bp, Homo sapiens
aaaatacatactat

SEQ ID NO: 489637 - DNA, 15 bp, Homo sapiens
aaaatcacaaactca

SEQ ID NO: 489638 - DNA, 19 bp, Homo sapiens
aaaatccatacatttgtgt

SEQ ID NO: 489639 - DNA, 14 bp, Homo sapiens
aaaatccatgaaca

SEQ ID NO: 489640 - DNA, 17 bp, Homo sapiens
aaaatctcaatatttca

SEQ ID NO: 489641 - DNA, 18 bp, Homo sapiens
aaaatgcaacaacatgta

SEQ ID NO: 489642 - DNA, 16 bp, Homo sapiens
aaaattaattctttat

SEQ ID NO: 489643 - DNA, 13 bp, Homo sapiens
aaaattgtataga

SEQ ID NO: 489644 - DNA, 22 bp, Homo sapiens
aaaattttttctctaggaaata

SEQ ID NO: 489645 - DNA, 21 bp, Homo sapiens
aaacatatataacaatgctgt

SEQ ID NO: 489646 - DNA, 12 bp, Homo sapiens
aaacatgtcatg

SEQ ID NO: 489647 - DNA, 22 bp, Homo sapiens
aaacattagttctatttctatc

SEQ ID NO: 489648 - DNA, 13 bp, Homo sapiens
aaacatttatctt

SEQ ID NO: 489649 - DNA, 14 bp, Homo sapiens
aaacattttcacac

SEQ ID NO: 489650 - DNA, 15 bp, Homo sapiens
aaaccacaagcatct

SEQ ID NO: 489651 - DNA, 16 bp, Homo sapiens
aaaccacaagcatctc

SEQ ID NO: 489652 - DNA, 19 bp, Homo sapiens
aaacccttgccatgtgcta

SEQ ID NO: 489653 - DNA, 17 bp, Homo sapiens
aaactgtcaaagaatca

SEQ ID NO: 489654 - DNA, 17 bp, Homo sapiens
aaacttagaataaaatt

SEQ ID NO: 489655 - DNA, 12 bp, Homo sapiens
aaacttatttga

SEQ ID NO: 489656 - DNA, 14 bp, Homo sapiens
aaacttatttgagt

SEQ ID NO: 489657 - DNA, 13 bp, Homo sapiens
aaagaaacatttg

SEQ ID NO: 489658 - DNA, 20 bp, Homo sapiens
aaagaaggtttcagaaagaa

SEQ ID NO: 489659 - DNA, 16 bp, Homo sapiens
aaagaatgattatgaa

SEQ ID NO: 489660 - DNA, 13 bp, Homo sapiens
aaagagagaaaac

SEQ ID NO: 489661 - DNA, 16 bp, Homo sapiens
aactatgatttggaaa

SEQ ID NO: 489662 - DNA, 12 bp, Homo sapiens
aactcaatattt

SEQ ID NO: 489663 - DNA, 14 bp, Homo sapiens
aactcaatattttc

SEQ ID NO: 489664 - DNA, 20 bp, Homo sapiens
aactcaatattttccatgaa

SEQ ID NO: 489665 - DNA, 18 bp, Homo sapiens
aactcgttaatttgtagt

SEQ ID NO: 489666 - DNA, 19 bp, Homo sapiens
aactctgaattttaaagca

SEQ ID NO: 489667 - DNA, 15 bp, Homo sapiens
aactgactcttaaga

SEQ ID NO: 489668 - DNA, 12 bp, Homo sapiens
aactgaggcaga

SEQ ID NO: 489669 - DNA, 16 bp, Homo sapiens
aactgctccagcctct

SEQ ID NO: 489670 - DNA, 21 bp, Homo sapiens
aactgtcaaagaatcaatcca

SEQ ID NO: 489671 - DNA, 20 bp, Homo sapiens
aacttcgaaagcatcattat

SEQ ID NO: 489672 - DNA, 16 bp, Homo sapiens
aacttcttgttcaaaa

SEQ ID NO: 489673 - DNA, 22 bp, Homo sapiens
aacttgagggtaataaacttag

SEQ ID NO: 489674 - DNA, 20 bp, Homo sapiens
aactttgaggaggaagcaga

SEQ ID NO: 489675 - DNA, 12 bp, Homo sapiens
aagaaacattta

SEQ ID NO: 489676 - DNA, 13 bp, Homo sapiens
aagaactgaaatc

SEQ ID NO: 489677 - DNA, 15 bp, Homo sapiens
aagaagactgcatta

SEQ ID NO: 489678 - DNA, 15 bp, Homo sapiens
aagaagagccacagt

SEQ ID NO: 489679 - DNA, 14 bp, Homo sapiens
aagaagcaggctac

SEQ ID NO: 489680 - DNA, 17 bp, Homo sapiens
aagaaggaaaaggcagg

SEQ ID NO: 489681 - DNA, 19 bp, Homo sapiens
aagaaggcagcaggtggca

SEQ ID NO: 489682 - DNA, 22 bp, Homo sapiens
aagaagggctagaacctggagg

SEQ ID NO: 489683 - DNA, 22 bp, Homo sapiens
aagaatcattgtaaacattagt

SEQ ID NO: 489684 - DNA, 16 bp, Homo sapiens
aagaatgattatgaat

SEQ ID NO: 489685 - DNA, 17 bp, Homo sapiens
aagacaaatcaaagcag

SEQ ID NO: 489686 - DNA, 14 bp, Homo sapiens
aagacactgaaata

SEQ ID NO: 489687 - DNA, 15 bp, Homo sapiens
aagacagagctggga

SEQ ID NO: 489688 - DNA, 12 bp, Homo sapiens
aagaccagcctg

SEQ ID NO: 489689 - DNA, 13 bp, Homo sapiens
aagaccctgtctc

SEQ ID NO: 489690 - DNA, 21 bp, Homo sapiens
aagactcaagtgggaacgact

SEQ ID NO: 489691 - DNA, 17 bp, Homo sapiens
aagactgcattatattt

SEQ ID NO: 489692 - DNA, 14 bp, Homo sapiens
aagacttcccagct

SEQ ID NO: 489693 - DNA, 20 bp, Homo sapiens
aagagaaatgaaatattttt

SEQ ID NO: 489694 - DNA, 21 bp, Homo sapiens
aagagacagtcaccccaggac

SEQ ID NO: 489695 - DNA, 22 bp, Homo sapiens
aagagacagtcaccccaggact

SEQ ID NO: 489696 - DNA, 17 bp, Homo sapiens
aagagatggcctgagaa

SEQ ID NO: 489697 - DNA, 21 bp, Homo sapiens
aagagccatgtagaagctgca

SEQ ID NO: 489698 - DNA, 13 bp, Homo sapiens
aagaggaaaatga

SEQ ID NO: 489699 - DNA, 16 bp, Homo sapiens
aagagggcacacactg

SEQ ID NO: 489700 - DNA, 17 bp, Homo sapiens
aagagggcacacactgt

SEQ ID NO: 489701 - DNA, 15 bp, Homo sapiens
aagaggtataaagct

SEQ ID NO: 489702 - DNA, 22 bp, Homo sapiens
aagagtaagcacctttagaata

SEQ ID NO: 489703 - DNA, 19 bp, Homo sapiens
aagatccccaactgctcca

SEQ ID NO: 489704 - DNA, 17 bp, Homo sapiens
aagattcctgtccttca

SEQ ID NO: 489705 - DNA, 16 bp, Homo sapiens
aagatttaccacttgt

SEQ ID NO: 489706 - DNA, 16 bp, Homo sapiens
aagatttgctttaatt

SEQ ID NO: 489707 - DNA, 12 bp, Homo sapiens
aagcaaacacat

SEQ ID NO: 489708 - DNA, 13 bp, Homo sapiens
aagcaaacacatt

SEQ ID NO: 489709 - DNA, 22 bp, Homo sapiens
aagcaagtgattgggacagagg

SEQ ID NO: 489710 - DNA, 14 bp, Homo sapiens
aagcaccaagctca

SEQ ID NO: 489711 - DNA, 17 bp, Homo sapiens
aagcagtggacaccagg

SEQ ID NO: 489712 - DNA, 17 bp, Homo sapiens
aagcatattgttattat

SEQ ID NO: 489713 - DNA, 23 bp, Homo sapiens
aagcatattgttattatataatt

SEQ ID NO: 489714 - DNA, 18 bp, Homo sapiens
aagcgatcacttcctata

SEQ ID NO: 489715 - DNA, 16 bp, Homo sapiens
aagctaaaacctgagc

SEQ ID NO: 489716 - DNA, 15 bp, Homo sapiens
aagctagaaaaatta

SEQ ID NO: 489717 - DNA, 17 bp, Homo sapiens
aagctagaacctggagg

SEQ ID NO: 489718 - DNA, 17 bp, Homo sapiens
aagctatcctggctctt

SEQ ID NO: 489719 - DNA, 19 bp, Homo sapiens
aagctcccaagggatggtg

SEQ ID NO: 489720 - DNA, 19 bp, Homo sapiens
aagctggaggactagaacc

SEQ ID NO: 489721 - DNA, 23 bp, Homo sapiens
aagctggaggactagaacctgga

SEQ ID NO: 489722 - DNA, 23 bp, Homo sapiens
aagctgttctcattcctgttctt

SEQ ID NO: 489723 - DNA, 14 bp, Homo sapiens
aagcttcattctca

SEQ ID NO: 489724 - DNA, 20 bp, Homo sapiens
agatataactattgcccagg

SEQ ID NO: 489725 - DNA, 11 bp, Homo sapiens
agatcatgggt

SEQ ID NO: 489726 - DNA, 15 bp, Homo sapiens
agatccccaactgct

SEQ ID NO: 489727 - DNA, 17 bp, Homo sapiens
agatcctcttctcaaag

SEQ ID NO: 489728 - DNA, 13 bp, Homo sapiens
agatcctggaaat

SEQ ID NO: 489729 - DNA, 13 bp, Homo sapiens
agatcgagaccat

SEQ ID NO: 489730 - DNA, 14 bp, Homo sapiens
agatgaaacacaaa

SEQ ID NO: 489731 - DNA, 20 bp, Homo sapiens
agatgaaatcttacagctgg

SEQ ID NO: 489732 - DNA, 23 bp, Homo sapiens
agatgaaatcttacagctgggtg

SEQ ID NO: 489733 - DNA, 17 bp, Homo sapiens
agatgactgaatttcta

SEQ ID NO: 489734 - DNA, 19 bp, Homo sapiens
agatgcagcaaaatgtgaa

SEQ ID NO: 489735 - DNA, 11 bp, Homo sapiens
agatgccctga

SEQ ID NO: 489736 - DNA, 13 bp, Homo sapiens
agatggagtccct

SEQ ID NO: 489737 - DNA, 15 bp, Homo sapiens
agatgggggaaagca

SEQ ID NO: 489738 - DNA, 18 bp, Homo sapiens
agatgggggaaagcacag

SEQ ID NO: 489739 - DNA, 14 bp, Homo sapiens
agattctttattag

SEQ ID NO: 489740 - DNA, 13 bp, Homo sapiens
agattttccttcc

SEQ ID NO: 489741 - DNA, 23 bp, Homo sapiens
agcaaaatgtgaatgggaaaaga

SEQ ID NO: 489742 - DNA, 23 bp, Homo sapiens
agcaaaattttttctctaggaaa

SEQ ID NO: 489743 - DNA, 22 bp, Homo sapiens
agcaaagtctaaagtttacagt

SEQ ID NO: 489744 - DNA, 18 bp, Homo sapiens
agcaaattccaatacatt

SEQ ID NO: 489745 - DNA, 13 bp, Homo sapiens
agcaagtctcttt

SEQ ID NO: 489746 - DNA, 16 bp, Homo sapiens
agcaccaatcatgaat

SEQ ID NO: 489747 - DNA, 16 bp, Homo sapiens
agcactaaagcagtgg

SEQ ID NO: 489748 - DNA, 23 bp, Homo sapiens
agcactaaagcagtggacaccag

SEQ ID NO: 489749 - DNA, 15 bp, Homo sapiens
aatcactcatttatt

SEQ ID NO: 489750 - DNA, 16 bp, Homo sapiens
aatcagcctagttgat

SEQ ID NO: 489751 - DNA, 21 bp, Homo sapiens
aatcagggttagtattgtcca

SEQ ID NO: 489752 - DNA, 22 bp, Homo sapiens
aatcagggttagtattgtccag

SEQ ID NO: 489753 - DNA, 14 bp, Homo sapiens
aatccactccttcc

SEQ ID NO: 489754 - DNA, 13 bp, Homo sapiens
aatccttgaagat

SEQ ID NO: 489755 - DNA, 17 bp, Homo sapiens
aatctcaattcttccct

SEQ ID NO: 489756 - DNA, 17 bp, Homo sapiens
aatctgatggcttctcc

SEQ ID NO: 489757 - DNA, 14 bp, Homo sapiens
aatcttatggggcc

SEQ ID NO: 489758 - DNA, 18 bp, Homo sapiens
aatgaccagtaattgtga

SEQ ID NO: 489759 - DNA, 14 bp, Homo sapiens
aatgataactggaa

SEQ ID NO: 489760 - DNA, 20 bp, Homo sapiens
aatgataatattgtggtgcc

SEQ ID NO: 489761 - DNA, 23 bp, Homo sapiens
aatgattatgaattacatttgta

SEQ ID NO: 489762 - DNA, 16 bp, Homo sapiens
aatgcaaattctcaag

SEQ ID NO: 489763 - DNA, 16 bp, Homo sapiens
aatgcataaaatgtta

SEQ ID NO: 489764 - DNA, 12 bp, Homo sapiens
aatgcatttaaa

SEQ ID NO: 489765 - DNA, 21 bp, Homo sapiens
aatgcatttaaactcatttga

SEQ ID NO: 489766 - DNA, 21 bp, Homo sapiens
aatgccatcctcaaacactgc

SEQ ID NO: 489767 - DNA, 21 bp, Homo sapiens
aatgctaaatgtaagaatcat

SEQ ID NO: 489768 - DNA, 20 bp, Homo sapiens
aatgctgtattttaaaagaa

SEQ ID NO: 489769 - DNA, 21 bp, Homo sapiens
aatgctgtattttaaaagaat

SEQ ID NO: 489770 - DNA, 22 bp, Homo sapiens
aatgctgtattttaaaagaatg

SEQ ID NO: 489771 - DNA, 15 bp, Homo sapiens
aatggaaaggagagg

SEQ ID NO: 489772 - DNA, 14 bp, Homo sapiens
aatggaagacacat

SEQ ID NO: 489773 - DNA, 19 bp, Homo sapiens
aatggcacagcccaaagaa

SEQ ID NO: 489774 - DNA, 18 bp, Homo sapiens
aatgggactgatgtcatc

SEQ ID NO: 489775 - DNA, 22 bp, Homo sapiens
aatgggactgatgtcatcttga

SEQ ID NO: 489776 - DNA, 23 bp, Homo sapiens
aatggtttgaatataaacactat

SEQ ID NO: 489777 - DNA, 16 bp, Homo sapiens
aatgtcagggccaggt

SEQ ID NO: 489778 - DNA, 21 bp, Homo sapiens
aatgtgcccttttggccgggc

SEQ ID NO: 489779 - DNA, 17 bp, Homo sapiens
aatgtgcctagttcttt

SEQ ID NO: 489780 - DNA, 23 bp, Homo sapiens
aatgtttcaaacatatataacaa

SEQ ID NO: 489781 - DNA, 13 bp, Homo sapiens
aattatattttga

SEQ ID NO: 489782 - DNA, 15 bp, Homo sapiens
aattatctgggcatg

SEQ ID NO: 489783 - DNA, 23 bp, Homo sapiens
aattcatcaaatggaagacacat

SEQ ID NO: 489784 - DNA, 21 bp, Homo sapiens
aattcattccatttgctgatt

SEQ ID NO: 489785 - DNA, 17 bp, Homo sapiens
aattccaatacattatt

SEQ ID NO: 489786 - DNA, 15 bp, Homo sapiens
aattctgctacctca

SEQ ID NO: 489787 - DNA, 16 bp, Homo sapiens
aattgtattttagtaa

SEQ ID NO: 489788 - DNA, 12 bp, Homo sapiens
aatttaaagcaa

SEQ ID NO: 489789 - DNA, 14 bp, Homo sapiens
aatttgtaagttta

SEQ ID NO: 489790 - DNA, 15 bp, Homo sapiens
aatttgtatctgaag

SEQ ID NO: 489791 - DNA, 17 bp, Homo sapiens
aatttgtatctgaagga

SEQ ID NO: 489792 - DNA, 17 bp, Homo sapiens
aattttgtgaagcaaaa

SEQ ID NO: 489793 - DNA, 15 bp, Homo sapiens
acaaaataaagctgt

SEQ ID NO: 489794 - DNA, 12 bp, Homo sapiens
acaaacctgcct

SEQ ID NO: 489795 - DNA, 14 bp, Homo sapiens
acaaagggcccaga

SEQ ID NO: 489796 - DNA, 18 bp, Homo sapiens
acaaagtgagacagtcca

SEQ ID NO: 489797 - DNA, 19 bp, Homo sapiens
acaaataaagcaatgaata

SEQ ID NO: 489798 - DNA, 18 bp, Homo sapiens
acaaatgggactgatgtc

SEQ ID NO: 489799 - DNA, 21 bp, Homo sapiens
acaaatgggactgatgtcatc

SEQ ID NO: 489800 - DNA, 22 bp, Homo sapiens
acaacatgtataatatttttaa

SEQ ID NO: 489801 - DNA, 22 bp, Homo sapiens
acaagacccaagtagctgctac

SEQ ID NO: 489802 - DNA, 15 bp, Homo sapiens
acaagtaaaactgtg

SEQ ID NO: 489803 - DNA, 21 bp, Homo sapiens
acaataagttaactattttat

SEQ ID NO: 489804 - DNA, 23 bp, Homo sapiens
acaatacatcccttacctgggaa

SEQ ID NO: 489805 - DNA, 18 bp, Homo sapiens
acaatagtaacctgggta

SEQ ID NO: 489806 - DNA, 18 bp, Homo sapiens
acaatgctgtattttaaa

SEQ ID NO: 489807 - DNA, 14 bp, Homo sapiens
acaatttaaagcaa

SEQ ID NO: 489808 - DNA, 15 bp, Homo sapiens
acacaaacctgcctg

SEQ ID NO: 489809 - DNA, 17 bp, Homo sapiens
acacaaacctgcctggg

SEQ ID NO: 489810 - DNA, 17 bp, Homo sapiens
acacaaagcctgtgtta

SEQ ID NO: 489811 - DNA, 16 bp, Homo sapiens
acacaacaccaggact

SEQ ID NO: 489812 - DNA, 14 bp, Homo sapiens
acacaactatattg

SEQ ID NO: 489813 - DNA, 12 bp, Homo sapiens
acacaatacaat

SEQ ID NO: 489814 - DNA, 12 bp, Homo sapiens
acacacagctcc

SEQ ID NO: 489815 - DNA, 17 bp, Homo sapiens
acacacaggcaactgag

SEQ ID NO: 489816 - DNA, 16 bp, Homo sapiens
acacaccccaacatgc

SEQ ID NO: 489817 - DNA, 13 bp, Homo sapiens
acacactgaagaa

SEQ ID NO: 489818 - DNA, 20 bp, Homo sapiens
acacagactattgacatcag

SEQ ID NO: 489819 - DNA, 15 bp, Homo sapiens
acacaggcaactgag

SEQ ID NO: 489820 - DNA, 19 bp, Homo sapiens
acacaggcaactgaggcag

SEQ ID NO: 489821 - DNA, 20 bp, Homo sapiens
acacaggcaactgaggcaga

SEQ ID NO: 489822 - DNA, 19 bp, Homo sapiens
acaccaggagtccctggta

SEQ ID NO: 489823 - DNA, 16 bp, Homo sapiens
acacccctcccctgcc

SEQ ID NO: 489824 - DNA, 17 bp, Homo sapiens
acacgcacgcacacaca

SEQ ID NO: 489825 - DNA, 14 bp, Homo sapiens
acactaagagagaa

SEQ ID NO: 489826 - DNA, 15 bp, Homo sapiens
acactagaggccagg

SEQ ID NO: 489827 - DNA, 16 bp, Homo sapiens
acactagaggccaggg

SEQ ID NO: 489828 - DNA, 17 bp, Homo sapiens
acactcaagaagcaggc

SEQ ID NO: 489829 - DNA, 20 bp, Homo sapiens
acactgaaatatacacacag

SEQ ID NO: 489830 - DNA, 22 bp, Homo sapiens
acactgaaatatacacacagca

SEQ ID NO: 489831 - DNA, 21 bp, Homo sapiens
acactgaagctcttgaagaca

SEQ ID NO: 489832 - DNA, 14 bp, Homo sapiens
acactgagctgtca

SEQ ID NO: 489833 - DNA, 11 bp, Homo sapiens
acactgcacag

SEQ ID NO: 489834 - DNA, 20 bp, Homo sapiens
acactgcaggcatcacagct

SEQ ID NO: 489835 - DNA, 21 bp, Homo sapiens
acactgcaggcatcacagcta

SEQ ID NO: 489836 - DNA, 19 bp, Homo sapiens
acactgcttgtgtttttaa

SEQ ID NO: 489837 - DNA, 15 bp, Homo sapiens
acactgggggagggg

SEQ ID NO: 489838 - DNA, 22 bp, Homo sapiens
acactgtctggtttcaccgagg

SEQ ID NO: 489839 - DNA, 22 bp, Homo sapiens
acacttcttcttggtcttattt

SEQ ID NO: 489840 - DNA, 13 bp, Homo sapiens
acagaacactaaa

SEQ ID NO: 489841 - DNA, 12 bp, Homo sapiens
acagaacactgt

SEQ ID NO: 489842 - DNA, 17 bp, Homo sapiens
acagaattctgctacct

SEQ ID NO: 489843 - DNA, 14 bp, Homo sapiens
acagacctttgaac

SEQ ID NO: 489844 - DNA, 14 bp, Homo sapiens
acagagacctcctg

SEQ ID NO: 489845 - DNA, 22 bp, Homo sapiens
acagatctctgctttggaaatc

SEQ ID NO: 489846 - DNA, 15 bp, Homo sapiens
acagcagctcaggca

SEQ ID NO: 489847 - DNA, 17 bp, Homo sapiens
acagcagctcaggcaca

SEQ ID NO: 489848 - DNA, 17 bp, Homo sapiens
acagcccaaagaaggaa

SEQ ID NO: 489849 - DNA, 14 bp, Homo sapiens
acagcccatctgcc

SEQ ID NO: 489850 - DNA, 20 bp, Homo sapiens
acagcccttctttccacaga

SEQ ID NO: 489851 - DNA, 21 bp, Homo sapiens
acagcccttctttccacagaa

SEQ ID NO: 489852 - DNA, 20 bp, Homo sapiens
acagccgctcctgtctgcca

SEQ ID NO: 489853 - DNA, 18 bp, Homo sapiens
acagctaacacacagctc

SEQ ID NO: 489854 - DNA, 14 bp, Homo sapiens
acagctgtatgatt

SEQ ID NO: 489855 - DNA, 20 bp, Homo sapiens
acagcttctcatcctgcagg

SEQ ID NO: 489856 - DNA, 16 bp, Homo sapiens
acaggcaactgaggca

SEQ ID NO: 489857 - DNA, 12 bp, Homo sapiens
acagtaaataaa

SEQ ID NO: 489858 - DNA, 15 bp, Homo sapiens
acagtaaataaattg

SEQ ID NO: 489859 - DNA, 17 bp, Homo sapiens
acagtatgtcccatagg

SEQ ID NO: 489860 - DNA, 17 bp, Homo sapiens
acagtcacctcatggaa

SEQ ID NO: 489861 - DNA, 20 bp, Homo sapiens
acagtgcttgccacagagcg

SEQ ID NO: 489862 - DNA, 16 bp, Homo sapiens
acagtgggcatcagca

SEQ ID NO: 489863 - DNA, 21 bp, Homo sapiens
acagtgggtgccccccttgcc

SEQ ID NO: 489864 - DNA, 21 bp, Homo sapiens
acagttacctctgcctcagaa

SEQ ID NO: 489865 - DNA, 22 bp, Homo sapiens
acagtttccagtcatggccaaa

SEQ ID NO: 489866 - DNA, 15 bp, Homo sapiens
acataaataaaatga

SEQ ID NO: 489867 - DNA, 21 bp, Homo sapiens
acatacaaaaattagccgggc

SEQ ID NO: 489868 - DNA, 16 bp, Homo sapiens
acatagaacatgtgtc

SEQ ID NO: 489869 - DNA, 16 bp, Homo sapiens
acatagtgaaagttta

SEQ ID NO: 489870 - DNA, 16 bp, Homo sapiens
acatcctcaaaagaaa

SEQ ID NO: 489871 - DNA, 23 bp, Homo sapiens
acatctcttcctccgaggccagt

SEQ ID NO: 489872 - DNA, 13 bp, Homo sapiens
acatcttggcaca

SEQ ID NO: 489873 - DNA, 14 bp, Homo sapiens
acatgccaagcact

SEQ ID NO: 489874 - DNA, 15 bp, Homo sapiens
acatgggacatttgc

SEQ ID NO: 489875 - DNA, 13 bp, Homo sapiens
acatgggagttta

SEQ ID NO: 489876 - DNA, 23 bp, Homo sapiens
acatggtgtctggattcccagga

SEQ ID NO: 489877 - DNA, 12 bp, Homo sapiens
acatgtcatgta

SEQ ID NO: 489878 - DNA, 19 bp, Homo sapiens
acattagttctatttctat

SEQ ID NO: 489879 - DNA, 19 bp, Homo sapiens
acattattggacttccatt

SEQ ID NO: 489880 - DNA, 15 bp, Homo sapiens
acattcatgcctggc

SEQ ID NO: 489881 - DNA, 16 bp, Homo sapiens
acattcatgcctggct

SEQ ID NO: 489882 - DNA, 13 bp, Homo sapiens
acattccatcctt

SEQ ID NO: 489883 - DNA, 14 bp, Homo sapiens
acatttatctttgt

SEQ ID NO: 489884 - DNA, 15 bp, Homo sapiens
acatttgctcatgga

SEQ ID NO: 489885 - DNA, 16 bp, Homo sapiens
acatttgctcatggaa

SEQ ID NO: 489886 - DNA, 16 bp, Homo sapiens
acatttgtataaaata

SEQ ID NO: 489887 - DNA, 20 bp, Homo sapiens
acattttcacacaatacaat

SEQ ID NO: 489888 - DNA, 13 bp, Homo sapiens
accaatcatgaat

SEQ ID NO: 489889 - DNA, 14 bp, Homo sapiens
accacaatatgtat

SEQ ID NO: 489890 - DNA, 12 bp, Homo sapiens
accacacatctg

SEQ ID NO: 489891 - DNA, 12 bp, Homo sapiens
accacagctgct

SEQ ID NO: 489892 - DNA, 17 bp, Homo sapiens
tttgtataaaataattt

SEQ ID NO: 489893 - DNA, 18 bp, Homo sapiens
tttgtataaaataatttt

SEQ ID NO: 489894 - DNA, 19 bp, Homo sapiens
tttgtataaaataattttt

SEQ ID NO: 489895 - DNA, 13 bp, Homo sapiens
tttgtatctgaag

SEQ ID NO: 489896 - DNA, 18 bp, Homo sapiens
tttgttatttgtacagtt

SEQ ID NO: 489897 - DNA, 19 bp, Homo sapiens
tttgttatttgtacagttc

SEQ ID NO: 489898 - DNA, 21 bp, Homo sapiens
ttttaaaagaatgattatgaa

SEQ ID NO: 489899 - DNA, 22 bp, Homo sapiens
ttttaagaaaaacatgtcatgt

SEQ ID NO: 489900 - DNA, 12 bp, Homo sapiens
ttttaataatgt

SEQ ID NO: 489901 - DNA, 13 bp, Homo sapiens
ttttaataatgtt

SEQ ID NO: 489902 - DNA, 13 bp, Homo sapiens
ttttaatttgata

SEQ ID NO: 489903 - DNA, 19 bp, Homo sapiens
ttttaggcagggatttgag

SEQ ID NO: 489904 - DNA, 14 bp, Homo sapiens
ttttataattttgt

SEQ ID NO: 489905 - DNA, 20 bp, Homo sapiens
ttttatatgcttctgtttta

SEQ ID NO: 489906 - DNA, 18 bp, Homo sapiens
ttttatatttgaaatatt

SEQ ID NO: 489907 - DNA, 19 bp, Homo sapiens
ttttatgccttttatttct

SEQ ID NO: 489908 - DNA, 19 bp, Homo sapiens
ttttatggcactagtattt

SEQ ID NO: 489909 - DNA, 20 bp, Homo sapiens
ttttcaggctagatgtatgt

SEQ ID NO: 489910 - DNA, 18 bp, Homo sapiens
ttttccatgaaaatgcaa

SEQ ID NO: 489911 - DNA, 14 bp, Homo sapiens
ttttctctaggaaa

SEQ ID NO: 489912 - DNA, 21 bp, Homo sapiens
ttttgtgaagaaacatttatc

SEQ ID NO: 489913 - DNA, 23 bp, Homo sapiens
tttttaagctgtaaaaagagaga

SEQ ID NO: 489914 - DNA, 23 bp, Homo sapiens
ttttttaaaaaagaaacatttgg

SEQ ID NO: 489915 - DNA, 20 bp, Homo sapiens
tgtaagtttatgtctaaaga

SEQ ID NO: 489916 - DNA, 13 bp, Homo sapiens
tgtaattcaagct

SEQ ID NO: 489917 - DNA, 21 bp, Homo sapiens
tgtacagaattctgctacctc

SEQ ID NO: 489918 - DNA, 17 bp, Homo sapiens
tgtacgttcttctattg

SEQ ID NO: 489919 - DNA, 16 bp, Homo sapiens
tgtagtgttggagaag

SEQ ID NO: 489920 - DNA, 13 bp, Homo sapiens
tgtataaaataat

SEQ ID NO: 489921 - DNA, 16 bp, Homo sapiens
tgtataactgtgcaga

SEQ ID NO: 489922 - DNA, 19 bp, Homo sapiens
tgtataagtccttgcaaga

SEQ ID NO: 489923 - DNA, 15 bp, Homo sapiens
tgtatctacctcact

SEQ ID NO: 489924 - DNA, 22 bp, Homo sapiens
tgtatctgaaggagattttcct

SEQ ID NO: 489925 - DNA, 15 bp, Homo sapiens
tgtattagtcacaga

SEQ ID NO: 489926 - DNA, 19 bp, Homo sapiens
tgtattgcatatatacata

SEQ ID NO: 489927 - DNA, 13 bp, Homo sapiens
tgtatttaaatat

SEQ ID NO: 489928 - DNA, 14 bp, Homo sapiens
tgtcaaagaatcaa

SEQ ID NO: 489929 - DNA, 21 bp, Homo sapiens
tgtcaataaaatccatacatt

SEQ ID NO: 489930 - DNA, 15 bp, Homo sapiens
tgtcacacagggcag

SEQ ID NO: 489931 - DNA, 20 bp, Homo sapiens
tgtcacatgaaacatttgca

SEQ ID NO: 489932 - DNA, 22 bp, Homo sapiens
tgtcagggccaggtgcagacct

SEQ ID NO: 489933 - DNA, 23 bp, Homo sapiens
tgtcatccacacaacaccaggac

SEQ ID NO: 489934 - DNA, 19 bp, Homo sapiens
tgtcatgtaggttgtctaa

SEQ ID NO: 489935 - DNA, 21 bp, Homo sapiens
tgtcatgtaggttgtctaaaa

SEQ ID NO: 489936 - DNA, 19 bp, Homo sapiens
tgtccaaagcagggtctgg

SEQ ID NO: 489937 - DNA, 18 bp, Homo sapiens
tgtccacacccagctcag

SEQ ID NO: 489938 - DNA, 12 bp, Homo sapiens
tgtccctacacc

SEQ ID NO: 489939 - DNA, 14 bp, Homo sapiens
tgtcctcaccacat

SEQ ID NO: 489940 - DNA, 12 bp, Homo sapiens
tgtcctgctggt

SEQ ID NO: 489941 - DNA, 20 bp, Homo sapiens
tgtctaaaaataaaatgcat

SEQ ID NO: 489942 - DNA, 19 bp, Homo sapiens
tgtctaaagagctttagtc

SEQ ID NO: 489943 - DNA, 17 bp, Homo sapiens
tgtctacactaagagag

SEQ ID NO: 489944 - DNA, 12 bp, Homo sapiens
tgtctcaaaaaa

SEQ ID NO: 489945 - DNA, 20 bp, Homo sapiens
tgtctcttaaaaaaataaaa

SEQ ID NO: 489946 - DNA, 15 bp, Homo sapiens
tgtctggccaggcct

SEQ ID NO: 489947 - DNA, 15 bp, Homo sapiens
tgtgaagaaacattt

SEQ ID NO: 489948 - DNA, 19 bp, Homo sapiens
tgtgaagaaacatttatct

SEQ ID NO: 489949 - DNA, 19 bp, Homo sapiens
tgtgattcctttgaagagg

SEQ ID NO: 489950 - DNA, 15 bp, Homo sapiens
tgtgcctctgtcctt

SEQ ID NO: 489951 - DNA, 13 bp, Homo sapiens
tgtggagggcaca

SEQ ID NO: 489952 - DNA, 15 bp, Homo sapiens
tgtggcctgggcctc

SEQ ID NO: 489953 - DNA, 16 bp, Homo sapiens
tgtggcctgggcctcc

SEQ ID NO: 489954 - DNA, 15 bp, Homo sapiens
tgtgggaaggccagc

SEQ ID NO: 489955 - DNA, 15 bp, Homo sapiens
tgtggttaatgccat

SEQ ID NO: 489956 - DNA, 13 bp, Homo sapiens
tgtgtacacatgg

SEQ ID NO: 489957 - DNA, 22 bp, Homo sapiens
tgtgtgaaaggtacttcaaatc

SEQ ID NO: 489958 - DNA, 12 bp, Homo sapiens
tgtgttactgat

SEQ ID NO: 489959 - DNA, 17 bp, Homo sapiens
tgttaatggtttgaata

SEQ ID NO: 489960 - DNA, 17 bp, Homo sapiens
tgttactggtgtccagc

SEQ ID NO: 489961 - DNA, 12 bp, Homo sapiens
tgttataatctt

SEQ ID NO: 489962 - DNA, 16 bp, Homo sapiens
tgttctattcatctca

SEQ ID NO: 489963 - DNA, 12 bp, Homo sapiens
tgttgccctggg

SEQ ID NO: 489964 - DNA, 16 bp, Homo sapiens
tgttggagaagaactg

SEQ ID NO: 489965 - DNA, 17 bp, Homo sapiens
tgttggagaagaactga

SEQ ID NO: 489966 - DNA, 21 bp, Homo sapiens
tgtttcaaacatatataacaa

SEQ ID NO: 489967 - DNA, 22 bp, Homo sapiens
tgtttcaaacatatataacaat

SEQ ID NO: 489968 - DNA, 17 bp, Homo sapiens
tgtttccaggtcagaaa

SEQ ID NO: 489969 - DNA, 20 bp, Homo sapiens
tgtttccaggtcagaaacca

SEQ ID NO: 489970 - DNA, 15 bp, Homo sapiens
tgtttggaggagcaa

SEQ ID NO: 489971 - DNA, 22 bp, Homo sapiens
tgttttcccgagcaaagtctaa

SEQ ID NO: 489972 - DNA, 16 bp, Homo sapiens
gaactctcctgctcct

SEQ ID NO: 489973 - DNA, 14 bp, Homo sapiens
gaactgaaatcata

SEQ ID NO: 489974 - DNA, 15 bp, Homo sapiens
gaacttggaggcacc

SEQ ID NO: 489975 - DNA, 13 bp, Homo sapiens
gaagaacagcaga

SEQ ID NO: 489976 - DNA, 21 bp, Homo sapiens
gaagacactgaaatatacaca

SEQ ID NO: 489977 - DNA, 12 bp, Homo sapiens
gaagactgtggc

SEQ ID NO: 489978 - DNA, 20 bp, Homo sapiens
gaagactttaaaccacctag

SEQ ID NO: 489979 - DNA, 16 bp, Homo sapiens
gaagagccggagcctc

SEQ ID NO: 489980 - DNA, 13 bp, Homo sapiens
gaagatccccaac

SEQ ID NO: 489981 - DNA, 17 bp, Homo sapiens
gaagatcctaaaacaaa

SEQ ID NO: 489982 - DNA, 13 bp, Homo sapiens
gaagcagctcaag

SEQ ID NO: 489983 - DNA, 18 bp, Homo sapiens
gaaggaaaaggcagggag

SEQ ID NO: 489984 - DNA, 19 bp, Homo sapiens
gaaggagggttagggaggg

SEQ ID NO: 489985 - DNA, 17 bp, Homo sapiens
gaaggcagcaggtggca

SEQ ID NO: 489986 - DNA, 18 bp, Homo sapiens
gaaggctcttctccccag

SEQ ID NO: 489987 - DNA, 23 bp, Homo sapiens
gaaggctcttctccccagagttc

SEQ ID NO: 489988 - DNA, 19 bp, Homo sapiens
gaagggcatccttctgcct

SEQ ID NO: 489989 - DNA, 20 bp, Homo sapiens
gaagggctagaacctggaga

SEQ ID NO: 489990 - DNA, 14 bp, Homo sapiens
gaagtaacagtaac

SEQ ID NO: 489991 - DNA, 13 bp, Homo sapiens
gaagtatgcacta

SEQ ID NO: 489992 - DNA, 22 bp, Homo sapiens
gaagtccaagcatttagatgta

SEQ ID NO: 489993 - DNA, 20 bp, Homo sapiens
gaagtgactttggctgcatg

SEQ ID NO: 489994 - DNA, 21 bp, Homo sapiens
gaagtgactttggctgcatgc

SEQ ID NO: 489995 - DNA, 15 bp, Homo sapiens
gaagtggggacagag

SEQ ID NO: 489996 - DNA, 21 bp, Homo sapiens
gaagtttccttggctggtgca

SEQ ID NO: 489997 - DNA, 13 bp, Homo sapiens
gaataaaattgta

SEQ ID NO: 489998 - DNA, 13 bp, Homo sapiens
gaataatgggctt

SEQ ID NO: 489999 - DNA, 21 bp, Homo sapiens
gaatcactcatttatttccat

SEQ ID NO: 490000 - DNA, 16 bp, Homo sapiens
gaatcagacctgggtg

SEQ ID NO: 490001 - DNA, 15 bp, Homo sapiens
gaatcagtgcaaaga

SEQ ID NO: 490002 - DNA, 19 bp, Homo sapiens
gaatcgcttgaacctggga

SEQ ID NO: 490003 - DNA, 16 bp, Homo sapiens
gaatgcctgagtgcct

SEQ ID NO: 490004 - DNA, 19 bp, Homo sapiens
gaatgcctgagtgcctggc

SEQ ID NO: 490005 - DNA, 18 bp, Homo sapiens
gaatgcttataggtggcc

SEQ ID NO: 490006 - DNA, 13 bp, Homo sapiens
gaatggcaatggt

SEQ ID NO: 490007 - DNA, 17 bp, Homo sapiens
gaatggcacagcccaaa

SEQ ID NO: 490008 - DNA, 18 bp, Homo sapiens
gaattaagttagggaatg

SEQ ID NO: 490009 - DNA, 21 bp, Homo sapiens
gaattaagttagggaatggca

SEQ ID NO: 490010 - DNA, 15 bp, Homo sapiens
gaattacatttgtat

SEQ ID NO: 490011 - DNA, 18 bp, Homo sapiens
gaattagaaacataaata

SEQ ID NO: 490012 - DNA, 16 bp, Homo sapiens
gaattgaaaaggactc

SEQ ID NO: 490013 - DNA, 22 bp, Homo sapiens
gaattgaatcgctgcgatactg

SEQ ID NO: 490014 - DNA, 16 bp, Homo sapiens
gaatttttcttgcgaa

SEQ ID NO: 490015 - DNA, 15 bp, Homo sapiens
gacaaatgggactga

SEQ ID NO: 490016 - DNA, 17 bp, Homo sapiens
gacacaaacctgcctgg

SEQ ID NO: 490017 - DNA, 18 bp, Homo sapiens
gacacaaacctgcctggg

SEQ ID NO: 490018 - DNA, 13 bp, Homo sapiens
gacagaagaaggc

SEQ ID NO: 490019 - DNA, 19 bp, Homo sapiens
gacagatctctgctttgga

SEQ ID NO: 490020 - DNA, 23 bp, Homo sapiens
gacagatctctgctttggaaatc

SEQ ID NO: 490021 - DNA, 14 bp, Homo sapiens
gacagcagctcagg

SEQ ID NO: 490022 - DNA, 14 bp, Homo sapiens
gacagctgttccac

SEQ ID NO: 490023 - DNA, 23 bp, Homo sapiens
gacaggatggttcccttgatgaa

SEQ ID NO: 490024 - DNA, 23 bp, Homo sapiens
gacagggatgagcatggagctgg

SEQ ID NO: 490025 - DNA, 16 bp, Homo sapiens
gacagtcaccccagga

SEQ ID NO: 490026 - DNA, 13 bp, Homo sapiens
gacatcagcatca

SEQ ID NO: 490027 - DNA, 17 bp, Homo sapiens
gacatgggacatttgct

SEQ ID NO: 490028 - DNA, 22 bp, Homo sapiens
gacatgggacatttgctcatgg

SEQ ID NO: 490029 - DNA, 16 bp, Homo sapiens
gacatgtggtgggaca

SEQ ID NO: 490030 - DNA, 20 bp, Homo sapiens
gaccatcctggccaacatga

SEQ ID NO: 490031 - DNA, 17 bp, Homo sapiens
gacccaagtagctgcta

SEQ ID NO: 490032 - DNA, 22 bp, Homo sapiens
gacccaagtagctgctaccttc

SEQ ID NO: 490033 - DNA, 14 bp, Homo sapiens
gacccaggctgggc

SEQ ID NO: 490034 - DNA, 13 bp, Homo sapiens
gacccagggccta

SEQ ID NO: 490035 - DNA, 13 bp, Homo sapiens
gacctcagccttc

SEQ ID NO: 490036 - DNA, 15 bp, Homo sapiens
gacctgactattgaa

SEQ ID NO: 490037 - DNA, 11 bp, Homo sapiens
gacctgcctcc

SEQ ID NO: 490038 - DNA, 22 bp, Homo sapiens
gacctgcctcccttcatgcatg

SEQ ID NO: 490039 - DNA, 16 bp, Homo sapiens
gacctggcaaggacac

SEQ ID NO: 490040 - DNA, 17 bp, Homo sapiens
gacctggcaaggacaca

SEQ ID NO: 490041 - DNA, 15 bp, Homo sapiens
gaccttctaggaagc

SEQ ID NO: 490042 - DNA, 17 bp, Homo sapiens
gacctttcagctgtgaa

SEQ ID NO: 490043 - DNA, 13 bp, Homo sapiens
gacgccacccagc

SEQ ID NO: 490044 - DNA, 17 bp, Homo sapiens
gacggtgctccaggcag

SEQ ID NO: 490045 - DNA, 23 bp, Homo sapiens
gacgtgcactgagagtgaagtga

SEQ ID NO: 490046 - DNA, 18 bp, Homo sapiens
gactatattgtacacacc

SEQ ID NO: 490047 - DNA, 18 bp, Homo sapiens
gactatcaaactgaagcc

SEQ ID NO: 490048 - DNA, 16 bp, Homo sapiens
gactatttaacttgag

SEQ ID NO: 490049 - DNA, 22 bp, Homo sapiens
gactcaaaacccatctgggctc

SEQ ID NO: 490050 - DNA, 23 bp, Homo sapiens
gactcaaaacccatctgggctcc

SEQ ID NO: 490051 - DNA, 17 bp, Homo sapiens
gactcagggccccagca

SEQ ID NO: 490052 - DNA, 20 bp, Homo sapiens
gactcagggccccagcacta

SEQ ID NO: 490053 - DNA, 19 bp, Homo sapiens
gactcctaggcaggacatg

SEQ ID NO: 490054 - DNA, 16 bp, Homo sapiens
gactctgtctcaaaaa

SEQ ID NO: 490055 - DNA, 15 bp, Homo sapiens
gactcttaagaagac

SEQ ID NO: 490056 - DNA, 16 bp, Homo sapiens
gactcttaagaagact

SEQ ID NO: 490057 - DNA, 18 bp, Homo sapiens
gactcttaagaagactgc

SEQ ID NO: 490058 - DNA, 14 bp, Homo sapiens
gactgcattatatt

SEQ ID NO: 490059 - DNA, 17 bp, Homo sapiens
gactgtgatttatttgg

SEQ ID NO: 490060 - DNA, 19 bp, Homo sapiens
gactgtgatttatttggag

SEQ ID NO: 490061 - DNA, 19 bp, Homo sapiens
gactgttcaagagcacact

SEQ ID NO: 490062 - DNA, 23 bp, Homo sapiens
gactgttcaagagcacacttggc

SEQ ID NO: 490063 - DNA, 14 bp, Homo sapiens
gactgttcctgtct

SEQ ID NO: 490064 - DNA, 15 bp, Homo sapiens
gacttaagacaaatg

SEQ ID NO: 490065 - DNA, 22 bp, Homo sapiens
gacttaagacaaatgggactga

SEQ ID NO: 490066 - DNA, 15 bp, Homo sapiens
gacttccatttggaa

SEQ ID NO: 490067 - DNA, 13 bp, Homo sapiens
gacttcccagctt

SEQ ID NO: 490068 - DNA, 19 bp, Homo sapiens
gacttgagaaacaaataat

SEQ ID NO: 490069 - DNA, 12 bp, Homo sapiens
gcacgcagtggc

SEQ ID NO: 490070 - DNA, 12 bp, Homo sapiens
gcacggctgctg

SEQ ID NO: 490071 - DNA, 13 bp, Homo sapiens
gcacggctgctga

SEQ ID NO: 490072 - DNA, 22 bp, Homo sapiens
gcacgttaaaaattaaaagaag

SEQ ID NO: 490073 - DNA, 14 bp, Homo sapiens
gcactaaagcagtg

SEQ ID NO: 490074 - DNA, 15 bp, Homo sapiens
gcactctagcctggc

SEQ ID NO: 490075 - DNA, 15 bp, Homo sapiens
gcactgactggaagg

SEQ ID NO: 490076 - DNA, 11 bp, Homo sapiens
gcactggtggg

SEQ ID NO: 490077 - DNA, 19 bp, Homo sapiens
gcactgtgggtagacacac

SEQ ID NO: 490078 - DNA, 21 bp, Homo sapiens
gcactttgggaggctgaggtg

SEQ ID NO: 490079 - DNA, 16 bp, Homo sapiens
gcagaaaattgcctaa

SEQ ID NO: 490080 - DNA, 21 bp, Homo sapiens
gcagaacagccgctcctgtct

SEQ ID NO: 490081 - DNA, 16 bp, Homo sapiens
gcagacagcagctcag

SEQ ID NO: 490082 - DNA, 12 bp, Homo sapiens
gcagagccaggc

SEQ ID NO: 490083 - DNA, 14 bp, Homo sapiens
gcagagctctgccg

SEQ ID NO: 490084 - DNA, 13 bp, Homo sapiens
gcagagtcacacg

SEQ ID NO: 490085 - DNA, 22 bp, Homo sapiens
gcagatggcggtgatcagcaga

SEQ ID NO: 490086 - DNA, 16 bp, Homo sapiens
gcagatttgggctgga

SEQ ID NO: 490087 - DNA, 20 bp, Homo sapiens
gcagcaggtggcagaatggg

SEQ ID NO: 490088 - DNA, 12 bp, Homo sapiens
gcagccaaggga

SEQ ID NO: 490089 - DNA, 13 bp, Homo sapiens
gcagccagctctc

SEQ ID NO: 490090 - DNA, 18 bp, Homo sapiens
gcagccagctctcagcca

SEQ ID NO: 490091 - DNA, 12 bp, Homo sapiens
gcagctgcctcc

SEQ ID NO: 490092 - DNA, 13 bp, Homo sapiens
gcagctgcctccc

SEQ ID NO: 490093 - DNA, 18 bp, Homo sapiens
gcagctgcctcccctcct

SEQ ID NO: 490094 - DNA, 19 bp, Homo sapiens
gcaggactcagctccccag

SEQ ID NO: 490095 - DNA, 18 bp, Homo sapiens
gcaggaggggggctgggt

SEQ ID NO: 490096 - DNA, 24 bp, Homo sapiens
gcaggatggcctggccagggcctg

SEQ ID NO: 490097 - DNA, 15 bp, Homo sapiens
gctcagttctgcctt

SEQ ID NO: 490098 - DNA, 22 bp, Homo sapiens
gctcatctctgtcccacttggc

SEQ ID NO: 490099 - DNA, 13 bp, Homo sapiens
gctccagcctctg

SEQ ID NO: 490100 - DNA, 16 bp, Homo sapiens
gctccagcctctgccg

SEQ ID NO: 490101 - DNA, 21 bp, Homo sapiens
gctccaggcaggctaaggcgt

SEQ ID NO: 490102 - DNA, 21 bp, Homo sapiens
gctcctcatccagggctctga

SEQ ID NO: 490103 - DNA, 14 bp, Homo sapiens
gctcctgtctgcca

SEQ ID NO: 490104 - DNA, 18 bp, Homo sapiens
gctcctgtctgccagcca

SEQ ID NO: 490105 - DNA, 21 bp, Homo sapiens
gctcctgtctgccagccagca

SEQ ID NO: 490106 - DNA, 15 bp, Homo sapiens
gctctcttcaataaa

SEQ ID NO: 490107 - DNA, 17 bp, Homo sapiens
gctctcttcaataaacc

SEQ ID NO: 490108 - DNA, 15 bp, Homo sapiens
gctgaagatccccaa

SEQ ID NO: 490109 - DNA, 21 bp, Homo sapiens
gctgaagatccccaactgctc

SEQ ID NO: 490110 - DNA, 17 bp, Homo sapiens
gctgacacaaacctgcc

SEQ ID NO: 490111 - DNA, 20 bp, Homo sapiens
gctgacacaaacctgcctgg

SEQ ID NO: 490112 - DNA, 21 bp, Homo sapiens
gctgagcaggaggggggctgg

SEQ ID NO: 490113 - DNA, 22 bp, Homo sapiens
gctgaggccccttctaggtggc

SEQ ID NO: 490114 - DNA, 19 bp, Homo sapiens
gctgaggtgggaggatcac

SEQ ID NO: 490115 - DNA, 13 bp, Homo sapiens
gctgagttggtgt

SEQ ID NO: 490116 - DNA, 20 bp, Homo sapiens
gctgattctcagggtctctg

SEQ ID NO: 490117 - DNA, 18 bp, Homo sapiens
gctgcagatttgggctgg

SEQ ID NO: 490118 - DNA, 21 bp, Homo sapiens
gctgcagatttgggctggaac

SEQ ID NO: 490119 - DNA, 17 bp, Homo sapiens
gctgccatgctttgagt

SEQ ID NO: 490120 - DNA, 12 bp, Homo sapiens
gctgcccaggcc

SEQ ID NO: 490121 - DNA, 16 bp, Homo sapiens
gctgcccgtcttcagc

SEQ ID NO: 490122 - DNA, 20 bp, Homo sapiens
gctgcccgtcttcagcctag

SEQ ID NO: 490123 - DNA, 17 bp, Homo sapiens
gctgccgccccacccag

SEQ ID NO: 490124 - DNA, 21 bp, Homo sapiens
gctgcctcccctcctctgctt

SEQ ID NO: 490125 - DNA, 19 bp, Homo sapiens
gctgctagcacttggagcc

SEQ ID NO: 490126 - DNA, 21 bp, Homo sapiens
gctggaaaagtatgttagtgc

SEQ ID NO: 490127 - DNA, 21 bp, Homo sapiens
gctggaatctggagagctaga

SEQ ID NO: 490128 - DNA, 18 bp, Homo sapiens
gctggccgtgggcctggg

SEQ ID NO: 490129 - DNA, 19 bp, Homo sapiens
gctgggattacaggtgtga

SEQ ID NO: 490130 - DNA, 20 bp, Homo sapiens
gctggggaagtcctctgggt

SEQ ID NO: 490131 - DNA, 16 bp, Homo sapiens
gctgggggtgctggat

SEQ ID NO: 490132 - DNA, 15 bp, Homo sapiens
gctgggtggcactgc

SEQ ID NO: 490133 - DNA, 23 bp, Homo sapiens
gctggtaatttgtatctgaagga

SEQ ID NO: 490134 - DNA, 16 bp, Homo sapiens
gctggtctgtttccag

SEQ ID NO: 490135 - DNA, 20 bp, Homo sapiens
gctggtgagtgatgcggcag

SEQ ID NO: 490136 - DNA, 17 bp, Homo sapiens
gctggttggagagctag

SEQ ID NO: 490137 - DNA, 22 bp, Homo sapiens
gctgtataactgtgcagagact

SEQ ID NO: 490138 - DNA, 18 bp, Homo sapiens
gctgtattttaaaagaat

SEQ ID NO: 490139 - DNA, 14 bp, Homo sapiens
gctgtccccttcca

SEQ ID NO: 490140 - DNA, 20 bp, Homo sapiens
gctgtctacactaagagaga

SEQ ID NO: 490141 - DNA, 17 bp, Homo sapiens
gctgttccacaggggct

SEQ ID NO: 490142 - DNA, 14 bp, Homo sapiens
gcttagacctcagc

SEQ ID NO: 490143 - DNA, 18 bp, Homo sapiens
gcttagacctcagcctgt

SEQ ID NO: 490144 - DNA, 18 bp, Homo sapiens
gcttcagttgttttcccg

SEQ ID NO: 490145 - DNA, 16 bp, Homo sapiens
gcttcattagagcagg

SEQ ID NO: 490146 - DNA, 19 bp, Homo sapiens
gcttcccagtggctgctgc

SEQ ID NO: 490147 - DNA, 20 bp, Homo sapiens
gcttcccagtggctgctgcc

SEQ ID NO: 490148 - DNA, 21 bp, Homo sapiens
gcttcccagtggctgctgccc

SEQ ID NO: 490149 - DNA, 22 bp, Homo sapiens
gcttcccagtggctgctgccca

SEQ ID NO: 490150 - DNA, 14 bp, Homo sapiens
gcttccgcatccta

SEQ ID NO: 490151 - DNA, 16 bp, Homo sapiens
gcttctcatcctgcag

SEQ ID NO: 490152 - DNA, 16 bp, Homo sapiens
gcttctgccacataaa

SEQ ID NO: 490153 - DNA, 19 bp, Homo sapiens
gcttgaacctgggaggcag

SEQ ID NO: 490154 - DNA, 20 bp, Homo sapiens
gcttgaacctgggaggcaga

SEQ ID NO: 490155 - DNA, 18 bp, Homo sapiens
gcttgccatccctccctc

SEQ ID NO: 490156 - DNA, 14 bp, Homo sapiens
gcttgcctgcaggc

SEQ ID NO: 490157 - DNA, 20 bp, Homo sapiens
gctttcaagacccctgtctt

SEQ ID NO: 490158 - DNA, 11 bp, Homo sapiens
gctttctgtct

SEQ ID NO: 490159 - DNA, 12 bp, Homo sapiens
gctttgctctgc

SEQ ID NO: 490160 - DNA, 15 bp, Homo sapiens
ggaaaccacagctgc

SEQ ID NO: 490161 - DNA, 17 bp, Homo sapiens
ggaaactggatgaggtc

SEQ ID NO: 490162 - DNA, 18 bp, Homo sapiens
ggaaagaagagccggagc

SEQ ID NO: 490163 - DNA, 13 bp, Homo sapiens
ggaaatatttatt

SEQ ID NO: 490164 - DNA, 19 bp, Homo sapiens
ggaaatcagggttagtatt

SEQ ID NO: 490165 - DNA, 19 bp, Homo sapiens
ggaaattcccttcatctgg

SEQ ID NO: 490166 - DNA, 22 bp, Homo sapiens
ggaaattcccttcatctggaac

SEQ ID NO: 490167 - DNA, 16 bp, Homo sapiens
ggaacatacagacaca

SEQ ID NO: 490168 - DNA, 18 bp, Homo sapiens
ggaacatacagacacatt

SEQ ID NO: 490169 - DNA, 17 bp, Homo sapiens
ggaactcacctggggct

SEQ ID NO: 490170 - DNA, 16 bp, Homo sapiens
ggaagaaagagaagga

SEQ ID NO: 490171 - DNA, 20 bp, Homo sapiens
ggaaggagggttagggaggg

SEQ ID NO: 490172 - DNA, 21 bp, Homo sapiens
ggaaggctcttctccccagag

SEQ ID NO: 490173 - DNA, 23 bp, Homo sapiens
ggaagggaagttcaggctctgag

SEQ ID NO: 490174 - DNA, 16 bp, Homo sapiens
ggaaggtggggacagg

SEQ ID NO: 490175 - DNA, 13 bp, Homo sapiens
ggaatatgagctt

SEQ ID NO: 490176 - DNA, 20 bp, Homo sapiens
ggaatccactcccaggcagc

SEQ ID NO: 490177 - DNA, 12 bp, Homo sapiens
ggaatggagctg

SEQ ID NO: 490178 - DNA, 15 bp, Homo sapiens
ggaatggcacagccc

SEQ ID NO: 490179 - DNA, 20 bp, Homo sapiens
ggaattcatctctctttaat

SEQ ID NO: 490180 - DNA, 16 bp, Homo sapiens
ggaattggagctcgtg

SEQ ID NO: 490181 - DNA, 20 bp, Homo sapiens
ggacaaggaggtctgtgcca

SEQ ID NO: 490182 - DNA, 16 bp, Homo sapiens
ggacacagatgaaaca

SEQ ID NO: 490183 - DNA, 21 bp, Homo sapiens
ggacagaggttatctgtccca

SEQ ID NO: 490184 - DNA, 17 bp, Homo sapiens
ggacatttgctcatgga

SEQ ID NO: 490185 - DNA, 15 bp, Homo sapiens
ggaccagcttttccc

SEQ ID NO: 490186 - DNA, 13 bp, Homo sapiens
ggaccaggcaatg

SEQ ID NO: 490187 - DNA, 14 bp, Homo sapiens
ggacccagggatga

SEQ ID NO: 490188 - DNA, 17 bp, Homo sapiens
ggacctttcagctgtga

SEQ ID NO: 490189 - DNA, 15 bp, Homo sapiens
ggacggtgctccagg

SEQ ID NO: 490190 - DNA, 20 bp, Homo sapiens
ggacggtgctccaggcaggc

SEQ ID NO: 490191 - DNA, 14 bp, Homo sapiens
ggactagaacctgg

SEQ ID NO: 490192 - DNA, 13 bp, Homo sapiens
ggactcagctccc

SEQ ID NO: 490193 - DNA, 18 bp, Homo sapiens
ggactgatgtcatcttga

SEQ ID NO: 490194 - DNA, 22 bp, Homo sapiens
ggacttaagacaaatgggactg

SEQ ID NO: 490195 - DNA, 13 bp, Homo sapiens
ggacttccatttg

SEQ ID NO: 490196 - DNA, 18 bp, Homo sapiens
ggacttgaggattttgag

SEQ ID NO: 490197 - DNA, 18 bp, Homo sapiens
ggagaactagaacctgga

SEQ ID NO: 490198 - DNA, 17 bp, Homo sapiens
ggagactatcagcccaa

SEQ ID NO: 490199 - DNA, 16 bp, Homo sapiens
ggagactcctaggcag

SEQ ID NO: 490200 - DNA, 20 bp, Homo sapiens
ggagagccagaacctggagg

SEQ ID NO: 490201 - DNA, 20 bp, Homo sapiens
ggagagctagaacccggcag

SEQ ID NO: 490202 - DNA, 20 bp, Homo sapiens
ggagagctagaacctggaga

SEQ ID NO: 490203 - DNA, 21 bp, Homo sapiens
ggagagctagaacctggaggg

SEQ ID NO: 490204 - DNA, 12 bp, Homo sapiens
ggagaggaaaga

SEQ ID NO: 490205 - DNA, 14 bp, Homo sapiens
ggagcaaaggctga

SEQ ID NO: 490206 - DNA, 18 bp, Homo sapiens
ggagcagtgcaggcacag

SEQ ID NO: 490207 - DNA, 17 bp, Homo sapiens
ggagcatggctgtgagg

SEQ ID NO: 490208 - DNA, 19 bp, Homo sapiens
ggagcctcatccgaggcag

SEQ ID NO: 490209 - DNA, 21 bp, Homo sapiens
ggagcctcatccgaggcaggg

SEQ ID NO: 490210 - DNA, 23 bp, Homo sapiens
ggagctgtataactgtgcagaga

SEQ ID NO: 490211 - DNA, 21 bp, Homo sapiens
ggaggaaggcttacacccaca

SEQ ID NO: 490212 - DNA, 22 bp, Homo sapiens
ggaggactagaacctggagggc

SEQ ID NO: 490213 - DNA, 17 bp, Homo sapiens
ggaggagcagtgcaggc

SEQ ID NO: 490214 - DNA, 12 bp, Homo sapiens
ggaggaggcctg

SEQ ID NO: 490215 - DNA, 22 bp, Homo sapiens
ggaggaggcctgggggcaggga

SEQ ID NO: 490216 - DNA, 14 bp, Homo sapiens
ggaggcctgggggc

SEQ ID NO: 490217 - DNA, 19 bp, Homo sapiens
ggaggctacctcacctggg

SEQ ID NO: 490218 - DNA, 20 bp, Homo sapiens
ggaggctacctcacctgggc

SEQ ID NO: 490219 - DNA, 20 bp, Homo sapiens
ggagggctagaacctagaag

SEQ ID NO: 490220 - DNA, 18 bp, Homo sapiens
ctcatcacatttgtaaat

SEQ ID NO: 490221 - DNA, 16 bp, Homo sapiens
ctcatccagggctctg

SEQ ID NO: 490222 - DNA, 21 bp, Homo sapiens
ctcatccctaatgctgcagat

SEQ ID NO: 490223 - DNA, 14 bp, Homo sapiens
ctcatccgaggcag

SEQ ID NO: 490224 - DNA, 13 bp, Homo sapiens
ctcatcctgcagg

SEQ ID NO: 490225 - DNA, 15 bp, Homo sapiens
ctcattcctgttctt

SEQ ID NO: 490226 - DNA, 12 bp, Homo sapiens
ctcatttcagga

SEQ ID NO: 490227 - DNA, 16 bp, Homo sapiens
ctcatttcaggagcag

SEQ ID NO: 490228 - DNA, 13 bp, Homo sapiens
ctcatttcaggat

SEQ ID NO: 490229 - DNA, 14 bp, Homo sapiens
ctcatttccaagca

SEQ ID NO: 490230 - DNA, 17 bp, Homo sapiens
ctccacctccctgcaat

SEQ ID NO: 490231 - DNA, 13 bp, Homo sapiens
ctccagcctctgc

SEQ ID NO: 490232 - DNA, 17 bp, Homo sapiens
ctccagcctctgccgct

SEQ ID NO: 490233 - DNA, 19 bp, Homo sapiens
ctccagcctgcctggcagg

SEQ ID NO: 490234 - DNA, 11 bp, Homo sapiens
ctccaggcagg

SEQ ID NO: 490235 - DNA, 19 bp, Homo sapiens
ctccatcagttagagctga

SEQ ID NO: 490236 - DNA, 20 bp, Homo sapiens
ctccatcgctgtcatctcag

SEQ ID NO: 490237 - DNA, 14 bp, Homo sapiens
ctcccaagggatgg

SEQ ID NO: 490238 - DNA, 16 bp, Homo sapiens
ctcccagtacctcctg

SEQ ID NO: 490239 - DNA, 20 bp, Homo sapiens
ctccccagagttccccatgc

SEQ ID NO: 490240 - DNA, 13 bp, Homo sapiens
ctcccctcctctg

SEQ ID NO: 490241 - DNA, 22 bp, Homo sapiens
ctccctcatttcaggagcagcc

SEQ ID NO: 490242 - DNA, 17 bp, Homo sapiens
ctccctccacctccctg

SEQ ID NO: 490243 - DNA, 19 bp, Homo sapiens
ctccctccacctccctgca

SEQ ID NO: 490244 - DNA, 13 bp, Homo sapiens
ctccgaggccagt

SEQ ID NO: 490245 - DNA, 17 bp, Homo sapiens
ctcctctgcttgccatc

SEQ ID NO: 490246 - DNA, 21 bp, Homo sapiens
ctcctctgcttgccatccctc

SEQ ID NO: 490247 - DNA, 14 bp, Homo sapiens
ctcctctgtccagg

SEQ ID NO: 490248 - DNA, 17 bp, Homo sapiens
ctcctctgtccagggcc

SEQ ID NO: 490249 - DNA, 15 bp, Homo sapiens
ctcctgctcctcagg

SEQ ID NO: 490250 - DNA, 14 bp, Homo sapiens
ctcctgggcagctg

SEQ ID NO: 490251 - DNA, 17 bp, Homo sapiens
ctcctgtctgccagcca

SEQ ID NO: 490252 - DNA, 17 bp, Homo sapiens
ctccttgagagaccagg

SEQ ID NO: 490253 - DNA, 17 bp, Homo sapiens
ctcggacagcccatctg

SEQ ID NO: 490254 - DNA, 22 bp, Homo sapiens
ctcggacagcccatctgcctgt

SEQ ID NO: 490255 - DNA, 23 bp, Homo sapiens
ctcggagcctcatccgaggcagg

SEQ ID NO: 490256 - DNA, 14 bp, Homo sapiens
ctcggtggacccag

SEQ ID NO: 490257 - DNA, 15 bp, Homo sapiens
ctctaatatcagcaa

SEQ ID NO: 490258 - DNA, 16 bp, Homo sapiens
ctctatcattaaagtt

SEQ ID NO: 490259 - DNA, 22 bp, Homo sapiens
ctctcagcccctgatcctgtga

SEQ ID NO: 490260 - DNA, 20 bp, Homo sapiens
ctctcctccccaaggagaca

SEQ ID NO: 490261 - DNA, 16 bp, Homo sapiens
ctctcctgctcctcag

SEQ ID NO: 490262 - DNA, 16 bp, Homo sapiens
ctctcctgggcagctg

SEQ ID NO: 490263 - DNA, 18 bp, Homo sapiens
ctctcctgggcagctgcc

SEQ ID NO: 490264 - DNA, 19 bp, Homo sapiens
ctctcctgggcagctgcct

SEQ ID NO: 490265 - DNA, 13 bp, Homo sapiens
ctctcttcaataa

SEQ ID NO: 490266 - DNA, 15 bp, Homo sapiens
ctctcttcaataaac

SEQ ID NO: 490267 - DNA, 13 bp, Homo sapiens
ctctgagacacac

SEQ ID NO: 490268 - DNA, 15 bp, Homo sapiens
ctctgagacacaccc

SEQ ID NO: 490269 - DNA, 19 bp, Homo sapiens
ctctgccaacttcttcaga

SEQ ID NO: 490270 - DNA, 14 bp, Homo sapiens
ctctgccgctgcca

SEQ ID NO: 490271 - DNA, 17 bp, Homo sapiens
ctctgccgctgccatgc

SEQ ID NO: 490272 - DNA, 13 bp, Homo sapiens
ctctgctgccgcc

SEQ ID NO: 490273 - DNA, 14 bp, Homo sapiens
ctctgcttgccatc

SEQ ID NO: 490274 - DNA, 13 bp, Homo sapiens
ctctgctttgcat

SEQ ID NO: 490275 - DNA, 15 bp, Homo sapiens
ctctgctttggaaat

SEQ ID NO: 490276 - DNA, 15 bp, Homo sapiens
ctctggatgcctgat

SEQ ID NO: 490277 - DNA, 20 bp, Homo sapiens
ctctgtccagggccctgagc

SEQ ID NO: 490278 - DNA, 21 bp, Homo sapiens
ctctgtccagggccctgagct

SEQ ID NO: 490279 - DNA, 22 bp, Homo sapiens
ctctgtccagggccctgagctc

SEQ ID NO: 490280 - DNA, 15 bp, Homo sapiens
ctcttagatgcagtt

SEQ ID NO: 490281 - DNA, 20 bp, Homo sapiens
ctcttagatgcagttctgaa

SEQ ID NO: 490282 - DNA, 19 bp, Homo sapiens
cttagagcagtttctgtcc

SEQ ID NO: 490283 - DNA, 22 bp, Homo sapiens
cttagagcagtttctgtcctgc

SEQ ID NO: 490284 - DNA, 20 bp, Homo sapiens
cttagatgcagttctgaaga

SEQ ID NO: 490285 - DNA, 15 bp, Homo sapiens
cttagcttagacctc

SEQ ID NO: 490286 - DNA, 21 bp, Homo sapiens
cttagcttagacctcagcctg

SEQ ID NO: 490287 - DNA, 23 bp, Homo sapiens
cttagcttagacctcagcctgtg

SEQ ID NO: 490288 - DNA, 18 bp, Homo sapiens
cttaggagcagagctctg

SEQ ID NO: 490289 - DNA, 15 bp, Homo sapiens
cttatccagctggtg

SEQ ID NO: 490290 - DNA, 23 bp, Homo sapiens
cttatttgctgccacacctgagc

SEQ ID NO: 490291 - DNA, 14 bp, Homo sapiens
cttcaataaaccac

SEQ ID NO: 490292 - DNA, 23 bp, Homo sapiens
cttcaataaaccacaagcatctc

SEQ ID NO: 490293 - DNA, 16 bp, Homo sapiens
cttcacacacaggcaa

SEQ ID NO: 490294 - DNA, 13 bp, Homo sapiens
cttcagaggctga

SEQ ID NO: 490295 - DNA, 13 bp, Homo sapiens
cttcatgcatgga

SEQ ID NO: 490296 - DNA, 23 bp, Homo sapiens
cttcatgcatggaaattcccttc

SEQ ID NO: 490297 - DNA, 16 bp, Homo sapiens
cttcattagagcaggc

SEQ ID NO: 490298 - DNA, 21 bp, Homo sapiens
cttccaggggtcaccttgaga

SEQ ID NO: 490299 - DNA, 20 bp, Homo sapiens
cttccatttggaatcatatg

SEQ ID NO: 490300 - DNA, 15 bp, Homo sapiens
cttcccagtggctgc

SEQ ID NO: 490301 - DNA, 20 bp, Homo sapiens
cttcccataccacccaatgc

SEQ ID NO: 490302 - DNA, 20 bp, Homo sapiens
cttcccatgacccaggctgg

SEQ ID NO: 490303 - DNA, 21 bp, Homo sapiens
cttcccatgacccaggctggg

SEQ ID NO: 490304 - DNA, 23 bp, Homo sapiens
cttcccatgacccaggctgggca

SEQ ID NO: 490305 - DNA, 19 bp, Homo sapiens
cttccccttgcccagggct

SEQ ID NO: 490306 - DNA, 15 bp, Homo sapiens
cttccgcatcctagt

SEQ ID NO: 490307 - DNA, 13 bp, Homo sapiens
cttctaccagacc

SEQ ID NO: 490308 - DNA, 16 bp, Homo sapiens
cttctaggacgccacc

SEQ ID NO: 490309 - DNA, 19 bp, Homo sapiens
cttctaggacgccacccag

SEQ ID NO: 490310 - DNA, 20 bp, Homo sapiens
cttctaggtggcaaggctgt

SEQ ID NO: 490311 - DNA, 22 bp, Homo sapiens
cttctaggtggcaaggctgtgc

SEQ ID NO: 490312 - DNA, 21 bp, Homo sapiens
cttctcaaagctgggattaca

SEQ ID NO: 490313 - DNA, 17 bp, Homo sapiens
cttctcatcctgcaggc

SEQ ID NO: 490314 - DNA, 16 bp, Homo sapiens
cttctccccagagttc

SEQ ID NO: 490315 - DNA, 22 bp, Homo sapiens
cttctccctcatttcaggagca

SEQ ID NO: 490316 - DNA, 18 bp, Homo sapiens
cttctctctctaaaatga

SEQ ID NO: 490317 - DNA, 14 bp, Homo sapiens
cttctcttctgagc

SEQ ID NO: 490318 - DNA, 15 bp, Homo sapiens
cttctgttttataat

SEQ ID NO: 490319 - DNA, 14 bp, Homo sapiens
cttcttcagagctg

SEQ ID NO: 490320 - DNA, 16 bp, Homo sapiens
cttcttcagagctgac

SEQ ID NO: 490321 - DNA, 13 bp, Homo sapiens
cttctttccacag

SEQ ID NO: 490322 - DNA, 19 bp, Homo sapiens
cttctttgctttgcccagc

SEQ ID NO: 490323 - DNA, 15 bp, Homo sapiens
cttgaaaagggtgtt

SEQ ID NO: 490324 - DNA, 14 bp, Homo sapiens
cttgaacccgggag

SEQ ID NO: 490325 - DNA, 14 bp, Homo sapiens
cttgagagaccagg

SEQ ID NO: 490326 - DNA, 16 bp, Homo sapiens
cttgaggattttgagt

SEQ ID NO: 490327 - DNA, 15 bp, Homo sapiens
cttgcaaaaagggtc

SEQ ID NO: 490328 - DNA, 16 bp, Homo sapiens
cttgcaaaaagggtca

SEQ ID NO: 490329 - DNA, 18 bp, Homo sapiens
cttgcaagaatcagtgca

SEQ ID NO: 490330 - DNA, 15 bp, Homo sapiens
cttgccactgcactc

SEQ ID NO: 490331 - DNA, 14 bp, Homo sapiens
cttgccatccctcc

SEQ ID NO: 490332 - DNA, 13 bp, Homo sapiens
cttgcccagggct

SEQ ID NO: 490333 - DNA, 18 bp, Homo sapiens
cttgcccagggctcagcc

SEQ ID NO: 490334 - DNA, 23 bp, Homo sapiens
cttgcccagggctcagcctggtg

SEQ ID NO: 490335 - DNA, 12 bp, Homo sapiens
cttgcctgcagg

SEQ ID NO: 490336 - DNA, 21 bp, Homo sapiens
cttgctctcttcaataaacca

SEQ ID NO: 490337 - DNA, 23 bp, Homo sapiens
cttgctggagtcatgtgcctctg

SEQ ID NO: 490338 - DNA, 18 bp, Homo sapiens
cttggaagttgcatggca

SEQ ID NO: 490339 - DNA, 16 bp, Homo sapiens
cttggctggtgcacct

SEQ ID NO: 490340 - DNA, 16 bp, Homo sapiens
cttggggctgatgcag

SEQ ID NO: 490341 - DNA, 16 bp, Homo sapiens
cttggttggctggcct

SEQ ID NO: 490342 - DNA, 23 bp, Homo sapiens
cttgttgctgagtctgcagatga

SEQ ID NO: 490343 - DNA, 20 bp, Homo sapiens
ctttaatcccggtttcagaa

SEQ ID NO: 490344 - DNA, 18 bp, Homo sapiens
ctttagaatattaaaaat

SEQ ID NO: 490345 - DNA, 19 bp, Homo sapiens
ctttagaatattaaaaatt

SEQ ID NO: 490346 - DNA, 20 bp, Homo sapiens
ctttatatggcctcaagatc

SEQ ID NO: 490347 - DNA, 16 bp, Homo sapiens
ctttatgtaataatgt

SEQ ID NO: 490348 - DNA, 21 bp, Homo sapiens
ctttcaatggtttgcaaggaa

SEQ ID NO: 490349 - DNA, 17 bp, Homo sapiens
ctttcatactgaagatg

SEQ ID NO: 490350 - DNA, 21 bp, Homo sapiens
ctttcctttttcccaataaat

SEQ ID NO: 490351 - DNA, 23 bp, Homo sapiens
ctttgacctgcctcccttcatgc

SEQ ID NO: 490352 - DNA, 17 bp, Homo sapiens
ctttgagataatacatt

SEQ ID NO: 490353 - DNA, 21 bp, Homo sapiens
ctttgagataatacattccga

SEQ ID NO: 490354 - DNA, 24 bp, Homo sapiens
ctttgagtccacgcccaccagcct

SEQ ID NO: 490355 - DNA, 22 bp, Homo sapiens
ctttgcatagcagctgctacta

SEQ ID NO: 490356 - DNA, 18 bp, Homo sapiens
ctttgcatgatctgtcaa

SEQ ID NO: 490357 - DNA, 21 bp, Homo sapiens
ctttgcatggaatttgtaagt

SEQ ID NO: 490358 - DNA, 18 bp, Homo sapiens
ctttgccaccctcatgct

SEQ ID NO: 490359 - DNA, 14 bp, Homo sapiens
ctttgctgagagct

SEQ ID NO: 490360 - DNA, 16 bp, Homo sapiens
ctttgctttgcccagc

SEQ ID NO: 490361 - DNA, 23 bp, Homo sapiens
ctttggagatcaaggagaggagg

SEQ ID NO: 490362 - DNA, 24 bp, Homo sapiens
ctttggcaggtgcagcccccactg

SEQ ID NO: 490363 - DNA, 17 bp, Homo sapiens
ctttgggaggctgaggt

SEQ ID NO: 490364 - DNA, 15 bp, Homo sapiens
ctttttgaaatcagc

SEQ ID NO: 490365 - DNA, 12 bp, Homo sapiens
gaaaaacatgtc

SEQ ID NO: 490366 - DNA, 15 bp, Homo sapiens
gaaaaacatgtcatg

SEQ ID NO: 490367 - DNA, 16 bp, Homo sapiens
gaaaaacatgtcatgt

SEQ ID NO: 490368 - DNA, 20 bp, Homo sapiens
gaaaaattagatgactgaat

SEQ ID NO: 490369 - DNA, 14 bp, Homo sapiens
gaaaacaaggatga

SEQ ID NO: 490370 - DNA, 15 bp, Homo sapiens
ccagtggctgctgcc

SEQ ID NO: 490371 - DNA, 16 bp, Homo sapiens
ccagtggctgctgccc

SEQ ID NO: 490372 - DNA, 17 bp, Homo sapiens
ccagtggctgctgccca

SEQ ID NO: 490373 - DNA, 20 bp, Homo sapiens
ccagtgtatgagagggccct

SEQ ID NO: 490374 - DNA, 17 bp, Homo sapiens
ccataaccgctgattct

SEQ ID NO: 490375 - DNA, 22 bp, Homo sapiens
ccataaccgctgattctcaggg

SEQ ID NO: 490376 - DNA, 13 bp, Homo sapiens
ccataggcccagt

SEQ ID NO: 490377 - DNA, 17 bp, Homo sapiens
ccatatcaagagacatg

SEQ ID NO: 490378 - DNA, 23 bp, Homo sapiens
ccatcagaaacaccctcacactg

SEQ ID NO: 490379 - DNA, 22 bp, Homo sapiens
ccatctctggatgcctgattgc

SEQ ID NO: 490380 - DNA, 19 bp, Homo sapiens
ccatgctttgagtccacgc

SEQ ID NO: 490381 - DNA, 20 bp, Homo sapiens
ccatgctttgagtccacgcc

SEQ ID NO: 490382 - DNA, 22 bp, Homo sapiens
ccatgctttgagtccacgccca

SEQ ID NO: 490383 - DNA, 19 bp, Homo sapiens
ccatggagagctggagcct

SEQ ID NO: 490384 - DNA, 23 bp, Homo sapiens
ccattaatgtagataaagcactg

SEQ ID NO: 490385 - DNA, 14 bp, Homo sapiens
ccattcattccatt

SEQ ID NO: 490386 - DNA, 18 bp, Homo sapiens
ccattcattccattctgg

SEQ ID NO: 490387 - DNA, 12 bp, Homo sapiens
ccattctggaag

SEQ ID NO: 490388 - DNA, 20 bp, Homo sapiens
ccattctttattcttttact

SEQ ID NO: 490389 - DNA, 15 bp, Homo sapiens
ccattgttcagaaga

SEQ ID NO: 490390 - DNA, 12 bp, Homo sapiens
ccatttgctgat

SEQ ID NO: 490391 - DNA, 15 bp, Homo sapiens
cccaactgctccagc

SEQ ID NO: 490392 - DNA, 12 bp, Homo sapiens
cccaccagcctt

SEQ ID NO: 490393 - DNA, 16 bp, Homo sapiens
cccaccagccttgctc

SEQ ID NO: 490394 - DNA, 17 bp, Homo sapiens
cccaccagccttgctct

SEQ ID NO: 490395 - DNA, 17 bp, Homo sapiens
cccagcactaaagcagt

SEQ ID NO: 490396 - DNA, 20 bp, Homo sapiens
cccagcattttactgattca

SEQ ID NO: 490397 - DNA, 20 bp, Homo sapiens
cccagccagcagttcagagc

SEQ ID NO: 490398 - DNA, 22 bp, Homo sapiens
cccaggaatgccaaggagacat

SEQ ID NO: 490399 - DNA, 12 bp, Homo sapiens
cccaggctgggc

SEQ ID NO: 490400 - DNA, 16 bp, Homo sapiens
cccagggctcagcctg

SEQ ID NO: 490401 - DNA, 13 bp, Homo sapiens
cccaggtttctgg

SEQ ID NO: 490402 - DNA, 19 bp, Homo sapiens
cccaggtttctggtctcta

SEQ ID NO: 490403 - DNA, 18 bp, Homo sapiens
cccatgacccaggctggg

SEQ ID NO: 490404 - DNA, 20 bp, Homo sapiens
ccccaactgctccagcctct

SEQ ID NO: 490405 - DNA, 17 bp, Homo sapiens
cccccactgcctttgac

SEQ ID NO: 490406 - DNA, 18 bp, Homo sapiens
cccccgggccgacggagc

SEQ ID NO: 490407 - DNA, 23 bp, Homo sapiens
cccccgggccgacggagccggga

SEQ ID NO: 490408 - DNA, 21 bp, Homo sapiens
ccccttgcccagggctcagcc

SEQ ID NO: 490409 - DNA, 23 bp, Homo sapiens
ccccttgcccagggctcagcctg

SEQ ID NO: 490410 - DNA, 23 bp, Homo sapiens
cccggtttcagaagctgcagctg

SEQ ID NO: 490411 - DNA, 18 bp, Homo sapiens
cccgtcttcagcctagcc

SEQ ID NO: 490412 - DNA, 18 bp, Homo sapiens
ccctacacccctcccctg

SEQ ID NO: 490413 - DNA, 20 bp, Homo sapiens
ccctaccacacatctgtgga

SEQ ID NO: 490414 - DNA, 22 bp, Homo sapiens
ccctatcccattctccctctca

SEQ ID NO: 490415 - DNA, 19 bp, Homo sapiens
ccctatctttgccaccctc

SEQ ID NO: 490416 - DNA, 16 bp, Homo sapiens
ccctcatttcaggagc

SEQ ID NO: 490417 - DNA, 12 bp, Homo sapiens
ccctccacctcc

SEQ ID NO: 490418 - DNA, 19 bp, Homo sapiens
ccctccacctccctgcaat

SEQ ID NO: 490419 - DNA, 15 bp, Homo sapiens
ccctcccctggggac

SEQ ID NO: 490420 - DNA, 23 bp, Homo sapiens
ccctctcctgggcagctgcctcc

SEQ ID NO: 490421 - DNA, 23 bp, Homo sapiens
ccctggttctgatgatgtgcctg

SEQ ID NO: 490422 - DNA, 18 bp, Homo sapiens
cccttcatccgcctgtgg

SEQ ID NO: 490423 - DNA, 14 bp, Homo sapiens
cccttcatctggaa

SEQ ID NO: 490424 - DNA, 21 bp, Homo sapiens
cccttccaggggtcaccttga

SEQ ID NO: 490425 - DNA, 22 bp, Homo sapiens
cccttctcagaaaacttctctt

SEQ ID NO: 490426 - DNA, 13 bp, Homo sapiens
cccttgccagaca

SEQ ID NO: 490427 - DNA, 12 bp, Homo sapiens
cccttgcccagg

SEQ ID NO: 490428 - DNA, 20 bp, Homo sapiens
cccttgcccagggctcagcc

SEQ ID NO: 490429 - DNA, 13 bp, Homo sapiens
ccgacctcagcct

SEQ ID NO: 490430 - DNA, 14 bp, Homo sapiens
ccgaggcagggtca

SEQ ID NO: 490431 - DNA, 11 bp, Homo sapiens
ccgaggccagt

SEQ ID NO: 490432 - DNA, 21 bp, Homo sapiens
ccgcatcctagtctctatcat

SEQ ID NO: 490433 - DNA, 20 bp, Homo sapiens
ccgccagcttcccttcactc

SEQ ID NO: 490434 - DNA, 14 bp, Homo sapiens
ccgcctgtgggcgc

SEQ ID NO: 490435 - DNA, 15 bp, Homo sapiens
ccgctcctgtctgcc

SEQ ID NO: 490436 - DNA, 22 bp, Homo sapiens
ccggaaggaatgtcagggccag

SEQ ID NO: 490437 - DNA, 16 bp, Homo sapiens
ccggagcctccagctg

SEQ ID NO: 490438 - DNA, 15 bp, Homo sapiens
ccggggaggggcgct

SEQ ID NO: 490439 - DNA, 13 bp, Homo sapiens
cctaaaacaaaag

SEQ ID NO: 490440 - DNA, 23 bp, Homo sapiens
cctaaggcacccacaaataaatg

SEQ ID NO: 490441 - DNA, 23 bp, Homo sapiens
cctacttctttgctttgcccagc

SEQ ID NO: 490442 - DNA, 13 bp, Homo sapiens
cctagaagggcta

SEQ ID NO: 490443 - DNA, 19 bp, Homo sapiens
cctagccgacctcagcctt

SEQ ID NO: 490444 - DNA, 23 bp, Homo sapiens
cctaggcaggacatgctgaagcc

SEQ ID NO: 490445 - DNA, 14 bp, Homo sapiens
cctagtctctatca

SEQ ID NO: 490446 - DNA, 16 bp, Homo sapiens
cctagtctctatcatt

SEQ ID NO: 490447 - DNA, 12 bp, Homo sapiens
cctatctttgcc

SEQ ID NO: 490448 - DNA, 13 bp, Homo sapiens
cctatctttgcca

SEQ ID NO: 490449 - DNA, 14 bp, Homo sapiens
catccgaggcaggg

SEQ ID NO: 490450 - DNA, 23 bp, Homo sapiens
catccgaggcagggtcaggagag

SEQ ID NO: 490451 - DNA, 16 bp, Homo sapiens
catcctcaaacactgc

SEQ ID NO: 490452 - DNA, 18 bp, Homo sapiens
catcctcaaacactgcag

SEQ ID NO: 490453 - DNA, 19 bp, Homo sapiens
catcctcaaacactgcagg

SEQ ID NO: 490454 - DNA, 12 bp, Homo sapiens
catcctgcaggc

SEQ ID NO: 490455 - DNA, 13 bp, Homo sapiens
catcctggccaac

SEQ ID NO: 490456 - DNA, 22 bp, Homo sapiens
catctacgtatggctccacacc

SEQ ID NO: 490457 - DNA, 17 bp, Homo sapiens
catctccatcttgaagg

SEQ ID NO: 490458 - DNA, 22 bp, Homo sapiens
catgaaaatgcaacaacatgta

SEQ ID NO: 490459 - DNA, 14 bp, Homo sapiens
catgaaactccacc

SEQ ID NO: 490460 - DNA, 18 bp, Homo sapiens
catgaagtttccttggct

SEQ ID NO: 490461 - DNA, 14 bp, Homo sapiens
catgacagctgttc

SEQ ID NO: 490462 - DNA, 15 bp, Homo sapiens
catgaccacatagaa

SEQ ID NO: 490463 - DNA, 19 bp, Homo sapiens
catgacccaggctgggcaa

SEQ ID NO: 490464 - DNA, 22 bp, Homo sapiens
catgacttgagaaacaaataat

SEQ ID NO: 490465 - DNA, 22 bp, Homo sapiens
catgagaagttgatatagaaca

SEQ ID NO: 490466 - DNA, 14 bp, Homo sapiens
catgagtgcgtgct

SEQ ID NO: 490467 - DNA, 18 bp, Homo sapiens
catgagtgcgtgctcagt

SEQ ID NO: 490468 - DNA, 16 bp, Homo sapiens
catgcaaaggctggga

SEQ ID NO: 490469 - DNA, 14 bp, Homo sapiens
catgcagcatctaa

SEQ ID NO: 490470 - DNA, 17 bp, Homo sapiens
catgcatagtcccagct

SEQ ID NO: 490471 - DNA, 15 bp, Homo sapiens
catgcatggaaattc

SEQ ID NO: 490472 - DNA, 16 bp, Homo sapiens
catgcggagaacaaat

SEQ ID NO: 490473 - DNA, 23 bp, Homo sapiens
catgctgtctacactaagagaga

SEQ ID NO: 490474 - DNA, 22 bp, Homo sapiens
catgctgtgtgactcaaaccaa

SEQ ID NO: 490475 - DNA, 16 bp, Homo sapiens
catggaatttgtaagt

SEQ ID NO: 490476 - DNA, 19 bp, Homo sapiens
catggaatttgtaagttta

SEQ ID NO: 490477 - DNA, 21 bp, Homo sapiens
catggacagaagaaggcagca

SEQ ID NO: 490478 - DNA, 19 bp, Homo sapiens
catggactgagctggggga

SEQ ID NO: 490479 - DNA, 14 bp, Homo sapiens
catggagagctgga

SEQ ID NO: 490480 - DNA, 20 bp, Homo sapiens
catggagagctggagcctgg

SEQ ID NO: 490481 - DNA, 21 bp, Homo sapiens
catggagagctggagcctggt

SEQ ID NO: 490482 - DNA, 12 bp, Homo sapiens
catggagctggc

SEQ ID NO: 490483 - DNA, 19 bp, Homo sapiens
catggcatcacctccacca

SEQ ID NO: 490484 - DNA, 16 bp, Homo sapiens
catggcccctgtgagt

SEQ ID NO: 490485 - DNA, 22 bp, Homo sapiens
catggccctcccagtacctcct

SEQ ID NO: 490486 - DNA, 17 bp, Homo sapiens
catgggcccaggaatgc

SEQ ID NO: 490487 - DNA, 12 bp, Homo sapiens
catggtgtctgg

SEQ ID NO: 490488 - DNA, 19 bp, Homo sapiens
catgtaccctaaggtcatt

SEQ ID NO: 490489 - DNA, 13 bp, Homo sapiens
catgtagaagctg

SEQ ID NO: 490490 - DNA, 15 bp, Homo sapiens
catgtagaagctgca

SEQ ID NO: 490491 - DNA, 22 bp, Homo sapiens
catgtaggttgtctaaaaataa

SEQ ID NO: 490492 - DNA, 14 bp, Homo sapiens
catgtcaaacgtga

SEQ ID NO: 490493 - DNA, 17 bp, Homo sapiens
catgtccctacacccct

SEQ ID NO: 490494 - DNA, 18 bp, Homo sapiens
catgtgcctctgtcctta

SEQ ID NO: 490495 - DNA, 22 bp, Homo sapiens
catgtggccctccagtgtatga

SEQ ID NO: 490496 - DNA, 12 bp, Homo sapiens
catgtggtggga

SEQ ID NO: 490497 - DNA, 24 bp, Homo sapiens
cattacagggaatgcctgagtgcc

SEQ ID NO: 490498 - DNA, 14 bp, Homo sapiens
cattagagcaggcg

SEQ ID NO: 490499 - DNA, 16 bp, Homo sapiens
cattcattccattctg

SEQ ID NO: 490500 - DNA, 17 bp, Homo sapiens
cattcattccattctgg

SEQ ID NO: 490501 - DNA, 14 bp, Homo sapiens
cattccatccttga

SEQ ID NO: 490502 - DNA, 19 bp, Homo sapiens
cattctacacagagcagga

SEQ ID NO: 490503 - DNA, 16 bp, Homo sapiens
cattctggaagtgact

SEQ ID NO: 490504 - DNA, 16 bp, Homo sapiens
cattcttggttggctg

SEQ ID NO: 490505 - DNA, 19 bp, Homo sapiens
cattgactatcaaactgaa

SEQ ID NO: 490506 - DNA, 18 bp, Homo sapiens
cattgttcagaagacctc

SEQ ID NO: 490507 - DNA, 23 bp, Homo sapiens
catttaagagacagtcaccccag

SEQ ID NO: 490508 - DNA, 21 bp, Homo sapiens
catttatttccatattaaaat

SEQ ID NO: 490509 - DNA, 18 bp, Homo sapiens
catttatttttctcatga

SEQ ID NO: 490510 - DNA, 16 bp, Homo sapiens
catttcaggagcagcc

SEQ ID NO: 490511 - DNA, 13 bp, Homo sapiens
catttgctcatgg

SEQ ID NO: 490512 - DNA, 16 bp, Homo sapiens
catttgtataaaataa

SEQ ID NO: 490513 - DNA, 21 bp, Homo sapiens
ccaaagccaataacacacagc

SEQ ID NO: 490514 - DNA, 14 bp, Homo sapiens
ccaacactcaagaa

SEQ ID NO: 490515 - DNA, 21 bp, Homo sapiens
ccaacactcaagaagcaggct

SEQ ID NO: 490516 - DNA, 17 bp, Homo sapiens
ccaactgctccagcctc

SEQ ID NO: 490517 - DNA, 21 bp, Homo sapiens
ccaactgctccagcctctgcc

SEQ ID NO: 490518 - DNA, 13 bp, Homo sapiens
ccaagaagggcta

SEQ ID NO: 490519 - DNA, 19 bp, Homo sapiens
ccaagagtggtggcagctc

SEQ ID NO: 490520 - DNA, 14 bp, Homo sapiens
ccaagcactgtgct

SEQ ID NO: 490521 - DNA, 21 bp, Homo sapiens
ccaagcactgtgctcagggct

SEQ ID NO: 490522 - DNA, 21 bp, Homo sapiens
ccaagcatagagaagagtctg

SEQ ID NO: 490523 - DNA, 16 bp, Homo sapiens
ccaagctatcctggct

SEQ ID NO: 490524 - DNA, 17 bp, Homo sapiens
ccaagctcaaagcgtgg

SEQ ID NO: 490525 - DNA, 21 bp, Homo sapiens
ccaaggaaaccacagctgctg

SEQ ID NO: 490526 - DNA, 14 bp, Homo sapiens
ccaaggagacacaa

SEQ ID NO: 490527 - DNA, 14 bp, Homo sapiens
ccaaggagatgaag

SEQ ID NO: 490528 - DNA, 21 bp, Homo sapiens
ccaagggaaagaaaaggaagg

SEQ ID NO: 490529 - DNA, 14 bp, Homo sapiens
ccaagtagctgcta

SEQ ID NO: 490530 - DNA, 13 bp, Homo sapiens
ccaagtggcagag

SEQ ID NO: 490531 - DNA, 14 bp, Homo sapiens
ccaagtggcagagc

SEQ ID NO: 490532 - DNA, 13 bp, Homo sapiens
ccaatacattatt

SEQ ID NO: 490533 - DNA, 17 bp, Homo sapiens
ccaatagttgctgtccc

SEQ ID NO: 490534 - DNA, 19 bp, Homo sapiens
ccaatagttgctgtcccct

SEQ ID NO: 490535 - DNA, 21 bp, Homo sapiens
ccaatgtattgataagagggc

SEQ ID NO: 490536 - DNA, 13 bp, Homo sapiens
ccacaagcatctc

SEQ ID NO: 490537 - DNA, 20 bp, Homo sapiens
ccacagaagacttcccagct

SEQ ID NO: 490538 - DNA, 15 bp, Homo sapiens
ccacagacctgctct

SEQ ID NO: 490539 - DNA, 14 bp, Homo sapiens
ccacagagcgggga

SEQ ID NO: 490540 - DNA, 20 bp, Homo sapiens
ccacaggaaccacaagactg

SEQ ID NO: 490541 - DNA, 23 bp, Homo sapiens
ccacaggggctatcccttctcag

SEQ ID NO: 490542 - DNA, 14 bp, Homo sapiens
ccaccagccttgct

SEQ ID NO: 490543 - DNA, 16 bp, Homo sapiens
ccacctccttccagca

SEQ ID NO: 490544 - DNA, 14 bp, Homo sapiens
ccacctctgtgggc

SEQ ID NO: 490545 - DNA, 15 bp, Homo sapiens
ccacgcccaccagcc

SEQ ID NO: 490546 - DNA, 14 bp, Homo sapiens
ccactccttccttt

SEQ ID NO: 490547 - DNA, 22 bp, Homo sapiens
ccactgatagatgtctattctt

SEQ ID NO: 490548 - DNA, 11 bp, Homo sapiens
ccactgcactc

SEQ ID NO: 490549 - DNA, 11 bp, Homo sapiens
ccactggagaa

SEQ ID NO: 490550 - DNA, 18 bp, Homo sapiens
ccacttggcatcagctgg

SEQ ID NO: 490551 - DNA, 21 bp, Homo sapiens
ccacttggctacacagggatg

SEQ ID NO: 490552 - DNA, 17 bp, Homo sapiens
ccagatggactccagcc

SEQ ID NO: 490553 - DNA, 24 bp, Homo sapiens
ccagcactttgggaggccgaggtg

SEQ ID NO: 490554 - DNA, 15 bp, Homo sapiens
ccagcagccagctct

SEQ ID NO: 490555 - DNA, 19 bp, Homo sapiens
ccagcagttcagagctgcc

SEQ ID NO: 490556 - DNA, 20 bp, Homo sapiens
ccagcagttcagagctgccc

SEQ ID NO: 490557 - DNA, 21 bp, Homo sapiens
ccagccagatggactccagcc

SEQ ID NO: 490558 - DNA, 13 bp, Homo sapiens
ccagccagcagcc

SEQ ID NO: 490559 - DNA, 15 bp, Homo sapiens
ccagccagcagccag

SEQ ID NO: 490560 - DNA, 15 bp, Homo sapiens
ccagccagggctgct

SEQ ID NO: 490561 - DNA, 13 bp, Homo sapiens
ccagcctctgccg

SEQ ID NO: 490562 - DNA, 21 bp, Homo sapiens
ccagcctgcctggcaggctgt

SEQ ID NO: 490563 - DNA, 13 bp, Homo sapiens
ccagccttgctct

SEQ ID NO: 490564 - DNA, 15 bp, Homo sapiens
ccagccttgctctct

SEQ ID NO: 490565 - DNA, 17 bp, Homo sapiens
ccagccttgctctcttc

SEQ ID NO: 490566 - DNA, 18 bp, Homo sapiens
ccagccttgctctcttca

SEQ ID NO: 490567 - DNA, 12 bp, Homo sapiens
ccagctcctcat

SEQ ID NO: 490568 - DNA, 12 bp, Homo sapiens
ccagctctcagc

SEQ ID NO: 490569 - DNA, 16 bp, Homo sapiens
ccagctgggttggaaa

SEQ ID NO: 490570 - DNA, 17 bp, Homo sapiens
ccagctgggttggaaaa

SEQ ID NO: 490571 - DNA, 12 bp, Homo sapiens
ccaggagaactg

SEQ ID NO: 490572 - DNA, 16 bp, Homo sapiens
ccaggaggctgaggtg

SEQ ID NO: 490573 - DNA, 23 bp, Homo sapiens
ccaggagtttaagaccagcctgg

SEQ ID NO: 490574 - DNA, 20 bp, Homo sapiens
ccaggatgagcatcccagga

SEQ ID NO: 490575 - DNA, 18 bp, Homo sapiens
ccaggcaggctaaggcgt

SEQ ID NO: 490576 - DNA, 16 bp, Homo sapiens
ccaggcctcttggcag

SEQ ID NO: 490577 - DNA, 18 bp, Homo sapiens
ccaggcctcttggcagtc

SEQ ID NO: 490578 - DNA, 17 bp, Homo sapiens
ccaggcctggccatgtg

SEQ ID NO: 490579 - DNA, 13 bp, Homo sapiens
ccaggcctgggcc

SEQ ID NO: 490580 - DNA, 20 bp, Homo sapiens
ccagggacgaagaagagcca

SEQ ID NO: 490581 - DNA, 16 bp, Homo sapiens
ccagggcctggaagac

SEQ ID NO: 490582 - DNA, 20 bp, Homo sapiens
ccagggcctggaagacagag

SEQ ID NO: 490583 - DNA, 21 bp, Homo sapiens
ccagggcctggaagacagaga

SEQ ID NO: 490584 - DNA, 14 bp, Homo sapiens
ccagggctcagcct

SEQ ID NO: 490585 - DNA, 16 bp, Homo sapiens
ccagggctcagcctgg

SEQ ID NO: 490586 - DNA, 20 bp, Homo sapiens
ccagggctcagcctggtggg

SEQ ID NO: 490587 - DNA, 16 bp, Homo sapiens
ccagggctctgaccag

SEQ ID NO: 490588 - DNA, 14 bp, Homo sapiens
ccaggtagaacaca

SEQ ID NO: 490589 - DNA, 18 bp, Homo sapiens
ccaggtgcagaccttggg

SEQ ID NO: 490590 - DNA, 16 bp, Homo sapiens
ccaggttatctgggca

SEQ ID NO: 490591 - DNA, 13 bp, Homo sapiens
ccagtgagatgca

SEQ ID NO: 490592 - DNA, 21 bp, Homo sapiens
cagcccctgatcctgtgaagt

SEQ ID NO: 490593 - DNA, 15 bp, Homo sapiens
cagcccttctttcca

SEQ ID NO: 490594 - DNA, 12 bp, Homo sapiens
cagccgctcctg

SEQ ID NO: 490595 - DNA, 17 bp, Homo sapiens
cagccgctcctgtctgc

SEQ ID NO: 490596 - DNA, 18 bp, Homo sapiens
cagccgctcctgtctgcc

SEQ ID NO: 490597 - DNA, 23 bp, Homo sapiens
cagccgctcctgtctgccagcca

SEQ ID NO: 490598 - DNA, 19 bp, Homo sapiens
cagcctagccgacctcagc

SEQ ID NO: 490599 - DNA, 21 bp, Homo sapiens
cagcctagccgacctcagcct

SEQ ID NO: 490600 - DNA, 12 bp, Homo sapiens
cagcctctgccg

SEQ ID NO: 490601 - DNA, 19 bp, Homo sapiens
cagcctctgccgctgccat

SEQ ID NO: 490602 - DNA, 15 bp, Homo sapiens
cagcctgcctggcag

SEQ ID NO: 490603 - DNA, 21 bp, Homo sapiens
cagcctgctccttcccaggag

SEQ ID NO: 490604 - DNA, 15 bp, Homo sapiens
cagcctggtgggcct

SEQ ID NO: 490605 - DNA, 17 bp, Homo sapiens
cagcctggtgggcctcc

SEQ ID NO: 490606 - DNA, 16 bp, Homo sapiens
cagccttccccttgcc

SEQ ID NO: 490607 - DNA, 11 bp, Homo sapiens
cagccttgctc

SEQ ID NO: 490608 - DNA, 12 bp, Homo sapiens
cagccttgctct

SEQ ID NO: 490609 - DNA, 23 bp, Homo sapiens
cagccttgctctcttcaataaac

SEQ ID NO: 490610 - DNA, 17 bp, Homo sapiens
cagctaacaattgtgaa

SEQ ID NO: 490611 - DNA, 21 bp, Homo sapiens
cagctcaggcacacttcttct

SEQ ID NO: 490612 - DNA, 15 bp, Homo sapiens
cagctcatctctgtc

SEQ ID NO: 490613 - DNA, 13 bp, Homo sapiens
cagctctcagcca

SEQ ID NO: 490614 - DNA, 15 bp, Homo sapiens
cagctgatacaaatt

SEQ ID NO: 490615 - DNA, 23 bp, Homo sapiens
cagctgatacaaattgcagactg

SEQ ID NO: 490616 - DNA, 15 bp, Homo sapiens
cagctgccccagcca

SEQ ID NO: 490617 - DNA, 12 bp, Homo sapiens
cagctgccccgg

SEQ ID NO: 490618 - DNA, 11 bp, Homo sapiens
cagctgcctcc

SEQ ID NO: 490619 - DNA, 18 bp, Homo sapiens
cagctgcctcccctcctc

SEQ ID NO: 490620 - DNA, 19 bp, Homo sapiens
cagctgctggagactccta

SEQ ID NO: 490621 - DNA, 16 bp, Homo sapiens
cagctgggtggcactg

SEQ ID NO: 490622 - DNA, 17 bp, Homo sapiens
cagctgggtggcactgc

SEQ ID NO: 490623 - DNA, 14 bp, Homo sapiens
cagctggtctgttt

SEQ ID NO: 490624 - DNA, 19 bp, Homo sapiens
cagctggtggtatctgagt

SEQ ID NO: 490625 - DNA, 18 bp, Homo sapiens
cagctgtatgattcccag

SEQ ID NO: 490626 - DNA, 18 bp, Homo sapiens
cagctgtgaacatggact

SEQ ID NO: 490627 - DNA, 15 bp, Homo sapiens
cagctgttccacagg

SEQ ID NO: 490628 - DNA, 12 bp, Homo sapiens
cagcttcagttg

SEQ ID NO: 490629 - DNA, 21 bp, Homo sapiens
cagcttctcatcctgcaggca

SEQ ID NO: 490630 - DNA, 22 bp, Homo sapiens
cagcttgcacacccatcgtctt

SEQ ID NO: 490631 - DNA, 20 bp, Homo sapiens
cagcttttcccaaaagccca

SEQ ID NO: 490632 - DNA, 13 bp, Homo sapiens
caggaacatacag

SEQ ID NO: 490633 - DNA, 14 bp, Homo sapiens
caggaacatacaga

SEQ ID NO: 490634 - DNA, 15 bp, Homo sapiens
caggaacatacagac

SEQ ID NO: 490635 - DNA, 18 bp, Homo sapiens
caggaacatacagacaca

SEQ ID NO: 490636 - DNA, 23 bp, Homo sapiens
caggacagcccttctttccacag

SEQ ID NO: 490637 - DNA, 19 bp, Homo sapiens
caggactcagctccccaga

SEQ ID NO: 490638 - DNA, 13 bp, Homo sapiens
caggactgcacag

SEQ ID NO: 490639 - DNA, 19 bp, Homo sapiens
caggacttaagacaaatgg

SEQ ID NO: 490640 - DNA, 21 bp, Homo sapiens
caggacttaagacaaatggga

SEQ ID NO: 490641 - DNA, 22 bp, Homo sapiens
caggagaatcgcttgaacctgg

SEQ ID NO: 490642 - DNA, 23 bp, Homo sapiens
caggagaatcgcttgaacctggg

SEQ ID NO: 490643 - DNA, 13 bp, Homo sapiens
caggagtccctgg

SEQ ID NO: 490644 - DNA, 16 bp, Homo sapiens
caggatggcctggcca

SEQ ID NO: 490645 - DNA, 21 bp, Homo sapiens
caggatggttcccttgatgaa

SEQ ID NO: 490646 - DNA, 16 bp, Homo sapiens
caggcaactgaggcag

SEQ ID NO: 490647 - DNA, 18 bp, Homo sapiens
caggcaactgaggcagac

SEQ ID NO: 490648 - DNA, 19 bp, Homo sapiens
caggcaactgaggcagaca

SEQ ID NO: 490649 - DNA, 22 bp, Homo sapiens
caggcaactgaggcagacagca

SEQ ID NO: 490650 - DNA, 15 bp, Homo sapiens
caggcacacttcttc

SEQ ID NO: 490651 - DNA, 20 bp, Homo sapiens
caggcaggaaggctgagagg

SEQ ID NO: 490652 - DNA, 20 bp, Homo sapiens
caggcaggctaaggcgtgga

SEQ ID NO: 490653 - DNA, 23 bp, Homo sapiens
caggcaggctaaggcgtggagct

SEQ ID NO: 490654 - DNA, 12 bp, Homo sapiens
caggcatgaagt

SEQ ID NO: 490655 - DNA, 18 bp, Homo sapiens
caggcctcttggcagtca

SEQ ID NO: 490656 - DNA, 19 bp, Homo sapiens
caggcctgaagtcttctcc

SEQ ID NO: 490657 - DNA, 12 bp, Homo sapiens
caggcctgggcc

SEQ ID NO: 490658 - DNA, 19 bp, Homo sapiens
caggcgttcagctcactgt

SEQ ID NO: 490659 - DNA, 13 bp, Homo sapiens
caggctagatgta

SEQ ID NO: 490660 - DNA, 19 bp, Homo sapiens
caggctagatgtatgtact

SEQ ID NO: 490661 - DNA, 22 bp, Homo sapiens
cagggacccacttcacacacag

SEQ ID NO: 490662 - DNA, 22 bp, Homo sapiens
cagggacgaagaagagccacag

SEQ ID NO: 490663 - DNA, 23 bp, Homo sapiens
cagggacgaagaagagccacagt

SEQ ID NO: 490664 - DNA, 18 bp, Homo sapiens
cagggactgttcctgtct

SEQ ID NO: 490665 - DNA, 19 bp, Homo sapiens
cagggatgagcatggagct

SEQ ID NO: 490666 - DNA, 20 bp, Homo sapiens
cagggatgagcatggagctg

SEQ ID NO: 490667 - DNA, 22 bp, Homo sapiens
cagggatgagcatggagctggc

SEQ ID NO: 490668 - DNA, 23 bp, Homo sapiens
cagggatgagcatggagctggcc

SEQ ID NO: 490669 - DNA, 14 bp, Homo sapiens
cagggatttgagga

SEQ ID NO: 490670 - DNA, 12 bp, Homo sapiens
cagggccaggtg

SEQ ID NO: 490671 - DNA, 23 bp, Homo sapiens
cagggccaggtgcagaccttggg

SEQ ID NO: 490672 - DNA, 18 bp, Homo sapiens
cagggcctggaagacaga

SEQ ID NO: 490673 - DNA, 14 bp, Homo sapiens
cagggctcagcctg

SEQ ID NO: 490674 - DNA, 16 bp, Homo sapiens
cagggctcagcctggt

SEQ ID NO: 490675 - DNA, 12 bp, Homo sapiens
cagggctctgac

SEQ ID NO: 490676 - DNA, 11 bp, Homo sapiens
caggggacagg

SEQ ID NO: 490677 - DNA, 19 bp, Homo sapiens
cagggtctctgctgccgcc

SEQ ID NO: 490678 - DNA, 15 bp, Homo sapiens
cagggtctgggcagg

SEQ ID NO: 490679 - DNA, 16 bp, Homo sapiens
cagggtctgggcagga

SEQ ID NO: 490680 - DNA, 13 bp, Homo sapiens
cagggtgctgtgg

SEQ ID NO: 490681 - DNA, 20 bp, Homo sapiens
caggtatgaccttctaggaa

SEQ ID NO: 490682 - DNA, 24 bp, Homo sapiens
caggtcagaaaccattgttcagaa

SEQ ID NO: 490683 - DNA, 17 bp, Homo sapiens
caggtgagcccatggcc

SEQ ID NO: 490684 - DNA, 17 bp, Homo sapiens
caggtgcagaccttggg

SEQ ID NO: 490685 - DNA, 21 bp, Homo sapiens
caggtgcagaccttgggggaa

SEQ ID NO: 490686 - DNA, 18 bp, Homo sapiens
caggtgcagcccccactg

SEQ ID NO: 490687 - DNA, 20 bp, Homo sapiens
caggtgcagcccccactgcc

SEQ ID NO: 490688 - DNA, 23 bp, Homo sapiens
caggtgggcttcccagtggctgc

SEQ ID NO: 490689 - DNA, 23 bp, Homo sapiens
caagtgcatttttatctgtgagt

SEQ ID NO: 490690 - DNA, 19 bp, Homo sapiens
caataaaccacaagcatct

SEQ ID NO: 490691 - DNA, 13 bp, Homo sapiens
caatattttccat

SEQ ID NO: 490692 - DNA, 15 bp, Homo sapiens
caatattttccatga

SEQ ID NO: 490693 - DNA, 17 bp, Homo sapiens
caatccagcggttctca

SEQ ID NO: 490694 - DNA, 13 bp, Homo sapiens
caatgctgatgtc

SEQ ID NO: 490695 - DNA, 22 bp, Homo sapiens
caatgctgcctgggagccaggg

SEQ ID NO: 490696 - DNA, 17 bp, Homo sapiens
caatgctgtattttaaa

SEQ ID NO: 490697 - DNA, 20 bp, Homo sapiens
caatgtattgataagagggc

SEQ ID NO: 490698 - DNA, 14 bp, Homo sapiens
caattcaacactcc

SEQ ID NO: 490699 - DNA, 20 bp, Homo sapiens
caattgcttactcattaaaa

SEQ ID NO: 490700 - DNA, 17 bp, Homo sapiens
caatttccaagagctga

SEQ ID NO: 490701 - DNA, 13 bp, Homo sapiens
cacaaacctgcct

SEQ ID NO: 490702 - DNA, 15 bp, Homo sapiens
cacaaacctgcctgg

SEQ ID NO: 490703 - DNA, 15 bp, Homo sapiens
cacaaagggcccaga

SEQ ID NO: 490704 - DNA, 12 bp, Homo sapiens
cacaaataaaat

SEQ ID NO: 490705 - DNA, 13 bp, Homo sapiens
cacaacaccagga

SEQ ID NO: 490706 - DNA, 13 bp, Homo sapiens
cacaactatattg

SEQ ID NO: 490707 - DNA, 20 bp, Homo sapiens
cacaagacccaagtagctgc

SEQ ID NO: 490708 - DNA, 12 bp, Homo sapiens
cacaagcatctc

SEQ ID NO: 490709 - DNA, 15 bp, Homo sapiens
cacacaacaccagga

SEQ ID NO: 490710 - DNA, 22 bp, Homo sapiens
cacaccaggcttgcctgcaggc

SEQ ID NO: 490711 - DNA, 11 bp, Homo sapiens
cacacctgagc

SEQ ID NO: 490712 - DNA, 13 bp, Homo sapiens
cacactgaagaag

SEQ ID NO: 490713 - DNA, 13 bp, Homo sapiens
cacagacctgctc

SEQ ID NO: 490714 - DNA, 14 bp, Homo sapiens
cacagagcaggact

SEQ ID NO: 490715 - DNA, 13 bp, Homo sapiens
cacagagcgggga

SEQ ID NO: 490716 - DNA, 19 bp, Homo sapiens
cacagcccaaagaaggaaa

SEQ ID NO: 490717 - DNA, 20 bp, Homo sapiens
cacagctaacaattgtgaag

SEQ ID NO: 490718 - DNA, 20 bp, Homo sapiens
cacagctaacacacagctcc

SEQ ID NO: 490719 - DNA, 14 bp, Homo sapiens
cacagctgctggag

SEQ ID NO: 490720 - DNA, 15 bp, Homo sapiens
cacaggagcatttgg

SEQ ID NO: 490721 - DNA, 16 bp, Homo sapiens
cacaggatgaaggcaa

SEQ ID NO: 490722 - DNA, 23 bp, Homo sapiens
cacaggggctatcccttctcaga

SEQ ID NO: 490723 - DNA, 23 bp, Homo sapiens
cacaggtatgaccttctaggaag

SEQ ID NO: 490724 - DNA, 15 bp, Homo sapiens
cacatctgtggagat

SEQ ID NO: 490725 - DNA, 19 bp, Homo sapiens
cacattccttgcctgcaca

SEQ ID NO: 490726 - DNA, 15 bp, Homo sapiens
cacatttacactaga

SEQ ID NO: 490727 - DNA, 22 bp, Homo sapiens
caccagccttgctctcttcaat

SEQ ID NO: 490728 - DNA, 21 bp, Homo sapiens
caccatagaagaacagcagat

SEQ ID NO: 490729 - DNA, 23 bp, Homo sapiens
caccatcttaagagatgcctcat

SEQ ID NO: 490730 - DNA, 21 bp, Homo sapiens
cacccactctcctctgcctca

SEQ ID NO: 490731 - DNA, 13 bp, Homo sapiens
caccccaggactc

SEQ ID NO: 490732 - DNA, 21 bp, Homo sapiens
caccctcatgctgtgtgactc

SEQ ID NO: 490733 - DNA, 13 bp, Homo sapiens
cacccttggactt

SEQ ID NO: 490734 - DNA, 16 bp, Homo sapiens
cacctagaattggctg

SEQ ID NO: 490735 - DNA, 22 bp, Homo sapiens
cacctcagagtatggagctcag

SEQ ID NO: 490736 - DNA, 11 bp, Homo sapiens
cacctcatgga

SEQ ID NO: 490737 - DNA, 12 bp, Homo sapiens
cacctcatggaa

SEQ ID NO: 490738 - DNA, 23 bp, Homo sapiens
cacctctgtgggcactggtgggc

SEQ ID NO: 490739 - DNA, 15 bp, Homo sapiens
cacctgggctttctg

SEQ ID NO: 490740 - DNA, 14 bp, Homo sapiens
caccttgcggggat

SEQ ID NO: 490741 - DNA, 19 bp, Homo sapiens
cacgcccaccagccttgct

SEQ ID NO: 490742 - DNA, 17 bp, Homo sapiens
cacggtttgaagcctgg

SEQ ID NO: 490743 - DNA, 18 bp, Homo sapiens
cacggtttgaagcctgga

SEQ ID NO: 490744 - DNA, 19 bp, Homo sapiens
cacggtttgaagcctggaa

SEQ ID NO: 490745 - DNA, 18 bp, Homo sapiens
cacgtggaggagcagtgc

SEQ ID NO: 490746 - DNA, 20 bp, Homo sapiens
cacgtggaggagcagtgcag

SEQ ID NO: 490747 - DNA, 20 bp, Homo sapiens
cacgtggctagggttccact

SEQ ID NO: 490748 - DNA, 13 bp, Homo sapiens
cactaaagcagtg

SEQ ID NO: 490749 - DNA, 14 bp, Homo sapiens
cactagtatttcta

SEQ ID NO: 490750 - DNA, 19 bp, Homo sapiens
cactagtatttctatgaaa

SEQ ID NO: 490751 - DNA, 23 bp, Homo sapiens
cactcaagaagcaggctacactg

SEQ ID NO: 490752 - DNA, 22 bp, Homo sapiens
cactcatttatttccatattaa

SEQ ID NO: 490753 - DNA, 13 bp, Homo sapiens
cactccagcctgg

SEQ ID NO: 490754 - DNA, 22 bp, Homo sapiens
cactcccttcccatgacccagg

SEQ ID NO: 490755 - DNA, 20 bp, Homo sapiens
cactgcaggcatcacagcta

SEQ ID NO: 490756 - DNA, 17 bp, Homo sapiens
cactgccatgcagggcc

SEQ ID NO: 490757 - DNA, 19 bp, Homo sapiens
cactgccatgcagggcctc

SEQ ID NO: 490758 - DNA, 20 bp, Homo sapiens
cactgccttctcaactccaa

SEQ ID NO: 490759 - DNA, 12 bp, Homo sapiens
cactgcctttga

SEQ ID NO: 490760 - DNA, 15 bp, Homo sapiens
cactgggggagggga

SEQ ID NO: 490761 - DNA, 18 bp, Homo sapiens
cactggggtcctggggcc

SEQ ID NO: 490762 - DNA, 15 bp, Homo sapiens
cactgtgctcagggc

SEQ ID NO: 490763 - DNA, 14 bp, Homo sapiens
cactgtgggaaggc

SEQ ID NO: 490764 - DNA, 23 bp, Homo sapiens
cacttcttcttggtcttatttat

SEQ ID NO: 490765 - DNA, 12 bp, Homo sapiens
cacttggagcca

SEQ ID NO: 490766 - DNA, 17 bp, Homo sapiens
cacttggcatcagctgg

SEQ ID NO: 490767 - DNA, 18 bp, Homo sapiens
cacttgtgccaacactca

SEQ ID NO: 490768 - DNA, 24 bp, Homo sapiens
cacttgtgccaacactcaagaagc

SEQ ID NO: 490769 - DNA, 17 bp, Homo sapiens
cactttcagtgaaagca

SEQ ID NO: 490770 - DNA, 18 bp, Homo sapiens
cactttcagtgaaagcat

SEQ ID NO: 490771 - DNA, 23 bp, Homo sapiens
cagaaaacttctcttctgagcct

SEQ ID NO: 490772 - DNA, 18 bp, Homo sapiens
cagaaacaccctcacact

SEQ ID NO: 490773 - DNA, 23 bp, Homo sapiens
cagaaacaccctcacactgggac

SEQ ID NO: 490774 - DNA, 24 bp, Homo sapiens
cagaaagaagtggggacagagcag

SEQ ID NO: 490775 - DNA, 20 bp, Homo sapiens
cagaacagccgctcctgtct

SEQ ID NO: 490776 - DNA, 12 bp, Homo sapiens
cagaacctggag

SEQ ID NO: 490777 - DNA, 20 bp, Homo sapiens
cagaagacctccctgtgaga

SEQ ID NO: 490778 - DNA, 22 bp, Homo sapiens
cagaagacctccctgtgagaga

SEQ ID NO: 490779 - DNA, 15 bp, Homo sapiens
cagaagctgcagctg

SEQ ID NO: 490780 - DNA, 14 bp, Homo sapiens
cagaatctttgcaa

SEQ ID NO: 490781 - DNA, 13 bp, Homo sapiens
cagacagcagctc

SEQ ID NO: 490782 - DNA, 16 bp, Homo sapiens
cagacagcagctcagg

SEQ ID NO: 490783 - DNA, 18 bp, Homo sapiens
cagacagggttcattgaa

SEQ ID NO: 490784 - DNA, 15 bp, Homo sapiens
cagacctgctctgga

SEQ ID NO: 490785 - DNA, 22 bp, Homo sapiens
cagacctgctctggacacttgc

SEQ ID NO: 490786 - DNA, 18 bp, Homo sapiens
cagactatttaacttgag

SEQ ID NO: 490787 - DNA, 22 bp, Homo sapiens
cagactgtgtaaaaagagagct

SEQ ID NO: 490788 - DNA, 20 bp, Homo sapiens
cagactttttttaaatagta

SEQ ID NO: 490789 - DNA, 13 bp, Homo sapiens
cagagaaagagga

SEQ ID NO: 490790 - DNA, 18 bp, Homo sapiens
cagagacctcctgcctcc

SEQ ID NO: 490791 - DNA, 15 bp, Homo sapiens
cagagataggcctgt

SEQ ID NO: 490792 - DNA, 11 bp, Homo sapiens
cagagccaggc

SEQ ID NO: 490793 - DNA, 15 bp, Homo sapiens
cagagcgcccctccc

SEQ ID NO: 490794 - DNA, 14 bp, Homo sapiens
cagagctctctgag

SEQ ID NO: 490795 - DNA, 21 bp, Homo sapiens
cagaggttatctgtcccaggt

SEQ ID NO: 490796 - DNA, 14 bp, Homo sapiens
taggttgtagcaga

SEQ ID NO: 490797 - DNA, 14 bp, Homo sapiens
tagtaattctcagg

SEQ ID NO: 490798 - DNA, 19 bp, Homo sapiens
tagtatttctatgaaatat

SEQ ID NO: 490799 - DNA, 13 bp, Homo sapiens
tagtcaaattgtg

SEQ ID NO: 490800 - DNA, 21 bp, Homo sapiens
tagtctctatcattaaagttc

SEQ ID NO: 490801 - DNA, 18 bp, Homo sapiens
tagtgagacccctgtctc

SEQ ID NO: 490802 - DNA, 15 bp, Homo sapiens
tagtgatcacagcag

SEQ ID NO: 490803 - DNA, 13 bp, Homo sapiens
tagttaattctgt

SEQ ID NO: 490804 - DNA, 16 bp, Homo sapiens
tagttatgtgagaaag

SEQ ID NO: 490805 - DNA, 15 bp, Homo sapiens
tagttttatatgctt

SEQ ID NO: 490806 - DNA, 22 bp, Homo sapiens
tataaaataatttttatatttg

SEQ ID NO: 490807 - DNA, 19 bp, Homo sapiens
tataattttgtgaagcaaa

SEQ ID NO: 490808 - DNA, 13 bp, Homo sapiens
tatataacaatgc

SEQ ID NO: 490809 - DNA, 19 bp, Homo sapiens
tatataacaatgctgtatt

SEQ ID NO: 490810 - DNA, 15 bp, Homo sapiens
tatatacatatatat

SEQ ID NO: 490811 - DNA, 17 bp, Homo sapiens
tatatggcctcaagatc

SEQ ID NO: 490812 - DNA, 16 bp, Homo sapiens
tatattcaaaaattat

SEQ ID NO: 490813 - DNA, 18 bp, Homo sapiens
tatattcaaaaattatat

SEQ ID NO: 490814 - DNA, 24 bp, Homo sapiens
tatattttcatgacttttccatgt

SEQ ID NO: 490815 - DNA, 13 bp, Homo sapiens
tatcaaactgaag

SEQ ID NO: 490816 - DNA, 16 bp, Homo sapiens
tatcaaactgaagcca

SEQ ID NO: 490817 - DNA, 15 bp, Homo sapiens
tatcacctgtcatca

SEQ ID NO: 490818 - DNA, 12 bp, Homo sapiens
tatcattaaagt

SEQ ID NO: 490819 - DNA, 13 bp, Homo sapiens
tatcattaaagtt

SEQ ID NO: 490820 - DNA, 16 bp, Homo sapiens
tatctcacttgtgcca

SEQ ID NO: 490821 - DNA, 21 bp, Homo sapiens
tatctgaaggagattttcctt

SEQ ID NO: 490822 - DNA, 11 bp, Homo sapiens
tatctttgcca

SEQ ID NO: 490823 - DNA, 21 bp, Homo sapiens
tatgaaatattatgttaaaac

SEQ ID NO: 490824 - DNA, 23 bp, Homo sapiens
tatgaattacatttgtataaaat

SEQ ID NO: 490825 - DNA, 14 bp, Homo sapiens
tatgacattcatgc

SEQ ID NO: 490826 - DNA, 13 bp, Homo sapiens
tatgatgtttaaa

SEQ ID NO: 490827 - DNA, 19 bp, Homo sapiens
tatgatgtttaaaagcata

SEQ ID NO: 490828 - DNA, 15 bp, Homo sapiens
tatgatttggaaaat

SEQ ID NO: 490829 - DNA, 15 bp, Homo sapiens
tatgcacgaccttgg

SEQ ID NO: 490830 - DNA, 15 bp, Homo sapiens
tatgcttctgtttta

SEQ ID NO: 490831 - DNA, 16 bp, Homo sapiens
tatggacggtgctcca

SEQ ID NO: 490832 - DNA, 17 bp, Homo sapiens
tatggagctcagagagg

SEQ ID NO: 490833 - DNA, 13 bp, Homo sapiens
tatggcagtgtct

SEQ ID NO: 490834 - DNA, 16 bp, Homo sapiens
tatggcagtgtctttc

SEQ ID NO: 490835 - DNA, 16 bp, Homo sapiens
tatgggaatcaagatt

SEQ ID NO: 490836 - DNA, 19 bp, Homo sapiens
tatgggctttctctttggt

SEQ ID NO: 490837 - DNA, 17 bp, Homo sapiens
tattaggggtaatatat

SEQ ID NO: 490838 - DNA, 18 bp, Homo sapiens
tattaggggtaatatatt

SEQ ID NO: 490839 - DNA, 17 bp, Homo sapiens
tattgacatcagcatca

SEQ ID NO: 490840 - DNA, 13 bp, Homo sapiens
tattgcccaggtt

SEQ ID NO: 490841 - DNA, 22 bp, Homo sapiens
tattgctgctggtaatttgtat

SEQ ID NO: 490842 - DNA, 22 bp, Homo sapiens
tatttaaatattaaatatgtta

SEQ ID NO: 490843 - DNA, 14 bp, Homo sapiens
tatttaacttgagg

SEQ ID NO: 490844 - DNA, 21 bp, Homo sapiens
tatttaacttgagggtaataa

SEQ ID NO: 490845 - DNA, 13 bp, Homo sapiens
tatttattactgt

SEQ ID NO: 490846 - DNA, 18 bp, Homo sapiens
tatttattttaataatgt

SEQ ID NO: 490847 - DNA, 14 bp, Homo sapiens
tatttccatattaa

SEQ ID NO: 490848 - DNA, 22 bp, Homo sapiens
tatttccatattaaaatcacaa

SEQ ID NO: 490849 - DNA, 20 bp, Homo sapiens
tatttccctcccctggggac

SEQ ID NO: 490850 - DNA, 20 bp, Homo sapiens
tatttctacctttctgagtc

SEQ ID NO: 490851 - DNA, 14 bp, Homo sapiens
tatttctatgaaat

SEQ ID NO: 490852 - DNA, 15 bp, Homo sapiens
tatttgcatatgtat

SEQ ID NO: 490853 - DNA, 18 bp, Homo sapiens
tattttaaaagaatgatt

SEQ ID NO: 490854 - DNA, 19 bp, Homo sapiens
tattttaataatgtttcaa

SEQ ID NO: 490855 - DNA, 22 bp, Homo sapiens
tattttaataatgtttcaaaca

SEQ ID NO: 490856 - DNA, 21 bp, Homo sapiens
tattttaggcagggatttgag

SEQ ID NO: 490857 - DNA, 22 bp, Homo sapiens
tattttaggcagggatttgagg

SEQ ID NO: 490858 - DNA, 21 bp, Homo sapiens
tattttcatgacttttccatg

SEQ ID NO: 490859 - DNA, 16 bp, Homo sapiens
tattttccatgaaaat

SEQ ID NO: 490860 - DNA, 14 bp, Homo sapiens
tattttctgttcta

SEQ ID NO: 490861 - DNA, 12 bp, Homo sapiens
tattttgaacaa

SEQ ID NO: 490862 - DNA, 18 bp, Homo sapiens
tattttgactgtgattta

SEQ ID NO: 490863 - DNA, 17 bp, Homo sapiens
tatttttaattaaataa

SEQ ID NO: 490864 - DNA, 13 bp, Homo sapiens
tatttttatttgt

SEQ ID NO: 490865 - DNA, 17 bp, Homo sapiens
tatttttatttgtttgt

SEQ ID NO: 490866 - DNA, 19 bp, Homo sapiens
tatttttttaagctgtaaa

SEQ ID NO: 490867 - DNA, 20 bp, Homo sapiens
tatttttttaagctgtaaaa

SEQ ID NO: 490868 - DNA, 22 bp, Homo sapiens
tcaaaaactgtcaaagaatcaa

SEQ ID NO: 490869 - DNA, 11 bp, Homo sapiens
tcaaaaagaaa

SEQ ID NO: 490870 - DNA, 19 bp, Homo sapiens
tcaaaacccatctgggctc

SEQ ID NO: 490871 - DNA, 20 bp, Homo sapiens
tcaaaaggatttactttttg

SEQ ID NO: 490872 - DNA, 15 bp, Homo sapiens
tcaaattgtgtgaaa

SEQ ID NO: 490873 - DNA, 19 bp, Homo sapiens
tcaacagtttccagtcatg

SEQ ID NO: 490874 - DNA, 18 bp, Homo sapiens
tcaaccctaaaaagcaga

SEQ ID NO: 490875 - DNA, 19 bp, Homo sapiens
tcaagaccagtctggccaa

SEQ ID NO: 490876 - DNA, 20 bp, Homo sapiens
tcaagactggaaggtgggga

SEQ ID NO: 490877 - DNA, 14 bp, Homo sapiens
tcaagagacatggt

SEQ ID NO: 490878 - DNA, 16 bp, Homo sapiens
tcaagatcaatgaaat

SEQ ID NO: 490879 - DNA, 14 bp, Homo sapiens
tcaagctttccgag

SEQ ID NO: 490880 - DNA, 17 bp, Homo sapiens
tcaagggaccctgggtg

SEQ ID NO: 490881 - DNA, 19 bp, Homo sapiens
tcaagggaccctgggtggg

SEQ ID NO: 490882 - DNA, 20 bp, Homo sapiens
tcaataaaccacaagcatct

SEQ ID NO: 490883 - DNA, 12 bp, Homo sapiens
tcaataaactga

SEQ ID NO: 490884 - DNA, 20 bp, Homo sapiens
tcaatactttgaacacaaag

SEQ ID NO: 490885 - DNA, 19 bp, Homo sapiens
tcaatatttcagataatca

SEQ ID NO: 490886 - DNA, 23 bp, Homo sapiens
tcaatatttcagataatcacaat

SEQ ID NO: 490887 - DNA, 16 bp, Homo sapiens
tcaatattttccatga

SEQ ID NO: 490888 - DNA, 19 bp, Homo sapiens
tcaatccagcggttctcaa

SEQ ID NO: 490889 - DNA, 17 bp, Homo sapiens
tcaatgctataactatg

SEQ ID NO: 490890 - DNA, 19 bp, Homo sapiens
tcaatggtttgcaaggaag

SEQ ID NO: 490891 - DNA, 13 bp, Homo sapiens
tcaattcaacact

SEQ ID NO: 490892 - DNA, 18 bp, Homo sapiens
tcaatttccaagagctga

SEQ ID NO: 490893 - DNA, 18 bp, Homo sapiens
tcacaaaagtatattcaa

SEQ ID NO: 490894 - DNA, 19 bp, Homo sapiens
tcacacaatacaataagtt

SEQ ID NO: 490895 - DNA, 20 bp, Homo sapiens
tcacacacaggcaactgagg

SEQ ID NO: 490896 - DNA, 21 bp, Homo sapiens
tcacaccaggcttgcctgcag

SEQ ID NO: 490897 - DNA, 22 bp, Homo sapiens
tcacaccaggcttgcctgcagg

SEQ ID NO: 490898 - DNA, 17 bp, Homo sapiens
tcacacgggggcagctg

SEQ ID NO: 490899 - DNA, 17 bp, Homo sapiens
tcacacggggtatttta

SEQ ID NO: 490900 - DNA, 11 bp, Homo sapiens
tcacactggga

SEQ ID NO: 490901 - DNA, 23 bp, Homo sapiens
tcacagatgtgtgattcacagtg

SEQ ID NO: 490902 - DNA, 13 bp, Homo sapiens
tcacagtgctgag

SEQ ID NO: 490903 - DNA, 18 bp, Homo sapiens
tcacatttgtaaatgtct

SEQ ID NO: 490904 - DNA, 20 bp, Homo sapiens
tcaccacatgcggagaacaa

SEQ ID NO: 490905 - DNA, 12 bp, Homo sapiens
tcacctcatgga

SEQ ID NO: 490906 - DNA, 18 bp, Homo sapiens
tcacctggggctgctggc

SEQ ID NO: 490907 - DNA, 23 bp, Homo sapiens
tcaccttgagaggcatgacagct

SEQ ID NO: 490908 - DNA, 18 bp, Homo sapiens
tcactattcaagtattag

SEQ ID NO: 490909 - DNA, 13 bp, Homo sapiens
tcactgccatata

SEQ ID NO: 490910 - DNA, 21 bp, Homo sapiens
tcactggggtcctggggcctc

SEQ ID NO: 490911 - DNA, 14 bp, Homo sapiens
tcacttgagcccag

SEQ ID NO: 490912 - DNA, 20 bp, Homo sapiens
tcagaaaacttctcttctga

SEQ ID NO: 490913 - DNA, 19 bp, Homo sapiens
tcagaaacaccctcacact

SEQ ID NO: 490914 - DNA, 19 bp, Homo sapiens
tcagaaaccattgttcaga

SEQ ID NO: 490915 - DNA, 17 bp, Homo sapiens
tcagaatcacttctgag

SEQ ID NO: 490916 - DNA, 20 bp, Homo sapiens
gtttctggtctctaggctgg

SEQ ID NO: 490917 - DNA, 16 bp, Homo sapiens
gtttctttagcagttt

SEQ ID NO: 490918 - DNA, 14 bp, Homo sapiens
gtttgaagcctgga

SEQ ID NO: 490919 - DNA, 19 bp, Homo sapiens
gtttgaatataaacactat

SEQ ID NO: 490920 - DNA, 13 bp, Homo sapiens
gtttgcaaggaag

SEQ ID NO: 490921 - DNA, 15 bp, Homo sapiens
gttttataattttgt

SEQ ID NO: 490922 - DNA, 15 bp, Homo sapiens
gtttttaactcaata

SEQ ID NO: 490923 - DNA, 22 bp, Homo sapiens
gtttttaagaaaaacatgtcat

SEQ ID NO: 490924 - DNA, 12 bp, Homo sapiens
taaaagaatgat

SEQ ID NO: 490925 - DNA, 22 bp, Homo sapiens
taaaagacaaatcaaagcagat

SEQ ID NO: 490926 - DNA, 20 bp, Homo sapiens
taaaataatttttatatttg

SEQ ID NO: 490927 - DNA, 13 bp, Homo sapiens
taaaatgcattta

SEQ ID NO: 490928 - DNA, 15 bp, Homo sapiens
taaaattgtaaaatt

SEQ ID NO: 490929 - DNA, 22 bp, Homo sapiens
taaaattgtaaaattgtataga

SEQ ID NO: 490930 - DNA, 16 bp, Homo sapiens
taaaattgtatagaga

SEQ ID NO: 490931 - DNA, 19 bp, Homo sapiens
taaacaaatgtatgattac

SEQ ID NO: 490932 - DNA, 13 bp, Homo sapiens
taaacattagttc

SEQ ID NO: 490933 - DNA, 23 bp, Homo sapiens
taaacattagttctatttctatc

SEQ ID NO: 490934 - DNA, 22 bp, Homo sapiens
taaactgaatttttcttgcgaa

SEQ ID NO: 490935 - DNA, 14 bp, Homo sapiens
taaagctgttctca

SEQ ID NO: 490936 - DNA, 23 bp, Homo sapiens
taaagctgttctcattcctgttc

SEQ ID NO: 490937 - DNA, 19 bp, Homo sapiens
taaagtatggtattgaaac

SEQ ID NO: 490938 - DNA, 14 bp, Homo sapiens
taaagtttacagta

SEQ ID NO: 490939 - DNA, 16 bp, Homo sapiens
taaagtttacagtaaa

SEQ ID NO: 490940 - DNA, 12 bp, Homo sapiens
taaataaattgt

SEQ ID NO: 490941 - DNA, 20 bp, Homo sapiens
taaattatgggaatcaagat

SEQ ID NO: 490942 - DNA, 21 bp, Homo sapiens
taaattatgggaatcaagatt

SEQ ID NO: 490943 - DNA, 12 bp, Homo sapiens
taaattgtttga

SEQ ID NO: 490944 - DNA, 14 bp, Homo sapiens
taacaacctggaga

SEQ ID NO: 490945 - DNA, 21 bp, Homo sapiens
taacaactatgatttggaaaa

SEQ ID NO: 490946 - DNA, 22 bp, Homo sapiens
taacaactatgatttggaaaat

SEQ ID NO: 490947 - DNA, 15 bp, Homo sapiens
taacacacagctccc

SEQ ID NO: 490948 - DNA, 17 bp, Homo sapiens
taacacacagctcccat

SEQ ID NO: 490949 - DNA, 16 bp, Homo sapiens
taactatgttgataaa

SEQ ID NO: 490950 - DNA, 17 bp, Homo sapiens
taactgggttcaaaaag

SEQ ID NO: 490951 - DNA, 14 bp, Homo sapiens
taactgtgcagaga

SEQ ID NO: 490952 - DNA, 12 bp, Homo sapiens
taagaaaaacat

SEQ ID NO: 490953 - DNA, 19 bp, Homo sapiens
taagaaaaacatgtcatgt

SEQ ID NO: 490954 - DNA, 23 bp, Homo sapiens
taagagagaatgagagacacact

SEQ ID NO: 490955 - DNA, 21 bp, Homo sapiens
taagagcacaggttagggcat

SEQ ID NO: 490956 - DNA, 18 bp, Homo sapiens
taagagggcacacactgt

SEQ ID NO: 490957 - DNA, 21 bp, Homo sapiens
taagagtaagcacctttagaa

SEQ ID NO: 490958 - DNA, 16 bp, Homo sapiens
taagcacctttagaat

SEQ ID NO: 490959 - DNA, 18 bp, Homo sapiens
taagcacctttagaatat

SEQ ID NO: 490960 - DNA, 16 bp, Homo sapiens
taagcattccaactat

SEQ ID NO: 490961 - DNA, 12 bp, Homo sapiens
taagctgtaaaa

SEQ ID NO: 490962 - DNA, 18 bp, Homo sapiens
taaggtcattaccacagg

SEQ ID NO: 490963 - DNA, 22 bp, Homo sapiens
taagtcttatcaagcagccaag

SEQ ID NO: 490964 - DNA, 14 bp, Homo sapiens
taagtgcacaacat

SEQ ID NO: 490965 - DNA, 20 bp, Homo sapiens
taagtgtgcacagatacaca

SEQ ID NO: 490966 - DNA, 20 bp, Homo sapiens
taagtttatgtctaaagagc

SEQ ID NO: 490967 - DNA, 13 bp, Homo sapiens
taataaaatacat

SEQ ID NO: 490968 - DNA, 14 bp, Homo sapiens
taataaaatacata

SEQ ID NO: 490969 - DNA, 13 bp, Homo sapiens
taataatgtgaat

SEQ ID NO: 490970 - DNA, 15 bp, Homo sapiens
taataatgtttcaaa

SEQ ID NO: 490971 - DNA, 16 bp, Homo sapiens
taatatggggatgcag

SEQ ID NO: 490972 - DNA, 17 bp, Homo sapiens
taatctaattctaagga

SEQ ID NO: 490973 - DNA, 20 bp, Homo sapiens
taatctgatggcttctccag

SEQ ID NO: 490974 - DNA, 21 bp, Homo sapiens
taatctgatggcttctccagg

SEQ ID NO: 490975 - DNA, 13 bp, Homo sapiens
taatctttcacag

SEQ ID NO: 490976 - DNA, 14 bp, Homo sapiens
taatgctaaatgta

SEQ ID NO: 490977 - DNA, 22 bp, Homo sapiens
taatgctaaatgtaagaatcat

SEQ ID NO: 490978 - DNA, 18 bp, Homo sapiens
taatgggcttagagcagt

SEQ ID NO: 490979 - DNA, 17 bp, Homo sapiens
taatgtgcctagttctt

SEQ ID NO: 490980 - DNA, 21 bp, Homo sapiens
taattaaataaaaatctgtgg

SEQ ID NO: 490981 - DNA, 15 bp, Homo sapiens
taattcaagctttcc

SEQ ID NO: 490982 - DNA, 16 bp, Homo sapiens
taattctttatcacat

SEQ ID NO: 490983 - DNA, 20 bp, Homo sapiens
taatttgtagtgttggagaa

SEQ ID NO: 490984 - DNA, 18 bp, Homo sapiens
taattttgtgaagcaaaa

SEQ ID NO: 490985 - DNA, 12 bp, Homo sapiens
taatttttatat

SEQ ID NO: 490986 - DNA, 21 bp, Homo sapiens
taatttttatatttgaaatat

SEQ ID NO: 490987 - DNA, 18 bp, Homo sapiens
tacacaccttatatttac

SEQ ID NO: 490988 - DNA, 21 bp, Homo sapiens
tacacagactattgacatcag

SEQ ID NO: 490989 - DNA, 20 bp, Homo sapiens
tacacagggatgtacaaggc

SEQ ID NO: 490990 - DNA, 18 bp, Homo sapiens
tacagaattctgctacct

SEQ ID NO: 490991 - DNA, 20 bp, Homo sapiens
tacagctgggtggcactgcc

SEQ ID NO: 490992 - DNA, 21 bp, Homo sapiens
tacagctgggtggcactgcca

SEQ ID NO: 490993 - DNA, 16 bp, Homo sapiens
tacagggaatgcctga

SEQ ID NO: 490994 - DNA, 22 bp, Homo sapiens
tacagggcgagactctgtctca

SEQ ID NO: 490995 - DNA, 18 bp, Homo sapiens
tacagtaaataaattgtt

SEQ ID NO: 490996 - DNA, 17 bp, Homo sapiens
tacagtttgtcacatga

SEQ ID NO: 490997 - DNA, 18 bp, Homo sapiens
tacatactatagattctt

SEQ ID NO: 490998 - DNA, 21 bp, Homo sapiens
tacatactatagattctttat

SEQ ID NO: 490999 - DNA, 21 bp, Homo sapiens
tacatatttgcatatgtatga

SEQ ID NO: 491000 - DNA, 16 bp, Homo sapiens
tacatttgtataaaat

SEQ ID NO: 491001 - DNA, 22 bp, Homo sapiens
taccaaaaatctcaatatttca

SEQ ID NO: 491002 - DNA, 14 bp, Homo sapiens
tacccttaagctag

SEQ ID NO: 491003 - DNA, 14 bp, Homo sapiens
taccttctccctca

SEQ ID NO: 491004 - DNA, 24 bp, Homo sapiens
tacgctccatcgctgtcatctcag

SEQ ID NO: 491005 - DNA, 13 bp, Homo sapiens
tacgtatgagacg

SEQ ID NO: 491006 - DNA, 14 bp, Homo sapiens
tactcaaacatgtt

SEQ ID NO: 491007 - DNA, 13 bp, Homo sapiens
tactcctgggtca

SEQ ID NO: 491008 - DNA, 22 bp, Homo sapiens
tactgaagatgcagcaaaatgt

SEQ ID NO: 491009 - DNA, 22 bp, Homo sapiens
tactgtgtacagaattctgcta

SEQ ID NO: 491010 - DNA, 19 bp, Homo sapiens
tacttcaaatccttgaaga

SEQ ID NO: 491011 - DNA, 16 bp, Homo sapiens
tacttcatgctgtcta

SEQ ID NO: 491012 - DNA, 19 bp, Homo sapiens
tacttcttagggttatgat

SEQ ID NO: 491013 - DNA, 16 bp, Homo sapiens
tacttctttgctttgc

SEQ ID NO: 491014 - DNA, 18 bp, Homo sapiens
tactttttgtaaaaagct

SEQ ID NO: 491015 - DNA, 15 bp, Homo sapiens
tagaaacacaactat

SEQ ID NO: 491016 - DNA, 22 bp, Homo sapiens
tagaacatggagagctagaacc

SEQ ID NO: 491017 - DNA, 16 bp, Homo sapiens
tagaaccaagaagggc

SEQ ID NO: 491018 - DNA, 17 bp, Homo sapiens
tagaaccaagaagggct

SEQ ID NO: 491019 - DNA, 23 bp, Homo sapiens
tagaacctagaagggctagaacc

SEQ ID NO: 491020 - DNA, 17 bp, Homo sapiens
tagaacctggaagggct

SEQ ID NO: 491021 - DNA, 22 bp, Homo sapiens
tagaacctggagagctagaacc

SEQ ID NO: 491022 - DNA, 13 bp, Homo sapiens
tagaacctggagg

SEQ ID NO: 491023 - DNA, 22 bp, Homo sapiens
tagaacctggagggctagaacc

SEQ ID NO: 491024 - DNA, 22 bp, Homo sapiens
tagaactttgcatagcagctgc

SEQ ID NO: 491025 - DNA, 22 bp, Homo sapiens
tagaagggctagaacctggaga

SEQ ID NO: 491026 - DNA, 14 bp, Homo sapiens
tagaataaaattgt

SEQ ID NO: 491027 - DNA, 12 bp, Homo sapiens
tagaatctggag

SEQ ID NO: 491028 - DNA, 19 bp, Homo sapiens
tagaattggctgaactcat

SEQ ID NO: 491029 - DNA, 22 bp, Homo sapiens
tagacaagtccagcctggcaag

SEQ ID NO: 491030 - DNA, 15 bp, Homo sapiens
tagacccatcttctt

SEQ ID NO: 491031 - DNA, 11 bp, Homo sapiens
tagacctcagc

SEQ ID NO: 491032 - DNA, 15 bp, Homo sapiens
tagacctcagcctgt

SEQ ID NO: 491033 - DNA, 22 bp, Homo sapiens
tagacctcagcctgtgctgccc

SEQ ID NO: 491034 - DNA, 20 bp, Homo sapiens
tagagatatgcagaaggaag

SEQ ID NO: 491035 - DNA, 23 bp, Homo sapiens
tagagctgacacaaacctgcctg

SEQ ID NO: 491036 - DNA, 13 bp, Homo sapiens
tagaggccaggga

SEQ ID NO: 491037 - DNA, 14 bp, Homo sapiens
tagataggccatgg

SEQ ID NO: 491038 - DNA, 17 bp, Homo sapiens
tagataggccatgggca

SEQ ID NO: 491039 - DNA, 22 bp, Homo sapiens
tagatcgatgatatgaccagaa

SEQ ID NO: 491040 - DNA, 19 bp, Homo sapiens
tagatctccaggagaactg

SEQ ID NO: 491041 - DNA, 19 bp, Homo sapiens
tagatgactgaatttctat

SEQ ID NO: 491042 - DNA, 21 bp, Homo sapiens
tagatgcagttctgaagaaga

SEQ ID NO: 491043 - DNA, 18 bp, Homo sapiens
tagcaaattccaatacat

SEQ ID NO: 491044 - DNA, 13 bp, Homo sapiens
gtaatttgtatct

SEQ ID NO: 491045 - DNA, 15 bp, Homo sapiens
gtacacagactattg

SEQ ID NO: 491046 - DNA, 23 bp, Homo sapiens
gtacactgccttctcaactccaa

SEQ ID NO: 491047 - DNA, 20 bp, Homo sapiens
gtacagaattctgctacctc

SEQ ID NO: 491048 - DNA, 23 bp, Homo sapiens
gtacagttcagttcctctttgca

SEQ ID NO: 491049 - DNA, 14 bp, Homo sapiens
gtaccttgaacact

SEQ ID NO: 491050 - DNA, 15 bp, Homo sapiens
gtactacaatttaaa

SEQ ID NO: 491051 - DNA, 20 bp, Homo sapiens
gtactcatcatcaaccctaa

SEQ ID NO: 491052 - DNA, 21 bp, Homo sapiens
gtacttcaaatccttgaagat

SEQ ID NO: 491053 - DNA, 21 bp, Homo sapiens
gtagaaagacagagctgggat

SEQ ID NO: 491054 - DNA, 14 bp, Homo sapiens
gtagataaagcact

SEQ ID NO: 491055 - DNA, 17 bp, Homo sapiens
gtagatcagtggtctcc

SEQ ID NO: 491056 - DNA, 21 bp, Homo sapiens
gtagattttaaaagttattaa

SEQ ID NO: 491057 - DNA, 17 bp, Homo sapiens
gtagctgctaccttctt

SEQ ID NO: 491058 - DNA, 20 bp, Homo sapiens
gtagtgttggagaagaactg

SEQ ID NO: 491059 - DNA, 23 bp, Homo sapiens
gtataagtccttgcaagaatcag

SEQ ID NO: 491060 - DNA, 15 bp, Homo sapiens
gtatagagatatgca

SEQ ID NO: 491061 - DNA, 15 bp, Homo sapiens
gtatcaaataaaatt

SEQ ID NO: 491062 - DNA, 11 bp, Homo sapiens
gtatctgaagg

SEQ ID NO: 491063 - DNA, 20 bp, Homo sapiens
gtatgcactaatcaatactt

SEQ ID NO: 491064 - DNA, 15 bp, Homo sapiens
gtatggagctcagag

SEQ ID NO: 491065 - DNA, 18 bp, Homo sapiens
gtatggagctcagagagg

SEQ ID NO: 491066 - DNA, 17 bp, Homo sapiens
gtatgttagtgcaaatt

SEQ ID NO: 491067 - DNA, 19 bp, Homo sapiens
gtattaggggtaatatatt

SEQ ID NO: 491068 - DNA, 17 bp, Homo sapiens
gtatttctatgaaatat

SEQ ID NO: 491069 - DNA, 22 bp, Homo sapiens
gtatttctatgaaatattatgt

SEQ ID NO: 491070 - DNA, 14 bp, Homo sapiens
gtatttgttaatgg

SEQ ID NO: 491071 - DNA, 19 bp, Homo sapiens
gtattttaggcagggattt

SEQ ID NO: 491072 - DNA, 14 bp, Homo sapiens
gtcaaacgtgaaaa

SEQ ID NO: 491073 - DNA, 23 bp, Homo sapiens
gtcaccatcttaagagatgcctc

SEQ ID NO: 491074 - DNA, 13 bp, Homo sapiens
gtcaggaaagaga

SEQ ID NO: 491075 - DNA, 14 bp, Homo sapiens
gtcagggccaggtg

SEQ ID NO: 491076 - DNA, 24 bp, Homo sapiens
gtcagtgtccaaagcagggtctgg

SEQ ID NO: 491077 - DNA, 20 bp, Homo sapiens
gtcatccacacaacaccagg

SEQ ID NO: 491078 - DNA, 16 bp, Homo sapiens
gtcatctcagctggat

SEQ ID NO: 491079 - DNA, 17 bp, Homo sapiens
gtcatgcaaaggctggg

SEQ ID NO: 491080 - DNA, 19 bp, Homo sapiens
gtcatgtaggttgtctaaa

SEQ ID NO: 491081 - DNA, 17 bp, Homo sapiens
gtccaaggaaaccacag

SEQ ID NO: 491082 - DNA, 13 bp, Homo sapiens
gtccacgcccacc

SEQ ID NO: 491083 - DNA, 17 bp, Homo sapiens
gtccacgcccaccagcc

SEQ ID NO: 491084 - DNA, 22 bp, Homo sapiens
gtccacgcccaccagccttgct

SEQ ID NO: 491085 - DNA, 14 bp, Homo sapiens
gtccagggccctga

SEQ ID NO: 491086 - DNA, 15 bp, Homo sapiens
gtccagggccctgag

SEQ ID NO: 491087 - DNA, 16 bp, Homo sapiens
gtccagggccctgagc

SEQ ID NO: 491088 - DNA, 13 bp, Homo sapiens
gtccccttccagg

SEQ ID NO: 491089 - DNA, 16 bp, Homo sapiens
gtccccttccaggggt

SEQ ID NO: 491090 - DNA, 21 bp, Homo sapiens
gtccctacacccctcccctgc

SEQ ID NO: 491091 - DNA, 15 bp, Homo sapiens
gtccctggtaataag

SEQ ID NO: 491092 - DNA, 14 bp, Homo sapiens
gtcctggggcctcg

SEQ ID NO: 491093 - DNA, 22 bp, Homo sapiens
gtcctggggcctcggagcctca

SEQ ID NO: 491094 - DNA, 18 bp, Homo sapiens
gtcctgtccacacccagc

SEQ ID NO: 491095 - DNA, 22 bp, Homo sapiens
gtcctgtccacacccagctcag

SEQ ID NO: 491096 - DNA, 17 bp, Homo sapiens
gtccttcacctttccca

SEQ ID NO: 491097 - DNA, 15 bp, Homo sapiens
gtcgtctggcatctc

SEQ ID NO: 491098 - DNA, 17 bp, Homo sapiens
gtctaaagtttacagta

SEQ ID NO: 491099 - DNA, 14 bp, Homo sapiens
gtctctaggctggg

SEQ ID NO: 491100 - DNA, 16 bp, Homo sapiens
gtctctatcattaaag

SEQ ID NO: 491101 - DNA, 14 bp, Homo sapiens
gtctctgctgccgc

SEQ ID NO: 491102 - DNA, 20 bp, Homo sapiens
gtctgaaccaccctggaaat

SEQ ID NO: 491103 - DNA, 19 bp, Homo sapiens
gtctgactgtgcccaagtg

SEQ ID NO: 491104 - DNA, 13 bp, Homo sapiens
gtctgactgtttc

SEQ ID NO: 491105 - DNA, 15 bp, Homo sapiens
gtctgctatattttc

SEQ ID NO: 491106 - DNA, 17 bp, Homo sapiens
gtctgctatattttcat

SEQ ID NO: 491107 - DNA, 17 bp, Homo sapiens
gtctggcatctcccaca

SEQ ID NO: 491108 - DNA, 22 bp, Homo sapiens
gtctggccaatatggagaaacc

SEQ ID NO: 491109 - DNA, 23 bp, Homo sapiens
gtctgggcaccacctctgtgggc

SEQ ID NO: 491110 - DNA, 12 bp, Homo sapiens
gtctgtaatgac

SEQ ID NO: 491111 - DNA, 18 bp, Homo sapiens
gtctgtaatgacaaataa

SEQ ID NO: 491112 - DNA, 15 bp, Homo sapiens
gtcttatcaagcagc

SEQ ID NO: 491113 - DNA, 22 bp, Homo sapiens
gtcttcagagataggcctgtgg

SEQ ID NO: 491114 - DNA, 21 bp, Homo sapiens
gtgacatttatttttctcatg

SEQ ID NO: 491115 - DNA, 14 bp, Homo sapiens
gtgagaaagttaga

SEQ ID NO: 491116 - DNA, 16 bp, Homo sapiens
gtgagacccctgtctc

SEQ ID NO: 491117 - DNA, 16 bp, Homo sapiens
gtgagagtctgggtcc

SEQ ID NO: 491118 - DNA, 13 bp, Homo sapiens
gtgatcagcagag

SEQ ID NO: 491119 - DNA, 19 bp, Homo sapiens
gtgattatttgttatttgt

SEQ ID NO: 491120 - DNA, 21 bp, Homo sapiens
gtgattcctttgaagaggaaa

SEQ ID NO: 491121 - DNA, 15 bp, Homo sapiens
gtgattgacaactga

SEQ ID NO: 491122 - DNA, 15 bp, Homo sapiens
gtgatttatttggag

SEQ ID NO: 491123 - DNA, 21 bp, Homo sapiens
gtgatttatttggagtggagg

SEQ ID NO: 491124 - DNA, 17 bp, Homo sapiens
gtgcagatgaggttgct

SEQ ID NO: 491125 - DNA, 18 bp, Homo sapiens
gtgcaggcctgctcaggg

SEQ ID NO: 491126 - DNA, 21 bp, Homo sapiens
gtgcatttttatctgtgagtt

SEQ ID NO: 491127 - DNA, 22 bp, Homo sapiens
gtgccaacactcaagaagcagg

SEQ ID NO: 491128 - DNA, 15 bp, Homo sapiens
gtgccgacagaagga

SEQ ID NO: 491129 - DNA, 12 bp, Homo sapiens
gtgcgtgctcag

SEQ ID NO: 491130 - DNA, 20 bp, Homo sapiens
gtgctacgtacatgtgaggc

SEQ ID NO: 491131 - DNA, 23 bp, Homo sapiens
gtgctgagttggtgttgacatgt

SEQ ID NO: 491132 - DNA, 19 bp, Homo sapiens
gtgctgcccgtcttcagcc

SEQ ID NO: 491133 - DNA, 19 bp, Homo sapiens
gtgctttctatctaatttt

SEQ ID NO: 491134 - DNA, 22 bp, Homo sapiens
gtggacaccaggagtccctggt

SEQ ID NO: 491135 - DNA, 12 bp, Homo sapiens
gtggagatgccc

SEQ ID NO: 491136 - DNA, 13 bp, Homo sapiens
gtggagctgcctg

SEQ ID NO: 491137 - DNA, 15 bp, Homo sapiens
gtggaggagcagtgc

SEQ ID NO: 491138 - DNA, 15 bp, Homo sapiens
gtggaggcattgttt

SEQ ID NO: 491139 - DNA, 13 bp, Homo sapiens
gtggcaaggctgt

SEQ ID NO: 491140 - DNA, 16 bp, Homo sapiens
gtggcaaggctgtgct

SEQ ID NO: 491141 - DNA, 19 bp, Homo sapiens
gtggcagagcttggactgg

SEQ ID NO: 491142 - DNA, 23 bp, Homo sapiens
gtggcagagcttggactggatgc

SEQ ID NO: 491143 - DNA, 21 bp, Homo sapiens
gtggcctctccttgtggcctg

SEQ ID NO: 491144 - DNA, 15 bp, Homo sapiens
gtggcctgggcctcc

SEQ ID NO: 491145 - DNA, 19 bp, Homo sapiens
gtggcttcattagagcagg

SEQ ID NO: 491146 - DNA, 21 bp, Homo sapiens
gtggcttcattagagcaggcg

SEQ ID NO: 491147 - DNA, 14 bp, Homo sapiens
gtgggaaggccagc

SEQ ID NO: 491148 - DNA, 21 bp, Homo sapiens
gtgggacagtcacctcatgga

SEQ ID NO: 491149 - DNA, 20 bp, Homo sapiens
gtgggcctcctctgtccagg

SEQ ID NO: 491150 - DNA, 21 bp, Homo sapiens
gtgggttttcatcaagactgg

SEQ ID NO: 491151 - DNA, 23 bp, Homo sapiens
gtggttaatgccatggacagaag

SEQ ID NO: 491152 - DNA, 22 bp, Homo sapiens
gtgtctgaaccaccctggaaat

SEQ ID NO: 491153 - DNA, 17 bp, Homo sapiens
gtgtctggattcccagg

SEQ ID NO: 491154 - DNA, 21 bp, Homo sapiens
gtgtcttttctgtagagcata

SEQ ID NO: 491155 - DNA, 17 bp, Homo sapiens
gtgttatttaaatgagt

SEQ ID NO: 491156 - DNA, 13 bp, Homo sapiens
gtgttcctctttg

SEQ ID NO: 491157 - DNA, 14 bp, Homo sapiens
gtgtttgtcaaaaa

SEQ ID NO: 491158 - DNA, 21 bp, Homo sapiens
gttaaaaattaaaagaaggaa

SEQ ID NO: 491159 - DNA, 21 bp, Homo sapiens
gttaactattttattttctaa

SEQ ID NO: 491160 - DNA, 15 bp, Homo sapiens
gttaagatatgatgt

SEQ ID NO: 491161 - DNA, 23 bp, Homo sapiens
gttacctctgcctcagaaaacaa

SEQ ID NO: 491162 - DNA, 14 bp, Homo sapiens
gttactatctgctt

SEQ ID NO: 491163 - DNA, 15 bp, Homo sapiens
gttagggaaaacatt

SEQ ID NO: 491164 - DNA, 11 bp, Homo sapiens
gttagggaggg

SEQ ID NO: 491165 - DNA, 13 bp, Homo sapiens
gttagggaggggt

SEQ ID NO: 491166 - DNA, 15 bp, Homo sapiens
gttatttaaatgagt

SEQ ID NO: 491167 - DNA, 17 bp, Homo sapiens
gttcagagctgccctct

SEQ ID NO: 491168 - DNA, 22 bp, Homo sapiens
gttcagagctgccctctcctgg

SEQ ID NO: 491169 - DNA, 23 bp, Homo sapiens
gttccactggagaattgaaaagg

SEQ ID NO: 491170 - DNA, 18 bp, Homo sapiens
gttcccttgatgaagaag

SEQ ID NO: 491171 - DNA, 13 bp, Homo sapiens
gttcctctttgca

SEQ ID NO: 491172 - DNA, 16 bp, Homo sapiens
gttcctctttgcatga

SEQ ID NO: 491173 - DNA, 13 bp, Homo sapiens
gttctgaagaaga

SEQ ID NO: 491174 - DNA, 22 bp, Homo sapiens
gttctgagattattttaatcta

SEQ ID NO: 491175 - DNA, 18 bp, Homo sapiens
gttgacatgggacatttg

SEQ ID NO: 491176 - DNA, 19 bp, Homo sapiens
gttgacttgacagaacact

SEQ ID NO: 491177 - DNA, 17 bp, Homo sapiens
gttggctgggaactcac

SEQ ID NO: 491178 - DNA, 13 bp, Homo sapiens
gtttacagtaaat

SEQ ID NO: 491179 - DNA, 19 bp, Homo sapiens
gtttacagtaaataaattg

SEQ ID NO: 491180 - DNA, 15 bp, Homo sapiens
gtttatacctttgcc

SEQ ID NO: 491181 - DNA, 16 bp, Homo sapiens
ttggaagttgcatggc

SEQ ID NO: 491182 - DNA, 13 bp, Homo sapiens
ttggacttgagga

SEQ ID NO: 491183 - DNA, 14 bp, Homo sapiens
ttggagatcaagga

SEQ ID NO: 491184 - DNA, 16 bp, Homo sapiens
ttggagtggaggcatt

SEQ ID NO: 491185 - DNA, 17 bp, Homo sapiens
ttggatctatcacctgt

SEQ ID NO: 491186 - DNA, 13 bp, Homo sapiens
ttgggattaatat

SEQ ID NO: 491187 - DNA, 20 bp, Homo sapiens
ttggtgcgggcacaataaat

SEQ ID NO: 491188 - DNA, 13 bp, Homo sapiens
ttggtgttgacat

SEQ ID NO: 491189 - DNA, 20 bp, Homo sapiens
ttgtaaacattagttctatt

SEQ ID NO: 491190 - DNA, 21 bp, Homo sapiens
ttgtaaatgtggtaaagagtt

SEQ ID NO: 491191 - DNA, 15 bp, Homo sapiens
ttgtacagttcagtt

SEQ ID NO: 491192 - DNA, 23 bp, Homo sapiens
ttgtagtgttggagaagaactga

SEQ ID NO: 491193 - DNA, 19 bp, Homo sapiens
ttgtataaaataattttta

SEQ ID NO: 491194 - DNA, 21 bp, Homo sapiens
ttgtgaagaaacatttatctt

SEQ ID NO: 491195 - DNA, 22 bp, Homo sapiens
ttgtgaagaaacatttatcttt

SEQ ID NO: 491196 - DNA, 15 bp, Homo sapiens
ttgtgctttctatct

SEQ ID NO: 491197 - DNA, 23 bp, Homo sapiens
ttgtgtgaaaggtacttcaaatc

SEQ ID NO: 491198 - DNA, 15 bp, Homo sapiens
ttgtgtgttatttaa

SEQ ID NO: 491199 - DNA, 20 bp, Homo sapiens
ttgtgtgttatttaaatgag

SEQ ID NO: 491200 - DNA, 21 bp, Homo sapiens
ttgtgtgttatttaaatgagt

SEQ ID NO: 491201 - DNA, 23 bp, Homo sapiens
ttgttattatataattacatatt

SEQ ID NO: 491202 - DNA, 13 bp, Homo sapiens
ttgtttttccttg

SEQ ID NO: 491203 - DNA, 20 bp, Homo sapiens
tttaaaaaagaaacatttgg

SEQ ID NO: 491204 - DNA, 18 bp, Homo sapiens
tttaagaaaaacatgtca

SEQ ID NO: 491205 - DNA, 14 bp, Homo sapiens
tttaagctgtaaaa

SEQ ID NO: 491206 - DNA, 11 bp, Homo sapiens
tttaaggaaaa

SEQ ID NO: 491207 - DNA, 14 bp, Homo sapiens
tttaataatgtttc

SEQ ID NO: 491208 - DNA, 15 bp, Homo sapiens
tttaataatgtttca

SEQ ID NO: 491209 - DNA, 13 bp, Homo sapiens
tttaattaaataa

SEQ ID NO: 491210 - DNA, 20 bp, Homo sapiens
tttacagtaaataaattgtt

SEQ ID NO: 491211 - DNA, 13 bp, Homo sapiens
tttaccacttgtg

SEQ ID NO: 491212 - DNA, 19 bp, Homo sapiens
tttagaatattaaaaatta

SEQ ID NO: 491213 - DNA, 20 bp, Homo sapiens
tttagacttaatagaaacat

SEQ ID NO: 491214 - DNA, 14 bp, Homo sapiens
tttatgtctaaaga

SEQ ID NO: 491215 - DNA, 14 bp, Homo sapiens
tttcagctgtgaac

SEQ ID NO: 491216 - DNA, 16 bp, Homo sapiens
tttccaagagctgagg

SEQ ID NO: 491217 - DNA, 15 bp, Homo sapiens
tttccacagaagctc

SEQ ID NO: 491218 - DNA, 15 bp, Homo sapiens
tttccctactcccca

SEQ ID NO: 491219 - DNA, 16 bp, Homo sapiens
tttccttggctggtgc

SEQ ID NO: 491220 - DNA, 23 bp, Homo sapiens
tttctccagaaccagtgtctgaa

SEQ ID NO: 491221 - DNA, 12 bp, Homo sapiens
tttctctaggaa

SEQ ID NO: 491222 - DNA, 18 bp, Homo sapiens
tttcttacacaagagctg

SEQ ID NO: 491223 - DNA, 21 bp, Homo sapiens
tttcttacacaagagctggag

SEQ ID NO: 491224 - DNA, 13 bp, Homo sapiens
tttcttactcaaa

SEQ ID NO: 491225 - DNA, 16 bp, Homo sapiens
tttgaacaactcgaat

SEQ ID NO: 491226 - DNA, 22 bp, Homo sapiens
tttgaacaactcgaatcactca

SEQ ID NO: 491227 - DNA, 17 bp, Homo sapiens
tttgaatataaacacta

SEQ ID NO: 491228 - DNA, 18 bp, Homo sapiens
tttgaatataaacactat

SEQ ID NO: 491229 - DNA, 22 bp, Homo sapiens
tttgatatgggctttctctttg

SEQ ID NO: 491230 - DNA, 12 bp, Homo sapiens
tttgcaaggaag

SEQ ID NO: 491231 - DNA, 19 bp, Homo sapiens
tttgccaccctcatgctgt

SEQ ID NO: 491232 - DNA, 12 bp, Homo sapiens
tttgctctgcca

SEQ ID NO: 491233 - DNA, 15 bp, Homo sapiens
tttgctgattgtctg

SEQ ID NO: 491234 - DNA, 19 bp, Homo sapiens
tttgctgattgtctgaaat

SEQ ID NO: 491235 - DNA, 15 bp, Homo sapiens
tttgctttgcccagc

SEQ ID NO: 491236 - DNA, 13 bp, Homo sapiens
tttggcaggtgca

SEQ ID NO: 491237 - DNA, 17 bp, Homo sapiens
tttgggaggctgaggtg

SEQ ID NO: 491238 - DNA, 18 bp, Homo sapiens
tttggtaaggggaattga

SEQ ID NO: 491239 - DNA, 17 bp, Homo sapiens
tttgtagtgttggagaa

SEQ ID NO: 491240 - DNA, 22 bp, Homo sapiens
tttgtcgatatttccatcatta

SEQ ID NO: 491241 - DNA, 13 bp, Homo sapiens
ttttaaaaaagaa

SEQ ID NO: 491242 - DNA, 15 bp, Homo sapiens
ttttaaaagaatgat

SEQ ID NO: 491243 - DNA, 17 bp, Homo sapiens
ttttaagaaaaacatgt

SEQ ID NO: 491244 - DNA, 16 bp, Homo sapiens
ttttaataatgtttca

SEQ ID NO: 491245 - DNA, 20 bp, Homo sapiens
ttttaataatgtttcaaaca

SEQ ID NO: 491246 - DNA, 13 bp, Homo sapiens
ttttaattaaata

SEQ ID NO: 491247 - DNA, 15 bp, Homo sapiens
ttttatatgcttctg

SEQ ID NO: 491248 - DNA, 13 bp, Homo sapiens
ttttatatttgaa

SEQ ID NO: 491249 - DNA, 13 bp, Homo sapiens
ttttccagctcct

SEQ ID NO: 491250 - DNA, 13 bp, Homo sapiens
ttttcccaataaa

SEQ ID NO: 491251 - DNA, 23 bp, Homo sapiens
ttttcccgagcaaagtctaaagt

SEQ ID NO: 491252 - DNA, 13 bp, Homo sapiens
ttttctagaatac

SEQ ID NO: 491253 - DNA, 18 bp, Homo sapiens
ttttggtctggagggaag

SEQ ID NO: 491254 - DNA, 18 bp, Homo sapiens
tttttaaaaaagaaacat

SEQ ID NO: 491255 - DNA, 20 bp, Homo sapiens
tttttaaatgatgttgaata

SEQ ID NO: 491256 - DNA, 19 bp, Homo sapiens
tttttatatttgaaatatt

SEQ ID NO: 491257 - DNA, 18 bp, Homo sapiens
tttttctacttttaaaga

SEQ ID NO: 491258 - DNA, 19 bp, Homo sapiens
tttttctctaggaaatatt

SEQ ID NO: 491259 - DNA, 15 bp, Homo sapiens
tttttgtgtatttgt

SEQ ID NO: 491260 - DNA, 22 bp, Homo sapiens
tggagagaactgattgtgagct

SEQ ID NO: 491261 - DNA, 12 bp, Homo sapiens
tggagagaaggc

SEQ ID NO: 491262 - DNA, 18 bp, Homo sapiens
tggagagccagaacctgg

SEQ ID NO: 491263 - DNA, 20 bp, Homo sapiens
tggagagccagaacctggag

SEQ ID NO: 491264 - DNA, 18 bp, Homo sapiens
tggagagctagaacctgg

SEQ ID NO: 491265 - DNA, 21 bp, Homo sapiens
tggagagctagaacctggaga

SEQ ID NO: 491266 - DNA, 13 bp, Homo sapiens
tggagagctggag

SEQ ID NO: 491267 - DNA, 15 bp, Homo sapiens
tggagagctggagcc

SEQ ID NO: 491268 - DNA, 17 bp, Homo sapiens
tggagagctggagcctg

SEQ ID NO: 491269 - DNA, 15 bp, Homo sapiens
tggagctgcctgata

SEQ ID NO: 491270 - DNA, 14 bp, Homo sapiens
tggaggagcaaagg

SEQ ID NO: 491271 - DNA, 16 bp, Homo sapiens
tggaggagcaaaggct

SEQ ID NO: 491272 - DNA, 19 bp, Homo sapiens
tggaggagctcaggacact

SEQ ID NO: 491273 - DNA, 20 bp, Homo sapiens
tggaggagctcaggacacta

SEQ ID NO: 491274 - DNA, 22 bp, Homo sapiens
tggaggagctcaggacactaat

SEQ ID NO: 491275 - DNA, 23 bp, Homo sapiens
tggaggaggcctgggggcaggga

SEQ ID NO: 491276 - DNA, 13 bp, Homo sapiens
tggaggcattgtt

SEQ ID NO: 491277 - DNA, 21 bp, Homo sapiens
tggagggctagaacctggaga

SEQ ID NO: 491278 - DNA, 22 bp, Homo sapiens
tggagggctagaatctggagag

SEQ ID NO: 491279 - DNA, 17 bp, Homo sapiens
tggagtcatgtgcctct

SEQ ID NO: 491280 - DNA, 22 bp, Homo sapiens
tggagtcatgtgcctctgtcct

SEQ ID NO: 491281 - DNA, 15 bp, Homo sapiens
tggagtggaggcatt

SEQ ID NO: 491282 - DNA, 16 bp, Homo sapiens
tggagtggaggcattg

SEQ ID NO: 491283 - DNA, 19 bp, Homo sapiens
tggagtggaggcattgttt

SEQ ID NO: 491284 - DNA, 20 bp, Homo sapiens
tggattggagatagggaaag

SEQ ID NO: 491285 - DNA, 21 bp, Homo sapiens
tggattggagatagggaaaga

SEQ ID NO: 491286 - DNA, 14 bp, Homo sapiens
tggcaaaagacatc

SEQ ID NO: 491287 - DNA, 14 bp, Homo sapiens
tggcaaggctgtgc

SEQ ID NO: 491288 - DNA, 20 bp, Homo sapiens
tggcaaggctgtgctccctg

SEQ ID NO: 491289 - DNA, 18 bp, Homo sapiens
tggcacagcccaaagaag

SEQ ID NO: 491290 - DNA, 20 bp, Homo sapiens
tggcacagcccaaagaagga

SEQ ID NO: 491291 - DNA, 14 bp, Homo sapiens
tggcagagccaggc

SEQ ID NO: 491292 - DNA, 22 bp, Homo sapiens
tggcagagcttggactggatgc

SEQ ID NO: 491293 - DNA, 16 bp, Homo sapiens
tggcatattgataata

SEQ ID NO: 491294 - DNA, 15 bp, Homo sapiens
tggcatctcccacac

SEQ ID NO: 491295 - DNA, 23 bp, Homo sapiens
tggccagggcctggaagacagag

SEQ ID NO: 491296 - DNA, 16 bp, Homo sapiens
tggccatctctggatg

SEQ ID NO: 491297 - DNA, 21 bp, Homo sapiens
tggccctcccagtacctcctg

SEQ ID NO: 491298 - DNA, 19 bp, Homo sapiens
tggccgttgatgttggctg

SEQ ID NO: 491299 - DNA, 21 bp, Homo sapiens
tggccgttgatgttggctggg

SEQ ID NO: 491300 - DNA, 22 bp, Homo sapiens
tggccgttgatgttggctggga

SEQ ID NO: 491301 - DNA, 18 bp, Homo sapiens
tggcctctctgacatatg

SEQ ID NO: 491302 - DNA, 17 bp, Homo sapiens
tggcctgggcctcctca

SEQ ID NO: 491303 - DNA, 23 bp, Homo sapiens
tggcctgttttagaaggttctct

SEQ ID NO: 491304 - DNA, 22 bp, Homo sapiens
tggctagggttccactggagaa

SEQ ID NO: 491305 - DNA, 12 bp, Homo sapiens
tggctgcatgcg

SEQ ID NO: 491306 - DNA, 12 bp, Homo sapiens
tggctgtgagga

SEQ ID NO: 491307 - DNA, 16 bp, Homo sapiens
tggcttcctggcaata

SEQ ID NO: 491308 - DNA, 21 bp, Homo sapiens
tggcttctgcttgtcatccac

SEQ ID NO: 491309 - DNA, 21 bp, Homo sapiens
tgggacagtcacctcatggaa

SEQ ID NO: 491310 - DNA, 20 bp, Homo sapiens
tgggacatttgctcatggaa

SEQ ID NO: 491311 - DNA, 15 bp, Homo sapiens
tgggactgatgtcat

SEQ ID NO: 491312 - DNA, 16 bp, Homo sapiens
tgggactgatgtcatc

SEQ ID NO: 491313 - DNA, 19 bp, Homo sapiens
tgggactgatgtcatcttg

SEQ ID NO: 491314 - DNA, 21 bp, Homo sapiens
tgggactgatgtcatcttgag

SEQ ID NO: 491315 - DNA, 20 bp, Homo sapiens
tgggaggcagaggttgcagt

SEQ ID NO: 491316 - DNA, 17 bp, Homo sapiens
tgggaggccgaggcacg

SEQ ID NO: 491317 - DNA, 16 bp, Homo sapiens
tgggcaacagagcaag

SEQ ID NO: 491318 - DNA, 22 bp, Homo sapiens
tgggcaccacctctgtgggcac

SEQ ID NO: 491319 - DNA, 12 bp, Homo sapiens
tgggcagctgcc

SEQ ID NO: 491320 - DNA, 17 bp, Homo sapiens
tgggcagctgcctcccc

SEQ ID NO: 491321 - DNA, 20 bp, Homo sapiens
tgggcagctgcctcccctcc

SEQ ID NO: 491322 - DNA, 23 bp, Homo sapiens
tgggcagctgcctcccctcctct

SEQ ID NO: 491323 - DNA, 21 bp, Homo sapiens
tgggcaggactcagctcccca

SEQ ID NO: 491324 - DNA, 22 bp, Homo sapiens
tgggcaggactcagctccccag

SEQ ID NO: 491325 - DNA, 17 bp, Homo sapiens
tgggcgcagtggctcac

SEQ ID NO: 491326 - DNA, 18 bp, Homo sapiens
tgggctggaacagattca

SEQ ID NO: 491327 - DNA, 23 bp, Homo sapiens
tgggcttcccagtggctgctgcc

SEQ ID NO: 491328 - DNA, 16 bp, Homo sapiens
tggggaagactgtggc

SEQ ID NO: 491329 - DNA, 17 bp, Homo sapiens
tggggaagactgtggct

SEQ ID NO: 491330 - DNA, 15 bp, Homo sapiens
tgggggaaagcacag

SEQ ID NO: 491331 - DNA, 17 bp, Homo sapiens
tgggtagacacacatga

SEQ ID NO: 491332 - DNA, 23 bp, Homo sapiens
tgggtcagtgtccaaagcagggt

SEQ ID NO: 491333 - DNA, 20 bp, Homo sapiens
tgggtccaggcctggccatg

SEQ ID NO: 491334 - DNA, 15 bp, Homo sapiens
tgggtggcactgcca

SEQ ID NO: 491335 - DNA, 18 bp, Homo sapiens
tgggttagggaaaacatt

SEQ ID NO: 491336 - DNA, 15 bp, Homo sapiens
tgggttcaaaaagaa

SEQ ID NO: 491337 - DNA, 16 bp, Homo sapiens
tggtattcctgcctcc

SEQ ID NO: 491338 - DNA, 16 bp, Homo sapiens
tggtctctaggctggg

SEQ ID NO: 491339 - DNA, 21 bp, Homo sapiens
tggtctgtttccaggtcagaa

SEQ ID NO: 491340 - DNA, 19 bp, Homo sapiens
tggtgcgggcacaataaat

SEQ ID NO: 491341 - DNA, 13 bp, Homo sapiens
tggttctgtgcca

SEQ ID NO: 491342 - DNA, 17 bp, Homo sapiens
tggttgcacgttaaaaa

SEQ ID NO: 491343 - DNA, 16 bp, Homo sapiens
tggttggagagctaga

SEQ ID NO: 491344 - DNA, 15 bp, Homo sapiens
tggtttgcaaggaag

SEQ ID NO: 491345 - DNA, 17 bp, Homo sapiens
tggtttgcaaggaagcc

SEQ ID NO: 491346 - DNA, 19 bp, Homo sapiens
tggtttggccatctctgga

SEQ ID NO: 491347 - DNA, 21 bp, Homo sapiens
tgtaaatactgtttttaacaa

SEQ ID NO: 491348 - DNA, 16 bp, Homo sapiens
tgtaactgggttcaaa

SEQ ID NO: 491349 - DNA, 15 bp, Homo sapiens
tgtaagaatcattgt

SEQ ID NO: 491350 - DNA, 19 bp, Homo sapiens
tgtaagtttatgtctaaag

SEQ ID NO: 491351 - DNA, 13 bp, Homo sapiens
tgtaataatgtga

SEQ ID NO: 491352 - DNA, 20 bp, Homo sapiens
tgtacagttcagttcctctt

SEQ ID NO: 491353 - DNA, 17 bp, Homo sapiens
tgtagcaaattccaata

SEQ ID NO: 491354 - DNA, 23 bp, Homo sapiens
tgtagcaaattccaatacattat

SEQ ID NO: 491355 - DNA, 20 bp, Homo sapiens
tgtagcatattttctccgaa

SEQ ID NO: 491356 - DNA, 17 bp, Homo sapiens
tgtaggttgtctaaaaa

SEQ ID NO: 491357 - DNA, 14 bp, Homo sapiens
tgtagtgttggaga

SEQ ID NO: 491358 - DNA, 15 bp, Homo sapiens
tgtagtgttggagaa

SEQ ID NO: 491359 - DNA, 17 bp, Homo sapiens
tgtagtgttggagaaga

SEQ ID NO: 491360 - DNA, 21 bp, Homo sapiens
tgtagtgttggagaagaactg

SEQ ID NO: 491361 - DNA, 16 bp, Homo sapiens
tgtagttttacttggt

SEQ ID NO: 491362 - DNA, 17 bp, Homo sapiens
tgtagttttacttggtg

SEQ ID NO: 491363 - DNA, 16 bp, Homo sapiens
tgtatgattcccagcc

SEQ ID NO: 491364 - DNA, 15 bp, Homo sapiens
tgtatggttctgtgc

SEQ ID NO: 491365 - DNA, 23 bp, Homo sapiens
tgtcaaaaatgtcttgggtaggc

SEQ ID NO: 491366 - DNA, 20 bp, Homo sapiens
tgtcaatcagcctagttgat

SEQ ID NO: 491367 - DNA, 16 bp, Homo sapiens
tgtcacgattgtcatc

SEQ ID NO: 491368 - DNA, 15 bp, Homo sapiens
tgtcagggccaggtg

SEQ ID NO: 491369 - DNA, 13 bp, Homo sapiens
tgtcatctcagct

SEQ ID NO: 491370 - DNA, 12 bp, Homo sapiens
tgtccaaagcag

SEQ ID NO: 491371 - DNA, 15 bp, Homo sapiens
tgtccacacccagct

SEQ ID NO: 491372 - DNA, 19 bp, Homo sapiens
tgtccagggccctgagctc

SEQ ID NO: 491373 - DNA, 15 bp, Homo sapiens
tgtccccttccaggg

SEQ ID NO: 491374 - DNA, 22 bp, Homo sapiens
tgtccctaatttaacccagctc

SEQ ID NO: 491375 - DNA, 19 bp, Homo sapiens
tgtcgatatttccatcatt

SEQ ID NO: 491376 - DNA, 13 bp, Homo sapiens
tgtctgaaatttt

SEQ ID NO: 491377 - DNA, 15 bp, Homo sapiens
tgtctgaaattttct

SEQ ID NO: 491378 - DNA, 16 bp, Homo sapiens
tgtctgccagccagca

SEQ ID NO: 491379 - DNA, 14 bp, Homo sapiens
tgtgaacatggact

SEQ ID NO: 491380 - DNA, 20 bp, Homo sapiens
tgtgaagaaacatttatctt

SEQ ID NO: 491381 - DNA, 22 bp, Homo sapiens
tgtgagagagttgctcctcagg

SEQ ID NO: 491382 - DNA, 16 bp, Homo sapiens
tgtgatgaggcagagg

SEQ ID NO: 491383 - DNA, 20 bp, Homo sapiens
tgtgattcctttgaagagga

SEQ ID NO: 491384 - DNA, 15 bp, Homo sapiens
tgtgatttatttgga

SEQ ID NO: 491385 - DNA, 16 bp, Homo sapiens
tgtgcctctgtcctta

SEQ ID NO: 491386 - DNA, 20 bp, Homo sapiens
tgtgcctgggtggacatggc

SEQ ID NO: 491387 - DNA, 19 bp, Homo sapiens
tgtgctagtaattggaaag

SEQ ID NO: 491388 - DNA, 22 bp, Homo sapiens
tgtgctttctatctaattttta

SEQ ID NO: 491389 - DNA, 22 bp, Homo sapiens
tgtggagatgcccaggatttga

SEQ ID NO: 491390 - DNA, 14 bp, Homo sapiens
tgtggctgctagca

SEQ ID NO: 491391 - DNA, 14 bp, Homo sapiens
tgtggttaatgcca

SEQ ID NO: 491392 - DNA, 20 bp, Homo sapiens
tgtgtgaaaggtacttcaaa

SEQ ID NO: 491393 - DNA, 14 bp, Homo sapiens
tgtgttatttaaat

SEQ ID NO: 491394 - DNA, 16 bp, Homo sapiens
tgtgttatttaaatga

SEQ ID NO: 491395 - DNA, 19 bp, Homo sapiens
tgtgttttgcaagccagat

SEQ ID NO: 491396 - DNA, 22 bp, Homo sapiens
tgttagaggatccctctctgga

SEQ ID NO: 491397 - DNA, 14 bp, Homo sapiens
tgttagtgcaaatt

SEQ ID NO: 491398 - DNA, 15 bp, Homo sapiens
tgttataatctttca

SEQ ID NO: 491399 - DNA, 15 bp, Homo sapiens
tgttatttaaatgag

SEQ ID NO: 491400 - DNA, 16 bp, Homo sapiens
tgttcaccatcggcag

SEQ ID NO: 491401 - DNA, 18 bp, Homo sapiens
tgttctcattcctgttct

SEQ ID NO: 491402 - DNA, 19 bp, Homo sapiens
tgttctcattcctgttctt

SEQ ID NO: 491403 - DNA, 22 bp, Homo sapiens
tgttctcattcctgttctttct

SEQ ID NO: 491404 - DNA, 20 bp, Homo sapiens
tgttgacatgggacatttgc

SEQ ID NO: 491405 - DNA, 15 bp, Homo sapiens
tgttgagaggctgag

SEQ ID NO: 491406 - DNA, 14 bp, Homo sapiens
tgttgccaggcagg

SEQ ID NO: 491407 - DNA, 19 bp, Homo sapiens
tgttggagaagaactgaaa

SEQ ID NO: 491408 - DNA, 16 bp, Homo sapiens
tgtttatacctttgcc

SEQ ID NO: 491409 - DNA, 21 bp, Homo sapiens
tgtttatgttgcaatctggtt

SEQ ID NO: 491410 - DNA, 13 bp, Homo sapiens
tgtttcaaacata

SEQ ID NO: 491411 - DNA, 13 bp, Homo sapiens
tgttttataattt

SEQ ID NO: 491412 - DNA, 20 bp, Homo sapiens
tgttttataattttgtgaag

SEQ ID NO: 491413 - DNA, 18 bp, Homo sapiens
tgtttttaagaaaaacat

SEQ ID NO: 491414 - DNA, 20 bp, Homo sapiens
tgtttttccttgtatttaaa

SEQ ID NO: 491415 - DNA, 19 bp, Homo sapiens
ttaaaagaatgattatgaa

SEQ ID NO: 491416 - DNA, 12 bp, Homo sapiens
ttaaaagcatac

SEQ ID NO: 491417 - DNA, 21 bp, Homo sapiens
ttaaatatgttagcaaagagt

SEQ ID NO: 491418 - DNA, 19 bp, Homo sapiens
ttaactattttattttcta

SEQ ID NO: 491419 - DNA, 17 bp, Homo sapiens
ttaagaaaaacatgtca

SEQ ID NO: 491420 - DNA, 14 bp, Homo sapiens
ttaagaaacactga

SEQ ID NO: 491421 - DNA, 16 bp, Homo sapiens
ttaataatgtttcaaa

SEQ ID NO: 491422 - DNA, 18 bp, Homo sapiens
ttaataatgtttcaaaca

SEQ ID NO: 491423 - DNA, 15 bp, Homo sapiens
ttaatgtagataaag

SEQ ID NO: 491424 - DNA, 23 bp, Homo sapiens
ttaattctttatcacatgttgtc

SEQ ID NO: 491425 - DNA, 16 bp, Homo sapiens
ttacacaagagctgga

SEQ ID NO: 491426 - DNA, 13 bp, Homo sapiens
ttacagtaaataa

SEQ ID NO: 491427 - DNA, 14 bp, Homo sapiens
ttacatttgtataa

SEQ ID NO: 491428 - DNA, 21 bp, Homo sapiens
ttaccacttgtgttttgcaag

SEQ ID NO: 491429 - DNA, 21 bp, Homo sapiens
ttactatcatgtcaaacgtga

SEQ ID NO: 491430 - DNA, 14 bp, Homo sapiens
ttagaataaaattg

SEQ ID NO: 491431 - DNA, 12 bp, Homo sapiens
ttagacctcagc

SEQ ID NO: 491432 - DNA, 14 bp, Homo sapiens
ttagacctcagcct

SEQ ID NO: 491433 - DNA, 21 bp, Homo sapiens
ttagatgcagttctgaagaag

SEQ ID NO: 491434 - DNA, 19 bp, Homo sapiens
ttagcaaagagttaatata

SEQ ID NO: 491435 - DNA, 16 bp, Homo sapiens
ttagcttagacctcag

SEQ ID NO: 491436 - DNA, 17 bp, Homo sapiens
ttagcttagacctcagc

SEQ ID NO: 491437 - DNA, 18 bp, Homo sapiens
ttaggcagggatttgagg

SEQ ID NO: 491438 - DNA, 12 bp, Homo sapiens
ttagggaggggt

SEQ ID NO: 491439 - DNA, 11 bp, Homo sapiens
ttataatcttt

SEQ ID NO: 491440 - DNA, 14 bp, Homo sapiens
ttataattttgtga

SEQ ID NO: 491441 - DNA, 15 bp, Homo sapiens
ttataattttgtgaa

SEQ ID NO: 491442 - DNA, 19 bp, Homo sapiens
ttataggtggcctctcctt

SEQ ID NO: 491443 - DNA, 20 bp, Homo sapiens
ttatatttattactgtaaga

SEQ ID NO: 491444 - DNA, 19 bp, Homo sapiens
ttatcaattacaacagtga

SEQ ID NO: 491445 - DNA, 16 bp, Homo sapiens
ttatctcacttgtgcc

SEQ ID NO: 491446 - DNA, 17 bp, Homo sapiens
ttatgggaatcaagatt

SEQ ID NO: 491447 - DNA, 16 bp, Homo sapiens
ttatgtaataatgtga

SEQ ID NO: 491448 - DNA, 16 bp, Homo sapiens
ttattactgtaagaaa

SEQ ID NO: 491449 - DNA, 12 bp, Homo sapiens
ttatttccatat

SEQ ID NO: 491450 - DNA, 22 bp, Homo sapiens
ttatttccatattaaaatcaca

SEQ ID NO: 491451 - DNA, 19 bp, Homo sapiens
ttatttcttaaacaaatgt

SEQ ID NO: 491452 - DNA, 15 bp, Homo sapiens
ttatttgcagagaca

SEQ ID NO: 491453 - DNA, 17 bp, Homo sapiens
ttattttaataatgttt

SEQ ID NO: 491454 - DNA, 20 bp, Homo sapiens
ttattttaataatgtttcaa

SEQ ID NO: 491455 - DNA, 14 bp, Homo sapiens
ttcaaacatatata

SEQ ID NO: 491456 - DNA, 21 bp, Homo sapiens
ttcaagtactgtaactgtgtc

SEQ ID NO: 491457 - DNA, 17 bp, Homo sapiens
ttcaagttaaattttat

SEQ ID NO: 491458 - DNA, 22 bp, Homo sapiens
ttcaataaaccacaagcatctc

SEQ ID NO: 491459 - DNA, 22 bp, Homo sapiens
ttcaatggtttgcaaggaagcc

SEQ ID NO: 491460 - DNA, 17 bp, Homo sapiens
ttcaattcaacactccc

SEQ ID NO: 491461 - DNA, 21 bp, Homo sapiens
ttcacacacaggcaactgagg

SEQ ID NO: 491462 - DNA, 14 bp, Homo sapiens
ttcacacagacaag

SEQ ID NO: 491463 - DNA, 20 bp, Homo sapiens
ttcacctttcccactttctt

SEQ ID NO: 491464 - DNA, 15 bp, Homo sapiens
ttcagaatcacttct

SEQ ID NO: 491465 - DNA, 21 bp, Homo sapiens
ttcagaatcacttctgagaac

SEQ ID NO: 491466 - DNA, 15 bp, Homo sapiens
ttcagagactcaggg

SEQ ID NO: 491467 - DNA, 22 bp, Homo sapiens
ttcagagctgccctctcctggg

SEQ ID NO: 491468 - DNA, 23 bp, Homo sapiens
ttcagagctgccctctcctgggc

SEQ ID NO: 491469 - DNA, 23 bp, Homo sapiens
ttcagcctagccgacctcagcct

SEQ ID NO: 491470 - DNA, 17 bp, Homo sapiens
ttcagcggtttatataa

SEQ ID NO: 491471 - DNA, 13 bp, Homo sapiens
ttcagctcactgt

SEQ ID NO: 491472 - DNA, 17 bp, Homo sapiens
ttcagttcctctttgca

SEQ ID NO: 491473 - DNA, 14 bp, Homo sapiens
ttcatcaagactgg

SEQ ID NO: 491474 - DNA, 13 bp, Homo sapiens
ttcatgcatggaa

SEQ ID NO: 491475 - DNA, 15 bp, Homo sapiens
ttcatgcatggaaat

SEQ ID NO: 491476 - DNA, 16 bp, Homo sapiens
ttcatgcatggaaatt

SEQ ID NO: 491477 - DNA, 16 bp, Homo sapiens
ttcatgcctggcttcg

SEQ ID NO: 491478 - DNA, 14 bp, Homo sapiens
ttcattccatttgc

SEQ ID NO: 491479 - DNA, 23 bp, Homo sapiens
ttccaaaggccatggagagctgg

SEQ ID NO: 491480 - DNA, 18 bp, Homo sapiens
ttccacaccaagcagcaa

SEQ ID NO: 491481 - DNA, 18 bp, Homo sapiens
ttccagatcctggaaatc

SEQ ID NO: 491482 - DNA, 13 bp, Homo sapiens
ttccagtcatggc

SEQ ID NO: 491483 - DNA, 24 bp, Homo sapiens
ttccatgaaaatgcaacaacatgt

SEQ ID NO: 491484 - DNA, 20 bp, Homo sapiens
ttcccaggatgagcatccca

SEQ ID NO: 491485 - DNA, 15 bp, Homo sapiens
ttcccagtggctgct

SEQ ID NO: 491486 - DNA, 17 bp, Homo sapiens
ttcccagtggctgctgc

SEQ ID NO: 491487 - DNA, 19 bp, Homo sapiens
ttcccagtggctgctgccc

SEQ ID NO: 491488 - DNA, 21 bp, Homo sapiens
ttcccagtggctgctgcccag

SEQ ID NO: 491489 - DNA, 19 bp, Homo sapiens
ttcccatgacccaggctgg

SEQ ID NO: 491490 - DNA, 17 bp, Homo sapiens
ttccctgcttaatgaaa

SEQ ID NO: 491491 - DNA, 15 bp, Homo sapiens
ttcccttcatctgga

SEQ ID NO: 491492 - DNA, 17 bp, Homo sapiens
ttcccttgatgaagaag

SEQ ID NO: 491493 - DNA, 12 bp, Homo sapiens
ttcctatatgca

SEQ ID NO: 491494 - DNA, 15 bp, Homo sapiens
ttcctctttgcatga

SEQ ID NO: 491495 - DNA, 21 bp, Homo sapiens
ttcctgatggcaggatggcct

SEQ ID NO: 491496 - DNA, 19 bp, Homo sapiens
ttccttgcctgcacaaact

SEQ ID NO: 491497 - DNA, 15 bp, Homo sapiens
ttcctttgaagagga

SEQ ID NO: 491498 - DNA, 19 bp, Homo sapiens
ttctaaaatataatcaacc

SEQ ID NO: 491499 - DNA, 20 bp, Homo sapiens
ttctactaaaaatacaaaaa

SEQ ID NO: 491500 - DNA, 18 bp, Homo sapiens
ttctagaatactaataaa

SEQ ID NO: 491501 - DNA, 19 bp, Homo sapiens
ttctagaatactaataaaa

SEQ ID NO: 491502 - DNA, 23 bp, Homo sapiens
ttctaggtggcaaggctgtgctc

SEQ ID NO: 491503 - DNA, 14 bp, Homo sapiens
ttctatgaaatatt

SEQ ID NO: 491504 - DNA, 15 bp, Homo sapiens
ttctcaaagctggga

SEQ ID NO: 491505 - DNA, 18 bp, Homo sapiens
ttctcaactccaaactga

SEQ ID NO: 491506 - DNA, 17 bp, Homo sapiens
ttctcagggtctctgct

SEQ ID NO: 491507 - DNA, 19 bp, Homo sapiens
ttctcagggtctctgctgc

SEQ ID NO: 491508 - DNA, 21 bp, Homo sapiens
ttctcagggtctctgctgccg

SEQ ID NO: 491509 - DNA, 12 bp, Homo sapiens
ttctgaagaaga

SEQ ID NO: 491510 - DNA, 17 bp, Homo sapiens
ttcttaaacaaatgtat

SEQ ID NO: 491511 - DNA, 15 bp, Homo sapiens
ttcttacaaacatgt

SEQ ID NO: 491512 - DNA, 12 bp, Homo sapiens
ttcttacaagga

SEQ ID NO: 491513 - DNA, 16 bp, Homo sapiens
ttcttggttggctggc

SEQ ID NO: 491514 - DNA, 12 bp, Homo sapiens
ttgaacctggga

SEQ ID NO: 491515 - DNA, 15 bp, Homo sapiens
ttgaagacactgaaa

SEQ ID NO: 491516 - DNA, 13 bp, Homo sapiens
ttgacatgggaca

SEQ ID NO: 491517 - DNA, 20 bp, Homo sapiens
ttgagaaacaaataatttgt

SEQ ID NO: 491518 - DNA, 16 bp, Homo sapiens
ttgagagaccaggcaa

SEQ ID NO: 491519 - DNA, 17 bp, Homo sapiens
ttgagagaccaggcaaa

SEQ ID NO: 491520 - DNA, 22 bp, Homo sapiens
ttgagccctcctggaatggagc

SEQ ID NO: 491521 - DNA, 12 bp, Homo sapiens
ttgaggaggaag

SEQ ID NO: 491522 - DNA, 15 bp, Homo sapiens
ttgaggattttgagt

SEQ ID NO: 491523 - DNA, 18 bp, Homo sapiens
ttgagttttcttctgtga

SEQ ID NO: 491524 - DNA, 22 bp, Homo sapiens
ttgataagagggcacacactgt

SEQ ID NO: 491525 - DNA, 18 bp, Homo sapiens
ttgataataaaattcatt

SEQ ID NO: 491526 - DNA, 18 bp, Homo sapiens
ttgatataaataaaacat

SEQ ID NO: 491527 - DNA, 21 bp, Homo sapiens
ttgatataatttccatagtgt

SEQ ID NO: 491528 - DNA, 22 bp, Homo sapiens
ttgatatagaacagtgcttgcc

SEQ ID NO: 491529 - DNA, 23 bp, Homo sapiens
ttgatgaagaagttgatatgcct

SEQ ID NO: 491530 - DNA, 13 bp, Homo sapiens
ttgatgttggctg

SEQ ID NO: 491531 - DNA, 14 bp, Homo sapiens
ttgcaagaatcagt

SEQ ID NO: 491532 - DNA, 19 bp, Homo sapiens
ttgcagagacaggacctga

SEQ ID NO: 491533 - DNA, 18 bp, Homo sapiens
ttgcatgaccacatagaa

SEQ ID NO: 491534 - DNA, 13 bp, Homo sapiens
ttgccaccctcat

SEQ ID NO: 491535 - DNA, 16 bp, Homo sapiens
ttgccaccctcatgct

SEQ ID NO: 491536 - DNA, 13 bp, Homo sapiens
ttgccatccctcc

SEQ ID NO: 491537 - DNA, 23 bp, Homo sapiens
ttgccatccctccctccacctcc

SEQ ID NO: 491538 - DNA, 20 bp, Homo sapiens
ttgcccagggctcagcctgg

SEQ ID NO: 491539 - DNA, 21 bp, Homo sapiens
ttgcgtggaattgtgctgagt

SEQ ID NO: 491540 - DNA, 15 bp, Homo sapiens
ttgctcacagctgta

SEQ ID NO: 491541 - DNA, 12 bp, Homo sapiens
ttgctcatggaa

SEQ ID NO: 491542 - DNA, 15 bp, Homo sapiens
ttggaaaataaatca

SEQ ID NO: 491543 - DNA, 12 bp, Homo sapiens
tcaggagaaaaa

SEQ ID NO: 491544 - DNA, 21 bp, Homo sapiens
tcaggagcagcctcagaacaa

SEQ ID NO: 491545 - DNA, 16 bp, Homo sapiens
tcaggaggaaggctta

SEQ ID NO: 491546 - DNA, 21 bp, Homo sapiens
tcaggccatcatcagtggagc

SEQ ID NO: 491547 - DNA, 22 bp, Homo sapiens
tcaggccatcatcagtggagcc

SEQ ID NO: 491548 - DNA, 13 bp, Homo sapiens
tcaggctagatgt

SEQ ID NO: 491549 - DNA, 17 bp, Homo sapiens
tcaggctagatgtatgt

SEQ ID NO: 491550 - DNA, 17 bp, Homo sapiens
tcagggccaggtgcaga

SEQ ID NO: 491551 - DNA, 20 bp, Homo sapiens
tcagggccaggtgcagacct

SEQ ID NO: 491552 - DNA, 23 bp, Homo sapiens
tcagggccaggtgcagaccttgg

SEQ ID NO: 491553 - DNA, 16 bp, Homo sapiens
tcagggccccagcact

SEQ ID NO: 491554 - DNA, 23 bp, Homo sapiens
tcagggccccagcactaaagcag

SEQ ID NO: 491555 - DNA, 16 bp, Homo sapiens
tcagggtctctgctgc

SEQ ID NO: 491556 - DNA, 13 bp, Homo sapiens
tcagtaagacgac

SEQ ID NO: 491557 - DNA, 12 bp, Homo sapiens
tcagtggagcca

SEQ ID NO: 491558 - DNA, 18 bp, Homo sapiens
tcagttagagctgacaca

SEQ ID NO: 491559 - DNA, 22 bp, Homo sapiens
tcagttagagctgacacaaacc

SEQ ID NO: 491560 - DNA, 17 bp, Homo sapiens
tcagttcctctttgcat

SEQ ID NO: 491561 - DNA, 17 bp, Homo sapiens
tcagttctgccttatct

SEQ ID NO: 491562 - DNA, 16 bp, Homo sapiens
tcataagcgatcactt

SEQ ID NO: 491563 - DNA, 15 bp, Homo sapiens
tcatactgaagatgc

SEQ ID NO: 491564 - DNA, 20 bp, Homo sapiens
tcatatgacattcatgcctg

SEQ ID NO: 491565 - DNA, 20 bp, Homo sapiens
tcatatgggatactgctggt

SEQ ID NO: 491566 - DNA, 23 bp, Homo sapiens
tcatcaaatggaagacacattga

SEQ ID NO: 491567 - DNA, 17 bp, Homo sapiens
tcatcaaccctaaaaag

SEQ ID NO: 491568 - DNA, 11 bp, Homo sapiens
tcatcaagact

SEQ ID NO: 491569 - DNA, 19 bp, Homo sapiens
tcatcaagactggaaggtg

SEQ ID NO: 491570 - DNA, 15 bp, Homo sapiens
tcatcaaggcactgc

SEQ ID NO: 491571 - DNA, 16 bp, Homo sapiens
tcatcaaggcactgcc

SEQ ID NO: 491572 - DNA, 15 bp, Homo sapiens
tcatcagtggagcca

SEQ ID NO: 491573 - DNA, 14 bp, Homo sapiens
tcatccgcctgtgg

SEQ ID NO: 491574 - DNA, 15 bp, Homo sapiens
tcatccgcctgtggg

SEQ ID NO: 491575 - DNA, 16 bp, Homo sapiens
tcatgaattagtttta

SEQ ID NO: 491576 - DNA, 22 bp, Homo sapiens
tcatgaattagttttatatgct

SEQ ID NO: 491577 - DNA, 17 bp, Homo sapiens
tcatgacttttccatgt

SEQ ID NO: 491578 - DNA, 18 bp, Homo sapiens
tcatgacttttccatgta

SEQ ID NO: 491579 - DNA, 15 bp, Homo sapiens
tcatgcatggaaatt

SEQ ID NO: 491580 - DNA, 21 bp, Homo sapiens
tcatggaattggagctcgtgg

SEQ ID NO: 491581 - DNA, 17 bp, Homo sapiens
tcatgtaggttgtctaa

SEQ ID NO: 491582 - DNA, 21 bp, Homo sapiens
tcatgttttaaagcttgctca

SEQ ID NO: 491583 - DNA, 12 bp, Homo sapiens
tcattagagcag

SEQ ID NO: 491584 - DNA, 13 bp, Homo sapiens
tcattagagcagg

SEQ ID NO: 491585 - DNA, 22 bp, Homo sapiens
tcattataatgtcattaaacat

SEQ ID NO: 491586 - DNA, 15 bp, Homo sapiens
tcatttcaggagcag

SEQ ID NO: 491587 - DNA, 18 bp, Homo sapiens
tcatttgaggccaggagt

SEQ ID NO: 491588 - DNA, 23 bp, Homo sapiens
tccaaaggccatggagagctgga

SEQ ID NO: 491589 - DNA, 15 bp, Homo sapiens
tccaacccggggacc

SEQ ID NO: 491590 - DNA, 12 bp, Homo sapiens
tccaagagctga

SEQ ID NO: 491591 - DNA, 17 bp, Homo sapiens
tccaagagtctgatgat

SEQ ID NO: 491592 - DNA, 20 bp, Homo sapiens
tccaagcatttagatgtata

SEQ ID NO: 491593 - DNA, 12 bp, Homo sapiens
tccaagcttttg

SEQ ID NO: 491594 - DNA, 16 bp, Homo sapiens
tccacacaacaccagg

SEQ ID NO: 491595 - DNA, 19 bp, Homo sapiens
tccacacaacaccaggact

SEQ ID NO: 491596 - DNA, 20 bp, Homo sapiens
tccacacaacaccaggactt

SEQ ID NO: 491597 - DNA, 17 bp, Homo sapiens
tccacaccaagcagcaa

SEQ ID NO: 491598 - DNA, 15 bp, Homo sapiens
tccagccagggctgc

SEQ ID NO: 491599 - DNA, 17 bp, Homo sapiens
tccagcctctgccgctg

SEQ ID NO: 491600 - DNA, 19 bp, Homo sapiens
tccagctgggttggaaaac

SEQ ID NO: 491601 - DNA, 14 bp, Homo sapiens
tccaggcaggctaa

SEQ ID NO: 491602 - DNA, 13 bp, Homo sapiens
tccagggctctga

SEQ ID NO: 491603 - DNA, 19 bp, Homo sapiens
tccaggggtcaccttgaga

SEQ ID NO: 491604 - DNA, 16 bp, Homo sapiens
tccagtccaaggaaac

SEQ ID NO: 491605 - DNA, 18 bp, Homo sapiens
tccagtgcaacactgaag

SEQ ID NO: 491606 - DNA, 12 bp, Homo sapiens
tccataatcact

SEQ ID NO: 491607 - DNA, 15 bp, Homo sapiens
tccatacatttgtgt

SEQ ID NO: 491608 - DNA, 18 bp, Homo sapiens
tccatctttcctgatggc

SEQ ID NO: 491609 - DNA, 15 bp, Homo sapiens
tccatgaaaatgcaa

SEQ ID NO: 491610 - DNA, 15 bp, Homo sapiens
tccatgatgctggga

SEQ ID NO: 491611 - DNA, 17 bp, Homo sapiens
tccatgctataaaaact

SEQ ID NO: 491612 - DNA, 13 bp, Homo sapiens
tccattctggaag

SEQ ID NO: 491613 - DNA, 14 bp, Homo sapiens
tccattctggaagt

SEQ ID NO: 491614 - DNA, 19 bp, Homo sapiens
tccatttgctgattgtctg

SEQ ID NO: 491615 - DNA, 21 bp, Homo sapiens
tcccaaactaagctatgtgaa

SEQ ID NO: 491616 - DNA, 21 bp, Homo sapiens
tcccaagggatggtgccctgt

SEQ ID NO: 491617 - DNA, 17 bp, Homo sapiens
tcccacacaagacccaa

SEQ ID NO: 491618 - DNA, 12 bp, Homo sapiens
tcccactttctt

SEQ ID NO: 491619 - DNA, 20 bp, Homo sapiens
tcccagcatgttgagaggct

SEQ ID NO: 491620 - DNA, 18 bp, Homo sapiens
tcccagccagcagttcag

SEQ ID NO: 491621 - DNA, 16 bp, Homo sapiens
tcccagctactcagga

SEQ ID NO: 491622 - DNA, 22 bp, Homo sapiens
tcccaggagtggaggaggcctg

SEQ ID NO: 491623 - DNA, 23 bp, Homo sapiens
tcccagtacctcctgtctctggc

SEQ ID NO: 491624 - DNA, 22 bp, Homo sapiens
tctagcctggcaacagagcgag

SEQ ID NO: 491625 - DNA, 18 bp, Homo sapiens
tctaggacgccacccagc

SEQ ID NO: 491626 - DNA, 11 bp, Homo sapiens
tctatcacctg

SEQ ID NO: 491627 - DNA, 15 bp, Homo sapiens
tctatcacctgtcat

SEQ ID NO: 491628 - DNA, 15 bp, Homo sapiens
tctatcattaaagtt

SEQ ID NO: 491629 - DNA, 16 bp, Homo sapiens
tctatcattaaagttc

SEQ ID NO: 491630 - DNA, 15 bp, Homo sapiens
tctatctaattttta

SEQ ID NO: 491631 - DNA, 13 bp, Homo sapiens
tctatgaaatatt

SEQ ID NO: 491632 - DNA, 18 bp, Homo sapiens
tctatgaaatattatgtt

SEQ ID NO: 491633 - DNA, 20 bp, Homo sapiens
tctcaaacggtacacagact

SEQ ID NO: 491634 - DNA, 20 bp, Homo sapiens
tctcactgtgggaaggccag

SEQ ID NO: 491635 - DNA, 13 bp, Homo sapiens
tctcacttgtgcc

SEQ ID NO: 491636 - DNA, 17 bp, Homo sapiens
tctcagggtctctgctg

SEQ ID NO: 491637 - DNA, 19 bp, Homo sapiens
tctcagggtctctgctgcc

SEQ ID NO: 491638 - DNA, 13 bp, Homo sapiens
tctcatcctgcag

SEQ ID NO: 491639 - DNA, 18 bp, Homo sapiens
tctcatgaatctgcaatg

SEQ ID NO: 491640 - DNA, 16 bp, Homo sapiens
tctcattcctgttctt

SEQ ID NO: 491641 - DNA, 12 bp, Homo sapiens
tctccccagagt

SEQ ID NO: 491642 - DNA, 16 bp, Homo sapiens
tctcctctcagcccct

SEQ ID NO: 491643 - DNA, 15 bp, Homo sapiens
tctcctgggcagctg

SEQ ID NO: 491644 - DNA, 20 bp, Homo sapiens
tctcctgggcagctgcctcc

SEQ ID NO: 491645 - DNA, 21 bp, Homo sapiens
tctcctgggcagctgcctccc

SEQ ID NO: 491646 - DNA, 15 bp, Homo sapiens
tctctaggctgggga

SEQ ID NO: 491647 - DNA, 16 bp, Homo sapiens
tctctatcattaaagt

SEQ ID NO: 491648 - DNA, 17 bp, Homo sapiens
tctctatcattaaagtt

SEQ ID NO: 491649 - DNA, 18 bp, Homo sapiens
tctctatcattaaagttc

SEQ ID NO: 491650 - DNA, 11 bp, Homo sapiens
tctctgctgcc

SEQ ID NO: 491651 - DNA, 15 bp, Homo sapiens
tctctggatgcctga

SEQ ID NO: 491652 - DNA, 13 bp, Homo sapiens
tctcttcaataaa

SEQ ID NO: 491653 - DNA, 14 bp, Homo sapiens
tctcttcaataaac

SEQ ID NO: 491654 - DNA, 19 bp, Homo sapiens
tctcttcctccgaggccag

SEQ ID NO: 491655 - DNA, 22 bp, Homo sapiens
tctgaaattttctagaatacta

SEQ ID NO: 491656 - DNA, 14 bp, Homo sapiens
tctgaactggagcc

SEQ ID NO: 491657 - DNA, 15 bp, Homo sapiens
tctgaactggagcca

SEQ ID NO: 491658 - DNA, 15 bp, Homo sapiens
tctgagacacacccc

SEQ ID NO: 491659 - DNA, 16 bp, Homo sapiens
tctgatgatgtgcctg

SEQ ID NO: 491660 - DNA, 13 bp, Homo sapiens
tctgatggcttct

SEQ ID NO: 491661 - DNA, 15 bp, Homo sapiens
tctgatggcttctcc

SEQ ID NO: 491662 - DNA, 17 bp, Homo sapiens
tctgccagccagcagcc

SEQ ID NO: 491663 - DNA, 19 bp, Homo sapiens
tctgccagccagcagccag

SEQ ID NO: 491664 - DNA, 20 bp, Homo sapiens
tctgccgctgccatgctttg

SEQ ID NO: 491665 - DNA, 17 bp, Homo sapiens
tctgctacctcactggg

SEQ ID NO: 491666 - DNA, 22 bp, Homo sapiens
tctgctgccgccccacccagat

SEQ ID NO: 491667 - DNA, 12 bp, Homo sapiens
tctgcttgccat

SEQ ID NO: 491668 - DNA, 13 bp, Homo sapiens
tctgcttgtcatc

SEQ ID NO: 491669 - DNA, 22 bp, Homo sapiens
tctggaagtgactttggctgca

SEQ ID NO: 491670 - DNA, 19 bp, Homo sapiens
tctggaatttaaggcccaa

SEQ ID NO: 491671 - DNA, 21 bp, Homo sapiens
tctggagagctagaacctgga

SEQ ID NO: 491672 - DNA, 23 bp, Homo sapiens
tctggagagctagaacctggagg

SEQ ID NO: 491673 - DNA, 17 bp, Homo sapiens
tctggattcccaggatg

SEQ ID NO: 491674 - DNA, 16 bp, Homo sapiens
tctggcatctcccaca

SEQ ID NO: 491675 - DNA, 21 bp, Homo sapiens
tctgggcaggactcagctccc

SEQ ID NO: 491676 - DNA, 12 bp, Homo sapiens
tctgggcatggt

SEQ ID NO: 491677 - DNA, 21 bp, Homo sapiens
tctggtctctaggctggggaa

SEQ ID NO: 491678 - DNA, 23 bp, Homo sapiens
tctggtgccagatcctcttctca

SEQ ID NO: 491679 - DNA, 15 bp, Homo sapiens
tctggtttcaccgag

SEQ ID NO: 491680 - DNA, 17 bp, Homo sapiens
tctgtcccacttggcat

SEQ ID NO: 491681 - DNA, 14 bp, Homo sapiens
tctgtctccttaac

SEQ ID NO: 491682 - DNA, 14 bp, Homo sapiens
tctgtgagttctgt

SEQ ID NO: 491683 - DNA, 19 bp, Homo sapiens
tctgtgcacgcagtggcct

SEQ ID NO: 491684 - DNA, 17 bp, Homo sapiens
tctgtgggcactggtgg

SEQ ID NO: 491685 - DNA, 20 bp, Homo sapiens
tctgttgtgtttgtcaaaaa

SEQ ID NO: 491686 - DNA, 22 bp, Homo sapiens
tctgttttataattttgtgaag

SEQ ID NO: 491687 - DNA, 17 bp, Homo sapiens
tcttaaacaaatgtatg

SEQ ID NO: 491688 - DNA, 12 bp, Homo sapiens
tcttaagaagac

SEQ ID NO: 491689 - DNA, 14 bp, Homo sapiens
tcttacaaacatgt

SEQ ID NO: 491690 - DNA, 22 bp, Homo sapiens
tcttagatgcagttctgaagaa

SEQ ID NO: 491691 - DNA, 12 bp, Homo sapiens
tcttcaataaac

SEQ ID NO: 491692 - DNA, 13 bp, Homo sapiens
tcttcaataaacc

SEQ ID NO: 491693 - DNA, 21 bp, Homo sapiens
tcttcagcctagccgacctca

SEQ ID NO: 491694 - DNA, 16 bp, Homo sapiens
tcttcatttattttga

SEQ ID NO: 491695 - DNA, 18 bp, Homo sapiens
tcttcccccactcctctt

SEQ ID NO: 491696 - DNA, 14 bp, Homo sapiens
tgcccaggatttga

SEQ ID NO: 491697 - DNA, 19 bp, Homo sapiens
tgcccagggctcagcctgg

SEQ ID NO: 491698 - DNA, 18 bp, Homo sapiens
tgccccccttgccagaca

SEQ ID NO: 491699 - DNA, 19 bp, Homo sapiens
tgcccgtcttcagcctagc

SEQ ID NO: 491700 - DNA, 12 bp, Homo sapiens
tgccctctcctg

SEQ ID NO: 491701 - DNA, 15 bp, Homo sapiens
tgccctctcctgggc

SEQ ID NO: 491702 - DNA, 18 bp, Homo sapiens
tgccctctcctgggcagc

SEQ ID NO: 491703 - DNA, 17 bp, Homo sapiens
tgccctgttctctacca

SEQ ID NO: 491704 - DNA, 13 bp, Homo sapiens
tgccgctgccatg

SEQ ID NO: 491705 - DNA, 19 bp, Homo sapiens
tgccgctgccatgctttga

SEQ ID NO: 491706 - DNA, 14 bp, Homo sapiens
tgcctaaaatatga

SEQ ID NO: 491707 - DNA, 14 bp, Homo sapiens
tgcctatagtccca

SEQ ID NO: 491708 - DNA, 17 bp, Homo sapiens
tgcctatagtcccagct

SEQ ID NO: 491709 - DNA, 22 bp, Homo sapiens
tgcctcccctcctctgcttgcc

SEQ ID NO: 491710 - DNA, 23 bp, Homo sapiens
tgcctggcaggctgtctggccag

SEQ ID NO: 491711 - DNA, 22 bp, Homo sapiens
tgcctggcttcgcaaaatgttt

SEQ ID NO: 491712 - DNA, 20 bp, Homo sapiens
tgcctgggagccagggtgag

SEQ ID NO: 491713 - DNA, 21 bp, Homo sapiens
tgcctgggtggacatggcccc

SEQ ID NO: 491714 - DNA, 22 bp, Homo sapiens
tgcctgggtttaaggggagagg

SEQ ID NO: 491715 - DNA, 15 bp, Homo sapiens
tgccttctcaactcc

SEQ ID NO: 491716 - DNA, 18 bp, Homo sapiens
tgccttggaagttgcatg

SEQ ID NO: 491717 - DNA, 23 bp, Homo sapiens
tgcctttgacctgcctcccttca

SEQ ID NO: 491718 - DNA, 17 bp, Homo sapiens
tgccttttcccaactcc

SEQ ID NO: 491719 - DNA, 19 bp, Homo sapiens
tgccttttcccaactccag

SEQ ID NO: 491720 - DNA, 13 bp, Homo sapiens
tgcggagaacaaa

SEQ ID NO: 491721 - DNA, 17 bp, Homo sapiens
tgcgggcacaataaatc

SEQ ID NO: 491722 - DNA, 17 bp, Homo sapiens
tgcgttccatgatgctg

SEQ ID NO: 491723 - DNA, 15 bp, Homo sapiens
tgctacctcactggg

SEQ ID NO: 491724 - DNA, 16 bp, Homo sapiens
tgctacctcactgggg

SEQ ID NO: 491725 - DNA, 22 bp, Homo sapiens
tgctacctcactggggtcctgg

SEQ ID NO: 491726 - DNA, 15 bp, Homo sapiens
tgctaccttctttgg

SEQ ID NO: 491727 - DNA, 20 bp, Homo sapiens
tgctagcacttggagccaag

SEQ ID NO: 491728 - DNA, 18 bp, Homo sapiens
tgctatattttcatgact

SEQ ID NO: 491729 - DNA, 14 bp, Homo sapiens
tgctcacagctgta

SEQ ID NO: 491730 - DNA, 15 bp, Homo sapiens
tgctcatgccctgcc

SEQ ID NO: 491731 - DNA, 14 bp, Homo sapiens
tgctcatggaattg

SEQ ID NO: 491732 - DNA, 20 bp, Homo sapiens
tgctccagcctctgccgctg

SEQ ID NO: 491733 - DNA, 14 bp, Homo sapiens
tgctccaggcaggc

SEQ ID NO: 491734 - DNA, 12 bp, Homo sapiens
tgctcctcagga

SEQ ID NO: 491735 - DNA, 22 bp, Homo sapiens
tgctcctcagggtccctcagga

SEQ ID NO: 491736 - DNA, 16 bp, Homo sapiens
tgctctcttcaataaa

SEQ ID NO: 491737 - DNA, 19 bp, Homo sapiens
tgctctcttcaataaacca

SEQ ID NO: 491738 - DNA, 23 bp, Homo sapiens
tgctgattgtctgaaattttcta

SEQ ID NO: 491739 - DNA, 23 bp, Homo sapiens
tgctgccgccccacccagatggg

SEQ ID NO: 491740 - DNA, 21 bp, Homo sapiens
tgctgtgaatttgtgtaagga

SEQ ID NO: 491741 - DNA, 21 bp, Homo sapiens
tgctgtgggtgatatggacag

SEQ ID NO: 491742 - DNA, 14 bp, Homo sapiens
tgcttaatgaaaag

SEQ ID NO: 491743 - DNA, 16 bp, Homo sapiens
tgcttactcattaaaa

SEQ ID NO: 491744 - DNA, 20 bp, Homo sapiens
tgcttagtccaattccttgc

SEQ ID NO: 491745 - DNA, 18 bp, Homo sapiens
tgcttataggtggcctct

SEQ ID NO: 491746 - DNA, 14 bp, Homo sapiens
tgcttgtcatccac

SEQ ID NO: 491747 - DNA, 23 bp, Homo sapiens
tgcttgtcatccacacaacacca

SEQ ID NO: 491748 - DNA, 15 bp, Homo sapiens
tgctttctatctaat

SEQ ID NO: 491749 - DNA, 18 bp, Homo sapiens
tgctttgagtccacgccc

SEQ ID NO: 491750 - DNA, 22 bp, Homo sapiens
tggaaaagtatgttagtgcaaa

SEQ ID NO: 491751 - DNA, 15 bp, Homo sapiens
tggaaaataaatcaa

SEQ ID NO: 491752 - DNA, 16 bp, Homo sapiens
tggaaaggagaggaaa

SEQ ID NO: 491753 - DNA, 19 bp, Homo sapiens
tggaaaggagaggaaagaa

SEQ ID NO: 491754 - DNA, 23 bp, Homo sapiens
tggaacagattcacactgtctgg

SEQ ID NO: 491755 - DNA, 23 bp, Homo sapiens
tggaacatcatcaaggcactgcc

SEQ ID NO: 491756 - DNA, 23 bp, Homo sapiens
tggaactctcctgctcctcagga

SEQ ID NO: 491757 - DNA, 15 bp, Homo sapiens
tggaagacacattga

SEQ ID NO: 491758 - DNA, 19 bp, Homo sapiens
tggaagcatattgttatta

SEQ ID NO: 491759 - DNA, 13 bp, Homo sapiens
tggaatctggaga

SEQ ID NO: 491760 - DNA, 15 bp, Homo sapiens
tggaatctggagagc

SEQ ID NO: 491761 - DNA, 13 bp, Homo sapiens
tggaatggagctg

SEQ ID NO: 491762 - DNA, 16 bp, Homo sapiens
tggaatttgtaagttt

SEQ ID NO: 491763 - DNA, 13 bp, Homo sapiens
tggacaaggaggt

SEQ ID NO: 491764 - DNA, 19 bp, Homo sapiens
tggacagagcgcccctccc

SEQ ID NO: 491765 - DNA, 22 bp, Homo sapiens
tggacagtgggcatcagcagca

SEQ ID NO: 491766 - DNA, 17 bp, Homo sapiens
tggacatggcccctgtg

SEQ ID NO: 491767 - DNA, 20 bp, Homo sapiens
tggacccagggatgacatgt

SEQ ID NO: 491768 - DNA, 18 bp, Homo sapiens
tggacggtgctccaggca

SEQ ID NO: 491769 - DNA, 20 bp, Homo sapiens
tggacggtgctccaggcagg

SEQ ID NO: 491770 - DNA, 22 bp, Homo sapiens
tggacggtgctccaggcaggct

SEQ ID NO: 491771 - DNA, 17 bp, Homo sapiens
tggacttaaccggagtt

SEQ ID NO: 491772 - DNA, 18 bp, Homo sapiens
tggacttgaggattttga

SEQ ID NO: 491773 - DNA, 13 bp, Homo sapiens
tggagaagaactg

SEQ ID NO: 491774 - DNA, 14 bp, Homo sapiens
aatcttacagctgg

SEQ ID NO: 491775 - DNA, 18 bp, Homo sapiens
aatcttacagctgggtgg

SEQ ID NO: 491776 - DNA, 21 bp, Homo sapiens
aatgaccagtaattgtgaaaa

SEQ ID NO: 491777 - DNA, 21 bp, Homo sapiens
aatgagagacacactgaagaa

SEQ ID NO: 491778 - DNA, 22 bp, Homo sapiens
aatgagagacacactgaagaag

SEQ ID NO: 491779 - DNA, 15 bp, Homo sapiens
aatgattatgaatta

SEQ ID NO: 491780 - DNA, 14 bp, Homo sapiens
aatgcaaattctca

SEQ ID NO: 491781 - DNA, 19 bp, Homo sapiens
aatgcctgagtgcctggcc

SEQ ID NO: 491782 - DNA, 12 bp, Homo sapiens
aatgctgcagat

SEQ ID NO: 491783 - DNA, 20 bp, Homo sapiens
aatgctgcagatttgggctg

SEQ ID NO: 491784 - DNA, 18 bp, Homo sapiens
aatggacaaaatccatga

SEQ ID NO: 491785 - DNA, 20 bp, Homo sapiens
aatggcacagcccaaagaag

SEQ ID NO: 491786 - DNA, 21 bp, Homo sapiens
aatggcttatccagctggtga

SEQ ID NO: 491787 - DNA, 17 bp, Homo sapiens
aatgggcttagagcagt

SEQ ID NO: 491788 - DNA, 18 bp, Homo sapiens
aatggtttgcaaggaagc

SEQ ID NO: 491789 - DNA, 19 bp, Homo sapiens
aatggtttgcaaggaagcc

SEQ ID NO: 491790 - DNA, 21 bp, Homo sapiens
aatgtgattcctttgaagagg

SEQ ID NO: 491791 - DNA, 15 bp, Homo sapiens
aatgttagatagtta

SEQ ID NO: 491792 - DNA, 13 bp, Homo sapiens
aattaattcttta

SEQ ID NO: 491793 - DNA, 13 bp, Homo sapiens
aattacatttgta

SEQ ID NO: 491794 - DNA, 16 bp, Homo sapiens
aattagatgactgaat

SEQ ID NO: 491795 - DNA, 17 bp, Homo sapiens
aattagttttatatgct

SEQ ID NO: 491796 - DNA, 14 bp, Homo sapiens
aattatattttgaa

SEQ ID NO: 491797 - DNA, 22 bp, Homo sapiens
aattatgcagcttgcacaccca

SEQ ID NO: 491798 - DNA, 19 bp, Homo sapiens
aattattttggatctatca

SEQ ID NO: 491799 - DNA, 14 bp, Homo sapiens
aattcattccattt

SEQ ID NO: 491800 - DNA, 23 bp, Homo sapiens
aattccttagcttagacctcagc

SEQ ID NO: 491801 - DNA, 14 bp, Homo sapiens
aattctaacttttt

SEQ ID NO: 491802 - DNA, 19 bp, Homo sapiens
aattctgctacctcactgg

SEQ ID NO: 491803 - DNA, 19 bp, Homo sapiens
aattctgtcactcaccact

SEQ ID NO: 491804 - DNA, 17 bp, Homo sapiens
aattctttatcacatgt

SEQ ID NO: 491805 - DNA, 14 bp, Homo sapiens
aattgaaaaggact

SEQ ID NO: 491806 - DNA, 18 bp, Homo sapiens
aattgaggacactgatat

SEQ ID NO: 491807 - DNA, 21 bp, Homo sapiens
aattgctcatgcatagtccca

SEQ ID NO: 491808 - DNA, 15 bp, Homo sapiens
aattggagctcgtgg

SEQ ID NO: 491809 - DNA, 18 bp, Homo sapiens
aattgtaaaattgtatag

SEQ ID NO: 491810 - DNA, 21 bp, Homo sapiens
aattgtaaaattgtatagaga

SEQ ID NO: 491811 - DNA, 15 bp, Homo sapiens
aattgtatagagata

SEQ ID NO: 491812 - DNA, 23 bp, Homo sapiens
aattgtatagagatatgcagaag

SEQ ID NO: 491813 - DNA, 23 bp, Homo sapiens
aattgtgtgaaaggtacttcaaa

SEQ ID NO: 491814 - DNA, 14 bp, Homo sapiens
aatttacatggcaa

SEQ ID NO: 491815 - DNA, 21 bp, Homo sapiens
aatttgatagtattgtgcata

SEQ ID NO: 491816 - DNA, 15 bp, Homo sapiens
aatttgtaagtttat

SEQ ID NO: 491817 - DNA, 19 bp, Homo sapiens
aatttgtatctgaaggaga

SEQ ID NO: 491818 - DNA, 16 bp, Homo sapiens
aattttctagaatact

SEQ ID NO: 491819 - DNA, 19 bp, Homo sapiens
aatttttatatttgaaata

SEQ ID NO: 491820 - DNA, 19 bp, Homo sapiens
aattttttctctaggaaat

SEQ ID NO: 491821 - DNA, 22 bp, Homo sapiens
aattttttctctaggaaatatt

SEQ ID NO: 491822 - DNA, 19 bp, Homo sapiens
acaaacatgtggttaatgc

SEQ ID NO: 491823 - DNA, 18 bp, Homo sapiens
acaaacctgcctgggttt

SEQ ID NO: 491824 - DNA, 12 bp, Homo sapiens
acaaataaagca

SEQ ID NO: 491825 - DNA, 14 bp, Homo sapiens
acaaatctatgcca

SEQ ID NO: 491826 - DNA, 21 bp, Homo sapiens
acaaatctatgccactcagaa

SEQ ID NO: 491827 - DNA, 19 bp, Homo sapiens
acaaatgggactgatgtca

SEQ ID NO: 491828 - DNA, 20 bp, Homo sapiens
acaaatgggactgatgtcat

SEQ ID NO: 491829 - DNA, 22 bp, Homo sapiens
acaaatgggactgatgtcatct

SEQ ID NO: 491830 - DNA, 12 bp, Homo sapiens
acaacaccagga

SEQ ID NO: 491831 - DNA, 13 bp, Homo sapiens
acaacaccaggac

SEQ ID NO: 491832 - DNA, 14 bp, Homo sapiens
acaacatgtataat

SEQ ID NO: 491833 - DNA, 20 bp, Homo sapiens
acaactcctagggccactga

SEQ ID NO: 491834 - DNA, 13 bp, Homo sapiens
acaagactgcaca

SEQ ID NO: 491835 - DNA, 11 bp, Homo sapiens
acaagcatctc

SEQ ID NO: 491836 - DNA, 16 bp, Homo sapiens
acaagtaaaactgtgg

SEQ ID NO: 491837 - DNA, 21 bp, Homo sapiens
acaagtgagacaaaaagcact

SEQ ID NO: 491838 - DNA, 22 bp, Homo sapiens
acaagtgagttgttgccctggg

SEQ ID NO: 491839 - DNA, 17 bp, Homo sapiens
acaatgctgtattttaa

SEQ ID NO: 491840 - DNA, 14 bp, Homo sapiens
acacaagtaaaact

SEQ ID NO: 491841 - DNA, 14 bp, Homo sapiens
acacaatacaataa

SEQ ID NO: 491842 - DNA, 14 bp, Homo sapiens
acacacacatacag

SEQ ID NO: 491843 - DNA, 13 bp, Homo sapiens
acacacatacaga

SEQ ID NO: 491844 - DNA, 21 bp, Homo sapiens
acacagatgaaacacaaacaa

SEQ ID NO: 491845 - DNA, 20 bp, Homo sapiens
acacagctaacacacagctc

SEQ ID NO: 491846 - DNA, 21 bp, Homo sapiens
acacagctaacacacagctcc

SEQ ID NO: 491847 - DNA, 23 bp, Homo sapiens
acacagctaacacacagctccca

SEQ ID NO: 491848 - DNA, 16 bp, Homo sapiens
acacaggcaactgagg

SEQ ID NO: 491849 - DNA, 21 bp, Homo sapiens
acacaggcaactgaggcagac

SEQ ID NO: 491850 - DNA, 22 bp, Homo sapiens
acacatacagagctctctgagg

SEQ ID NO: 491851 - DNA, 15 bp, Homo sapiens
acacatgaagtccaa

SEQ ID NO: 491852 - DNA, 16 bp, Homo sapiens
acacccttggacttga

SEQ ID NO: 491853 - DNA, 18 bp, Homo sapiens
acacccttggacttgagg

SEQ ID NO: 491854 - DNA, 16 bp, Homo sapiens
acacggggtattttag

SEQ ID NO: 491855 - DNA, 22 bp, Homo sapiens
acacggtttgaagcctggaaca

SEQ ID NO: 491856 - DNA, 20 bp, Homo sapiens
acactaaacagactatttaa

SEQ ID NO: 491857 - DNA, 19 bp, Homo sapiens
acactaagagagaatgaga

SEQ ID NO: 491858 - DNA, 19 bp, Homo sapiens
acactcacctctaaaacag

SEQ ID NO: 491859 - DNA, 17 bp, Homo sapiens
acactgaaatatacaca

SEQ ID NO: 491860 - DNA, 18 bp, Homo sapiens
acactgaaatatacacac

SEQ ID NO: 491861 - DNA, 12 bp, Homo sapiens
acactgaagaag

SEQ ID NO: 491862 - DNA, 16 bp, Homo sapiens
acactgcaggcatcac

SEQ ID NO: 491863 - DNA, 23 bp, Homo sapiens
acactgcttgtgtttttaactca

SEQ ID NO: 491864 - DNA, 13 bp, Homo sapiens
acactgggacttg

SEQ ID NO: 491865 - DNA, 19 bp, Homo sapiens
acactgggacttgcaaaaa

SEQ ID NO: 491866 - DNA, 16 bp, Homo sapiens
acactgggggagggga

SEQ ID NO: 491867 - DNA, 18 bp, Homo sapiens
acacttgctcatgccctg

SEQ ID NO: 491868 - DNA, 16 bp, Homo sapiens
acagaagaaggcagca

SEQ ID NO: 491869 - DNA, 16 bp, Homo sapiens
acagactattgacatc

SEQ ID NO: 491870 - DNA, 19 bp, Homo sapiens
acagagaaagaggaagctt

SEQ ID NO: 491871 - DNA, 10 bp, Homo sapiens
acagagctgg

SEQ ID NO: 491872 - DNA, 21 bp, Homo sapiens
acagagctgggatgtttctgt

SEQ ID NO: 491873 - DNA, 15 bp, Homo sapiens
acagattcacactgt

SEQ ID NO: 491874 - DNA, 16 bp, Homo sapiens
acagattcacactgtc

SEQ ID NO: 491875 - DNA, 19 bp, Homo sapiens
acagcccttctttccacag

SEQ ID NO: 491876 - DNA, 14 bp, Homo sapiens
acagccgctcctgt

SEQ ID NO: 491877 - DNA, 18 bp, Homo sapiens
acagccgctcctgtctgc

SEQ ID NO: 491878 - DNA, 16 bp, Homo sapiens
acagctgggtggcact

SEQ ID NO: 491879 - DNA, 23 bp, Homo sapiens
acagctgtatgattcccagccag

SEQ ID NO: 491880 - DNA, 21 bp, Homo sapiens
acagcttctcatcctgcaggc

SEQ ID NO: 491881 - DNA, 14 bp, Homo sapiens
acagctttctccag

SEQ ID NO: 491882 - DNA, 14 bp, Homo sapiens
acaggatgaaggca

SEQ ID NO: 491883 - DNA, 22 bp, Homo sapiens
acaggcaactgaggcagacagc

SEQ ID NO: 491884 - DNA, 22 bp, Homo sapiens
acagggaatgcctgagtgcctg

SEQ ID NO: 491885 - DNA, 13 bp, Homo sapiens
acagggatgagca

SEQ ID NO: 491886 - DNA, 21 bp, Homo sapiens
acagggatgagcatggagctg

SEQ ID NO: 491887 - DNA, 21 bp, Homo sapiens
acagggcctttggcaggtgca

SEQ ID NO: 491888 - DNA, 20 bp, Homo sapiens
acaggggctatcccttctca

SEQ ID NO: 491889 - DNA, 20 bp, Homo sapiens
acaggtgggcttcccagtgg

SEQ ID NO: 491890 - DNA, 14 bp, Homo sapiens
acagtaaataaatt

SEQ ID NO: 491891 - DNA, 18 bp, Homo sapiens
acagtaaataaattgttt

SEQ ID NO: 491892 - DNA, 17 bp, Homo sapiens
acagtaacgcaggggaa

SEQ ID NO: 491893 - DNA, 18 bp, Homo sapiens
acagtcacctcatggaat

SEQ ID NO: 491894 - DNA, 14 bp, Homo sapiens
acagtccagcctgg

SEQ ID NO: 491895 - DNA, 15 bp, Homo sapiens
acagtcttgcagcag

SEQ ID NO: 491896 - DNA, 21 bp, Homo sapiens
acagtgcttgccacagagcgg

SEQ ID NO: 491897 - DNA, 13 bp, Homo sapiens
acagtgggcatca

SEQ ID NO: 491898 - DNA, 12 bp, Homo sapiens
acagttcagttc

SEQ ID NO: 491899 - DNA, 16 bp, Homo sapiens
acagttcagttcctct

SEQ ID NO: 491900 - DNA, 16 bp, Homo sapiens
acagtttccagtcatg

SEQ ID NO: 491901 - DNA, 14 bp, Homo sapiens
acagtttgtcacat

SEQ ID NO: 491902 - DNA, 22 bp, Homo sapiens
acataacataagctagaaaaat

SEQ ID NO: 491903 - DNA, 14 bp, Homo sapiens
acatacagacacat

SEQ ID NO: 491904 - DNA, 17 bp, Homo sapiens
acatactatagattctt

SEQ ID NO: 491905 - DNA, 19 bp, Homo sapiens
acatatataacaatgctgt

SEQ ID NO: 491906 - DNA, 16 bp, Homo sapiens
acatgaagtccaagca

SEQ ID NO: 491907 - DNA, 17 bp, Homo sapiens
acatgcggagaacaaat

SEQ ID NO: 491908 - DNA, 20 bp, Homo sapiens
acatggctctaaaaagtttt

SEQ ID NO: 491909 - DNA, 11 bp, Homo sapiens
acatgggacat

SEQ ID NO: 491910 - DNA, 14 bp, Homo sapiens
acatgggacatttg

SEQ ID NO: 491911 - DNA, 14 bp, Homo sapiens
agcaaagtctaaag

SEQ ID NO: 491912 - DNA, 21 bp, Homo sapiens
agcaagaagatcctaaaacaa

SEQ ID NO: 491913 - DNA, 21 bp, Homo sapiens
agcaagtgattgggacagagg

SEQ ID NO: 491914 - DNA, 18 bp, Homo sapiens
agcaccaagctcaaagcg

SEQ ID NO: 491915 - DNA, 14 bp, Homo sapiens
agcactaaagcagt

SEQ ID NO: 491916 - DNA, 14 bp, Homo sapiens
agcactgtgctcag

SEQ ID NO: 491917 - DNA, 15 bp, Homo sapiens
agcactgtgctcagg

SEQ ID NO: 491918 - DNA, 23 bp, Homo sapiens
agcacttggagccaagggttcag

SEQ ID NO: 491919 - DNA, 16 bp, Homo sapiens
agcactttgggaggcc

SEQ ID NO: 491920 - DNA, 14 bp, Homo sapiens
agcagcagggtttt

SEQ ID NO: 491921 - DNA, 20 bp, Homo sapiens
agcagcctcagaacaaagtg

SEQ ID NO: 491922 - DNA, 15 bp, Homo sapiens
agcagcggacttcaa

SEQ ID NO: 491923 - DNA, 13 bp, Homo sapiens
agcagctcaggca

SEQ ID NO: 491924 - DNA, 21 bp, Homo sapiens
agcagctcaggcacacttctt

SEQ ID NO: 491925 - DNA, 11 bp, Homo sapiens
agcagctgcta

SEQ ID NO: 491926 - DNA, 17 bp, Homo sapiens
agcagcttcagttgttt

SEQ ID NO: 491927 - DNA, 22 bp, Homo sapiens
agcaggctacactgacactggt

SEQ ID NO: 491928 - DNA, 17 bp, Homo sapiens
agcagggtctgggcagg

SEQ ID NO: 491929 - DNA, 15 bp, Homo sapiens
agcagtggacaccag

SEQ ID NO: 491930 - DNA, 16 bp, Homo sapiens
agcagttcagagctgc

SEQ ID NO: 491931 - DNA, 18 bp, Homo sapiens
agcagttcagagctgccc

SEQ ID NO: 491932 - DNA, 19 bp, Homo sapiens
agcagttcagagctgccct

SEQ ID NO: 491933 - DNA, 19 bp, Homo sapiens
agcagtttctgtcctgctg

SEQ ID NO: 491934 - DNA, 14 bp, Homo sapiens
agcatactctatgt

SEQ ID NO: 491935 - DNA, 22 bp, Homo sapiens
agcatcccttgaccaggcctgg

SEQ ID NO: 491936 - DNA, 19 bp, Homo sapiens
agcattatgatgtgggtca

SEQ ID NO: 491937 - DNA, 13 bp, Homo sapiens
agccacagctggt

SEQ ID NO: 491938 - DNA, 19 bp, Homo sapiens
agccagaaataaagttggt

SEQ ID NO: 491939 - DNA, 19 bp, Homo sapiens
agccagattttcctgaaaa

SEQ ID NO: 491940 - DNA, 15 bp, Homo sapiens
agccagcagttcaga

SEQ ID NO: 491941 - DNA, 17 bp, Homo sapiens
agccagcagttcagagc

SEQ ID NO: 491942 - DNA, 16 bp, Homo sapiens
agccagctctcagcca

SEQ ID NO: 491943 - DNA, 11 bp, Homo sapiens
agccagggctg

SEQ ID NO: 491944 - DNA, 12 bp, Homo sapiens
agccagggctgc

SEQ ID NO: 491945 - DNA, 14 bp, Homo sapiens
agccagggctgcta

SEQ ID NO: 491946 - DNA, 18 bp, Homo sapiens
agccagtaaacagaggag

SEQ ID NO: 491947 - DNA, 22 bp, Homo sapiens
agccatctccatcttgaaggaa

SEQ ID NO: 491948 - DNA, 22 bp, Homo sapiens
agccatgggcacaaagggccca

SEQ ID NO: 491949 - DNA, 13 bp, Homo sapiens
agcccaaagaagg

SEQ ID NO: 491950 - DNA, 14 bp, Homo sapiens
agcccaaagaagga

SEQ ID NO: 491951 - DNA, 16 bp, Homo sapiens
agcccaaagaaggaaa

SEQ ID NO: 491952 - DNA, 20 bp, Homo sapiens
agcccctgatcctgtgaagt

SEQ ID NO: 491953 - DNA, 17 bp, Homo sapiens
agcccgtgccctaccac

SEQ ID NO: 491954 - DNA, 12 bp, Homo sapiens
agccgacctcag

SEQ ID NO: 491955 - DNA, 16 bp, Homo sapiens
agccgcatcccagact

SEQ ID NO: 491956 - DNA, 21 bp, Homo sapiens
agccggagcctccagctgccc

SEQ ID NO: 491957 - DNA, 17 bp, Homo sapiens
agcctagccgacctcag

SEQ ID NO: 491958 - DNA, 19 bp, Homo sapiens
agcctagccgacctcagcc

SEQ ID NO: 491959 - DNA, 14 bp, Homo sapiens
agcctcatccgagg

SEQ ID NO: 491960 - DNA, 19 bp, Homo sapiens
agcctcatccgaggcaggg

SEQ ID NO: 491961 - DNA, 17 bp, Homo sapiens
agcctccagctgccccg

SEQ ID NO: 491962 - DNA, 22 bp, Homo sapiens
agcctccagtccaaggaaacca

SEQ ID NO: 491963 - DNA, 10 bp, Homo sapiens
agcctctgcc

SEQ ID NO: 491964 - DNA, 19 bp, Homo sapiens
agcctctgccgctgccatg

SEQ ID NO: 491965 - DNA, 21 bp, Homo sapiens
agcctctgccgctgccatgct

SEQ ID NO: 491966 - DNA, 22 bp, Homo sapiens
agcctctgccgctgccatgctt

SEQ ID NO: 491967 - DNA, 20 bp, Homo sapiens
agcctgctccttcccaggag

SEQ ID NO: 491968 - DNA, 19 bp, Homo sapiens
agcctggaacatcatcaag

SEQ ID NO: 491969 - DNA, 21 bp, Homo sapiens
agcctggaacatcatcaaggc

SEQ ID NO: 491970 - DNA, 18 bp, Homo sapiens
agcctggcaacagagcga

SEQ ID NO: 491971 - DNA, 19 bp, Homo sapiens
agcctggcaacagagcgag

SEQ ID NO: 491972 - DNA, 22 bp, Homo sapiens
agcctggtgggcctcctctgtc

SEQ ID NO: 491973 - DNA, 20 bp, Homo sapiens
agccttgctctcttcaataa

SEQ ID NO: 491974 - DNA, 16 bp, Homo sapiens
agccttggatgtatat

SEQ ID NO: 491975 - DNA, 20 bp, Homo sapiens
agccttggggctgatgcagt

SEQ ID NO: 491976 - DNA, 18 bp, Homo sapiens
agcgtactcatcatcaac

SEQ ID NO: 491977 - DNA, 15 bp, Homo sapiens
agcgtggacaggtgt

SEQ ID NO: 491978 - DNA, 15 bp, Homo sapiens
agctaaaacctgagc

SEQ ID NO: 491979 - DNA, 19 bp, Homo sapiens
agctaacacacagctccca

SEQ ID NO: 491980 - DNA, 16 bp, Homo sapiens
agctagaacccggcag

SEQ ID NO: 491981 - DNA, 16 bp, Homo sapiens
agctagttatgtgaga

SEQ ID NO: 491982 - DNA, 15 bp, Homo sapiens
agctatcctggctct

SEQ ID NO: 491983 - DNA, 22 bp, Homo sapiens
agctatttttatttgtttgtgc

SEQ ID NO: 491984 - DNA, 22 bp, Homo sapiens
agctcaaagcgtggacaggtgt

SEQ ID NO: 491985 - DNA, 14 bp, Homo sapiens
agctcagagagggc

SEQ ID NO: 491986 - DNA, 21 bp, Homo sapiens
agctcagagagggcaggcatg

SEQ ID NO: 491987 - DNA, 14 bp, Homo sapiens
agctcaggaccagg

SEQ ID NO: 491988 - DNA, 14 bp, Homo sapiens
agctcatctctgtc

SEQ ID NO: 491989 - DNA, 23 bp, Homo sapiens
agctcccaagggatggtgccctg

SEQ ID NO: 491990 - DNA, 19 bp, Homo sapiens
agctcctcatccagggctc

SEQ ID NO: 491991 - DNA, 18 bp, Homo sapiens
agctcggtggacccaggg

SEQ ID NO: 491992 - DNA, 13 bp, Homo sapiens
agctctcagccaa

SEQ ID NO: 491993 - DNA, 19 bp, Homo sapiens
agctcttgaagacactgaa

SEQ ID NO: 491994 - DNA, 14 bp, Homo sapiens
agctctttgagata

SEQ ID NO: 491995 - DNA, 17 bp, Homo sapiens
agctgaagatccccaac

SEQ ID NO: 491996 - DNA, 24 bp, Homo sapiens
agctgaagatccccaactgctcca

SEQ ID NO: 491997 - DNA, 19 bp, Homo sapiens
agctgacacaaacctgcct

SEQ ID NO: 491998 - DNA, 13 bp, Homo sapiens
agctgcagtgagc

SEQ ID NO: 491999 - DNA, 14 bp, Homo sapiens
agctgccccagcca

SEQ ID NO: 492000 - DNA, 15 bp, Homo sapiens
agctgccccagccag

SEQ ID NO: 492001 - DNA, 13 bp, Homo sapiens
agctgccctctcc

SEQ ID NO: 492002 - DNA, 21 bp, Homo sapiens
agctgcctcccctcctctgct

SEQ ID NO: 492003 - DNA, 23 bp, Homo sapiens
agctggagcccgtgccctaccac

SEQ ID NO: 492004 - DNA, 17 bp, Homo sapiens
agctggagcctggtgcc

SEQ ID NO: 492005 - DNA, 13 bp, Homo sapiens
agctggaggacta

SEQ ID NO: 492006 - DNA, 20 bp, Homo sapiens
agctggaggactagaacctg

SEQ ID NO: 492007 - DNA, 22 bp, Homo sapiens
agctggatctccattctctcag

SEQ ID NO: 492008 - DNA, 17 bp, Homo sapiens
agctgggatgtttctgt

SEQ ID NO: 492009 - DNA, 19 bp, Homo sapiens
agctgggtggcactgccat

SEQ ID NO: 492010 - DNA, 20 bp, Homo sapiens
agctgggtggcactgccatg

SEQ ID NO: 492011 - DNA, 14 bp, Homo sapiens
agctgggttggaaa

SEQ ID NO: 492012 - DNA, 18 bp, Homo sapiens
agctggtgagtgatgcgg

SEQ ID NO: 492013 - DNA, 15 bp, Homo sapiens
agctggttggagagc

SEQ ID NO: 492014 - DNA, 15 bp, Homo sapiens
agcttagacctcagc

SEQ ID NO: 492015 - DNA, 16 bp, Homo sapiens
agcttagacctcagcc

SEQ ID NO: 492016 - DNA, 22 bp, Homo sapiens
agcttcattctcactctgcttt

SEQ ID NO: 492017 - DNA, 16 bp, Homo sapiens
agcttttaaaccctat

SEQ ID NO: 492018 - DNA, 15 bp, Homo sapiens
aggaaaagattcctg

SEQ ID NO: 492019 - DNA, 17 bp, Homo sapiens
aggaaaccacagctgct

SEQ ID NO: 492020 - DNA, 13 bp, Homo sapiens
aggaaagagaact

SEQ ID NO: 492021 - DNA, 19 bp, Homo sapiens
aggaaagagaacttccaga

SEQ ID NO: 492022 - DNA, 16 bp, Homo sapiens
aggaaatattgctggg

SEQ ID NO: 492023 - DNA, 12 bp, Homo sapiens
aggaacatacag

SEQ ID NO: 492024 - DNA, 15 bp, Homo sapiens
aggaaggctgagagg

SEQ ID NO: 492025 - DNA, 18 bp, Homo sapiens
aggaagggcatccttctg

SEQ ID NO: 492026 - DNA, 14 bp, Homo sapiens
aggaagtgaagaat

SEQ ID NO: 492027 - DNA, 23 bp, Homo sapiens
aggaataatgggcttagagcagt

SEQ ID NO: 492028 - DNA, 17 bp, Homo sapiens
aggaatccactcccagg

SEQ ID NO: 492029 - DNA, 16 bp, Homo sapiens
aggaatgtcagggcca

SEQ ID NO: 492030 - DNA, 17 bp, Homo sapiens
aggaatgtcagggccag

SEQ ID NO: 492031 - DNA, 19 bp, Homo sapiens
aggaatgtcagggccaggt

SEQ ID NO: 492032 - DNA, 20 bp, Homo sapiens
aggaatgtcagggccaggtg

SEQ ID NO: 492033 - DNA, 23 bp, Homo sapiens
aggacacagatgaaacacaaaca

SEQ ID NO: 492034 - DNA, 23 bp, Homo sapiens
aggacagcccttctttccacaga

SEQ ID NO: 492035 - DNA, 18 bp, Homo sapiens
aggactaatccaatacct

SEQ ID NO: 492036 - DNA, 17 bp, Homo sapiens
aggactagaacctggag

SEQ ID NO: 492037 - DNA, 13 bp, Homo sapiens
aggactcagctcc

SEQ ID NO: 492038 - DNA, 20 bp, Homo sapiens
aggactcagctccccagagt

SEQ ID NO: 492039 - DNA, 20 bp, Homo sapiens
aggagaatcgcttgaacctg

SEQ ID NO: 492040 - DNA, 22 bp, Homo sapiens
aggagaatcgcttgaacctggg

SEQ ID NO: 492041 - DNA, 12 bp, Homo sapiens
aggagaggaaag

SEQ ID NO: 492042 - DNA, 13 bp, Homo sapiens
aggagaggggcag

SEQ ID NO: 492043 - DNA, 15 bp, Homo sapiens
aggagattttccttc

SEQ ID NO: 492044 - DNA, 16 bp, Homo sapiens
aggagcaaaggctgag

SEQ ID NO: 492045 - DNA, 22 bp, Homo sapiens
aggagcaaaggctgagaacact

SEQ ID NO: 492046 - DNA, 20 bp, Homo sapiens
aggagcagcttcagttgttt

SEQ ID NO: 492047 - DNA, 16 bp, Homo sapiens
aggagcagtgcaggca

SEQ ID NO: 492048 - DNA, 20 bp, Homo sapiens
agtgactgttcaagagcaca

SEQ ID NO: 492049 - DNA, 16 bp, Homo sapiens
agtgagggagatccca

SEQ ID NO: 492050 - DNA, 15 bp, Homo sapiens
agtgatcacagcagc

SEQ ID NO: 492051 - DNA, 16 bp, Homo sapiens
agtgatcacagcagct

SEQ ID NO: 492052 - DNA, 21 bp, Homo sapiens
agtgcaaattgtcacaggaca

SEQ ID NO: 492053 - DNA, 17 bp, Homo sapiens
agtgcaacactgaagct

SEQ ID NO: 492054 - DNA, 17 bp, Homo sapiens
agtgcatttttatctgt

SEQ ID NO: 492055 - DNA, 20 bp, Homo sapiens
agtgcatttttatctgtgag

SEQ ID NO: 492056 - DNA, 21 bp, Homo sapiens
agtgcatttttatctgtgagt

SEQ ID NO: 492057 - DNA, 15 bp, Homo sapiens
agtgcttgccacaga

SEQ ID NO: 492058 - DNA, 17 bp, Homo sapiens
agtgcttgccacagagc

SEQ ID NO: 492059 - DNA, 19 bp, Homo sapiens
agtgcttgccacagagcgg

SEQ ID NO: 492060 - DNA, 15 bp, Homo sapiens
agtggaggcattgtt

SEQ ID NO: 492061 - DNA, 16 bp, Homo sapiens
agtggaggcattgttt

SEQ ID NO: 492062 - DNA, 19 bp, Homo sapiens
agtggcttcattagagcag

SEQ ID NO: 492063 - DNA, 12 bp, Homo sapiens
agtgggcgcagt

SEQ ID NO: 492064 - DNA, 15 bp, Homo sapiens
agtggggacagagca

SEQ ID NO: 492065 - DNA, 19 bp, Homo sapiens
agtggtggcaaaagacatc

SEQ ID NO: 492066 - DNA, 17 bp, Homo sapiens
agtgttggagaagaact

SEQ ID NO: 492067 - DNA, 16 bp, Homo sapiens
agttcagagctgccct

SEQ ID NO: 492068 - DNA, 17 bp, Homo sapiens
agttcagagctgccctc

SEQ ID NO: 492069 - DNA, 19 bp, Homo sapiens
agttcagagctgccctctc

SEQ ID NO: 492070 - DNA, 16 bp, Homo sapiens
agttcaggctctgaga

SEQ ID NO: 492071 - DNA, 21 bp, Homo sapiens
agttcgatgggcccaattctt

SEQ ID NO: 492072 - DNA, 14 bp, Homo sapiens
agttctgaagaaga

SEQ ID NO: 492073 - DNA, 19 bp, Homo sapiens
agttgatatagaacagtgc

SEQ ID NO: 492074 - DNA, 17 bp, Homo sapiens
agttgcaatagaacaga

SEQ ID NO: 492075 - DNA, 15 bp, Homo sapiens
agttgcacggctgct

SEQ ID NO: 492076 - DNA, 16 bp, Homo sapiens
agttgcacggctgctg

SEQ ID NO: 492077 - DNA, 20 bp, Homo sapiens
agttgcacggctgctgaggc

SEQ ID NO: 492078 - DNA, 16 bp, Homo sapiens
agttgcagattcattt

SEQ ID NO: 492079 - DNA, 22 bp, Homo sapiens
agttgcatgaccacatagaaca

SEQ ID NO: 492080 - DNA, 21 bp, Homo sapiens
agttgcatggcatcacctcca

SEQ ID NO: 492081 - DNA, 19 bp, Homo sapiens
agttgtttcattgactatc

SEQ ID NO: 492082 - DNA, 16 bp, Homo sapiens
agtttacagtaaataa

SEQ ID NO: 492083 - DNA, 18 bp, Homo sapiens
agtttacagtaaataaat

SEQ ID NO: 492084 - DNA, 20 bp, Homo sapiens
agtttagtgtgataaaggca

SEQ ID NO: 492085 - DNA, 16 bp, Homo sapiens
agtttatgtctaaaga

SEQ ID NO: 492086 - DNA, 21 bp, Homo sapiens
agtttatgtctaaagagcttt

SEQ ID NO: 492087 - DNA, 19 bp, Homo sapiens
agtttgatatgggctttct

SEQ ID NO: 492088 - DNA, 14 bp, Homo sapiens
ataaaagacacaga

SEQ ID NO: 492089 - DNA, 16 bp, Homo sapiens
ataaaataatttttat

SEQ ID NO: 492090 - DNA, 21 bp, Homo sapiens
ataaaataatttttatatttg

SEQ ID NO: 492091 - DNA, 12 bp, Homo sapiens
ataaaatacata

SEQ ID NO: 492092 - DNA, 13 bp, Homo sapiens
ataaaatgaccag

SEQ ID NO: 492093 - DNA, 21 bp, Homo sapiens
ataaaattgtaaaattgtata

SEQ ID NO: 492094 - DNA, 19 bp, Homo sapiens
ataaagtatggtattgaaa

SEQ ID NO: 492095 - DNA, 15 bp, Homo sapiens
ataaattgtttgacc

SEQ ID NO: 492096 - DNA, 17 bp, Homo sapiens
ataaattgtttgaccat

SEQ ID NO: 492097 - DNA, 14 bp, Homo sapiens
ataacacacagcta

SEQ ID NO: 492098 - DNA, 22 bp, Homo sapiens
ataagaccaccacctcagagta

SEQ ID NO: 492099 - DNA, 17 bp, Homo sapiens
ataagctagaaaaatta

SEQ ID NO: 492100 - DNA, 15 bp, Homo sapiens
ataagggcagagtca

SEQ ID NO: 492101 - DNA, 18 bp, Homo sapiens
ataagtactgtgtacaga

SEQ ID NO: 492102 - DNA, 19 bp, Homo sapiens
ataagtactgtgtacagaa

SEQ ID NO: 492103 - DNA, 14 bp, Homo sapiens
ataatctttcacag

SEQ ID NO: 492104 - DNA, 14 bp, Homo sapiens
ataatttttatatt

SEQ ID NO: 492105 - DNA, 23 bp, Homo sapiens
atacagacacatttacactagag

SEQ ID NO: 492106 - DNA, 19 bp, Homo sapiens
atacatactatagattctt

SEQ ID NO: 492107 - DNA, 15 bp, Homo sapiens
atacattgaattaga

SEQ ID NO: 492108 - DNA, 22 bp, Homo sapiens
ataccacaggaaccacaagact

SEQ ID NO: 492109 - DNA, 20 bp, Homo sapiens
atactaagatgttcactgtg

SEQ ID NO: 492110 - DNA, 16 bp, Homo sapiens
atactaataaaataca

SEQ ID NO: 492111 - DNA, 17 bp, Homo sapiens
atactaataaaatacat

SEQ ID NO: 492112 - DNA, 22 bp, Homo sapiens
atactaataaaatacatactat

SEQ ID NO: 492113 - DNA, 13 bp, Homo sapiens
atactgaagatgc

SEQ ID NO: 492114 - DNA, 20 bp, Homo sapiens
atagaaatatagccaaaaat

SEQ ID NO: 492115 - DNA, 13 bp, Homo sapiens
atagaacagtgct

SEQ ID NO: 492116 - DNA, 14 bp, Homo sapiens
atagattctttatt

SEQ ID NO: 492117 - DNA, 15 bp, Homo sapiens
atagattctttatta

SEQ ID NO: 492118 - DNA, 14 bp, Homo sapiens
atagtaaaaataaa

SEQ ID NO: 492119 - DNA, 14 bp, Homo sapiens
atagtcaaattgtg

SEQ ID NO: 492120 - DNA, 13 bp, Homo sapiens
atatatattttaa

SEQ ID NO: 492121 - DNA, 12 bp, Homo sapiens
atatattgctgc

SEQ ID NO: 492122 - DNA, 14 bp, Homo sapiens
atatcagcaagtct

SEQ ID NO: 492123 - DNA, 20 bp, Homo sapiens
atatgagctttatgtaataa

SEQ ID NO: 492124 - DNA, 20 bp, Homo sapiens
atatgcttctgttttataat

SEQ ID NO: 492125 - DNA, 22 bp, Homo sapiens
atatgcttctgttttataattt

SEQ ID NO: 492126 - DNA, 20 bp, Homo sapiens
atatggggatgcagcattat

SEQ ID NO: 492127 - DNA, 16 bp, Homo sapiens
atattaaaaattaatt

SEQ ID NO: 492128 - DNA, 19 bp, Homo sapiens
atattaaaaattaattctt

SEQ ID NO: 492129 - DNA, 12 bp, Homo sapiens
atattaaaatca

SEQ ID NO: 492130 - DNA, 13 bp, Homo sapiens
atattgataataa

SEQ ID NO: 492131 - DNA, 15 bp, Homo sapiens
atattgataataaaa

SEQ ID NO: 492132 - DNA, 17 bp, Homo sapiens
atattgataataaaatt

SEQ ID NO: 492133 - DNA, 22 bp, Homo sapiens
atattgataataaaattcattc

SEQ ID NO: 492134 - DNA, 21 bp, Homo sapiens
atattgctgctggtaatttgt

SEQ ID NO: 492135 - DNA, 14 bp, Homo sapiens
atatttattactgt

SEQ ID NO: 492136 - DNA, 19 bp, Homo sapiens
atatttattactgtaagaa

SEQ ID NO: 492137 - DNA, 14 bp, Homo sapiens
atatttattttaat

SEQ ID NO: 492138 - DNA, 15 bp, Homo sapiens
atatttattttaata

SEQ ID NO: 492139 - DNA, 13 bp, Homo sapiens
atatttgaaatat

SEQ ID NO: 492140 - DNA, 20 bp, Homo sapiens
atatttgtcgatatttccat

SEQ ID NO: 492141 - DNA, 15 bp, Homo sapiens
atatttttaattaaa

SEQ ID NO: 492142 - DNA, 15 bp, Homo sapiens
atcaaactgaagcca

SEQ ID NO: 492143 - DNA, 16 bp, Homo sapiens
atcaaactgaagccag

SEQ ID NO: 492144 - DNA, 17 bp, Homo sapiens
atcaaatggaagacaca

SEQ ID NO: 492145 - DNA, 16 bp, Homo sapiens
atcaaggcactgcctg

SEQ ID NO: 492146 - DNA, 20 bp, Homo sapiens
atcaatccagcggttctcaa

SEQ ID NO: 492147 - DNA, 18 bp, Homo sapiens
atcacaaactcatccatt

SEQ ID NO: 492148 - DNA, 15 bp, Homo sapiens
atcacctagaaactt

SEQ ID NO: 492149 - DNA, 14 bp, Homo sapiens
atcactgaactttg

SEQ ID NO: 492150 - DNA, 21 bp, Homo sapiens
atcactgaactttgctgagcc

SEQ ID NO: 492151 - DNA, 16 bp, Homo sapiens
atcagaaacaccctca

SEQ ID NO: 492152 - DNA, 23 bp, Homo sapiens
atcagcaacaaccagcatccctt

SEQ ID NO: 492153 - DNA, 17 bp, Homo sapiens
atcagggttagtattgt

SEQ ID NO: 492154 - DNA, 15 bp, Homo sapiens
atcagttagagctga

SEQ ID NO: 492155 - DNA, 23 bp, Homo sapiens
atcataactggcttctgcttgtc

SEQ ID NO: 492156 - DNA, 13 bp, Homo sapiens
atcatcaaggcac

SEQ ID NO: 492157 - DNA, 11 bp, Homo sapiens
atcattaaagt

SEQ ID NO: 492158 - DNA, 17 bp, Homo sapiens
atccaccgccagcttcc

SEQ ID NO: 492159 - DNA, 19 bp, Homo sapiens
atccagggctctgaccagt

SEQ ID NO: 492160 - DNA, 14 bp, Homo sapiens
atccatacatttgt

SEQ ID NO: 492161 - DNA, 23 bp, Homo sapiens
atcccaggatcgcaagagccatg

SEQ ID NO: 492162 - DNA, 23 bp, Homo sapiens
atccccaaaacaggccaggtgtg

SEQ ID NO: 492163 - DNA, 21 bp, Homo sapiens
atccccaactgctccagcctc

SEQ ID NO: 492164 - DNA, 22 bp, Homo sapiens
atccccaactgctccagcctct

SEQ ID NO: 492165 - DNA, 16 bp, Homo sapiens
atcccggtttcagaag

SEQ ID NO: 492166 - DNA, 14 bp, Homo sapiens
atccctccctccac

SEQ ID NO: 492167 - DNA, 16 bp, Homo sapiens
atccctccctccacct

SEQ ID NO: 492168 - DNA, 20 bp, Homo sapiens
atccctccctccacctccct

SEQ ID NO: 492169 - DNA, 23 bp, Homo sapiens
atccctccctccacctccctgca

SEQ ID NO: 492170 - DNA, 14 bp, Homo sapiens
atccgcctgtgggc

SEQ ID NO: 492171 - DNA, 23 bp, Homo sapiens
atcctagtctctatcattaaagt

SEQ ID NO: 492172 - DNA, 17 bp, Homo sapiens
atcctcaaacactgcag

SEQ ID NO: 492173 - DNA, 17 bp, Homo sapiens
atccttatgatgtccaa

SEQ ID NO: 492174 - DNA, 11 bp, Homo sapiens
atccttctgcc

SEQ ID NO: 492175 - DNA, 16 bp, Homo sapiens
atccttgagtcaaaaa

SEQ ID NO: 492176 - DNA, 17 bp, Homo sapiens
atcgagaccatcctggc

SEQ ID NO: 492177 - DNA, 16 bp, Homo sapiens
atctaatttttattaa

SEQ ID NO: 492178 - DNA, 14 bp, Homo sapiens
atctcaattcttcc

SEQ ID NO: 492179 - DNA, 22 bp, Homo sapiens
atctcacttgtgccaacactca

SEQ ID NO: 492180 - DNA, 17 bp, Homo sapiens
atctctgctttggaaat

SEQ ID NO: 492181 - DNA, 20 bp, Homo sapiens
atctttgcaagaaagtcaga

SEQ ID NO: 492182 - DNA, 15 bp, Homo sapiens
atctttgccaccctc

SEQ ID NO: 492183 - DNA, 16 bp, Homo sapiens
atctttgccaccctca

SEQ ID NO: 492184 - DNA, 20 bp, Homo sapiens
atgaaaatgcaacaacatgt

SEQ ID NO: 492185 - DNA, 14 bp, Homo sapiens
atttccatattaaa

SEQ ID NO: 492186 - DNA, 15 bp, Homo sapiens
atttctatgaaatat

SEQ ID NO: 492187 - DNA, 15 bp, Homo sapiens
atttctatggcatat

SEQ ID NO: 492188 - DNA, 19 bp, Homo sapiens
atttctatggcatattgat

SEQ ID NO: 492189 - DNA, 21 bp, Homo sapiens
atttcttaaacaaatgtatga

SEQ ID NO: 492190 - DNA, 12 bp, Homo sapiens
atttggaaaata

SEQ ID NO: 492191 - DNA, 14 bp, Homo sapiens
atttggaatcatat

SEQ ID NO: 492192 - DNA, 15 bp, Homo sapiens
atttggaatcatatg

SEQ ID NO: 492193 - DNA, 13 bp, Homo sapiens
atttggagtggag

SEQ ID NO: 492194 - DNA, 15 bp, Homo sapiens
atttggagtggaggc

SEQ ID NO: 492195 - DNA, 16 bp, Homo sapiens
atttggagtggaggca

SEQ ID NO: 492196 - DNA, 23 bp, Homo sapiens
atttggtaaggggaattgaggac

SEQ ID NO: 492197 - DNA, 22 bp, Homo sapiens
atttggtttggccatctctgga

SEQ ID NO: 492198 - DNA, 14 bp, Homo sapiens
atttgtaagtttat

SEQ ID NO: 492199 - DNA, 13 bp, Homo sapiens
atttgtacagttc

SEQ ID NO: 492200 - DNA, 14 bp, Homo sapiens
atttgtataaaata

SEQ ID NO: 492201 - DNA, 21 bp, Homo sapiens
atttgtataaaataattttta

SEQ ID NO: 492202 - DNA, 14 bp, Homo sapiens
atttgtatctgaag

SEQ ID NO: 492203 - DNA, 18 bp, Homo sapiens
atttgttatttgtacagt

SEQ ID NO: 492204 - DNA, 23 bp, Homo sapiens
attttaaaagaatgattatgaat

SEQ ID NO: 492205 - DNA, 14 bp, Homo sapiens
attttaataatgtt

SEQ ID NO: 492206 - DNA, 20 bp, Homo sapiens
attttatgccttttatttct

SEQ ID NO: 492207 - DNA, 13 bp, Homo sapiens
attttcatgactt

SEQ ID NO: 492208 - DNA, 13 bp, Homo sapiens
attttcctgaaaa

SEQ ID NO: 492209 - DNA, 20 bp, Homo sapiens
attttctagaatactaataa

SEQ ID NO: 492210 - DNA, 17 bp, Homo sapiens
attttgactgtgattta

SEQ ID NO: 492211 - DNA, 15 bp, Homo sapiens
atttttatatttgaa

SEQ ID NO: 492212 - DNA, 14 bp, Homo sapiens
caaaaagtcattgt

SEQ ID NO: 492213 - DNA, 19 bp, Homo sapiens
caaaagcccattcattcca

SEQ ID NO: 492214 - DNA, 15 bp, Homo sapiens
caaaagtatattcaa

SEQ ID NO: 492215 - DNA, 24 bp, Homo sapiens
caaacaatagtaattctcaggcca

SEQ ID NO: 492216 - DNA, 23 bp, Homo sapiens
caaacacattaagccttccacac

SEQ ID NO: 492217 - DNA, 23 bp, Homo sapiens
caaacatgtttagagtggataga

SEQ ID NO: 492218 - DNA, 13 bp, Homo sapiens
caaacctgcctgg

SEQ ID NO: 492219 - DNA, 16 bp, Homo sapiens
caaactcatccattaa

SEQ ID NO: 492220 - DNA, 14 bp, Homo sapiens
caaactgaagccag

SEQ ID NO: 492221 - DNA, 15 bp, Homo sapiens
caaactgaagccaga

SEQ ID NO: 492222 - DNA, 15 bp, Homo sapiens
caaagcagggtctgg

SEQ ID NO: 492223 - DNA, 19 bp, Homo sapiens
caaaggccatggagagctg

SEQ ID NO: 492224 - DNA, 23 bp, Homo sapiens
caaaggccatggagagctggagc

SEQ ID NO: 492225 - DNA, 14 bp, Homo sapiens
caaaggctgagaac

SEQ ID NO: 492226 - DNA, 12 bp, Homo sapiens
caaagggcccag

SEQ ID NO: 492227 - DNA, 14 bp, Homo sapiens
caaagggcccagat

SEQ ID NO: 492228 - DNA, 20 bp, Homo sapiens
caaagtcatgcaaaggctgg

SEQ ID NO: 492229 - DNA, 21 bp, Homo sapiens
caaagtcatgcaaaggctggg

SEQ ID NO: 492230 - DNA, 20 bp, Homo sapiens
caaagtctgatttgtgatga

SEQ ID NO: 492231 - DNA, 15 bp, Homo sapiens
caaatcaaagcagat

SEQ ID NO: 492232 - DNA, 18 bp, Homo sapiens
caaatgcccaagggaaag

SEQ ID NO: 492233 - DNA, 13 bp, Homo sapiens
caaatggaaagga

SEQ ID NO: 492234 - DNA, 11 bp, Homo sapiens
caaatgggact

SEQ ID NO: 492235 - DNA, 21 bp, Homo sapiens
caaatgtggcaattattttgg

SEQ ID NO: 492236 - DNA, 22 bp, Homo sapiens
caaatgtggcaattattttgga

SEQ ID NO: 492237 - DNA, 15 bp, Homo sapiens
caaatgttaacagag

SEQ ID NO: 492238 - DNA, 13 bp, Homo sapiens
caaattccaatac

SEQ ID NO: 492239 - DNA, 20 bp, Homo sapiens
caaattcctgttagccaggt

SEQ ID NO: 492240 - DNA, 12 bp, Homo sapiens
caacaaggaaat

SEQ ID NO: 492241 - DNA, 15 bp, Homo sapiens
caacaaggaaataga

SEQ ID NO: 492242 - DNA, 23 bp, Homo sapiens
caacaccttcagaggctgaggtg

SEQ ID NO: 492243 - DNA, 23 bp, Homo sapiens
caacatagtgagacccctgtctc

SEQ ID NO: 492244 - DNA, 16 bp, Homo sapiens
caacatggtgtctgga

SEQ ID NO: 492245 - DNA, 18 bp, Homo sapiens
caacatgtataatatttt

SEQ ID NO: 492246 - DNA, 16 bp, Homo sapiens
caactagtggagagaa

SEQ ID NO: 492247 - DNA, 18 bp, Homo sapiens
caactatgatttggaaaa

SEQ ID NO: 492248 - DNA, 19 bp, Homo sapiens
caactatgatttggaaaat

SEQ ID NO: 492249 - DNA, 19 bp, Homo sapiens
caactcctagggccactga

SEQ ID NO: 492250 - DNA, 22 bp, Homo sapiens
caactgaggcagacagcagctc

SEQ ID NO: 492251 - DNA, 14 bp, Homo sapiens
caactgctccagcc

SEQ ID NO: 492252 - DNA, 14 bp, Homo sapiens
caagaagcaggcta

SEQ ID NO: 492253 - DNA, 16 bp, Homo sapiens
caagacccaagtagct

SEQ ID NO: 492254 - DNA, 19 bp, Homo sapiens
caagactgcacatcaaaat

SEQ ID NO: 492255 - DNA, 12 bp, Homo sapiens
caagagctgagg

SEQ ID NO: 492256 - DNA, 18 bp, Homo sapiens
caagagtggtggcagctc

SEQ ID NO: 492257 - DNA, 20 bp, Homo sapiens
caagagtggtggcagctcaa

SEQ ID NO: 492258 - DNA, 13 bp, Homo sapiens
caagcaagaaaca

SEQ ID NO: 492259 - DNA, 23 bp, Homo sapiens
caagcaagctcccaagggatggt

SEQ ID NO: 492260 - DNA, 13 bp, Homo sapiens
caagcactgtgct

SEQ ID NO: 492261 - DNA, 16 bp, Homo sapiens
caagcatttagatgta

SEQ ID NO: 492262 - DNA, 19 bp, Homo sapiens
caagcatttagatgtatag

SEQ ID NO: 492263 - DNA, 17 bp, Homo sapiens
caagctagaacctggag

SEQ ID NO: 492264 - DNA, 18 bp, Homo sapiens
caagctagaacctggagg

SEQ ID NO: 492265 - DNA, 16 bp, Homo sapiens
caagctcaaagcgtgg

SEQ ID NO: 492266 - DNA, 13 bp, Homo sapiens
caagctcccaagg

SEQ ID NO: 492267 - DNA, 22 bp, Homo sapiens
caagctcccaagggatggtgcc

SEQ ID NO: 492268 - DNA, 14 bp, Homo sapiens
caaggaaaccacag

SEQ ID NO: 492269 - DNA, 22 bp, Homo sapiens
caaggaaaccacagctgctgga

SEQ ID NO: 492270 - DNA, 13 bp, Homo sapiens
caaggcactgcct

SEQ ID NO: 492271 - DNA, 14 bp, Homo sapiens
caaggcactgcctg

SEQ ID NO: 492272 - DNA, 16 bp, Homo sapiens
caaggcactgcctgat

SEQ ID NO: 492273 - DNA, 19 bp, Homo sapiens
caagggttcagagactcag

SEQ ID NO: 492274 - DNA, 16 bp, Homo sapiens
caaggtgagagaggta

SEQ ID NO: 492275 - DNA, 20 bp, Homo sapiens
caagtagctgctaccttctt

SEQ ID NO: 492276 - DNA, 14 bp, Homo sapiens
caagtattagaata

SEQ ID NO: 492277 - DNA, 20 bp, Homo sapiens
caagtattaggggtaatata

SEQ ID NO: 492278 - DNA, 22 bp, Homo sapiens
caagtgattgacaactgaagag

SEQ ID NO: 492279 - DNA, 23 bp, Homo sapiens
caagtgattgacaactgaagaga

SEQ ID NO: 492280 - DNA, 20 bp, Homo sapiens
caataaaatccatacatttg

SEQ ID NO: 492281 - DNA, 14 bp, Homo sapiens
caataaaccacaag

SEQ ID NO: 492282 - DNA, 15 bp, Homo sapiens
caataacacacagct

SEQ ID NO: 492283 - DNA, 21 bp, Homo sapiens
caatacattattggacttcca

SEQ ID NO: 492284 - DNA, 18 bp, Homo sapiens
caatagtaattctcaggc

SEQ ID NO: 492285 - DNA, 17 bp, Homo sapiens
caatagtcaaattgtgt

SEQ ID NO: 492286 - DNA, 23 bp, Homo sapiens
caatagttgctgtccccttccag

SEQ ID NO: 492287 - DNA, 13 bp, Homo sapiens
caatccaacccgg

SEQ ID NO: 492288 - DNA, 15 bp, Homo sapiens
caatccaagagtctg

SEQ ID NO: 492289 - DNA, 20 bp, Homo sapiens
caatgctgatgtcctcacca

SEQ ID NO: 492290 - DNA, 14 bp, Homo sapiens
caatgctgtatttt

SEQ ID NO: 492291 - DNA, 15 bp, Homo sapiens
caatgctgtatttta

SEQ ID NO: 492292 - DNA, 18 bp, Homo sapiens
caatggcttactccagga

SEQ ID NO: 492293 - DNA, 17 bp, Homo sapiens
caatggtttgcaaggaa

SEQ ID NO: 492294 - DNA, 19 bp, Homo sapiens
caatgttactatctgcttt

SEQ ID NO: 492295 - DNA, 12 bp, Homo sapiens
caattattttgg

SEQ ID NO: 492296 - DNA, 23 bp, Homo sapiens
caattattttggatctatcacct

SEQ ID NO: 492297 - DNA, 17 bp, Homo sapiens
caattcttacaaacatg

SEQ ID NO: 492298 - DNA, 19 bp, Homo sapiens
caattcttacaaacatgtg

SEQ ID NO: 492299 - DNA, 20 bp, Homo sapiens
caattcttccctatctttgc

SEQ ID NO: 492300 - DNA, 12 bp, Homo sapiens
caatttaaagca

SEQ ID NO: 492301 - DNA, 13 bp, Homo sapiens
caatttaaagcaa

SEQ ID NO: 492302 - DNA, 16 bp, Homo sapiens
cacaaagggcccagat

SEQ ID NO: 492303 - DNA, 14 bp, Homo sapiens
cacaacaccaggac

SEQ ID NO: 492304 - DNA, 16 bp, Homo sapiens
cacacaacaccaggac

SEQ ID NO: 492305 - DNA, 14 bp, Homo sapiens
cacacacacataca

SEQ ID NO: 492306 - DNA, 13 bp, Homo sapiens
cacacacatacag

SEQ ID NO: 492307 - DNA, 20 bp, Homo sapiens
cacacaggcaactgaggcag

SEQ ID NO: 492308 - DNA, 12 bp, Homo sapiens
cacacatacaga

SEQ ID NO: 492309 - DNA, 22 bp, Homo sapiens
cacacatgaagtccaagcattt

SEQ ID NO: 492310 - DNA, 18 bp, Homo sapiens
cacaccaagcagcaacag

SEQ ID NO: 492311 - DNA, 21 bp, Homo sapiens
cacaccaggcttgcctgcagg

SEQ ID NO: 492312 - DNA, 17 bp, Homo sapiens
cacacctgagccagcct

SEQ ID NO: 492313 - DNA, 14 bp, Homo sapiens
cacacgcctgtagt

SEQ ID NO: 492314 - DNA, 20 bp, Homo sapiens
cacacggtttgaagcctgga

SEQ ID NO: 492315 - DNA, 19 bp, Homo sapiens
cacactgggacttgcaaaa

SEQ ID NO: 492316 - DNA, 20 bp, Homo sapiens
cacagaagacttcccagctt

SEQ ID NO: 492317 - DNA, 23 bp, Homo sapiens
cacagactattgacatcagcatc

SEQ ID NO: 492318 - DNA, 15 bp, Homo sapiens
cacagatacacatac

SEQ ID NO: 492319 - DNA, 17 bp, Homo sapiens
cacagatgaaacacaaa

SEQ ID NO: 492320 - DNA, 19 bp, Homo sapiens
cacagcgtcctgtccacac

SEQ ID NO: 492321 - DNA, 17 bp, Homo sapiens
cacaggcaactgaggca

SEQ ID NO: 492322 - DNA, 18 bp, Homo sapiens
cacaggtgggcttcccag

SEQ ID NO: 492323 - DNA, 15 bp, Homo sapiens
catcttaagagatgc

SEQ ID NO: 492324 - DNA, 11 bp, Homo sapiens
catcttgagct

SEQ ID NO: 492325 - DNA, 21 bp, Homo sapiens
catctttcctgatggcaggat

SEQ ID NO: 492326 - DNA, 15 bp, Homo sapiens
catgaaaatgcaaca

SEQ ID NO: 492327 - DNA, 18 bp, Homo sapiens
catgaaggtttctgaaaa

SEQ ID NO: 492328 - DNA, 23 bp, Homo sapiens
catgaagtttccttggctggtgc

SEQ ID NO: 492329 - DNA, 15 bp, Homo sapiens
catgaatctgcaatg

SEQ ID NO: 492330 - DNA, 15 bp, Homo sapiens
catgacttttccatg

SEQ ID NO: 492331 - DNA, 14 bp, Homo sapiens
catgatgtttagaa

SEQ ID NO: 492332 - DNA, 19 bp, Homo sapiens
catgcagacatgagtgcgt

SEQ ID NO: 492333 - DNA, 13 bp, Homo sapiens
catgcctggcttc

SEQ ID NO: 492334 - DNA, 14 bp, Homo sapiens
catgcggagaacaa

SEQ ID NO: 492335 - DNA, 20 bp, Homo sapiens
catgctgaagccaaagccaa

SEQ ID NO: 492336 - DNA, 21 bp, Homo sapiens
catggaaattcccttcatctg

SEQ ID NO: 492337 - DNA, 20 bp, Homo sapiens
catggaattggagctcgtgg

SEQ ID NO: 492338 - DNA, 15 bp, Homo sapiens
catggactgagctgg

SEQ ID NO: 492339 - DNA, 14 bp, Homo sapiens
catggagagctaga

SEQ ID NO: 492340 - DNA, 13 bp, Homo sapiens
catggagagctgg

SEQ ID NO: 492341 - DNA, 16 bp, Homo sapiens
catggagagctggagc

SEQ ID NO: 492342 - DNA, 17 bp, Homo sapiens
catggagagctggagcc

SEQ ID NO: 492343 - DNA, 13 bp, Homo sapiens
catggagctggcc

SEQ ID NO: 492344 - DNA, 14 bp, Homo sapiens
catggccctcccag

SEQ ID NO: 492345 - DNA, 22 bp, Homo sapiens
catggctataaacaattacatg

SEQ ID NO: 492346 - DNA, 14 bp, Homo sapiens
catgggtcaagaga

SEQ ID NO: 492347 - DNA, 20 bp, Homo sapiens
catgtaggttgtctaaaaat

SEQ ID NO: 492348 - DNA, 14 bp, Homo sapiens
catgtatctacctc

SEQ ID NO: 492349 - DNA, 17 bp, Homo sapiens
catgtgcctctgtcctt

SEQ ID NO: 492350 - DNA, 20 bp, Homo sapiens
catgtgctagtaattggaaa

SEQ ID NO: 492351 - DNA, 17 bp, Homo sapiens
catgtggttaatgccat

SEQ ID NO: 492352 - DNA, 14 bp, Homo sapiens
catgttgagaggct

SEQ ID NO: 492353 - DNA, 12 bp, Homo sapiens
cattaaagttct

SEQ ID NO: 492354 - DNA, 16 bp, Homo sapiens
cattaagccttccaca

SEQ ID NO: 492355 - DNA, 12 bp, Homo sapiens
cattagagcagg

SEQ ID NO: 492356 - DNA, 19 bp, Homo sapiens
cattatatttattactgta

SEQ ID NO: 492357 - DNA, 22 bp, Homo sapiens
cattatgatgtgggtcaaggaa

SEQ ID NO: 492358 - DNA, 19 bp, Homo sapiens
cattattggacttccattt

SEQ ID NO: 492359 - DNA, 22 bp, Homo sapiens
cattccaactatctcatttcca

SEQ ID NO: 492360 - DNA, 12 bp, Homo sapiens
cattccatcctt

SEQ ID NO: 492361 - DNA, 15 bp, Homo sapiens
cattccattctggaa

SEQ ID NO: 492362 - DNA, 13 bp, Homo sapiens
cattcctgttctt

SEQ ID NO: 492363 - DNA, 14 bp, Homo sapiens
cattcctgttcttt

SEQ ID NO: 492364 - DNA, 16 bp, Homo sapiens
cattcctgttctttct

SEQ ID NO: 492365 - DNA, 13 bp, Homo sapiens
cattccttgcctg

SEQ ID NO: 492366 - DNA, 16 bp, Homo sapiens
cattctacacagagca

SEQ ID NO: 492367 - DNA, 16 bp, Homo sapiens
cattctcactctgctt

SEQ ID NO: 492368 - DNA, 18 bp, Homo sapiens
cattctgacccagggcct

SEQ ID NO: 492369 - DNA, 18 bp, Homo sapiens
cattgactatcaaactga

SEQ ID NO: 492370 - DNA, 23 bp, Homo sapiens
cattgcactctagcctggcaaca

SEQ ID NO: 492371 - DNA, 21 bp, Homo sapiens
cattgtttttaagaaaaacat

SEQ ID NO: 492372 - DNA, 19 bp, Homo sapiens
catttaagagacagtcacc

SEQ ID NO: 492373 - DNA, 14 bp, Homo sapiens
catttatctttgta

SEQ ID NO: 492374 - DNA, 19 bp, Homo sapiens
catttatttccatattaaa

SEQ ID NO: 492375 - DNA, 13 bp, Homo sapiens
catttattttgac

SEQ ID NO: 492376 - DNA, 22 bp, Homo sapiens
catttcaggagcagcctcagaa

SEQ ID NO: 492377 - DNA, 12 bp, Homo sapiens
catttccaagca

SEQ ID NO: 492378 - DNA, 20 bp, Homo sapiens
catttgctaactagcttgga

SEQ ID NO: 492379 - DNA, 16 bp, Homo sapiens
catttgctcatggaat

SEQ ID NO: 492380 - DNA, 18 bp, Homo sapiens
catttgctcatggaattg

SEQ ID NO: 492381 - DNA, 23 bp, Homo sapiens
catttgctgattgtctgaaattt

SEQ ID NO: 492382 - DNA, 19 bp, Homo sapiens
catttgtataaaataattt

SEQ ID NO: 492383 - DNA, 20 bp, Homo sapiens
catttgtataaaataatttt

SEQ ID NO: 492384 - DNA, 20 bp, Homo sapiens
catttttgaatacaggcata

SEQ ID NO: 492385 - DNA, 16 bp, Homo sapiens
ccaaagcagggtctgg

SEQ ID NO: 492386 - DNA, 19 bp, Homo sapiens
ccaaaggccatggagagct

SEQ ID NO: 492387 - DNA, 16 bp, Homo sapiens
ccaacaaggaaataga

SEQ ID NO: 492388 - DNA, 16 bp, Homo sapiens
ccaactgctccagcct

SEQ ID NO: 492389 - DNA, 20 bp, Homo sapiens
ccaactgctccagcctctgc

SEQ ID NO: 492390 - DNA, 22 bp, Homo sapiens
ccaagaagggctagaacctgga

SEQ ID NO: 492391 - DNA, 20 bp, Homo sapiens
ccaagctcaggaccaggcaa

SEQ ID NO: 492392 - DNA, 22 bp, Homo sapiens
ccaaggaaaccacagctgctgg

SEQ ID NO: 492393 - DNA, 20 bp, Homo sapiens
ccaagggatgaaagagaagg

SEQ ID NO: 492394 - DNA, 19 bp, Homo sapiens
ccaagtggcagagcttgga

SEQ ID NO: 492395 - DNA, 14 bp, Homo sapiens
ccaataacacacag

SEQ ID NO: 492396 - DNA, 16 bp, Homo sapiens
ccaataacacacagct

SEQ ID NO: 492397 - DNA, 16 bp, Homo sapiens
ccaatgctgcctggga

SEQ ID NO: 492398 - DNA, 20 bp, Homo sapiens
ccaattccttgcacatagta

SEQ ID NO: 492399 - DNA, 19 bp, Homo sapiens
ccaattcttacaaacatgt

SEQ ID NO: 492400 - DNA, 20 bp, Homo sapiens
ccacacaacaccaggactta

SEQ ID NO: 492401 - DNA, 16 bp, Homo sapiens
ccacacccagctcagc

SEQ ID NO: 492402 - DNA, 16 bp, Homo sapiens
ccacagaagctccagg

SEQ ID NO: 492403 - DNA, 18 bp, Homo sapiens
ccacagacctgctctgga

SEQ ID NO: 492404 - DNA, 16 bp, Homo sapiens
ccaccagccttgctct

SEQ ID NO: 492405 - DNA, 20 bp, Homo sapiens
ccaccagccttgctctcttc

SEQ ID NO: 492406 - DNA, 17 bp, Homo sapiens
ccacctactcctgggtc

SEQ ID NO: 492407 - DNA, 14 bp, Homo sapiens
ccacctccctgcaa

SEQ ID NO: 492408 - DNA, 21 bp, Homo sapiens
ccacctccctgcaataaaatg

SEQ ID NO: 492409 - DNA, 15 bp, Homo sapiens
ccactcctcttattt

SEQ ID NO: 492410 - DNA, 20 bp, Homo sapiens
ccactgcactccagcctggc

SEQ ID NO: 492411 - DNA, 14 bp, Homo sapiens
ccactgcctttgac

SEQ ID NO: 492412 - DNA, 20 bp, Homo sapiens
ccactttcttctaccagacc

SEQ ID NO: 492413 - DNA, 23 bp, Homo sapiens
ccagaaataaagttggtgacaga

SEQ ID NO: 492414 - DNA, 20 bp, Homo sapiens
ccagactcctgactgtctcc

SEQ ID NO: 492415 - DNA, 16 bp, Homo sapiens
ccagatgggggaaagc

SEQ ID NO: 492416 - DNA, 15 bp, Homo sapiens
ccagcaaaaggttgt

SEQ ID NO: 492417 - DNA, 17 bp, Homo sapiens
ccagcactaaagcagtg

SEQ ID NO: 492418 - DNA, 24 bp, Homo sapiens
ccagcactaaagcagtggacacca

SEQ ID NO: 492419 - DNA, 20 bp, Homo sapiens
ccagcactttgggaggccga

SEQ ID NO: 492420 - DNA, 21 bp, Homo sapiens
ccagcagccagctctcagcca

SEQ ID NO: 492421 - DNA, 15 bp, Homo sapiens
ccagcatcccttgac

SEQ ID NO: 492422 - DNA, 21 bp, Homo sapiens
ccagcatcccttgaccaggcc

SEQ ID NO: 492423 - DNA, 17 bp, Homo sapiens
ccagcctctgccgctgc

SEQ ID NO: 492424 - DNA, 18 bp, Homo sapiens
ccagcctgcctggcaggc

SEQ ID NO: 492425 - DNA, 14 bp, Homo sapiens
ccagccttgctctc

SEQ ID NO: 492426 - DNA, 22 bp, Homo sapiens
ccagccttgctctcttcaataa

SEQ ID NO: 492427 - DNA, 23 bp, Homo sapiens
ccagccttgctctcttcaataaa

SEQ ID NO: 492428 - DNA, 23 bp, Homo sapiens
ccagctcctcatccagggctctg

SEQ ID NO: 492429 - DNA, 14 bp, Homo sapiens
ccagctctcagcca

SEQ ID NO: 492430 - DNA, 15 bp, Homo sapiens
ccagctctcagccaa

SEQ ID NO: 492431 - DNA, 23 bp, Homo sapiens
ccagcttttcccaaaagcccatt

SEQ ID NO: 492432 - DNA, 17 bp, Homo sapiens
ccaggcaacttgggaac

SEQ ID NO: 492433 - DNA, 19 bp, Homo sapiens
ccaggcctcttggcagtca

SEQ ID NO: 492434 - DNA, 17 bp, Homo sapiens
ccaggcctgggccagag

SEQ ID NO: 492435 - DNA, 18 bp, Homo sapiens
ccaggctgggcaaggagg

SEQ ID NO: 492436 - DNA, 18 bp, Homo sapiens
ccagggacgaagaagagc

SEQ ID NO: 492437 - DNA, 23 bp, Homo sapiens
ccagggacgaagaagagccacag

SEQ ID NO: 492438 - DNA, 14 bp, Homo sapiens
ccagggcctaggac

SEQ ID NO: 492439 - DNA, 17 bp, Homo sapiens
ccagggcctggaagaca

SEQ ID NO: 492440 - DNA, 19 bp, Homo sapiens
ccagggcctggaagacaga

SEQ ID NO: 492441 - DNA, 20 bp, Homo sapiens
ccagggctgctagacggagg

SEQ ID NO: 492442 - DNA, 18 bp, Homo sapiens
ccaggggtcaccttgaga

SEQ ID NO: 492443 - DNA, 20 bp, Homo sapiens
ccaggtagagggtgtgtaag

SEQ ID NO: 492444 - DNA, 18 bp, Homo sapiens
ccagtacctcctgtctct

SEQ ID NO: 492445 - DNA, 20 bp, Homo sapiens
ccagtacctcctgtctctgg

SEQ ID NO: 492446 - DNA, 22 bp, Homo sapiens
ccagtacctcctgtctctggcc

SEQ ID NO: 492447 - DNA, 14 bp, Homo sapiens
ccagtccaaggaaa

SEQ ID NO: 492448 - DNA, 21 bp, Homo sapiens
ccagtgagatgcattcttggt

SEQ ID NO: 492449 - DNA, 18 bp, Homo sapiens
ccagtggctgctgcccag

SEQ ID NO: 492450 - DNA, 18 bp, Homo sapiens
ccagtttaacctgatgca

SEQ ID NO: 492451 - DNA, 16 bp, Homo sapiens
ccataaccgctgattc

SEQ ID NO: 492452 - DNA, 13 bp, Homo sapiens
ccatacatttgtg

SEQ ID NO: 492453 - DNA, 14 bp, Homo sapiens
ccatacatttgtgt

SEQ ID NO: 492454 - DNA, 22 bp, Homo sapiens
ccataccacccaatgctgatgt

SEQ ID NO: 492455 - DNA, 19 bp, Homo sapiens
ccatagaagaacagcagat

SEQ ID NO: 492456 - DNA, 18 bp, Homo sapiens
ccatcaagggtacactgc

SEQ ID NO: 492457 - DNA, 20 bp, Homo sapiens
ccatcagaaacaccctcaca

SEQ ID NO: 492458 - DNA, 17 bp, Homo sapiens
ccatcccctatggacca

SEQ ID NO: 492459 - DNA, 19 bp, Homo sapiens
cctgagctcggtggaccca

SEQ ID NO: 492460 - DNA, 16 bp, Homo sapiens
cctgatgcagtcacgt

SEQ ID NO: 492461 - DNA, 20 bp, Homo sapiens
cctgatggcaggatggcctg

SEQ ID NO: 492462 - DNA, 17 bp, Homo sapiens
cctgattgccaagctca

SEQ ID NO: 492463 - DNA, 22 bp, Homo sapiens
cctgctttcaagacccctgtct

SEQ ID NO: 492464 - DNA, 22 bp, Homo sapiens
cctggaagacagagacctcctg

SEQ ID NO: 492465 - DNA, 11 bp, Homo sapiens
cctggaagggc

SEQ ID NO: 492466 - DNA, 22 bp, Homo sapiens
cctggagagccagaacctggag

SEQ ID NO: 492467 - DNA, 14 bp, Homo sapiens
cctggagagctaga

SEQ ID NO: 492468 - DNA, 12 bp, Homo sapiens
cctggagggcta

SEQ ID NO: 492469 - DNA, 21 bp, Homo sapiens
cctggaggggctagaacctag

SEQ ID NO: 492470 - DNA, 16 bp, Homo sapiens
cctggcaacagagcga

SEQ ID NO: 492471 - DNA, 23 bp, Homo sapiens
cctggctacagggcgagactctg

SEQ ID NO: 492472 - DNA, 12 bp, Homo sapiens
cctgggaagggg

SEQ ID NO: 492473 - DNA, 14 bp, Homo sapiens
cctgggagccaggg

SEQ ID NO: 492474 - DNA, 22 bp, Homo sapiens
cctgggcagggatgatggcaga

SEQ ID NO: 492475 - DNA, 17 bp, Homo sapiens
cctgggcatactaataa

SEQ ID NO: 492476 - DNA, 22 bp, Homo sapiens
cctggggcctcggagcctcatc

SEQ ID NO: 492477 - DNA, 19 bp, Homo sapiens
cctgggggcagggagagga

SEQ ID NO: 492478 - DNA, 22 bp, Homo sapiens
cctggggtaccaagagactcct

SEQ ID NO: 492479 - DNA, 20 bp, Homo sapiens
cctggtgggcctcctctgtc

SEQ ID NO: 492480 - DNA, 15 bp, Homo sapiens
cctggttctgatgat

SEQ ID NO: 492481 - DNA, 21 bp, Homo sapiens
cctggttctgatgatgtgcct

SEQ ID NO: 492482 - DNA, 22 bp, Homo sapiens
cctgtcattcccaccaccctga

SEQ ID NO: 492483 - DNA, 22 bp, Homo sapiens
cctgtccacacccagctcagca

SEQ ID NO: 492484 - DNA, 16 bp, Homo sapiens
cctgtctgccagccag

SEQ ID NO: 492485 - DNA, 19 bp, Homo sapiens
cctgtctgccagccagcag

SEQ ID NO: 492486 - DNA, 20 bp, Homo sapiens
cctgtctgccagccagcagc

SEQ ID NO: 492487 - DNA, 23 bp, Homo sapiens
cctgtctgccagccagcagccag

SEQ ID NO: 492488 - DNA, 22 bp, Homo sapiens
cctgtgaaagactcaatgagct

SEQ ID NO: 492489 - DNA, 18 bp, Homo sapiens
cctgtgaagtaaggatgt

SEQ ID NO: 492490 - DNA, 22 bp, Homo sapiens
ccttagcttagacctcagcctg

SEQ ID NO: 492491 - DNA, 23 bp, Homo sapiens
ccttagcttagacctcagcctgt

SEQ ID NO: 492492 - DNA, 12 bp, Homo sapiens
ccttcatgcatg

SEQ ID NO: 492493 - DNA, 21 bp, Homo sapiens
ccttcccatgacccaggctgg

SEQ ID NO: 492494 - DNA, 22 bp, Homo sapiens
ccttccccttgcccagggctca

SEQ ID NO: 492495 - DNA, 20 bp, Homo sapiens
ccttgaacactgggggaggg

SEQ ID NO: 492496 - DNA, 15 bp, Homo sapiens
ccttgaccaggcctg

SEQ ID NO: 492497 - DNA, 21 bp, Homo sapiens
ccttgagagaccaggcaaagc

SEQ ID NO: 492498 - DNA, 13 bp, Homo sapiens
ccttgcccagggc

SEQ ID NO: 492499 - DNA, 16 bp, Homo sapiens
ccttgcccagggctca

SEQ ID NO: 492500 - DNA, 21 bp, Homo sapiens
ccttgcggggataaagagaga

SEQ ID NO: 492501 - DNA, 12 bp, Homo sapiens
ccttgctctctt

SEQ ID NO: 492502 - DNA, 14 bp, Homo sapiens
ccttgtatttaaat

SEQ ID NO: 492503 - DNA, 22 bp, Homo sapiens
ccttgtggcctgggcctcctca

SEQ ID NO: 492504 - DNA, 12 bp, Homo sapiens
cctttcagctgt

SEQ ID NO: 492505 - DNA, 21 bp, Homo sapiens
cctttgacctgcctcccttca

SEQ ID NO: 492506 - DNA, 14 bp, Homo sapiens
cctttgggaagggg

SEQ ID NO: 492507 - DNA, 22 bp, Homo sapiens
ccttttttatttttttaagctg

SEQ ID NO: 492508 - DNA, 22 bp, Homo sapiens
cgaaaagagcacttcacacaga

SEQ ID NO: 492509 - DNA, 15 bp, Homo sapiens
cgaagaagagccaca

SEQ ID NO: 492510 - DNA, 16 bp, Homo sapiens
cgaagaagagccacag

SEQ ID NO: 492511 - DNA, 18 bp, Homo sapiens
cgaagaagagccacagtg

SEQ ID NO: 492512 - DNA, 15 bp, Homo sapiens
cgagactctgtctca

SEQ ID NO: 492513 - DNA, 21 bp, Homo sapiens
cgaggacatgaaactccacct

SEQ ID NO: 492514 - DNA, 16 bp, Homo sapiens
cgagtttggtccctgg

SEQ ID NO: 492515 - DNA, 21 bp, Homo sapiens
cgatgggcccaattcttacaa

SEQ ID NO: 492516 - DNA, 22 bp, Homo sapiens
cgcacaatagtaacctgggtaa

SEQ ID NO: 492517 - DNA, 14 bp, Homo sapiens
cgcacgcacacaca

SEQ ID NO: 492518 - DNA, 23 bp, Homo sapiens
cgcacgcacacacacatacagag

SEQ ID NO: 492519 - DNA, 15 bp, Homo sapiens
cgcatcctagtctct

SEQ ID NO: 492520 - DNA, 16 bp, Homo sapiens
cgcccaccagccttgc

SEQ ID NO: 492521 - DNA, 22 bp, Homo sapiens
cgcccaccagccttgctctctt

SEQ ID NO: 492522 - DNA, 10 bp, Homo sapiens
cgcccctccc

SEQ ID NO: 492523 - DNA, 17 bp, Homo sapiens
cgcctgggtccagggga

SEQ ID NO: 492524 - DNA, 20 bp, Homo sapiens
cgcgcctttccgcggagccc

SEQ ID NO: 492525 - DNA, 20 bp, Homo sapiens
cgctcctgtctgccagccag

SEQ ID NO: 492526 - DNA, 20 bp, Homo sapiens
cggaaggaatgtcagggcca

SEQ ID NO: 492527 - DNA, 19 bp, Homo sapiens
cggagcccttggcccctcg

SEQ ID NO: 492528 - DNA, 22 bp, Homo sapiens
cggagcctcatccgaggcaggg

SEQ ID NO: 492529 - DNA, 20 bp, Homo sapiens
cggataggcaggaacataca

SEQ ID NO: 492530 - DNA, 21 bp, Homo sapiens
cggataggcaggaacatacag

SEQ ID NO: 492531 - DNA, 14 bp, Homo sapiens
cggccctatgcatg

SEQ ID NO: 492532 - DNA, 14 bp, Homo sapiens
cgggaaggagggtt

SEQ ID NO: 492533 - DNA, 14 bp, Homo sapiens
cgggcacaataaat

SEQ ID NO: 492534 - DNA, 20 bp, Homo sapiens
cggtaaaacaccggagacta

SEQ ID NO: 492535 - DNA, 16 bp, Homo sapiens
cggtgatcagcagaga

SEQ ID NO: 492536 - DNA, 14 bp, Homo sapiens
cggtgctccaggca

SEQ ID NO: 492537 - DNA, 15 bp, Homo sapiens
cggtgctccaggcag

SEQ ID NO: 492538 - DNA, 23 bp, Homo sapiens
cgtcctgtccacacccagctcag

SEQ ID NO: 492539 - DNA, 13 bp, Homo sapiens
cgtgaagggattt

SEQ ID NO: 492540 - DNA, 14 bp, Homo sapiens
cgttaccaggcagg

SEQ ID NO: 492541 - DNA, 20 bp, Homo sapiens
ctaaaacaaaagctcatcca

SEQ ID NO: 492542 - DNA, 15 bp, Homo sapiens
ctaaaacctgagcta

SEQ ID NO: 492543 - DNA, 16 bp, Homo sapiens
ctaaacagactattta

SEQ ID NO: 492544 - DNA, 13 bp, Homo sapiens
ctaaagtttacag

SEQ ID NO: 492545 - DNA, 21 bp, Homo sapiens
ctaaatcaccagagaccaaac

SEQ ID NO: 492546 - DNA, 15 bp, Homo sapiens
ctaagagagaatgag

SEQ ID NO: 492547 - DNA, 19 bp, Homo sapiens
ctaaggcgtggagctgcct

SEQ ID NO: 492548 - DNA, 20 bp, Homo sapiens
ctaaggcgtggagctgcctg

SEQ ID NO: 492549 - DNA, 19 bp, Homo sapiens
ctaaggtcattaccacagg

SEQ ID NO: 492550 - DNA, 12 bp, Homo sapiens
ctaatacaccag

SEQ ID NO: 492551 - DNA, 15 bp, Homo sapiens
ctaatccaatacctc

SEQ ID NO: 492552 - DNA, 19 bp, Homo sapiens
ctaatgaatgcataaaatg

SEQ ID NO: 492553 - DNA, 22 bp, Homo sapiens
ctaatgaatgcataaaatgtta

SEQ ID NO: 492554 - DNA, 14 bp, Homo sapiens
ctacacagggatgt

SEQ ID NO: 492555 - DNA, 22 bp, Homo sapiens
ctacagggcgagactctgtctc

SEQ ID NO: 492556 - DNA, 15 bp, Homo sapiens
ctaccacacatctgt

SEQ ID NO: 492557 - DNA, 16 bp, Homo sapiens
ctacctcacctgggca

SEQ ID NO: 492558 - DNA, 22 bp, Homo sapiens
ctacctcactattcaagtatta

SEQ ID NO: 492559 - DNA, 18 bp, Homo sapiens
ctaccttccagttcctca

SEQ ID NO: 492560 - DNA, 13 bp, Homo sapiens
ctaccttctttgg

SEQ ID NO: 492561 - DNA, 17 bp, Homo sapiens
ctacgtacatgtgaggc

SEQ ID NO: 492562 - DNA, 20 bp, Homo sapiens
ctactcaggaggctgaggca

SEQ ID NO: 492563 - DNA, 23 bp, Homo sapiens
ctactcaggaggctgaggcagga

SEQ ID NO: 492564 - DNA, 15 bp, Homo sapiens
ctagaacctggagag

SEQ ID NO: 492565 - DNA, 17 bp, Homo sapiens
ctagaatactaataaaa

SEQ ID NO: 492566 - DNA, 20 bp, Homo sapiens
ctagaatctggagagctaga

SEQ ID NO: 492567 - DNA, 18 bp, Homo sapiens
ctagactcccaagctgga

SEQ ID NO: 492568 - DNA, 18 bp, Homo sapiens
ctagagtttagctggaaa

SEQ ID NO: 492569 - DNA, 17 bp, Homo sapiens
ctagccgacctcagcct

SEQ ID NO: 492570 - DNA, 18 bp, Homo sapiens
ctagccgacctcagcctt

SEQ ID NO: 492571 - DNA, 14 bp, Homo sapiens
ctaggaaatattta

SEQ ID NO: 492572 - DNA, 13 bp, Homo sapiens
ctaggcaggacat

SEQ ID NO: 492573 - DNA, 14 bp, Homo sapiens
ctagggaagggtgg

SEQ ID NO: 492574 - DNA, 15 bp, Homo sapiens
ctagggccactgaag

SEQ ID NO: 492575 - DNA, 18 bp, Homo sapiens
ctagggttccactggaga

SEQ ID NO: 492576 - DNA, 22 bp, Homo sapiens
ctagtatttctatgaaatatta

SEQ ID NO: 492577 - DNA, 20 bp, Homo sapiens
ctagtctctatcattaaagt

SEQ ID NO: 492578 - DNA, 21 bp, Homo sapiens
ctagtctctatcattaaagtt

SEQ ID NO: 492579 - DNA, 20 bp, Homo sapiens
ctagtgaaactcgttaattt

SEQ ID NO: 492580 - DNA, 16 bp, Homo sapiens
ctataaacaattacat

SEQ ID NO: 492581 - DNA, 20 bp, Homo sapiens
ctatacctgggcatactaat

SEQ ID NO: 492582 - DNA, 21 bp, Homo sapiens
ctatacctgggcatactaata

SEQ ID NO: 492583 - DNA, 22 bp, Homo sapiens
ctatagattctttattagtgaa

SEQ ID NO: 492584 - DNA, 13 bp, Homo sapiens
ctatagtcccagc

SEQ ID NO: 492585 - DNA, 13 bp, Homo sapiens
ctatcacctgtca

SEQ ID NO: 492586 - DNA, 17 bp, Homo sapiens
ctatcattaaagttcta

SEQ ID NO: 492587 - DNA, 13 bp, Homo sapiens
ctatcccttctca

SEQ ID NO: 492588 - DNA, 15 bp, Homo sapiens
ctatcccttctcaga

SEQ ID NO: 492589 - DNA, 19 bp, Homo sapiens
ctatcctggctctttggag

SEQ ID NO: 492590 - DNA, 18 bp, Homo sapiens
ctatctcatttccaagca

SEQ ID NO: 492591 - DNA, 18 bp, Homo sapiens
ctatctttgccaccctca

SEQ ID NO: 492592 - DNA, 13 bp, Homo sapiens
ctatgaaatatta

SEQ ID NO: 492593 - DNA, 22 bp, Homo sapiens
ctatggacggtgctccaggcag

SEQ ID NO: 492594 - DNA, 22 bp, Homo sapiens
ctattgacatcagcatcaccta

SEQ ID NO: 492595 - DNA, 21 bp, Homo sapiens
cttcctccgaggccagtacct

SEQ ID NO: 492596 - DNA, 12 bp, Homo sapiens
cttctccccaga

SEQ ID NO: 492597 - DNA, 20 bp, Homo sapiens
cttcttggtcttatttatta

SEQ ID NO: 492598 - DNA, 20 bp, Homo sapiens
cttgaacaatcaaggcaact

SEQ ID NO: 492599 - DNA, 19 bp, Homo sapiens
cttgaacctgggaggcaga

SEQ ID NO: 492600 - DNA, 17 bp, Homo sapiens
cttgacagaacactgtc

SEQ ID NO: 492601 - DNA, 17 bp, Homo sapiens
cttgaccaggcctgggc

SEQ ID NO: 492602 - DNA, 16 bp, Homo sapiens
cttgagccctcctgga

SEQ ID NO: 492603 - DNA, 23 bp, Homo sapiens
cttgagctcttcatttattttga

SEQ ID NO: 492604 - DNA, 17 bp, Homo sapiens
cttgaggattttgagta

SEQ ID NO: 492605 - DNA, 13 bp, Homo sapiens
cttgcagagcttg

SEQ ID NO: 492606 - DNA, 13 bp, Homo sapiens
cttgcagcaggat

SEQ ID NO: 492607 - DNA, 17 bp, Homo sapiens
cttgccactgcactcca

SEQ ID NO: 492608 - DNA, 16 bp, Homo sapiens
cttgccagacatgtgg

SEQ ID NO: 492609 - DNA, 21 bp, Homo sapiens
cttgccatccctccctccacc

SEQ ID NO: 492610 - DNA, 14 bp, Homo sapiens
cttgcccagggctc

SEQ ID NO: 492611 - DNA, 16 bp, Homo sapiens
cttgcccagggctcag

SEQ ID NO: 492612 - DNA, 19 bp, Homo sapiens
cttgcccagggctcagcct

SEQ ID NO: 492613 - DNA, 20 bp, Homo sapiens
cttgcccagggctcagcctg

SEQ ID NO: 492614 - DNA, 16 bp, Homo sapiens
cttgctctcttcaata

SEQ ID NO: 492615 - DNA, 18 bp, Homo sapiens
cttgctctcttcaataaa

SEQ ID NO: 492616 - DNA, 20 bp, Homo sapiens
cttgctgaatcggaatctct

SEQ ID NO: 492617 - DNA, 13 bp, Homo sapiens
cttggacttgagg

SEQ ID NO: 492618 - DNA, 15 bp, Homo sapiens
cttgggtaggcggga

SEQ ID NO: 492619 - DNA, 19 bp, Homo sapiens
cttggtggctcacgcctgt

SEQ ID NO: 492620 - DNA, 23 bp, Homo sapiens
cttgtaactgggttcaaaaagaa

SEQ ID NO: 492621 - DNA, 12 bp, Homo sapiens
cttgtatttaaa

SEQ ID NO: 492622 - DNA, 22 bp, Homo sapiens
cttgtgtttttaactcaatatt

SEQ ID NO: 492623 - DNA, 16 bp, Homo sapiens
ctttaacagctttctc

SEQ ID NO: 492624 - DNA, 20 bp, Homo sapiens
ctttaacagctttctccaga

SEQ ID NO: 492625 - DNA, 12 bp, Homo sapiens
ctttaatataaa

SEQ ID NO: 492626 - DNA, 23 bp, Homo sapiens
ctttaattgttaagatatgatgt

SEQ ID NO: 492627 - DNA, 14 bp, Homo sapiens
ctttagtggcttca

SEQ ID NO: 492628 - DNA, 16 bp, Homo sapiens
ctttatggtaaagatg

SEQ ID NO: 492629 - DNA, 23 bp, Homo sapiens
ctttattagtgaagtatgcacta

SEQ ID NO: 492630 - DNA, 15 bp, Homo sapiens
ctttcagtgaaagca

SEQ ID NO: 492631 - DNA, 17 bp, Homo sapiens
ctttcagtgaaagcatc

SEQ ID NO: 492632 - DNA, 19 bp, Homo sapiens
ctttccctgcttaatgaaa

SEQ ID NO: 492633 - DNA, 13 bp, Homo sapiens
ctttctatctaat

SEQ ID NO: 492634 - DNA, 18 bp, Homo sapiens
ctttctatctaattttta

SEQ ID NO: 492635 - DNA, 18 bp, Homo sapiens
ctttgaagaggaaaatga

SEQ ID NO: 492636 - DNA, 15 bp, Homo sapiens
ctttgacctgcctcc

SEQ ID NO: 492637 - DNA, 19 bp, Homo sapiens
ctttgaggaggaagcagaa

SEQ ID NO: 492638 - DNA, 14 bp, Homo sapiens
ctttgagtccacgc

SEQ ID NO: 492639 - DNA, 16 bp, Homo sapiens
ctttgagtccacgccc

SEQ ID NO: 492640 - DNA, 16 bp, Homo sapiens
ctttgcaagaaagtca

SEQ ID NO: 492641 - DNA, 19 bp, Homo sapiens
ctttgcatagcagctgcta

SEQ ID NO: 492642 - DNA, 15 bp, Homo sapiens
ctttgcatgatctgt

SEQ ID NO: 492643 - DNA, 16 bp, Homo sapiens
ctttgccaccctcatg

SEQ ID NO: 492644 - DNA, 18 bp, Homo sapiens
ctttgctgagcctgtaaa

SEQ ID NO: 492645 - DNA, 16 bp, Homo sapiens
ctttggagatcaagga

SEQ ID NO: 492646 - DNA, 14 bp, Homo sapiens
ctttggctgcatgc

SEQ ID NO: 492647 - DNA, 20 bp, Homo sapiens
ctttggggcttttacaccag

SEQ ID NO: 492648 - DNA, 18 bp, Homo sapiens
ctttgggggagtgggcgc

SEQ ID NO: 492649 - DNA, 22 bp, Homo sapiens
ctttgggggagtgggcgcagtg

SEQ ID NO: 492650 - DNA, 21 bp, Homo sapiens
ctttggtgcgggcacaataaa

SEQ ID NO: 492651 - DNA, 17 bp, Homo sapiens
cttttatttcttaaaca

SEQ ID NO: 492652 - DNA, 22 bp, Homo sapiens
cttttggccgggcatggtagct

SEQ ID NO: 492653 - DNA, 16 bp, Homo sapiens
ctttttcccaataaat

SEQ ID NO: 492654 - DNA, 17 bp, Homo sapiens
ctttttcccaataaatt

SEQ ID NO: 492655 - DNA, 13 bp, Homo sapiens
gaaaaacatgtca

SEQ ID NO: 492656 - DNA, 17 bp, Homo sapiens
gaaaacattccatcctt

SEQ ID NO: 492657 - DNA, 19 bp, Homo sapiens
gaaaactgcaacttgtaaa

SEQ ID NO: 492658 - DNA, 15 bp, Homo sapiens
gaaaacttatttgag

SEQ ID NO: 492659 - DNA, 23 bp, Homo sapiens
gaaaagagcacttcacacagaca

SEQ ID NO: 492660 - DNA, 11 bp, Homo sapiens
gaaaaggcagg

SEQ ID NO: 492661 - DNA, 13 bp, Homo sapiens
gaaaatgaataat

SEQ ID NO: 492662 - DNA, 18 bp, Homo sapiens
gaaaatgcaacaacatgt

SEQ ID NO: 492663 - DNA, 15 bp, Homo sapiens
gaaaattaacactgc

SEQ ID NO: 492664 - DNA, 16 bp, Homo sapiens
gaaacacaactatatt

SEQ ID NO: 492665 - DNA, 17 bp, Homo sapiens
gaaacactgactcctgt

SEQ ID NO: 492666 - DNA, 22 bp, Homo sapiens
gaaacataaataaaatgaccag

SEQ ID NO: 492667 - DNA, 11 bp, Homo sapiens
gaaacatttgg

SEQ ID NO: 492668 - DNA, 17 bp, Homo sapiens
gaaaccacagctgctgg

SEQ ID NO: 492669 - DNA, 20 bp, Homo sapiens
gaaaccacagctgctggaga

SEQ ID NO: 492670 - DNA, 17 bp, Homo sapiens
gaaaccattgttcagaa

SEQ ID NO: 492671 - DNA, 18 bp, Homo sapiens
gaaacctgttctaccaat

SEQ ID NO: 492672 - DNA, 20 bp, Homo sapiens
gaaactccaccttgcgggga

SEQ ID NO: 492673 - DNA, 21 bp, Homo sapiens
gaaactccaccttgcggggat

SEQ ID NO: 492674 - DNA, 20 bp, Homo sapiens
gaaacttgttagaaatgcaa

SEQ ID NO: 492675 - DNA, 14 bp, Homo sapiens
gaaagacagagctg

SEQ ID NO: 492676 - DNA, 15 bp, Homo sapiens
gaaagagaaggtggg

SEQ ID NO: 492677 - DNA, 17 bp, Homo sapiens
gaaaggaaaagattcct

SEQ ID NO: 492678 - DNA, 14 bp, Homo sapiens
gaaaggagaggaaa

SEQ ID NO: 492679 - DNA, 20 bp, Homo sapiens
gaaatagctccgtggagcag

SEQ ID NO: 492680 - DNA, 15 bp, Homo sapiens
gaaatatacacacag

SEQ ID NO: 492681 - DNA, 13 bp, Homo sapiens
gaaatatttattt

SEQ ID NO: 492682 - DNA, 15 bp, Homo sapiens
gaaatatttatttta

SEQ ID NO: 492683 - DNA, 13 bp, Homo sapiens
gaaatatttttga

SEQ ID NO: 492684 - DNA, 21 bp, Homo sapiens
gaaattcccttcatctggaac

SEQ ID NO: 492685 - DNA, 22 bp, Homo sapiens
gaaattcccttcatctggaacc

SEQ ID NO: 492686 - DNA, 15 bp, Homo sapiens
gaacaaagtgagaca

SEQ ID NO: 492687 - DNA, 17 bp, Homo sapiens
gaacagattcacactgt

SEQ ID NO: 492688 - DNA, 21 bp, Homo sapiens
gaacagattcacactgtctgg

SEQ ID NO: 492689 - DNA, 18 bp, Homo sapiens
gaacagccgctcctgtct

SEQ ID NO: 492690 - DNA, 12 bp, Homo sapiens
gaacatacagac

SEQ ID NO: 492691 - DNA, 22 bp, Homo sapiens
gaacatcatcaaggcactgcct

SEQ ID NO: 492692 - DNA, 15 bp, Homo sapiens
gaacatggagagcta

SEQ ID NO: 492693 - DNA, 21 bp, Homo sapiens
gaacccaaagagacagctctt

SEQ ID NO: 492694 - DNA, 15 bp, Homo sapiens
gaacctggagagcta

SEQ ID NO: 492695 - DNA, 21 bp, Homo sapiens
gaactagagtttagctggaaa

SEQ ID NO: 492696 - DNA, 21 bp, Homo sapiens
gaactctcctgctcctcagga

SEQ ID NO: 492697 - DNA, 17 bp, Homo sapiens
gaactggagccatgggc

SEQ ID NO: 492698 - DNA, 18 bp, Homo sapiens
gaactggagccatgggca

SEQ ID NO: 492699 - DNA, 16 bp, Homo sapiens
gaactttgaggaggaa

SEQ ID NO: 492700 - DNA, 17 bp, Homo sapiens
gaagaaagagaaggagc

SEQ ID NO: 492701 - DNA, 12 bp, Homo sapiens
gaagaactgaaa

SEQ ID NO: 492702 - DNA, 15 bp, Homo sapiens
gaagaagagccacag

SEQ ID NO: 492703 - DNA, 11 bp, Homo sapiens
gaagactgtgg

SEQ ID NO: 492704 - DNA, 15 bp, Homo sapiens
gaagacttcccagct

SEQ ID NO: 492705 - DNA, 16 bp, Homo sapiens
gaagagagatcaaatg

SEQ ID NO: 492706 - DNA, 13 bp, Homo sapiens
gaagagccacagt

SEQ ID NO: 492707 - DNA, 15 bp, Homo sapiens
gaagctactttgttt

SEQ ID NO: 492708 - DNA, 18 bp, Homo sapiens
gaagctcttgaagacact

SEQ ID NO: 492709 - DNA, 22 bp, Homo sapiens
gaaggccagctgccccagccag

SEQ ID NO: 492710 - DNA, 21 bp, Homo sapiens
gaaggctcttctccccagagt

SEQ ID NO: 492711 - DNA, 19 bp, Homo sapiens
gaagggctagaacctggag

SEQ ID NO: 492712 - DNA, 22 bp, Homo sapiens
gaagggctagaacctggagagc

SEQ ID NO: 492713 - DNA, 23 bp, Homo sapiens
gaaggtggtgggggtgcagatga

SEQ ID NO: 492714 - DNA, 18 bp, Homo sapiens
gaagtcgtcttaactcac

SEQ ID NO: 492715 - DNA, 13 bp, Homo sapiens
gaagtgactttgg

SEQ ID NO: 492716 - DNA, 21 bp, Homo sapiens
gaagttgatatagaacagtgc

SEQ ID NO: 492717 - DNA, 16 bp, Homo sapiens
gaataatacattgaat

SEQ ID NO: 492718 - DNA, 13 bp, Homo sapiens
gaatataaacact

SEQ ID NO: 492719 - DNA, 14 bp, Homo sapiens
gaatataaacacta

SEQ ID NO: 492720 - DNA, 21 bp, Homo sapiens
gaatataaacactatatggca

SEQ ID NO: 492721 - DNA, 19 bp, Homo sapiens
gaatatgagctttatgtaa

SEQ ID NO: 492722 - DNA, 15 bp, Homo sapiens
gaatattaaaaatta

SEQ ID NO: 492723 - DNA, 23 bp, Homo sapiens
gaatattaaaaattaattcttta

SEQ ID NO: 492724 - DNA, 20 bp, Homo sapiens
gaatatttgtcgatatttcc

SEQ ID NO: 492725 - DNA, 20 bp, Homo sapiens
gaatgagagacacactgaag

SEQ ID NO: 492726 - DNA, 23 bp, Homo sapiens
gaatgagagacacactgaagaag

SEQ ID NO: 492727 - DNA, 18 bp, Homo sapiens
gaatgcctgagtgcctgg

SEQ ID NO: 492728 - DNA, 22 bp, Homo sapiens
gaatggcacagcccaaagaagg

SEQ ID NO: 492729 - DNA, 13 bp, Homo sapiens
gaatgggaaaaga

SEQ ID NO: 492730 - DNA, 19 bp, Homo sapiens
gaatgggaagcagctcaag

SEQ ID NO: 492731 - DNA, 15 bp, Homo sapiens
gaatgtcagggccag

SEQ ID NO: 492732 - DNA, 16 bp, Homo sapiens
gagtacaggtgaagca

SEQ ID NO: 492733 - DNA, 20 bp, Homo sapiens
gagtagaaagacagagctgg

SEQ ID NO: 492734 - DNA, 13 bp, Homo sapiens
gagtcatgtgcct

SEQ ID NO: 492735 - DNA, 13 bp, Homo sapiens
gagtccacgccca

SEQ ID NO: 492736 - DNA, 19 bp, Homo sapiens
gagtccacgcccaccagcc

SEQ ID NO: 492737 - DNA, 22 bp, Homo sapiens
gagtctcaataaactgaatttt

SEQ ID NO: 492738 - DNA, 12 bp, Homo sapiens
gagtctgatgat

SEQ ID NO: 492739 - DNA, 19 bp, Homo sapiens
gagtgcaggcctgctcagg

SEQ ID NO: 492740 - DNA, 14 bp, Homo sapiens
gagtgcgtgctcag

SEQ ID NO: 492741 - DNA, 10 bp, Homo sapiens
gagtggaggc

SEQ ID NO: 492742 - DNA, 12 bp, Homo sapiens
gagtggaggcat

SEQ ID NO: 492743 - DNA, 17 bp, Homo sapiens
gagtgtgtttgtcaccg

SEQ ID NO: 492744 - DNA, 14 bp, Homo sapiens
gagttcaagaccag

SEQ ID NO: 492745 - DNA, 22 bp, Homo sapiens
gagttctgttgtgtttgtcaaa

SEQ ID NO: 492746 - DNA, 22 bp, Homo sapiens
gataaatggcttcctggcaata

SEQ ID NO: 492747 - DNA, 16 bp, Homo sapiens
gataacaacctggaga

SEQ ID NO: 492748 - DNA, 17 bp, Homo sapiens
gataacaacctggagac

SEQ ID NO: 492749 - DNA, 17 bp, Homo sapiens
gataagaccaccacctc

SEQ ID NO: 492750 - DNA, 20 bp, Homo sapiens
gataagagggcacacactgt

SEQ ID NO: 492751 - DNA, 14 bp, Homo sapiens
gataataaaattca

SEQ ID NO: 492752 - DNA, 17 bp, Homo sapiens
gataataaaattcattc

SEQ ID NO: 492753 - DNA, 22 bp, Homo sapiens
gataataaaattcattccattt

SEQ ID NO: 492754 - DNA, 14 bp, Homo sapiens
gataatacattccg

SEQ ID NO: 492755 - DNA, 16 bp, Homo sapiens
gatagtattgtgcata

SEQ ID NO: 492756 - DNA, 17 bp, Homo sapiens
gatatttccatcattaa

SEQ ID NO: 492757 - DNA, 22 bp, Homo sapiens
gatatttccctcccctggggac

SEQ ID NO: 492758 - DNA, 16 bp, Homo sapiens
gatcaaattctacaac

SEQ ID NO: 492759 - DNA, 22 bp, Homo sapiens
gatccccaactgctccagcctc

SEQ ID NO: 492760 - DNA, 14 bp, Homo sapiens
gatccctctctgga

SEQ ID NO: 492761 - DNA, 20 bp, Homo sapiens
gatcgcaagagccatgtaga

SEQ ID NO: 492762 - DNA, 18 bp, Homo sapiens
gatctatcacctgtcatc

SEQ ID NO: 492763 - DNA, 16 bp, Homo sapiens
gatgaaatgtaaatac

SEQ ID NO: 492764 - DNA, 19 bp, Homo sapiens
gatgaagcaaacacattaa

SEQ ID NO: 492765 - DNA, 17 bp, Homo sapiens
gatgatggcagagccag

SEQ ID NO: 492766 - DNA, 16 bp, Homo sapiens
gatgcagcattatgat

SEQ ID NO: 492767 - DNA, 18 bp, Homo sapiens
gatgcagttctgaagaag

SEQ ID NO: 492768 - DNA, 22 bp, Homo sapiens
gatgcctgattgccaagctcag

SEQ ID NO: 492769 - DNA, 21 bp, Homo sapiens
gatgctttaagtgcacaacat

SEQ ID NO: 492770 - DNA, 13 bp, Homo sapiens
gatggcagagcca

SEQ ID NO: 492771 - DNA, 23 bp, Homo sapiens
gatggcagagccaggctgttgga

SEQ ID NO: 492772 - DNA, 18 bp, Homo sapiens
gatggcaggatggcctgg

SEQ ID NO: 492773 - DNA, 21 bp, Homo sapiens
gatggcaggatggcctggcca

SEQ ID NO: 492774 - DNA, 13 bp, Homo sapiens
gatggcctgagaa

SEQ ID NO: 492775 - DNA, 14 bp, Homo sapiens
gatggcctggccag

SEQ ID NO: 492776 - DNA, 21 bp, Homo sapiens
gatggcctggccagggcctgg

SEQ ID NO: 492777 - DNA, 16 bp, Homo sapiens
gatggggctgagcagg

SEQ ID NO: 492778 - DNA, 15 bp, Homo sapiens
gatgtgcctgggtgg

SEQ ID NO: 492779 - DNA, 18 bp, Homo sapiens
gatgttcactgtggcatt

SEQ ID NO: 492780 - DNA, 14 bp, Homo sapiens
gatgttggctggga

SEQ ID NO: 492781 - DNA, 15 bp, Homo sapiens
gatgttggctgggaa

SEQ ID NO: 492782 - DNA, 14 bp, Homo sapiens
gattaagtaatgat

SEQ ID NO: 492783 - DNA, 21 bp, Homo sapiens
gattatttgttatttgtacag

SEQ ID NO: 492784 - DNA, 17 bp, Homo sapiens
gattcccaggatgagca

SEQ ID NO: 492785 - DNA, 17 bp, Homo sapiens
gattcctttgaagagga

SEQ ID NO: 492786 - DNA, 17 bp, Homo sapiens
gattctcagggtctctg

SEQ ID NO: 492787 - DNA, 22 bp, Homo sapiens
gattctcagggtctctgctgcc

SEQ ID NO: 492788 - DNA, 23 bp, Homo sapiens
gattctcagggtctctgctgccg

SEQ ID NO: 492789 - DNA, 14 bp, Homo sapiens
gattgcaatttgca

SEQ ID NO: 492790 - DNA, 15 bp, Homo sapiens
gatttaccacttgtg

SEQ ID NO: 492791 - DNA, 12 bp, Homo sapiens
gatttatttgga

SEQ ID NO: 492792 - DNA, 15 bp, Homo sapiens
gatttccagccaggg

SEQ ID NO: 492793 - DNA, 23 bp, Homo sapiens
gatttgggctggaacagattcac

SEQ ID NO: 492794 - DNA, 15 bp, Homo sapiens
gattttcctgaaaac

SEQ ID NO: 492795 - DNA, 21 bp, Homo sapiens
gcaaaagtacaagggctgaga

SEQ ID NO: 492796 - DNA, 21 bp, Homo sapiens
gcaaagactattcccttctaa

SEQ ID NO: 492797 - DNA, 13 bp, Homo sapiens
gcaaaggctggga

SEQ ID NO: 492798 - DNA, 23 bp, Homo sapiens
gcaaagtcatgcaaaggctggga

SEQ ID NO: 492799 - DNA, 22 bp, Homo sapiens
gcaaagtctaaagtttacagta

SEQ ID NO: 492800 - DNA, 20 bp, Homo sapiens
gcaaatgcccaagggaaaga

SEQ ID NO: 492801 - DNA, 13 bp, Homo sapiens
gcaactgaggcag

SEQ ID NO: 492802 - DNA, 15 bp, Homo sapiens
gcaactgaggcagac

SEQ ID NO: 492803 - DNA, 18 bp, Homo sapiens
gcaagcaagaaacactgg

SEQ ID NO: 492804 - DNA, 10 bp, Homo sapiens
gcaagccaga

SEQ ID NO: 492805 - DNA, 12 bp, Homo sapiens
gcaaggctgtgc

SEQ ID NO: 492806 - DNA, 13 bp, Homo sapiens
gcaaggctgtgct

SEQ ID NO: 492807 - DNA, 18 bp, Homo sapiens
gcaatagtcaaattgtgt

SEQ ID NO: 492808 - DNA, 22 bp, Homo sapiens
gcaatagtcaaattgtgtgaaa

SEQ ID NO: 492809 - DNA, 19 bp, Homo sapiens
gcaatctcggctcattgaa

SEQ ID NO: 492810 - DNA, 11 bp, Homo sapiens
gcacacactgt

SEQ ID NO: 492811 - DNA, 19 bp, Homo sapiens
gcacacgcacgcacacaca

SEQ ID NO: 492812 - DNA, 14 bp, Homo sapiens
gcacatagagaggg

SEQ ID NO: 492813 - DNA, 14 bp, Homo sapiens
gcacatattgagca

SEQ ID NO: 492814 - DNA, 17 bp, Homo sapiens
gcacatttaagagacag

SEQ ID NO: 492815 - DNA, 14 bp, Homo sapiens
gcaccactctcctt

SEQ ID NO: 492816 - DNA, 22 bp, Homo sapiens
gcacccacaaataaatgacaag

SEQ ID NO: 492817 - DNA, 20 bp, Homo sapiens
gcacctgggctttctggaat

SEQ ID NO: 492818 - DNA, 15 bp, Homo sapiens
gcacctttagaatat

SEQ ID NO: 492819 - DNA, 17 bp, Homo sapiens
gcacgcacacacacata

SEQ ID NO: 492820 - DNA, 17 bp, Homo sapiens
gcactaatcaatacttt

SEQ ID NO: 492821 - DNA, 13 bp, Homo sapiens
gcactccagcctg

SEQ ID NO: 492822 - DNA, 14 bp, Homo sapiens
gcactgccatgcag

SEQ ID NO: 492823 - DNA, 21 bp, Homo sapiens
gcagaaaggaaaagattcctg

SEQ ID NO: 492824 - DNA, 23 bp, Homo sapiens
gcagaacagccgctcctgtctgc

SEQ ID NO: 492825 - DNA, 22 bp, Homo sapiens
gcagaaggaagggcatccttct

SEQ ID NO: 492826 - DNA, 21 bp, Homo sapiens
gcagacagcagctcaggcaca

SEQ ID NO: 492827 - DNA, 17 bp, Homo sapiens
gcagagacaggacctga

SEQ ID NO: 492828 - DNA, 19 bp, Homo sapiens
gcagagccaggctgttgga

SEQ ID NO: 492829 - DNA, 17 bp, Homo sapiens
gcagagcttggactgga

SEQ ID NO: 492830 - DNA, 23 bp, Homo sapiens
gcagagtcacacgggggcagctg

SEQ ID NO: 492831 - DNA, 20 bp, Homo sapiens
gcagattcatttttctttct

SEQ ID NO: 492832 - DNA, 21 bp, Homo sapiens
gcagctcatctctgtcccact

SEQ ID NO: 492833 - DNA, 16 bp, Homo sapiens
gcagctgatacaaatt

SEQ ID NO: 492834 - DNA, 11 bp, Homo sapiens
gcagctgcctc

SEQ ID NO: 492835 - DNA, 15 bp, Homo sapiens
gcagctgcctcccct

SEQ ID NO: 492836 - DNA, 16 bp, Homo sapiens
gcagctgcctcccctc

SEQ ID NO: 492837 - DNA, 17 bp, Homo sapiens
gcagctgcctcccctcc

SEQ ID NO: 492838 - DNA, 22 bp, Homo sapiens
gcagctgcctcccctcctctgc

SEQ ID NO: 492839 - DNA, 16 bp, Homo sapiens
gcaggaacatacagac

SEQ ID NO: 492840 - DNA, 19 bp, Homo sapiens
gcaggactgcacagcgtcc

SEQ ID NO: 492841 - DNA, 16 bp, Homo sapiens
gcaggatggcctggcc

SEQ ID NO: 492842 - DNA, 20 bp, Homo sapiens
gcaggctaaggcgtggagct

SEQ ID NO: 492843 - DNA, 20 bp, Homo sapiens
gcaggctacactgacactgg

SEQ ID NO: 492844 - DNA, 22 bp, Homo sapiens
gcagggagaggagtgactgagc

SEQ ID NO: 492845 - DNA, 21 bp, Homo sapiens
gcagggagcatggctgtgagg

SEQ ID NO: 492846 - DNA, 22 bp, Homo sapiens
gcagggatgatggcagagccag

SEQ ID NO: 492847 - DNA, 14 bp, Homo sapiens
gcagggtcaggaga

SEQ ID NO: 492848 - DNA, 15 bp, Homo sapiens
gcagtggacaccagg

SEQ ID NO: 492849 - DNA, 16 bp, Homo sapiens
gcatagatgcaggtga

SEQ ID NO: 492850 - DNA, 19 bp, Homo sapiens
gcatagatgcaggtgagcc

SEQ ID NO: 492851 - DNA, 21 bp, Homo sapiens
gcatatggagtgcctgtacaa

SEQ ID NO: 492852 - DNA, 15 bp, Homo sapiens
gcatatgtatgactc

SEQ ID NO: 492853 - DNA, 18 bp, Homo sapiens
gcatattgataataaaat

SEQ ID NO: 492854 - DNA, 19 bp, Homo sapiens
gcatattgttattatataa

SEQ ID NO: 492855 - DNA, 15 bp, Homo sapiens
gcatcacctccacca

SEQ ID NO: 492856 - DNA, 22 bp, Homo sapiens
gcatcattatttgcagagacag

SEQ ID NO: 492857 - DNA, 18 bp, Homo sapiens
gcatcccttgaccaggcc

SEQ ID NO: 492858 - DNA, 20 bp, Homo sapiens
gcatcccttgaccaggcctg

SEQ ID NO: 492859 - DNA, 11 bp, Homo sapiens
gcatcctagtc

SEQ ID NO: 492860 - DNA, 13 bp, Homo sapiens
gcatccttctgcc

SEQ ID NO: 492861 - DNA, 13 bp, Homo sapiens
gcatgaaggtttc

SEQ ID NO: 492862 - DNA, 14 bp, Homo sapiens
gcatgacagctgtt

SEQ ID NO: 492863 - DNA, 13 bp, Homo sapiens
gcatgaccacata

SEQ ID NO: 492864 - DNA, 13 bp, Homo sapiens
gcatggaatttgt

SEQ ID NO: 492865 - DNA, 17 bp, Homo sapiens
gcatggaatttgtaagt

SEQ ID NO: 492866 - DNA, 19 bp, Homo sapiens
gcatggtggggcatgcctg

SEQ ID NO: 492867 - DNA, 22 bp, Homo sapiens
gcatgtaccctaaggtcattac

SEQ ID NO: 492868 - DNA, 15 bp, Homo sapiens
gcatgttgagaggct

SEQ ID NO: 492869 - DNA, 23 bp, Homo sapiens
gctgccctctcctgggcagctgc

SEQ ID NO: 492870 - DNA, 17 bp, Homo sapiens
gctgcctcccctcctct

SEQ ID NO: 492871 - DNA, 16 bp, Homo sapiens
gctgctactagctctt

SEQ ID NO: 492872 - DNA, 13 bp, Homo sapiens
gctgctgcccagg

SEQ ID NO: 492873 - DNA, 21 bp, Homo sapiens
gctggaacagattcacactgt

SEQ ID NO: 492874 - DNA, 13 bp, Homo sapiens
gctggagactcct

SEQ ID NO: 492875 - DNA, 20 bp, Homo sapiens
gctggagactcctaggcagg

SEQ ID NO: 492876 - DNA, 17 bp, Homo sapiens
gctggagggagaaccca

SEQ ID NO: 492877 - DNA, 18 bp, Homo sapiens
gctggatggacagtgggc

SEQ ID NO: 492878 - DNA, 18 bp, Homo sapiens
gctgggaactcacctggg

SEQ ID NO: 492879 - DNA, 21 bp, Homo sapiens
gctgggaactcacctggggct

SEQ ID NO: 492880 - DNA, 23 bp, Homo sapiens
gctgggaactcacctggggctgc

SEQ ID NO: 492881 - DNA, 14 bp, Homo sapiens
gctgggtggcactg

SEQ ID NO: 492882 - DNA, 18 bp, Homo sapiens
gctggtgagtgatgcggc

SEQ ID NO: 492883 - DNA, 20 bp, Homo sapiens
gctgtattttaaaagaatga

SEQ ID NO: 492884 - DNA, 22 bp, Homo sapiens
gctgtattttaaaagaatgatt

SEQ ID NO: 492885 - DNA, 17 bp, Homo sapiens
gctgtctggccaggcct

SEQ ID NO: 492886 - DNA, 13 bp, Homo sapiens
gctgtgacatcta

SEQ ID NO: 492887 - DNA, 13 bp, Homo sapiens
gctgttgcagtga

SEQ ID NO: 492888 - DNA, 12 bp, Homo sapiens
gcttaatgaaaa

SEQ ID NO: 492889 - DNA, 17 bp, Homo sapiens
gcttagacctcagcctg

SEQ ID NO: 492890 - DNA, 18 bp, Homo sapiens
gcttagctttgctctgcc

SEQ ID NO: 492891 - DNA, 19 bp, Homo sapiens
gcttagctttgctctgcca

SEQ ID NO: 492892 - DNA, 15 bp, Homo sapiens
gcttataggtggcct

SEQ ID NO: 492893 - DNA, 17 bp, Homo sapiens
gcttataggtggcctct

SEQ ID NO: 492894 - DNA, 15 bp, Homo sapiens
gcttcattagagcag

SEQ ID NO: 492895 - DNA, 17 bp, Homo sapiens
gcttcattagagcaggc

SEQ ID NO: 492896 - DNA, 18 bp, Homo sapiens
gcttcattagagcaggcg

SEQ ID NO: 492897 - DNA, 20 bp, Homo sapiens
gcttcattctcactctgctt

SEQ ID NO: 492898 - DNA, 18 bp, Homo sapiens
gcttcccagtggctgctg

SEQ ID NO: 492899 - DNA, 19 bp, Homo sapiens
gcttcctggcaatagtcaa

SEQ ID NO: 492900 - DNA, 17 bp, Homo sapiens
gcttctcatcctgcagg

SEQ ID NO: 492901 - DNA, 18 bp, Homo sapiens
gcttctcatcctgcaggc

SEQ ID NO: 492902 - DNA, 22 bp, Homo sapiens
gcttctcatcctgcaggcagct

SEQ ID NO: 492903 - DNA, 19 bp, Homo sapiens
gcttctgttttataatttt

SEQ ID NO: 492904 - DNA, 16 bp, Homo sapiens
gcttgccatccctccc

SEQ ID NO: 492905 - DNA, 11 bp, Homo sapiens
gcttgtcatcc

SEQ ID NO: 492906 - DNA, 23 bp, Homo sapiens
gctttagtcctagaggacctgag

SEQ ID NO: 492907 - DNA, 12 bp, Homo sapiens
gctttgcccagc

SEQ ID NO: 492908 - DNA, 23 bp, Homo sapiens
gctttgggggagtgggcgcagtg

SEQ ID NO: 492909 - DNA, 15 bp, Homo sapiens
ggaaagaaagttgca

SEQ ID NO: 492910 - DNA, 12 bp, Homo sapiens
ggaaatatttat

SEQ ID NO: 492911 - DNA, 15 bp, Homo sapiens
ggaaatatttatttt

SEQ ID NO: 492912 - DNA, 20 bp, Homo sapiens
ggaaattcccttcatctgga

SEQ ID NO: 492913 - DNA, 14 bp, Homo sapiens
ggaagacctggcaa

SEQ ID NO: 492914 - DNA, 20 bp, Homo sapiens
ggaagcatattgttattata

SEQ ID NO: 492915 - DNA, 11 bp, Homo sapiens
ggaaggtgggg

SEQ ID NO: 492916 - DNA, 14 bp, Homo sapiens
ggaagtcctctggg

SEQ ID NO: 492917 - DNA, 22 bp, Homo sapiens
ggaataatgggcttagagcagt

SEQ ID NO: 492918 - DNA, 16 bp, Homo sapiens
ggaatccactcccagg

SEQ ID NO: 492919 - DNA, 19 bp, Homo sapiens
ggaatccactcccaggcag

SEQ ID NO: 492920 - DNA, 19 bp, Homo sapiens
ggaatgcctgagtgcctgg

SEQ ID NO: 492921 - DNA, 16 bp, Homo sapiens
ggaatgtcagggccag

SEQ ID NO: 492922 - DNA, 18 bp, Homo sapiens
ggaatgtcagggccaggt

SEQ ID NO: 492923 - DNA, 19 bp, Homo sapiens
ggaatttgtaagtttatgt

SEQ ID NO: 492924 - DNA, 14 bp, Homo sapiens
ggacagaagaaggc

SEQ ID NO: 492925 - DNA, 21 bp, Homo sapiens
ggacagcagaagggggagacc

SEQ ID NO: 492926 - DNA, 22 bp, Homo sapiens
ggacagggatgagcatggagct

SEQ ID NO: 492927 - DNA, 18 bp, Homo sapiens
ggacagtcacctcatgga

SEQ ID NO: 492928 - DNA, 16 bp, Homo sapiens
ggacatgctgaagcca

SEQ ID NO: 492929 - DNA, 19 bp, Homo sapiens
ggacatgctgaagccaaag

SEQ ID NO: 492930 - DNA, 18 bp, Homo sapiens
ggacatggcccctgtgag

SEQ ID NO: 492931 - DNA, 22 bp, Homo sapiens
ggaccagcttttcccaaaagcc

SEQ ID NO: 492932 - DNA, 23 bp, Homo sapiens
ggaccaggcaatgtgactttgca

SEQ ID NO: 492933 - DNA, 17 bp, Homo sapiens
ggacctgagtctgctat

SEQ ID NO: 492934 - DNA, 15 bp, Homo sapiens
ggacgccacccagca

SEQ ID NO: 492935 - DNA, 20 bp, Homo sapiens
ggactaatccaatacctctt

SEQ ID NO: 492936 - DNA, 14 bp, Homo sapiens
ggactgatgtcatc

SEQ ID NO: 492937 - DNA, 19 bp, Homo sapiens
ggactgatgtcatcttgag

SEQ ID NO: 492938 - DNA, 22 bp, Homo sapiens
ggactgcacagcgtcctgtcca

SEQ ID NO: 492939 - DNA, 17 bp, Homo sapiens
ggactggagtccctgtg

SEQ ID NO: 492940 - DNA, 19 bp, Homo sapiens
ggacttgcaaaaagggtca

SEQ ID NO: 492941 - DNA, 22 bp, Homo sapiens
ggagaactagaacctggagggc

SEQ ID NO: 492942 - DNA, 14 bp, Homo sapiens
ggagaagaactgaa

SEQ ID NO: 492943 - DNA, 19 bp, Homo sapiens
ggagaatgcacagtgggtg

SEQ ID NO: 492944 - DNA, 13 bp, Homo sapiens
ggagactcctagg

SEQ ID NO: 492945 - DNA, 14 bp, Homo sapiens
ggagagagactcca

SEQ ID NO: 492946 - DNA, 16 bp, Homo sapiens
ggagagccagaacctg

SEQ ID NO: 492947 - DNA, 19 bp, Homo sapiens
ggagagccagaacctggag

SEQ ID NO: 492948 - DNA, 19 bp, Homo sapiens
ggagagctagaacctggag

SEQ ID NO: 492949 - DNA, 22 bp, Homo sapiens
ggagagctggagcctggtgccc

SEQ ID NO: 492950 - DNA, 14 bp, Homo sapiens
ggagaggggcagaa

SEQ ID NO: 492951 - DNA, 23 bp, Homo sapiens
ggagatgaaatcttacagctggg

SEQ ID NO: 492952 - DNA, 17 bp, Homo sapiens
ggagattttccttccta

SEQ ID NO: 492953 - DNA, 17 bp, Homo sapiens
ggagcagagctctgccg

SEQ ID NO: 492954 - DNA, 15 bp, Homo sapiens
ggagcatggctgtga

SEQ ID NO: 492955 - DNA, 22 bp, Homo sapiens
ggagccaatccactccttcctt

SEQ ID NO: 492956 - DNA, 18 bp, Homo sapiens
ggagccagtaaacagagg

SEQ ID NO: 492957 - DNA, 17 bp, Homo sapiens
ggagcccttggcccctc

SEQ ID NO: 492958 - DNA, 16 bp, Homo sapiens
ggagccggtggcggtg

SEQ ID NO: 492959 - DNA, 12 bp, Homo sapiens
ggagcctggtgc

SEQ ID NO: 492960 - DNA, 20 bp, Homo sapiens
ggagctcagagagggcaggc

SEQ ID NO: 492961 - DNA, 21 bp, Homo sapiens
ggaggactagaacctggaggg

SEQ ID NO: 492962 - DNA, 12 bp, Homo sapiens
ggaggagcaaag

SEQ ID NO: 492963 - DNA, 19 bp, Homo sapiens
ggaggctgaggtgggcaga

SEQ ID NO: 492964 - DNA, 16 bp, Homo sapiens
ggagggctagaaccta

SEQ ID NO: 492965 - DNA, 19 bp, Homo sapiens
ggagggctagaacctggag

SEQ ID NO: 492966 - DNA, 22 bp, Homo sapiens
ggagggctagaacctggagagc

SEQ ID NO: 492967 - DNA, 20 bp, Homo sapiens
ggagggctagaacctggcag

SEQ ID NO: 492968 - DNA, 20 bp, Homo sapiens
ggaggtggaggttgccgtga

SEQ ID NO: 492969 - DNA, 14 bp, Homo sapiens
ggaggttgcagtga

SEQ ID NO: 492970 - DNA, 12 bp, Homo sapiens
ggagtgcagtgg

SEQ ID NO: 492971 - DNA, 12 bp, Homo sapiens
ggagtggaggca

SEQ ID NO: 492972 - DNA, 19 bp, Homo sapiens
ggagtttaagaccagcctg

SEQ ID NO: 492973 - DNA, 16 bp, Homo sapiens
ggatatctactgtggt

SEQ ID NO: 492974 - DNA, 17 bp, Homo sapiens
ggatcacttgagcccag

SEQ ID NO: 492975 - DNA, 15 bp, Homo sapiens
ggatccacacctggt

SEQ ID NO: 492976 - DNA, 20 bp, Homo sapiens
ggatgacatgtccctacacc

SEQ ID NO: 492977 - DNA, 18 bp, Homo sapiens
ggatgatggcagagccag

SEQ ID NO: 492978 - DNA, 13 bp, Homo sapiens
ggatgcagcatta

SEQ ID NO: 492979 - DNA, 21 bp, Homo sapiens
ggatgcatgttttccagctcc

SEQ ID NO: 492980 - DNA, 16 bp, Homo sapiens
ggatggcctggccagg

SEQ ID NO: 492981 - DNA, 22 bp, Homo sapiens
ggatggttcccttgatgaagaa

SEQ ID NO: 492982 - DNA, 19 bp, Homo sapiens
ggattcaggggctgggggt

SEQ ID NO: 492983 - DNA, 12 bp, Homo sapiens
ggattggggaag

SEQ ID NO: 492984 - DNA, 19 bp, Homo sapiens
ggatttccagccagggctg

SEQ ID NO: 492985 - DNA, 12 bp, Homo sapiens
ggcaaaagacat

SEQ ID NO: 492986 - DNA, 13 bp, Homo sapiens
ggcaaatgcccaa

SEQ ID NO: 492987 - DNA, 15 bp, Homo sapiens
ggcaactgaggcaga

SEQ ID NO: 492988 - DNA, 23 bp, Homo sapiens
ggcaactgaggcagacagcagct

SEQ ID NO: 492989 - DNA, 20 bp, Homo sapiens
ggcaagctagaacctggagg

SEQ ID NO: 492990 - DNA, 14 bp, Homo sapiens
ggcaaggctgtgct

SEQ ID NO: 492991 - DNA, 20 bp, Homo sapiens
ggcacacgcctgtagtccca

SEQ ID NO: 492992 - DNA, 12 bp, Homo sapiens
ggcacatagaga

SEQ ID NO: 492993 - DNA, 16 bp, Homo sapiens
ggcacccacaaataaa

SEQ ID NO: 492994 - DNA, 13 bp, Homo sapiens
ggcagacagcagc

SEQ ID NO: 492995 - DNA, 20 bp, Homo sapiens
ggcagacagcagctcaggca

SEQ ID NO: 492996 - DNA, 20 bp, Homo sapiens
ggcagatcatttgaggccag

SEQ ID NO: 492997 - DNA, 15 bp, Homo sapiens
ggcagctcatctctg

SEQ ID NO: 492998 - DNA, 12 bp, Homo sapiens
ggcagctgcctc

SEQ ID NO: 492999 - DNA, 13 bp, Homo sapiens
ggcagctgcctcc

SEQ ID NO: 493000 - DNA, 18 bp, Homo sapiens
ggcagctgcctcccctcc

SEQ ID NO: 493001 - DNA, 17 bp, Homo sapiens
ggcaggctaaggcgtgg

SEQ ID NO: 493002 - DNA, 16 bp, Homo sapiens
ggcaggttagaaccta

SEQ ID NO: 493003 - DNA, 19 bp, Homo sapiens
ggcatagatgcaggtgagc

SEQ ID NO: 493004 - DNA, 13 bp, Homo sapiens
ggcatcagcagca

SEQ ID NO: 493005 - DNA, 13 bp, Homo sapiens
ggcatcagctggc

SEQ ID NO: 493006 - DNA, 17 bp, Homo sapiens
taagctagaaaaattag

SEQ ID NO: 493007 - DNA, 23 bp, Homo sapiens
taagctaggatgttgctcagaag

SEQ ID NO: 493008 - DNA, 13 bp, Homo sapiens
taagctatgtgaa

SEQ ID NO: 493009 - DNA, 17 bp, Homo sapiens
taaggcgtggagctgcc

SEQ ID NO: 493010 - DNA, 17 bp, Homo sapiens
taagtttatgtctaaag

SEQ ID NO: 493011 - DNA, 17 bp, Homo sapiens
taataaacttagaataa

SEQ ID NO: 493012 - DNA, 12 bp, Homo sapiens
taatatattgct

SEQ ID NO: 493013 - DNA, 16 bp, Homo sapiens
taatattgtggtgcca

SEQ ID NO: 493014 - DNA, 20 bp, Homo sapiens
taatcaatactttgaacaca

SEQ ID NO: 493015 - DNA, 23 bp, Homo sapiens
taatcaatactttgaacacaaag

SEQ ID NO: 493016 - DNA, 18 bp, Homo sapiens
taatcccggtttcagaag

SEQ ID NO: 493017 - DNA, 16 bp, Homo sapiens
taatgataactggaaa

SEQ ID NO: 493018 - DNA, 21 bp, Homo sapiens
taatgctaaatgtaagaatca

SEQ ID NO: 493019 - DNA, 17 bp, Homo sapiens
taattacatatttgcat

SEQ ID NO: 493020 - DNA, 13 bp, Homo sapiens
taattagctgtgc

SEQ ID NO: 493021 - DNA, 21 bp, Homo sapiens
taattctaaggaatatgagct

SEQ ID NO: 493022 - DNA, 17 bp, Homo sapiens
taattctttatcacatg

SEQ ID NO: 493023 - DNA, 20 bp, Homo sapiens
taattctttatcacatgttg

SEQ ID NO: 493024 - DNA, 22 bp, Homo sapiens
taattggaaaggcagctctaaa

SEQ ID NO: 493025 - DNA, 16 bp, Homo sapiens
taatttaacccagctc

SEQ ID NO: 493026 - DNA, 23 bp, Homo sapiens
taatttgtagtgttggagaagaa

SEQ ID NO: 493027 - DNA, 13 bp, Homo sapiens
taatttgtatctg

SEQ ID NO: 493028 - DNA, 13 bp, Homo sapiens
taattttgtgaag

SEQ ID NO: 493029 - DNA, 18 bp, Homo sapiens
taatttttatatttgaaa

SEQ ID NO: 493030 - DNA, 12 bp, Homo sapiens
taatttttatta

SEQ ID NO: 493031 - DNA, 17 bp, Homo sapiens
tacaaaaattagccggg

SEQ ID NO: 493032 - DNA, 19 bp, Homo sapiens
tacaaaataaagctgttct

SEQ ID NO: 493033 - DNA, 18 bp, Homo sapiens
tacacagagcaggactgc

SEQ ID NO: 493034 - DNA, 14 bp, Homo sapiens
tacacccttggact

SEQ ID NO: 493035 - DNA, 21 bp, Homo sapiens
tacagaattctgctacctcac

SEQ ID NO: 493036 - DNA, 24 bp, Homo sapiens
tacagctgggtggcactgccatgc

SEQ ID NO: 493037 - DNA, 15 bp, Homo sapiens
tacaggcatagagtt

SEQ ID NO: 493038 - DNA, 22 bp, Homo sapiens
tacaggtgtgagcatagtgaga

SEQ ID NO: 493039 - DNA, 16 bp, Homo sapiens
tacagtaactgtgact

SEQ ID NO: 493040 - DNA, 16 bp, Homo sapiens
tacatcacttgagaca

SEQ ID NO: 493041 - DNA, 20 bp, Homo sapiens
tacatcccttacctgggaaa

SEQ ID NO: 493042 - DNA, 20 bp, Homo sapiens
tacattattggacttccatt

SEQ ID NO: 493043 - DNA, 11 bp, Homo sapiens
tacatttgtgt

SEQ ID NO: 493044 - DNA, 23 bp, Homo sapiens
taccacaggaaccacaagactgc

SEQ ID NO: 493045 - DNA, 18 bp, Homo sapiens
taccaccagtctgactgt

SEQ ID NO: 493046 - DNA, 15 bp, Homo sapiens
tacctcactggggtc

SEQ ID NO: 493047 - DNA, 22 bp, Homo sapiens
taccttctccctcatttcagga

SEQ ID NO: 493048 - DNA, 12 bp, Homo sapiens
tacctttctgag

SEQ ID NO: 493049 - DNA, 16 bp, Homo sapiens
tactaataaaatacat

SEQ ID NO: 493050 - DNA, 21 bp, Homo sapiens
tactcaggaggctgaggcagg

SEQ ID NO: 493051 - DNA, 21 bp, Homo sapiens
tactgcctctacagttaatag

SEQ ID NO: 493052 - DNA, 13 bp, Homo sapiens
tactgtaagaaaa

SEQ ID NO: 493053 - DNA, 14 bp, Homo sapiens
tactgtaagaaaat

SEQ ID NO: 493054 - DNA, 19 bp, Homo sapiens
tactttgtttttaaatgat

SEQ ID NO: 493055 - DNA, 12 bp, Homo sapiens
tagaaaaattag

SEQ ID NO: 493056 - DNA, 17 bp, Homo sapiens
tagaaagacagagctgg

SEQ ID NO: 493057 - DNA, 20 bp, Homo sapiens
tagaaccaccaacaagcaag

SEQ ID NO: 493058 - DNA, 13 bp, Homo sapiens
tagaacctagaag

SEQ ID NO: 493059 - DNA, 14 bp, Homo sapiens
tagaacctagaagg

SEQ ID NO: 493060 - DNA, 17 bp, Homo sapiens
tagaacctagaagggct

SEQ ID NO: 493061 - DNA, 16 bp, Homo sapiens
tagaacctggaagggc

SEQ ID NO: 493062 - DNA, 23 bp, Homo sapiens
tagaacctggaagggctagaacc

SEQ ID NO: 493063 - DNA, 14 bp, Homo sapiens
tagaagctggagga

SEQ ID NO: 493064 - DNA, 19 bp, Homo sapiens
tagaaggttctctcctccc

SEQ ID NO: 493065 - DNA, 23 bp, Homo sapiens
tagaataccacaggaaccacaag

SEQ ID NO: 493066 - DNA, 18 bp, Homo sapiens
tagaatactaataaaata

SEQ ID NO: 493067 - DNA, 19 bp, Homo sapiens
tagaatactaataaaatac

SEQ ID NO: 493068 - DNA, 21 bp, Homo sapiens
tagaatactaataaaatacat

SEQ ID NO: 493069 - DNA, 22 bp, Homo sapiens
tagaatattaaaaattaattct

SEQ ID NO: 493070 - DNA, 13 bp, Homo sapiens
tagacacacatga

SEQ ID NO: 493071 - DNA, 12 bp, Homo sapiens
tagacctcagcc

SEQ ID NO: 493072 - DNA, 20 bp, Homo sapiens
tagacctcagcctgtgctgc

SEQ ID NO: 493073 - DNA, 18 bp, Homo sapiens
tagacttaatagaaacat

SEQ ID NO: 493074 - DNA, 19 bp, Homo sapiens
tagagatatgcagaaggaa

SEQ ID NO: 493075 - DNA, 14 bp, Homo sapiens
tagataaagcactg

SEQ ID NO: 493076 - DNA, 15 bp, Homo sapiens
tagattctttattag

SEQ ID NO: 493077 - DNA, 19 bp, Homo sapiens
tagcctggcaacagagcga

SEQ ID NO: 493078 - DNA, 18 bp, Homo sapiens
tagctagttatgtgagaa

SEQ ID NO: 493079 - DNA, 18 bp, Homo sapiens
tagcttagacctcagcct

SEQ ID NO: 493080 - DNA, 19 bp, Homo sapiens
tagcttagacctcagcctg

SEQ ID NO: 493081 - DNA, 15 bp, Homo sapiens
tagcttggaaactgg

SEQ ID NO: 493082 - DNA, 20 bp, Homo sapiens
tagcttggaaactggatgag

SEQ ID NO: 493083 - DNA, 18 bp, Homo sapiens
taggaaatatttatttta

SEQ ID NO: 493084 - DNA, 14 bp, Homo sapiens
taggaatcagcaag

SEQ ID NO: 493085 - DNA, 15 bp, Homo sapiens
taggaatcagcaaga

SEQ ID NO: 493086 - DNA, 15 bp, Homo sapiens
taggacgccacccag

SEQ ID NO: 493087 - DNA, 21 bp, Homo sapiens
taggagactttaatcccggtt

SEQ ID NO: 493088 - DNA, 19 bp, Homo sapiens
taggcaggaacatacagac

SEQ ID NO: 493089 - DNA, 16 bp, Homo sapiens
taggcaggacatgctg

SEQ ID NO: 493090 - DNA, 19 bp, Homo sapiens
taggcagggatttgaggag

SEQ ID NO: 493091 - DNA, 20 bp, Homo sapiens
tagggaagggtggtggagcc

SEQ ID NO: 493092 - DNA, 16 bp, Homo sapiens
taggggtaatatattg

SEQ ID NO: 493093 - DNA, 12 bp, Homo sapiens
tagtagatttta

SEQ ID NO: 493094 - DNA, 14 bp, Homo sapiens
tagtcaaattgtgt

SEQ ID NO: 493095 - DNA, 22 bp, Homo sapiens
tagtgagcagtcaggaaagaga

SEQ ID NO: 493096 - DNA, 14 bp, Homo sapiens
tagtgatcacagca

SEQ ID NO: 493097 - DNA, 20 bp, Homo sapiens
tagtgatcacagcagcttct

SEQ ID NO: 493098 - DNA, 17 bp, Homo sapiens
tagtgttggagaagaac

SEQ ID NO: 493099 - DNA, 15 bp, Homo sapiens
tagttactatatgcc

SEQ ID NO: 493100 - DNA, 15 bp, Homo sapiens
tagttctatttctat

SEQ ID NO: 493101 - DNA, 20 bp, Homo sapiens
tagttctatttctatcccaa

SEQ ID NO: 493102 - DNA, 13 bp, Homo sapiens
tagtttgcagagg

SEQ ID NO: 493103 - DNA, 16 bp, Homo sapiens
tagttttatatgcttc

SEQ ID NO: 493104 - DNA, 22 bp, Homo sapiens
tataatatttttaattaaataa

SEQ ID NO: 493105 - DNA, 20 bp, Homo sapiens
tataatgtcattaaacatga

SEQ ID NO: 493106 - DNA, 18 bp, Homo sapiens
tataattacatatttgca

SEQ ID NO: 493107 - DNA, 12 bp, Homo sapiens
tatacacacagc

SEQ ID NO: 493108 - DNA, 16 bp, Homo sapiens
tatacctttgccttgg

SEQ ID NO: 493109 - DNA, 21 bp, Homo sapiens
tatagagatatgcagaaggaa

SEQ ID NO: 493110 - DNA, 13 bp, Homo sapiens
tatagattcttta

SEQ ID NO: 493111 - DNA, 23 bp, Homo sapiens
tatagattctttattagtgaagt

SEQ ID NO: 493112 - DNA, 14 bp, Homo sapiens
tatatattttaatt

SEQ ID NO: 493113 - DNA, 14 bp, Homo sapiens
tatatgcttctgtt

SEQ ID NO: 493114 - DNA, 15 bp, Homo sapiens
tatattgtttgctaa

SEQ ID NO: 493115 - DNA, 13 bp, Homo sapiens
tatatttgaaata

SEQ ID NO: 493116 - DNA, 14 bp, Homo sapiens
tatatttgaaatat

SEQ ID NO: 493117 - DNA, 21 bp, Homo sapiens
tatattttatacattaacttc

SEQ ID NO: 493118 - DNA, 13 bp, Homo sapiens
tatcacatgttgt

SEQ ID NO: 493119 - DNA, 12 bp, Homo sapiens
tatcacctgtca

SEQ ID NO: 493120 - DNA, 13 bp, Homo sapiens
tatcacctgtcat

SEQ ID NO: 493121 - DNA, 14 bp, Homo sapiens
tatcattaaagttc

SEQ ID NO: 493122 - DNA, 13 bp, Homo sapiens
tatctaattttta

SEQ ID NO: 493123 - DNA, 23 bp, Homo sapiens
tatctgcttttggttataatgtg

SEQ ID NO: 493124 - DNA, 22 bp, Homo sapiens
tatctttgccaccctcatgctg

SEQ ID NO: 493125 - DNA, 17 bp, Homo sapiens
tatgaattacatttgta

SEQ ID NO: 493126 - DNA, 20 bp, Homo sapiens
tatgacattcatgcctggct

SEQ ID NO: 493127 - DNA, 16 bp, Homo sapiens
tatgaccttctaggaa

SEQ ID NO: 493128 - DNA, 22 bp, Homo sapiens
tatgagatgtagcaaattccaa

SEQ ID NO: 493129 - DNA, 18 bp, Homo sapiens
tatgatgtgggtcaagga

SEQ ID NO: 493130 - DNA, 20 bp, Homo sapiens
tatgattaagtaatgataac

SEQ ID NO: 493131 - DNA, 16 bp, Homo sapiens
tatgattcccagccag

SEQ ID NO: 493132 - DNA, 23 bp, Homo sapiens
tatgcaaaagtacaagggctgag

SEQ ID NO: 493133 - DNA, 17 bp, Homo sapiens
tatgcacgaccttggga

SEQ ID NO: 493134 - DNA, 22 bp, Homo sapiens
tatgcatggtgtagatgccctg

SEQ ID NO: 493135 - DNA, 18 bp, Homo sapiens
tatgggctttctctttgg

SEQ ID NO: 493136 - DNA, 15 bp, Homo sapiens
tatgtaataatgtga

SEQ ID NO: 493137 - DNA, 17 bp, Homo sapiens
tatgtacttcatgctgt

SEQ ID NO: 493138 - DNA, 12 bp, Homo sapiens
tatgttaaaact

SEQ ID NO: 493139 - DNA, 21 bp, Homo sapiens
tatgttttcaggctagatgta

SEQ ID NO: 493140 - DNA, 16 bp, Homo sapiens
tattatgttaaaactg

SEQ ID NO: 493141 - DNA, 14 bp, Homo sapiens
tattcaaaaattat

SEQ ID NO: 493142 - DNA, 15 bp, Homo sapiens
tattcaaaaattata

SEQ ID NO: 493143 - DNA, 21 bp, Homo sapiens
tcttcaataaaccacaagcat

SEQ ID NO: 493144 - DNA, 12 bp, Homo sapiens
tcttcagagctg

SEQ ID NO: 493145 - DNA, 13 bp, Homo sapiens
tcttcagagctga

SEQ ID NO: 493146 - DNA, 18 bp, Homo sapiens
tcttcctccgaggccagt

SEQ ID NO: 493147 - DNA, 15 bp, Homo sapiens
tcttctattgtgctt

SEQ ID NO: 493148 - DNA, 16 bp, Homo sapiens
tcttgagccctcctgg

SEQ ID NO: 493149 - DNA, 16 bp, Homo sapiens
tcttggactaagaaga

SEQ ID NO: 493150 - DNA, 16 bp, Homo sapiens
tctttctgatgtcaaa

SEQ ID NO: 493151 - DNA, 22 bp, Homo sapiens
tctttgagataatacattccga

SEQ ID NO: 493152 - DNA, 16 bp, Homo sapiens
tctttgccaccctcat

SEQ ID NO: 493153 - DNA, 13 bp, Homo sapiens
tctttgctttgcc

SEQ ID NO: 493154 - DNA, 22 bp, Homo sapiens
tgaaaaggacaaataaagcaat

SEQ ID NO: 493155 - DNA, 15 bp, Homo sapiens
tgaaaaggactcttg

SEQ ID NO: 493156 - DNA, 16 bp, Homo sapiens
tgaaaaggactcttga

SEQ ID NO: 493157 - DNA, 19 bp, Homo sapiens
tgaaaaggactcttgagcc

SEQ ID NO: 493158 - DNA, 18 bp, Homo sapiens
tgaaaatgcaacaacatg

SEQ ID NO: 493159 - DNA, 23 bp, Homo sapiens
tgaaaatgcaacaacatgtataa

SEQ ID NO: 493160 - DNA, 15 bp, Homo sapiens
tgaaaattaacactg

SEQ ID NO: 493161 - DNA, 19 bp, Homo sapiens
tgaaatcttacagctgggt

SEQ ID NO: 493162 - DNA, 16 bp, Homo sapiens
tgaaattttctagaat

SEQ ID NO: 493163 - DNA, 18 bp, Homo sapiens
tgaacaactcgaatcact

SEQ ID NO: 493164 - DNA, 19 bp, Homo sapiens
tgaacaagttgtttcattg

SEQ ID NO: 493165 - DNA, 22 bp, Homo sapiens
tgaacaagttgtttcattgact

SEQ ID NO: 493166 - DNA, 14 bp, Homo sapiens
tgaacatggactct

SEQ ID NO: 493167 - DNA, 12 bp, Homo sapiens
tgaacctggagg

SEQ ID NO: 493168 - DNA, 20 bp, Homo sapiens
tgaactttgaggaggaagca

SEQ ID NO: 493169 - DNA, 15 bp, Homo sapiens
tgaactttgctgagc

SEQ ID NO: 493170 - DNA, 20 bp, Homo sapiens
tgaagaagcaccaatcatga

SEQ ID NO: 493171 - DNA, 12 bp, Homo sapiens
tgaagatgaaca

SEQ ID NO: 493172 - DNA, 21 bp, Homo sapiens
tgaagatgcagcaaaatgtga

SEQ ID NO: 493173 - DNA, 20 bp, Homo sapiens
tgaagatttaccacttgtgt

SEQ ID NO: 493174 - DNA, 13 bp, Homo sapiens
tgaagcaaacaca

SEQ ID NO: 493175 - DNA, 15 bp, Homo sapiens
tgaagtaagcaaaga

SEQ ID NO: 493176 - DNA, 14 bp, Homo sapiens
tgaagtatgcacta

SEQ ID NO: 493177 - DNA, 21 bp, Homo sapiens
tgaagtccaagcatttagatg

SEQ ID NO: 493178 - DNA, 17 bp, Homo sapiens
tgaagtcgttgtgaggg

SEQ ID NO: 493179 - DNA, 19 bp, Homo sapiens
tgaagtttccttggctggt

SEQ ID NO: 493180 - DNA, 14 bp, Homo sapiens
tgaatataaacact

SEQ ID NO: 493181 - DNA, 23 bp, Homo sapiens
tgaatatttgtcgatatttccat

SEQ ID NO: 493182 - DNA, 14 bp, Homo sapiens
tgaatgcataaaat

SEQ ID NO: 493183 - DNA, 16 bp, Homo sapiens
tgaatgcataaaatgt

SEQ ID NO: 493184 - DNA, 19 bp, Homo sapiens
tgaattagaaacataaata

SEQ ID NO: 493185 - DNA, 12 bp, Homo sapiens
tgaatttctatg

SEQ ID NO: 493186 - DNA, 19 bp, Homo sapiens
tgacacaaacctgcctggg

SEQ ID NO: 493187 - DNA, 20 bp, Homo sapiens
tgacactggtattcctgcct

SEQ ID NO: 493188 - DNA, 13 bp, Homo sapiens
tgacagaacactg

SEQ ID NO: 493189 - DNA, 14 bp, Homo sapiens
tgacagaacactgt

SEQ ID NO: 493190 - DNA, 13 bp, Homo sapiens
tgacagctgttcc

SEQ ID NO: 493191 - DNA, 14 bp, Homo sapiens
tgacagctgttcca

SEQ ID NO: 493192 - DNA, 15 bp, Homo sapiens
tgaccaggcctgggc

SEQ ID NO: 493193 - DNA, 21 bp, Homo sapiens
tgaccagtttaacctgatgca

SEQ ID NO: 493194 - DNA, 13 bp, Homo sapiens
tgacccaggctgg

SEQ ID NO: 493195 - DNA, 21 bp, Homo sapiens
tgacctgcctcccttcatgca

SEQ ID NO: 493196 - DNA, 17 bp, Homo sapiens
tgaccttctaggaagct

SEQ ID NO: 493197 - DNA, 12 bp, Homo sapiens
tgactcttaaga

SEQ ID NO: 493198 - DNA, 14 bp, Homo sapiens
tgactcttaagaag

SEQ ID NO: 493199 - DNA, 13 bp, Homo sapiens
tgactgaatttct

SEQ ID NO: 493200 - DNA, 22 bp, Homo sapiens
tgactgagcaagaccctgtctc

SEQ ID NO: 493201 - DNA, 15 bp, Homo sapiens
tgactgtttccatca

SEQ ID NO: 493202 - DNA, 19 bp, Homo sapiens
tgacttttccatgtatcta

SEQ ID NO: 493203 - DNA, 21 bp, Homo sapiens
tgagaaaaatttacatggcaa

SEQ ID NO: 493204 - DNA, 16 bp, Homo sapiens
tgagaacactgtgaaa

SEQ ID NO: 493205 - DNA, 18 bp, Homo sapiens
tgagaagagagatcaaat

SEQ ID NO: 493206 - DNA, 16 bp, Homo sapiens
tgagacagtccagcct

SEQ ID NO: 493207 - DNA, 15 bp, Homo sapiens
tgagacccctgtctc

SEQ ID NO: 493208 - DNA, 23 bp, Homo sapiens
tgagactctcttaggagcagagc

SEQ ID NO: 493209 - DNA, 19 bp, Homo sapiens
tgagagacacactgaagaa

SEQ ID NO: 493210 - DNA, 20 bp, Homo sapiens
tgagagacacactgaagaag

SEQ ID NO: 493211 - DNA, 21 bp, Homo sapiens
tgagatgtagcaaattccaat

SEQ ID NO: 493212 - DNA, 15 bp, Homo sapiens
tgagattattttaat

SEQ ID NO: 493213 - DNA, 13 bp, Homo sapiens
tgagcactgtagg

SEQ ID NO: 493214 - DNA, 14 bp, Homo sapiens
tgagcatggagctg

SEQ ID NO: 493215 - DNA, 17 bp, Homo sapiens
tgagcccatggccctcc

SEQ ID NO: 493216 - DNA, 22 bp, Homo sapiens
tgagccctcctggaatggagct

SEQ ID NO: 493217 - DNA, 22 bp, Homo sapiens
tgagcctctttaacagctttct

SEQ ID NO: 493218 - DNA, 15 bp, Homo sapiens
tgagctgtgttcttg

SEQ ID NO: 493219 - DNA, 15 bp, Homo sapiens
tgaggacactgatat

SEQ ID NO: 493220 - DNA, 16 bp, Homo sapiens
tgaggagcagcttcag

SEQ ID NO: 493221 - DNA, 16 bp, Homo sapiens
tgaggattttgagtat

SEQ ID NO: 493222 - DNA, 13 bp, Homo sapiens
tgaggcagacagc

SEQ ID NO: 493223 - DNA, 21 bp, Homo sapiens
tgagggtaataaacttagaat

SEQ ID NO: 493224 - DNA, 18 bp, Homo sapiens
tgagggtatcaaataaaa

SEQ ID NO: 493225 - DNA, 18 bp, Homo sapiens
tgaggtcatagcagtgct

SEQ ID NO: 493226 - DNA, 21 bp, Homo sapiens
tgaggttcagcaaggtgagag

SEQ ID NO: 493227 - DNA, 20 bp, Homo sapiens
tgagtaaaaagtttctaaag

SEQ ID NO: 493228 - DNA, 15 bp, Homo sapiens
tgagtcaaaaaatct

SEQ ID NO: 493229 - DNA, 18 bp, Homo sapiens
tgagtctcaataaactga

SEQ ID NO: 493230 - DNA, 20 bp, Homo sapiens
tgagtgatgcggcagattga

SEQ ID NO: 493231 - DNA, 20 bp, Homo sapiens
tgagtgattatttgttattt

SEQ ID NO: 493232 - DNA, 20 bp, Homo sapiens
tgagttcaagggctgtaggt

SEQ ID NO: 493233 - DNA, 19 bp, Homo sapiens
tgagtttctctcacattac

SEQ ID NO: 493234 - DNA, 17 bp, Homo sapiens
tgagttttcttctgtga

SEQ ID NO: 493235 - DNA, 18 bp, Homo sapiens
tgataacaacctggagac

SEQ ID NO: 493236 - DNA, 21 bp, Homo sapiens
tgataagagggcacacactgt

SEQ ID NO: 493237 - DNA, 21 bp, Homo sapiens
tgataataaaattcattccat

SEQ ID NO: 493238 - DNA, 14 bp, Homo sapiens
tgatataaataaaa

SEQ ID NO: 493239 - DNA, 22 bp, Homo sapiens
tgatatagaacagtgcttgcca

SEQ ID NO: 493240 - DNA, 15 bp, Homo sapiens
tgatatgggctttct

SEQ ID NO: 493241 - DNA, 14 bp, Homo sapiens
tgatcacagcagct

SEQ ID NO: 493242 - DNA, 12 bp, Homo sapiens
tgatcagcagag

SEQ ID NO: 493243 - DNA, 13 bp, Homo sapiens
tgatcagcagaga

SEQ ID NO: 493244 - DNA, 17 bp, Homo sapiens
tgatcagcttattgtct

SEQ ID NO: 493245 - DNA, 24 bp, Homo sapiens
tgatcagcttattgtctagtgaaa

SEQ ID NO: 493246 - DNA, 22 bp, Homo sapiens
tgatcctaatgaatgcataaaa

SEQ ID NO: 493247 - DNA, 18 bp, Homo sapiens
tgatccttatgatgtcca

SEQ ID NO: 493248 - DNA, 12 bp, Homo sapiens
tgatctgtcaaa

SEQ ID NO: 493249 - DNA, 15 bp, Homo sapiens
tgatggcagagccag

SEQ ID NO: 493250 - DNA, 15 bp, Homo sapiens
tgatgtccctatgga

SEQ ID NO: 493251 - DNA, 16 bp, Homo sapiens
tgatgtccctatggaa

SEQ ID NO: 493252 - DNA, 13 bp, Homo sapiens
tgatgtgcctggg

SEQ ID NO: 493253 - DNA, 16 bp, Homo sapiens
tgattaagtaatgata

SEQ ID NO: 493254 - DNA, 18 bp, Homo sapiens
tgattaagtaatgataac

SEQ ID NO: 493255 - DNA, 12 bp, Homo sapiens
tgattctcaggg

SEQ ID NO: 493256 - DNA, 19 bp, Homo sapiens
tgattctcagggtctctgc

SEQ ID NO: 493257 - DNA, 20 bp, Homo sapiens
tgattctcagggtctctgct

SEQ ID NO: 493258 - DNA, 23 bp, Homo sapiens
tgattctcagggtctctgctgcc

SEQ ID NO: 493259 - DNA, 17 bp, Homo sapiens
tgattgggacagaggtt

SEQ ID NO: 493260 - DNA, 13 bp, Homo sapiens
tgatttatttgga

SEQ ID NO: 493261 - DNA, 12 bp, Homo sapiens
tgcaaagatttg

SEQ ID NO: 493262 - DNA, 12 bp, Homo sapiens
tgcaaaggctgg

SEQ ID NO: 493263 - DNA, 23 bp, Homo sapiens
tgcaaagtcatgcaaaggctggg

SEQ ID NO: 493264 - DNA, 13 bp, Homo sapiens
tgcaacaacatgt

SEQ ID NO: 493265 - DNA, 15 bp, Homo sapiens
tgcaacaacatgtat

SEQ ID NO: 493266 - DNA, 21 bp, Homo sapiens
tgcaagccagattttcctgaa

SEQ ID NO: 493267 - DNA, 21 bp, Homo sapiens
tgcaataaaatgggttttact

SEQ ID NO: 493268 - DNA, 21 bp, Homo sapiens
tgcacaaccatctgtccctgc

SEQ ID NO: 493269 - DNA, 13 bp, Homo sapiens
tgcacggctgctg

SEQ ID NO: 493270 - DNA, 23 bp, Homo sapiens
tgcacgttaaaaattaaaagaag

SEQ ID NO: 493271 - DNA, 16 bp, Homo sapiens
tgcactctagcctggc

SEQ ID NO: 493272 - DNA, 23 bp, Homo sapiens
tgcagagactttatccatgccaa

SEQ ID NO: 493273 - DNA, 13 bp, Homo sapiens
tgcagattcattt

SEQ ID NO: 493274 - DNA, 16 bp, Homo sapiens
tgcagatttgggctgg

SEQ ID NO: 493275 - DNA, 21 bp, Homo sapiens
tgcagcaggatctagaggggg

SEQ ID NO: 493276 - DNA, 23 bp, Homo sapiens
tgcagcccccactgcctttgacc

SEQ ID NO: 493277 - DNA, 22 bp, Homo sapiens
tgcagctggtctgtttccaggt

SEQ ID NO: 493278 - DNA, 16 bp, Homo sapiens
tgcaggcctgctcagg

SEQ ID NO: 493279 - DNA, 19 bp, Homo sapiens
tgcaggtgagcccatggcc

SEQ ID NO: 493280 - DNA, 23 bp, Homo sapiens
tgcaggtgagcccatggccctcc

SEQ ID NO: 493281 - DNA, 19 bp, Homo sapiens
tgcagtcacgtggaggagc

SEQ ID NO: 493282 - DNA, 15 bp, Homo sapiens
tgcagttctgaagaa

SEQ ID NO: 493283 - DNA, 11 bp, Homo sapiens
tgcataaaatg

SEQ ID NO: 493284 - DNA, 17 bp, Homo sapiens
tgcatagagccacgtat

SEQ ID NO: 493285 - DNA, 16 bp, Homo sapiens
tgcatagcagctgcta

SEQ ID NO: 493286 - DNA, 15 bp, Homo sapiens
tgcatagtcccagct

SEQ ID NO: 493287 - DNA, 16 bp, Homo sapiens
tgcatagtcccagcta

SEQ ID NO: 493288 - DNA, 15 bp, Homo sapiens
tgcatatgtatgact

SEQ ID NO: 493289 - DNA, 19 bp, Homo sapiens
tgcatggaatttgtaagtt

SEQ ID NO: 493290 - DNA, 21 bp, Homo sapiens
tgcattatatttattactgta

SEQ ID NO: 493291 - DNA, 20 bp, Homo sapiens
tgcattcttggttggctggc

SEQ ID NO: 493292 - DNA, 22 bp, Homo sapiens
tgcatttttatctgtgagttct

SEQ ID NO: 493293 - DNA, 14 bp, Homo sapiens
tgccaagcactgtg

SEQ ID NO: 493294 - DNA, 15 bp, Homo sapiens
tgccaagcactgtgc

SEQ ID NO: 493295 - DNA, 15 bp, Homo sapiens
tgccaagctcaggac

SEQ ID NO: 493296 - DNA, 14 bp, Homo sapiens
tgccacagagcggg

SEQ ID NO: 493297 - DNA, 16 bp, Homo sapiens
tgccacagagcgggga

SEQ ID NO: 493298 - DNA, 16 bp, Homo sapiens
tgccagatcctcttct

SEQ ID NO: 493299 - DNA, 15 bp, Homo sapiens
tgccagccagcagcc

SEQ ID NO: 493300 - DNA, 16 bp, Homo sapiens
tgccagccagcagcca

SEQ ID NO: 493301 - DNA, 23 bp, Homo sapiens
tgccagccagcagccagctctca

SEQ ID NO: 493302 - DNA, 12 bp, Homo sapiens
tgccatccctcc

SEQ ID NO: 493303 - DNA, 15 bp, Homo sapiens
tgccatccctccctc

SEQ ID NO: 493304 - DNA, 22 bp, Homo sapiens
tgccatccctccctccacctcc

SEQ ID NO: 493305 - DNA, 15 bp, Homo sapiens
tgccatgctttgagt

SEQ ID NO: 493306 - DNA, 20 bp, Homo sapiens
tgccatgctttgagtccacg

SEQ ID NO: 493307 - DNA, 11 bp, Homo sapiens
tgcccagggct

SEQ ID NO: 493308 - DNA, 14 bp, Homo sapiens
tgcccagggctcag

SEQ ID NO: 493309 - DNA, 16 bp, Homo sapiens
tgcccagggctcagcc

SEQ ID NO: 493310 - DNA, 17 bp, Homo sapiens
tgcccagggctcagcct

SEQ ID NO: 493311 - DNA, 16 bp, Homo sapiens
tgccccattcaacatc

SEQ ID NO: 493312 - DNA, 19 bp, Homo sapiens
tgccccggggaggggcgct

SEQ ID NO: 493313 - DNA, 13 bp, Homo sapiens
tgcccgtcttcag

SEQ ID NO: 493314 - DNA, 16 bp, Homo sapiens
tgccctctcctgggca

SEQ ID NO: 493315 - DNA, 17 bp, Homo sapiens
tgccctctcctgggcag

SEQ ID NO: 493316 - DNA, 22 bp, Homo sapiens
tgccctctcctgggcagctgcc

SEQ ID NO: 493317 - DNA, 19 bp, Homo sapiens
tgccctgttctctaccaag

SEQ ID NO: 493318 - DNA, 22 bp, Homo sapiens
tgccgcaatggccatgtgggga

SEQ ID NO: 493319 - DNA, 15 bp, Homo sapiens
tgccgctgccatgct

SEQ ID NO: 493320 - DNA, 18 bp, Homo sapiens
tgcctcagaaaacaagga

SEQ ID NO: 493321 - DNA, 23 bp, Homo sapiens
tgcctcccctcctctgcttgcca

SEQ ID NO: 493322 - DNA, 16 bp, Homo sapiens
tgcctcccttcatgca

SEQ ID NO: 493323 - DNA, 22 bp, Homo sapiens
tgcctgatatttccctcccctg

SEQ ID NO: 493324 - DNA, 15 bp, Homo sapiens
tgcctgatggacctg

SEQ ID NO: 493325 - DNA, 15 bp, Homo sapiens
tgcctgattgccaag

SEQ ID NO: 493326 - DNA, 17 bp, Homo sapiens
tgcctgcacaaactcac

SEQ ID NO: 493327 - DNA, 17 bp, Homo sapiens
tgccttctcaactccaa

SEQ ID NO: 493328 - DNA, 17 bp, Homo sapiens
tgcgcgcacaatagtaa

SEQ ID NO: 493329 - DNA, 16 bp, Homo sapiens
tgcgggcacaataaat

SEQ ID NO: 493330 - DNA, 18 bp, Homo sapiens
tgctaaatgtaagaatca

SEQ ID NO: 493331 - DNA, 24 bp, Homo sapiens
tgctaaatgtaagaatcattgtaa

SEQ ID NO: 493332 - DNA, 22 bp, Homo sapiens
tgctaactagcttggaaactgg

SEQ ID NO: 493333 - DNA, 15 bp, Homo sapiens
tgctaagcattccaa

SEQ ID NO: 493334 - DNA, 19 bp, Homo sapiens
tgctaagcattccaactat

SEQ ID NO: 493335 - DNA, 14 bp, Homo sapiens
tgctacctcactgg

SEQ ID NO: 493336 - DNA, 14 bp, Homo sapiens
tgctactagctctt

SEQ ID NO: 493337 - DNA, 16 bp, Homo sapiens
tgctagtaattggaaa

SEQ ID NO: 493338 - DNA, 16 bp, Homo sapiens
tgctatattttcatga

SEQ ID NO: 493339 - DNA, 19 bp, Homo sapiens
tgctatccagctattttta

SEQ ID NO: 493340 - DNA, 17 bp, Homo sapiens
tgctcagttcagaatca

SEQ ID NO: 493341 - DNA, 18 bp, Homo sapiens
tgctcagttcagaatcac

SEQ ID NO: 493342 - DNA, 13 bp, Homo sapiens
tgctccagcctct

SEQ ID NO: 493343 - DNA, 15 bp, Homo sapiens
tgctccagcctctgc

SEQ ID NO: 493344 - DNA, 12 bp, Homo sapiens
tgctctcttcaa

SEQ ID NO: 493345 - DNA, 18 bp, Homo sapiens
tgctctcttcaataaacc

SEQ ID NO: 493346 - DNA, 15 bp, Homo sapiens
tgctctggacacttg

SEQ ID NO: 493347 - DNA, 17 bp, Homo sapiens
tgctgcccgtcttcagc

SEQ ID NO: 493348 - DNA, 21 bp, Homo sapiens
tgctgccgccccacccagatg

SEQ ID NO: 493349 - DNA, 13 bp, Homo sapiens
tgctggagactcc

SEQ ID NO: 493350 - DNA, 17 bp, Homo sapiens
tgcttgccacagagcgg

SEQ ID NO: 493351 - DNA, 11 bp, Homo sapiens
tggaaaataaa

SEQ ID NO: 493352 - DNA, 23 bp, Homo sapiens
tggaaagacagcttctcatcctg

SEQ ID NO: 493353 - DNA, 17 bp, Homo sapiens
tggaaaggagaggaaag

SEQ ID NO: 493354 - DNA, 23 bp, Homo sapiens
tggaaaggagaggaaagaactca

SEQ ID NO: 493355 - DNA, 22 bp, Homo sapiens
tggaaagttcttaggcaccata

SEQ ID NO: 493356 - DNA, 17 bp, Homo sapiens
tggaaattcccttcatc

SEQ ID NO: 493357 - DNA, 22 bp, Homo sapiens
tggaaattcccttcatctggaa

SEQ ID NO: 493358 - DNA, 19 bp, Homo sapiens
tggaacagattcacactgt

SEQ ID NO: 493359 - DNA, 21 bp, Homo sapiens
tggaacatcatcaaggcactg

SEQ ID NO: 493360 - DNA, 11 bp, Homo sapiens
tggaagacaca

SEQ ID NO: 493361 - DNA, 20 bp, Homo sapiens
tggaagacagagacctcctg

SEQ ID NO: 493362 - DNA, 17 bp, Homo sapiens
tggaagtgactttggct

SEQ ID NO: 493363 - DNA, 17 bp, Homo sapiens
tggaatgggcagctcat

SEQ ID NO: 493364 - DNA, 14 bp, Homo sapiens
tggaatttgtaagt

SEQ ID NO: 493365 - DNA, 18 bp, Homo sapiens
tggacaccaggagtccct

SEQ ID NO: 493366 - DNA, 12 bp, Homo sapiens
tggacagaagaa

SEQ ID NO: 493367 - DNA, 13 bp, Homo sapiens
tggactaagaaga

SEQ ID NO: 493368 - DNA, 20 bp, Homo sapiens
tggactccagcctgcctggc

SEQ ID NO: 493369 - DNA, 21 bp, Homo sapiens
tggactccagcctgcctggca

SEQ ID NO: 493370 - DNA, 14 bp, Homo sapiens
tggagaagaactga

SEQ ID NO: 493371 - DNA, 16 bp, Homo sapiens
tggagaagaactgaaa

SEQ ID NO: 493372 - DNA, 21 bp, Homo sapiens
tggagaagctccctgaagtaa

SEQ ID NO: 493373 - DNA, 18 bp, Homo sapiens
tggagactcctaggcagg

SEQ ID NO: 493374 - DNA, 22 bp, Homo sapiens
tggagactcctaggcaggacat

SEQ ID NO: 493375 - DNA, 19 bp, Homo sapiens
tggagagccagaacctgga

SEQ ID NO: 493376 - DNA, 22 bp, Homo sapiens
tggagagctagaacctggagag

SEQ ID NO: 493377 - DNA, 15 bp, Homo sapiens
tggagcagaatcagt

SEQ ID NO: 493378 - DNA, 21 bp, Homo sapiens
tggagctcgtggaacagttac

SEQ ID NO: 493379 - DNA, 21 bp, Homo sapiens
tggaggactagaacctggagg

SEQ ID NO: 493380 - DNA, 11 bp, Homo sapiens
tggaggagcaa

SEQ ID NO: 493381 - DNA, 21 bp, Homo sapiens
tggaggagcaaaggctgagaa

SEQ ID NO: 493382 - DNA, 15 bp, Homo sapiens
tggaggaggcctggg

SEQ ID NO: 493383 - DNA, 19 bp, Homo sapiens
tggagggaatgaacctgga

SEQ ID NO: 493384 - DNA, 20 bp, Homo sapiens
tggagggaatgaacctggag

SEQ ID NO: 493385 - DNA, 21 bp, Homo sapiens
tggagggaatgaacctggagg

SEQ ID NO: 493386 - DNA, 22 bp, Homo sapiens
tggagggctagaacctggagaa

SEQ ID NO: 493387 - DNA, 21 bp, Homo sapiens
tggagggctagaactggagag

SEQ ID NO: 493388 - DNA, 21 bp, Homo sapiens
tggagggctagaatctggaga

SEQ ID NO: 493389 - DNA, 23 bp, Homo sapiens
tggagggctagaatctggagagc

SEQ ID NO: 493390 - DNA, 22 bp, Homo sapiens
tggagggctggaatctggagag

SEQ ID NO: 493391 - DNA, 21 bp, Homo sapiens
tggaggttgccgtgagccaag

SEQ ID NO: 493392 - DNA, 17 bp, Homo sapiens
tggagtggaggcattgt

SEQ ID NO: 493393 - DNA, 15 bp, Homo sapiens
tggatctatcacctg

SEQ ID NO: 493394 - DNA, 21 bp, Homo sapiens
tggatctatcacctgtcatca

SEQ ID NO: 493395 - DNA, 22 bp, Homo sapiens
tggatgcatgttttccagctcc

SEQ ID NO: 493396 - DNA, 15 bp, Homo sapiens
tggcaaggctgtgct

SEQ ID NO: 493397 - DNA, 16 bp, Homo sapiens
tggcaaggctgtgctc

SEQ ID NO: 493398 - DNA, 23 bp, Homo sapiens
tggcaaggctgtgctccctggtt

SEQ ID NO: 493399 - DNA, 17 bp, Homo sapiens
tggcaagggttcacctg

SEQ ID NO: 493400 - DNA, 20 bp, Homo sapiens
tggcaatagtcaaattgtgt

SEQ ID NO: 493401 - DNA, 15 bp, Homo sapiens
tggcactagtatttc

SEQ ID NO: 493402 - DNA, 13 bp, Homo sapiens
tggcactgccatg

SEQ ID NO: 493403 - DNA, 12 bp, Homo sapiens
tggcagagccag

SEQ ID NO: 493404 - DNA, 16 bp, Homo sapiens
tggcagagccaggctg

SEQ ID NO: 493405 - DNA, 18 bp, Homo sapiens
tggcaggatggcctggcc

SEQ ID NO: 493406 - DNA, 20 bp, Homo sapiens
tggcaggatggcctggccag

SEQ ID NO: 493407 - DNA, 17 bp, Homo sapiens
tggccatctctggatgc

SEQ ID NO: 493408 - DNA, 19 bp, Homo sapiens
tggcccaagtggcagagct

SEQ ID NO: 493409 - DNA, 17 bp, Homo sapiens
tggccgggcatggtagc

SEQ ID NO: 493410 - DNA, 22 bp, Homo sapiens
tggcctcaagatcaatgaaatg

SEQ ID NO: 493411 - DNA, 13 bp, Homo sapiens
tggctattaaaaa

SEQ ID NO: 493412 - DNA, 13 bp, Homo sapiens
tggctgaactcat

SEQ ID NO: 493413 - DNA, 12 bp, Homo sapiens
tggctgctgccc

SEQ ID NO: 493414 - DNA, 21 bp, Homo sapiens
tggctggccttccacttggct

SEQ ID NO: 493415 - DNA, 15 bp, Homo sapiens
tggctgggaactcac

SEQ ID NO: 493416 - DNA, 15 bp, Homo sapiens
tggcttatccagctg

SEQ ID NO: 493417 - DNA, 17 bp, Homo sapiens
tttcaaacatatataac

SEQ ID NO: 493418 - DNA, 19 bp, Homo sapiens
tttcaaacatatataacaa

SEQ ID NO: 493419 - DNA, 18 bp, Homo sapiens
tttcaagacccctgtctt

SEQ ID NO: 493420 - DNA, 14 bp, Homo sapiens
tttcaatttccaag

SEQ ID NO: 493421 - DNA, 21 bp, Homo sapiens
tttcagaaagaagtggggaca

SEQ ID NO: 493422 - DNA, 17 bp, Homo sapiens
tttcagaagctgcagct

SEQ ID NO: 493423 - DNA, 13 bp, Homo sapiens
tttccaagagctg

SEQ ID NO: 493424 - DNA, 14 bp, Homo sapiens
tttccaagagctga

SEQ ID NO: 493425 - DNA, 13 bp, Homo sapiens
tttccatgtatct

SEQ ID NO: 493426 - DNA, 19 bp, Homo sapiens
tttcccactttcttctacc

SEQ ID NO: 493427 - DNA, 21 bp, Homo sapiens
tttcccgagcaaagtctaaag

SEQ ID NO: 493428 - DNA, 22 bp, Homo sapiens
tttcccgagcaaagtctaaagt

SEQ ID NO: 493429 - DNA, 22 bp, Homo sapiens
tttccctgcttaatgaaaagct

SEQ ID NO: 493430 - DNA, 14 bp, Homo sapiens
tttctagaatacta

SEQ ID NO: 493431 - DNA, 15 bp, Homo sapiens
tttctagaatactaa

SEQ ID NO: 493432 - DNA, 13 bp, Homo sapiens
tttctatgaaata

SEQ ID NO: 493433 - DNA, 20 bp, Homo sapiens
tttctatgaaatattatgtt

SEQ ID NO: 493434 - DNA, 17 bp, Homo sapiens
tttctatggcatattga

SEQ ID NO: 493435 - DNA, 23 bp, Homo sapiens
tttctgatctgatgcaagcaaga

SEQ ID NO: 493436 - DNA, 16 bp, Homo sapiens
tttcttaaacaaatgt

SEQ ID NO: 493437 - DNA, 15 bp, Homo sapiens
tttgaacaactcgaa

SEQ ID NO: 493438 - DNA, 16 bp, Homo sapiens
tttgagtgattatttg

SEQ ID NO: 493439 - DNA, 23 bp, Homo sapiens
tttgatatgggctttctctttgg

SEQ ID NO: 493440 - DNA, 14 bp, Homo sapiens
tttgcaagccagat

SEQ ID NO: 493441 - DNA, 18 bp, Homo sapiens
tttgccaccctcatgctg

SEQ ID NO: 493442 - DNA, 15 bp, Homo sapiens
tttgccagtgggaac

SEQ ID NO: 493443 - DNA, 22 bp, Homo sapiens
tttgctaactagcttggaaact

SEQ ID NO: 493444 - DNA, 23 bp, Homo sapiens
tttgctcacacggggtattttag

SEQ ID NO: 493445 - DNA, 11 bp, Homo sapiens
tttgctcatgg

SEQ ID NO: 493446 - DNA, 16 bp, Homo sapiens
tttgcttctctctcta

SEQ ID NO: 493447 - DNA, 23 bp, Homo sapiens
tttggccatctctggatgcctga

SEQ ID NO: 493448 - DNA, 12 bp, Homo sapiens
tttgggaagggg

SEQ ID NO: 493449 - DNA, 13 bp, Homo sapiens
tttgtataaaata

SEQ ID NO: 493450 - DNA, 17 bp, Homo sapiens
tttgtgaagcaaaattt

SEQ ID NO: 493451 - DNA, 21 bp, Homo sapiens
tttgtgttcctctttgcatga

SEQ ID NO: 493452 - DNA, 17 bp, Homo sapiens
tttgttatttgtacagt

SEQ ID NO: 493453 - DNA, 16 bp, Homo sapiens
ttttaaaagttattaa

SEQ ID NO: 493454 - DNA, 20 bp, Homo sapiens
ttttaaaccctattggtaaa

SEQ ID NO: 493455 - DNA, 22 bp, Homo sapiens
ttttaagctgtaaaaagagaga

SEQ ID NO: 493456 - DNA, 14 bp, Homo sapiens
ttttaataatgttt

SEQ ID NO: 493457 - DNA, 18 bp, Homo sapiens
ttttaggcagggatttga

SEQ ID NO: 493458 - DNA, 23 bp, Homo sapiens
ttttataattttgtgaagcaaaa

SEQ ID NO: 493459 - DNA, 10 bp, Homo sapiens
ttttatattt

SEQ ID NO: 493460 - DNA, 15 bp, Homo sapiens
ttttatctgtgagtt

SEQ ID NO: 493461 - DNA, 23 bp, Homo sapiens
ttttcacacaatacaataagtta

SEQ ID NO: 493462 - DNA, 14 bp, Homo sapiens
ttttccatgtatct

SEQ ID NO: 493463 - DNA, 16 bp, Homo sapiens
ttttctctaggaaata

SEQ ID NO: 493464 - DNA, 17 bp, Homo sapiens
ttttgtgttcctctttg

SEQ ID NO: 493465 - DNA, 16 bp, Homo sapiens
ttttgtttcatcctgt

SEQ ID NO: 493466 - DNA, 14 bp, Homo sapiens
tttttaagctgtaa

SEQ ID NO: 493467 - DNA, 17 bp, Homo sapiens
tttttatatttgaaata

SEQ ID NO: 493468 - DNA, 19 bp, Homo sapiens
tttttctcatgaatctgca

SEQ ID NO: 493469 - DNA, 13 bp, Homo sapiens
aaacagactattt

SEQ ID NO: 493470 - DNA, 19 bp, Homo sapiens
aaacatatataacaatgct

SEQ ID NO: 493471 - DNA, 13 bp, Homo sapiens
aaacatgtcatgt

SEQ ID NO: 493472 - DNA, 12 bp, Homo sapiens
aaacattgaaga

SEQ ID NO: 493473 - DNA, 16 bp, Homo sapiens
aaacattttcacacaa

SEQ ID NO: 493474 - DNA, 22 bp, Homo sapiens
aaacattttcacacaatacaat

SEQ ID NO: 493475 - DNA, 18 bp, Homo sapiens
aaaccaaatcactgaact

SEQ ID NO: 493476 - DNA, 20 bp, Homo sapiens
aaaccattatgaagaagaga

SEQ ID NO: 493477 - DNA, 16 bp, Homo sapiens
aaaccctattggtaaa

SEQ ID NO: 493478 - DNA, 16 bp, Homo sapiens
aaacctgcctgggttt

SEQ ID NO: 493479 - DNA, 15 bp, Homo sapiens
aaactcgttaatttg

SEQ ID NO: 493480 - DNA, 19 bp, Homo sapiens
aaactgaatttttcttgcg

SEQ ID NO: 493481 - DNA, 19 bp, Homo sapiens
aaacttccagtgcaacact

SEQ ID NO: 493482 - DNA, 10 bp, Homo sapiens
aaacttcttg

SEQ ID NO: 493483 - DNA, 15 bp, Homo sapiens
aaacttgttagaaat

SEQ ID NO: 493484 - DNA, 23 bp, Homo sapiens
aaagaaagttgcacggctgctga

SEQ ID NO: 493485 - DNA, 21 bp, Homo sapiens
aaagaagagccggagcctcca

SEQ ID NO: 493486 - DNA, 18 bp, Homo sapiens
aaagaagtggggacagag

SEQ ID NO: 493487 - DNA, 17 bp, Homo sapiens
aaagaatggaaggtgga

SEQ ID NO: 493488 - DNA, 19 bp, Homo sapiens
aaagacaaatcaaagcaga

SEQ ID NO: 493489 - DNA, 14 bp, Homo sapiens
aaagacagagctgg

SEQ ID NO: 493490 - DNA, 13 bp, Homo sapiens
aaagagagagaga

SEQ ID NO: 493491 - DNA, 18 bp, Homo sapiens
aaagagatggcctgagaa

SEQ ID NO: 493492 - DNA, 21 bp, Homo sapiens
aaagcaaacttaagaaacact

SEQ ID NO: 493493 - DNA, 19 bp, Homo sapiens
aaagccaataacacacagc

SEQ ID NO: 493494 - DNA, 17 bp, Homo sapiens
aaagcccattcattcca

SEQ ID NO: 493495 - DNA, 17 bp, Homo sapiens
aaagcctgtgttactga

SEQ ID NO: 493496 - DNA, 17 bp, Homo sapiens
aaagtatgttagtgcaa

SEQ ID NO: 493497 - DNA, 19 bp, Homo sapiens
aaagtggtggcaaaagaca

SEQ ID NO: 493498 - DNA, 21 bp, Homo sapiens
aaagttattaatattttaatt

SEQ ID NO: 493499 - DNA, 16 bp, Homo sapiens
aaagttctagtgaccg

SEQ ID NO: 493500 - DNA, 21 bp, Homo sapiens
aaagtttacagtaaataaatt

SEQ ID NO: 493501 - DNA, 22 bp, Homo sapiens
aaataaaacattttcacacaat

SEQ ID NO: 493502 - DNA, 14 bp, Homo sapiens
aaataaaatgacca

SEQ ID NO: 493503 - DNA, 12 bp, Homo sapiens
aaataaagctgt

SEQ ID NO: 493504 - DNA, 12 bp, Homo sapiens
aaataaattgtt

SEQ ID NO: 493505 - DNA, 15 bp, Homo sapiens
aaataaattgtttga

SEQ ID NO: 493506 - DNA, 18 bp, Homo sapiens
aaataagggcagagtcac

SEQ ID NO: 493507 - DNA, 20 bp, Homo sapiens
aaatacagtttgtcacatga

SEQ ID NO: 493508 - DNA, 16 bp, Homo sapiens
aaatagtaaaaataaa

SEQ ID NO: 493509 - DNA, 17 bp, Homo sapiens
aaatattatgttaaaac

SEQ ID NO: 493510 - DNA, 13 bp, Homo sapiens
aaatatttatttt

SEQ ID NO: 493511 - DNA, 20 bp, Homo sapiens
aaatatttattttaataatg

SEQ ID NO: 493512 - DNA, 15 bp, Homo sapiens
aaatcacaaactcat

SEQ ID NO: 493513 - DNA, 22 bp, Homo sapiens
aaatcacaaactcatccattaa

SEQ ID NO: 493514 - DNA, 13 bp, Homo sapiens
aaatctatgccac

SEQ ID NO: 493515 - DNA, 14 bp, Homo sapiens
aaatctatgccact

SEQ ID NO: 493516 - DNA, 18 bp, Homo sapiens
aaatctcaatatttcaga

SEQ ID NO: 493517 - DNA, 21 bp, Homo sapiens
aaatgaccagtaattgtgaaa

SEQ ID NO: 493518 - DNA, 20 bp, Homo sapiens
aaatgggactgatgtcatct

SEQ ID NO: 493519 - DNA, 21 bp, Homo sapiens
aaatgggactgatgtcatctt

SEQ ID NO: 493520 - DNA, 17 bp, Homo sapiens
aaatgtaagaatcattg

SEQ ID NO: 493521 - DNA, 20 bp, Homo sapiens
aaatgtaagaatcattgtaa

SEQ ID NO: 493522 - DNA, 21 bp, Homo sapiens
aaatgtaccatcaaatgttaa

SEQ ID NO: 493523 - DNA, 21 bp, Homo sapiens
aaatgttaacagagtttgata

SEQ ID NO: 493524 - DNA, 20 bp, Homo sapiens
aaatgttaagttgatggtga

SEQ ID NO: 493525 - DNA, 22 bp, Homo sapiens
aaatgttgacatgggacatttg

SEQ ID NO: 493526 - DNA, 13 bp, Homo sapiens
aaattaaagctga

SEQ ID NO: 493527 - DNA, 13 bp, Homo sapiens
aaattaacactgc

SEQ ID NO: 493528 - DNA, 22 bp, Homo sapiens
aaattaattctttatcacatgt

SEQ ID NO: 493529 - DNA, 16 bp, Homo sapiens
aaattcccttcatctg

SEQ ID NO: 493530 - DNA, 18 bp, Homo sapiens
aaattcccttcatctgga

SEQ ID NO: 493531 - DNA, 22 bp, Homo sapiens
aaattccttagcttagacctca

SEQ ID NO: 493532 - DNA, 23 bp, Homo sapiens
aaattccttagcttagacctcag

SEQ ID NO: 493533 - DNA, 15 bp, Homo sapiens
aaattttctagaata

SEQ ID NO: 493534 - DNA, 22 bp, Homo sapiens
aacaaattcatcaaatggaaga

SEQ ID NO: 493535 - DNA, 13 bp, Homo sapiens
aacaacatgtata

SEQ ID NO: 493536 - DNA, 19 bp, Homo sapiens
aacaagcaagctcccaagg

SEQ ID NO: 493537 - DNA, 17 bp, Homo sapiens
aacaatgctgtatttta

SEQ ID NO: 493538 - DNA, 22 bp, Homo sapiens
aacaatgctgtattttaaaaga

SEQ ID NO: 493539 - DNA, 23 bp, Homo sapiens
aagagggaagaaagagaaggagc

SEQ ID NO: 493540 - DNA, 11 bp, Homo sapiens
aagataaagag

SEQ ID NO: 493541 - DNA, 20 bp, Homo sapiens
aagatataactattgcccag

SEQ ID NO: 493542 - DNA, 19 bp, Homo sapiens
aagcaaaattttttctcta

SEQ ID NO: 493543 - DNA, 17 bp, Homo sapiens
aagcagggtctgggcag

SEQ ID NO: 493544 - DNA, 14 bp, Homo sapiens
aagcagtagacaag

SEQ ID NO: 493545 - DNA, 13 bp, Homo sapiens
aagccaaagccaa

SEQ ID NO: 493546 - DNA, 20 bp, Homo sapiens
aagccaataacacacagcta

SEQ ID NO: 493547 - DNA, 19 bp, Homo sapiens
aagccagattttcctgaaa

SEQ ID NO: 493548 - DNA, 16 bp, Homo sapiens
aagcccattcattcca

SEQ ID NO: 493549 - DNA, 21 bp, Homo sapiens
aagcccattcattccattctg

SEQ ID NO: 493550 - DNA, 12 bp, Homo sapiens
aagccctgaggg

SEQ ID NO: 493551 - DNA, 16 bp, Homo sapiens
aagccttccacactca

SEQ ID NO: 493552 - DNA, 23 bp, Homo sapiens
aagctaaaacctgagctagaagc

SEQ ID NO: 493553 - DNA, 16 bp, Homo sapiens
aagctagaacctggag

SEQ ID NO: 493554 - DNA, 20 bp, Homo sapiens
aagctcacagacctttgaac

SEQ ID NO: 493555 - DNA, 13 bp, Homo sapiens
aagctccaggtag

SEQ ID NO: 493556 - DNA, 20 bp, Homo sapiens
aagctcttgaagacactgaa

SEQ ID NO: 493557 - DNA, 14 bp, Homo sapiens
aagctgaagatccc

SEQ ID NO: 493558 - DNA, 22 bp, Homo sapiens
aagctgaagatccccaactgct

SEQ ID NO: 493559 - DNA, 18 bp, Homo sapiens
aagctgtaaaaagagaga

SEQ ID NO: 493560 - DNA, 17 bp, Homo sapiens
aaggaaaaataaatatt

SEQ ID NO: 493561 - DNA, 17 bp, Homo sapiens
aaggaaaccacagctgc

SEQ ID NO: 493562 - DNA, 18 bp, Homo sapiens
aaggaaaccacagctgct

SEQ ID NO: 493563 - DNA, 22 bp, Homo sapiens
aaggaagggcatccttctgcct

SEQ ID NO: 493564 - DNA, 16 bp, Homo sapiens
aaggaattatcaatta

SEQ ID NO: 493565 - DNA, 15 bp, Homo sapiens
aaggacaaataaagc

SEQ ID NO: 493566 - DNA, 12 bp, Homo sapiens
aaggagacacaa

SEQ ID NO: 493567 - DNA, 19 bp, Homo sapiens
aaggagggttagggagggg

SEQ ID NO: 493568 - DNA, 16 bp, Homo sapiens
aaggatttactttttg

SEQ ID NO: 493569 - DNA, 20 bp, Homo sapiens
aaggcagctctaaatgtcaa

SEQ ID NO: 493570 - DNA, 18 bp, Homo sapiens
aaggccatggagagctgg

SEQ ID NO: 493571 - DNA, 21 bp, Homo sapiens
aaggccatggagagctggagc

SEQ ID NO: 493572 - DNA, 18 bp, Homo sapiens
aaggcgtggagctgcctg

SEQ ID NO: 493573 - DNA, 18 bp, Homo sapiens
aaggctggagtgcagtgg

SEQ ID NO: 493574 - DNA, 22 bp, Homo sapiens
aaggctgtgctccctggttctg

SEQ ID NO: 493575 - DNA, 21 bp, Homo sapiens
aagggaagttcaggctctgag

SEQ ID NO: 493576 - DNA, 20 bp, Homo sapiens
aagggattttagtcacacgt

SEQ ID NO: 493577 - DNA, 17 bp, Homo sapiens
aagggcatccttctgcc

SEQ ID NO: 493578 - DNA, 19 bp, Homo sapiens
aagggctagaacctggaga

SEQ ID NO: 493579 - DNA, 13 bp, Homo sapiens
aaggtacttcaaa

SEQ ID NO: 493580 - DNA, 23 bp, Homo sapiens
aaggtttcagaaagaagtgggga

SEQ ID NO: 493581 - DNA, 16 bp, Homo sapiens
aagtaatcctagggaa

SEQ ID NO: 493582 - DNA, 18 bp, Homo sapiens
aagtatgcactaatcaat

SEQ ID NO: 493583 - DNA, 11 bp, Homo sapiens
aagtctaaagt

SEQ ID NO: 493584 - DNA, 15 bp, Homo sapiens
aagtctaaagtttac

SEQ ID NO: 493585 - DNA, 19 bp, Homo sapiens
aagtgactgttcaagagca

SEQ ID NO: 493586 - DNA, 21 bp, Homo sapiens
aagtgattgacaactgaagag

SEQ ID NO: 493587 - DNA, 21 bp, Homo sapiens
aagtggacagagcgcccctcc

SEQ ID NO: 493588 - DNA, 15 bp, Homo sapiens
aagtggggacagagc

SEQ ID NO: 493589 - DNA, 20 bp, Homo sapiens
aagttgatatagaacagtgc

SEQ ID NO: 493590 - DNA, 21 bp, Homo sapiens
aagttgatatagaacagtgct

SEQ ID NO: 493591 - DNA, 19 bp, Homo sapiens
aagtttacagtaaataaat

SEQ ID NO: 493592 - DNA, 20 bp, Homo sapiens
aagtttacagtaaataaatt

SEQ ID NO: 493593 - DNA, 20 bp, Homo sapiens
aagtttccttggctggtgca

SEQ ID NO: 493594 - DNA, 19 bp, Homo sapiens
aataaaacattttcacaca

SEQ ID NO: 493595 - DNA, 13 bp, Homo sapiens
aataaaagagaga

SEQ ID NO: 493596 - DNA, 15 bp, Homo sapiens
aataaaatgcattta

SEQ ID NO: 493597 - DNA, 17 bp, Homo sapiens
aataaaatgcatttaaa

SEQ ID NO: 493598 - DNA, 12 bp, Homo sapiens
aataaaattgta

SEQ ID NO: 493599 - DNA, 23 bp, Homo sapiens
aataaactgaatttttcttgcga

SEQ ID NO: 493600 - DNA, 14 bp, Homo sapiens
acacagatgaaaca

SEQ ID NO: 493601 - DNA, 13 bp, Homo sapiens
acaccaagcagca

SEQ ID NO: 493602 - DNA, 16 bp, Homo sapiens
acaccaagcagcaaca

SEQ ID NO: 493603 - DNA, 13 bp, Homo sapiens
acaccaggactta

SEQ ID NO: 493604 - DNA, 17 bp, Homo sapiens
acaccaggagtccctgg

SEQ ID NO: 493605 - DNA, 21 bp, Homo sapiens
acaccaggcttgcctgcaggc

SEQ ID NO: 493606 - DNA, 23 bp, Homo sapiens
acacccctcccctgccctagagc

SEQ ID NO: 493607 - DNA, 13 bp, Homo sapiens
acaccctcacact

SEQ ID NO: 493608 - DNA, 16 bp, Homo sapiens
acaccctcacactggg

SEQ ID NO: 493609 - DNA, 17 bp, Homo sapiens
acacctgagccagcctg

SEQ ID NO: 493610 - DNA, 16 bp, Homo sapiens
acacgggggcagctga

SEQ ID NO: 493611 - DNA, 23 bp, Homo sapiens
acacgggggcagctgatacaaat

SEQ ID NO: 493612 - DNA, 17 bp, Homo sapiens
acacggggtattttagg

SEQ ID NO: 493613 - DNA, 19 bp, Homo sapiens
acacggtttgaagcctgga

SEQ ID NO: 493614 - DNA, 15 bp, Homo sapiens
acactaaacagacta

SEQ ID NO: 493615 - DNA, 17 bp, Homo sapiens
acactaagagagaatga

SEQ ID NO: 493616 - DNA, 18 bp, Homo sapiens
acactagaggccagggat

SEQ ID NO: 493617 - DNA, 16 bp, Homo sapiens
acactattcactaaaa

SEQ ID NO: 493618 - DNA, 16 bp, Homo sapiens
acactcaagaagcagg

SEQ ID NO: 493619 - DNA, 21 bp, Homo sapiens
acactgaaatatacacacagc

SEQ ID NO: 493620 - DNA, 18 bp, Homo sapiens
acactgggacttgcaaaa

SEQ ID NO: 493621 - DNA, 13 bp, Homo sapiens
acactgtcttgaa

SEQ ID NO: 493622 - DNA, 14 bp, Homo sapiens
acagaacactgtct

SEQ ID NO: 493623 - DNA, 20 bp, Homo sapiens
acagaagaaggcagcaggtg

SEQ ID NO: 493624 - DNA, 14 bp, Homo sapiens
acagaagacagcag

SEQ ID NO: 493625 - DNA, 16 bp, Homo sapiens
acagacctgctctgga

SEQ ID NO: 493626 - DNA, 14 bp, Homo sapiens
acagagcaggactg

SEQ ID NO: 493627 - DNA, 16 bp, Homo sapiens
acagagcgcccctccc

SEQ ID NO: 493628 - DNA, 14 bp, Homo sapiens
acagagctgggatg

SEQ ID NO: 493629 - DNA, 15 bp, Homo sapiens
acagatacacataca

SEQ ID NO: 493630 - DNA, 16 bp, Homo sapiens
acagatacacatacac

SEQ ID NO: 493631 - DNA, 14 bp, Homo sapiens
acagatcctctggg

SEQ ID NO: 493632 - DNA, 19 bp, Homo sapiens
acagatgaaacacaaacaa

SEQ ID NO: 493633 - DNA, 20 bp, Homo sapiens
acagatgaaacacaaacaat

SEQ ID NO: 493634 - DNA, 14 bp, Homo sapiens
acagcagctcaggc

SEQ ID NO: 493635 - DNA, 16 bp, Homo sapiens
acagcagctcaggcac

SEQ ID NO: 493636 - DNA, 16 bp, Homo sapiens
acagcccaaagaagga

SEQ ID NO: 493637 - DNA, 19 bp, Homo sapiens
acagcccaaagaaggaaaa

SEQ ID NO: 493638 - DNA, 19 bp, Homo sapiens
acagccgctcctgtctgcc

SEQ ID NO: 493639 - DNA, 11 bp, Homo sapiens
acagctgctgg

SEQ ID NO: 493640 - DNA, 19 bp, Homo sapiens
acagctgtatgattcccag

SEQ ID NO: 493641 - DNA, 16 bp, Homo sapiens
acagctttctccagaa

SEQ ID NO: 493642 - DNA, 12 bp, Homo sapiens
acagggacccac

SEQ ID NO: 493643 - DNA, 22 bp, Homo sapiens
acaggtgggcttcccagtggct

SEQ ID NO: 493644 - DNA, 17 bp, Homo sapiens
acagtaaataaattgtt

SEQ ID NO: 493645 - DNA, 16 bp, Homo sapiens
acagtcacctcatgga

SEQ ID NO: 493646 - DNA, 15 bp, Homo sapiens
acagtccagcctgga

SEQ ID NO: 493647 - DNA, 18 bp, Homo sapiens
acagtccagcctggagat

SEQ ID NO: 493648 - DNA, 19 bp, Homo sapiens
acataaataaaatgaccag

SEQ ID NO: 493649 - DNA, 20 bp, Homo sapiens
acataagctagaaaaattag

SEQ ID NO: 493650 - DNA, 17 bp, Homo sapiens
acatacagagctctctg

SEQ ID NO: 493651 - DNA, 19 bp, Homo sapiens
acatcatcaaggcactgcc

SEQ ID NO: 493652 - DNA, 20 bp, Homo sapiens
acatcatcaaggcactgcct

SEQ ID NO: 493653 - DNA, 22 bp, Homo sapiens
acatcatggactgagctggggg

SEQ ID NO: 493654 - DNA, 14 bp, Homo sapiens
acatcctcaaaaga

SEQ ID NO: 493655 - DNA, 15 bp, Homo sapiens
acatctgtcctgtga

SEQ ID NO: 493656 - DNA, 18 bp, Homo sapiens
acatgccaagcactgtgc

SEQ ID NO: 493657 - DNA, 14 bp, Homo sapiens
acatgctgaagcca

SEQ ID NO: 493658 - DNA, 13 bp, Homo sapiens
acatggagttccc

SEQ ID NO: 493659 - DNA, 21 bp, Homo sapiens
acatgggacatttgctcatgg

SEQ ID NO: 493660 - DNA, 17 bp, Homo sapiens
acattaagccttccaca

SEQ ID NO: 493661 - DNA, 18 bp, Homo sapiens
acattccttgcctgcaca

SEQ ID NO: 493662 - DNA, 14 bp, Homo sapiens
acattgaattagaa

SEQ ID NO: 493663 - DNA, 18 bp, Homo sapiens
acattgaattagaaacat

SEQ ID NO: 493664 - DNA, 20 bp, Homo sapiens
acatttaagagacagtcacc

SEQ ID NO: 493665 - DNA, 14 bp, Homo sapiens
acatttgtataaaa

SEQ ID NO: 493666 - DNA, 21 bp, Homo sapiens
acatttgtataaaataatttt

SEQ ID NO: 493667 - DNA, 15 bp, Homo sapiens
acattttaatgcacc

SEQ ID NO: 493668 - DNA, 15 bp, Homo sapiens
acattttcacacaat

SEQ ID NO: 493669 - DNA, 23 bp, Homo sapiens
accaaaaatctcaatatttcaga

SEQ ID NO: 493670 - DNA, 17 bp, Homo sapiens
accaagctatcctggct

SEQ ID NO: 493671 - DNA, 17 bp, Homo sapiens
accaaggagatgaagca

SEQ ID NO: 493672 - DNA, 14 bp, Homo sapiens
accacaagcatctc

SEQ ID NO: 493673 - DNA, 16 bp, Homo sapiens
accacacatctgtgga

SEQ ID NO: 493674 - DNA, 14 bp, Homo sapiens
accacagctgctgg

SEQ ID NO: 493675 - DNA, 15 bp, Homo sapiens
accacagctgctgga

SEQ ID NO: 493676 - DNA, 19 bp, Homo sapiens
accacttgtgttttgcaag

SEQ ID NO: 493677 - DNA, 13 bp, Homo sapiens
accagacccttct

SEQ ID NO: 493678 - DNA, 14 bp, Homo sapiens
accagccttgctct

SEQ ID NO: 493679 - DNA, 19 bp, Homo sapiens
accagccttgctctcttca

SEQ ID NO: 493680 - DNA, 20 bp, Homo sapiens
accagccttgctctcttcaa

SEQ ID NO: 493681 - DNA, 23 bp, Homo sapiens
accagccttgctctcttcaataa

SEQ ID NO: 493682 - DNA, 19 bp, Homo sapiens
accaggcaacttgggaact

SEQ ID NO: 493683 - DNA, 21 bp, Homo sapiens
accagtttaacctgatgcagt

SEQ ID NO: 493684 - DNA, 23 bp, Homo sapiens
accatcagaaacaccctcacact

SEQ ID NO: 493685 - DNA, 16 bp, Homo sapiens
accattgttcagaaga

SEQ ID NO: 493686 - DNA, 17 bp, Homo sapiens
acccaagtagctgctac

SEQ ID NO: 493687 - DNA, 19 bp, Homo sapiens
acccaagtagctgctacct

SEQ ID NO: 493688 - DNA, 22 bp, Homo sapiens
acccccacagacctgctctgga

SEQ ID NO: 493689 - DNA, 12 bp, Homo sapiens
accctcatgctg

SEQ ID NO: 493690 - DNA, 21 bp, Homo sapiens
accgccacacacacaggagca

SEQ ID NO: 493691 - DNA, 12 bp, Homo sapiens
acctaccacatg

SEQ ID NO: 493692 - DNA, 21 bp, Homo sapiens
acctagggtgatattaaccag

SEQ ID NO: 493693 - DNA, 18 bp, Homo sapiens
acctcagagtatggagct

SEQ ID NO: 493694 - DNA, 16 bp, Homo sapiens
acctcagcctgtgctg

SEQ ID NO: 493695 - DNA, 17 bp, Homo sapiens
acctcagcctgtgctgc

SEQ ID NO: 493696 - DNA, 19 bp, Homo sapiens
acctcagcctgtgctgccc

SEQ ID NO: 493697 - DNA, 20 bp, Homo sapiens
acctcagccttccccttgcc

SEQ ID NO: 493698 - DNA, 22 bp, Homo sapiens
acctgcctaaaatatgatgttt

SEQ ID NO: 493699 - DNA, 13 bp, Homo sapiens
acctgcctgggtt

SEQ ID NO: 493700 - DNA, 21 bp, Homo sapiens
acctggaagggctagaacctg

SEQ ID NO: 493701 - DNA, 23 bp, Homo sapiens
acctggagagccagaacctggag

SEQ ID NO: 493702 - DNA, 13 bp, Homo sapiens
acctggagggcta

SEQ ID NO: 493703 - DNA, 22 bp, Homo sapiens
acctggagggctagaacctgga

SEQ ID NO: 493704 - DNA, 14 bp, Homo sapiens
acctggaggggcta

SEQ ID NO: 493705 - DNA, 22 bp, Homo sapiens
acctggaggggctagaacctag

SEQ ID NO: 493706 - DNA, 22 bp, Homo sapiens
acctggcaagctagaacctgga

SEQ ID NO: 493707 - DNA, 14 bp, Homo sapiens
acctggggctgctg

SEQ ID NO: 493708 - DNA, 14 bp, Homo sapiens
acctgtcaatacta

SEQ ID NO: 493709 - DNA, 23 bp, Homo sapiens
acctgtcacgattgtcatcagga

SEQ ID NO: 493710 - DNA, 20 bp, Homo sapiens
accttctttggccccttgct

SEQ ID NO: 493711 - DNA, 18 bp, Homo sapiens
accttgaacactggggga

SEQ ID NO: 493712 - DNA, 17 bp, Homo sapiens
acctttcccactttctt

SEQ ID NO: 493713 - DNA, 15 bp, Homo sapiens
acgaagaagagccac

SEQ ID NO: 493714 - DNA, 15 bp, Homo sapiens
acgcacagccaagga

SEQ ID NO: 493715 - DNA, 17 bp, Homo sapiens
acgcacagccaaggact

SEQ ID NO: 493716 - DNA, 12 bp, Homo sapiens
acgccacccagc

SEQ ID NO: 493717 - DNA, 15 bp, Homo sapiens
acgcccaccagcctt

SEQ ID NO: 493718 - DNA, 19 bp, Homo sapiens
acgcccaccagccttgctc

SEQ ID NO: 493719 - DNA, 18 bp, Homo sapiens
acgcctgtaatcccagca

SEQ ID NO: 493720 - DNA, 21 bp, Homo sapiens
acgcctgtaatcccagcactt

SEQ ID NO: 493721 - DNA, 17 bp, Homo sapiens
acggtttgaagcctgga

SEQ ID NO: 493722 - DNA, 13 bp, Homo sapiens
acgtggaggagca

SEQ ID NO: 493723 - DNA, 17 bp, Homo sapiens
acgtggaggagcagtgc

SEQ ID NO: 493724 - DNA, 20 bp, Homo sapiens
actaagaagatgttttgaaa

SEQ ID NO: 493725 - DNA, 16 bp, Homo sapiens
actaagagagaatgag

SEQ ID NO: 493726 - DNA, 15 bp, Homo sapiens
actaatcaatacttt

SEQ ID NO: 493727 - DNA, 22 bp, Homo sapiens
actacaatttaaagcaaaggag

SEQ ID NO: 493728 - DNA, 14 bp, Homo sapiens
actagaacctggag

SEQ ID NO: 493729 - DNA, 20 bp, Homo sapiens
actagagtttagctggaaaa

SEQ ID NO: 493730 - DNA, 15 bp, Homo sapiens
actagtaaagacata

SEQ ID NO: 493731 - DNA, 18 bp, Homo sapiens
actagtatttctatgaaa

SEQ ID NO: 493732 - DNA, 20 bp, Homo sapiens
actagtatttctatgaaata

SEQ ID NO: 493733 - DNA, 18 bp, Homo sapiens
actatagattctttatta

SEQ ID NO: 493734 - DNA, 17 bp, Homo sapiens
actatattgtttgctaa

SEQ ID NO: 493735 - DNA, 14 bp, Homo sapiens
actatcaaactgaa

SEQ ID NO: 493736 - DNA, 22 bp, Homo sapiens
actatcatgtcaaacgtgaaaa

SEQ ID NO: 493737 - DNA, 15 bp, Homo sapiens
actatctcatttcca

SEQ ID NO: 493738 - DNA, 12 bp, Homo sapiens
actatctgcttt

SEQ ID NO: 493739 - DNA, 15 bp, Homo sapiens
actatgggagcctca

SEQ ID NO: 493740 - DNA, 14 bp, Homo sapiens
actatttaacttga

SEQ ID NO: 493741 - DNA, 15 bp, Homo sapiens
actatttaacttgag

SEQ ID NO: 493742 - DNA, 18 bp, Homo sapiens
actatttaacttgagggt

SEQ ID NO: 493743 - DNA, 21 bp, Homo sapiens
attgtaatctttcatagccat

SEQ ID NO: 493744 - DNA, 20 bp, Homo sapiens
attgtaattcaagctttccg

SEQ ID NO: 493745 - DNA, 19 bp, Homo sapiens
attgtacacaccttatatt

SEQ ID NO: 493746 - DNA, 22 bp, Homo sapiens
attgtatagagatatgcagaag

SEQ ID NO: 493747 - DNA, 14 bp, Homo sapiens
attgtgctttctat

SEQ ID NO: 493748 - DNA, 16 bp, Homo sapiens
attgtgtgttatttaa

SEQ ID NO: 493749 - DNA, 16 bp, Homo sapiens
atttaaatattaaata

SEQ ID NO: 493750 - DNA, 16 bp, Homo sapiens
atttaagagacagtca

SEQ ID NO: 493751 - DNA, 19 bp, Homo sapiens
atttagaagctgaagatcc

SEQ ID NO: 493752 - DNA, 20 bp, Homo sapiens
atttattactgtaagaaaat

SEQ ID NO: 493753 - DNA, 22 bp, Homo sapiens
atttattgctgtgtaacactgt

SEQ ID NO: 493754 - DNA, 12 bp, Homo sapiens
atttatttccat

SEQ ID NO: 493755 - DNA, 20 bp, Homo sapiens
atttatttccatattaaaat

SEQ ID NO: 493756 - DNA, 21 bp, Homo sapiens
atttatttttctcatgaatct

SEQ ID NO: 493757 - DNA, 21 bp, Homo sapiens
atttcaatttccaagagctga

SEQ ID NO: 493758 - DNA, 14 bp, Homo sapiens
atttccacaccaag

SEQ ID NO: 493759 - DNA, 18 bp, Homo sapiens
atttccagccagggctgc

SEQ ID NO: 493760 - DNA, 13 bp, Homo sapiens
atttccatattaa

SEQ ID NO: 493761 - DNA, 19 bp, Homo sapiens
atttgaggagcagcttcag

SEQ ID NO: 493762 - DNA, 20 bp, Homo sapiens
atttgatagtattgtgcata

SEQ ID NO: 493763 - DNA, 19 bp, Homo sapiens
atttgcagagacaggacct

SEQ ID NO: 493764 - DNA, 15 bp, Homo sapiens
atttgcatatgtatg

SEQ ID NO: 493765 - DNA, 13 bp, Homo sapiens
atttggaaaataa

SEQ ID NO: 493766 - DNA, 14 bp, Homo sapiens
atttggagtggagg

SEQ ID NO: 493767 - DNA, 22 bp, Homo sapiens
atttggagtggaggcattgttt

SEQ ID NO: 493768 - DNA, 18 bp, Homo sapiens
atttgtagtgttggagaa

SEQ ID NO: 493769 - DNA, 22 bp, Homo sapiens
atttgtagtgttggagaagaac

SEQ ID NO: 493770 - DNA, 18 bp, Homo sapiens
atttgtataaaataattt

SEQ ID NO: 493771 - DNA, 19 bp, Homo sapiens
atttgtataaaataatttt

SEQ ID NO: 493772 - DNA, 21 bp, Homo sapiens
atttgtatctgaaggagattt

SEQ ID NO: 493773 - DNA, 22 bp, Homo sapiens
attttaaaagaatgattatgaa

SEQ ID NO: 493774 - DNA, 21 bp, Homo sapiens
attttaatgcacctgaatgtt

SEQ ID NO: 493775 - DNA, 17 bp, Homo sapiens
attttaggcagggattt

SEQ ID NO: 493776 - DNA, 21 bp, Homo sapiens
attttaggcagggatttgagg

SEQ ID NO: 493777 - DNA, 20 bp, Homo sapiens
attttcatgacttttccatg

SEQ ID NO: 493778 - DNA, 15 bp, Homo sapiens
attttccatgaaaat

SEQ ID NO: 493779 - DNA, 18 bp, Homo sapiens
attttctagaatactaat

SEQ ID NO: 493780 - DNA, 20 bp, Homo sapiens
attttgaacaactcgaatca

SEQ ID NO: 493781 - DNA, 18 bp, Homo sapiens
attttgccagtgggaact

SEQ ID NO: 493782 - DNA, 16 bp, Homo sapiens
atttttatatttgaaa

SEQ ID NO: 493783 - DNA, 18 bp, Homo sapiens
atttttattaatttgtaa

SEQ ID NO: 493784 - DNA, 13 bp, Homo sapiens
atttttttaagct

SEQ ID NO: 493785 - DNA, 18 bp, Homo sapiens
atttttttaagctgtaaa

SEQ ID NO: 493786 - DNA, 15 bp, Homo sapiens
caaaaattagccggg

SEQ ID NO: 493787 - DNA, 11 bp, Homo sapiens
caaaagacatc

SEQ ID NO: 493788 - DNA, 22 bp, Homo sapiens
caaaagacatcctcaaaagaaa

SEQ ID NO: 493789 - DNA, 22 bp, Homo sapiens
caaaagcccattcattccattc

SEQ ID NO: 493790 - DNA, 22 bp, Homo sapiens
caaaagtatattcaaaaattat

SEQ ID NO: 493791 - DNA, 16 bp, Homo sapiens
caaaattttttctcta

SEQ ID NO: 493792 - DNA, 14 bp, Homo sapiens
caaacctgcctggg

SEQ ID NO: 493793 - DNA, 16 bp, Homo sapiens
caaacctgcctgggtt

SEQ ID NO: 493794 - DNA, 23 bp, Homo sapiens
caaactcataacagtcttactgc

SEQ ID NO: 493795 - DNA, 21 bp, Homo sapiens
caaactgactcttaagaagac

SEQ ID NO: 493796 - DNA, 17 bp, Homo sapiens
caaacttaagaaacact

SEQ ID NO: 493797 - DNA, 16 bp, Homo sapiens
caaacttcttgttcaa

SEQ ID NO: 493798 - DNA, 16 bp, Homo sapiens
caaagagttaatatat

SEQ ID NO: 493799 - DNA, 20 bp, Homo sapiens
caaaggccatggagagctgg

SEQ ID NO: 493800 - DNA, 21 bp, Homo sapiens
caaaggccatggagagctgga

SEQ ID NO: 493801 - DNA, 12 bp, Homo sapiens
caaaggctggga

SEQ ID NO: 493802 - DNA, 13 bp, Homo sapiens
caaaggctgggac

SEQ ID NO: 493803 - DNA, 13 bp, Homo sapiens
caaagtctaaagt

SEQ ID NO: 493804 - DNA, 13 bp, Homo sapiens
caaatcaaagcag

SEQ ID NO: 493805 - DNA, 14 bp, Homo sapiens
caaatggaaaggag

SEQ ID NO: 493806 - DNA, 15 bp, Homo sapiens
caaatggaagacaca

SEQ ID NO: 493807 - DNA, 17 bp, Homo sapiens
caaatgggactgatgtc

SEQ ID NO: 493808 - DNA, 19 bp, Homo sapiens
caaatgggactgatgtcat

SEQ ID NO: 493809 - DNA, 14 bp, Homo sapiens
caacaccaggactt

SEQ ID NO: 493810 - DNA, 22 bp, Homo sapiens
caacaccaggacttaagacaaa

SEQ ID NO: 493811 - DNA, 18 bp, Homo sapiens
caacaccccacaggaggg

SEQ ID NO: 493812 - DNA, 20 bp, Homo sapiens
caacatgcctgcacctgcag

SEQ ID NO: 493813 - DNA, 15 bp, Homo sapiens
caacatggtgtctgg

SEQ ID NO: 493814 - DNA, 23 bp, Homo sapiens
caacatgtataatatttttaatt

SEQ ID NO: 493815 - DNA, 21 bp, Homo sapiens
caacattacagggaatgcctg

SEQ ID NO: 493816 - DNA, 22 bp, Homo sapiens
caaccagcatcccttgaccagg

SEQ ID NO: 493817 - DNA, 19 bp, Homo sapiens
caactatattgtttgctaa

SEQ ID NO: 493818 - DNA, 19 bp, Homo sapiens
caactatctcatttccaag

SEQ ID NO: 493819 - DNA, 17 bp, Homo sapiens
caactatgatttggaaa

SEQ ID NO: 493820 - DNA, 15 bp, Homo sapiens
caactgaagagacac

SEQ ID NO: 493821 - DNA, 20 bp, Homo sapiens
caactgaggcagacagcagc

SEQ ID NO: 493822 - DNA, 18 bp, Homo sapiens
caactgctccagcctctg

SEQ ID NO: 493823 - DNA, 21 bp, Homo sapiens
caactgctccagcctctgccg

SEQ ID NO: 493824 - DNA, 18 bp, Homo sapiens
caacttagatctccagga

SEQ ID NO: 493825 - DNA, 16 bp, Homo sapiens
caacttgtaaatgtgg

SEQ ID NO: 493826 - DNA, 20 bp, Homo sapiens
caagaagcaggctacactga

SEQ ID NO: 493827 - DNA, 16 bp, Homo sapiens
caagagcacacttggc

SEQ ID NO: 493828 - DNA, 18 bp, Homo sapiens
caagcaagaaacactggg

SEQ ID NO: 493829 - DNA, 12 bp, Homo sapiens
caagcaagctcc

SEQ ID NO: 493830 - DNA, 17 bp, Homo sapiens
caagcactgtgctcagg

SEQ ID NO: 493831 - DNA, 16 bp, Homo sapiens
caagcagtagacaagc

SEQ ID NO: 493832 - DNA, 21 bp, Homo sapiens
caagccagattttcctgaaaa

SEQ ID NO: 493833 - DNA, 14 bp, Homo sapiens
caagccctgagagt

SEQ ID NO: 493834 - DNA, 16 bp, Homo sapiens
caagctagaacctgga

SEQ ID NO: 493835 - DNA, 18 bp, Homo sapiens
caagctcaggaccaggca

SEQ ID NO: 493836 - DNA, 22 bp, Homo sapiens
caaggactaatccaatacctct

SEQ ID NO: 493837 - DNA, 13 bp, Homo sapiens
caaggagaggagg

SEQ ID NO: 493838 - DNA, 18 bp, Homo sapiens
caaggagaggaggcaact

SEQ ID NO: 493839 - DNA, 13 bp, Homo sapiens
caaggagatgaag

SEQ ID NO: 493840 - DNA, 23 bp, Homo sapiens
caaggagatgaagcaaacacatt

SEQ ID NO: 493841 - DNA, 17 bp, Homo sapiens
caaggaggtctgtgcca

SEQ ID NO: 493842 - DNA, 17 bp, Homo sapiens
caaggctgtgctccctg

SEQ ID NO: 493843 - DNA, 13 bp, Homo sapiens
caagggatggtgc

SEQ ID NO: 493844 - DNA, 14 bp, Homo sapiens
caagtagctgctac

SEQ ID NO: 493845 - DNA, 20 bp, Homo sapiens
caagtattagaataccacag

SEQ ID NO: 493846 - DNA, 21 bp, Homo sapiens
caagtgattgacaactgaaga

SEQ ID NO: 493847 - DNA, 19 bp, Homo sapiens
caagtggctaagtgtccat

SEQ ID NO: 493848 - DNA, 15 bp, Homo sapiens
caataaaatgggttt

SEQ ID NO: 493849 - DNA, 20 bp, Homo sapiens
caataaaccacaagcatctc

SEQ ID NO: 493850 - DNA, 13 bp, Homo sapiens
caataaactgaat

SEQ ID NO: 493851 - DNA, 14 bp, Homo sapiens
caataaactgaatt

SEQ ID NO: 493852 - DNA, 21 bp, Homo sapiens
caatatttcagataatcacaa

SEQ ID NO: 493853 - DNA, 11 bp, Homo sapiens
caatattttcc

SEQ ID NO: 493854 - DNA, 19 bp, Homo sapiens
caatattttccatgaaaat

SEQ ID NO: 493855 - DNA, 22 bp, Homo sapiens
caatattttccatgaaaatgca

SEQ ID NO: 493856 - DNA, 16 bp, Homo sapiens
caatgccatcctcaaa

SEQ ID NO: 493857 - DNA, 18 bp, Homo sapiens
caatgccatcctcaaaca

SEQ ID NO: 493858 - DNA, 16 bp, Homo sapiens
caatgctgtattttaa

SEQ ID NO: 493859 - DNA, 22 bp, Homo sapiens
caatggtgttcaccatcggcag

SEQ ID NO: 493860 - DNA, 18 bp, Homo sapiens
caatggtttgcaaggaag

SEQ ID NO: 493861 - DNA, 19 bp, Homo sapiens
caatggtttgcaaggaagc

SEQ ID NO: 493862 - DNA, 18 bp, Homo sapiens
caattcttacaaacatgt

SEQ ID NO: 493863 - DNA, 21 bp, Homo sapiens
caattcttccctatctttgcc

SEQ ID NO: 493864 - DNA, 20 bp, Homo sapiens
cacaaaagtatattcaaaaa

SEQ ID NO: 493865 - DNA, 21 bp, Homo sapiens
cacaaagcctgtgttactgat

SEQ ID NO: 493866 - DNA, 15 bp, Homo sapiens
cacaacaccaggact

SEQ ID NO: 493867 - DNA, 23 bp, Homo sapiens
cacaagacccaagtagctgctac

SEQ ID NO: 493868 - DNA, 13 bp, Homo sapiens
cacaagagctgga

SEQ ID NO: 493869 - DNA, 13 bp, Homo sapiens
cacaatacaataa

SEQ ID NO: 493870 - DNA, 13 bp, Homo sapiens
cacacacacatac

SEQ ID NO: 493871 - DNA, 13 bp, Homo sapiens
cacacacaggagc

SEQ ID NO: 493872 - DNA, 13 bp, Homo sapiens
cacacacaggcaa

SEQ ID NO: 493873 - DNA, 21 bp, Homo sapiens
cacacacaggcaactgaggca

SEQ ID NO: 493874 - DNA, 19 bp, Homo sapiens
cacacaggcaactgaggca

SEQ ID NO: 493875 - DNA, 16 bp, Homo sapiens
cacacatctgtggaga

SEQ ID NO: 493876 - DNA, 17 bp, Homo sapiens
cacacatgaagtccaag

SEQ ID NO: 493877 - DNA, 19 bp, Homo sapiens
cacacggtttgaagcctgg

SEQ ID NO: 493878 - DNA, 14 bp, Homo sapiens
cacactgaagaagc

SEQ ID NO: 493879 - DNA, 21 bp, Homo sapiens
cacacttggcccaagtggcag

SEQ ID NO: 493880 - DNA, 19 bp, Homo sapiens
cacagaagacttcccagct

SEQ ID NO: 493881 - DNA, 14 bp, Homo sapiens
cacagacctgctct

SEQ ID NO: 493882 - DNA, 22 bp, Homo sapiens
cacagacctgctctggacactt

SEQ ID NO: 493883 - DNA, 19 bp, Homo sapiens
cacagacgccttactggca

SEQ ID NO: 493884 - DNA, 14 bp, Homo sapiens
cacagccaaggact

SEQ ID NO: 493885 - DNA, 17 bp, Homo sapiens
cacagcctcttagatgc

SEQ ID NO: 493886 - DNA, 21 bp, Homo sapiens
cacagcctcttagatgcagtt

SEQ ID NO: 493887 - DNA, 21 bp, Homo sapiens
cacagctaacaattgtgaagt

SEQ ID NO: 493888 - DNA, 15 bp, Homo sapiens
cacagctgctggaga

SEQ ID NO: 493889 - DNA, 20 bp, Homo sapiens
cacaggaaccacaagactgc

SEQ ID NO: 493890 - DNA, 17 bp, Homo sapiens
cacaggagggtaatttt

SEQ ID NO: 493891 - DNA, 13 bp, Homo sapiens
cacaggcaactga

SEQ ID NO: 493892 - DNA, 14 bp, Homo sapiens
cacaggcaactgag

SEQ ID NO: 493893 - DNA, 19 bp, Homo sapiens
cacaggcaactgaggcaga

SEQ ID NO: 493894 - DNA, 20 bp, Homo sapiens
cacaggcaactgaggcagac

SEQ ID NO: 493895 - DNA, 23 bp, Homo sapiens
cacaggcaactgaggcagacagc

SEQ ID NO: 493896 - DNA, 21 bp, Homo sapiens
cacagggcctttggcaggtgc

SEQ ID NO: 493897 - DNA, 19 bp, Homo sapiens
cacagtgagggagatccca

SEQ ID NO: 493898 - DNA, 22 bp, Homo sapiens
cacagtggaaagacagcttctc

SEQ ID NO: 493899 - DNA, 21 bp, Homo sapiens
cacatagctagttatgtgaga

SEQ ID NO: 493900 - DNA, 17 bp, Homo sapiens
cacatgaagtccaagca

SEQ ID NO: 493901 - DNA, 18 bp, Homo sapiens
cacatggctatgttttag

SEQ ID NO: 493902 - DNA, 14 bp, Homo sapiens
caccacctcagagt

SEQ ID NO: 493903 - DNA, 17 bp, Homo sapiens
caccagccttgctctct

SEQ ID NO: 493904 - DNA, 19 bp, Homo sapiens
caccagccttgctctcttc

SEQ ID NO: 493905 - DNA, 14 bp, Homo sapiens
cacccagctcagca

SEQ ID NO: 493906 - DNA, 15 bp, Homo sapiens
cacccctcccctgcc

SEQ ID NO: 493907 - DNA, 12 bp, Homo sapiens
caccctcacact

SEQ ID NO: 493908 - DNA, 14 bp, Homo sapiens
caccctcatgctgt

SEQ ID NO: 493909 - DNA, 12 bp, Homo sapiens
cacctctgtggg

SEQ ID NO: 493910 - DNA, 16 bp, Homo sapiens
cacctgggctttctgg

SEQ ID NO: 493911 - DNA, 17 bp, Homo sapiens
cacctgggctttctgga

SEQ ID NO: 493912 - DNA, 14 bp, Homo sapiens
cacctggggctgct

SEQ ID NO: 493913 - DNA, 15 bp, Homo sapiens
caccttatatttacg

SEQ ID NO: 493914 - DNA, 14 bp, Homo sapiens
cacctttagaatat

SEQ ID NO: 493915 - DNA, 17 bp, Homo sapiens
caccttttttaaggaaa

SEQ ID NO: 493916 - DNA, 15 bp, Homo sapiens
cacgcacacacacat

SEQ ID NO: 493917 - DNA, 15 bp, Homo sapiens
cacgcacgcacacac

SEQ ID NO: 493918 - DNA, 17 bp, Homo sapiens
cacgcacgcacacacac

SEQ ID NO: 493919 - DNA, 16 bp, Homo sapiens
cacgcccaccagcctt

SEQ ID NO: 493920 - DNA, 13 bp, Homo sapiens
cacggctgctgag

SEQ ID NO: 493921 - DNA, 15 bp, Homo sapiens
cacggggtattttag

SEQ ID NO: 493922 - DNA, 20 bp, Homo sapiens
cacggtattcccaagagtgg

SEQ ID NO: 493923 - DNA, 13 bp, Homo sapiens
cactaatcaatac

SEQ ID NO: 493924 - DNA, 14 bp, Homo sapiens
cactaatcaatact

SEQ ID NO: 493925 - DNA, 15 bp, Homo sapiens
cactagaggccaggg

SEQ ID NO: 493926 - DNA, 14 bp, Homo sapiens
cactcaagaagcag

SEQ ID NO: 493927 - DNA, 17 bp, Homo sapiens
cactcaagaagcaggct

SEQ ID NO: 493928 - DNA, 19 bp, Homo sapiens
cactcaagaagcaggctac

SEQ ID NO: 493929 - DNA, 20 bp, Homo sapiens
cactcaagaagcaggctaca

SEQ ID NO: 493930 - DNA, 13 bp, Homo sapiens
cactcccaggcag

SEQ ID NO: 493931 - DNA, 14 bp, Homo sapiens
cactctagcctggc

SEQ ID NO: 493932 - DNA, 15 bp, Homo sapiens
cactctgctttgcat

SEQ ID NO: 493933 - DNA, 20 bp, Homo sapiens
cactgaaatatacacacagc

SEQ ID NO: 493934 - DNA, 20 bp, Homo sapiens
cactgacactggtattcctg

SEQ ID NO: 493935 - DNA, 14 bp, Homo sapiens
cactgactcctgtg

SEQ ID NO: 493936 - DNA, 15 bp, Homo sapiens
cactgagctgtcatg

SEQ ID NO: 493937 - DNA, 12 bp, Homo sapiens
cactgcactcca

SEQ ID NO: 493938 - DNA, 14 bp, Homo sapiens
cactgccatatact

SEQ ID NO: 493939 - DNA, 21 bp, Homo sapiens
cactgggggaggggacattga

SEQ ID NO: 493940 - DNA, 20 bp, Homo sapiens
cactggggtcctggggcctc

SEQ ID NO: 493941 - DNA, 16 bp, Homo sapiens
cactggtattcctgcc

SEQ ID NO: 493942 - DNA, 17 bp, Homo sapiens
cactggtattcctgcct

SEQ ID NO: 493943 - DNA, 20 bp, Homo sapiens
cactggtattcctgcctcca

SEQ ID NO: 493944 - DNA, 20 bp, Homo sapiens
cactgtgggaaggccagctg

SEQ ID NO: 493945 - DNA, 24 bp, Homo sapiens
cactgtgggtagacacacatgaag

SEQ ID NO: 493946 - DNA, 23 bp, Homo sapiens
cactgttctattcatctcaagga

SEQ ID NO: 493947 - DNA, 22 bp, Homo sapiens
cacttgctcatgccctgccaag

SEQ ID NO: 493948 - DNA, 16 bp, Homo sapiens
cacttgtcaataaaat

SEQ ID NO: 493949 - DNA, 19 bp, Homo sapiens
cactttcagtgaaagcatc

SEQ ID NO: 493950 - DNA, 22 bp, Homo sapiens
cagaaaggaaaagattcctgtc

SEQ ID NO: 493951 - DNA, 20 bp, Homo sapiens
cagaaataaagttggtgaca

SEQ ID NO: 493952 - DNA, 12 bp, Homo sapiens
cagaacagccgc

SEQ ID NO: 493953 - DNA, 15 bp, Homo sapiens
cagaagaaggcagca

SEQ ID NO: 493954 - DNA, 21 bp, Homo sapiens
cagaaggaagggcatccttct

SEQ ID NO: 493955 - DNA, 17 bp, Homo sapiens
cagaagggggagaccaa

SEQ ID NO: 493956 - DNA, 17 bp, Homo sapiens
cagaatgccatattttt

SEQ ID NO: 493957 - DNA, 14 bp, Homo sapiens
cagaattctgctac

SEQ ID NO: 493958 - DNA, 23 bp, Homo sapiens
cagaattctgctacctcactggg

SEQ ID NO: 493959 - DNA, 17 bp, Homo sapiens
cagacagcagctcaggc

SEQ ID NO: 493960 - DNA, 18 bp, Homo sapiens
cagacatgtggtgggaca

SEQ ID NO: 493961 - DNA, 16 bp, Homo sapiens
cagacctgctctggac

SEQ ID NO: 493962 - DNA, 21 bp, Homo sapiens
cagaccttctaggacgccacc

SEQ ID NO: 493963 - DNA, 16 bp, Homo sapiens
cagagacctcctgcct

SEQ ID NO: 493964 - DNA, 14 bp, Homo sapiens
cagagagggcaggc

SEQ ID NO: 493965 - DNA, 15 bp, Homo sapiens
cagagagggcaggca

SEQ ID NO: 493966 - DNA, 18 bp, Homo sapiens
cagagagggcaggcatga

SEQ ID NO: 493967 - DNA, 21 bp, Homo sapiens
cagagagggcaggcatgaagt

SEQ ID NO: 493968 - DNA, 13 bp, Homo sapiens
cagagctgccctc

SEQ ID NO: 493969 - DNA, 20 bp, Homo sapiens
cagagctgccctctcctggg

SEQ ID NO: 493970 - DNA, 21 bp, Homo sapiens
cagagctgccctctcctgggc

SEQ ID NO: 493971 - DNA, 9 bp, Homo sapiens
cagagctgg

SEQ ID NO: 493972 - DNA, 23 bp, Homo sapiens
cagaggagcaaattgaggttcag

SEQ ID NO: 493973 - DNA, 17 bp, Homo sapiens
cagaggagtacaggtga

SEQ ID NO: 493974 - DNA, 18 bp, Homo sapiens
cagaggttatctgtccca

SEQ ID NO: 493975 - DNA, 20 bp, Homo sapiens
cagagtatggagctcagaga

SEQ ID NO: 493976 - DNA, 14 bp, Homo sapiens
cagataatcacaat

SEQ ID NO: 493977 - DNA, 18 bp, Homo sapiens
cagatcatttgaggccag

SEQ ID NO: 493978 - DNA, 23 bp, Homo sapiens
cagatcctcttctcaaagctggg

SEQ ID NO: 493979 - DNA, 12 bp, Homo sapiens
cagatcctggaa

SEQ ID NO: 493980 - DNA, 19 bp, Homo sapiens
cagatggactccagcctgc

SEQ ID NO: 493981 - DNA, 19 bp, Homo sapiens
cagattcacactgtctggt

SEQ ID NO: 493982 - DNA, 15 bp, Homo sapiens
cagattcatttttct

SEQ ID NO: 493983 - DNA, 15 bp, Homo sapiens
cagattttcctgaaa

SEQ ID NO: 493984 - DNA, 17 bp, Homo sapiens
cagcactaaagcagtgg

SEQ ID NO: 493985 - DNA, 14 bp, Homo sapiens
cagcagccagctct

SEQ ID NO: 493986 - DNA, 18 bp, Homo sapiens
cagcagccagctctcagc

SEQ ID NO: 493987 - DNA, 21 bp, Homo sapiens
cagcagccagctctcagccaa

SEQ ID NO: 493988 - DNA, 13 bp, Homo sapiens
cagcagttcagag

SEQ ID NO: 493989 - DNA, 20 bp, Homo sapiens
cagcagttcagagctgccct

SEQ ID NO: 493990 - DNA, 21 bp, Homo sapiens
cagcagttcagagctgccctc

SEQ ID NO: 493991 - DNA, 23 bp, Homo sapiens
cagcatcccttgaccaggcctgg

SEQ ID NO: 493992 - DNA, 20 bp, Homo sapiens
cagcatttccacaccaagca

SEQ ID NO: 493993 - DNA, 21 bp, Homo sapiens
cagcatttccacaccaagcag

SEQ ID NO: 493994 - DNA, 20 bp, Homo sapiens
cagccaagggatgaaagaga

SEQ ID NO: 493995 - DNA, 22 bp, Homo sapiens
cagccagcagttcagagctgcc

SEQ ID NO: 493996 - DNA, 23 bp, Homo sapiens
cagccagcagttcagagctgccc

SEQ ID NO: 493997 - DNA, 17 bp, Homo sapiens
cagccagctctcagcca

SEQ ID NO: 493998 - DNA, 13 bp, Homo sapiens
cagccagggctgc

SEQ ID NO: 493999 - DNA, 16 bp, Homo sapiens
cagccagggctgctag

SEQ ID NO: 494000 - DNA, 14 bp, Homo sapiens
cagccgctcctgtc

SEQ ID NO: 494001 - DNA, 21 bp, Homo sapiens
cagccgctcctgtctgccagc

SEQ ID NO: 494002 - DNA, 15 bp, Homo sapiens
cagccggtacctggg

SEQ ID NO: 494003 - DNA, 17 bp, Homo sapiens
cagccggtacctgggaa

SEQ ID NO: 494004 - DNA, 21 bp, Homo sapiens
cagccggtacctgggaagggg

SEQ ID NO: 494005 - DNA, 20 bp, Homo sapiens
cagcctagccgacctcagcc

SEQ ID NO: 494006 - DNA, 16 bp, Homo sapiens
cagcctagttgatcag

SEQ ID NO: 494007 - DNA, 16 bp, Homo sapiens
cagcctggagatgaaa

SEQ ID NO: 494008 - DNA, 23 bp, Homo sapiens
cagcctggtgggcctcctctgtc

SEQ ID NO: 494009 - DNA, 16 bp, Homo sapiens
cagcctgtgctgcccg

SEQ ID NO: 494010 - DNA, 23 bp, Homo sapiens
cagccttccccttgcccagggct

SEQ ID NO: 494011 - DNA, 17 bp, Homo sapiens
cagccttgctctcttca

SEQ ID NO: 494012 - DNA, 16 bp, Homo sapiens
cagctaacacacagct

SEQ ID NO: 494013 - DNA, 18 bp, Homo sapiens
cagctaacacacagctcc

SEQ ID NO: 494014 - DNA, 20 bp, Homo sapiens
cagctaacacacagctccca

SEQ ID NO: 494015 - DNA, 24 bp, Homo sapiens
cagctacccaggaggctgaggtgg

SEQ ID NO: 494016 - DNA, 13 bp, Homo sapiens
cagctatttttat

SEQ ID NO: 494017 - DNA, 12 bp, Homo sapiens
cagctcaggcac

SEQ ID NO: 494018 - DNA, 13 bp, Homo sapiens
cagctccccagag

SEQ ID NO: 494019 - DNA, 24 bp, Homo sapiens
cagctccccagagtcctctatgaa

SEQ ID NO: 494020 - DNA, 15 bp, Homo sapiens
cagctcctcatccag

SEQ ID NO: 494021 - DNA, 17 bp, Homo sapiens
agcttctgccacataaa

SEQ ID NO: 494022 - DNA, 15 bp, Homo sapiens
agcttgctcacatct

SEQ ID NO: 494023 - DNA, 17 bp, Homo sapiens
agcttgctcacatcttg

SEQ ID NO: 494024 - DNA, 23 bp, Homo sapiens
agcttggaaactggatgaggtca

SEQ ID NO: 494025 - DNA, 14 bp, Homo sapiens
agctttatgtaata

SEQ ID NO: 494026 - DNA, 22 bp, Homo sapiens
agctttcctttttcccaataaa

SEQ ID NO: 494027 - DNA, 18 bp, Homo sapiens
agcttttcccaaaagccc

SEQ ID NO: 494028 - DNA, 12 bp, Homo sapiens
aggaaatattta

SEQ ID NO: 494029 - DNA, 13 bp, Homo sapiens
aggaaatatttat

SEQ ID NO: 494030 - DNA, 14 bp, Homo sapiens
aggaaatatttatt

SEQ ID NO: 494031 - DNA, 16 bp, Homo sapiens
aggaagccacagctgg

SEQ ID NO: 494032 - DNA, 21 bp, Homo sapiens
aggaaggctcttctccccaga

SEQ ID NO: 494033 - DNA, 15 bp, Homo sapiens
aggaatgtcagggcc

SEQ ID NO: 494034 - DNA, 19 bp, Homo sapiens
aggaatttgaagctgcagt

SEQ ID NO: 494035 - DNA, 13 bp, Homo sapiens
aggacatgaaact

SEQ ID NO: 494036 - DNA, 15 bp, Homo sapiens
aggaccaaagaacac

SEQ ID NO: 494037 - DNA, 15 bp, Homo sapiens
aggacgccacccagc

SEQ ID NO: 494038 - DNA, 18 bp, Homo sapiens
aggactagaacctggagg

SEQ ID NO: 494039 - DNA, 22 bp, Homo sapiens
aggactagaacctggagggctg

SEQ ID NO: 494040 - DNA, 17 bp, Homo sapiens
aggactcagctccccag

SEQ ID NO: 494041 - DNA, 21 bp, Homo sapiens
aggactgcacagcgtcctgtc

SEQ ID NO: 494042 - DNA, 23 bp, Homo sapiens
aggacttaagacaaatgggactg

SEQ ID NO: 494043 - DNA, 17 bp, Homo sapiens
aggactttctgaagcct

SEQ ID NO: 494044 - DNA, 18 bp, Homo sapiens
aggagattttccttccta

SEQ ID NO: 494045 - DNA, 14 bp, Homo sapiens
aggagcagtgcagg

SEQ ID NO: 494046 - DNA, 21 bp, Homo sapiens
aggagcatttggagagaaggc

SEQ ID NO: 494047 - DNA, 15 bp, Homo sapiens
aggaggaagcagaat

SEQ ID NO: 494048 - DNA, 18 bp, Homo sapiens
aggagtacaggtgaagca

SEQ ID NO: 494049 - DNA, 18 bp, Homo sapiens
aggagtggaggaggcctg

SEQ ID NO: 494050 - DNA, 17 bp, Homo sapiens
aggagttcaagaccagt

SEQ ID NO: 494051 - DNA, 21 bp, Homo sapiens
aggagtttaagaccagcctgg

SEQ ID NO: 494052 - DNA, 18 bp, Homo sapiens
aggataacacaagtaaaa

SEQ ID NO: 494053 - DNA, 18 bp, Homo sapiens
aggatcacagtgctgaga

SEQ ID NO: 494054 - DNA, 19 bp, Homo sapiens
aggatcacttgagcccagg

SEQ ID NO: 494055 - DNA, 16 bp, Homo sapiens
aggatccctctctgga

SEQ ID NO: 494056 - DNA, 17 bp, Homo sapiens
aggatccctctctggat

SEQ ID NO: 494057 - DNA, 17 bp, Homo sapiens
aggatggcctggccagg

SEQ ID NO: 494058 - DNA, 22 bp, Homo sapiens
aggatggcctggccagggcctg

SEQ ID NO: 494059 - DNA, 14 bp, Homo sapiens
aggcaaatgcccaa

SEQ ID NO: 494060 - DNA, 15 bp, Homo sapiens
aggcaaatgcccaag

SEQ ID NO: 494061 - DNA, 14 bp, Homo sapiens
aggcaatcacatag

SEQ ID NO: 494062 - DNA, 16 bp, Homo sapiens
aggcacacttcttctt

SEQ ID NO: 494063 - DNA, 19 bp, Homo sapiens
aggcaccatagaagaacag

SEQ ID NO: 494064 - DNA, 14 bp, Homo sapiens
aggcactgcctgat

SEQ ID NO: 494065 - DNA, 14 bp, Homo sapiens
aggcagacagcagc

SEQ ID NO: 494066 - DNA, 19 bp, Homo sapiens
aggcagacagcagctcagg

SEQ ID NO: 494067 - DNA, 23 bp, Homo sapiens
aggcaggacatgctgaagccaaa

SEQ ID NO: 494068 - DNA, 13 bp, Homo sapiens
aggcaggcacctg

SEQ ID NO: 494069 - DNA, 17 bp, Homo sapiens
aggcagggtcaggagag

SEQ ID NO: 494070 - DNA, 14 bp, Homo sapiens
aggcatcacagcta

SEQ ID NO: 494071 - DNA, 20 bp, Homo sapiens
aggcatccttcctcacacca

SEQ ID NO: 494072 - DNA, 21 bp, Homo sapiens
aggccatcatcagtggagcca

SEQ ID NO: 494073 - DNA, 17 bp, Homo sapiens
aggccgaggtgggcaga

SEQ ID NO: 494074 - DNA, 14 bp, Homo sapiens
aggcctgaagtctt

SEQ ID NO: 494075 - DNA, 18 bp, Homo sapiens
aggcctgctcagggactg

SEQ ID NO: 494076 - DNA, 14 bp, Homo sapiens
aggcgggaaggagg

SEQ ID NO: 494077 - DNA, 16 bp, Homo sapiens
aggcgtggagctgcct

SEQ ID NO: 494078 - DNA, 18 bp, Homo sapiens
aggcgtggagctgcctga

SEQ ID NO: 494079 - DNA, 15 bp, Homo sapiens
aggctaaggcgtgga

SEQ ID NO: 494080 - DNA, 20 bp, Homo sapiens
aggctaaggcgtggagctgc

SEQ ID NO: 494081 - DNA, 14 bp, Homo sapiens
aggctctgagacac

SEQ ID NO: 494082 - DNA, 17 bp, Homo sapiens
aggctctgagacacacc

SEQ ID NO: 494083 - DNA, 16 bp, Homo sapiens
aggctgctctgcctgt

SEQ ID NO: 494084 - DNA, 18 bp, Homo sapiens
aggctggggaagtcctct

SEQ ID NO: 494085 - DNA, 17 bp, Homo sapiens
aggctgtctggccaggc

SEQ ID NO: 494086 - DNA, 20 bp, Homo sapiens
aggctgtgctccctggttct

SEQ ID NO: 494087 - DNA, 20 bp, Homo sapiens
aggcttagctttgctctgcc

SEQ ID NO: 494088 - DNA, 16 bp, Homo sapiens
agggaaaacattccat

SEQ ID NO: 494089 - DNA, 12 bp, Homo sapiens
agggaaagaaaa

SEQ ID NO: 494090 - DNA, 18 bp, Homo sapiens
agggaatgaacctggagg

SEQ ID NO: 494091 - DNA, 17 bp, Homo sapiens
agggagaggagtgactg

SEQ ID NO: 494092 - DNA, 14 bp, Homo sapiens
agggagcatggctg

SEQ ID NO: 494093 - DNA, 16 bp, Homo sapiens
agggatacccagtgat

SEQ ID NO: 494094 - DNA, 21 bp, Homo sapiens
agggatgagcatggagctggc

SEQ ID NO: 494095 - DNA, 18 bp, Homo sapiens
agggatgatggcagagcc

SEQ ID NO: 494096 - DNA, 11 bp, Homo sapiens
agggcaggcat

SEQ ID NO: 494097 - DNA, 18 bp, Homo sapiens
agggcatccttctgcctt

SEQ ID NO: 494098 - DNA, 19 bp, Homo sapiens
agggcgagactctgtctca

SEQ ID NO: 494099 - DNA, 22 bp, Homo sapiens
agggctagaacctagaagggct

SEQ ID NO: 494100 - DNA, 20 bp, Homo sapiens
agggctagaacctggagagc

SEQ ID NO: 494101 - DNA, 22 bp, Homo sapiens
agggctagaacctggagggctg

SEQ ID NO: 494102 - DNA, 23 bp, Homo sapiens
agggctagaacctggaggggcta

SEQ ID NO: 494103 - DNA, 18 bp, Homo sapiens
agggctagaatctggaga

SEQ ID NO: 494104 - DNA, 12 bp, Homo sapiens
agggctcagcct

SEQ ID NO: 494105 - DNA, 13 bp, Homo sapiens
agggctcagcctg

SEQ ID NO: 494106 - DNA, 19 bp, Homo sapiens
aggggacgctttgaaggaa

SEQ ID NO: 494107 - DNA, 14 bp, Homo sapiens
aggggcagaacagc

SEQ ID NO: 494108 - DNA, 16 bp, Homo sapiens
agggtaattttctaac

SEQ ID NO: 494109 - DNA, 15 bp, Homo sapiens
agggtcaggagaggg

SEQ ID NO: 494110 - DNA, 18 bp, Homo sapiens
agggtcaggagaggggca

SEQ ID NO: 494111 - DNA, 14 bp, Homo sapiens
agggtctctgctgc

SEQ ID NO: 494112 - DNA, 22 bp, Homo sapiens
agggtgctacgtacatgtgagg

SEQ ID NO: 494113 - DNA, 13 bp, Homo sapiens
agggttagggagg

SEQ ID NO: 494114 - DNA, 16 bp, Homo sapiens
agggttagggaggggt

SEQ ID NO: 494115 - DNA, 16 bp, Homo sapiens
agggttcagagactca

SEQ ID NO: 494116 - DNA, 20 bp, Homo sapiens
aggtatgaccttctaggaag

SEQ ID NO: 494117 - DNA, 15 bp, Homo sapiens
aggtggcaaggctgt

SEQ ID NO: 494118 - DNA, 15 bp, Homo sapiens
aggtgggcttcccag

SEQ ID NO: 494119 - DNA, 13 bp, Homo sapiens
aggtggggacagg

SEQ ID NO: 494120 - DNA, 14 bp, Homo sapiens
aggtggggacaggg

SEQ ID NO: 494121 - DNA, 16 bp, Homo sapiens
aggttatctgtcccag

SEQ ID NO: 494122 - DNA, 14 bp, Homo sapiens
aggttctctcctcc

SEQ ID NO: 494123 - DNA, 17 bp, Homo sapiens
aggttctctcctcccca

SEQ ID NO: 494124 - DNA, 23 bp, Homo sapiens
aggtttctggtctctaggctggg

SEQ ID NO: 494125 - DNA, 12 bp, Homo sapiens
agtaaaaataaa

SEQ ID NO: 494126 - DNA, 18 bp, Homo sapiens
agtaaataaattgtttga

SEQ ID NO: 494127 - DNA, 22 bp, Homo sapiens
agtaaatggcttatccagctgg

SEQ ID NO: 494128 - DNA, 14 bp, Homo sapiens
agtaactgtgactg

SEQ ID NO: 494129 - DNA, 17 bp, Homo sapiens
agtaagcacctttagaa

SEQ ID NO: 494130 - DNA, 17 bp, Homo sapiens
agtaatgataactggaa

SEQ ID NO: 494131 - DNA, 20 bp, Homo sapiens
agtagaaagacagagctggg

SEQ ID NO: 494132 - DNA, 14 bp, Homo sapiens
agtagttaattctg

SEQ ID NO: 494133 - DNA, 18 bp, Homo sapiens
agtatattcaaaaattat

SEQ ID NO: 494134 - DNA, 23 bp, Homo sapiens
agtatctcggacctttcagctgt

SEQ ID NO: 494135 - DNA, 18 bp, Homo sapiens
agtatgcactaatcaata

SEQ ID NO: 494136 - DNA, 14 bp, Homo sapiens
agtatggagctcag

SEQ ID NO: 494137 - DNA, 21 bp, Homo sapiens
agtatgttagtgcaaattgtc

SEQ ID NO: 494138 - DNA, 21 bp, Homo sapiens
agtattagaataccacaggaa

SEQ ID NO: 494139 - DNA, 16 bp, Homo sapiens
agtattgtccaggtct

SEQ ID NO: 494140 - DNA, 13 bp, Homo sapiens
agtatttctatga

SEQ ID NO: 494141 - DNA, 19 bp, Homo sapiens
agtcaaattgtgtgaaagg

SEQ ID NO: 494142 - DNA, 23 bp, Homo sapiens
agtcaaattgtgtgaaaggtact

SEQ ID NO: 494143 - DNA, 16 bp, Homo sapiens
agtcacacgggggcag

SEQ ID NO: 494144 - DNA, 19 bp, Homo sapiens
agtcacacgggggcagctg

SEQ ID NO: 494145 - DNA, 14 bp, Homo sapiens
agtcacctcatgga

SEQ ID NO: 494146 - DNA, 21 bp, Homo sapiens
agtcacgtggaggagcagtgc

SEQ ID NO: 494147 - DNA, 14 bp, Homo sapiens
agtcaggaaagaga

SEQ ID NO: 494148 - DNA, 16 bp, Homo sapiens
agtcaggaaagagaac

SEQ ID NO: 494149 - DNA, 17 bp, Homo sapiens
agtcatgcaaaggctgg

SEQ ID NO: 494150 - DNA, 13 bp, Homo sapiens
agtcatggccaaa

SEQ ID NO: 494151 - DNA, 13 bp, Homo sapiens
agtcatgtgcctc

SEQ ID NO: 494152 - DNA, 20 bp, Homo sapiens
agtcatgtgcctctgtcctt

SEQ ID NO: 494153 - DNA, 21 bp, Homo sapiens
agtccaagcatttagatgtat

SEQ ID NO: 494154 - DNA, 19 bp, Homo sapiens
agtccacgcccaccagcct

SEQ ID NO: 494155 - DNA, 21 bp, Homo sapiens
agtccacgcccaccagccttg

SEQ ID NO: 494156 - DNA, 23 bp, Homo sapiens
agtccacgcccaccagccttgct

SEQ ID NO: 494157 - DNA, 21 bp, Homo sapiens
agtccatatttcaatttccaa

SEQ ID NO: 494158 - DNA, 15 bp, Homo sapiens
agtccttgcaagaat

SEQ ID NO: 494159 - DNA, 14 bp, Homo sapiens
agtctaaagtttac

SEQ ID NO: 494160 - DNA, 18 bp, Homo sapiens
agtctctatcattaaagt

SEQ ID NO: 494161 - DNA, 20 bp, Homo sapiens
agtctctatcattaaagttc

SEQ ID NO: 494162 - DNA, 15 bp, Homo sapiens
agtcttatcaagcag

SEQ ID NO: 494163 - DNA, 14 bp, Homo sapiens
agtcttctcctcca

SEQ ID NO: 494164 - DNA, 16 bp, Homo sapiens
agtcttgcagcaggat

SEQ ID NO: 494165 - DNA, 19 bp, Homo sapiens
agtgactgttcaagagcac

SEQ ID NO: 494166 - DNA, 18 bp, Homo sapiens
agtgactttggctgcatg

SEQ ID NO: 494167 - DNA, 14 bp, Homo sapiens
agtgagatattttt

SEQ ID NO: 494168 - DNA, 12 bp, Homo sapiens
agtgagatgcat

SEQ ID NO: 494169 - DNA, 21 bp, Homo sapiens
agtgagcagtcaggaaagaga

SEQ ID NO: 494170 - DNA, 21 bp, Homo sapiens
agtgcaaagatttgctttaat

SEQ ID NO: 494171 - DNA, 14 bp, Homo sapiens
agtgcaaattgtca

SEQ ID NO: 494172 - DNA, 23 bp, Homo sapiens
agtgcatttttatctgtgagttc

SEQ ID NO: 494173 - DNA, 14 bp, Homo sapiens
agtgcgtgctcagt

SEQ ID NO: 494174 - DNA, 17 bp, Homo sapiens
agtgctcatttcaggat

SEQ ID NO: 494175 - DNA, 22 bp, Homo sapiens
agtggaaagacagcttctcatc

SEQ ID NO: 494176 - DNA, 20 bp, Homo sapiens
agtggacaccaggagtccct

SEQ ID NO: 494177 - DNA, 13 bp, Homo sapiens
agtggaggcattg

SEQ ID NO: 494178 - DNA, 16 bp, Homo sapiens
agtggctcacacctgt

SEQ ID NO: 494179 - DNA, 22 bp, Homo sapiens
agtggctgctgcccaggcccag

SEQ ID NO: 494180 - DNA, 21 bp, Homo sapiens
agtggcttcattagagcaggc

SEQ ID NO: 494181 - DNA, 15 bp, Homo sapiens
atctgggtgactgag

SEQ ID NO: 494182 - DNA, 13 bp, Homo sapiens
atctgtgagttct

SEQ ID NO: 494183 - DNA, 13 bp, Homo sapiens
atcttacagctgg

SEQ ID NO: 494184 - DNA, 23 bp, Homo sapiens
atcttggcacatttaagagacag

SEQ ID NO: 494185 - DNA, 20 bp, Homo sapiens
atgaaatattatgttaaaac

SEQ ID NO: 494186 - DNA, 20 bp, Homo sapiens
atgaagtccaagcatttaga

SEQ ID NO: 494187 - DNA, 23 bp, Homo sapiens
atgaagtttccttggctggtgca

SEQ ID NO: 494188 - DNA, 14 bp, Homo sapiens
atgaatgaatgaat

SEQ ID NO: 494189 - DNA, 19 bp, Homo sapiens
atgaattacatttgtataa

SEQ ID NO: 494190 - DNA, 22 bp, Homo sapiens
atgaattacatttgtataaaat

SEQ ID NO: 494191 - DNA, 23 bp, Homo sapiens
atgaattagttttatatgcttct

SEQ ID NO: 494192 - DNA, 15 bp, Homo sapiens
atgacccaggctggg

SEQ ID NO: 494193 - DNA, 16 bp, Homo sapiens
atgacccaggctgggc

SEQ ID NO: 494194 - DNA, 17 bp, Homo sapiens
atgaccttctaggaagc

SEQ ID NO: 494195 - DNA, 18 bp, Homo sapiens
atgaccttctaggaagct

SEQ ID NO: 494196 - DNA, 13 bp, Homo sapiens
atgactgtagaat

SEQ ID NO: 494197 - DNA, 16 bp, Homo sapiens
atgagactgaactgtg

SEQ ID NO: 494198 - DNA, 19 bp, Homo sapiens
atgagagacacactgaaga

SEQ ID NO: 494199 - DNA, 15 bp, Homo sapiens
atgagcatcccagga

SEQ ID NO: 494200 - DNA, 15 bp, Homo sapiens
atgagcatggagctg

SEQ ID NO: 494201 - DNA, 22 bp, Homo sapiens
atgagctttatgtaataatgtg

SEQ ID NO: 494202 - DNA, 15 bp, Homo sapiens
atgatcctaatgaat

SEQ ID NO: 494203 - DNA, 15 bp, Homo sapiens
atgatcttttcaagt

SEQ ID NO: 494204 - DNA, 16 bp, Homo sapiens
atgatggcagagccag

SEQ ID NO: 494205 - DNA, 18 bp, Homo sapiens
atgatggcagagccaggc

SEQ ID NO: 494206 - DNA, 14 bp, Homo sapiens
atgatgtgcctggg

SEQ ID NO: 494207 - DNA, 19 bp, Homo sapiens
atgatgtgggtcaaggaat

SEQ ID NO: 494208 - DNA, 18 bp, Homo sapiens
atgatgttgaatatttgt

SEQ ID NO: 494209 - DNA, 18 bp, Homo sapiens
atgattaagtaatgataa

SEQ ID NO: 494210 - DNA, 22 bp, Homo sapiens
atgattatgaattacatttgta

SEQ ID NO: 494211 - DNA, 16 bp, Homo sapiens
atgcaacaacatgtat

SEQ ID NO: 494212 - DNA, 21 bp, Homo sapiens
atgcaacaacatgtataatat

SEQ ID NO: 494213 - DNA, 22 bp, Homo sapiens
atgcagacatgagtgcgtgctc

SEQ ID NO: 494214 - DNA, 13 bp, Homo sapiens
atgcagcgtgaag

SEQ ID NO: 494215 - DNA, 15 bp, Homo sapiens
atgcagttctgaaga

SEQ ID NO: 494216 - DNA, 17 bp, Homo sapiens
atgcagttctgaagaag

SEQ ID NO: 494217 - DNA, 18 bp, Homo sapiens
atgcagttctgaagaaga

SEQ ID NO: 494218 - DNA, 21 bp, Homo sapiens
atgcattcttggttggctggc

SEQ ID NO: 494219 - DNA, 19 bp, Homo sapiens
atgccatggacagaagaag

SEQ ID NO: 494220 - DNA, 12 bp, Homo sapiens
atgcccaaggga

SEQ ID NO: 494221 - DNA, 20 bp, Homo sapiens
atgcctgagtgcctggccaa

SEQ ID NO: 494222 - DNA, 21 bp, Homo sapiens
atgcctgattgccaagctcag

SEQ ID NO: 494223 - DNA, 14 bp, Homo sapiens
atgccttttatttc

SEQ ID NO: 494224 - DNA, 14 bp, Homo sapiens
atgccttttcccaa

SEQ ID NO: 494225 - DNA, 21 bp, Homo sapiens
atgctaaatgtaagaatcatt

SEQ ID NO: 494226 - DNA, 16 bp, Homo sapiens
atgctgatgtcctcac

SEQ ID NO: 494227 - DNA, 23 bp, Homo sapiens
atgctgcctgggagccagggtga

SEQ ID NO: 494228 - DNA, 22 bp, Homo sapiens
atgctgtattttaaaagaatga

SEQ ID NO: 494229 - DNA, 23 bp, Homo sapiens
atgctgtctacactaagagagaa

SEQ ID NO: 494230 - DNA, 14 bp, Homo sapiens
atgctgtgtgactc

SEQ ID NO: 494231 - DNA, 22 bp, Homo sapiens
atggaaaggagaggaaagaact

SEQ ID NO: 494232 - DNA, 23 bp, Homo sapiens
atggaattggagctcgtgggaca

SEQ ID NO: 494233 - DNA, 19 bp, Homo sapiens
atggacagaagaaggcagc

SEQ ID NO: 494234 - DNA, 20 bp, Homo sapiens
atggacggtgctccaggcag

SEQ ID NO: 494235 - DNA, 13 bp, Homo sapiens
atggagagctgga

SEQ ID NO: 494236 - DNA, 22 bp, Homo sapiens
atggagctcagagagggcaggc

SEQ ID NO: 494237 - DNA, 16 bp, Homo sapiens
atggcactagtatttc

SEQ ID NO: 494238 - DNA, 12 bp, Homo sapiens
atggcagagcca

SEQ ID NO: 494239 - DNA, 15 bp, Homo sapiens
atggcatcacctcca

SEQ ID NO: 494240 - DNA, 22 bp, Homo sapiens
atgggacatttgctcatggaat

SEQ ID NO: 494241 - DNA, 17 bp, Homo sapiens
atgggactgatgtcatc

SEQ ID NO: 494242 - DNA, 20 bp, Homo sapiens
atgggcacaaagggcccaga

SEQ ID NO: 494243 - DNA, 22 bp, Homo sapiens
atgggttagggaaaacattcca

SEQ ID NO: 494244 - DNA, 21 bp, Homo sapiens
atggtttgaatataaacacta

SEQ ID NO: 494245 - DNA, 22 bp, Homo sapiens
atggtttgaatataaacactat

SEQ ID NO: 494246 - DNA, 14 bp, Homo sapiens
atgtaataatgtga

SEQ ID NO: 494247 - DNA, 23 bp, Homo sapiens
atgtaatctgatggcttctccag

SEQ ID NO: 494248 - DNA, 14 bp, Homo sapiens
atgtattgataaga

SEQ ID NO: 494249 - DNA, 20 bp, Homo sapiens
atgtcagggccaggtgcaga

SEQ ID NO: 494250 - DNA, 15 bp, Homo sapiens
atgtcatcttgagct

SEQ ID NO: 494251 - DNA, 21 bp, Homo sapiens
atgtccctacacccctcccct

SEQ ID NO: 494252 - DNA, 19 bp, Homo sapiens
atgtcttgggtaggcggga

SEQ ID NO: 494253 - DNA, 16 bp, Homo sapiens
atgtgaatgggaaaag

SEQ ID NO: 494254 - DNA, 23 bp, Homo sapiens
atgtgattcctttgaagaggaaa

SEQ ID NO: 494255 - DNA, 20 bp, Homo sapiens
atgtgatttatttatttcta

SEQ ID NO: 494256 - DNA, 16 bp, Homo sapiens
atgtgcctctgtcctt

SEQ ID NO: 494257 - DNA, 14 bp, Homo sapiens
atgtgcctgggtgg

SEQ ID NO: 494258 - DNA, 19 bp, Homo sapiens
atgtgctagtaattggaaa

SEQ ID NO: 494259 - DNA, 16 bp, Homo sapiens
atgtgggtcaaggaat

SEQ ID NO: 494260 - DNA, 15 bp, Homo sapiens
atgtggtgggacagg

SEQ ID NO: 494261 - DNA, 21 bp, Homo sapiens
atgtggtgggacagggaccca

SEQ ID NO: 494262 - DNA, 15 bp, Homo sapiens
atgttagcaaagagt

SEQ ID NO: 494263 - DNA, 13 bp, Homo sapiens
atgttggctggga

SEQ ID NO: 494264 - DNA, 24 bp, Homo sapiens
atgtttaaaagcatactctatgtg

SEQ ID NO: 494265 - DNA, 23 bp, Homo sapiens
atgtttgggagactgctgagtca

SEQ ID NO: 494266 - DNA, 16 bp, Homo sapiens
atgttttccagctcct

SEQ ID NO: 494267 - DNA, 14 bp, Homo sapiens
attaaaaattaatt

SEQ ID NO: 494268 - DNA, 13 bp, Homo sapiens
attaaaatcacaa

SEQ ID NO: 494269 - DNA, 16 bp, Homo sapiens
attaaaatcacaaact

SEQ ID NO: 494270 - DNA, 18 bp, Homo sapiens
attaaaatcacaaactca

SEQ ID NO: 494271 - DNA, 22 bp, Homo sapiens
attaaatatgttagcaaagagt

SEQ ID NO: 494272 - DNA, 13 bp, Homo sapiens
attaagtaatgat

SEQ ID NO: 494273 - DNA, 20 bp, Homo sapiens
attaatatggggatgcagca

SEQ ID NO: 494274 - DNA, 13 bp, Homo sapiens
attacatttgtat

SEQ ID NO: 494275 - DNA, 17 bp, Homo sapiens
attacatttgtataaaa

SEQ ID NO: 494276 - DNA, 12 bp, Homo sapiens
attaccttctcc

SEQ ID NO: 494277 - DNA, 17 bp, Homo sapiens
attagaaacataaataa

SEQ ID NO: 494278 - DNA, 21 bp, Homo sapiens
attagatgactgaatttctat

SEQ ID NO: 494279 - DNA, 18 bp, Homo sapiens
attagtgaagtatgcact

SEQ ID NO: 494280 - DNA, 17 bp, Homo sapiens
attatctcacttgtgcc

SEQ ID NO: 494281 - DNA, 14 bp, Homo sapiens
attatgaattacat

SEQ ID NO: 494282 - DNA, 17 bp, Homo sapiens
attatgaattacatttg

SEQ ID NO: 494283 - DNA, 20 bp, Homo sapiens
attatgaattacatttgtat

SEQ ID NO: 494284 - DNA, 22 bp, Homo sapiens
attatttgttatttgtacagtt

SEQ ID NO: 494285 - DNA, 13 bp, Homo sapiens
attcaataaattg

SEQ ID NO: 494286 - DNA, 11 bp, Homo sapiens
attcacactgt

SEQ ID NO: 494287 - DNA, 16 bp, Homo sapiens
attcacccccaaacag

SEQ ID NO: 494288 - DNA, 17 bp, Homo sapiens
attcagcggaatattga

SEQ ID NO: 494289 - DNA, 13 bp, Homo sapiens
attcatgcctggc

SEQ ID NO: 494290 - DNA, 12 bp, Homo sapiens
attcattccatt

SEQ ID NO: 494291 - DNA, 18 bp, Homo sapiens
attcattccattctggaa

SEQ ID NO: 494292 - DNA, 11 bp, Homo sapiens
attccatcctt

SEQ ID NO: 494293 - DNA, 21 bp, Homo sapiens
attccattctggaagtgactt

SEQ ID NO: 494294 - DNA, 23 bp, Homo sapiens
attcccaagagtggtggcagctc

SEQ ID NO: 494295 - DNA, 16 bp, Homo sapiens
attcctgttctttctt

SEQ ID NO: 494296 - DNA, 20 bp, Homo sapiens
attccttagcttagacctca

SEQ ID NO: 494297 - DNA, 21 bp, Homo sapiens
attccttagcttagacctcag

SEQ ID NO: 494298 - DNA, 22 bp, Homo sapiens
attccttagcttagacctcagc

SEQ ID NO: 494299 - DNA, 16 bp, Homo sapiens
attctcactctgcttt

SEQ ID NO: 494300 - DNA, 17 bp, Homo sapiens
attctcagggtctctgc

SEQ ID NO: 494301 - DNA, 20 bp, Homo sapiens
attcttccctatctttgcca

SEQ ID NO: 494302 - DNA, 15 bp, Homo sapiens
attctttatcacatg

SEQ ID NO: 494303 - DNA, 18 bp, Homo sapiens
attgacatcagcatcacc

SEQ ID NO: 494304 - DNA, 18 bp, Homo sapiens
attgactatcaaactgaa

SEQ ID NO: 494305 - DNA, 18 bp, Homo sapiens
attgactttttatggcac

SEQ ID NO: 494306 - DNA, 13 bp, Homo sapiens
attgataataaaa

SEQ ID NO: 494307 - DNA, 18 bp, Homo sapiens
attgataataaaattcat

SEQ ID NO: 494308 - DNA, 18 bp, Homo sapiens
attgatataaataaaaca

SEQ ID NO: 494309 - DNA, 17 bp, Homo sapiens
ccaggtttctggtctct

SEQ ID NO: 494310 - DNA, 17 bp, Homo sapiens
ccagtaaacagaggagt

SEQ ID NO: 494311 - DNA, 14 bp, Homo sapiens
ccagtgagatgcat

SEQ ID NO: 494312 - DNA, 17 bp, Homo sapiens
ccagtgagatgcattct

SEQ ID NO: 494313 - DNA, 14 bp, Homo sapiens
ccagtggctgctgc

SEQ ID NO: 494314 - DNA, 22 bp, Homo sapiens
ccagtgtctgaaccaccctgga

SEQ ID NO: 494315 - DNA, 22 bp, Homo sapiens
ccagttcctttcaatggtttgc

SEQ ID NO: 494316 - DNA, 23 bp, Homo sapiens
ccagttcctttcaatggtttgca

SEQ ID NO: 494317 - DNA, 18 bp, Homo sapiens
ccagttgatcaatgaata

SEQ ID NO: 494318 - DNA, 16 bp, Homo sapiens
ccatcgctgtcatctc

SEQ ID NO: 494319 - DNA, 18 bp, Homo sapiens
ccatctctggatgcctga

SEQ ID NO: 494320 - DNA, 14 bp, Homo sapiens
ccatctgtccctgc

SEQ ID NO: 494321 - DNA, 16 bp, Homo sapiens
ccatgacccaggctgg

SEQ ID NO: 494322 - DNA, 22 bp, Homo sapiens
ccatgccaatagttgctgtccc

SEQ ID NO: 494323 - DNA, 21 bp, Homo sapiens
ccatgggcacaaagggcccag

SEQ ID NO: 494324 - DNA, 14 bp, Homo sapiens
ccatgtagaagctg

SEQ ID NO: 494325 - DNA, 19 bp, Homo sapiens
ccatgtagaagctgcatct

SEQ ID NO: 494326 - DNA, 15 bp, Homo sapiens
ccatgtatctacctc

SEQ ID NO: 494327 - DNA, 13 bp, Homo sapiens
ccattcattccat

SEQ ID NO: 494328 - DNA, 15 bp, Homo sapiens
ccattctggaagtga

SEQ ID NO: 494329 - DNA, 19 bp, Homo sapiens
ccattctggaagtgacttt

SEQ ID NO: 494330 - DNA, 20 bp, Homo sapiens
cccaactgctccagcctctg

SEQ ID NO: 494331 - DNA, 16 bp, Homo sapiens
cccaagtggcagagct

SEQ ID NO: 494332 - DNA, 14 bp, Homo sapiens
cccaccagccttgc

SEQ ID NO: 494333 - DNA, 23 bp, Homo sapiens
cccaccagccttgctctcttcaa

SEQ ID NO: 494334 - DNA, 14 bp, Homo sapiens
cccactgcctttga

SEQ ID NO: 494335 - DNA, 16 bp, Homo sapiens
cccactttcttctacc

SEQ ID NO: 494336 - DNA, 21 bp, Homo sapiens
cccagcactttgggaggctga

SEQ ID NO: 494337 - DNA, 22 bp, Homo sapiens
cccagccagatggactccagcc

SEQ ID NO: 494338 - DNA, 22 bp, Homo sapiens
cccaggaatttgaagctgcagt

SEQ ID NO: 494339 - DNA, 13 bp, Homo sapiens
cccaggaggctga

SEQ ID NO: 494340 - DNA, 22 bp, Homo sapiens
cccaggagtggaggaggcctgg

SEQ ID NO: 494341 - DNA, 22 bp, Homo sapiens
cccaggatttgactcgggcctt

SEQ ID NO: 494342 - DNA, 15 bp, Homo sapiens
cccagggaagttttg

SEQ ID NO: 494343 - DNA, 17 bp, Homo sapiens
cccagggctcagcctgg

SEQ ID NO: 494344 - DNA, 18 bp, Homo sapiens
cccagtggctgctgccca

SEQ ID NO: 494345 - DNA, 21 bp, Homo sapiens
cccagtggctgctgcccaggc

SEQ ID NO: 494346 - DNA, 17 bp, Homo sapiens
cccatggccctcccagt

SEQ ID NO: 494347 - DNA, 18 bp, Homo sapiens
cccattcattccattctg

SEQ ID NO: 494348 - DNA, 15 bp, Homo sapiens
ccccaaacttcttgt

SEQ ID NO: 494349 - DNA, 23 bp, Homo sapiens
ccccaactgctccagcctctgcc

SEQ ID NO: 494350 - DNA, 11 bp, Homo sapiens
ccccagcacta

SEQ ID NO: 494351 - DNA, 23 bp, Homo sapiens
ccccagccagatggactccagcc

SEQ ID NO: 494352 - DNA, 13 bp, Homo sapiens
cccctcctctgct

SEQ ID NO: 494353 - DNA, 14 bp, Homo sapiens
cccctcctctgctt

SEQ ID NO: 494354 - DNA, 22 bp, Homo sapiens
ccccttctaggtggcaaggctg

SEQ ID NO: 494355 - DNA, 20 bp, Homo sapiens
ccccttgcccagggctcagc

SEQ ID NO: 494356 - DNA, 13 bp, Homo sapiens
cccgatggggcat

SEQ ID NO: 494357 - DNA, 15 bp, Homo sapiens
cccggtttcagaagc

SEQ ID NO: 494358 - DNA, 16 bp, Homo sapiens
cccggtttcagaagct

SEQ ID NO: 494359 - DNA, 13 bp, Homo sapiens
cccgtcttcagcc

SEQ ID NO: 494360 - DNA, 14 bp, Homo sapiens
cccgtcttcagcct

SEQ ID NO: 494361 - DNA, 15 bp, Homo sapiens
cccgtcttcagccta

SEQ ID NO: 494362 - DNA, 17 bp, Homo sapiens
cccgtcttcagcctagc

SEQ ID NO: 494363 - DNA, 14 bp, Homo sapiens
ccctatctttgcca

SEQ ID NO: 494364 - DNA, 17 bp, Homo sapiens
ccctatggaagcatatt

SEQ ID NO: 494365 - DNA, 12 bp, Homo sapiens
ccctcacactgg

SEQ ID NO: 494366 - DNA, 14 bp, Homo sapiens
ccctcacactggga

SEQ ID NO: 494367 - DNA, 14 bp, Homo sapiens
ccctccacctccct

SEQ ID NO: 494368 - DNA, 15 bp, Homo sapiens
ccctccacctccctg

SEQ ID NO: 494369 - DNA, 17 bp, Homo sapiens
ccctccacctccctgca

SEQ ID NO: 494370 - DNA, 13 bp, Homo sapiens
ccctccctccacc

SEQ ID NO: 494371 - DNA, 22 bp, Homo sapiens
ccctcctctgcttgccatccct

SEQ ID NO: 494372 - DNA, 14 bp, Homo sapiens
ccctctcctgggca

SEQ ID NO: 494373 - DNA, 20 bp, Homo sapiens
ccctctcctgggcagctgcc

SEQ ID NO: 494374 - DNA, 21 bp, Homo sapiens
ccctctcctgggcagctgcct

SEQ ID NO: 494375 - DNA, 22 bp, Homo sapiens
ccctctcctgggcagctgcctc

SEQ ID NO: 494376 - DNA, 17 bp, Homo sapiens
ccctgaggggtccctga

SEQ ID NO: 494377 - DNA, 18 bp, Homo sapiens
ccctgataacaacctgga

SEQ ID NO: 494378 - DNA, 19 bp, Homo sapiens
ccctgataacaacctggag

SEQ ID NO: 494379 - DNA, 14 bp, Homo sapiens
ccctgcaataaaat

SEQ ID NO: 494380 - DNA, 16 bp, Homo sapiens
ccctgcctgaaacctg

SEQ ID NO: 494381 - DNA, 17 bp, Homo sapiens
ccctggggacagcaagg

SEQ ID NO: 494382 - DNA, 20 bp, Homo sapiens
ccctggggacagcaagggct

SEQ ID NO: 494383 - DNA, 16 bp, Homo sapiens
cccttcatgcatggaa

SEQ ID NO: 494384 - DNA, 21 bp, Homo sapiens
cccttcccatgacccaggctg

SEQ ID NO: 494385 - DNA, 22 bp, Homo sapiens
cccttctggtgccagatcctct

SEQ ID NO: 494386 - DNA, 17 bp, Homo sapiens
cccttctttccacagaa

SEQ ID NO: 494387 - DNA, 21 bp, Homo sapiens
cccttgcccagggctcagcct

SEQ ID NO: 494388 - DNA, 22 bp, Homo sapiens
cccttgctggagtcatgtgcct

SEQ ID NO: 494389 - DNA, 14 bp, Homo sapiens
ccgacctcagcctt

SEQ ID NO: 494390 - DNA, 11 bp, Homo sapiens
ccgcctgtggg

SEQ ID NO: 494391 - DNA, 15 bp, Homo sapiens
ccgcggagcccttgg

SEQ ID NO: 494392 - DNA, 17 bp, Homo sapiens
ccgctcctgtctgccag

SEQ ID NO: 494393 - DNA, 22 bp, Homo sapiens
ccgctgattctcagggtctctg

SEQ ID NO: 494394 - DNA, 17 bp, Homo sapiens
ccgctgccatgctttga

SEQ ID NO: 494395 - DNA, 14 bp, Homo sapiens
ccgggcatggtggc

SEQ ID NO: 494396 - DNA, 13 bp, Homo sapiens
ccgtgggcctggg

SEQ ID NO: 494397 - DNA, 21 bp, Homo sapiens
ccgtgtgttctccgtccctgc

SEQ ID NO: 494398 - DNA, 18 bp, Homo sapiens
ccgttgatgttggctggg

SEQ ID NO: 494399 - DNA, 16 bp, Homo sapiens
cctagccgacctcagc

SEQ ID NO: 494400 - DNA, 22 bp, Homo sapiens
cctagggaagggtggtggagcc

SEQ ID NO: 494401 - DNA, 23 bp, Homo sapiens
cctagggaagggtggtggagcca

SEQ ID NO: 494402 - DNA, 14 bp, Homo sapiens
cctatagtcccagc

SEQ ID NO: 494403 - DNA, 13 bp, Homo sapiens
cctcaaacactgc

SEQ ID NO: 494404 - DNA, 17 bp, Homo sapiens
cctcaaacactgcaggc

SEQ ID NO: 494405 - DNA, 20 bp, Homo sapiens
cctcagaaaacaaggatgaa

SEQ ID NO: 494406 - DNA, 21 bp, Homo sapiens
cctcagaacaaagtgagacag

SEQ ID NO: 494407 - DNA, 11 bp, Homo sapiens
cctcagcctgt

SEQ ID NO: 494408 - DNA, 16 bp, Homo sapiens
cctcagcctgtgctgc

SEQ ID NO: 494409 - DNA, 21 bp, Homo sapiens
cctcagtaagtatctggagga

SEQ ID NO: 494410 - DNA, 15 bp, Homo sapiens
cctcatccgaggcag

SEQ ID NO: 494411 - DNA, 13 bp, Homo sapiens
cctccacctccct

SEQ ID NO: 494412 - DNA, 12 bp, Homo sapiens
cctcccctcctc

SEQ ID NO: 494413 - DNA, 13 bp, Homo sapiens
cctcccctcctct

SEQ ID NO: 494414 - DNA, 14 bp, Homo sapiens
cctcccctcctctg

SEQ ID NO: 494415 - DNA, 18 bp, Homo sapiens
cctcccctcctctgcttg

SEQ ID NO: 494416 - DNA, 14 bp, Homo sapiens
cctcccctggggac

SEQ ID NO: 494417 - DNA, 15 bp, Homo sapiens
cctcctctgtccagg

SEQ ID NO: 494418 - DNA, 18 bp, Homo sapiens
cctcctctgtccagggcc

SEQ ID NO: 494419 - DNA, 15 bp, Homo sapiens
cctcctgtctctggc

SEQ ID NO: 494420 - DNA, 19 bp, Homo sapiens
cctcggacagcccatctgc

SEQ ID NO: 494421 - DNA, 11 bp, Homo sapiens
cctctcctggg

SEQ ID NO: 494422 - DNA, 18 bp, Homo sapiens
cctctgccgctgccatgc

SEQ ID NO: 494423 - DNA, 15 bp, Homo sapiens
cctctgtccagggcc

SEQ ID NO: 494424 - DNA, 23 bp, Homo sapiens
cctctgtccagggccctgagctc

SEQ ID NO: 494425 - DNA, 16 bp, Homo sapiens
cctgagctcggtggac

SEQ ID NO: 494426 - DNA, 19 bp, Homo sapiens
cctgataaagaacatctgt

SEQ ID NO: 494427 - DNA, 19 bp, Homo sapiens
cctgataacaacctggaga

SEQ ID NO: 494428 - DNA, 21 bp, Homo sapiens
cctgatatttccctcccctgg

SEQ ID NO: 494429 - DNA, 15 bp, Homo sapiens
cctgatcctgtgaag

SEQ ID NO: 494430 - DNA, 15 bp, Homo sapiens
cctgatgcagtcacg

SEQ ID NO: 494431 - DNA, 22 bp, Homo sapiens
cctgccctagagcacactgtag

SEQ ID NO: 494432 - DNA, 16 bp, Homo sapiens
cctgcctcccttcatg

SEQ ID NO: 494433 - DNA, 12 bp, Homo sapiens
cctgctggtcaa

SEQ ID NO: 494434 - DNA, 15 bp, Homo sapiens
cctgcttccaggcct

SEQ ID NO: 494435 - DNA, 22 bp, Homo sapiens
cctggaacatcatcaaggcact

SEQ ID NO: 494436 - DNA, 14 bp, Homo sapiens
cctggaagacagag

SEQ ID NO: 494437 - DNA, 15 bp, Homo sapiens
cctggaagacagaga

SEQ ID NO: 494438 - DNA, 12 bp, Homo sapiens
cctggaagggct

SEQ ID NO: 494439 - DNA, 24 bp, Homo sapiens
cctggaagggctagaacctgtaga

SEQ ID NO: 494440 - DNA, 23 bp, Homo sapiens
cctggagaactagaacctggagg

SEQ ID NO: 494441 - DNA, 21 bp, Homo sapiens
cctggagagccagaacctgga

SEQ ID NO: 494442 - DNA, 19 bp, Homo sapiens
cctggagggctagaaccta

SEQ ID NO: 494443 - DNA, 21 bp, Homo sapiens
cctggagggctagaacctgga

SEQ ID NO: 494444 - DNA, 22 bp, Homo sapiens
cctggagggctagaacctggag

SEQ ID NO: 494445 - DNA, 18 bp, Homo sapiens
cctggagggctagaactg

SEQ ID NO: 494446 - DNA, 22 bp, Homo sapiens
cctggaggggctagaacctaga

SEQ ID NO: 494447 - DNA, 17 bp, Homo sapiens
cctggcaacagagcgag

SEQ ID NO: 494448 - DNA, 23 bp, Homo sapiens
cctggcaacagagcgagattcca

SEQ ID NO: 494449 - DNA, 21 bp, Homo sapiens
cctggcaagctagaacctgga

SEQ ID NO: 494450 - DNA, 22 bp, Homo sapiens
cctggcaagctagaacctggag

SEQ ID NO: 494451 - DNA, 21 bp, Homo sapiens
cctggcaggctgtctggccag

SEQ ID NO: 494452 - DNA, 21 bp, Homo sapiens
cctggcaggttagaacctaga

SEQ ID NO: 494453 - DNA, 18 bp, Homo sapiens
cctgggagccagggtgag

SEQ ID NO: 494454 - DNA, 20 bp, Homo sapiens
cctgggaggcagaggttgca

SEQ ID NO: 494455 - DNA, 15 bp, Homo sapiens
cctgggcagctgcct

SEQ ID NO: 494456 - DNA, 12 bp, Homo sapiens
cctggggcctcg

SEQ ID NO: 494457 - DNA, 15 bp, Homo sapiens
cctggggctgctggc

SEQ ID NO: 494458 - DNA, 17 bp, Homo sapiens
cctggggctgctggcct

SEQ ID NO: 494459 - DNA, 23 bp, Homo sapiens
cctgggtccaggggaggccttcc

SEQ ID NO: 494460 - DNA, 18 bp, Homo sapiens
cctggtgggcctcctctg

SEQ ID NO: 494461 - DNA, 14 bp, Homo sapiens
cctgtagagctaga

SEQ ID NO: 494462 - DNA, 16 bp, Homo sapiens
cctgtccacacccagc

SEQ ID NO: 494463 - DNA, 14 bp, Homo sapiens
cctgtctgccagcc

SEQ ID NO: 494464 - DNA, 17 bp, Homo sapiens
cctgtctgccagccagc

SEQ ID NO: 494465 - DNA, 17 bp, Homo sapiens
ccttagcttagacctca

SEQ ID NO: 494466 - DNA, 19 bp, Homo sapiens
ccttagcttagacctcagc

SEQ ID NO: 494467 - DNA, 20 bp, Homo sapiens
ccttagcttagacctcagcc

SEQ ID NO: 494468 - DNA, 21 bp, Homo sapiens
ccttagcttagacctcagcct

SEQ ID NO: 494469 - DNA, 17 bp, Homo sapiens
ccttcatccgcctgtgg

SEQ ID NO: 494470 - DNA, 13 bp, Homo sapiens
ccttcatctggaa

SEQ ID NO: 494471 - DNA, 21 bp, Homo sapiens
ccttcatgcatggaaattccc

SEQ ID NO: 494472 - DNA, 20 bp, Homo sapiens
ccttcctacacccttggact

SEQ ID NO: 494473 - DNA, 14 bp, Homo sapiens
ccttctaggaagct

SEQ ID NO: 494474 - DNA, 13 bp, Homo sapiens
ccttgaacactgg

SEQ ID NO: 494475 - DNA, 16 bp, Homo sapiens
ccttgaccaggcctgg

SEQ ID NO: 494476 - DNA, 16 bp, Homo sapiens
ccttgagagaccaggc

SEQ ID NO: 494477 - DNA, 20 bp, Homo sapiens
ccttgagagaccaggcaaag

SEQ ID NO: 494478 - DNA, 13 bp, Homo sapiens
ccttgccagacat

SEQ ID NO: 494479 - DNA, 14 bp, Homo sapiens
actgtgcagagact

SEQ ID NO: 494480 - DNA, 14 bp, Homo sapiens
acttaagacaaatg

SEQ ID NO: 494481 - DNA, 22 bp, Homo sapiens
acttaagacaaatgggactgat

SEQ ID NO: 494482 - DNA, 15 bp, Homo sapiens
acttaatagaaacat

SEQ ID NO: 494483 - DNA, 18 bp, Homo sapiens
acttaggcatgcacagct

SEQ ID NO: 494484 - DNA, 21 bp, Homo sapiens
acttaggcatgcacagctgta

SEQ ID NO: 494485 - DNA, 16 bp, Homo sapiens
acttattctcaagaag

SEQ ID NO: 494486 - DNA, 11 bp, Homo sapiens
acttatttgag

SEQ ID NO: 494487 - DNA, 16 bp, Homo sapiens
acttcaaaaactgtca

SEQ ID NO: 494488 - DNA, 18 bp, Homo sapiens
acttcaaatccttgaaga

SEQ ID NO: 494489 - DNA, 20 bp, Homo sapiens
acttccatttggaatcatat

SEQ ID NO: 494490 - DNA, 19 bp, Homo sapiens
acttctcttctgagcctct

SEQ ID NO: 494491 - DNA, 21 bp, Homo sapiens
acttcttcagagctgacacag

SEQ ID NO: 494492 - DNA, 18 bp, Homo sapiens
acttctttgctttgccca

SEQ ID NO: 494493 - DNA, 21 bp, Homo sapiens
acttctttgctttgcccagca

SEQ ID NO: 494494 - DNA, 17 bp, Homo sapiens
acttgacagaacactgt

SEQ ID NO: 494495 - DNA, 18 bp, Homo sapiens
acttggcatcagctggcg

SEQ ID NO: 494496 - DNA, 18 bp, Homo sapiens
acttgtaaatgtggtaaa

SEQ ID NO: 494497 - DNA, 16 bp, Homo sapiens
acttgttagaaatgca

SEQ ID NO: 494498 - DNA, 22 bp, Homo sapiens
actttcaggccacatggctaaa

SEQ ID NO: 494499 - DNA, 14 bp, Homo sapiens
actttgaggaggaa

SEQ ID NO: 494500 - DNA, 20 bp, Homo sapiens
actttgaggaggaagcagaa

SEQ ID NO: 494501 - DNA, 13 bp, Homo sapiens
actttggctgcat

SEQ ID NO: 494502 - DNA, 21 bp, Homo sapiens
actttttatattttatacatt

SEQ ID NO: 494503 - DNA, 13 bp, Homo sapiens
agaaaaaaaccat

SEQ ID NO: 494504 - DNA, 11 bp, Homo sapiens
agaaaaacatg

SEQ ID NO: 494505 - DNA, 16 bp, Homo sapiens
agaaacacaactatat

SEQ ID NO: 494506 - DNA, 11 bp, Homo sapiens
agaaacactga

SEQ ID NO: 494507 - DNA, 15 bp, Homo sapiens
agaaacataaataaa

SEQ ID NO: 494508 - DNA, 16 bp, Homo sapiens
agaaacataaataaaa

SEQ ID NO: 494509 - DNA, 23 bp, Homo sapiens
agaaacataaataaaatgaccag

SEQ ID NO: 494510 - DNA, 20 bp, Homo sapiens
agaaaccattgttcagaaga

SEQ ID NO: 494511 - DNA, 17 bp, Homo sapiens
agaaagttgcacggctg

SEQ ID NO: 494512 - DNA, 20 bp, Homo sapiens
agaaagttgcacggctgctg

SEQ ID NO: 494513 - DNA, 18 bp, Homo sapiens
agaaatgcaaattctcaa

SEQ ID NO: 494514 - DNA, 20 bp, Homo sapiens
agaacaaagtgagacagtcc

SEQ ID NO: 494515 - DNA, 20 bp, Homo sapiens
agaacactcgaaaagagcac

SEQ ID NO: 494516 - DNA, 13 bp, Homo sapiens
agaacagcagatg

SEQ ID NO: 494517 - DNA, 17 bp, Homo sapiens
agaaccaggcaacttgg

SEQ ID NO: 494518 - DNA, 18 bp, Homo sapiens
agaaccagtgtctgaacc

SEQ ID NO: 494519 - DNA, 16 bp, Homo sapiens
agaacctggaagggct

SEQ ID NO: 494520 - DNA, 13 bp, Homo sapiens
agaagaactgaaa

SEQ ID NO: 494521 - DNA, 15 bp, Homo sapiens
agaagagagatcaaa

SEQ ID NO: 494522 - DNA, 20 bp, Homo sapiens
agaagagccggagcctccag

SEQ ID NO: 494523 - DNA, 18 bp, Homo sapiens
agaagatggtaccaccag

SEQ ID NO: 494524 - DNA, 14 bp, Homo sapiens
agaagctccaggta

SEQ ID NO: 494525 - DNA, 16 bp, Homo sapiens
agaaggaaaaggcagg

SEQ ID NO: 494526 - DNA, 13 bp, Homo sapiens
agaaggaagggca

SEQ ID NO: 494527 - DNA, 21 bp, Homo sapiens
agaagggctagaacctggagg

SEQ ID NO: 494528 - DNA, 22 bp, Homo sapiens
agaaggtgggttttcatcaaga

SEQ ID NO: 494529 - DNA, 19 bp, Homo sapiens
agaagttgatatagaacag

SEQ ID NO: 494530 - DNA, 15 bp, Homo sapiens
agaatattaaaaatt

SEQ ID NO: 494531 - DNA, 19 bp, Homo sapiens
agaatattaaaaattaatt

SEQ ID NO: 494532 - DNA, 13 bp, Homo sapiens
agaatcattgtaa

SEQ ID NO: 494533 - DNA, 22 bp, Homo sapiens
agaattctgctacctcactggg

SEQ ID NO: 494534 - DNA, 15 bp, Homo sapiens
agaattttgagcagg

SEQ ID NO: 494535 - DNA, 15 bp, Homo sapiens
agacacaacaactcc

SEQ ID NO: 494536 - DNA, 17 bp, Homo sapiens
agacacactgaagaagc

SEQ ID NO: 494537 - DNA, 16 bp, Homo sapiens
agacagagacctcctg

SEQ ID NO: 494538 - DNA, 19 bp, Homo sapiens
agacagagacctcctgcct

SEQ ID NO: 494539 - DNA, 22 bp, Homo sapiens
agacagcttctcatcctgcagg

SEQ ID NO: 494540 - DNA, 18 bp, Homo sapiens
agacaggacctgactatt

SEQ ID NO: 494541 - DNA, 15 bp, Homo sapiens
agacagtccagcctg

SEQ ID NO: 494542 - DNA, 20 bp, Homo sapiens
agacatgagtgcgtgctcag

SEQ ID NO: 494543 - DNA, 14 bp, Homo sapiens
agacccctgtctcc

SEQ ID NO: 494544 - DNA, 13 bp, Homo sapiens
agacccctgtctt

SEQ ID NO: 494545 - DNA, 23 bp, Homo sapiens
agacccctgtctttgctgagagc

SEQ ID NO: 494546 - DNA, 16 bp, Homo sapiens
agacccttctggtgcc

SEQ ID NO: 494547 - DNA, 17 bp, Homo sapiens
agacctccctgtgagag

SEQ ID NO: 494548 - DNA, 12 bp, Homo sapiens
agacctgctctg

SEQ ID NO: 494549 - DNA, 14 bp, Homo sapiens
agacctgctctgga

SEQ ID NO: 494550 - DNA, 17 bp, Homo sapiens
agacctgctctggacac

SEQ ID NO: 494551 - DNA, 14 bp, Homo sapiens
agacgccttactgg

SEQ ID NO: 494552 - DNA, 15 bp, Homo sapiens
agactatcagcccaa

SEQ ID NO: 494553 - DNA, 17 bp, Homo sapiens
agactcagggccccagc

SEQ ID NO: 494554 - DNA, 20 bp, Homo sapiens
agactcagggccccagcact

SEQ ID NO: 494555 - DNA, 21 bp, Homo sapiens
agactcagggccccagcacta

SEQ ID NO: 494556 - DNA, 14 bp, Homo sapiens
agactcctaggcag

SEQ ID NO: 494557 - DNA, 22 bp, Homo sapiens
agactcctaggcaggacatgct

SEQ ID NO: 494558 - DNA, 20 bp, Homo sapiens
agactccttgagagaccagg

SEQ ID NO: 494559 - DNA, 11 bp, Homo sapiens
agactggaagg

SEQ ID NO: 494560 - DNA, 23 bp, Homo sapiens
agacttaatagaaacattgaaga

SEQ ID NO: 494561 - DNA, 18 bp, Homo sapiens
agacttcccagcttctgc

SEQ ID NO: 494562 - DNA, 12 bp, Homo sapiens
agacttgctgaa

SEQ ID NO: 494563 - DNA, 23 bp, Homo sapiens
agactttaatcccggtttcagaa

SEQ ID NO: 494564 - DNA, 15 bp, Homo sapiens
agagacctcctgcct

SEQ ID NO: 494565 - DNA, 13 bp, Homo sapiens
agagagaaaaaca

SEQ ID NO: 494566 - DNA, 14 bp, Homo sapiens
agagagaaaaacaa

SEQ ID NO: 494567 - DNA, 20 bp, Homo sapiens
agagatggcctgagaagaga

SEQ ID NO: 494568 - DNA, 17 bp, Homo sapiens
agagattgaactttgag

SEQ ID NO: 494569 - DNA, 20 bp, Homo sapiens
agagcaagactctgtctcaa

SEQ ID NO: 494570 - DNA, 22 bp, Homo sapiens
agagcagtttctgtcctgctgg

SEQ ID NO: 494571 - DNA, 20 bp, Homo sapiens
agagccatgtagaagctgca

SEQ ID NO: 494572 - DNA, 17 bp, Homo sapiens
agagctagaacatggag

SEQ ID NO: 494573 - DNA, 18 bp, Homo sapiens
agagctagaacatggaga

SEQ ID NO: 494574 - DNA, 19 bp, Homo sapiens
agagctagaacatggagag

SEQ ID NO: 494575 - DNA, 22 bp, Homo sapiens
agagctagaacatggagagcta

SEQ ID NO: 494576 - DNA, 23 bp, Homo sapiens
agagctgacacaaacctgcctgg

SEQ ID NO: 494577 - DNA, 23 bp, Homo sapiens
agagctgacacaggatgaaggca

SEQ ID NO: 494578 - DNA, 15 bp, Homo sapiens
agagctgccctctcc

SEQ ID NO: 494579 - DNA, 18 bp, Homo sapiens
ctcctctgtccagggccc

SEQ ID NO: 494580 - DNA, 15 bp, Homo sapiens
ctcctgggcagctgc

SEQ ID NO: 494581 - DNA, 19 bp, Homo sapiens
ctcctgggcagctgcctcc

SEQ ID NO: 494582 - DNA, 14 bp, Homo sapiens
ctcctgtctgccag

SEQ ID NO: 494583 - DNA, 16 bp, Homo sapiens
ctccttgagttttcct

SEQ ID NO: 494584 - DNA, 22 bp, Homo sapiens
ctcggagcctcatccgaggcag

SEQ ID NO: 494585 - DNA, 18 bp, Homo sapiens
ctcggtggacccagggat

SEQ ID NO: 494586 - DNA, 14 bp, Homo sapiens
ctcgttaatttgta

SEQ ID NO: 494587 - DNA, 20 bp, Homo sapiens
ctctaccaagctatcctggc

SEQ ID NO: 494588 - DNA, 12 bp, Homo sapiens
ctctaggctggg

SEQ ID NO: 494589 - DNA, 14 bp, Homo sapiens
ctctaggctgggga

SEQ ID NO: 494590 - DNA, 15 bp, Homo sapiens
ctctatcattaaagt

SEQ ID NO: 494591 - DNA, 13 bp, Homo sapiens
ctctcacattact

SEQ ID NO: 494592 - DNA, 20 bp, Homo sapiens
ctctcctgggcagctgcctc

SEQ ID NO: 494593 - DNA, 23 bp, Homo sapiens
ctctgccaacttcttcagagctg

SEQ ID NO: 494594 - DNA, 16 bp, Homo sapiens
ctctgccgctgccatg

SEQ ID NO: 494595 - DNA, 22 bp, Homo sapiens
ctctgccgctgccatgctttga

SEQ ID NO: 494596 - DNA, 12 bp, Homo sapiens
ctctgcttgcca

SEQ ID NO: 494597 - DNA, 17 bp, Homo sapiens
ctctgcttgccatccct

SEQ ID NO: 494598 - DNA, 20 bp, Homo sapiens
ctctgcttgccatccctccc

SEQ ID NO: 494599 - DNA, 14 bp, Homo sapiens
ctctgtccagggcc

SEQ ID NO: 494600 - DNA, 21 bp, Homo sapiens
ctcttagatgcagttctgaag

SEQ ID NO: 494601 - DNA, 15 bp, Homo sapiens
ctcttcaataaacca

SEQ ID NO: 494602 - DNA, 14 bp, Homo sapiens
ctcttctccccaga

SEQ ID NO: 494603 - DNA, 20 bp, Homo sapiens
ctcttgaagacactgaaata

SEQ ID NO: 494604 - DNA, 19 bp, Homo sapiens
ctcttgggttcaagtgatt

SEQ ID NO: 494605 - DNA, 14 bp, Homo sapiens
ctgaaattttctag

SEQ ID NO: 494606 - DNA, 19 bp, Homo sapiens
ctgaactgatgggtttctc

SEQ ID NO: 494607 - DNA, 21 bp, Homo sapiens
ctgaactttgctgagcctgta

SEQ ID NO: 494608 - DNA, 23 bp, Homo sapiens
ctgaagatataactattgcccag

SEQ ID NO: 494609 - DNA, 16 bp, Homo sapiens
ctgaagatccccaact

SEQ ID NO: 494610 - DNA, 16 bp, Homo sapiens
ctgaaggagattttcc

SEQ ID NO: 494611 - DNA, 20 bp, Homo sapiens
ctgaaggagattttccttcc

SEQ ID NO: 494612 - DNA, 22 bp, Homo sapiens
ctgaatgcttataggtggcctc

SEQ ID NO: 494613 - DNA, 16 bp, Homo sapiens
ctgaatttttcttgcg

SEQ ID NO: 494614 - DNA, 14 bp, Homo sapiens
ctgacacaaacctg

SEQ ID NO: 494615 - DNA, 18 bp, Homo sapiens
ctgacacaaacctgcctg

SEQ ID NO: 494616 - DNA, 19 bp, Homo sapiens
ctgacacaaacctgcctgg

SEQ ID NO: 494617 - DNA, 20 bp, Homo sapiens
ctgacacaaacctgcctggg

SEQ ID NO: 494618 - DNA, 15 bp, Homo sapiens
ctgactgtgcccaag

SEQ ID NO: 494619 - DNA, 22 bp, Homo sapiens
ctgagaacactgtgaaaacatt

SEQ ID NO: 494620 - DNA, 23 bp, Homo sapiens
ctgagaagagagatcaaatggaa

SEQ ID NO: 494621 - DNA, 20 bp, Homo sapiens
ctgagcaagaccctgtctct

SEQ ID NO: 494622 - DNA, 16 bp, Homo sapiens
ctgagccagtgtcagg

SEQ ID NO: 494623 - DNA, 22 bp, Homo sapiens
ctgagccagtgtcaggaggaag

SEQ ID NO: 494624 - DNA, 22 bp, Homo sapiens
ctgagcgcctgggtccagggga

SEQ ID NO: 494625 - DNA, 19 bp, Homo sapiens
ctgagctagaagctggagg

SEQ ID NO: 494626 - DNA, 22 bp, Homo sapiens
ctgagctcggtggacccaggga

SEQ ID NO: 494627 - DNA, 17 bp, Homo sapiens
ctgagctgggggaagaa

SEQ ID NO: 494628 - DNA, 22 bp, Homo sapiens
ctgaggattcaggggctggggg

SEQ ID NO: 494629 - DNA, 21 bp, Homo sapiens
ctgaggccccttctaggtggc

SEQ ID NO: 494630 - DNA, 17 bp, Homo sapiens
ctgagtctgctatattt

SEQ ID NO: 494631 - DNA, 14 bp, Homo sapiens
ctgagtgcctggcc

SEQ ID NO: 494632 - DNA, 20 bp, Homo sapiens
ctgagttgacttgacagaac

SEQ ID NO: 494633 - DNA, 21 bp, Homo sapiens
ctgagttggtgttgacatgtg

SEQ ID NO: 494634 - DNA, 22 bp, Homo sapiens
ctgagtttttaaaaatggacaa

SEQ ID NO: 494635 - DNA, 17 bp, Homo sapiens
ctgataacaacctggag

SEQ ID NO: 494636 - DNA, 22 bp, Homo sapiens
ctgataacaacctggagaccag

SEQ ID NO: 494637 - DNA, 15 bp, Homo sapiens
ctgatacgtgtatga

SEQ ID NO: 494638 - DNA, 20 bp, Homo sapiens
ctgatcctgtgaagtaagga

SEQ ID NO: 494639 - DNA, 20 bp, Homo sapiens
ctgatctgatgcaagcaaga

SEQ ID NO: 494640 - DNA, 23 bp, Homo sapiens
ctgatgcagtcacgtggaggagc

SEQ ID NO: 494641 - DNA, 15 bp, Homo sapiens
ctgatggacctgtca

SEQ ID NO: 494642 - DNA, 22 bp, Homo sapiens
ctgatggcaggatggcctggcc

SEQ ID NO: 494643 - DNA, 12 bp, Homo sapiens
ctgatggcttct

SEQ ID NO: 494644 - DNA, 17 bp, Homo sapiens
ctgattctcagggtctc

SEQ ID NO: 494645 - DNA, 17 bp, Homo sapiens
ctgattgtctgaaattt

SEQ ID NO: 494646 - DNA, 16 bp, Homo sapiens
ctgcacaaactcacca

SEQ ID NO: 494647 - DNA, 14 bp, Homo sapiens
ctgcacagaagaca

SEQ ID NO: 494648 - DNA, 11 bp, Homo sapiens
ctgcacctgca

SEQ ID NO: 494649 - DNA, 19 bp, Homo sapiens
ctgcactccagcctgggca

SEQ ID NO: 494650 - DNA, 18 bp, Homo sapiens
ctgcagatttgggctgga

SEQ ID NO: 494651 - DNA, 15 bp, Homo sapiens
ctgccacacctgagc

SEQ ID NO: 494652 - DNA, 18 bp, Homo sapiens
ctgccaccaccagaaagc

SEQ ID NO: 494653 - DNA, 14 bp, Homo sapiens
ctgccagccagcag

SEQ ID NO: 494654 - DNA, 18 bp, Homo sapiens
ctgccagccagcagccag

SEQ ID NO: 494655 - DNA, 15 bp, Homo sapiens
ctgccatgcagggcc

SEQ ID NO: 494656 - DNA, 16 bp, Homo sapiens
ctgccatgcagggcct

SEQ ID NO: 494657 - DNA, 17 bp, Homo sapiens
ctgccatgcagggcctc

SEQ ID NO: 494658 - DNA, 13 bp, Homo sapiens
ctgccatgctttg

SEQ ID NO: 494659 - DNA, 15 bp, Homo sapiens
ctgcccgtcttcagc

SEQ ID NO: 494660 - DNA, 17 bp, Homo sapiens
ctgcccgtcttcagcct

SEQ ID NO: 494661 - DNA, 18 bp, Homo sapiens
ctgcccgtcttcagccta

SEQ ID NO: 494662 - DNA, 15 bp, Homo sapiens
ctgccctagagcaca

SEQ ID NO: 494663 - DNA, 12 bp, Homo sapiens
ctgccctctcct

SEQ ID NO: 494664 - DNA, 19 bp, Homo sapiens
ctgccctctcctgggcagc

SEQ ID NO: 494665 - DNA, 13 bp, Homo sapiens
ctgccgctgccat

SEQ ID NO: 494666 - DNA, 18 bp, Homo sapiens
ctgcctcccctcctctgc

SEQ ID NO: 494667 - DNA, 19 bp, Homo sapiens
ctgcctcccctcctctgct

SEQ ID NO: 494668 - DNA, 15 bp, Homo sapiens
ctgcctcccttcatg

SEQ ID NO: 494669 - DNA, 19 bp, Homo sapiens
ctgcctcccttcatgcatg

SEQ ID NO: 494670 - DNA, 12 bp, Homo sapiens
ctgcctggcagg

SEQ ID NO: 494671 - DNA, 22 bp, Homo sapiens
ctgccttatctaaatcaccaga

SEQ ID NO: 494672 - DNA, 15 bp, Homo sapiens
ctgctacctcactgg

SEQ ID NO: 494673 - DNA, 16 bp, Homo sapiens
cttccctaaaatcagg

SEQ ID NO: 494674 - DNA, 16 bp, Homo sapiens
cttccctatctttgcc

SEQ ID NO: 494675 - DNA, 17 bp, Homo sapiens
cttccctatctttgcca

SEQ ID NO: 494676 - DNA, 23 bp, Homo sapiens
cttcctacacccttggacttgag

SEQ ID NO: 494677 - DNA, 18 bp, Homo sapiens
cttcctatatgcacttat

SEQ ID NO: 494678 - DNA, 17 bp, Homo sapiens
cttctagaaccaggcaa

SEQ ID NO: 494679 - DNA, 13 bp, Homo sapiens
cttctaggaagct

SEQ ID NO: 494680 - DNA, 15 bp, Homo sapiens
cttctcatcctgcag

SEQ ID NO: 494681 - DNA, 13 bp, Homo sapiens
cttctgccttttt

SEQ ID NO: 494682 - DNA, 16 bp, Homo sapiens
cttctgcttgtcatcc

SEQ ID NO: 494683 - DNA, 15 bp, Homo sapiens
cttgaacactggggg

SEQ ID NO: 494684 - DNA, 14 bp, Homo sapiens
cttgacagaacact

SEQ ID NO: 494685 - DNA, 16 bp, Homo sapiens
cttgacagaacactgt

SEQ ID NO: 494686 - DNA, 15 bp, Homo sapiens
cttgaccaggcctgg

SEQ ID NO: 494687 - DNA, 20 bp, Homo sapiens
cttgagaggcatgacagctg

SEQ ID NO: 494688 - DNA, 13 bp, Homo sapiens
cttgatgaagaag

SEQ ID NO: 494689 - DNA, 22 bp, Homo sapiens
cttgcaagaatcagtgcaaaga

SEQ ID NO: 494690 - DNA, 12 bp, Homo sapiens
cttgcagcagga

SEQ ID NO: 494691 - DNA, 16 bp, Homo sapiens
cttgccatccctccct

SEQ ID NO: 494692 - DNA, 22 bp, Homo sapiens
cttgccatccctccctccacct

SEQ ID NO: 494693 - DNA, 13 bp, Homo sapiens
cttgcctgcaggc

SEQ ID NO: 494694 - DNA, 20 bp, Homo sapiens
cttgctctcttcaataaacc

SEQ ID NO: 494695 - DNA, 21 bp, Homo sapiens
cttggaaactggatgaggtca

SEQ ID NO: 494696 - DNA, 13 bp, Homo sapiens
cttggctggtgca

SEQ ID NO: 494697 - DNA, 17 bp, Homo sapiens
cttgggtcccagggaag

SEQ ID NO: 494698 - DNA, 15 bp, Homo sapiens
cttggttggctggcc

SEQ ID NO: 494699 - DNA, 18 bp, Homo sapiens
cttgtatttaaatattaa

SEQ ID NO: 494700 - DNA, 20 bp, Homo sapiens
cttgtatttaaatattaaat

SEQ ID NO: 494701 - DNA, 23 bp, Homo sapiens
cttgtcaataaaatccatacatt

SEQ ID NO: 494702 - DNA, 18 bp, Homo sapiens
cttgtgccaacactcaag

SEQ ID NO: 494703 - DNA, 20 bp, Homo sapiens
ctttaaaagacaaatcaaag

SEQ ID NO: 494704 - DNA, 17 bp, Homo sapiens
ctttaagtgcacaacat

SEQ ID NO: 494705 - DNA, 14 bp, Homo sapiens
ctttattagtgaag

SEQ ID NO: 494706 - DNA, 20 bp, Homo sapiens
ctttcaatggtttgcaagga

SEQ ID NO: 494707 - DNA, 14 bp, Homo sapiens
ctttcagctgtgaa

SEQ ID NO: 494708 - DNA, 21 bp, Homo sapiens
ctttccaaaggccatggagag

SEQ ID NO: 494709 - DNA, 13 bp, Homo sapiens
ctttccacagaag

SEQ ID NO: 494710 - DNA, 22 bp, Homo sapiens
ctttccatatcaagagacatgg

SEQ ID NO: 494711 - DNA, 18 bp, Homo sapiens
ctttcccactttcttcta

SEQ ID NO: 494712 - DNA, 19 bp, Homo sapiens
ctttcctgatggcaggatg

SEQ ID NO: 494713 - DNA, 19 bp, Homo sapiens
ctttccttgttccccatca

SEQ ID NO: 494714 - DNA, 13 bp, Homo sapiens
ctttcctttttcc

SEQ ID NO: 494715 - DNA, 14 bp, Homo sapiens
ctttctatctaatt

SEQ ID NO: 494716 - DNA, 23 bp, Homo sapiens
ctttctccagaaccagtgtctga

SEQ ID NO: 494717 - DNA, 20 bp, Homo sapiens
ctttctgaagcctcacttat

SEQ ID NO: 494718 - DNA, 21 bp, Homo sapiens
ctttcttacacaagagctgga

SEQ ID NO: 494719 - DNA, 15 bp, Homo sapiens
ctttcttctaccaga

SEQ ID NO: 494720 - DNA, 13 bp, Homo sapiens
ctttgaagaggaa

SEQ ID NO: 494721 - DNA, 20 bp, Homo sapiens
ctttgaagaggaaaatgaat

SEQ ID NO: 494722 - DNA, 14 bp, Homo sapiens
ctttgacctgcctc

SEQ ID NO: 494723 - DNA, 20 bp, Homo sapiens
ctttgacctgcctcccttca

SEQ ID NO: 494724 - DNA, 16 bp, Homo sapiens
ctttgagcttaagaat

SEQ ID NO: 494725 - DNA, 16 bp, Homo sapiens
ctttgaggaggaagca

SEQ ID NO: 494726 - DNA, 23 bp, Homo sapiens
ctttgagtccacgcccaccagcc

SEQ ID NO: 494727 - DNA, 19 bp, Homo sapiens
ctttgcatgatctgtcaaa

SEQ ID NO: 494728 - DNA, 23 bp, Homo sapiens
gcgcctttccgcggagcccttgg

SEQ ID NO: 494729 - DNA, 13 bp, Homo sapiens
gcgggaaggaggg

SEQ ID NO: 494730 - DNA, 21 bp, Homo sapiens
gcgtcctgtccacacccagct

SEQ ID NO: 494731 - DNA, 12 bp, Homo sapiens
gcgtggagctgc

SEQ ID NO: 494732 - DNA, 15 bp, Homo sapiens
gcgtggagctgcctg

SEQ ID NO: 494733 - DNA, 16 bp, Homo sapiens
gcgtggagctgcctga

SEQ ID NO: 494734 - DNA, 16 bp, Homo sapiens
gctaaggcgtggagct

SEQ ID NO: 494735 - DNA, 13 bp, Homo sapiens
gctagaaaaatta

SEQ ID NO: 494736 - DNA, 19 bp, Homo sapiens
gctagaaccaagaagggct

SEQ ID NO: 494737 - DNA, 20 bp, Homo sapiens
gctagaacctagaagggcta

SEQ ID NO: 494738 - DNA, 18 bp, Homo sapiens
gctagaacctggaagggc

SEQ ID NO: 494739 - DNA, 19 bp, Homo sapiens
gctagaacctggaagggct

SEQ ID NO: 494740 - DNA, 19 bp, Homo sapiens
gctagaacctggagagcta

SEQ ID NO: 494741 - DNA, 15 bp, Homo sapiens
gctagaacctggagg

SEQ ID NO: 494742 - DNA, 19 bp, Homo sapiens
gctagaacctggagggctg

SEQ ID NO: 494743 - DNA, 16 bp, Homo sapiens
gctagatgtatgtact

SEQ ID NO: 494744 - DNA, 17 bp, Homo sapiens
gctagcacttggagcca

SEQ ID NO: 494745 - DNA, 17 bp, Homo sapiens
gctataaacaattacat

SEQ ID NO: 494746 - DNA, 23 bp, Homo sapiens
gctatacctgggcatactaataa

SEQ ID NO: 494747 - DNA, 15 bp, Homo sapiens
gctatcccttctcag

SEQ ID NO: 494748 - DNA, 15 bp, Homo sapiens
gctcaacataacata

SEQ ID NO: 494749 - DNA, 21 bp, Homo sapiens
gctcacacggggtattttagg

SEQ ID NO: 494750 - DNA, 15 bp, Homo sapiens
gctcagaagtgacca

SEQ ID NO: 494751 - DNA, 13 bp, Homo sapiens
gctcagagagggc

SEQ ID NO: 494752 - DNA, 18 bp, Homo sapiens
gctcagagagggcaggca

SEQ ID NO: 494753 - DNA, 19 bp, Homo sapiens
gctcagagagggcaggcat

SEQ ID NO: 494754 - DNA, 11 bp, Homo sapiens
gctcagcctgg

SEQ ID NO: 494755 - DNA, 14 bp, Homo sapiens
gctcagcctggtgg

SEQ ID NO: 494756 - DNA, 20 bp, Homo sapiens
gctcagcctggtgggcctcc

SEQ ID NO: 494757 - DNA, 14 bp, Homo sapiens
gctcaggaccaggc

SEQ ID NO: 494758 - DNA, 16 bp, Homo sapiens
gctcaggaccaggcaa

SEQ ID NO: 494759 - DNA, 14 bp, Homo sapiens
gctcatttcaggat

SEQ ID NO: 494760 - DNA, 15 bp, Homo sapiens
gctccagcctctgcc

SEQ ID NO: 494761 - DNA, 22 bp, Homo sapiens
gctccagcctctgccgctgcca

SEQ ID NO: 494762 - DNA, 13 bp, Homo sapiens
gctccaggcaggc

SEQ ID NO: 494763 - DNA, 11 bp, Homo sapiens
gctcccaaggg

SEQ ID NO: 494764 - DNA, 18 bp, Homo sapiens
gctcctcatccagggctc

SEQ ID NO: 494765 - DNA, 17 bp, Homo sapiens
gctcctgtctgccagcc

SEQ ID NO: 494766 - DNA, 19 bp, Homo sapiens
gctcctgtctgccagccag

SEQ ID NO: 494767 - DNA, 23 bp, Homo sapiens
gctccttcccaggagtggaggag

SEQ ID NO: 494768 - DNA, 12 bp, Homo sapiens
gctcggtggacc

SEQ ID NO: 494769 - DNA, 17 bp, Homo sapiens
gctcggtggacccaggg

SEQ ID NO: 494770 - DNA, 13 bp, Homo sapiens
gctctcttcaata

SEQ ID NO: 494771 - DNA, 14 bp, Homo sapiens
gctctcttcaataa

SEQ ID NO: 494772 - DNA, 16 bp, Homo sapiens
gctctcttcaataaac

SEQ ID NO: 494773 - DNA, 14 bp, Homo sapiens
gctctgagacacac

SEQ ID NO: 494774 - DNA, 23 bp, Homo sapiens
gctctgccaacttcttcagagct

SEQ ID NO: 494775 - DNA, 13 bp, Homo sapiens
gctctgcctgtgg

SEQ ID NO: 494776 - DNA, 15 bp, Homo sapiens
gctcttttcaatgaa

SEQ ID NO: 494777 - DNA, 15 bp, Homo sapiens
gctgaactcatgaga

SEQ ID NO: 494778 - DNA, 17 bp, Homo sapiens
gctgaagatccccaact

SEQ ID NO: 494779 - DNA, 14 bp, Homo sapiens
gctgagaacactgt

SEQ ID NO: 494780 - DNA, 16 bp, Homo sapiens
gctgagaggagagaga

SEQ ID NO: 494781 - DNA, 15 bp, Homo sapiens
gctgaggtgagagga

SEQ ID NO: 494782 - DNA, 13 bp, Homo sapiens
gctgattctcagg

SEQ ID NO: 494783 - DNA, 16 bp, Homo sapiens
gctgccacacctgagc

SEQ ID NO: 494784 - DNA, 19 bp, Homo sapiens
gctgcccgtcttcagccta

SEQ ID NO: 494785 - DNA, 12 bp, Homo sapiens
gctgccctctcc

SEQ ID NO: 494786 - DNA, 20 bp, Homo sapiens
gctgccctctcctgggcagc

SEQ ID NO: 494787 - DNA, 22 bp, Homo sapiens
gctgccctctcctgggcagctg

SEQ ID NO: 494788 - DNA, 14 bp, Homo sapiens
gctgcctcccctcc

SEQ ID NO: 494789 - DNA, 20 bp, Homo sapiens
gctgcctcccctcctctgct

SEQ ID NO: 494790 - DNA, 22 bp, Homo sapiens
gctgcctcccctcctctgcttg

SEQ ID NO: 494791 - DNA, 12 bp, Homo sapiens
gctgcctgggag

SEQ ID NO: 494792 - DNA, 17 bp, Homo sapiens
gctgcctgggagccagg

SEQ ID NO: 494793 - DNA, 15 bp, Homo sapiens
gctgcgatactggca

SEQ ID NO: 494794 - DNA, 23 bp, Homo sapiens
gctgctagcacttggagccaagg

SEQ ID NO: 494795 - DNA, 15 bp, Homo sapiens
gctgctgcccaggcc

SEQ ID NO: 494796 - DNA, 23 bp, Homo sapiens
gctggaaaagtatgttagtgcaa

SEQ ID NO: 494797 - DNA, 16 bp, Homo sapiens
gctggaatctggagag

SEQ ID NO: 494798 - DNA, 19 bp, Homo sapiens
gctggaatctggagagcta

SEQ ID NO: 494799 - DNA, 21 bp, Homo sapiens
gctggagactcctaggcagga

SEQ ID NO: 494800 - DNA, 17 bp, Homo sapiens
gctggagcctggtgccc

SEQ ID NO: 494801 - DNA, 21 bp, Homo sapiens
gctggaggactagaacctgga

SEQ ID NO: 494802 - DNA, 23 bp, Homo sapiens
gctggaggactagaacctggagg

SEQ ID NO: 494803 - DNA, 23 bp, Homo sapiens
gctggcctctctgacatatgcta

SEQ ID NO: 494804 - DNA, 16 bp, Homo sapiens
gctgggaactcacctg

SEQ ID NO: 494805 - DNA, 15 bp, Homo sapiens
gctgggggtgctgga

SEQ ID NO: 494806 - DNA, 18 bp, Homo sapiens
gctgggtaagagcacagg

SEQ ID NO: 494807 - DNA, 18 bp, Homo sapiens
gctggttggagagctaga

SEQ ID NO: 494808 - DNA, 21 bp, Homo sapiens
gctgtattttaaaagaatgat

SEQ ID NO: 494809 - DNA, 13 bp, Homo sapiens
gctgtcatctcag

SEQ ID NO: 494810 - DNA, 17 bp, Homo sapiens
gctgtccccttccaggg

SEQ ID NO: 494811 - DNA, 13 bp, Homo sapiens
gctgtctggccag

SEQ ID NO: 494812 - DNA, 18 bp, Homo sapiens
gctgtgaacatggactct

SEQ ID NO: 494813 - DNA, 20 bp, Homo sapiens
gctgtgaatttgtgtaagga

SEQ ID NO: 494814 - DNA, 19 bp, Homo sapiens
gctgttctcattcctgttc

SEQ ID NO: 494815 - DNA, 21 bp, Homo sapiens
gctgttctcattcctgttctt

SEQ ID NO: 494816 - DNA, 13 bp, Homo sapiens
gcttagacctcag

SEQ ID NO: 494817 - DNA, 12 bp, Homo sapiens
gcttagagcagt

SEQ ID NO: 494818 - DNA, 23 bp, Homo sapiens
gcttgaacctgggaggcagaggt

SEQ ID NO: 494819 - DNA, 14 bp, Homo sapiens
gcttgccacagagc

SEQ ID NO: 494820 - DNA, 18 bp, Homo sapiens
gcttggaaactggatgag

SEQ ID NO: 494821 - DNA, 22 bp, Homo sapiens
gcttgtcatccacacaacacca

SEQ ID NO: 494822 - DNA, 22 bp, Homo sapiens
gctttctctttggtttctcatc

SEQ ID NO: 494823 - DNA, 15 bp, Homo sapiens
gctttgaaggaacca

SEQ ID NO: 494824 - DNA, 19 bp, Homo sapiens
gctttgaaggaaccaagtg

SEQ ID NO: 494825 - DNA, 17 bp, Homo sapiens
gctttgagtccacgccc

SEQ ID NO: 494826 - DNA, 13 bp, Homo sapiens
gctttgctctgcc

SEQ ID NO: 494827 - DNA, 16 bp, Homo sapiens
gcttttcccaaaagcc

SEQ ID NO: 494828 - DNA, 20 bp, Homo sapiens
ggaaaaggcagggagcgagg

SEQ ID NO: 494829 - DNA, 16 bp, Homo sapiens
ggaaaccacagctgct

SEQ ID NO: 494830 - DNA, 18 bp, Homo sapiens
ggaaaccacagctgctgg

SEQ ID NO: 494831 - DNA, 19 bp, Homo sapiens
ggaaaccacagctgctgga

SEQ ID NO: 494832 - DNA, 15 bp, Homo sapiens
ggaaagaagagccgg

SEQ ID NO: 494833 - DNA, 16 bp, Homo sapiens
ggaaagcacaggtggg

SEQ ID NO: 494834 - DNA, 15 bp, Homo sapiens
ggaaaggagaggaaa

SEQ ID NO: 494835 - DNA, 20 bp, Homo sapiens
ggaaaggcaaatgcccaagg

SEQ ID NO: 494836 - DNA, 17 bp, Homo sapiens
ggaaatattgctggggt

SEQ ID NO: 494837 - DNA, 15 bp, Homo sapiens
ggaacatcatcaagg

SEQ ID NO: 494838 - DNA, 22 bp, Homo sapiens
ggaacatcatcaaggcactgcc

SEQ ID NO: 494839 - DNA, 23 bp, Homo sapiens
ggaacatcatcaaggcactgcct

SEQ ID NO: 494840 - DNA, 14 bp, Homo sapiens
ggaacgactgggca

SEQ ID NO: 494841 - DNA, 19 bp, Homo sapiens
ggaagaaagagaaggagcc

SEQ ID NO: 494842 - DNA, 23 bp, Homo sapiens
ggaagacagagacctcctgcctc

SEQ ID NO: 494843 - DNA, 20 bp, Homo sapiens
ggaaggaatgtcagggccag

SEQ ID NO: 494844 - DNA, 17 bp, Homo sapiens
ggaagggcatccttctg

SEQ ID NO: 494845 - DNA, 23 bp, Homo sapiens
ggaagtaacagtaacgcagggga

SEQ ID NO: 494846 - DNA, 13 bp, Homo sapiens
ggaagtcctctgg

SEQ ID NO: 494847 - DNA, 17 bp, Homo sapiens
ggaagttcaggctctga

SEQ ID NO: 494848 - DNA, 21 bp, Homo sapiens
ggaagttttgtggaggagctc

SEQ ID NO: 494849 - DNA, 18 bp, Homo sapiens
ggaatgcctgagtgcctg

SEQ ID NO: 494850 - DNA, 15 bp, Homo sapiens
ggaatgggggcagaa

SEQ ID NO: 494851 - DNA, 15 bp, Homo sapiens
ggaatgtcagggcca

SEQ ID NO: 494852 - DNA, 19 bp, Homo sapiens
ggaatgtcagggccaggtg

SEQ ID NO: 494853 - DNA, 12 bp, Homo sapiens
ggaatttgtaag

SEQ ID NO: 494854 - DNA, 14 bp, Homo sapiens
ggacaaataaagca

SEQ ID NO: 494855 - DNA, 15 bp, Homo sapiens
ggacagcccatctgc

SEQ ID NO: 494856 - DNA, 20 bp, Homo sapiens
ggacaggtgtgccgacagaa

SEQ ID NO: 494857 - DNA, 22 bp, Homo sapiens
ggacagttgcttttcagcatgg

SEQ ID NO: 494858 - DNA, 16 bp, Homo sapiens
ggacatttgctcatgg

SEQ ID NO: 494859 - DNA, 20 bp, Homo sapiens
ggacatttgctcatggaatt

SEQ ID NO: 494860 - DNA, 17 bp, Homo sapiens
ggaccaaggagatgaag

SEQ ID NO: 494861 - DNA, 17 bp, Homo sapiens
ggaccagcttttcccaa

SEQ ID NO: 494862 - DNA, 15 bp, Homo sapiens
ggacctttcagctgt

SEQ ID NO: 494863 - DNA, 18 bp, Homo sapiens
ggacggtgctccaggcag

SEQ ID NO: 494864 - DNA, 17 bp, Homo sapiens
ggactagaacctggagg

SEQ ID NO: 494865 - DNA, 17 bp, Homo sapiens
ggactcagctccccaga

SEQ ID NO: 494866 - DNA, 23 bp, Homo sapiens
ggactgcacagcgtcctgtccac

SEQ ID NO: 494867 - DNA, 21 bp, Homo sapiens
ggagacacaacaactcctagg

SEQ ID NO: 494868 - DNA, 18 bp, Homo sapiens
ggagactcctaggcagga

SEQ ID NO: 494869 - DNA, 21 bp, Homo sapiens
ggagactcctaggcaggacat

SEQ ID NO: 494870 - DNA, 20 bp, Homo sapiens
gagggctagaatctggagag

SEQ ID NO: 494871 - DNA, 15 bp, Homo sapiens
gagggctggaatctg

SEQ ID NO: 494872 - DNA, 16 bp, Homo sapiens
gagggtaataaactta

SEQ ID NO: 494873 - DNA, 13 bp, Homo sapiens
gaggttgcagtga

SEQ ID NO: 494874 - DNA, 21 bp, Homo sapiens
gagtaagcacctttagaatat

SEQ ID NO: 494875 - DNA, 17 bp, Homo sapiens
gagtagaaagacagagc

SEQ ID NO: 494876 - DNA, 14 bp, Homo sapiens
gagtattggtctcc

SEQ ID NO: 494877 - DNA, 18 bp, Homo sapiens
gagtccacgcccaccagc

SEQ ID NO: 494878 - DNA, 20 bp, Homo sapiens
gagtccacgcccaccagcct

SEQ ID NO: 494879 - DNA, 21 bp, Homo sapiens
gagtcccttaatcttatgggg

SEQ ID NO: 494880 - DNA, 21 bp, Homo sapiens
gagtctgctatattttcatga

SEQ ID NO: 494881 - DNA, 14 bp, Homo sapiens
gagtgcctggccaa

SEQ ID NO: 494882 - DNA, 17 bp, Homo sapiens
gagtggaggaggcctgg

SEQ ID NO: 494883 - DNA, 18 bp, Homo sapiens
gagtggaggaggcctggg

SEQ ID NO: 494884 - DNA, 15 bp, Homo sapiens
gagttgttgccctgg

SEQ ID NO: 494885 - DNA, 18 bp, Homo sapiens
gataatattgtggtgcca

SEQ ID NO: 494886 - DNA, 23 bp, Homo sapiens
gataggcaggaacatacagacac

SEQ ID NO: 494887 - DNA, 14 bp, Homo sapiens
gatatgggctttct

SEQ ID NO: 494888 - DNA, 15 bp, Homo sapiens
gatatgggctttctc

SEQ ID NO: 494889 - DNA, 22 bp, Homo sapiens
gatatgttaaatgtatagctgg

SEQ ID NO: 494890 - DNA, 18 bp, Homo sapiens
gatcaaggagaggaggca

SEQ ID NO: 494891 - DNA, 13 bp, Homo sapiens
gatccccaactgc

SEQ ID NO: 494892 - DNA, 15 bp, Homo sapiens
gatccccaactgctc

SEQ ID NO: 494893 - DNA, 16 bp, Homo sapiens
gatccccaactgctcc

SEQ ID NO: 494894 - DNA, 20 bp, Homo sapiens
gatcgagaccatcctggcca

SEQ ID NO: 494895 - DNA, 14 bp, Homo sapiens
gatctatcacctgt

SEQ ID NO: 494896 - DNA, 15 bp, Homo sapiens
gatctatcacctgtc

SEQ ID NO: 494897 - DNA, 16 bp, Homo sapiens
gatcttttcaagttaa

SEQ ID NO: 494898 - DNA, 20 bp, Homo sapiens
gatgaaatcttacagctggg

SEQ ID NO: 494899 - DNA, 15 bp, Homo sapiens
gatgaagcaaacaca

SEQ ID NO: 494900 - DNA, 16 bp, Homo sapiens
gatgaagcaaacacat

SEQ ID NO: 494901 - DNA, 15 bp, Homo sapiens
gatgagcatggagct

SEQ ID NO: 494902 - DNA, 13 bp, Homo sapiens
gatgaggcagagg

SEQ ID NO: 494903 - DNA, 16 bp, Homo sapiens
gatgatggcagagcca

SEQ ID NO: 494904 - DNA, 19 bp, Homo sapiens
gatgatggcagagccaggc

SEQ ID NO: 494905 - DNA, 17 bp, Homo sapiens
gatgatgtgcctgggtg

SEQ ID NO: 494906 - DNA, 22 bp, Homo sapiens
gatgatttcttgaaaagggtgt

SEQ ID NO: 494907 - DNA, 17 bp, Homo sapiens
gatgcagcaaaatgtga

SEQ ID NO: 494908 - DNA, 22 bp, Homo sapiens
gatgcaggtgagcccatggccc

SEQ ID NO: 494909 - DNA, 11 bp, Homo sapiens
gatgctgggat

SEQ ID NO: 494910 - DNA, 14 bp, Homo sapiens
gatggcagagccag

SEQ ID NO: 494911 - DNA, 13 bp, Homo sapiens
gatggcaggatgg

SEQ ID NO: 494912 - DNA, 17 bp, Homo sapiens
gatgggggaaagcacag

SEQ ID NO: 494913 - DNA, 22 bp, Homo sapiens
gatggttcccttgatgaagaag

SEQ ID NO: 494914 - DNA, 13 bp, Homo sapiens
gatgtcatcttga

SEQ ID NO: 494915 - DNA, 17 bp, Homo sapiens
gatgtcctcaccacatg

SEQ ID NO: 494916 - DNA, 20 bp, Homo sapiens
gatgtgggggaagacctggc

SEQ ID NO: 494917 - DNA, 17 bp, Homo sapiens
gatgtgggtcaaggaat

SEQ ID NO: 494918 - DNA, 21 bp, Homo sapiens
gattatataaagacctataaa

SEQ ID NO: 494919 - DNA, 23 bp, Homo sapiens
gattatttgttatttgtacagtt

SEQ ID NO: 494920 - DNA, 21 bp, Homo sapiens
gattcctttgaagaggaaaat

SEQ ID NO: 494921 - DNA, 12 bp, Homo sapiens
gattctcagggt

SEQ ID NO: 494922 - DNA, 21 bp, Homo sapiens
gattctcagggtctctgctgc

SEQ ID NO: 494923 - DNA, 22 bp, Homo sapiens
gattggagatagggaaagaaag

SEQ ID NO: 494924 - DNA, 13 bp, Homo sapiens
gattgggacagag

SEQ ID NO: 494925 - DNA, 17 bp, Homo sapiens
gatttatttatttctac

SEQ ID NO: 494926 - DNA, 18 bp, Homo sapiens
gatttccagccagggctg

SEQ ID NO: 494927 - DNA, 19 bp, Homo sapiens
gatttccagccagggctgc

SEQ ID NO: 494928 - DNA, 22 bp, Homo sapiens
gatttgaggagcagcttcagtt

SEQ ID NO: 494929 - DNA, 12 bp, Homo sapiens
gatttgggctgg

SEQ ID NO: 494930 - DNA, 14 bp, Homo sapiens
gattttgagtatct

SEQ ID NO: 494931 - DNA, 16 bp, Homo sapiens
gcaaaacccacagaag

SEQ ID NO: 494932 - DNA, 22 bp, Homo sapiens
gcaaagactattcccttctaac

SEQ ID NO: 494933 - DNA, 21 bp, Homo sapiens
gcaaagtcatgcaaaggctgg

SEQ ID NO: 494934 - DNA, 14 bp, Homo sapiens
gcaaagtctaaagt

SEQ ID NO: 494935 - DNA, 14 bp, Homo sapiens
gcaaatgcccaagg

SEQ ID NO: 494936 - DNA, 14 bp, Homo sapiens
gcaaattccaatac

SEQ ID NO: 494937 - DNA, 19 bp, Homo sapiens
gcaacagcaaatcacgacc

SEQ ID NO: 494938 - DNA, 16 bp, Homo sapiens
gcaactagtggagaga

SEQ ID NO: 494939 - DNA, 16 bp, Homo sapiens
gcaagaccctgtctct

SEQ ID NO: 494940 - DNA, 19 bp, Homo sapiens
gcaagctagaacctggagg

SEQ ID NO: 494941 - DNA, 22 bp, Homo sapiens
ggagagctagaacccggcaggc

SEQ ID NO: 494942 - DNA, 16 bp, Homo sapiens
ggagagctagaacctg

SEQ ID NO: 494943 - DNA, 18 bp, Homo sapiens
ggagagctagaacctgga

SEQ ID NO: 494944 - DNA, 20 bp, Homo sapiens
ggagatcaaggagaggaggc

SEQ ID NO: 494945 - DNA, 19 bp, Homo sapiens
ggagatgaagcaaacacat

SEQ ID NO: 494946 - DNA, 16 bp, Homo sapiens
ggagattttccttcct

SEQ ID NO: 494947 - DNA, 14 bp, Homo sapiens
ggagcagtgcaggc

SEQ ID NO: 494948 - DNA, 19 bp, Homo sapiens
ggagcatttggagagaagg

SEQ ID NO: 494949 - DNA, 23 bp, Homo sapiens
ggagcccgtgccctaccacacat

SEQ ID NO: 494950 - DNA, 14 bp, Homo sapiens
ggagcctcagactc

SEQ ID NO: 494951 - DNA, 17 bp, Homo sapiens
ggagctcagagagggca

SEQ ID NO: 494952 - DNA, 21 bp, Homo sapiens
ggagctggccgtgggcctggg

SEQ ID NO: 494953 - DNA, 16 bp, Homo sapiens
ggaggactagaacctg

SEQ ID NO: 494954 - DNA, 17 bp, Homo sapiens
ggaggccgaggcacgag

SEQ ID NO: 494955 - DNA, 18 bp, Homo sapiens
ggaggcctgggggcaggg

SEQ ID NO: 494956 - DNA, 17 bp, Homo sapiens
ggaggccttccagggac

SEQ ID NO: 494957 - DNA, 15 bp, Homo sapiens
ggaggctgaggcagg

SEQ ID NO: 494958 - DNA, 21 bp, Homo sapiens
ggagggaatgaacctggaggg

SEQ ID NO: 494959 - DNA, 21 bp, Homo sapiens
ggagggcacattccttgcctg

SEQ ID NO: 494960 - DNA, 16 bp, Homo sapiens
ggagggctagaacctg

SEQ ID NO: 494961 - DNA, 23 bp, Homo sapiens
ggagggctagaacctggcaggtt

SEQ ID NO: 494962 - DNA, 19 bp, Homo sapiens
ggagggctagaactggaga

SEQ ID NO: 494963 - DNA, 20 bp, Homo sapiens
ggagggctagaatctggaga

SEQ ID NO: 494964 - DNA, 22 bp, Homo sapiens
ggagggctagaatctggagagc

SEQ ID NO: 494965 - DNA, 16 bp, Homo sapiens
ggagggctggaatctg

SEQ ID NO: 494966 - DNA, 13 bp, Homo sapiens
ggagtggaggcat

SEQ ID NO: 494967 - DNA, 17 bp, Homo sapiens
ggagtggaggcattgtt

SEQ ID NO: 494968 - DNA, 13 bp, Homo sapiens
ggatatgtggaga

SEQ ID NO: 494969 - DNA, 14 bp, Homo sapiens
ggatccacacctgg

SEQ ID NO: 494970 - DNA, 23 bp, Homo sapiens
ggatctctctagtgatggtcaga

SEQ ID NO: 494971 - DNA, 19 bp, Homo sapiens
ggatgagcatggagctggc

SEQ ID NO: 494972 - DNA, 20 bp, Homo sapiens
ggatgagcatggagctggcc

SEQ ID NO: 494973 - DNA, 20 bp, Homo sapiens
ggatgatggcagagccaggc

SEQ ID NO: 494974 - DNA, 21 bp, Homo sapiens
ggatgctcctcccttctctac

SEQ ID NO: 494975 - DNA, 13 bp, Homo sapiens
ggatggtgccctg

SEQ ID NO: 494976 - DNA, 23 bp, Homo sapiens
ggatggttcccttgatgaagaag

SEQ ID NO: 494977 - DNA, 18 bp, Homo sapiens
ggatgtatatgtcatctc

SEQ ID NO: 494978 - DNA, 14 bp, Homo sapiens
ggatgttgctcaga

SEQ ID NO: 494979 - DNA, 18 bp, Homo sapiens
ggattggggaagactgtg

SEQ ID NO: 494980 - DNA, 21 bp, Homo sapiens
ggatttgaggagcagcttcag

SEQ ID NO: 494981 - DNA, 16 bp, Homo sapiens
ggcaaatgcccaaggg

SEQ ID NO: 494982 - DNA, 20 bp, Homo sapiens
ggcaacagagcaagactctg

SEQ ID NO: 494983 - DNA, 13 bp, Homo sapiens
ggcaactgaggca

SEQ ID NO: 494984 - DNA, 19 bp, Homo sapiens
ggcaactgaggcagacagc

SEQ ID NO: 494985 - DNA, 14 bp, Homo sapiens
ggcaaggacacaga

SEQ ID NO: 494986 - DNA, 16 bp, Homo sapiens
ggcaaggacacagatg

SEQ ID NO: 494987 - DNA, 13 bp, Homo sapiens
ggcaaggctgtgc

SEQ ID NO: 494988 - DNA, 17 bp, Homo sapiens
ggcacaaagggcccaga

SEQ ID NO: 494989 - DNA, 17 bp, Homo sapiens
atccctccctccacctc

SEQ ID NO: 494990 - DNA, 21 bp, Homo sapiens
atccctccctccacctccctg

SEQ ID NO: 494991 - DNA, 14 bp, Homo sapiens
atcccttctcagaa

SEQ ID NO: 494992 - DNA, 13 bp, Homo sapiens
atccgaggcaggg

SEQ ID NO: 494993 - DNA, 16 bp, Homo sapiens
atcctcaaacactgca

SEQ ID NO: 494994 - DNA, 17 bp, Homo sapiens
atccttcctcacaccag

SEQ ID NO: 494995 - DNA, 16 bp, Homo sapiens
atcgcttgaacctggg

SEQ ID NO: 494996 - DNA, 19 bp, Homo sapiens
atctagacccatcttcttt

SEQ ID NO: 494997 - DNA, 14 bp, Homo sapiens
atctatcacctgtc

SEQ ID NO: 494998 - DNA, 16 bp, Homo sapiens
atctatcacctgtcat

SEQ ID NO: 494999 - DNA, 15 bp, Homo sapiens
atctgaaggagattt

SEQ ID NO: 495000 - DNA, 17 bp, Homo sapiens
atctgatggcttctcca

SEQ ID NO: 495001 - DNA, 18 bp, Homo sapiens
atctgatggcttctccag

SEQ ID NO: 495002 - DNA, 20 bp, Homo sapiens
atctggagagctagaacctg

SEQ ID NO: 495003 - DNA, 22 bp, Homo sapiens
atctggagagctagaacctgga

SEQ ID NO: 495004 - DNA, 18 bp, Homo sapiens
atctgggcatagatgcag

SEQ ID NO: 495005 - DNA, 16 bp, Homo sapiens
atctgtccctgcctca

SEQ ID NO: 495006 - DNA, 13 bp, Homo sapiens
atctgtttcccag

SEQ ID NO: 495007 - DNA, 14 bp, Homo sapiens
atctgtttcccagc

SEQ ID NO: 495008 - DNA, 14 bp, Homo sapiens
atctttgccaccct

SEQ ID NO: 495009 - DNA, 13 bp, Homo sapiens
atgaaatattatg

SEQ ID NO: 495010 - DNA, 17 bp, Homo sapiens
atgaaatattatgttaa

SEQ ID NO: 495011 - DNA, 21 bp, Homo sapiens
atgaaatattatgttaaaact

SEQ ID NO: 495012 - DNA, 18 bp, Homo sapiens
atgaaatcttacagctgg

SEQ ID NO: 495013 - DNA, 17 bp, Homo sapiens
atgaacatcatggactg

SEQ ID NO: 495014 - DNA, 15 bp, Homo sapiens
atgaagcaaacacat

SEQ ID NO: 495015 - DNA, 18 bp, Homo sapiens
atgaagtcgttgtgaggg

SEQ ID NO: 495016 - DNA, 15 bp, Homo sapiens
atgaagttgtaggta

SEQ ID NO: 495017 - DNA, 19 bp, Homo sapiens
atgaagtttccttggctgg

SEQ ID NO: 495018 - DNA, 15 bp, Homo sapiens
atgaattacatttgt

SEQ ID NO: 495019 - DNA, 16 bp, Homo sapiens
atgaattacatttgta

SEQ ID NO: 495020 - DNA, 19 bp, Homo sapiens
atgacaagtgagacaaaaa

SEQ ID NO: 495021 - DNA, 14 bp, Homo sapiens
atgacagctgttcc

SEQ ID NO: 495022 - DNA, 19 bp, Homo sapiens
atgaccagtaattgtgaaa

SEQ ID NO: 495023 - DNA, 22 bp, Homo sapiens
atgacccaggctgggcaaggag

SEQ ID NO: 495024 - DNA, 13 bp, Homo sapiens
atgagagacacac

SEQ ID NO: 495025 - DNA, 14 bp, Homo sapiens
atgagagacacact

SEQ ID NO: 495026 - DNA, 14 bp, Homo sapiens
atgagcatcccagg

SEQ ID NO: 495027 - DNA, 13 bp, Homo sapiens
atgaggcagagga

SEQ ID NO: 495028 - DNA, 15 bp, Homo sapiens
atgagtaaatgaata

SEQ ID NO: 495029 - DNA, 17 bp, Homo sapiens
atgagtgcgtgctcagt

SEQ ID NO: 495030 - DNA, 14 bp, Homo sapiens
atgcaaattctcaa

SEQ ID NO: 495031 - DNA, 14 bp, Homo sapiens
atgcaacaacatgt

SEQ ID NO: 495032 - DNA, 14 bp, Homo sapiens
atgcacgaccttgg

SEQ ID NO: 495033 - DNA, 13 bp, Homo sapiens
atgcagaaggaag

SEQ ID NO: 495034 - DNA, 17 bp, Homo sapiens
atgcagcatctaagtaa

SEQ ID NO: 495035 - DNA, 13 bp, Homo sapiens
atgcagttctgaa

SEQ ID NO: 495036 - DNA, 23 bp, Homo sapiens
atgcatagtcccagctacccagg

SEQ ID NO: 495037 - DNA, 19 bp, Homo sapiens
atgcatgttttccagctcc

SEQ ID NO: 495038 - DNA, 17 bp, Homo sapiens
atgccaagcactgtgct

SEQ ID NO: 495039 - DNA, 19 bp, Homo sapiens
atgccaagcactgtgctca

SEQ ID NO: 495040 - DNA, 21 bp, Homo sapiens
atgccaagcactgtgctcagg

SEQ ID NO: 495041 - DNA, 14 bp, Homo sapiens
atgccatatttttg

SEQ ID NO: 495042 - DNA, 23 bp, Homo sapiens
atgccatcctcaaacactgcagg

SEQ ID NO: 495043 - DNA, 19 bp, Homo sapiens
atgccctaaaatgtagtga

SEQ ID NO: 495044 - DNA, 23 bp, Homo sapiens
atgctaaaggttgtattgcatat

SEQ ID NO: 495045 - DNA, 19 bp, Homo sapiens
atgctgtattttaaaagaa

SEQ ID NO: 495046 - DNA, 19 bp, Homo sapiens
atggaaaggagaggaaaga

SEQ ID NO: 495047 - DNA, 14 bp, Homo sapiens
atggaagacacatt

SEQ ID NO: 495048 - DNA, 12 bp, Homo sapiens
atggaatttgta

SEQ ID NO: 495049 - DNA, 20 bp, Homo sapiens
atggacagaagaaggcagca

SEQ ID NO: 495050 - DNA, 21 bp, Homo sapiens
atggacagtgggcatcagcag

SEQ ID NO: 495051 - DNA, 21 bp, Homo sapiens
atggacggtgctccaggcagg

SEQ ID NO: 495052 - DNA, 17 bp, Homo sapiens
atggactcttcccccac

SEQ ID NO: 495053 - DNA, 23 bp, Homo sapiens
atggagagctggagcctggtgcc

SEQ ID NO: 495054 - DNA, 14 bp, Homo sapiens
atggagctcagaga

SEQ ID NO: 495055 - DNA, 13 bp, Homo sapiens
atggagctggccg

SEQ ID NO: 495056 - DNA, 23 bp, Homo sapiens
atggcacagcccaaagaaggaaa

SEQ ID NO: 495057 - DNA, 13 bp, Homo sapiens
atggcagagccag

SEQ ID NO: 495058 - DNA, 16 bp, Homo sapiens
atggcagagccaggct

SEQ ID NO: 495059 - DNA, 22 bp, Homo sapiens
atggcagagccaggctgttgga

SEQ ID NO: 495060 - DNA, 12 bp, Homo sapiens
atggcctggcca

SEQ ID NO: 495061 - DNA, 20 bp, Homo sapiens
atggcggtgatcagcagaga

SEQ ID NO: 495062 - DNA, 18 bp, Homo sapiens
atggctctaaaaagtttt

SEQ ID NO: 495063 - DNA, 14 bp, Homo sapiens
atggctgtgaggat

SEQ ID NO: 495064 - DNA, 15 bp, Homo sapiens
atggctgtgaggatg

SEQ ID NO: 495065 - DNA, 17 bp, Homo sapiens
atggcttatccagctgg

SEQ ID NO: 495066 - DNA, 18 bp, Homo sapiens
atggcttatccagctggt

SEQ ID NO: 495067 - DNA, 23 bp, Homo sapiens
atggcttcctggcaatagtcaaa

SEQ ID NO: 495068 - DNA, 18 bp, Homo sapiens
atgggaatcaagatttaa

SEQ ID NO: 495069 - DNA, 19 bp, Homo sapiens
atgggactgatgtcatctt

SEQ ID NO: 495070 - DNA, 21 bp, Homo sapiens
atgggactgatgtcatcttga

SEQ ID NO: 495071 - DNA, 21 bp, Homo sapiens
atgggactggagtccctgtga

SEQ ID NO: 495072 - DNA, 16 bp, Homo sapiens
atgggcttagagcagt

SEQ ID NO: 495073 - DNA, 15 bp, Homo sapiens
atgggctttctcttt

SEQ ID NO: 495074 - DNA, 22 bp, Homo sapiens
atgggctttctctttggtttct

SEQ ID NO: 495075 - DNA, 16 bp, Homo sapiens
atgggggaaagcacag

SEQ ID NO: 495076 - DNA, 16 bp, Homo sapiens
atggtgatgaaatgta

SEQ ID NO: 495077 - DNA, 18 bp, Homo sapiens
atggtggcacacgcctgt

SEQ ID NO: 495078 - DNA, 21 bp, Homo sapiens
atggttcccttgatgaagaag

SEQ ID NO: 495079 - DNA, 18 bp, Homo sapiens
atggttgcacgttaaaaa

SEQ ID NO: 495080 - DNA, 16 bp, Homo sapiens
atggtttgcaaggaag

SEQ ID NO: 495081 - DNA, 17 bp, Homo sapiens
atggtttgcaaggaagc

SEQ ID NO: 495082 - DNA, 18 bp, Homo sapiens
atggtttgcaaggaagcc

SEQ ID NO: 495083 - DNA, 13 bp, Homo sapiens
atgtaagaatcat

SEQ ID NO: 495084 - DNA, 16 bp, Homo sapiens
atgtacttcatgctgt

SEQ ID NO: 495085 - DNA, 13 bp, Homo sapiens
atgtagaagctgc

SEQ ID NO: 495086 - DNA, 16 bp, Homo sapiens
atgtagataaagcact

SEQ ID NO: 495087 - DNA, 22 bp, Homo sapiens
atgtagcaaattccaatacatt

SEQ ID NO: 495088 - DNA, 14 bp, Homo sapiens
atgtataatatttt

SEQ ID NO: 495089 - DNA, 14 bp, Homo sapiens
atgtcatcttgagc

SEQ ID NO: 495090 - DNA, 13 bp, Homo sapiens
atgtctaaagagc

SEQ ID NO: 495091 - DNA, 16 bp, Homo sapiens
atgtcttttcaaaagg

SEQ ID NO: 495092 - DNA, 20 bp, Homo sapiens
atgtgctagtaattggaaag

SEQ ID NO: 495093 - DNA, 23 bp, Homo sapiens
atgttagaggatccctctctgga

SEQ ID NO: 495094 - DNA, 18 bp, Homo sapiens
atgttgtaaacaggaagc

SEQ ID NO: 495095 - DNA, 21 bp, Homo sapiens
atgtttcaaacatatataaca

SEQ ID NO: 495096 - DNA, 19 bp, Homo sapiens
atgttttccagctcctcat

SEQ ID NO: 495097 - DNA, 12 bp, Homo sapiens
attaaagttcta

SEQ ID NO: 495098 - DNA, 20 bp, Homo sapiens
attaaatatgttagcaaaga

SEQ ID NO: 495099 - DNA, 13 bp, Homo sapiens
attaaatttttcc

SEQ ID NO: 495100 - DNA, 15 bp, Homo sapiens
attaagtaatgataa

SEQ ID NO: 495101 - DNA, 22 bp, Homo sapiens
attaattctttatcacatgttg

SEQ ID NO: 495102 - DNA, 15 bp, Homo sapiens
attacaacagtgaga

SEQ ID NO: 495103 - DNA, 20 bp, Homo sapiens
attacatttgtataaaataa

SEQ ID NO: 495104 - DNA, 15 bp, Homo sapiens
attactgtaagaaaa

SEQ ID NO: 495105 - DNA, 15 bp, Homo sapiens
attagatgactgaat

SEQ ID NO: 495106 - DNA, 18 bp, Homo sapiens
attagatgactgaatttc

SEQ ID NO: 495107 - DNA, 18 bp, Homo sapiens
attatatttattactgta

SEQ ID NO: 495108 - DNA, 22 bp, Homo sapiens
attatattttgaacaactcgaa

SEQ ID NO: 495109 - DNA, 21 bp, Homo sapiens
attatgatgtgggtcaaggaa

SEQ ID NO: 495110 - DNA, 18 bp, Homo sapiens
attattggacttccattt

SEQ ID NO: 495111 - DNA, 23 bp, Homo sapiens
attattgtgtgttatttaaatga

SEQ ID NO: 495112 - DNA, 19 bp, Homo sapiens
attcaaaaattatattttg

SEQ ID NO: 495113 - DNA, 22 bp, Homo sapiens
attcaaaaattatattttgaac

SEQ ID NO: 495114 - DNA, 12 bp, Homo sapiens
attcaagtatta

SEQ ID NO: 495115 - DNA, 21 bp, Homo sapiens
attcactcatacatctggccg

SEQ ID NO: 495116 - DNA, 17 bp, Homo sapiens
attcaggggctgggggt

SEQ ID NO: 495117 - DNA, 19 bp, Homo sapiens
attcatcaaatggaagaca

SEQ ID NO: 495118 - DNA, 17 bp, Homo sapiens
attcatctctctttaat

SEQ ID NO: 495119 - DNA, 14 bp, Homo sapiens
attcatgcctggct

SEQ ID NO: 495120 - DNA, 13 bp, Homo sapiens
attcattccattt

SEQ ID NO: 495121 - DNA, 16 bp, Homo sapiens
attcccttcatctgga

SEQ ID NO: 495122 - DNA, 23 bp, Homo sapiens
attccttagcttagacctcagcc

SEQ ID NO: 495123 - DNA, 19 bp, Homo sapiens
attctaacttttttgctat

SEQ ID NO: 495124 - DNA, 13 bp, Homo sapiens
attctacacagag

SEQ ID NO: 495125 - DNA, 15 bp, Homo sapiens
attctagctttgagc

SEQ ID NO: 495126 - DNA, 16 bp, Homo sapiens
attctcagggtctctg

SEQ ID NO: 495127 - DNA, 19 bp, Homo sapiens
attctcagggtctctgctg

SEQ ID NO: 495128 - DNA, 20 bp, Homo sapiens
attctcagggtctctgctgc

SEQ ID NO: 495129 - DNA, 21 bp, Homo sapiens
attctcagggtctctgctgcc

SEQ ID NO: 495130 - DNA, 16 bp, Homo sapiens
attctgacccagggcc

SEQ ID NO: 495131 - DNA, 14 bp, Homo sapiens
aggattcaggggct

SEQ ID NO: 495132 - DNA, 14 bp, Homo sapiens
aggcaactgaggca

SEQ ID NO: 495133 - DNA, 16 bp, Homo sapiens
aggcaactgaggcaga

SEQ ID NO: 495134 - DNA, 19 bp, Homo sapiens
aggcaactgaggcagacag

SEQ ID NO: 495135 - DNA, 16 bp, Homo sapiens
aggcaccatagaagaa

SEQ ID NO: 495136 - DNA, 13 bp, Homo sapiens
aggcactgcctga

SEQ ID NO: 495137 - DNA, 18 bp, Homo sapiens
aggcagacagcagctcag

SEQ ID NO: 495138 - DNA, 20 bp, Homo sapiens
aggcagacagcagctcaggc

SEQ ID NO: 495139 - DNA, 20 bp, Homo sapiens
aggcagctttttctctccca

SEQ ID NO: 495140 - DNA, 15 bp, Homo sapiens
aggcaggaacataca

SEQ ID NO: 495141 - DNA, 14 bp, Homo sapiens
aggcaggacatgct

SEQ ID NO: 495142 - DNA, 22 bp, Homo sapiens
aggcaggcacctgggctttctg

SEQ ID NO: 495143 - DNA, 14 bp, Homo sapiens
aggcagggatttga

SEQ ID NO: 495144 - DNA, 19 bp, Homo sapiens
aggcagggtcaggagaggg

SEQ ID NO: 495145 - DNA, 18 bp, Homo sapiens
aggcatccttcctcacac

SEQ ID NO: 495146 - DNA, 14 bp, Homo sapiens
aggcatgacagctg

SEQ ID NO: 495147 - DNA, 19 bp, Homo sapiens
aggccacgtgatgtggagg

SEQ ID NO: 495148 - DNA, 19 bp, Homo sapiens
aggccagctgccccagcca

SEQ ID NO: 495149 - DNA, 18 bp, Homo sapiens
aggccagggatagaggat

SEQ ID NO: 495150 - DNA, 17 bp, Homo sapiens
aggccatggagagctgg

SEQ ID NO: 495151 - DNA, 23 bp, Homo sapiens
aggccatgggcactgtgggtaga

SEQ ID NO: 495152 - DNA, 15 bp, Homo sapiens
aggcctgctcaggga

SEQ ID NO: 495153 - DNA, 17 bp, Homo sapiens
aggcctgggggcaggga

SEQ ID NO: 495154 - DNA, 23 bp, Homo sapiens
aggcctgtgtgttgccaggcagg

SEQ ID NO: 495155 - DNA, 15 bp, Homo sapiens
aggcgggaaggaggg

SEQ ID NO: 495156 - DNA, 15 bp, Homo sapiens
aggcgtggagctgcc

SEQ ID NO: 495157 - DNA, 17 bp, Homo sapiens
aggcgtggagctgcctg

SEQ ID NO: 495158 - DNA, 18 bp, Homo sapiens
aggctaaggcgtggagct

SEQ ID NO: 495159 - DNA, 19 bp, Homo sapiens
aggctaaggcgtggagctg

SEQ ID NO: 495160 - DNA, 23 bp, Homo sapiens
aggctaaggcgtggagctgcctg

SEQ ID NO: 495161 - DNA, 13 bp, Homo sapiens
aggctacactgac

SEQ ID NO: 495162 - DNA, 17 bp, Homo sapiens
aggctacctcacctggg

SEQ ID NO: 495163 - DNA, 21 bp, Homo sapiens
aggctacctcacctgggcagg

SEQ ID NO: 495164 - DNA, 16 bp, Homo sapiens
aggctcttctccccag

SEQ ID NO: 495165 - DNA, 17 bp, Homo sapiens
aggctcttctccccaga

SEQ ID NO: 495166 - DNA, 19 bp, Homo sapiens
aggctcttctccccagagt

SEQ ID NO: 495167 - DNA, 16 bp, Homo sapiens
aggctgagaacactgt

SEQ ID NO: 495168 - DNA, 19 bp, Homo sapiens
aggctgagaacactgtgaa

SEQ ID NO: 495169 - DNA, 17 bp, Homo sapiens
aggctgggaccacgtga

SEQ ID NO: 495170 - DNA, 13 bp, Homo sapiens
aggctgggcaagg

SEQ ID NO: 495171 - DNA, 21 bp, Homo sapiens
aggctggggaagtcctctggg

SEQ ID NO: 495172 - DNA, 13 bp, Homo sapiens
aggctgtgctccc

SEQ ID NO: 495173 - DNA, 23 bp, Homo sapiens
aggctgttggaaaatccagaact

SEQ ID NO: 495174 - DNA, 15 bp, Homo sapiens
aggcttagctttgct

SEQ ID NO: 495175 - DNA, 16 bp, Homo sapiens
aggcttgcctgcaggc

SEQ ID NO: 495176 - DNA, 17 bp, Homo sapiens
aggcttgcctgcaggca

SEQ ID NO: 495177 - DNA, 19 bp, Homo sapiens
agggaaagaaaaggaaggc

SEQ ID NO: 495178 - DNA, 21 bp, Homo sapiens
agggaatgcctgagtgcctgg

SEQ ID NO: 495179 - DNA, 15 bp, Homo sapiens
agggaatggcacagc

SEQ ID NO: 495180 - DNA, 21 bp, Homo sapiens
agggagaagactatattgtac

SEQ ID NO: 495181 - DNA, 17 bp, Homo sapiens
agggatgaaagagaagg

SEQ ID NO: 495182 - DNA, 19 bp, Homo sapiens
agggattttagtcacacgt

SEQ ID NO: 495183 - DNA, 20 bp, Homo sapiens
agggcacattccttgcctgc

SEQ ID NO: 495184 - DNA, 18 bp, Homo sapiens
agggccaggtgcagacct

SEQ ID NO: 495185 - DNA, 22 bp, Homo sapiens
agggccaggtgcagaccttggg

SEQ ID NO: 495186 - DNA, 16 bp, Homo sapiens
agggccctgagctcgg

SEQ ID NO: 495187 - DNA, 19 bp, Homo sapiens
agggcctggaagacagaga

SEQ ID NO: 495188 - DNA, 21 bp, Homo sapiens
agggctagaacctagaagggc

SEQ ID NO: 495189 - DNA, 17 bp, Homo sapiens
agggctagaacctggag

SEQ ID NO: 495190 - DNA, 18 bp, Homo sapiens
agggctagaacctggaga

SEQ ID NO: 495191 - DNA, 19 bp, Homo sapiens
agggctagaacctggagaa

SEQ ID NO: 495192 - DNA, 18 bp, Homo sapiens
agggctagaacctggcag

SEQ ID NO: 495193 - DNA, 22 bp, Homo sapiens
agggctagaacctgtagagcta

SEQ ID NO: 495194 - DNA, 20 bp, Homo sapiens
agggctagaatctggagagc

SEQ ID NO: 495195 - DNA, 14 bp, Homo sapiens
agggctcagcctgg

SEQ ID NO: 495196 - DNA, 14 bp, Homo sapiens
agggctctgaccag

SEQ ID NO: 495197 - DNA, 15 bp, Homo sapiens
agggctctgaccagt

SEQ ID NO: 495198 - DNA, 13 bp, Homo sapiens
agggctgctgtga

SEQ ID NO: 495199 - DNA, 16 bp, Homo sapiens
aggggaattgaggaca

SEQ ID NO: 495200 - DNA, 20 bp, Homo sapiens
aggggcgctcgcttccgcat

SEQ ID NO: 495201 - DNA, 15 bp, Homo sapiens
aggggctatcccttc

SEQ ID NO: 495202 - DNA, 15 bp, Homo sapiens
aggggctcagttctg

SEQ ID NO: 495203 - DNA, 20 bp, Homo sapiens
aggggctgggggtgctggat

SEQ ID NO: 495204 - DNA, 19 bp, Homo sapiens
aggggtaatatattgctgc

SEQ ID NO: 495205 - DNA, 17 bp, Homo sapiens
aggggtcaccttgagag

SEQ ID NO: 495206 - DNA, 14 bp, Homo sapiens
agggtcaggagagg

SEQ ID NO: 495207 - DNA, 13 bp, Homo sapiens
agggtctctgctg

SEQ ID NO: 495208 - DNA, 15 bp, Homo sapiens
agggtgagacactgc

SEQ ID NO: 495209 - DNA, 23 bp, Homo sapiens
agggtgctacgtacatgtgaggc

SEQ ID NO: 495210 - DNA, 15 bp, Homo sapiens
agggtggtggagcca

SEQ ID NO: 495211 - DNA, 15 bp, Homo sapiens
agggttagggagggg

SEQ ID NO: 495212 - DNA, 17 bp, Homo sapiens
agggttccactggagaa

SEQ ID NO: 495213 - DNA, 23 bp, Homo sapiens
aggtacttcaaatccttgaagat

SEQ ID NO: 495214 - DNA, 23 bp, Homo sapiens
aggtggcctctccttgtggcctg

SEQ ID NO: 495215 - DNA, 18 bp, Homo sapiens
aggttagaacctagaagg

SEQ ID NO: 495216 - DNA, 14 bp, Homo sapiens
aggttgcagtgagc

SEQ ID NO: 495217 - DNA, 16 bp, Homo sapiens
aggttgttcctaaaat

SEQ ID NO: 495218 - DNA, 23 bp, Homo sapiens
aggtttctgaaaattaacactgc

SEQ ID NO: 495219 - DNA, 22 bp, Homo sapiens
aggtttctggtctctaggctgg

SEQ ID NO: 495220 - DNA, 13 bp, Homo sapiens
agtaaagacatag

SEQ ID NO: 495221 - DNA, 16 bp, Homo sapiens
agtaaataaattgttt

SEQ ID NO: 495222 - DNA, 12 bp, Homo sapiens
agtaacctgggt

SEQ ID NO: 495223 - DNA, 13 bp, Homo sapiens
agtaatgataact

SEQ ID NO: 495224 - DNA, 18 bp, Homo sapiens
agtaatgataactggaaa

SEQ ID NO: 495225 - DNA, 20 bp, Homo sapiens
agtaatgataactggaaact

SEQ ID NO: 495226 - DNA, 12 bp, Homo sapiens
agtaattggaaa

SEQ ID NO: 495227 - DNA, 13 bp, Homo sapiens
agtaattggaaag

SEQ ID NO: 495228 - DNA, 13 bp, Homo sapiens
agtaattgtgaaa

SEQ ID NO: 495229 - DNA, 15 bp, Homo sapiens
agtacaagggctgag

SEQ ID NO: 495230 - DNA, 17 bp, Homo sapiens
agtagacgaacagctga

SEQ ID NO: 495231 - DNA, 20 bp, Homo sapiens
agtagcagtagatgcatgta

SEQ ID NO: 495232 - DNA, 17 bp, Homo sapiens
agtagctgctaccttct

SEQ ID NO: 495233 - DNA, 23 bp, Homo sapiens
agtatgcactaatcaatactttg

SEQ ID NO: 495234 - DNA, 18 bp, Homo sapiens
agtatgggttagggaaaa

SEQ ID NO: 495235 - DNA, 18 bp, Homo sapiens
agtattagaataccacag

SEQ ID NO: 495236 - DNA, 15 bp, Homo sapiens
agtatttctatgaaa

SEQ ID NO: 495237 - DNA, 17 bp, Homo sapiens
agtatttctatgaaata

SEQ ID NO: 495238 - DNA, 22 bp, Homo sapiens
agtatttctatgaaatattatg

SEQ ID NO: 495239 - DNA, 14 bp, Homo sapiens
agtcacatctcttc

SEQ ID NO: 495240 - DNA, 16 bp, Homo sapiens
agtcacatctcttcct

SEQ ID NO: 495241 - DNA, 17 bp, Homo sapiens
agtcacctcatggaatt

SEQ ID NO: 495242 - DNA, 18 bp, Homo sapiens
agtcatgcaaaggctggg

SEQ ID NO: 495243 - DNA, 19 bp, Homo sapiens
agtcatgcaaaggctggga

SEQ ID NO: 495244 - DNA, 19 bp, Homo sapiens
agtcatgcgtttaatcaca

SEQ ID NO: 495245 - DNA, 16 bp, Homo sapiens
agtcattgtaatcttt

SEQ ID NO: 495246 - DNA, 23 bp, Homo sapiens
agtccaaggaaaccacagctgct

SEQ ID NO: 495247 - DNA, 15 bp, Homo sapiens
agtccagcctggaga

SEQ ID NO: 495248 - DNA, 11 bp, Homo sapiens
agtcccagcta

SEQ ID NO: 495249 - DNA, 12 bp, Homo sapiens
agtctaaagttt

SEQ ID NO: 495250 - DNA, 18 bp, Homo sapiens
agtctaaagtttacagta

SEQ ID NO: 495251 - DNA, 17 bp, Homo sapiens
agtgactgttcaagagc

SEQ ID NO: 495252 - DNA, 21 bp, Homo sapiens
agtgagacagtccagcctgga

SEQ ID NO: 495253 - DNA, 18 bp, Homo sapiens
agtgagacccctgtctcc

SEQ ID NO: 495254 - DNA, 18 bp, Homo sapiens
agtgagttgttgccctgg

SEQ ID NO: 495255 - DNA, 19 bp, Homo sapiens
agtgagttgttgccctggg

SEQ ID NO: 495256 - DNA, 20 bp, Homo sapiens
agtgagttgttgccctgggt

SEQ ID NO: 495257 - DNA, 14 bp, Homo sapiens
agtgatcacagcag

SEQ ID NO: 495258 - DNA, 17 bp, Homo sapiens
agtgattgggacagagg

SEQ ID NO: 495259 - DNA, 18 bp, Homo sapiens
agtgcaaattgtcacagg

SEQ ID NO: 495260 - DNA, 12 bp, Homo sapiens
agtgctgagacc

SEQ ID NO: 495261 - DNA, 12 bp, Homo sapiens
agtgctgtaaaa

SEQ ID NO: 495262 - DNA, 16 bp, Homo sapiens
agtgcttgccacagag

SEQ ID NO: 495263 - DNA, 22 bp, Homo sapiens
agtggacaccaggagtccctgg

SEQ ID NO: 495264 - DNA, 11 bp, Homo sapiens
agtggaggcat

SEQ ID NO: 495265 - DNA, 18 bp, Homo sapiens
agcactgtgctcagggct

SEQ ID NO: 495266 - DNA, 19 bp, Homo sapiens
agcactgtgctcagggcta

SEQ ID NO: 495267 - DNA, 13 bp, Homo sapiens
agcacttgctgta

SEQ ID NO: 495268 - DNA, 14 bp, Homo sapiens
agcacttggagcca

SEQ ID NO: 495269 - DNA, 22 bp, Homo sapiens
agcactttgggaggctgaggtg

SEQ ID NO: 495270 - DNA, 22 bp, Homo sapiens
agcagaaaggaaaagattcctg

SEQ ID NO: 495271 - DNA, 15 bp, Homo sapiens
agcagagctctgccg

SEQ ID NO: 495272 - DNA, 15 bp, Homo sapiens
agcagcaagtgtgct

SEQ ID NO: 495273 - DNA, 19 bp, Homo sapiens
agcagccagctctcagcca

SEQ ID NO: 495274 - DNA, 16 bp, Homo sapiens
agcagggctgctgtga

SEQ ID NO: 495275 - DNA, 15 bp, Homo sapiens
agcagggtgctgtgg

SEQ ID NO: 495276 - DNA, 18 bp, Homo sapiens
agcagtcaggaaagagaa

SEQ ID NO: 495277 - DNA, 19 bp, Homo sapiens
agcagtcaggaaagagaac

SEQ ID NO: 495278 - DNA, 19 bp, Homo sapiens
agcagtggacaccaggagt

SEQ ID NO: 495279 - DNA, 15 bp, Homo sapiens
agcagttcagagctg

SEQ ID NO: 495280 - DNA, 17 bp, Homo sapiens
agcatcacttgggatta

SEQ ID NO: 495281 - DNA, 13 bp, Homo sapiens
agcatggagctgg

SEQ ID NO: 495282 - DNA, 14 bp, Homo sapiens
agcatggagctggc

SEQ ID NO: 495283 - DNA, 16 bp, Homo sapiens
agcatggagctggccg

SEQ ID NO: 495284 - DNA, 22 bp, Homo sapiens
agccagatggactccagcctgc

SEQ ID NO: 495285 - DNA, 15 bp, Homo sapiens
agccagattttcctg

SEQ ID NO: 495286 - DNA, 16 bp, Homo sapiens
agccagcagccagctc

SEQ ID NO: 495287 - DNA, 20 bp, Homo sapiens
agccagcagccagctctcag

SEQ ID NO: 495288 - DNA, 14 bp, Homo sapiens
agccagcagttcag

SEQ ID NO: 495289 - DNA, 19 bp, Homo sapiens
agccagcagttcagagctg

SEQ ID NO: 495290 - DNA, 22 bp, Homo sapiens
agccagcagttcagagctgccc

SEQ ID NO: 495291 - DNA, 14 bp, Homo sapiens
agccagctctcagc

SEQ ID NO: 495292 - DNA, 20 bp, Homo sapiens
agccagggtgagagtctggg

SEQ ID NO: 495293 - DNA, 16 bp, Homo sapiens
agccagtaaacagagg

SEQ ID NO: 495294 - DNA, 20 bp, Homo sapiens
agccatgacttgagaaacaa

SEQ ID NO: 495295 - DNA, 22 bp, Homo sapiens
agcccattcattccattctgga

SEQ ID NO: 495296 - DNA, 19 bp, Homo sapiens
agcccttctttccacagaa

SEQ ID NO: 495297 - DNA, 14 bp, Homo sapiens
agccgacctcagcc

SEQ ID NO: 495298 - DNA, 15 bp, Homo sapiens
agccgacctcagcct

SEQ ID NO: 495299 - DNA, 16 bp, Homo sapiens
agccgacctcagcctt

SEQ ID NO: 495300 - DNA, 21 bp, Homo sapiens
agccgctcctgtctgccagcc

SEQ ID NO: 495301 - DNA, 20 bp, Homo sapiens
agccgggaaagaagagccgg

SEQ ID NO: 495302 - DNA, 20 bp, Homo sapiens
agcctagccgacctcagcct

SEQ ID NO: 495303 - DNA, 17 bp, Homo sapiens
agcctcagactcattgt

SEQ ID NO: 495304 - DNA, 16 bp, Homo sapiens
agcctccagtccaagg

SEQ ID NO: 495305 - DNA, 17 bp, Homo sapiens
agcctctgccgctgcca

SEQ ID NO: 495306 - DNA, 21 bp, Homo sapiens
agcctctttaacagctttctc

SEQ ID NO: 495307 - DNA, 14 bp, Homo sapiens
agcctgcctggcag

SEQ ID NO: 495308 - DNA, 22 bp, Homo sapiens
agcctgctccttcccaggagtg

SEQ ID NO: 495309 - DNA, 20 bp, Homo sapiens
agcctggaacatcatcaagg

SEQ ID NO: 495310 - DNA, 18 bp, Homo sapiens
agcctgggcaacagagca

SEQ ID NO: 495311 - DNA, 21 bp, Homo sapiens
agcctggtgggcctcctctgt

SEQ ID NO: 495312 - DNA, 17 bp, Homo sapiens
agcctgtgttactgatt

SEQ ID NO: 495313 - DNA, 22 bp, Homo sapiens
agccttccccttgcccagggct

SEQ ID NO: 495314 - DNA, 17 bp, Homo sapiens
agccttgctctcttcaa

SEQ ID NO: 495315 - DNA, 17 bp, Homo sapiens
agctaacacacagctcc

SEQ ID NO: 495316 - DNA, 15 bp, Homo sapiens
agctagaacctggag

SEQ ID NO: 495317 - DNA, 16 bp, Homo sapiens
agctagaacctggaga

SEQ ID NO: 495318 - DNA, 14 bp, Homo sapiens
agctagttatgtga

SEQ ID NO: 495319 - DNA, 16 bp, Homo sapiens
agctatcctggctctt

SEQ ID NO: 495320 - DNA, 23 bp, Homo sapiens
agctattgatataaataaaacat

SEQ ID NO: 495321 - DNA, 21 bp, Homo sapiens
agctcaagggaccctgggtgg

SEQ ID NO: 495322 - DNA, 18 bp, Homo sapiens
agctcaggaccaggcaat

SEQ ID NO: 495323 - DNA, 18 bp, Homo sapiens
agctcccaagggatggtg

SEQ ID NO: 495324 - DNA, 18 bp, Homo sapiens
agctccccagagtcctct

SEQ ID NO: 495325 - DNA, 15 bp, Homo sapiens
agctccgtggagcag

SEQ ID NO: 495326 - DNA, 18 bp, Homo sapiens
agctcctcatccagggct

SEQ ID NO: 495327 - DNA, 21 bp, Homo sapiens
agctcctcatccagggctctg

SEQ ID NO: 495328 - DNA, 12 bp, Homo sapiens
agctcggtggac

SEQ ID NO: 495329 - DNA, 16 bp, Homo sapiens
agctcggtggacccag

SEQ ID NO: 495330 - DNA, 17 bp, Homo sapiens
agctcggtggacccagg

SEQ ID NO: 495331 - DNA, 12 bp, Homo sapiens
agctctcagcca

SEQ ID NO: 495332 - DNA, 17 bp, Homo sapiens
agctctgccgcaatggc

SEQ ID NO: 495333 - DNA, 22 bp, Homo sapiens
agctgaagatccccaactgctc

SEQ ID NO: 495334 - DNA, 23 bp, Homo sapiens
agctgaagatccccaactgctcc

SEQ ID NO: 495335 - DNA, 14 bp, Homo sapiens
agctgacacaaacc

SEQ ID NO: 495336 - DNA, 22 bp, Homo sapiens
agctgacacaaacctgcctggg

SEQ ID NO: 495337 - DNA, 23 bp, Homo sapiens
agctgacacaaacctgcctgggt

SEQ ID NO: 495338 - DNA, 17 bp, Homo sapiens
agctgaggcaattctaa

SEQ ID NO: 495339 - DNA, 23 bp, Homo sapiens
agctgatgttttgtattttgtgt

SEQ ID NO: 495340 - DNA, 14 bp, Homo sapiens
agctgccctctcct

SEQ ID NO: 495341 - DNA, 20 bp, Homo sapiens
agctgcctcccctcctctgc

SEQ ID NO: 495342 - DNA, 15 bp, Homo sapiens
agctgctaccttctt

SEQ ID NO: 495343 - DNA, 18 bp, Homo sapiens
agctgctaccttctttgg

SEQ ID NO: 495344 - DNA, 23 bp, Homo sapiens
agctgctggagactcctaggcag

SEQ ID NO: 495345 - DNA, 13 bp, Homo sapiens
agctggaaaagta

SEQ ID NO: 495346 - DNA, 16 bp, Homo sapiens
agctggagcccgtgcc

SEQ ID NO: 495347 - DNA, 14 bp, Homo sapiens
agctggagcctggt

SEQ ID NO: 495348 - DNA, 17 bp, Homo sapiens
agctggccgtgggcctg

SEQ ID NO: 495349 - DNA, 19 bp, Homo sapiens
agctggccgtgggcctggg

SEQ ID NO: 495350 - DNA, 16 bp, Homo sapiens
agctgggttggaaaac

SEQ ID NO: 495351 - DNA, 20 bp, Homo sapiens
agctgggttggaaaacagta

SEQ ID NO: 495352 - DNA, 21 bp, Homo sapiens
agctggtggtatctgagttga

SEQ ID NO: 495353 - DNA, 17 bp, Homo sapiens
agctgtatgattcccag

SEQ ID NO: 495354 - DNA, 15 bp, Homo sapiens
agctgttctcattcc

SEQ ID NO: 495355 - DNA, 14 bp, Homo sapiens
agcttagacctcag

SEQ ID NO: 495356 - DNA, 17 bp, Homo sapiens
agcttagacctcagcct

SEQ ID NO: 495357 - DNA, 18 bp, Homo sapiens
agcttagacctcagcctg

SEQ ID NO: 495358 - DNA, 19 bp, Homo sapiens
agcttcagttgttttcccg

SEQ ID NO: 495359 - DNA, 19 bp, Homo sapiens
agcttctcatcctgcaggc

SEQ ID NO: 495360 - DNA, 22 bp, Homo sapiens
agcttgttttgtttcatcctgt

SEQ ID NO: 495361 - DNA, 22 bp, Homo sapiens
agctttatgtaataatgtgaat

SEQ ID NO: 495362 - DNA, 23 bp, Homo sapiens
agctttcctttttcccaataaat

SEQ ID NO: 495363 - DNA, 13 bp, Homo sapiens
agctttctccaga

SEQ ID NO: 495364 - DNA, 20 bp, Homo sapiens
agctttgcttctctctctaa

SEQ ID NO: 495365 - DNA, 18 bp, Homo sapiens
aggaaatatttattttaa

SEQ ID NO: 495366 - DNA, 18 bp, Homo sapiens
aggaagccacagctggtg

SEQ ID NO: 495367 - DNA, 20 bp, Homo sapiens
aggaaggctcttctccccag

SEQ ID NO: 495368 - DNA, 20 bp, Homo sapiens
aggaagggcatccttctgcc

SEQ ID NO: 495369 - DNA, 15 bp, Homo sapiens
aggaataatgggctt

SEQ ID NO: 495370 - DNA, 16 bp, Homo sapiens
aggaatccactcccag

SEQ ID NO: 495371 - DNA, 15 bp, Homo sapiens
aggacaaataaagca

SEQ ID NO: 495372 - DNA, 18 bp, Homo sapiens
aggacatgaaactccacc

SEQ ID NO: 495373 - DNA, 19 bp, Homo sapiens
aggactcagctccccagag

SEQ ID NO: 495374 - DNA, 13 bp, Homo sapiens
aggagaattgctt

SEQ ID NO: 495375 - DNA, 20 bp, Homo sapiens
aggagaattgcttgaacctg

SEQ ID NO: 495376 - DNA, 11 bp, Homo sapiens
aggagacacaa

SEQ ID NO: 495377 - DNA, 19 bp, Homo sapiens
aggagacacaacaactcct

SEQ ID NO: 495378 - DNA, 14 bp, Homo sapiens
aggagacccacagg

SEQ ID NO: 495379 - DNA, 18 bp, Homo sapiens
aggagaggggcagaacag

SEQ ID NO: 495380 - DNA, 19 bp, Homo sapiens
aggagaggggcagaacagc

SEQ ID NO: 495381 - DNA, 13 bp, Homo sapiens
accacagctgctg

SEQ ID NO: 495382 - DNA, 16 bp, Homo sapiens
accacagctgctggag

SEQ ID NO: 495383 - DNA, 14 bp, Homo sapiens
accacatagaacat

SEQ ID NO: 495384 - DNA, 15 bp, Homo sapiens
accacctctgtgggc

SEQ ID NO: 495385 - DNA, 23 bp, Homo sapiens
accacttgtgttttgcaagccag

SEQ ID NO: 495386 - DNA, 12 bp, Homo sapiens
accagccttgct

SEQ ID NO: 495387 - DNA, 17 bp, Homo sapiens
accagccttgctctctt

SEQ ID NO: 495388 - DNA, 19 bp, Homo sapiens
accaggcttgcctgcaggc

SEQ ID NO: 495389 - DNA, 19 bp, Homo sapiens
accagtttaacctgatgca

SEQ ID NO: 495390 - DNA, 20 bp, Homo sapiens
accagtttaacctgatgcag

SEQ ID NO: 495391 - DNA, 20 bp, Homo sapiens
accatagaagaacagcagat

SEQ ID NO: 495392 - DNA, 20 bp, Homo sapiens
accatcagaaacaccctcac

SEQ ID NO: 495393 - DNA, 19 bp, Homo sapiens
accatcctggccaacatga

SEQ ID NO: 495394 - DNA, 18 bp, Homo sapiens
accattatgaagaagaga

SEQ ID NO: 495395 - DNA, 18 bp, Homo sapiens
acccaaggtcacatagct

SEQ ID NO: 495396 - DNA, 20 bp, Homo sapiens
acccactctcctctgcctca

SEQ ID NO: 495397 - DNA, 19 bp, Homo sapiens
acccaggctggagtgcagt

SEQ ID NO: 495398 - DNA, 20 bp, Homo sapiens
acccaggctgggcaaggagg

SEQ ID NO: 495399 - DNA, 14 bp, Homo sapiens
acccagggcctagg

SEQ ID NO: 495400 - DNA, 13 bp, Homo sapiens
acccatctgggct

SEQ ID NO: 495401 - DNA, 18 bp, Homo sapiens
acccccaaatactctgaa

SEQ ID NO: 495402 - DNA, 22 bp, Homo sapiens
acccggcaggctagaacctggc

SEQ ID NO: 495403 - DNA, 22 bp, Homo sapiens
accctaaggtcattaccacagg

SEQ ID NO: 495404 - DNA, 15 bp, Homo sapiens
accctcacactggga

SEQ ID NO: 495405 - DNA, 13 bp, Homo sapiens
accctcatgctgt

SEQ ID NO: 495406 - DNA, 20 bp, Homo sapiens
accctcatgctgtgtgactc

SEQ ID NO: 495407 - DNA, 20 bp, Homo sapiens
accctgggtgggagcatagg

SEQ ID NO: 495408 - DNA, 15 bp, Homo sapiens
acccttggacttgag

SEQ ID NO: 495409 - DNA, 20 bp, Homo sapiens
acctcactattcaagtatta

SEQ ID NO: 495410 - DNA, 13 bp, Homo sapiens
acctccctgcaat

SEQ ID NO: 495411 - DNA, 14 bp, Homo sapiens
acctccctgtgaga

SEQ ID NO: 495412 - DNA, 15 bp, Homo sapiens
acctcctgtctctgg

SEQ ID NO: 495413 - DNA, 18 bp, Homo sapiens
acctctaaaacagtcctt

SEQ ID NO: 495414 - DNA, 18 bp, Homo sapiens
acctctgcctcagaaaac

SEQ ID NO: 495415 - DNA, 21 bp, Homo sapiens
acctgcagcgcgcacacgcac

SEQ ID NO: 495416 - DNA, 21 bp, Homo sapiens
acctgcctcccttcatgcatg

SEQ ID NO: 495417 - DNA, 14 bp, Homo sapiens
acctgctctggaca

SEQ ID NO: 495418 - DNA, 15 bp, Homo sapiens
acctgctttcaagac

SEQ ID NO: 495419 - DNA, 13 bp, Homo sapiens
acctggagaccag

SEQ ID NO: 495420 - DNA, 22 bp, Homo sapiens
acctggagagccagaacctgga

SEQ ID NO: 495421 - DNA, 21 bp, Homo sapiens
acctggagagctagaacctag

SEQ ID NO: 495422 - DNA, 23 bp, Homo sapiens
acctggagagctagaacctggag

SEQ ID NO: 495423 - DNA, 21 bp, Homo sapiens
acctggagggctagaacctag

SEQ ID NO: 495424 - DNA, 21 bp, Homo sapiens
actttaatcccggtttcagaa

SEQ ID NO: 495425 - DNA, 18 bp, Homo sapiens
actttccatatcaagaga

SEQ ID NO: 495426 - DNA, 21 bp, Homo sapiens
actttcctcttagtcgagcca

SEQ ID NO: 495427 - DNA, 12 bp, Homo sapiens
actttgaaggac

SEQ ID NO: 495428 - DNA, 17 bp, Homo sapiens
actttggctgcatgcga

SEQ ID NO: 495429 - DNA, 19 bp, Homo sapiens
actttgggaggctgaggtg

SEQ ID NO: 495430 - DNA, 22 bp, Homo sapiens
actttggtgcgggcacaataaa

SEQ ID NO: 495431 - DNA, 22 bp, Homo sapiens
actttttatggcactagtattt

SEQ ID NO: 495432 - DNA, 12 bp, Homo sapiens
agaaaaacatgt

SEQ ID NO: 495433 - DNA, 14 bp, Homo sapiens
agaaaaacatgtca

SEQ ID NO: 495434 - DNA, 19 bp, Homo sapiens
agaaaaatttacatggcaa

SEQ ID NO: 495435 - DNA, 16 bp, Homo sapiens
agaaaacaaggatgaa

SEQ ID NO: 495436 - DNA, 16 bp, Homo sapiens
agaaaattatgcagct

SEQ ID NO: 495437 - DNA, 14 bp, Homo sapiens
agaaacattgaaga

SEQ ID NO: 495438 - DNA, 15 bp, Homo sapiens
agaaacattgaagat

SEQ ID NO: 495439 - DNA, 17 bp, Homo sapiens
agaaacatttatctttg

SEQ ID NO: 495440 - DNA, 21 bp, Homo sapiens
agaaataaagttggtgacaga

SEQ ID NO: 495441 - DNA, 19 bp, Homo sapiens
agaaatagctccgtggagc

SEQ ID NO: 495442 - DNA, 16 bp, Homo sapiens
agaacacaaggtcatt

SEQ ID NO: 495443 - DNA, 14 bp, Homo sapiens
agaacactgtgaaa

SEQ ID NO: 495444 - DNA, 18 bp, Homo sapiens
agaacagccgctcctgtc

SEQ ID NO: 495445 - DNA, 20 bp, Homo sapiens
agaacagccgctcctgtctg

SEQ ID NO: 495446 - DNA, 22 bp, Homo sapiens
agaacagccgctcctgtctgcc

SEQ ID NO: 495447 - DNA, 23 bp, Homo sapiens
agaacagccgctcctgtctgcca

SEQ ID NO: 495448 - DNA, 15 bp, Homo sapiens
agaacctggaagggc

SEQ ID NO: 495449 - DNA, 12 bp, Homo sapiens
agaacctggaga

SEQ ID NO: 495450 - DNA, 14 bp, Homo sapiens
agaagaactgaaat

SEQ ID NO: 495451 - DNA, 21 bp, Homo sapiens
agaagaaggcagcaggtggca

SEQ ID NO: 495452 - DNA, 21 bp, Homo sapiens
agaagactgcattatatttat

SEQ ID NO: 495453 - DNA, 13 bp, Homo sapiens
agaagagccacag

SEQ ID NO: 495454 - DNA, 14 bp, Homo sapiens
agaagagccacagt

SEQ ID NO: 495455 - DNA, 23 bp, Homo sapiens
agaagctccctgaagtaagcaaa

SEQ ID NO: 495456 - DNA, 13 bp, Homo sapiens
agaagctgcagct

SEQ ID NO: 495457 - DNA, 19 bp, Homo sapiens
agaagtttctttaaagacg

SEQ ID NO: 495458 - DNA, 12 bp, Homo sapiens
agaataaaattg

SEQ ID NO: 495459 - DNA, 13 bp, Homo sapiens
agaataaaattgt

SEQ ID NO: 495460 - DNA, 19 bp, Homo sapiens
agaatctgtttcccagcag

SEQ ID NO: 495461 - DNA, 17 bp, Homo sapiens
agaatgattatgaatta

SEQ ID NO: 495462 - DNA, 18 bp, Homo sapiens
agaatgtgctcatgcatt

SEQ ID NO: 495463 - DNA, 13 bp, Homo sapiens
agaattctgctac

SEQ ID NO: 495464 - DNA, 20 bp, Homo sapiens
agaattctgctacctcactg

SEQ ID NO: 495465 - DNA, 18 bp, Homo sapiens
agaattggctgaactcat

SEQ ID NO: 495466 - DNA, 22 bp, Homo sapiens
agaattggctgaactcatgaga

SEQ ID NO: 495467 - DNA, 23 bp, Homo sapiens
agacaaatctatgccactcagaa

SEQ ID NO: 495468 - DNA, 14 bp, Homo sapiens
agacaaatgggact

SEQ ID NO: 495469 - DNA, 22 bp, Homo sapiens
agacaaatgggactgatgtcat

SEQ ID NO: 495470 - DNA, 18 bp, Homo sapiens
agacacaacaactcctag

SEQ ID NO: 495471 - DNA, 14 bp, Homo sapiens
agacacagaacaca

SEQ ID NO: 495472 - DNA, 20 bp, Homo sapiens
agacactgaaatatacacac

SEQ ID NO: 495473 - DNA, 15 bp, Homo sapiens
agacactgcacagaa

SEQ ID NO: 495474 - DNA, 21 bp, Homo sapiens
agacagagacctcctgcctcc

SEQ ID NO: 495475 - DNA, 12 bp, Homo sapiens
agacagcagctc

SEQ ID NO: 495476 - DNA, 14 bp, Homo sapiens
agacagcagctcag

SEQ ID NO: 495477 - DNA, 16 bp, Homo sapiens
agacagcagctcaggc

SEQ ID NO: 495478 - DNA, 17 bp, Homo sapiens
agacagtcaccccagga

SEQ ID NO: 495479 - DNA, 17 bp, Homo sapiens
agacatgtggtgggaca

SEQ ID NO: 495480 - DNA, 16 bp, Homo sapiens
agaccaggcaaagcaa

SEQ ID NO: 495481 - DNA, 17 bp, Homo sapiens
agaccaggcaaagcaag

SEQ ID NO: 495482 - DNA, 15 bp, Homo sapiens
agaccagtctggcca

SEQ ID NO: 495483 - DNA, 12 bp, Homo sapiens
agaccctgtctc

SEQ ID NO: 495484 - DNA, 14 bp, Homo sapiens
agacctcagcctgt

SEQ ID NO: 495485 - DNA, 16 bp, Homo sapiens
agacctcagcctgtgc

SEQ ID NO: 495486 - DNA, 20 bp, Homo sapiens
agacctccctgtgagagagt

SEQ ID NO: 495487 - DNA, 21 bp, Homo sapiens
agacggaggcctactcttcca

SEQ ID NO: 495488 - DNA, 19 bp, Homo sapiens
agactaattcctgccctgc

SEQ ID NO: 495489 - DNA, 17 bp, Homo sapiens
agactatttaacttgag

SEQ ID NO: 495490 - DNA, 16 bp, Homo sapiens
agactcagggccccag

SEQ ID NO: 495491 - DNA, 23 bp, Homo sapiens
agactcctgactgtctcccggga

SEQ ID NO: 495492 - DNA, 14 bp, Homo sapiens
agactctcttagga

SEQ ID NO: 495493 - DNA, 18 bp, Homo sapiens
agactctgtctcaaaaaa

SEQ ID NO: 495494 - DNA, 17 bp, Homo sapiens
agactgcattatattta

SEQ ID NO: 495495 - DNA, 15 bp, Homo sapiens
agacttcccagcttc

SEQ ID NO: 495496 - DNA, 18 bp, Homo sapiens
agagaaaacttatttgag

SEQ ID NO: 495497 - DNA, 20 bp, Homo sapiens
agagaagctaaaacctgagc

SEQ ID NO: 495498 - DNA, 14 bp, Homo sapiens
agagaatcagacct

SEQ ID NO: 495499 - DNA, 16 bp, Homo sapiens
agagacacactgaaga

SEQ ID NO: 495500 - DNA, 18 bp, Homo sapiens
agagacacactgaagaag

SEQ ID NO: 495501 - DNA, 20 bp, Homo sapiens
agagacacactgaagaagca

SEQ ID NO: 495502 - DNA, 12 bp, Homo sapiens
agagacagtcac

SEQ ID NO: 495503 - DNA, 19 bp, Homo sapiens
agagactcagggccccagc

SEQ ID NO: 495504 - DNA, 16 bp, Homo sapiens
agagactccagctggg

SEQ ID NO: 495505 - DNA, 22 bp, Homo sapiens
agagactccttgagagaccagg

SEQ ID NO: 495506 - DNA, 21 bp, Homo sapiens
agagagaaaacttatttgagt

SEQ ID NO: 495507 - DNA, 14 bp, Homo sapiens
agagagggcaggca

SEQ ID NO: 495508 - DNA, 15 bp, Homo sapiens
agagatcgagaccat

SEQ ID NO: 495509 - DNA, 23 bp, Homo sapiens
agagattgaactttgaggaggaa

SEQ ID NO: 495510 - DNA, 21 bp, Homo sapiens
agagattggaatgggcagctc

SEQ ID NO: 495511 - DNA, 22 bp, Homo sapiens
agagattggaatgggcagctca

SEQ ID NO: 495512 - DNA, 14 bp, Homo sapiens
agagcacactgtag

SEQ ID NO: 495513 - DNA, 17 bp, Homo sapiens
agagcacttcacacaga

SEQ ID NO: 495514 - DNA, 19 bp, Homo sapiens
agagcaggcgttcagctca

SEQ ID NO: 495515 - DNA, 22 bp, Homo sapiens
agagccagaacctggagggcta

SEQ ID NO: 495516 - DNA, 18 bp, Homo sapiens
agagccatgtagaagctg

SEQ ID NO: 495517 - DNA, 23 bp, Homo sapiens
agagctagaacccggcaggctag

SEQ ID NO: 495518 - DNA, 18 bp, Homo sapiens
agagctagaacctggaga

SEQ ID NO: 495519 - DNA, 19 bp, Homo sapiens
agagctagaacctggagag

SEQ ID NO: 495520 - DNA, 22 bp, Homo sapiens
agagctagaacctggagggcta

SEQ ID NO: 495521 - DNA, 18 bp, Homo sapiens
agagctgacacaaacctg

SEQ ID NO: 495522 - DNA, 11 bp, Homo sapiens
agagctgaggc

SEQ ID NO: 495523 - DNA, 17 bp, Homo sapiens
agagctggagcctggtg

SEQ ID NO: 495524 - DNA, 14 bp, Homo sapiens
agagcttggactgg

SEQ ID NO: 495525 - DNA, 17 bp, Homo sapiens
agaggaaaatgaataat

SEQ ID NO: 495526 - DNA, 19 bp, Homo sapiens
agaggaaatattgctgggg

SEQ ID NO: 495527 - DNA, 16 bp, Homo sapiens
agaggggcagaacagc

SEQ ID NO: 495528 - DNA, 17 bp, Homo sapiens
agaggttatctgtccca

SEQ ID NO: 495529 - DNA, 13 bp, Homo sapiens
agagtatggagct

SEQ ID NO: 495530 - DNA, 14 bp, Homo sapiens
agagtatggagctc

SEQ ID NO: 495531 - DNA, 20 bp, Homo sapiens
agagtcacacgggggcagct

SEQ ID NO: 495532 - DNA, 23 bp, Homo sapiens
aagcttgtattcctttttctctc

SEQ ID NO: 495533 - DNA, 15 bp, Homo sapiens
aagctttctgtctcc

SEQ ID NO: 495534 - DNA, 20 bp, Homo sapiens
aaggaaaccacagctgctgg

SEQ ID NO: 495535 - DNA, 18 bp, Homo sapiens
aaggacacagatgaaaca

SEQ ID NO: 495536 - DNA, 22 bp, Homo sapiens
aaggacacagatgaaacacaaa

SEQ ID NO: 495537 - DNA, 22 bp, Homo sapiens
aaggactaatccaatacctctt

SEQ ID NO: 495538 - DNA, 17 bp, Homo sapiens
aaggagaggaaagaact

SEQ ID NO: 495539 - DNA, 15 bp, Homo sapiens
aaggagatgaagcaa

SEQ ID NO: 495540 - DNA, 16 bp, Homo sapiens
aaggatgtgggggaag

SEQ ID NO: 495541 - DNA, 16 bp, Homo sapiens
aaggcaaatgcccaag

SEQ ID NO: 495542 - DNA, 18 bp, Homo sapiens
aaggcaactagtggagag

SEQ ID NO: 495543 - DNA, 22 bp, Homo sapiens
aaggcaatgccatcctcaaaca

SEQ ID NO: 495544 - DNA, 20 bp, Homo sapiens
aaggcacccacaaataaatg

SEQ ID NO: 495545 - DNA, 13 bp, Homo sapiens
aaggcactgcctg

SEQ ID NO: 495546 - DNA, 19 bp, Homo sapiens
aaggcgtggagctgcctga

SEQ ID NO: 495547 - DNA, 17 bp, Homo sapiens
aaggctcttctccccag

SEQ ID NO: 495548 - DNA, 14 bp, Homo sapiens
aagggaatgcatta

SEQ ID NO: 495549 - DNA, 17 bp, Homo sapiens
aagggattttagtcaca

SEQ ID NO: 495550 - DNA, 15 bp, Homo sapiens
aagggcagagtcaca

SEQ ID NO: 495551 - DNA, 17 bp, Homo sapiens
aaggggaattgaggaca

SEQ ID NO: 495552 - DNA, 14 bp, Homo sapiens
aaggtacttcaaat

SEQ ID NO: 495553 - DNA, 16 bp, Homo sapiens
aaggtggggacaggga

SEQ ID NO: 495554 - DNA, 16 bp, Homo sapiens
aaggttaagccctgag

SEQ ID NO: 495555 - DNA, 13 bp, Homo sapiens
aagtaagcaaaga

SEQ ID NO: 495556 - DNA, 19 bp, Homo sapiens
aagtaatgataactggaaa

SEQ ID NO: 495557 - DNA, 18 bp, Homo sapiens
aagtagctgctaccttct

SEQ ID NO: 495558 - DNA, 18 bp, Homo sapiens
aagtatattcaaaaatta

SEQ ID NO: 495559 - DNA, 19 bp, Homo sapiens
aagtatattcaaaaattat

SEQ ID NO: 495560 - DNA, 16 bp, Homo sapiens
aagtatgcactaatca

SEQ ID NO: 495561 - DNA, 22 bp, Homo sapiens
aagtatgcactaatcaatactt

SEQ ID NO: 495562 - DNA, 18 bp, Homo sapiens
aagtatgttagtgcaaat

SEQ ID NO: 495563 - DNA, 21 bp, Homo sapiens
aagtatgttagtgcaaattgt

SEQ ID NO: 495564 - DNA, 15 bp, Homo sapiens
aagtcgttgtgaggg

SEQ ID NO: 495565 - DNA, 14 bp, Homo sapiens
aagtctaaagttta

SEQ ID NO: 495566 - DNA, 17 bp, Homo sapiens
aagtctaaagtttacag

SEQ ID NO: 495567 - DNA, 19 bp, Homo sapiens
aagtctaaagtttacagta

SEQ ID NO: 495568 - DNA, 16 bp, Homo sapiens
aagtcttatcaagcag

SEQ ID NO: 495569 - DNA, 17 bp, Homo sapiens
aagtcttatcaagcagc

SEQ ID NO: 495570 - DNA, 19 bp, Homo sapiens
aagtgactttggctgcatg

SEQ ID NO: 495571 - DNA, 15 bp, Homo sapiens
aagtgagacagtcca

SEQ ID NO: 495572 - DNA, 22 bp, Homo sapiens
aagtgagacagtccagcctgga

SEQ ID NO: 495573 - DNA, 18 bp, Homo sapiens
aagtgattgggacagagg

SEQ ID NO: 495574 - DNA, 15 bp, Homo sapiens
aagtggctgtgacat

SEQ ID NO: 495575 - DNA, 19 bp, Homo sapiens
aagttattaatattttaat

SEQ ID NO: 495576 - DNA, 16 bp, Homo sapiens
aagttcaggctctgag

SEQ ID NO: 495577 - DNA, 17 bp, Homo sapiens
aagttgatatagaacag

SEQ ID NO: 495578 - DNA, 18 bp, Homo sapiens
aagttgatggtgatgaaa

SEQ ID NO: 495579 - DNA, 15 bp, Homo sapiens
aagttgtttcattga

SEQ ID NO: 495580 - DNA, 21 bp, Homo sapiens
aagtttacagtaaataaattg

SEQ ID NO: 495581 - DNA, 22 bp, Homo sapiens
aagtttacagtaaataaattgt

SEQ ID NO: 495582 - DNA, 16 bp, Homo sapiens
aagtttccttggctgg

SEQ ID NO: 495583 - DNA, 17 bp, Homo sapiens
aataaaacattttcaca

SEQ ID NO: 495584 - DNA, 13 bp, Homo sapiens
aataaaatgcatt

SEQ ID NO: 495585 - DNA, 19 bp, Homo sapiens
aataaaatgggttttactg

SEQ ID NO: 495586 - DNA, 23 bp, Homo sapiens
aataaaattaaagctgaaaactg

SEQ ID NO: 495587 - DNA, 18 bp, Homo sapiens
aataaaattcattccatt

SEQ ID NO: 495588 - DNA, 22 bp, Homo sapiens
aataaaattcattccatttgct

SEQ ID NO: 495589 - DNA, 19 bp, Homo sapiens
aataaaccacaagcatctc

SEQ ID NO: 495590 - DNA, 19 bp, Homo sapiens
aataaacttagaataaaat

SEQ ID NO: 495591 - DNA, 17 bp, Homo sapiens
aataatttttatatttg

SEQ ID NO: 495592 - DNA, 20 bp, Homo sapiens
aataatttttatatttgaaa

SEQ ID NO: 495593 - DNA, 22 bp, Homo sapiens
aatacattattggacttccatt

SEQ ID NO: 495594 - DNA, 19 bp, Homo sapiens
aatagagttgggacaattg

SEQ ID NO: 495595 - DNA, 14 bp, Homo sapiens
aatataaacactat

SEQ ID NO: 495596 - DNA, 13 bp, Homo sapiens
aatatacacacag

SEQ ID NO: 495597 - DNA, 21 bp, Homo sapiens
aatatattgctgctggtaatt

SEQ ID NO: 495598 - DNA, 12 bp, Homo sapiens
aatatcacttgt

SEQ ID NO: 495599 - DNA, 20 bp, Homo sapiens
aatatcacttgtcaataaaa

SEQ ID NO: 495600 - DNA, 17 bp, Homo sapiens
aatatgagtctcaataa

SEQ ID NO: 495601 - DNA, 21 bp, Homo sapiens
aatatgccccattcaacatct

SEQ ID NO: 495602 - DNA, 16 bp, Homo sapiens
aatatgttagcaaaga

SEQ ID NO: 495603 - DNA, 15 bp, Homo sapiens
aatattaaaaattaa

SEQ ID NO: 495604 - DNA, 23 bp, Homo sapiens
aatattaaaaattaattctttat

SEQ ID NO: 495605 - DNA, 20 bp, Homo sapiens
aatcaagatttaatcctaga

SEQ ID NO: 495606 - DNA, 12 bp, Homo sapiens
aatcaatacttt

SEQ ID NO: 495607 - DNA, 21 bp, Homo sapiens
aatcaatactttgaacacaaa

SEQ ID NO: 495608 - DNA, 22 bp, Homo sapiens
aatcaatccagcggttctcaaa

SEQ ID NO: 495609 - DNA, 16 bp, Homo sapiens
aatcacaaaagtatat

SEQ ID NO: 495610 - DNA, 19 bp, Homo sapiens
aatcacattcgagtgtttc

SEQ ID NO: 495611 - DNA, 18 bp, Homo sapiens
aaagagagaaaacttatt

SEQ ID NO: 495612 - DNA, 22 bp, Homo sapiens
aaagagcacttcacacagacaa

SEQ ID NO: 495613 - DNA, 22 bp, Homo sapiens
aaagcacaggtgggcttcccag

SEQ ID NO: 495614 - DNA, 16 bp, Homo sapiens
aaagcccattcattcc

SEQ ID NO: 495615 - DNA, 21 bp, Homo sapiens
aaaggaatccactcccaggca

SEQ ID NO: 495616 - DNA, 17 bp, Homo sapiens
aaaggacaaataaagca

SEQ ID NO: 495617 - DNA, 14 bp, Homo sapiens
aaaggccatggaga

SEQ ID NO: 495618 - DNA, 22 bp, Homo sapiens
aaagggctgttataatctttca

SEQ ID NO: 495619 - DNA, 13 bp, Homo sapiens
aaagtatattcaa

SEQ ID NO: 495620 - DNA, 23 bp, Homo sapiens
aaagtatattcaaaaattatatt

SEQ ID NO: 495621 - DNA, 20 bp, Homo sapiens
aaagtcatgcaaaggctggg

SEQ ID NO: 495622 - DNA, 12 bp, Homo sapiens
aaagtctaaagt

SEQ ID NO: 495623 - DNA, 16 bp, Homo sapiens
aaagttggtgacagat

SEQ ID NO: 495624 - DNA, 18 bp, Homo sapiens
aaagtttacagtaaataa

SEQ ID NO: 495625 - DNA, 22 bp, Homo sapiens
aaagtttacagtaaataaattg

SEQ ID NO: 495626 - DNA, 12 bp, Homo sapiens
aaataaaacatt

SEQ ID NO: 495627 - DNA, 16 bp, Homo sapiens
aaataaaagagagaga

SEQ ID NO: 495628 - DNA, 15 bp, Homo sapiens
aaataaaatggattt

SEQ ID NO: 495629 - DNA, 22 bp, Homo sapiens
aaataaaattaaagctgaaaac

SEQ ID NO: 495630 - DNA, 22 bp, Homo sapiens
aaatacagtttgtcacatgaaa

SEQ ID NO: 495631 - DNA, 20 bp, Homo sapiens
aaatatgttagcaaagagtt

SEQ ID NO: 495632 - DNA, 13 bp, Homo sapiens
aaatattgctggg

SEQ ID NO: 495633 - DNA, 15 bp, Homo sapiens
aaatccatacatttg

SEQ ID NO: 495634 - DNA, 16 bp, Homo sapiens
aaatctcaattcttcc

SEQ ID NO: 495635 - DNA, 16 bp, Homo sapiens
aaatgcaacaacatgt

SEQ ID NO: 495636 - DNA, 21 bp, Homo sapiens
aaatggaaaggagaggaaaga

SEQ ID NO: 495637 - DNA, 15 bp, Homo sapiens
aaatgggttttactg

SEQ ID NO: 495638 - DNA, 18 bp, Homo sapiens
aaatgtatgattacatca

SEQ ID NO: 495639 - DNA, 19 bp, Homo sapiens
aaatgtgaatgggaaaaga

SEQ ID NO: 495640 - DNA, 23 bp, Homo sapiens
aaatgttgacatgggacatttgc

SEQ ID NO: 495641 - DNA, 13 bp, Homo sapiens
aaattaaaagaag

SEQ ID NO: 495642 - DNA, 12 bp, Homo sapiens
aaattaacactg

SEQ ID NO: 495643 - DNA, 13 bp, Homo sapiens
aaattcattccat

SEQ ID NO: 495644 - DNA, 16 bp, Homo sapiens
aaattcattccatttg

SEQ ID NO: 495645 - DNA, 22 bp, Homo sapiens
aaattttctagaatactaataa

SEQ ID NO: 495646 - DNA, 18 bp, Homo sapiens
aacaatcaaggcaactag

SEQ ID NO: 495647 - DNA, 14 bp, Homo sapiens
aacaattgtgaagt

SEQ ID NO: 495648 - DNA, 22 bp, Homo sapiens
aacacaaaaattatctgggcat

SEQ ID NO: 495649 - DNA, 15 bp, Homo sapiens
aacacaactatattg

SEQ ID NO: 495650 - DNA, 12 bp, Homo sapiens
aacaccaggact

SEQ ID NO: 495651 - DNA, 13 bp, Homo sapiens
aacaccaggactt

SEQ ID NO: 495652 - DNA, 21 bp, Homo sapiens
aacactatatggcagtgtctt

SEQ ID NO: 495653 - DNA, 14 bp, Homo sapiens
aacactgcttgtgt

SEQ ID NO: 495654 - DNA, 17 bp, Homo sapiens
aacactgcttgtgtttt

SEQ ID NO: 495655 - DNA, 20 bp, Homo sapiens
aacagactatttaacttgag

SEQ ID NO: 495656 - DNA, 12 bp, Homo sapiens
aacagagcaaga

SEQ ID NO: 495657 - DNA, 16 bp, Homo sapiens
aacagattcacactgt

SEQ ID NO: 495658 - DNA, 12 bp, Homo sapiens
aacagctttctc

SEQ ID NO: 495659 - DNA, 10 bp, Homo sapiens
aacaggaagc

SEQ ID NO: 495660 - DNA, 14 bp, Homo sapiens
aacataagctagaa

SEQ ID NO: 495661 - DNA, 21 bp, Homo sapiens
aacatcatcaaggcactgcct

SEQ ID NO: 495662 - DNA, 17 bp, Homo sapiens
aacatgtataatatttt

SEQ ID NO: 495663 - DNA, 22 bp, Homo sapiens
aacatgtcatgtaggttgtcta

SEQ ID NO: 495664 - DNA, 13 bp, Homo sapiens
aacattccatcct

SEQ ID NO: 495665 - DNA, 22 bp, Homo sapiens
aaccaaatcactgaactttgct

SEQ ID NO: 495666 - DNA, 14 bp, Homo sapiens
aaccaagaagggct

SEQ ID NO: 495667 - DNA, 14 bp, Homo sapiens
aaccacaagcatct

SEQ ID NO: 495668 - DNA, 13 bp, Homo sapiens
aaccacagctgct

SEQ ID NO: 495669 - DNA, 22 bp, Homo sapiens
aaccataggctgctctgcctgt

SEQ ID NO: 495670 - DNA, 17 bp, Homo sapiens
aaccattgttcagaaga

SEQ ID NO: 495671 - DNA, 22 bp, Homo sapiens
aacccaaattacgtgtactaca

SEQ ID NO: 495672 - DNA, 13 bp, Homo sapiens
aacccaatagttg

SEQ ID NO: 495673 - DNA, 20 bp, Homo sapiens
aacctactttcatactgaag

SEQ ID NO: 495674 - DNA, 17 bp, Homo sapiens
aacctgatgcagtcacg

SEQ ID NO: 495675 - DNA, 10 bp, Homo sapiens
aacctggagg

SEQ ID NO: 495676 - DNA, 19 bp, Homo sapiens
aacctggcaagctagaacc

SEQ ID NO: 495677 - DNA, 22 bp, Homo sapiens
aacggtacacagactattgaca

SEQ ID NO: 495678 - DNA, 12 bp, Homo sapiens
aacgtgaaaatg

SEQ ID NO: 495679 - DNA, 23 bp, Homo sapiens
aacgttttctgtttggaggagca

SEQ ID NO: 495680 - DNA, 20 bp, Homo sapiens
aactagactcccaagctgga

SEQ ID NO: 495681 - DNA, 17 bp, Homo sapiens
tgacctgcctcccttca

SEQ ID NO: 495682 - DNA, 16 bp, Homo sapiens
tgactatcaaactgaa

SEQ ID NO: 495683 - DNA, 22 bp, Homo sapiens
tgactatcaaactgaagccaga

SEQ ID NO: 495684 - DNA, 13 bp, Homo sapiens
tgactcttaagaa

SEQ ID NO: 495685 - DNA, 19 bp, Homo sapiens
tgactgagcaagaccctgt

SEQ ID NO: 495686 - DNA, 22 bp, Homo sapiens
tgacttttccatgtatctacct

SEQ ID NO: 495687 - DNA, 12 bp, Homo sapiens
tgagaacactgt

SEQ ID NO: 495688 - DNA, 14 bp, Homo sapiens
tgagaacactgtga

SEQ ID NO: 495689 - DNA, 19 bp, Homo sapiens
tgagacactgcacagaaga

SEQ ID NO: 495690 - DNA, 18 bp, Homo sapiens
tgagacagtccagcctgg

SEQ ID NO: 495691 - DNA, 19 bp, Homo sapiens
tgagacagtccagcctgga

SEQ ID NO: 495692 - DNA, 20 bp, Homo sapiens
tgagagagttgctcctcagg

SEQ ID NO: 495693 - DNA, 18 bp, Homo sapiens
tgagaggcatgacagctg

SEQ ID NO: 495694 - DNA, 20 bp, Homo sapiens
tgagaggcatgacagctgtt

SEQ ID NO: 495695 - DNA, 19 bp, Homo sapiens
tgagagggccctgcctgct

SEQ ID NO: 495696 - DNA, 19 bp, Homo sapiens
tgagcaagaccctgtctct

SEQ ID NO: 495697 - DNA, 23 bp, Homo sapiens
tgagcctctttaacagctttctc

SEQ ID NO: 495698 - DNA, 19 bp, Homo sapiens
tgagctagaagctggagga

SEQ ID NO: 495699 - DNA, 14 bp, Homo sapiens
tgaggaggaagcag

SEQ ID NO: 495700 - DNA, 12 bp, Homo sapiens
tgaggcagacag

SEQ ID NO: 495701 - DNA, 17 bp, Homo sapiens
tgaggcagacagcagct

SEQ ID NO: 495702 - DNA, 24 bp, Homo sapiens
tgaggcagacagcagctcaggcac

SEQ ID NO: 495703 - DNA, 23 bp, Homo sapiens
tgaggcttagctttgctctgcca

SEQ ID NO: 495704 - DNA, 14 bp, Homo sapiens
tgagggagatccca

SEQ ID NO: 495705 - DNA, 24 bp, Homo sapiens
tgaggttcagcaaggtgagagagg

SEQ ID NO: 495706 - DNA, 16 bp, Homo sapiens
tgaggttgctagagaa

SEQ ID NO: 495707 - DNA, 20 bp, Homo sapiens
tgagtccacgcccaccagcc

SEQ ID NO: 495708 - DNA, 14 bp, Homo sapiens
tgagtgattatttg

SEQ ID NO: 495709 - DNA, 23 bp, Homo sapiens
tgagttgacttgacagaacactg

SEQ ID NO: 495710 - DNA, 17 bp, Homo sapiens
tgataacaacctggaga

SEQ ID NO: 495711 - DNA, 16 bp, Homo sapiens
tgataactggaaactt

SEQ ID NO: 495712 - DNA, 19 bp, Homo sapiens
tgataatattgtggtgcca

SEQ ID NO: 495713 - DNA, 18 bp, Homo sapiens
tgatataatttccatagt

SEQ ID NO: 495714 - DNA, 16 bp, Homo sapiens
tgatatgcatttcctg

SEQ ID NO: 495715 - DNA, 16 bp, Homo sapiens
tgatatgggctttctc

SEQ ID NO: 495716 - DNA, 23 bp, Homo sapiens
tgatatttccctcccctggggac

SEQ ID NO: 495717 - DNA, 21 bp, Homo sapiens
tgatctgatgcaagcaagaaa

SEQ ID NO: 495718 - DNA, 18 bp, Homo sapiens
tgatgaaatgtaaatact

SEQ ID NO: 495719 - DNA, 17 bp, Homo sapiens
tgatgaagaagttgata

SEQ ID NO: 495720 - DNA, 19 bp, Homo sapiens
gacttgaggattttgagta

SEQ ID NO: 495721 - DNA, 23 bp, Homo sapiens
gagaaagttagagtacagatcct

SEQ ID NO: 495722 - DNA, 22 bp, Homo sapiens
gagaacttccagatcctggaaa

SEQ ID NO: 495723 - DNA, 23 bp, Homo sapiens
gagaacttccagatcctggaaat

SEQ ID NO: 495724 - DNA, 14 bp, Homo sapiens
gagaagaactgaaa

SEQ ID NO: 495725 - DNA, 16 bp, Homo sapiens
gagaagaactgaaatc

SEQ ID NO: 495726 - DNA, 17 bp, Homo sapiens
gagaatgagagacacac

SEQ ID NO: 495727 - DNA, 21 bp, Homo sapiens
gagaatgagagacacactgaa

SEQ ID NO: 495728 - DNA, 18 bp, Homo sapiens
gagaattgaaaaggactc

SEQ ID NO: 495729 - DNA, 18 bp, Homo sapiens
gagacaaatctatgccac

SEQ ID NO: 495730 - DNA, 13 bp, Homo sapiens
gagacatggtatt

SEQ ID NO: 495731 - DNA, 13 bp, Homo sapiens
gagacctcctgcc

SEQ ID NO: 495732 - DNA, 21 bp, Homo sapiens
gagactcagggccccagcact

SEQ ID NO: 495733 - DNA, 14 bp, Homo sapiens
gagagaaaaacaaa

SEQ ID NO: 495734 - DNA, 20 bp, Homo sapiens
gagagaaaacttatttgagt

SEQ ID NO: 495735 - DNA, 19 bp, Homo sapiens
gagagacacactgaagaag

SEQ ID NO: 495736 - DNA, 14 bp, Homo sapiens
gagagaccaggcaa

SEQ ID NO: 495737 - DNA, 16 bp, Homo sapiens
gagagccagaacctgg

SEQ ID NO: 495738 - DNA, 20 bp, Homo sapiens
gagagctagaacctggagag

SEQ ID NO: 495739 - DNA, 14 bp, Homo sapiens
gagagctggagcct

SEQ ID NO: 495740 - DNA, 16 bp, Homo sapiens
gagagctggagcctgg

SEQ ID NO: 495741 - DNA, 16 bp, Homo sapiens
gagagcttaatgataa

SEQ ID NO: 495742 - DNA, 20 bp, Homo sapiens
gagaggaaatattgctgggg

SEQ ID NO: 495743 - DNA, 13 bp, Homo sapiens
gagaggaggcaac

SEQ ID NO: 495744 - DNA, 17 bp, Homo sapiens
gagaggcatgacagctg

SEQ ID NO: 495745 - DNA, 17 bp, Homo sapiens
gagaggctgaggtgggc

SEQ ID NO: 495746 - DNA, 16 bp, Homo sapiens
gagagggcaggcatga

SEQ ID NO: 495747 - DNA, 16 bp, Homo sapiens
gagagttgctcctcag

SEQ ID NO: 495748 - DNA, 17 bp, Homo sapiens
gagagttgctcctcagg

SEQ ID NO: 495749 - DNA, 19 bp, Homo sapiens
gagatcccatccccttgtc

SEQ ID NO: 495750 - DNA, 12 bp, Homo sapiens
gagattttcctt

SEQ ID NO: 495751 - DNA, 13 bp, Homo sapiens
gagcaaaggctga

SEQ ID NO: 495752 - DNA, 19 bp, Homo sapiens
gagcacaggttagggcatg

SEQ ID NO: 495753 - DNA, 20 bp, Homo sapiens
gagcagtttctgtcctgctg

SEQ ID NO: 495754 - DNA, 21 bp, Homo sapiens
gagcagtttctgtcctgctgg

SEQ ID NO: 495755 - DNA, 14 bp, Homo sapiens
gagcatggctgtga

SEQ ID NO: 495756 - DNA, 23 bp, Homo sapiens
gagccaagggttcagagactcag

SEQ ID NO: 495757 - DNA, 20 bp, Homo sapiens
gagccaatccactccttcct

SEQ ID NO: 495758 - DNA, 18 bp, Homo sapiens
gagccagtaaacagagga

SEQ ID NO: 495759 - DNA, 20 bp, Homo sapiens
gagccgagatcacgccactg

SEQ ID NO: 495760 - DNA, 12 bp, Homo sapiens
gagccggagcct

SEQ ID NO: 495761 - DNA, 22 bp, Homo sapiens
gagccgggaaagaagagccgga

SEQ ID NO: 495762 - DNA, 12 bp, Homo sapiens
gagcctcagact

SEQ ID NO: 495763 - DNA, 22 bp, Homo sapiens
gagctagaacctagaagggcta

SEQ ID NO: 495764 - DNA, 17 bp, Homo sapiens
gagctagaacctggaga

SEQ ID NO: 495765 - DNA, 21 bp, Homo sapiens
gagctcagagagggcaggcat

SEQ ID NO: 495766 - DNA, 17 bp, Homo sapiens
gagctcaggacactaat

SEQ ID NO: 495767 - DNA, 16 bp, Homo sapiens
gagctcgtgggacagt

SEQ ID NO: 495768 - DNA, 22 bp, Homo sapiens
gagctgacacaaacctgcctgg

SEQ ID NO: 495769 - DNA, 15 bp, Homo sapiens
gagctgccctctcct

SEQ ID NO: 495770 - DNA, 17 bp, Homo sapiens
gagctggccgtgggcct

SEQ ID NO: 495771 - DNA, 18 bp, Homo sapiens
gaggagctcaggacacta

SEQ ID NO: 495772 - DNA, 17 bp, Homo sapiens
gaggatccctctctgga

SEQ ID NO: 495773 - DNA, 16 bp, Homo sapiens
gaggattcaggggctg

SEQ ID NO: 495774 - DNA, 11 bp, Homo sapiens
gaggccaggga

SEQ ID NO: 495775 - DNA, 20 bp, Homo sapiens
gaggccccttctaggtggca

SEQ ID NO: 495776 - DNA, 11 bp, Homo sapiens
gaggccttcca

SEQ ID NO: 495777 - DNA, 16 bp, Homo sapiens
gaggctacctcacctg

SEQ ID NO: 495778 - DNA, 18 bp, Homo sapiens
gaggctacctcacctggg

SEQ ID NO: 495779 - DNA, 13 bp, Homo sapiens
gaggctgaggcag

SEQ ID NO: 495780 - DNA, 15 bp, Homo sapiens
gaggctgaggcagga

SEQ ID NO: 495781 - DNA, 20 bp, Homo sapiens
gagggcacattccttgcctg

SEQ ID NO: 495782 - DNA, 17 bp, Homo sapiens
gagggctagaacctaga

SEQ ID NO: 495783 - DNA, 16 bp, Homo sapiens
gagggctagaacctgg

SEQ ID NO: 495784 - DNA, 21 bp, Homo sapiens
gagggctagaacctggagagc

SEQ ID NO: 495785 - DNA, 20 bp, Homo sapiens
gagggctagaacctggcagg

SEQ ID NO: 495786 - DNA, 18 bp, Homo sapiens
gagggctagaactggaga

SEQ ID NO: 495787 - DNA, 19 bp, Homo sapiens
gagggctagaatctggaga

SEQ ID NO: 495788 - DNA, 19 bp, Homo sapiens
gaggggggatttccagcca

SEQ ID NO: 495789 - DNA, 16 bp, Homo sapiens
gaggtagttaagggat

SEQ ID NO: 495790 - DNA, 14 bp, Homo sapiens
gagtaatttattgt

SEQ ID NO: 495791 - DNA, 23 bp, Homo sapiens
gagtatctcggacctttcagctg

SEQ ID NO: 495792 - DNA, 16 bp, Homo sapiens
gagtccacgcccacca

SEQ ID NO: 495793 - DNA, 23 bp, Homo sapiens
gagtccacgcccaccagccttgc

SEQ ID NO: 495794 - DNA, 18 bp, Homo sapiens
gagtctgctatattttca

SEQ ID NO: 495795 - DNA, 13 bp, Homo sapiens
gagtggaggcatt

SEQ ID NO: 495796 - DNA, 23 bp, Homo sapiens
gagttgacttgacagaacactgt

SEQ ID NO: 495797 - DNA, 19 bp, Homo sapiens
gagtttaagaccagcctgg

SEQ ID NO: 495798 - DNA, 12 bp, Homo sapiens
gagtttggtccc

SEQ ID NO: 495799 - DNA, 16 bp, Homo sapiens
gataataaaattcatt

SEQ ID NO: 495800 - DNA, 18 bp, Homo sapiens
gataattctagctttgag

SEQ ID NO: 495801 - DNA, 14 bp, Homo sapiens
gatagtagcttcct

SEQ ID NO: 495802 - DNA, 19 bp, Homo sapiens
gatataactattgcccagg

SEQ ID NO: 495803 - DNA, 16 bp, Homo sapiens
gatatagaacagtgct

SEQ ID NO: 495804 - DNA, 21 bp, Homo sapiens
gatatgggctttctctttggt

SEQ ID NO: 495805 - DNA, 16 bp, Homo sapiens
gatatttccatcatta

SEQ ID NO: 495806 - DNA, 16 bp, Homo sapiens
gatcaaggagaggagg

SEQ ID NO: 495807 - DNA, 13 bp, Homo sapiens
gatcaatgaaatg

SEQ ID NO: 495808 - DNA, 16 bp, Homo sapiens
gatcacagcagcttct

SEQ ID NO: 495809 - DNA, 23 bp, Homo sapiens
gatcagcttattgtctagtgaaa

SEQ ID NO: 495810 - DNA, 24 bp, Homo sapiens
gatcccatcttgataagaccacca

SEQ ID NO: 495811 - DNA, 21 bp, Homo sapiens
gatccccaactgctccagcct

SEQ ID NO: 495812 - DNA, 23 bp, Homo sapiens
gatcctaatgaatgcataaaatg

SEQ ID NO: 495813 - DNA, 13 bp, Homo sapiens
gatcctggaaatc

SEQ ID NO: 495814 - DNA, 19 bp, Homo sapiens
gatctatcacctgtcatca

SEQ ID NO: 495815 - DNA, 19 bp, Homo sapiens
gatgaaatcttacagctgg

SEQ ID NO: 495816 - DNA, 13 bp, Homo sapiens
gatgactgaattt

SEQ ID NO: 495817 - DNA, 16 bp, Homo sapiens
gatgactgaatttcta

SEQ ID NO: 495818 - DNA, 16 bp, Homo sapiens
gatgagcatcccagga

SEQ ID NO: 495819 - DNA, 16 bp, Homo sapiens
gatgagcatggagctg

SEQ ID NO: 495820 - DNA, 17 bp, Homo sapiens
gatgagcatggagctgg

SEQ ID NO: 495821 - DNA, 20 bp, Homo sapiens
gatgcatgttttccagctcc

SEQ ID NO: 495822 - DNA, 21 bp, Homo sapiens
gatgcatgttttccagctcct

SEQ ID NO: 495823 - DNA, 16 bp, Homo sapiens
gatggcagagccaggc

SEQ ID NO: 495824 - DNA, 15 bp, Homo sapiens
gatggcaggatggcc

SEQ ID NO: 495825 - DNA, 17 bp, Homo sapiens
gatggcaggatggcctg

SEQ ID NO: 495826 - DNA, 21 bp, Homo sapiens
gatgggggaaagcacaggtgg

SEQ ID NO: 495827 - DNA, 14 bp, Homo sapiens
gatgtcatcttgag

SEQ ID NO: 495828 - DNA, 14 bp, Homo sapiens
gatgtccaacaagg

SEQ ID NO: 495829 - DNA, 16 bp, Homo sapiens
gatgtccaacaaggaa

SEQ ID NO: 495830 - DNA, 22 bp, Homo sapiens
gattaagtaatgataactggaa

SEQ ID NO: 495831 - DNA, 18 bp, Homo sapiens
gattaatatggggatgca

SEQ ID NO: 495832 - DNA, 19 bp, Homo sapiens
gattctcagggtctctgct

SEQ ID NO: 495833 - DNA, 21 bp, Homo sapiens
gattgcaatttgcacaagttt

SEQ ID NO: 495834 - DNA, 22 bp, Homo sapiens
gattgcaatttgcacaagtttt

SEQ ID NO: 495835 - DNA, 22 bp, Homo sapiens
gattgcgtggaattgtgctgag

SEQ ID NO: 495836 - DNA, 16 bp, Homo sapiens
gatttatttggagtgg

SEQ ID NO: 495837 - DNA, 20 bp, Homo sapiens
gatttatttggagtggaggc

SEQ ID NO: 495838 - DNA, 19 bp, Homo sapiens
gatttggtgtacaattcag

SEQ ID NO: 495839 - DNA, 13 bp, Homo sapiens
gcaaaatgtgaat

SEQ ID NO: 495840 - DNA, 21 bp, Homo sapiens
gcaaaattgtttttggttgga

SEQ ID NO: 495841 - DNA, 15 bp, Homo sapiens
gcaaagtctaaagtt

SEQ ID NO: 495842 - DNA, 16 bp, Homo sapiens
gcaaattgtcacagga

SEQ ID NO: 495843 - DNA, 19 bp, Homo sapiens
gcaactgaggcagacagca

SEQ ID NO: 495844 - DNA, 21 bp, Homo sapiens
gcaactgaggcagacagcagc

SEQ ID NO: 495845 - DNA, 16 bp, Homo sapiens
gcaagactctgtctca

SEQ ID NO: 495846 - DNA, 13 bp, Homo sapiens
gcaagctcccaag

SEQ ID NO: 495847 - DNA, 19 bp, Homo sapiens
gcaagtgattgggacagag

SEQ ID NO: 495848 - DNA, 16 bp, Homo sapiens
gcaataaaatgggttt

SEQ ID NO: 495849 - DNA, 23 bp, Homo sapiens
gcaatgccatcctcaaacactgc

SEQ ID NO: 495850 - DNA, 15 bp, Homo sapiens
gcacaatagtaacct

SEQ ID NO: 495851 - DNA, 20 bp, Homo sapiens
gcacaatagtaacctgggta

SEQ ID NO: 495852 - DNA, 12 bp, Homo sapiens
gcacactgtagc

SEQ ID NO: 495853 - DNA, 21 bp, Homo sapiens
gcacagccatacggcactgaa

SEQ ID NO: 495854 - DNA, 17 bp, Homo sapiens
gcacagcccaaagaagg

SEQ ID NO: 495855 - DNA, 23 bp, Homo sapiens
gcacatttaagagacagtcaccc

SEQ ID NO: 495856 - DNA, 17 bp, Homo sapiens
gcaccacctctgtgggc

SEQ ID NO: 495857 - DNA, 23 bp, Homo sapiens
gcaccatagaagaacagcagatg

SEQ ID NO: 495858 - DNA, 22 bp, Homo sapiens
gcacctgcagcgcgcacacgca

SEQ ID NO: 495859 - DNA, 14 bp, Homo sapiens
gcacgcacacacac

SEQ ID NO: 495860 - DNA, 16 bp, Homo sapiens
gcacgcacacacacat

SEQ ID NO: 495861 - DNA, 23 bp, Homo sapiens
tgttttcccgagcaaagtctaaa

SEQ ID NO: 495862 - DNA, 15 bp, Homo sapiens
tgtttttaagaaaaa

SEQ ID NO: 495863 - DNA, 20 bp, Homo sapiens
tgtttttaagaaaaacatgt

SEQ ID NO: 495864 - DNA, 19 bp, Homo sapiens
ttaaaaaagaaacatttgg

SEQ ID NO: 495865 - DNA, 20 bp, Homo sapiens
ttaaaaataatagagcccca

SEQ ID NO: 495866 - DNA, 18 bp, Homo sapiens
ttaaaaattaattcttta

SEQ ID NO: 495867 - DNA, 14 bp, Homo sapiens
ttaaagcaaaggag

SEQ ID NO: 495868 - DNA, 12 bp, Homo sapiens
ttaaagcttggt

SEQ ID NO: 495869 - DNA, 23 bp, Homo sapiens
ttaacagagtttgatatgggctt

SEQ ID NO: 495870 - DNA, 19 bp, Homo sapiens
ttaacagctttctccagaa

SEQ ID NO: 495871 - DNA, 12 bp, Homo sapiens
ttaactcaatat

SEQ ID NO: 495872 - DNA, 16 bp, Homo sapiens
ttaagaaaaacatgtc

SEQ ID NO: 495873 - DNA, 19 bp, Homo sapiens
ttaagaaaaacatgtcatg

SEQ ID NO: 495874 - DNA, 20 bp, Homo sapiens
ttaagaaaaacatgtcatgt

SEQ ID NO: 495875 - DNA, 22 bp, Homo sapiens
ttaagaagactgcattatattt

SEQ ID NO: 495876 - DNA, 18 bp, Homo sapiens
ttaagacaaatgggactg

SEQ ID NO: 495877 - DNA, 22 bp, Homo sapiens
ttaagacaaatgggactgatgt

SEQ ID NO: 495878 - DNA, 13 bp, Homo sapiens
ttaagccctgagg

SEQ ID NO: 495879 - DNA, 16 bp, Homo sapiens
ttaatatggggatgca

SEQ ID NO: 495880 - DNA, 20 bp, Homo sapiens
ttacagctgggtggcactgc

SEQ ID NO: 495881 - DNA, 18 bp, Homo sapiens
ttacatcaaggcttcaaa

SEQ ID NO: 495882 - DNA, 15 bp, Homo sapiens
ttacatttgtataaa

SEQ ID NO: 495883 - DNA, 19 bp, Homo sapiens
ttacctaccacatgccaag

SEQ ID NO: 495884 - DNA, 12 bp, Homo sapiens
ttacctgggaaa

SEQ ID NO: 495885 - DNA, 19 bp, Homo sapiens
ttactatcatgtcaaacgt

SEQ ID NO: 495886 - DNA, 13 bp, Homo sapiens
ttagaaacataaa

SEQ ID NO: 495887 - DNA, 16 bp, Homo sapiens
ttagaaacataaataa

SEQ ID NO: 495888 - DNA, 13 bp, Homo sapiens
ttagaaatgcaaa

SEQ ID NO: 495889 - DNA, 11 bp, Homo sapiens
ttagacctcag

SEQ ID NO: 495890 - DNA, 13 bp, Homo sapiens
ttagacctcagcc

SEQ ID NO: 495891 - DNA, 22 bp, Homo sapiens
ttagatgcagttctgaagaaga

SEQ ID NO: 495892 - DNA, 20 bp, Homo sapiens
ttagcaaagagttaatatat

SEQ ID NO: 495893 - DNA, 18 bp, Homo sapiens
ttagccgggcatggtggc

SEQ ID NO: 495894 - DNA, 12 bp, Homo sapiens
ttagctggaaaa

SEQ ID NO: 495895 - DNA, 18 bp, Homo sapiens
ttagcttagacctcagcc

SEQ ID NO: 495896 - DNA, 21 bp, Homo sapiens
ttagcttagacctcagcctgt

SEQ ID NO: 495897 - DNA, 15 bp, Homo sapiens
ttagggaaaacattc

SEQ ID NO: 495898 - DNA, 23 bp, Homo sapiens
ttagtgaagtatgcactaatcaa

SEQ ID NO: 495899 - DNA, 12 bp, Homo sapiens
ttagttctattt

SEQ ID NO: 495900 - DNA, 18 bp, Homo sapiens
ttatataagcttgtattc

SEQ ID NO: 495901 - DNA, 19 bp, Homo sapiens
ttatatttgaaatattgac

SEQ ID NO: 495902 - DNA, 15 bp, Homo sapiens
ttatattttgaacaa

SEQ ID NO: 495903 - DNA, 20 bp, Homo sapiens
ttatcctgagtcccttaatc

SEQ ID NO: 495904 - DNA, 14 bp, Homo sapiens
ttatgaattacatt

SEQ ID NO: 495905 - DNA, 20 bp, Homo sapiens
ttatgatgtgggtcaaggaa

SEQ ID NO: 495906 - DNA, 21 bp, Homo sapiens
ttatgtaataatgtgaatcat

SEQ ID NO: 495907 - DNA, 18 bp, Homo sapiens
ttattactgtaagaaaat

SEQ ID NO: 495908 - DNA, 15 bp, Homo sapiens
ttattgtctagtgaa

SEQ ID NO: 495909 - DNA, 16 bp, Homo sapiens
ttatttccatattaaa

SEQ ID NO: 495910 - DNA, 18 bp, Homo sapiens
ttatttctacctttctga

SEQ ID NO: 495911 - DNA, 13 bp, Homo sapiens
ttatttgtacagt

SEQ ID NO: 495912 - DNA, 14 bp, Homo sapiens
ttatttgtacagtt

SEQ ID NO: 495913 - DNA, 19 bp, Homo sapiens
ttattttaataatgtttca

SEQ ID NO: 495914 - DNA, 17 bp, Homo sapiens
ttcaaaaattatatttt

SEQ ID NO: 495915 - DNA, 17 bp, Homo sapiens
ttcaaatccttgaagat

SEQ ID NO: 495916 - DNA, 21 bp, Homo sapiens
ttcaagtattaggggtaatat

SEQ ID NO: 495917 - DNA, 13 bp, Homo sapiens
ttcaataaaccac

SEQ ID NO: 495918 - DNA, 21 bp, Homo sapiens
ttcaataaaccacaagcatct

SEQ ID NO: 495919 - DNA, 19 bp, Homo sapiens
ttcagaatcacttctgaga

SEQ ID NO: 495920 - DNA, 23 bp, Homo sapiens
ttcagagctgacacaggatgaag

SEQ ID NO: 495921 - DNA, 13 bp, Homo sapiens
ttcagagctgccc

SEQ ID NO: 495922 - DNA, 15 bp, Homo sapiens
ttcagagctgccctc

SEQ ID NO: 495923 - DNA, 20 bp, Homo sapiens
ttcagagctgccctctcctg

SEQ ID NO: 495924 - DNA, 16 bp, Homo sapiens
ttcagaggctgaggtg

SEQ ID NO: 495925 - DNA, 22 bp, Homo sapiens
ttcagcctagccgacctcagcc

SEQ ID NO: 495926 - DNA, 16 bp, Homo sapiens
ttcaggagcagcctca

SEQ ID NO: 495927 - DNA, 20 bp, Homo sapiens
ttcaggagcagcctcagaac

SEQ ID NO: 495928 - DNA, 15 bp, Homo sapiens
ttcaggggctggggg

SEQ ID NO: 495929 - DNA, 20 bp, Homo sapiens
ttcaggggctgggggtgctg

SEQ ID NO: 495930 - DNA, 16 bp, Homo sapiens
ttcagtgaaagcatca

SEQ ID NO: 495931 - DNA, 20 bp, Homo sapiens
ttcatatgacattcatgcct

SEQ ID NO: 495932 - DNA, 19 bp, Homo sapiens
ttcatcaaatggaagacac

SEQ ID NO: 495933 - DNA, 16 bp, Homo sapiens
ttcatccgcctgtggg

SEQ ID NO: 495934 - DNA, 23 bp, Homo sapiens
ttcatctggaaccatcagaaaca

SEQ ID NO: 495935 - DNA, 23 bp, Homo sapiens
ttcatgacttttccatgtatcta

SEQ ID NO: 495936 - DNA, 16 bp, Homo sapiens
ttcattccattctgga

SEQ ID NO: 495937 - DNA, 16 bp, Homo sapiens
ttcattgactatcaaa

SEQ ID NO: 495938 - DNA, 12 bp, Homo sapiens
tgctcctcaggg

SEQ ID NO: 495939 - DNA, 17 bp, Homo sapiens
tgctctcttcaataaac

SEQ ID NO: 495940 - DNA, 14 bp, Homo sapiens
tgctcttctttaga

SEQ ID NO: 495941 - DNA, 19 bp, Homo sapiens
tgctgaatcggaatctctg

SEQ ID NO: 495942 - DNA, 15 bp, Homo sapiens
tgctgagttggtgtt

SEQ ID NO: 495943 - DNA, 20 bp, Homo sapiens
tgctgcccgtcttcagccta

SEQ ID NO: 495944 - DNA, 21 bp, Homo sapiens
tgctgcccgtcttcagcctag

SEQ ID NO: 495945 - DNA, 17 bp, Homo sapiens
tgctggagtcatgtgcc

SEQ ID NO: 495946 - DNA, 18 bp, Homo sapiens
tgctggcctctctgacat

SEQ ID NO: 495947 - DNA, 21 bp, Homo sapiens
tgctggcctctctgacatatg

SEQ ID NO: 495948 - DNA, 22 bp, Homo sapiens
tgctggtaatttgtatctgaag

SEQ ID NO: 495949 - DNA, 17 bp, Homo sapiens
tgctgtaaaaactgtgg

SEQ ID NO: 495950 - DNA, 21 bp, Homo sapiens
tgctgtattttaaaagaatga

SEQ ID NO: 495951 - DNA, 23 bp, Homo sapiens
tgctgtattttaaaagaatgatt

SEQ ID NO: 495952 - DNA, 12 bp, Homo sapiens
tgcttaatgaaa

SEQ ID NO: 495953 - DNA, 17 bp, Homo sapiens
tgcttctgttttataat

SEQ ID NO: 495954 - DNA, 22 bp, Homo sapiens
tgcttctgttttataattttgt

SEQ ID NO: 495955 - DNA, 15 bp, Homo sapiens
tgcttgccatccctc

SEQ ID NO: 495956 - DNA, 16 bp, Homo sapiens
tgcttgccatccctcc

SEQ ID NO: 495957 - DNA, 19 bp, Homo sapiens
tgctttaattgttaagata

SEQ ID NO: 495958 - DNA, 13 bp, Homo sapiens
tgctttggaaatc

SEQ ID NO: 495959 - DNA, 21 bp, Homo sapiens
tggaaactggatgaggtcata

SEQ ID NO: 495960 - DNA, 19 bp, Homo sapiens
tggaaagacagcttctcat

SEQ ID NO: 495961 - DNA, 14 bp, Homo sapiens
tggaaaggagagga

SEQ ID NO: 495962 - DNA, 15 bp, Homo sapiens
tggaaaggagaggaa

SEQ ID NO: 495963 - DNA, 18 bp, Homo sapiens
tggaaattcccttcatct

SEQ ID NO: 495964 - DNA, 20 bp, Homo sapiens
tggaacagattcacactgtc

SEQ ID NO: 495965 - DNA, 21 bp, Homo sapiens
tggaactctcctgctcctcag

SEQ ID NO: 495966 - DNA, 13 bp, Homo sapiens
tggaagacagaga

SEQ ID NO: 495967 - DNA, 15 bp, Homo sapiens
tggaagtgactttgg

SEQ ID NO: 495968 - DNA, 18 bp, Homo sapiens
tggaagttgcatggcatc

SEQ ID NO: 495969 - DNA, 12 bp, Homo sapiens
tggaatctggag

SEQ ID NO: 495970 - DNA, 18 bp, Homo sapiens
tggaattggagctcgtgg

SEQ ID NO: 495971 - DNA, 14 bp, Homo sapiens
tggacaaggaggtc

SEQ ID NO: 495972 - DNA, 17 bp, Homo sapiens
tggacggtgctccaggc

SEQ ID NO: 495973 - DNA, 19 bp, Homo sapiens
tggacggtgctccaggcag

SEQ ID NO: 495974 - DNA, 14 bp, Homo sapiens
tggacttccatttg

SEQ ID NO: 495975 - DNA, 18 bp, Homo sapiens
tggagaactagaacctgg

SEQ ID NO: 495976 - DNA, 19 bp, Homo sapiens
tggagaactagaacctgga

SEQ ID NO: 495977 - DNA, 20 bp, Homo sapiens
tggagaactagaacctggag

SEQ ID NO: 495978 - DNA, 19 bp, Homo sapiens
tggagactcctaggcagga

SEQ ID NO: 495979 - DNA, 19 bp, Homo sapiens
tggagagctagaacctgga

SEQ ID NO: 495980 - DNA, 23 bp, Homo sapiens
tggagagctagaacctggagagc

SEQ ID NO: 495981 - DNA, 21 bp, Homo sapiens
tggagagctagaacctggagg

SEQ ID NO: 495982 - DNA, 14 bp, Homo sapiens
tggagctcgtggaa

SEQ ID NO: 495983 - DNA, 17 bp, Homo sapiens
tggagctcgtggaacag

SEQ ID NO: 495984 - DNA, 21 bp, Homo sapiens
tggagctcgtgggacagtcac

SEQ ID NO: 495985 - DNA, 22 bp, Homo sapiens
gctaaggcgtggagctgcctga

SEQ ID NO: 495986 - DNA, 22 bp, Homo sapiens
gctacaaaataaagctgttctc

SEQ ID NO: 495987 - DNA, 15 bp, Homo sapiens
gctacctcacctggg

SEQ ID NO: 495988 - DNA, 14 bp, Homo sapiens
gctactagctcttt

SEQ ID NO: 495989 - DNA, 12 bp, Homo sapiens
gctactttgttt

SEQ ID NO: 495990 - DNA, 20 bp, Homo sapiens
gctagaaccaagaagggcta

SEQ ID NO: 495991 - DNA, 20 bp, Homo sapiens
gctagaacctggaagggcta

SEQ ID NO: 495992 - DNA, 15 bp, Homo sapiens
gctagaagctggagg

SEQ ID NO: 495993 - DNA, 18 bp, Homo sapiens
gctagatgtatgtacttc

SEQ ID NO: 495994 - DNA, 19 bp, Homo sapiens
gctatccagctatttttat

SEQ ID NO: 495995 - DNA, 22 bp, Homo sapiens
gctatttttatttgtttgtgca

SEQ ID NO: 495996 - DNA, 22 bp, Homo sapiens
gctcaaaatgatatgtttgagt

SEQ ID NO: 495997 - DNA, 19 bp, Homo sapiens
gctcaagggaccctgggtg

SEQ ID NO: 495998 - DNA, 20 bp, Homo sapiens
gctcaagggaccctgggtgg

SEQ ID NO: 495999 - DNA, 16 bp, Homo sapiens
gctcagagagggcagg

SEQ ID NO: 496000 - DNA, 17 bp, Homo sapiens
gctcagcctggtgggcc

SEQ ID NO: 496001 - DNA, 18 bp, Homo sapiens
gctcagcctggtgggcct

SEQ ID NO: 496002 - DNA, 15 bp, Homo sapiens
gctcaggaccaggca

SEQ ID NO: 496003 - DNA, 18 bp, Homo sapiens
ggattcaggggctggggg

SEQ ID NO: 496004 - DNA, 19 bp, Homo sapiens
ggattggggaagactgtgg

SEQ ID NO: 496005 - DNA, 12 bp, Homo sapiens
ggattttgagta

SEQ ID NO: 496006 - DNA, 16 bp, Homo sapiens
ggattttgtcaagcag

SEQ ID NO: 496007 - DNA, 18 bp, Homo sapiens
ggcaaaagacatcctcaa

SEQ ID NO: 496008 - DNA, 14 bp, Homo sapiens
ggcaactgaggcag

SEQ ID NO: 496009 - DNA, 23 bp, Homo sapiens
ggcaacttgggaactagactccc

SEQ ID NO: 496010 - DNA, 22 bp, Homo sapiens
ggcaactttccttgttccccat

SEQ ID NO: 496011 - DNA, 12 bp, Homo sapiens
ggcacaataaat

SEQ ID NO: 496012 - DNA, 17 bp, Homo sapiens
ggcacagtatgtcccat

SEQ ID NO: 496013 - DNA, 20 bp, Homo sapiens
ggcaccatagaagaacagca

SEQ ID NO: 496014 - DNA, 23 bp, Homo sapiens
ggcaccatagaagaacagcagat

SEQ ID NO: 496015 - DNA, 14 bp, Homo sapiens
ggcagaacagccgc

SEQ ID NO: 496016 - DNA, 20 bp, Homo sapiens
ggcagaacagccgctcctgt

SEQ ID NO: 496017 - DNA, 15 bp, Homo sapiens
ggcagacagcagctc

SEQ ID NO: 496018 - DNA, 15 bp, Homo sapiens
ggcagagccaggctg

SEQ ID NO: 496019 - DNA, 17 bp, Homo sapiens
ggcagagcttggactgg

SEQ ID NO: 496020 - DNA, 21 bp, Homo sapiens
ggcagagcttggactggatgc

SEQ ID NO: 496021 - DNA, 21 bp, Homo sapiens
ggcagcgtactcatcatcaac

SEQ ID NO: 496022 - DNA, 23 bp, Homo sapiens
ggcaggactcagctccccagagt

SEQ ID NO: 496023 - DNA, 15 bp, Homo sapiens
ggcaggatggcctgg

SEQ ID NO: 496024 - DNA, 19 bp, Homo sapiens
ggcaggatggcctggccag

SEQ ID NO: 496025 - DNA, 21 bp, Homo sapiens
ggcaggctaaggcgtggagct

SEQ ID NO: 496026 - DNA, 22 bp, Homo sapiens
ggcaggctaaggcgtggagctg

SEQ ID NO: 496027 - DNA, 22 bp, Homo sapiens
ggcaggctgtctggccaggcct

SEQ ID NO: 496028 - DNA, 22 bp, Homo sapiens
ggcagggatgatggcagagcca

SEQ ID NO: 496029 - DNA, 16 bp, Homo sapiens
ggcagtgccagggcag

SEQ ID NO: 496030 - DNA, 14 bp, Homo sapiens
ggcatactaataaa

SEQ ID NO: 496031 - DNA, 16 bp, Homo sapiens
ggcatcagcagcaggg

SEQ ID NO: 496032 - DNA, 16 bp, Homo sapiens
ggcatcagctggcgtc

SEQ ID NO: 496033 - DNA, 20 bp, Homo sapiens
ggcatccttcctcacaccag

SEQ ID NO: 496034 - DNA, 23 bp, Homo sapiens
ggcatggtggcacacgcctgtag

SEQ ID NO: 496035 - DNA, 21 bp, Homo sapiens
ggcatgtgcctatagtcccag

SEQ ID NO: 496036 - DNA, 20 bp, Homo sapiens
ggccagctgccccagccaga

SEQ ID NO: 496037 - DNA, 17 bp, Homo sapiens
ggccagggcctggaaga

SEQ ID NO: 496038 - DNA, 16 bp, Homo sapiens
ggccagtacctttcca

SEQ ID NO: 496039 - DNA, 14 bp, Homo sapiens
ggccatggagagct

SEQ ID NO: 496040 - DNA, 17 bp, Homo sapiens
ggccatggagagctgga

SEQ ID NO: 496041 - DNA, 12 bp, Homo sapiens
ggccctcccagt

SEQ ID NO: 496042 - DNA, 19 bp, Homo sapiens
ggccctgagctcggtggac

SEQ ID NO: 496043 - DNA, 14 bp, Homo sapiens
ggccgacggagccg

SEQ ID NO: 496044 - DNA, 16 bp, Homo sapiens
ggccgacggagccggg

SEQ ID NO: 496045 - DNA, 19 bp, Homo sapiens
ggccgttgatgttggctgg

SEQ ID NO: 496046 - DNA, 18 bp, Homo sapiens
ggcctcaagatcaatgaa

SEQ ID NO: 496047 - DNA, 22 bp, Homo sapiens
ggcctcctcacaacatggtgtc

SEQ ID NO: 496048 - DNA, 22 bp, Homo sapiens
ggcctgaatgcttataggtggc

SEQ ID NO: 496049 - DNA, 16 bp, Homo sapiens
ggcctggaagacagag

SEQ ID NO: 496050 - DNA, 17 bp, Homo sapiens
ggcctggccagggcctg

SEQ ID NO: 496051 - DNA, 23 bp, Homo sapiens
ggcgctacaaaataaagctgttc

SEQ ID NO: 496052 - DNA, 12 bp, Homo sapiens
ggcgtggagctg

SEQ ID NO: 496053 - DNA, 19 bp, Homo sapiens
ggctaaggcgtggagctgc

SEQ ID NO: 496054 - DNA, 22 bp, Homo sapiens
ggctaaggcgtggagctgcctg

SEQ ID NO: 496055 - DNA, 16 bp, Homo sapiens
ggctagaacctggaga

SEQ ID NO: 496056 - DNA, 18 bp, Homo sapiens
ggctagaacctggagggc

SEQ ID NO: 496057 - DNA, 14 bp, Homo sapiens
ggctagaacctggc

SEQ ID NO: 496058 - DNA, 10 bp, Homo sapiens
ggctcagcct

SEQ ID NO: 496059 - DNA, 13 bp, Homo sapiens
ggctctgaccagt

SEQ ID NO: 496060 - DNA, 17 bp, Homo sapiens
ggctctgagacacaccc

SEQ ID NO: 496061 - DNA, 17 bp, Homo sapiens
ggctcttctccccagag

SEQ ID NO: 496062 - DNA, 14 bp, Homo sapiens
ggctgagaacactg

SEQ ID NO: 496063 - DNA, 13 bp, Homo sapiens
ggctgctggcctg

SEQ ID NO: 496064 - DNA, 23 bp, Homo sapiens
ggctggaacagattcacactgtc

SEQ ID NO: 496065 - DNA, 18 bp, Homo sapiens
ggctggaatctggagagc

SEQ ID NO: 496066 - DNA, 20 bp, Homo sapiens
ggctggaatctggagagcta

SEQ ID NO: 496067 - DNA, 17 bp, Homo sapiens
ggctgggcaaggaggcc

SEQ ID NO: 496068 - DNA, 16 bp, Homo sapiens
ggctgggggtgctgga

SEQ ID NO: 496069 - DNA, 13 bp, Homo sapiens
ggctttctggaat

SEQ ID NO: 496070 - DNA, 16 bp, Homo sapiens
gggaatgaacctggag

SEQ ID NO: 496071 - DNA, 22 bp, Homo sapiens
gggacagtcacctcatggaatt

SEQ ID NO: 496072 - DNA, 19 bp, Homo sapiens
gggacatttgctcatggaa

SEQ ID NO: 496073 - DNA, 14 bp, Homo sapiens
gggaccctgggtgg

SEQ ID NO: 496074 - DNA, 17 bp, Homo sapiens
gggacgaagaagagcca

SEQ ID NO: 496075 - DNA, 12 bp, Homo sapiens
gggagccagggt

SEQ ID NO: 496076 - DNA, 20 bp, Homo sapiens
gggaggcagaggttgcagtg

SEQ ID NO: 496077 - DNA, 18 bp, Homo sapiens
gggatgatggcagagcca

SEQ ID NO: 496078 - DNA, 12 bp, Homo sapiens
gggcagctgcct

SEQ ID NO: 496079 - DNA, 15 bp, Homo sapiens
gggcaggcatgaagt

SEQ ID NO: 496080 - DNA, 20 bp, Homo sapiens
gggccagagtattggtctcc

SEQ ID NO: 496081 - DNA, 17 bp, Homo sapiens
gggccaggtgcagacct

SEQ ID NO: 496082 - DNA, 21 bp, Homo sapiens
gggcctcctctgtccagggcc

SEQ ID NO: 496083 - DNA, 16 bp, Homo sapiens
gggcctttggcaggtg

SEQ ID NO: 496084 - DNA, 20 bp, Homo sapiens
gggcgagactctgtctcaaa

SEQ ID NO: 496085 - DNA, 17 bp, Homo sapiens
gggctagaacctggaga

SEQ ID NO: 496086 - DNA, 12 bp, Homo sapiens
gggctagaatct

SEQ ID NO: 496087 - DNA, 20 bp, Homo sapiens
gggctcagcctggtgggcct

SEQ ID NO: 496088 - DNA, 13 bp, Homo sapiens
gggcttagagcag

SEQ ID NO: 496089 - DNA, 14 bp, Homo sapiens
gggcttagagcagt

SEQ ID NO: 496090 - DNA, 15 bp, Homo sapiens
ggggaattcatctct

SEQ ID NO: 496091 - DNA, 19 bp, Homo sapiens
ggggaattgaggacactga

SEQ ID NO: 496092 - DNA, 13 bp, Homo sapiens
ggggaggggcgct

SEQ ID NO: 496093 - DNA, 15 bp, Homo sapiens
ggggctgctggcctg

SEQ ID NO: 496094 - DNA, 12 bp, Homo sapiens
gggggaaagcac

SEQ ID NO: 496095 - DNA, 22 bp, Homo sapiens
ggggtcaccttgagaggcatga

SEQ ID NO: 496096 - DNA, 14 bp, Homo sapiens
gggtcaggagaggg

SEQ ID NO: 496097 - DNA, 13 bp, Homo sapiens
gggtctctgctgc

SEQ ID NO: 496098 - DNA, 15 bp, Homo sapiens
gggtctctgctgccg

SEQ ID NO: 496099 - DNA, 14 bp, Homo sapiens
gggtggcactgcca

SEQ ID NO: 496100 - DNA, 20 bp, Homo sapiens
gggttcacctgggctgaggc

SEQ ID NO: 496101 - DNA, 19 bp, Homo sapiens
gggttcagagactcagggc

SEQ ID NO: 496102 - DNA, 17 bp, Homo sapiens
ggtattgactcaacagt

SEQ ID NO: 496103 - DNA, 22 bp, Homo sapiens
ggtcaggagaggggcagaacag

SEQ ID NO: 496104 - DNA, 24 bp, Homo sapiens
ggtcagtgtccaaagcagggtctg

SEQ ID NO: 496105 - DNA, 15 bp, Homo sapiens
ggtcatttatgaaaa

SEQ ID NO: 496106 - DNA, 20 bp, Homo sapiens
ggtccacaggaagtgaagaa

SEQ ID NO: 496107 - DNA, 20 bp, Homo sapiens
ggtccctgataacaacctgg

SEQ ID NO: 496108 - DNA, 23 bp, Homo sapiens
ggtccctgataacaacctggaga

SEQ ID NO: 496109 - DNA, 14 bp, Homo sapiens
ggtcctggggcctc

SEQ ID NO: 496110 - DNA, 16 bp, Homo sapiens
ggtctctaggctgggg

SEQ ID NO: 496111 - DNA, 17 bp, Homo sapiens
ggtctctaggctgggga

SEQ ID NO: 496112 - DNA, 14 bp, Homo sapiens
ggtctctgctgccg

SEQ ID NO: 496113 - DNA, 18 bp, Homo sapiens
ggtgccacaaataaaatg

SEQ ID NO: 496114 - DNA, 22 bp, Homo sapiens
ggtgccccccttgccagacatg

SEQ ID NO: 496115 - DNA, 15 bp, Homo sapiens
ggtggacatggcccc

SEQ ID NO: 496116 - DNA, 19 bp, Homo sapiens
ggtggagccaatccactcc

SEQ ID NO: 496117 - DNA, 21 bp, Homo sapiens
ggtggagccagtaaacagagg

SEQ ID NO: 496118 - DNA, 17 bp, Homo sapiens
ggtggcacacgcctgta

SEQ ID NO: 496119 - DNA, 19 bp, Homo sapiens
ggtggcatgtgcctatagt

SEQ ID NO: 496120 - DNA, 23 bp, Homo sapiens
ggtggcatgtgcctatagtccca

SEQ ID NO: 496121 - DNA, 14 bp, Homo sapiens
ggtggctcacgcct

SEQ ID NO: 496122 - DNA, 20 bp, Homo sapiens
ggtgggcagatcacgaggtc

SEQ ID NO: 496123 - DNA, 14 bp, Homo sapiens
ggtgggcttcccag

SEQ ID NO: 496124 - DNA, 20 bp, Homo sapiens
ggtgggcttcccagtggctg

SEQ ID NO: 496125 - DNA, 16 bp, Homo sapiens
ggttaagccctgaggg

SEQ ID NO: 496126 - DNA, 15 bp, Homo sapiens
ggttggagagctaga

SEQ ID NO: 496127 - DNA, 13 bp, Homo sapiens
ggtttcagaagct

SEQ ID NO: 496128 - DNA, 15 bp, Homo sapiens
ggtttctggtctcta

SEQ ID NO: 496129 - DNA, 17 bp, Homo sapiens
ggtttgaagcctggaac

SEQ ID NO: 496130 - DNA, 16 bp, Homo sapiens
gtaaaataaaaggtcg

SEQ ID NO: 496131 - DNA, 15 bp, Homo sapiens
gtaaaattgtataga

SEQ ID NO: 496132 - DNA, 13 bp, Homo sapiens
gtaagagcacagg

SEQ ID NO: 496133 - DNA, 12 bp, Homo sapiens
gtaatatattgc

SEQ ID NO: 496134 - DNA, 15 bp, Homo sapiens
gtaatatattgctgc

SEQ ID NO: 496135 - DNA, 16 bp, Homo sapiens
gtaatatattgctgct

SEQ ID NO: 496136 - DNA, 13 bp, Homo sapiens
gaaaacattccat

SEQ ID NO: 496137 - DNA, 14 bp, Homo sapiens
gaaaacttatttga

SEQ ID NO: 496138 - DNA, 16 bp, Homo sapiens
gaaaacttatttgagt

SEQ ID NO: 496139 - DNA, 23 bp, Homo sapiens
gaaaacttctcttctgagcctct

SEQ ID NO: 496140 - DNA, 14 bp, Homo sapiens
gaaaagagatggcc

SEQ ID NO: 496141 - DNA, 19 bp, Homo sapiens
gaaaaggacaaataaagca

SEQ ID NO: 496142 - DNA, 14 bp, Homo sapiens
gaaaagtatgttag

SEQ ID NO: 496143 - DNA, 12 bp, Homo sapiens
gaaaatatcact

SEQ ID NO: 496144 - DNA, 19 bp, Homo sapiens
gaaacaccctcacactggg

SEQ ID NO: 496145 - DNA, 22 bp, Homo sapiens
gaaacaccctcacactgggact

SEQ ID NO: 496146 - DNA, 17 bp, Homo sapiens
gaaacataaataaaatg

SEQ ID NO: 496147 - DNA, 13 bp, Homo sapiens
gaaacatttatct

SEQ ID NO: 496148 - DNA, 15 bp, Homo sapiens
gaaaccacagctgct

SEQ ID NO: 496149 - DNA, 18 bp, Homo sapiens
gaaaccacagctgctgga

SEQ ID NO: 496150 - DNA, 21 bp, Homo sapiens
gaaaccattatgaagaagaga

SEQ ID NO: 496151 - DNA, 23 bp, Homo sapiens
gaaactcgttaatttgtagtgtt

SEQ ID NO: 496152 - DNA, 17 bp, Homo sapiens
gaaacttgttagaaatg

SEQ ID NO: 496153 - DNA, 22 bp, Homo sapiens
gaaagaaagttgcacggctgct

SEQ ID NO: 496154 - DNA, 18 bp, Homo sapiens
gaaagaagtggggacaga

SEQ ID NO: 496155 - DNA, 17 bp, Homo sapiens
gaaagagaacttccaga

SEQ ID NO: 496156 - DNA, 14 bp, Homo sapiens
gaaagagaaggtgg

SEQ ID NO: 496157 - DNA, 23 bp, Homo sapiens
gaaagcacaggtgggcttcccag

SEQ ID NO: 496158 - DNA, 19 bp, Homo sapiens
gaaaggaaaagattcctgt

SEQ ID NO: 496159 - DNA, 16 bp, Homo sapiens
gaaatattgctggggt

SEQ ID NO: 496160 - DNA, 16 bp, Homo sapiens
gaaatatttattttaa

SEQ ID NO: 496161 - DNA, 17 bp, Homo sapiens
gaaatatttattttaat

SEQ ID NO: 496162 - DNA, 22 bp, Homo sapiens
gaaatgtaccatcaaatgttaa

SEQ ID NO: 496163 - DNA, 17 bp, Homo sapiens
gaaattcccttcatctg

SEQ ID NO: 496164 - DNA, 15 bp, Homo sapiens
gaaattttctagaat

SEQ ID NO: 496165 - DNA, 13 bp, Homo sapiens
gaacaactcgaat

SEQ ID NO: 496166 - DNA, 16 bp, Homo sapiens
gaacactgggggaggg

SEQ ID NO: 496167 - DNA, 18 bp, Homo sapiens
gaacactgggggagggga

SEQ ID NO: 496168 - DNA, 18 bp, Homo sapiens
gaacagtgcttgccacag

SEQ ID NO: 496169 - DNA, 20 bp, Homo sapiens
gaacatcatcaaggcactgc

SEQ ID NO: 496170 - DNA, 14 bp, Homo sapiens
gaaccacaagactg

SEQ ID NO: 496171 - DNA, 15 bp, Homo sapiens
gaaccagtgtctgaa

SEQ ID NO: 496172 - DNA, 20 bp, Homo sapiens
gaacccaaagagacagctct

SEQ ID NO: 496173 - DNA, 17 bp, Homo sapiens
gaacctagaagggctag

SEQ ID NO: 496174 - DNA, 16 bp, Homo sapiens
gaacctggaggggcta

SEQ ID NO: 496175 - DNA, 17 bp, Homo sapiens
gaacctggaggggctag

SEQ ID NO: 496176 - DNA, 17 bp, Homo sapiens
gaacctgggaggcagag

SEQ ID NO: 496177 - DNA, 12 bp, Homo sapiens
gaacgtgtatgt

SEQ ID NO: 496178 - DNA, 22 bp, Homo sapiens
gaactagagtttagctggaaaa

SEQ ID NO: 496179 - DNA, 16 bp, Homo sapiens
gaactcacctggggct

SEQ ID NO: 496180 - DNA, 22 bp, Homo sapiens
gaactcacctggggctgctggc

SEQ ID NO: 496181 - DNA, 12 bp, Homo sapiens
ctcttatttgct

SEQ ID NO: 496182 - DNA, 18 bp, Homo sapiens
ctcttcaaggactttctg

SEQ ID NO: 496183 - DNA, 12 bp, Homo sapiens
ctcttcaataaa

SEQ ID NO: 496184 - DNA, 22 bp, Homo sapiens
ctcttcaataaaccacaagcat

SEQ ID NO: 496185 - DNA, 13 bp, Homo sapiens
ctcttctccccag

SEQ ID NO: 496186 - DNA, 11 bp, Homo sapiens
ctcttctgagc

SEQ ID NO: 496187 - DNA, 13 bp, Homo sapiens
ctgaaattttcta

SEQ ID NO: 496188 - DNA, 16 bp, Homo sapiens
ctgaagccaaagccaa

SEQ ID NO: 496189 - DNA, 19 bp, Homo sapiens
ctgaatagtcttcagagat

SEQ ID NO: 496190 - DNA, 19 bp, Homo sapiens
ctgaatgcttataggtggc

SEQ ID NO: 496191 - DNA, 22 bp, Homo sapiens
ctgacactggtattcctgcctc

SEQ ID NO: 496192 - DNA, 17 bp, Homo sapiens
ctgactcttaagaagac

SEQ ID NO: 496193 - DNA, 22 bp, Homo sapiens
ctgagaagagagatcaaatgga

SEQ ID NO: 496194 - DNA, 19 bp, Homo sapiens
ctgagattattttaatcta

SEQ ID NO: 496195 - DNA, 18 bp, Homo sapiens
ctgaggattcaggggctg

SEQ ID NO: 496196 - DNA, 21 bp, Homo sapiens
ctgaggattcaggggctgggg

SEQ ID NO: 496197 - DNA, 13 bp, Homo sapiens
ctgaggcagacag

SEQ ID NO: 496198 - DNA, 15 bp, Homo sapiens
ctgaggcagacagca

SEQ ID NO: 496199 - DNA, 16 bp, Homo sapiens
ctgaggcagacagcag

SEQ ID NO: 496200 - DNA, 13 bp, Homo sapiens
ctgagtgcctggc

SEQ ID NO: 496201 - DNA, 16 bp, Homo sapiens
ctgagtgcctggccaa

SEQ ID NO: 496202 - DNA, 22 bp, Homo sapiens
ctgatatttccctcccctgggg

SEQ ID NO: 496203 - DNA, 17 bp, Homo sapiens
ctgatgatgtgcctggg

SEQ ID NO: 496204 - DNA, 16 bp, Homo sapiens
ctgatggcaggatggc

SEQ ID NO: 496205 - DNA, 19 bp, Homo sapiens
ctgatggcttctccagggt

SEQ ID NO: 496206 - DNA, 11 bp, Homo sapiens
ctgatgtcatc

SEQ ID NO: 496207 - DNA, 12 bp, Homo sapiens
ctgatgtcatct

SEQ ID NO: 496208 - DNA, 17 bp, Homo sapiens
ctgatgtcatcttgagc

SEQ ID NO: 496209 - DNA, 18 bp, Homo sapiens
ctgatgtcatcttgagct

SEQ ID NO: 496210 - DNA, 14 bp, Homo sapiens
ctgattctcagggt

SEQ ID NO: 496211 - DNA, 18 bp, Homo sapiens
ctgattctcagggtctct

SEQ ID NO: 496212 - DNA, 21 bp, Homo sapiens
ctgattctcagggtctctgct

SEQ ID NO: 496213 - DNA, 22 bp, Homo sapiens
ctgcaataaaatgggttttact

SEQ ID NO: 496214 - DNA, 17 bp, Homo sapiens
ctgcagatttgggctgg

SEQ ID NO: 496215 - DNA, 19 bp, Homo sapiens
ctgcagatttgggctggaa

SEQ ID NO: 496216 - DNA, 23 bp, Homo sapiens
ctgcagatttgggctggaacaga

SEQ ID NO: 496217 - DNA, 15 bp, Homo sapiens
ctgcagtgagctgtg

SEQ ID NO: 496218 - DNA, 23 bp, Homo sapiens
ctgcatgcgagtgctcatttcag

SEQ ID NO: 496219 - DNA, 21 bp, Homo sapiens
ctgccaacttcttcagagctg

SEQ ID NO: 496220 - DNA, 15 bp, Homo sapiens
ctgccagccagcagc

SEQ ID NO: 496221 - DNA, 19 bp, Homo sapiens
ctgccagccagcagccagc

SEQ ID NO: 496222 - DNA, 18 bp, Homo sapiens
ctgccagtctcactgtgg

SEQ ID NO: 496223 - DNA, 16 bp, Homo sapiens
ctgcccacctccttcc

SEQ ID NO: 496224 - DNA, 13 bp, Homo sapiens
ctgccccagccag

SEQ ID NO: 496225 - DNA, 14 bp, Homo sapiens
ctgccccagccaga

SEQ ID NO: 496226 - DNA, 21 bp, Homo sapiens
ctgcccgtcttcagcctagcc

SEQ ID NO: 496227 - DNA, 14 bp, Homo sapiens
ctgccctctcctgg

SEQ ID NO: 496228 - DNA, 16 bp, Homo sapiens
ctgccctctcctgggc

SEQ ID NO: 496229 - DNA, 18 bp, Homo sapiens
ctgccctctcctgggcag

SEQ ID NO: 496230 - DNA, 14 bp, Homo sapiens
ctgcctcccctcct

SEQ ID NO: 496231 - DNA, 14 bp, Homo sapiens
ctgcctcccttcat

SEQ ID NO: 496232 - DNA, 16 bp, Homo sapiens
ctgcctgggagccagg

SEQ ID NO: 496233 - DNA, 13 bp, Homo sapiens
ctgcctgtggagt

SEQ ID NO: 496234 - DNA, 16 bp, Homo sapiens
ctgcctgttctgagga

SEQ ID NO: 496235 - DNA, 13 bp, Homo sapiens
ctgctacctcact

SEQ ID NO: 496236 - DNA, 14 bp, Homo sapiens
ctgctacctcactg

SEQ ID NO: 496237 - DNA, 15 bp, Homo sapiens
ctgctactagctctt

SEQ ID NO: 496238 - DNA, 19 bp, Homo sapiens
ctgctccagcctctgccgc

SEQ ID NO: 496239 - DNA, 20 bp, Homo sapiens
ctgctgccgccccacccaga

SEQ ID NO: 496240 - DNA, 17 bp, Homo sapiens
ctgctggtcttatcctg

SEQ ID NO: 496241 - DNA, 21 bp, Homo sapiens
ctgctggttaacttgtttggc

SEQ ID NO: 496242 - DNA, 23 bp, Homo sapiens
ctgctgtgaatttgtgtaaggat

SEQ ID NO: 496243 - DNA, 19 bp, Homo sapiens
ctgcttgccatccctccct

SEQ ID NO: 496244 - DNA, 13 bp, Homo sapiens
ctgctttggaaat

SEQ ID NO: 496245 - DNA, 16 bp, Homo sapiens
ctggaaattctgcctt

SEQ ID NO: 496246 - DNA, 16 bp, Homo sapiens
ctggaaccatcagaaa

SEQ ID NO: 496247 - DNA, 15 bp, Homo sapiens
ctggaagtgactttg

SEQ ID NO: 496248 - DNA, 19 bp, Homo sapiens
ctggaatggagctgtataa

SEQ ID NO: 496249 - DNA, 22 bp, Homo sapiens
ctggagaactagaacctggagg

SEQ ID NO: 496250 - DNA, 20 bp, Homo sapiens
ctggagaattgaaaaggact

SEQ ID NO: 496251 - DNA, 22 bp, Homo sapiens
ctggagagccagaacctggagg

SEQ ID NO: 496252 - DNA, 13 bp, Homo sapiens
ctggagagctaga

SEQ ID NO: 496253 - DNA, 15 bp, Homo sapiens
ctggagccatgggca

SEQ ID NO: 496254 - DNA, 20 bp, Homo sapiens
ctggagggctagaacctgga

SEQ ID NO: 496255 - DNA, 22 bp, Homo sapiens
ctggagggctggaatctggaga

SEQ ID NO: 496256 - DNA, 21 bp, Homo sapiens
ctggaggggctagaacctaga

SEQ ID NO: 496257 - DNA, 22 bp, Homo sapiens
ctggcaagctagaacctggagg

SEQ ID NO: 496258 - DNA, 14 bp, Homo sapiens
ctggccagggcctg

SEQ ID NO: 496259 - DNA, 16 bp, Homo sapiens
ctggccagggcctgga

SEQ ID NO: 496260 - DNA, 13 bp, Homo sapiens
ctgggaggcagag

SEQ ID NO: 496261 - DNA, 15 bp, Homo sapiens
ctgggaggcagaggt

SEQ ID NO: 496262 - DNA, 12 bp, Homo sapiens
ttgcaaggaagc

SEQ ID NO: 496263 - DNA, 13 bp, Homo sapiens
ttgcaaggaagcc

SEQ ID NO: 496264 - DNA, 15 bp, Homo sapiens
ttgcacggctgctga

SEQ ID NO: 496265 - DNA, 18 bp, Homo sapiens
ttgcagggagcatggctg

SEQ ID NO: 496266 - DNA, 17 bp, Homo sapiens
ttgcccagggctcagcc

SEQ ID NO: 496267 - DNA, 12 bp, Homo sapiens
ttgcctgcaggc

SEQ ID NO: 496268 - DNA, 16 bp, Homo sapiens
ttgctcatgccctgcc

SEQ ID NO: 496269 - DNA, 11 bp, Homo sapiens
ttgctgagcct

SEQ ID NO: 496270 - DNA, 21 bp, Homo sapiens
ttgctggagtcatgtgcctct

SEQ ID NO: 496271 - DNA, 18 bp, Homo sapiens
ttggaatgggcagctcat

SEQ ID NO: 496272 - DNA, 15 bp, Homo sapiens
ttggcatcagctggc

SEQ ID NO: 496273 - DNA, 19 bp, Homo sapiens
ttgggctggaacagattca

SEQ ID NO: 496274 - DNA, 18 bp, Homo sapiens
ttggtggctcacgcctgt

SEQ ID NO: 496275 - DNA, 16 bp, Homo sapiens
ttgtaaatgtggtaaa

SEQ ID NO: 496276 - DNA, 12 bp, Homo sapiens
ttgtaagtttat

SEQ ID NO: 496277 - DNA, 17 bp, Homo sapiens
ttgtacgttcttctatt

SEQ ID NO: 496278 - DNA, 20 bp, Homo sapiens
ttgtatgatcctaatgaatg

SEQ ID NO: 496279 - DNA, 23 bp, Homo sapiens
ttgtcatccacacaacaccagga

SEQ ID NO: 496280 - DNA, 16 bp, Homo sapiens
ttgtctgaaattttct

SEQ ID NO: 496281 - DNA, 16 bp, Homo sapiens
ttgtgtgttatttaaa

SEQ ID NO: 496282 - DNA, 15 bp, Homo sapiens
ttgttatttgtacag

SEQ ID NO: 496283 - DNA, 19 bp, Homo sapiens
ttgttccccatcatctgtg

SEQ ID NO: 496284 - DNA, 20 bp, Homo sapiens
ttgtttcattgactatcaaa

SEQ ID NO: 496285 - DNA, 22 bp, Homo sapiens
ttgtttttccttgtatttaaat

SEQ ID NO: 496286 - DNA, 17 bp, Homo sapiens
tttaaaagaatgattat

SEQ ID NO: 496287 - DNA, 15 bp, Homo sapiens
tttaaaagttattaa

SEQ ID NO: 496288 - DNA, 14 bp, Homo sapiens
tttaacagctttct

SEQ ID NO: 496289 - DNA, 20 bp, Homo sapiens
tttaagaaaaacatgtcatg

SEQ ID NO: 496290 - DNA, 13 bp, Homo sapiens
tttaataatgttt

SEQ ID NO: 496291 - DNA, 18 bp, Homo sapiens
tttaattgttaagatatg

SEQ ID NO: 496292 - DNA, 12 bp, Homo sapiens
tttagaaacaca

SEQ ID NO: 496293 - DNA, 13 bp, Homo sapiens
tttagcaccccca

SEQ ID NO: 496294 - DNA, 13 bp, Homo sapiens
tttatttccatat

SEQ ID NO: 496295 - DNA, 16 bp, Homo sapiens
tttattttaataatgt

SEQ ID NO: 496296 - DNA, 21 bp, Homo sapiens
tttcaatggtttgcaaggaag

SEQ ID NO: 496297 - DNA, 15 bp, Homo sapiens
tttcagataatcaca

SEQ ID NO: 496298 - DNA, 21 bp, Homo sapiens
tttcagataatcacaatacat

SEQ ID NO: 496299 - DNA, 17 bp, Homo sapiens
tttcagtgaaagcatca

SEQ ID NO: 496300 - DNA, 22 bp, Homo sapiens
tttcattgactatcaaactgaa

SEQ ID NO: 496301 - DNA, 16 bp, Homo sapiens
tttccaggtcagaaac

SEQ ID NO: 496302 - DNA, 17 bp, Homo sapiens
tttccatgaaaatgcaa

SEQ ID NO: 496303 - DNA, 13 bp, Homo sapiens
tttccgagtcaag

SEQ ID NO: 496304 - DNA, 22 bp, Homo sapiens
tttcctcttagtcgagccaagt

SEQ ID NO: 496305 - DNA, 15 bp, Homo sapiens
tttctacctttctga

SEQ ID NO: 496306 - DNA, 18 bp, Homo sapiens
tttctcatgaatctgcaa

SEQ ID NO: 496307 - DNA, 19 bp, Homo sapiens
tttctgaaaattaacactg

SEQ ID NO: 496308 - DNA, 20 bp, Homo sapiens
tttctgaaaattaacactgc

SEQ ID NO: 496309 - DNA, 14 bp, Homo sapiens
tttgaaatattgac

SEQ ID NO: 496310 - DNA, 15 bp, Homo sapiens
tttgaaatattgact

SEQ ID NO: 496311 - DNA, 15 bp, Homo sapiens
tttgaaatcagcata

SEQ ID NO: 496312 - DNA, 15 bp, Homo sapiens
tttgactgtgattta

SEQ ID NO: 496313 - DNA, 20 bp, Homo sapiens
tttgaggagcagcttcagtt

SEQ ID NO: 496314 - DNA, 14 bp, Homo sapiens
tttgcaaggaagcc

SEQ ID NO: 496315 - DNA, 21 bp, Homo sapiens
tttgcaaggaagccacagctg

SEQ ID NO: 496316 - DNA, 15 bp, Homo sapiens
tttgcatatgtatga

SEQ ID NO: 496317 - DNA, 23 bp, Homo sapiens
tttgcatcccccaaacttcttgt

SEQ ID NO: 496318 - DNA, 20 bp, Homo sapiens
tttgcctacgtgacaacaca

SEQ ID NO: 496319 - DNA, 19 bp, Homo sapiens
tttgctaagcattccaact

SEQ ID NO: 496320 - DNA, 12 bp, Homo sapiens
tttgctcatgga

SEQ ID NO: 496321 - DNA, 19 bp, Homo sapiens
tttggatctatcacctgtc

SEQ ID NO: 496322 - DNA, 21 bp, Homo sapiens
tttggccgttttgtgaagaaa

SEQ ID NO: 496323 - DNA, 22 bp, Homo sapiens
tttggctattaaaaaagtggtg

SEQ ID NO: 496324 - DNA, 13 bp, Homo sapiens
tttggtccctggg

SEQ ID NO: 496325 - DNA, 13 bp, Homo sapiens
tttgtaagtttat

SEQ ID NO: 496326 - DNA, 21 bp, Homo sapiens
tttgtaagtttatgtctaaag

SEQ ID NO: 496327 - DNA, 19 bp, Homo sapiens
tttgtagtgttggagaaga

SEQ ID NO: 496328 - DNA, 21 bp, Homo sapiens
tttgtagtgttggagaagaac

SEQ ID NO: 496329 - DNA, 14 bp, Homo sapiens
tttgtataaaataa

SEQ ID NO: 496330 - DNA, 15 bp, Homo sapiens
tagcttagacctcag

SEQ ID NO: 496331 - DNA, 17 bp, Homo sapiens
tagcttagacctcagcc

SEQ ID NO: 496332 - DNA, 23 bp, Homo sapiens
tagcttagacctcagcctgtgct

SEQ ID NO: 496333 - DNA, 16 bp, Homo sapiens
tagctttgctctgcca

SEQ ID NO: 496334 - DNA, 19 bp, Homo sapiens
taggaaatatttattttaa

SEQ ID NO: 496335 - DNA, 16 bp, Homo sapiens
taggacgccacccagc

SEQ ID NO: 496336 - DNA, 11 bp, Homo sapiens
taggagacttt

SEQ ID NO: 496337 - DNA, 17 bp, Homo sapiens
taggcaggacatgctga

SEQ ID NO: 496338 - DNA, 13 bp, Homo sapiens
tagggaaaacatt

SEQ ID NO: 496339 - DNA, 16 bp, Homo sapiens
tagggaaaacattcca

SEQ ID NO: 496340 - DNA, 18 bp, Homo sapiens
tagggaaaacattccatc

SEQ ID NO: 496341 - DNA, 23 bp, Homo sapiens
taggggtaatatattgctgctgg

SEQ ID NO: 496342 - DNA, 16 bp, Homo sapiens
taggtggcaaggctgt

SEQ ID NO: 496343 - DNA, 17 bp, Homo sapiens
cgagaccatcctggcca

SEQ ID NO: 496344 - DNA, 20 bp, Homo sapiens
cgagcaaagtctaaagttta

SEQ ID NO: 496345 - DNA, 18 bp, Homo sapiens
cgagcagggtgctgtggg

SEQ ID NO: 496346 - DNA, 14 bp, Homo sapiens
cgaggcagggtcag

SEQ ID NO: 496347 - DNA, 22 bp, Homo sapiens
cgaggcagggtcaggagagggg

SEQ ID NO: 496348 - DNA, 22 bp, Homo sapiens
cgcaagagccatgtagaagctg

SEQ ID NO: 496349 - DNA, 17 bp, Homo sapiens
cgcacacacacatacag

SEQ ID NO: 496350 - DNA, 15 bp, Homo sapiens
cgcccaccagccttg

SEQ ID NO: 496351 - DNA, 23 bp, Homo sapiens
cgcccaccagccttgctctcttc

SEQ ID NO: 496352 - DNA, 13 bp, Homo sapiens
cgccccacccaga

SEQ ID NO: 496353 - DNA, 17 bp, Homo sapiens
cgcctttccgcggagcc

SEQ ID NO: 496354 - DNA, 23 bp, Homo sapiens
cgctacaaaataaagctgttctc

SEQ ID NO: 496355 - DNA, 14 bp, Homo sapiens
cgctcctgtctgcc

SEQ ID NO: 496356 - DNA, 16 bp, Homo sapiens
cgctcctgtctgccag

SEQ ID NO: 496357 - DNA, 21 bp, Homo sapiens
cgctcctgtctgccagccagc

SEQ ID NO: 496358 - DNA, 23 bp, Homo sapiens
cgctgattctcagggtctctgct

SEQ ID NO: 496359 - DNA, 23 bp, Homo sapiens
cggaaggaatgtcagggccaggt

SEQ ID NO: 496360 - DNA, 21 bp, Homo sapiens
cggaaggggacgctttgaagg

SEQ ID NO: 496361 - DNA, 20 bp, Homo sapiens
cggagcctcatccgaggcag

SEQ ID NO: 496362 - DNA, 21 bp, Homo sapiens
cggagcctcatccgaggcagg

SEQ ID NO: 496363 - DNA, 23 bp, Homo sapiens
cggataggcaggaacatacagac

SEQ ID NO: 496364 - DNA, 15 bp, Homo sapiens
cggcattaaagccat

SEQ ID NO: 496365 - DNA, 15 bp, Homo sapiens
cggtgatcagcagag

SEQ ID NO: 496366 - DNA, 15 bp, Homo sapiens
cggtttatataagct

SEQ ID NO: 496367 - DNA, 14 bp, Homo sapiens
cggtttcagaagct

SEQ ID NO: 496368 - DNA, 14 bp, Homo sapiens
cgtacatgtgaggc

SEQ ID NO: 496369 - DNA, 14 bp, Homo sapiens
cgtcttcagcctag

SEQ ID NO: 496370 - DNA, 15 bp, Homo sapiens
cgtcttcagcctagc

SEQ ID NO: 496371 - DNA, 12 bp, Homo sapiens
cgtgacaacaca

SEQ ID NO: 496372 - DNA, 16 bp, Homo sapiens
cgtggacaggtgtgcc

SEQ ID NO: 496373 - DNA, 18 bp, Homo sapiens
cgtggagcagaatcagta

SEQ ID NO: 496374 - DNA, 16 bp, Homo sapiens
cgtggaggagcagtgc

SEQ ID NO: 496375 - DNA, 11 bp, Homo sapiens
cgttgtgaggg

SEQ ID NO: 496376 - DNA, 22 bp, Homo sapiens
ctaaaataagggcagagtcaca

SEQ ID NO: 496377 - DNA, 18 bp, Homo sapiens
ctaaacagactatttaac

SEQ ID NO: 496378 - DNA, 21 bp, Homo sapiens
ctaaagaaggtttcagaaaga

SEQ ID NO: 496379 - DNA, 18 bp, Homo sapiens
ctaaagcagtggacacca

SEQ ID NO: 496380 - DNA, 15 bp, Homo sapiens
ctaaagtatgaagca

SEQ ID NO: 496381 - DNA, 19 bp, Homo sapiens
ctaaagtttacagtaaata

SEQ ID NO: 496382 - DNA, 18 bp, Homo sapiens
ctaaatgtaagaatcatt

SEQ ID NO: 496383 - DNA, 16 bp, Homo sapiens
ctaacacacagctccc

SEQ ID NO: 496384 - DNA, 17 bp, Homo sapiens
ctaagatgttcactgtg

SEQ ID NO: 496385 - DNA, 12 bp, Homo sapiens
ctaatatcagca

SEQ ID NO: 496386 - DNA, 17 bp, Homo sapiens
ctaatttaacccagctc

SEQ ID NO: 496387 - DNA, 16 bp, Homo sapiens
ctacaaaataaagctg

SEQ ID NO: 496388 - DNA, 22 bp, Homo sapiens
ctacacccctcccctgccctag

SEQ ID NO: 496389 - DNA, 14 bp, Homo sapiens
ctacactaagagag

SEQ ID NO: 496390 - DNA, 19 bp, Homo sapiens
ctaccaagctatcctggct

SEQ ID NO: 496391 - DNA, 19 bp, Homo sapiens
ctaccaattatagatcaaa

SEQ ID NO: 496392 - DNA, 18 bp, Homo sapiens
ctaccacatgccaagcac

SEQ ID NO: 496393 - DNA, 20 bp, Homo sapiens
ctacccaggaggctgaggtg

SEQ ID NO: 496394 - DNA, 14 bp, Homo sapiens
ctactcctgggtca

SEQ ID NO: 496395 - DNA, 17 bp, Homo sapiens
ctagaacctagaagggc

SEQ ID NO: 496396 - DNA, 18 bp, Homo sapiens
ctagaacctagaagggct

SEQ ID NO: 496397 - DNA, 14 bp, Homo sapiens
ctagaacctggaga

SEQ ID NO: 496398 - DNA, 16 bp, Homo sapiens
ctagaacctggagggc

SEQ ID NO: 496399 - DNA, 19 bp, Homo sapiens
ctagaatactaataaaata

SEQ ID NO: 496400 - DNA, 13 bp, Homo sapiens
ctagccgacctca

SEQ ID NO: 496401 - DNA, 12 bp, Homo sapiens
ctagctctttga

SEQ ID NO: 496402 - DNA, 20 bp, Homo sapiens
ctaggaaatatttattttaa

SEQ ID NO: 496403 - DNA, 18 bp, Homo sapiens
ctaggacgccacccagca

SEQ ID NO: 496404 - DNA, 22 bp, Homo sapiens
ctaggctggggaagtcctctgg

SEQ ID NO: 496405 - DNA, 19 bp, Homo sapiens
ctagggttccactggagaa

SEQ ID NO: 496406 - DNA, 21 bp, Homo sapiens
ctagtaaagacataggaacat

SEQ ID NO: 496407 - DNA, 13 bp, Homo sapiens
ctagtggagagaa

SEQ ID NO: 496408 - DNA, 23 bp, Homo sapiens
ctagttgatcagcttattgtcta

SEQ ID NO: 496409 - DNA, 17 bp, Homo sapiens
ctataaacaattacatg

SEQ ID NO: 496410 - DNA, 13 bp, Homo sapiens
ctatattgtacac

SEQ ID NO: 496411 - DNA, 14 bp, Homo sapiens
ctatattgtacaca

SEQ ID NO: 496412 - DNA, 19 bp, Homo sapiens
ctatattgtttgctaagca

SEQ ID NO: 496413 - DNA, 13 bp, Homo sapiens
ctatcaaactgaa

SEQ ID NO: 496414 - DNA, 12 bp, Homo sapiens
ctatcacctgtc

SEQ ID NO: 496415 - DNA, 16 bp, Homo sapiens
ctatcacctgtcatca

SEQ ID NO: 496416 - DNA, 18 bp, Homo sapiens
ctatcatgtcaaacgtga

SEQ ID NO: 496417 - DNA, 14 bp, Homo sapiens
ctatctttgccacc

SEQ ID NO: 496418 - DNA, 19 bp, Homo sapiens
ctatctttgccaccctcat

SEQ ID NO: 496419 - DNA, 21 bp, Homo sapiens
ctatctttgccaccctcatgc

SEQ ID NO: 496420 - DNA, 15 bp, Homo sapiens
ctatgatttggaaaa

SEQ ID NO: 496421 - DNA, 17 bp, Homo sapiens
ctatggaagcatattgt

SEQ ID NO: 496422 - DNA, 23 bp, Homo sapiens
ctatggcatattgataataaaat

SEQ ID NO: 496423 - DNA, 15 bp, Homo sapiens
ctatgggagcctcag

SEQ ID NO: 496424 - DNA, 16 bp, Homo sapiens
ctattgtgctttctat

SEQ ID NO: 496425 - DNA, 15 bp, Homo sapiens
ctatttaacttgagg

SEQ ID NO: 496426 - DNA, 22 bp, Homo sapiens
ctcaaaacccatctgggctcct

SEQ ID NO: 496427 - DNA, 21 bp, Homo sapiens
ctcaaaatgatatgtttgagt

SEQ ID NO: 496428 - DNA, 13 bp, Homo sapiens
ctcaaacactgca

SEQ ID NO: 496429 - DNA, 16 bp, Homo sapiens
ctcaaacactgcaggc

SEQ ID NO: 496430 - DNA, 18 bp, Homo sapiens
ctcaaacactgcaggcat

SEQ ID NO: 496431 - DNA, 22 bp, Homo sapiens
ctcaaaccaaatcactgaactt

SEQ ID NO: 496432 - DNA, 14 bp, Homo sapiens
ctcaagaagcaggc

SEQ ID NO: 496433 - DNA, 17 bp, Homo sapiens
ctcaagatcaatgaaat

SEQ ID NO: 496434 - DNA, 22 bp, Homo sapiens
ctcaagtgggaacgactgggca

SEQ ID NO: 496435 - DNA, 20 bp, Homo sapiens
ctcaataaactgaatttttc

SEQ ID NO: 496436 - DNA, 19 bp, Homo sapiens
ctcaatattttccatgaaa

SEQ ID NO: 496437 - DNA, 23 bp, Homo sapiens
ctcacaccaggcttgcctgcagg

SEQ ID NO: 496438 - DNA, 20 bp, Homo sapiens
ctcacctgggcagggatgat

SEQ ID NO: 496439 - DNA, 17 bp, Homo sapiens
ctcacctggggctgctg

SEQ ID NO: 496440 - DNA, 20 bp, Homo sapiens
ctcacctggggctgctggcc

SEQ ID NO: 496441 - DNA, 21 bp, Homo sapiens
ctcacctggggctgctggcct

SEQ ID NO: 496442 - DNA, 17 bp, Homo sapiens
ctcactggggtcctggg

SEQ ID NO: 496443 - DNA, 17 bp, Homo sapiens
ctcagaaaacttctctt

SEQ ID NO: 496444 - DNA, 23 bp, Homo sapiens
ctcagaaaacttctcttctgagc

SEQ ID NO: 496445 - DNA, 13 bp, Homo sapiens
ggagagctggagc

SEQ ID NO: 496446 - DNA, 17 bp, Homo sapiens
ggagagctggagcctgg

SEQ ID NO: 496447 - DNA, 18 bp, Homo sapiens
ggagagctggagcctggt

SEQ ID NO: 496448 - DNA, 20 bp, Homo sapiens
ggagaggagtgactgagctt

SEQ ID NO: 496449 - DNA, 21 bp, Homo sapiens
ggagaggctagaaccaagaag

SEQ ID NO: 496450 - DNA, 14 bp, Homo sapiens
ggagatagggaaag

SEQ ID NO: 496451 - DNA, 13 bp, Homo sapiens
ggagcagaatcag

SEQ ID NO: 496452 - DNA, 23 bp, Homo sapiens
ggagcagaatcagtattgggagc

SEQ ID NO: 496453 - DNA, 13 bp, Homo sapiens
ggagcagcctcag

SEQ ID NO: 496454 - DNA, 15 bp, Homo sapiens
ggagcatttggagag

SEQ ID NO: 496455 - DNA, 23 bp, Homo sapiens
ggagccaagggttcagagactca

SEQ ID NO: 496456 - DNA, 16 bp, Homo sapiens
ggagcccttggcccct

SEQ ID NO: 496457 - DNA, 21 bp, Homo sapiens
ggagccgggaaagaagagccg

SEQ ID NO: 496458 - DNA, 20 bp, Homo sapiens
ggagcctcatccgaggcagg

SEQ ID NO: 496459 - DNA, 14 bp, Homo sapiens
ggagctcagagagg

SEQ ID NO: 496460 - DNA, 19 bp, Homo sapiens
ggaggactagaacctggag

SEQ ID NO: 496461 - DNA, 17 bp, Homo sapiens
ggaggagcaaaggctga

SEQ ID NO: 496462 - DNA, 16 bp, Homo sapiens
ggaggccgaggcacga

SEQ ID NO: 496463 - DNA, 18 bp, Homo sapiens
ggaggccgaggtgggcag

SEQ ID NO: 496464 - DNA, 13 bp, Homo sapiens
ggaggctgaggca

SEQ ID NO: 496465 - DNA, 21 bp, Homo sapiens
ggagggctagaacctggaagg

SEQ ID NO: 496466 - DNA, 14 bp, Homo sapiens
ggagggctggaatc

SEQ ID NO: 496467 - DNA, 20 bp, Homo sapiens
ggagggctggaatctggaga

SEQ ID NO: 496468 - DNA, 21 bp, Homo sapiens
ggaggttgccgtgagccaaga

SEQ ID NO: 496469 - DNA, 14 bp, Homo sapiens
ggagtcatgtgcct

SEQ ID NO: 496470 - DNA, 15 bp, Homo sapiens
ggagtctgactgtgc

SEQ ID NO: 496471 - DNA, 16 bp, Homo sapiens
ggagtctgactgtgcc

SEQ ID NO: 496472 - DNA, 11 bp, Homo sapiens
ggagtggaggc

SEQ ID NO: 496473 - DNA, 21 bp, Homo sapiens
ggagttggaagtgtgtgatct

SEQ ID NO: 496474 - DNA, 20 bp, Homo sapiens
ggagtttaagaccagcctgg

SEQ ID NO: 496475 - DNA, 20 bp, Homo sapiens
ggataggcaggaacatacag

SEQ ID NO: 496476 - DNA, 17 bp, Homo sapiens
ggatctatcacctgtca

SEQ ID NO: 496477 - DNA, 16 bp, Homo sapiens
ggatgacatgtcccta

SEQ ID NO: 496478 - DNA, 17 bp, Homo sapiens
ggatgagcatggagctg

SEQ ID NO: 496479 - DNA, 17 bp, Homo sapiens
ggatgatggcagagcca

SEQ ID NO: 496480 - DNA, 15 bp, Homo sapiens
ggattgttcctgtca

SEQ ID NO: 496481 - DNA, 16 bp, Homo sapiens
ggcaaaaatgtgccct

SEQ ID NO: 496482 - DNA, 20 bp, Homo sapiens
ggcaactgaggcagacagca

SEQ ID NO: 496483 - DNA, 18 bp, Homo sapiens
ggcaacttgggaactaga

SEQ ID NO: 496484 - DNA, 18 bp, Homo sapiens
ggcaagctagaacctgga

SEQ ID NO: 496485 - DNA, 18 bp, Homo sapiens
ggcaattattttggatct

SEQ ID NO: 496486 - DNA, 11 bp, Homo sapiens
ggcacaataaa

SEQ ID NO: 496487 - DNA, 18 bp, Homo sapiens
ggcacatttaagagacag

SEQ ID NO: 496488 - DNA, 12 bp, Homo sapiens
ggcactgcctga

SEQ ID NO: 496489 - DNA, 18 bp, Homo sapiens
ggcagaacagccgctcct

SEQ ID NO: 496490 - DNA, 14 bp, Homo sapiens
ggcagacagcagct

SEQ ID NO: 496491 - DNA, 16 bp, Homo sapiens
ggcagacagcagctca

SEQ ID NO: 496492 - DNA, 17 bp, Homo sapiens
ggcagacagcagctcag

SEQ ID NO: 496493 - DNA, 18 bp, Homo sapiens
ggcagacagcagctcagg

SEQ ID NO: 496494 - DNA, 23 bp, Homo sapiens
ggcagagattggaatgggcagct

SEQ ID NO: 496495 - DNA, 21 bp, Homo sapiens
ggcagaggttgcagtgagccg

SEQ ID NO: 496496 - DNA, 16 bp, Homo sapiens
ggcagctgcctcccct

SEQ ID NO: 496497 - DNA, 21 bp, Homo sapiens
ggcagctgcctcccctcctct

SEQ ID NO: 496498 - DNA, 22 bp, Homo sapiens
ggcagctgcctcccctcctctg

SEQ ID NO: 496499 - DNA, 14 bp, Homo sapiens
ggcaggaaggctga

SEQ ID NO: 496500 - DNA, 21 bp, Homo sapiens
ggcaggactcagctccccaga

SEQ ID NO: 496501 - DNA, 16 bp, Homo sapiens
ggcaggatggcctggc

SEQ ID NO: 496502 - DNA, 18 bp, Homo sapiens
ggcaggctagaacctggc

SEQ ID NO: 496503 - DNA, 19 bp, Homo sapiens
ggcaggctagaacctggca

SEQ ID NO: 496504 - DNA, 15 bp, Homo sapiens
ggcagggtcaggaga

SEQ ID NO: 496505 - DNA, 20 bp, Homo sapiens
ggcaggttagaacctagaag

SEQ ID NO: 496506 - DNA, 16 bp, Homo sapiens
ggcatccttctgcctt

SEQ ID NO: 496507 - DNA, 19 bp, Homo sapiens
ggccagagtattggtctcc

SEQ ID NO: 496508 - DNA, 23 bp, Homo sapiens
ggccaggagtttaagaccagcct

SEQ ID NO: 496509 - DNA, 12 bp, Homo sapiens
ggccagggcctg

SEQ ID NO: 496510 - DNA, 19 bp, Homo sapiens
ggccagggcctggaagaca

SEQ ID NO: 496511 - DNA, 23 bp, Homo sapiens
ggccagggcctggaagacagaga

SEQ ID NO: 496512 - DNA, 21 bp, Homo sapiens
ggccatggagagctggagcct

SEQ ID NO: 496513 - DNA, 22 bp, Homo sapiens
ggcccagtatgagccctagaag

SEQ ID NO: 496514 - DNA, 16 bp, Homo sapiens
ggccccagcactaaag

SEQ ID NO: 496515 - DNA, 14 bp, Homo sapiens
ggccctgagctcgg

SEQ ID NO: 496516 - DNA, 15 bp, Homo sapiens
ggccgaggtgggcag

SEQ ID NO: 496517 - DNA, 19 bp, Homo sapiens
ggcctctccttgtggcctg

SEQ ID NO: 496518 - DNA, 18 bp, Homo sapiens
ggcctggccagggcctgg

SEQ ID NO: 496519 - DNA, 22 bp, Homo sapiens
ggcctggccagggcctggaaga

SEQ ID NO: 496520 - DNA, 14 bp, Homo sapiens
ggcctgggccagag

SEQ ID NO: 496521 - DNA, 18 bp, Homo sapiens
ggcctggggtaccaagag

SEQ ID NO: 496522 - DNA, 23 bp, Homo sapiens
ggcctgtgtgttgccaggcaggc

SEQ ID NO: 496523 - DNA, 15 bp, Homo sapiens
ggcgtggagctgcct

SEQ ID NO: 496524 - DNA, 21 bp, Homo sapiens
ggctagaaccaagaagggcta

SEQ ID NO: 496525 - DNA, 22 bp, Homo sapiens
ggctagaacctggagagctaga

SEQ ID NO: 496526 - DNA, 16 bp, Homo sapiens
ggctagaacctggagg

SEQ ID NO: 496527 - DNA, 22 bp, Homo sapiens
ggctagaatctggagagctaga

SEQ ID NO: 496528 - DNA, 15 bp, Homo sapiens
ggctatcccttctca

SEQ ID NO: 496529 - DNA, 11 bp, Homo sapiens
ggctcagcctg

SEQ ID NO: 496530 - DNA, 20 bp, Homo sapiens
ggctcagcctggtgggcctc

SEQ ID NO: 496531 - DNA, 18 bp, Homo sapiens
ggctccacacctccaatg

SEQ ID NO: 496532 - DNA, 15 bp, Homo sapiens
ggctgatggagtaaa

SEQ ID NO: 496533 - DNA, 19 bp, Homo sapiens
ggctggaatctggagagct

SEQ ID NO: 496534 - DNA, 17 bp, Homo sapiens
ggctggggaagtcctct

SEQ ID NO: 496535 - DNA, 18 bp, Homo sapiens
ggcttagctttgctctgc

SEQ ID NO: 496536 - DNA, 16 bp, Homo sapiens
ggcttatccagctggt

SEQ ID NO: 496537 - DNA, 21 bp, Homo sapiens
ggcttcccagtggctgctgcc

SEQ ID NO: 496538 - DNA, 18 bp, Homo sapiens
ggcttctgcttgtcatcc

SEQ ID NO: 496539 - DNA, 14 bp, Homo sapiens
ggcttgcctgcagg

SEQ ID NO: 496540 - DNA, 15 bp, Homo sapiens
ggcttgcctgcaggc

SEQ ID NO: 496541 - DNA, 21 bp, Homo sapiens
ggcttggtggctcacgcctgt

SEQ ID NO: 496542 - DNA, 12 bp, Homo sapiens
gggaatcaagat

SEQ ID NO: 496543 - DNA, 21 bp, Homo sapiens
gggaatgcctgagtgcctggc

SEQ ID NO: 496544 - DNA, 16 bp, Homo sapiens
gggaatggcacagccc

SEQ ID NO: 496545 - DNA, 22 bp, Homo sapiens
gggaatggcacagcccaaagaa

SEQ ID NO: 496546 - DNA, 13 bp, Homo sapiens
gggacagagcaga

SEQ ID NO: 496547 - DNA, 21 bp, Homo sapiens
gggacatttgctcatggaatt

SEQ ID NO: 496548 - DNA, 20 bp, Homo sapiens
gggacgaagaagagccacag

SEQ ID NO: 496549 - DNA, 16 bp, Homo sapiens
gggactgatgtcatct

SEQ ID NO: 496550 - DNA, 17 bp, Homo sapiens
gggagagtgcaggcctg

SEQ ID NO: 496551 - DNA, 22 bp, Homo sapiens
gggaggggtaaaattccttagc

SEQ ID NO: 496552 - DNA, 22 bp, Homo sapiens
gggatgatggcagagccaggct

SEQ ID NO: 496553 - DNA, 22 bp, Homo sapiens
gggatgtacaaggcgatcccat

SEQ ID NO: 496554 - DNA, 22 bp, Homo sapiens
gggcagaacagccgctcctgtc

SEQ ID NO: 496555 - DNA, 14 bp, Homo sapiens
gggcagctgcctcc

SEQ ID NO: 496556 - DNA, 22 bp, Homo sapiens
gggcaggactcagctccccaga

SEQ ID NO: 496557 - DNA, 15 bp, Homo sapiens
gggcatactaataaa

SEQ ID NO: 496558 - DNA, 12 bp, Homo sapiens
gggccctgagct

SEQ ID NO: 496559 - DNA, 12 bp, Homo sapiens
gggccctgcctg

SEQ ID NO: 496560 - DNA, 17 bp, Homo sapiens
gggcctcggagcctcat

SEQ ID NO: 496561 - DNA, 14 bp, Homo sapiens
gggctagaacctgg

SEQ ID NO: 496562 - DNA, 15 bp, Homo sapiens
gggctagaacctgga

SEQ ID NO: 496563 - DNA, 17 bp, Homo sapiens
gggctagaacctggagg

SEQ ID NO: 496564 - DNA, 18 bp, Homo sapiens
gggctatcccttctcaga

SEQ ID NO: 496565 - DNA, 12 bp, Homo sapiens
gggctcagcctg

SEQ ID NO: 496566 - DNA, 13 bp, Homo sapiens
gggctcagcctgg

SEQ ID NO: 496567 - DNA, 16 bp, Homo sapiens
gggctcagcctggtgg

SEQ ID NO: 496568 - DNA, 12 bp, Homo sapiens
gggctgctgtga

SEQ ID NO: 496569 - DNA, 18 bp, Homo sapiens
gggctggaatctggagag

SEQ ID NO: 496570 - DNA, 21 bp, Homo sapiens
gggctggaatctggagagcta

SEQ ID NO: 496571 - DNA, 20 bp, Homo sapiens
gggcttcccagtggctgctg

SEQ ID NO: 496572 - DNA, 22 bp, Homo sapiens
gggcttcccagtggctgctgcc

SEQ ID NO: 496573 - DNA, 13 bp, Homo sapiens
ggggaaagcacag

SEQ ID NO: 496574 - DNA, 16 bp, Homo sapiens
ggggaagtcctctggg

SEQ ID NO: 496575 - DNA, 20 bp, Homo sapiens
ggggcagctgatacaaattg

SEQ ID NO: 496576 - DNA, 21 bp, Homo sapiens
ggggctagaacctagagaagc

SEQ ID NO: 496577 - DNA, 18 bp, Homo sapiens
ggggtattttaggcaggg

SEQ ID NO: 496578 - DNA, 14 bp, Homo sapiens
gttcagagctgccc

SEQ ID NO: 496579 - DNA, 15 bp, Homo sapiens
gttcagagctgccct

SEQ ID NO: 496580 - DNA, 20 bp, Homo sapiens
gttcagttcctctttgcatg

SEQ ID NO: 496581 - DNA, 14 bp, Homo sapiens
gttccccatgcaga

SEQ ID NO: 496582 - DNA, 22 bp, Homo sapiens
gttctaccaattatagatcaaa

SEQ ID NO: 496583 - DNA, 16 bp, Homo sapiens
gttctctcctccccaa

SEQ ID NO: 496584 - DNA, 14 bp, Homo sapiens
gttctgaagaagat

SEQ ID NO: 496585 - DNA, 20 bp, Homo sapiens
gttctgaggattcaggggct

SEQ ID NO: 496586 - DNA, 16 bp, Homo sapiens
gttgatgttggctggg

SEQ ID NO: 496587 - DNA, 22 bp, Homo sapiens
gttgccgtgagccaagatcacg

SEQ ID NO: 496588 - DNA, 22 bp, Homo sapiens
gttggagagctagaacctggag

SEQ ID NO: 496589 - DNA, 23 bp, Homo sapiens
gttgtctaaaaataaaatgcatt

SEQ ID NO: 496590 - DNA, 20 bp, Homo sapiens
gtttagctggaaaagtatgt

SEQ ID NO: 496591 - DNA, 11 bp, Homo sapiens
gtttcagaagc

SEQ ID NO: 496592 - DNA, 21 bp, Homo sapiens
gtttctgaaaattaacactgc

SEQ ID NO: 496593 - DNA, 17 bp, Homo sapiens
gtttctgtcctgctggt

SEQ ID NO: 496594 - DNA, 13 bp, Homo sapiens
gtttgaatataaa

SEQ ID NO: 496595 - DNA, 15 bp, Homo sapiens
gtttgcaaggaagcc

SEQ ID NO: 496596 - DNA, 16 bp, Homo sapiens
gtttgcagaggagcaa

SEQ ID NO: 496597 - DNA, 16 bp, Homo sapiens
gttttagaaggttctc

SEQ ID NO: 496598 - DNA, 22 bp, Homo sapiens
gttttataattttgtgaagcaa

SEQ ID NO: 496599 - DNA, 18 bp, Homo sapiens
gttttcaggctagatgta

SEQ ID NO: 496600 - DNA, 19 bp, Homo sapiens
gttttgtggaggagctcag

SEQ ID NO: 496601 - DNA, 19 bp, Homo sapiens
gtttttaactcaatatttt

SEQ ID NO: 496602 - DNA, 17 bp, Homo sapiens
gtttttaagaaaaacat

SEQ ID NO: 496603 - DNA, 23 bp, Homo sapiens
gtttttttttaaaaaagaaacat

SEQ ID NO: 496604 - DNA, 18 bp, Homo sapiens
taaaaataaaatgcattt

SEQ ID NO: 496605 - DNA, 19 bp, Homo sapiens
taaaaataaaatgcattta

SEQ ID NO: 496606 - DNA, 18 bp, Homo sapiens
taaaacattttcacacaa

SEQ ID NO: 496607 - DNA, 18 bp, Homo sapiens
taaaacctgagctagaag

SEQ ID NO: 496608 - DNA, 23 bp, Homo sapiens
taaaactttttatattttataca

SEQ ID NO: 496609 - DNA, 22 bp, Homo sapiens
taaaagcatactctatgtgatt

SEQ ID NO: 496610 - DNA, 17 bp, Homo sapiens
taaaagttattaatatt

SEQ ID NO: 496611 - DNA, 14 bp, Homo sapiens
taaaatacatacta

SEQ ID NO: 496612 - DNA, 23 bp, Homo sapiens
taaaatacatactatagattctt

SEQ ID NO: 496613 - DNA, 22 bp, Homo sapiens
taaaatagaaatatagccaaaa

SEQ ID NO: 496614 - DNA, 17 bp, Homo sapiens
taaaatatgatgtttaa

SEQ ID NO: 496615 - DNA, 17 bp, Homo sapiens
taaaatccatacatttg

SEQ ID NO: 496616 - DNA, 18 bp, Homo sapiens
taaaatccatacatttgt

SEQ ID NO: 496617 - DNA, 15 bp, Homo sapiens
taaaattcattccat

SEQ ID NO: 496618 - DNA, 16 bp, Homo sapiens
taaaattcattccatt

SEQ ID NO: 496619 - DNA, 12 bp, Homo sapiens
taaacaaatgta

SEQ ID NO: 496620 - DNA, 23 bp, Homo sapiens
taaacagactatttaacttgagg

SEQ ID NO: 496621 - DNA, 14 bp, Homo sapiens
taaaccacaagcat

SEQ ID NO: 496622 - DNA, 15 bp, Homo sapiens
taaacttagaataaa

SEQ ID NO: 496623 - DNA, 19 bp, Homo sapiens
taaacttagaataaaattg

SEQ ID NO: 496624 - DNA, 21 bp, Homo sapiens
taaacttagaataaaattgta

SEQ ID NO: 496625 - DNA, 18 bp, Homo sapiens
taaagagttagtttgagt

SEQ ID NO: 496626 - DNA, 13 bp, Homo sapiens
taaagcagtggac

SEQ ID NO: 496627 - DNA, 19 bp, Homo sapiens
taaagcagtggacaccagg

SEQ ID NO: 496628 - DNA, 13 bp, Homo sapiens
taaagtttacagt

SEQ ID NO: 496629 - DNA, 17 bp, Homo sapiens
taaagtttacagtaaat

SEQ ID NO: 496630 - DNA, 23 bp, Homo sapiens
taaagtttacagtaaataaattg

SEQ ID NO: 496631 - DNA, 21 bp, Homo sapiens
taaataaaacattttcacaca

SEQ ID NO: 496632 - DNA, 22 bp, Homo sapiens
taaataaaacattttcacacaa

SEQ ID NO: 496633 - DNA, 20 bp, Homo sapiens
taaataaattgtttgaccat

SEQ ID NO: 496634 - DNA, 14 bp, Homo sapiens
taaatgatgttgaa

SEQ ID NO: 496635 - DNA, 20 bp, Homo sapiens
taaatggcttcctggcaata

SEQ ID NO: 496636 - DNA, 13 bp, Homo sapiens
taaatgtggtaaa

SEQ ID NO: 496637 - DNA, 15 bp, Homo sapiens
taaatgttgacatgg

SEQ ID NO: 496638 - DNA, 13 bp, Homo sapiens
taacaatgctgta

SEQ ID NO: 496639 - DNA, 15 bp, Homo sapiens
taacaattgtgaagt

SEQ ID NO: 496640 - DNA, 14 bp, Homo sapiens
taacacacagctcc

SEQ ID NO: 496641 - DNA, 15 bp, Homo sapiens
taacactgttaagag

SEQ ID NO: 496642 - DNA, 23 bp, Homo sapiens
taacagagtttgatatgggcttt

SEQ ID NO: 496643 - DNA, 14 bp, Homo sapiens
taacaggcttctgg

SEQ ID NO: 496644 - DNA, 23 bp, Homo sapiens
taacataagctagaaaaattaga

SEQ ID NO: 496645 - DNA, 17 bp, Homo sapiens
taaccaggggccatgaa

SEQ ID NO: 496646 - DNA, 15 bp, Homo sapiens
taactagcttggaaa

SEQ ID NO: 496647 - DNA, 17 bp, Homo sapiens
taactattgcccaggtt

SEQ ID NO: 496648 - DNA, 21 bp, Homo sapiens
taactggcttctgcttgtcat

SEQ ID NO: 496649 - DNA, 16 bp, Homo sapiens
taactgtgcagagact

SEQ ID NO: 496650 - DNA, 13 bp, Homo sapiens
taagaaaaacatg

SEQ ID NO: 496651 - DNA, 23 bp, Homo sapiens
taagaagatgttttgaaatgtac

SEQ ID NO: 496652 - DNA, 21 bp, Homo sapiens
taagaatcattgtaaacatta

SEQ ID NO: 496653 - DNA, 13 bp, Homo sapiens
taagacaaatggg

SEQ ID NO: 496654 - DNA, 15 bp, Homo sapiens
taagacaaatgggac

SEQ ID NO: 496655 - DNA, 18 bp, Homo sapiens
taagaccaccacctcaga

SEQ ID NO: 496656 - DNA, 13 bp, Homo sapiens
taagaccagcctg

SEQ ID NO: 496657 - DNA, 18 bp, Homo sapiens
taagagaagctactttgt

SEQ ID NO: 496658 - DNA, 13 bp, Homo sapiens
taagagagaatga

SEQ ID NO: 496659 - DNA, 15 bp, Homo sapiens
taagctgtaaaaaga

SEQ ID NO: 496660 - DNA, 16 bp, Homo sapiens
taaggcgtggagctgc

SEQ ID NO: 496661 - DNA, 19 bp, Homo sapiens
taagtaatgataactggaa

SEQ ID NO: 496662 - DNA, 20 bp, Homo sapiens
taagtccttgcaagaatcag

SEQ ID NO: 496663 - DNA, 20 bp, Homo sapiens
taagtcttatcaagcagcca

SEQ ID NO: 496664 - DNA, 18 bp, Homo sapiens
taagtttttttttaaaaa

SEQ ID NO: 496665 - DNA, 19 bp, Homo sapiens
taataaaattcattccatt

SEQ ID NO: 496666 - DNA, 20 bp, Homo sapiens
taataaaattcattccattt

SEQ ID NO: 496667 - DNA, 18 bp, Homo sapiens
taataaacttagaataaa

SEQ ID NO: 496668 - DNA, 23 bp, Homo sapiens
taataaacttagaataaaattgt

SEQ ID NO: 496669 - DNA, 18 bp, Homo sapiens
taataggaaaaacggaag

SEQ ID NO: 496670 - DNA, 19 bp, Homo sapiens
taatataaagttggatgcg

SEQ ID NO: 496671 - DNA, 15 bp, Homo sapiens
taatatttttaatta

SEQ ID NO: 496672 - DNA, 22 bp, Homo sapiens
taatcaatactttgaacacaaa

SEQ ID NO: 496673 - DNA, 19 bp, Homo sapiens
taatcccggtttcagaagc

SEQ ID NO: 496674 - DNA, 15 bp, Homo sapiens
taatgaatgcataaa

SEQ ID NO: 496675 - DNA, 22 bp, Homo sapiens
taatgataactggaaacttcag

SEQ ID NO: 496676 - DNA, 17 bp, Homo sapiens
taatgatgtcgtttgaa

SEQ ID NO: 496677 - DNA, 23 bp, Homo sapiens
taatgatgtcgtttgaatcacag

SEQ ID NO: 496678 - DNA, 15 bp, Homo sapiens
taatggtttgaatat

SEQ ID NO: 496679 - DNA, 16 bp, Homo sapiens
taatgtagataaagca

SEQ ID NO: 496680 - DNA, 15 bp, Homo sapiens
taatgtttcaaacat

SEQ ID NO: 496681 - DNA, 16 bp, Homo sapiens
taattatctaaagtat

SEQ ID NO: 496682 - DNA, 13 bp, Homo sapiens
taattctaaggaa

SEQ ID NO: 496683 - DNA, 12 bp, Homo sapiens
taattctcaggc

SEQ ID NO: 496684 - DNA, 15 bp, Homo sapiens
taattctcaggccat

SEQ ID NO: 496685 - DNA, 20 bp, Homo sapiens
taatttattgtttttccttg

SEQ ID NO: 496686 - DNA, 16 bp, Homo sapiens
taatttttatatttga

SEQ ID NO: 496687 - DNA, 19 bp, Homo sapiens
taatttttatatttgaaat

SEQ ID NO: 496688 - DNA, 14 bp, Homo sapiens
tacactaagagaga

SEQ ID NO: 496689 - DNA, 20 bp, Homo sapiens
tacagggaatgcctgagtgc

SEQ ID NO: 496690 - DNA, 16 bp, Homo sapiens
tacaggtgtgagcata

SEQ ID NO: 496691 - DNA, 15 bp, Homo sapiens
tacagtaaataaatt

SEQ ID NO: 496692 - DNA, 16 bp, Homo sapiens
tacagtaaataaattg

SEQ ID NO: 496693 - DNA, 17 bp, Homo sapiens
tacagtaaataaattgt

SEQ ID NO: 496694 - DNA, 17 bp, Homo sapiens
tacagtcttgcagcagg

SEQ ID NO: 496695 - DNA, 12 bp, Homo sapiens
tacagttcagtt

SEQ ID NO: 496696 - DNA, 22 bp, Homo sapiens
tacagttcagttcctctttgca

SEQ ID NO: 496697 - DNA, 17 bp, Homo sapiens
tacattgaattagaaac

SEQ ID NO: 496698 - DNA, 17 bp, Homo sapiens
tacatttgtataaaata

SEQ ID NO: 496699 - DNA, 15 bp, Homo sapiens
taccacccaatgctg

SEQ ID NO: 496700 - DNA, 15 bp, Homo sapiens
tacctcctgtctctg

SEQ ID NO: 496701 - DNA, 20 bp, Homo sapiens
tacctgggcatactaataaa

SEQ ID NO: 496702 - DNA, 18 bp, Homo sapiens
taccttgaacactggggg

SEQ ID NO: 496703 - DNA, 16 bp, Homo sapiens
tacctttctgagtctc

SEQ ID NO: 496704 - DNA, 20 bp, Homo sapiens
tacctttctgagtctcttgg

SEQ ID NO: 496705 - DNA, 21 bp, Homo sapiens
tactacccccacagacctgct

SEQ ID NO: 496706 - DNA, 20 bp, Homo sapiens
tactatcatgtcaaacgtga

SEQ ID NO: 496707 - DNA, 15 bp, Homo sapiens
tactatggagtacca

SEQ ID NO: 496708 - DNA, 12 bp, Homo sapiens
tactcctgggtc

SEQ ID NO: 496709 - DNA, 15 bp, Homo sapiens
tactctatgtgattt

SEQ ID NO: 496710 - DNA, 22 bp, Homo sapiens
tactgatttggccgttttgtga

SEQ ID NO: 496711 - DNA, 21 bp, Homo sapiens
tacttcaaatccttgaagatt

SEQ ID NO: 496712 - DNA, 19 bp, Homo sapiens
tacttgggaggccgaggca

SEQ ID NO: 496713 - DNA, 21 bp, Homo sapiens
tactttgcctttccataatca

SEQ ID NO: 496714 - DNA, 14 bp, Homo sapiens
tagaaacataaata

SEQ ID NO: 496715 - DNA, 15 bp, Homo sapiens
tagaaacattgaaga

SEQ ID NO: 496716 - DNA, 21 bp, Homo sapiens
tagaaatagctccgtggagca

SEQ ID NO: 496717 - DNA, 23 bp, Homo sapiens
tagaacagagaaagaggaagctt

SEQ ID NO: 496718 - DNA, 22 bp, Homo sapiens
tagaaccaccaacaagcaagct

SEQ ID NO: 496719 - DNA, 12 bp, Homo sapiens
tagaaccaggca

SEQ ID NO: 496720 - DNA, 23 bp, Homo sapiens
tagaaccaggcaacttgggaact

SEQ ID NO: 496721 - DNA, 22 bp, Homo sapiens
tagaactggagaggctagaacc

SEQ ID NO: 496722 - DNA, 15 bp, Homo sapiens
tagaagaacagcaga

SEQ ID NO: 496723 - DNA, 17 bp, Homo sapiens
tagaagctgaagatccc

SEQ ID NO: 496724 - DNA, 15 bp, Homo sapiens
tagaataaaattgta

SEQ ID NO: 496725 - DNA, 22 bp, Homo sapiens
tagaatactaataaaatacata

SEQ ID NO: 496726 - DNA, 20 bp, Homo sapiens
tagaatattaaaaattaatt

SEQ ID NO: 496727 - DNA, 16 bp, Homo sapiens
tagacctcagcctgtg

SEQ ID NO: 496728 - DNA, 21 bp, Homo sapiens
tagacctcagcctgtgctgcc

SEQ ID NO: 496729 - DNA, 11 bp, Homo sapiens
tagagcaggcg

SEQ ID NO: 496730 - DNA, 22 bp, Homo sapiens
tagagcaggcgttcagctcact

SEQ ID NO: 496731 - DNA, 17 bp, Homo sapiens
tagagcagtttctgtcc

SEQ ID NO: 496732 - DNA, 16 bp, Homo sapiens
tagaggacgaaggcct

SEQ ID NO: 496733 - DNA, 20 bp, Homo sapiens
tagaggatccctctctggat

SEQ ID NO: 496734 - DNA, 23 bp, Homo sapiens
tagaggggggatttccagccagg

SEQ ID NO: 496735 - DNA, 14 bp, Homo sapiens
tagagggtgtgtaa

SEQ ID NO: 496736 - DNA, 17 bp, Homo sapiens
tagagtttagctggaaa

SEQ ID NO: 496737 - DNA, 18 bp, Homo sapiens
tagagtttagctggaaaa

SEQ ID NO: 496738 - DNA, 16 bp, Homo sapiens
tagatgcagttctgaa

SEQ ID NO: 496739 - DNA, 17 bp, Homo sapiens
tagatgcagttctgaag

SEQ ID NO: 496740 - DNA, 20 bp, Homo sapiens
tagatgcagttctgaagaag

SEQ ID NO: 496741 - DNA, 16 bp, Homo sapiens
tagatgtatgtacttc

SEQ ID NO: 496742 - DNA, 20 bp, Homo sapiens
tagatgtatgtacttcatgc

SEQ ID NO: 496743 - DNA, 14 bp, Homo sapiens
tagattctttatta

SEQ ID NO: 496744 - DNA, 14 bp, Homo sapiens
tagcaaattccaat

SEQ ID NO: 496745 - DNA, 17 bp, Homo sapiens
tagcacttatgttactg

SEQ ID NO: 496746 - DNA, 21 bp, Homo sapiens
tagcagctgctactagctctt

SEQ ID NO: 496747 - DNA, 14 bp, Homo sapiens
tagccgacctcagc

SEQ ID NO: 496748 - DNA, 14 bp, Homo sapiens
tgaggcagacagca

SEQ ID NO: 496749 - DNA, 15 bp, Homo sapiens
tgaggcagacagcag

SEQ ID NO: 496750 - DNA, 23 bp, Homo sapiens
tgaggcagacagcagctcaggca

SEQ ID NO: 496751 - DNA, 21 bp, Homo sapiens
tgaggccccttctaggtggca

SEQ ID NO: 496752 - DNA, 18 bp, Homo sapiens
tgagggtaataaacttag

SEQ ID NO: 496753 - DNA, 20 bp, Homo sapiens
tgaggtgggcagatcacgag

SEQ ID NO: 496754 - DNA, 14 bp, Homo sapiens
tgagtccacgccca

SEQ ID NO: 496755 - DNA, 19 bp, Homo sapiens
tgagtccacgcccaccagc

SEQ ID NO: 496756 - DNA, 23 bp, Homo sapiens
tgagtccacgcccaccagccttg

SEQ ID NO: 496757 - DNA, 18 bp, Homo sapiens
tgagttgttgccctgggt

SEQ ID NO: 496758 - DNA, 16 bp, Homo sapiens
tgataataaaattcat

SEQ ID NO: 496759 - DNA, 17 bp, Homo sapiens
tgataataaaattcatt

SEQ ID NO: 496760 - DNA, 20 bp, Homo sapiens
tgatacaaattgcagactgt

SEQ ID NO: 496761 - DNA, 19 bp, Homo sapiens
tgatatgcatttcctgctg

SEQ ID NO: 496762 - DNA, 14 bp, Homo sapiens
tgatcctgtgaagt

SEQ ID NO: 496763 - DNA, 15 bp, Homo sapiens
tgatggtggtatgtt

SEQ ID NO: 496764 - DNA, 11 bp, Homo sapiens
tgatgtcatct

SEQ ID NO: 496765 - DNA, 16 bp, Homo sapiens
tgatgttggctgggaa

SEQ ID NO: 496766 - DNA, 14 bp, Homo sapiens
tgattaatgctaaa

SEQ ID NO: 496767 - DNA, 19 bp, Homo sapiens
tgattatgaattacatttg

SEQ ID NO: 496768 - DNA, 12 bp, Homo sapiens
tgattcacagtg

SEQ ID NO: 496769 - DNA, 18 bp, Homo sapiens
tgattgccaagctcagga

SEQ ID NO: 496770 - DNA, 20 bp, Homo sapiens
tgattggcaggagttggaag

SEQ ID NO: 496771 - DNA, 22 bp, Homo sapiens
tgattgtctgaaattttctaga

SEQ ID NO: 496772 - DNA, 22 bp, Homo sapiens
tgcaaagtcatgcaaaggctgg

SEQ ID NO: 496773 - DNA, 15 bp, Homo sapiens
tgcaagccagatttt

SEQ ID NO: 496774 - DNA, 20 bp, Homo sapiens
tgcaaggaagccacagctgg

SEQ ID NO: 496775 - DNA, 17 bp, Homo sapiens
tgcaataaaatgggttt

SEQ ID NO: 496776 - DNA, 15 bp, Homo sapiens
tgcacagatacacat

SEQ ID NO: 496777 - DNA, 14 bp, Homo sapiens
tgcacggctgctga

SEQ ID NO: 496778 - DNA, 15 bp, Homo sapiens
tgcactccagcctgg

SEQ ID NO: 496779 - DNA, 23 bp, Homo sapiens
tgcagaaggaagggcatccttct

SEQ ID NO: 496780 - DNA, 17 bp, Homo sapiens
tgcagagacaggacctg

SEQ ID NO: 496781 - DNA, 17 bp, Homo sapiens
tgcagatttgggctgga

SEQ ID NO: 496782 - DNA, 17 bp, Homo sapiens
tgcagcccccactgcct

SEQ ID NO: 496783 - DNA, 16 bp, Homo sapiens
tgcaggcatcacagct

SEQ ID NO: 496784 - DNA, 21 bp, Homo sapiens
tgcaggcctgctcagggactg

SEQ ID NO: 496785 - DNA, 12 bp, Homo sapiens
tgcagttctgaa

SEQ ID NO: 496786 - DNA, 18 bp, Homo sapiens
tgcagttctgaagaagat

SEQ ID NO: 496787 - DNA, 22 bp, Homo sapiens
tgcagttctgaagaagatggta

SEQ ID NO: 496788 - DNA, 19 bp, Homo sapiens
tgcatagagccacgtatgt

SEQ ID NO: 496789 - DNA, 21 bp, Homo sapiens
tgcatagcagctgctactagc

SEQ ID NO: 496790 - DNA, 13 bp, Homo sapiens
tgcatgaaggttt

SEQ ID NO: 496791 - DNA, 18 bp, Homo sapiens
tgcatgaaggtttctgaa

SEQ ID NO: 496792 - DNA, 21 bp, Homo sapiens
tgcatgaaggtttctgaaaat

SEQ ID NO: 496793 - DNA, 20 bp, Homo sapiens
tgcatgatctgtcaaagtga

SEQ ID NO: 496794 - DNA, 19 bp, Homo sapiens
tgcatggaaattcccttca

SEQ ID NO: 496795 - DNA, 14 bp, Homo sapiens
tgcattatatttat

SEQ ID NO: 496796 - DNA, 15 bp, Homo sapiens
tgcattatatttatt

SEQ ID NO: 496797 - DNA, 19 bp, Homo sapiens
tgcatttttatctgtgagt

SEQ ID NO: 496798 - DNA, 17 bp, Homo sapiens
tgccaagcactgtgctc

SEQ ID NO: 496799 - DNA, 16 bp, Homo sapiens
tgccaccctcatgctg

SEQ ID NO: 496800 - DNA, 11 bp, Homo sapiens
tgccagccagc

SEQ ID NO: 496801 - DNA, 17 bp, Homo sapiens
tgccagccagcagccag

SEQ ID NO: 496802 - DNA, 23 bp, Homo sapiens
tgccagtctcactgtgggaaggc

SEQ ID NO: 496803 - DNA, 14 bp, Homo sapiens
tgccatatttttga

SEQ ID NO: 496804 - DNA, 11 bp, Homo sapiens
tgccatccctc

SEQ ID NO: 496805 - DNA, 19 bp, Homo sapiens
tgccatccctccctccacc

SEQ ID NO: 496806 - DNA, 16 bp, Homo sapiens
tgccatgcagggcctc

SEQ ID NO: 496807 - DNA, 23 bp, Homo sapiens
tgccatggacagaagaaggcagc

SEQ ID NO: 496808 - DNA, 18 bp, Homo sapiens
tgccatgttttgccaccc

SEQ ID NO: 496809 - DNA, 21 bp, Homo sapiens
tgccatgttttgccaccccct

SEQ ID NO: 496810 - DNA, 18 bp, Homo sapiens
tgcccaagccctgagagt

SEQ ID NO: 496811 - DNA, 11 bp, Homo sapiens
cagtgggaact

SEQ ID NO: 496812 - DNA, 22 bp, Homo sapiens
cagtgtccaaagcagggtctgg

SEQ ID NO: 496813 - DNA, 23 bp, Homo sapiens
cagttcagaatcacttctgagaa

SEQ ID NO: 496814 - DNA, 16 bp, Homo sapiens
cagttcagagctgccc

SEQ ID NO: 496815 - DNA, 18 bp, Homo sapiens
cagttcagagctgccctc

SEQ ID NO: 496816 - DNA, 15 bp, Homo sapiens
cagttcctttcaatg

SEQ ID NO: 496817 - DNA, 12 bp, Homo sapiens
cagttctgaaga

SEQ ID NO: 496818 - DNA, 20 bp, Homo sapiens
cagtttaacctgatgcagtc

SEQ ID NO: 496819 - DNA, 21 bp, Homo sapiens
cataaagccttggatgtatat

SEQ ID NO: 496820 - DNA, 20 bp, Homo sapiens
cataatctaccaacgaaaga

SEQ ID NO: 496821 - DNA, 19 bp, Homo sapiens
catacagagctctctgagg

SEQ ID NO: 496822 - DNA, 19 bp, Homo sapiens
catactcaatgttactatc

SEQ ID NO: 496823 - DNA, 23 bp, Homo sapiens
catactccatcagttagagctga

SEQ ID NO: 496824 - DNA, 12 bp, Homo sapiens
catagcagctgc

SEQ ID NO: 496825 - DNA, 19 bp, Homo sapiens
catagctagttatgtgaga

SEQ ID NO: 496826 - DNA, 15 bp, Homo sapiens
cataggaacatgtag

SEQ ID NO: 496827 - DNA, 18 bp, Homo sapiens
cataggaggggtctggac

SEQ ID NO: 496828 - DNA, 13 bp, Homo sapiens
cataggcccagtg

SEQ ID NO: 496829 - DNA, 19 bp, Homo sapiens
catatgacattcatgcctg

SEQ ID NO: 496830 - DNA, 21 bp, Homo sapiens
catatgacattcatgcctggc

SEQ ID NO: 496831 - DNA, 16 bp, Homo sapiens
catatggagtgcctgt

SEQ ID NO: 496832 - DNA, 20 bp, Homo sapiens
catatggagtgcctgtacaa

SEQ ID NO: 496833 - DNA, 21 bp, Homo sapiens
catatggagtgcctgtacaag

SEQ ID NO: 496834 - DNA, 13 bp, Homo sapiens
catattaaaatca

SEQ ID NO: 496835 - DNA, 21 bp, Homo sapiens
catattgagcacttgctgtat

SEQ ID NO: 496836 - DNA, 16 bp, Homo sapiens
catattgataataaaa

SEQ ID NO: 496837 - DNA, 17 bp, Homo sapiens
catatttgcatatgtat

SEQ ID NO: 496838 - DNA, 16 bp, Homo sapiens
catcaaggcactgcct

SEQ ID NO: 496839 - DNA, 17 bp, Homo sapiens
catcaaggcactgcctg

SEQ ID NO: 496840 - DNA, 13 bp, Homo sapiens
catcacctccacc

SEQ ID NO: 496841 - DNA, 14 bp, Homo sapiens
catcacctccacca

SEQ ID NO: 496842 - DNA, 17 bp, Homo sapiens
catcagaaacaccctca

SEQ ID NO: 496843 - DNA, 20 bp, Homo sapiens
catcagttagagctgacaca

SEQ ID NO: 496844 - DNA, 24 bp, Homo sapiens
catcataactggcttctgcttgtc

SEQ ID NO: 496845 - DNA, 21 bp, Homo sapiens
catcatcaaggcactgcctga

SEQ ID NO: 496846 - DNA, 17 bp, Homo sapiens
catcatcagtggagcca

SEQ ID NO: 496847 - DNA, 23 bp, Homo sapiens
catccctccctccacctccctgc

SEQ ID NO: 496848 - DNA, 12 bp, Homo sapiens
catcctggccaa

SEQ ID NO: 496849 - DNA, 15 bp, Homo sapiens
catccttctgccttt

SEQ ID NO: 496850 - DNA, 22 bp, Homo sapiens
catctagtgagcagtcaggaaa

SEQ ID NO: 496851 - DNA, 22 bp, Homo sapiens
catctcaaggaataatgggctt

SEQ ID NO: 496852 - DNA, 18 bp, Homo sapiens
catctcagtgctgtaaaa

SEQ ID NO: 496853 - DNA, 16 bp, Homo sapiens
catctctggatgcctg

SEQ ID NO: 496854 - DNA, 13 bp, Homo sapiens
catctctgtccca

SEQ ID NO: 496855 - DNA, 21 bp, Homo sapiens
catctcttcctccgaggccag

SEQ ID NO: 496856 - DNA, 12 bp, Homo sapiens
catctggaacca

SEQ ID NO: 496857 - DNA, 17 bp, Homo sapiens
catctgtggagatgccc

SEQ ID NO: 496858 - DNA, 19 bp, Homo sapiens
catgaagtcgttgtgaggg

SEQ ID NO: 496859 - DNA, 22 bp, Homo sapiens
catgaagtttccttggctggtg

SEQ ID NO: 496860 - DNA, 13 bp, Homo sapiens
catgacccaggct

SEQ ID NO: 496861 - DNA, 17 bp, Homo sapiens
catgacccaggctgggc

SEQ ID NO: 496862 - DNA, 21 bp, Homo sapiens
catgacttttccatgtatcta

SEQ ID NO: 496863 - DNA, 13 bp, Homo sapiens
catgatctgtcaa

SEQ ID NO: 496864 - DNA, 14 bp, Homo sapiens
catgatctgtcaaa

SEQ ID NO: 496865 - DNA, 16 bp, Homo sapiens
catgatgctgggattt

SEQ ID NO: 496866 - DNA, 15 bp, Homo sapiens
catgcaaaggctggg

SEQ ID NO: 496867 - DNA, 20 bp, Homo sapiens
catgccaatagttgctgtcc

SEQ ID NO: 496868 - DNA, 10 bp, Homo sapiens
catgcctgca

SEQ ID NO: 496869 - DNA, 14 bp, Homo sapiens
catgcctggcttcg

SEQ ID NO: 496870 - DNA, 15 bp, Homo sapiens
catgctgaagccaaa

SEQ ID NO: 496871 - DNA, 19 bp, Homo sapiens
catgctttgagtccacgcc

SEQ ID NO: 496872 - DNA, 15 bp, Homo sapiens
catggacagaagaag

SEQ ID NO: 496873 - DNA, 18 bp, Homo sapiens
catggcatcacctccacc

SEQ ID NO: 496874 - DNA, 23 bp, Homo sapiens
catggccctcccagtacctcctg

SEQ ID NO: 496875 - DNA, 20 bp, Homo sapiens
catggtattgactcaacagt

SEQ ID NO: 496876 - DNA, 20 bp, Homo sapiens
catggtggcacacgcctgta

SEQ ID NO: 496877 - DNA, 19 bp, Homo sapiens
catggtggggcatgcctgt

SEQ ID NO: 496878 - DNA, 20 bp, Homo sapiens
catgtataatatttttaatt

SEQ ID NO: 496879 - DNA, 19 bp, Homo sapiens
catgtcaaacgtgaaaatg

SEQ ID NO: 496880 - DNA, 10 bp, Homo sapiens
catgtcatgt

SEQ ID NO: 496881 - DNA, 22 bp, Homo sapiens
catgtcatgtaggttgtctaaa

SEQ ID NO: 496882 - DNA, 22 bp, Homo sapiens
catgtgcctatagtcccagcta

SEQ ID NO: 496883 - DNA, 20 bp, Homo sapiens
catgtggttactagtacagg

SEQ ID NO: 496884 - DNA, 12 bp, Homo sapiens
cattaaagccat

SEQ ID NO: 496885 - DNA, 21 bp, Homo sapiens
cattacagtgggtgcccccct

SEQ ID NO: 496886 - DNA, 13 bp, Homo sapiens
cattagagcaggc

SEQ ID NO: 496887 - DNA, 21 bp, Homo sapiens
cattatgatgtgggtcaagga

SEQ ID NO: 496888 - DNA, 14 bp, Homo sapiens
cattcatgcctggc

SEQ ID NO: 496889 - DNA, 14 bp, Homo sapiens
cattccattctgga

SEQ ID NO: 496890 - DNA, 12 bp, Homo sapiens
cattccatttgc

SEQ ID NO: 496891 - DNA, 21 bp, Homo sapiens
cattccgaggggctcagttct

SEQ ID NO: 496892 - DNA, 22 bp, Homo sapiens
cattctacacagagcaggactg

SEQ ID NO: 496893 - DNA, 12 bp, Homo sapiens
cattctggaagt

SEQ ID NO: 496894 - DNA, 14 bp, Homo sapiens
cattgaattagaaa

SEQ ID NO: 496895 - DNA, 13 bp, Homo sapiens
cattgttcagaag

SEQ ID NO: 496896 - DNA, 14 bp, Homo sapiens
cattgttcagaaga

SEQ ID NO: 496897 - DNA, 17 bp, Homo sapiens
catttaagagacagtca

SEQ ID NO: 496898 - DNA, 21 bp, Homo sapiens
catttagaagctgaagatccc

SEQ ID NO: 496899 - DNA, 18 bp, Homo sapiens
catttatttccatattaa

SEQ ID NO: 496900 - DNA, 20 bp, Homo sapiens
catttatttccatattaaaa

SEQ ID NO: 496901 - DNA, 19 bp, Homo sapiens
catttccacaccaagcagc

SEQ ID NO: 496902 - DNA, 21 bp, Homo sapiens
catttgcgttccatgatgctg

SEQ ID NO: 496903 - DNA, 17 bp, Homo sapiens
catttgtataaaataat

SEQ ID NO: 496904 - DNA, 18 bp, Homo sapiens
catttttgaatacaggca

SEQ ID NO: 496905 - DNA, 12 bp, Homo sapiens
ccaaagcagggt

SEQ ID NO: 496906 - DNA, 15 bp, Homo sapiens
ccaaagcagggtctg

SEQ ID NO: 496907 - DNA, 20 bp, Homo sapiens
ccaaaggccatggagagctg

SEQ ID NO: 496908 - DNA, 16 bp, Homo sapiens
ccaacatgcctgcacc

SEQ ID NO: 496909 - DNA, 19 bp, Homo sapiens
ccaactgctccagcctctg

SEQ ID NO: 496910 - DNA, 24 bp, Homo sapiens
ccaactgctccagcctctgccgct

SEQ ID NO: 496911 - DNA, 19 bp, Homo sapiens
ccaacttcttcagagctga

SEQ ID NO: 496912 - DNA, 12 bp, Homo sapiens
ccaagaagggct

SEQ ID NO: 496913 - DNA, 24 bp, Homo sapiens
ccaagagactccttgagagaccag

SEQ ID NO: 496914 - DNA, 22 bp, Homo sapiens
ccaagagctgaggcaattctaa

SEQ ID NO: 496915 - DNA, 14 bp, Homo sapiens
ccaagcaagtatta

SEQ ID NO: 496916 - DNA, 22 bp, Homo sapiens
ccaagcactgtgctcagggcta

SEQ ID NO: 496917 - DNA, 18 bp, Homo sapiens
ccaagctcaaagcgtgga

SEQ ID NO: 496918 - DNA, 19 bp, Homo sapiens
ccaagctcaggaccaggca

SEQ ID NO: 496919 - DNA, 23 bp, Homo sapiens
ccaaggaaaccacagctgctgga

SEQ ID NO: 496920 - DNA, 19 bp, Homo sapiens
ccaagggatgaaagagaag

SEQ ID NO: 496921 - DNA, 14 bp, Homo sapiens
atgggaaaagagat

SEQ ID NO: 496922 - DNA, 19 bp, Homo sapiens
atgggaagcagctcaaggg

SEQ ID NO: 496923 - DNA, 21 bp, Homo sapiens
atgggacatttgctcatggaa

SEQ ID NO: 496924 - DNA, 15 bp, Homo sapiens
atgggactgatgtca

SEQ ID NO: 496925 - DNA, 18 bp, Homo sapiens
atgggcacaaagggccca

SEQ ID NO: 496926 - DNA, 12 bp, Homo sapiens
atggggatgcag

SEQ ID NO: 496927 - DNA, 11 bp, Homo sapiens
atgggggaaag

SEQ ID NO: 496928 - DNA, 22 bp, Homo sapiens
atgggggaaagcacaggtgggc

SEQ ID NO: 496929 - DNA, 14 bp, Homo sapiens
atggtgatgaaatg

SEQ ID NO: 496930 - DNA, 17 bp, Homo sapiens
atggtgatgaaatgtaa

SEQ ID NO: 496931 - DNA, 21 bp, Homo sapiens
atggtgttttcttatgcagga

SEQ ID NO: 496932 - DNA, 15 bp, Homo sapiens
atgtaagaatcattg

SEQ ID NO: 496933 - DNA, 20 bp, Homo sapiens
atgtagcaaattccaataca

SEQ ID NO: 496934 - DNA, 23 bp, Homo sapiens
atgtataatatttttaattaaat

SEQ ID NO: 496935 - DNA, 16 bp, Homo sapiens
atgtcaatcagcctag

SEQ ID NO: 496936 - DNA, 21 bp, Homo sapiens
atgtcaatcagcctagttgat

SEQ ID NO: 496937 - DNA, 16 bp, Homo sapiens
atgtcagggccaggtg

SEQ ID NO: 496938 - DNA, 21 bp, Homo sapiens
atgtcatgtaggttgtctaaa

SEQ ID NO: 496939 - DNA, 16 bp, Homo sapiens
atgtcattaaacatga

SEQ ID NO: 496940 - DNA, 15 bp, Homo sapiens
atgtcctcaccacat

SEQ ID NO: 496941 - DNA, 17 bp, Homo sapiens
atgtcctcaccacatgc

SEQ ID NO: 496942 - DNA, 11 bp, Homo sapiens
atgtctaaaga

SEQ ID NO: 496943 - DNA, 17 bp, Homo sapiens
atgtcttttcaaaagga

SEQ ID NO: 496944 - DNA, 18 bp, Homo sapiens
atgtcttttcaaaaggat

SEQ ID NO: 496945 - DNA, 14 bp, Homo sapiens
atgtgcctctgtcc

SEQ ID NO: 496946 - DNA, 21 bp, Homo sapiens
atgtgctagtaattggaaagg

SEQ ID NO: 496947 - DNA, 15 bp, Homo sapiens
atgttgacatgggac

SEQ ID NO: 496948 - DNA, 12 bp, Homo sapiens
atgttggctggg

SEQ ID NO: 496949 - DNA, 17 bp, Homo sapiens
atgttttcaggctagat

SEQ ID NO: 496950 - DNA, 18 bp, Homo sapiens
atgttttccagctcctca

SEQ ID NO: 496951 - DNA, 17 bp, Homo sapiens
atgtttttgtgtatttg

SEQ ID NO: 496952 - DNA, 12 bp, Homo sapiens
attaaaatcaca

SEQ ID NO: 496953 - DNA, 14 bp, Homo sapiens
attaaatttttcct

SEQ ID NO: 496954 - DNA, 16 bp, Homo sapiens
attaaatttttcctta

SEQ ID NO: 496955 - DNA, 21 bp, Homo sapiens
attacatatttgcatatgtat

SEQ ID NO: 496956 - DNA, 15 bp, Homo sapiens
attacatttgtataa

SEQ ID NO: 496957 - DNA, 16 bp, Homo sapiens
attacatttgtataaa

SEQ ID NO: 496958 - DNA, 15 bp, Homo sapiens
attagtgaagtatgc

SEQ ID NO: 496959 - DNA, 21 bp, Homo sapiens
attagtgaagtatgcactaat

SEQ ID NO: 496960 - DNA, 15 bp, Homo sapiens
attatatttattact

SEQ ID NO: 496961 - DNA, 13 bp, Homo sapiens
attatattttgaa

SEQ ID NO: 496962 - DNA, 17 bp, Homo sapiens
attatgggaatcaagat

SEQ ID NO: 496963 - DNA, 17 bp, Homo sapiens
attattggacttccatt

SEQ ID NO: 496964 - DNA, 18 bp, Homo sapiens
attcaaaaattatatttt

SEQ ID NO: 496965 - DNA, 22 bp, Homo sapiens
attcaacactcccttcccatga

SEQ ID NO: 496966 - DNA, 20 bp, Homo sapiens
attcaagtattaggggtaat

SEQ ID NO: 496967 - DNA, 22 bp, Homo sapiens
attcatctctctttaatataaa

SEQ ID NO: 496968 - DNA, 17 bp, Homo sapiens
attcattccattctgga

SEQ ID NO: 496969 - DNA, 12 bp, Homo sapiens
attccaatacat

SEQ ID NO: 496970 - DNA, 14 bp, Homo sapiens
attccaatacatta

SEQ ID NO: 496971 - DNA, 16 bp, Homo sapiens
attccaatacattatt

SEQ ID NO: 496972 - DNA, 20 bp, Homo sapiens
attccaatacattattggac

SEQ ID NO: 496973 - DNA, 16 bp, Homo sapiens
attccattctggattt

SEQ ID NO: 496974 - DNA, 16 bp, Homo sapiens
attccatttgctgatt

SEQ ID NO: 496975 - DNA, 22 bp, Homo sapiens
attcccaagagtggtggcagct

SEQ ID NO: 496976 - DNA, 15 bp, Homo sapiens
attcctgtccttcac

SEQ ID NO: 496977 - DNA, 24 bp, Homo sapiens
attccttagcttagacctcagcct

SEQ ID NO: 496978 - DNA, 18 bp, Homo sapiens
attcctttgaagaggaaa

SEQ ID NO: 496979 - DNA, 19 bp, Homo sapiens
attctcaagccgcatccca

SEQ ID NO: 496980 - DNA, 20 bp, Homo sapiens
attctcaagccgcatcccag

SEQ ID NO: 496981 - DNA, 21 bp, Homo sapiens
attctcaagccgcatcccaga

SEQ ID NO: 496982 - DNA, 23 bp, Homo sapiens
attctcaagccgcatcccagact

SEQ ID NO: 496983 - DNA, 18 bp, Homo sapiens
attctcagggtctctgct

SEQ ID NO: 496984 - DNA, 19 bp, Homo sapiens
attctgctacctcactggg

SEQ ID NO: 496985 - DNA, 21 bp, Homo sapiens
attctggattttgtcaagcag

SEQ ID NO: 496986 - DNA, 12 bp, Homo sapiens
attgaaaaggac

SEQ ID NO: 496987 - DNA, 22 bp, Homo sapiens
attgaacaagttgtttcattga

SEQ ID NO: 496988 - DNA, 20 bp, Homo sapiens
attgacaactgaagagacac

SEQ ID NO: 496989 - DNA, 22 bp, Homo sapiens
attgacatcagcatcacctaga

SEQ ID NO: 496990 - DNA, 23 bp, Homo sapiens
attgataagagggcacacactgt

SEQ ID NO: 496991 - DNA, 15 bp, Homo sapiens
attgataataaaatt

SEQ ID NO: 496992 - DNA, 19 bp, Homo sapiens
attgatataaataaaacat

SEQ ID NO: 496993 - DNA, 12 bp, Homo sapiens
attgattagaaa

SEQ ID NO: 496994 - DNA, 16 bp, Homo sapiens
attgcatatatacata

SEQ ID NO: 496995 - DNA, 18 bp, Homo sapiens
attggaatgggcagctca

SEQ ID NO: 496996 - DNA, 17 bp, Homo sapiens
attggacttccatttgg

SEQ ID NO: 496997 - DNA, 16 bp, Homo sapiens
attggagctcgtggaa

SEQ ID NO: 496998 - DNA, 17 bp, Homo sapiens
attggagctcgtgggac

SEQ ID NO: 496999 - DNA, 14 bp, Homo sapiens
attggtctcctctc

SEQ ID NO: 497000 - DNA, 21 bp, Homo sapiens
attgtatagagatatgcagaa

SEQ ID NO: 497001 - DNA, 13 bp, Homo sapiens
attgtctagtgaa

SEQ ID NO: 497002 - DNA, 18 bp, Homo sapiens
attgtctgaaattttcta

SEQ ID NO: 497003 - DNA, 12 bp, Homo sapiens
attgtggtgcca

SEQ ID NO: 497004 - DNA, 14 bp, Homo sapiens
attgtggtgccaca

SEQ ID NO: 497005 - DNA, 12 bp, Homo sapiens
attgttcagaag

SEQ ID NO: 497006 - DNA, 21 bp, Homo sapiens
attgttcagaagacctccctg

SEQ ID NO: 497007 - DNA, 13 bp, Homo sapiens
attgttcctgtca

SEQ ID NO: 497008 - DNA, 20 bp, Homo sapiens
attgtttttaagaaaaacat

SEQ ID NO: 497009 - DNA, 22 bp, Homo sapiens
attgtttttaagaaaaacatgt

SEQ ID NO: 497010 - DNA, 14 bp, Homo sapiens
atttaacccagctc

SEQ ID NO: 497011 - DNA, 18 bp, Homo sapiens
atttaacttgagggtaat

SEQ ID NO: 497012 - DNA, 20 bp, Homo sapiens
atttaacttgagggtaataa

SEQ ID NO: 497013 - DNA, 21 bp, Homo sapiens
atttaacttgagggtaataaa

SEQ ID NO: 497014 - DNA, 22 bp, Homo sapiens
atttaccacttgtgttttgcaa

SEQ ID NO: 497015 - DNA, 14 bp, Homo sapiens
atttaccttgaaca

SEQ ID NO: 497016 - DNA, 11 bp, Homo sapiens
atttatctttg

SEQ ID NO: 497017 - DNA, 19 bp, Homo sapiens
atttattactgtaagaaaa

SEQ ID NO: 497018 - DNA, 14 bp, Homo sapiens
atttatttccatat

SEQ ID NO: 497019 - DNA, 23 bp, Homo sapiens
atttatttggagtggaggcattg

SEQ ID NO: 497020 - DNA, 19 bp, Homo sapiens
atttattttaataatgttt

SEQ ID NO: 497021 - DNA, 20 bp, Homo sapiens
atttattttaataatgtttc

SEQ ID NO: 497022 - DNA, 15 bp, Homo sapiens
atttcaggagcagcc

SEQ ID NO: 497023 - DNA, 16 bp, Homo sapiens
atttccaagagctgag

SEQ ID NO: 497024 - DNA, 14 bp, Homo sapiens
atttccagccaggg

SEQ ID NO: 497025 - DNA, 17 bp, Homo sapiens
atttccagccagggctg

SEQ ID NO: 497026 - DNA, 18 bp, Homo sapiens
atttccatattaaaatca

SEQ ID NO: 497027 - DNA, 16 bp, Homo sapiens
atttctatggcatatt

SEQ ID NO: 497028 - DNA, 23 bp, Homo sapiens
atttgaagctgcagtgagctgtg

SEQ ID NO: 497029 - DNA, 22 bp, Homo sapiens
atttgaggagcagcttcagttg

SEQ ID NO: 497030 - DNA, 15 bp, Homo sapiens
atttgcacaagtttt

SEQ ID NO: 497031 - DNA, 15 bp, Homo sapiens
atttgcagagacagg

SEQ ID NO: 497032 - DNA, 17 bp, Homo sapiens
atttgctcatggaattg

SEQ ID NO: 497033 - DNA, 18 bp, Homo sapiens
atttgctgattgtctgaa

SEQ ID NO: 497034 - DNA, 20 bp, Homo sapiens
atttgctgattgtctgaaat

SEQ ID NO: 497035 - DNA, 21 bp, Homo sapiens
atttggagtggaggcattgtt

SEQ ID NO: 497036 - DNA, 22 bp, Homo sapiens
atttgtaagtttatgtctaaag

SEQ ID NO: 497037 - DNA, 15 bp, Homo sapiens
atttgtacagttcag

SEQ ID NO: 497038 - DNA, 16 bp, Homo sapiens
cagctgggttggaaaa

SEQ ID NO: 497039 - DNA, 17 bp, Homo sapiens
cagctgggttggaaaac

SEQ ID NO: 497040 - DNA, 19 bp, Homo sapiens
cagctgtatgattcccagc

SEQ ID NO: 497041 - DNA, 14 bp, Homo sapiens
cagcttattgtcta

SEQ ID NO: 497042 - DNA, 20 bp, Homo sapiens
caggaacatacagacacatt

SEQ ID NO: 497043 - DNA, 20 bp, Homo sapiens
caggaactatgggagcctca

SEQ ID NO: 497044 - DNA, 21 bp, Homo sapiens
caggaatgccaaggagacatc

SEQ ID NO: 497045 - DNA, 20 bp, Homo sapiens
caggaatttgaagctgcagt

SEQ ID NO: 497046 - DNA, 17 bp, Homo sapiens
caggacatgctgaagcc

SEQ ID NO: 497047 - DNA, 18 bp, Homo sapiens
caggaccaggcaatgtga

SEQ ID NO: 497048 - DNA, 20 bp, Homo sapiens
caggactcagctccccagag

SEQ ID NO: 497049 - DNA, 21 bp, Homo sapiens
caggactcagctccccagagt

SEQ ID NO: 497050 - DNA, 15 bp, Homo sapiens
caggagcagcctcag

SEQ ID NO: 497051 - DNA, 20 bp, Homo sapiens
caggagcagcctcagaacaa

SEQ ID NO: 497052 - DNA, 23 bp, Homo sapiens
caggagcagcctcagaacaaagt

SEQ ID NO: 497053 - DNA, 18 bp, Homo sapiens
caggaggctgaggcagga

SEQ ID NO: 497054 - DNA, 15 bp, Homo sapiens
caggagtccctggta

SEQ ID NO: 497055 - DNA, 21 bp, Homo sapiens
caggagtttaagaccagcctg

SEQ ID NO: 497056 - DNA, 22 bp, Homo sapiens
caggagtttaagaccagcctgg

SEQ ID NO: 497057 - DNA, 15 bp, Homo sapiens
caggatggcctggcc

SEQ ID NO: 497058 - DNA, 17 bp, Homo sapiens
caggatggcctggccag

SEQ ID NO: 497059 - DNA, 15 bp, Homo sapiens
caggcaactgaggca

SEQ ID NO: 497060 - DNA, 17 bp, Homo sapiens
caggcaactgaggcaga

SEQ ID NO: 497061 - DNA, 20 bp, Homo sapiens
caggcaactgaggcagacag

SEQ ID NO: 497062 - DNA, 22 bp, Homo sapiens
caggcagctttttctctcccac

SEQ ID NO: 497063 - DNA, 15 bp, Homo sapiens
caggcatcacagcta

SEQ ID NO: 497064 - DNA, 15 bp, Homo sapiens
caggcctcttggcag

SEQ ID NO: 497065 - DNA, 19 bp, Homo sapiens
caggcctcttggcagtcac

SEQ ID NO: 497066 - DNA, 13 bp, Homo sapiens
caggcgttcagct

SEQ ID NO: 497067 - DNA, 19 bp, Homo sapiens
caggctaaggcgtggagct

SEQ ID NO: 497068 - DNA, 17 bp, Homo sapiens
caggctctgagacacac

SEQ ID NO: 497069 - DNA, 18 bp, Homo sapiens
caggctctgagacacacc

SEQ ID NO: 497070 - DNA, 19 bp, Homo sapiens
cagggacgaagaagagcca

SEQ ID NO: 497071 - DNA, 23 bp, Homo sapiens
cagggactgttcctgtctcagca

SEQ ID NO: 497072 - DNA, 19 bp, Homo sapiens
cagggagcatggctgtgag

SEQ ID NO: 497073 - DNA, 21 bp, Homo sapiens
cagggatgagcatggagctgg

SEQ ID NO: 497074 - DNA, 23 bp, Homo sapiens
cagggatgatggcagagccaggc

SEQ ID NO: 497075 - DNA, 18 bp, Homo sapiens
cagggatgtacaaggcga

SEQ ID NO: 497076 - DNA, 19 bp, Homo sapiens
cagggccaggtgcagacct

SEQ ID NO: 497077 - DNA, 20 bp, Homo sapiens
cagggccaggtgcagacctt

SEQ ID NO: 497078 - DNA, 15 bp, Homo sapiens
cagggccctgagctc

SEQ ID NO: 497079 - DNA, 14 bp, Homo sapiens
agggaatgcctgag

SEQ ID NO: 497080 - DNA, 18 bp, Homo sapiens
agggaatgcctgagtgcc

SEQ ID NO: 497081 - DNA, 16 bp, Homo sapiens
agggaattgcagagta

SEQ ID NO: 497082 - DNA, 21 bp, Homo sapiens
agggacgaagaagagccacag

SEQ ID NO: 497083 - DNA, 22 bp, Homo sapiens
agggacgaagaagagccacagt

SEQ ID NO: 497084 - DNA, 16 bp, Homo sapiens
agggagcgagggagaa

SEQ ID NO: 497085 - DNA, 19 bp, Homo sapiens
agggatgatggcagagcca

SEQ ID NO: 497086 - DNA, 20 bp, Homo sapiens
agggatgatggcagagccag

SEQ ID NO: 497087 - DNA, 22 bp, Homo sapiens
agggatgatggcagagccaggc

SEQ ID NO: 497088 - DNA, 17 bp, Homo sapiens
agggcagagtcacacgg

SEQ ID NO: 497089 - DNA, 14 bp, Homo sapiens
agggccccagcact

SEQ ID NO: 497090 - DNA, 17 bp, Homo sapiens
agggctagaacctagaa

SEQ ID NO: 497091 - DNA, 17 bp, Homo sapiens
agggctagaacctggaa

SEQ ID NO: 497092 - DNA, 18 bp, Homo sapiens
agggctagaacctggaag

SEQ ID NO: 497093 - DNA, 22 bp, Homo sapiens
agggctagaacctggaagggct

SEQ ID NO: 497094 - DNA, 19 bp, Homo sapiens
agggctagaacctggagag

SEQ ID NO: 497095 - DNA, 18 bp, Homo sapiens
agggctagaacctggagg

SEQ ID NO: 497096 - DNA, 22 bp, Homo sapiens
agggctagaacctggagggcta

SEQ ID NO: 497097 - DNA, 18 bp, Homo sapiens
agggctagaactggagag

SEQ ID NO: 497098 - DNA, 15 bp, Homo sapiens
agggctcagcctggt

SEQ ID NO: 497099 - DNA, 17 bp, Homo sapiens
agggctgctagacggag

SEQ ID NO: 497100 - DNA, 20 bp, Homo sapiens
aggggctagaacctagagaa

SEQ ID NO: 497101 - DNA, 16 bp, Homo sapiens
aggggctatcccttct

SEQ ID NO: 497102 - DNA, 19 bp, Homo sapiens
aggggctatcccttctcag

SEQ ID NO: 497103 - DNA, 22 bp, Homo sapiens
agggtaataaacttagaataaa

SEQ ID NO: 497104 - DNA, 18 bp, Homo sapiens
agggtatcaaataaaatt

SEQ ID NO: 497105 - DNA, 18 bp, Homo sapiens
atagtcaaattgtgtgaa

SEQ ID NO: 497106 - DNA, 13 bp, Homo sapiens
atataaacactat

SEQ ID NO: 497107 - DNA, 18 bp, Homo sapiens
atataaagacctataaat

SEQ ID NO: 497108 - DNA, 15 bp, Homo sapiens
atataaataaaacat

SEQ ID NO: 497109 - DNA, 12 bp, Homo sapiens
atataacaatgc

SEQ ID NO: 497110 - DNA, 17 bp, Homo sapiens
atataacaatgctgtat

SEQ ID NO: 497111 - DNA, 22 bp, Homo sapiens
atatactaagatgttcactgtg

SEQ ID NO: 497112 - DNA, 18 bp, Homo sapiens
atatataacaatgctgta

SEQ ID NO: 497113 - DNA, 13 bp, Homo sapiens
atatattttaatt

SEQ ID NO: 497114 - DNA, 22 bp, Homo sapiens
atatgagatgtagcaaattcca

SEQ ID NO: 497115 - DNA, 23 bp, Homo sapiens
atatgcttctgttttataatttt

SEQ ID NO: 497116 - DNA, 16 bp, Homo sapiens
atatggggatgcagca

SEQ ID NO: 497117 - DNA, 21 bp, Homo sapiens
atattaaaaattaattcttta

SEQ ID NO: 497118 - DNA, 15 bp, Homo sapiens
atattaaaatcacaa

SEQ ID NO: 497119 - DNA, 13 bp, Homo sapiens
atattatgttaaa

SEQ ID NO: 497120 - DNA, 21 bp, Homo sapiens
atattcaaaaattatattttg

SEQ ID NO: 497121 - DNA, 14 bp, Homo sapiens
atattgataataaa

SEQ ID NO: 497122 - DNA, 16 bp, Homo sapiens
atattgataataaaat

SEQ ID NO: 497123 - DNA, 22 bp, Homo sapiens
atatttattactgtaagaaaat

SEQ ID NO: 497124 - DNA, 21 bp, Homo sapiens
atattttctttaaaagacaaa

SEQ ID NO: 497125 - DNA, 14 bp, Homo sapiens
atcaaactgaagcc

SEQ ID NO: 497126 - DNA, 22 bp, Homo sapiens
atcaaatggaaaggagaggaaa

SEQ ID NO: 497127 - DNA, 18 bp, Homo sapiens
atcaaattctacaacttt

SEQ ID NO: 497128 - DNA, 15 bp, Homo sapiens
atcaagactggaagg

SEQ ID NO: 497129 - DNA, 14 bp, Homo sapiens
atcaagcagccaag

SEQ ID NO: 497130 - DNA, 14 bp, Homo sapiens
atcaaggcactgcc

SEQ ID NO: 497131 - DNA, 17 bp, Homo sapiens
atcacatagtgaaagtt

SEQ ID NO: 497132 - DNA, 14 bp, Homo sapiens
atcacatttgtaaa

SEQ ID NO: 497133 - DNA, 11 bp, Homo sapiens
atcacctgtca

SEQ ID NO: 497134 - DNA, 14 bp, Homo sapiens
atcacctgtcatca

SEQ ID NO: 497135 - DNA, 14 bp, Homo sapiens
atcactcatttatt

SEQ ID NO: 497136 - DNA, 22 bp, Homo sapiens
atcacttgtcaataaaatccat

SEQ ID NO: 497137 - DNA, 20 bp, Homo sapiens
atcagacctgggtggaactc

SEQ ID NO: 497138 - DNA, 19 bp, Homo sapiens
atcatcaaggcactgcctg

SEQ ID NO: 497139 - DNA, 21 bp, Homo sapiens
atcatgaattagttttatatg

SEQ ID NO: 497140 - DNA, 14 bp, Homo sapiens
atcatgggtcaaga

SEQ ID NO: 497141 - DNA, 14 bp, Homo sapiens
atcattaaagttct

SEQ ID NO: 497142 - DNA, 17 bp, Homo sapiens
atcattaaatttttcct

SEQ ID NO: 497143 - DNA, 23 bp, Homo sapiens
atcattaaatttttccttagcat

SEQ ID NO: 497144 - DNA, 16 bp, Homo sapiens
atcattgtaaacatta

SEQ ID NO: 497145 - DNA, 21 bp, Homo sapiens
atccacacaacaccaggactt

SEQ ID NO: 497146 - DNA, 14 bp, Homo sapiens
atccagctggtgag

SEQ ID NO: 497147 - DNA, 23 bp, Homo sapiens
atccatttgcgttccatgatgct

SEQ ID NO: 497148 - DNA, 16 bp, Homo sapiens
atccccaactgctcca

SEQ ID NO: 497149 - DNA, 17 bp, Homo sapiens
atcccggtttcagaagc

SEQ ID NO: 497150 - DNA, 18 bp, Homo sapiens
atcccggtttcagaagct

SEQ ID NO: 497151 - DNA, 16 bp, Homo sapiens
atccctaatgctgcag

SEQ ID NO: 497152 - DNA, 11 bp, Homo sapiens
atccctccctc

SEQ ID NO: 497153 - DNA, 18 bp, Homo sapiens
atccctccctccacctcc

SEQ ID NO: 497154 - DNA, 14 bp, Homo sapiens
atccctctctggat

SEQ ID NO: 497155 - DNA, 14 bp, Homo sapiens
atcccttgaccagg

SEQ ID NO: 497156 - DNA, 18 bp, Homo sapiens
atcccttgaccaggcctg

SEQ ID NO: 497157 - DNA, 12 bp, Homo sapiens
atccgaggcagg

SEQ ID NO: 497158 - DNA, 22 bp, Homo sapiens
atccgcctgtgggcgcatacta

SEQ ID NO: 497159 - DNA, 19 bp, Homo sapiens
atcctaaaacaaaagctca

SEQ ID NO: 497160 - DNA, 13 bp, Homo sapiens
atcctcaaaagaa

SEQ ID NO: 497161 - DNA, 15 bp, Homo sapiens
atcctcaaacactgc

SEQ ID NO: 497162 - DNA, 21 bp, Homo sapiens
atcctcaaacactgcaggcat

SEQ ID NO: 497163 - DNA, 21 bp, Homo sapiens
atcctcttctcaaagctggga

SEQ ID NO: 497164 - DNA, 24 bp, Homo sapiens
atcctggctctttggagatcaagg

SEQ ID NO: 497165 - DNA, 13 bp, Homo sapiens
atccttctgcctt

SEQ ID NO: 497166 - DNA, 19 bp, Homo sapiens
atcggtcttgcccagagga

SEQ ID NO: 497167 - DNA, 18 bp, Homo sapiens
atctaatttttattaatt

SEQ ID NO: 497168 - DNA, 16 bp, Homo sapiens
atctactgtacacaat

SEQ ID NO: 497169 - DNA, 13 bp, Homo sapiens
atctatcacctgt

SEQ ID NO: 497170 - DNA, 13 bp, Homo sapiens
atctcaatatttc

SEQ ID NO: 497171 - DNA, 21 bp, Homo sapiens
atctcatttccaagcaagtat

SEQ ID NO: 497172 - DNA, 17 bp, Homo sapiens
atctctctttaatataa

SEQ ID NO: 497173 - DNA, 16 bp, Homo sapiens
atctctgctttggaaa

SEQ ID NO: 497174 - DNA, 14 bp, Homo sapiens
atctgatggcttct

SEQ ID NO: 497175 - DNA, 18 bp, Homo sapiens
atctggaaccatcagaaa

SEQ ID NO: 497176 - DNA, 15 bp, Homo sapiens
atctggagagctaga

SEQ ID NO: 497177 - DNA, 23 bp, Homo sapiens
atctggagagctagaacctggag

SEQ ID NO: 497178 - DNA, 23 bp, Homo sapiens
atctggccgttgatgttggctgg

SEQ ID NO: 497179 - DNA, 12 bp, Homo sapiens
atcttgaaggaa

SEQ ID NO: 497180 - DNA, 14 bp, Homo sapiens
atgaaatatttttg

SEQ ID NO: 497181 - DNA, 14 bp, Homo sapiens
atgaagcaaacaca

SEQ ID NO: 497182 - DNA, 19 bp, Homo sapiens
atgaaggtttctgaaaatt

SEQ ID NO: 497183 - DNA, 23 bp, Homo sapiens
atgaagtccaagcatttagatgt

SEQ ID NO: 497184 - DNA, 15 bp, Homo sapiens
atgaattaagttttt

SEQ ID NO: 497185 - DNA, 17 bp, Homo sapiens
atgaattacatttgtat

SEQ ID NO: 497186 - DNA, 18 bp, Homo sapiens
atgaattacatttgtata

SEQ ID NO: 497187 - DNA, 21 bp, Homo sapiens
atgaattagttttatatgctt

SEQ ID NO: 497188 - DNA, 17 bp, Homo sapiens
atgacaaataagtggaa

SEQ ID NO: 497189 - DNA, 17 bp, Homo sapiens
atgacattcatgcctgg

SEQ ID NO: 497190 - DNA, 18 bp, Homo sapiens
atgacattcatgcctggc

SEQ ID NO: 497191 - DNA, 12 bp, Homo sapiens
atgacccaggct

SEQ ID NO: 497192 - DNA, 17 bp, Homo sapiens
atgactgtagaatttgt

SEQ ID NO: 497193 - DNA, 14 bp, Homo sapiens
atgagaactctgag

SEQ ID NO: 497194 - DNA, 22 bp, Homo sapiens
atgagaagttgatatagaacag

SEQ ID NO: 497195 - DNA, 17 bp, Homo sapiens
atgagagacacactgaa

SEQ ID NO: 497196 - DNA, 23 bp, Homo sapiens
atgagagacacactgaagaagca

SEQ ID NO: 497197 - DNA, 16 bp, Homo sapiens
atgagccccttcatcc

SEQ ID NO: 497198 - DNA, 22 bp, Homo sapiens
atgagtctcaataaactgaatt

SEQ ID NO: 497199 - DNA, 14 bp, Homo sapiens
atgataactggaaa

SEQ ID NO: 497200 - DNA, 12 bp, Homo sapiens
atgatctgtcaa

SEQ ID NO: 497201 - DNA, 15 bp, Homo sapiens
atgatggcagagcca

SEQ ID NO: 497202 - DNA, 21 bp, Homo sapiens
atgatggcagagccaggctgt

SEQ ID NO: 497203 - DNA, 18 bp, Homo sapiens
atgatgtccaacaaggaa

SEQ ID NO: 497204 - DNA, 16 bp, Homo sapiens
atgatgtgcctgggtg

SEQ ID NO: 497205 - DNA, 17 bp, Homo sapiens
atgatgttgaatatttg

SEQ ID NO: 497206 - DNA, 15 bp, Homo sapiens
atgcaaaggctggga

SEQ ID NO: 497207 - DNA, 12 bp, Homo sapiens
atgcacagctgt

SEQ ID NO: 497208 - DNA, 24 bp, Homo sapiens
atgcacctgaatgttagatagtta

SEQ ID NO: 497209 - DNA, 21 bp, Homo sapiens
atgcactaatcaatactttga

SEQ ID NO: 497210 - DNA, 15 bp, Homo sapiens
atgcagtattgagca

SEQ ID NO: 497211 - DNA, 19 bp, Homo sapiens
atgcagttctgaagaagat

SEQ ID NO: 497212 - DNA, 12 bp, Homo sapiens
atgcatggaaat

SEQ ID NO: 497213 - DNA, 20 bp, Homo sapiens
atgcatgttttccagctcct

SEQ ID NO: 497214 - DNA, 16 bp, Homo sapiens
atgccaagcactgtgc

SEQ ID NO: 497215 - DNA, 12 bp, Homo sapiens
atgccatcctca

SEQ ID NO: 497216 - DNA, 21 bp, Homo sapiens
atgccatcctcaaacactgca

SEQ ID NO: 497217 - DNA, 17 bp, Homo sapiens
atgccatggacagaaga

SEQ ID NO: 497218 - DNA, 18 bp, Homo sapiens
atgccatggacagaagaa

SEQ ID NO: 497219 - DNA, 17 bp, Homo sapiens
atgcccaagccctgaga

SEQ ID NO: 497220 - DNA, 15 bp, Homo sapiens
atgcccaagggaaag

SEQ ID NO: 497221 - DNA, 16 bp, Homo sapiens
atgcctgagtgcctgg

SEQ ID NO: 497222 - DNA, 19 bp, Homo sapiens
atgcctgagtgcctggcca

SEQ ID NO: 497223 - DNA, 13 bp, Homo sapiens
atgcctggcttcg

SEQ ID NO: 497224 - DNA, 19 bp, Homo sapiens
atgcgagtgctcatttcag

SEQ ID NO: 497225 - DNA, 19 bp, Homo sapiens
atgctgaagccaaagccaa

SEQ ID NO: 497226 - DNA, 14 bp, Homo sapiens
atgctgatgtcctc

SEQ ID NO: 497227 - DNA, 20 bp, Homo sapiens
atgctgcagatttgggctgg

SEQ ID NO: 497228 - DNA, 23 bp, Homo sapiens
atgctgtattttaaaagaatgat

SEQ ID NO: 497229 - DNA, 22 bp, Homo sapiens
atgctgtctacactaagagaga

SEQ ID NO: 497230 - DNA, 21 bp, Homo sapiens
atgcttctgttttataatttt

SEQ ID NO: 497231 - DNA, 15 bp, Homo sapiens
atggaaaggagagga

SEQ ID NO: 497232 - DNA, 15 bp, Homo sapiens
atggaatttgtaagt

SEQ ID NO: 497233 - DNA, 17 bp, Homo sapiens
atggaatttgtaagttt

SEQ ID NO: 497234 - DNA, 21 bp, Homo sapiens
atggaatttgtaagtttatgt

SEQ ID NO: 497235 - DNA, 15 bp, Homo sapiens
atggacggtgctcca

SEQ ID NO: 497236 - DNA, 22 bp, Homo sapiens
atggacggtgctccaggcaggc

SEQ ID NO: 497237 - DNA, 20 bp, Homo sapiens
atggagagctagaacccggc

SEQ ID NO: 497238 - DNA, 14 bp, Homo sapiens
atggcactagtatt

SEQ ID NO: 497239 - DNA, 16 bp, Homo sapiens
atggcaggatggcctg

SEQ ID NO: 497240 - DNA, 14 bp, Homo sapiens
atggcatattgata

SEQ ID NO: 497241 - DNA, 20 bp, Homo sapiens
ccacgcccaccagccttgct

SEQ ID NO: 497242 - DNA, 14 bp, Homo sapiens
ccactcccaggcag

SEQ ID NO: 497243 - DNA, 23 bp, Homo sapiens
ccactgaagtccccctttctcct

SEQ ID NO: 497244 - DNA, 19 bp, Homo sapiens
ccactgcactccagcctgg

SEQ ID NO: 497245 - DNA, 20 bp, Homo sapiens
ccactgcactccagcctggg

SEQ ID NO: 497246 - DNA, 19 bp, Homo sapiens
ccagacatgtggtgggaca

SEQ ID NO: 497247 - DNA, 23 bp, Homo sapiens
ccagacatgtggtgggacaggga

SEQ ID NO: 497248 - DNA, 21 bp, Homo sapiens
ccagactcctgactgtctccc

SEQ ID NO: 497249 - DNA, 14 bp, Homo sapiens
ccagacttgctgaa

SEQ ID NO: 497250 - DNA, 21 bp, Homo sapiens
ccagagttccccatgcagaca

SEQ ID NO: 497251 - DNA, 15 bp, Homo sapiens
ccagatcctcttctc

SEQ ID NO: 497252 - DNA, 16 bp, Homo sapiens
ccagatggactccagc

SEQ ID NO: 497253 - DNA, 18 bp, Homo sapiens
ccagcactaaagcagtgg

SEQ ID NO: 497254 - DNA, 16 bp, Homo sapiens
ccagcagccagctctc

SEQ ID NO: 497255 - DNA, 18 bp, Homo sapiens
ccagcagccagctctcag

SEQ ID NO: 497256 - DNA, 19 bp, Homo sapiens
ccagcagccagctctcagc

SEQ ID NO: 497257 - DNA, 13 bp, Homo sapiens
ccagcagttcaga

SEQ ID NO: 497258 - DNA, 18 bp, Homo sapiens
ccagcagttcagagctgc

SEQ ID NO: 497259 - DNA, 22 bp, Homo sapiens
ccagcagttcagagctgccctc

SEQ ID NO: 497260 - DNA, 16 bp, Homo sapiens
ccagccagcagccagc

SEQ ID NO: 497261 - DNA, 23 bp, Homo sapiens
ccagccagcagccagctctcagc

SEQ ID NO: 497262 - DNA, 14 bp, Homo sapiens
ccagccagggctgc

SEQ ID NO: 497263 - DNA, 12 bp, Homo sapiens
ccagcctctgcc

SEQ ID NO: 497264 - DNA, 20 bp, Homo sapiens
ccagcctctgccgctgccat

SEQ ID NO: 497265 - DNA, 19 bp, Homo sapiens
ccagcctgcctggcaggct

SEQ ID NO: 497266 - DNA, 13 bp, Homo sapiens
ccagcctggagat

SEQ ID NO: 497267 - DNA, 19 bp, Homo sapiens
ccagccttgctctcttcaa

SEQ ID NO: 497268 - DNA, 21 bp, Homo sapiens
ccagccttgctctcttcaata

SEQ ID NO: 497269 - DNA, 13 bp, Homo sapiens
ccagctctcagcc

SEQ ID NO: 497270 - DNA, 18 bp, Homo sapiens
ccagctgccccagccaga

SEQ ID NO: 497271 - DNA, 21 bp, Homo sapiens
ccagctggtgagtgatgcggc

SEQ ID NO: 497272 - DNA, 13 bp, Homo sapiens
ccagcttttccca

SEQ ID NO: 497273 - DNA, 23 bp, Homo sapiens
ccaggacttaagacaaatgggac

SEQ ID NO: 497274 - DNA, 15 bp, Homo sapiens
ccaggaggctgaggt

SEQ ID NO: 497275 - DNA, 15 bp, Homo sapiens
ccaggcaggcacctg

SEQ ID NO: 497276 - DNA, 17 bp, Homo sapiens
ccaggcaggcacctggg

SEQ ID NO: 497277 - DNA, 20 bp, Homo sapiens
ccaggctgggcaaggaggcc

SEQ ID NO: 497278 - DNA, 17 bp, Homo sapiens
ccaggcttgcctgcagg

SEQ ID NO: 497279 - DNA, 19 bp, Homo sapiens
ccagggacgaagaagagcc

SEQ ID NO: 497280 - DNA, 15 bp, Homo sapiens
ccagggccctgagct

SEQ ID NO: 497281 - DNA, 18 bp, Homo sapiens
ccagggccctgagctcgg

SEQ ID NO: 497282 - DNA, 11 bp, Homo sapiens
ccagggctcag

SEQ ID NO: 497283 - DNA, 13 bp, Homo sapiens
ccagggctcagcc

SEQ ID NO: 497284 - DNA, 15 bp, Homo sapiens
ccagggctcagcctg

SEQ ID NO: 497285 - DNA, 15 bp, Homo sapiens
ccaggggccatgaat

SEQ ID NO: 497286 - DNA, 14 bp, Homo sapiens
ccaggtgcagacct

SEQ ID NO: 497287 - DNA, 22 bp, Homo sapiens
ccaggtgtggttgctcacagct

SEQ ID NO: 497288 - DNA, 22 bp, Homo sapiens
ccaggtttctggtctctaggct

SEQ ID NO: 497289 - DNA, 12 bp, Homo sapiens
ccagtaaacaga

SEQ ID NO: 497290 - DNA, 15 bp, Homo sapiens
ccagtatgagcccta

SEQ ID NO: 497291 - DNA, 21 bp, Homo sapiens
ccagtgatgctaaaggttgta

SEQ ID NO: 497292 - DNA, 14 bp, Homo sapiens
ccagtgcaacactg

SEQ ID NO: 497293 - DNA, 13 bp, Homo sapiens
ccagtggctgctg

SEQ ID NO: 497294 - DNA, 19 bp, Homo sapiens
ccagtggctgctgcccagg

SEQ ID NO: 497295 - DNA, 21 bp, Homo sapiens
ccagtggctgctgcccaggcc

SEQ ID NO: 497296 - DNA, 21 bp, Homo sapiens
ccagttcctttcaatggtttg

SEQ ID NO: 497297 - DNA, 17 bp, Homo sapiens
ccagtttaacctgatgc

SEQ ID NO: 497298 - DNA, 18 bp, Homo sapiens
ccatagaagaacagcaga

SEQ ID NO: 497299 - DNA, 14 bp, Homo sapiens
ccatattaaaatca

SEQ ID NO: 497300 - DNA, 23 bp, Homo sapiens
ccatattaaaatcacaaactcat

SEQ ID NO: 497301 - DNA, 18 bp, Homo sapiens
ccatcagaaacaccctca

SEQ ID NO: 497302 - DNA, 22 bp, Homo sapiens
ccatcagaaacaccctcacact

SEQ ID NO: 497303 - DNA, 16 bp, Homo sapiens
ccatcagttagagctg

SEQ ID NO: 497304 - DNA, 15 bp, Homo sapiens
ccatccctccctcca

SEQ ID NO: 497305 - DNA, 13 bp, Homo sapiens
ccatcctcaaaca

SEQ ID NO: 497306 - DNA, 18 bp, Homo sapiens
ccatcctcaaacactgca

SEQ ID NO: 497307 - DNA, 20 bp, Homo sapiens
ccatctgcctgttctgagga

SEQ ID NO: 497308 - DNA, 22 bp, Homo sapiens
ccatctgggctcctaaccttcc

SEQ ID NO: 497309 - DNA, 14 bp, Homo sapiens
ccatgacccaggct

SEQ ID NO: 497310 - DNA, 15 bp, Homo sapiens
ccatgacccaggctg

SEQ ID NO: 497311 - DNA, 15 bp, Homo sapiens
ccatggagagctgga

SEQ ID NO: 497312 - DNA, 18 bp, Homo sapiens
ccatggagagctggagcc

SEQ ID NO: 497313 - DNA, 22 bp, Homo sapiens
ccatggagagctggagcctggt

SEQ ID NO: 497314 - DNA, 18 bp, Homo sapiens
ccatgggcactgtgggta

SEQ ID NO: 497315 - DNA, 18 bp, Homo sapiens
ccatgtagaagctgcatc

SEQ ID NO: 497316 - DNA, 20 bp, Homo sapiens
ccattcattccattctggaa

SEQ ID NO: 497317 - DNA, 14 bp, Homo sapiens
ccattctacacaga

SEQ ID NO: 497318 - DNA, 22 bp, Homo sapiens
ccattctggattttgtcaagca

SEQ ID NO: 497319 - DNA, 17 bp, Homo sapiens
cccaactgctccagcct

SEQ ID NO: 497320 - DNA, 19 bp, Homo sapiens
cccaactgctccagcctct

SEQ ID NO: 497321 - DNA, 16 bp, Homo sapiens
cccaagagtggtggca

SEQ ID NO: 497322 - DNA, 22 bp, Homo sapiens
cccaagtagctgctaccttctt

SEQ ID NO: 497323 - DNA, 18 bp, Homo sapiens
cccaattttgcagggagc

SEQ ID NO: 497324 - DNA, 19 bp, Homo sapiens
cccaccagccttgctctct

SEQ ID NO: 497325 - DNA, 20 bp, Homo sapiens
cccaccagccttgctctctt

SEQ ID NO: 497326 - DNA, 16 bp, Homo sapiens
cccagcactaaagcag

SEQ ID NO: 497327 - DNA, 17 bp, Homo sapiens
cccagccagcagttcag

SEQ ID NO: 497328 - DNA, 24 bp, Homo sapiens
cccagccagcagttcagagctgcc

SEQ ID NO: 497329 - DNA, 12 bp, Homo sapiens
cccagctcagca

SEQ ID NO: 497330 - DNA, 19 bp, Homo sapiens
cccaggctgggcaaggagg

SEQ ID NO: 497331 - DNA, 15 bp, Homo sapiens
cccagggctcagcct

SEQ ID NO: 497332 - DNA, 22 bp, Homo sapiens
cccaggtttctggtctctaggc

SEQ ID NO: 497333 - DNA, 14 bp, Homo sapiens
cccagtacctcctg

SEQ ID NO: 497334 - DNA, 20 bp, Homo sapiens
cccagtacctcctgtctctg

SEQ ID NO: 497335 - DNA, 15 bp, Homo sapiens
cccagtggctgctgc

SEQ ID NO: 497336 - DNA, 16 bp, Homo sapiens
cccagtggctgctgcc

SEQ ID NO: 497337 - DNA, 17 bp, Homo sapiens
cccagtggctgctgccc

SEQ ID NO: 497338 - DNA, 19 bp, Homo sapiens
cccatgacccaggctgggc

SEQ ID NO: 497339 - DNA, 21 bp, Homo sapiens
cccattcattccattctggaa

SEQ ID NO: 497340 - DNA, 22 bp, Homo sapiens
cccattcattccattctggaag

SEQ ID NO: 497341 - DNA, 18 bp, Homo sapiens
cccattctacacagagca

SEQ ID NO: 497342 - DNA, 16 bp, Homo sapiens
ccccaactgctccagc

SEQ ID NO: 497343 - DNA, 18 bp, Homo sapiens
cccccttgccagacatgt

SEQ ID NO: 497344 - DNA, 16 bp, Homo sapiens
cccggggacccccaac

SEQ ID NO: 497345 - DNA, 22 bp, Homo sapiens
cccggtttcagaagctgcagct

SEQ ID NO: 497346 - DNA, 16 bp, Homo sapiens
cccgtcttcagcctag

SEQ ID NO: 497347 - DNA, 12 bp, Homo sapiens
ccctcatgctgt

SEQ ID NO: 497348 - DNA, 16 bp, Homo sapiens
ccctcccctgccctag

SEQ ID NO: 497349 - DNA, 12 bp, Homo sapiens
ccctccctccac

SEQ ID NO: 497350 - DNA, 20 bp, Homo sapiens
ccctccctccacctccctgc

SEQ ID NO: 497351 - DNA, 13 bp, Homo sapiens
ccctcctctgctt

SEQ ID NO: 497352 - DNA, 13 bp, Homo sapiens
ccctctcctgggc

SEQ ID NO: 497353 - DNA, 15 bp, Homo sapiens
ccctctcctgggcag

SEQ ID NO: 497354 - DNA, 11 bp, Homo sapiens
ccctctctgga

SEQ ID NO: 497355 - DNA, 12 bp, Homo sapiens
ccctgagctcgg

SEQ ID NO: 497356 - DNA, 15 bp, Homo sapiens
ccctgatcctgtgaa

SEQ ID NO: 497357 - DNA, 15 bp, Homo sapiens
ccctgcaataaaatg

SEQ ID NO: 497358 - DNA, 16 bp, Homo sapiens
ccctgccccagcaaga

SEQ ID NO: 497359 - DNA, 19 bp, Homo sapiens
ccctggggacagcaagggc

SEQ ID NO: 497360 - DNA, 14 bp, Homo sapiens
ccctgggtgggagc

SEQ ID NO: 497361 - DNA, 23 bp, Homo sapiens
ccctggtaataagtactgtgtac

SEQ ID NO: 497362 - DNA, 23 bp, Homo sapiens
ccctgtgagtttgtacagtcttg

SEQ ID NO: 497363 - DNA, 20 bp, Homo sapiens
cccttcatccgcctgtgggc

SEQ ID NO: 497364 - DNA, 15 bp, Homo sapiens
cccttgatgaagaag

SEQ ID NO: 497365 - DNA, 15 bp, Homo sapiens
cccttgccagacatg

SEQ ID NO: 497366 - DNA, 15 bp, Homo sapiens
cccttgcccagggct

SEQ ID NO: 497367 - DNA, 16 bp, Homo sapiens
cccttggacttgagga

SEQ ID NO: 497368 - DNA, 14 bp, Homo sapiens
ccgacggagccggg

SEQ ID NO: 497369 - DNA, 13 bp, Homo sapiens
ccgaggtgggcag

SEQ ID NO: 497370 - DNA, 19 bp, Homo sapiens
ccgctgccatgctttgagt

SEQ ID NO: 497371 - DNA, 22 bp, Homo sapiens
ccgggaaagaagagccggagcc

SEQ ID NO: 497372 - DNA, 14 bp, Homo sapiens
ccgtcttcagccta

SEQ ID NO: 497373 - DNA, 19 bp, Homo sapiens
ccgttgatgttggctggga

SEQ ID NO: 497374 - DNA, 20 bp, Homo sapiens
ccgttggggattggggaaga

SEQ ID NO: 497375 - DNA, 12 bp, Homo sapiens
cctaatgctgca

SEQ ID NO: 497376 - DNA, 20 bp, Homo sapiens
cctacacccttggacttgag

SEQ ID NO: 497377 - DNA, 21 bp, Homo sapiens
cctagaagagtgtgaaaagga

SEQ ID NO: 497378 - DNA, 22 bp, Homo sapiens
cctagaagggctagaacctgga

SEQ ID NO: 497379 - DNA, 23 bp, Homo sapiens
cctagagaagctaaaacctgagc

SEQ ID NO: 497380 - DNA, 15 bp, Homo sapiens
cctagccgacctcag

SEQ ID NO: 497381 - DNA, 17 bp, Homo sapiens
cctagccgacctcagcc

SEQ ID NO: 497382 - DNA, 22 bp, Homo sapiens
cctaggcaggacatgctgaagc

SEQ ID NO: 497383 - DNA, 15 bp, Homo sapiens
cctagtctctatcat

SEQ ID NO: 497384 - DNA, 15 bp, Homo sapiens
cctatagtcccagct

SEQ ID NO: 497385 - DNA, 21 bp, Homo sapiens
cctatgcatggtgtagatgcc

SEQ ID NO: 497386 - DNA, 15 bp, Homo sapiens
cctcaaacactgcag

SEQ ID NO: 497387 - DNA, 13 bp, Homo sapiens
cctcacactggga

SEQ ID NO: 497388 - DNA, 17 bp, Homo sapiens
cctcactattcaagtat

SEQ ID NO: 497389 - DNA, 19 bp, Homo sapiens
cctcactggggtcctgggg

SEQ ID NO: 497390 - DNA, 22 bp, Homo sapiens
cctcagccttccccttgcccag

SEQ ID NO: 497391 - DNA, 23 bp, Homo sapiens
cctcatccagggctctgaccagt

SEQ ID NO: 497392 - DNA, 14 bp, Homo sapiens
cctcatccgaggca

SEQ ID NO: 497393 - DNA, 21 bp, Homo sapiens
cctccaatgctgcctgggagc

SEQ ID NO: 497394 - DNA, 22 bp, Homo sapiens
cctccacctccctgcaataaaa

SEQ ID NO: 497395 - DNA, 17 bp, Homo sapiens
cctcccagtacctcctg

SEQ ID NO: 497396 - DNA, 13 bp, Homo sapiens
cctcccctgggga

SEQ ID NO: 497397 - DNA, 20 bp, Homo sapiens
cctccctccacctccctgca

SEQ ID NO: 497398 - DNA, 12 bp, Homo sapiens
cctccctgcaat

SEQ ID NO: 497399 - DNA, 16 bp, Homo sapiens
cctccctgcaataaaa

SEQ ID NO: 497400 - DNA, 13 bp, Homo sapiens
cctcctctgcttg

SEQ ID NO: 497401 - DNA, 16 bp, Homo sapiens
cctcctctgcttgcca

SEQ ID NO: 497402 - DNA, 16 bp, Homo sapiens
cctcctctgtccaggg

SEQ ID NO: 497403 - DNA, 15 bp, Homo sapiens
cctcctggaatggag

SEQ ID NO: 497404 - DNA, 23 bp, Homo sapiens
cctcggagcctcatccgaggcag

SEQ ID NO: 497405 - DNA, 19 bp, Homo sapiens
cctctatgaactatggacg

SEQ ID NO: 497406 - DNA, 12 bp, Homo sapiens
cctctcctgggc

SEQ ID NO: 497407 - DNA, 15 bp, Homo sapiens
cctctcctgggcagc

SEQ ID NO: 497408 - DNA, 17 bp, Homo sapiens
cctctcctgggcagctg

SEQ ID NO: 497409 - DNA, 18 bp, Homo sapiens
cctctcctgggcagctgc

SEQ ID NO: 497410 - DNA, 19 bp, Homo sapiens
cctctcctgggcagctgcc

SEQ ID NO: 497411 - DNA, 21 bp, Homo sapiens
cctctccttgtggcctgggcc

SEQ ID NO: 497412 - DNA, 19 bp, Homo sapiens
cctctgccgctgccatgct

SEQ ID NO: 497413 - DNA, 23 bp, Homo sapiens
cctctgccgctgccatgctttga

SEQ ID NO: 497414 - DNA, 20 bp, Homo sapiens
cctctgcttgccatccctcc

SEQ ID NO: 497415 - DNA, 21 bp, Homo sapiens
cctctgcttgccatccctccc

SEQ ID NO: 497416 - DNA, 18 bp, Homo sapiens
cctctgtccagggccctg

SEQ ID NO: 497417 - DNA, 15 bp, Homo sapiens
cctcttaagtgtgca

SEQ ID NO: 497418 - DNA, 21 bp, Homo sapiens
cctgaagccaggccatggcta

SEQ ID NO: 497419 - DNA, 19 bp, Homo sapiens
cctgaagtaagcaaagact

SEQ ID NO: 497420 - DNA, 13 bp, Homo sapiens
cctgactgtctcc

SEQ ID NO: 497421 - DNA, 13 bp, Homo sapiens
cctgagaagagag

SEQ ID NO: 497422 - DNA, 17 bp, Homo sapiens
cctgagcgcctgggtcc

SEQ ID NO: 497423 - DNA, 18 bp, Homo sapiens
cctgagctcggtggaccc

SEQ ID NO: 497424 - DNA, 20 bp, Homo sapiens
cctgagctcggtggacccag

SEQ ID NO: 497425 - DNA, 21 bp, Homo sapiens
cctgagctcggtggacccagg

SEQ ID NO: 497426 - DNA, 17 bp, Homo sapiens
cctgataacaacctgga

SEQ ID NO: 497427 - DNA, 18 bp, Homo sapiens
cctgataacaacctggag

SEQ ID NO: 497428 - DNA, 23 bp, Homo sapiens
cctgatggcaggatggcctggcc

SEQ ID NO: 497429 - DNA, 18 bp, Homo sapiens
cctgccctagagcacact

SEQ ID NO: 497430 - DNA, 14 bp, Homo sapiens
cctgcctggcaggc

SEQ ID NO: 497431 - DNA, 12 bp, Homo sapiens
cctgctcctcag

SEQ ID NO: 497432 - DNA, 18 bp, Homo sapiens
cctgctccttcccaggag

SEQ ID NO: 497433 - DNA, 23 bp, Homo sapiens
cctggaaatcagggttagtattg

SEQ ID NO: 497434 - DNA, 15 bp, Homo sapiens
cctggaaattctgcc

SEQ ID NO: 497435 - DNA, 13 bp, Homo sapiens
cctggaagacaga

SEQ ID NO: 497436 - DNA, 14 bp, Homo sapiens
cctggaatggagct

SEQ ID NO: 497437 - DNA, 23 bp, Homo sapiens
cctggagagccagaacctggagg

SEQ ID NO: 497438 - DNA, 13 bp, Homo sapiens
cctggagagctag

SEQ ID NO: 497439 - DNA, 21 bp, Homo sapiens
cctggagagctagaacctgga

SEQ ID NO: 497440 - DNA, 22 bp, Homo sapiens
cctggagagctagaacctggag

SEQ ID NO: 497441 - DNA, 21 bp, Homo sapiens
cctggagggaatgaacctgga

SEQ ID NO: 497442 - DNA, 20 bp, Homo sapiens
cctggagggctagaacctag

SEQ ID NO: 497443 - DNA, 21 bp, Homo sapiens
cctggagggctagaacctaga

SEQ ID NO: 497444 - DNA, 23 bp, Homo sapiens
cctggcaagctagaacctggagg

SEQ ID NO: 497445 - DNA, 19 bp, Homo sapiens
cctggcaggttagaaccta

SEQ ID NO: 497446 - DNA, 20 bp, Homo sapiens
cctggcaggttagaacctag

SEQ ID NO: 497447 - DNA, 15 bp, Homo sapiens
cctggccagggcctg

SEQ ID NO: 497448 - DNA, 19 bp, Homo sapiens
cctggccagggcctggaag

SEQ ID NO: 497449 - DNA, 14 bp, Homo sapiens
cctgggcagctgcc

SEQ ID NO: 497450 - DNA, 16 bp, Homo sapiens
cctgggcagctgcctc

SEQ ID NO: 497451 - DNA, 22 bp, Homo sapiens
cctgggcagctgcctcccctcc

SEQ ID NO: 497452 - DNA, 12 bp, Homo sapiens
cctgggctttct

SEQ ID NO: 497453 - DNA, 13 bp, Homo sapiens
cctgggctttctg

SEQ ID NO: 497454 - DNA, 14 bp, Homo sapiens
cctggggctgctgg

SEQ ID NO: 497455 - DNA, 20 bp, Homo sapiens
cctgggtaaatgcagcgtga

SEQ ID NO: 497456 - DNA, 22 bp, Homo sapiens
cctgggtaaatgcagcgtgaag

SEQ ID NO: 497457 - DNA, 10 bp, Homo sapiens
cctggtgccc

SEQ ID NO: 497458 - DNA, 14 bp, Homo sapiens
cctggtgggcctcc

SEQ ID NO: 497459 - DNA, 14 bp, Homo sapiens
cctgtaatcccagc

SEQ ID NO: 497460 - DNA, 15 bp, Homo sapiens
cctgtaatcccagca

SEQ ID NO: 497461 - DNA, 18 bp, Homo sapiens
cctgtaatcccagcactt

SEQ ID NO: 497462 - DNA, 21 bp, Homo sapiens
cctgtctgccagccagcagcc

SEQ ID NO: 497463 - DNA, 21 bp, Homo sapiens
cctgtgctgcccgtcttcagc

SEQ ID NO: 497464 - DNA, 22 bp, Homo sapiens
cctgtgctgcccgtcttcagcc

SEQ ID NO: 497465 - DNA, 23 bp, Homo sapiens
cctgtgctgcccgtcttcagcct

SEQ ID NO: 497466 - DNA, 13 bp, Homo sapiens
cctgttagccagg

SEQ ID NO: 497467 - DNA, 12 bp, Homo sapiens
ccttaacactga

SEQ ID NO: 497468 - DNA, 11 bp, Homo sapiens
ccttcagaggc

SEQ ID NO: 497469 - DNA, 18 bp, Homo sapiens
ccttcatccgcctgtggg

SEQ ID NO: 497470 - DNA, 14 bp, Homo sapiens
ccttcatctggaac

SEQ ID NO: 497471 - DNA, 23 bp, Homo sapiens
ccttccaggggtcaccttgagag

SEQ ID NO: 497472 - DNA, 18 bp, Homo sapiens
ccttcccatgacccaggc

SEQ ID NO: 497473 - DNA, 18 bp, Homo sapiens
ccttccccttgcccaggg

SEQ ID NO: 497474 - DNA, 20 bp, Homo sapiens
ccttccccttgcccagggct

SEQ ID NO: 497475 - DNA, 12 bp, Homo sapiens
ccttgaccaggc

SEQ ID NO: 497476 - DNA, 20 bp, Homo sapiens
ccttgagaggcatgacagct

SEQ ID NO: 497477 - DNA, 20 bp, Homo sapiens
ccttgctctcttcaataaac

SEQ ID NO: 497478 - DNA, 13 bp, Homo sapiens
ccttggacttgag

SEQ ID NO: 497479 - DNA, 14 bp, Homo sapiens
ccttggctggtgca

SEQ ID NO: 497480 - DNA, 13 bp, Homo sapiens
ccttgtatttaaa

SEQ ID NO: 497481 - DNA, 16 bp, Homo sapiens
ccttgtatttaaatat

SEQ ID NO: 497482 - DNA, 18 bp, Homo sapiens
ccttgtctctactaaaaa

SEQ ID NO: 497483 - DNA, 17 bp, Homo sapiens
ccttgtctgaactggag

SEQ ID NO: 497484 - DNA, 16 bp, Homo sapiens
ccttgtggcctgggcc

SEQ ID NO: 497485 - DNA, 15 bp, Homo sapiens
cctttagaatattaa

SEQ ID NO: 497486 - DNA, 16 bp, Homo sapiens
cctttagaatattaaa

SEQ ID NO: 497487 - DNA, 20 bp, Homo sapiens
cctttagaatattaaaaatt

SEQ ID NO: 497488 - DNA, 21 bp, Homo sapiens
cctttccgcggagcccttggc

SEQ ID NO: 497489 - DNA, 11 bp, Homo sapiens
cctttctgagt

SEQ ID NO: 497490 - DNA, 14 bp, Homo sapiens
cctttgaagaggaa

SEQ ID NO: 497491 - DNA, 15 bp, Homo sapiens
cctttgacctgcctc

SEQ ID NO: 497492 - DNA, 16 bp, Homo sapiens
cctttgacctgcctcc

SEQ ID NO: 497493 - DNA, 17 bp, Homo sapiens
aaaaagcctccagtcca

SEQ ID NO: 497494 - DNA, 19 bp, Homo sapiens
aaaaattaaaagaaggaat

SEQ ID NO: 497495 - DNA, 14 bp, Homo sapiens
aaaacaaggatgaa

SEQ ID NO: 497496 - DNA, 19 bp, Homo sapiens
aaaacattttcacacaata

SEQ ID NO: 497497 - DNA, 17 bp, Homo sapiens
aaaactttttatatttt

SEQ ID NO: 497498 - DNA, 11 bp, Homo sapiens
aaaagaatgat

SEQ ID NO: 497499 - DNA, 19 bp, Homo sapiens
aaaagagatggcctgagaa

SEQ ID NO: 497500 - DNA, 18 bp, Homo sapiens
aaaaggacaaataaagca

SEQ ID NO: 497501 - DNA, 23 bp, Homo sapiens
aaaaggtaaaactttttatattt

SEQ ID NO: 497502 - DNA, 19 bp, Homo sapiens
aaaataaaattaaagctga

SEQ ID NO: 497503 - DNA, 20 bp, Homo sapiens
aaaataatttttatatttga

SEQ ID NO: 497504 - DNA, 16 bp, Homo sapiens
aaaatctgtggtggtc

SEQ ID NO: 497505 - DNA, 21 bp, Homo sapiens
aaaatgagttacctacatttt

SEQ ID NO: 497506 - DNA, 23 bp, Homo sapiens
aaaatgctgtattagtcacagag

SEQ ID NO: 497507 - DNA, 16 bp, Homo sapiens
aaaattcattccattt

SEQ ID NO: 497508 - DNA, 15 bp, Homo sapiens
aaaattgtatagaga

SEQ ID NO: 497509 - DNA, 21 bp, Homo sapiens
aaaattgtatagagatatgca

SEQ ID NO: 497510 - DNA, 14 bp, Homo sapiens
aaacactgcaggca

SEQ ID NO: 497511 - DNA, 17 bp, Homo sapiens
aacacaactatattgtt

SEQ ID NO: 497512 - DNA, 21 bp, Homo sapiens
aacaccctcacactgggactt

SEQ ID NO: 497513 - DNA, 22 bp, Homo sapiens
aacaccttcagaggctgaggtg

SEQ ID NO: 497514 - DNA, 19 bp, Homo sapiens
aacactaaacagactattt

SEQ ID NO: 497515 - DNA, 18 bp, Homo sapiens
aacactatatggcagtgt

SEQ ID NO: 497516 - DNA, 15 bp, Homo sapiens
aacactgagctgtca

SEQ ID NO: 497517 - DNA, 16 bp, Homo sapiens
aacactgtcttgaaga

SEQ ID NO: 497518 - DNA, 15 bp, Homo sapiens
aacagattcacactg

SEQ ID NO: 497519 - DNA, 14 bp, Homo sapiens
aacataaataaaat

SEQ ID NO: 497520 - DNA, 21 bp, Homo sapiens
aacatagtgagacccctgtct

SEQ ID NO: 497521 - DNA, 16 bp, Homo sapiens
aacatatataacaatg

SEQ ID NO: 497522 - DNA, 14 bp, Homo sapiens
aacatgatgaaacc

SEQ ID NO: 497523 - DNA, 18 bp, Homo sapiens
aacatggtgtctggattc

SEQ ID NO: 497524 - DNA, 11 bp, Homo sapiens
aacatgtcatg

SEQ ID NO: 497525 - DNA, 23 bp, Homo sapiens
aacattccatccttgagtcaaaa

SEQ ID NO: 497526 - DNA, 13 bp, Homo sapiens
aacattttcacac

SEQ ID NO: 497527 - DNA, 21 bp, Homo sapiens
aaccagcatcccttgaccagg

SEQ ID NO: 497528 - DNA, 13 bp, Homo sapiens
aaccagtgtctga

SEQ ID NO: 497529 - DNA, 21 bp, Homo sapiens
aaccctaaaaagcagagcttt

SEQ ID NO: 497530 - DNA, 14 bp, Homo sapiens
aacctagaagggct

SEQ ID NO: 497531 - DNA, 17 bp, Homo sapiens
aacctagggtgatatta

SEQ ID NO: 497532 - DNA, 20 bp, Homo sapiens
aacctagggtgatattaacc

SEQ ID NO: 497533 - DNA, 22 bp, Homo sapiens
aacctgctttcaagacccctgt

SEQ ID NO: 497534 - DNA, 10 bp, Homo sapiens
aacctggaga

SEQ ID NO: 497535 - DNA, 19 bp, Homo sapiens
aacctggagagctagaacc

SEQ ID NO: 497536 - DNA, 19 bp, Homo sapiens
aacctggagggctagaacc

SEQ ID NO: 497537 - DNA, 22 bp, Homo sapiens
aacctggagggctagaatctgg

SEQ ID NO: 497538 - DNA, 15 bp, Homo sapiens
aacctgggaggcaga

SEQ ID NO: 497539 - DNA, 20 bp, Homo sapiens
aactatctcatttccaagca

SEQ ID NO: 497540 - DNA, 21 bp, Homo sapiens
aactatgatttggaaaataaa

SEQ ID NO: 497541 - DNA, 21 bp, Homo sapiens
aactcaatattttccatgaaa

SEQ ID NO: 497542 - DNA, 15 bp, Homo sapiens
aactcacctggggct

SEQ ID NO: 497543 - DNA, 21 bp, Homo sapiens
aactcctagggccactgaaga

SEQ ID NO: 497544 - DNA, 13 bp, Homo sapiens
aactctaattcta

SEQ ID NO: 497545 - DNA, 15 bp, Homo sapiens
aactctcctgctcct

SEQ ID NO: 497546 - DNA, 19 bp, Homo sapiens
aactgaaaacaagccatga

SEQ ID NO: 497547 - DNA, 12 bp, Homo sapiens
aactgaaatcat

SEQ ID NO: 497548 - DNA, 18 bp, Homo sapiens
aactgactcttaagaaga

SEQ ID NO: 497549 - DNA, 18 bp, Homo sapiens
aactgctccagcctctgc

SEQ ID NO: 497550 - DNA, 22 bp, Homo sapiens
aactgctccagcctctgccgct

SEQ ID NO: 497551 - DNA, 24 bp, Homo sapiens
aactgctccagcctctgccgctgc

SEQ ID NO: 497552 - DNA, 18 bp, Homo sapiens
aactggcttctgcttgtc

SEQ ID NO: 497553 - DNA, 19 bp, Homo sapiens
aacttagaataaaattgta

SEQ ID NO: 497554 - DNA, 18 bp, Homo sapiens
aacttcagcggtttatat

SEQ ID NO: 497555 - DNA, 18 bp, Homo sapiens
aacttctcttctgagcct

SEQ ID NO: 497556 - DNA, 12 bp, Homo sapiens
aacttgggaact

SEQ ID NO: 497557 - DNA, 15 bp, Homo sapiens
aacttgtaaatgtgg

SEQ ID NO: 497558 - DNA, 22 bp, Homo sapiens
aactttgaggaggaagcagaat

SEQ ID NO: 497559 - DNA, 15 bp, Homo sapiens
aactttgctgagcct

SEQ ID NO: 497560 - DNA, 13 bp, Homo sapiens
aagaaaaacatgt

SEQ ID NO: 497561 - DNA, 14 bp, Homo sapiens
aagaaaaacatgtc

SEQ ID NO: 497562 - DNA, 16 bp, Homo sapiens
aagaaacatttatctt

SEQ ID NO: 497563 - DNA, 12 bp, Homo sapiens
aagaaagtcaga

SEQ ID NO: 497564 - DNA, 22 bp, Homo sapiens
aagaaagtcagacctgtttctt

SEQ ID NO: 497565 - DNA, 14 bp, Homo sapiens
aagaacaacggcaa

SEQ ID NO: 497566 - DNA, 14 bp, Homo sapiens
aagaagagccacag

SEQ ID NO: 497567 - DNA, 19 bp, Homo sapiens
aagaagatcctaaaacaaa

SEQ ID NO: 497568 - DNA, 13 bp, Homo sapiens
aagacaaatggga

SEQ ID NO: 497569 - DNA, 16 bp, Homo sapiens
aagacagagctgggat

SEQ ID NO: 497570 - DNA, 16 bp, Homo sapiens
aagaccaccacctcag

SEQ ID NO: 497571 - DNA, 18 bp, Homo sapiens
aagacctccctgtgagag

SEQ ID NO: 497572 - DNA, 12 bp, Homo sapiens
aagacctggcaa

SEQ ID NO: 497573 - DNA, 23 bp, Homo sapiens
aagactcaagtgggaacgactgg

SEQ ID NO: 497574 - DNA, 15 bp, Homo sapiens
aagactgtggctgct

SEQ ID NO: 497575 - DNA, 18 bp, Homo sapiens
aagactgtggctgctagc

SEQ ID NO: 497576 - DNA, 20 bp, Homo sapiens
aagagacagtcaccccagga

SEQ ID NO: 497577 - DNA, 12 bp, Homo sapiens
aagagagaaaaa

SEQ ID NO: 497578 - DNA, 16 bp, Homo sapiens
aagagagaaaaacaaa

SEQ ID NO: 497579 - DNA, 17 bp, Homo sapiens
aagagcacttcacacag

SEQ ID NO: 497580 - DNA, 11 bp, Homo sapiens
aagagccacag

SEQ ID NO: 497581 - DNA, 11 bp, Homo sapiens
aagagctgagg

SEQ ID NO: 497582 - DNA, 14 bp, Homo sapiens
aagaggaaaatgaa

SEQ ID NO: 497583 - DNA, 22 bp, Homo sapiens
aataaacttagaataaaattgt

SEQ ID NO: 497584 - DNA, 15 bp, Homo sapiens
aataaagctgttctc

SEQ ID NO: 497585 - DNA, 22 bp, Homo sapiens
aataagttaactattttatttt

SEQ ID NO: 497586 - DNA, 19 bp, Homo sapiens
aataatgggcttagagcag

SEQ ID NO: 497587 - DNA, 14 bp, Homo sapiens
aataatgtttcaaa

SEQ ID NO: 497588 - DNA, 16 bp, Homo sapiens
aataatttttatattt

SEQ ID NO: 497589 - DNA, 19 bp, Homo sapiens
aataatttttatatttgaa

SEQ ID NO: 497590 - DNA, 23 bp, Homo sapiens
aataccacaggaaccacaagact

SEQ ID NO: 497591 - DNA, 13 bp, Homo sapiens
aatacctcttgga

SEQ ID NO: 497592 - DNA, 14 bp, Homo sapiens
aatactaataaaat

SEQ ID NO: 497593 - DNA, 15 bp, Homo sapiens
aatactaataaaata

SEQ ID NO: 497594 - DNA, 18 bp, Homo sapiens
aatactaataaaatacat

SEQ ID NO: 497595 - DNA, 16 bp, Homo sapiens
aatagtcaaattgtgt

SEQ ID NO: 497596 - DNA, 14 bp, Homo sapiens
aatagttgttgatt

SEQ ID NO: 497597 - DNA, 13 bp, Homo sapiens
aatataaacacta

SEQ ID NO: 497598 - DNA, 22 bp, Homo sapiens
aatatcacttgtcaataaaatc

SEQ ID NO: 497599 - DNA, 15 bp, Homo sapiens
aatatttcagataat

SEQ ID NO: 497600 - DNA, 21 bp, Homo sapiens
aatattttccatgaaaatgca

SEQ ID NO: 497601 - DNA, 23 bp, Homo sapiens
aatcaagttggcttctaatcaaa

SEQ ID NO: 497602 - DNA, 14 bp, Homo sapiens
aatcaatactttga

SEQ ID NO: 497603 - DNA, 17 bp, Homo sapiens
aatcacaaaagtatatt

SEQ ID NO: 497604 - DNA, 21 bp, Homo sapiens
aatcacaaaagtatattcaaa

SEQ ID NO: 497605 - DNA, 20 bp, Homo sapiens
aatcactcatttatttccat

SEQ ID NO: 497606 - DNA, 14 bp, Homo sapiens
aatcagcaagaaga

SEQ ID NO: 497607 - DNA, 16 bp, Homo sapiens
aatcagggttagtatt

SEQ ID NO: 497608 - DNA, 20 bp, Homo sapiens
aatcatatgggatactgctg

SEQ ID NO: 497609 - DNA, 12 bp, Homo sapiens
aatcatgaatta

SEQ ID NO: 497610 - DNA, 15 bp, Homo sapiens
aatcatgaattagtt

SEQ ID NO: 497611 - DNA, 23 bp, Homo sapiens
aatcatgaattagttttatatgc

SEQ ID NO: 497612 - DNA, 17 bp, Homo sapiens
aatcattaagacaactg

SEQ ID NO: 497613 - DNA, 17 bp, Homo sapiens
aatccactcccaggcag

SEQ ID NO: 497614 - DNA, 17 bp, Homo sapiens
aatgaatgcataaaatg

SEQ ID NO: 497615 - DNA, 19 bp, Homo sapiens
aatgaccagtaattgtgaa

SEQ ID NO: 497616 - DNA, 23 bp, Homo sapiens
aatgagccccttcatccgcctgt

SEQ ID NO: 497617 - DNA, 15 bp, Homo sapiens
aatgataactggaaa

SEQ ID NO: 497618 - DNA, 17 bp, Homo sapiens
aatgataactggaaact

SEQ ID NO: 497619 - DNA, 15 bp, Homo sapiens
aatgcaacaacatgt

SEQ ID NO: 497620 - DNA, 14 bp, Homo sapiens
aatgcagcgtgaag

SEQ ID NO: 497621 - DNA, 20 bp, Homo sapiens
aatgcatttaaactcatttg

SEQ ID NO: 497622 - DNA, 21 bp, Homo sapiens
aatgccatggacagaagaagg

SEQ ID NO: 497623 - DNA, 16 bp, Homo sapiens
aatgcctgagtgcctg

SEQ ID NO: 497624 - DNA, 23 bp, Homo sapiens
aatgctataactatgttgataaa

SEQ ID NO: 497625 - DNA, 22 bp, Homo sapiens
aatgctgtattagtcacagaga

SEQ ID NO: 497626 - DNA, 16 bp, Homo sapiens
aatgctgtattttaaa

SEQ ID NO: 497627 - DNA, 13 bp, Homo sapiens
aatggaagacaca

SEQ ID NO: 497628 - DNA, 17 bp, Homo sapiens
aatggcacagcccaaag

SEQ ID NO: 497629 - DNA, 22 bp, Homo sapiens
aatggcttatccagctggtgag

SEQ ID NO: 497630 - DNA, 14 bp, Homo sapiens
aatgggaaaagaga

SEQ ID NO: 497631 - DNA, 20 bp, Homo sapiens
aatgggactgatgtcatctt

SEQ ID NO: 497632 - DNA, 18 bp, Homo sapiens
aatgggactggagtccct

SEQ ID NO: 497633 - DNA, 14 bp, Homo sapiens
aatggtttgaatat

SEQ ID NO: 497634 - DNA, 12 bp, Homo sapiens
aattaacactgc

SEQ ID NO: 497635 - DNA, 22 bp, Homo sapiens
aattaagttagggaatggcaca

SEQ ID NO: 497636 - DNA, 20 bp, Homo sapiens
aattagttttatatgcttct

SEQ ID NO: 497637 - DNA, 13 bp, Homo sapiens
aattccaatacat

SEQ ID NO: 497638 - DNA, 16 bp, Homo sapiens
aattctgctacctcac

SEQ ID NO: 497639 - DNA, 21 bp, Homo sapiens
aattcttccctatctttgcca

SEQ ID NO: 497640 - DNA, 19 bp, Homo sapiens
aattgcttactcattaaaa

SEQ ID NO: 497641 - DNA, 12 bp, Homo sapiens
aatttgtatctg

SEQ ID NO: 497642 - DNA, 14 bp, Homo sapiens
aatttgtatctgaa

SEQ ID NO: 497643 - DNA, 18 bp, Homo sapiens
aatttgtatctgaaggag

SEQ ID NO: 497644 - DNA, 20 bp, Homo sapiens
aatttgtatctgaaggagat

SEQ ID NO: 497645 - DNA, 17 bp, Homo sapiens
aattttctagaatacta

SEQ ID NO: 497646 - DNA, 13 bp, Homo sapiens
aattttgtgaagc

SEQ ID NO: 497647 - DNA, 18 bp, Homo sapiens
aattttgtgaagcaaaat

SEQ ID NO: 497648 - DNA, 15 bp, Homo sapiens
aatttttcttgcgaa

SEQ ID NO: 497649 - DNA, 16 bp, Homo sapiens
acaaaagtatattcaa

SEQ ID NO: 497650 - DNA, 13 bp, Homo sapiens
acaaactcatcca

SEQ ID NO: 497651 - DNA, 13 bp, Homo sapiens
acaaatgtatgat

SEQ ID NO: 497652 - DNA, 12 bp, Homo sapiens
acaacctggaga

SEQ ID NO: 497653 - DNA, 18 bp, Homo sapiens
acaactatgatttggaaa

SEQ ID NO: 497654 - DNA, 14 bp, Homo sapiens
acaagactgcacat

SEQ ID NO: 497655 - DNA, 22 bp, Homo sapiens
acaagcaattagacaagaactt

SEQ ID NO: 497656 - DNA, 21 bp, Homo sapiens
acaaggatgaattaagttttt

SEQ ID NO: 497657 - DNA, 19 bp, Homo sapiens
acaagtgagacaaaaagca

SEQ ID NO: 497658 - DNA, 22 bp, Homo sapiens
acaatgctgtattttaaaagaa

SEQ ID NO: 497659 - DNA, 13 bp, Homo sapiens
acaatttaaagca

SEQ ID NO: 497660 - DNA, 22 bp, Homo sapiens
acacaaagcctgtgttactgat

SEQ ID NO: 497661 - DNA, 18 bp, Homo sapiens
acacaaatttgggagggt

SEQ ID NO: 497662 - DNA, 17 bp, Homo sapiens
acacaactatattgttt

SEQ ID NO: 497663 - DNA, 19 bp, Homo sapiens
actcaaaccaaatcactga

SEQ ID NO: 497664 - DNA, 15 bp, Homo sapiens
actcaatattttcca

SEQ ID NO: 497665 - DNA, 18 bp, Homo sapiens
actcaatattttccatga

SEQ ID NO: 497666 - DNA, 22 bp, Homo sapiens
actcaatattttccatgaaaat

SEQ ID NO: 497667 - DNA, 20 bp, Homo sapiens
actcacatggctatgtttta

SEQ ID NO: 497668 - DNA, 13 bp, Homo sapiens
actcaccatctgt

SEQ ID NO: 497669 - DNA, 16 bp, Homo sapiens
actcacctctaaaaca

SEQ ID NO: 497670 - DNA, 12 bp, Homo sapiens
actcacctgggg

SEQ ID NO: 497671 - DNA, 14 bp, Homo sapiens
actcacctggggct

SEQ ID NO: 497672 - DNA, 15 bp, Homo sapiens
actcagctccccaga

SEQ ID NO: 497673 - DNA, 15 bp, Homo sapiens
actcagggccccagc

SEQ ID NO: 497674 - DNA, 22 bp, Homo sapiens
actcatttatttccatattaaa

SEQ ID NO: 497675 - DNA, 23 bp, Homo sapiens
actccagcctgggcaacagagca

SEQ ID NO: 497676 - DNA, 16 bp, Homo sapiens
actcctaggcaggaca

SEQ ID NO: 497677 - DNA, 20 bp, Homo sapiens
actcctaggcaggacatgct

SEQ ID NO: 497678 - DNA, 15 bp, Homo sapiens
actcctgggtcagga

SEQ ID NO: 497679 - DNA, 18 bp, Homo sapiens
actctcctgctcctcagg

SEQ ID NO: 497680 - DNA, 15 bp, Homo sapiens
actctgctttgcatc

SEQ ID NO: 497681 - DNA, 15 bp, Homo sapiens
actcttaagaagact

SEQ ID NO: 497682 - DNA, 21 bp, Homo sapiens
actcttaagaagactgcatta

SEQ ID NO: 497683 - DNA, 17 bp, Homo sapiens
actgaaatatacacaca

SEQ ID NO: 497684 - DNA, 13 bp, Homo sapiens
actgaagagacac

SEQ ID NO: 497685 - DNA, 18 bp, Homo sapiens
actgaagccagaaataaa

SEQ ID NO: 497686 - DNA, 12 bp, Homo sapiens
actgaatttcta

SEQ ID NO: 497687 - DNA, 19 bp, Homo sapiens
actgaatttctatggcata

SEQ ID NO: 497688 - DNA, 17 bp, Homo sapiens
actgactcttaagaaga

SEQ ID NO: 497689 - DNA, 21 bp, Homo sapiens
actgagcaagaccctgtctct

SEQ ID NO: 497690 - DNA, 15 bp, Homo sapiens
actgagctgggggaa

SEQ ID NO: 497691 - DNA, 13 bp, Homo sapiens
actgaggcagaca

SEQ ID NO: 497692 - DNA, 15 bp, Homo sapiens
actgaggcagacagc

SEQ ID NO: 497693 - DNA, 16 bp, Homo sapiens
actgcacagcgtcctg

SEQ ID NO: 497694 - DNA, 18 bp, Homo sapiens
actgcacagcgtcctgtc

SEQ ID NO: 497695 - DNA, 15 bp, Homo sapiens
actgctccagcctct

SEQ ID NO: 497696 - DNA, 20 bp, Homo sapiens
actgctccagcctctgccgc

SEQ ID NO: 497697 - DNA, 18 bp, Homo sapiens
actggaaggtggggacag

SEQ ID NO: 497698 - DNA, 14 bp, Homo sapiens
actgggttcaaaaa

SEQ ID NO: 497699 - DNA, 18 bp, Homo sapiens
actgggttcaaaaagaaa

SEQ ID NO: 497700 - DNA, 18 bp, Homo sapiens
actggtattcctgcctcc

SEQ ID NO: 497701 - DNA, 14 bp, Homo sapiens
actggtgtccagct

SEQ ID NO: 497702 - DNA, 19 bp, Homo sapiens
actgtaagaaaatatcact

SEQ ID NO: 497703 - DNA, 13 bp, Homo sapiens
actgtgatttatt

SEQ ID NO: 497704 - DNA, 23 bp, Homo sapiens
actgtgatttatttggagtggag

SEQ ID NO: 497705 - DNA, 18 bp, Homo sapiens
agagctgccctctcctgg

SEQ ID NO: 497706 - DNA, 20 bp, Homo sapiens
agagctgccctctcctgggc

SEQ ID NO: 497707 - DNA, 15 bp, Homo sapiens
agagctggagcctgg

SEQ ID NO: 497708 - DNA, 21 bp, Homo sapiens
agagcttaatgataatattgt

SEQ ID NO: 497709 - DNA, 16 bp, Homo sapiens
agaggaaaatgaataa

SEQ ID NO: 497710 - DNA, 20 bp, Homo sapiens
agaggaaaatgaataataca

SEQ ID NO: 497711 - DNA, 20 bp, Homo sapiens
agaggaaatattgctggggt

SEQ ID NO: 497712 - DNA, 20 bp, Homo sapiens
agaggagtacaggtgaagca

SEQ ID NO: 497713 - DNA, 16 bp, Homo sapiens
agaggagtgactgagc

SEQ ID NO: 497714 - DNA, 15 bp, Homo sapiens
agaggcatgacagct

SEQ ID NO: 497715 - DNA, 23 bp, Homo sapiens
agagtaagcacctttagaatatt

SEQ ID NO: 497716 - DNA, 21 bp, Homo sapiens
agagtatggagctcagagagg

SEQ ID NO: 497717 - DNA, 21 bp, Homo sapiens
agagtcacacgggggcagctg

SEQ ID NO: 497718 - DNA, 19 bp, Homo sapiens
agagttccccatgcagaca

SEQ ID NO: 497719 - DNA, 16 bp, Homo sapiens
agagttgctcctcagg

SEQ ID NO: 497720 - DNA, 15 bp, Homo sapiens
agatagttactatat

SEQ ID NO: 497721 - DNA, 18 bp, Homo sapiens
agatccccaactgctcca

SEQ ID NO: 497722 - DNA, 16 bp, Homo sapiens
agatcctaaaacaaaa

SEQ ID NO: 497723 - DNA, 22 bp, Homo sapiens
agatcctaaaacaaaagctcat

SEQ ID NO: 497724 - DNA, 20 bp, Homo sapiens
agatcctcttctcaaagctg

SEQ ID NO: 497725 - DNA, 18 bp, Homo sapiens
agatctctgctttggaaa

SEQ ID NO: 497726 - DNA, 18 bp, Homo sapiens
agatgaagcaaacacatt

SEQ ID NO: 497727 - DNA, 18 bp, Homo sapiens
agatgactgaatttctat

SEQ ID NO: 497728 - DNA, 24 bp, Homo sapiens
agatgactgaatttctatggcata

SEQ ID NO: 497729 - DNA, 14 bp, Homo sapiens
agatgcagcaaaat

SEQ ID NO: 497730 - DNA, 21 bp, Homo sapiens
agatgcagcaaaatgtgaatg

SEQ ID NO: 497731 - DNA, 20 bp, Homo sapiens
agatgcagttctgaagaaga

SEQ ID NO: 497732 - DNA, 20 bp, Homo sapiens
agatggcggtgatcagcaga

SEQ ID NO: 497733 - DNA, 21 bp, Homo sapiens
agatggcggtgatcagcagag

SEQ ID NO: 497734 - DNA, 20 bp, Homo sapiens
agatggggagggtgccctcc

SEQ ID NO: 497735 - DNA, 22 bp, Homo sapiens
agatgtatgtacttcatgctgt

SEQ ID NO: 497736 - DNA, 13 bp, Homo sapiens
agattcacactgt

SEQ ID NO: 497737 - DNA, 16 bp, Homo sapiens
agatttaccacttgtg

SEQ ID NO: 497738 - DNA, 21 bp, Homo sapiens
agcaaaaactagtaaagacat

SEQ ID NO: 497739 - DNA, 14 bp, Homo sapiens
agcaaaatgtgaat

SEQ ID NO: 497740 - DNA, 24 bp, Homo sapiens
agcaaaattttttctctaggaaat

SEQ ID NO: 497741 - DNA, 19 bp, Homo sapiens
agcaaaggctgagaacact

SEQ ID NO: 497742 - DNA, 14 bp, Homo sapiens
agcaaattccaata

SEQ ID NO: 497743 - DNA, 11 bp, Homo sapiens
agcaagctccc

SEQ ID NO: 497744 - DNA, 15 bp, Homo sapiens
agcaagctcccaagg

SEQ ID NO: 497745 - DNA, 22 bp, Homo sapiens
agcaagtgtgctggcctctctg

SEQ ID NO: 497746 - DNA, 20 bp, Homo sapiens
agcaattccatgctataaaa

SEQ ID NO: 497747 - DNA, 23 bp, Homo sapiens
agcaattccatgctataaaaact

SEQ ID NO: 497748 - DNA, 19 bp, Homo sapiens
agcacactgtagcattaca

SEQ ID NO: 497749 - DNA, 19 bp, Homo sapiens
agcacaggtgggcttccca

SEQ ID NO: 497750 - DNA, 21 bp, Homo sapiens
agcacaggtgggcttcccagt

SEQ ID NO: 497751 - DNA, 13 bp, Homo sapiens
agcacctttagaa

SEQ ID NO: 497752 - DNA, 13 bp, Homo sapiens
agcactaaagcag

SEQ ID NO: 497753 - DNA, 20 bp, Homo sapiens
agcactgtttggatatgaga

SEQ ID NO: 497754 - DNA, 17 bp, Homo sapiens
agcacttcacacagaca

SEQ ID NO: 497755 - DNA, 22 bp, Homo sapiens
agcactttgggaggccgaggtg

SEQ ID NO: 497756 - DNA, 19 bp, Homo sapiens
agcagaatctttgcaagaa

SEQ ID NO: 497757 - DNA, 21 bp, Homo sapiens
agcagaatctttgcaagaaag

SEQ ID NO: 497758 - DNA, 16 bp, Homo sapiens
agcagatggggagggt

SEQ ID NO: 497759 - DNA, 20 bp, Homo sapiens
agcagccaagggatgaaaga

SEQ ID NO: 497760 - DNA, 14 bp, Homo sapiens
agcagccagctctc

SEQ ID NO: 497761 - DNA, 16 bp, Homo sapiens
agcagccagctctcag

SEQ ID NO: 497762 - DNA, 17 bp, Homo sapiens
agcagccagctctcagc

SEQ ID NO: 497763 - DNA, 23 bp, Homo sapiens
agcagccagctctcagccaacga

SEQ ID NO: 497764 - DNA, 14 bp, Homo sapiens
agcagctcaggcac

SEQ ID NO: 497765 - DNA, 16 bp, Homo sapiens
agcagcttcagttgtt

SEQ ID NO: 497766 - DNA, 19 bp, Homo sapiens
agcaggaggggggctgggt

SEQ ID NO: 497767 - DNA, 16 bp, Homo sapiens
agcaggctacactgac

SEQ ID NO: 497768 - DNA, 16 bp, Homo sapiens
agcagggtctgggcag

SEQ ID NO: 497769 - DNA, 17 bp, Homo sapiens
agcagtcaggaaagaga

SEQ ID NO: 497770 - DNA, 13 bp, Homo sapiens
agcagtgcaggca

SEQ ID NO: 497771 - DNA, 15 bp, Homo sapiens
agcagtgcaggcaca

SEQ ID NO: 497772 - DNA, 20 bp, Homo sapiens
agcagttcagagctgccctc

SEQ ID NO: 497773 - DNA, 23 bp, Homo sapiens
agcagttcagagctgccctctcc

SEQ ID NO: 497774 - DNA, 18 bp, Homo sapiens
agcagtttctgtcctgct

SEQ ID NO: 497775 - DNA, 20 bp, Homo sapiens
agcagtttctgtcctgctgg

SEQ ID NO: 497776 - DNA, 21 bp, Homo sapiens
agcatcattatttgcagagac

SEQ ID NO: 497777 - DNA, 22 bp, Homo sapiens
agcatcccaggatcgcaagagc

SEQ ID NO: 497778 - DNA, 21 bp, Homo sapiens
agcatcccttgaccaggcctg

SEQ ID NO: 497779 - DNA, 23 bp, Homo sapiens
agcatcccttgaccaggcctggg

SEQ ID NO: 497780 - DNA, 16 bp, Homo sapiens
agcatggctgtgagga

SEQ ID NO: 497781 - DNA, 17 bp, Homo sapiens
agcatggctgtgaggat

SEQ ID NO: 497782 - DNA, 19 bp, Homo sapiens
agccaagatcacgccactg

SEQ ID NO: 497783 - DNA, 18 bp, Homo sapiens
agccaagggttcagagac

SEQ ID NO: 497784 - DNA, 18 bp, Homo sapiens
agccaataacacacagct

SEQ ID NO: 497785 - DNA, 11 bp, Homo sapiens
agccagcagcc

SEQ ID NO: 497786 - DNA, 20 bp, Homo sapiens
agccagcagttcagagctgc

SEQ ID NO: 497787 - DNA, 21 bp, Homo sapiens
agccagcagttcagagctgcc

SEQ ID NO: 497788 - DNA, 13 bp, Homo sapiens
agccagctctcag

SEQ ID NO: 497789 - DNA, 21 bp, Homo sapiens
agccagggctgctagacggag

SEQ ID NO: 497790 - DNA, 23 bp, Homo sapiens
agccatgggcacaaagggcccag

SEQ ID NO: 497791 - DNA, 24 bp, Homo sapiens
agcccaggaatttgaagctgcagt

SEQ ID NO: 497792 - DNA, 19 bp, Homo sapiens
agcccatggccctcccagt

SEQ ID NO: 497793 - DNA, 17 bp, Homo sapiens
agcccattcattccatt

SEQ ID NO: 497794 - DNA, 14 bp, Homo sapiens
agccctcctggaat

SEQ ID NO: 497795 - DNA, 21 bp, Homo sapiens
agccctcctggaatggagctg

SEQ ID NO: 497796 - DNA, 18 bp, Homo sapiens
agcccttctttccacaga

SEQ ID NO: 497797 - DNA, 14 bp, Homo sapiens
agccgctcctgtct

SEQ ID NO: 497798 - DNA, 17 bp, Homo sapiens
agccgctcctgtctgcc

SEQ ID NO: 497799 - DNA, 19 bp, Homo sapiens
agccgctcctgtctgccag

SEQ ID NO: 497800 - DNA, 22 bp, Homo sapiens
agccgctcctgtctgccagcca

SEQ ID NO: 497801 - DNA, 18 bp, Homo sapiens
agcctagccgacctcagc

SEQ ID NO: 497802 - DNA, 18 bp, Homo sapiens
agcctcatccgaggcagg

SEQ ID NO: 497803 - DNA, 13 bp, Homo sapiens
agcctctgccgct

SEQ ID NO: 497804 - DNA, 18 bp, Homo sapiens
agcctctgccgctgccat

SEQ ID NO: 497805 - DNA, 16 bp, Homo sapiens
agcctgggcaacagag

SEQ ID NO: 497806 - DNA, 11 bp, Homo sapiens
agcctggtgcc

SEQ ID NO: 497807 - DNA, 16 bp, Homo sapiens
agcctggtgggcctcc

SEQ ID NO: 497808 - DNA, 18 bp, Homo sapiens
agcctggtgggcctcctc

SEQ ID NO: 497809 - DNA, 20 bp, Homo sapiens
agccttccccttgcccaggg

SEQ ID NO: 497810 - DNA, 11 bp, Homo sapiens
agccttgctct

SEQ ID NO: 497811 - DNA, 13 bp, Homo sapiens
agccttgctctct

SEQ ID NO: 497812 - DNA, 16 bp, Homo sapiens
agctaacacacagctc

SEQ ID NO: 497813 - DNA, 18 bp, Homo sapiens
agctaacacacagctccc

SEQ ID NO: 497814 - DNA, 18 bp, Homo sapiens
agctagaacctggagagc

SEQ ID NO: 497815 - DNA, 19 bp, Homo sapiens
agctagaactttgaaggac

SEQ ID NO: 497816 - DNA, 17 bp, Homo sapiens
agctattgatataaata

SEQ ID NO: 497817 - DNA, 16 bp, Homo sapiens
agctcagagagggcag

SEQ ID NO: 497818 - DNA, 13 bp, Homo sapiens
agctccagttcga

SEQ ID NO: 497819 - DNA, 13 bp, Homo sapiens
agctccccagagt

SEQ ID NO: 497820 - DNA, 15 bp, Homo sapiens
agctcctcatccagg

SEQ ID NO: 497821 - DNA, 15 bp, Homo sapiens
agctcggtggaccca

SEQ ID NO: 497822 - DNA, 19 bp, Homo sapiens
agctcggtggacccaggga

SEQ ID NO: 497823 - DNA, 23 bp, Homo sapiens
agctctttgagataatacattcc

SEQ ID NO: 497824 - DNA, 20 bp, Homo sapiens
agctgaagatccccaactgc

SEQ ID NO: 497825 - DNA, 20 bp, Homo sapiens
agctgacacaaacctgcctg

SEQ ID NO: 497826 - DNA, 21 bp, Homo sapiens
agctgatacaaattgcagact

SEQ ID NO: 497827 - DNA, 16 bp, Homo sapiens
agctgccccagccaga

SEQ ID NO: 497828 - DNA, 20 bp, Homo sapiens
agctgccccggggaggggcg

SEQ ID NO: 497829 - DNA, 15 bp, Homo sapiens
agctgccctctcctg

SEQ ID NO: 497830 - DNA, 16 bp, Homo sapiens
agctgccctctcctgg

SEQ ID NO: 497831 - DNA, 19 bp, Homo sapiens
agctgccctctcctgggca

SEQ ID NO: 497832 - DNA, 15 bp, Homo sapiens
agctgcctcccctcc

SEQ ID NO: 497833 - DNA, 16 bp, Homo sapiens
agctgcctcccctcct

SEQ ID NO: 497834 - DNA, 17 bp, Homo sapiens
agctgcctcccctcctc

SEQ ID NO: 497835 - DNA, 18 bp, Homo sapiens
agctgcctcccctcctct

SEQ ID NO: 497836 - DNA, 14 bp, Homo sapiens
agctgctggagact

SEQ ID NO: 497837 - DNA, 15 bp, Homo sapiens
agctggagcctggtg

SEQ ID NO: 497838 - DNA, 14 bp, Homo sapiens
agctgtatgattcc

SEQ ID NO: 497839 - DNA, 18 bp, Homo sapiens
agctgtatgattcccagc

SEQ ID NO: 497840 - DNA, 17 bp, Homo sapiens
agctgtgaacatggact

SEQ ID NO: 497841 - DNA, 17 bp, Homo sapiens
agctgttctcattcctg

SEQ ID NO: 497842 - DNA, 21 bp, Homo sapiens
agctgttctcattcctgttct

SEQ ID NO: 497843 - DNA, 19 bp, Homo sapiens
agcttagacctcagcctgt

SEQ ID NO: 497844 - DNA, 20 bp, Homo sapiens
agcttagacctcagcctgtg

SEQ ID NO: 497845 - DNA, 13 bp, Homo sapiens
agtgtgcacagat

SEQ ID NO: 497846 - DNA, 16 bp, Homo sapiens
agttaactattttatt

SEQ ID NO: 497847 - DNA, 21 bp, Homo sapiens
agttcagagctgccctctcct

SEQ ID NO: 497848 - DNA, 22 bp, Homo sapiens
agttcagagctgccctctcctg

SEQ ID NO: 497849 - DNA, 21 bp, Homo sapiens
agttcaggctctgagacacac

SEQ ID NO: 497850 - DNA, 20 bp, Homo sapiens
agttcagttcctctttgcat

SEQ ID NO: 497851 - DNA, 24 bp, Homo sapiens
agttcagttcctctttgcatggaa

SEQ ID NO: 497852 - DNA, 17 bp, Homo sapiens
agttccccatgcagaca

SEQ ID NO: 497853 - DNA, 15 bp, Homo sapiens
agttcctctttgcat

SEQ ID NO: 497854 - DNA, 16 bp, Homo sapiens
agttcctctttgcatg

SEQ ID NO: 497855 - DNA, 15 bp, Homo sapiens
agttctagttgcttg

SEQ ID NO: 497856 - DNA, 14 bp, Homo sapiens
agttctatttctat

SEQ ID NO: 497857 - DNA, 17 bp, Homo sapiens
agttgatatagaacagt

SEQ ID NO: 497858 - DNA, 20 bp, Homo sapiens
agttgcatggcatcacctcc

SEQ ID NO: 497859 - DNA, 13 bp, Homo sapiens
agttggcttctaa

SEQ ID NO: 497860 - DNA, 13 bp, Homo sapiens
agttggtgacaga

SEQ ID NO: 497861 - DNA, 16 bp, Homo sapiens
agttgtttcattgact

SEQ ID NO: 497862 - DNA, 15 bp, Homo sapiens
agtttagctggaaaa

SEQ ID NO: 497863 - DNA, 16 bp, Homo sapiens
agtttagctggaaaag

SEQ ID NO: 497864 - DNA, 17 bp, Homo sapiens
agtttccttggctggtg

SEQ ID NO: 497865 - DNA, 14 bp, Homo sapiens
agttttcttctgtg

SEQ ID NO: 497866 - DNA, 12 bp, Homo sapiens
ataaaagacaca

SEQ ID NO: 497867 - DNA, 22 bp, Homo sapiens
ataaaataatttttatatttga

SEQ ID NO: 497868 - DNA, 15 bp, Homo sapiens
ataaaatgcatttaa

SEQ ID NO: 497869 - DNA, 11 bp, Homo sapiens
ataaaattgta

SEQ ID NO: 497870 - DNA, 23 bp, Homo sapiens
ataaaattgtaaaattgtataga

SEQ ID NO: 497871 - DNA, 16 bp, Homo sapiens
ataaaccacaagcatc

SEQ ID NO: 497872 - DNA, 15 bp, Homo sapiens
ataaacttagaataa

SEQ ID NO: 497873 - DNA, 21 bp, Homo sapiens
ataaacttagaataaaattgt

SEQ ID NO: 497874 - DNA, 21 bp, Homo sapiens
ataaagagagaaaaacaaatt

SEQ ID NO: 497875 - DNA, 20 bp, Homo sapiens
ataaagattatataaagacc

SEQ ID NO: 497876 - DNA, 13 bp, Homo sapiens
ataaagcaatgaa

SEQ ID NO: 497877 - DNA, 14 bp, Homo sapiens
ataaagcaatgaat

SEQ ID NO: 497878 - DNA, 18 bp, Homo sapiens
ataaagcactgtttggat

SEQ ID NO: 497879 - DNA, 14 bp, Homo sapiens
ataaagctgttctc

SEQ ID NO: 497880 - DNA, 18 bp, Homo sapiens
ataaagttggtgacagat

SEQ ID NO: 497881 - DNA, 13 bp, Homo sapiens
ataaataaaacat

SEQ ID NO: 497882 - DNA, 15 bp, Homo sapiens
ataacaatgctgtat

SEQ ID NO: 497883 - DNA, 17 bp, Homo sapiens
ataacaatgctgtattt

SEQ ID NO: 497884 - DNA, 20 bp, Homo sapiens
ataacaatgctgtattttaa

SEQ ID NO: 497885 - DNA, 15 bp, Homo sapiens
ataactatgttgata

SEQ ID NO: 497886 - DNA, 16 bp, Homo sapiens
ataagtactgtgtaca

SEQ ID NO: 497887 - DNA, 13 bp, Homo sapiens
ataataaaattca

SEQ ID NO: 497888 - DNA, 14 bp, Homo sapiens
ataataaaattcat

SEQ ID NO: 497889 - DNA, 15 bp, Homo sapiens
ataataaaattcatt

SEQ ID NO: 497890 - DNA, 18 bp, Homo sapiens
ataatgtttcaaacatat

SEQ ID NO: 497891 - DNA, 13 bp, Homo sapiens
ataattttgtgaa

SEQ ID NO: 497892 - DNA, 22 bp, Homo sapiens
ataatttttatatttgaaatat

SEQ ID NO: 497893 - DNA, 19 bp, Homo sapiens
atacaaaaattagccgggc

SEQ ID NO: 497894 - DNA, 12 bp, Homo sapiens
atacagacacat

SEQ ID NO: 497895 - DNA, 22 bp, Homo sapiens
atacagtttgtcacatgaaaca

SEQ ID NO: 497896 - DNA, 19 bp, Homo sapiens
atacattgaattagaaaca

SEQ ID NO: 497897 - DNA, 18 bp, Homo sapiens
atacctgggcatactaat

SEQ ID NO: 497898 - DNA, 14 bp, Homo sapiens
atacctgtcaatac

SEQ ID NO: 497899 - DNA, 13 bp, Homo sapiens
atactatagattc

SEQ ID NO: 497900 - DNA, 17 bp, Homo sapiens
atactatagattcttta

SEQ ID NO: 497901 - DNA, 18 bp, Homo sapiens
atactatagattctttat

SEQ ID NO: 497902 - DNA, 18 bp, Homo sapiens
ataggcaggaacatacag

SEQ ID NO: 497903 - DNA, 19 bp, Homo sapiens
ataggcaggaacatacaga

SEQ ID NO: 497904 - DNA, 23 bp, Homo sapiens
ataggcaggaacatacagacaca

SEQ ID NO: 497905 - DNA, 13 bp, Homo sapiens
atagtaaaaataa

SEQ ID NO: 497906 - DNA, 16 bp, Homo sapiens
atagtaacctgggtaa

SEQ ID NO: 497907 - DNA, 14 bp, Homo sapiens
atagtaattctcag

SEQ ID NO: 497908 - DNA, 13 bp, Homo sapiens
atagtgtgaggga

SEQ ID NO: 497909 - DNA, 18 bp, Homo sapiens
atataactattgcccagg

SEQ ID NO: 497910 - DNA, 13 bp, Homo sapiens
atatacacacagc

SEQ ID NO: 497911 - DNA, 15 bp, Homo sapiens
atatagaacagtgct

SEQ ID NO: 497912 - DNA, 14 bp, Homo sapiens
atatataacaatgc

SEQ ID NO: 497913 - DNA, 14 bp, Homo sapiens
atatatacatatat

SEQ ID NO: 497914 - DNA, 14 bp, Homo sapiens
atatcaagagacat

SEQ ID NO: 497915 - DNA, 18 bp, Homo sapiens
atatcacttgtcaataaa

SEQ ID NO: 497916 - DNA, 14 bp, Homo sapiens
atatgatgtttaaa

SEQ ID NO: 497917 - DNA, 15 bp, Homo sapiens
atatggcctcaagat

SEQ ID NO: 497918 - DNA, 16 bp, Homo sapiens
atatggcctcaagatc

SEQ ID NO: 497919 - DNA, 22 bp, Homo sapiens
atattaaaaattaattctttat

SEQ ID NO: 497920 - DNA, 18 bp, Homo sapiens
atattaaaatcacaaact

SEQ ID NO: 497921 - DNA, 23 bp, Homo sapiens
atattaaatatgttagcaaagag

SEQ ID NO: 497922 - DNA, 16 bp, Homo sapiens
atattcaaaaattata

SEQ ID NO: 497923 - DNA, 19 bp, Homo sapiens
atattgataataaaattca

SEQ ID NO: 497924 - DNA, 20 bp, Homo sapiens
atattgataataaaattcat

SEQ ID NO: 497925 - DNA, 20 bp, Homo sapiens
atattgttattatataatta

SEQ ID NO: 497926 - DNA, 17 bp, Homo sapiens
atatttattttaataat

SEQ ID NO: 497927 - DNA, 14 bp, Homo sapiens
atatttgaaatatt

SEQ ID NO: 497928 - DNA, 19 bp, Homo sapiens
atatttgaaatattgactt

SEQ ID NO: 497929 - DNA, 23 bp, Homo sapiens
atattttcatgacttttccatgt

SEQ ID NO: 497930 - DNA, 16 bp, Homo sapiens
atattttccatgaaaa

SEQ ID NO: 497931 - DNA, 18 bp, Homo sapiens
atattttccatgaaaatg

SEQ ID NO: 497932 - DNA, 17 bp, Homo sapiens
atcaaactgaagccaga

SEQ ID NO: 497933 - DNA, 13 bp, Homo sapiens
atcaaggcactgc

SEQ ID NO: 497934 - DNA, 21 bp, Homo sapiens
atcaagggtacactgccttct

SEQ ID NO: 497935 - DNA, 13 bp, Homo sapiens
atcaatactttga

SEQ ID NO: 497936 - DNA, 19 bp, Homo sapiens
atcaatcacaaaagtatat

SEQ ID NO: 497937 - DNA, 23 bp, Homo sapiens
atcaatcacaaaagtatattcaa

SEQ ID NO: 497938 - DNA, 21 bp, Homo sapiens
atcacaaaagtatattcaaaa

SEQ ID NO: 497939 - DNA, 17 bp, Homo sapiens
atcacgccactgcactc

SEQ ID NO: 497940 - DNA, 20 bp, Homo sapiens
atcacgccactgcactccag

SEQ ID NO: 497941 - DNA, 18 bp, Homo sapiens
atcacttctgagaactca

SEQ ID NO: 497942 - DNA, 21 bp, Homo sapiens
atcagcaagtctctttatatg

SEQ ID NO: 497943 - DNA, 13 bp, Homo sapiens
atcagcagagaga

SEQ ID NO: 497944 - DNA, 18 bp, Homo sapiens
atcagctccactttcagt

SEQ ID NO: 497945 - DNA, 18 bp, Homo sapiens
atcatcagtggagccatg

SEQ ID NO: 497946 - DNA, 17 bp, Homo sapiens
atcatgaattagtttta

SEQ ID NO: 497947 - DNA, 12 bp, Homo sapiens
atcattaaagtt

SEQ ID NO: 497948 - DNA, 15 bp, Homo sapiens
atcattaagacaact

SEQ ID NO: 497949 - DNA, 18 bp, Homo sapiens
atccacacaacaccagga

SEQ ID NO: 497950 - DNA, 19 bp, Homo sapiens
atccacacaacaccaggac

SEQ ID NO: 497951 - DNA, 16 bp, Homo sapiens
atccactcccaggcag

SEQ ID NO: 497952 - DNA, 15 bp, Homo sapiens
atccccaactgctcc

SEQ ID NO: 497953 - DNA, 18 bp, Homo sapiens
atccccaactgctccagc

SEQ ID NO: 497954 - DNA, 16 bp, Homo sapiens
atccctctctggattg

SEQ ID NO: 497955 - DNA, 22 bp, Homo sapiens
atcccttgaccaggcctgggcc

SEQ ID NO: 497956 - DNA, 13 bp, Homo sapiens
atccgcctgtggg

SEQ ID NO: 497957 - DNA, 23 bp, Homo sapiens
atcctaaaacaaaagctcatcca

SEQ ID NO: 497958 - DNA, 12 bp, Homo sapiens
atcctaatgaat

SEQ ID NO: 497959 - DNA, 13 bp, Homo sapiens
atcctaatgaatg

SEQ ID NO: 497960 - DNA, 19 bp, Homo sapiens
atcctaatgaatgcataaa

SEQ ID NO: 497961 - DNA, 21 bp, Homo sapiens
atcctagagatttggtgtaca

SEQ ID NO: 497962 - DNA, 23 bp, Homo sapiens
atcctagagatttggtgtacaat

SEQ ID NO: 497963 - DNA, 20 bp, Homo sapiens
atcctagtctctatcattaa

SEQ ID NO: 497964 - DNA, 19 bp, Homo sapiens
atcctcaaacactgcaggc

SEQ ID NO: 497965 - DNA, 19 bp, Homo sapiens
atcctcttctcaaagctgg

SEQ ID NO: 497966 - DNA, 20 bp, Homo sapiens
atcctcttctcaaagctggg

SEQ ID NO: 497967 - DNA, 12 bp, Homo sapiens
atcctggccaac

SEQ ID NO: 497968 - DNA, 16 bp, Homo sapiens
atcctgtgaagtaagg

SEQ ID NO: 497969 - DNA, 12 bp, Homo sapiens
atccttgaagat

SEQ ID NO: 497970 - DNA, 18 bp, Homo sapiens
atcgtctttaaccccaaa

SEQ ID NO: 497971 - DNA, 15 bp, Homo sapiens
atctaaatcaccaga

SEQ ID NO: 497972 - DNA, 21 bp, Homo sapiens
atctacctcactattcaagta

SEQ ID NO: 497973 - DNA, 15 bp, Homo sapiens
atctatcacctgtca

SEQ ID NO: 497974 - DNA, 16 bp, Homo sapiens
atctcaattcttccct

SEQ ID NO: 497975 - DNA, 13 bp, Homo sapiens
atctcacttgtgc

SEQ ID NO: 497976 - DNA, 18 bp, Homo sapiens
atctcacttgtgccaaca

SEQ ID NO: 497977 - DNA, 17 bp, Homo sapiens
atctcagtgctgtaaaa

SEQ ID NO: 497978 - DNA, 14 bp, Homo sapiens
atctcatttccaag

SEQ ID NO: 497979 - DNA, 23 bp, Homo sapiens
atctcatttccaagcaagtatta

SEQ ID NO: 497980 - DNA, 13 bp, Homo sapiens
atctgaaggagat

SEQ ID NO: 497981 - DNA, 18 bp, Homo sapiens
atctgatgcaagcaagaa

SEQ ID NO: 497982 - DNA, 22 bp, Homo sapiens
atctgggctcctaaccttcctg

SEQ ID NO: 497983 - DNA, 14 bp, Homo sapiens
tgaattaagttttt

SEQ ID NO: 497984 - DNA, 14 bp, Homo sapiens
tgaattacatttgt

SEQ ID NO: 497985 - DNA, 17 bp, Homo sapiens
tgacaactgaagagaca

SEQ ID NO: 497986 - DNA, 18 bp, Homo sapiens
tgacaactgaagagacac

SEQ ID NO: 497987 - DNA, 20 bp, Homo sapiens
tgacaagctcacagaccttt

SEQ ID NO: 497988 - DNA, 20 bp, Homo sapiens
taaaaaggaatccactccca

SEQ ID NO: 497989 - DNA, 15 bp, Homo sapiens
taaaaattaattctt

SEQ ID NO: 497990 - DNA, 16 bp, Homo sapiens
taaaacaaaagctcat

SEQ ID NO: 497991 - DNA, 15 bp, Homo sapiens
taaaacattttcaca

SEQ ID NO: 497992 - DNA, 20 bp, Homo sapiens
taaaagacaaatcaaagcag

SEQ ID NO: 497993 - DNA, 22 bp, Homo sapiens
taaaataatttttatatttgaa

SEQ ID NO: 497994 - DNA, 21 bp, Homo sapiens
taaaatcacaaactcatccat

SEQ ID NO: 497995 - DNA, 16 bp, Homo sapiens
taaaattaaagctgaa

SEQ ID NO: 497996 - DNA, 19 bp, Homo sapiens
taaaattcattccatttgc

SEQ ID NO: 497997 - DNA, 14 bp, Homo sapiens
taaaattgtaaaat

SEQ ID NO: 497998 - DNA, 16 bp, Homo sapiens
taaaattgtaaaattg

SEQ ID NO: 497999 - DNA, 14 bp, Homo sapiens
taaaattgtataga

SEQ ID NO: 498000 - DNA, 23 bp, Homo sapiens
taaaattgtatagagatatgcag

SEQ ID NO: 498001 - DNA, 17 bp, Homo sapiens
taaaccacaagcatctc

SEQ ID NO: 498002 - DNA, 14 bp, Homo sapiens
taaagacataggaa

SEQ ID NO: 498003 - DNA, 14 bp, Homo sapiens
taaagctgaaaact

SEQ ID NO: 498004 - DNA, 13 bp, Homo sapiens
taaataaaatgac

SEQ ID NO: 498005 - DNA, 15 bp, Homo sapiens
taaataaaatgacca

SEQ ID NO: 498006 - DNA, 13 bp, Homo sapiens
taaataaattgtt

SEQ ID NO: 498007 - DNA, 19 bp, Homo sapiens
taaatagtaaaaataaaat

SEQ ID NO: 498008 - DNA, 20 bp, Homo sapiens
taaatagtaaaaataaaatt

SEQ ID NO: 498009 - DNA, 18 bp, Homo sapiens
taaatatgttagcaaaga

SEQ ID NO: 498010 - DNA, 22 bp, Homo sapiens
taaatgggactggagtccctgt

SEQ ID NO: 498011 - DNA, 16 bp, Homo sapiens
taaatgtaagaatcat

SEQ ID NO: 498012 - DNA, 16 bp, Homo sapiens
taaatgtcttttcaaa

SEQ ID NO: 498013 - DNA, 19 bp, Homo sapiens
taaatgtcttttcaaaagg

SEQ ID NO: 498014 - DNA, 21 bp, Homo sapiens
taacaaaccctcgtttctgat

SEQ ID NO: 498015 - DNA, 23 bp, Homo sapiens
taacaaaccctcgtttctgatta

SEQ ID NO: 498016 - DNA, 16 bp, Homo sapiens
taacaactatgatttg

SEQ ID NO: 498017 - DNA, 15 bp, Homo sapiens
taacaatgctgtatt

SEQ ID NO: 498018 - DNA, 12 bp, Homo sapiens
taacacacagct

SEQ ID NO: 498019 - DNA, 15 bp, Homo sapiens
taacagtaacgcagg

SEQ ID NO: 498020 - DNA, 22 bp, Homo sapiens
taactcaatattttccatgaaa

SEQ ID NO: 498021 - DNA, 15 bp, Homo sapiens
taactggaaacttca

SEQ ID NO: 498022 - DNA, 22 bp, Homo sapiens
taactggcttctgcttgtcatc

SEQ ID NO: 498023 - DNA, 16 bp, Homo sapiens
taagaaaaacatgtca

SEQ ID NO: 498024 - DNA, 18 bp, Homo sapiens
taagaaaaacatgtcatg

SEQ ID NO: 498025 - DNA, 21 bp, Homo sapiens
taagaaaatatcacttgtcaa

SEQ ID NO: 498026 - DNA, 14 bp, Homo sapiens
taagacaaatggga

SEQ ID NO: 498027 - DNA, 17 bp, Homo sapiens
taagacaaatgggactg

SEQ ID NO: 498028 - DNA, 20 bp, Homo sapiens
taagacaaatgggactgatg

SEQ ID NO: 498029 - DNA, 22 bp, Homo sapiens
taagacaaatgggactgatgtc

SEQ ID NO: 498030 - DNA, 17 bp, Homo sapiens
taagaccaccacctcag

SEQ ID NO: 498031 - DNA, 14 bp, Homo sapiens
taagaccagcctgg

SEQ ID NO: 498032 - DNA, 14 bp, Homo sapiens
taagacgacaagga

SEQ ID NO: 498033 - DNA, 13 bp, Homo sapiens
taagagacagtca

SEQ ID NO: 498034 - DNA, 21 bp, Homo sapiens
taagagacagtcaccccagga

SEQ ID NO: 498035 - DNA, 14 bp, Homo sapiens
taagagagaatgag

SEQ ID NO: 498036 - DNA, 15 bp, Homo sapiens
taagaggatgaagtg

SEQ ID NO: 498037 - DNA, 17 bp, Homo sapiens
taagagggcacacactg

SEQ ID NO: 498038 - DNA, 20 bp, Homo sapiens
taagagggcacacactgtgt

SEQ ID NO: 498039 - DNA, 17 bp, Homo sapiens
taagatgttcactgtgg

SEQ ID NO: 498040 - DNA, 20 bp, Homo sapiens
taagcattccaactatctca

SEQ ID NO: 498041 - DNA, 13 bp, Homo sapiens
taagctgtaaaaa

SEQ ID NO: 498042 - DNA, 16 bp, Homo sapiens
taagcttgtattcctt

SEQ ID NO: 498043 - DNA, 20 bp, Homo sapiens
taaggcgtggagctgcctga

SEQ ID NO: 498044 - DNA, 13 bp, Homo sapiens
taagggcagagtc

SEQ ID NO: 498045 - DNA, 14 bp, Homo sapiens
taagggcagagtca

SEQ ID NO: 498046 - DNA, 20 bp, Homo sapiens
taagtaatgataactggaaa

SEQ ID NO: 498047 - DNA, 14 bp, Homo sapiens
taagtactgtgtac

SEQ ID NO: 498048 - DNA, 22 bp, Homo sapiens
taagtgcacaacattacaggga

SEQ ID NO: 498049 - DNA, 22 bp, Homo sapiens
taagtgtccattatttaccttg

SEQ ID NO: 498050 - DNA, 18 bp, Homo sapiens
taagtttatgtctaaaga

SEQ ID NO: 498051 - DNA, 18 bp, Homo sapiens
taataaaaataaaagaga

SEQ ID NO: 498052 - DNA, 16 bp, Homo sapiens
taataaaatacatact

SEQ ID NO: 498053 - DNA, 14 bp, Homo sapiens
taataaaattcatt

SEQ ID NO: 498054 - DNA, 14 bp, Homo sapiens
taataatgtttcaa

SEQ ID NO: 498055 - DNA, 14 bp, Homo sapiens
taatataaagttgg

SEQ ID NO: 498056 - DNA, 14 bp, Homo sapiens
taatatattgctgc

SEQ ID NO: 498057 - DNA, 14 bp, Homo sapiens
taatatttttaatt

SEQ ID NO: 498058 - DNA, 14 bp, Homo sapiens
taatcaatactttg

SEQ ID NO: 498059 - DNA, 19 bp, Homo sapiens
taatccaatacctcttgga

SEQ ID NO: 498060 - DNA, 17 bp, Homo sapiens
taatgataactggaaac

SEQ ID NO: 498061 - DNA, 23 bp, Homo sapiens
taatgataactggaaacttcagc

SEQ ID NO: 498062 - DNA, 14 bp, Homo sapiens
taatgtttcaaaca

SEQ ID NO: 498063 - DNA, 22 bp, Homo sapiens
taatgtttcaaacatatataac

SEQ ID NO: 498064 - DNA, 15 bp, Homo sapiens
taattcagctcttga

SEQ ID NO: 498065 - DNA, 20 bp, Homo sapiens
taattgttaagatatgatgt

SEQ ID NO: 498066 - DNA, 22 bp, Homo sapiens
taatttgatagtattgtgcata

SEQ ID NO: 498067 - DNA, 17 bp, Homo sapiens
taatttttatatttgaa

SEQ ID NO: 498068 - DNA, 17 bp, Homo sapiens
tacaaacatgtggttaa

SEQ ID NO: 498069 - DNA, 17 bp, Homo sapiens
tacaaggaaggtggtgg

SEQ ID NO: 498070 - DNA, 16 bp, Homo sapiens
tacacaagagctggag

SEQ ID NO: 498071 - DNA, 17 bp, Homo sapiens
tacacagactattgaca

SEQ ID NO: 498072 - DNA, 22 bp, Homo sapiens
tacacagactattgacatcagc

SEQ ID NO: 498073 - DNA, 18 bp, Homo sapiens
tacactaagagagaatga

SEQ ID NO: 498074 - DNA, 19 bp, Homo sapiens
tacactaagagagaatgag

SEQ ID NO: 498075 - DNA, 19 bp, Homo sapiens
tacagatcctctggggttt

SEQ ID NO: 498076 - DNA, 13 bp, Homo sapiens
tacagtaaataaa

SEQ ID NO: 498077 - DNA, 21 bp, Homo sapiens
tacagtaaataaattgtttga

SEQ ID NO: 498078 - DNA, 16 bp, Homo sapiens
tacatactatagattc

SEQ ID NO: 498079 - DNA, 19 bp, Homo sapiens
tacatactatagattcttt

SEQ ID NO: 498080 - DNA, 19 bp, Homo sapiens
tacatatttgcatatgtat

SEQ ID NO: 498081 - DNA, 21 bp, Homo sapiens
tacattagtcattcaataaat

SEQ ID NO: 498082 - DNA, 15 bp, Homo sapiens
tacattattggactt

SEQ ID NO: 498083 - DNA, 20 bp, Homo sapiens
taccacacatctgtggagat

SEQ ID NO: 498084 - DNA, 22 bp, Homo sapiens
taccatcaaatgttaacagagt

SEQ ID NO: 498085 - DNA, 20 bp, Homo sapiens
tacccccacagacctgctct

SEQ ID NO: 498086 - DNA, 14 bp, Homo sapiens
tacctcctgtctct

SEQ ID NO: 498087 - DNA, 15 bp, Homo sapiens
tacctgcctaaaata

SEQ ID NO: 498088 - DNA, 14 bp, Homo sapiens
tacctgggaagggg

SEQ ID NO: 498089 - DNA, 16 bp, Homo sapiens
tacgtacatgtgaggc

SEQ ID NO: 498090 - DNA, 14 bp, Homo sapiens
tacgttaccaggca

SEQ ID NO: 498091 - DNA, 15 bp, Homo sapiens
tactaataaaataca

SEQ ID NO: 498092 - DNA, 17 bp, Homo sapiens
tactaataaaatacata

SEQ ID NO: 498093 - DNA, 14 bp, Homo sapiens
tactagctctttga

SEQ ID NO: 498094 - DNA, 17 bp, Homo sapiens
tactatagattctttat

SEQ ID NO: 498095 - DNA, 22 bp, Homo sapiens
tactcaatgttactatctgctt

SEQ ID NO: 498096 - DNA, 15 bp, Homo sapiens
ttccagccagggctg

SEQ ID NO: 498097 - DNA, 15 bp, Homo sapiens
ttccagtgcaacact

SEQ ID NO: 498098 - DNA, 19 bp, Homo sapiens
ttccagtgcaacactgaag

SEQ ID NO: 498099 - DNA, 12 bp, Homo sapiens
ttccatattaaa

SEQ ID NO: 498100 - DNA, 15 bp, Homo sapiens
ttccatgaaaatgca

SEQ ID NO: 498101 - DNA, 13 bp, Homo sapiens
ttccatgatgctg

SEQ ID NO: 498102 - DNA, 18 bp, Homo sapiens
ttccatgatgctgggatt

SEQ ID NO: 498103 - DNA, 15 bp, Homo sapiens
ttccattctggaagt

SEQ ID NO: 498104 - DNA, 13 bp, Homo sapiens
ttccatttgctga

SEQ ID NO: 498105 - DNA, 11 bp, Homo sapiens
ttcccaaaagc

SEQ ID NO: 498106 - DNA, 14 bp, Homo sapiens
ttcccagtggctgc

SEQ ID NO: 498107 - DNA, 21 bp, Homo sapiens
ttcccataccacccaatgctg

SEQ ID NO: 498108 - DNA, 14 bp, Homo sapiens
ttcccttcatctgg

SEQ ID NO: 498109 - DNA, 18 bp, Homo sapiens
ttcctacacccttggact

SEQ ID NO: 498110 - DNA, 15 bp, Homo sapiens
ttcctctttgcatgg

SEQ ID NO: 498111 - DNA, 17 bp, Homo sapiens
ttcctctttgcatggaa

SEQ ID NO: 498112 - DNA, 21 bp, Homo sapiens
ttccttagcttagacctcagc

SEQ ID NO: 498113 - DNA, 15 bp, Homo sapiens
ttccttgtatttaaa

SEQ ID NO: 498114 - DNA, 18 bp, Homo sapiens
ttccttgtatttaaatat

SEQ ID NO: 498115 - DNA, 20 bp, Homo sapiens
ttcgatgggcccaattctta

SEQ ID NO: 498116 - DNA, 21 bp, Homo sapiens
ttcgatgggcccaattcttac

SEQ ID NO: 498117 - DNA, 14 bp, Homo sapiens
ttctaaggaatatg

SEQ ID NO: 498118 - DNA, 15 bp, Homo sapiens
ttctacacagagcag

SEQ ID NO: 498119 - DNA, 18 bp, Homo sapiens
ttctaggtggcaaggctg

SEQ ID NO: 498120 - DNA, 23 bp, Homo sapiens
ttctatggcatattgataataaa

SEQ ID NO: 498121 - DNA, 18 bp, Homo sapiens
ttctcaagccgcatccca

SEQ ID NO: 498122 - DNA, 23 bp, Homo sapiens
ttctcaagccgcatcccagactt

SEQ ID NO: 498123 - DNA, 18 bp, Homo sapiens
ttctcactctgctttgca

SEQ ID NO: 498124 - DNA, 13 bp, Homo sapiens
ttctcagggtctc

SEQ ID NO: 498125 - DNA, 18 bp, Homo sapiens
ttctcagggtctctgctg

SEQ ID NO: 498126 - DNA, 20 bp, Homo sapiens
ttctcagggtctctgctgcc

SEQ ID NO: 498127 - DNA, 15 bp, Homo sapiens
ttctcatcacatttg

SEQ ID NO: 498128 - DNA, 16 bp, Homo sapiens
ttctcattcctgttct

SEQ ID NO: 498129 - DNA, 22 bp, Homo sapiens
ttctccagaaccagtgtctgaa

SEQ ID NO: 498130 - DNA, 20 bp, Homo sapiens
ttctccctcatttcaggagc

SEQ ID NO: 498131 - DNA, 23 bp, Homo sapiens
ttctctcctctccccatgatgtt

SEQ ID NO: 498132 - DNA, 19 bp, Homo sapiens
ttctgaaaattaacactgc

SEQ ID NO: 498133 - DNA, 13 bp, Homo sapiens
ttctgaagaagat

SEQ ID NO: 498134 - DNA, 22 bp, Homo sapiens
ttctgagcctctttaacagctt

SEQ ID NO: 498135 - DNA, 18 bp, Homo sapiens
ttctgatgatgtgcctgg

SEQ ID NO: 498136 - DNA, 15 bp, Homo sapiens
ttctgccttttttat

SEQ ID NO: 498137 - DNA, 15 bp, Homo sapiens
ttctgctacctcact

SEQ ID NO: 498138 - DNA, 16 bp, Homo sapiens
ttctgctacctcactg

SEQ ID NO: 498139 - DNA, 15 bp, Homo sapiens
ttctgcttgtcatcc

SEQ ID NO: 498140 - DNA, 20 bp, Homo sapiens
ttctggattttgtcaagcag

SEQ ID NO: 498141 - DNA, 16 bp, Homo sapiens
ttctgttttataattt

SEQ ID NO: 498142 - DNA, 20 bp, Homo sapiens
ttcttaggcaccatagaaga

SEQ ID NO: 498143 - DNA, 15 bp, Homo sapiens
ttcttagtagatttt

SEQ ID NO: 498144 - DNA, 15 bp, Homo sapiens
ttgaacaactcgaat

SEQ ID NO: 498145 - DNA, 21 bp, Homo sapiens
ttgaacaactcgaatcactca

SEQ ID NO: 498146 - DNA, 13 bp, Homo sapiens
ttgaacactgggg

SEQ ID NO: 498147 - DNA, 13 bp, Homo sapiens
ttgaagacactga

SEQ ID NO: 498148 - DNA, 21 bp, Homo sapiens
ttgaagaggaaaatgaataat

SEQ ID NO: 498149 - DNA, 22 bp, Homo sapiens
ttgaagaggaaaatgaataata

SEQ ID NO: 498150 - DNA, 18 bp, Homo sapiens
ttgaaggaaccaagtgca

SEQ ID NO: 498151 - DNA, 15 bp, Homo sapiens
ttgaatataaacact

SEQ ID NO: 498152 - DNA, 15 bp, Homo sapiens
ttgacagaacactgt

SEQ ID NO: 498153 - DNA, 17 bp, Homo sapiens
ttgacagaacactgtct

SEQ ID NO: 498154 - DNA, 11 bp, Homo sapiens
ttgaccaggcc

SEQ ID NO: 498155 - DNA, 21 bp, Homo sapiens
ttgaccccaatccaacccggg

SEQ ID NO: 498156 - DNA, 19 bp, Homo sapiens
ttgacttgacagaacactg

SEQ ID NO: 498157 - DNA, 21 bp, Homo sapiens
ttgacttgacagaacactgtc

SEQ ID NO: 498158 - DNA, 12 bp, Homo sapiens
ttgactttttat

SEQ ID NO: 498159 - DNA, 17 bp, Homo sapiens
ttgagaggcatgacagc

SEQ ID NO: 498160 - DNA, 16 bp, Homo sapiens
ttgagctcttcattta

SEQ ID NO: 498161 - DNA, 19 bp, Homo sapiens
ttgaggagcagcttcagtt

SEQ ID NO: 498162 - DNA, 16 bp, Homo sapiens
ttgaggattttgagta

SEQ ID NO: 498163 - DNA, 16 bp, Homo sapiens
ttgagtcaaaaaatct

SEQ ID NO: 498164 - DNA, 16 bp, Homo sapiens
ttgataagagggcaca

SEQ ID NO: 498165 - DNA, 17 bp, Homo sapiens
ttgatatagaacagtgc

SEQ ID NO: 498166 - DNA, 20 bp, Homo sapiens
ttgatatgccttttcccaac

SEQ ID NO: 498167 - DNA, 16 bp, Homo sapiens
ttgatatgggctttct

SEQ ID NO: 498168 - DNA, 14 bp, Homo sapiens
ttgatgaagaagtt

SEQ ID NO: 498169 - DNA, 19 bp, Homo sapiens
ttgatggtggtatgttttc

SEQ ID NO: 498170 - DNA, 16 bp, Homo sapiens
ttgatgttggctggga

SEQ ID NO: 498171 - DNA, 20 bp, Homo sapiens
ttgcactctagcctggcaac

SEQ ID NO: 498172 - DNA, 14 bp, Homo sapiens
ttgcagagacagga

SEQ ID NO: 498173 - DNA, 17 bp, Homo sapiens
ttgcatagcagctgcta

SEQ ID NO: 498174 - DNA, 14 bp, Homo sapiens
ttgcatatgtatga

SEQ ID NO: 498175 - DNA, 19 bp, Homo sapiens
ttgcatggcatcacctcca

SEQ ID NO: 498176 - DNA, 22 bp, Homo sapiens
ttgccagacatgtggtgggaca

SEQ ID NO: 498177 - DNA, 23 bp, Homo sapiens
ttgccatcccctatggaccagaa

SEQ ID NO: 498178 - DNA, 14 bp, Homo sapiens
ttgccatccctccc

SEQ ID NO: 498179 - DNA, 16 bp, Homo sapiens
ttgccatccctccctc

SEQ ID NO: 498180 - DNA, 17 bp, Homo sapiens
ttgccatccctccctcc

SEQ ID NO: 498181 - DNA, 18 bp, Homo sapiens
ttgccatccctccctcca

SEQ ID NO: 498182 - DNA, 22 bp, Homo sapiens
ttgccatccctccctccacctc

SEQ ID NO: 498183 - DNA, 22 bp, Homo sapiens
ttgcccagcattttactgattc

SEQ ID NO: 498184 - DNA, 19 bp, Homo sapiens
ttgcccagggctcagcctg

SEQ ID NO: 498185 - DNA, 22 bp, Homo sapiens
ttgcctttagtgatcacagcag

SEQ ID NO: 498186 - DNA, 23 bp, Homo sapiens
ttgcctttagtgatcacagcagc

SEQ ID NO: 498187 - DNA, 16 bp, Homo sapiens
ttgctaagcattccaa

SEQ ID NO: 498188 - DNA, 20 bp, Homo sapiens
ttgctactacttacctacca

SEQ ID NO: 498189 - DNA, 11 bp, Homo sapiens
ttgctcatgga

SEQ ID NO: 498190 - DNA, 23 bp, Homo sapiens
ttgctcctcagggtccctcagga

SEQ ID NO: 498191 - DNA, 18 bp, Homo sapiens
ttgctctcttcaataaac

SEQ ID NO: 498192 - DNA, 20 bp, Homo sapiens
ttgctctgccaacttcttca

SEQ ID NO: 498193 - DNA, 17 bp, Homo sapiens
ttgctgtccccttccag

SEQ ID NO: 498194 - DNA, 16 bp, Homo sapiens
ttgctttaattgttaa

SEQ ID NO: 498195 - DNA, 14 bp, Homo sapiens
ttgctttgcccagc

SEQ ID NO: 498196 - DNA, 15 bp, Homo sapiens
ttggactggatgcat

SEQ ID NO: 498197 - DNA, 17 bp, Homo sapiens
ttggagaagaactgaaa

SEQ ID NO: 498198 - DNA, 22 bp, Homo sapiens
ttggagagctagaacctggaga

SEQ ID NO: 498199 - DNA, 16 bp, Homo sapiens
ttggccatctctggat

SEQ ID NO: 498200 - DNA, 14 bp, Homo sapiens
ttgggtaggcggga

SEQ ID NO: 498201 - DNA, 15 bp, Homo sapiens
ttggttggctggcct

SEQ ID NO: 498202 - DNA, 20 bp, Homo sapiens
ttggtttggccatctctgga

SEQ ID NO: 498203 - DNA, 22 bp, Homo sapiens
ttgtaaacattagttctatttc

SEQ ID NO: 498204 - DNA, 14 bp, Homo sapiens
ttgtaagtttatgt

SEQ ID NO: 498205 - DNA, 11 bp, Homo sapiens
ttgtacagttc

SEQ ID NO: 498206 - DNA, 16 bp, Homo sapiens
ttgtacagttcagttc

SEQ ID NO: 498207 - DNA, 16 bp, Homo sapiens
ttgtataaaataattt

SEQ ID NO: 498208 - DNA, 17 bp, Homo sapiens
ttgtatagagatatgca

SEQ ID NO: 498209 - DNA, 22 bp, Homo sapiens
ttgtcatccacacaacaccagg

SEQ ID NO: 498210 - DNA, 18 bp, Homo sapiens
ttgtgaagcaaaattttt

SEQ ID NO: 498211 - DNA, 22 bp, Homo sapiens
ttgtggaggagctcaggacact

SEQ ID NO: 498212 - DNA, 14 bp, Homo sapiens
ttgttattatataa

SEQ ID NO: 498213 - DNA, 18 bp, Homo sapiens
ttgtttatacctttgcct

SEQ ID NO: 498214 - DNA, 21 bp, Homo sapiens
ttgtttttccttgtatttaaa

SEQ ID NO: 498215 - DNA, 19 bp, Homo sapiens
tttaaaagttattaatatt

SEQ ID NO: 498216 - DNA, 23 bp, Homo sapiens
tttaacaactatgatttggaaaa

SEQ ID NO: 498217 - DNA, 24 bp, Homo sapiens
tttaactcaatattttccatgaaa

SEQ ID NO: 498218 - DNA, 19 bp, Homo sapiens
tttaagaaaaacatgtcat

SEQ ID NO: 498219 - DNA, 16 bp, Homo sapiens
tttaagaccagcctgg

SEQ ID NO: 498220 - DNA, 13 bp, Homo sapiens
tttaagctgtaaa

SEQ ID NO: 498221 - DNA, 19 bp, Homo sapiens
tttaataatgtttcaaaca

SEQ ID NO: 498222 - DNA, 21 bp, Homo sapiens
tttaatcccggtttcagaagc

SEQ ID NO: 498223 - DNA, 21 bp, Homo sapiens
tttacaccagttcctttcaat

SEQ ID NO: 498224 - DNA, 19 bp, Homo sapiens
tttaccttgaacaatcaag

SEQ ID NO: 498225 - DNA, 19 bp, Homo sapiens
tttatgtctaaagagcttt

SEQ ID NO: 498226 - DNA, 16 bp, Homo sapiens
tttattactgtaagaa

SEQ ID NO: 498227 - DNA, 19 bp, Homo sapiens
tttattgctgtgtaacact

SEQ ID NO: 498228 - DNA, 13 bp, Homo sapiens
tttatttcttaaa

SEQ ID NO: 498229 - DNA, 20 bp, Homo sapiens
tttatttgtttgtgcatttg

SEQ ID NO: 498230 - DNA, 16 bp, Homo sapiens
tttcaaacatatataa

SEQ ID NO: 498231 - DNA, 19 bp, Homo sapiens
tttcaatttccaagagctg

SEQ ID NO: 498232 - DNA, 13 bp, Homo sapiens
tttcactgccata

SEQ ID NO: 498233 - DNA, 21 bp, Homo sapiens
tttcagctgtgaacatggact

SEQ ID NO: 498234 - DNA, 17 bp, Homo sapiens
tttcaggagcagcctca

SEQ ID NO: 498235 - DNA, 23 bp, Homo sapiens
tttccatcattaaatttttcctt

SEQ ID NO: 498236 - DNA, 17 bp, Homo sapiens
tttcccactttcttcta

SEQ ID NO: 498237 - DNA, 16 bp, Homo sapiens
tttctacttttaaaga

SEQ ID NO: 498238 - DNA, 22 bp, Homo sapiens
tttctagaatactaataaaata

SEQ ID NO: 498239 - DNA, 14 bp, Homo sapiens
tttctatgaaatat

SEQ ID NO: 498240 - DNA, 17 bp, Homo sapiens
tttcttacacaagagct

SEQ ID NO: 498241 - DNA, 15 bp, Homo sapiens
tttgaagaggaaaat

SEQ ID NO: 498242 - DNA, 19 bp, Homo sapiens
tttgaatataaacactata

SEQ ID NO: 498243 - DNA, 21 bp, Homo sapiens
tttgaggagcagcttcagttg

SEQ ID NO: 498244 - DNA, 22 bp, Homo sapiens
tttgaggagcagcttcagttgt

SEQ ID NO: 498245 - DNA, 15 bp, Homo sapiens
tttgaggaggaagca

SEQ ID NO: 498246 - DNA, 18 bp, Homo sapiens
tttgatagtattgtgcat

SEQ ID NO: 498247 - DNA, 21 bp, Homo sapiens
tttgcatagcagctgctacta

SEQ ID NO: 498248 - DNA, 21 bp, Homo sapiens
tttgcatcccccaaacttctt

SEQ ID NO: 498249 - DNA, 21 bp, Homo sapiens
tttgcatggaatttgtaagtt

SEQ ID NO: 498250 - DNA, 16 bp, Homo sapiens
tttgccagtgggaact

SEQ ID NO: 498251 - DNA, 13 bp, Homo sapiens
tttgctcatggaa

SEQ ID NO: 498252 - DNA, 21 bp, Homo sapiens
tttggagtggaggcattgttt

SEQ ID NO: 498253 - DNA, 19 bp, Homo sapiens
tttggccgttttgtgaaga

SEQ ID NO: 498254 - DNA, 12 bp, Homo sapiens
tttgggttgacc

SEQ ID NO: 498255 - DNA, 16 bp, Homo sapiens
tttgtataaaataatt

SEQ ID NO: 498256 - DNA, 21 bp, Homo sapiens
tttgtataaaataatttttat

SEQ ID NO: 498257 - DNA, 15 bp, Homo sapiens
tttgtgaagaaacat

SEQ ID NO: 498258 - DNA, 12 bp, Homo sapiens
tttgttatttgt

SEQ ID NO: 498259 - DNA, 13 bp, Homo sapiens
tttgtttgtgcat

SEQ ID NO: 498260 - DNA, 14 bp, Homo sapiens
ttttaaaagaatga

SEQ ID NO: 498261 - DNA, 13 bp, Homo sapiens
ttttaactcaata

SEQ ID NO: 498262 - DNA, 19 bp, Homo sapiens
ttttaagaaaaacatgtca

SEQ ID NO: 498263 - DNA, 21 bp, Homo sapiens
ttttataattttgtgaagcaa

SEQ ID NO: 498264 - DNA, 22 bp, Homo sapiens
ttttatggcactagtatttcta

SEQ ID NO: 498265 - DNA, 19 bp, Homo sapiens
ttttccatgaaaatgcaac

SEQ ID NO: 498266 - DNA, 14 bp, Homo sapiens
ttttcccaataaat

SEQ ID NO: 498267 - DNA, 13 bp, Homo sapiens
ttttcctgaaaac

SEQ ID NO: 498268 - DNA, 14 bp, Homo sapiens
ttttcctgaaaacc

SEQ ID NO: 498269 - DNA, 23 bp, Homo sapiens
ttttctagaatactaataaaata

SEQ ID NO: 498270 - DNA, 14 bp, Homo sapiens
ttttgtgaagcaaa

SEQ ID NO: 498271 - DNA, 22 bp, Homo sapiens
tttttaactcaatattttccat

SEQ ID NO: 498272 - DNA, 19 bp, Homo sapiens
tttttatttgtttgtgcat

SEQ ID NO: 498273 - DNA, 17 bp, Homo sapiens
tttttccttgtatttaa

SEQ ID NO: 498274 - DNA, 16 bp, Homo sapiens
tggttggctggccttc

SEQ ID NO: 498275 - DNA, 14 bp, Homo sapiens
tgtaaaaactgtgg

SEQ ID NO: 498276 - DNA, 22 bp, Homo sapiens
tgtaaaaagagagaaaacttat

SEQ ID NO: 498277 - DNA, 14 bp, Homo sapiens
tgtaaaattgtata

SEQ ID NO: 498278 - DNA, 21 bp, Homo sapiens
tgtaatctttcatagccatac

SEQ ID NO: 498279 - DNA, 22 bp, Homo sapiens
tgtacattagtcattcaataaa

SEQ ID NO: 498280 - DNA, 20 bp, Homo sapiens
tgtagcaaattccaatacat

SEQ ID NO: 498281 - DNA, 19 bp, Homo sapiens
tgtagtcccacttacttgg

SEQ ID NO: 498282 - DNA, 19 bp, Homo sapiens
tgtagtgttggagaagaac

SEQ ID NO: 498283 - DNA, 22 bp, Homo sapiens
tgtagttgcaatagaacagaga

SEQ ID NO: 498284 - DNA, 16 bp, Homo sapiens
tgtataagtccttgca

SEQ ID NO: 498285 - DNA, 18 bp, Homo sapiens
tgtatctgaaggagattt

SEQ ID NO: 498286 - DNA, 23 bp, Homo sapiens
tgtatgagagggccctgcctgct

SEQ ID NO: 498287 - DNA, 15 bp, Homo sapiens
tgtatgattcccagc

SEQ ID NO: 498288 - DNA, 18 bp, Homo sapiens
tgtatttgttaatggttt

SEQ ID NO: 498289 - DNA, 19 bp, Homo sapiens
tgtattttaaaagaatgat

SEQ ID NO: 498290 - DNA, 21 bp, Homo sapiens
tgtcatccacacaacaccagg

SEQ ID NO: 498291 - DNA, 15 bp, Homo sapiens
tgtcattaaacatga

SEQ ID NO: 498292 - DNA, 17 bp, Homo sapiens
tgtccagggccctgagc

SEQ ID NO: 498293 - DNA, 19 bp, Homo sapiens
tgtccctacacccctcccc

SEQ ID NO: 498294 - DNA, 22 bp, Homo sapiens
tgtctaaaaataaaatgcattt

SEQ ID NO: 498295 - DNA, 22 bp, Homo sapiens
tgtctacactaagagagaatga

SEQ ID NO: 498296 - DNA, 18 bp, Homo sapiens
tgtctccttaacactgag

SEQ ID NO: 498297 - DNA, 13 bp, Homo sapiens
tgtctctggcctg

SEQ ID NO: 498298 - DNA, 18 bp, Homo sapiens
tgtctgccagccagcagc

SEQ ID NO: 498299 - DNA, 19 bp, Homo sapiens
tgtctgccagccagcagcc

SEQ ID NO: 498300 - DNA, 19 bp, Homo sapiens
tgtctggattcccaggatg

SEQ ID NO: 498301 - DNA, 14 bp, Homo sapiens
tgtgaagcaaaatt

SEQ ID NO: 498302 - DNA, 21 bp, Homo sapiens
tgtgattcctttgaagaggaa

SEQ ID NO: 498303 - DNA, 15 bp, Homo sapiens
tgtgccgacagaagg

SEQ ID NO: 498304 - DNA, 17 bp, Homo sapiens
tgtgcctatagtcccag

SEQ ID NO: 498305 - DNA, 14 bp, Homo sapiens
tgtgcctctgtcct

SEQ ID NO: 498306 - DNA, 21 bp, Homo sapiens
tgtgctccctggttctgatga

SEQ ID NO: 498307 - DNA, 20 bp, Homo sapiens
tgtggttaatgccatggaca

SEQ ID NO: 498308 - DNA, 15 bp, Homo sapiens
tgtgtaaaaagagag

SEQ ID NO: 498309 - DNA, 13 bp, Homo sapiens
tgtgtaagtagat

SEQ ID NO: 498310 - DNA, 23 bp, Homo sapiens
tgtgtacagaattctgctacctc

SEQ ID NO: 498311 - DNA, 21 bp, Homo sapiens
tgtgtgaaaggtacttcaaat

SEQ ID NO: 498312 - DNA, 19 bp, Homo sapiens
tgtgttcctctttgcatga

SEQ ID NO: 498313 - DNA, 13 bp, Homo sapiens
tgtgttttgcaag

SEQ ID NO: 498314 - DNA, 22 bp, Homo sapiens
tgttaagttgatggtgatgaaa

SEQ ID NO: 498315 - DNA, 16 bp, Homo sapiens
tgttactatctgcttt

SEQ ID NO: 498316 - DNA, 15 bp, Homo sapiens
tgttagccaggtgga

SEQ ID NO: 498317 - DNA, 12 bp, Homo sapiens
tgttattatata

SEQ ID NO: 498318 - DNA, 17 bp, Homo sapiens
tgttatttgtacagttc

SEQ ID NO: 498319 - DNA, 14 bp, Homo sapiens
tgttctcattcctg

SEQ ID NO: 498320 - DNA, 23 bp, Homo sapiens
tgttctcattcctgttctttctt

SEQ ID NO: 498321 - DNA, 21 bp, Homo sapiens
tgttctgaggattcaggggct

SEQ ID NO: 498322 - DNA, 19 bp, Homo sapiens
tgttcttgccactgcactc

SEQ ID NO: 498323 - DNA, 22 bp, Homo sapiens
tgttgcccacagctgtatgatt

SEQ ID NO: 498324 - DNA, 14 bp, Homo sapiens
tgttgctcagaagt

SEQ ID NO: 498325 - DNA, 14 bp, Homo sapiens
tgttggagaagaac

SEQ ID NO: 498326 - DNA, 20 bp, Homo sapiens
tgttggagaagaactgaaat

SEQ ID NO: 498327 - DNA, 21 bp, Homo sapiens
tgttggagaagaactgaaatc

SEQ ID NO: 498328 - DNA, 15 bp, Homo sapiens
tgtttgctaagcatt

SEQ ID NO: 498329 - DNA, 19 bp, Homo sapiens
tgtttgctaagcattccaa

SEQ ID NO: 498330 - DNA, 17 bp, Homo sapiens
tgttttccagctcctca

SEQ ID NO: 498331 - DNA, 14 bp, Homo sapiens
tgttttgcaagcca

SEQ ID NO: 498332 - DNA, 18 bp, Homo sapiens
ttaaaaaagaaacatttg

SEQ ID NO: 498333 - DNA, 16 bp, Homo sapiens
ttaaaaattaattctt

SEQ ID NO: 498334 - DNA, 22 bp, Homo sapiens
ttaaaatcacaaactcatccat

SEQ ID NO: 498335 - DNA, 22 bp, Homo sapiens
ttaaacaaatgtatgattacat

SEQ ID NO: 498336 - DNA, 18 bp, Homo sapiens
ttaaatagtaaaaataaa

SEQ ID NO: 498337 - DNA, 12 bp, Homo sapiens
ttaaatttttcc

SEQ ID NO: 498338 - DNA, 13 bp, Homo sapiens
ttaacactgagct

SEQ ID NO: 498339 - DNA, 19 bp, Homo sapiens
ttaacactgcttgtgtttt

SEQ ID NO: 498340 - DNA, 14 bp, Homo sapiens
ttaacagctttctc

SEQ ID NO: 498341 - DNA, 20 bp, Homo sapiens
ttaacagctttctccagaac

SEQ ID NO: 498342 - DNA, 15 bp, Homo sapiens
ttaagaaaaacatgt

SEQ ID NO: 498343 - DNA, 12 bp, Homo sapiens
ttaagaaacact

SEQ ID NO: 498344 - DNA, 14 bp, Homo sapiens
ttaagacaaatggg

SEQ ID NO: 498345 - DNA, 15 bp, Homo sapiens
ttaagaccagcctgg

SEQ ID NO: 498346 - DNA, 18 bp, Homo sapiens
ttaaggcccaacattaaa

SEQ ID NO: 498347 - DNA, 18 bp, Homo sapiens
ttaagtaatgataactgg

SEQ ID NO: 498348 - DNA, 22 bp, Homo sapiens
ttaatatggggatgcagcatta

SEQ ID NO: 498349 - DNA, 20 bp, Homo sapiens
ttaatcccggtttcagaagc

SEQ ID NO: 498350 - DNA, 18 bp, Homo sapiens
ttaatgtaatctgatggc

SEQ ID NO: 498351 - DNA, 14 bp, Homo sapiens
ttaatgtagataaa

SEQ ID NO: 498352 - DNA, 18 bp, Homo sapiens
ttaatgtagataaagcac

SEQ ID NO: 498353 - DNA, 21 bp, Homo sapiens
ttacagctgggtggcactgcc

SEQ ID NO: 498354 - DNA, 16 bp, Homo sapiens
ttacagtaaataaatt

SEQ ID NO: 498355 - DNA, 17 bp, Homo sapiens
ttacagtaaataaattg

SEQ ID NO: 498356 - DNA, 18 bp, Homo sapiens
ttacagtaaataaattgt

SEQ ID NO: 498357 - DNA, 22 bp, Homo sapiens
ttacagtaaataaattgtttga

SEQ ID NO: 498358 - DNA, 20 bp, Homo sapiens
ttacatttgtataaaataat

SEQ ID NO: 498359 - DNA, 20 bp, Homo sapiens
ttactcattaaaaataatag

SEQ ID NO: 498360 - DNA, 15 bp, Homo sapiens
ttactgtaagaaaat

SEQ ID NO: 498361 - DNA, 20 bp, Homo sapiens
ttagaaaagcaaagggtgct

SEQ ID NO: 498362 - DNA, 19 bp, Homo sapiens
ttagaaacacaactatatt

SEQ ID NO: 498363 - DNA, 21 bp, Homo sapiens
ttagaactttgcatagcagct

SEQ ID NO: 498364 - DNA, 15 bp, Homo sapiens
ttagaataaaattgt

SEQ ID NO: 498365 - DNA, 14 bp, Homo sapiens
ttagaatattaaaa

SEQ ID NO: 498366 - DNA, 14 bp, Homo sapiens
ttagatgactgaat

SEQ ID NO: 498367 - DNA, 20 bp, Homo sapiens
ttagatgcagttctgaagaa

SEQ ID NO: 498368 - DNA, 23 bp, Homo sapiens
ttagatgcagttctgaagaagat

SEQ ID NO: 498369 - DNA, 13 bp, Homo sapiens
ttagcaaagagtt

SEQ ID NO: 498370 - DNA, 13 bp, Homo sapiens
ttagctggaaaag

SEQ ID NO: 498371 - DNA, 15 bp, Homo sapiens
ttagctttgctctgc

SEQ ID NO: 498372 - DNA, 19 bp, Homo sapiens
ttagctttgctctgccaac

SEQ ID NO: 498373 - DNA, 19 bp, Homo sapiens
ttaggcagggatttgagga

SEQ ID NO: 498374 - DNA, 14 bp, Homo sapiens
ttagggttatgatt

SEQ ID NO: 498375 - DNA, 12 bp, Homo sapiens
ttagtggcttca

SEQ ID NO: 498376 - DNA, 16 bp, Homo sapiens
ttataattttgtgaag

SEQ ID NO: 498377 - DNA, 17 bp, Homo sapiens
ttataattttgtgaagc

SEQ ID NO: 498378 - DNA, 18 bp, Homo sapiens
ttataattttgtgaagca

SEQ ID NO: 498379 - DNA, 16 bp, Homo sapiens
ttatagccgaaatgat

SEQ ID NO: 498380 - DNA, 13 bp, Homo sapiens
ttatatttgaaat

SEQ ID NO: 498381 - DNA, 15 bp, Homo sapiens
ttatatttgaaatat

SEQ ID NO: 498382 - DNA, 20 bp, Homo sapiens
ttatattttaaagcttggtg

SEQ ID NO: 498383 - DNA, 12 bp, Homo sapiens
ttatctgtccca

SEQ ID NO: 498384 - DNA, 16 bp, Homo sapiens
ttatgaattacatttg

SEQ ID NO: 498385 - DNA, 21 bp, Homo sapiens
ttatgaattacatttgtataa

SEQ ID NO: 498386 - DNA, 21 bp, Homo sapiens
ttatgatgtgggtcaaggaat

SEQ ID NO: 498387 - DNA, 19 bp, Homo sapiens
ttatgattaagtaatgata

SEQ ID NO: 498388 - DNA, 22 bp, Homo sapiens
ttatgattaagtaatgataact

SEQ ID NO: 498389 - DNA, 15 bp, Homo sapiens
ttatgccttttattt

SEQ ID NO: 498390 - DNA, 21 bp, Homo sapiens
ttatggcactagtatttctat

SEQ ID NO: 498391 - DNA, 17 bp, Homo sapiens
ttatgtaataatgtgaa

SEQ ID NO: 498392 - DNA, 17 bp, Homo sapiens
ttattactgtaagaaaa

SEQ ID NO: 498393 - DNA, 16 bp, Homo sapiens
ttattggacttccatt

SEQ ID NO: 498394 - DNA, 12 bp, Homo sapiens
ttatttaaatga

SEQ ID NO: 498395 - DNA, 13 bp, Homo sapiens
ttatttccatatt

SEQ ID NO: 498396 - DNA, 20 bp, Homo sapiens
ttattttgactgtgatttat

SEQ ID NO: 498397 - DNA, 20 bp, Homo sapiens
ttatttttttaagctgtaaa

SEQ ID NO: 498398 - DNA, 20 bp, Homo sapiens
ttcaatggtttgcaaggaag

SEQ ID NO: 498399 - DNA, 23 bp, Homo sapiens
ttcaatggtttgcaaggaagcca

SEQ ID NO: 498400 - DNA, 14 bp, Homo sapiens
ttcaccgaggacat

SEQ ID NO: 498401 - DNA, 15 bp, Homo sapiens
ttcagaaagaagtgg

SEQ ID NO: 498402 - DNA, 14 bp, Homo sapiens
ttcagagctgccct

SEQ ID NO: 498403 - DNA, 18 bp, Homo sapiens
ttcagagctgccctctcc

SEQ ID NO: 498404 - DNA, 19 bp, Homo sapiens
ttcagagctgccctctcct

SEQ ID NO: 498405 - DNA, 21 bp, Homo sapiens
ttcagagctgccctctcctgg

SEQ ID NO: 498406 - DNA, 20 bp, Homo sapiens
ttcagcctagccgacctcag

SEQ ID NO: 498407 - DNA, 20 bp, Homo sapiens
ttcagctgtgaacatggact

SEQ ID NO: 498408 - DNA, 22 bp, Homo sapiens
ttcaggagcagcctcagaacaa

SEQ ID NO: 498409 - DNA, 23 bp, Homo sapiens
ttcagttcctctttgcatggaat

SEQ ID NO: 498410 - DNA, 16 bp, Homo sapiens
ttcatcaaatggaaga

SEQ ID NO: 498411 - DNA, 17 bp, Homo sapiens
ttcatctggaaccatca

SEQ ID NO: 498412 - DNA, 14 bp, Homo sapiens
ttcatgcatggaaa

SEQ ID NO: 498413 - DNA, 13 bp, Homo sapiens
ttcattccatttg

SEQ ID NO: 498414 - DNA, 12 bp, Homo sapiens
ttccagccaggg

SEQ ID NO: 498415 - DNA, 15 bp, Homo sapiens
attgctgctggtaat

SEQ ID NO: 498416 - DNA, 14 bp, Homo sapiens
attggacttccatt

SEQ ID NO: 498417 - DNA, 15 bp, Homo sapiens
attggacttccattt

SEQ ID NO: 498418 - DNA, 17 bp, Homo sapiens
attggagatagggaaag

SEQ ID NO: 498419 - DNA, 19 bp, Homo sapiens
attggagctcgtgggacag

SEQ ID NO: 498420 - DNA, 19 bp, Homo sapiens
gcaagctcccaagggatgg

SEQ ID NO: 498421 - DNA, 21 bp, Homo sapiens
gcaaggacacagatgaaacac

SEQ ID NO: 498422 - DNA, 18 bp, Homo sapiens
gcaaggctgtgctccctg

SEQ ID NO: 498423 - DNA, 16 bp, Homo sapiens
gcaaggtgagagaggt

SEQ ID NO: 498424 - DNA, 19 bp, Homo sapiens
gcaagtctctttatatggc

SEQ ID NO: 498425 - DNA, 20 bp, Homo sapiens
gcaagtgattgggacagagg

SEQ ID NO: 498426 - DNA, 16 bp, Homo sapiens
gcacaaagggcccaga

SEQ ID NO: 498427 - DNA, 16 bp, Homo sapiens
gcacacacacatacag

SEQ ID NO: 498428 - DNA, 20 bp, Homo sapiens
gcacacgcacgcacacacac

SEQ ID NO: 498429 - DNA, 18 bp, Homo sapiens
gcacagcctcttagatgc

SEQ ID NO: 498430 - DNA, 20 bp, Homo sapiens
gcacagcctcttagatgcag

SEQ ID NO: 498431 - DNA, 20 bp, Homo sapiens
gcacaggtgggcttcccagt

SEQ ID NO: 498432 - DNA, 21 bp, Homo sapiens
gcacatttaagagacagtcac

SEQ ID NO: 498433 - DNA, 16 bp, Homo sapiens
gcacctgggctttctg

SEQ ID NO: 498434 - DNA, 22 bp, Homo sapiens
gcacgcacacacacatacagag

SEQ ID NO: 498435 - DNA, 14 bp, Homo sapiens
gcactccagcctgg

SEQ ID NO: 498436 - DNA, 15 bp, Homo sapiens
gcactgccatgcagg

SEQ ID NO: 498437 - DNA, 14 bp, Homo sapiens
gcactgtgctcagg

SEQ ID NO: 498438 - DNA, 16 bp, Homo sapiens
gcacttggagccaagg

SEQ ID NO: 498439 - DNA, 22 bp, Homo sapiens
gcacttggagccaagggttcag

SEQ ID NO: 498440 - DNA, 23 bp, Homo sapiens
gcagaatctttgcaagaaagtca

SEQ ID NO: 498441 - DNA, 17 bp, Homo sapiens
gcagacagcagctcagg

SEQ ID NO: 498442 - DNA, 18 bp, Homo sapiens
gcagacagcagctcaggc

SEQ ID NO: 498443 - DNA, 19 bp, Homo sapiens
gcagacagcagctcaggca

SEQ ID NO: 498444 - DNA, 22 bp, Homo sapiens
gcagagattggaatgggcagct

SEQ ID NO: 498445 - DNA, 18 bp, Homo sapiens
gcagatgtccttgatgct

SEQ ID NO: 498446 - DNA, 19 bp, Homo sapiens
gcagattcatttttctttc

SEQ ID NO: 498447 - DNA, 16 bp, Homo sapiens
gcagccagctctcagc

SEQ ID NO: 498448 - DNA, 19 bp, Homo sapiens
gcaggcgttcagctcactg

SEQ ID NO: 498449 - DNA, 17 bp, Homo sapiens
gcaggctaaggcgtgga

SEQ ID NO: 498450 - DNA, 21 bp, Homo sapiens
gcaggctaaggcgtggagctg

SEQ ID NO: 498451 - DNA, 17 bp, Homo sapiens
gcaggctgtctggccag

SEQ ID NO: 498452 - DNA, 16 bp, Homo sapiens
gcagggcctcacacgg

SEQ ID NO: 498453 - DNA, 14 bp, Homo sapiens
gcagggtctgggca

SEQ ID NO: 498454 - DNA, 17 bp, Homo sapiens
gcagggtctgggcagga

SEQ ID NO: 498455 - DNA, 20 bp, Homo sapiens
gcagggtctgggcaggactc

SEQ ID NO: 498456 - DNA, 24 bp, Homo sapiens
gcagtcacgtggaggagcagtgca

SEQ ID NO: 498457 - DNA, 14 bp, Homo sapiens
gcagtgagctgtgt

SEQ ID NO: 498458 - DNA, 18 bp, Homo sapiens
gcagttcagagctgccct

SEQ ID NO: 498459 - DNA, 22 bp, Homo sapiens
gcagttgttgcccacagctgta

SEQ ID NO: 498460 - DNA, 16 bp, Homo sapiens
gcatactaataaagta

SEQ ID NO: 498461 - DNA, 17 bp, Homo sapiens
gcataggaggggtctgg

SEQ ID NO: 498462 - DNA, 21 bp, Homo sapiens
gcatcagctggcgtcatgcaa

SEQ ID NO: 498463 - DNA, 12 bp, Homo sapiens
gcatggagctgg

SEQ ID NO: 498464 - DNA, 15 bp, Homo sapiens
gcatggagctggccg

SEQ ID NO: 498465 - DNA, 17 bp, Homo sapiens
gcattcttggttggctg

SEQ ID NO: 498466 - DNA, 12 bp, Homo sapiens
gcatttagatgt

SEQ ID NO: 498467 - DNA, 18 bp, Homo sapiens
gcatttcctgctggtcaa

SEQ ID NO: 498468 - DNA, 16 bp, Homo sapiens
gccaacactcaagaag

SEQ ID NO: 498469 - DNA, 19 bp, Homo sapiens
gccaacttcttcagagctg

SEQ ID NO: 498470 - DNA, 20 bp, Homo sapiens
gccaacttcttcagagctga

SEQ ID NO: 498471 - DNA, 20 bp, Homo sapiens
gccaagatcacgccactgca

SEQ ID NO: 498472 - DNA, 15 bp, Homo sapiens
gccaagcactgtgct

SEQ ID NO: 498473 - DNA, 23 bp, Homo sapiens
gccaagctcaggaccaggcaatg

SEQ ID NO: 498474 - DNA, 19 bp, Homo sapiens
gccaattgaataggatcaa

SEQ ID NO: 498475 - DNA, 15 bp, Homo sapiens
gccacaaataaaatg

SEQ ID NO: 498476 - DNA, 13 bp, Homo sapiens
gccaccctcatgc

SEQ ID NO: 498477 - DNA, 12 bp, Homo sapiens
gccagaaataaa

SEQ ID NO: 498478 - DNA, 14 bp, Homo sapiens
gccagacatgtggt

SEQ ID NO: 498479 - DNA, 17 bp, Homo sapiens
gccagatcctcttctca

SEQ ID NO: 498480 - DNA, 12 bp, Homo sapiens
gccagcagccag

SEQ ID NO: 498481 - DNA, 15 bp, Homo sapiens
gccagcagccagctc

SEQ ID NO: 498482 - DNA, 16 bp, Homo sapiens
gccagcagccagctct

SEQ ID NO: 498483 - DNA, 18 bp, Homo sapiens
gccagcagccagctctca

SEQ ID NO: 498484 - DNA, 23 bp, Homo sapiens
gccagcagccagctctcagccaa

SEQ ID NO: 498485 - DNA, 21 bp, Homo sapiens
gccagcagttcagagctgccc

SEQ ID NO: 498486 - DNA, 14 bp, Homo sapiens
gccagccagcagcc

SEQ ID NO: 498487 - DNA, 16 bp, Homo sapiens
gccagccagcagccag

SEQ ID NO: 498488 - DNA, 19 bp, Homo sapiens
gccagccagcagccagctc

SEQ ID NO: 498489 - DNA, 15 bp, Homo sapiens
gccagctctcagcca

SEQ ID NO: 498490 - DNA, 18 bp, Homo sapiens
gccagctgccccagccag

SEQ ID NO: 498491 - DNA, 10 bp, Homo sapiens
gccaggcagg

SEQ ID NO: 498492 - DNA, 17 bp, Homo sapiens
gccaggcctcttggcag

SEQ ID NO: 498493 - DNA, 15 bp, Homo sapiens
gccagggcctggaag

SEQ ID NO: 498494 - DNA, 14 bp, Homo sapiens
gccaggtgcagacc

SEQ ID NO: 498495 - DNA, 22 bp, Homo sapiens
gccagtctcactgtgggaaggc

SEQ ID NO: 498496 - DNA, 19 bp, Homo sapiens
gccatatactcttcaagga

SEQ ID NO: 498497 - DNA, 19 bp, Homo sapiens
gccatcctcaaacactgca

SEQ ID NO: 498498 - DNA, 21 bp, Homo sapiens
gccatcctcaaacactgcagg

SEQ ID NO: 498499 - DNA, 22 bp, Homo sapiens
gccatgctttgagtccacgccc

SEQ ID NO: 498500 - DNA, 22 bp, Homo sapiens
gccatggagagctggagcctgg

SEQ ID NO: 498501 - DNA, 23 bp, Homo sapiens
gccatggagagctggagcctggt

SEQ ID NO: 498502 - DNA, 22 bp, Homo sapiens
gccatgtgctagtaattggaaa

SEQ ID NO: 498503 - DNA, 23 bp, Homo sapiens
gccatgttaatgtaatctgatgg

SEQ ID NO: 498504 - DNA, 13 bp, Homo sapiens
gcccaagccctga

SEQ ID NO: 498505 - DNA, 20 bp, Homo sapiens
gcccaagtggcagagcttgg

SEQ ID NO: 498506 - DNA, 22 bp, Homo sapiens
gcccaattcttacaaacatgtg

SEQ ID NO: 498507 - DNA, 20 bp, Homo sapiens
gcccaggaatttgaagctgc

SEQ ID NO: 498508 - DNA, 14 bp, Homo sapiens
gcccaggtttctgg

SEQ ID NO: 498509 - DNA, 23 bp, Homo sapiens
gcccaggtttctggtctctaggc

SEQ ID NO: 498510 - DNA, 16 bp, Homo sapiens
gcccattcattccatt

SEQ ID NO: 498511 - DNA, 12 bp, Homo sapiens
gccccacccaga

SEQ ID NO: 498512 - DNA, 11 bp, Homo sapiens
gccccagccag

SEQ ID NO: 498513 - DNA, 23 bp, Homo sapiens
gccccttctaggtggcaaggctg

SEQ ID NO: 498514 - DNA, 15 bp, Homo sapiens
gcccgtcttcagcct

SEQ ID NO: 498515 - DNA, 18 bp, Homo sapiens
gcccgtcttcagcctagc

SEQ ID NO: 498516 - DNA, 21 bp, Homo sapiens
gccctagagcacactgtagca

SEQ ID NO: 498517 - DNA, 15 bp, Homo sapiens
gccctctcctgggca

SEQ ID NO: 498518 - DNA, 18 bp, Homo sapiens
gccctctcctgggcagct

SEQ ID NO: 498519 - DNA, 16 bp, Homo sapiens
gccctgagctcggtgg

SEQ ID NO: 498520 - DNA, 22 bp, Homo sapiens
gccctgagctcggtggacccag

SEQ ID NO: 498521 - DNA, 21 bp, Homo sapiens
gccctgattaaaaaatctccc

SEQ ID NO: 498522 - DNA, 18 bp, Homo sapiens
gccctgccaagcagcaga

SEQ ID NO: 498523 - DNA, 15 bp, Homo sapiens
gccctgcctgctgca

SEQ ID NO: 498524 - DNA, 13 bp, Homo sapiens
gccgacctcagcc

SEQ ID NO: 498525 - DNA, 15 bp, Homo sapiens
gccgaggtgggcaga

SEQ ID NO: 498526 - DNA, 14 bp, Homo sapiens
gccgctgccatgct

SEQ ID NO: 498527 - DNA, 15 bp, Homo sapiens
gcctagccgacctca

SEQ ID NO: 498528 - DNA, 20 bp, Homo sapiens
gcctataatcccagcatgtt

SEQ ID NO: 498529 - DNA, 22 bp, Homo sapiens
gcctatgtgcatgcagcatcta

SEQ ID NO: 498530 - DNA, 18 bp, Homo sapiens
gcctccagctgccccggg

SEQ ID NO: 498531 - DNA, 20 bp, Homo sapiens
gcctcccctcctctgcttgc

SEQ ID NO: 498532 - DNA, 20 bp, Homo sapiens
gcctcccttcatgcatggaa

SEQ ID NO: 498533 - DNA, 22 bp, Homo sapiens
gcctcccttcatgcatggaaat

SEQ ID NO: 498534 - DNA, 15 bp, Homo sapiens
gcctcggagcctcat

SEQ ID NO: 498535 - DNA, 21 bp, Homo sapiens
gcctctccttgtggcctgggc

SEQ ID NO: 498536 - DNA, 22 bp, Homo sapiens
gcctctccttgtggcctgggcc

SEQ ID NO: 498537 - DNA, 15 bp, Homo sapiens
gcctctgccgctgcc

SEQ ID NO: 498538 - DNA, 21 bp, Homo sapiens
gcctctgccgctgccatgctt

SEQ ID NO: 498539 - DNA, 17 bp, Homo sapiens
gcctctttaacagcttt

SEQ ID NO: 498540 - DNA, 22 bp, Homo sapiens
gcctgaatgcttataggtggcc

SEQ ID NO: 498541 - DNA, 15 bp, Homo sapiens
gcctgagtgcctggc

SEQ ID NO: 498542 - DNA, 14 bp, Homo sapiens
gcctgatggacctg

SEQ ID NO: 498543 - DNA, 20 bp, Homo sapiens
gcctgattgccaagctcagg

SEQ ID NO: 498544 - DNA, 13 bp, Homo sapiens
gcctgcctggcag

SEQ ID NO: 498545 - DNA, 14 bp, Homo sapiens
gcctggaagacaga

SEQ ID NO: 498546 - DNA, 15 bp, Homo sapiens
gcctggcaacagagc

SEQ ID NO: 498547 - DNA, 17 bp, Homo sapiens
gcctggccagggcctgg

SEQ ID NO: 498548 - DNA, 20 bp, Homo sapiens
gcctgggcaacagagcaaga

SEQ ID NO: 498549 - DNA, 16 bp, Homo sapiens
gcctgggtccagggga

SEQ ID NO: 498550 - DNA, 15 bp, Homo sapiens
gcctgggtggacatg

SEQ ID NO: 498551 - DNA, 20 bp, Homo sapiens
gcctgggtttaaggggagag

SEQ ID NO: 498552 - DNA, 14 bp, Homo sapiens
gcctgtgctgcccg

SEQ ID NO: 498553 - DNA, 23 bp, Homo sapiens
gcctgtgctgcccgtcttcagcc

SEQ ID NO: 498554 - DNA, 21 bp, Homo sapiens
gcctgtgggcgcatactacag

SEQ ID NO: 498555 - DNA, 15 bp, Homo sapiens
gcctgttctgaggat

SEQ ID NO: 498556 - DNA, 20 bp, Homo sapiens
gcctgttttagaaggttctc

SEQ ID NO: 498557 - DNA, 19 bp, Homo sapiens
gccttggaagttgcatggc

SEQ ID NO: 498558 - DNA, 19 bp, Homo sapiens
gcctttagtgatcacagca

SEQ ID NO: 498559 - DNA, 16 bp, Homo sapiens
gcctttgacctgcctc

SEQ ID NO: 498560 - DNA, 20 bp, Homo sapiens
gcgcacaatagtaacctggg

SEQ ID NO: 498561 - DNA, 12 bp, Homo sapiens
ggcactggtggg

SEQ ID NO: 498562 - DNA, 14 bp, Homo sapiens
ggcactggtgggcc

SEQ ID NO: 498563 - DNA, 19 bp, Homo sapiens
ggcagacagcagctcaggc

SEQ ID NO: 498564 - DNA, 13 bp, Homo sapiens
ggcagagccaggc

SEQ ID NO: 498565 - DNA, 11 bp, Homo sapiens
ggcagctgcct

SEQ ID NO: 498566 - DNA, 23 bp, Homo sapiens
ggcaggacatgctgaagccaaag

SEQ ID NO: 498567 - DNA, 16 bp, Homo sapiens
ggcaggactcagctcc

SEQ ID NO: 498568 - DNA, 15 bp, Homo sapiens
ggcagggatttgagg

SEQ ID NO: 498569 - DNA, 17 bp, Homo sapiens
ggcagggtcaggagagg

SEQ ID NO: 498570 - DNA, 22 bp, Homo sapiens
ggcagtcattcagcaccagagc

SEQ ID NO: 498571 - DNA, 23 bp, Homo sapiens
ggcagtcattcagcaccagagca

SEQ ID NO: 498572 - DNA, 14 bp, Homo sapiens
ggcagtgccagggc

SEQ ID NO: 498573 - DNA, 22 bp, Homo sapiens
ggcatgaagtttccttggctgg

SEQ ID NO: 498574 - DNA, 15 bp, Homo sapiens
ggcatgcacagctgt

SEQ ID NO: 498575 - DNA, 18 bp, Homo sapiens
ggccacgtgatgtggagg

SEQ ID NO: 498576 - DNA, 18 bp, Homo sapiens
ggccagtacctttccatt

SEQ ID NO: 498577 - DNA, 14 bp, Homo sapiens
ggcccaacattaaa

SEQ ID NO: 498578 - DNA, 17 bp, Homo sapiens
ggcccagtatgagccct

SEQ ID NO: 498579 - DNA, 21 bp, Homo sapiens
ggccccagcactaaagcagtg

SEQ ID NO: 498580 - DNA, 21 bp, Homo sapiens
ggccctgagctcggtggaccc

SEQ ID NO: 498581 - DNA, 15 bp, Homo sapiens
ggccgaggcacgaga

SEQ ID NO: 498582 - DNA, 14 bp, Homo sapiens
ggccgtgggcctgg

SEQ ID NO: 498583 - DNA, 21 bp, Homo sapiens
ggccgttgatgttggctggga

SEQ ID NO: 498584 - DNA, 18 bp, Homo sapiens
ggcctcctctgtccaggg

SEQ ID NO: 498585 - DNA, 13 bp, Homo sapiens
ggcctcggagcct

SEQ ID NO: 498586 - DNA, 22 bp, Homo sapiens
ggcctcggagcctcatccgagg

SEQ ID NO: 498587 - DNA, 21 bp, Homo sapiens
ggcctgaagtcttctcctcca

SEQ ID NO: 498588 - DNA, 14 bp, Homo sapiens
ggcctggccatgtg

SEQ ID NO: 498589 - DNA, 18 bp, Homo sapiens
ggcctgggggcagggaga

SEQ ID NO: 498590 - DNA, 15 bp, Homo sapiens
ggctacacagggatg

SEQ ID NO: 498591 - DNA, 22 bp, Homo sapiens
ggctagaacctgtagagctaga

SEQ ID NO: 498592 - DNA, 15 bp, Homo sapiens
ggctagaactggaga

SEQ ID NO: 498593 - DNA, 14 bp, Homo sapiens
ggctagaatctgga

SEQ ID NO: 498594 - DNA, 16 bp, Homo sapiens
ggctagaatctggaga

SEQ ID NO: 498595 - DNA, 12 bp, Homo sapiens
ggctcagcctgg

SEQ ID NO: 498596 - DNA, 13 bp, Homo sapiens
ggctcagcctggt

SEQ ID NO: 498597 - DNA, 15 bp, Homo sapiens
ggctcagttctgcct

SEQ ID NO: 498598 - DNA, 16 bp, Homo sapiens
ggctcttctccccaga

SEQ ID NO: 498599 - DNA, 16 bp, Homo sapiens
ggctgctctgcctgtg

SEQ ID NO: 498600 - DNA, 12 bp, Homo sapiens
ggctgctgccca

SEQ ID NO: 498601 - DNA, 14 bp, Homo sapiens
ggctgctgcccagg

SEQ ID NO: 498602 - DNA, 22 bp, Homo sapiens
ggctggaacagattcacactgt

SEQ ID NO: 498603 - DNA, 13 bp, Homo sapiens
ggctggaatctgg

SEQ ID NO: 498604 - DNA, 16 bp, Homo sapiens
ggctggaatctggaga

SEQ ID NO: 498605 - DNA, 19 bp, Homo sapiens
ggctgggaactcacctggg

SEQ ID NO: 498606 - DNA, 21 bp, Homo sapiens
ggctggggaagtcctctgggt

SEQ ID NO: 498607 - DNA, 14 bp, Homo sapiens
ggctgggggtgctg

SEQ ID NO: 498608 - DNA, 13 bp, Homo sapiens
ggcttacacccac

SEQ ID NO: 498609 - DNA, 12 bp, Homo sapiens
ggcttcacagat

SEQ ID NO: 498610 - DNA, 17 bp, Homo sapiens
ggcttcccagtggctgc

SEQ ID NO: 498611 - DNA, 19 bp, Homo sapiens
ggcttcccagtggctgctg

SEQ ID NO: 498612 - DNA, 20 bp, Homo sapiens
ggcttcccagtggctgctgc

SEQ ID NO: 498613 - DNA, 22 bp, Homo sapiens
ggcttcccagtggctgctgccc

SEQ ID NO: 498614 - DNA, 13 bp, Homo sapiens
ggcttgcctgcag

SEQ ID NO: 498615 - DNA, 22 bp, Homo sapiens
gggaactcacctggggctgctg

SEQ ID NO: 498616 - DNA, 23 bp, Homo sapiens
gggaactcacctggggctgctgg

SEQ ID NO: 498617 - DNA, 16 bp, Homo sapiens
gggaagaaagagaagg

SEQ ID NO: 498618 - DNA, 20 bp, Homo sapiens
gggaaggagggttagggagg

SEQ ID NO: 498619 - DNA, 17 bp, Homo sapiens
gggaatgcctgagtgcc

SEQ ID NO: 498620 - DNA, 21 bp, Homo sapiens
gggacagtcacctcatggaat

SEQ ID NO: 498621 - DNA, 21 bp, Homo sapiens
gggacgaagaagagccacagt

SEQ ID NO: 498622 - DNA, 11 bp, Homo sapiens
gggactgatgt

SEQ ID NO: 498623 - DNA, 11 bp, Homo sapiens
gggatgaaaga

SEQ ID NO: 498624 - DNA, 20 bp, Homo sapiens
gggatgagcatggagctggc

SEQ ID NO: 498625 - DNA, 12 bp, Homo sapiens
gggatggtgccc

SEQ ID NO: 498626 - DNA, 13 bp, Homo sapiens
gggatggtgccct

SEQ ID NO: 498627 - DNA, 15 bp, Homo sapiens
gggcacaaagggccc

SEQ ID NO: 498628 - DNA, 16 bp, Homo sapiens
gggcacaaagggccca

SEQ ID NO: 498629 - DNA, 17 bp, Homo sapiens
gggcacaaagggcccag

SEQ ID NO: 498630 - DNA, 13 bp, Homo sapiens
gggcacacactgt

SEQ ID NO: 498631 - DNA, 12 bp, Homo sapiens
gggcagagtcac

SEQ ID NO: 498632 - DNA, 16 bp, Homo sapiens
gggcagagtcacacgg

SEQ ID NO: 498633 - DNA, 13 bp, Homo sapiens
gggcagctgcctc

SEQ ID NO: 498634 - DNA, 19 bp, Homo sapiens
gggcagctgcctcccctcc

SEQ ID NO: 498635 - DNA, 20 bp, Homo sapiens
gggcagctgcctcccctcct

SEQ ID NO: 498636 - DNA, 23 bp, Homo sapiens
gggcaggactcagctccccagag

SEQ ID NO: 498637 - DNA, 19 bp, Homo sapiens
gggcagggatgatggcaga

SEQ ID NO: 498638 - DNA, 23 bp, Homo sapiens
gggcagggatgatggcagagcca

SEQ ID NO: 498639 - DNA, 22 bp, Homo sapiens
gggcatagatgcaggtgagccc

SEQ ID NO: 498640 - DNA, 16 bp, Homo sapiens
gggcatggtagctcaa

SEQ ID NO: 498641 - DNA, 13 bp, Homo sapiens
gggccctgagctc

SEQ ID NO: 498642 - DNA, 15 bp, Homo sapiens
gggcctcggagcctc

SEQ ID NO: 498643 - DNA, 20 bp, Homo sapiens
gggcgctcgcttccgcatcc

SEQ ID NO: 498644 - DNA, 16 bp, Homo sapiens
gggctagaacctggca

SEQ ID NO: 498645 - DNA, 11 bp, Homo sapiens
gggctcagcct

SEQ ID NO: 498646 - DNA, 11 bp, Homo sapiens
gggctggaaca

SEQ ID NO: 498647 - DNA, 24 bp, Homo sapiens
gggcttagagcagtttctgtcctg

SEQ ID NO: 498648 - DNA, 13 bp, Homo sapiens
ggggacagggatg

SEQ ID NO: 498649 - DNA, 21 bp, Homo sapiens
ggggatttccagccagggctg

SEQ ID NO: 498650 - DNA, 15 bp, Homo sapiens
ggggcatgcctgtag

SEQ ID NO: 498651 - DNA, 14 bp, Homo sapiens
ggggctagaaccta

SEQ ID NO: 498652 - DNA, 22 bp, Homo sapiens
ggggtaaaattccttagcttag

SEQ ID NO: 498653 - DNA, 22 bp, Homo sapiens
gggtaaaattccttagcttaga

SEQ ID NO: 498654 - DNA, 18 bp, Homo sapiens
gggtctctgctgccgccc

SEQ ID NO: 498655 - DNA, 14 bp, Homo sapiens
gggtgaggataaca

SEQ ID NO: 498656 - DNA, 15 bp, Homo sapiens
ggtaataaacttaga

SEQ ID NO: 498657 - DNA, 19 bp, Homo sapiens
ggtaataagtactgtgtac

SEQ ID NO: 498658 - DNA, 18 bp, Homo sapiens
ggtaccttgaacactggg

SEQ ID NO: 498659 - DNA, 22 bp, Homo sapiens
ggtacttcaaatccttgaagat

SEQ ID NO: 498660 - DNA, 22 bp, Homo sapiens
ggtagacacacatgaagtccaa

SEQ ID NO: 498661 - DNA, 21 bp, Homo sapiens
ggtatgaccttctaggaagct

SEQ ID NO: 498662 - DNA, 13 bp, Homo sapiens
ggtccaagtggct

SEQ ID NO: 498663 - DNA, 22 bp, Homo sapiens
ggtctgaggggcaactgagtct

SEQ ID NO: 498664 - DNA, 22 bp, Homo sapiens
ggtgagcccatggccctcccag

SEQ ID NO: 498665 - DNA, 19 bp, Homo sapiens
ggtgccctgttctctacca

SEQ ID NO: 498666 - DNA, 12 bp, Homo sapiens
ggtggacccagg

SEQ ID NO: 498667 - DNA, 17 bp, Homo sapiens
ggtggcaaggctgtgct

SEQ ID NO: 498668 - DNA, 20 bp, Homo sapiens
ggtggcaaggctgtgctccc

SEQ ID NO: 498669 - DNA, 23 bp, Homo sapiens
ggtggcctctccttgtggcctgg

SEQ ID NO: 498670 - DNA, 20 bp, Homo sapiens
ggtgggcagatcatgggtca

SEQ ID NO: 498671 - DNA, 17 bp, Homo sapiens
ggtgttgacatgtgctt

SEQ ID NO: 498672 - DNA, 16 bp, Homo sapiens
ggttagggaaaacatt

SEQ ID NO: 498673 - DNA, 13 bp, Homo sapiens
ggttagggagggg

SEQ ID NO: 498674 - DNA, 12 bp, Homo sapiens
ggttccactgga

SEQ ID NO: 498675 - DNA, 15 bp, Homo sapiens
ggttccactggagaa

SEQ ID NO: 498676 - DNA, 12 bp, Homo sapiens
ggtttcagaagc

SEQ ID NO: 498677 - DNA, 14 bp, Homo sapiens
ggtttcagaagctg

SEQ ID NO: 498678 - DNA, 13 bp, Homo sapiens
ggtttctgaaaat

SEQ ID NO: 498679 - DNA, 15 bp, Homo sapiens
ggtttgaatataaac

SEQ ID NO: 498680 - DNA, 13 bp, Homo sapiens
gtaaaaataaaat

SEQ ID NO: 498681 - DNA, 22 bp, Homo sapiens
gtaaacccctttagtggcttca

SEQ ID NO: 498682 - DNA, 18 bp, Homo sapiens
gtaaataaattgtttgac

SEQ ID NO: 498683 - DNA, 17 bp, Homo sapiens
gtaaatgcagcgtgaag

SEQ ID NO: 498684 - DNA, 22 bp, Homo sapiens
gtaaatggcttatccagctggt

SEQ ID NO: 498685 - DNA, 17 bp, Homo sapiens
gtaactgggttcaaaaa

SEQ ID NO: 498686 - DNA, 14 bp, Homo sapiens
gtaactgtgtcatg

SEQ ID NO: 498687 - DNA, 12 bp, Homo sapiens
gtaatcccagca

SEQ ID NO: 498688 - DNA, 16 bp, Homo sapiens
gtaatctgatggcttc

SEQ ID NO: 498689 - DNA, 15 bp, Homo sapiens
gtaattggaaaggca

SEQ ID NO: 498690 - DNA, 22 bp, Homo sapiens
gtacagttcagttcctctttgc

SEQ ID NO: 498691 - DNA, 23 bp, Homo sapiens
gtaccgccttgcacactcagaag

SEQ ID NO: 498692 - DNA, 18 bp, Homo sapiens
gtaccttgaacactgggg

SEQ ID NO: 498693 - DNA, 23 bp, Homo sapiens
gtaccttgaacactgggggaggg

SEQ ID NO: 498694 - DNA, 12 bp, Homo sapiens
gtactacaattt

SEQ ID NO: 498695 - DNA, 19 bp, Homo sapiens
gtactggctgatggagtaa

SEQ ID NO: 498696 - DNA, 15 bp, Homo sapiens
gtacttcatgctgtc

SEQ ID NO: 498697 - DNA, 18 bp, Homo sapiens
gtagaaagacagagctgg

SEQ ID NO: 498698 - DNA, 23 bp, Homo sapiens
gtagcagaaaggaaaagattcct

SEQ ID NO: 498699 - DNA, 15 bp, Homo sapiens
gtagcagtagatgca

SEQ ID NO: 498700 - DNA, 14 bp, Homo sapiens
gtaggttgtctaaa

SEQ ID NO: 498701 - DNA, 19 bp, Homo sapiens
gtataactgtgcagagact

SEQ ID NO: 498702 - DNA, 16 bp, Homo sapiens
gtatattcaaaaatta

SEQ ID NO: 498703 - DNA, 20 bp, Homo sapiens
gtatctcggacctttcagct

SEQ ID NO: 498704 - DNA, 14 bp, Homo sapiens
gtatctgaaggaga

SEQ ID NO: 498705 - DNA, 23 bp, Homo sapiens
gtatgtttttgtgtatttgttaa

SEQ ID NO: 498706 - DNA, 18 bp, Homo sapiens
gtattttaaaagaatgat

SEQ ID NO: 498707 - DNA, 20 bp, Homo sapiens
gtattttaaaagaatgatta

SEQ ID NO: 498708 - DNA, 21 bp, Homo sapiens
gtattttgtgttcctctttgc

SEQ ID NO: 498709 - DNA, 15 bp, Homo sapiens
gtcaaacgtgaaaat

SEQ ID NO: 498710 - DNA, 19 bp, Homo sapiens
gtcaagagatcgagaccat

SEQ ID NO: 498711 - DNA, 21 bp, Homo sapiens
gtcagaaaccattgttcagaa

SEQ ID NO: 498712 - DNA, 23 bp, Homo sapiens
gtcagaaaccattgttcagaaga

SEQ ID NO: 498713 - DNA, 17 bp, Homo sapiens
gtcagtgtccaaagcag

SEQ ID NO: 498714 - DNA, 20 bp, Homo sapiens
gtcagtgtccaaagcagggt

SEQ ID NO: 498715 - DNA, 17 bp, Homo sapiens
gtcatcaggagaaaaag

SEQ ID NO: 498716 - DNA, 21 bp, Homo sapiens
gtcatccacacaacaccagga

SEQ ID NO: 498717 - DNA, 23 bp, Homo sapiens
gtcatccacacaacaccaggact

SEQ ID NO: 498718 - DNA, 11 bp, Homo sapiens
gtcatggccaa

SEQ ID NO: 498719 - DNA, 22 bp, Homo sapiens
gtcatggccaaatgttcaatat

SEQ ID NO: 498720 - DNA, 18 bp, Homo sapiens
gtccacgcccaccagcct

SEQ ID NO: 498721 - DNA, 17 bp, Homo sapiens
gtccagggccctgagct

SEQ ID NO: 498722 - DNA, 20 bp, Homo sapiens
gtcccagccagcagttcaga

SEQ ID NO: 498723 - DNA, 18 bp, Homo sapiens
gtcccataggcccagtga

SEQ ID NO: 498724 - DNA, 21 bp, Homo sapiens
gtctaaaaataaaatgcattt

SEQ ID NO: 498725 - DNA, 15 bp, Homo sapiens
gtctaaagtttacag

SEQ ID NO: 498726 - DNA, 23 bp, Homo sapiens
gtctcactgtgggaaggccagct

SEQ ID NO: 498727 - DNA, 15 bp, Homo sapiens
gtctcctctcagccc

SEQ ID NO: 498728 - DNA, 13 bp, Homo sapiens
gtctctaggctgg

SEQ ID NO: 498729 - DNA, 15 bp, Homo sapiens
gtctctaggctgggg

SEQ ID NO: 498730 - DNA, 17 bp, Homo sapiens
gtctctatcattaaagt

SEQ ID NO: 498731 - DNA, 19 bp, Homo sapiens
gtctctatcattaaagttc

SEQ ID NO: 498732 - DNA, 20 bp, Homo sapiens
gtctctatcattaaagttct

SEQ ID NO: 498733 - DNA, 12 bp, Homo sapiens
gtctctgctgcc

SEQ ID NO: 498734 - DNA, 16 bp, Homo sapiens
gtctgatttgtgatga

SEQ ID NO: 498735 - DNA, 14 bp, Homo sapiens
gtctgccagccagc

SEQ ID NO: 498736 - DNA, 15 bp, Homo sapiens
gtctgccagccagca

SEQ ID NO: 498737 - DNA, 17 bp, Homo sapiens
gtctgccagccagcagc

SEQ ID NO: 498738 - DNA, 15 bp, Homo sapiens
gtctggcttcacaga

SEQ ID NO: 498739 - DNA, 18 bp, Homo sapiens
gtctgggtccaggcctgg

SEQ ID NO: 498740 - DNA, 14 bp, Homo sapiens
gtcttatttattat

SEQ ID NO: 498741 - DNA, 12 bp, Homo sapiens
gtcttcagccta

SEQ ID NO: 498742 - DNA, 13 bp, Homo sapiens
gtcttcagcctag

SEQ ID NO: 498743 - DNA, 15 bp, Homo sapiens
gtcttcagcctagcc

SEQ ID NO: 498744 - DNA, 18 bp, Homo sapiens
gtgaagactgggtgagga

SEQ ID NO: 498745 - DNA, 17 bp, Homo sapiens
gtgaagcaccaagctca

SEQ ID NO: 498746 - DNA, 15 bp, Homo sapiens
gtgaatgggaaaaga

SEQ ID NO: 498747 - DNA, 16 bp, Homo sapiens
gtgacaagctcacaga

SEQ ID NO: 498748 - DNA, 20 bp, Homo sapiens
gtgactttggctgcatgcga

SEQ ID NO: 498749 - DNA, 19 bp, Homo sapiens
gtgagacagtccagcctgg

SEQ ID NO: 498750 - DNA, 21 bp, Homo sapiens
gtgaggataacacaagtaaaa

SEQ ID NO: 498751 - DNA, 14 bp, Homo sapiens
gtgatcagcagaga

SEQ ID NO: 498752 - DNA, 13 bp, Homo sapiens
gtgatgcggcaga

SEQ ID NO: 498753 - DNA, 22 bp, Homo sapiens
gtgatgctaaaggttgtattgc

SEQ ID NO: 498754 - DNA, 22 bp, Homo sapiens
gtgattcaattcaacactccct

SEQ ID NO: 498755 - DNA, 19 bp, Homo sapiens
gtgattcctttgaagagga

SEQ ID NO: 498756 - DNA, 23 bp, Homo sapiens
gtgattgacaactgaagagacac

SEQ ID NO: 498757 - DNA, 16 bp, Homo sapiens
gtgattgggacagagg

SEQ ID NO: 498758 - DNA, 13 bp, Homo sapiens
gtgccaacactca

SEQ ID NO: 498759 - DNA, 18 bp, Homo sapiens
gtgccaacactcaagaag

SEQ ID NO: 498760 - DNA, 14 bp, Homo sapiens
gtgcctcattgctt

SEQ ID NO: 498761 - DNA, 22 bp, Homo sapiens
gtgcctgggtggacatggcccc

SEQ ID NO: 498762 - DNA, 17 bp, Homo sapiens
gtgcgggcacaataaat

SEQ ID NO: 498763 - DNA, 18 bp, Homo sapiens
gtgctagtaattggaaag

SEQ ID NO: 498764 - DNA, 16 bp, Homo sapiens
gtgctcatttcaggat

SEQ ID NO: 498765 - DNA, 22 bp, Homo sapiens
gtggaactctcctgctcctcag

SEQ ID NO: 498766 - DNA, 21 bp, Homo sapiens
gtggacaccaggagtccctgg

SEQ ID NO: 498767 - DNA, 17 bp, Homo sapiens
gtggaggagcagtgcag

SEQ ID NO: 498768 - DNA, 16 bp, Homo sapiens
gtggaggagctcagga

SEQ ID NO: 498769 - DNA, 23 bp, Homo sapiens
gtggagggcacattccttgcctg

SEQ ID NO: 498770 - DNA, 12 bp, Homo sapiens
gtggcactgcca

SEQ ID NO: 498771 - DNA, 15 bp, Homo sapiens
gtggcagagcttgga

SEQ ID NO: 498772 - DNA, 22 bp, Homo sapiens
gtggcctctccttgtggcctgg

SEQ ID NO: 498773 - DNA, 23 bp, Homo sapiens
gtggcctctccttgtggcctggg

SEQ ID NO: 498774 - DNA, 12 bp, Homo sapiens
gtggcctgggcc

SEQ ID NO: 498775 - DNA, 17 bp, Homo sapiens
gtggctgctagcacttg

SEQ ID NO: 498776 - DNA, 19 bp, Homo sapiens
gtggctgctagcacttgga

SEQ ID NO: 498777 - DNA, 12 bp, Homo sapiens
gtggctgctgcc

SEQ ID NO: 498778 - DNA, 13 bp, Homo sapiens
gtggctgctgccc

SEQ ID NO: 498779 - DNA, 20 bp, Homo sapiens
gtggcttcattagagcaggc

SEQ ID NO: 498780 - DNA, 23 bp, Homo sapiens
gtgggaacgactgggcactgcca

SEQ ID NO: 498781 - DNA, 23 bp, Homo sapiens
gtgggagcataggaggggtctgg

SEQ ID NO: 498782 - DNA, 15 bp, Homo sapiens
gtgggcactggtggg

SEQ ID NO: 498783 - DNA, 23 bp, Homo sapiens
gtgggcctcctctgtccagggcc

SEQ ID NO: 498784 - DNA, 12 bp, Homo sapiens
gtggtggagcca

SEQ ID NO: 498785 - DNA, 21 bp, Homo sapiens
gtgtaagtagataggccatgg

SEQ ID NO: 498786 - DNA, 19 bp, Homo sapiens
gtgtctgaaccaccctgga

SEQ ID NO: 498787 - DNA, 16 bp, Homo sapiens
gtgttaatcatttcat

SEQ ID NO: 498788 - DNA, 15 bp, Homo sapiens
gtgttgccaggcagg

SEQ ID NO: 498789 - DNA, 23 bp, Homo sapiens
gtgttgccaggcaggcacctggg

SEQ ID NO: 498790 - DNA, 15 bp, Homo sapiens
gtgtttttaactcaa

SEQ ID NO: 498791 - DNA, 23 bp, Homo sapiens
gttagggaaaacattccatcctt

SEQ ID NO: 498792 - DNA, 10 bp, Homo sapiens
gttatttaaa

SEQ ID NO: 498793 - DNA, 11 bp, Homo sapiens
gttatttaaat

SEQ ID NO: 498794 - DNA, 13 bp, Homo sapiens
gttatttgtacag

SEQ ID NO: 498795 - DNA, 14 bp, Homo sapiens
gttatttgtacagt

SEQ ID NO: 498796 - DNA, 19 bp, Homo sapiens
gttcaatatgagtctcaat

SEQ ID NO: 498797 - DNA, 15 bp, Homo sapiens
ccttgcccagggctc

SEQ ID NO: 498798 - DNA, 20 bp, Homo sapiens
ccttgcccagggctcagcct

SEQ ID NO: 498799 - DNA, 22 bp, Homo sapiens
ccttgcccagggctcagcctgg

SEQ ID NO: 498800 - DNA, 14 bp, Homo sapiens
ccttgctctcttca

SEQ ID NO: 498801 - DNA, 21 bp, Homo sapiens
ccttgctctcttcaataaacc

SEQ ID NO: 498802 - DNA, 22 bp, Homo sapiens
ccttggaagttgcatggcatca

SEQ ID NO: 498803 - DNA, 13 bp, Homo sapiens
ccttggctggtgc

SEQ ID NO: 498804 - DNA, 19 bp, Homo sapiens
ccttggggctgatgcagtt

SEQ ID NO: 498805 - DNA, 15 bp, Homo sapiens
cctttcagctgtgaa

SEQ ID NO: 498806 - DNA, 12 bp, Homo sapiens
cctttgaagagg

SEQ ID NO: 498807 - DNA, 18 bp, Homo sapiens
cctttggcaggtgcagcc

SEQ ID NO: 498808 - DNA, 14 bp, Homo sapiens
cgacctcagccttc

SEQ ID NO: 498809 - DNA, 15 bp, Homo sapiens
cgacctcagccttcc

SEQ ID NO: 498810 - DNA, 19 bp, Homo sapiens
cgagcaaagtctaaagttt

SEQ ID NO: 498811 - DNA, 11 bp, Homo sapiens
cgaggccagta

SEQ ID NO: 498812 - DNA, 19 bp, Homo sapiens
cgaggccagtacctttcca

SEQ ID NO: 498813 - DNA, 21 bp, Homo sapiens
cgcacacgcacgcacacacac

SEQ ID NO: 498814 - DNA, 13 bp, Homo sapiens
cgccactgcactc

SEQ ID NO: 498815 - DNA, 14 bp, Homo sapiens
cgcccaccagcctt

SEQ ID NO: 498816 - DNA, 18 bp, Homo sapiens
cgcccaccagccttgctc

SEQ ID NO: 498817 - DNA, 12 bp, Homo sapiens
cgccccacccag

SEQ ID NO: 498818 - DNA, 19 bp, Homo sapiens
cgcccccaccctgagcgcc

SEQ ID NO: 498819 - DNA, 21 bp, Homo sapiens
cgctcgcttccgcatcctagt

SEQ ID NO: 498820 - DNA, 14 bp, Homo sapiens
cggacctttcagct

SEQ ID NO: 498821 - DNA, 14 bp, Homo sapiens
cgggaaagaagagc

SEQ ID NO: 498822 - DNA, 23 bp, Homo sapiens
cgggaaggagggttagggagggg

SEQ ID NO: 498823 - DNA, 19 bp, Homo sapiens
cgggccgacggagccggga

SEQ ID NO: 498824 - DNA, 17 bp, Homo sapiens
cggtgatcagcagagag

SEQ ID NO: 498825 - DNA, 13 bp, Homo sapiens
cggtgctccaggc

SEQ ID NO: 498826 - DNA, 13 bp, Homo sapiens
cggtttcagaagc

SEQ ID NO: 498827 - DNA, 16 bp, Homo sapiens
cgtatggctccacacc

SEQ ID NO: 498828 - DNA, 13 bp, Homo sapiens
cgtcttcagccta

SEQ ID NO: 498829 - DNA, 23 bp, Homo sapiens
cgtgacaacacaaatttgggagg

SEQ ID NO: 498830 - DNA, 17 bp, Homo sapiens
cgtggagcagaatcagt

SEQ ID NO: 498831 - DNA, 14 bp, Homo sapiens
cgtggagctgcctg

SEQ ID NO: 498832 - DNA, 15 bp, Homo sapiens
cgtggagctgcctga

SEQ ID NO: 498833 - DNA, 22 bp, Homo sapiens
cgtggaggagcagtgcaggcac

SEQ ID NO: 498834 - DNA, 23 bp, Homo sapiens
cgtggctagggttccactggaga

SEQ ID NO: 498835 - DNA, 17 bp, Homo sapiens
cgttgatgttggctggg

SEQ ID NO: 498836 - DNA, 18 bp, Homo sapiens
cgttgatgttggctggga

SEQ ID NO: 498837 - DNA, 20 bp, Homo sapiens
ctaaaaataaaatgcattta

SEQ ID NO: 498838 - DNA, 13 bp, Homo sapiens
ctaaaccacaata

SEQ ID NO: 498839 - DNA, 14 bp, Homo sapiens
ctaaagtttacagt

SEQ ID NO: 498840 - DNA, 18 bp, Homo sapiens
ctaaagtttacagtaaat

SEQ ID NO: 498841 - DNA, 15 bp, Homo sapiens
ctaacacacagctcc

SEQ ID NO: 498842 - DNA, 21 bp, Homo sapiens
ctaactctagtttgcagagga

SEQ ID NO: 498843 - DNA, 14 bp, Homo sapiens
ctaagagagaatga

SEQ ID NO: 498844 - DNA, 20 bp, Homo sapiens
ctaaggcacccacaaataaa

SEQ ID NO: 498845 - DNA, 17 bp, Homo sapiens
ctaaggcgtggagctgc

SEQ ID NO: 498846 - DNA, 21 bp, Homo sapiens
ctaaggcgtggagctgcctga

SEQ ID NO: 498847 - DNA, 22 bp, Homo sapiens
ctaaggcgtggagctgcctgat

SEQ ID NO: 498848 - DNA, 15 bp, Homo sapiens
ctaataaaatacata

SEQ ID NO: 498849 - DNA, 18 bp, Homo sapiens
ctaatccaatacctcttg

SEQ ID NO: 498850 - DNA, 16 bp, Homo sapiens
ctaatcctctttttct

SEQ ID NO: 498851 - DNA, 20 bp, Homo sapiens
ctaatttttattaatttgta

SEQ ID NO: 498852 - DNA, 21 bp, Homo sapiens
ctacaaaataaagctgttctc

SEQ ID NO: 498853 - DNA, 16 bp, Homo sapiens
ctacacccttggactt

SEQ ID NO: 498854 - DNA, 16 bp, Homo sapiens
ctacactgacactggt

SEQ ID NO: 498855 - DNA, 17 bp, Homo sapiens
ctacctcactggggtcc

SEQ ID NO: 498856 - DNA, 14 bp, Homo sapiens
ctaccttctttggc

SEQ ID NO: 498857 - DNA, 17 bp, Homo sapiens
ctacgttaccaggcagg

SEQ ID NO: 498858 - DNA, 18 bp, Homo sapiens
ctactacccccacagacc

SEQ ID NO: 498859 - DNA, 18 bp, Homo sapiens
ctactagctctttgagat

SEQ ID NO: 498860 - DNA, 22 bp, Homo sapiens
ctacttctttgctttgcccagc

SEQ ID NO: 498861 - DNA, 14 bp, Homo sapiens
ctagaacctggagg

SEQ ID NO: 498862 - DNA, 22 bp, Homo sapiens
ctagaagggctagaacctggag

SEQ ID NO: 498863 - DNA, 20 bp, Homo sapiens
ctagaatactaataaaatac

SEQ ID NO: 498864 - DNA, 19 bp, Homo sapiens
ctagagaatgttagaggat

SEQ ID NO: 498865 - DNA, 16 bp, Homo sapiens
ctagcacttggagcca

SEQ ID NO: 498866 - DNA, 15 bp, Homo sapiens
ctagccgacctcagc

SEQ ID NO: 498867 - DNA, 19 bp, Homo sapiens
ctagccgacctcagccttc

SEQ ID NO: 498868 - DNA, 19 bp, Homo sapiens
ctaggaaatatttatttta

SEQ ID NO: 498869 - DNA, 22 bp, Homo sapiens
ctaggacgccacccagcaaaag

SEQ ID NO: 498870 - DNA, 20 bp, Homo sapiens
ctaggatgttgctcagaagt

SEQ ID NO: 498871 - DNA, 11 bp, Homo sapiens
ctaggctgggg

SEQ ID NO: 498872 - DNA, 13 bp, Homo sapiens
ctaggctggggaa

SEQ ID NO: 498873 - DNA, 17 bp, Homo sapiens
ctaggtggcaaggctgt

SEQ ID NO: 498874 - DNA, 23 bp, Homo sapiens
ctaggtggcaaggctgtgctccc

SEQ ID NO: 498875 - DNA, 14 bp, Homo sapiens
ctagtaaagacata

SEQ ID NO: 498876 - DNA, 20 bp, Homo sapiens
ctagtatttctatgaaatat

SEQ ID NO: 498877 - DNA, 22 bp, Homo sapiens
ctagtctctatcattaaagttc

SEQ ID NO: 498878 - DNA, 15 bp, Homo sapiens
ctatagtcccagcta

SEQ ID NO: 498879 - DNA, 18 bp, Homo sapiens
ctatattgtttgctaagc

SEQ ID NO: 498880 - DNA, 16 bp, Homo sapiens
ctatcaaactgaagcc

SEQ ID NO: 498881 - DNA, 21 bp, Homo sapiens
ctatcaaactgaagccagaaa

SEQ ID NO: 498882 - DNA, 13 bp, Homo sapiens
ctatcattaaagt

SEQ ID NO: 498883 - DNA, 12 bp, Homo sapiens
ctatctttgcca

SEQ ID NO: 498884 - DNA, 18 bp, Homo sapiens
ctatgaaatattatgtta

SEQ ID NO: 498885 - DNA, 19 bp, Homo sapiens
ctatgaaatattatgttaa

SEQ ID NO: 498886 - DNA, 23 bp, Homo sapiens
ctatggacggtgctccaggcagg

SEQ ID NO: 498887 - DNA, 12 bp, Homo sapiens
ctattgcccagg

SEQ ID NO: 498888 - DNA, 20 bp, Homo sapiens
ctattgtgctttctatctaa

SEQ ID NO: 498889 - DNA, 14 bp, Homo sapiens
ctatttaacttgag

SEQ ID NO: 498890 - DNA, 19 bp, Homo sapiens
ctcaaaacccatctgggct

SEQ ID NO: 498891 - DNA, 12 bp, Homo sapiens
ctcaaacactgc

SEQ ID NO: 498892 - DNA, 19 bp, Homo sapiens
ctcaaaccaaatcactgaa

SEQ ID NO: 498893 - DNA, 16 bp, Homo sapiens
ctcaacataacataag

SEQ ID NO: 498894 - DNA, 18 bp, Homo sapiens
ctcaacataacataagct

SEQ ID NO: 498895 - DNA, 15 bp, Homo sapiens
ctcaagaagcaggct

SEQ ID NO: 498896 - DNA, 23 bp, Homo sapiens
ctcaagaagcaggctacactgac

SEQ ID NO: 498897 - DNA, 18 bp, Homo sapiens
ctcaagatcaatgaaatg

SEQ ID NO: 498898 - DNA, 17 bp, Homo sapiens
ctgctacctcactgggg

SEQ ID NO: 498899 - DNA, 14 bp, Homo sapiens
ctgctagcacttgg

SEQ ID NO: 498900 - DNA, 13 bp, Homo sapiens
ctgctccagcctc

SEQ ID NO: 498901 - DNA, 23 bp, Homo sapiens
ctgctccagcctctgccgctgcc

SEQ ID NO: 498902 - DNA, 22 bp, Homo sapiens
ctgctggtaatttgtatctgaa

SEQ ID NO: 498903 - DNA, 14 bp, Homo sapiens
ctgcttaatgaaaa

SEQ ID NO: 498904 - DNA, 16 bp, Homo sapiens
ctgcttgccatccctc

SEQ ID NO: 498905 - DNA, 22 bp, Homo sapiens
ctgcttgccatccctccctcca

SEQ ID NO: 498906 - DNA, 23 bp, Homo sapiens
ctggaaaagtatgttagtgcaaa

SEQ ID NO: 498907 - DNA, 20 bp, Homo sapiens
ctggaacatcatcaaggcac

SEQ ID NO: 498908 - DNA, 15 bp, Homo sapiens
ctggaaccatcagaa

SEQ ID NO: 498909 - DNA, 15 bp, Homo sapiens
ctggaagggctagaa

SEQ ID NO: 498910 - DNA, 20 bp, Homo sapiens
ctggaaggtggggacaggga

SEQ ID NO: 498911 - DNA, 15 bp, Homo sapiens
ctggaatggagctgt

SEQ ID NO: 498912 - DNA, 22 bp, Homo sapiens
ctggagagctagaacctggaga

SEQ ID NO: 498913 - DNA, 19 bp, Homo sapiens
ctggaggactagaacctgg

SEQ ID NO: 498914 - DNA, 21 bp, Homo sapiens
ctggaggactagaacctggag

SEQ ID NO: 498915 - DNA, 20 bp, Homo sapiens
ctggagggctagaacctaga

SEQ ID NO: 498916 - DNA, 21 bp, Homo sapiens
ctggagggctagaacctggag

SEQ ID NO: 498917 - DNA, 21 bp, Homo sapiens
ctggagggctagaactggaga

SEQ ID NO: 498918 - DNA, 19 bp, Homo sapiens
ctggagggctggaatctgg

SEQ ID NO: 498919 - DNA, 22 bp, Homo sapiens
ctggagtcatgtgcctctgtcc

SEQ ID NO: 498920 - DNA, 14 bp, Homo sapiens
ctggagtccctgtg

SEQ ID NO: 498921 - DNA, 14 bp, Homo sapiens
ctggagtgcagtgg

SEQ ID NO: 498922 - DNA, 20 bp, Homo sapiens
ctggatctccattctctcag

SEQ ID NO: 498923 - DNA, 13 bp, Homo sapiens
ctggattcccagg

SEQ ID NO: 498924 - DNA, 19 bp, Homo sapiens
ctggcaagctagaacctgg

SEQ ID NO: 498925 - DNA, 22 bp, Homo sapiens
ctggccatgtggccctccagtg

SEQ ID NO: 498926 - DNA, 15 bp, Homo sapiens
ctggccgtgggcctg

SEQ ID NO: 498927 - DNA, 22 bp, Homo sapiens
ctggccgttgatgttggctggg

SEQ ID NO: 498928 - DNA, 16 bp, Homo sapiens
ctggcctctctgacat

SEQ ID NO: 498929 - DNA, 19 bp, Homo sapiens
ctggcgtcatgcaaagtca

SEQ ID NO: 498930 - DNA, 14 bp, Homo sapiens
ctggcttcacagat

SEQ ID NO: 498931 - DNA, 20 bp, Homo sapiens
ctgggaactcacctggggct

SEQ ID NO: 498932 - DNA, 14 bp, Homo sapiens
ctgggaccacgtga

SEQ ID NO: 498933 - DNA, 18 bp, Homo sapiens
ctgggacttgcaaaaagg

SEQ ID NO: 498934 - DNA, 14 bp, Homo sapiens
ctgggatgtttctg

SEQ ID NO: 498935 - DNA, 19 bp, Homo sapiens
ctgggatgtttctgtcaca

SEQ ID NO: 498936 - DNA, 17 bp, Homo sapiens
ctgggatttacacttga

SEQ ID NO: 498937 - DNA, 15 bp, Homo sapiens
ctgggcaacagagca

SEQ ID NO: 498938 - DNA, 21 bp, Homo sapiens
ctgggcaaggaggccacgtga

SEQ ID NO: 498939 - DNA, 21 bp, Homo sapiens
ctgggcagctgcctcccctcc

SEQ ID NO: 498940 - DNA, 11 bp, Homo sapiens
ctgggcatggt

SEQ ID NO: 498941 - DNA, 21 bp, Homo sapiens
ctgggctcctaaccttcctgt

SEQ ID NO: 498942 - DNA, 23 bp, Homo sapiens
ctggggcctcggagcctcatccg

SEQ ID NO: 498943 - DNA, 17 bp, Homo sapiens
ctgggggtgctggatgg

SEQ ID NO: 498944 - DNA, 19 bp, Homo sapiens
ctggggtcctggggcctcg

SEQ ID NO: 498945 - DNA, 17 bp, Homo sapiens
ctttgccaccctcatgc

SEQ ID NO: 498946 - DNA, 21 bp, Homo sapiens
ctttgccaccctcatgctgtg

SEQ ID NO: 498947 - DNA, 13 bp, Homo sapiens
ctttggcaggtgc

SEQ ID NO: 498948 - DNA, 21 bp, Homo sapiens
ctttggggcttttacaccagt

SEQ ID NO: 498949 - DNA, 19 bp, Homo sapiens
gaaaaacaaattcatcaaa

SEQ ID NO: 498950 - DNA, 20 bp, Homo sapiens
gaaaatgcaacaacatgtat

SEQ ID NO: 498951 - DNA, 13 bp, Homo sapiens
gaaaattaacact

SEQ ID NO: 498952 - DNA, 18 bp, Homo sapiens
gaaacaccctcacactgg

SEQ ID NO: 498953 - DNA, 13 bp, Homo sapiens
gaaacataaataa

SEQ ID NO: 498954 - DNA, 18 bp, Homo sapiens
gaaacataaataaaatga

SEQ ID NO: 498955 - DNA, 14 bp, Homo sapiens
gaaaccacagctgc

SEQ ID NO: 498956 - DNA, 15 bp, Homo sapiens
gaaaccttgtctcta

SEQ ID NO: 498957 - DNA, 19 bp, Homo sapiens
gaaagaagagccggagcct

SEQ ID NO: 498958 - DNA, 16 bp, Homo sapiens
gaaagacagcttctca

SEQ ID NO: 498959 - DNA, 17 bp, Homo sapiens
gaaagacagcttctcat

SEQ ID NO: 498960 - DNA, 14 bp, Homo sapiens
gaaagagaaatgaa

SEQ ID NO: 498961 - DNA, 15 bp, Homo sapiens
gaaagcacaggtggg

SEQ ID NO: 498962 - DNA, 17 bp, Homo sapiens
gaaaggagaggaaagaa

SEQ ID NO: 498963 - DNA, 18 bp, Homo sapiens
gaaataaagttggtgaca

SEQ ID NO: 498964 - DNA, 13 bp, Homo sapiens
gaaatattatgtt

SEQ ID NO: 498965 - DNA, 18 bp, Homo sapiens
gaaatatttattttaata

SEQ ID NO: 498966 - DNA, 22 bp, Homo sapiens
gaaatatttattttaataatgt

SEQ ID NO: 498967 - DNA, 20 bp, Homo sapiens
gaaatgtaccatcaaatgtt

SEQ ID NO: 498968 - DNA, 14 bp, Homo sapiens
gaaattttctagaa

SEQ ID NO: 498969 - DNA, 21 bp, Homo sapiens
gaacaagttgtttcattgact

SEQ ID NO: 498970 - DNA, 17 bp, Homo sapiens
gaacactgggggagggg

SEQ ID NO: 498971 - DNA, 18 bp, Homo sapiens
gaaccagtgtctgaacca

SEQ ID NO: 498972 - DNA, 14 bp, Homo sapiens
gaacctagaagggc

SEQ ID NO: 498973 - DNA, 15 bp, Homo sapiens
gaacctggagggcta

SEQ ID NO: 498974 - DNA, 15 bp, Homo sapiens
gaacctgggaggcag

SEQ ID NO: 498975 - DNA, 16 bp, Homo sapiens
gaacctgggaggcaga

SEQ ID NO: 498976 - DNA, 17 bp, Homo sapiens
gaactatggacggtgct

SEQ ID NO: 498977 - DNA, 21 bp, Homo sapiens
gaactatggacggtgctccag

SEQ ID NO: 498978 - DNA, 21 bp, Homo sapiens
gaactcacctggggctgctgg

SEQ ID NO: 498979 - DNA, 18 bp, Homo sapiens
gaactcatccctaatgct

SEQ ID NO: 498980 - DNA, 22 bp, Homo sapiens
gaactcatccctaatgctgcag

SEQ ID NO: 498981 - DNA, 16 bp, Homo sapiens
gaactcctaaatcaag

SEQ ID NO: 498982 - DNA, 14 bp, Homo sapiens
gaactttgaaggac

SEQ ID NO: 498983 - DNA, 19 bp, Homo sapiens
gaactttgcatagcagctg

SEQ ID NO: 498984 - DNA, 19 bp, Homo sapiens
gaactttgctgagcctgta

SEQ ID NO: 498985 - DNA, 22 bp, Homo sapiens
gaagaacatctttatggtaaag

SEQ ID NO: 498986 - DNA, 14 bp, Homo sapiens
gaagaagagccaca

SEQ ID NO: 498987 - DNA, 20 bp, Homo sapiens
gaagaatctgtttcccagca

SEQ ID NO: 498988 - DNA, 20 bp, Homo sapiens
gaagacagcagcaagtgtgc

SEQ ID NO: 498989 - DNA, 15 bp, Homo sapiens
gaagaggaaaatgaa

SEQ ID NO: 498990 - DNA, 18 bp, Homo sapiens
gaagaggaaaatgaataa

SEQ ID NO: 498991 - DNA, 21 bp, Homo sapiens
gaagatataactattgcccag

SEQ ID NO: 498992 - DNA, 19 bp, Homo sapiens
gaagatccccaactgctcc

SEQ ID NO: 498993 - DNA, 20 bp, Homo sapiens
gaagatccccaactgctcca

SEQ ID NO: 498994 - DNA, 15 bp, Homo sapiens
gaagcaaacacatta

SEQ ID NO: 498995 - DNA, 17 bp, Homo sapiens
gaagcaaacacattaag

SEQ ID NO: 498996 - DNA, 14 bp, Homo sapiens
gaagcaggctacac

SEQ ID NO: 498997 - DNA, 19 bp, Homo sapiens
gaagcaggctacactgaca

SEQ ID NO: 498998 - DNA, 13 bp, Homo sapiens
gaagcctggaaca

SEQ ID NO: 498999 - DNA, 13 bp, Homo sapiens
gaagcctttggga

SEQ ID NO: 499000 - DNA, 18 bp, Homo sapiens
gaagcctttgggaagggg

SEQ ID NO: 499001 - DNA, 15 bp, Homo sapiens
gaagctgaagatccc

SEQ ID NO: 499002 - DNA, 19 bp, Homo sapiens
gaagctgaagatccccaac

SEQ ID NO: 499003 - DNA, 20 bp, Homo sapiens
gaagctgaagatccccaact

SEQ ID NO: 499004 - DNA, 18 bp, Homo sapiens
gaagctgcagctggtctg

SEQ ID NO: 499005 - DNA, 20 bp, Homo sapiens
gaaggaaaaggcagggagcg

SEQ ID NO: 499006 - DNA, 19 bp, Homo sapiens
gaaggaatgtcagggccag

SEQ ID NO: 499007 - DNA, 13 bp, Homo sapiens
gaaggcaatgcca

SEQ ID NO: 499008 - DNA, 20 bp, Homo sapiens
gaagggattttagtcacacg

SEQ ID NO: 499009 - DNA, 17 bp, Homo sapiens
gaagggtggtggagcca

SEQ ID NO: 499010 - DNA, 12 bp, Homo sapiens
gaagtccaagca

SEQ ID NO: 499011 - DNA, 23 bp, Homo sapiens
gaagtccaagcatttagatgtat

SEQ ID NO: 499012 - DNA, 15 bp, Homo sapiens
gaagtgactttggct

SEQ ID NO: 499013 - DNA, 18 bp, Homo sapiens
gaagttgatatagaacag

SEQ ID NO: 499014 - DNA, 14 bp, Homo sapiens
gaatactaataaaa

SEQ ID NO: 499015 - DNA, 15 bp, Homo sapiens
gaatactaataaaat

SEQ ID NO: 499016 - DNA, 18 bp, Homo sapiens
gaatactaataaaataca

SEQ ID NO: 499017 - DNA, 20 bp, Homo sapiens
gaatcagtattgggagccgg

SEQ ID NO: 499018 - DNA, 20 bp, Homo sapiens
gaatcattgtaaacattagt

SEQ ID NO: 499019 - DNA, 12 bp, Homo sapiens
gaatctttgcaa

SEQ ID NO: 499020 - DNA, 22 bp, Homo sapiens
gaatgagagacacactgaagaa

SEQ ID NO: 499021 - DNA, 22 bp, Homo sapiens
gaatgattatgaattacatttg

SEQ ID NO: 499022 - DNA, 16 bp, Homo sapiens
gaatgcacagtgggtg

SEQ ID NO: 499023 - DNA, 14 bp, Homo sapiens
gaatgcataaaatg

SEQ ID NO: 499024 - DNA, 18 bp, Homo sapiens
gaattctgctacctcact

SEQ ID NO: 499025 - DNA, 19 bp, Homo sapiens
gaattctgctacctcactg

SEQ ID NO: 499026 - DNA, 14 bp, Homo sapiens
gacaaataaagcaa

SEQ ID NO: 499027 - DNA, 18 bp, Homo sapiens
gacaaataaagcaatgaa

SEQ ID NO: 499028 - DNA, 15 bp, Homo sapiens
gacaaatcaaagcag

SEQ ID NO: 499029 - DNA, 13 bp, Homo sapiens
gacaaatgggact

SEQ ID NO: 499030 - DNA, 14 bp, Homo sapiens
gacaaatgggactg

SEQ ID NO: 499031 - DNA, 17 bp, Homo sapiens
gacaaatgggactgatg

SEQ ID NO: 499032 - DNA, 21 bp, Homo sapiens
gacaaatgggactgatgtcat

SEQ ID NO: 499033 - DNA, 19 bp, Homo sapiens
gacaactgaagagacacgt

SEQ ID NO: 499034 - DNA, 19 bp, Homo sapiens
gacaagcaattagacaaga

SEQ ID NO: 499035 - DNA, 19 bp, Homo sapiens
gacaaggaaaggcaaatgc

SEQ ID NO: 499036 - DNA, 20 bp, Homo sapiens
gacacaaacctgcctgggtt

SEQ ID NO: 499037 - DNA, 16 bp, Homo sapiens
gacacactgaagaagc

SEQ ID NO: 499038 - DNA, 15 bp, Homo sapiens
gacacagaacacaga

SEQ ID NO: 499039 - DNA, 17 bp, Homo sapiens
gacacaggatgaaggca

SEQ ID NO: 499040 - DNA, 20 bp, Homo sapiens
gacacaggatgaaggcaatg

SEQ ID NO: 499041 - DNA, 20 bp, Homo sapiens
gacaccaggagtccctggta

SEQ ID NO: 499042 - DNA, 23 bp, Homo sapiens
gacactgaaatatacacacagca

SEQ ID NO: 499043 - DNA, 15 bp, Homo sapiens
gacagcagctcaggc

SEQ ID NO: 499044 - DNA, 21 bp, Homo sapiens
gacagcttctcatcctgcagg

SEQ ID NO: 499045 - DNA, 22 bp, Homo sapiens
gacagcttctcatcctgcaggc

SEQ ID NO: 499046 - DNA, 16 bp, Homo sapiens
gacaggtgtgccgaca

SEQ ID NO: 499047 - DNA, 14 bp, Homo sapiens
gacagtcaccccag

SEQ ID NO: 499048 - DNA, 16 bp, Homo sapiens
gacagtccagcctgga

SEQ ID NO: 499049 - DNA, 16 bp, Homo sapiens
gacagtgcctatactg

SEQ ID NO: 499050 - DNA, 14 bp, Homo sapiens
gacatgctgaagcc

SEQ ID NO: 499051 - DNA, 19 bp, Homo sapiens
gacatgctgaagccaaagc

SEQ ID NO: 499052 - DNA, 14 bp, Homo sapiens
gacatgtggtggga

SEQ ID NO: 499053 - DNA, 13 bp, Homo sapiens
gacattcatgcct

SEQ ID NO: 499054 - DNA, 16 bp, Homo sapiens
gacattcatgcctggc

SEQ ID NO: 499055 - DNA, 18 bp, Homo sapiens
gacattcatgcctggctt

SEQ ID NO: 499056 - DNA, 16 bp, Homo sapiens
gaccaaggagatgaag

SEQ ID NO: 499057 - DNA, 18 bp, Homo sapiens
gaccaaggttccagctca

SEQ ID NO: 499058 - DNA, 15 bp, Homo sapiens
gaccacatagaacat

SEQ ID NO: 499059 - DNA, 21 bp, Homo sapiens
gaccagaaatcaaaaagggaa

SEQ ID NO: 499060 - DNA, 11 bp, Homo sapiens
gaccagcctgg

SEQ ID NO: 499061 - DNA, 13 bp, Homo sapiens
gaccaggcctggg

SEQ ID NO: 499062 - DNA, 14 bp, Homo sapiens
gaccagtctggcca

SEQ ID NO: 499063 - DNA, 19 bp, Homo sapiens
gaccccaatccaacccggg

SEQ ID NO: 499064 - DNA, 14 bp, Homo sapiens
gacccccaactcct

SEQ ID NO: 499065 - DNA, 13 bp, Homo sapiens
gacccctgtctcc

SEQ ID NO: 499066 - DNA, 12 bp, Homo sapiens
gacccctgtctt

SEQ ID NO: 499067 - DNA, 19 bp, Homo sapiens
gacctcagcctgtgctgcc

SEQ ID NO: 499068 - DNA, 20 bp, Homo sapiens
gacctcagccttccccttgc

SEQ ID NO: 499069 - DNA, 12 bp, Homo sapiens
gacctcctgcct

SEQ ID NO: 499070 - DNA, 14 bp, Homo sapiens
gacctcctgcctcc

SEQ ID NO: 499071 - DNA, 12 bp, Homo sapiens
gacctgctctgg

SEQ ID NO: 499072 - DNA, 16 bp, Homo sapiens
gacgaagaagagccac

SEQ ID NO: 499073 - DNA, 18 bp, Homo sapiens
gacgaagaagagccacag

SEQ ID NO: 499074 - DNA, 22 bp, Homo sapiens
gacgtgattcaattcaacactc

SEQ ID NO: 499075 - DNA, 15 bp, Homo sapiens
gactagaacctggag

SEQ ID NO: 499076 - DNA, 16 bp, Homo sapiens
gactagaacctggagg

SEQ ID NO: 499077 - DNA, 14 bp, Homo sapiens
gactcaaaccaaat

SEQ ID NO: 499078 - DNA, 14 bp, Homo sapiens
gactcagctcccca

SEQ ID NO: 499079 - DNA, 18 bp, Homo sapiens
gactcagctccccagagt

SEQ ID NO: 499080 - DNA, 14 bp, Homo sapiens
gactcagggcccca

SEQ ID NO: 499081 - DNA, 15 bp, Homo sapiens
gactcagggccccag

SEQ ID NO: 499082 - DNA, 18 bp, Homo sapiens
gactcagggccccagcac

SEQ ID NO: 499083 - DNA, 17 bp, Homo sapiens
gactcctaggcaggaca

SEQ ID NO: 499084 - DNA, 23 bp, Homo sapiens
gactcctaggcaggacatgctga

SEQ ID NO: 499085 - DNA, 22 bp, Homo sapiens
gactccttgagagaccaggcaa

SEQ ID NO: 499086 - DNA, 14 bp, Homo sapiens
gactcttaagaaga

SEQ ID NO: 499087 - DNA, 15 bp, Homo sapiens
gactgagctggggga

SEQ ID NO: 499088 - DNA, 18 bp, Homo sapiens
tggtggcacacgcctgta

SEQ ID NO: 499089 - DNA, 20 bp, Homo sapiens
tggtggcacacgcctgtagt

SEQ ID NO: 499090 - DNA, 20 bp, Homo sapiens
tggtgttttcttatgcagga

SEQ ID NO: 499091 - DNA, 13 bp, Homo sapiens
tggttaatgccat

SEQ ID NO: 499092 - DNA, 16 bp, Homo sapiens
tggttcccttgatgaa

SEQ ID NO: 499093 - DNA, 20 bp, Homo sapiens
tggttctgatgatgtgcctg

SEQ ID NO: 499094 - DNA, 17 bp, Homo sapiens
tcagagactcagggccc

SEQ ID NO: 499095 - DNA, 19 bp, Homo sapiens
tcagagactcagggcccca

SEQ ID NO: 499096 - DNA, 16 bp, Homo sapiens
tcagagataggcctgt

SEQ ID NO: 499097 - DNA, 14 bp, Homo sapiens
tcagagctgacaca

SEQ ID NO: 499098 - DNA, 15 bp, Homo sapiens
tcagagctgccctct

SEQ ID NO: 499099 - DNA, 17 bp, Homo sapiens
tcagagctgccctctcc

SEQ ID NO: 499100 - DNA, 22 bp, Homo sapiens
tcagagctgccctctcctgggc

SEQ ID NO: 499101 - DNA, 14 bp, Homo sapiens
tcagagggcccaaa

SEQ ID NO: 499102 - DNA, 19 bp, Homo sapiens
tcagcatttccacaccaag

SEQ ID NO: 499103 - DNA, 21 bp, Homo sapiens
tcagccaacgagtaatttatt

SEQ ID NO: 499104 - DNA, 22 bp, Homo sapiens
tcagcccctgatcctgtgaagt

SEQ ID NO: 499105 - DNA, 18 bp, Homo sapiens
tcagcctagccgacctca

SEQ ID NO: 499106 - DNA, 22 bp, Homo sapiens
tcagcctagccgacctcagcct

SEQ ID NO: 499107 - DNA, 14 bp, Homo sapiens
tcagcctggtgggc

SEQ ID NO: 499108 - DNA, 17 bp, Homo sapiens
tcagcctggtgggcctc

SEQ ID NO: 499109 - DNA, 18 bp, Homo sapiens
tcagcctggtgggcctcc

SEQ ID NO: 499110 - DNA, 12 bp, Homo sapiens
tcagcctgtgct

SEQ ID NO: 499111 - DNA, 23 bp, Homo sapiens
tcagccttccccttgcccagggc

SEQ ID NO: 499112 - DNA, 13 bp, Homo sapiens
tcagctccccaga

SEQ ID NO: 499113 - DNA, 15 bp, Homo sapiens
tcagctccccagagt

SEQ ID NO: 499114 - DNA, 13 bp, Homo sapiens
tcaggaaagagaa

SEQ ID NO: 499115 - DNA, 17 bp, Homo sapiens
tcaggaccaaagaacac

SEQ ID NO: 499116 - DNA, 21 bp, Homo sapiens
cagggccctgagctcggtgga

SEQ ID NO: 499117 - DNA, 13 bp, Homo sapiens
cagggcctaggac

SEQ ID NO: 499118 - DNA, 19 bp, Homo sapiens
cagggcctggaagacagag

SEQ ID NO: 499119 - DNA, 20 bp, Homo sapiens
cagggcgagactctgtctca

SEQ ID NO: 499120 - DNA, 12 bp, Homo sapiens
cagggctcagcc

SEQ ID NO: 499121 - DNA, 15 bp, Homo sapiens
cagggctcagcctgg

SEQ ID NO: 499122 - DNA, 15 bp, Homo sapiens
cagggctctgaccag

SEQ ID NO: 499123 - DNA, 18 bp, Homo sapiens
cagggctgctagacggag

SEQ ID NO: 499124 - DNA, 14 bp, Homo sapiens
caggggctgggggt

SEQ ID NO: 499125 - DNA, 16 bp, Homo sapiens
caggggtcaccttgag

SEQ ID NO: 499126 - DNA, 22 bp, Homo sapiens
cagggtccacaggaagtgaaga

SEQ ID NO: 499127 - DNA, 17 bp, Homo sapiens
cagggtctctgctgccg

SEQ ID NO: 499128 - DNA, 18 bp, Homo sapiens
cagggtctctgctgccgc

SEQ ID NO: 499129 - DNA, 19 bp, Homo sapiens
caggtagaacacaaggtca

SEQ ID NO: 499130 - DNA, 20 bp, Homo sapiens
caggtgaagcaccaagctca

SEQ ID NO: 499131 - DNA, 19 bp, Homo sapiens
caggtgggcttcccagtgg

SEQ ID NO: 499132 - DNA, 18 bp, Homo sapiens
caggtgtgccgacagaag

SEQ ID NO: 499133 - DNA, 19 bp, Homo sapiens
caggtgtgccgacagaagg

SEQ ID NO: 499134 - DNA, 15 bp, Homo sapiens
cagtaaataaattgt

SEQ ID NO: 499135 - DNA, 17 bp, Homo sapiens
cagtaaataaattgttt

SEQ ID NO: 499136 - DNA, 19 bp, Homo sapiens
cagtaaataaattgtttga

SEQ ID NO: 499137 - DNA, 19 bp, Homo sapiens
cagtcacctcatggaattg

SEQ ID NO: 499138 - DNA, 22 bp, Homo sapiens
cagtcaggaaagagaacttcca

SEQ ID NO: 499139 - DNA, 24 bp, Homo sapiens
cagtccaaggaaaccacagctgct

SEQ ID NO: 499140 - DNA, 16 bp, Homo sapiens
cagtccagcctggaga

SEQ ID NO: 499141 - DNA, 19 bp, Homo sapiens
cagtctcactgtgggaagg

SEQ ID NO: 499142 - DNA, 20 bp, Homo sapiens
cagtctgactgtttccatca

SEQ ID NO: 499143 - DNA, 17 bp, Homo sapiens
cagtgcttgccacagag

SEQ ID NO: 499144 - DNA, 13 bp, Homo sapiens
cagtggacaccag

SEQ ID NO: 499145 - DNA, 14 bp, Homo sapiens
cagtggctgctgcc

SEQ ID NO: 499146 - DNA, 17 bp, Homo sapiens
cagtggctgctgcccag

SEQ ID NO: 499147 - DNA, 20 bp, Homo sapiens
atggcatattgataataaaa

SEQ ID NO: 499148 - DNA, 21 bp, Homo sapiens
atggcatattgataataaaat

SEQ ID NO: 499149 - DNA, 14 bp, Homo sapiens
atggccaaatgttc

SEQ ID NO: 499150 - DNA, 21 bp, Homo sapiens
atggcctcaagatcaatgaaa

SEQ ID NO: 499151 - DNA, 17 bp, Homo sapiens
atggcctgagaagagag

SEQ ID NO: 499152 - DNA, 13 bp, Homo sapiens
atggctgtgagga

SEQ ID NO: 499153 - DNA, 20 bp, Homo sapiens
ccaagtgcatttttatctgt

SEQ ID NO: 499154 - DNA, 22 bp, Homo sapiens
ccaagtgcatttttatctgtga

SEQ ID NO: 499155 - DNA, 18 bp, Homo sapiens
ccaagtggcagagcttgg

SEQ ID NO: 499156 - DNA, 17 bp, Homo sapiens
ccaatgctgatgtcctc

SEQ ID NO: 499157 - DNA, 11 bp, Homo sapiens
ccaattcttac

SEQ ID NO: 499158 - DNA, 18 bp, Homo sapiens
ccaattcttacaaacatg

SEQ ID NO: 499159 - DNA, 20 bp, Homo sapiens
ccacaagcaggctcaacata

SEQ ID NO: 499160 - DNA, 15 bp, Homo sapiens
ccacacatctgtgga

SEQ ID NO: 499161 - DNA, 14 bp, Homo sapiens
ccacaccaagcagc

SEQ ID NO: 499162 - DNA, 21 bp, Homo sapiens
ccacagaagacttcccagctt

SEQ ID NO: 499163 - DNA, 12 bp, Homo sapiens
ccacagctgctg

SEQ ID NO: 499164 - DNA, 13 bp, Homo sapiens
ccacagctgctgg

SEQ ID NO: 499165 - DNA, 17 bp, Homo sapiens
ccacaggaagtgaagaa

SEQ ID NO: 499166 - DNA, 24 bp, Homo sapiens
ccacaggggctatcccttctcaga

SEQ ID NO: 499167 - DNA, 15 bp, Homo sapiens
ccaccaccagaaagc

SEQ ID NO: 499168 - DNA, 13 bp, Homo sapiens
ccaccaccctgag

SEQ ID NO: 499169 - DNA, 12 bp, Homo sapiens
ccaccagccttg

SEQ ID NO: 499170 - DNA, 15 bp, Homo sapiens
ccaccagccttgctc

SEQ ID NO: 499171 - DNA, 21 bp, Homo sapiens
ccaccagccttgctctcttca

SEQ ID NO: 499172 - DNA, 15 bp, Homo sapiens
ccacccaatgctgat

SEQ ID NO: 499173 - DNA, 15 bp, Homo sapiens
ccacctccctgcaat

SEQ ID NO: 499174 - DNA, 19 bp, Homo sapiens
ccacctccctgcaataaaa

SEQ ID NO: 499175 - DNA, 16 bp, Homo sapiens
ccacgcccaccagcct

SEQ ID NO: 499176 - DNA, 19 bp, Homo sapiens
ccacgcccaccagccttgc

SEQ ID NO: 499177 - DNA, 22 bp, Homo sapiens
cctttgacctgcctcccttcat

SEQ ID NO: 499178 - DNA, 19 bp, Homo sapiens
cctttggcaggtgcagccc

SEQ ID NO: 499179 - DNA, 20 bp, Homo sapiens
cctttggcaggtgcagcccc

SEQ ID NO: 499180 - DNA, 19 bp, Homo sapiens
ccttttggccgggcatggt

SEQ ID NO: 499181 - DNA, 17 bp, Homo sapiens
cctttttcccaataaat

SEQ ID NO: 499182 - DNA, 21 bp, Homo sapiens
cgaatcactcatttatttcca

SEQ ID NO: 499183 - DNA, 21 bp, Homo sapiens
cgagaattgcttgaacccggg

SEQ ID NO: 499184 - DNA, 17 bp, Homo sapiens
cttcccagtggctgctg

SEQ ID NO: 499185 - DNA, 15 bp, Homo sapiens
cttcccatgacccag

SEQ ID NO: 499186 - DNA, 18 bp, Homo sapiens
cttccctatctttgccac

SEQ ID NO: 499187 - DNA, 22 bp, Homo sapiens
cttccctatctttgccaccctc

SEQ ID NO: 499188 - DNA, 18 bp, Homo sapiens
cttccgcatcctagtctc

SEQ ID NO: 499189 - DNA, 17 bp, Homo sapiens
cttcctccgaggccagt

SEQ ID NO: 499190 - DNA, 20 bp, Homo sapiens
cttcgaaagcatcattattt

SEQ ID NO: 499191 - DNA, 13 bp, Homo sapiens
cttctagaaccag

SEQ ID NO: 499192 - DNA, 16 bp, Homo sapiens
cttctcatcctgcagg

SEQ ID NO: 499193 - DNA, 13 bp, Homo sapiens
cttctccagggtc

SEQ ID NO: 499194 - DNA, 19 bp, Homo sapiens
cttctccagggtccacagg

SEQ ID NO: 499195 - DNA, 18 bp, Homo sapiens
cttctggtgccagatcct

SEQ ID NO: 499196 - DNA, 20 bp, Homo sapiens
cttctgttttataattttgt

SEQ ID NO: 499197 - DNA, 16 bp, Homo sapiens
cttcttggtcttattt

SEQ ID NO: 499198 - DNA, 19 bp, Homo sapiens
cttctttccacagaagctc

SEQ ID NO: 499199 - DNA, 13 bp, Homo sapiens
cttgaacactggg

SEQ ID NO: 499200 - DNA, 16 bp, Homo sapiens
cttgaacactggggga

SEQ ID NO: 499201 - DNA, 16 bp, Homo sapiens
cttgagagaccaggca

SEQ ID NO: 499202 - DNA, 24 bp, Homo sapiens
cttgaggcttagctttgctctgcc

SEQ ID NO: 499203 - DNA, 12 bp, Homo sapiens
cttgatgaagaa

SEQ ID NO: 499204 - DNA, 14 bp, Homo sapiens
cttgcaagaatcag

SEQ ID NO: 499205 - DNA, 23 bp, Homo sapiens
cttgcagcaggatctagaggggg

SEQ ID NO: 499206 - DNA, 15 bp, Homo sapiens
cttgccatccctccc

SEQ ID NO: 499207 - DNA, 17 bp, Homo sapiens
cttgccatccctccctc

SEQ ID NO: 499208 - DNA, 19 bp, Homo sapiens
cttgccatccctccctcca

SEQ ID NO: 499209 - DNA, 15 bp, Homo sapiens
cttgcccagggctca

SEQ ID NO: 499210 - DNA, 21 bp, Homo sapiens
cttgcccagggctcagcctgg

SEQ ID NO: 499211 - DNA, 16 bp, Homo sapiens
cttgcctgcacaaact

SEQ ID NO: 499212 - DNA, 13 bp, Homo sapiens
cttgctctcttca

SEQ ID NO: 499213 - DNA, 15 bp, Homo sapiens
cttgctctcttcaat

SEQ ID NO: 499214 - DNA, 16 bp, Homo sapiens
cttgctgtatatgcag

SEQ ID NO: 499215 - DNA, 15 bp, Homo sapiens
cttggatgtatatgt

SEQ ID NO: 499216 - DNA, 23 bp, Homo sapiens
cttggcacatttaagagacagtc

SEQ ID NO: 499217 - DNA, 16 bp, Homo sapiens
cttggcatcagctggc

SEQ ID NO: 499218 - DNA, 17 bp, Homo sapiens
cttggcatcagctggcg

SEQ ID NO: 499219 - DNA, 17 bp, Homo sapiens
cttggctacacagggat

SEQ ID NO: 499220 - DNA, 18 bp, Homo sapiens
cttggggctgatgcagtt

SEQ ID NO: 499221 - DNA, 17 bp, Homo sapiens
cttggtagtttggaaag

SEQ ID NO: 499222 - DNA, 15 bp, Homo sapiens
cttggtcttatttat

SEQ ID NO: 499223 - DNA, 14 bp, Homo sapiens
cttggttggctggc

SEQ ID NO: 499224 - DNA, 15 bp, Homo sapiens
cttgtcatccacaca

SEQ ID NO: 499225 - DNA, 21 bp, Homo sapiens
cttgtcatccacacaacacca

SEQ ID NO: 499226 - DNA, 15 bp, Homo sapiens
ctttaacagctttct

SEQ ID NO: 499227 - DNA, 13 bp, Homo sapiens
ctttagaatatta

SEQ ID NO: 499228 - DNA, 16 bp, Homo sapiens
ctttagaatattaaaa

SEQ ID NO: 499229 - DNA, 20 bp, Homo sapiens
ctttagtgatcacagcagct

SEQ ID NO: 499230 - DNA, 22 bp, Homo sapiens
ctttcaatggtttgcaaggaag

SEQ ID NO: 499231 - DNA, 13 bp, Homo sapiens
ctttcagctgtga

SEQ ID NO: 499232 - DNA, 13 bp, Homo sapiens
ctttctctttggt

SEQ ID NO: 499233 - DNA, 22 bp, Homo sapiens
ctttcttacaaggaaggtggtg

SEQ ID NO: 499234 - DNA, 14 bp, Homo sapiens
ctttgaagaggaaa

SEQ ID NO: 499235 - DNA, 22 bp, Homo sapiens
ctttgaagaggaaaatgaataa

SEQ ID NO: 499236 - DNA, 18 bp, Homo sapiens
ctttgacctgcctccctt

SEQ ID NO: 499237 - DNA, 20 bp, Homo sapiens
ctttgagataatacattccg

SEQ ID NO: 499238 - DNA, 16 bp, Homo sapiens
ctttggctgcatgcga

SEQ ID NO: 499239 - DNA, 13 bp, Homo sapiens
ctttgggaagggg

SEQ ID NO: 499240 - DNA, 16 bp, Homo sapiens
ctttgtttttaaatga

SEQ ID NO: 499241 - DNA, 18 bp, Homo sapiens
ctttttgaaatcagcata

SEQ ID NO: 499242 - DNA, 14 bp, Homo sapiens
gaaaaacatgtcat

SEQ ID NO: 499243 - DNA, 17 bp, Homo sapiens
gaaaaacatgtcatgta

SEQ ID NO: 499244 - DNA, 21 bp, Homo sapiens
gaaaacttctcttctgagcct

SEQ ID NO: 499245 - DNA, 21 bp, Homo sapiens
gaaaagagatggcctgagaag

SEQ ID NO: 499246 - DNA, 20 bp, Homo sapiens
gaaaaggactcttgagccct

SEQ ID NO: 499247 - DNA, 20 bp, Homo sapiens
gaaaagtatgttagtgcaaa

SEQ ID NO: 499248 - DNA, 23 bp, Homo sapiens
gaaaataaatcaatgctataact

SEQ ID NO: 499249 - DNA, 12 bp, Homo sapiens
gaaaatgaataa

SEQ ID NO: 499250 - DNA, 18 bp, Homo sapiens
ctcctgggcagctgcctc

SEQ ID NO: 499251 - DNA, 19 bp, Homo sapiens
ctcctgtctgccagccagc

SEQ ID NO: 499252 - DNA, 23 bp, Homo sapiens
ctcctgtctgccagccagcagcc

SEQ ID NO: 499253 - DNA, 17 bp, Homo sapiens
ctccttaacactgagct

SEQ ID NO: 499254 - DNA, 16 bp, Homo sapiens
ctccttgtggcctggg

SEQ ID NO: 499255 - DNA, 18 bp, Homo sapiens
ctccttgtggcctgggcc

SEQ ID NO: 499256 - DNA, 20 bp, Homo sapiens
ctccttgtggcctgggcctc

SEQ ID NO: 499257 - DNA, 15 bp, Homo sapiens
ctcgaaaagagcact

SEQ ID NO: 499258 - DNA, 12 bp, Homo sapiens
ctcggagcctca

SEQ ID NO: 499259 - DNA, 16 bp, Homo sapiens
ctcggagcctcatccg

SEQ ID NO: 499260 - DNA, 22 bp, Homo sapiens
ctctagcctggcaacagagcga

SEQ ID NO: 499261 - DNA, 17 bp, Homo sapiens
ctctaggaaatatttat

SEQ ID NO: 499262 - DNA, 13 bp, Homo sapiens
ctctatcattaaa

SEQ ID NO: 499263 - DNA, 14 bp, Homo sapiens
ctctcacattactg

SEQ ID NO: 499264 - DNA, 23 bp, Homo sapiens
ctctcagccaacgagtaatttat

SEQ ID NO: 499265 - DNA, 21 bp, Homo sapiens
ctctcagcccctgatcctgtg

SEQ ID NO: 499266 - DNA, 15 bp, Homo sapiens
ctctccccatgatgt

SEQ ID NO: 499267 - DNA, 16 bp, Homo sapiens
ctctccccatgatgtt

SEQ ID NO: 499268 - DNA, 15 bp, Homo sapiens
ctctcctctgcctca

SEQ ID NO: 499269 - DNA, 17 bp, Homo sapiens
ctctcctgctcctcagg

SEQ ID NO: 499270 - DNA, 15 bp, Homo sapiens
ctctcctgggcagct

SEQ ID NO: 499271 - DNA, 15 bp, Homo sapiens
ctctctgacatatgc

SEQ ID NO: 499272 - DNA, 20 bp, Homo sapiens
ctctcttaggagcagagctc

SEQ ID NO: 499273 - DNA, 17 bp, Homo sapiens
ctctcttcaataaacca

SEQ ID NO: 499274 - DNA, 22 bp, Homo sapiens
ctctgagggtgatggggctgag

SEQ ID NO: 499275 - DNA, 19 bp, Homo sapiens
ctctgccgctgccatgctt

SEQ ID NO: 499276 - DNA, 21 bp, Homo sapiens
ctctgctgccgccccacccag

SEQ ID NO: 499277 - DNA, 23 bp, Homo sapiens
ctctggatgcctgattgccaagc

SEQ ID NO: 499278 - DNA, 22 bp, Homo sapiens
ctctgtcccacttggcatcagc

SEQ ID NO: 499279 - DNA, 13 bp, Homo sapiens
ctcttaagaagac

SEQ ID NO: 499280 - DNA, 22 bp, Homo sapiens
ctcttagatgcagttctgaaga

SEQ ID NO: 499281 - DNA, 14 bp, Homo sapiens
ctcttcaataaacc

SEQ ID NO: 499282 - DNA, 16 bp, Homo sapiens
ctcttcaataaaccac

SEQ ID NO: 499283 - DNA, 18 bp, Homo sapiens
ctcttcaataaaccacaa

SEQ ID NO: 499284 - DNA, 23 bp, Homo sapiens
ctcttctactacccccacagacc

SEQ ID NO: 499285 - DNA, 16 bp, Homo sapiens
ctcttctccccagagt

SEQ ID NO: 499286 - DNA, 20 bp, Homo sapiens
ctcttgagccctcctggaat

SEQ ID NO: 499287 - DNA, 22 bp, Homo sapiens
ctctttatatggcctcaagatc

SEQ ID NO: 499288 - DNA, 17 bp, Homo sapiens
ctgaaaattaacactgc

SEQ ID NO: 499289 - DNA, 15 bp, Homo sapiens
ctgaaccaccctgga

SEQ ID NO: 499290 - DNA, 12 bp, Homo sapiens
ctgaactttgct

SEQ ID NO: 499291 - DNA, 13 bp, Homo sapiens
ctgaactttgctg

SEQ ID NO: 499292 - DNA, 14 bp, Homo sapiens
ctgaactttgctga

SEQ ID NO: 499293 - DNA, 14 bp, Homo sapiens
ctgaagatccccaa

SEQ ID NO: 499294 - DNA, 18 bp, Homo sapiens
ctgaagatccccaactgc

SEQ ID NO: 499295 - DNA, 19 bp, Homo sapiens
ctgaagatccccaactgct

SEQ ID NO: 499296 - DNA, 20 bp, Homo sapiens
ctgaagatccccaactgctc

SEQ ID NO: 499297 - DNA, 22 bp, Homo sapiens
ctgaagatgcagcaaaatgtga

SEQ ID NO: 499298 - DNA, 12 bp, Homo sapiens
ctgaaggagatt

SEQ ID NO: 499299 - DNA, 18 bp, Homo sapiens
ctgacacaggatgaaggc

SEQ ID NO: 499300 - DNA, 23 bp, Homo sapiens
ctgaccagtttaacctgatgcag

SEQ ID NO: 499301 - DNA, 20 bp, Homo sapiens
ctgactgtctcccgggacta

SEQ ID NO: 499302 - DNA, 11 bp, Homo sapiens
ctgagaacact

SEQ ID NO: 499303 - DNA, 17 bp, Homo sapiens
ctgagaacactgtgaaa

SEQ ID NO: 499304 - DNA, 21 bp, Homo sapiens
ctgagactctcttaggagcag

SEQ ID NO: 499305 - DNA, 18 bp, Homo sapiens
ctgagctcggtggaccca

SEQ ID NO: 499306 - DNA, 20 bp, Homo sapiens
ctgagctcggtggacccagg

SEQ ID NO: 499307 - DNA, 14 bp, Homo sapiens
ctgaggcagacagc

SEQ ID NO: 499308 - DNA, 17 bp, Homo sapiens
ctgaggcagacagcagc

SEQ ID NO: 499309 - DNA, 22 bp, Homo sapiens
ctgaggcagacagcagctcagg

SEQ ID NO: 499310 - DNA, 21 bp, Homo sapiens
ctgagtctgctatattttcat

SEQ ID NO: 499311 - DNA, 22 bp, Homo sapiens
ctgagtctgctatattttcatg

SEQ ID NO: 499312 - DNA, 17 bp, Homo sapiens
ctgagttcaagggctgt

SEQ ID NO: 499313 - DNA, 23 bp, Homo sapiens
ctgatcctgtgaagtaaggatgt

SEQ ID NO: 499314 - DNA, 20 bp, Homo sapiens
ctgatgatttcttgaaaagg

SEQ ID NO: 499315 - DNA, 19 bp, Homo sapiens
ctgatggcaggatggcctg

SEQ ID NO: 499316 - DNA, 18 bp, Homo sapiens
ctgatggcttctccaggg

SEQ ID NO: 499317 - DNA, 18 bp, Homo sapiens
ctgatgttttgtattttg

SEQ ID NO: 499318 - DNA, 20 bp, Homo sapiens
ctgattctcagggtctctgc

SEQ ID NO: 499319 - DNA, 18 bp, Homo sapiens
ctgcaacttgtaaatgtg

SEQ ID NO: 499320 - DNA, 19 bp, Homo sapiens
ctgcaacttgtaaatgtgg

SEQ ID NO: 499321 - DNA, 15 bp, Homo sapiens
ctgcaataaaatggg

SEQ ID NO: 499322 - DNA, 18 bp, Homo sapiens
ctgcaatgtgggcagaga

SEQ ID NO: 499323 - DNA, 20 bp, Homo sapiens
ctgcactccaatctgggtga

SEQ ID NO: 499324 - DNA, 20 bp, Homo sapiens
ctgcagatttgggctggaac

SEQ ID NO: 499325 - DNA, 13 bp, Homo sapiens
ctgccagccagca

SEQ ID NO: 499326 - DNA, 20 bp, Homo sapiens
ctgccagccagcagccagct

SEQ ID NO: 499327 - DNA, 14 bp, Homo sapiens
ctgccatgctttga

SEQ ID NO: 499328 - DNA, 21 bp, Homo sapiens
ctgcccaattttgcagggagc

SEQ ID NO: 499329 - DNA, 20 bp, Homo sapiens
ctgcccacctccttccagca

SEQ ID NO: 499330 - DNA, 16 bp, Homo sapiens
ctgcccgtcttcagcc

SEQ ID NO: 499331 - DNA, 16 bp, Homo sapiens
ctgccctactcactct

SEQ ID NO: 499332 - DNA, 19 bp, Homo sapiens
ctgccctagagcacactgt

SEQ ID NO: 499333 - DNA, 21 bp, Homo sapiens
ctgccctagagcacactgtag

SEQ ID NO: 499334 - DNA, 13 bp, Homo sapiens
ctgccctctcctg

SEQ ID NO: 499335 - DNA, 15 bp, Homo sapiens
ctgccctctcctggg

SEQ ID NO: 499336 - DNA, 21 bp, Homo sapiens
ctgccctctcctgggcagctg

SEQ ID NO: 499337 - DNA, 16 bp, Homo sapiens
ctgccgccccacccag

SEQ ID NO: 499338 - DNA, 16 bp, Homo sapiens
ctgccgctgccatgct

SEQ ID NO: 499339 - DNA, 17 bp, Homo sapiens
ctgcctcccctcctctg

SEQ ID NO: 499340 - DNA, 18 bp, Homo sapiens
gaagacagagacctcctg

SEQ ID NO: 499341 - DNA, 21 bp, Homo sapiens
gaagacagagacctcctgcct

SEQ ID NO: 499342 - DNA, 22 bp, Homo sapiens
gaagacctggcaaggacacaga

SEQ ID NO: 499343 - DNA, 17 bp, Homo sapiens
gaagactgcattatatt

SEQ ID NO: 499344 - DNA, 19 bp, Homo sapiens
gaagactgcattatattta

SEQ ID NO: 499345 - DNA, 13 bp, Homo sapiens
gaagactgtggct

SEQ ID NO: 499346 - DNA, 19 bp, Homo sapiens
gaagagagatcaaatggaa

SEQ ID NO: 499347 - DNA, 21 bp, Homo sapiens
gaagagagtccatatttcaat

SEQ ID NO: 499348 - DNA, 12 bp, Homo sapiens
gaagagccacag

SEQ ID NO: 499349 - DNA, 14 bp, Homo sapiens
gaagaggaaaatga

SEQ ID NO: 499350 - DNA, 16 bp, Homo sapiens
gaagagtctggaggga

SEQ ID NO: 499351 - DNA, 22 bp, Homo sapiens
gaagatataactattgcccagg

SEQ ID NO: 499352 - DNA, 21 bp, Homo sapiens
gaagatgcagcaaaatgtgaa

SEQ ID NO: 499353 - DNA, 14 bp, Homo sapiens
gaagcaaaattttt

SEQ ID NO: 499354 - DNA, 13 bp, Homo sapiens
gaagcaaacacat

SEQ ID NO: 499355 - DNA, 18 bp, Homo sapiens
gaagcaggctacactgac

SEQ ID NO: 499356 - DNA, 23 bp, Homo sapiens
gaagcaggctacactgacactgg

SEQ ID NO: 499357 - DNA, 21 bp, Homo sapiens
gaagccttggggctgatgcag

SEQ ID NO: 499358 - DNA, 19 bp, Homo sapiens
gaagctactttgtttttaa

SEQ ID NO: 499359 - DNA, 22 bp, Homo sapiens
gaagctgaagatccccaactgc

SEQ ID NO: 499360 - DNA, 14 bp, Homo sapiens
gaagctttctgtct

SEQ ID NO: 499361 - DNA, 24 bp, Homo sapiens
gaaggcactaaaaagagctgtcct

SEQ ID NO: 499362 - DNA, 20 bp, Homo sapiens
gaagggctagaacctggagg

SEQ ID NO: 499363 - DNA, 22 bp, Homo sapiens
gaataaaattgtaaaattgtat

SEQ ID NO: 499364 - DNA, 20 bp, Homo sapiens
gaatactaataaaatacata

SEQ ID NO: 499365 - DNA, 23 bp, Homo sapiens
gaatactaataaaatacatacta

SEQ ID NO: 499366 - DNA, 16 bp, Homo sapiens
gaatattaaaaattaa

SEQ ID NO: 499367 - DNA, 16 bp, Homo sapiens
gaatcactcatttatt

SEQ ID NO: 499368 - DNA, 17 bp, Homo sapiens
gaatccactcccaggca

SEQ ID NO: 499369 - DNA, 15 bp, Homo sapiens
gaatcggaatctctg

SEQ ID NO: 499370 - DNA, 14 bp, Homo sapiens
gaatgattatgaat

SEQ ID NO: 499371 - DNA, 22 bp, Homo sapiens
gaatgcttataggtggcctctc

SEQ ID NO: 499372 - DNA, 13 bp, Homo sapiens
gaattacatttgt

SEQ ID NO: 499373 - DNA, 11 bp, Homo sapiens
gaattagtttt

SEQ ID NO: 499374 - DNA, 16 bp, Homo sapiens
gaattggagctcgtgg

SEQ ID NO: 499375 - DNA, 22 bp, Homo sapiens
gaatttgtaagtttatgtctaa

SEQ ID NO: 499376 - DNA, 13 bp, Homo sapiens
gacaaataaagca

SEQ ID NO: 499377 - DNA, 16 bp, Homo sapiens
gacaaatgggactgat

SEQ ID NO: 499378 - DNA, 20 bp, Homo sapiens
gacaaatgggactgatgtca

SEQ ID NO: 499379 - DNA, 16 bp, Homo sapiens
gacaactgaagagaca

SEQ ID NO: 499380 - DNA, 14 bp, Homo sapiens
gacacaaacctgcc

SEQ ID NO: 499381 - DNA, 14 bp, Homo sapiens
gacacaacaactcc

SEQ ID NO: 499382 - DNA, 12 bp, Homo sapiens
gacacacatgaa

SEQ ID NO: 499383 - DNA, 22 bp, Homo sapiens
gacacaccccaacatgcctgca

SEQ ID NO: 499384 - DNA, 19 bp, Homo sapiens
gacaccaggagtccctggt

SEQ ID NO: 499385 - DNA, 22 bp, Homo sapiens
gacactgcacagaagacagcag

SEQ ID NO: 499386 - DNA, 19 bp, Homo sapiens
gacactggtattcctgcct

SEQ ID NO: 499387 - DNA, 13 bp, Homo sapiens
gacagaacactgt

SEQ ID NO: 499388 - DNA, 15 bp, Homo sapiens
gacagaacactgtct

SEQ ID NO: 499389 - DNA, 17 bp, Homo sapiens
gacagagcgcccctccc

SEQ ID NO: 499390 - DNA, 21 bp, Homo sapiens
gacagatctctgctttggaaa

SEQ ID NO: 499391 - DNA, 18 bp, Homo sapiens
gacagcagctcaggcaca

SEQ ID NO: 499392 - DNA, 20 bp, Homo sapiens
gacagcagctcaggcacact

SEQ ID NO: 499393 - DNA, 13 bp, Homo sapiens
gacagctgttcca

SEQ ID NO: 499394 - DNA, 18 bp, Homo sapiens
gacagctgttccacaggg

SEQ ID NO: 499395 - DNA, 13 bp, Homo sapiens
gacaggacctgac

SEQ ID NO: 499396 - DNA, 15 bp, Homo sapiens
gacaggacctgacta

SEQ ID NO: 499397 - DNA, 14 bp, Homo sapiens
gacagggatgagca

SEQ ID NO: 499398 - DNA, 21 bp, Homo sapiens
gacagggatgagcatggagct

SEQ ID NO: 499399 - DNA, 18 bp, Homo sapiens
gacagtcacctcatggaa

SEQ ID NO: 499400 - DNA, 15 bp, Homo sapiens
gacagtccagcctgg

SEQ ID NO: 499401 - DNA, 17 bp, Homo sapiens
gacagtccagcctggag

SEQ ID NO: 499402 - DNA, 19 bp, Homo sapiens
gacagtccagcctggagat

SEQ ID NO: 499403 - DNA, 18 bp, Homo sapiens
gacatcagcatcacctag

SEQ ID NO: 499404 - DNA, 20 bp, Homo sapiens
gacatcctcaaaagaaagag

SEQ ID NO: 499405 - DNA, 19 bp, Homo sapiens
gacatgagtgcgtgctcag

SEQ ID NO: 499406 - DNA, 15 bp, Homo sapiens
gacatgctgaagcca

SEQ ID NO: 499407 - DNA, 16 bp, Homo sapiens
gacatgggacatttgc

SEQ ID NO: 499408 - DNA, 22 bp, Homo sapiens
gacatgtggtgggacagggacc

SEQ ID NO: 499409 - DNA, 16 bp, Homo sapiens
gacatttgctcatgga

SEQ ID NO: 499410 - DNA, 17 bp, Homo sapiens
gacatttgctcatggaa

SEQ ID NO: 499411 - DNA, 16 bp, Homo sapiens
gaccaccacctcagag

SEQ ID NO: 499412 - DNA, 22 bp, Homo sapiens
gaccagcttttcccaaaagccc

SEQ ID NO: 499413 - DNA, 15 bp, Homo sapiens
gacccaggctgggca

SEQ ID NO: 499414 - DNA, 20 bp, Homo sapiens
gacccattctacacagagca

SEQ ID NO: 499415 - DNA, 20 bp, Homo sapiens
gaccccccaccaccagccgg

SEQ ID NO: 499416 - DNA, 10 bp, Homo sapiens
gacctcagcc

SEQ ID NO: 499417 - DNA, 11 bp, Homo sapiens
gacctcagcct

SEQ ID NO: 499418 - DNA, 12 bp, Homo sapiens
gacctcagcctg

SEQ ID NO: 499419 - DNA, 13 bp, Homo sapiens
gacctcagcctgt

SEQ ID NO: 499420 - DNA, 14 bp, Homo sapiens
gacctcagcctgtg

SEQ ID NO: 499421 - DNA, 16 bp, Homo sapiens
gacctccctgtgagag

SEQ ID NO: 499422 - DNA, 18 bp, Homo sapiens
gacctggcaaggacacag

SEQ ID NO: 499423 - DNA, 12 bp, Homo sapiens
gacgccacccag

SEQ ID NO: 499424 - DNA, 23 bp, Homo sapiens
gacggataggcaggaacatacag

SEQ ID NO: 499425 - DNA, 21 bp, Homo sapiens
gactaattcctgccctgccca

SEQ ID NO: 499426 - DNA, 20 bp, Homo sapiens
gactagaacctggagggctg

SEQ ID NO: 499427 - DNA, 13 bp, Homo sapiens
gactatcagccca

SEQ ID NO: 499428 - DNA, 17 bp, Homo sapiens
gactcagctccccagag

SEQ ID NO: 499429 - DNA, 20 bp, Homo sapiens
gactcagctccccagagtcc

SEQ ID NO: 499430 - DNA, 14 bp, Homo sapiens
gactcctgtggaga

SEQ ID NO: 499431 - DNA, 22 bp, Homo sapiens
gactcctgtggagatgacttgg

SEQ ID NO: 499432 - DNA, 21 bp, Homo sapiens
gactcttaagaagactgcatt

SEQ ID NO: 499433 - DNA, 22 bp, Homo sapiens
gactcttgagccctcctggaat

SEQ ID NO: 499434 - DNA, 14 bp, Homo sapiens
gactgaatttctat

SEQ ID NO: 499435 - DNA, 21 bp, Homo sapiens
gactgagcaagaccctgtctc

SEQ ID NO: 499436 - DNA, 13 bp, Homo sapiens
gactgatgtcatc

SEQ ID NO: 499437 - DNA, 21 bp, Homo sapiens
gactgcacagcgtcctgtcca

SEQ ID NO: 499438 - DNA, 24 bp, Homo sapiens
gactgcattatatttattactgta

SEQ ID NO: 499439 - DNA, 15 bp, Homo sapiens
gactggagtccctgt

SEQ ID NO: 499440 - DNA, 18 bp, Homo sapiens
gactgtgatttatttgga

SEQ ID NO: 499441 - DNA, 19 bp, Homo sapiens
gactgtgcccaagtgggtc

SEQ ID NO: 499442 - DNA, 14 bp, Homo sapiens
gactgttcaagagc

SEQ ID NO: 499443 - DNA, 16 bp, Homo sapiens
gacttaagacaaatgg

SEQ ID NO: 499444 - DNA, 19 bp, Homo sapiens
gacttaagacaaatgggac

SEQ ID NO: 499445 - DNA, 16 bp, Homo sapiens
gacttaatagaaacat

SEQ ID NO: 499446 - DNA, 13 bp, Homo sapiens
ctcagagagggca

SEQ ID NO: 499447 - DNA, 15 bp, Homo sapiens
ctcagagagggcagg

SEQ ID NO: 499448 - DNA, 23 bp, Homo sapiens
ctcagcccctgatcctgtgaagt

SEQ ID NO: 499449 - DNA, 16 bp, Homo sapiens
ctcagcctggtgggcc

SEQ ID NO: 499450 - DNA, 19 bp, Homo sapiens
ctcagcctggtgggcctcc

SEQ ID NO: 499451 - DNA, 22 bp, Homo sapiens
ctcagccttccccttgcccagg

SEQ ID NO: 499452 - DNA, 16 bp, Homo sapiens
ctcagctccccagagt

SEQ ID NO: 499453 - DNA, 15 bp, Homo sapiens
ctcaggaccaggcaa

SEQ ID NO: 499454 - DNA, 19 bp, Homo sapiens
ctcaggaggctgaggcagg

SEQ ID NO: 499455 - DNA, 12 bp, Homo sapiens
ctcagggcccca

SEQ ID NO: 499456 - DNA, 19 bp, Homo sapiens
ctcagggtctctgctgccg

SEQ ID NO: 499457 - DNA, 15 bp, Homo sapiens
ctcagttcagaatca

SEQ ID NO: 499458 - DNA, 21 bp, Homo sapiens
ctcagttcagaatcacttctg

SEQ ID NO: 499459 - DNA, 14 bp, Homo sapiens
ctcagttctgcctt

SEQ ID NO: 499460 - DNA, 19 bp, Homo sapiens
ctcatccattaatgtagat

SEQ ID NO: 499461 - DNA, 17 bp, Homo sapiens
ctcatccgaggcagggt

SEQ ID NO: 499462 - DNA, 14 bp, Homo sapiens
ctcatcctgcaggc

SEQ ID NO: 499463 - DNA, 17 bp, Homo sapiens
ctcatttatttccatat

SEQ ID NO: 499464 - DNA, 22 bp, Homo sapiens
ctcatttatttccatattaaaa

SEQ ID NO: 499465 - DNA, 15 bp, Homo sapiens
ctccacctccctgca

SEQ ID NO: 499466 - DNA, 15 bp, Homo sapiens
ctccaccttgcgggg

SEQ ID NO: 499467 - DNA, 19 bp, Homo sapiens
ctccagcctctgccgctgc

SEQ ID NO: 499468 - DNA, 19 bp, Homo sapiens
ctccagctgggttggaaaa

SEQ ID NO: 499469 - DNA, 13 bp, Homo sapiens
ctccaggcaggct

SEQ ID NO: 499470 - DNA, 18 bp, Homo sapiens
ctccatcagttagagctg

SEQ ID NO: 499471 - DNA, 18 bp, Homo sapiens
ctcccaagggatggtgcc

SEQ ID NO: 499472 - DNA, 20 bp, Homo sapiens
ctcccataaccgctgattct

SEQ ID NO: 499473 - DNA, 15 bp, Homo sapiens
ctccctccacctccc

SEQ ID NO: 499474 - DNA, 20 bp, Homo sapiens
ctccctccacctccctgcaa

SEQ ID NO: 499475 - DNA, 16 bp, Homo sapiens
ctccctgtgagagagt

SEQ ID NO: 499476 - DNA, 20 bp, Homo sapiens
ctccggtaaaacaccggaga

SEQ ID NO: 499477 - DNA, 12 bp, Homo sapiens
ctcctctgcttg

SEQ ID NO: 499478 - DNA, 14 bp, Homo sapiens
ctcctctgcttgcc

SEQ ID NO: 499479 - DNA, 16 bp, Homo sapiens
ctcctctgcttgccat

SEQ ID NO: 499480 - DNA, 20 bp, Homo sapiens
ctcctctgcttgccatccct

SEQ ID NO: 499481 - DNA, 16 bp, Homo sapiens
ctcctgctcctcagga

SEQ ID NO: 499482 - DNA, 16 bp, Homo sapiens
ctcctggaatggagct

SEQ ID NO: 499483 - DNA, 12 bp, Homo sapiens
ctcctgggcagc

SEQ ID NO: 499484 - DNA, 16 bp, Homo sapiens
ctcctgggcagctgcc

SEQ ID NO: 499485 - DNA, 17 bp, Homo sapiens
ctcctgggcagctgcct

SEQ ID NO: 499486 - DNA, 18 bp, Homo sapiens
gagacacactgaagaagc

SEQ ID NO: 499487 - DNA, 14 bp, Homo sapiens
gagacccctgtctc

SEQ ID NO: 499488 - DNA, 15 bp, Homo sapiens
gagacggtcgagcag

SEQ ID NO: 499489 - DNA, 17 bp, Homo sapiens
gagactcagggccccag

SEQ ID NO: 499490 - DNA, 14 bp, Homo sapiens
gagagaatcagacc

SEQ ID NO: 499491 - DNA, 15 bp, Homo sapiens
gagagaatcagacct

SEQ ID NO: 499492 - DNA, 17 bp, Homo sapiens
gagagaatcagacctgg

SEQ ID NO: 499493 - DNA, 16 bp, Homo sapiens
gagagaccaggcaaag

SEQ ID NO: 499494 - DNA, 14 bp, Homo sapiens
gagagagaatcaga

SEQ ID NO: 499495 - DNA, 15 bp, Homo sapiens
gagagagaatcagac

SEQ ID NO: 499496 - DNA, 19 bp, Homo sapiens
gagagctagaacctggaga

SEQ ID NO: 499497 - DNA, 13 bp, Homo sapiens
gagagctggagcc

SEQ ID NO: 499498 - DNA, 21 bp, Homo sapiens
gagagctggagcctggtgccc

SEQ ID NO: 499499 - DNA, 16 bp, Homo sapiens
gagatatgcagaagga

SEQ ID NO: 499500 - DNA, 21 bp, Homo sapiens
gagatcacgccactgcactcc

SEQ ID NO: 499501 - DNA, 21 bp, Homo sapiens
gagatgaaatcttacagctgg

SEQ ID NO: 499502 - DNA, 15 bp, Homo sapiens
gagatgaagcaaaca

SEQ ID NO: 499503 - DNA, 15 bp, Homo sapiens
gagatgtagcaaatt

SEQ ID NO: 499504 - DNA, 22 bp, Homo sapiens
gagcaaaggctgagaacactgt

SEQ ID NO: 499505 - DNA, 23 bp, Homo sapiens
gagcacttcacacagacaagtgg

SEQ ID NO: 499506 - DNA, 14 bp, Homo sapiens
gagcacttgctgta

SEQ ID NO: 499507 - DNA, 14 bp, Homo sapiens
gagcagtcaggaaa

SEQ ID NO: 499508 - DNA, 16 bp, Homo sapiens
gagcagtgcaggcaca

SEQ ID NO: 499509 - DNA, 17 bp, Homo sapiens
gagcagtttctgtcctg

SEQ ID NO: 499510 - DNA, 22 bp, Homo sapiens
gagcagtttctgtcctgctggt

SEQ ID NO: 499511 - DNA, 17 bp, Homo sapiens
gagcatggagctggccg

SEQ ID NO: 499512 - DNA, 16 bp, Homo sapiens
gagcatggctgtgagg

SEQ ID NO: 499513 - DNA, 16 bp, Homo sapiens
gagccagaacctggag

SEQ ID NO: 499514 - DNA, 21 bp, Homo sapiens
gagccagaacctggagggcta

SEQ ID NO: 499515 - DNA, 13 bp, Homo sapiens
gagccagggtgag

SEQ ID NO: 499516 - DNA, 17 bp, Homo sapiens
gagccatgggcacaaag

SEQ ID NO: 499517 - DNA, 20 bp, Homo sapiens
gagccctcctggaatggagc

SEQ ID NO: 499518 - DNA, 23 bp, Homo sapiens
gagccctcctggaatggagctgt

SEQ ID NO: 499519 - DNA, 19 bp, Homo sapiens
gagccgagatcacgccact

SEQ ID NO: 499520 - DNA, 18 bp, Homo sapiens
gagcctcatccgaggcag

SEQ ID NO: 499521 - DNA, 20 bp, Homo sapiens
gagcctcatccgaggcaggg

SEQ ID NO: 499522 - DNA, 12 bp, Homo sapiens
gagcctggtgcc

SEQ ID NO: 499523 - DNA, 17 bp, Homo sapiens
gagctagaacctggagg

SEQ ID NO: 499524 - DNA, 21 bp, Homo sapiens
gagctagaacctggagggcta

SEQ ID NO: 499525 - DNA, 18 bp, Homo sapiens
gagctcagagagggcagg

SEQ ID NO: 499526 - DNA, 20 bp, Homo sapiens
gagctcagagagggcaggca

SEQ ID NO: 499527 - DNA, 14 bp, Homo sapiens
gagctcaggacact

SEQ ID NO: 499528 - DNA, 23 bp, Homo sapiens
gagctgacacaaacctgcctggg

SEQ ID NO: 499529 - DNA, 16 bp, Homo sapiens
gagctgacacaggatg

SEQ ID NO: 499530 - DNA, 17 bp, Homo sapiens
gagctgacacaggatga

SEQ ID NO: 499531 - DNA, 18 bp, Homo sapiens
gagctgccctctcctggg

SEQ ID NO: 499532 - DNA, 23 bp, Homo sapiens
gagctgccctctcctgggcagct

SEQ ID NO: 499533 - DNA, 14 bp, Homo sapiens
gagctggagcctgg

SEQ ID NO: 499534 - DNA, 20 bp, Homo sapiens
gagctggagcctggtgccct

SEQ ID NO: 499535 - DNA, 16 bp, Homo sapiens
gaggactagaacctgg

SEQ ID NO: 499536 - DNA, 15 bp, Homo sapiens
gaggagcagtgcagg

SEQ ID NO: 499537 - DNA, 21 bp, Homo sapiens
gaggaggcctgggggcaggga

SEQ ID NO: 499538 - DNA, 19 bp, Homo sapiens
gaggatcacagtgctgaga

SEQ ID NO: 499539 - DNA, 17 bp, Homo sapiens
gaggattcaggggctgg

SEQ ID NO: 499540 - DNA, 16 bp, Homo sapiens
gaggcagacagcagct

SEQ ID NO: 499541 - DNA, 19 bp, Homo sapiens
gaggcagacagcagctcag

SEQ ID NO: 499542 - DNA, 13 bp, Homo sapiens
gaggcagggtcag

SEQ ID NO: 499543 - DNA, 18 bp, Homo sapiens
gaggccgaggtgggcaga

SEQ ID NO: 499544 - DNA, 22 bp, Homo sapiens
gaggctacctcacctgggcagg

SEQ ID NO: 499545 - DNA, 21 bp, Homo sapiens
gaggctagaaccaagaagggc

SEQ ID NO: 499546 - DNA, 18 bp, Homo sapiens
gagggctggaatctggag

SEQ ID NO: 499547 - DNA, 19 bp, Homo sapiens
gagggctggaatctggaga

SEQ ID NO: 499548 - DNA, 20 bp, Homo sapiens
gagggctggaatctggagag

SEQ ID NO: 499549 - DNA, 21 bp, Homo sapiens
gagggctggaatctggagagc

SEQ ID NO: 499550 - DNA, 18 bp, Homo sapiens
gaggggcagaacagccgc

SEQ ID NO: 499551 - DNA, 17 bp, Homo sapiens
gaggtgggcagatcatt

SEQ ID NO: 499552 - DNA, 15 bp, Homo sapiens
gaggttcagcaaggt

SEQ ID NO: 499553 - DNA, 20 bp, Homo sapiens
gaggttgccgtgagccaaga

SEQ ID NO: 499554 - DNA, 16 bp, Homo sapiens
gagtaatttattgttt

SEQ ID NO: 499555 - DNA, 22 bp, Homo sapiens
gagtagaaagacagagctggga

SEQ ID NO: 499556 - DNA, 22 bp, Homo sapiens
gagtcatgtgcctctgtcctta

SEQ ID NO: 499557 - DNA, 12 bp, Homo sapiens
gagtctcaataa

SEQ ID NO: 499558 - DNA, 18 bp, Homo sapiens
gagtctcaataaactgaa

SEQ ID NO: 499559 - DNA, 17 bp, Homo sapiens
gagtgcaggcctgctca

SEQ ID NO: 499560 - DNA, 17 bp, Homo sapiens
gagtgggcgcagtggct

SEQ ID NO: 499561 - DNA, 13 bp, Homo sapiens
gagtggtggcagc

SEQ ID NO: 499562 - DNA, 15 bp, Homo sapiens
gagtggtggcagctc

SEQ ID NO: 499563 - DNA, 18 bp, Homo sapiens
gagttccccatgcagaca

SEQ ID NO: 499564 - DNA, 14 bp, Homo sapiens
gagttgatgtctcc

SEQ ID NO: 499565 - DNA, 14 bp, Homo sapiens
gagttgctcctcag

SEQ ID NO: 499566 - DNA, 17 bp, Homo sapiens
gagtttaagaccagcct

SEQ ID NO: 499567 - DNA, 16 bp, Homo sapiens
gagtttagctggaaaa

SEQ ID NO: 499568 - DNA, 15 bp, Homo sapiens
gagtttggtccctgg

SEQ ID NO: 499569 - DNA, 13 bp, Homo sapiens
gatacgtgtatga

SEQ ID NO: 499570 - DNA, 20 bp, Homo sapiens
gataggcacatagagaggga

SEQ ID NO: 499571 - DNA, 19 bp, Homo sapiens
gataggcaggaacatacag

SEQ ID NO: 499572 - DNA, 23 bp, Homo sapiens
gataggcctgtgggccagattgc

SEQ ID NO: 499573 - DNA, 13 bp, Homo sapiens
gatataaataaaa

SEQ ID NO: 499574 - DNA, 15 bp, Homo sapiens
gatataaataaaaca

SEQ ID NO: 499575 - DNA, 12 bp, Homo sapiens
gatatagaacag

SEQ ID NO: 499576 - DNA, 14 bp, Homo sapiens
gatatgcagaagga

SEQ ID NO: 499577 - DNA, 17 bp, Homo sapiens
gatccccaactgctcca

SEQ ID NO: 499578 - DNA, 14 bp, Homo sapiens
gatcctggaaatca

SEQ ID NO: 499579 - DNA, 12 bp, Homo sapiens
gatcctgtgaag

SEQ ID NO: 499580 - DNA, 16 bp, Homo sapiens
gatctatcacctgtca

SEQ ID NO: 499581 - DNA, 17 bp, Homo sapiens
gatctgatgcaagcaag

SEQ ID NO: 499582 - DNA, 17 bp, Homo sapiens
gatctgtcaaagtgaga

SEQ ID NO: 499583 - DNA, 19 bp, Homo sapiens
gatgaaagagaaggtgggt

SEQ ID NO: 499584 - DNA, 14 bp, Homo sapiens
gatgactgaatttc

SEQ ID NO: 499585 - DNA, 17 bp, Homo sapiens
gatgagcatcccaggat

SEQ ID NO: 499586 - DNA, 14 bp, Homo sapiens
gatgatgtgcctgg

SEQ ID NO: 499587 - DNA, 15 bp, Homo sapiens
gatgatgtgcctggg

SEQ ID NO: 499588 - DNA, 21 bp, Homo sapiens
gatgcattcttggttggctgg

SEQ ID NO: 499589 - DNA, 15 bp, Homo sapiens
gatgcctgattgcca

SEQ ID NO: 499590 - DNA, 22 bp, Homo sapiens
gatggcaggatggcctggccag

SEQ ID NO: 499591 - DNA, 20 bp, Homo sapiens
gatggcctggccagggcctg

SEQ ID NO: 499592 - DNA, 16 bp, Homo sapiens
gatgggcccaattctt

SEQ ID NO: 499593 - DNA, 16 bp, Homo sapiens
gatgtcatcttgagct

SEQ ID NO: 499594 - DNA, 21 bp, Homo sapiens
gatgtcctcaccacatgcgga

SEQ ID NO: 499595 - DNA, 13 bp, Homo sapiens
gatgtgcctgggt

SEQ ID NO: 499596 - DNA, 22 bp, Homo sapiens
gattatttgttatttgtacagt

SEQ ID NO: 499597 - DNA, 12 bp, Homo sapiens
gattcacactgt

SEQ ID NO: 499598 - DNA, 18 bp, Homo sapiens
gattcaggggctgggggt

SEQ ID NO: 499599 - DNA, 15 bp, Homo sapiens
gattcctgagccagt

SEQ ID NO: 499600 - DNA, 17 bp, Homo sapiens
gattgacaactgaagag

SEQ ID NO: 499601 - DNA, 20 bp, Homo sapiens
gattggggaagactgtggct

SEQ ID NO: 499602 - DNA, 17 bp, Homo sapiens
gattgtctgaaattttc

SEQ ID NO: 499603 - DNA, 16 bp, Homo sapiens
gatttaccacttgtgt

SEQ ID NO: 499604 - DNA, 23 bp, Homo sapiens
gatttgaggagcagcttcagttg

SEQ ID NO: 499605 - DNA, 20 bp, Homo sapiens
gcaaacttaagaaacactga

SEQ ID NO: 499606 - DNA, 17 bp, Homo sapiens
gcaaaggagtagaaaga

SEQ ID NO: 499607 - DNA, 16 bp, Homo sapiens
gcaaagtcatgcaaag

SEQ ID NO: 499608 - DNA, 22 bp, Homo sapiens
gcaaagtcatgcaaaggctggg

SEQ ID NO: 499609 - DNA, 16 bp, Homo sapiens
gcaaagtctaaagttt

SEQ ID NO: 499610 - DNA, 21 bp, Homo sapiens
gcaaagtctaaagtttacagt

SEQ ID NO: 499611 - DNA, 17 bp, Homo sapiens
gcaaattccaatacatt

SEQ ID NO: 499612 - DNA, 12 bp, Homo sapiens
gcaaattctcaa

SEQ ID NO: 499613 - DNA, 14 bp, Homo sapiens
gcaactgaggcaga

SEQ ID NO: 499614 - DNA, 22 bp, Homo sapiens
gcaactgaggcagacagcagct

SEQ ID NO: 499615 - DNA, 18 bp, Homo sapiens
gcaactgagtctgcggga

SEQ ID NO: 499616 - DNA, 17 bp, Homo sapiens
gcaagactctgtctcaa

SEQ ID NO: 499617 - DNA, 20 bp, Homo sapiens
gcaagtattagaataccaca

SEQ ID NO: 499618 - DNA, 22 bp, Homo sapiens
gcaagtgtgctggcctctctga

SEQ ID NO: 499619 - DNA, 15 bp, Homo sapiens
gcaatgtgggcagag

SEQ ID NO: 499620 - DNA, 13 bp, Homo sapiens
gcaattattttgg

SEQ ID NO: 499621 - DNA, 18 bp, Homo sapiens
gcacaaactcaccatctg

SEQ ID NO: 499622 - DNA, 11 bp, Homo sapiens
gcacaataaat

SEQ ID NO: 499623 - DNA, 15 bp, Homo sapiens
gcacacacacataca

SEQ ID NO: 499624 - DNA, 18 bp, Homo sapiens
gcacacacacatacagag

SEQ ID NO: 499625 - DNA, 14 bp, Homo sapiens
gcacacttggccca

SEQ ID NO: 499626 - DNA, 20 bp, Homo sapiens
gcacacttggcccaagtggc

SEQ ID NO: 499627 - DNA, 17 bp, Homo sapiens
gcacagatacacataca

SEQ ID NO: 499628 - DNA, 15 bp, Homo sapiens
gcacagccaaggact

SEQ ID NO: 499629 - DNA, 15 bp, Homo sapiens
gcacagcctcttaga

SEQ ID NO: 499630 - DNA, 21 bp, Homo sapiens
gcacaggtgggcttcccagtg

SEQ ID NO: 499631 - DNA, 16 bp, Homo sapiens
gcaccacctctgtggg

SEQ ID NO: 499632 - DNA, 21 bp, Homo sapiens
gcaccatagaagaacagcaga

SEQ ID NO: 499633 - DNA, 23 bp, Homo sapiens
gcaccattgcactctagcctggc

SEQ ID NO: 499634 - DNA, 20 bp, Homo sapiens
gcacgcacacacacatacag

SEQ ID NO: 499635 - DNA, 20 bp, Homo sapiens
gcactaaagcagtggacacc

SEQ ID NO: 499636 - DNA, 14 bp, Homo sapiens
gcactaatcaatac

SEQ ID NO: 499637 - DNA, 17 bp, Homo sapiens
gcactgccatgcagggc

SEQ ID NO: 499638 - DNA, 11 bp, Homo sapiens
gcactgcctga

SEQ ID NO: 499639 - DNA, 18 bp, Homo sapiens
gcactgcctgatggacct

SEQ ID NO: 499640 - DNA, 13 bp, Homo sapiens
gcactgtgctcag

SEQ ID NO: 499641 - DNA, 16 bp, Homo sapiens
gcactgtgctcagggc

SEQ ID NO: 499642 - DNA, 18 bp, Homo sapiens
gcactgtgctcagggcta

SEQ ID NO: 499643 - DNA, 13 bp, Homo sapiens
gcacttggagcca

SEQ ID NO: 499644 - DNA, 18 bp, Homo sapiens
gcagaacagccgctcctg

SEQ ID NO: 499645 - DNA, 13 bp, Homo sapiens
gcagacagcagct

SEQ ID NO: 499646 - DNA, 14 bp, Homo sapiens
gcagacagcagctc

SEQ ID NO: 499647 - DNA, 20 bp, Homo sapiens
gcagacagcagctcaggcac

SEQ ID NO: 499648 - DNA, 23 bp, Homo sapiens
gcagagattggaatgggcagctc

SEQ ID NO: 499649 - DNA, 14 bp, Homo sapiens
gcagagtcacacgg

SEQ ID NO: 499650 - DNA, 14 bp, Homo sapiens
gcagatgaggttgc

SEQ ID NO: 499651 - DNA, 19 bp, Homo sapiens
gcagatgaggttgctagag

SEQ ID NO: 499652 - DNA, 15 bp, Homo sapiens
gcagccagctctcag

SEQ ID NO: 499653 - DNA, 17 bp, Homo sapiens
gcagccagctctcagcc

SEQ ID NO: 499654 - DNA, 14 bp, Homo sapiens
gcagctcatctctg

SEQ ID NO: 499655 - DNA, 19 bp, Homo sapiens
gcagctcatctctgtccca

SEQ ID NO: 499656 - DNA, 16 bp, Homo sapiens
gcagctgttgcagtga

SEQ ID NO: 499657 - DNA, 13 bp, Homo sapiens
gcagcttcagttg

SEQ ID NO: 499658 - DNA, 14 bp, Homo sapiens
gcaggaacatacag

SEQ ID NO: 499659 - DNA, 20 bp, Homo sapiens
gcaggaaggctgagaggaga

SEQ ID NO: 499660 - DNA, 17 bp, Homo sapiens
gcaggaggggggctggg

SEQ ID NO: 499661 - DNA, 16 bp, Homo sapiens
gcaggcacctgggctt

SEQ ID NO: 499662 - DNA, 22 bp, Homo sapiens
gcaggctaaggcgtggagctgc

SEQ ID NO: 499663 - DNA, 16 bp, Homo sapiens
gcaggctagaacctgg

SEQ ID NO: 499664 - DNA, 19 bp, Homo sapiens
gcagggatgatggcagagc

SEQ ID NO: 499665 - DNA, 20 bp, Homo sapiens
gcagggatgatggcagagcc

SEQ ID NO: 499666 - DNA, 17 bp, Homo sapiens
gcagggtcaggagaggg

SEQ ID NO: 499667 - DNA, 15 bp, Homo sapiens
gcagtgcaggcacag

SEQ ID NO: 499668 - DNA, 19 bp, Homo sapiens
gcagttcagagctgccctc

SEQ ID NO: 499669 - DNA, 20 bp, Homo sapiens
gcagttcagagctgccctct

SEQ ID NO: 499670 - DNA, 22 bp, Homo sapiens
gcagttcagagctgccctctcc

SEQ ID NO: 499671 - DNA, 23 bp, Homo sapiens
gcagttcagagctgccctctcct

SEQ ID NO: 499672 - DNA, 15 bp, Homo sapiens
gcagttctgaagaag

SEQ ID NO: 499673 - DNA, 17 bp, Homo sapiens
gcagttctgaagaagat

SEQ ID NO: 499674 - DNA, 20 bp, Homo sapiens
gcagtttctgtcctgctggt

SEQ ID NO: 499675 - DNA, 15 bp, Homo sapiens
gcatagcagctgcta

SEQ ID NO: 499676 - DNA, 13 bp, Homo sapiens
gcatattgataat

SEQ ID NO: 499677 - DNA, 15 bp, Homo sapiens
gcatattgttattat

SEQ ID NO: 499678 - DNA, 16 bp, Homo sapiens
gcatattttctccgaa

SEQ ID NO: 499679 - DNA, 21 bp, Homo sapiens
gcatcacctagaaacttgtta

SEQ ID NO: 499680 - DNA, 17 bp, Homo sapiens
gcatcagctggcgtcat

SEQ ID NO: 499681 - DNA, 22 bp, Homo sapiens
gcatcccttgaccaggcctggg

SEQ ID NO: 499682 - DNA, 14 bp, Homo sapiens
gcatgatctgtcaa

SEQ ID NO: 499683 - DNA, 23 bp, Homo sapiens
gcatggaaattcccttcatctgg

SEQ ID NO: 499684 - DNA, 15 bp, Homo sapiens
gcatggctgtgagga

SEQ ID NO: 499685 - DNA, 18 bp, Homo sapiens
gcatgttttccagctcct

SEQ ID NO: 499686 - DNA, 19 bp, Homo sapiens
gcatgttttccagctcctc

SEQ ID NO: 499687 - DNA, 13 bp, Homo sapiens
gcattatatttat

SEQ ID NO: 499688 - DNA, 21 bp, Homo sapiens
gcattcttggttggctggcct

SEQ ID NO: 499689 - DNA, 21 bp, Homo sapiens
gccaagggatgaaagagaagg

SEQ ID NO: 499690 - DNA, 14 bp, Homo sapiens
gccacacctgagcc

SEQ ID NO: 499691 - DNA, 17 bp, Homo sapiens
gccagaacctggagggc

SEQ ID NO: 499692 - DNA, 20 bp, Homo sapiens
gccagcagccagctctcagc

SEQ ID NO: 499693 - DNA, 22 bp, Homo sapiens
gccagcagccagctctcagcca

SEQ ID NO: 499694 - DNA, 14 bp, Homo sapiens
gccagcagttcaga

SEQ ID NO: 499695 - DNA, 20 bp, Homo sapiens
gccagcagttcagagctgcc

SEQ ID NO: 499696 - DNA, 13 bp, Homo sapiens
gccagctctcagc

SEQ ID NO: 499697 - DNA, 17 bp, Homo sapiens
gccagctgccccagcca

SEQ ID NO: 499698 - DNA, 15 bp, Homo sapiens
gccaggtgcagacct

SEQ ID NO: 499699 - DNA, 19 bp, Homo sapiens
gccaggtgcagaccttggg

SEQ ID NO: 499700 - DNA, 20 bp, Homo sapiens
gccagtgatgctaaaggttg

SEQ ID NO: 499701 - DNA, 19 bp, Homo sapiens
gccatcatcagtggagcca

SEQ ID NO: 499702 - DNA, 11 bp, Homo sapiens
gccatccctcc

SEQ ID NO: 499703 - DNA, 18 bp, Homo sapiens
gccatcctcaaacactgc

SEQ ID NO: 499704 - DNA, 23 bp, Homo sapiens
gccatcctcaaacactgcaggca

SEQ ID NO: 499705 - DNA, 15 bp, Homo sapiens
gccatctctggatgc

SEQ ID NO: 499706 - DNA, 16 bp, Homo sapiens
gccatctctggatgcc

SEQ ID NO: 499707 - DNA, 19 bp, Homo sapiens
gccatctctggatgcctga

SEQ ID NO: 499708 - DNA, 20 bp, Homo sapiens
gccatggagagctggagcct

SEQ ID NO: 499709 - DNA, 21 bp, Homo sapiens
gccatgggcacaaagggccca

SEQ ID NO: 499710 - DNA, 16 bp, Homo sapiens
gccatgtagaagctgc

SEQ ID NO: 499711 - DNA, 13 bp, Homo sapiens
gcccaccagcctt

SEQ ID NO: 499712 - DNA, 17 bp, Homo sapiens
gcccaccagccttgctc

SEQ ID NO: 499713 - DNA, 22 bp, Homo sapiens
gcccaccagccttgctctcttc

SEQ ID NO: 499714 - DNA, 13 bp, Homo sapiens
gccccacccagat

SEQ ID NO: 499715 - DNA, 22 bp, Homo sapiens
gccccacccagatgggggaaag

SEQ ID NO: 499716 - DNA, 20 bp, Homo sapiens
gccccttcatccgcctgtgg

SEQ ID NO: 499717 - DNA, 16 bp, Homo sapiens
gcccgtcttcagccta

SEQ ID NO: 499718 - DNA, 21 bp, Homo sapiens
gccctacttctttgctttgcc

SEQ ID NO: 499719 - DNA, 19 bp, Homo sapiens
gccctagagcacactgtag

SEQ ID NO: 499720 - DNA, 19 bp, Homo sapiens
gccctctcctgggcagctg

SEQ ID NO: 499721 - DNA, 21 bp, Homo sapiens
gccctctcctgggcagctgcc

SEQ ID NO: 499722 - DNA, 20 bp, Homo sapiens
gccgctcctgtctgccagcc

SEQ ID NO: 499723 - DNA, 22 bp, Homo sapiens
gccgctcctgtctgccagccag

SEQ ID NO: 499724 - DNA, 23 bp, Homo sapiens
gccgctcctgtctgccagccagc

SEQ ID NO: 499725 - DNA, 23 bp, Homo sapiens
gccggaaggaatgtcagggccag

SEQ ID NO: 499726 - DNA, 17 bp, Homo sapiens
gccgttgatgttggctg

SEQ ID NO: 499727 - DNA, 19 bp, Homo sapiens
gccgttgatgttggctggg

SEQ ID NO: 499728 - DNA, 20 bp, Homo sapiens
gccgttgatgttggctggga

SEQ ID NO: 499729 - DNA, 17 bp, Homo sapiens
gcctagccgacctcagc

SEQ ID NO: 499730 - DNA, 18 bp, Homo sapiens
gcctagccgacctcagcc

SEQ ID NO: 499731 - DNA, 19 bp, Homo sapiens
gcctagccgacctcagcct

SEQ ID NO: 499732 - DNA, 13 bp, Homo sapiens
gcctatagtccca

SEQ ID NO: 499733 - DNA, 23 bp, Homo sapiens
gcctcacacggtttgaagcctgg

SEQ ID NO: 499734 - DNA, 13 bp, Homo sapiens
gcctcagactcat

SEQ ID NO: 499735 - DNA, 20 bp, Homo sapiens
gcctcagtaagacgacaagg

SEQ ID NO: 499736 - DNA, 22 bp, Homo sapiens
gcctcagtaagtatctggagga

SEQ ID NO: 499737 - DNA, 16 bp, Homo sapiens
gcctcatccgaggcag

SEQ ID NO: 499738 - DNA, 14 bp, Homo sapiens
gcctcccctcctct

SEQ ID NO: 499739 - DNA, 16 bp, Homo sapiens
gcctcccctcctctgc

SEQ ID NO: 499740 - DNA, 19 bp, Homo sapiens
gcctcccctcctctgcttg

SEQ ID NO: 499741 - DNA, 22 bp, Homo sapiens
gcctcccctcctctgcttgcca

SEQ ID NO: 499742 - DNA, 15 bp, Homo sapiens
gcctcccttcatgca

SEQ ID NO: 499743 - DNA, 18 bp, Homo sapiens
gcctcccttcatgcatgg

SEQ ID NO: 499744 - DNA, 17 bp, Homo sapiens
gcctcggagcctcatcc

SEQ ID NO: 499745 - DNA, 16 bp, Homo sapiens
gcctctgccgctgcca

SEQ ID NO: 499746 - DNA, 19 bp, Homo sapiens
gcctctgccgctgccatgc

SEQ ID NO: 499747 - DNA, 20 bp, Homo sapiens
gcctctgccgctgccatgct

SEQ ID NO: 499748 - DNA, 15 bp, Homo sapiens
gcctcttagatgcag

SEQ ID NO: 499749 - DNA, 20 bp, Homo sapiens
gcctctttaacagctttctc

SEQ ID NO: 499750 - DNA, 22 bp, Homo sapiens
gcctgagaagagagatcaaatg

SEQ ID NO: 499751 - DNA, 21 bp, Homo sapiens
gcctgattgccaagctcagga

SEQ ID NO: 499752 - DNA, 16 bp, Homo sapiens
gcctgcctggcaggct

SEQ ID NO: 499753 - DNA, 13 bp, Homo sapiens
gcctggaagacag

SEQ ID NO: 499754 - DNA, 15 bp, Homo sapiens
gcctggaagacagag

SEQ ID NO: 499755 - DNA, 18 bp, Homo sapiens
gcctggcaacagagcgag

SEQ ID NO: 499756 - DNA, 15 bp, Homo sapiens
gcctggccaaaggga

SEQ ID NO: 499757 - DNA, 21 bp, Homo sapiens
gcctgggcctcctcacaacat

SEQ ID NO: 499758 - DNA, 22 bp, Homo sapiens
gcctgggggcagggagaggagt

SEQ ID NO: 499759 - DNA, 21 bp, Homo sapiens
gcctgtgtgttgccaggcagg

SEQ ID NO: 499760 - DNA, 23 bp, Homo sapiens
gcctttccgcggagcccttggcc

SEQ ID NO: 499761 - DNA, 13 bp, Homo sapiens
aatgcataaaatg

SEQ ID NO: 499762 - DNA, 17 bp, Homo sapiens
aatgccatcctcaaaca

SEQ ID NO: 499763 - DNA, 22 bp, Homo sapiens
aatgccatcctcaaacactgca

SEQ ID NO: 499764 - DNA, 17 bp, Homo sapiens
aatgcctgagtgcctgg

SEQ ID NO: 499765 - DNA, 13 bp, Homo sapiens
aatggaaaggaga

SEQ ID NO: 499766 - DNA, 21 bp, Homo sapiens
aatgggactgatgtcatcttg

SEQ ID NO: 499767 - DNA, 17 bp, Homo sapiens
aatggtttgaatataaa

SEQ ID NO: 499768 - DNA, 17 bp, Homo sapiens
aatggtttgcaaggaag

SEQ ID NO: 499769 - DNA, 17 bp, Homo sapiens
aatgtaagaatcattgt

SEQ ID NO: 499770 - DNA, 23 bp, Homo sapiens
aatgtaagaatcattgtaaacat

SEQ ID NO: 499771 - DNA, 17 bp, Homo sapiens
aatgtcttttcaaaagg

SEQ ID NO: 499772 - DNA, 18 bp, Homo sapiens
aatgtcttttcaaaagga

SEQ ID NO: 499773 - DNA, 17 bp, Homo sapiens
aatgtgaatgggaaaag

SEQ ID NO: 499774 - DNA, 22 bp, Homo sapiens
aatgtgattcctttgaagagga

SEQ ID NO: 499775 - DNA, 19 bp, Homo sapiens
aatgtgccctcttaagtgt

SEQ ID NO: 499776 - DNA, 14 bp, Homo sapiens
aatgtgggcagaga

SEQ ID NO: 499777 - DNA, 18 bp, Homo sapiens
aatgttgacatgggacat

SEQ ID NO: 499778 - DNA, 14 bp, Homo sapiens
aattaattctttat

SEQ ID NO: 499779 - DNA, 23 bp, Homo sapiens
aattaattctttatcacatgttg

SEQ ID NO: 499780 - DNA, 14 bp, Homo sapiens
aattacatttgtat

SEQ ID NO: 499781 - DNA, 14 bp, Homo sapiens
aattagttttatat

SEQ ID NO: 499782 - DNA, 23 bp, Homo sapiens
aattatattttgaacaactcgaa

SEQ ID NO: 499783 - DNA, 13 bp, Homo sapiens
aattcattccatt

SEQ ID NO: 499784 - DNA, 15 bp, Homo sapiens
aattcattccatttg

SEQ ID NO: 499785 - DNA, 13 bp, Homo sapiens
aattccttagctt

SEQ ID NO: 499786 - DNA, 22 bp, Homo sapiens
aattctagctttgagcttaaga

SEQ ID NO: 499787 - DNA, 17 bp, Homo sapiens
aattcttacaaacatgt

SEQ ID NO: 499788 - DNA, 11 bp, Homo sapiens
aattcttccct

SEQ ID NO: 499789 - DNA, 19 bp, Homo sapiens
aattctttatcacatgttg

SEQ ID NO: 499790 - DNA, 13 bp, Homo sapiens
aattgcagactgt

SEQ ID NO: 499791 - DNA, 13 bp, Homo sapiens
aattgtatagaga

SEQ ID NO: 499792 - DNA, 15 bp, Homo sapiens
aattgttaagatatg

SEQ ID NO: 499793 - DNA, 12 bp, Homo sapiens
aatttctatggc

SEQ ID NO: 499794 - DNA, 16 bp, Homo sapiens
aatttgggagggtgag

SEQ ID NO: 499795 - DNA, 19 bp, Homo sapiens
aattttctagaatactaat

SEQ ID NO: 499796 - DNA, 22 bp, Homo sapiens
acaaaaaggtaaaactttttat

SEQ ID NO: 499797 - DNA, 23 bp, Homo sapiens
acaaaagtatattcaaaaattat

SEQ ID NO: 499798 - DNA, 14 bp, Homo sapiens
acaaacctgcctgg

SEQ ID NO: 499799 - DNA, 20 bp, Homo sapiens
acaaactcaccatctgtgca

SEQ ID NO: 499800 - DNA, 15 bp, Homo sapiens
acaaatctatgccac

SEQ ID NO: 499801 - DNA, 13 bp, Homo sapiens
acaaatgggactg

SEQ ID NO: 499802 - DNA, 14 bp, Homo sapiens
acaacaccaggact

SEQ ID NO: 499803 - DNA, 15 bp, Homo sapiens
acaacaccaggactt

SEQ ID NO: 499804 - DNA, 16 bp, Homo sapiens
acaacaccccacagga

SEQ ID NO: 499805 - DNA, 13 bp, Homo sapiens
acaactatattgt

SEQ ID NO: 499806 - DNA, 18 bp, Homo sapiens
acaagacccaagtagctg

SEQ ID NO: 499807 - DNA, 13 bp, Homo sapiens
acaagcaagctcc

SEQ ID NO: 499808 - DNA, 15 bp, Homo sapiens
acaagcaagctccca

SEQ ID NO: 499809 - DNA, 22 bp, Homo sapiens
acaagctcacagacctttgaac

SEQ ID NO: 499810 - DNA, 17 bp, Homo sapiens
acaaggaaggtggtggg

SEQ ID NO: 499811 - DNA, 17 bp, Homo sapiens
acaagtgagacaaaaag

SEQ ID NO: 499812 - DNA, 16 bp, Homo sapiens
acaatatgtatagcat

SEQ ID NO: 499813 - DNA, 14 bp, Homo sapiens
acaatgctgtattt

SEQ ID NO: 499814 - DNA, 21 bp, Homo sapiens
acaattgcttactcattaaaa

SEQ ID NO: 499815 - DNA, 20 bp, Homo sapiens
acaatttaaagcaaaggagt

SEQ ID NO: 499816 - DNA, 16 bp, Homo sapiens
acacaaacctgcctgg

SEQ ID NO: 499817 - DNA, 12 bp, Homo sapiens
acacaacaccag

SEQ ID NO: 499818 - DNA, 14 bp, Homo sapiens
acacaacaccagga

SEQ ID NO: 499819 - DNA, 15 bp, Homo sapiens
acacaacaccaggac

SEQ ID NO: 499820 - DNA, 13 bp, Homo sapiens
acacaactatatt

SEQ ID NO: 499821 - DNA, 14 bp, Homo sapiens
acacaagagctgga

SEQ ID NO: 499822 - DNA, 11 bp, Homo sapiens
acacacacata

SEQ ID NO: 499823 - DNA, 20 bp, Homo sapiens
acacacagctaacacacagc

SEQ ID NO: 499824 - DNA, 12 bp, Homo sapiens
acacacatacag

SEQ ID NO: 499825 - DNA, 14 bp, Homo sapiens
acacactgaagaag

SEQ ID NO: 499826 - DNA, 16 bp, Homo sapiens
acacagactattgaca

SEQ ID NO: 499827 - DNA, 16 bp, Homo sapiens
acacagatgaaacaca

SEQ ID NO: 499828 - DNA, 20 bp, Homo sapiens
acacatacacggtattccca

SEQ ID NO: 499829 - DNA, 13 bp, Homo sapiens
acacatctgtgga

SEQ ID NO: 499830 - DNA, 17 bp, Homo sapiens
acacatctgtggagatg

SEQ ID NO: 499831 - DNA, 16 bp, Homo sapiens
acacatttacactaga

SEQ ID NO: 499832 - DNA, 12 bp, Homo sapiens
acaccaggactt

SEQ ID NO: 499833 - DNA, 22 bp, Homo sapiens
acaccaggacttaagacaaatg

SEQ ID NO: 499834 - DNA, 15 bp, Homo sapiens
acaccttatatttac

SEQ ID NO: 499835 - DNA, 20 bp, Homo sapiens
acacgcacgcacacacacat

SEQ ID NO: 499836 - DNA, 21 bp, Homo sapiens
acactaaacagactatttaac

SEQ ID NO: 499837 - DNA, 13 bp, Homo sapiens
acactaagagaga

SEQ ID NO: 499838 - DNA, 18 bp, Homo sapiens
acactaagagagaatgag

SEQ ID NO: 499839 - DNA, 15 bp, Homo sapiens
acactcaagaagcag

SEQ ID NO: 499840 - DNA, 18 bp, Homo sapiens
acactcacctctaaaaca

SEQ ID NO: 499841 - DNA, 18 bp, Homo sapiens
acactcgaaaagagcact

SEQ ID NO: 499842 - DNA, 14 bp, Homo sapiens
acactgaagaagca

SEQ ID NO: 499843 - DNA, 18 bp, Homo sapiens
acactggtattcctgcct

SEQ ID NO: 499844 - DNA, 19 bp, Homo sapiens
acactggtattcctgcctc

SEQ ID NO: 499845 - DNA, 21 bp, Homo sapiens
acactggtattcctgcctcca

SEQ ID NO: 499846 - DNA, 22 bp, Homo sapiens
acacttggcccaagtggcagag

SEQ ID NO: 499847 - DNA, 16 bp, Homo sapiens
acagaagctccaggta

SEQ ID NO: 499848 - DNA, 15 bp, Homo sapiens
acagaattctgctac

SEQ ID NO: 499849 - DNA, 19 bp, Homo sapiens
acagactattgacatcagc

SEQ ID NO: 499850 - DNA, 17 bp, Homo sapiens
acagactatttaacttg

SEQ ID NO: 499851 - DNA, 15 bp, Homo sapiens
acagagcgcccctcc

SEQ ID NO: 499852 - DNA, 18 bp, Homo sapiens
acagagctgggatgtttc

SEQ ID NO: 499853 - DNA, 17 bp, Homo sapiens
acagattcacactgtct

SEQ ID NO: 499854 - DNA, 19 bp, Homo sapiens
acagattcacactgtctgg

SEQ ID NO: 499855 - DNA, 18 bp, Homo sapiens
acagcccaaagaaggaaa

SEQ ID NO: 499856 - DNA, 23 bp, Homo sapiens
acagccgctcctgtctgccagcc

SEQ ID NO: 499857 - DNA, 24 bp, Homo sapiens
acagccgctcctgtctgccagcca

SEQ ID NO: 499858 - DNA, 16 bp, Homo sapiens
acagcctcttagatgc

SEQ ID NO: 499859 - DNA, 19 bp, Homo sapiens
acagctaacaattgtgaag

SEQ ID NO: 499860 - DNA, 15 bp, Homo sapiens
acagctaacacacag

SEQ ID NO: 499861 - DNA, 19 bp, Homo sapiens
acagctaacacacagctcc

SEQ ID NO: 499862 - DNA, 18 bp, Homo sapiens
acagctgggtggcactgc

SEQ ID NO: 499863 - DNA, 19 bp, Homo sapiens
acagctgggtggcactgcc

SEQ ID NO: 499864 - DNA, 20 bp, Homo sapiens
acagctgggtggcactgcca

SEQ ID NO: 499865 - DNA, 23 bp, Homo sapiens
acagctgggtggcactgccatgc

SEQ ID NO: 499866 - DNA, 20 bp, Homo sapiens
acagctgtatgattcccagc

SEQ ID NO: 499867 - DNA, 15 bp, Homo sapiens
acagctttctccaga

SEQ ID NO: 499868 - DNA, 22 bp, Homo sapiens
acaggaaccacaagactgcaca

SEQ ID NO: 499869 - DNA, 15 bp, Homo sapiens
acaggaagtgaagaa

SEQ ID NO: 499870 - DNA, 22 bp, Homo sapiens
acaggatggttcccttgatgaa

SEQ ID NO: 499871 - DNA, 24 bp, Homo sapiens
acaggatggttcccttgatgaaga

SEQ ID NO: 499872 - DNA, 22 bp, Homo sapiens
agctgccctctcctgggcagct

SEQ ID NO: 499873 - DNA, 19 bp, Homo sapiens
agctgcctcccctcctctg

SEQ ID NO: 499874 - DNA, 22 bp, Homo sapiens
agctgcctcccctcctctgctt

SEQ ID NO: 499875 - DNA, 23 bp, Homo sapiens
agctgcctcccctcctctgcttg

SEQ ID NO: 499876 - DNA, 14 bp, Homo sapiens
agctgctaccttct

SEQ ID NO: 499877 - DNA, 20 bp, Homo sapiens
agctgctactagctctttga

SEQ ID NO: 499878 - DNA, 19 bp, Homo sapiens
agctggagcctggtgccct

SEQ ID NO: 499879 - DNA, 22 bp, Homo sapiens
agctggaggactagaacctgga

SEQ ID NO: 499880 - DNA, 16 bp, Homo sapiens
agctggccgtgggcct

SEQ ID NO: 499881 - DNA, 21 bp, Homo sapiens
agctggcgtcatgcaaagtca

SEQ ID NO: 499882 - DNA, 18 bp, Homo sapiens
agctgggtggcactgcca

SEQ ID NO: 499883 - DNA, 20 bp, Homo sapiens
agctggtctgtttccaggtc

SEQ ID NO: 499884 - DNA, 15 bp, Homo sapiens
agctgtaaaaagaga

SEQ ID NO: 499885 - DNA, 19 bp, Homo sapiens
agctgtaaaaagagagaaa

SEQ ID NO: 499886 - DNA, 19 bp, Homo sapiens
agctgtataactgtgcaga

SEQ ID NO: 499887 - DNA, 22 bp, Homo sapiens
agctgtataactgtgcagagac

SEQ ID NO: 499888 - DNA, 14 bp, Homo sapiens
agctgttccacagg

SEQ ID NO: 499889 - DNA, 18 bp, Homo sapiens
agctgttccacaggggct

SEQ ID NO: 499890 - DNA, 22 bp, Homo sapiens
agctgttctcattcctgttctt

SEQ ID NO: 499891 - DNA, 23 bp, Homo sapiens
agctgttctcattcctgttcttt

SEQ ID NO: 499892 - DNA, 21 bp, Homo sapiens
agcttattgtctagtgaaact

SEQ ID NO: 499893 - DNA, 23 bp, Homo sapiens
agcttccctcccgtgtgttctcc

SEQ ID NO: 499894 - DNA, 16 bp, Homo sapiens
agctttatgtaataat

SEQ ID NO: 499895 - DNA, 17 bp, Homo sapiens
agctttggtgcaatggc

SEQ ID NO: 499896 - DNA, 14 bp, Homo sapiens
aggaaaatgaataa

SEQ ID NO: 499897 - DNA, 16 bp, Homo sapiens
aggaaaccacagctgc

SEQ ID NO: 499898 - DNA, 20 bp, Homo sapiens
aggaaaccacagctgctgga

SEQ ID NO: 499899 - DNA, 18 bp, Homo sapiens
aggaaagtgatatgcatt

SEQ ID NO: 499900 - DNA, 15 bp, Homo sapiens
aggaagccacagctg

SEQ ID NO: 499901 - DNA, 22 bp, Homo sapiens
aggaaggctgagaggagagaga

SEQ ID NO: 499902 - DNA, 14 bp, Homo sapiens
aggaaggtggtggg

SEQ ID NO: 499903 - DNA, 22 bp, Homo sapiens
aggaatcagcaagaagatccta

SEQ ID NO: 499904 - DNA, 21 bp, Homo sapiens
aggaatccactcccaggcagc

SEQ ID NO: 499905 - DNA, 23 bp, Homo sapiens
aggaattaagttagggaatggca

SEQ ID NO: 499906 - DNA, 16 bp, Homo sapiens
aggacaaataaagcaa

SEQ ID NO: 499907 - DNA, 14 bp, Homo sapiens
aggacactgatatg

SEQ ID NO: 499908 - DNA, 17 bp, Homo sapiens
aggacactgatatgggt

SEQ ID NO: 499909 - DNA, 17 bp, Homo sapiens
aggacatgctgaagcca

SEQ ID NO: 499910 - DNA, 13 bp, Homo sapiens
aggaccaggcaat

SEQ ID NO: 499911 - DNA, 21 bp, Homo sapiens
aggactaatccaatacctctt

SEQ ID NO: 499912 - DNA, 14 bp, Homo sapiens
aggactcagctccc

SEQ ID NO: 499913 - DNA, 18 bp, Homo sapiens
aggactcagctccccaga

SEQ ID NO: 499914 - DNA, 23 bp, Homo sapiens
aggactgcacagcgtcctgtcca

SEQ ID NO: 499915 - DNA, 18 bp, Homo sapiens
aggacttaagacaaatgg

SEQ ID NO: 499916 - DNA, 16 bp, Homo sapiens
aggagcagcctcagaa

SEQ ID NO: 499917 - DNA, 19 bp, Homo sapiens
aggagcagtgcaggcacag

SEQ ID NO: 499918 - DNA, 14 bp, Homo sapiens
aggaggaagcagaa

SEQ ID NO: 499919 - DNA, 20 bp, Homo sapiens
aggaggcagctgttgcagtg

SEQ ID NO: 499920 - DNA, 21 bp, Homo sapiens
aggaggggtctggacatgtgg

SEQ ID NO: 499921 - DNA, 19 bp, Homo sapiens
aggatccctctctggattg

SEQ ID NO: 499922 - DNA, 14 bp, Homo sapiens
aggatctagagggg

SEQ ID NO: 499923 - DNA, 13 bp, Homo sapiens
aggatggcctggc

SEQ ID NO: 499924 - DNA, 23 bp, Homo sapiens
aggatggttcccttgatgaagaa

SEQ ID NO: 499925 - DNA, 22 bp, Homo sapiens
aggcaactagtggagagaactg

SEQ ID NO: 499926 - DNA, 15 bp, Homo sapiens
aggcaactgaggcag

SEQ ID NO: 499927 - DNA, 16 bp, Homo sapiens
aggcaacttgggaact

SEQ ID NO: 499928 - DNA, 12 bp, Homo sapiens
aggcacacttct

SEQ ID NO: 499929 - DNA, 15 bp, Homo sapiens
aggcacacttcttct

SEQ ID NO: 499930 - DNA, 20 bp, Homo sapiens
aggcacacttcttcttggtc

SEQ ID NO: 499931 - DNA, 13 bp, Homo sapiens
aggcacctgggct

SEQ ID NO: 499932 - DNA, 13 bp, Homo sapiens
aggcagacagcag

SEQ ID NO: 499933 - DNA, 16 bp, Homo sapiens
aggcaggaacatacag

SEQ ID NO: 499934 - DNA, 22 bp, Homo sapiens
aggcaggctaaggcgtggagct

SEQ ID NO: 499935 - DNA, 15 bp, Homo sapiens
aggcagggatttgag

SEQ ID NO: 499936 - DNA, 14 bp, Homo sapiens
aggcagggtcagga

SEQ ID NO: 499937 - DNA, 23 bp, Homo sapiens
aggcagggtcaggagaggggcag

SEQ ID NO: 499938 - DNA, 21 bp, Homo sapiens
aggcattgtttttaagaaaaa

SEQ ID NO: 499939 - DNA, 15 bp, Homo sapiens
aggccaggagttcaa

SEQ ID NO: 499940 - DNA, 22 bp, Homo sapiens
aggccatggagagctggagcct

SEQ ID NO: 499941 - DNA, 16 bp, Homo sapiens
aggccgaggtgggcag

SEQ ID NO: 499942 - DNA, 19 bp, Homo sapiens
aggctacactgacactggt

SEQ ID NO: 499943 - DNA, 15 bp, Homo sapiens
aggctagatgtatgt

SEQ ID NO: 499944 - DNA, 17 bp, Homo sapiens
aggctagatgtatgtac

SEQ ID NO: 499945 - DNA, 14 bp, Homo sapiens
aggctgaggcagga

SEQ ID NO: 499946 - DNA, 17 bp, Homo sapiens
aggctgaggtgggcaga

SEQ ID NO: 499947 - DNA, 22 bp, Homo sapiens
aggctggggaagtcctctgggt

SEQ ID NO: 499948 - DNA, 24 bp, Homo sapiens
aggctgtgctccctggttctgatg

SEQ ID NO: 499949 - DNA, 19 bp, Homo sapiens
aggcttagctttgctctgc

SEQ ID NO: 499950 - DNA, 15 bp, Homo sapiens
aggcttgcctgcagg

SEQ ID NO: 499951 - DNA, 15 bp, Homo sapiens
agggaaaacattcca

SEQ ID NO: 499952 - DNA, 19 bp, Homo sapiens
agggaagttcaggctctga

SEQ ID NO: 499953 - DNA, 13 bp, Homo sapiens
agggaagttttgt

SEQ ID NO: 499954 - DNA, 13 bp, Homo sapiens
agggaatgcctga

SEQ ID NO: 499955 - DNA, 15 bp, Homo sapiens
atttgtataaaataa

SEQ ID NO: 499956 - DNA, 18 bp, Homo sapiens
atttgtcgatatttccat

SEQ ID NO: 499957 - DNA, 19 bp, Homo sapiens
atttgttatttgtacagtt

SEQ ID NO: 499958 - DNA, 12 bp, Homo sapiens
attttaataatg

SEQ ID NO: 499959 - DNA, 15 bp, Homo sapiens
attttaataatgttt

SEQ ID NO: 499960 - DNA, 18 bp, Homo sapiens
attttaataatgtttcaa

SEQ ID NO: 499961 - DNA, 13 bp, Homo sapiens
attttaatctaat

SEQ ID NO: 499962 - DNA, 23 bp, Homo sapiens
attttagtcacacgtggtctttc

SEQ ID NO: 499963 - DNA, 14 bp, Homo sapiens
attttcctgaaaac

SEQ ID NO: 499964 - DNA, 14 bp, Homo sapiens
attttctagaatac

SEQ ID NO: 499965 - DNA, 21 bp, Homo sapiens
attttggatctatcacctgtc

SEQ ID NO: 499966 - DNA, 20 bp, Homo sapiens
attttttctctaggaaatat

SEQ ID NO: 499967 - DNA, 23 bp, Homo sapiens
attttttctctaggaaatattta

SEQ ID NO: 499968 - DNA, 16 bp, Homo sapiens
caaaagacatcctcaa

SEQ ID NO: 499969 - DNA, 15 bp, Homo sapiens
caaaagcccattcat

SEQ ID NO: 499970 - DNA, 20 bp, Homo sapiens
caaaagcccattcattccat

SEQ ID NO: 499971 - DNA, 22 bp, Homo sapiens
caaaattttttctctaggaaat

SEQ ID NO: 499972 - DNA, 18 bp, Homo sapiens
caaacatgtggttaatgc

SEQ ID NO: 499973 - DNA, 20 bp, Homo sapiens
caaacatgtggttaatgcca

SEQ ID NO: 499974 - DNA, 15 bp, Homo sapiens
caaacctgcctgggt

SEQ ID NO: 499975 - DNA, 14 bp, Homo sapiens
caaacggtacacag

SEQ ID NO: 499976 - DNA, 16 bp, Homo sapiens
caaactgactcttaag

SEQ ID NO: 499977 - DNA, 19 bp, Homo sapiens
caaacttaagaaacactga

SEQ ID NO: 499978 - DNA, 16 bp, Homo sapiens
caaaggagtagaaaga

SEQ ID NO: 499979 - DNA, 11 bp, Homo sapiens
caaaggctggg

SEQ ID NO: 499980 - DNA, 22 bp, Homo sapiens
caaagtcatgcaaaggctggga

SEQ ID NO: 499981 - DNA, 16 bp, Homo sapiens
caaagtctaaagttta

SEQ ID NO: 499982 - DNA, 19 bp, Homo sapiens
caaagtctaaagtttacag

SEQ ID NO: 499983 - DNA, 14 bp, Homo sapiens
caaatcaaagcaga

SEQ ID NO: 499984 - DNA, 14 bp, Homo sapiens
caaatcactgaact

SEQ ID NO: 499985 - DNA, 15 bp, Homo sapiens
caaatcactgaactt

SEQ ID NO: 499986 - DNA, 20 bp, Homo sapiens
caaattctacaacttttcct

SEQ ID NO: 499987 - DNA, 15 bp, Homo sapiens
caaattgtgtgaaag

SEQ ID NO: 499988 - DNA, 22 bp, Homo sapiens
caacaccttcagaggctgaggt

SEQ ID NO: 499989 - DNA, 16 bp, Homo sapiens
caacagagcaagactc

SEQ ID NO: 499990 - DNA, 17 bp, Homo sapiens
caacagcaaatcacgac

SEQ ID NO: 499991 - DNA, 17 bp, Homo sapiens
caacatgtataatattt

SEQ ID NO: 499992 - DNA, 19 bp, Homo sapiens
caacatgtataatattttt

SEQ ID NO: 499993 - DNA, 11 bp, Homo sapiens
caacctggaga

SEQ ID NO: 499994 - DNA, 21 bp, Homo sapiens
caactatctcatttccaagca

SEQ ID NO: 499995 - DNA, 12 bp, Homo sapiens
caactccagaaa

SEQ ID NO: 499996 - DNA, 22 bp, Homo sapiens
caactcgaatcactcatttatt

SEQ ID NO: 499997 - DNA, 13 bp, Homo sapiens
caactgaggcaga

SEQ ID NO: 499998 - DNA, 14 bp, Homo sapiens
caactgaggcagac

SEQ ID NO: 499999 - DNA, 13 bp, Homo sapiens
caactgctccagc

SEQ ID NO: 500000 - DNA, 16 bp, Homo sapiens
caactgctccagcctc

SEQ ID NO: 500001 - DNA, 17 bp, Homo sapiens
caactgctccagcctct

SEQ ID NO: 500002 - DNA, 19 bp, Homo sapiens
caactgctccagcctctgc

SEQ ID NO: 500003 - DNA, 20 bp, Homo sapiens
caactgctccagcctctgcc

SEQ ID NO: 500004 - DNA, 22 bp, Homo sapiens
caactgctccagcctctgccgc

SEQ ID NO: 500005 - DNA, 14 bp, Homo sapiens
caacttcttcagag

SEQ ID NO: 500006 - DNA, 12 bp, Homo sapiens
caacttgggaac

SEQ ID NO: 500007 - DNA, 13 bp, Homo sapiens
caagaagcaggct

SEQ ID NO: 500008 - DNA, 18 bp, Homo sapiens
caagaatcagtgcaaaga

SEQ ID NO: 500009 - DNA, 19 bp, Homo sapiens
caagaatcagtgcaaagat

SEQ ID NO: 500010 - DNA, 15 bp, Homo sapiens
caagacccctgtctt

SEQ ID NO: 500011 - DNA, 14 bp, Homo sapiens
caagaccctgtctc

SEQ ID NO: 500012 - DNA, 14 bp, Homo sapiens
caagactctgtctc

SEQ ID NO: 500013 - DNA, 22 bp, Homo sapiens
caagactggaaggtggggacag

SEQ ID NO: 500014 - DNA, 18 bp, Homo sapiens
caagatcacgccactgca

SEQ ID NO: 500015 - DNA, 18 bp, Homo sapiens
caagcaggctcaacataa

SEQ ID NO: 500016 - DNA, 10 bp, Homo sapiens
caagcatctc

SEQ ID NO: 500017 - DNA, 15 bp, Homo sapiens
caagctatcctggct

SEQ ID NO: 500018 - DNA, 16 bp, Homo sapiens
caagctcaggaccagg

SEQ ID NO: 500019 - DNA, 18 bp, Homo sapiens
caaggaaaccacagctgc

SEQ ID NO: 500020 - DNA, 21 bp, Homo sapiens
caaggaaaccacagctgctgg

SEQ ID NO: 500021 - DNA, 14 bp, Homo sapiens
caaggagaggaggc

SEQ ID NO: 500022 - DNA, 18 bp, Homo sapiens
caaggcaactagtggaga

SEQ ID NO: 500023 - DNA, 23 bp, Homo sapiens
caaggcaactagtggagagaact

SEQ ID NO: 500024 - DNA, 14 bp, Homo sapiens
caagggctgtaggt

SEQ ID NO: 500025 - DNA, 20 bp, Homo sapiens
caagtgattgacaactgaag

SEQ ID NO: 500026 - DNA, 18 bp, Homo sapiens
caagtgattgggacagag

SEQ ID NO: 500027 - DNA, 18 bp, Homo sapiens
caagtggcagagcttgga

SEQ ID NO: 500028 - DNA, 23 bp, Homo sapiens
caagtggcagagcttggactgga

SEQ ID NO: 500029 - DNA, 16 bp, Homo sapiens
caagttgtttcattga

SEQ ID NO: 500030 - DNA, 23 bp, Homo sapiens
caataaaatccatacatttgtgt

SEQ ID NO: 500031 - DNA, 19 bp, Homo sapiens
caataaactgaatttttct

SEQ ID NO: 500032 - DNA, 23 bp, Homo sapiens
caatacatcccttacctgggaaa

SEQ ID NO: 500033 - DNA, 14 bp, Homo sapiens
caatacctcttgga

SEQ ID NO: 500034 - DNA, 19 bp, Homo sapiens
caatagtcaaattgtgtga

SEQ ID NO: 500035 - DNA, 12 bp, Homo sapiens
caatatggagaa

SEQ ID NO: 500036 - DNA, 12 bp, Homo sapiens
caatatttcaga

SEQ ID NO: 500037 - DNA, 20 bp, Homo sapiens
caatatttcagataatcaca

SEQ ID NO: 500038 - DNA, 16 bp, Homo sapiens
caatattttccatgaa

SEQ ID NO: 500039 - DNA, 20 bp, Homo sapiens
caatattttccatgaaaatg

SEQ ID NO: 500040 - DNA, 17 bp, Homo sapiens
caatcagcctagttgat

SEQ ID NO: 500041 - DNA, 20 bp, Homo sapiens
caatgccatcctcaaacact

SEQ ID NO: 500042 - DNA, 17 bp, Homo sapiens
caatgctgcctgggagc

SEQ ID NO: 500043 - DNA, 23 bp, Homo sapiens
caatgctgtattttaaaagaatg

SEQ ID NO: 500044 - DNA, 13 bp, Homo sapiens
caatggtttgcaa

SEQ ID NO: 500045 - DNA, 16 bp, Homo sapiens
caatggtttgcaagga

SEQ ID NO: 500046 - DNA, 20 bp, Homo sapiens
caatggtttgcaaggaagcc

SEQ ID NO: 500047 - DNA, 11 bp, Homo sapiens
caatgtgccct

SEQ ID NO: 500048 - DNA, 18 bp, Homo sapiens
caattccatgctataaaa

SEQ ID NO: 500049 - DNA, 17 bp, Homo sapiens
caattcttccctatctt

SEQ ID NO: 500050 - DNA, 22 bp, Homo sapiens
caattcttccctatctttgcca

SEQ ID NO: 500051 - DNA, 17 bp, Homo sapiens
cacaaacctgcctgggt

SEQ ID NO: 500052 - DNA, 13 bp, Homo sapiens
cacaaactcacca

SEQ ID NO: 500053 - DNA, 13 bp, Homo sapiens
cacaaagggccca

SEQ ID NO: 500054 - DNA, 23 bp, Homo sapiens
cacaaccatctgtccctgcctca

SEQ ID NO: 500055 - DNA, 18 bp, Homo sapiens
cacaagactgcacatcaa

SEQ ID NO: 500056 - DNA, 14 bp, Homo sapiens
cacacaacaccagg

SEQ ID NO: 500057 - DNA, 17 bp, Homo sapiens
cacacaacaccaggact

SEQ ID NO: 500058 - DNA, 15 bp, Homo sapiens
cacacacacatacag

SEQ ID NO: 500059 - DNA, 15 bp, Homo sapiens
cacacacaggagcat

SEQ ID NO: 500060 - DNA, 13 bp, Homo sapiens
cacacagctccca

SEQ ID NO: 500061 - DNA, 13 bp, Homo sapiens
cacacaggcaact

SEQ ID NO: 500062 - DNA, 16 bp, Homo sapiens
cacacaggcaactgag

SEQ ID NO: 500063 - DNA, 15 bp, Homo sapiens
cacaccccaacatgc

SEQ ID NO: 500064 - DNA, 19 bp, Homo sapiens
cacacgcacgcacacacac

SEQ ID NO: 500065 - DNA, 23 bp, Homo sapiens
cacactgtagcattacagtgggt

SEQ ID NO: 500066 - DNA, 19 bp, Homo sapiens
cacagacctgctctggaca

SEQ ID NO: 500067 - DNA, 21 bp, Homo sapiens
cacagagcaggactgcacagc

SEQ ID NO: 500068 - DNA, 14 bp, Homo sapiens
cacagagcggggac

SEQ ID NO: 500069 - DNA, 12 bp, Homo sapiens
cacagctgctgg

SEQ ID NO: 500070 - DNA, 20 bp, Homo sapiens
cacagctgctggagactcct

SEQ ID NO: 500071 - DNA, 19 bp, Homo sapiens
cacaggaaccacaagactg

SEQ ID NO: 500072 - DNA, 12 bp, Homo sapiens
cacaggagggta

SEQ ID NO: 500073 - DNA, 18 bp, Homo sapiens
cacaggcaactgaggcag

SEQ ID NO: 500074 - DNA, 22 bp, Homo sapiens
cacaggcaactgaggcagacag

SEQ ID NO: 500075 - DNA, 22 bp, Homo sapiens
cacaggggctatcccttctcag

SEQ ID NO: 500076 - DNA, 21 bp, Homo sapiens
cacatacagagctctctgagg

SEQ ID NO: 500077 - DNA, 24 bp, Homo sapiens
cacatcagctccactttcagtgaa

SEQ ID NO: 500078 - DNA, 21 bp, Homo sapiens
cacatctgtggagatgcccag

SEQ ID NO: 500079 - DNA, 16 bp, Homo sapiens
cacatgaagtccaagc

SEQ ID NO: 500080 - DNA, 18 bp, Homo sapiens
cacatgcggagaacaaat

SEQ ID NO: 500081 - DNA, 20 bp, Homo sapiens
cacatttacactagaggcca

SEQ ID NO: 500082 - DNA, 19 bp, Homo sapiens
cacatttgtaaatgtcttt

SEQ ID NO: 500083 - DNA, 13 bp, Homo sapiens
caccaagctcaaa

SEQ ID NO: 500084 - DNA, 16 bp, Homo sapiens
caccacctctgtgggc

SEQ ID NO: 500085 - DNA, 12 bp, Homo sapiens
caccagccttgc

SEQ ID NO: 500086 - DNA, 16 bp, Homo sapiens
caccagccttgctctc

SEQ ID NO: 500087 - DNA, 20 bp, Homo sapiens
caccagccttgctctcttca

SEQ ID NO: 500088 - DNA, 17 bp, Homo sapiens
caccaggagtccctggt

SEQ ID NO: 500089 - DNA, 18 bp, Homo sapiens
caccagttcctttcaatg

SEQ ID NO: 500090 - DNA, 21 bp, Homo sapiens
cacccagatgggggaaagcac

SEQ ID NO: 500091 - DNA, 22 bp, Homo sapiens
cacccctcccctgccctagagc

SEQ ID NO: 500092 - DNA, 13 bp, Homo sapiens
caccctcatgctg

SEQ ID NO: 500093 - DNA, 14 bp, Homo sapiens
cacccttggacttg

SEQ ID NO: 500094 - DNA, 16 bp, Homo sapiens
cacccttggacttgag

SEQ ID NO: 500095 - DNA, 21 bp, Homo sapiens
caccgttggggattggggaag

SEQ ID NO: 500096 - DNA, 17 bp, Homo sapiens
cacctagaaacttgtta

SEQ ID NO: 500097 - DNA, 19 bp, Homo sapiens
cacctcagagtatggagct

SEQ ID NO: 500098 - DNA, 17 bp, Homo sapiens
cacctccttccagcact

SEQ ID NO: 500099 - DNA, 23 bp, Homo sapiens
cacctgggcagggatgatggcag

SEQ ID NO: 500100 - DNA, 15 bp, Homo sapiens
cacctggggctgctg

SEQ ID NO: 500101 - DNA, 20 bp, Homo sapiens
caccttcagaggctgaggtg

SEQ ID NO: 500102 - DNA, 23 bp, Homo sapiens
caccttgagaggcatgacagctg

SEQ ID NO: 500103 - DNA, 22 bp, Homo sapiens
cacctttagaatattaaaaatt

SEQ ID NO: 500104 - DNA, 12 bp, Homo sapiens
cacgcacacaca

SEQ ID NO: 500105 - DNA, 19 bp, Homo sapiens
cacgcacacacacatacag

SEQ ID NO: 500106 - DNA, 14 bp, Homo sapiens
cacgcccaccagcc

SEQ ID NO: 500107 - DNA, 17 bp, Homo sapiens
cacgcccaccagccttg

SEQ ID NO: 500108 - DNA, 12 bp, Homo sapiens
cacggctgctga

SEQ ID NO: 500109 - DNA, 15 bp, Homo sapiens
cacgggggcagctga

SEQ ID NO: 500110 - DNA, 20 bp, Homo sapiens
cacggtttgaagcctggaac

SEQ ID NO: 500111 - DNA, 16 bp, Homo sapiens
cactagaggccaggga

SEQ ID NO: 500112 - DNA, 15 bp, Homo sapiens
cactcaagaagcagg

SEQ ID NO: 500113 - DNA, 16 bp, Homo sapiens
cactcatttatttcca

SEQ ID NO: 500114 - DNA, 14 bp, Homo sapiens
cactcccaggcagc

SEQ ID NO: 500115 - DNA, 16 bp, Homo sapiens
cactctagcctggcaa

SEQ ID NO: 500116 - DNA, 16 bp, Homo sapiens
cactgaaatatacaca

SEQ ID NO: 500117 - DNA, 23 bp, Homo sapiens
cactgaagaagcaccaatcatga

SEQ ID NO: 500118 - DNA, 23 bp, Homo sapiens
cactgacactggtattcctgcct

SEQ ID NO: 500119 - DNA, 22 bp, Homo sapiens
cactgcctgatggacctgtcac

SEQ ID NO: 500120 - DNA, 22 bp, Homo sapiens
cactggagaattgaaaaggact

SEQ ID NO: 500121 - DNA, 17 bp, Homo sapiens
cactgggacttgcaaaa

SEQ ID NO: 500122 - DNA, 13 bp, Homo sapiens
cactgggcttcta

SEQ ID NO: 500123 - DNA, 14 bp, Homo sapiens
cactgggggagggg

SEQ ID NO: 500124 - DNA, 18 bp, Homo sapiens
cactgggggaggggacat

SEQ ID NO: 500125 - DNA, 19 bp, Homo sapiens
cactggtattcctgcctcc

SEQ ID NO: 500126 - DNA, 21 bp, Homo sapiens
cactgtagcattacagtgggt

SEQ ID NO: 500127 - DNA, 16 bp, Homo sapiens
cactgtgctcagggct

SEQ ID NO: 500128 - DNA, 17 bp, Homo sapiens
cactgtgggaaggccag

SEQ ID NO: 500129 - DNA, 21 bp, Homo sapiens
cactgtgggaaggccagctgc

SEQ ID NO: 500130 - DNA, 22 bp, Homo sapiens
cactgtgggtagacacacatga

SEQ ID NO: 500131 - DNA, 17 bp, Homo sapiens
cacttattctcaagaag

SEQ ID NO: 500132 - DNA, 19 bp, Homo sapiens
cacttggcatcagctggcg

SEQ ID NO: 500133 - DNA, 22 bp, Homo sapiens
cacttggcccaagtggcagagc

SEQ ID NO: 500134 - DNA, 22 bp, Homo sapiens
cacttgtgccaacactcaagaa

SEQ ID NO: 500135 - DNA, 17 bp, Homo sapiens
cacttgtgttttgcaag

SEQ ID NO: 500136 - DNA, 22 bp, Homo sapiens
cacttgtgttttgcaagccaga

SEQ ID NO: 500137 - DNA, 21 bp, Homo sapiens
cagaaacaccctcacactggg

SEQ ID NO: 500138 - DNA, 20 bp, Homo sapiens
cagaaaccattgttcagaag

SEQ ID NO: 500139 - DNA, 20 bp, Homo sapiens
cagaaaggaaaagattcctg

SEQ ID NO: 500140 - DNA, 11 bp, Homo sapiens
cagaacactgt

SEQ ID NO: 500141 - DNA, 20 bp, Homo sapiens
cagaaccagtgtctgaacca

SEQ ID NO: 500142 - DNA, 20 bp, Homo sapiens
cagaacctggagggctagaa

SEQ ID NO: 500143 - DNA, 23 bp, Homo sapiens
cagaagacagcagcaagtgtgct

SEQ ID NO: 500144 - DNA, 18 bp, Homo sapiens
cagaagacctccctgtga

SEQ ID NO: 500145 - DNA, 21 bp, Homo sapiens
cagaagacctccctgtgagag

SEQ ID NO: 500146 - DNA, 18 bp, Homo sapiens
cagaagacttcccagctt

SEQ ID NO: 500147 - DNA, 16 bp, Homo sapiens
cagaagctgcagctgg

SEQ ID NO: 500148 - DNA, 21 bp, Homo sapiens
cagaagctgcagctggtctgt

SEQ ID NO: 500149 - DNA, 18 bp, Homo sapiens
cagaatggggtgcatgaa

SEQ ID NO: 500150 - DNA, 21 bp, Homo sapiens
cagaattctgctacctcactg

SEQ ID NO: 500151 - DNA, 15 bp, Homo sapiens
cagacagcagctcag

SEQ ID NO: 500152 - DNA, 18 bp, Homo sapiens
cagacagcagctcaggca

SEQ ID NO: 500153 - DNA, 19 bp, Homo sapiens
cagacagcagctcaggcac

SEQ ID NO: 500154 - DNA, 23 bp, Homo sapiens
cagactcctgactgtctcccggg

SEQ ID NO: 500155 - DNA, 15 bp, Homo sapiens
cagagaaagaggaag

SEQ ID NO: 500156 - DNA, 17 bp, Homo sapiens
cagagaaagaggaagct

SEQ ID NO: 500157 - DNA, 19 bp, Homo sapiens
cagagactcagggccccag

SEQ ID NO: 500158 - DNA, 21 bp, Homo sapiens
cagagactcagggccccagca

SEQ ID NO: 500159 - DNA, 22 bp, Homo sapiens
cagagattggaatgggcagctc

SEQ ID NO: 500160 - DNA, 20 bp, Homo sapiens
cagagcaagactctgtctca

SEQ ID NO: 500161 - DNA, 21 bp, Homo sapiens
cagagcaagactctgtctcaa

SEQ ID NO: 500162 - DNA, 14 bp, Homo sapiens
cagagcaggactgc

SEQ ID NO: 500163 - DNA, 19 bp, Homo sapiens
cagagccaggctgttggaa

SEQ ID NO: 500164 - DNA, 14 bp, Homo sapiens
cagagcgcccctcc

SEQ ID NO: 500165 - DNA, 15 bp, Homo sapiens
cagagctgacacagg

SEQ ID NO: 500166 - DNA, 19 bp, Homo sapiens
cagagctgacacaggatga

SEQ ID NO: 500167 - DNA, 15 bp, Homo sapiens
cagagctgccctctc

SEQ ID NO: 500168 - DNA, 17 bp, Homo sapiens
cagagctgccctctcct

SEQ ID NO: 500169 - DNA, 19 bp, Homo sapiens
cagagctgccctctcctgg

SEQ ID NO: 500170 - DNA, 15 bp, Homo sapiens
cagagcttggactgg

SEQ ID NO: 500171 - DNA, 19 bp, Homo sapiens
cagagcttggactggatgc

SEQ ID NO: 500172 - DNA, 21 bp, Homo sapiens
cagaggagtacaggtgaagca

SEQ ID NO: 500173 - DNA, 16 bp, Homo sapiens
cagagttccccatgca

SEQ ID NO: 500174 - DNA, 19 bp, Homo sapiens
cagatatattaagtgactg

SEQ ID NO: 500175 - DNA, 22 bp, Homo sapiens
cagatggcggtgatcagcagag

SEQ ID NO: 500176 - DNA, 22 bp, Homo sapiens
cagattgagttttcttctgtga

SEQ ID NO: 500177 - DNA, 15 bp, Homo sapiens
cagatttgggctgga

SEQ ID NO: 500178 - DNA, 20 bp, Homo sapiens
cagcactaaagcagtggaca

SEQ ID NO: 500179 - DNA, 13 bp, Homo sapiens
cagcagccagctc

SEQ ID NO: 500180 - DNA, 13 bp, Homo sapiens
cagcagctcaggc

SEQ ID NO: 500181 - DNA, 16 bp, Homo sapiens
cagcagctcaggcaca

SEQ ID NO: 500182 - DNA, 21 bp, Homo sapiens
cagcagggttttgggttgacc

SEQ ID NO: 500183 - DNA, 19 bp, Homo sapiens
cagcagttcagagctgccc

SEQ ID NO: 500184 - DNA, 22 bp, Homo sapiens
cagcatcccttgaccaggcctg

SEQ ID NO: 500185 - DNA, 20 bp, Homo sapiens
cagcatgggcccaggaatgc

SEQ ID NO: 500186 - DNA, 23 bp, Homo sapiens
cagcatttccacaccaagcagca

SEQ ID NO: 500187 - DNA, 17 bp, Homo sapiens
cagccagcagccagctc

SEQ ID NO: 500188 - DNA, 18 bp, Homo sapiens
cagccagcagccagctct

SEQ ID NO: 500189 - DNA, 19 bp, Homo sapiens
cagccagcagccagctctc

SEQ ID NO: 500190 - DNA, 14 bp, Homo sapiens
cagccagcagttca

SEQ ID NO: 500191 - DNA, 15 bp, Homo sapiens
cagccagcagttcag

SEQ ID NO: 500192 - DNA, 15 bp, Homo sapiens
cagccagctctcagc

SEQ ID NO: 500193 - DNA, 16 bp, Homo sapiens
cagcccatctgcctgt

SEQ ID NO: 500194 - DNA, 14 bp, Homo sapiens
cagcccctgatcct

SEQ ID NO: 500195 - DNA, 16 bp, Homo sapiens
cagccgctcctgtctg

SEQ ID NO: 500196 - DNA, 19 bp, Homo sapiens
cagccgctcctgtctgcca

SEQ ID NO: 500197 - DNA, 19 bp, Homo sapiens
cagccggtacctgggaagg

SEQ ID NO: 500198 - DNA, 15 bp, Homo sapiens
cagcctagccgacct

SEQ ID NO: 500199 - DNA, 13 bp, Homo sapiens
cagcctctgccgc

SEQ ID NO: 500200 - DNA, 14 bp, Homo sapiens
cagcctctgccgct

SEQ ID NO: 500201 - DNA, 15 bp, Homo sapiens
cagcctctgccgctg

SEQ ID NO: 500202 - DNA, 16 bp, Homo sapiens
cagcctctgccgctgc

SEQ ID NO: 500203 - DNA, 21 bp, Homo sapiens
cagcctctgccgctgccatgc

SEQ ID NO: 500204 - DNA, 22 bp, Homo sapiens
cagcctctgccgctgccatgct

SEQ ID NO: 500205 - DNA, 20 bp, Homo sapiens
cagcctgctccttcccagga

SEQ ID NO: 500206 - DNA, 22 bp, Homo sapiens
cagcctgctccttcccaggagt

SEQ ID NO: 500207 - DNA, 18 bp, Homo sapiens
cagcctggtgggcctcct

SEQ ID NO: 500208 - DNA, 21 bp, Homo sapiens
cagccttccccttgcccaggg

SEQ ID NO: 500209 - DNA, 14 bp, Homo sapiens
cagccttgctctct

SEQ ID NO: 500210 - DNA, 16 bp, Homo sapiens
cagccttgctctcttc

SEQ ID NO: 500211 - DNA, 15 bp, Homo sapiens
cagcgtactcatcat

SEQ ID NO: 500212 - DNA, 14 bp, Homo sapiens
cagcgtcctgtcca

SEQ ID NO: 500213 - DNA, 18 bp, Homo sapiens
cagctattgatataaata

SEQ ID NO: 500214 - DNA, 23 bp, Homo sapiens
cagctcaggcacacttcttcttg

SEQ ID NO: 500215 - DNA, 23 bp, Homo sapiens
cagctcccataaccgctgattct

SEQ ID NO: 500216 - DNA, 12 bp, Homo sapiens
cagctctcagcc

SEQ ID NO: 500217 - DNA, 9 bp, Homo sapiens
cagctgcct

SEQ ID NO: 500218 - DNA, 21 bp, Homo sapiens
cagctgcctcccctcctctgc

SEQ ID NO: 500219 - DNA, 23 bp, Homo sapiens
cagctgctggagactcctaggca

SEQ ID NO: 500220 - DNA, 18 bp, Homo sapiens
cagctgggtggcactgcc

SEQ ID NO: 500221 - DNA, 20 bp, Homo sapiens
aactgactcttaagaagact

SEQ ID NO: 500222 - DNA, 17 bp, Homo sapiens
aactgctccagcctctg

SEQ ID NO: 500223 - DNA, 20 bp, Homo sapiens
aactgctccagcctctgccg

SEQ ID NO: 500224 - DNA, 17 bp, Homo sapiens
aactgggacaggggaga

SEQ ID NO: 500225 - DNA, 18 bp, Homo sapiens
aatcccggtttcagaagc

SEQ ID NO: 500226 - DNA, 19 bp, Homo sapiens
aatcccggtttcagaagct

SEQ ID NO: 500227 - DNA, 16 bp, Homo sapiens
aatctcaatatttcag

SEQ ID NO: 500228 - DNA, 19 bp, Homo sapiens
aatctggagagctagaacc

SEQ ID NO: 500229 - DNA, 23 bp, Homo sapiens
aatcttacagctgggtggcactg

SEQ ID NO: 500230 - DNA, 17 bp, Homo sapiens
aatgaagttgtaggtaa

SEQ ID NO: 500231 - DNA, 19 bp, Homo sapiens
aatgagttacctacatttt

SEQ ID NO: 500232 - DNA, 16 bp, Homo sapiens
aatgataactggaaac

SEQ ID NO: 500233 - DNA, 20 bp, Homo sapiens
aatgataactggaaacttca

SEQ ID NO: 500234 - DNA, 17 bp, Homo sapiens
aatgatccttatgatgt

SEQ ID NO: 500235 - DNA, 17 bp, Homo sapiens
aatgatcttttcaagtt

SEQ ID NO: 500236 - DNA, 14 bp, Homo sapiens
aatgatgttgaata

SEQ ID NO: 500237 - DNA, 21 bp, Homo sapiens
aatgattatgaattacatttg

SEQ ID NO: 500238 - DNA, 18 bp, Homo sapiens
aatgcaacaacatgtata

SEQ ID NO: 500239 - DNA, 17 bp, Homo sapiens
acttttccatgtatcta

SEQ ID NO: 500240 - DNA, 21 bp, Homo sapiens
acttttccatgtatctacctc

SEQ ID NO: 500241 - DNA, 23 bp, Homo sapiens
acttttttgctatccagctattt

SEQ ID NO: 500242 - DNA, 16 bp, Homo sapiens
agaaaaacatgtcatg

SEQ ID NO: 500243 - DNA, 17 bp, Homo sapiens
agaaacataaataaaat

SEQ ID NO: 500244 - DNA, 15 bp, Homo sapiens
agaaacatttggtaa

SEQ ID NO: 500245 - DNA, 15 bp, Homo sapiens
agaaagacagagctg

SEQ ID NO: 500246 - DNA, 18 bp, Homo sapiens
agaaagacagagctggga

SEQ ID NO: 500247 - DNA, 14 bp, Homo sapiens
agaaagtcagacct

SEQ ID NO: 500248 - DNA, 21 bp, Homo sapiens
agaaagttgcacggctgctga

SEQ ID NO: 500249 - DNA, 16 bp, Homo sapiens
agaaatgcaaattctc

SEQ ID NO: 500250 - DNA, 17 bp, Homo sapiens
agaacactgtgaaaaca

SEQ ID NO: 500251 - DNA, 19 bp, Homo sapiens
agaacagccgctcctgtct

SEQ ID NO: 500252 - DNA, 18 bp, Homo sapiens
agaacatctgtcctgtga

SEQ ID NO: 500253 - DNA, 16 bp, Homo sapiens
agaaccaagaagggct

SEQ ID NO: 500254 - DNA, 20 bp, Homo sapiens
agaaccaggcaacttgggaa

SEQ ID NO: 500255 - DNA, 23 bp, Homo sapiens
agaacctggagggctagaactgg

SEQ ID NO: 500256 - DNA, 17 bp, Homo sapiens
agaacctgtagagctag

SEQ ID NO: 500257 - DNA, 16 bp, Homo sapiens
agaactttgaaggaca

SEQ ID NO: 500258 - DNA, 20 bp, Homo sapiens
agaactttgcatagcagctg

SEQ ID NO: 500259 - DNA, 14 bp, Homo sapiens
agaagaacagcaga

SEQ ID NO: 500260 - DNA, 21 bp, Homo sapiens
agaagaactgaaatcatactt

SEQ ID NO: 500261 - DNA, 13 bp, Homo sapiens
agaagaaggcagc

SEQ ID NO: 500262 - DNA, 19 bp, Homo sapiens
agaagacctccctgtgaga

SEQ ID NO: 500263 - DNA, 18 bp, Homo sapiens
agaagactgcattatatt

SEQ ID NO: 500264 - DNA, 22 bp, Homo sapiens
agaagagagtccatatttcaat

SEQ ID NO: 500265 - DNA, 17 bp, Homo sapiens
agaagatcctaaaacaa

SEQ ID NO: 500266 - DNA, 18 bp, Homo sapiens
agaagatcctaaaacaaa

SEQ ID NO: 500267 - DNA, 18 bp, Homo sapiens
agaagctaaaacctgagc

SEQ ID NO: 500268 - DNA, 21 bp, Homo sapiens
agaagctgaagatccccaact

SEQ ID NO: 500269 - DNA, 13 bp, Homo sapiens
agaagctggagga

SEQ ID NO: 500270 - DNA, 16 bp, Homo sapiens
agaagctggaggacta

SEQ ID NO: 500271 - DNA, 14 bp, Homo sapiens
agaagggctagaac

SEQ ID NO: 500272 - DNA, 18 bp, Homo sapiens
agaagttgatatagaaca

SEQ ID NO: 500273 - DNA, 13 bp, Homo sapiens
agaagttgatatg

SEQ ID NO: 500274 - DNA, 14 bp, Homo sapiens
agaataaaattgta

SEQ ID NO: 500275 - DNA, 15 bp, Homo sapiens
agaatactaataaaa

SEQ ID NO: 500276 - DNA, 20 bp, Homo sapiens
agaatactaataaaatacat

SEQ ID NO: 500277 - DNA, 14 bp, Homo sapiens
agaatattaaaaat

SEQ ID NO: 500278 - DNA, 16 bp, Homo sapiens
agaatctttgcaagaa

SEQ ID NO: 500279 - DNA, 22 bp, Homo sapiens
agaatgccatatttttgagggc

SEQ ID NO: 500280 - DNA, 16 bp, Homo sapiens
agacaaatgggactga

SEQ ID NO: 500281 - DNA, 12 bp, Homo sapiens
agacacacatga

SEQ ID NO: 500282 - DNA, 15 bp, Homo sapiens
agacacacatgaagt

SEQ ID NO: 500283 - DNA, 16 bp, Homo sapiens
agacacactgaagaag

SEQ ID NO: 500284 - DNA, 13 bp, Homo sapiens
agacactgaaata

SEQ ID NO: 500285 - DNA, 21 bp, Homo sapiens
agacactgaaatatacacaca

SEQ ID NO: 500286 - DNA, 22 bp, Homo sapiens
agacactgaaatatacacacag

SEQ ID NO: 500287 - DNA, 22 bp, Homo sapiens
agacatcctcaaaagaaagaga

SEQ ID NO: 500288 - DNA, 14 bp, Homo sapiens
agaccagtctggcc

SEQ ID NO: 500289 - DNA, 12 bp, Homo sapiens
agacctcagcct

SEQ ID NO: 500290 - DNA, 13 bp, Homo sapiens
agacctcagcctg

SEQ ID NO: 500291 - DNA, 20 bp, Homo sapiens
agacctcagcctgtgctgcc

SEQ ID NO: 500292 - DNA, 19 bp, Homo sapiens
agaccttgggggaagactt

SEQ ID NO: 500293 - DNA, 17 bp, Homo sapiens
agactatattgtacaca

SEQ ID NO: 500294 - DNA, 18 bp, Homo sapiens
agactatttaacttgagg

SEQ ID NO: 500295 - DNA, 16 bp, Homo sapiens
agactcccaagctgga

SEQ ID NO: 500296 - DNA, 21 bp, Homo sapiens
agactgcattatatttattac

SEQ ID NO: 500297 - DNA, 21 bp, Homo sapiens
agactgggtgaggataacaca

SEQ ID NO: 500298 - DNA, 17 bp, Homo sapiens
agacttaatagaaacat

SEQ ID NO: 500299 - DNA, 20 bp, Homo sapiens
agacttgctgaatcggaatc

SEQ ID NO: 500300 - DNA, 13 bp, Homo sapiens
agagaaaaacaaa

SEQ ID NO: 500301 - DNA, 15 bp, Homo sapiens
agagaaaaacaaatt

SEQ ID NO: 500302 - DNA, 20 bp, Homo sapiens
agagaaaacttatttgagtg

SEQ ID NO: 500303 - DNA, 17 bp, Homo sapiens
agagaacttccagatcc

SEQ ID NO: 500304 - DNA, 12 bp, Homo sapiens
agagaaggagcc

SEQ ID NO: 500305 - DNA, 13 bp, Homo sapiens
agagaaggagcca

SEQ ID NO: 500306 - DNA, 17 bp, Homo sapiens
agagacacactgaagaa

SEQ ID NO: 500307 - DNA, 14 bp, Homo sapiens
agagacatggtatt

SEQ ID NO: 500308 - DNA, 23 bp, Homo sapiens
agagacatggtattgactcaaca

SEQ ID NO: 500309 - DNA, 19 bp, Homo sapiens
agagaccaggcaaagcaag

SEQ ID NO: 500310 - DNA, 20 bp, Homo sapiens
agagactcagggccccagca

SEQ ID NO: 500311 - DNA, 19 bp, Homo sapiens
agagagaatcagacctggg

SEQ ID NO: 500312 - DNA, 21 bp, Homo sapiens
agagagatcaaatggaaagga

SEQ ID NO: 500313 - DNA, 19 bp, Homo sapiens
agagatcaaatggaaagga

SEQ ID NO: 500314 - DNA, 20 bp, Homo sapiens
agagcacacttggcccaagt

SEQ ID NO: 500315 - DNA, 16 bp, Homo sapiens
agagcacttcacacag

SEQ ID NO: 500316 - DNA, 16 bp, Homo sapiens
agagctagaacctgga

SEQ ID NO: 500317 - DNA, 22 bp, Homo sapiens
agagctagaacctggagaacta

SEQ ID NO: 500318 - DNA, 18 bp, Homo sapiens
agagctagaacctggagg

SEQ ID NO: 500319 - DNA, 22 bp, Homo sapiens
agagctgacacaaacctgcctg

SEQ ID NO: 500320 - DNA, 13 bp, Homo sapiens
agagctgccctct

SEQ ID NO: 500321 - DNA, 17 bp, Homo sapiens
agagctgccctctcctg

SEQ ID NO: 500322 - DNA, 22 bp, Homo sapiens
agagctgccctctcctgggcag

SEQ ID NO: 500323 - DNA, 18 bp, Homo sapiens
agagctggagcctggtgc

SEQ ID NO: 500324 - DNA, 19 bp, Homo sapiens
agagctggagcctggtgcc

SEQ ID NO: 500325 - DNA, 23 bp, Homo sapiens
agagcttggactggatgcatgtt

SEQ ID NO: 500326 - DNA, 16 bp, Homo sapiens
agaggcatgacagctg

SEQ ID NO: 500327 - DNA, 16 bp, Homo sapiens
agagggcacacactgt

SEQ ID NO: 500328 - DNA, 15 bp, Homo sapiens
agaggggcagaacag

SEQ ID NO: 500329 - DNA, 21 bp, Homo sapiens
agagtaagcacctttagaata

SEQ ID NO: 500330 - DNA, 17 bp, Homo sapiens
agagtacagatcctctg

SEQ ID NO: 500331 - DNA, 23 bp, Homo sapiens
agagtattggtctcctctcagcc

SEQ ID NO: 500332 - DNA, 15 bp, Homo sapiens
gcctttggcaggtgc

SEQ ID NO: 500333 - DNA, 16 bp, Homo sapiens
gcgagactctgtctca

SEQ ID NO: 500334 - DNA, 14 bp, Homo sapiens
gcgggaaggagggt

SEQ ID NO: 500335 - DNA, 19 bp, Homo sapiens
gcggggactcggtaagcac

SEQ ID NO: 500336 - DNA, 21 bp, Homo sapiens
gcgtgctcagttcagaatcac

SEQ ID NO: 500337 - DNA, 14 bp, Homo sapiens
gcgtggacaggtgt

SEQ ID NO: 500338 - DNA, 20 bp, Homo sapiens
gctaacacacagctcccata

SEQ ID NO: 500339 - DNA, 17 bp, Homo sapiens
gctaaggcgtggagctg

SEQ ID NO: 500340 - DNA, 21 bp, Homo sapiens
gctaaggcgtggagctgcctg

SEQ ID NO: 500341 - DNA, 14 bp, Homo sapiens
gctacacagggatg

SEQ ID NO: 500342 - DNA, 23 bp, Homo sapiens
gctacagggcgagactctgtctc

SEQ ID NO: 500343 - DNA, 14 bp, Homo sapiens
gctacctcactggg

SEQ ID NO: 500344 - DNA, 17 bp, Homo sapiens
gctactcaggaggctga

SEQ ID NO: 500345 - DNA, 23 bp, Homo sapiens
gctactcaggaggctgaggcagg

SEQ ID NO: 500346 - DNA, 18 bp, Homo sapiens
gctagaaccaagaagggc

SEQ ID NO: 500347 - DNA, 15 bp, Homo sapiens
gctagaacctggaga

SEQ ID NO: 500348 - DNA, 20 bp, Homo sapiens
gctagaacctggagagctag

SEQ ID NO: 500349 - DNA, 20 bp, Homo sapiens
gctagaacctgtagagctag

SEQ ID NO: 500350 - DNA, 14 bp, Homo sapiens
gctagaagctggag

SEQ ID NO: 500351 - DNA, 13 bp, Homo sapiens
gctagatgtatgt

SEQ ID NO: 500352 - DNA, 14 bp, Homo sapiens
gctatattttcatg

SEQ ID NO: 500353 - DNA, 22 bp, Homo sapiens
gctatattttcatgacttttcc

SEQ ID NO: 500354 - DNA, 16 bp, Homo sapiens
gctatcccttctcaga

SEQ ID NO: 500355 - DNA, 17 bp, Homo sapiens
gctatcccttctcagaa

SEQ ID NO: 500356 - DNA, 22 bp, Homo sapiens
gctattgatataaataaaacat

SEQ ID NO: 500357 - DNA, 17 bp, Homo sapiens
gctcagttcagaatcac

SEQ ID NO: 500358 - DNA, 16 bp, Homo sapiens
gctcagttctgcctta

SEQ ID NO: 500359 - DNA, 16 bp, Homo sapiens
gctcatctctgtccca

SEQ ID NO: 500360 - DNA, 17 bp, Homo sapiens
gctcatgcatagtccca

SEQ ID NO: 500361 - DNA, 21 bp, Homo sapiens
gctcattataatgtcattaaa

SEQ ID NO: 500362 - DNA, 14 bp, Homo sapiens
gctccagcctctgc

SEQ ID NO: 500363 - DNA, 19 bp, Homo sapiens
gctccagcctctgccgctg

SEQ ID NO: 500364 - DNA, 12 bp, Homo sapiens
gctcccaaggga

SEQ ID NO: 500365 - DNA, 23 bp, Homo sapiens
gctcccaagggatggtgccctgt

SEQ ID NO: 500366 - DNA, 20 bp, Homo sapiens
gctcctgtctgccagccagc

SEQ ID NO: 500367 - DNA, 18 bp, Homo sapiens
gctcggtggacccaggga

SEQ ID NO: 500368 - DNA, 10 bp, Homo sapiens
gctctcagcc

SEQ ID NO: 500369 - DNA, 18 bp, Homo sapiens
gctctcttcaataaacca

SEQ ID NO: 500370 - DNA, 22 bp, Homo sapiens
gctctgccaacttcttcagagc

SEQ ID NO: 500371 - DNA, 14 bp, Homo sapiens
gctctttggagatc

SEQ ID NO: 500372 - DNA, 22 bp, Homo sapiens
gctgaagatccccaactgctcc

SEQ ID NO: 500373 - DNA, 18 bp, Homo sapiens
gctgacacaaacctgcct

SEQ ID NO: 500374 - DNA, 15 bp, Homo sapiens
gctgaggcaattcta

SEQ ID NO: 500375 - DNA, 19 bp, Homo sapiens
gctgaggtgagaggatcag

SEQ ID NO: 500376 - DNA, 20 bp, Homo sapiens
gctgatgtcctcaccacatg

SEQ ID NO: 500377 - DNA, 23 bp, Homo sapiens
gctgatgttttgtattttgtgtt

SEQ ID NO: 500378 - DNA, 21 bp, Homo sapiens
gctgattctcagggtctctgc

SEQ ID NO: 500379 - DNA, 17 bp, Homo sapiens
gctgcagatttgggctg

SEQ ID NO: 500380 - DNA, 14 bp, Homo sapiens
gctgccatgctttg

SEQ ID NO: 500381 - DNA, 14 bp, Homo sapiens
gctgcccaggccca

SEQ ID NO: 500382 - DNA, 12 bp, Homo sapiens
gctgccccagcc

SEQ ID NO: 500383 - DNA, 14 bp, Homo sapiens
gctgccctctcctg

SEQ ID NO: 500384 - DNA, 17 bp, Homo sapiens
gctgccctctcctgggc

SEQ ID NO: 500385 - DNA, 18 bp, Homo sapiens
gctgccctctcctgggca

SEQ ID NO: 500386 - DNA, 16 bp, Homo sapiens
gctgcctcccctcctc

SEQ ID NO: 500387 - DNA, 13 bp, Homo sapiens
gctgcctgggagc

SEQ ID NO: 500388 - DNA, 20 bp, Homo sapiens
gctgctagcacttggagcca

SEQ ID NO: 500389 - DNA, 12 bp, Homo sapiens
gctgctgcccag

SEQ ID NO: 500390 - DNA, 13 bp, Homo sapiens
gctgctggagact

SEQ ID NO: 500391 - DNA, 14 bp, Homo sapiens
gctgctggagactc

SEQ ID NO: 500392 - DNA, 16 bp, Homo sapiens
gctggaacagattcac

SEQ ID NO: 500393 - DNA, 18 bp, Homo sapiens
gctggagactcctaggca

SEQ ID NO: 500394 - DNA, 14 bp, Homo sapiens
gctggagtgcagtg

SEQ ID NO: 500395 - DNA, 15 bp, Homo sapiens
gctggagtgcagtgg

SEQ ID NO: 500396 - DNA, 17 bp, Homo sapiens
gctgggtggcactgcca

SEQ ID NO: 500397 - DNA, 23 bp, Homo sapiens
gctggtcccagccagcagttcag

SEQ ID NO: 500398 - DNA, 16 bp, Homo sapiens
gctggttggagagcta

SEQ ID NO: 500399 - DNA, 19 bp, Homo sapiens
gctgtattagtcacagaga

SEQ ID NO: 500400 - DNA, 12 bp, Homo sapiens
gctgtattttaa

SEQ ID NO: 500401 - DNA, 13 bp, Homo sapiens
gctgtattttaaa

SEQ ID NO: 500402 - DNA, 16 bp, Homo sapiens
gctgttctcattcctg

SEQ ID NO: 500403 - DNA, 14 bp, Homo sapiens
gcttactcattaaa

SEQ ID NO: 500404 - DNA, 15 bp, Homo sapiens
gcttagacctcagcc

SEQ ID NO: 500405 - DNA, 16 bp, Homo sapiens
gcttagacctcagcct

SEQ ID NO: 500406 - DNA, 19 bp, Homo sapiens
gcttagacctcagcctgtg

SEQ ID NO: 500407 - DNA, 23 bp, Homo sapiens
gcttagacctcagcctgtgctgc

SEQ ID NO: 500408 - DNA, 17 bp, Homo sapiens
gcttagctttgctctgc

SEQ ID NO: 500409 - DNA, 15 bp, Homo sapiens
gcttcagttgttttc

SEQ ID NO: 500410 - DNA, 16 bp, Homo sapiens
gcttgccacagagcgg

SEQ ID NO: 500411 - DNA, 21 bp, Homo sapiens
gcttgccatccctccctccac

SEQ ID NO: 500412 - DNA, 13 bp, Homo sapiens
gcttgcctgcagg

SEQ ID NO: 500413 - DNA, 12 bp, Homo sapiens
gcttggactgga

SEQ ID NO: 500414 - DNA, 23 bp, Homo sapiens
gcttgtcatccacacaacaccag

SEQ ID NO: 500415 - DNA, 15 bp, Homo sapiens
gctttatgtaataat

SEQ ID NO: 500416 - DNA, 22 bp, Homo sapiens
gctttcctttttcccaataaat

SEQ ID NO: 500417 - DNA, 19 bp, Homo sapiens
gctttctccagaaccagtg

SEQ ID NO: 500418 - DNA, 21 bp, Homo sapiens
gctttgagtccacgcccacca

SEQ ID NO: 500419 - DNA, 15 bp, Homo sapiens
ggaaaacattccatc

SEQ ID NO: 500420 - DNA, 21 bp, Homo sapiens
ggaaaagagatggcctgagaa

SEQ ID NO: 500421 - DNA, 14 bp, Homo sapiens
ggaaaatgaataat

SEQ ID NO: 500422 - DNA, 21 bp, Homo sapiens
ggaaaccacagctgctggaga

SEQ ID NO: 500423 - DNA, 17 bp, Homo sapiens
ggaaagcacaggtgggc

SEQ ID NO: 500424 - DNA, 18 bp, Homo sapiens
ggaaaggcaaatgcccaa

SEQ ID NO: 500425 - DNA, 17 bp, Homo sapiens
ggaaatatttattttaa

SEQ ID NO: 500426 - DNA, 18 bp, Homo sapiens
ggaaatatttattttaat

SEQ ID NO: 500427 - DNA, 23 bp, Homo sapiens
ggaactagactcccaagctggac

SEQ ID NO: 500428 - DNA, 18 bp, Homo sapiens
ggaactatgggagcctca

SEQ ID NO: 500429 - DNA, 20 bp, Homo sapiens
ggaactctcctgctcctcag

SEQ ID NO: 500430 - DNA, 21 bp, Homo sapiens
ggaactctcctgctcctcagg

SEQ ID NO: 500431 - DNA, 12 bp, Homo sapiens
ggaagacagaga

SEQ ID NO: 500432 - DNA, 23 bp, Homo sapiens
ggaaggaatgtcagggccaggtg

SEQ ID NO: 500433 - DNA, 17 bp, Homo sapiens
ggaaggctgagaggaga

SEQ ID NO: 500434 - DNA, 13 bp, Homo sapiens
ggaagggtggtgg

SEQ ID NO: 500435 - DNA, 12 bp, Homo sapiens
ggaatcaagatt

SEQ ID NO: 500436 - DNA, 16 bp, Homo sapiens
ggaatcagcaagaaga

SEQ ID NO: 500437 - DNA, 14 bp, Homo sapiens
ggaatccactccca

SEQ ID NO: 500438 - DNA, 13 bp, Homo sapiens
ggaatctggagag

SEQ ID NO: 500439 - DNA, 19 bp, Homo sapiens
ggaatctggagagctagaa

SEQ ID NO: 500440 - DNA, 23 bp, Homo sapiens
ggaatgcattatttattgctgtg

SEQ ID NO: 500441 - DNA, 14 bp, Homo sapiens
ggaatgcctgagtg

SEQ ID NO: 500442 - DNA, 23 bp, Homo sapiens
ggaatgcctgagtgcctggccaa

SEQ ID NO: 500443 - DNA, 22 bp, Homo sapiens
ggaattggagctcgtgggacag

SEQ ID NO: 500444 - DNA, 13 bp, Homo sapiens
ggacaccaggagt

SEQ ID NO: 500445 - DNA, 19 bp, Homo sapiens
ggacagcccatctgcctgt

SEQ ID NO: 500446 - DNA, 17 bp, Homo sapiens
ggacagtcacctcatgg

SEQ ID NO: 500447 - DNA, 21 bp, Homo sapiens
ggacagtcacctcatggaatt

SEQ ID NO: 500448 - DNA, 19 bp, Homo sapiens
ggacgaagaagagccacag

SEQ ID NO: 500449 - DNA, 20 bp, Homo sapiens
ggacgaagaagagccacagt

SEQ ID NO: 500450 - DNA, 14 bp, Homo sapiens
ggacggtgctccag

SEQ ID NO: 500451 - DNA, 17 bp, Homo sapiens
ggacggtgctccaggca

SEQ ID NO: 500452 - DNA, 21 bp, Homo sapiens
ggactcttgagccctcctgga

SEQ ID NO: 500453 - DNA, 16 bp, Homo sapiens
ggactgagctggggga

SEQ ID NO: 500454 - DNA, 17 bp, Homo sapiens
ggacttaagacaaatgg

SEQ ID NO: 500455 - DNA, 11 bp, Homo sapiens
ggagaagaact

SEQ ID NO: 500456 - DNA, 22 bp, Homo sapiens
ggagactgctgagtcaacccaa

SEQ ID NO: 500457 - DNA, 21 bp, Homo sapiens
ggagagccagaacctggaggg

SEQ ID NO: 500458 - DNA, 22 bp, Homo sapiens
ggagagctagaacctggagagc

SEQ ID NO: 500459 - DNA, 20 bp, Homo sapiens
ggagagctagaacctggagg

SEQ ID NO: 500460 - DNA, 22 bp, Homo sapiens
ggagagctagaacctggagggc

SEQ ID NO: 500461 - DNA, 15 bp, Homo sapiens
aaaaagtcattgtaa

SEQ ID NO: 500462 - DNA, 17 bp, Homo sapiens
aaaaagtcattgtaatc

SEQ ID NO: 500463 - DNA, 23 bp, Homo sapiens
aaaaagttttgccctttttaagg

SEQ ID NO: 500464 - DNA, 17 bp, Homo sapiens
aaaaataaaatgcattt

SEQ ID NO: 500465 - DNA, 22 bp, Homo sapiens
aaaaatgtcttgggtaggcggg

SEQ ID NO: 500466 - DNA, 14 bp, Homo sapiens
aaaaattaattctt

SEQ ID NO: 500467 - DNA, 15 bp, Homo sapiens
aaaaattaattcttt

SEQ ID NO: 500468 - DNA, 11 bp, Homo sapiens
aaaacttattt

SEQ ID NO: 500469 - DNA, 15 bp, Homo sapiens
aaaacttatttgagt

SEQ ID NO: 500470 - DNA, 15 bp, Homo sapiens
aaaacttctcttctg

SEQ ID NO: 500471 - DNA, 20 bp, Homo sapiens
aaaactttttatattttata

SEQ ID NO: 500472 - DNA, 16 bp, Homo sapiens
aaaataaaatgcattt

SEQ ID NO: 500473 - DNA, 17 bp, Homo sapiens
aaaataaaatgcattta

SEQ ID NO: 500474 - DNA, 19 bp, Homo sapiens
aaaataaaatgcatttaaa

SEQ ID NO: 500475 - DNA, 17 bp, Homo sapiens
aaaataaagctgttctc

SEQ ID NO: 500476 - DNA, 21 bp, Homo sapiens
aaaatacagtttgtcacatga

SEQ ID NO: 500477 - DNA, 19 bp, Homo sapiens
aaaatgaccagtaattgtg

SEQ ID NO: 500478 - DNA, 23 bp, Homo sapiens
aaaatgcatttaaactcatttga

SEQ ID NO: 500479 - DNA, 14 bp, Homo sapiens
aaaattaacactgc

SEQ ID NO: 500480 - DNA, 23 bp, Homo sapiens
aaaattaattctttatcacatgt

SEQ ID NO: 500481 - DNA, 15 bp, Homo sapiens
aaaattcattccatt

SEQ ID NO: 500482 - DNA, 18 bp, Homo sapiens
aaaattcattccatttgc

SEQ ID NO: 500483 - DNA, 16 bp, Homo sapiens
aaaattgtatagagat

SEQ ID NO: 500484 - DNA, 17 bp, Homo sapiens
aaacaaggatgaattaa

SEQ ID NO: 500485 - DNA, 22 bp, Homo sapiens
aaacaatagtaattctcaggcc

SEQ ID NO: 500486 - DNA, 13 bp, Homo sapiens
aaacattttcaca

SEQ ID NO: 500487 - DNA, 14 bp, Homo sapiens
aaaccacagctgct

SEQ ID NO: 500488 - DNA, 23 bp, Homo sapiens
aaaccctcgtttctgattaatgc

SEQ ID NO: 500489 - DNA, 12 bp, Homo sapiens
aaacgtgaaaat

SEQ ID NO: 500490 - DNA, 16 bp, Homo sapiens
aaactagtaaagacat

SEQ ID NO: 500491 - DNA, 18 bp, Homo sapiens
aaacttagaataaaattg

SEQ ID NO: 500492 - DNA, 22 bp, Homo sapiens
aaacttagaataaaattgtaaa

SEQ ID NO: 500493 - DNA, 10 bp, Homo sapiens
aaacttattt

SEQ ID NO: 500494 - DNA, 23 bp, Homo sapiens
aaacttcagcggtttatataagc

SEQ ID NO: 500495 - DNA, 22 bp, Homo sapiens
aaacttccagtgcaacactgaa

SEQ ID NO: 500496 - DNA, 18 bp, Homo sapiens
aaagagaacttccagatc

SEQ ID NO: 500497 - DNA, 18 bp, Homo sapiens
aaagagagaaaaacaaat

SEQ ID NO: 500498 - DNA, 22 bp, Homo sapiens
aaagagagaaaacttatttgag

SEQ ID NO: 500499 - DNA, 22 bp, Homo sapiens
aaagagctttagtcctagagga

SEQ ID NO: 500500 - DNA, 15 bp, Homo sapiens
aaagctgaaaactgc

SEQ ID NO: 500501 - DNA, 19 bp, Homo sapiens
aaagctgttctcattcctg

SEQ ID NO: 500502 - DNA, 17 bp, Homo sapiens
aaaggaaaagattcctg

SEQ ID NO: 500503 - DNA, 16 bp, Homo sapiens
aaaggacaaataaagc

SEQ ID NO: 500504 - DNA, 19 bp, Homo sapiens
aaaggccatggagagctgg

SEQ ID NO: 500505 - DNA, 16 bp, Homo sapiens
aaagtctaaagtttac

SEQ ID NO: 500506 - DNA, 22 bp, Homo sapiens
aaagtctaaagtttacagtaaa

SEQ ID NO: 500507 - DNA, 20 bp, Homo sapiens
aaagttagagtacagatcct

SEQ ID NO: 500508 - DNA, 15 bp, Homo sapiens
aaagtttacagtaaa

SEQ ID NO: 500509 - DNA, 18 bp, Homo sapiens
aaataaaacattttcaca

SEQ ID NO: 500510 - DNA, 15 bp, Homo sapiens
aaataaaatgaccag

SEQ ID NO: 500511 - DNA, 16 bp, Homo sapiens
aaataaaatgaccagt

SEQ ID NO: 500512 - DNA, 14 bp, Homo sapiens
aaataaagcaatga

SEQ ID NO: 500513 - DNA, 22 bp, Homo sapiens
aaatactgtttttaacaactat

SEQ ID NO: 500514 - DNA, 13 bp, Homo sapiens
aaatagtaaaaat

SEQ ID NO: 500515 - DNA, 15 bp, Homo sapiens
aaatatttattttaa

SEQ ID NO: 500516 - DNA, 21 bp, Homo sapiens
aaatatttattttaataatgt

SEQ ID NO: 500517 - DNA, 19 bp, Homo sapiens
aaatcaatgctataactat

SEQ ID NO: 500518 - DNA, 14 bp, Homo sapiens
aaatccttgaagat

SEQ ID NO: 500519 - DNA, 19 bp, Homo sapiens
aaatgaccagtaattgtga

SEQ ID NO: 500520 - DNA, 12 bp, Homo sapiens
aaatgagtgtgt

SEQ ID NO: 500521 - DNA, 16 bp, Homo sapiens
aaatgatcttttcaag

SEQ ID NO: 500522 - DNA, 15 bp, Homo sapiens
aaatggaagacacat

SEQ ID NO: 500523 - DNA, 19 bp, Homo sapiens
aaatggcttcctggcaata

SEQ ID NO: 500524 - DNA, 16 bp, Homo sapiens
aaatgggactgatgtc

SEQ ID NO: 500525 - DNA, 19 bp, Homo sapiens
aaatgggactgatgtcatc

SEQ ID NO: 500526 - DNA, 14 bp, Homo sapiens
aaatgggttttact

SEQ ID NO: 500527 - DNA, 21 bp, Homo sapiens
aaattaattctttatcacatg

SEQ ID NO: 500528 - DNA, 15 bp, Homo sapiens
aaattcattccattt

SEQ ID NO: 500529 - DNA, 22 bp, Homo sapiens
aaattctgccttattatttctt

SEQ ID NO: 500530 - DNA, 19 bp, Homo sapiens
aaattttctagaatactaa

SEQ ID NO: 500531 - DNA, 17 bp, Homo sapiens
aaatttttccttagcat

SEQ ID NO: 500532 - DNA, 21 bp, Homo sapiens
aacaaaccctcgtttctgatt

SEQ ID NO: 500533 - DNA, 13 bp, Homo sapiens
aacaacctggaga

SEQ ID NO: 500534 - DNA, 20 bp, Homo sapiens
aacaactcgaatcactcatt

SEQ ID NO: 500535 - DNA, 18 bp, Homo sapiens
aacaatagtaattctcag

SEQ ID NO: 500536 - DNA, 14 bp, Homo sapiens
aacaatgctgtatt

SEQ ID NO: 500537 - DNA, 21 bp, Homo sapiens
aacacattaagccttccacac

SEQ ID NO: 500538 - DNA, 14 bp, Homo sapiens
aacaccaggactta

SEQ ID NO: 500539 - DNA, 22 bp, Homo sapiens
aacaccaggacttaagacaaat

SEQ ID NO: 500540 - DNA, 14 bp, Homo sapiens
aacactatatggca

SEQ ID NO: 500541 - DNA, 20 bp, Homo sapiens
aacactatatggcagtgtct

SEQ ID NO: 500542 - DNA, 16 bp, Homo sapiens
aacactgggggagggg

SEQ ID NO: 500543 - DNA, 17 bp, Homo sapiens
aacagactatttaactt

SEQ ID NO: 500544 - DNA, 18 bp, Homo sapiens
aacagattcacactgtct

SEQ ID NO: 500545 - DNA, 20 bp, Homo sapiens
aacagctttctccagaacca

SEQ ID NO: 500546 - DNA, 17 bp, Homo sapiens
aacataaataaaatgac

SEQ ID NO: 500547 - DNA, 18 bp, Homo sapiens
aacataaataaaatgacc

SEQ ID NO: 500548 - DNA, 22 bp, Homo sapiens
aacataagctagaaaaattaga

SEQ ID NO: 500549 - DNA, 14 bp, Homo sapiens
aacatacagacaca

SEQ ID NO: 500550 - DNA, 12 bp, Homo sapiens
aacatatataac

SEQ ID NO: 500551 - DNA, 14 bp, Homo sapiens
aacatcatcaaggc

SEQ ID NO: 500552 - DNA, 22 bp, Homo sapiens
aacatcatcaaggcactgcctg

SEQ ID NO: 500553 - DNA, 22 bp, Homo sapiens
aacattacagggaatgcctgag

SEQ ID NO: 500554 - DNA, 14 bp, Homo sapiens
aacattccatcctt

SEQ ID NO: 500555 - DNA, 15 bp, Homo sapiens
aacatttatctttgt

SEQ ID NO: 500556 - DNA, 15 bp, Homo sapiens
aaccacaagcatctc

SEQ ID NO: 500557 - DNA, 14 bp, Homo sapiens
aaccacagctgctg

SEQ ID NO: 500558 - DNA, 16 bp, Homo sapiens
aaccacagctgctgga

SEQ ID NO: 500559 - DNA, 18 bp, Homo sapiens
aaccacagctgctggaga

SEQ ID NO: 500560 - DNA, 20 bp, Homo sapiens
aaccatctgtccctgcctca

SEQ ID NO: 500561 - DNA, 15 bp, Homo sapiens
aaccctattggtaaa

SEQ ID NO: 500562 - DNA, 22 bp, Homo sapiens
aacctactttcatactgaagat

SEQ ID NO: 500563 - DNA, 22 bp, Homo sapiens
aacctggagggctggaatctgg

SEQ ID NO: 500564 - DNA, 18 bp, Homo sapiens
aacgactgggcactgcca

SEQ ID NO: 500565 - DNA, 16 bp, Homo sapiens
aactagaacctggagg

SEQ ID NO: 500566 - DNA, 23 bp, Homo sapiens
aactagactcccaagctggacta

SEQ ID NO: 500567 - DNA, 13 bp, Homo sapiens
aactatattgttt

SEQ ID NO: 500568 - DNA, 23 bp, Homo sapiens
aactatctcatttccaagcaagt

SEQ ID NO: 500569 - DNA, 13 bp, Homo sapiens
aactcaatatttt

SEQ ID NO: 500570 - DNA, 20 bp, Homo sapiens
aactcacctggggctgctgg

SEQ ID NO: 500571 - DNA, 22 bp, Homo sapiens
aactcatccctaatgctgcaga

SEQ ID NO: 500572 - DNA, 19 bp, Homo sapiens
aactccaccttgcggggat

SEQ ID NO: 500573 - DNA, 14 bp, Homo sapiens
aactccagaaagtg

SEQ ID NO: 500574 - DNA, 19 bp, Homo sapiens
acatgtataatatttttaa

SEQ ID NO: 500575 - DNA, 20 bp, Homo sapiens
acatgtataatatttttaat

SEQ ID NO: 500576 - DNA, 15 bp, Homo sapiens
acatgtccctacacc

SEQ ID NO: 500577 - DNA, 23 bp, Homo sapiens
acatgtggtgggacagggaccca

SEQ ID NO: 500578 - DNA, 21 bp, Homo sapiens
acatgtggttactagtacagg

SEQ ID NO: 500579 - DNA, 12 bp, Homo sapiens
acattaaacaca

SEQ ID NO: 500580 - DNA, 21 bp, Homo sapiens
acattattggacttccatttg

SEQ ID NO: 500581 - DNA, 23 bp, Homo sapiens
acattccgaggggctcagttctg

SEQ ID NO: 500582 - DNA, 22 bp, Homo sapiens
acattgaattagaaacataaat

SEQ ID NO: 500583 - DNA, 18 bp, Homo sapiens
acatttgctcatggaatt

SEQ ID NO: 500584 - DNA, 19 bp, Homo sapiens
acatttgtataaaataatt

SEQ ID NO: 500585 - DNA, 15 bp, Homo sapiens
accaatcatgaatta

SEQ ID NO: 500586 - DNA, 13 bp, Homo sapiens
accaccctgaggc

SEQ ID NO: 500587 - DNA, 16 bp, Homo sapiens
accagaaatcaaaaag

SEQ ID NO: 500588 - DNA, 22 bp, Homo sapiens
accagcatcccttgaccaggcc

SEQ ID NO: 500589 - DNA, 18 bp, Homo sapiens
accagccttgctctcttc

SEQ ID NO: 500590 - DNA, 18 bp, Homo sapiens
accaggcttgcctgcagg

SEQ ID NO: 500591 - DNA, 18 bp, Homo sapiens
accagtaattgtgaaaat

SEQ ID NO: 500592 - DNA, 14 bp, Homo sapiens
accagtctgactgt

SEQ ID NO: 500593 - DNA, 21 bp, Homo sapiens
acccaaagagacagctcttct

SEQ ID NO: 500594 - DNA, 18 bp, Homo sapiens
acccactctcctctgcct

SEQ ID NO: 500595 - DNA, 22 bp, Homo sapiens
acccaggctgggcaaggaggcc

SEQ ID NO: 500596 - DNA, 23 bp, Homo sapiens
acccccacagacctgctctggac

SEQ ID NO: 500597 - DNA, 22 bp, Homo sapiens
acccccgagtttggtccctggg

SEQ ID NO: 500598 - DNA, 20 bp, Homo sapiens
acccggggacccccaactcc

SEQ ID NO: 500599 - DNA, 19 bp, Homo sapiens
accctaaaaagcagagctt

SEQ ID NO: 500600 - DNA, 13 bp, Homo sapiens
acccttggacttg

SEQ ID NO: 500601 - DNA, 15 bp, Homo sapiens
accgaggacatgaaa

SEQ ID NO: 500602 - DNA, 18 bp, Homo sapiens
accgttggggattgggga

SEQ ID NO: 500603 - DNA, 14 bp, Homo sapiens
acctagaagggcta

SEQ ID NO: 500604 - DNA, 21 bp, Homo sapiens
acctcactggggtcctggggc

SEQ ID NO: 500605 - DNA, 23 bp, Homo sapiens
acctcactggggtcctggggcct

SEQ ID NO: 500606 - DNA, 12 bp, Homo sapiens
acctcagcctgt

SEQ ID NO: 500607 - DNA, 12 bp, Homo sapiens
acctccctgcaa

SEQ ID NO: 500608 - DNA, 13 bp, Homo sapiens
acctccctgtgag

SEQ ID NO: 500609 - DNA, 16 bp, Homo sapiens
acctcctgtctctggc

SEQ ID NO: 500610 - DNA, 17 bp, Homo sapiens
acctcctgtctctggcc

SEQ ID NO: 500611 - DNA, 20 bp, Homo sapiens
acctctgcctcagaaaacaa

SEQ ID NO: 500612 - DNA, 20 bp, Homo sapiens
acctctgtgggcactggtgg

SEQ ID NO: 500613 - DNA, 18 bp, Homo sapiens
acctgagtctgctatatt

SEQ ID NO: 500614 - DNA, 23 bp, Homo sapiens
acctgcctcccttcatgcatgga

SEQ ID NO: 500615 - DNA, 23 bp, Homo sapiens
acctggagaactagaacctggag

SEQ ID NO: 500616 - DNA, 23 bp, Homo sapiens
acctggagggctagaacctggag

SEQ ID NO: 500617 - DNA, 20 bp, Homo sapiens
acctggcaagctagaacctg

SEQ ID NO: 500618 - DNA, 18 bp, Homo sapiens
acctgggctttctggaat

SEQ ID NO: 500619 - DNA, 19 bp, Homo sapiens
acctgggtaaatgcagcgt

SEQ ID NO: 500620 - DNA, 22 bp, Homo sapiens
acctttcccactttcttctacc

SEQ ID NO: 500621 - DNA, 19 bp, Homo sapiens
acgacaaggaaaggcaaat

SEQ ID NO: 500622 - DNA, 20 bp, Homo sapiens
acgaggtcaagagatcgaga

SEQ ID NO: 500623 - DNA, 16 bp, Homo sapiens
acgagtaatttattgt

SEQ ID NO: 500624 - DNA, 18 bp, Homo sapiens
acgcacacacacatacag

SEQ ID NO: 500625 - DNA, 14 bp, Homo sapiens
acgcagtggccttc

SEQ ID NO: 500626 - DNA, 21 bp, Homo sapiens
acgccactgcactccagcctg

SEQ ID NO: 500627 - DNA, 13 bp, Homo sapiens
acgcccaccagcc

SEQ ID NO: 500628 - DNA, 18 bp, Homo sapiens
acgcccaccagccttgct

SEQ ID NO: 500629 - DNA, 15 bp, Homo sapiens
acggtgctccaggca

SEQ ID NO: 500630 - DNA, 18 bp, Homo sapiens
acgtggaggagcagtgca

SEQ ID NO: 500631 - DNA, 18 bp, Homo sapiens
acgtgtactacaatttaa

SEQ ID NO: 500632 - DNA, 13 bp, Homo sapiens
actaagagagaat

SEQ ID NO: 500633 - DNA, 14 bp, Homo sapiens
actaatcaatactt

SEQ ID NO: 500634 - DNA, 23 bp, Homo sapiens
actacccccacagacctgctctg

SEQ ID NO: 500635 - DNA, 16 bp, Homo sapiens
actagtaaagacatag

SEQ ID NO: 500636 - DNA, 23 bp, Homo sapiens
actagtttttagaaaagaaagca

SEQ ID NO: 500637 - DNA, 19 bp, Homo sapiens
actatcaaactgaagccag

SEQ ID NO: 500638 - DNA, 20 bp, Homo sapiens
actatcagcccaagatgctt

SEQ ID NO: 500639 - DNA, 13 bp, Homo sapiens
actattcaagtat

SEQ ID NO: 500640 - DNA, 18 bp, Homo sapiens
actattgaagttgcagat

SEQ ID NO: 500641 - DNA, 12 bp, Homo sapiens
actattgacatc

SEQ ID NO: 500642 - DNA, 17 bp, Homo sapiens
actattgacatcagcat

SEQ ID NO: 500643 - DNA, 13 bp, Homo sapiens
actattgcccagg

SEQ ID NO: 500644 - DNA, 17 bp, Homo sapiens
actattttattttctaa

SEQ ID NO: 500645 - DNA, 22 bp, Homo sapiens
actcaaatgagccccttcatcc

SEQ ID NO: 500646 - DNA, 16 bp, Homo sapiens
actcaagaagcaggct

SEQ ID NO: 500647 - DNA, 19 bp, Homo sapiens
actcaagaagcaggctaca

SEQ ID NO: 500648 - DNA, 19 bp, Homo sapiens
actcacatggctatgtttt

SEQ ID NO: 500649 - DNA, 14 bp, Homo sapiens
actcagctccccag

SEQ ID NO: 500650 - DNA, 19 bp, Homo sapiens
actcagctccccagagtcc

SEQ ID NO: 500651 - DNA, 14 bp, Homo sapiens
actcagggccccag

SEQ ID NO: 500652 - DNA, 18 bp, Homo sapiens
actcagggccccagcact

SEQ ID NO: 500653 - DNA, 19 bp, Homo sapiens
actcatccctaatgctgca

SEQ ID NO: 500654 - DNA, 21 bp, Homo sapiens
actccaaactgactcttaaga

SEQ ID NO: 500655 - DNA, 15 bp, Homo sapiens
actccagcctgggca

SEQ ID NO: 500656 - DNA, 20 bp, Homo sapiens
actccagctgggttggaaaa

SEQ ID NO: 500657 - DNA, 19 bp, Homo sapiens
actccatcagttagagctg

SEQ ID NO: 500658 - DNA, 21 bp, Homo sapiens
actcccttcccatgacccagg

SEQ ID NO: 500659 - DNA, 23 bp, Homo sapiens
actcccttcccatgacccaggct

SEQ ID NO: 500660 - DNA, 18 bp, Homo sapiens
actcctaggcaggacatg

SEQ ID NO: 500661 - DNA, 21 bp, Homo sapiens
actcctaggcaggacatgctg

SEQ ID NO: 500662 - DNA, 21 bp, Homo sapiens
actccttgagagaccaggcaa

SEQ ID NO: 500663 - DNA, 23 bp, Homo sapiens
actccttgagagaccaggcaaag

SEQ ID NO: 500664 - DNA, 15 bp, Homo sapiens
actcgaaaagagcac

SEQ ID NO: 500665 - DNA, 19 bp, Homo sapiens
actcgttaatttgtagtgt

SEQ ID NO: 500666 - DNA, 23 bp, Homo sapiens
actctagcctggcaacagagcga

SEQ ID NO: 500667 - DNA, 20 bp, Homo sapiens
actcttcccccactcctctt

SEQ ID NO: 500668 - DNA, 17 bp, Homo sapiens
actgaatttttcttgcg

SEQ ID NO: 500669 - DNA, 13 bp, Homo sapiens
actgactcttaag

SEQ ID NO: 500670 - DNA, 15 bp, Homo sapiens
actgactcttaagaa

SEQ ID NO: 500671 - DNA, 18 bp, Homo sapiens
actgactcttaagaagac

SEQ ID NO: 500672 - DNA, 12 bp, Homo sapiens
actgatgtcatc

SEQ ID NO: 500673 - DNA, 15 bp, Homo sapiens
actgatgtcatcttg

SEQ ID NO: 500674 - DNA, 20 bp, Homo sapiens
actgcactccagcctgggca

SEQ ID NO: 500675 - DNA, 14 bp, Homo sapiens
actgcattatattt

SEQ ID NO: 500676 - DNA, 17 bp, Homo sapiens
actgcctgatggacctg

SEQ ID NO: 500677 - DNA, 22 bp, Homo sapiens
actgccttctcaactccaaact

SEQ ID NO: 500678 - DNA, 13 bp, Homo sapiens
actgcctttgacc

SEQ ID NO: 500679 - DNA, 22 bp, Homo sapiens
actgctccagcctctgccgctg

SEQ ID NO: 500680 - DNA, 19 bp, Homo sapiens
actggcttctgcttgtcat

SEQ ID NO: 500681 - DNA, 18 bp, Homo sapiens
actgggacaggggagaac

SEQ ID NO: 500682 - DNA, 13 bp, Homo sapiens
actgggggagggg

SEQ ID NO: 500683 - DNA, 22 bp, Homo sapiens
actgtaactgtgtcatgattca

SEQ ID NO: 500684 - DNA, 13 bp, Homo sapiens
actgtaagaaaat

SEQ ID NO: 500685 - DNA, 19 bp, Homo sapiens
actgtggctgctagcactt

SEQ ID NO: 500686 - DNA, 13 bp, Homo sapiens
actgtgggtagac

SEQ ID NO: 500687 - DNA, 13 bp, Homo sapiens
actgttcaagagc

SEQ ID NO: 500688 - DNA, 17 bp, Homo sapiens
acttaagacaaatggga

SEQ ID NO: 500689 - DNA, 19 bp, Homo sapiens
acttaagacaaatgggact

SEQ ID NO: 500690 - DNA, 20 bp, Homo sapiens
acttaagacaaatgggactg

SEQ ID NO: 500691 - DNA, 13 bp, Homo sapiens
acttaataatgtg

SEQ ID NO: 500692 - DNA, 17 bp, Homo sapiens
acttaataatgtgtaca

SEQ ID NO: 500693 - DNA, 14 bp, Homo sapiens
acttaatagaaaca

SEQ ID NO: 500694 - DNA, 17 bp, Homo sapiens
acttagaataaaattgt

SEQ ID NO: 500695 - DNA, 22 bp, Homo sapiens
acttagaataaaattgtaaaat

SEQ ID NO: 500696 - DNA, 18 bp, Homo sapiens
acttagatctccaggaga

SEQ ID NO: 500697 - DNA, 12 bp, Homo sapiens
acttatttgagt

SEQ ID NO: 500698 - DNA, 16 bp, Homo sapiens
acttcacacacaggca

SEQ ID NO: 500699 - DNA, 19 bp, Homo sapiens
acttcacacacaggcaact

SEQ ID NO: 500700 - DNA, 18 bp, Homo sapiens
acttcagcggtttatata

SEQ ID NO: 500701 - DNA, 20 bp, Homo sapiens
acttccagatcctggaaatc

SEQ ID NO: 500702 - DNA, 14 bp, Homo sapiens
acttctcttctgag

SEQ ID NO: 500703 - DNA, 18 bp, Homo sapiens
acttgacagaacactgtc

SEQ ID NO: 500704 - DNA, 17 bp, Homo sapiens
acttgagggtaataaac

SEQ ID NO: 500705 - DNA, 23 bp, Homo sapiens
acttgcaaaaagggtcagtatgg

SEQ ID NO: 500706 - DNA, 21 bp, Homo sapiens
acttgctgaatcggaatctct

SEQ ID NO: 500707 - DNA, 14 bp, Homo sapiens
acttggagccaagg

SEQ ID NO: 500708 - DNA, 13 bp, Homo sapiens
acttgtgccaaca

SEQ ID NO: 500709 - DNA, 18 bp, Homo sapiens
actttcagtgaaagcatc

SEQ ID NO: 500710 - DNA, 13 bp, Homo sapiens
aggaggaagcaga

SEQ ID NO: 500711 - DNA, 19 bp, Homo sapiens
aggaggccacgtgatgtgg

SEQ ID NO: 500712 - DNA, 16 bp, Homo sapiens
aggaggctgaggcagg

SEQ ID NO: 500713 - DNA, 17 bp, Homo sapiens
aggaggctgaggcagga

SEQ ID NO: 500714 - DNA, 18 bp, Homo sapiens
aggagggttagggagggg

SEQ ID NO: 500715 - DNA, 12 bp, Homo sapiens
aggagtccctgg

SEQ ID NO: 500716 - DNA, 19 bp, Homo sapiens
aggagtttaagaccagcct

SEQ ID NO: 500717 - DNA, 16 bp, Homo sapiens
aggatggcctggccag

SEQ ID NO: 500718 - DNA, 23 bp, Homo sapiens
aggatggcctggccagggcctgg

SEQ ID NO: 500719 - DNA, 15 bp, Homo sapiens
aggattcaggggctg

SEQ ID NO: 500720 - DNA, 14 bp, Homo sapiens
aggatttacttttt

SEQ ID NO: 500721 - DNA, 17 bp, Homo sapiens
aggcaactagtggagag

SEQ ID NO: 500722 - DNA, 20 bp, Homo sapiens
aggcaactagtggagagaac

SEQ ID NO: 500723 - DNA, 17 bp, Homo sapiens
aggcaactgaggcagac

SEQ ID NO: 500724 - DNA, 23 bp, Homo sapiens
aggcaccatagaagaacagcaga

SEQ ID NO: 500725 - DNA, 18 bp, Homo sapiens
aggcacctgggctttctg

SEQ ID NO: 500726 - DNA, 19 bp, Homo sapiens
aggcactcatgggtaataa

SEQ ID NO: 500727 - DNA, 15 bp, Homo sapiens
aggcagacagcagct

SEQ ID NO: 500728 - DNA, 21 bp, Homo sapiens
aggcagacagcagctcaggca

SEQ ID NO: 500729 - DNA, 20 bp, Homo sapiens
aggcagctctaaatgtcaat

SEQ ID NO: 500730 - DNA, 19 bp, Homo sapiens
aggcaggacatgctgaagc

SEQ ID NO: 500731 - DNA, 21 bp, Homo sapiens
aggcaggacatgctgaagcca

SEQ ID NO: 500732 - DNA, 18 bp, Homo sapiens
aggcaggctaaggcgtgg

SEQ ID NO: 500733 - DNA, 23 bp, Homo sapiens
aggcaggctaaggcgtggagctg

SEQ ID NO: 500734 - DNA, 16 bp, Homo sapiens
aggcagggatttgagg

SEQ ID NO: 500735 - DNA, 20 bp, Homo sapiens
aggcagggtcaggagagggg

SEQ ID NO: 500736 - DNA, 19 bp, Homo sapiens
aggcatgacagctgttcca

SEQ ID NO: 500737 - DNA, 23 bp, Homo sapiens
aggccacgtgatgtggagggcac

SEQ ID NO: 500738 - DNA, 16 bp, Homo sapiens
aggccatggagagctg

SEQ ID NO: 500739 - DNA, 18 bp, Homo sapiens
aggccatggagagctgga

SEQ ID NO: 500740 - DNA, 21 bp, Homo sapiens
aggccatggagagctggagcc

SEQ ID NO: 500741 - DNA, 21 bp, Homo sapiens
aggccatgggcactgtgggta

SEQ ID NO: 500742 - DNA, 13 bp, Homo sapiens
aggcccagtgaga

SEQ ID NO: 500743 - DNA, 17 bp, Homo sapiens
aggcccagtgagatgca

SEQ ID NO: 500744 - DNA, 18 bp, Homo sapiens
aggctacactgacactgg

SEQ ID NO: 500745 - DNA, 19 bp, Homo sapiens
aggctagaacctggcaagc

SEQ ID NO: 500746 - DNA, 16 bp, Homo sapiens
aggctagatgtatgta

SEQ ID NO: 500747 - DNA, 19 bp, Homo sapiens
aggctctgaggggatgcaa

SEQ ID NO: 500748 - DNA, 18 bp, Homo sapiens
aggctcttctccccagag

SEQ ID NO: 500749 - DNA, 16 bp, Homo sapiens
aggctggggaagtcct

SEQ ID NO: 500750 - DNA, 14 bp, Homo sapiens
aggctgtgctccct

SEQ ID NO: 500751 - DNA, 14 bp, Homo sapiens
aggcttacacccac

SEQ ID NO: 500752 - DNA, 18 bp, Homo sapiens
agggaaaacattccatcc

SEQ ID NO: 500753 - DNA, 23 bp, Homo sapiens
agggaaagaaagttgcacggctg

SEQ ID NO: 500754 - DNA, 12 bp, Homo sapiens
agggaagggtgg

SEQ ID NO: 500755 - DNA, 16 bp, Homo sapiens
agggaagtaacagtaa

SEQ ID NO: 500756 - DNA, 22 bp, Homo sapiens
agggaagtaacagtaacgcagg

SEQ ID NO: 500757 - DNA, 22 bp, Homo sapiens
agggaatgcctgagtgcctggc

SEQ ID NO: 500758 - DNA, 17 bp, Homo sapiens
agggacgaagaagagcc

SEQ ID NO: 500759 - DNA, 13 bp, Homo sapiens
agggagaggagtg

SEQ ID NO: 500760 - DNA, 21 bp, Homo sapiens
agggatatctactgtggtctg

SEQ ID NO: 500761 - DNA, 19 bp, Homo sapiens
agggatgagcatggagctg

SEQ ID NO: 500762 - DNA, 20 bp, Homo sapiens
agggatgagcatggagctgg

SEQ ID NO: 500763 - DNA, 13 bp, Homo sapiens
agggatggtgccc

SEQ ID NO: 500764 - DNA, 12 bp, Homo sapiens
agggatttgagg

SEQ ID NO: 500765 - DNA, 14 bp, Homo sapiens
agggcacacactgt

SEQ ID NO: 500766 - DNA, 19 bp, Homo sapiens
agggcacattccttgcctg

SEQ ID NO: 500767 - DNA, 21 bp, Homo sapiens
agggcacattccttgcctgca

SEQ ID NO: 500768 - DNA, 14 bp, Homo sapiens
agggccactgaaga

SEQ ID NO: 500769 - DNA, 15 bp, Homo sapiens
agggccaggtgcaga

SEQ ID NO: 500770 - DNA, 12 bp, Homo sapiens
agggccccagca

SEQ ID NO: 500771 - DNA, 18 bp, Homo sapiens
agggccccagcactaaag

SEQ ID NO: 500772 - DNA, 16 bp, Homo sapiens
agggctagaacctgga

SEQ ID NO: 500773 - DNA, 19 bp, Homo sapiens
agggctagaacctggaagg

SEQ ID NO: 500774 - DNA, 21 bp, Homo sapiens
agggctagaacctggaggggc

SEQ ID NO: 500775 - DNA, 17 bp, Homo sapiens
agggctagaactggaga

SEQ ID NO: 500776 - DNA, 22 bp, Homo sapiens
agggctggaatctggagagcta

SEQ ID NO: 500777 - DNA, 22 bp, Homo sapiens
agggctgttataatctttcaca

SEQ ID NO: 500778 - DNA, 15 bp, Homo sapiens
aggggaggccttcca

SEQ ID NO: 500779 - DNA, 16 bp, Homo sapiens
aggggtcaccttgaga

SEQ ID NO: 500780 - DNA, 19 bp, Homo sapiens
agggtaccttgaacactgg

SEQ ID NO: 500781 - DNA, 23 bp, Homo sapiens
agggtaccttgaacactggggga

SEQ ID NO: 500782 - DNA, 23 bp, Homo sapiens
agggtccacaggaagtgaagaat

SEQ ID NO: 500783 - DNA, 15 bp, Homo sapiens
agggtctctgctgcc

SEQ ID NO: 500784 - DNA, 16 bp, Homo sapiens
agggtctctgctgccg

SEQ ID NO: 500785 - DNA, 17 bp, Homo sapiens
agggtggtggagccagt

SEQ ID NO: 500786 - DNA, 17 bp, Homo sapiens
agggttatgattaagta

SEQ ID NO: 500787 - DNA, 23 bp, Homo sapiens
aggtatgaccttctaggaagctc

SEQ ID NO: 500788 - DNA, 16 bp, Homo sapiens
aggtgcagaccttggg

SEQ ID NO: 500789 - DNA, 14 bp, Homo sapiens
aggtggcaaggctg

SEQ ID NO: 500790 - DNA, 16 bp, Homo sapiens
aggtggcaaggctgtg

SEQ ID NO: 500791 - DNA, 18 bp, Homo sapiens
aggtggcaaggctgtgct

SEQ ID NO: 500792 - DNA, 21 bp, Homo sapiens
aggtgggcttcccagtggctg

SEQ ID NO: 500793 - DNA, 17 bp, Homo sapiens
aggtggggacagggatg

SEQ ID NO: 500794 - DNA, 23 bp, Homo sapiens
aggtgggttttcatcaagactgg

SEQ ID NO: 500795 - DNA, 22 bp, Homo sapiens
aggttcagcaaggtgagagagg

SEQ ID NO: 500796 - DNA, 22 bp, Homo sapiens
aggttctctcctccccaaggag

SEQ ID NO: 500797 - DNA, 13 bp, Homo sapiens
aggttgccgtgag

SEQ ID NO: 500798 - DNA, 14 bp, Homo sapiens
aggtttctgaaaat

SEQ ID NO: 500799 - DNA, 15 bp, Homo sapiens
agtaaaaataaaatt

SEQ ID NO: 500800 - DNA, 15 bp, Homo sapiens
agtaaataaattgtt

SEQ ID NO: 500801 - DNA, 13 bp, Homo sapiens
agtaactgtgact

SEQ ID NO: 500802 - DNA, 14 bp, Homo sapiens
agtaattctcaggc

SEQ ID NO: 500803 - DNA, 23 bp, Homo sapiens
agtaatttattgtttttccttgt

SEQ ID NO: 500804 - DNA, 14 bp, Homo sapiens
agtacagatcctct

SEQ ID NO: 500805 - DNA, 18 bp, Homo sapiens
agtacaggttttgccctg

SEQ ID NO: 500806 - DNA, 12 bp, Homo sapiens
agtacctcctgt

SEQ ID NO: 500807 - DNA, 16 bp, Homo sapiens
agtactgtgtacagaa

SEQ ID NO: 500808 - DNA, 21 bp, Homo sapiens
agtagaaagacagagctggga

SEQ ID NO: 500809 - DNA, 18 bp, Homo sapiens
agtagctgctaccttctt

SEQ ID NO: 500810 - DNA, 22 bp, Homo sapiens
agtagctgctaccttctttggc

SEQ ID NO: 500811 - DNA, 15 bp, Homo sapiens
agtatattcaaaaat

SEQ ID NO: 500812 - DNA, 22 bp, Homo sapiens
agtatctcggacctttcagctg

SEQ ID NO: 500813 - DNA, 19 bp, Homo sapiens
agtatggagctcagagagg

SEQ ID NO: 500814 - DNA, 18 bp, Homo sapiens
agtatgttagtgcaaatt

SEQ ID NO: 500815 - DNA, 16 bp, Homo sapiens
agtatttctatgaaat

SEQ ID NO: 500816 - DNA, 15 bp, Homo sapiens
agtcaaactgtgcca

SEQ ID NO: 500817 - DNA, 13 bp, Homo sapiens
agtcaaattgtgt

SEQ ID NO: 500818 - DNA, 15 bp, Homo sapiens
agtcaaattgtgtga

SEQ ID NO: 500819 - DNA, 22 bp, Homo sapiens
agtcacagagataattctagct

SEQ ID NO: 500820 - DNA, 13 bp, Homo sapiens
agtcaccccagga

SEQ ID NO: 500821 - DNA, 18 bp, Homo sapiens
agtcacgtggaggagcag

SEQ ID NO: 500822 - DNA, 20 bp, Homo sapiens
agtcatgcaaaggctgggac

SEQ ID NO: 500823 - DNA, 14 bp, Homo sapiens
agtcatgtgcctct

SEQ ID NO: 500824 - DNA, 18 bp, Homo sapiens
agtccaaggaaaccacag

SEQ ID NO: 500825 - DNA, 22 bp, Homo sapiens
agtccacgcccaccagccttgc

SEQ ID NO: 500826 - DNA, 13 bp, Homo sapiens
agtccagcctgga

SEQ ID NO: 500827 - DNA, 23 bp, Homo sapiens
agtccatatttcaatttccaaga

SEQ ID NO: 500828 - DNA, 21 bp, Homo sapiens
agtccctgtgaagactgggtg

SEQ ID NO: 500829 - DNA, 23 bp, Homo sapiens
agtcccttaatcttatggggccg

SEQ ID NO: 500830 - DNA, 18 bp, Homo sapiens
agtccttgcaagaatcag

SEQ ID NO: 500831 - DNA, 13 bp, Homo sapiens
agtctaaagttta

SEQ ID NO: 500832 - DNA, 17 bp, Homo sapiens
agtctaaagtttacagt

SEQ ID NO: 500833 - DNA, 20 bp, Homo sapiens
agtctaaagtttacagtaaa

SEQ ID NO: 500834 - DNA, 17 bp, Homo sapiens
agtctcaataaactgaa

SEQ ID NO: 500835 - DNA, 15 bp, Homo sapiens
agtctctatcattaa

SEQ ID NO: 500836 - DNA, 17 bp, Homo sapiens
agtctctatcattaaag

SEQ ID NO: 500837 - DNA, 21 bp, Homo sapiens
agtctcttggactaagaagat

SEQ ID NO: 500838 - DNA, 19 bp, Homo sapiens
agtctggccaatatggaga

SEQ ID NO: 500839 - DNA, 17 bp, Homo sapiens
agtctgggtccaggcct

SEQ ID NO: 500840 - DNA, 23 bp, Homo sapiens
agtcttctcctccatgaacatca

SEQ ID NO: 500841 - DNA, 20 bp, Homo sapiens
agtgaaactcgttaatttgt

SEQ ID NO: 500842 - DNA, 14 bp, Homo sapiens
agtgaaagcatcac

SEQ ID NO: 500843 - DNA, 16 bp, Homo sapiens
agtgaagtatgcacta

SEQ ID NO: 500844 - DNA, 21 bp, Homo sapiens
agtgaagtatgcactaatcaa

SEQ ID NO: 500845 - DNA, 23 bp, Homo sapiens
agtgaagtatgcactaatcaata

SEQ ID NO: 500846 - DNA, 13 bp, Homo sapiens
cacatcttggcac

SEQ ID NO: 500847 - DNA, 20 bp, Homo sapiens
cacatgaagtccaagcattt

SEQ ID NO: 500848 - DNA, 23 bp, Homo sapiens
cacattaagccttccacactcac

SEQ ID NO: 500849 - DNA, 18 bp, Homo sapiens
cacattccttgcctgcac

SEQ ID NO: 500850 - DNA, 16 bp, Homo sapiens
cacatttaagagacag

SEQ ID NO: 500851 - DNA, 19 bp, Homo sapiens
cacatttaagagacagtca

SEQ ID NO: 500852 - DNA, 16 bp, Homo sapiens
caccaagctcaaagcg

SEQ ID NO: 500853 - DNA, 13 bp, Homo sapiens
caccacctcagag

SEQ ID NO: 500854 - DNA, 13 bp, Homo sapiens
caccagccttgct

SEQ ID NO: 500855 - DNA, 15 bp, Homo sapiens
caccagccttgctct

SEQ ID NO: 500856 - DNA, 18 bp, Homo sapiens
caccagccttgctctctt

SEQ ID NO: 500857 - DNA, 21 bp, Homo sapiens
caccaggacttaagacaaatg

SEQ ID NO: 500858 - DNA, 20 bp, Homo sapiens
caccaggcttgcctgcaggc

SEQ ID NO: 500859 - DNA, 16 bp, Homo sapiens
caccaggtagaacaca

SEQ ID NO: 500860 - DNA, 13 bp, Homo sapiens
caccatagaagaa

SEQ ID NO: 500861 - DNA, 20 bp, Homo sapiens
caccatagaagaacagcaga

SEQ ID NO: 500862 - DNA, 18 bp, Homo sapiens
caccccaacatgcctgca

SEQ ID NO: 500863 - DNA, 16 bp, Homo sapiens
caccctcatgctgtgt

SEQ ID NO: 500864 - DNA, 12 bp, Homo sapiens
caccgccagctt

SEQ ID NO: 500865 - DNA, 21 bp, Homo sapiens
cacctagttctccccgatggg

SEQ ID NO: 500866 - DNA, 14 bp, Homo sapiens
cacctcatggaatt

SEQ ID NO: 500867 - DNA, 18 bp, Homo sapiens
cacctccaatgctgcctg

SEQ ID NO: 500868 - DNA, 10 bp, Homo sapiens
cacctccctg

SEQ ID NO: 500869 - DNA, 13 bp, Homo sapiens
cacctccctgcaa

SEQ ID NO: 500870 - DNA, 14 bp, Homo sapiens
cacctccctgcaat

SEQ ID NO: 500871 - DNA, 17 bp, Homo sapiens
cacctttagaatattaa

SEQ ID NO: 500872 - DNA, 20 bp, Homo sapiens
cacgcacacacacatacaga

SEQ ID NO: 500873 - DNA, 16 bp, Homo sapiens
cacgcacgcacacaca

SEQ ID NO: 500874 - DNA, 18 bp, Homo sapiens
cacgcccaccagccttgc

SEQ ID NO: 500875 - DNA, 21 bp, Homo sapiens
cacgcccaccagccttgctct

SEQ ID NO: 500876 - DNA, 22 bp, Homo sapiens
cacgggggcagctgatacaaat

SEQ ID NO: 500877 - DNA, 21 bp, Homo sapiens
cacgtggaggagcagtgcagg

SEQ ID NO: 500878 - DNA, 21 bp, Homo sapiens
cacgttaaaaattaaaagaag

SEQ ID NO: 500879 - DNA, 17 bp, Homo sapiens
cactaaacagactattt

SEQ ID NO: 500880 - DNA, 17 bp, Homo sapiens
cactaagagagaatgag

SEQ ID NO: 500881 - DNA, 15 bp, Homo sapiens
cactaatacaccagg

SEQ ID NO: 500882 - DNA, 16 bp, Homo sapiens
cactccaatctgggtg

SEQ ID NO: 500883 - DNA, 15 bp, Homo sapiens
cactcccaggcagcc

SEQ ID NO: 500884 - DNA, 20 bp, Homo sapiens
cactgaactttgctgagcct

SEQ ID NO: 500885 - DNA, 11 bp, Homo sapiens
cactgaagaag

SEQ ID NO: 500886 - DNA, 13 bp, Homo sapiens
cactgacactggt

SEQ ID NO: 500887 - DNA, 14 bp, Homo sapiens
cactgactggaagg

SEQ ID NO: 500888 - DNA, 19 bp, Homo sapiens
cactgatggacaaggaggt

SEQ ID NO: 500889 - DNA, 12 bp, Homo sapiens
cactgcacagaa

SEQ ID NO: 500890 - DNA, 23 bp, Homo sapiens
cactgcacagaagacagcagcaa

SEQ ID NO: 500891 - DNA, 18 bp, Homo sapiens
cactgcactccagcctgg

SEQ ID NO: 500892 - DNA, 15 bp, Homo sapiens
cactggggtcctggg

SEQ ID NO: 500893 - DNA, 19 bp, Homo sapiens
cactggggtcctggggcct

SEQ ID NO: 500894 - DNA, 14 bp, Homo sapiens
cactgtcttgaaga

SEQ ID NO: 500895 - DNA, 13 bp, Homo sapiens
cactgtgctcagg

SEQ ID NO: 500896 - DNA, 19 bp, Homo sapiens
cactgtgggtagacacaca

SEQ ID NO: 500897 - DNA, 15 bp, Homo sapiens
cactgtttggatatg

SEQ ID NO: 500898 - DNA, 15 bp, Homo sapiens
cacttacttgggagg

SEQ ID NO: 500899 - DNA, 23 bp, Homo sapiens
cacttatgttactggtgtccagc

SEQ ID NO: 500900 - DNA, 18 bp, Homo sapiens
cacttcacacacaggcaa

SEQ ID NO: 500901 - DNA, 19 bp, Homo sapiens
cacttggcccaagtggcag

SEQ ID NO: 500902 - DNA, 19 bp, Homo sapiens
cacttgtgttttgcaagcc

SEQ ID NO: 500903 - DNA, 20 bp, Homo sapiens
cagaaacaccctcacactgg

SEQ ID NO: 500904 - DNA, 21 bp, Homo sapiens
cagaaaccattgttcagaaga

SEQ ID NO: 500905 - DNA, 17 bp, Homo sapiens
cagaacagccgctcctg

SEQ ID NO: 500906 - DNA, 13 bp, Homo sapiens
cagaacctggagg

SEQ ID NO: 500907 - DNA, 21 bp, Homo sapiens
cagaacctggagggctagaac

SEQ ID NO: 500908 - DNA, 14 bp, Homo sapiens
cagaagaaggcagc

SEQ ID NO: 500909 - DNA, 13 bp, Homo sapiens
cagaattctgcta

SEQ ID NO: 500910 - DNA, 22 bp, Homo sapiens
cagacaagtggctaagtgtcca

SEQ ID NO: 500911 - DNA, 22 bp, Homo sapiens
cagacatgtggtgggacaggga

SEQ ID NO: 500912 - DNA, 18 bp, Homo sapiens
cagaccttgggggaagac

SEQ ID NO: 500913 - DNA, 15 bp, Homo sapiens
cagacgccttactgg

SEQ ID NO: 500914 - DNA, 19 bp, Homo sapiens
cagactatttaacttgagg

SEQ ID NO: 500915 - DNA, 21 bp, Homo sapiens
cagactgtgtaaaaagagagc

SEQ ID NO: 500916 - DNA, 18 bp, Homo sapiens
cagagaaagaggaagctt

SEQ ID NO: 500917 - DNA, 17 bp, Homo sapiens
cagagaccaaacaagga

SEQ ID NO: 500918 - DNA, 20 bp, Homo sapiens
cagagactcagggccccagc

SEQ ID NO: 500919 - DNA, 22 bp, Homo sapiens
cagagactcagggccccagcac

SEQ ID NO: 500920 - DNA, 23 bp, Homo sapiens
cagagactcagggccccagcact

SEQ ID NO: 500921 - DNA, 13 bp, Homo sapiens
cagagagggcagg

SEQ ID NO: 500922 - DNA, 16 bp, Homo sapiens
cagagagggcaggcat

SEQ ID NO: 500923 - DNA, 21 bp, Homo sapiens
cagagattggaatgggcagct

SEQ ID NO: 500924 - DNA, 23 bp, Homo sapiens
cagagattggaatgggcagctca

SEQ ID NO: 500925 - DNA, 18 bp, Homo sapiens
cagagccaggctgttgga

SEQ ID NO: 500926 - DNA, 14 bp, Homo sapiens
cagagctgacacag

SEQ ID NO: 500927 - DNA, 18 bp, Homo sapiens
cagagctgccctctcctg

SEQ ID NO: 500928 - DNA, 23 bp, Homo sapiens
cagagctgccctctcctgggcag

SEQ ID NO: 500929 - DNA, 20 bp, Homo sapiens
cagagctgggatgtttctgt

SEQ ID NO: 500930 - DNA, 16 bp, Homo sapiens
cagagcttggactgga

SEQ ID NO: 500931 - DNA, 13 bp, Homo sapiens
cagaggctgaggt

SEQ ID NO: 500932 - DNA, 19 bp, Homo sapiens
cagaggttatctgtcccag

SEQ ID NO: 500933 - DNA, 14 bp, Homo sapiens
cagagtatggagct

SEQ ID NO: 500934 - DNA, 19 bp, Homo sapiens
cagagtttgatatgggctt

SEQ ID NO: 500935 - DNA, 19 bp, Homo sapiens
cagatcatgggtcaagaga

SEQ ID NO: 500936 - DNA, 14 bp, Homo sapiens
cagatcctggaaat

SEQ ID NO: 500937 - DNA, 18 bp, Homo sapiens
cagatggactccagcctg

SEQ ID NO: 500938 - DNA, 19 bp, Homo sapiens
cagatgggggaaagcacag

SEQ ID NO: 500939 - DNA, 14 bp, Homo sapiens
cagatttgggctgg

SEQ ID NO: 500940 - DNA, 18 bp, Homo sapiens
cagatttgggctggaaca

SEQ ID NO: 500941 - DNA, 14 bp, Homo sapiens
cagattttcctgaa

SEQ ID NO: 500942 - DNA, 14 bp, Homo sapiens
cagcaagtctcttt

SEQ ID NO: 500943 - DNA, 22 bp, Homo sapiens
cagcacagcctcttagatgcag

SEQ ID NO: 500944 - DNA, 19 bp, Homo sapiens
cagcactaaagcagtggac

SEQ ID NO: 500945 - DNA, 23 bp, Homo sapiens
cagcactttgggaggctgaggtg

SEQ ID NO: 500946 - DNA, 15 bp, Homo sapiens
cagcagccagctctc

SEQ ID NO: 500947 - DNA, 17 bp, Homo sapiens
cagcagccagctctcag

SEQ ID NO: 500948 - DNA, 19 bp, Homo sapiens
cagcagccagctctcagcc

SEQ ID NO: 500949 - DNA, 20 bp, Homo sapiens
cagcagccagctctcagcca

SEQ ID NO: 500950 - DNA, 15 bp, Homo sapiens
cagcagctcaggcac

SEQ ID NO: 500951 - DNA, 17 bp, Homo sapiens
cagcagggctgctgtga

SEQ ID NO: 500952 - DNA, 18 bp, Homo sapiens
cagcagggctgctgtgaa

SEQ ID NO: 500953 - DNA, 18 bp, Homo sapiens
cagcagttcagagctgcc

SEQ ID NO: 500954 - DNA, 19 bp, Homo sapiens
cagcatcccttgaccaggc

SEQ ID NO: 500955 - DNA, 12 bp, Homo sapiens
cagccagcagcc

SEQ ID NO: 500956 - DNA, 14 bp, Homo sapiens
cagccagcagccag

SEQ ID NO: 500957 - DNA, 21 bp, Homo sapiens
cagccagcagccagctctcag

SEQ ID NO: 500958 - DNA, 18 bp, Homo sapiens
cagccagctctcagccaa

SEQ ID NO: 500959 - DNA, 20 bp, Homo sapiens
cagcccctgatcctgtgaag

SEQ ID NO: 500960 - DNA, 19 bp, Homo sapiens
cagcccttctttccacaga

SEQ ID NO: 500961 - DNA, 20 bp, Homo sapiens
cagcccttctttccacagaa

SEQ ID NO: 500962 - DNA, 20 bp, Homo sapiens
cagccgctcctgtctgccag

SEQ ID NO: 500963 - DNA, 22 bp, Homo sapiens
cagccgctcctgtctgccagcc

SEQ ID NO: 500964 - DNA, 17 bp, Homo sapiens
cagcctagccgacctca

SEQ ID NO: 500965 - DNA, 18 bp, Homo sapiens
cagcctagccgacctcag

SEQ ID NO: 500966 - DNA, 22 bp, Homo sapiens
cagcctagccgacctcagcctt

SEQ ID NO: 500967 - DNA, 17 bp, Homo sapiens
cagcctctgccgctgcc

SEQ ID NO: 500968 - DNA, 19 bp, Homo sapiens
cagcctgcctggcaggctg

SEQ ID NO: 500969 - DNA, 16 bp, Homo sapiens
cagcctggtgggcctc

SEQ ID NO: 500970 - DNA, 14 bp, Homo sapiens
cagcctgtgctgcc

SEQ ID NO: 500971 - DNA, 18 bp, Homo sapiens
cagccttgctctcttcaa

SEQ ID NO: 500972 - DNA, 20 bp, Homo sapiens
cagccttgctctcttcaata

SEQ ID NO: 500973 - DNA, 21 bp, Homo sapiens
cagccttgctctcttcaataa

SEQ ID NO: 500974 - DNA, 15 bp, Homo sapiens
cagcgtcctgtccac

SEQ ID NO: 500975 - DNA, 15 bp, Homo sapiens
cagctaacacacagc

SEQ ID NO: 500976 - DNA, 17 bp, Homo sapiens
cagctaacacacagctc

SEQ ID NO: 500977 - DNA, 22 bp, Homo sapiens
cagctcaagggaccctgggtgg

SEQ ID NO: 500978 - DNA, 22 bp, Homo sapiens
cagctcattataatgtcattaa

SEQ ID NO: 500979 - DNA, 15 bp, Homo sapiens
cagctccccagagtc

SEQ ID NO: 500980 - DNA, 13 bp, Homo sapiens
cagctgccccggg

SEQ ID NO: 500981 - DNA, 15 bp, Homo sapiens
cagctgcctcccctc

SEQ ID NO: 500982 - DNA, 17 bp, Homo sapiens
cagctgcctcccctcct

SEQ ID NO: 500983 - DNA, 13 bp, Homo sapiens
ccatccctccctc

SEQ ID NO: 500984 - DNA, 14 bp, Homo sapiens
ccatccctccctcc

SEQ ID NO: 500985 - DNA, 12 bp, Homo sapiens
ccatctctggat

SEQ ID NO: 500986 - DNA, 15 bp, Homo sapiens
ccatctctggatgcc

SEQ ID NO: 500987 - DNA, 18 bp, Homo sapiens
ccatctgcctgttctgag

SEQ ID NO: 500988 - DNA, 16 bp, Homo sapiens
ccatctgtgcacgcag

SEQ ID NO: 500989 - DNA, 22 bp, Homo sapiens
ccatgaaaatgcaacaacatgt

SEQ ID NO: 500990 - DNA, 17 bp, Homo sapiens
ccatgacccaggctggg

SEQ ID NO: 500991 - DNA, 18 bp, Homo sapiens
ccatgacccaggctgggc

SEQ ID NO: 500992 - DNA, 18 bp, Homo sapiens
ccatgacttgagaaacaa

SEQ ID NO: 500993 - DNA, 12 bp, Homo sapiens
ccatgatgctgg

SEQ ID NO: 500994 - DNA, 16 bp, Homo sapiens
ccatgatgtttagaaa

SEQ ID NO: 500995 - DNA, 15 bp, Homo sapiens
ccatgctttgagtcc

SEQ ID NO: 500996 - DNA, 15 bp, Homo sapiens
ccatggccctcccag

SEQ ID NO: 500997 - DNA, 15 bp, Homo sapiens
ccatgtagaagctgc

SEQ ID NO: 500998 - DNA, 17 bp, Homo sapiens
ccattatgaagaagaga

SEQ ID NO: 500999 - DNA, 20 bp, Homo sapiens
ccattgcactctagcctggc

SEQ ID NO: 501000 - DNA, 21 bp, Homo sapiens
ccatttgcgttccatgatgct

SEQ ID NO: 501001 - DNA, 16 bp, Homo sapiens
ccatttggaatcatat

SEQ ID NO: 501002 - DNA, 12 bp, Homo sapiens
cccaaagaagga

SEQ ID NO: 501003 - DNA, 13 bp, Homo sapiens
cccaactccagaa

SEQ ID NO: 501004 - DNA, 12 bp, Homo sapiens
cccaactgctcc

SEQ ID NO: 501005 - DNA, 18 bp, Homo sapiens
cccaactgctccagcctc

SEQ ID NO: 501006 - DNA, 21 bp, Homo sapiens
cccaactgctccagcctctgc

SEQ ID NO: 501007 - DNA, 22 bp, Homo sapiens
cccaactgctccagcctctgcc

SEQ ID NO: 501008 - DNA, 23 bp, Homo sapiens
cccaactgctccagcctctgccg

SEQ ID NO: 501009 - DNA, 19 bp, Homo sapiens
cccaagagtggtggcagct

SEQ ID NO: 501010 - DNA, 17 bp, Homo sapiens
cccaagggaaagaaaag

SEQ ID NO: 501011 - DNA, 15 bp, Homo sapiens
cccaatgctgatgtc

SEQ ID NO: 501012 - DNA, 21 bp, Homo sapiens
cccaattcttacaaacatgtg

SEQ ID NO: 501013 - DNA, 13 bp, Homo sapiens
cccaccagccttg

SEQ ID NO: 501014 - DNA, 15 bp, Homo sapiens
cccaccagccttgct

SEQ ID NO: 501015 - DNA, 22 bp, Homo sapiens
cccaccagccttgctctcttca

SEQ ID NO: 501016 - DNA, 23 bp, Homo sapiens
cccagacttgctgaatcggaatc

SEQ ID NO: 501017 - DNA, 21 bp, Homo sapiens
cccagatgggggaaagcacag

SEQ ID NO: 501018 - DNA, 16 bp, Homo sapiens
cccagccagcagttca

SEQ ID NO: 501019 - DNA, 14 bp, Homo sapiens
cccaggatttgact

SEQ ID NO: 501020 - DNA, 13 bp, Homo sapiens
cccaggctgggca

SEQ ID NO: 501021 - DNA, 14 bp, Homo sapiens
cccagggctcagcc

SEQ ID NO: 501022 - DNA, 18 bp, Homo sapiens
cccagggctcagcctggt

SEQ ID NO: 501023 - DNA, 20 bp, Homo sapiens
cccagggctcagcctggtgg

SEQ ID NO: 501024 - DNA, 21 bp, Homo sapiens
cccagtacctcctgtctctgg

SEQ ID NO: 501025 - DNA, 22 bp, Homo sapiens
cccagtacctcctgtctctggc

SEQ ID NO: 501026 - DNA, 14 bp, Homo sapiens
cccagtggctgctg

SEQ ID NO: 501027 - DNA, 17 bp, Homo sapiens
cccatgacccaggctgg

SEQ ID NO: 501028 - DNA, 19 bp, Homo sapiens
cccattctacacagagcag

SEQ ID NO: 501029 - DNA, 12 bp, Homo sapiens
ccccaactgctc

SEQ ID NO: 501030 - DNA, 13 bp, Homo sapiens
ccccaactgctcc

SEQ ID NO: 501031 - DNA, 17 bp, Homo sapiens
ccccaactgctccagcc

SEQ ID NO: 501032 - DNA, 18 bp, Homo sapiens
ccccaactgctccagcct

SEQ ID NO: 501033 - DNA, 19 bp, Homo sapiens
ccccagcactaaagcagtg

SEQ ID NO: 501034 - DNA, 17 bp, Homo sapiens
cccctcctctgcttgcc

SEQ ID NO: 501035 - DNA, 14 bp, Homo sapiens
cccctcggacagcc

SEQ ID NO: 501036 - DNA, 17 bp, Homo sapiens
ccccttgcccagggctc

SEQ ID NO: 501037 - DNA, 19 bp, Homo sapiens
cccgagtttggtccctggg

SEQ ID NO: 501038 - DNA, 12 bp, Homo sapiens
cccgtcttcagc

SEQ ID NO: 501039 - DNA, 21 bp, Homo sapiens
ccctaaggtcattaccacagg

SEQ ID NO: 501040 - DNA, 19 bp, Homo sapiens
ccctaatttaacccagctc

SEQ ID NO: 501041 - DNA, 16 bp, Homo sapiens
ccctatctttgccacc

SEQ ID NO: 501042 - DNA, 21 bp, Homo sapiens
ccctatctttgccaccctcat

SEQ ID NO: 501043 - DNA, 17 bp, Homo sapiens
ccctattggtaaagaat

SEQ ID NO: 501044 - DNA, 10 bp, Homo sapiens
ccctcacact

SEQ ID NO: 501045 - DNA, 13 bp, Homo sapiens
ccctcacactggg

SEQ ID NO: 501046 - DNA, 11 bp, Homo sapiens
ccctctcctgg

SEQ ID NO: 501047 - DNA, 12 bp, Homo sapiens
ccctctcctggg

SEQ ID NO: 501048 - DNA, 22 bp, Homo sapiens
ccctgagctcggtggacccagg

SEQ ID NO: 501049 - DNA, 14 bp, Homo sapiens
ccctgcctgctgca

SEQ ID NO: 501050 - DNA, 18 bp, Homo sapiens
ccctggaaattctgcctt

SEQ ID NO: 501051 - DNA, 22 bp, Homo sapiens
ccctggttctgatgatgtgcct

SEQ ID NO: 501052 - DNA, 16 bp, Homo sapiens
cccttcatctggaacc

SEQ ID NO: 501053 - DNA, 16 bp, Homo sapiens
cccttgatgaagaagt

SEQ ID NO: 501054 - DNA, 14 bp, Homo sapiens
cccttgcccagggc

SEQ ID NO: 501055 - DNA, 19 bp, Homo sapiens
cccttgcccagggctcagc

SEQ ID NO: 501056 - DNA, 22 bp, Homo sapiens
cccttgcccagggctcagcctg

SEQ ID NO: 501057 - DNA, 23 bp, Homo sapiens
cccttgcccagggctcagcctgg

SEQ ID NO: 501058 - DNA, 12 bp, Homo sapiens
cccttggcccct

SEQ ID NO: 501059 - DNA, 12 bp, Homo sapiens
ccgacctcagcc

SEQ ID NO: 501060 - DNA, 15 bp, Homo sapiens
ccgacctcagccttc

SEQ ID NO: 501061 - DNA, 18 bp, Homo sapiens
ccgagcaaagtctaaagt

SEQ ID NO: 501062 - DNA, 20 bp, Homo sapiens
ccgagcaaagtctaaagttt

SEQ ID NO: 501063 - DNA, 20 bp, Homo sapiens
ccgaggcagggtcaggagag

SEQ ID NO: 501064 - DNA, 16 bp, Homo sapiens
ccgcatcctagtctct

SEQ ID NO: 501065 - DNA, 23 bp, Homo sapiens
ccgcccattctgacccagggcct

SEQ ID NO: 501066 - DNA, 14 bp, Homo sapiens
ccgctcctgtctgc

SEQ ID NO: 501067 - DNA, 13 bp, Homo sapiens
ccgctgattctca

SEQ ID NO: 501068 - DNA, 15 bp, Homo sapiens
ccgctgattctcagg

SEQ ID NO: 501069 - DNA, 21 bp, Homo sapiens
ccggaaggaatgtcagggcca

SEQ ID NO: 501070 - DNA, 14 bp, Homo sapiens
ccggagcctccagc

SEQ ID NO: 501071 - DNA, 15 bp, Homo sapiens
ccgtcttcagcctag

SEQ ID NO: 501072 - DNA, 13 bp, Homo sapiens
ccgtgagccaaga

SEQ ID NO: 501073 - DNA, 18 bp, Homo sapiens
cctaaaacaaaagctcat

SEQ ID NO: 501074 - DNA, 17 bp, Homo sapiens
cctacacccttggactt

SEQ ID NO: 501075 - DNA, 14 bp, Homo sapiens
cctaccacatgcca

SEQ ID NO: 501076 - DNA, 15 bp, Homo sapiens
cctagagcacactgt

SEQ ID NO: 501077 - DNA, 14 bp, Homo sapiens
cctagccgacctca

SEQ ID NO: 501078 - DNA, 18 bp, Homo sapiens
cctagccgacctcagcct

SEQ ID NO: 501079 - DNA, 20 bp, Homo sapiens
cctagccgacctcagccttc

SEQ ID NO: 501080 - DNA, 13 bp, Homo sapiens
cctaggcaggaca

SEQ ID NO: 501081 - DNA, 18 bp, Homo sapiens
cctaggcaggacatgctg

SEQ ID NO: 501082 - DNA, 17 bp, Homo sapiens
cctagggccactgaaga

SEQ ID NO: 501083 - DNA, 21 bp, Homo sapiens
cctagtctctatcattaaagt

SEQ ID NO: 501084 - DNA, 15 bp, Homo sapiens
cctatctttgccacc

SEQ ID NO: 501085 - DNA, 18 bp, Homo sapiens
cctcaaacactgcaggca

SEQ ID NO: 501086 - DNA, 21 bp, Homo sapiens
cctcaaacactgcaggcatca

SEQ ID NO: 501087 - DNA, 12 bp, Homo sapiens
cctcacactggg

SEQ ID NO: 501088 - DNA, 15 bp, Homo sapiens
cctcacactgggact

SEQ ID NO: 501089 - DNA, 12 bp, Homo sapiens
cctcacctgggc

SEQ ID NO: 501090 - DNA, 20 bp, Homo sapiens
cctcactggggtcctggggc

SEQ ID NO: 501091 - DNA, 23 bp, Homo sapiens
cctcagaacaaagtgagacagtc

SEQ ID NO: 501092 - DNA, 15 bp, Homo sapiens
cctcagactcattgt

SEQ ID NO: 501093 - DNA, 23 bp, Homo sapiens
cctcaggaactatgggagcctca

SEQ ID NO: 501094 - DNA, 14 bp, Homo sapiens
cctcatccagggct

SEQ ID NO: 501095 - DNA, 17 bp, Homo sapiens
cctcatccgaggcaggg

SEQ ID NO: 501096 - DNA, 20 bp, Homo sapiens
cctcatccgaggcagggtca

SEQ ID NO: 501097 - DNA, 23 bp, Homo sapiens
cctcatggaattggagctcgtgg

SEQ ID NO: 501098 - DNA, 22 bp, Homo sapiens
cctcatttcaggagcagcctca

SEQ ID NO: 501099 - DNA, 23 bp, Homo sapiens
cctcatttttgaatacaggcata

SEQ ID NO: 501100 - DNA, 15 bp, Homo sapiens
cctccacctccctgc

SEQ ID NO: 501101 - DNA, 17 bp, Homo sapiens
cctccacctccctgcaa

SEQ ID NO: 501102 - DNA, 15 bp, Homo sapiens
cctcccctcctctgc

SEQ ID NO: 501103 - DNA, 17 bp, Homo sapiens
cctcccctcctctgctt

SEQ ID NO: 501104 - DNA, 14 bp, Homo sapiens
cctcccctgcccta

SEQ ID NO: 501105 - DNA, 11 bp, Homo sapiens
cctcctctgct

SEQ ID NO: 501106 - DNA, 18 bp, Homo sapiens
cctcctctgcttgccatc

SEQ ID NO: 501107 - DNA, 12 bp, Homo sapiens
cctcctctgtcc

SEQ ID NO: 501108 - DNA, 16 bp, Homo sapiens
cctccttccagcactg

SEQ ID NO: 501109 - DNA, 13 bp, Homo sapiens
cctcggagcctca

SEQ ID NO: 501110 - DNA, 14 bp, Homo sapiens
cctcggagcctcat

SEQ ID NO: 501111 - DNA, 13 bp, Homo sapiens
cctctcctgggca

SEQ ID NO: 501112 - DNA, 20 bp, Homo sapiens
cctctcctgggcagctgcct

SEQ ID NO: 501113 - DNA, 22 bp, Homo sapiens
cctctcctgggcagctgcctcc

SEQ ID NO: 501114 - DNA, 16 bp, Homo sapiens
cctctgccgctgccat

SEQ ID NO: 501115 - DNA, 14 bp, Homo sapiens
cctctgtccagggc

SEQ ID NO: 501116 - DNA, 20 bp, Homo sapiens
cctctgtccagggccctgag

SEQ ID NO: 501117 - DNA, 23 bp, Homo sapiens
cctcttagatgcagttctgaaga

SEQ ID NO: 501118 - DNA, 12 bp, Homo sapiens
cctgagaagaga

SEQ ID NO: 501119 - DNA, 18 bp, Homo sapiens
cctgagctagaagctgga

SEQ ID NO: 501120 - DNA, 15 bp, Homo sapiens
cctgagctcggtgga

SEQ ID NO: 501121 - DNA, 13 bp, Homo sapiens
ctgcctcccctcc

SEQ ID NO: 501122 - DNA, 18 bp, Homo sapiens
ctgcctcccttcatgcat

SEQ ID NO: 501123 - DNA, 23 bp, Homo sapiens
ctgcctcccttcatgcatggaaa

SEQ ID NO: 501124 - DNA, 12 bp, Homo sapiens
ctgcctgggagc

SEQ ID NO: 501125 - DNA, 14 bp, Homo sapiens
ctgcctgttctgag

SEQ ID NO: 501126 - DNA, 12 bp, Homo sapiens
ctgctacctcac

SEQ ID NO: 501127 - DNA, 18 bp, Homo sapiens
ctgctacctcactggggt

SEQ ID NO: 501128 - DNA, 19 bp, Homo sapiens
ctgctatattttcatgact

SEQ ID NO: 501129 - DNA, 23 bp, Homo sapiens
ctgctatattttcatgacttttc

SEQ ID NO: 501130 - DNA, 15 bp, Homo sapiens
ctgctccagcctctg

SEQ ID NO: 501131 - DNA, 17 bp, Homo sapiens
ctgctccagcctctgcc

SEQ ID NO: 501132 - DNA, 12 bp, Homo sapiens
ctgctctggaca

SEQ ID NO: 501133 - DNA, 18 bp, Homo sapiens
ctgcttgccatccctccc

SEQ ID NO: 501134 - DNA, 18 bp, Homo sapiens
ctggaagtgactttggct

SEQ ID NO: 501135 - DNA, 19 bp, Homo sapiens
ctggaatctggagagctag

SEQ ID NO: 501136 - DNA, 13 bp, Homo sapiens
ctggagaactaga

SEQ ID NO: 501137 - DNA, 22 bp, Homo sapiens
ctggagaattgaaaaggactct

SEQ ID NO: 501138 - DNA, 18 bp, Homo sapiens
ctggagactcctaggcag

SEQ ID NO: 501139 - DNA, 20 bp, Homo sapiens
ctggagactcctaggcagga

SEQ ID NO: 501140 - DNA, 19 bp, Homo sapiens
ctggagagctagaacctgg

SEQ ID NO: 501141 - DNA, 22 bp, Homo sapiens
ctggagagctagaacctggagg

SEQ ID NO: 501142 - DNA, 21 bp, Homo sapiens
ctggagccatgggcacaaagg

SEQ ID NO: 501143 - DNA, 15 bp, Homo sapiens
ctggagcctggtgcc

SEQ ID NO: 501144 - DNA, 20 bp, Homo sapiens
ctggaggactagaacctgga

SEQ ID NO: 501145 - DNA, 22 bp, Homo sapiens
ctggaggactagaacctggagg

SEQ ID NO: 501146 - DNA, 19 bp, Homo sapiens
ctggagggaatgaacctgg

SEQ ID NO: 501147 - DNA, 22 bp, Homo sapiens
ctggagggctagaacctggaga

SEQ ID NO: 501148 - DNA, 19 bp, Homo sapiens
ctggagggctagaatctgg

SEQ ID NO: 501149 - DNA, 20 bp, Homo sapiens
ctggagggctagaatctgga

SEQ ID NO: 501150 - DNA, 14 bp, Homo sapiens
ctggattcccagga

SEQ ID NO: 501151 - DNA, 13 bp, Homo sapiens
ctggattttgtca

SEQ ID NO: 501152 - DNA, 15 bp, Homo sapiens
ctggcaacagagcga

SEQ ID NO: 501153 - DNA, 16 bp, Homo sapiens
ctggcaaggacacaga

SEQ ID NO: 501154 - DNA, 17 bp, Homo sapiens
ctggcaaggacacagat

SEQ ID NO: 501155 - DNA, 18 bp, Homo sapiens
ctggcaaggacacagatg

SEQ ID NO: 501156 - DNA, 21 bp, Homo sapiens
ctggcacacagtaggtgctca

SEQ ID NO: 501157 - DNA, 15 bp, Homo sapiens
ctggccagggcctgg

SEQ ID NO: 501158 - DNA, 22 bp, Homo sapiens
ctggctctttggagatcaagga

SEQ ID NO: 501159 - DNA, 18 bp, Homo sapiens
ctggcttctgcttgtcat

SEQ ID NO: 501160 - DNA, 17 bp, Homo sapiens
ctgggaactcacctggg

SEQ ID NO: 501161 - DNA, 10 bp, Homo sapiens
ctgggacagg

SEQ ID NO: 501162 - DNA, 16 bp, Homo sapiens
ctgggaccacgtgaga

SEQ ID NO: 501163 - DNA, 12 bp, Homo sapiens
ctgggaggcaga

SEQ ID NO: 501164 - DNA, 22 bp, Homo sapiens
ctgggaggcagaggttgcagtg

SEQ ID NO: 501165 - DNA, 16 bp, Homo sapiens
ctgggcaacagagcaa

SEQ ID NO: 501166 - DNA, 15 bp, Homo sapiens
ctgggcaaggaggcc

SEQ ID NO: 501167 - DNA, 20 bp, Homo sapiens
ctgggcaccacctctgtggg

SEQ ID NO: 501168 - DNA, 13 bp, Homo sapiens
ctgggcagctgcc

SEQ ID NO: 501169 - DNA, 14 bp, Homo sapiens
ctgggcagctgcct

SEQ ID NO: 501170 - DNA, 16 bp, Homo sapiens
ctgggcagctgcctcc

SEQ ID NO: 501171 - DNA, 22 bp, Homo sapiens
ctgggcagctgcctcccctcct

SEQ ID NO: 501172 - DNA, 16 bp, Homo sapiens
ctgggcatagatgcag

SEQ ID NO: 501173 - DNA, 23 bp, Homo sapiens
ctgggcatagatgcaggtgagcc

SEQ ID NO: 501174 - DNA, 13 bp, Homo sapiens
ctgggccagagta

SEQ ID NO: 501175 - DNA, 20 bp, Homo sapiens
ctgggcctcctcacaacatg

SEQ ID NO: 501176 - DNA, 11 bp, Homo sapiens
ctgggctttct

SEQ ID NO: 501177 - DNA, 14 bp, Homo sapiens
ctggggctgctggc

SEQ ID NO: 501178 - DNA, 16 bp, Homo sapiens
ctggggctgctggcct

SEQ ID NO: 501179 - DNA, 15 bp, Homo sapiens
ctggggtcctggggc

SEQ ID NO: 501180 - DNA, 18 bp, Homo sapiens
ctggggtcctggggcctc

SEQ ID NO: 501181 - DNA, 23 bp, Homo sapiens
ctgggtggaactctcctgctcct

SEQ ID NO: 501182 - DNA, 23 bp, Homo sapiens
ctgggtggacatggcccctgtga

SEQ ID NO: 501183 - DNA, 13 bp, Homo sapiens
ctgggttggaaaa

SEQ ID NO: 501184 - DNA, 18 bp, Homo sapiens
ctggtaatttgtatctga

SEQ ID NO: 501185 - DNA, 16 bp, Homo sapiens
ctggtctctaggctgg

SEQ ID NO: 501186 - DNA, 17 bp, Homo sapiens
ctggtctctaggctggg

SEQ ID NO: 501187 - DNA, 12 bp, Homo sapiens
ctggtgggcctc

SEQ ID NO: 501188 - DNA, 17 bp, Homo sapiens
ctggttggagagctaga

SEQ ID NO: 501189 - DNA, 23 bp, Homo sapiens
ctggttggagagctagaacctgg

SEQ ID NO: 501190 - DNA, 21 bp, Homo sapiens
ctgtaaaaagagagaaaactt

SEQ ID NO: 501191 - DNA, 21 bp, Homo sapiens
ctgtagagctagaacatggag

SEQ ID NO: 501192 - DNA, 20 bp, Homo sapiens
ctgtaggttcatgcccaagc

SEQ ID NO: 501193 - DNA, 17 bp, Homo sapiens
ctgtattagtcacagag

SEQ ID NO: 501194 - DNA, 15 bp, Homo sapiens
ctgtcaaagaatcaa

SEQ ID NO: 501195 - DNA, 21 bp, Homo sapiens
ctgtctcttaaaaaaataaaa

SEQ ID NO: 501196 - DNA, 15 bp, Homo sapiens
ctgtctgccagccag

SEQ ID NO: 501197 - DNA, 20 bp, Homo sapiens
ctgtctgccagccagcagcc

SEQ ID NO: 501198 - DNA, 22 bp, Homo sapiens
ctgtgagagagttgctcctcag

SEQ ID NO: 501199 - DNA, 20 bp, Homo sapiens
ctgtgagttctgttgtgttt

SEQ ID NO: 501200 - DNA, 16 bp, Homo sapiens
ctgtgatttatttgga

SEQ ID NO: 501201 - DNA, 18 bp, Homo sapiens
ctgtgatttatttggagt

SEQ ID NO: 501202 - DNA, 22 bp, Homo sapiens
ctgtgatttatttggagtggag

SEQ ID NO: 501203 - DNA, 23 bp, Homo sapiens
ctgtgatttatttggagtggagg

SEQ ID NO: 501204 - DNA, 23 bp, Homo sapiens
ctgtgcccaagtgggtccaagtg

SEQ ID NO: 501205 - DNA, 14 bp, Homo sapiens
ctgtgctccctggt

SEQ ID NO: 501206 - DNA, 15 bp, Homo sapiens
ctgtgggaaggccag

SEQ ID NO: 501207 - DNA, 20 bp, Homo sapiens
ctgtgggaaggccagctgcc

SEQ ID NO: 501208 - DNA, 17 bp, Homo sapiens
ctgtgggcactggtggg

SEQ ID NO: 501209 - DNA, 15 bp, Homo sapiens
ctgtgtaacactgtt

SEQ ID NO: 501210 - DNA, 19 bp, Homo sapiens
ctgtgtgaacgtgtatgta

SEQ ID NO: 501211 - DNA, 15 bp, Homo sapiens
ctgttctcattcctg

SEQ ID NO: 501212 - DNA, 21 bp, Homo sapiens
ctgtttcccagcagtggactc

SEQ ID NO: 501213 - DNA, 14 bp, Homo sapiens
cttaaaaaaataaa

SEQ ID NO: 501214 - DNA, 21 bp, Homo sapiens
cttaagaagactgcattatat

SEQ ID NO: 501215 - DNA, 15 bp, Homo sapiens
cttaagacaaatggg

SEQ ID NO: 501216 - DNA, 23 bp, Homo sapiens
cttaagacaaatgggactgatgt

SEQ ID NO: 501217 - DNA, 17 bp, Homo sapiens
cttaagagatgcctcat

SEQ ID NO: 501218 - DNA, 20 bp, Homo sapiens
cttaatagaaacattgaaga

SEQ ID NO: 501219 - DNA, 11 bp, Homo sapiens
cttacacccac

SEQ ID NO: 501220 - DNA, 20 bp, Homo sapiens
cttacacccacagtggaaag

SEQ ID NO: 501221 - DNA, 23 bp, Homo sapiens
cttacagctgggtggcactgcca

SEQ ID NO: 501222 - DNA, 14 bp, Homo sapiens
cttactcaaacatg

SEQ ID NO: 501223 - DNA, 11 bp, Homo sapiens
cttagaataaa

SEQ ID NO: 501224 - DNA, 15 bp, Homo sapiens
cttagacctcagcct

SEQ ID NO: 501225 - DNA, 16 bp, Homo sapiens
cttagacctcagcctg

SEQ ID NO: 501226 - DNA, 22 bp, Homo sapiens
cttagatgcagttctgaagaag

SEQ ID NO: 501227 - DNA, 16 bp, Homo sapiens
cttagcttagacctca

SEQ ID NO: 501228 - DNA, 19 bp, Homo sapiens
cttagcttagacctcagcc

SEQ ID NO: 501229 - DNA, 16 bp, Homo sapiens
cttaggagcagagctc

SEQ ID NO: 501230 - DNA, 22 bp, Homo sapiens
cttaggcaccatagaagaacag

SEQ ID NO: 501231 - DNA, 21 bp, Homo sapiens
cttaggttgtagcagaaagga

SEQ ID NO: 501232 - DNA, 13 bp, Homo sapiens
cttataggtggcc

SEQ ID NO: 501233 - DNA, 11 bp, Homo sapiens
cttatttgagt

SEQ ID NO: 501234 - DNA, 13 bp, Homo sapiens
cttatttgagtga

SEQ ID NO: 501235 - DNA, 21 bp, Homo sapiens
cttcaaaaactgtcaaagaat

SEQ ID NO: 501236 - DNA, 12 bp, Homo sapiens
cttcaataaacc

SEQ ID NO: 501237 - DNA, 22 bp, Homo sapiens
cttcaataaaccacaagcatct

SEQ ID NO: 501238 - DNA, 22 bp, Homo sapiens
cttcacacacaggcaactgagg

SEQ ID NO: 501239 - DNA, 19 bp, Homo sapiens
cttcacacagacaagtggc

SEQ ID NO: 501240 - DNA, 18 bp, Homo sapiens
cttcagagataggcctgt

SEQ ID NO: 501241 - DNA, 10 bp, Homo sapiens
cttcagaggc

SEQ ID NO: 501242 - DNA, 16 bp, Homo sapiens
cttcagaggctgaggt

SEQ ID NO: 501243 - DNA, 23 bp, Homo sapiens
cttcagcctagccgacctcagcc

SEQ ID NO: 501244 - DNA, 16 bp, Homo sapiens
cttcatccgcctgtgg

SEQ ID NO: 501245 - DNA, 13 bp, Homo sapiens
cttcatctggaac

SEQ ID NO: 501246 - DNA, 15 bp, Homo sapiens
cttcatctggaacca

SEQ ID NO: 501247 - DNA, 15 bp, Homo sapiens
cttcatgcatggaaa

SEQ ID NO: 501248 - DNA, 15 bp, Homo sapiens
cttcatttattttga

SEQ ID NO: 501249 - DNA, 19 bp, Homo sapiens
cttccagatcctggaaatc

SEQ ID NO: 501250 - DNA, 19 bp, Homo sapiens
cttcccaggagtggaggag

SEQ ID NO: 501251 - DNA, 19 bp, Homo sapiens
cttcccatgacccaggctg

SEQ ID NO: 501252 - DNA, 22 bp, Homo sapiens
cttcccatgacccaggctgggc

SEQ ID NO: 501253 - DNA, 23 bp, Homo sapiens
cttccccttgcccagggctcagc

SEQ ID NO: 501254 - DNA, 23 bp, Homo sapiens
cttccctatctttgccaccctca

SEQ ID NO: 501255 - DNA, 17 bp, Homo sapiens
cttccgcatcctagtct

SEQ ID NO: 501256 - DNA, 20 bp, Homo sapiens
cttcctccgaggccagtacc

SEQ ID NO: 501257 - DNA, 13 bp, Homo sapiens
gcatttagatgta

SEQ ID NO: 501258 - DNA, 18 bp, Homo sapiens
gccaagcactgtgctcag

SEQ ID NO: 501259 - DNA, 19 bp, Homo sapiens
gccaaggctggagtgcagt

SEQ ID NO: 501260 - DNA, 15 bp, Homo sapiens
gccaccctcatgctg

SEQ ID NO: 501261 - DNA, 16 bp, Homo sapiens
gccaccctcatgctgt

SEQ ID NO: 501262 - DNA, 19 bp, Homo sapiens
gccactgcactccagcctg

SEQ ID NO: 501263 - DNA, 20 bp, Homo sapiens
gccactgcactccagcctgg

SEQ ID NO: 501264 - DNA, 22 bp, Homo sapiens
gccagatggactccagcctgcc

SEQ ID NO: 501265 - DNA, 19 bp, Homo sapiens
gccagcagccagctctcag

SEQ ID NO: 501266 - DNA, 21 bp, Homo sapiens
gccagcagccagctctcagcc

SEQ ID NO: 501267 - DNA, 19 bp, Homo sapiens
gccagcagttcagagctgc

SEQ ID NO: 501268 - DNA, 22 bp, Homo sapiens
gccagcagttcagagctgccct

SEQ ID NO: 501269 - DNA, 13 bp, Homo sapiens
gccagccagcagc

SEQ ID NO: 501270 - DNA, 14 bp, Homo sapiens
gccagctctcagcc

SEQ ID NO: 501271 - DNA, 19 bp, Homo sapiens
gccagggtgagagtctggg

SEQ ID NO: 501272 - DNA, 19 bp, Homo sapiens
gccagtgatgctaaaggtt

SEQ ID NO: 501273 - DNA, 14 bp, Homo sapiens
gccatccctccctc

SEQ ID NO: 501274 - DNA, 16 bp, Homo sapiens
gccatccctccctcca

SEQ ID NO: 501275 - DNA, 18 bp, Homo sapiens
gccatccctccctccacc

SEQ ID NO: 501276 - DNA, 20 bp, Homo sapiens
gccatcctcaaacactgcag

SEQ ID NO: 501277 - DNA, 18 bp, Homo sapiens
gccatggacagaagaagg

SEQ ID NO: 501278 - DNA, 15 bp, Homo sapiens
gccatggagagctgg

SEQ ID NO: 501279 - DNA, 16 bp, Homo sapiens
gccatggagagctgga

SEQ ID NO: 501280 - DNA, 18 bp, Homo sapiens
gccatgtagaagctgcat

SEQ ID NO: 501281 - DNA, 13 bp, Homo sapiens
gcccaagatgctt

SEQ ID NO: 501282 - DNA, 16 bp, Homo sapiens
gcccacagctgtatga

SEQ ID NO: 501283 - DNA, 15 bp, Homo sapiens
gcccaccagccttgc

SEQ ID NO: 501284 - DNA, 16 bp, Homo sapiens
gcccaccagccttgct

SEQ ID NO: 501285 - DNA, 18 bp, Homo sapiens
gcccaccagccttgctct

SEQ ID NO: 501286 - DNA, 19 bp, Homo sapiens
gcccaccagccttgctctc

SEQ ID NO: 501287 - DNA, 20 bp, Homo sapiens
gcccaccagccttgctctct

SEQ ID NO: 501288 - DNA, 12 bp, Homo sapiens
gcccagggctca

SEQ ID NO: 501289 - DNA, 14 bp, Homo sapiens
gcccagggctcagc

SEQ ID NO: 501290 - DNA, 15 bp, Homo sapiens
gcccagggctcagcc

SEQ ID NO: 501291 - DNA, 16 bp, Homo sapiens
gcccagggctcagcct

SEQ ID NO: 501292 - DNA, 22 bp, Homo sapiens
gcccatggccctcccagtacct

SEQ ID NO: 501293 - DNA, 19 bp, Homo sapiens
gcccattcattccattctg

SEQ ID NO: 501294 - DNA, 23 bp, Homo sapiens
gcccattcattccattctggaag

SEQ ID NO: 501295 - DNA, 17 bp, Homo sapiens
gccccagcactaaagca

SEQ ID NO: 501296 - DNA, 23 bp, Homo sapiens
gccccagcactaaagcagtggac

SEQ ID NO: 501297 - DNA, 23 bp, Homo sapiens
gccccatccaccgccagcttccc

SEQ ID NO: 501298 - DNA, 19 bp, Homo sapiens
gcccccactgcctttgacc

SEQ ID NO: 501299 - DNA, 18 bp, Homo sapiens
gcccccgggccgacggag

SEQ ID NO: 501300 - DNA, 14 bp, Homo sapiens
gcccgtcttcagcc

SEQ ID NO: 501301 - DNA, 19 bp, Homo sapiens
gcccgtgccctaccacaca

SEQ ID NO: 501302 - DNA, 13 bp, Homo sapiens
gccctagagcaca

SEQ ID NO: 501303 - DNA, 12 bp, Homo sapiens
gccctctcctgg

SEQ ID NO: 501304 - DNA, 23 bp, Homo sapiens
gccctctcctgggcagctgcctc

SEQ ID NO: 501305 - DNA, 13 bp, Homo sapiens
gccctgagctcgg

SEQ ID NO: 501306 - DNA, 15 bp, Homo sapiens
gccctgagctcggtg

SEQ ID NO: 501307 - DNA, 14 bp, Homo sapiens
gccctttttaagga

SEQ ID NO: 501308 - DNA, 11 bp, Homo sapiens
gccgacctcag

SEQ ID NO: 501309 - DNA, 12 bp, Homo sapiens
gccgacctcagc

SEQ ID NO: 501310 - DNA, 15 bp, Homo sapiens
gccgacctcagcctt

SEQ ID NO: 501311 - DNA, 17 bp, Homo sapiens
gccgacctcagccttcc

SEQ ID NO: 501312 - DNA, 21 bp, Homo sapiens
gccgctcctgtctgccagcca

SEQ ID NO: 501313 - DNA, 22 bp, Homo sapiens
gccggaaggaatgtcagggcca

SEQ ID NO: 501314 - DNA, 14 bp, Homo sapiens
gccggtacctggga

SEQ ID NO: 501315 - DNA, 15 bp, Homo sapiens
gccgtgggcctgggg

SEQ ID NO: 501316 - DNA, 16 bp, Homo sapiens
gcctagccgacctcag

SEQ ID NO: 501317 - DNA, 18 bp, Homo sapiens
gcctcatccgaggcaggg

SEQ ID NO: 501318 - DNA, 19 bp, Homo sapiens
gcctcatccgaggcagggt

SEQ ID NO: 501319 - DNA, 22 bp, Homo sapiens
gcctcatccgaggcagggtcag

SEQ ID NO: 501320 - DNA, 11 bp, Homo sapiens
gcctcccctcc

SEQ ID NO: 501321 - DNA, 12 bp, Homo sapiens
gcctcccctcct

SEQ ID NO: 501322 - DNA, 13 bp, Homo sapiens
gcctcccctcctc

SEQ ID NO: 501323 - DNA, 23 bp, Homo sapiens
gcctcccctcctctgcttgccat

SEQ ID NO: 501324 - DNA, 23 bp, Homo sapiens
gcctcggagcctcatccgaggca

SEQ ID NO: 501325 - DNA, 17 bp, Homo sapiens
gcctctgccgctgccat

SEQ ID NO: 501326 - DNA, 20 bp, Homo sapiens
gcctgaagtcttctcctcca

SEQ ID NO: 501327 - DNA, 15 bp, Homo sapiens
gcctgcctggcaggc

SEQ ID NO: 501328 - DNA, 17 bp, Homo sapiens
gcctgcctggcaggctg

SEQ ID NO: 501329 - DNA, 22 bp, Homo sapiens
gcctggaagacagagacctcct

SEQ ID NO: 501330 - DNA, 23 bp, Homo sapiens
gcctggaagacagagacctcctg

SEQ ID NO: 501331 - DNA, 17 bp, Homo sapiens
gcctggcaacagagcga

SEQ ID NO: 501332 - DNA, 14 bp, Homo sapiens
gcctggcaggctgt

SEQ ID NO: 501333 - DNA, 14 bp, Homo sapiens
gcctggccatgtgg

SEQ ID NO: 501334 - DNA, 15 bp, Homo sapiens
gcctgggcaacagag

SEQ ID NO: 501335 - DNA, 22 bp, Homo sapiens
gcctgggcaacatagtgagacc

SEQ ID NO: 501336 - DNA, 22 bp, Homo sapiens
gcctggggtaccaagagactcc

SEQ ID NO: 501337 - DNA, 19 bp, Homo sapiens
gcctgtacaagctgatgtt

SEQ ID NO: 501338 - DNA, 19 bp, Homo sapiens
gcctgttctgaggattcag

SEQ ID NO: 501339 - DNA, 16 bp, Homo sapiens
gccttagaactttgca

SEQ ID NO: 501340 - DNA, 22 bp, Homo sapiens
gccttatctaaatcaccagaga

SEQ ID NO: 501341 - DNA, 16 bp, Homo sapiens
gccttccccttgccca

SEQ ID NO: 501342 - DNA, 15 bp, Homo sapiens
gccttgctctcttca

SEQ ID NO: 501343 - DNA, 18 bp, Homo sapiens
gccttggggctgatgcag

SEQ ID NO: 501344 - DNA, 22 bp, Homo sapiens
gcctttagtgatcacagcagct

SEQ ID NO: 501345 - DNA, 13 bp, Homo sapiens
gcctttggcaggt

SEQ ID NO: 501346 - DNA, 16 bp, Homo sapiens
gccttttatttcttaa

SEQ ID NO: 501347 - DNA, 15 bp, Homo sapiens
gcgggcacaataaat

SEQ ID NO: 501348 - DNA, 16 bp, Homo sapiens
gcggtgatcagcagag

SEQ ID NO: 501349 - DNA, 19 bp, Homo sapiens
gcgtcctgtccacacccag

SEQ ID NO: 501350 - DNA, 16 bp, Homo sapiens
gctaaaacctgagcta

SEQ ID NO: 501351 - DNA, 21 bp, Homo sapiens
gctaactagcttggaaactgg

SEQ ID NO: 501352 - DNA, 14 bp, Homo sapiens
gctaagcattccaa

SEQ ID NO: 501353 - DNA, 20 bp, Homo sapiens
gctaaggcgtggagctgcct

SEQ ID NO: 501354 - DNA, 21 bp, Homo sapiens
gctacccaggaggctgaggtg

SEQ ID NO: 501355 - DNA, 18 bp, Homo sapiens
gctacgtacatgtgaggc

SEQ ID NO: 501356 - DNA, 22 bp, Homo sapiens
gctactcaggaggctgaggcag

SEQ ID NO: 501357 - DNA, 18 bp, Homo sapiens
gctagaacctagaagggc

SEQ ID NO: 501358 - DNA, 19 bp, Homo sapiens
gctagaacctagaagggct

SEQ ID NO: 501359 - DNA, 19 bp, Homo sapiens
gctagaatctggagagcta

SEQ ID NO: 501360 - DNA, 14 bp, Homo sapiens
gctagatgtatgta

SEQ ID NO: 501361 - DNA, 18 bp, Homo sapiens
gctaggatgttgctcaga

SEQ ID NO: 501362 - DNA, 20 bp, Homo sapiens
gctagggttccactggagaa

SEQ ID NO: 501363 - DNA, 21 bp, Homo sapiens
gctagtaattggaaaggcagc

SEQ ID NO: 501364 - DNA, 20 bp, Homo sapiens
gctataactatgttgataaa

SEQ ID NO: 501365 - DNA, 23 bp, Homo sapiens
gctatattttcatgacttttcca

SEQ ID NO: 501366 - DNA, 15 bp, Homo sapiens
gctatcctggctctt

SEQ ID NO: 501367 - DNA, 15 bp, Homo sapiens
gctcagcctggtggg

SEQ ID NO: 501368 - DNA, 19 bp, Homo sapiens
gctcagcctggtgggcctc

SEQ ID NO: 501369 - DNA, 16 bp, Homo sapiens
gctcagttcagaatca

SEQ ID NO: 501370 - DNA, 18 bp, Homo sapiens
gctcatgcatagtcccag

SEQ ID NO: 501371 - DNA, 15 bp, Homo sapiens
gctcatgccctgcca

SEQ ID NO: 501372 - DNA, 17 bp, Homo sapiens
gctccagcctctgccgc

SEQ ID NO: 501373 - DNA, 21 bp, Homo sapiens
gctccagcctctgccgctgcc

SEQ ID NO: 501374 - DNA, 18 bp, Homo sapiens
gctcccttccacctgtca

SEQ ID NO: 501375 - DNA, 16 bp, Homo sapiens
gctcctgtctgccagc

SEQ ID NO: 501376 - DNA, 14 bp, Homo sapiens
gctcggtggaccca

SEQ ID NO: 501377 - DNA, 11 bp, Homo sapiens
gctctcagcca

SEQ ID NO: 501378 - DNA, 17 bp, Homo sapiens
gctctcagccaacgagt

SEQ ID NO: 501379 - DNA, 11 bp, Homo sapiens
gctctctgagg

SEQ ID NO: 501380 - DNA, 19 bp, Homo sapiens
gctctcttcaataaaccac

SEQ ID NO: 501381 - DNA, 16 bp, Homo sapiens
gctgaagatccccaac

SEQ ID NO: 501382 - DNA, 23 bp, Homo sapiens
gctgaagatccccaactgctcca

SEQ ID NO: 501383 - DNA, 19 bp, Homo sapiens
gctgacacaaacctgcctg

SEQ ID NO: 501384 - DNA, 21 bp, Homo sapiens
gctgacacaaacctgcctggg

SEQ ID NO: 501385 - DNA, 14 bp, Homo sapiens
gctgaggcaattct

SEQ ID NO: 501386 - DNA, 17 bp, Homo sapiens
gctgagtctgcagatga

SEQ ID NO: 501387 - DNA, 19 bp, Homo sapiens
gctgccatgctttgagtcc

SEQ ID NO: 501388 - DNA, 14 bp, Homo sapiens
gctgccccagccag

SEQ ID NO: 501389 - DNA, 16 bp, Homo sapiens
gctgccccagccagat

SEQ ID NO: 501390 - DNA, 21 bp, Homo sapiens
gctgcccgtcttcagcctagc

SEQ ID NO: 501391 - DNA, 13 bp, Homo sapiens
gctgccctctcct

SEQ ID NO: 501392 - DNA, 15 bp, Homo sapiens
gctgccctctcctgg

SEQ ID NO: 501393 - DNA, 16 bp, Homo sapiens
gctgccctctcctggg

SEQ ID NO: 501394 - DNA, 11 bp, Homo sapiens
gtctaaagttt

SEQ ID NO: 501395 - DNA, 23 bp, Homo sapiens
gtctacactaagagagaatgaga

SEQ ID NO: 501396 - DNA, 22 bp, Homo sapiens
gtctccttaacactgagctgtc

SEQ ID NO: 501397 - DNA, 17 bp, Homo sapiens
gtctctaggctggggaa

SEQ ID NO: 501398 - DNA, 18 bp, Homo sapiens
gtctctatcattaaagtt

SEQ ID NO: 501399 - DNA, 12 bp, Homo sapiens
gtctctggcctg

SEQ ID NO: 501400 - DNA, 17 bp, Homo sapiens
gtctcttaaaaaaataa

SEQ ID NO: 501401 - DNA, 17 bp, Homo sapiens
gtctgaaattttctaga

SEQ ID NO: 501402 - DNA, 21 bp, Homo sapiens
gtctgaaattttctagaatac

SEQ ID NO: 501403 - DNA, 23 bp, Homo sapiens
gtctgagactctcttaggagcag

SEQ ID NO: 501404 - DNA, 18 bp, Homo sapiens
gtctgctatattttcatg

SEQ ID NO: 501405 - DNA, 17 bp, Homo sapiens
gtctggtttcaccgagg

SEQ ID NO: 501406 - DNA, 22 bp, Homo sapiens
gtctggtttcaccgaggacatg

SEQ ID NO: 501407 - DNA, 23 bp, Homo sapiens
gtcttcagcctagccgacctcag

SEQ ID NO: 501408 - DNA, 16 bp, Homo sapiens
gtcttttcaaaaggat

SEQ ID NO: 501409 - DNA, 18 bp, Homo sapiens
gtgactttggctgcatgc

SEQ ID NO: 501410 - DNA, 18 bp, Homo sapiens
gtgagacagtccagcctg

SEQ ID NO: 501411 - DNA, 20 bp, Homo sapiens
gtgagacagtccagcctgga

SEQ ID NO: 501412 - DNA, 16 bp, Homo sapiens
gtgagcagtcaggaaa

SEQ ID NO: 501413 - DNA, 18 bp, Homo sapiens
gtgagcccatggccctcc

SEQ ID NO: 501414 - DNA, 17 bp, Homo sapiens
gtgatcacagcagcttc

SEQ ID NO: 501415 - DNA, 16 bp, Homo sapiens
gtgatttatttggagt

SEQ ID NO: 501416 - DNA, 18 bp, Homo sapiens
gtgcaaattgtcacagga

SEQ ID NO: 501417 - DNA, 19 bp, Homo sapiens
gtgcagcccccactgcctt

SEQ ID NO: 501418 - DNA, 15 bp, Homo sapiens
gtgccagatcctctt

SEQ ID NO: 501419 - DNA, 16 bp, Homo sapiens
gtgccagggcagcact

SEQ ID NO: 501420 - DNA, 21 bp, Homo sapiens
gtgcccaagtgggtccaagtg

SEQ ID NO: 501421 - DNA, 20 bp, Homo sapiens
gtgccccccttgccagacat

SEQ ID NO: 501422 - DNA, 14 bp, Homo sapiens
gtgccgacagaagg

SEQ ID NO: 501423 - DNA, 15 bp, Homo sapiens
gtgcctctgtcctta

SEQ ID NO: 501424 - DNA, 13 bp, Homo sapiens
gtgctccaggcag

SEQ ID NO: 501425 - DNA, 18 bp, Homo sapiens
gtgctgcccgtcttcagc

SEQ ID NO: 501426 - DNA, 16 bp, Homo sapiens
gtgcttgccacagagc

SEQ ID NO: 501427 - DNA, 20 bp, Homo sapiens
gtgctttctatctaattttt

SEQ ID NO: 501428 - DNA, 12 bp, Homo sapiens
gtggaggagcag

SEQ ID NO: 501429 - DNA, 14 bp, Homo sapiens
gtggaggaggcctg

SEQ ID NO: 501430 - DNA, 15 bp, Homo sapiens
gtggcaaggctgtgc

SEQ ID NO: 501431 - DNA, 16 bp, Homo sapiens
gtggctgtgacatcta

SEQ ID NO: 501432 - DNA, 17 bp, Homo sapiens
gtgggaacgactgggca

SEQ ID NO: 501433 - DNA, 15 bp, Homo sapiens
gtgggcctcctctgt

SEQ ID NO: 501434 - DNA, 23 bp, Homo sapiens
gtgggcttcccagtggctgctgc

SEQ ID NO: 501435 - DNA, 23 bp, Homo sapiens
gtgggggtgcagatgaggttgct

SEQ ID NO: 501436 - DNA, 14 bp, Homo sapiens
gtgggtagacacac

SEQ ID NO: 501437 - DNA, 14 bp, Homo sapiens
gtgggtcaaggaat

SEQ ID NO: 501438 - DNA, 22 bp, Homo sapiens
gtggtggagccagtaaacagag

SEQ ID NO: 501439 - DNA, 18 bp, Homo sapiens
gtggtgggacagggaccc

SEQ ID NO: 501440 - DNA, 18 bp, Homo sapiens
gtgtacagaattctgcta

SEQ ID NO: 501441 - DNA, 13 bp, Homo sapiens
gtgtccaaagcag

SEQ ID NO: 501442 - DNA, 15 bp, Homo sapiens
gtgtgtttctgatct

SEQ ID NO: 501443 - DNA, 12 bp, Homo sapiens
gtgttcctcttt

SEQ ID NO: 501444 - DNA, 16 bp, Homo sapiens
gtgttcctctttgcat

SEQ ID NO: 501445 - DNA, 13 bp, Homo sapiens
gttactatatgcc

SEQ ID NO: 501446 - DNA, 20 bp, Homo sapiens
gttagggaaaacattccatc

SEQ ID NO: 501447 - DNA, 18 bp, Homo sapiens
gttcaatatgagtctcaa

SEQ ID NO: 501448 - DNA, 12 bp, Homo sapiens
gttcagaagacc

SEQ ID NO: 501449 - DNA, 22 bp, Homo sapiens
gttcagagactcagggccccag

SEQ ID NO: 501450 - DNA, 16 bp, Homo sapiens
gttcagagctgccctc

SEQ ID NO: 501451 - DNA, 23 bp, Homo sapiens
gttcagagctgccctctcctggg

SEQ ID NO: 501452 - DNA, 14 bp, Homo sapiens
gttccactggagaa

SEQ ID NO: 501453 - DNA, 15 bp, Homo sapiens
gttcctctttgcatg

SEQ ID NO: 501454 - DNA, 22 bp, Homo sapiens
gttcgacgagacggtcgagcag

SEQ ID NO: 501455 - DNA, 21 bp, Homo sapiens
gttctcattcctgttctttct

SEQ ID NO: 501456 - DNA, 18 bp, Homo sapiens
gttctgatgatgtgcctg

SEQ ID NO: 501457 - DNA, 11 bp, Homo sapiens
gttctgcctta

SEQ ID NO: 501458 - DNA, 22 bp, Homo sapiens
gttcttaggcaccatagaagaa

SEQ ID NO: 501459 - DNA, 19 bp, Homo sapiens
gttcttgccactgcactcc

SEQ ID NO: 501460 - DNA, 13 bp, Homo sapiens
gttgacatgggac

SEQ ID NO: 501461 - DNA, 14 bp, Homo sapiens
gttgacatgggaca

SEQ ID NO: 501462 - DNA, 20 bp, Homo sapiens
gttgacttgacagaacactg

SEQ ID NO: 501463 - DNA, 21 bp, Homo sapiens
gttgatggtggtatgttttca

SEQ ID NO: 501464 - DNA, 22 bp, Homo sapiens
gttgcaatagaacagagaaaga

SEQ ID NO: 501465 - DNA, 12 bp, Homo sapiens
gttggctggcct

SEQ ID NO: 501466 - DNA, 13 bp, Homo sapiens
gttggctggcctt

SEQ ID NO: 501467 - DNA, 16 bp, Homo sapiens
gttgtaaacaggaagc

SEQ ID NO: 501468 - DNA, 15 bp, Homo sapiens
gttgtctaaaaataa

SEQ ID NO: 501469 - DNA, 22 bp, Homo sapiens
gtttaaaagcatactctatgtg

SEQ ID NO: 501470 - DNA, 17 bp, Homo sapiens
gtttaagaccagcctgg

SEQ ID NO: 501471 - DNA, 15 bp, Homo sapiens
gtttacagtaaataa

SEQ ID NO: 501472 - DNA, 16 bp, Homo sapiens
gtttctgtcctgctgg

SEQ ID NO: 501473 - DNA, 17 bp, Homo sapiens
gtttgaatataaacact

SEQ ID NO: 501474 - DNA, 17 bp, Homo sapiens
gtttgcaaggaagccac

SEQ ID NO: 501475 - DNA, 22 bp, Homo sapiens
gtttgcaaggaagccacagctg

SEQ ID NO: 501476 - DNA, 21 bp, Homo sapiens
gtttggaggagcaaaggctga

SEQ ID NO: 501477 - DNA, 17 bp, Homo sapiens
gtttgtcacatgaaaca

SEQ ID NO: 501478 - DNA, 14 bp, Homo sapiens
gttttcatcaagac

SEQ ID NO: 501479 - DNA, 17 bp, Homo sapiens
gttttgtgaagaaacat

SEQ ID NO: 501480 - DNA, 19 bp, Homo sapiens
gtttttctacttttaaaga

SEQ ID NO: 501481 - DNA, 19 bp, Homo sapiens
taaaaagagagaaaactta

SEQ ID NO: 501482 - DNA, 20 bp, Homo sapiens
taaaaagagagaaaacttat

SEQ ID NO: 501483 - DNA, 15 bp, Homo sapiens
taaaaatggacaaaa

SEQ ID NO: 501484 - DNA, 16 bp, Homo sapiens
taaaaattaattcttt

SEQ ID NO: 501485 - DNA, 18 bp, Homo sapiens
taaaaattaattctttat

SEQ ID NO: 501486 - DNA, 17 bp, Homo sapiens
taaaacattttcacaca

SEQ ID NO: 501487 - DNA, 13 bp, Homo sapiens
taaaactttttat

SEQ ID NO: 501488 - DNA, 11 bp, Homo sapiens
taaaagacaaa

SEQ ID NO: 501489 - DNA, 12 bp, Homo sapiens
taaaagacaaat

SEQ ID NO: 501490 - DNA, 20 bp, Homo sapiens
taaaagcatactctatgtga

SEQ ID NO: 501491 - DNA, 14 bp, Homo sapiens
taaaatcacaaact

SEQ ID NO: 501492 - DNA, 16 bp, Homo sapiens
taaaatcacaaactca

SEQ ID NO: 501493 - DNA, 23 bp, Homo sapiens
taaaatcacaaactcatccatta

SEQ ID NO: 501494 - DNA, 15 bp, Homo sapiens
taaaatccatacatt

SEQ ID NO: 501495 - DNA, 19 bp, Homo sapiens
taaaatccatacatttgtg

SEQ ID NO: 501496 - DNA, 21 bp, Homo sapiens
taaaatgaccagtaattgtga

SEQ ID NO: 501497 - DNA, 17 bp, Homo sapiens
taaaatgggttttactg

SEQ ID NO: 501498 - DNA, 18 bp, Homo sapiens
taaaattaaagctgaaaa

SEQ ID NO: 501499 - DNA, 19 bp, Homo sapiens
taaaattaaagctgaaaac

SEQ ID NO: 501500 - DNA, 19 bp, Homo sapiens
taaaattgtaaaattgtat

SEQ ID NO: 501501 - DNA, 18 bp, Homo sapiens
taaacattagttctattt

SEQ ID NO: 501502 - DNA, 16 bp, Homo sapiens
taaaccacaagcatct

SEQ ID NO: 501503 - DNA, 20 bp, Homo sapiens
taaactgaatttttcttgcg

SEQ ID NO: 501504 - DNA, 20 bp, Homo sapiens
taaacttagaataaaattgt

SEQ ID NO: 501505 - DNA, 14 bp, Homo sapiens
taaagaaggtttca

SEQ ID NO: 501506 - DNA, 13 bp, Homo sapiens
taaagctgttctc

SEQ ID NO: 501507 - DNA, 15 bp, Homo sapiens
taaataaattgtttg

SEQ ID NO: 501508 - DNA, 21 bp, Homo sapiens
taaatatgttagcaaagagtt

SEQ ID NO: 501509 - DNA, 19 bp, Homo sapiens
taaatcaagttggcttcta

SEQ ID NO: 501510 - DNA, 14 bp, Homo sapiens
taaatgtccctaat

SEQ ID NO: 501511 - DNA, 14 bp, Homo sapiens
taaatttttcctta

SEQ ID NO: 501512 - DNA, 20 bp, Homo sapiens
taacaaaccctcgtttctga

SEQ ID NO: 501513 - DNA, 17 bp, Homo sapiens
taacaatgctgtatttt

SEQ ID NO: 501514 - DNA, 19 bp, Homo sapiens
taacaatgctgtattttaa

SEQ ID NO: 501515 - DNA, 13 bp, Homo sapiens
taacacacagcta

SEQ ID NO: 501516 - DNA, 22 bp, Homo sapiens
taacagagtttgatatgggctt

SEQ ID NO: 501517 - DNA, 13 bp, Homo sapiens
taacagctttctc

SEQ ID NO: 501518 - DNA, 17 bp, Homo sapiens
taacagctttctccaga

SEQ ID NO: 501519 - DNA, 15 bp, Homo sapiens
taacagtcttactgc

SEQ ID NO: 501520 - DNA, 19 bp, Homo sapiens
taacagtcttactgcaggc

SEQ ID NO: 501521 - DNA, 21 bp, Homo sapiens
taacataagctagaaaaatta

SEQ ID NO: 501522 - DNA, 19 bp, Homo sapiens
taactattttattttctaa

SEQ ID NO: 501523 - DNA, 14 bp, Homo sapiens
taactcaatatttt

SEQ ID NO: 501524 - DNA, 14 bp, Homo sapiens
taactgggttcaaa

SEQ ID NO: 501525 - DNA, 22 bp, Homo sapiens
taacttgagggtaataaactta

SEQ ID NO: 501526 - DNA, 15 bp, Homo sapiens
taagaaaaacatgtc

SEQ ID NO: 501527 - DNA, 17 bp, Homo sapiens
taagaaaaacatgtcat

SEQ ID NO: 501528 - DNA, 16 bp, Homo sapiens
taagacaaatgggact

SEQ ID NO: 501529 - DNA, 21 bp, Homo sapiens
taagacaaatgggactgatgt

SEQ ID NO: 501530 - DNA, 18 bp, Homo sapiens
taagcattccaactatct

SEQ ID NO: 501531 - DNA, 16 bp, Homo sapiens
tccattaatgtagata

SEQ ID NO: 501532 - DNA, 12 bp, Homo sapiens
tccattctggaa

SEQ ID NO: 501533 - DNA, 13 bp, Homo sapiens
tccatttgctgat

SEQ ID NO: 501534 - DNA, 21 bp, Homo sapiens
tccatttggaatcatatggga

SEQ ID NO: 501535 - DNA, 20 bp, Homo sapiens
tcccaaaagcccattcattc

SEQ ID NO: 501536 - DNA, 20 bp, Homo sapiens
tcccaagagtggtggcagct

SEQ ID NO: 501537 - DNA, 18 bp, Homo sapiens
tcccaagggatggtgccc

SEQ ID NO: 501538 - DNA, 15 bp, Homo sapiens
tcccaccaccctgag

SEQ ID NO: 501539 - DNA, 23 bp, Homo sapiens
tcccacttggcatcagctggcgt

SEQ ID NO: 501540 - DNA, 20 bp, Homo sapiens
tcccactttcttctaccaga

SEQ ID NO: 501541 - DNA, 20 bp, Homo sapiens
tcccagctactcaggaggct

SEQ ID NO: 501542 - DNA, 22 bp, Homo sapiens
tcccaggatgagcatcccagga

SEQ ID NO: 501543 - DNA, 17 bp, Homo sapiens
tcccagtggctgctgcc

SEQ ID NO: 501544 - DNA, 23 bp, Homo sapiens
tcccagtggctgctgcccaggcc

SEQ ID NO: 501545 - DNA, 18 bp, Homo sapiens
tcccataaccgctgattc

SEQ ID NO: 501546 - DNA, 15 bp, Homo sapiens
tcccataggcccagt

SEQ ID NO: 501547 - DNA, 16 bp, Homo sapiens
tcccatgacccaggct

SEQ ID NO: 501548 - DNA, 19 bp, Homo sapiens
tcccatgacccaggctggg

SEQ ID NO: 501549 - DNA, 20 bp, Homo sapiens
tcccatgacccaggctgggc

SEQ ID NO: 501550 - DNA, 13 bp, Homo sapiens
tccccaactgctc

SEQ ID NO: 501551 - DNA, 17 bp, Homo sapiens
tccccagagttccccat

SEQ ID NO: 501552 - DNA, 18 bp, Homo sapiens
tccccatcatctgtggaa

SEQ ID NO: 501553 - DNA, 19 bp, Homo sapiens
tcccctcactgatggacaa

SEQ ID NO: 501554 - DNA, 12 bp, Homo sapiens
tcccctcctctg

SEQ ID NO: 501555 - DNA, 14 bp, Homo sapiens
tccccttccagggg

SEQ ID NO: 501556 - DNA, 13 bp, Homo sapiens
tccccttgcccag

SEQ ID NO: 501557 - DNA, 16 bp, Homo sapiens
tccccttgcccagggc

SEQ ID NO: 501558 - DNA, 24 bp, Homo sapiens
tccccttgcccagggctcagcctg

SEQ ID NO: 501559 - DNA, 20 bp, Homo sapiens
tccccttgtctgaactggag

SEQ ID NO: 501560 - DNA, 20 bp, Homo sapiens
tcccgagcaaagtctaaagt

SEQ ID NO: 501561 - DNA, 20 bp, Homo sapiens
tccctaatttaacccagctc

SEQ ID NO: 501562 - DNA, 23 bp, Homo sapiens
tccctcatttcaggagcagcctc

SEQ ID NO: 501563 - DNA, 21 bp, Homo sapiens
tccctccacctccctgcaata

SEQ ID NO: 501564 - DNA, 23 bp, Homo sapiens
tccctccacctccctgcaataaa

SEQ ID NO: 501565 - DNA, 17 bp, Homo sapiens
tccctccctccacctcc

SEQ ID NO: 501566 - DNA, 21 bp, Homo sapiens
tccctggtaataagtactgtg

SEQ ID NO: 501567 - DNA, 21 bp, Homo sapiens
tcccttcatctggaaccatca

SEQ ID NO: 501568 - DNA, 18 bp, Homo sapiens
tcccttcatgcatggaaa

SEQ ID NO: 501569 - DNA, 13 bp, Homo sapiens
tcccttctcagaa

SEQ ID NO: 501570 - DNA, 21 bp, Homo sapiens
tcccttgaccaggcctgggcc

SEQ ID NO: 501571 - DNA, 12 bp, Homo sapiens
tccgaggcaggg

SEQ ID NO: 501572 - DNA, 13 bp, Homo sapiens
tccgaggcagggt

SEQ ID NO: 501573 - DNA, 22 bp, Homo sapiens
tcctaaaataagggcagagtca

SEQ ID NO: 501574 - DNA, 18 bp, Homo sapiens
tcctacacccttggactt

SEQ ID NO: 501575 - DNA, 20 bp, Homo sapiens
tcctacacccttggacttga

SEQ ID NO: 501576 - DNA, 13 bp, Homo sapiens
tcctatatgcact

SEQ ID NO: 501577 - DNA, 14 bp, Homo sapiens
tcctccgaggccag

SEQ ID NO: 501578 - DNA, 15 bp, Homo sapiens
tcctccgaggccagt

SEQ ID NO: 501579 - DNA, 21 bp, Homo sapiens
tcctgatggcaggatggcctg

SEQ ID NO: 501580 - DNA, 14 bp, Homo sapiens
tcctgcctcagcct

SEQ ID NO: 501581 - DNA, 17 bp, Homo sapiens
tcctggcaatagtcaaa

SEQ ID NO: 501582 - DNA, 13 bp, Homo sapiens
tcctggggcctcg

SEQ ID NO: 501583 - DNA, 21 bp, Homo sapiens
tcctggggcctcggagcctca

SEQ ID NO: 501584 - DNA, 15 bp, Homo sapiens
tcctgtccttcacct

SEQ ID NO: 501585 - DNA, 15 bp, Homo sapiens
tcctgtctctggcct

SEQ ID NO: 501586 - DNA, 12 bp, Homo sapiens
tcctgtctgcca

SEQ ID NO: 501587 - DNA, 22 bp, Homo sapiens
tcctgtctgccagccagcagcc

SEQ ID NO: 501588 - DNA, 19 bp, Homo sapiens
tccttagcttagacctcag

SEQ ID NO: 501589 - DNA, 23 bp, Homo sapiens
tccttagcttagacctcagcctg

SEQ ID NO: 501590 - DNA, 18 bp, Homo sapiens
tccttaggttgtagcaga

SEQ ID NO: 501591 - DNA, 23 bp, Homo sapiens
tccttcctacacccttggacttg

SEQ ID NO: 501592 - DNA, 16 bp, Homo sapiens
tccttcctcacaccag

SEQ ID NO: 501593 - DNA, 16 bp, Homo sapiens
tccttgagagaccagg

SEQ ID NO: 501594 - DNA, 15 bp, Homo sapiens
tccttggctggtgca

SEQ ID NO: 501595 - DNA, 18 bp, Homo sapiens
tccttgtggcctgggcct

SEQ ID NO: 501596 - DNA, 19 bp, Homo sapiens
tcgatatttccatcattaa

SEQ ID NO: 501597 - DNA, 22 bp, Homo sapiens
tcggtggagactatcagcccaa

SEQ ID NO: 501598 - DNA, 22 bp, Homo sapiens
tcgtgggacagtcacctcatgg

SEQ ID NO: 501599 - DNA, 12 bp, Homo sapiens
tctaaagtttac

SEQ ID NO: 501600 - DNA, 22 bp, Homo sapiens
tctaaagtttacagtaaataaa

SEQ ID NO: 501601 - DNA, 19 bp, Homo sapiens
tctaagtcaatccaagagt

SEQ ID NO: 501602 - DNA, 17 bp, Homo sapiens
tctacactaagagagaa

SEQ ID NO: 501603 - DNA, 21 bp, Homo sapiens
tctacactaagagagaatgag

SEQ ID NO: 501604 - DNA, 20 bp, Homo sapiens
tctactaaaaatacaaaaat

SEQ ID NO: 501605 - DNA, 18 bp, Homo sapiens
tctagaatactaataaaa

SEQ ID NO: 501606 - DNA, 14 bp, Homo sapiens
tctagcctggcaac

SEQ ID NO: 501607 - DNA, 17 bp, Homo sapiens
tctaggaaatatttatt

SEQ ID NO: 501608 - DNA, 12 bp, Homo sapiens
tctaggctgggg

SEQ ID NO: 501609 - DNA, 22 bp, Homo sapiens
tctagtgagcagtcaggaaaga

SEQ ID NO: 501610 - DNA, 18 bp, Homo sapiens
tctagttgcttgtaaaat

SEQ ID NO: 501611 - DNA, 14 bp, Homo sapiens
tctatcacctgtca

SEQ ID NO: 501612 - DNA, 16 bp, Homo sapiens
tctatcacctgtcatc

SEQ ID NO: 501613 - DNA, 18 bp, Homo sapiens
tctatcacctgtcatcat

SEQ ID NO: 501614 - DNA, 14 bp, Homo sapiens
tctatgaaatatta

SEQ ID NO: 501615 - DNA, 21 bp, Homo sapiens
tctatggcatattgataataa

SEQ ID NO: 501616 - DNA, 15 bp, Homo sapiens
tctcaaagctgggat

SEQ ID NO: 501617 - DNA, 15 bp, Homo sapiens
tctcaactccaaact

SEQ ID NO: 501618 - DNA, 20 bp, Homo sapiens
tctcaagccgcatcccagac

SEQ ID NO: 501619 - DNA, 21 bp, Homo sapiens
tctcaagccgcatcccagact

SEQ ID NO: 501620 - DNA, 23 bp, Homo sapiens
tctcagaaaacttctcttctgag

SEQ ID NO: 501621 - DNA, 14 bp, Homo sapiens
tctcatgaatctgc

SEQ ID NO: 501622 - DNA, 19 bp, Homo sapiens
tctcccactagacaagtcc

SEQ ID NO: 501623 - DNA, 17 bp, Homo sapiens
tctcctgggcagctgcc

SEQ ID NO: 501624 - DNA, 19 bp, Homo sapiens
tctcctgggcagctgcctc

SEQ ID NO: 501625 - DNA, 14 bp, Homo sapiens
tctccttgtggcct

SEQ ID NO: 501626 - DNA, 20 bp, Homo sapiens
tctccttgtggcctgggcct

SEQ ID NO: 501627 - DNA, 19 bp, Homo sapiens
tctctaggaaatatttatt

SEQ ID NO: 501628 - DNA, 13 bp, Homo sapiens
tctctatcattaa

SEQ ID NO: 501629 - DNA, 14 bp, Homo sapiens
tctctgagggtgat

SEQ ID NO: 501630 - DNA, 12 bp, Homo sapiens
tctctgctgccg

SEQ ID NO: 501631 - DNA, 16 bp, Homo sapiens
tctcttcaataaacca

SEQ ID NO: 501632 - DNA, 17 bp, Homo sapiens
tctgaaaattaacactg

SEQ ID NO: 501633 - DNA, 19 bp, Homo sapiens
tctgaaaattaacactgct

SEQ ID NO: 501634 - DNA, 12 bp, Homo sapiens
tctgaagaagat

SEQ ID NO: 501635 - DNA, 21 bp, Homo sapiens
tctgacccagggcctaggacg

SEQ ID NO: 501636 - DNA, 22 bp, Homo sapiens
tctgagactctcttaggagcag

SEQ ID NO: 501637 - DNA, 14 bp, Homo sapiens
tctgagtctcttgg

SEQ ID NO: 501638 - DNA, 21 bp, Homo sapiens
tctgatgcaagcaagaaacac

SEQ ID NO: 501639 - DNA, 15 bp, Homo sapiens
tctgccagccagcag

SEQ ID NO: 501640 - DNA, 16 bp, Homo sapiens
tctgccagccagcagc

SEQ ID NO: 501641 - DNA, 14 bp, Homo sapiens
tctgccgctgccat

SEQ ID NO: 501642 - DNA, 19 bp, Homo sapiens
tctgccgctgccatgcttt

SEQ ID NO: 501643 - DNA, 14 bp, Homo sapiens
tctgctacctcact

SEQ ID NO: 501644 - DNA, 14 bp, Homo sapiens
tctgcttgccatcc

SEQ ID NO: 501645 - DNA, 16 bp, Homo sapiens
tctgcttgccatccct

SEQ ID NO: 501646 - DNA, 17 bp, Homo sapiens
tctgcttgccatccctc

SEQ ID NO: 501647 - DNA, 14 bp, Homo sapiens
tctgcttgtcatcc

SEQ ID NO: 501648 - DNA, 18 bp, Homo sapiens
tctggaagtgactttggc

SEQ ID NO: 501649 - DNA, 13 bp, Homo sapiens
tctggagagctag

SEQ ID NO: 501650 - DNA, 14 bp, Homo sapiens
tctggagagctaga

SEQ ID NO: 501651 - DNA, 20 bp, Homo sapiens
tctggagagctagaacctgg

SEQ ID NO: 501652 - DNA, 22 bp, Homo sapiens
tctggatgcctgattgccaagc

SEQ ID NO: 501653 - DNA, 22 bp, Homo sapiens
tctggattcccaggatgagcat

SEQ ID NO: 501654 - DNA, 22 bp, Homo sapiens
tctggcacacagtaggtgctca

SEQ ID NO: 501655 - DNA, 23 bp, Homo sapiens
tctgggcaccacctctgtgggca

SEQ ID NO: 501656 - DNA, 18 bp, Homo sapiens
tctggtctctaggctggg

SEQ ID NO: 501657 - DNA, 13 bp, Homo sapiens
tctgtccagggcc

SEQ ID NO: 501658 - DNA, 17 bp, Homo sapiens
tctgtccagggccctga

SEQ ID NO: 501659 - DNA, 20 bp, Homo sapiens
tctgtccagggccctgagct

SEQ ID NO: 501660 - DNA, 18 bp, Homo sapiens
tctgtgagttctgttgtg

SEQ ID NO: 501661 - DNA, 12 bp, Homo sapiens
tctgtggagatg

SEQ ID NO: 501662 - DNA, 19 bp, Homo sapiens
tcttacacaagagctggag

SEQ ID NO: 501663 - DNA, 19 bp, Homo sapiens
tcttaggagcagagctctg

SEQ ID NO: 501664 - DNA, 16 bp, Homo sapiens
tcttaggcaatcacat

SEQ ID NO: 501665 - DNA, 13 bp, Homo sapiens
tcttaggggcttg

SEQ ID NO: 501666 - DNA, 13 bp, Homo sapiens
tcttatttattat

SEQ ID NO: 501667 - DNA, 16 bp, Homo sapiens
tcttcaataaaccaca

SEQ ID NO: 501668 - DNA, 13 bp, Homo sapiens
ttcagaagacctc

SEQ ID NO: 501669 - DNA, 20 bp, Homo sapiens
ttcagagactcagggcccca

SEQ ID NO: 501670 - DNA, 21 bp, Homo sapiens
ttcagagactcagggccccag

SEQ ID NO: 501671 - DNA, 17 bp, Homo sapiens
ttcagagctgccctctc

SEQ ID NO: 501672 - DNA, 20 bp, Homo sapiens
ttcagataatcacaatacat

SEQ ID NO: 501673 - DNA, 21 bp, Homo sapiens
ttcagcctagccgacctcagc

SEQ ID NO: 501674 - DNA, 23 bp, Homo sapiens
ttcagctgtgaacatggactctt

SEQ ID NO: 501675 - DNA, 14 bp, Homo sapiens
ttcaggctctgaga

SEQ ID NO: 501676 - DNA, 23 bp, Homo sapiens
ttcaggggctgggggtgctggat

SEQ ID NO: 501677 - DNA, 23 bp, Homo sapiens
ttcatatgacattcatgcctggc

SEQ ID NO: 501678 - DNA, 15 bp, Homo sapiens
ttcatccgcctgtgg

SEQ ID NO: 501679 - DNA, 12 bp, Homo sapiens
ttcatctggaac

SEQ ID NO: 501680 - DNA, 13 bp, Homo sapiens
ttcattagagcag

SEQ ID NO: 501681 - DNA, 16 bp, Homo sapiens
ttcattccatttgctg

SEQ ID NO: 501682 - DNA, 18 bp, Homo sapiens
ttcattccatttgctgat

SEQ ID NO: 501683 - DNA, 18 bp, Homo sapiens
ttccacactcacctctaa

SEQ ID NO: 501684 - DNA, 13 bp, Homo sapiens
ttccagctcctca

SEQ ID NO: 501685 - DNA, 22 bp, Homo sapiens
ttccaggcctgaagtcttctcc

SEQ ID NO: 501686 - DNA, 22 bp, Homo sapiens
ttccaggggtcaccttgagagg

SEQ ID NO: 501687 - DNA, 17 bp, Homo sapiens
ttccaggtcagaaacca

SEQ ID NO: 501688 - DNA, 15 bp, Homo sapiens
ttccagtcatggcca

SEQ ID NO: 501689 - DNA, 18 bp, Homo sapiens
ttccatattaaaatcaca

SEQ ID NO: 501690 - DNA, 13 bp, Homo sapiens
ttccattctggaa

SEQ ID NO: 501691 - DNA, 21 bp, Homo sapiens
ttcccaagagtggtggcagct

SEQ ID NO: 501692 - DNA, 22 bp, Homo sapiens
ttcccagcagtggactcaaaac

SEQ ID NO: 501693 - DNA, 16 bp, Homo sapiens
ttcccagtggctgctg

SEQ ID NO: 501694 - DNA, 18 bp, Homo sapiens
ttcccagtggctgctgcc

SEQ ID NO: 501695 - DNA, 23 bp, Homo sapiens
ttccccttgcccagggctcagcc

SEQ ID NO: 501696 - DNA, 21 bp, Homo sapiens
ttcccgagcaaagtctaaagt

SEQ ID NO: 501697 - DNA, 21 bp, Homo sapiens
ttcctacacccttggacttga

SEQ ID NO: 501698 - DNA, 21 bp, Homo sapiens
ttcctcacaccaggcttgcct

SEQ ID NO: 501699 - DNA, 12 bp, Homo sapiens
ttcctctttgca

SEQ ID NO: 501700 - DNA, 20 bp, Homo sapiens
ttccttagcttagacctcag

SEQ ID NO: 501701 - DNA, 22 bp, Homo sapiens
ttccttagcttagacctcagcc

SEQ ID NO: 501702 - DNA, 13 bp, Homo sapiens
ttccttggctggt

SEQ ID NO: 501703 - DNA, 14 bp, Homo sapiens
ttcctttgaagagg

SEQ ID NO: 501704 - DNA, 18 bp, Homo sapiens
ttctaaggaatatgagct

SEQ ID NO: 501705 - DNA, 15 bp, Homo sapiens
ttctacttttaaaga

SEQ ID NO: 501706 - DNA, 23 bp, Homo sapiens
ttctatcccaaactaagctatgt

SEQ ID NO: 501707 - DNA, 18 bp, Homo sapiens
ttctattgtgctttctat

SEQ ID NO: 501708 - DNA, 14 bp, Homo sapiens
ttctcaactccaaa

SEQ ID NO: 501709 - DNA, 17 bp, Homo sapiens
ttctcaggccatcatca

SEQ ID NO: 501710 - DNA, 16 bp, Homo sapiens
ttctcagggtctctgc

SEQ ID NO: 501711 - DNA, 12 bp, Homo sapiens
ttctcattcctg

SEQ ID NO: 501712 - DNA, 21 bp, Homo sapiens
ttctccgaaaggcaaaaatgt

SEQ ID NO: 501713 - DNA, 12 bp, Homo sapiens
ttctctaggaaa

SEQ ID NO: 501714 - DNA, 14 bp, Homo sapiens
ttctgaagaagatg

SEQ ID NO: 501715 - DNA, 21 bp, Homo sapiens
ttctgctacctcactggggtc

SEQ ID NO: 501716 - DNA, 17 bp, Homo sapiens
ttctgttttataatttt

SEQ ID NO: 501717 - DNA, 19 bp, Homo sapiens
ttcttagggttatgattaa

SEQ ID NO: 501718 - DNA, 17 bp, Homo sapiens
ttcttatgttgcccagt

SEQ ID NO: 501719 - DNA, 20 bp, Homo sapiens
ttcttggttggctggccttc

SEQ ID NO: 501720 - DNA, 12 bp, Homo sapiens
ttcttgttcaaa

SEQ ID NO: 501721 - DNA, 21 bp, Homo sapiens
ttctttccctgcttaatgaaa

SEQ ID NO: 501722 - DNA, 19 bp, Homo sapiens
ttgaaatattgacttttta

SEQ ID NO: 501723 - DNA, 20 bp, Homo sapiens
ttgaacaagttgtttcattg

SEQ ID NO: 501724 - DNA, 13 bp, Homo sapiens
ttgaagaggaaaa

SEQ ID NO: 501725 - DNA, 16 bp, Homo sapiens
ttgaatataaacacta

SEQ ID NO: 501726 - DNA, 18 bp, Homo sapiens
ttgaatataaacactata

SEQ ID NO: 501727 - DNA, 22 bp, Homo sapiens
ttgaatatttgtcgatatttcc

SEQ ID NO: 501728 - DNA, 14 bp, Homo sapiens
ttgaattagaaaca

SEQ ID NO: 501729 - DNA, 23 bp, Homo sapiens
ttgaattagaaacataaataaaa

SEQ ID NO: 501730 - DNA, 16 bp, Homo sapiens
ttgacaactgaagaga

SEQ ID NO: 501731 - DNA, 14 bp, Homo sapiens
ttgacagaacactg

SEQ ID NO: 501732 - DNA, 17 bp, Homo sapiens
ttgactatcaaactgaa

SEQ ID NO: 501733 - DNA, 14 bp, Homo sapiens
ttgactgtgattta

SEQ ID NO: 501734 - DNA, 19 bp, Homo sapiens
ttgagataatacattccga

SEQ ID NO: 501735 - DNA, 15 bp, Homo sapiens
ttgaggacactgata

SEQ ID NO: 501736 - DNA, 18 bp, Homo sapiens
ttgagggtaataaactta

SEQ ID NO: 501737 - DNA, 15 bp, Homo sapiens
ttgagtccacgccca

SEQ ID NO: 501738 - DNA, 12 bp, Homo sapiens
ttgagtgattat

SEQ ID NO: 501739 - DNA, 23 bp, Homo sapiens
ttgatggtgatgaaatgtaaata

SEQ ID NO: 501740 - DNA, 18 bp, Homo sapiens
ttgatggtggtatgtttt

SEQ ID NO: 501741 - DNA, 13 bp, Homo sapiens
ttgattatgcata

SEQ ID NO: 501742 - DNA, 22 bp, Homo sapiens
ttgcaagccagattttcctgaa

SEQ ID NO: 501743 - DNA, 14 bp, Homo sapiens
ttgcacggctgctg

SEQ ID NO: 501744 - DNA, 17 bp, Homo sapiens
ttgcacgttaaaaatta

SEQ ID NO: 501745 - DNA, 18 bp, Homo sapiens
ttgcagattcatttttct

SEQ ID NO: 501746 - DNA, 19 bp, Homo sapiens
ttgcatagcagctgctact

SEQ ID NO: 501747 - DNA, 14 bp, Homo sapiens
ttgcatatatacat

SEQ ID NO: 501748 - DNA, 21 bp, Homo sapiens
ttgcatgatctgtcaaagtga

SEQ ID NO: 501749 - DNA, 15 bp, Homo sapiens
ttgccaagctcagga

SEQ ID NO: 501750 - DNA, 18 bp, Homo sapiens
ttgcccagggctcagcct

SEQ ID NO: 501751 - DNA, 18 bp, Homo sapiens
ttgctaagcattccaact

SEQ ID NO: 501752 - DNA, 23 bp, Homo sapiens
ttgctcatgcatagtcccagcta

SEQ ID NO: 501753 - DNA, 19 bp, Homo sapiens
ttgctctcttcaataaacc

SEQ ID NO: 501754 - DNA, 22 bp, Homo sapiens
ttgctgaatcggaatctctggg

SEQ ID NO: 501755 - DNA, 11 bp, Homo sapiens
ttgctgagagc

SEQ ID NO: 501756 - DNA, 18 bp, Homo sapiens
ttgctttaattgttaaga

SEQ ID NO: 501757 - DNA, 12 bp, Homo sapiens
ttggaaaataaa

SEQ ID NO: 501758 - DNA, 17 bp, Homo sapiens
ttggaatgggcagctca

SEQ ID NO: 501759 - DNA, 15 bp, Homo sapiens
ttggagaagaactga

SEQ ID NO: 501760 - DNA, 22 bp, Homo sapiens
ttggagaagaactgaaatcata

SEQ ID NO: 501761 - DNA, 19 bp, Homo sapiens
ttggagtggaggcattgtt

SEQ ID NO: 501762 - DNA, 19 bp, Homo sapiens
ttggatctatcacctgtca

SEQ ID NO: 501763 - DNA, 22 bp, Homo sapiens
ttggatctatcacctgtcatca

SEQ ID NO: 501764 - DNA, 10 bp, Homo sapiens
ttgggttgac

SEQ ID NO: 501765 - DNA, 20 bp, Homo sapiens
ttggtaaggggaattgagga

SEQ ID NO: 501766 - DNA, 13 bp, Homo sapiens
ttggtccctgggg

SEQ ID NO: 501767 - DNA, 15 bp, Homo sapiens
ttggtcttatttatt

SEQ ID NO: 501768 - DNA, 19 bp, Homo sapiens
ttggtcttatttattattg

SEQ ID NO: 501769 - DNA, 19 bp, Homo sapiens
ttgtacacaccttatattt

SEQ ID NO: 501770 - DNA, 13 bp, Homo sapiens
ttgtataaaataa

SEQ ID NO: 501771 - DNA, 15 bp, Homo sapiens
ttgtataaaataatt

SEQ ID NO: 501772 - DNA, 17 bp, Homo sapiens
ttgtataaaataatttt

SEQ ID NO: 501773 - DNA, 20 bp, Homo sapiens
ttgtcaataaaatccataca

SEQ ID NO: 501774 - DNA, 22 bp, Homo sapiens
ttgtcacatgaaacatttgcaa

SEQ ID NO: 501775 - DNA, 15 bp, Homo sapiens
ttgtctagtgaaact

SEQ ID NO: 501776 - DNA, 22 bp, Homo sapiens
ttgtgataagttctagttgctt

SEQ ID NO: 501777 - DNA, 21 bp, Homo sapiens
ttgtggcctgggcctcctcac

SEQ ID NO: 501778 - DNA, 18 bp, Homo sapiens
ttgtgttcctctttgcat

SEQ ID NO: 501779 - DNA, 18 bp, Homo sapiens
ttgtgttttgcaagccag

SEQ ID NO: 501780 - DNA, 17 bp, Homo sapiens
ttgttaagatatgatgt

SEQ ID NO: 501781 - DNA, 19 bp, Homo sapiens
ttgttaatggtttgaatat

SEQ ID NO: 501782 - DNA, 14 bp, Homo sapiens
tttaaaagaatgat

SEQ ID NO: 501783 - DNA, 15 bp, Homo sapiens
tttaacagctttctc

SEQ ID NO: 501784 - DNA, 19 bp, Homo sapiens
tttaacttgagggtaataa

SEQ ID NO: 501785 - DNA, 15 bp, Homo sapiens
tttaagaaaaacatg

SEQ ID NO: 501786 - DNA, 15 bp, Homo sapiens
tttacagtaaataaa

SEQ ID NO: 501787 - DNA, 19 bp, Homo sapiens
tttacagtaaataaattgt

SEQ ID NO: 501788 - DNA, 20 bp, Homo sapiens
tttagaaacacaactatatt

SEQ ID NO: 501789 - DNA, 21 bp, Homo sapiens
tttagaatattaaaaattaat

SEQ ID NO: 501790 - DNA, 20 bp, Homo sapiens
tttagctggaaaagtatgtt

SEQ ID NO: 501791 - DNA, 22 bp, Homo sapiens
tttagctggaaaagtatgttag

SEQ ID NO: 501792 - DNA, 19 bp, Homo sapiens
tttaggcagggatttgagg

SEQ ID NO: 501793 - DNA, 19 bp, Homo sapiens
tttagtgatcacagcagct

SEQ ID NO: 501794 - DNA, 13 bp, Homo sapiens
tttagtggcttca

SEQ ID NO: 501795 - DNA, 22 bp, Homo sapiens
tttataattttgtgaagcaaaa

SEQ ID NO: 501796 - DNA, 13 bp, Homo sapiens
tttatataagctt

SEQ ID NO: 501797 - DNA, 17 bp, Homo sapiens
tttatatgcttctgttt

SEQ ID NO: 501798 - DNA, 19 bp, Homo sapiens
tttatatgcttctgtttta

SEQ ID NO: 501799 - DNA, 21 bp, Homo sapiens
tttatatgcttctgttttata

SEQ ID NO: 501800 - DNA, 20 bp, Homo sapiens
tttatgccttttatttctta

SEQ ID NO: 501801 - DNA, 17 bp, Homo sapiens
tttatggcactagtatt

SEQ ID NO: 501802 - DNA, 19 bp, Homo sapiens
tttattactgtaagaaaat

SEQ ID NO: 501803 - DNA, 14 bp, Homo sapiens
tttattagtgaagt

SEQ ID NO: 501804 - DNA, 11 bp, Homo sapiens
aaaaacatgtc

SEQ ID NO: 501805 - DNA, 14 bp, Homo sapiens
aaaaacatgtcatg

SEQ ID NO: 501806 - DNA, 15 bp, Homo sapiens
aaaaacatgtcatgt

SEQ ID NO: 501807 - DNA, 17 bp, Homo sapiens
aaaaagcactagtataa

SEQ ID NO: 501808 - DNA, 23 bp, Homo sapiens
aaaaattaattctttatcacatg

SEQ ID NO: 501809 - DNA, 15 bp, Homo sapiens
aaaaattagccgggc

SEQ ID NO: 501810 - DNA, 14 bp, Homo sapiens
aaaaattatatttt

SEQ ID NO: 501811 - DNA, 11 bp, Homo sapiens
aaaagaaggaa

SEQ ID NO: 501812 - DNA, 19 bp, Homo sapiens
aaaagagagaaaacttatt

SEQ ID NO: 501813 - DNA, 19 bp, Homo sapiens
aaaagcatactctatgtga

SEQ ID NO: 501814 - DNA, 23 bp, Homo sapiens
aaaaggacaaataaagcaatgaa

SEQ ID NO: 501815 - DNA, 14 bp, Homo sapiens
aaaaggactcttga

SEQ ID NO: 501816 - DNA, 14 bp, Homo sapiens
aaaaggtaaaactt

SEQ ID NO: 501817 - DNA, 20 bp, Homo sapiens
aaaagtatattcaaaaatta

SEQ ID NO: 501818 - DNA, 22 bp, Homo sapiens
aaaagtatattcaaaaattata

SEQ ID NO: 501819 - DNA, 19 bp, Homo sapiens
aaaagtatgttagtgcaaa

SEQ ID NO: 501820 - DNA, 17 bp, Homo sapiens
aaaagttattaatattt

SEQ ID NO: 501821 - DNA, 18 bp, Homo sapiens
aaaataaaatgcatttaa

SEQ ID NO: 501822 - DNA, 11 bp, Homo sapiens
aaaataatttt

SEQ ID NO: 501823 - DNA, 21 bp, Homo sapiens
aaaataatttttatatttgaa

SEQ ID NO: 501824 - DNA, 15 bp, Homo sapiens
aaaatacatactata

SEQ ID NO: 501825 - DNA, 16 bp, Homo sapiens
aaaatctcaatatttc

SEQ ID NO: 501826 - DNA, 20 bp, Homo sapiens
aaaatgaccagtaattgtga

SEQ ID NO: 501827 - DNA, 21 bp, Homo sapiens
aaaatgctgtattagtcacag

SEQ ID NO: 501828 - DNA, 16 bp, Homo sapiens
aaaatgggttttactg

SEQ ID NO: 501829 - DNA, 15 bp, Homo sapiens
aaaattgtaaaattg

SEQ ID NO: 501830 - DNA, 19 bp, Homo sapiens
aaaattttttctctaggaa

SEQ ID NO: 501831 - DNA, 14 bp, Homo sapiens
aaacacaactatat

SEQ ID NO: 501832 - DNA, 15 bp, Homo sapiens
aaacaccctcacact

SEQ ID NO: 501833 - DNA, 15 bp, Homo sapiens
aaacactgcaggcat

SEQ ID NO: 501834 - DNA, 13 bp, Homo sapiens
aaacataaataaa

SEQ ID NO: 501835 - DNA, 14 bp, Homo sapiens
aaacataaataaaa

SEQ ID NO: 501836 - DNA, 17 bp, Homo sapiens
aaacataaataaaatga

SEQ ID NO: 501837 - DNA, 13 bp, Homo sapiens
aaacatatataac

SEQ ID NO: 501838 - DNA, 16 bp, Homo sapiens
aaacatatataacaat

SEQ ID NO: 501839 - DNA, 18 bp, Homo sapiens
aaaccattgttcagaaga

SEQ ID NO: 501840 - DNA, 19 bp, Homo sapiens
aaaccgtcctgtgtacaca

SEQ ID NO: 501841 - DNA, 12 bp, Homo sapiens
aaacctgcctgg

SEQ ID NO: 501842 - DNA, 14 bp, Homo sapiens
aaactgaagccaga

SEQ ID NO: 501843 - DNA, 16 bp, Homo sapiens
aaactgactcttaaga

SEQ ID NO: 501844 - DNA, 17 bp, Homo sapiens
aaactgactcttaagaa

SEQ ID NO: 501845 - DNA, 14 bp, Homo sapiens
aaacttaagaaaca

SEQ ID NO: 501846 - DNA, 21 bp, Homo sapiens
aaacttccagtgcaacactga

SEQ ID NO: 501847 - DNA, 23 bp, Homo sapiens
aaacttccagtgcaacactgaag

SEQ ID NO: 501848 - DNA, 16 bp, Homo sapiens
aaagacaaatcaaagc

SEQ ID NO: 501849 - DNA, 18 bp, Homo sapiens
aaagacacagaacacaga

SEQ ID NO: 501850 - DNA, 14 bp, Homo sapiens
aaagagaaggagcc

SEQ ID NO: 501851 - DNA, 23 bp, Homo sapiens
aaagcaaacttaagaaacactga

SEQ ID NO: 501852 - DNA, 22 bp, Homo sapiens
aaagcaagtgattgggacagag

SEQ ID NO: 501853 - DNA, 16 bp, Homo sapiens
aaagcatcacttggga

SEQ ID NO: 501854 - DNA, 12 bp, Homo sapiens
aaagctgaaaac

SEQ ID NO: 501855 - DNA, 20 bp, Homo sapiens
aaagggctgttataatcttt

SEQ ID NO: 501856 - DNA, 14 bp, Homo sapiens
aaaggtacttcaaa

SEQ ID NO: 501857 - DNA, 19 bp, Homo sapiens
aaagtatggtattgaaact

SEQ ID NO: 501858 - DNA, 18 bp, Homo sapiens
aaagtatgttagtgcaaa

SEQ ID NO: 501859 - DNA, 19 bp, Homo sapiens
aaagtcatgcaaaggctgg

SEQ ID NO: 501860 - DNA, 21 bp, Homo sapiens
aaagtcatgcaaaggctggga

SEQ ID NO: 501861 - DNA, 19 bp, Homo sapiens
aaagtctaaagtttacagt

SEQ ID NO: 501862 - DNA, 20 bp, Homo sapiens
aaagtggtggcaaaagacat

SEQ ID NO: 501863 - DNA, 18 bp, Homo sapiens
aaagttgcacggctgctg

SEQ ID NO: 501864 - DNA, 15 bp, Homo sapiens
aaataaaatgcattt

SEQ ID NO: 501865 - DNA, 18 bp, Homo sapiens
aaataaagttggtgacag

SEQ ID NO: 501866 - DNA, 13 bp, Homo sapiens
aaataaattgttt

SEQ ID NO: 501867 - DNA, 15 bp, Homo sapiens
aaataatttttatat

SEQ ID NO: 501868 - DNA, 18 bp, Homo sapiens
aaataatttttatatttg

SEQ ID NO: 501869 - DNA, 20 bp, Homo sapiens
aaataatttttatatttgaa

SEQ ID NO: 501870 - DNA, 21 bp, Homo sapiens
aaataatttttatatttgaaa

SEQ ID NO: 501871 - DNA, 22 bp, Homo sapiens
aaataatttttatatttgaaat

SEQ ID NO: 501872 - DNA, 23 bp, Homo sapiens
aaataatttttatatttgaaata

SEQ ID NO: 501873 - DNA, 19 bp, Homo sapiens
aaatagctccgtggagcag

SEQ ID NO: 501874 - DNA, 15 bp, Homo sapiens
aaatatacacacagc

SEQ ID NO: 501875 - DNA, 22 bp, Homo sapiens
aaatatcacttgtcaataaaat

SEQ ID NO: 501876 - DNA, 21 bp, Homo sapiens
aaatatgatgtttaaaagcat

SEQ ID NO: 501877 - DNA, 15 bp, Homo sapiens
aaatattgatgaaaa

SEQ ID NO: 501878 - DNA, 18 bp, Homo sapiens
aaatcacaaactcatcca

SEQ ID NO: 501879 - DNA, 18 bp, Homo sapiens
aaatccatacatttgtgt

SEQ ID NO: 501880 - DNA, 20 bp, Homo sapiens
aaatctatgccactcagaat

SEQ ID NO: 501881 - DNA, 18 bp, Homo sapiens
aaatgagtgtgtttgtca

SEQ ID NO: 501882 - DNA, 21 bp, Homo sapiens
aaatgagttacctacatttta

SEQ ID NO: 501883 - DNA, 18 bp, Homo sapiens
aaatggaagacacattga

SEQ ID NO: 501884 - DNA, 18 bp, Homo sapiens
aaatggcttcctggcaat

SEQ ID NO: 501885 - DNA, 18 bp, Homo sapiens
aaatgggactgatgtcat

SEQ ID NO: 501886 - DNA, 17 bp, Homo sapiens
aaattaaagctgaaaac

SEQ ID NO: 501887 - DNA, 21 bp, Homo sapiens
aaattaacactgcttgtgttt

SEQ ID NO: 501888 - DNA, 13 bp, Homo sapiens
aaattaattcttt

SEQ ID NO: 501889 - DNA, 16 bp, Homo sapiens
aaattagatgactgaa

SEQ ID NO: 501890 - DNA, 21 bp, Homo sapiens
aaattcatcaaatggaagaca

SEQ ID NO: 501891 - DNA, 13 bp, Homo sapiens
aaattccaataca

SEQ ID NO: 501892 - DNA, 19 bp, Homo sapiens
aaattgaggttcagcaagg

SEQ ID NO: 501893 - DNA, 18 bp, Homo sapiens
aaattttcacataaaata

SEQ ID NO: 501894 - DNA, 20 bp, Homo sapiens
aaattttttctctaggaaat

SEQ ID NO: 501895 - DNA, 14 bp, Homo sapiens
aacaaatgtgaagg

SEQ ID NO: 501896 - DNA, 21 bp, Homo sapiens
aacaactcctagggccactga

SEQ ID NO: 501897 - DNA, 15 bp, Homo sapiens
aacaaggatgaatta

SEQ ID NO: 501898 - DNA, 15 bp, Homo sapiens
aacaatgctgtattt

SEQ ID NO: 501899 - DNA, 16 bp, Homo sapiens
aacacaactatattgt

SEQ ID NO: 501900 - DNA, 17 bp, Homo sapiens
aacaccctcacactggg

SEQ ID NO: 501901 - DNA, 17 bp, Homo sapiens
aacactcaagaagcagg

SEQ ID NO: 501902 - DNA, 18 bp, Homo sapiens
aacactcgaaaagagcac

SEQ ID NO: 501903 - DNA, 14 bp, Homo sapiens
aacactgcaggcat

SEQ ID NO: 501904 - DNA, 17 bp, Homo sapiens
aacactgggggagggga

SEQ ID NO: 501905 - DNA, 12 bp, Homo sapiens
aacactgtgaaa

SEQ ID NO: 501906 - DNA, 13 bp, Homo sapiens
aacagactattta

SEQ ID NO: 501907 - DNA, 20 bp, Homo sapiens
aacagccgctcctgtctgcc

SEQ ID NO: 501908 - DNA, 21 bp, Homo sapiens
aacagccgctcctgtctgcca

SEQ ID NO: 501909 - DNA, 17 bp, Homo sapiens
aacagctttctccagaa

SEQ ID NO: 501910 - DNA, 18 bp, Homo sapiens
aacagtcttactgcaggc

SEQ ID NO: 501911 - DNA, 20 bp, Homo sapiens
aacagtgcttgccacagagc

SEQ ID NO: 501912 - DNA, 16 bp, Homo sapiens
aacataagctagaaaa

SEQ ID NO: 501913 - DNA, 17 bp, Homo sapiens
aacataagctagaaaaa

SEQ ID NO: 501914 - DNA, 15 bp, Homo sapiens
aacatacagacacat

SEQ ID NO: 501915 - DNA, 16 bp, Homo sapiens
aacatcatcaaggcac

SEQ ID NO: 501916 - DNA, 22 bp, Homo sapiens
aacatctgtcctgtgaaagact

SEQ ID NO: 501917 - DNA, 21 bp, Homo sapiens
aacatgaagtcgttgtgaggg

SEQ ID NO: 501918 - DNA, 20 bp, Homo sapiens
aacattacagggaatgcctg

SEQ ID NO: 501919 - DNA, 10 bp, Homo sapiens
aacattccat

SEQ ID NO: 501920 - DNA, 14 bp, Homo sapiens
aacatttatctttg

SEQ ID NO: 501921 - DNA, 18 bp, Homo sapiens
aacatttggtaaggggaa

SEQ ID NO: 501922 - DNA, 15 bp, Homo sapiens
aaccacagctgctgg

SEQ ID NO: 501923 - DNA, 16 bp, Homo sapiens
aaccagtgtctgaacc

SEQ ID NO: 501924 - DNA, 21 bp, Homo sapiens
aacccaaagagacagctcttc

SEQ ID NO: 501925 - DNA, 15 bp, Homo sapiens
aaccctcgtttctga

SEQ ID NO: 501926 - DNA, 20 bp, Homo sapiens
aacctggaggggctagaacc

SEQ ID NO: 501927 - DNA, 21 bp, Homo sapiens
aactagagtttagctggaaaa

SEQ ID NO: 501928 - DNA, 18 bp, Homo sapiens
aactagcttggaaactgg

SEQ ID NO: 501929 - DNA, 15 bp, Homo sapiens
aactatgttgataaa

SEQ ID NO: 501930 - DNA, 14 bp, Homo sapiens
aactattgcccagg

SEQ ID NO: 501931 - DNA, 21 bp, Homo sapiens
aactcatccctaatgctgcag

SEQ ID NO: 501932 - DNA, 13 bp, Homo sapiens
aactgaaatcata

SEQ ID NO: 501933 - DNA, 18 bp, Homo sapiens
aactgaatttttcttgcg

SEQ ID NO: 501934 - DNA, 19 bp, Homo sapiens
aactgggttcaaaaagaaa

SEQ ID NO: 501935 - DNA, 15 bp, Homo sapiens
aacttaagaaacact

SEQ ID NO: 501936 - DNA, 15 bp, Homo sapiens
aacttagaataaaat

SEQ ID NO: 501937 - DNA, 16 bp, Homo sapiens
aacttagaataaaatt

SEQ ID NO: 501938 - DNA, 17 bp, Homo sapiens
aacttagaataaaattg

SEQ ID NO: 501939 - DNA, 13 bp, Homo sapiens
aacttatttgagt

SEQ ID NO: 501940 - DNA, 19 bp, Homo sapiens
aacttatttgagtgattat

SEQ ID NO: 501941 - DNA, 21 bp, Homo sapiens
aacttcagcggtttatataag

SEQ ID NO: 501942 - DNA, 15 bp, Homo sapiens
aacttctcttctgag

SEQ ID NO: 501943 - DNA, 11 bp, Homo sapiens
aacttcttcag

SEQ ID NO: 501944 - DNA, 19 bp, Homo sapiens
aacttcttcagagctgaca

SEQ ID NO: 501945 - DNA, 16 bp, Homo sapiens
aagaaaaacatgtcat

SEQ ID NO: 501946 - DNA, 12 bp, Homo sapiens
aagaaacactga

SEQ ID NO: 501947 - DNA, 11 bp, Homo sapiens
aagaaacattt

SEQ ID NO: 501948 - DNA, 15 bp, Homo sapiens
aagaaacatttatct

SEQ ID NO: 501949 - DNA, 12 bp, Homo sapiens
aagaacagcaga

SEQ ID NO: 501950 - DNA, 15 bp, Homo sapiens
aagaactgaaatcat

SEQ ID NO: 501951 - DNA, 20 bp, Homo sapiens
aagaagactgcattatattt

SEQ ID NO: 501952 - DNA, 22 bp, Homo sapiens
aagaagcaccaatcatgaatta

SEQ ID NO: 501953 - DNA, 12 bp, Homo sapiens
aagaagcaggct

SEQ ID NO: 501954 - DNA, 19 bp, Homo sapiens
aagaagcaggctacactga

SEQ ID NO: 501955 - DNA, 14 bp, Homo sapiens
aagacaaatgggac

SEQ ID NO: 501956 - DNA, 21 bp, Homo sapiens
aagacactgaaatatacacac

SEQ ID NO: 501957 - DNA, 22 bp, Homo sapiens
aagacactgaaatatacacaca

SEQ ID NO: 501958 - DNA, 22 bp, Homo sapiens
aagacagcttctcatcctgcag

SEQ ID NO: 501959 - DNA, 14 bp, Homo sapiens
aagacccctgtctt

SEQ ID NO: 501960 - DNA, 17 bp, Homo sapiens
aagacctccctgtgaga

SEQ ID NO: 501961 - DNA, 21 bp, Homo sapiens
aagactggaaggtggggacag

SEQ ID NO: 501962 - DNA, 15 bp, Homo sapiens
aagagaacttccaga

SEQ ID NO: 501963 - DNA, 22 bp, Homo sapiens
aagagagcttaatgataatatt

SEQ ID NO: 501964 - DNA, 13 bp, Homo sapiens
aagagcacacttg

SEQ ID NO: 501965 - DNA, 14 bp, Homo sapiens
aagagccggagcct

SEQ ID NO: 501966 - DNA, 18 bp, Homo sapiens
aagagctgaggcaattct

SEQ ID NO: 501967 - DNA, 20 bp, Homo sapiens
aagatccccaactgctccag

SEQ ID NO: 501968 - DNA, 14 bp, Homo sapiens
aagattcctgtcct

SEQ ID NO: 501969 - DNA, 22 bp, Homo sapiens
aagcaaaaactagtaaagacat

SEQ ID NO: 501970 - DNA, 14 bp, Homo sapiens
aagcaaacacatta

SEQ ID NO: 501971 - DNA, 22 bp, Homo sapiens
aagcaaagactttcctcttagt

SEQ ID NO: 501972 - DNA, 16 bp, Homo sapiens
aagcacatattgagca

SEQ ID NO: 501973 - DNA, 16 bp, Homo sapiens
aagcactgtgctcagg

SEQ ID NO: 501974 - DNA, 16 bp, Homo sapiens
aagcaggctcaacata

SEQ ID NO: 501975 - DNA, 16 bp, Homo sapiens
aagcatttagatgtat

SEQ ID NO: 501976 - DNA, 17 bp, Homo sapiens
aagccaataacacacag

SEQ ID NO: 501977 - DNA, 18 bp, Homo sapiens
aagccaataacacacagc

SEQ ID NO: 501978 - DNA, 14 bp, Homo sapiens
aagccacagctggt

SEQ ID NO: 501979 - DNA, 13 bp, Homo sapiens
aagccagattttc

SEQ ID NO: 501980 - DNA, 17 bp, Homo sapiens
aagctcaggaccaggca

SEQ ID NO: 501981 - DNA, 14 bp, Homo sapiens
aagctccaggtaga

SEQ ID NO: 501982 - DNA, 21 bp, Homo sapiens
aagctcccaagggatggtgcc

SEQ ID NO: 501983 - DNA, 17 bp, Homo sapiens
aagctcttgaagacact

SEQ ID NO: 501984 - DNA, 17 bp, Homo sapiens
aagctgaagatccccaa

SEQ ID NO: 501985 - DNA, 19 bp, Homo sapiens
aagctgaagatccccaact

SEQ ID NO: 501986 - DNA, 17 bp, Homo sapiens
aagctgtaaaaagagag

SEQ ID NO: 501987 - DNA, 21 bp, Homo sapiens
aagctttccgagtcaagtgat

SEQ ID NO: 501988 - DNA, 21 bp, Homo sapiens
aagctttgggggagtgggcgc

SEQ ID NO: 501989 - DNA, 16 bp, Homo sapiens
aaggaaaagattcctg

SEQ ID NO: 501990 - DNA, 16 bp, Homo sapiens
aaggaaaccacagctg

SEQ ID NO: 501991 - DNA, 21 bp, Homo sapiens
aaggaaggctcttctccccag

SEQ ID NO: 501992 - DNA, 22 bp, Homo sapiens
aaggaatccactcccaggcagc

SEQ ID NO: 501993 - DNA, 23 bp, Homo sapiens
aaggaatccactcccaggcagcc

SEQ ID NO: 501994 - DNA, 14 bp, Homo sapiens
aaggagaggaggca

SEQ ID NO: 501995 - DNA, 18 bp, Homo sapiens
aaggagattttccttcct

SEQ ID NO: 501996 - DNA, 18 bp, Homo sapiens
aaggagggttagggaggg

SEQ ID NO: 501997 - DNA, 21 bp, Homo sapiens
aaggatttactttttgtaaaa

SEQ ID NO: 501998 - DNA, 17 bp, Homo sapiens
aaggcaaatgcccaagg

SEQ ID NO: 501999 - DNA, 19 bp, Homo sapiens
aaggcacccacaaataaat

SEQ ID NO: 502000 - DNA, 14 bp, Homo sapiens
aaggcactgcctga

SEQ ID NO: 502001 - DNA, 20 bp, Homo sapiens
aaggcagggagcgagggaga

SEQ ID NO: 502002 - DNA, 22 bp, Homo sapiens
aaggccatggagagctggagcc

SEQ ID NO: 502003 - DNA, 23 bp, Homo sapiens
aaggcgatcccatcttgataaga

SEQ ID NO: 502004 - DNA, 14 bp, Homo sapiens
aaggcgtggagctg

SEQ ID NO: 502005 - DNA, 19 bp, Homo sapiens
aaggctcttctccccagag

SEQ ID NO: 502006 - DNA, 19 bp, Homo sapiens
aaggctgagaggagagaga

SEQ ID NO: 502007 - DNA, 17 bp, Homo sapiens
aagggctagaacctgga

SEQ ID NO: 502008 - DNA, 20 bp, Homo sapiens
aaggtggtgggggtgcagat

SEQ ID NO: 502009 - DNA, 21 bp, Homo sapiens
aaggttctctcctccccaagg

SEQ ID NO: 502010 - DNA, 13 bp, Homo sapiens
aaggttgtattgc

SEQ ID NO: 502011 - DNA, 16 bp, Homo sapiens
aagtactgtgtacaga

SEQ ID NO: 502012 - DNA, 19 bp, Homo sapiens
aagtatgttagtgcaaatt

SEQ ID NO: 502013 - DNA, 13 bp, Homo sapiens
aagtattagaata

SEQ ID NO: 502014 - DNA, 20 bp, Homo sapiens
aagtattaggggtaatatat

SEQ ID NO: 502015 - DNA, 17 bp, Homo sapiens
aagtcatgcaaaggctg

SEQ ID NO: 502016 - DNA, 20 bp, Homo sapiens
aagtcatgcaaaggctggga

SEQ ID NO: 502017 - DNA, 18 bp, Homo sapiens
aagtccaagcatttagat

SEQ ID NO: 502018 - DNA, 20 bp, Homo sapiens
aagtctaaagtttacagtaa

SEQ ID NO: 502019 - DNA, 22 bp, Homo sapiens
aagtgcatttttatctgtgagt

SEQ ID NO: 502020 - DNA, 22 bp, Homo sapiens
aagtggacagagcgcccctccc

SEQ ID NO: 502021 - DNA, 23 bp, Homo sapiens
aagttaagaatgttcttatgttg

SEQ ID NO: 502022 - DNA, 14 bp, Homo sapiens
aagttattaatatt

SEQ ID NO: 502023 - DNA, 22 bp, Homo sapiens
aagttgatatgccttttcccaa

SEQ ID NO: 502024 - DNA, 15 bp, Homo sapiens
aagttgcacggctgc

SEQ ID NO: 502025 - DNA, 16 bp, Homo sapiens
aagttgcacggctgct

SEQ ID NO: 502026 - DNA, 18 bp, Homo sapiens
aagttgcacggctgctga

SEQ ID NO: 502027 - DNA, 23 bp, Homo sapiens
aagtttataagaggatgaagtga

SEQ ID NO: 502028 - DNA, 16 bp, Homo sapiens
aagtttatgtctaaag

SEQ ID NO: 502029 - DNA, 17 bp, Homo sapiens
aagtttatgtctaaaga

SEQ ID NO: 502030 - DNA, 14 bp, Homo sapiens
aataaaatgggttt

SEQ ID NO: 502031 - DNA, 13 bp, Homo sapiens
aataaaattcatt

SEQ ID NO: 502032 - DNA, 16 bp, Homo sapiens
aataaaattcattcca

SEQ ID NO: 502033 - DNA, 17 bp, Homo sapiens
aataaaattcattccat

SEQ ID NO: 502034 - DNA, 16 bp, Homo sapiens
aataaaccacaagcat

SEQ ID NO: 502035 - DNA, 15 bp, Homo sapiens
aataacacacagcta

SEQ ID NO: 502036 - DNA, 19 bp, Homo sapiens
aataatgtttcaaacatat

SEQ ID NO: 502037 - DNA, 14 bp, Homo sapiens
aatacaataagtta

SEQ ID NO: 502038 - DNA, 21 bp, Homo sapiens
aatacaccaggtagaacacaa

SEQ ID NO: 502039 - DNA, 23 bp, Homo sapiens
aatacatcccttacctgggaaag

SEQ ID NO: 502040 - DNA, 17 bp, Homo sapiens
aatacattgaattagaa

SEQ ID NO: 502041 - DNA, 15 bp, Homo sapiens
aatatcacttgtcaa

SEQ ID NO: 502042 - DNA, 24 bp, Homo sapiens
aatatgccccattcaacatctagt

SEQ ID NO: 502043 - DNA, 11 bp, Homo sapiens
aatattaaaaa

SEQ ID NO: 502044 - DNA, 18 bp, Homo sapiens
aatattaaaaattaattc

SEQ ID NO: 502045 - DNA, 20 bp, Homo sapiens
aatattaaaaattaattctt

SEQ ID NO: 502046 - DNA, 16 bp, Homo sapiens
aatattatgttaaaac

SEQ ID NO: 502047 - DNA, 15 bp, Homo sapiens
aatatttattttaat

SEQ ID NO: 502048 - DNA, 18 bp, Homo sapiens
aatatttattttaataat

SEQ ID NO: 502049 - DNA, 19 bp, Homo sapiens
aatatttattttaataatg

SEQ ID NO: 502050 - DNA, 13 bp, Homo sapiens
aatcaatactttg

SEQ ID NO: 502051 - DNA, 15 bp, Homo sapiens
aatcaatactttgaa

SEQ ID NO: 502052 - DNA, 19 bp, Homo sapiens
aatcacaaactcatccatt

SEQ ID NO: 502053 - DNA, 13 bp, Homo sapiens
aatcacaatacat

SEQ ID NO: 502054 - DNA, 17 bp, Homo sapiens
aatcactcatttatttc

SEQ ID NO: 502055 - DNA, 19 bp, Homo sapiens
aatcatgaattagttttat

SEQ ID NO: 502056 - DNA, 15 bp, Homo sapiens
aatcatggtttttct

SEQ ID NO: 502057 - DNA, 20 bp, Homo sapiens
aatcattgtaaacattagtt

SEQ ID NO: 502058 - DNA, 18 bp, Homo sapiens
aatccactcccaggcagc

SEQ ID NO: 502059 - DNA, 18 bp, Homo sapiens
aatccagcggttctcaaa

SEQ ID NO: 502060 - DNA, 13 bp, Homo sapiens
aatccatacattt

SEQ ID NO: 502061 - DNA, 16 bp, Homo sapiens
aatccatacatttgtg

SEQ ID NO: 502062 - DNA, 18 bp, Homo sapiens
acaggcaactgaggcaga

SEQ ID NO: 502063 - DNA, 19 bp, Homo sapiens
acaggcaactgaggcagac

SEQ ID NO: 502064 - DNA, 14 bp, Homo sapiens
acagggatgagcat

SEQ ID NO: 502065 - DNA, 23 bp, Homo sapiens
acagggatgagcatggagctggc

SEQ ID NO: 502066 - DNA, 21 bp, Homo sapiens
acaggggctatcccttctcag

SEQ ID NO: 502067 - DNA, 13 bp, Homo sapiens
acagtaaataaat

SEQ ID NO: 502068 - DNA, 23 bp, Homo sapiens
acagtaaataaattgtttgacca

SEQ ID NO: 502069 - DNA, 19 bp, Homo sapiens
acagtaacgcaggggaaac

SEQ ID NO: 502070 - DNA, 16 bp, Homo sapiens
acagtccagcctggag

SEQ ID NO: 502071 - DNA, 18 bp, Homo sapiens
acagtgagggagatccca

SEQ ID NO: 502072 - DNA, 15 bp, Homo sapiens
acagtgggcatcagc

SEQ ID NO: 502073 - DNA, 18 bp, Homo sapiens
acagtgggcatcagcagc

SEQ ID NO: 502074 - DNA, 21 bp, Homo sapiens
acagttcagttcctctttgca

SEQ ID NO: 502075 - DNA, 17 bp, Homo sapiens
acataagctagaaaaat

SEQ ID NO: 502076 - DNA, 18 bp, Homo sapiens
acataagctagaaaaatt

SEQ ID NO: 502077 - DNA, 15 bp, Homo sapiens
acatagaacatgtgt

SEQ ID NO: 502078 - DNA, 20 bp, Homo sapiens
acatcccttacctgggaaag

SEQ ID NO: 502079 - DNA, 13 bp, Homo sapiens
acatctcttcctc

SEQ ID NO: 502080 - DNA, 24 bp, Homo sapiens
acatcttggcacatttaagagaca

SEQ ID NO: 502081 - DNA, 11 bp, Homo sapiens
acatgcctgca

SEQ ID NO: 502082 - DNA, 23 bp, Homo sapiens
acatgcggagaacaaatgtgaag

SEQ ID NO: 502083 - DNA, 17 bp, Homo sapiens
acatgctgaagccaaag

SEQ ID NO: 502084 - DNA, 14 bp, Homo sapiens
acatggagttcccg

SEQ ID NO: 502085 - DNA, 14 bp, Homo sapiens
acatgtataatatt

SEQ ID NO: 502086 - DNA, 11 bp, Homo sapiens
acatgtcatgt

SEQ ID NO: 502087 - DNA, 23 bp, Homo sapiens
acatgtcatgtaggttgtctaaa

SEQ ID NO: 502088 - DNA, 15 bp, Homo sapiens
acatgtggtgggaca

SEQ ID NO: 502089 - DNA, 19 bp, Homo sapiens
acattatctcacttgtgcc

SEQ ID NO: 502090 - DNA, 20 bp, Homo sapiens
acattattggacttccattt

SEQ ID NO: 502091 - DNA, 22 bp, Homo sapiens
acattccgaggggctcagttct

SEQ ID NO: 502092 - DNA, 17 bp, Homo sapiens
acattccttgcctgcac

SEQ ID NO: 502093 - DNA, 19 bp, Homo sapiens
acattttaatgcacctgaa

SEQ ID NO: 502094 - DNA, 13 bp, Homo sapiens
acattttcacaca

SEQ ID NO: 502095 - DNA, 15 bp, Homo sapiens
accaagctatcctgg

SEQ ID NO: 502096 - DNA, 16 bp, Homo sapiens
accacaagactgcaca

SEQ ID NO: 502097 - DNA, 13 bp, Homo sapiens
accacaagcatct

SEQ ID NO: 502098 - DNA, 20 bp, Homo sapiens
accacatgccaagcactgtg

SEQ ID NO: 502099 - DNA, 22 bp, Homo sapiens
accacatgccaagcactgtgct

SEQ ID NO: 502100 - DNA, 18 bp, Homo sapiens
accacatgcggagaacaa

SEQ ID NO: 502101 - DNA, 23 bp, Homo sapiens
accacccactctcctctgcctca

SEQ ID NO: 502102 - DNA, 18 bp, Homo sapiens
accacttgtgttttgcaa

SEQ ID NO: 502103 - DNA, 16 bp, Homo sapiens
accagccttgctctct

SEQ ID NO: 502104 - DNA, 11 bp, Homo sapiens
accaggactta

SEQ ID NO: 502105 - DNA, 17 bp, Homo sapiens
accaggagtccctggta

SEQ ID NO: 502106 - DNA, 22 bp, Homo sapiens
accaggagtccctggtaataag

SEQ ID NO: 502107 - DNA, 12 bp, Homo sapiens
accaggcctggg

SEQ ID NO: 502108 - DNA, 16 bp, Homo sapiens
accagtgtctgaacca

SEQ ID NO: 502109 - DNA, 21 bp, Homo sapiens
accattgcactctagcctggc

SEQ ID NO: 502110 - DNA, 22 bp, Homo sapiens
acccagatgggggaaagcacag

SEQ ID NO: 502111 - DNA, 12 bp, Homo sapiens
acccaggctggg

SEQ ID NO: 502112 - DNA, 13 bp, Homo sapiens
acccaggctgggc

SEQ ID NO: 502113 - DNA, 14 bp, Homo sapiens
acccaggctgggca

SEQ ID NO: 502114 - DNA, 19 bp, Homo sapiens
acccattctacacagagca

SEQ ID NO: 502115 - DNA, 13 bp, Homo sapiens
acccccacagacc

SEQ ID NO: 502116 - DNA, 18 bp, Homo sapiens
acccttggacttgaggat

SEQ ID NO: 502117 - DNA, 17 bp, Homo sapiens
accgctgattctcaggg

SEQ ID NO: 502118 - DNA, 15 bp, Homo sapiens
acctaccacatgcca

SEQ ID NO: 502119 - DNA, 16 bp, Homo sapiens
acctactcctgggtca

SEQ ID NO: 502120 - DNA, 16 bp, Homo sapiens
acctagggtgatatta

SEQ ID NO: 502121 - DNA, 11 bp, Homo sapiens
acctcagcctg

SEQ ID NO: 502122 - DNA, 17 bp, Homo sapiens
acctccaatgctgcctg

SEQ ID NO: 502123 - DNA, 11 bp, Homo sapiens
acctcctgcct

SEQ ID NO: 502124 - DNA, 17 bp, Homo sapiens
acctctgcctcagaaaa

SEQ ID NO: 502125 - DNA, 21 bp, Homo sapiens
acctctgtgggcactggtggg

SEQ ID NO: 502126 - DNA, 20 bp, Homo sapiens
acctgactattgaagttgca

SEQ ID NO: 502127 - DNA, 16 bp, Homo sapiens
acctgagccagcctgc

SEQ ID NO: 502128 - DNA, 19 bp, Homo sapiens
acctgagctagaagctgga

SEQ ID NO: 502129 - DNA, 20 bp, Homo sapiens
acctgagctagaagctggag

SEQ ID NO: 502130 - DNA, 22 bp, Homo sapiens
acctgcctcccttcatgcatgg

SEQ ID NO: 502131 - DNA, 20 bp, Homo sapiens
acctggagagccagaacctg

SEQ ID NO: 502132 - DNA, 13 bp, Homo sapiens
acctggagagcta

SEQ ID NO: 502133 - DNA, 20 bp, Homo sapiens
acctggagagctagaacctg

SEQ ID NO: 502134 - DNA, 22 bp, Homo sapiens
acctggagagctagaacctgga

SEQ ID NO: 502135 - DNA, 15 bp, Homo sapiens
acctggagggctgga

SEQ ID NO: 502136 - DNA, 23 bp, Homo sapiens
acctggcaagctagaacctggag

SEQ ID NO: 502137 - DNA, 13 bp, Homo sapiens
acctgggaagggg

SEQ ID NO: 502138 - DNA, 13 bp, Homo sapiens
acctgggctttct

SEQ ID NO: 502139 - DNA, 15 bp, Homo sapiens
acctggggctgctgg

SEQ ID NO: 502140 - DNA, 18 bp, Homo sapiens
acctgtttcttgtaactg

SEQ ID NO: 502141 - DNA, 22 bp, Homo sapiens
accttctaggacgccacccagc

SEQ ID NO: 502142 - DNA, 23 bp, Homo sapiens
accttctccctcatttcaggagc

SEQ ID NO: 502143 - DNA, 17 bp, Homo sapiens
acctttcagctgtgaac

SEQ ID NO: 502144 - DNA, 12 bp, Homo sapiens
acctttctgagt

SEQ ID NO: 502145 - DNA, 18 bp, Homo sapiens
acgaagaagagccacagt

SEQ ID NO: 502146 - DNA, 20 bp, Homo sapiens
acgagaattgcttgaacccg

SEQ ID NO: 502147 - DNA, 16 bp, Homo sapiens
acgcacacacacatac

SEQ ID NO: 502148 - DNA, 19 bp, Homo sapiens
acgcacacacacatacaga

SEQ ID NO: 502149 - DNA, 15 bp, Homo sapiens
acgcacgcacacaca

SEQ ID NO: 502150 - DNA, 22 bp, Homo sapiens
acggataggcaggaacatacag

SEQ ID NO: 502151 - DNA, 22 bp, Homo sapiens
acgtgattcaattcaacactcc

SEQ ID NO: 502152 - DNA, 15 bp, Homo sapiens
acgttaccaggcagg

SEQ ID NO: 502153 - DNA, 20 bp, Homo sapiens
actaaagcagtggacaccag

SEQ ID NO: 502154 - DNA, 18 bp, Homo sapiens
actaagatgttcactgtg

SEQ ID NO: 502155 - DNA, 16 bp, Homo sapiens
actaataaaatacata

SEQ ID NO: 502156 - DNA, 18 bp, Homo sapiens
actaatccaatacctctt

SEQ ID NO: 502157 - DNA, 15 bp, Homo sapiens
actagaacctggagg

SEQ ID NO: 502158 - DNA, 14 bp, Homo sapiens
actagtaaagacat

SEQ ID NO: 502159 - DNA, 22 bp, Homo sapiens
actatattgtttgctaagcatt

SEQ ID NO: 502160 - DNA, 15 bp, Homo sapiens
actatgatttggaaa

SEQ ID NO: 502161 - DNA, 11 bp, Homo sapiens
actattttatt

SEQ ID NO: 502162 - DNA, 20 bp, Homo sapiens
actcaaaacccatctgggct

SEQ ID NO: 502163 - DNA, 20 bp, Homo sapiens
actcaaaccaaatcactgaa

SEQ ID NO: 502164 - DNA, 13 bp, Homo sapiens
actcaagaagcag

SEQ ID NO: 502165 - DNA, 15 bp, Homo sapiens
actcaagaagcaggc

SEQ ID NO: 502166 - DNA, 12 bp, Homo sapiens
actcaatatttt

SEQ ID NO: 502167 - DNA, 23 bp, Homo sapiens
actcaatattttccatgaaaatg

SEQ ID NO: 502168 - DNA, 14 bp, Homo sapiens
actcaccatctgtg

SEQ ID NO: 502169 - DNA, 15 bp, Homo sapiens
actcaccatctgtgc

SEQ ID NO: 502170 - DNA, 18 bp, Homo sapiens
actcacctggggctgctg

SEQ ID NO: 502171 - DNA, 19 bp, Homo sapiens
actcacctggggctgctgg

SEQ ID NO: 502172 - DNA, 20 bp, Homo sapiens
actcacctggggctgctggc

SEQ ID NO: 502173 - DNA, 21 bp, Homo sapiens
actcaggaggctgaggcagga

SEQ ID NO: 502174 - DNA, 14 bp, Homo sapiens
actcatacatctgg

SEQ ID NO: 502175 - DNA, 12 bp, Homo sapiens
actcatccatta

SEQ ID NO: 502176 - DNA, 13 bp, Homo sapiens
actcatccattaa

SEQ ID NO: 502177 - DNA, 18 bp, Homo sapiens
actcatccattaatgtag

SEQ ID NO: 502178 - DNA, 16 bp, Homo sapiens
actcatttatttccat

SEQ ID NO: 502179 - DNA, 19 bp, Homo sapiens
actcatttatttccatatt

SEQ ID NO: 502180 - DNA, 14 bp, Homo sapiens
actccagaaagtga

SEQ ID NO: 502181 - DNA, 21 bp, Homo sapiens
actccagcctgggcaacagag

SEQ ID NO: 502182 - DNA, 13 bp, Homo sapiens
actcccttcccat

SEQ ID NO: 502183 - DNA, 13 bp, Homo sapiens
actcctaggcagg

SEQ ID NO: 502184 - DNA, 16 bp, Homo sapiens
actcctcttatttgct

SEQ ID NO: 502185 - DNA, 14 bp, Homo sapiens
actcgttaatttgt

SEQ ID NO: 502186 - DNA, 17 bp, Homo sapiens
actctcctgctcctcag

SEQ ID NO: 502187 - DNA, 19 bp, Homo sapiens
actctcctgctcctcagga

SEQ ID NO: 502188 - DNA, 20 bp, Homo sapiens
actctcctgctcctcaggaa

SEQ ID NO: 502189 - DNA, 13 bp, Homo sapiens
actctgctttgca

SEQ ID NO: 502190 - DNA, 13 bp, Homo sapiens
actctgtctcaaa

SEQ ID NO: 502191 - DNA, 21 bp, Homo sapiens
actgaactttgctgagcctgt

SEQ ID NO: 502192 - DNA, 23 bp, Homo sapiens
actgaggcagacagcagctcagg

SEQ ID NO: 502193 - DNA, 13 bp, Homo sapiens
actgatgtcatct

SEQ ID NO: 502194 - DNA, 14 bp, Homo sapiens
actgatgtcatctt

SEQ ID NO: 502195 - DNA, 16 bp, Homo sapiens
actgcactccagcctg

SEQ ID NO: 502196 - DNA, 19 bp, Homo sapiens
actgcaggcatcacagcta

SEQ ID NO: 502197 - DNA, 15 bp, Homo sapiens
actgcattatattta

SEQ ID NO: 502198 - DNA, 16 bp, Homo sapiens
actgccatgcagggcc

SEQ ID NO: 502199 - DNA, 20 bp, Homo sapiens
actgcctgatggacctgtca

SEQ ID NO: 502200 - DNA, 19 bp, Homo sapiens
actgccttctcaactccaa

SEQ ID NO: 502201 - DNA, 11 bp, Homo sapiens
actgcctttga

SEQ ID NO: 502202 - DNA, 18 bp, Homo sapiens
actgctccagcctctgcc

SEQ ID NO: 502203 - DNA, 21 bp, Homo sapiens
actgctccagcctctgccgct

SEQ ID NO: 502204 - DNA, 20 bp, Homo sapiens
actgtcaaagaatcaatcca

SEQ ID NO: 502205 - DNA, 14 bp, Homo sapiens
actgtgctcagggc

SEQ ID NO: 502206 - DNA, 12 bp, Homo sapiens
actgtggctgct

SEQ ID NO: 502207 - DNA, 20 bp, Homo sapiens
actgtgggaaggccagctgc

SEQ ID NO: 502208 - DNA, 15 bp, Homo sapiens
actgttcaagagcac

SEQ ID NO: 502209 - DNA, 16 bp, Homo sapiens
acttaaccggagttcg

SEQ ID NO: 502210 - DNA, 22 bp, Homo sapiens
acttacttgggaggccgaggca

SEQ ID NO: 502211 - DNA, 23 bp, Homo sapiens
acttatgttactggtgtccagct

SEQ ID NO: 502212 - DNA, 22 bp, Homo sapiens
acttattaatctgtatgaagat

SEQ ID NO: 502213 - DNA, 22 bp, Homo sapiens
acttatttgagtgattatttgt

SEQ ID NO: 502214 - DNA, 21 bp, Homo sapiens
acttcaaaaactgtcaaagaa

SEQ ID NO: 502215 - DNA, 19 bp, Homo sapiens
acttcaaatccttgaagat

SEQ ID NO: 502216 - DNA, 20 bp, Homo sapiens
acttcaaatccttgaagatt

SEQ ID NO: 502217 - DNA, 17 bp, Homo sapiens
acttcacacacaggcaa

SEQ ID NO: 502218 - DNA, 18 bp, Homo sapiens
acttcacacagacaagtg

SEQ ID NO: 502219 - DNA, 17 bp, Homo sapiens
acttcagcggtttatat

SEQ ID NO: 502220 - DNA, 19 bp, Homo sapiens
acttcagcggtttatataa

SEQ ID NO: 502221 - DNA, 20 bp, Homo sapiens
acttccagtgcaacactgaa

SEQ ID NO: 502222 - DNA, 12 bp, Homo sapiens
acttccatttgg

SEQ ID NO: 502223 - DNA, 13 bp, Homo sapiens
acttcttcagagc

SEQ ID NO: 502224 - DNA, 16 bp, Homo sapiens
acttcttcagagctga

SEQ ID NO: 502225 - DNA, 20 bp, Homo sapiens
acttcttcagagctgacaca

SEQ ID NO: 502226 - DNA, 16 bp, Homo sapiens
acttctttgctttgcc

SEQ ID NO: 502227 - DNA, 20 bp, Homo sapiens
acttctttgctttgcccagc

SEQ ID NO: 502228 - DNA, 18 bp, Homo sapiens
acttgaggattttgagta

SEQ ID NO: 502229 - DNA, 18 bp, Homo sapiens
acttgagggtaataaact

SEQ ID NO: 502230 - DNA, 17 bp, Homo sapiens
acttgcaaaaagggtca

SEQ ID NO: 502231 - DNA, 11 bp, Homo sapiens
acttggagcca

SEQ ID NO: 502232 - DNA, 19 bp, Homo sapiens
acttggagccaagggttca

SEQ ID NO: 502233 - DNA, 16 bp, Homo sapiens
acttgtcaataaaatc

SEQ ID NO: 502234 - DNA, 23 bp, Homo sapiens
actttcttctaccagacccttct

SEQ ID NO: 502235 - DNA, 22 bp, Homo sapiens
agagtggtggcagctcaaaatg

SEQ ID NO: 502236 - DNA, 20 bp, Homo sapiens
agagttaatatatagaaggg

SEQ ID NO: 502237 - DNA, 15 bp, Homo sapiens
agagttgctcctcag

SEQ ID NO: 502238 - DNA, 19 bp, Homo sapiens
agagttgggacaattgctt

SEQ ID NO: 502239 - DNA, 17 bp, Homo sapiens
agagtttagctggaaaa

SEQ ID NO: 502240 - DNA, 22 bp, Homo sapiens
agagtttgatatgggctttctc

SEQ ID NO: 502241 - DNA, 16 bp, Homo sapiens
agataatacattccga

SEQ ID NO: 502242 - DNA, 20 bp, Homo sapiens
agatatattaagtgactgtt

SEQ ID NO: 502243 - DNA, 17 bp, Homo sapiens
agatcacgccactgcac

SEQ ID NO: 502244 - DNA, 21 bp, Homo sapiens
agatccccaactgctccagcc

SEQ ID NO: 502245 - DNA, 23 bp, Homo sapiens
agatccccaactgctccagcctc

SEQ ID NO: 502246 - DNA, 13 bp, Homo sapiens
agatcctaaaaca

SEQ ID NO: 502247 - DNA, 12 bp, Homo sapiens
agatcctcttct

SEQ ID NO: 502248 - DNA, 21 bp, Homo sapiens
agatcctcttctcaaagctgg

SEQ ID NO: 502249 - DNA, 14 bp, Homo sapiens
agatcctggaaatc

SEQ ID NO: 502250 - DNA, 16 bp, Homo sapiens
agatgcagttctgaag

SEQ ID NO: 502251 - DNA, 17 bp, Homo sapiens
agatgcagttctgaaga

SEQ ID NO: 502252 - DNA, 18 bp, Homo sapiens
agatgcagttctgaagaa

SEQ ID NO: 502253 - DNA, 19 bp, Homo sapiens
agatgcagttctgaagaag

SEQ ID NO: 502254 - DNA, 22 bp, Homo sapiens
agatggcggtgatcagcagaga

SEQ ID NO: 502255 - DNA, 12 bp, Homo sapiens
agattcattttt

SEQ ID NO: 502256 - DNA, 17 bp, Homo sapiens
agattcatttttctttc

SEQ ID NO: 502257 - DNA, 14 bp, Homo sapiens
agattcctgtcctt

SEQ ID NO: 502258 - DNA, 16 bp, Homo sapiens
agattttcctgaaaac

SEQ ID NO: 502259 - DNA, 15 bp, Homo sapiens
agcaaaatgtgaatg

SEQ ID NO: 502260 - DNA, 15 bp, Homo sapiens
agcaaagtctaaagt

SEQ ID NO: 502261 - DNA, 20 bp, Homo sapiens
agcaaagtctaaagtttaca

SEQ ID NO: 502262 - DNA, 23 bp, Homo sapiens
agcaaagtctaaagtttacagta

SEQ ID NO: 502263 - DNA, 20 bp, Homo sapiens
agcaagctcccaagggatgg

SEQ ID NO: 502264 - DNA, 14 bp, Homo sapiens
agcacactgtagca

SEQ ID NO: 502265 - DNA, 22 bp, Homo sapiens
agcacagcctcttagatgcagt

SEQ ID NO: 502266 - DNA, 15 bp, Homo sapiens
agcacaggtgggctt

SEQ ID NO: 502267 - DNA, 17 bp, Homo sapiens
agcacaggttagggcat

SEQ ID NO: 502268 - DNA, 17 bp, Homo sapiens
agcaccaagctcaaagc

SEQ ID NO: 502269 - DNA, 23 bp, Homo sapiens
agcacctttagaatattaaaaat

SEQ ID NO: 502270 - DNA, 17 bp, Homo sapiens
agcactaaagcagtgga

SEQ ID NO: 502271 - DNA, 20 bp, Homo sapiens
agcactaaagcagtggacac

SEQ ID NO: 502272 - DNA, 17 bp, Homo sapiens
agcacttggagccaagg

SEQ ID NO: 502273 - DNA, 13 bp, Homo sapiens
agcagcaagtgtg

SEQ ID NO: 502274 - DNA, 13 bp, Homo sapiens
agcagccagctct

SEQ ID NO: 502275 - DNA, 15 bp, Homo sapiens
agcagccagctctca

SEQ ID NO: 502276 - DNA, 18 bp, Homo sapiens
agcagccagctctcagcc

SEQ ID NO: 502277 - DNA, 12 bp, Homo sapiens
agcagctcaggc

SEQ ID NO: 502278 - DNA, 12 bp, Homo sapiens
agcagctgctac

SEQ ID NO: 502279 - DNA, 21 bp, Homo sapiens
agcaggcgttcagctcactgt

SEQ ID NO: 502280 - DNA, 12 bp, Homo sapiens
agcagtggacac

SEQ ID NO: 502281 - DNA, 17 bp, Homo sapiens
agcagttcagagctgcc

SEQ ID NO: 502282 - DNA, 23 bp, Homo sapiens
agcataaatgttgacatgggaca

SEQ ID NO: 502283 - DNA, 21 bp, Homo sapiens
agcataggaggggtctggaca

SEQ ID NO: 502284 - DNA, 21 bp, Homo sapiens
agcatatggagtgcctgtaca

SEQ ID NO: 502285 - DNA, 23 bp, Homo sapiens
agcatattttctccgaaaggcaa

SEQ ID NO: 502286 - DNA, 18 bp, Homo sapiens
agcatcacctagaaactt

SEQ ID NO: 502287 - DNA, 13 bp, Homo sapiens
agcatggctgtga

SEQ ID NO: 502288 - DNA, 22 bp, Homo sapiens
agcatttagatgtataggttga

SEQ ID NO: 502289 - DNA, 12 bp, Homo sapiens
agccaaagccaa

SEQ ID NO: 502290 - DNA, 22 bp, Homo sapiens
agccaagggttcagagactcag

SEQ ID NO: 502291 - DNA, 20 bp, Homo sapiens
agccacagtgagggagatcc

SEQ ID NO: 502292 - DNA, 22 bp, Homo sapiens
agccacagtgagggagatccca

SEQ ID NO: 502293 - DNA, 23 bp, Homo sapiens
agccagaaataaagttggtgaca

SEQ ID NO: 502294 - DNA, 14 bp, Homo sapiens
agccagaacctgga

SEQ ID NO: 502295 - DNA, 13 bp, Homo sapiens
agccagcagccag

SEQ ID NO: 502296 - DNA, 14 bp, Homo sapiens
agccagcagccagc

SEQ ID NO: 502297 - DNA, 15 bp, Homo sapiens
agccagctctcagcc

SEQ ID NO: 502298 - DNA, 22 bp, Homo sapiens
agccatgtagaagctgcatctt

SEQ ID NO: 502299 - DNA, 18 bp, Homo sapiens
agcccatctgcctgttct

SEQ ID NO: 502300 - DNA, 14 bp, Homo sapiens
agcccattcattcc

SEQ ID NO: 502301 - DNA, 23 bp, Homo sapiens
agcccattcattccattctggaa

SEQ ID NO: 502302 - DNA, 21 bp, Homo sapiens
agccccttcatccgcctgtgg

SEQ ID NO: 502303 - DNA, 17 bp, Homo sapiens
agcccttctttccacag

SEQ ID NO: 502304 - DNA, 13 bp, Homo sapiens
agccgacctcagc

SEQ ID NO: 502305 - DNA, 16 bp, Homo sapiens
agccgctcctgtctgc

SEQ ID NO: 502306 - DNA, 21 bp, Homo sapiens
agcctagccgacctcagcctt

SEQ ID NO: 502307 - DNA, 17 bp, Homo sapiens
agcctcatccgaggcag

SEQ ID NO: 502308 - DNA, 20 bp, Homo sapiens
agcctcatccgaggcagggt

SEQ ID NO: 502309 - DNA, 11 bp, Homo sapiens
agcctctgccg

SEQ ID NO: 502310 - DNA, 16 bp, Homo sapiens
agcctctgccgctgcc

SEQ ID NO: 502311 - DNA, 20 bp, Homo sapiens
agcctctgccgctgccatgc

SEQ ID NO: 502312 - DNA, 11 bp, Homo sapiens
agcctggtggg

SEQ ID NO: 502313 - DNA, 14 bp, Homo sapiens
agcctggtgggcct

SEQ ID NO: 502314 - DNA, 16 bp, Homo sapiens
agccttccacactcac

SEQ ID NO: 502315 - DNA, 12 bp, Homo sapiens
agccttgctctc

SEQ ID NO: 502316 - DNA, 16 bp, Homo sapiens
agccttgctctcttca

SEQ ID NO: 502317 - DNA, 18 bp, Homo sapiens
agccttgctctcttcaat

SEQ ID NO: 502318 - DNA, 22 bp, Homo sapiens
agccttgctctcttcaataaac

SEQ ID NO: 502319 - DNA, 23 bp, Homo sapiens
agccttgctctcttcaataaacc

SEQ ID NO: 502320 - DNA, 22 bp, Homo sapiens
agctacccaggaggctgaggtg

SEQ ID NO: 502321 - DNA, 13 bp, Homo sapiens
agctactttgttt

SEQ ID NO: 502322 - DNA, 16 bp, Homo sapiens
agctagaacctggagg

SEQ ID NO: 502323 - DNA, 23 bp, Homo sapiens
agctcaagggaccctgggtggga

SEQ ID NO: 502324 - DNA, 17 bp, Homo sapiens
agctcagagagggcagg

SEQ ID NO: 502325 - DNA, 16 bp, Homo sapiens
agctcagcatttccac

SEQ ID NO: 502326 - DNA, 21 bp, Homo sapiens
agctcattataatgtcattaa

SEQ ID NO: 502327 - DNA, 20 bp, Homo sapiens
agctcccaagggatggtgcc

SEQ ID NO: 502328 - DNA, 22 bp, Homo sapiens
agctcccaagggatggtgccct

SEQ ID NO: 502329 - DNA, 14 bp, Homo sapiens
agctccgtggagca

SEQ ID NO: 502330 - DNA, 14 bp, Homo sapiens
agctcggtggaccc

SEQ ID NO: 502331 - DNA, 20 bp, Homo sapiens
agctcggtggacccagggat

SEQ ID NO: 502332 - DNA, 16 bp, Homo sapiens
agctgaagatccccaa

SEQ ID NO: 502333 - DNA, 18 bp, Homo sapiens
agctgaagatccccaact

SEQ ID NO: 502334 - DNA, 21 bp, Homo sapiens
agctgaagatccccaactgct

SEQ ID NO: 502335 - DNA, 21 bp, Homo sapiens
agctgacacaaacctgcctgg

SEQ ID NO: 502336 - DNA, 17 bp, Homo sapiens
agctgccctctcctggg

SEQ ID NO: 502337 - DNA, 18 bp, Homo sapiens
agctgccctctcctgggc

SEQ ID NO: 502338 - DNA, 20 bp, Homo sapiens
agctgccctctcctgggcag

SEQ ID NO: 502339 - DNA, 21 bp, Homo sapiens
agctgccctctcctgggcagc

SEQ ID NO: 502340 - DNA, 22 bp, Homo sapiens
tcccataaccgctgattctcag

SEQ ID NO: 502341 - DNA, 12 bp, Homo sapiens
tccccaactgct

SEQ ID NO: 502342 - DNA, 14 bp, Homo sapiens
tccccaactgctcc

SEQ ID NO: 502343 - DNA, 14 bp, Homo sapiens
tcccctcctctgct

SEQ ID NO: 502344 - DNA, 17 bp, Homo sapiens
tccccttgcccagggct

SEQ ID NO: 502345 - DNA, 16 bp, Homo sapiens
tcccggtttcagaagc

SEQ ID NO: 502346 - DNA, 14 bp, Homo sapiens
tcccgtgcacctac

SEQ ID NO: 502347 - DNA, 14 bp, Homo sapiens
tccctaatgctgca

SEQ ID NO: 502348 - DNA, 19 bp, Homo sapiens
tccctatctttgccaccct

SEQ ID NO: 502349 - DNA, 15 bp, Homo sapiens
tccctcatttcagga

SEQ ID NO: 502350 - DNA, 13 bp, Homo sapiens
tccctccctccac

SEQ ID NO: 502351 - DNA, 14 bp, Homo sapiens
tccctccctccacc

SEQ ID NO: 502352 - DNA, 19 bp, Homo sapiens
tccctgataacaacctgga

SEQ ID NO: 502353 - DNA, 21 bp, Homo sapiens
tccctgataacaacctggaga

SEQ ID NO: 502354 - DNA, 14 bp, Homo sapiens
tccgaggcagggtc

SEQ ID NO: 502355 - DNA, 12 bp, Homo sapiens
tccgcctgtggg

SEQ ID NO: 502356 - DNA, 14 bp, Homo sapiens
tccgcggagccctt

SEQ ID NO: 502357 - DNA, 23 bp, Homo sapiens
tcctaaaataagggcagagtcac

SEQ ID NO: 502358 - DNA, 22 bp, Homo sapiens
tcctaatgaatgcataaaatgt

SEQ ID NO: 502359 - DNA, 15 bp, Homo sapiens
tcctagaggacctga

SEQ ID NO: 502360 - DNA, 19 bp, Homo sapiens
tcctaggcaggacatgctg

SEQ ID NO: 502361 - DNA, 19 bp, Homo sapiens
tcctagggaagggtggtgg

SEQ ID NO: 502362 - DNA, 22 bp, Homo sapiens
tcctcaaaagaaagagaaatga

SEQ ID NO: 502363 - DNA, 15 bp, Homo sapiens
tcctcaaacactgca

SEQ ID NO: 502364 - DNA, 16 bp, Homo sapiens
tcctcaaacactgcag

SEQ ID NO: 502365 - DNA, 16 bp, Homo sapiens
tcctcatccagggctc

SEQ ID NO: 502366 - DNA, 14 bp, Homo sapiens
tcctctcagcccct

SEQ ID NO: 502367 - DNA, 17 bp, Homo sapiens
tcctctccccatgatgt

SEQ ID NO: 502368 - DNA, 10 bp, Homo sapiens
tcctctgcct

SEQ ID NO: 502369 - DNA, 22 bp, Homo sapiens
tcctctgcttgccatccctccc

SEQ ID NO: 502370 - DNA, 14 bp, Homo sapiens
tcctctgtccaggg

SEQ ID NO: 502371 - DNA, 23 bp, Homo sapiens
tcctctgtccagggccctgagct

SEQ ID NO: 502372 - DNA, 14 bp, Homo sapiens
tcctctttgcatgg

SEQ ID NO: 502373 - DNA, 21 bp, Homo sapiens
tcctgaaaacccttgccatgt

SEQ ID NO: 502374 - DNA, 22 bp, Homo sapiens
tcctgaaaacccttgccatgtg

SEQ ID NO: 502375 - DNA, 17 bp, Homo sapiens
tcctgggcagctgcctc

SEQ ID NO: 502376 - DNA, 22 bp, Homo sapiens
tcctgggcagctgcctcccctc

SEQ ID NO: 502377 - DNA, 22 bp, Homo sapiens
tcctgtccacacccagctcagc

SEQ ID NO: 502378 - DNA, 13 bp, Homo sapiens
tcctgtctgccag

SEQ ID NO: 502379 - DNA, 16 bp, Homo sapiens
tcctgtctgccagcca

SEQ ID NO: 502380 - DNA, 21 bp, Homo sapiens
tcctgtctgccagccagcagc

SEQ ID NO: 502381 - DNA, 20 bp, Homo sapiens
tccttagcttagacctcagc

SEQ ID NO: 502382 - DNA, 21 bp, Homo sapiens
tccttagcttagacctcagcc

SEQ ID NO: 502383 - DNA, 13 bp, Homo sapiens
tccttcacctttc

SEQ ID NO: 502384 - DNA, 12 bp, Homo sapiens
tccttctgcctt

SEQ ID NO: 502385 - DNA, 15 bp, Homo sapiens
tccttctgccttttt

SEQ ID NO: 502386 - DNA, 15 bp, Homo sapiens
tcctttgaagaggaa

SEQ ID NO: 502387 - DNA, 18 bp, Homo sapiens
tcctttttcccaataaat

SEQ ID NO: 502388 - DNA, 14 bp, Homo sapiens
tcgaatcactcatt

SEQ ID NO: 502389 - DNA, 16 bp, Homo sapiens
tcgaatcactcattta

SEQ ID NO: 502390 - DNA, 14 bp, Homo sapiens
tcgagcagggtgct

SEQ ID NO: 502391 - DNA, 17 bp, Homo sapiens
tcggacctttcagctgt

SEQ ID NO: 502392 - DNA, 22 bp, Homo sapiens
tcggagcctcatccgaggcagg

SEQ ID NO: 502393 - DNA, 21 bp, Homo sapiens
tcgtggaacagttacctctgc

SEQ ID NO: 502394 - DNA, 23 bp, Homo sapiens
tctaaaaataaaatgcatttaaa

SEQ ID NO: 502395 - DNA, 13 bp, Homo sapiens
tctaaaatgagtt

SEQ ID NO: 502396 - DNA, 17 bp, Homo sapiens
tctaaagtttacagtaa

SEQ ID NO: 502397 - DNA, 20 bp, Homo sapiens
tctaaatcaccagagaccaa

SEQ ID NO: 502398 - DNA, 14 bp, Homo sapiens
tctactacccccac

SEQ ID NO: 502399 - DNA, 16 bp, Homo sapiens
tctactgtacacaatc

SEQ ID NO: 502400 - DNA, 14 bp, Homo sapiens
tctacttttaaaga

SEQ ID NO: 502401 - DNA, 13 bp, Homo sapiens
tctagaatactaa

SEQ ID NO: 502402 - DNA, 15 bp, Homo sapiens
tagccgacctcagcc

SEQ ID NO: 502403 - DNA, 17 bp, Homo sapiens
tagccgacctcagcctt

SEQ ID NO: 502404 - DNA, 15 bp, Homo sapiens
tagctctttgagata

SEQ ID NO: 502405 - DNA, 15 bp, Homo sapiens
tagctgctaccttct

SEQ ID NO: 502406 - DNA, 14 bp, Homo sapiens
taggagcagagctc

SEQ ID NO: 502407 - DNA, 22 bp, Homo sapiens
taggcaggacatgctgaagcca

SEQ ID NO: 502408 - DNA, 17 bp, Homo sapiens
taggcagggatttgagg

SEQ ID NO: 502409 - DNA, 14 bp, Homo sapiens
tagggaagtaacag

SEQ ID NO: 502410 - DNA, 15 bp, Homo sapiens
taggttgtctaaaaa

SEQ ID NO: 502411 - DNA, 13 bp, Homo sapiens
tagtaaaaataaa

SEQ ID NO: 502412 - DNA, 16 bp, Homo sapiens
tagtaaaaataaaatt

SEQ ID NO: 502413 - DNA, 18 bp, Homo sapiens
tagtcaaattgtgtgaaa

SEQ ID NO: 502414 - DNA, 20 bp, Homo sapiens
tagtctctatcattaaagtt

SEQ ID NO: 502415 - DNA, 15 bp, Homo sapiens
tagtgagacccctgt

SEQ ID NO: 502416 - DNA, 20 bp, Homo sapiens
tagtggcttcattagagcag

SEQ ID NO: 502417 - DNA, 16 bp, Homo sapiens
tagtgttggagaagaa

SEQ ID NO: 502418 - DNA, 23 bp, Homo sapiens
tagtgttggagaagaactgaaat

SEQ ID NO: 502419 - DNA, 17 bp, Homo sapiens
tagttgcaatagaacag

SEQ ID NO: 502420 - DNA, 21 bp, Homo sapiens
tataaaataatttttatattt

SEQ ID NO: 502421 - DNA, 14 bp, Homo sapiens
tataaacactatat

SEQ ID NO: 502422 - DNA, 19 bp, Homo sapiens
tataactatgttgataaaa

SEQ ID NO: 502423 - DNA, 19 bp, Homo sapiens
tataatcccagcatgttga

SEQ ID NO: 502424 - DNA, 17 bp, Homo sapiens
tataatgtcattaaaca

SEQ ID NO: 502425 - DNA, 22 bp, Homo sapiens
tatacctgggcatactaataaa

SEQ ID NO: 502426 - DNA, 19 bp, Homo sapiens
tatactaagatgttcactg

SEQ ID NO: 502427 - DNA, 15 bp, Homo sapiens
tatagagatatgcag

SEQ ID NO: 502428 - DNA, 14 bp, Homo sapiens
tatagattctttat

SEQ ID NO: 502429 - DNA, 20 bp, Homo sapiens
tatagattctttattagtga

SEQ ID NO: 502430 - DNA, 15 bp, Homo sapiens
tatatttattactgt

SEQ ID NO: 502431 - DNA, 20 bp, Homo sapiens
tatatttattactgtaagaa

SEQ ID NO: 502432 - DNA, 23 bp, Homo sapiens
tatatttattactgtaagaaaat

SEQ ID NO: 502433 - DNA, 14 bp, Homo sapiens
tatattttaatttg

SEQ ID NO: 502434 - DNA, 23 bp, Homo sapiens
tatattttcatgacttttccatg

SEQ ID NO: 502435 - DNA, 15 bp, Homo sapiens
tatattttgaacaac

SEQ ID NO: 502436 - DNA, 15 bp, Homo sapiens
tatcaagcagccaag

SEQ ID NO: 502437 - DNA, 21 bp, Homo sapiens
tatcatgtcaaacgtgaaaat

SEQ ID NO: 502438 - DNA, 15 bp, Homo sapiens
tatcattaaagttct

SEQ ID NO: 502439 - DNA, 15 bp, Homo sapiens
tatcccttctcagaa

SEQ ID NO: 502440 - DNA, 16 bp, Homo sapiens
tatctaaatcaccaga

SEQ ID NO: 502441 - DNA, 18 bp, Homo sapiens
tatctaatttttattaat

SEQ ID NO: 502442 - DNA, 15 bp, Homo sapiens
tatctgtgagttctg

SEQ ID NO: 502443 - DNA, 14 bp, Homo sapiens
tatctttgccaccc

SEQ ID NO: 502444 - DNA, 18 bp, Homo sapiens
tatgaccttctaggaagc

SEQ ID NO: 502445 - DNA, 16 bp, Homo sapiens
tatgactcccaaattt

SEQ ID NO: 502446 - DNA, 16 bp, Homo sapiens
tatgattaagtaatga

SEQ ID NO: 502447 - DNA, 21 bp, Homo sapiens
tatgattaagtaatgataact

SEQ ID NO: 502448 - DNA, 17 bp, Homo sapiens
tatgatttggaaaataa

SEQ ID NO: 502449 - DNA, 18 bp, Homo sapiens
tatgatttggaaaataaa

SEQ ID NO: 502450 - DNA, 19 bp, Homo sapiens
tatgcagtattgagcactg

SEQ ID NO: 502451 - DNA, 15 bp, Homo sapiens
tatgccccattcaac

SEQ ID NO: 502452 - DNA, 22 bp, Homo sapiens
tatggaagcatattgttattat

SEQ ID NO: 502453 - DNA, 21 bp, Homo sapiens
tatggacggtgctccaggcag

SEQ ID NO: 502454 - DNA, 18 bp, Homo sapiens
tatggagctcagagaggg

SEQ ID NO: 502455 - DNA, 19 bp, Homo sapiens
tatggcatattgataataa

SEQ ID NO: 502456 - DNA, 13 bp, Homo sapiens
tatgtacttcatg

SEQ ID NO: 502457 - DNA, 19 bp, Homo sapiens
tatgttagtgcaaattgtc

SEQ ID NO: 502458 - DNA, 14 bp, Homo sapiens
tatgttgataaaag

SEQ ID NO: 502459 - DNA, 14 bp, Homo sapiens
tatgtttttgtgta

SEQ ID NO: 502460 - DNA, 18 bp, Homo sapiens
tatgtttttgtgtatttg

SEQ ID NO: 502461 - DNA, 20 bp, Homo sapiens
tattaaaaattaattcttta

SEQ ID NO: 502462 - DNA, 15 bp, Homo sapiens
tattaatattttaat

SEQ ID NO: 502463 - DNA, 14 bp, Homo sapiens
tattactgtaagaa

SEQ ID NO: 502464 - DNA, 15 bp, Homo sapiens
tattagaataccaca

SEQ ID NO: 502465 - DNA, 20 bp, Homo sapiens
tattagtgaagtatgcacta

SEQ ID NO: 502466 - DNA, 17 bp, Homo sapiens
tattcaaaaattatatt

SEQ ID NO: 502467 - DNA, 11 bp, Homo sapiens
tattcctgcct

SEQ ID NO: 502468 - DNA, 14 bp, Homo sapiens
tattgataataaaa

SEQ ID NO: 502469 - DNA, 17 bp, Homo sapiens
tattgataataaaattc

SEQ ID NO: 502470 - DNA, 12 bp, Homo sapiens
tattgctggggt

SEQ ID NO: 502471 - DNA, 16 bp, Homo sapiens
tattggacttccattt

SEQ ID NO: 502472 - DNA, 17 bp, Homo sapiens
tattgtctagtgaaact

SEQ ID NO: 502473 - DNA, 17 bp, Homo sapiens
tattgtgtgttatttaa

SEQ ID NO: 502474 - DNA, 15 bp, Homo sapiens
tatttccatattaaa

SEQ ID NO: 502475 - DNA, 15 bp, Homo sapiens
tatttccctcccctg

SEQ ID NO: 502476 - DNA, 18 bp, Homo sapiens
tatttggagtggaggcat

SEQ ID NO: 502477 - DNA, 23 bp, Homo sapiens
tatttggagtggaggcattgttt

SEQ ID NO: 502478 - DNA, 21 bp, Homo sapiens
tatttggtttggccatctctg

SEQ ID NO: 502479 - DNA, 19 bp, Homo sapiens
tatttgtacagttcagttc

SEQ ID NO: 502480 - DNA, 22 bp, Homo sapiens
tatttgttaatggtttgaatat

SEQ ID NO: 502481 - DNA, 14 bp, Homo sapiens
tattttaaaagaat

SEQ ID NO: 502482 - DNA, 18 bp, Homo sapiens
tattttaggcagggattt

SEQ ID NO: 502483 - DNA, 16 bp, Homo sapiens
tattttatacattaac

SEQ ID NO: 502484 - DNA, 20 bp, Homo sapiens
tattttccatgaaaatgcaa

SEQ ID NO: 502485 - DNA, 15 bp, Homo sapiens
tattttctccgaaag

SEQ ID NO: 502486 - DNA, 11 bp, Homo sapiens
tcaaaaagtca

SEQ ID NO: 502487 - DNA, 16 bp, Homo sapiens
tcaaactgaagccaga

SEQ ID NO: 502488 - DNA, 22 bp, Homo sapiens
tcaaacttccagtgcaacactg

SEQ ID NO: 502489 - DNA, 20 bp, Homo sapiens
tcaaagtgtaaacaccatag

SEQ ID NO: 502490 - DNA, 16 bp, Homo sapiens
tcaaatccttgaagat

SEQ ID NO: 502491 - DNA, 23 bp, Homo sapiens
tcaaatggaaaggagaggaaaga

SEQ ID NO: 502492 - DNA, 20 bp, Homo sapiens
tcaaatggaagacacattga

SEQ ID NO: 502493 - DNA, 18 bp, Homo sapiens
tcaacactcccttcccat

SEQ ID NO: 502494 - DNA, 18 bp, Homo sapiens
tcaacataacataagcta

SEQ ID NO: 502495 - DNA, 16 bp, Homo sapiens
tcaagacccctgtctt

SEQ ID NO: 502496 - DNA, 15 bp, Homo sapiens
tcaagagcacacttg

SEQ ID NO: 502497 - DNA, 20 bp, Homo sapiens
tcaaggactttctgaagcct

SEQ ID NO: 502498 - DNA, 14 bp, Homo sapiens
tcaaggagaggagg

SEQ ID NO: 502499 - DNA, 13 bp, Homo sapiens
tcaaggcactgcc

SEQ ID NO: 502500 - DNA, 14 bp, Homo sapiens
tcaaggcactgcct

SEQ ID NO: 502501 - DNA, 16 bp, Homo sapiens
tcaaggcactgcctga

SEQ ID NO: 502502 - DNA, 14 bp, Homo sapiens
tcaataaaatccat

SEQ ID NO: 502503 - DNA, 21 bp, Homo sapiens
tcaataaaatccatacatttg

SEQ ID NO: 502504 - DNA, 15 bp, Homo sapiens
tcaatatttcagata

SEQ ID NO: 502505 - DNA, 22 bp, Homo sapiens
tcaatcacaaaagtatattcaa

SEQ ID NO: 502506 - DNA, 18 bp, Homo sapiens
tcaatggtttgcaaggaa

SEQ ID NO: 502507 - DNA, 17 bp, Homo sapiens
tcaattcaacactccct

SEQ ID NO: 502508 - DNA, 13 bp, Homo sapiens
tcaatttccaaga

SEQ ID NO: 502509 - DNA, 20 bp, Homo sapiens
tcaatttccaagagctgagg

SEQ ID NO: 502510 - DNA, 23 bp, Homo sapiens
tcacaccaggcttgcctgcaggc

SEQ ID NO: 502511 - DNA, 18 bp, Homo sapiens
tcacacgggggcagctga

SEQ ID NO: 502512 - DNA, 15 bp, Homo sapiens
tcacagagcagagtc

SEQ ID NO: 502513 - DNA, 21 bp, Homo sapiens
tcacagatgtgtgattcacag

SEQ ID NO: 502514 - DNA, 23 bp, Homo sapiens
tcacaggacagcccttctttcca

SEQ ID NO: 502515 - DNA, 18 bp, Homo sapiens
tcacataaaatagatttt

SEQ ID NO: 502516 - DNA, 16 bp, Homo sapiens
tcacatagtgaaagtt

SEQ ID NO: 502517 - DNA, 15 bp, Homo sapiens
tcacatcttggcaca

SEQ ID NO: 502518 - DNA, 14 bp, Homo sapiens
tcaccatctgtgca

SEQ ID NO: 502519 - DNA, 14 bp, Homo sapiens
tcacctagaaactt

SEQ ID NO: 502520 - DNA, 18 bp, Homo sapiens
tcacctagaaacttgtta

SEQ ID NO: 502521 - DNA, 17 bp, Homo sapiens
tcacctggggctgctgg

SEQ ID NO: 502522 - DNA, 20 bp, Homo sapiens
tcacctggggctgctggcct

SEQ ID NO: 502523 - DNA, 21 bp, Homo sapiens
tcacgattgtcatcaggagaa

SEQ ID NO: 502524 - DNA, 16 bp, Homo sapiens
tcacgccactgcactc

SEQ ID NO: 502525 - DNA, 20 bp, Homo sapiens
tcactggggtcctggggcct

SEQ ID NO: 502526 - DNA, 18 bp, Homo sapiens
tcactgtgggaaggccag

SEQ ID NO: 502527 - DNA, 14 bp, Homo sapiens
tcacttgagacaaa

SEQ ID NO: 502528 - DNA, 22 bp, Homo sapiens
tcacttgtcctcagtttttcct

SEQ ID NO: 502529 - DNA, 21 bp, Homo sapiens
tcacttgtgccaacactcaag

SEQ ID NO: 502530 - DNA, 22 bp, Homo sapiens
tcagaaacaccctcacactggg

SEQ ID NO: 502531 - DNA, 14 bp, Homo sapiens
tcagaagcctttgg

SEQ ID NO: 502532 - DNA, 19 bp, Homo sapiens
tcagaatcacttctgagaa

SEQ ID NO: 502533 - DNA, 18 bp, Homo sapiens
tcagagctgacacaggat

SEQ ID NO: 502534 - DNA, 13 bp, Homo sapiens
tcagagctgccct

SEQ ID NO: 502535 - DNA, 18 bp, Homo sapiens
tcagagctgccctctcct

SEQ ID NO: 502536 - DNA, 19 bp, Homo sapiens
tcagagctgccctctcctg

SEQ ID NO: 502537 - DNA, 21 bp, Homo sapiens
tcagagctgccctctcctggg

SEQ ID NO: 502538 - DNA, 23 bp, Homo sapiens
tcagagctgccctctcctgggca

SEQ ID NO: 502539 - DNA, 15 bp, Homo sapiens
tcagagtatggagct

SEQ ID NO: 502540 - DNA, 16 bp, Homo sapiens
tcagcccaagatgctt

SEQ ID NO: 502541 - DNA, 22 bp, Homo sapiens
tcagccttccccttgcccaggg

SEQ ID NO: 502542 - DNA, 19 bp, Homo sapiens
tcaggaaagagaacttcca

SEQ ID NO: 502543 - DNA, 20 bp, Homo sapiens
tcaggaactatgggagcctc

SEQ ID NO: 502544 - DNA, 15 bp, Homo sapiens
ggtttgaagcctgga

SEQ ID NO: 502545 - DNA, 14 bp, Homo sapiens
ggtttgcaaggaag

SEQ ID NO: 502546 - DNA, 23 bp, Homo sapiens
ggtttggccatctctggatgcct

SEQ ID NO: 502547 - DNA, 11 bp, Homo sapiens
gtaaaaagctt

SEQ ID NO: 502548 - DNA, 14 bp, Homo sapiens
gtaaaaataaaatt

SEQ ID NO: 502549 - DNA, 21 bp, Homo sapiens
gtaaacattagttctatttct

SEQ ID NO: 502550 - DNA, 13 bp, Homo sapiens
gtaagaatcattg

SEQ ID NO: 502551 - DNA, 19 bp, Homo sapiens
gtaagtttatgtctaaaga

SEQ ID NO: 502552 - DNA, 16 bp, Homo sapiens
gtaataatgtgaatca

SEQ ID NO: 502553 - DNA, 13 bp, Homo sapiens
gtaatatattgct

SEQ ID NO: 502554 - DNA, 18 bp, Homo sapiens
gtaatatattgctgctgg

SEQ ID NO: 502555 - DNA, 13 bp, Homo sapiens
gtaatctttcata

SEQ ID NO: 502556 - DNA, 20 bp, Homo sapiens
gtaatctttcatagccatac

SEQ ID NO: 502557 - DNA, 15 bp, Homo sapiens
gtaatttgtatctga

SEQ ID NO: 502558 - DNA, 21 bp, Homo sapiens
gtaatttgtatctgaaggaga

SEQ ID NO: 502559 - DNA, 19 bp, Homo sapiens
gtacagttcagttcctctt

SEQ ID NO: 502560 - DNA, 22 bp, Homo sapiens
gtagaacacaaggtcatttgct

SEQ ID NO: 502561 - DNA, 20 bp, Homo sapiens
gtagcaaattccaatacatt

SEQ ID NO: 502562 - DNA, 10 bp, Homo sapiens
gtagctgcta

SEQ ID NO: 502563 - DNA, 17 bp, Homo sapiens
gtagtgttggagaagaa

SEQ ID NO: 502564 - DNA, 15 bp, Homo sapiens
gtataaaataatttt

SEQ ID NO: 502565 - DNA, 16 bp, Homo sapiens
gtataaagctcagaag

SEQ ID NO: 502566 - DNA, 12 bp, Homo sapiens
gtataatatttt

SEQ ID NO: 502567 - DNA, 15 bp, Homo sapiens
gtataatatttttaa

SEQ ID NO: 502568 - DNA, 23 bp, Homo sapiens
gtatattcaaaaattatattttg

SEQ ID NO: 502569 - DNA, 22 bp, Homo sapiens
gtatgcactaatcaatactttg

SEQ ID NO: 502570 - DNA, 21 bp, Homo sapiens
gtatgggttagggaaaacatt

SEQ ID NO: 502571 - DNA, 19 bp, Homo sapiens
gtatgtttttgtgtatttg

SEQ ID NO: 502572 - DNA, 21 bp, Homo sapiens
gtattttagtaagagattcct

SEQ ID NO: 502573 - DNA, 16 bp, Homo sapiens
gtcaaattgtgtgaaa

SEQ ID NO: 502574 - DNA, 15 bp, Homo sapiens
gtcaataaaatccat

SEQ ID NO: 502575 - DNA, 22 bp, Homo sapiens
gtcaataaaatccatacatttg

SEQ ID NO: 502576 - DNA, 23 bp, Homo sapiens
gtcaataaaatccatacatttgt

SEQ ID NO: 502577 - DNA, 13 bp, Homo sapiens
gtcacatgaaaca

SEQ ID NO: 502578 - DNA, 14 bp, Homo sapiens
gtcacctcatggaa

SEQ ID NO: 502579 - DNA, 22 bp, Homo sapiens
gtcacgtggaggagcagtgcag

SEQ ID NO: 502580 - DNA, 14 bp, Homo sapiens
gtcaggaaagagaa

SEQ ID NO: 502581 - DNA, 23 bp, Homo sapiens
gtcagtgtccaaagcagggtctg

SEQ ID NO: 502582 - DNA, 19 bp, Homo sapiens
gtcatccacacaacaccag

SEQ ID NO: 502583 - DNA, 12 bp, Homo sapiens
gtcatcttgagc

SEQ ID NO: 502584 - DNA, 16 bp, Homo sapiens
gtcatgcaaaggctgg

SEQ ID NO: 502585 - DNA, 18 bp, Homo sapiens
gtcatgtgcctctgtcct

SEQ ID NO: 502586 - DNA, 17 bp, Homo sapiens
gtccaaagcagggtctg

SEQ ID NO: 502587 - DNA, 21 bp, Homo sapiens
gtccaagcatttagatgtata

SEQ ID NO: 502588 - DNA, 22 bp, Homo sapiens
gtccaaggaaaccacagctgct

SEQ ID NO: 502589 - DNA, 13 bp, Homo sapiens
gtccacaggaagt

SEQ ID NO: 502590 - DNA, 23 bp, Homo sapiens
gtccacgcccaccagccttgctc

SEQ ID NO: 502591 - DNA, 20 bp, Homo sapiens
gtccagggccctgagctcgg

SEQ ID NO: 502592 - DNA, 18 bp, Homo sapiens
gtccaggggaggccttcc

SEQ ID NO: 502593 - DNA, 16 bp, Homo sapiens
gtccctacacccctcc

SEQ ID NO: 502594 - DNA, 18 bp, Homo sapiens
gtccctgccccagcaaga

SEQ ID NO: 502595 - DNA, 22 bp, Homo sapiens
gtctaaaaataaaatgcattta

SEQ ID NO: 502596 - DNA, 16 bp, Homo sapiens
gtctaaagtttacagt

SEQ ID NO: 502597 - DNA, 17 bp, Homo sapiens
gtctacactaagagaga

SEQ ID NO: 502598 - DNA, 22 bp, Homo sapiens
gtctcactgtgggaaggccagc

SEQ ID NO: 502599 - DNA, 16 bp, Homo sapiens
gtctccttaacactga

SEQ ID NO: 502600 - DNA, 13 bp, Homo sapiens
gtctctgctgccg

SEQ ID NO: 502601 - DNA, 13 bp, Homo sapiens
gtctctggcctgt

SEQ ID NO: 502602 - DNA, 22 bp, Homo sapiens
gtctgaggggcaactgagtctg

SEQ ID NO: 502603 - DNA, 16 bp, Homo sapiens
gtctgccagccagcag

SEQ ID NO: 502604 - DNA, 18 bp, Homo sapiens
gtctgccagccagcagcc

SEQ ID NO: 502605 - DNA, 22 bp, Homo sapiens
gtctgtttccaggtcagaaacc

SEQ ID NO: 502606 - DNA, 20 bp, Homo sapiens
gtgaaactcgttaatttgta

SEQ ID NO: 502607 - DNA, 20 bp, Homo sapiens
gtgaaagcatcacttgggat

SEQ ID NO: 502608 - DNA, 18 bp, Homo sapiens
gtgaagcaccaagctcaa

SEQ ID NO: 502609 - DNA, 15 bp, Homo sapiens
gtgaagtatgcacta

SEQ ID NO: 502610 - DNA, 17 bp, Homo sapiens
gtgaagtatgcactaat

SEQ ID NO: 502611 - DNA, 23 bp, Homo sapiens
gtgactgagcaagaccctgtctc

SEQ ID NO: 502612 - DNA, 22 bp, Homo sapiens
gtgagacactgcacagaagaca

SEQ ID NO: 502613 - DNA, 17 bp, Homo sapiens
gtgagcccatggccctc

SEQ ID NO: 502614 - DNA, 15 bp, Homo sapiens
gtgagttctgttgtg

SEQ ID NO: 502615 - DNA, 12 bp, Homo sapiens
gtgatgcggcag

SEQ ID NO: 502616 - DNA, 20 bp, Homo sapiens
gtgattcacagtgtgaatct

SEQ ID NO: 502617 - DNA, 14 bp, Homo sapiens
gtgatttatttgga

SEQ ID NO: 502618 - DNA, 18 bp, Homo sapiens
gtgcacgcagtggccttc

SEQ ID NO: 502619 - DNA, 22 bp, Homo sapiens
gtgcatgaaggtttctgaaaat

SEQ ID NO: 502620 - DNA, 18 bp, Homo sapiens
gtgcatgcagcatctaag

SEQ ID NO: 502621 - DNA, 23 bp, Homo sapiens
gtgccaacactcaagaagcaggc

SEQ ID NO: 502622 - DNA, 13 bp, Homo sapiens
gtgccccccttgc

SEQ ID NO: 502623 - DNA, 18 bp, Homo sapiens
gtgcctatagtcccagct

SEQ ID NO: 502624 - DNA, 17 bp, Homo sapiens
gtgcctgtacaagctga

SEQ ID NO: 502625 - DNA, 19 bp, Homo sapiens
gtgcctgtacaagctgatg

SEQ ID NO: 502626 - DNA, 13 bp, Homo sapiens
gtgctcagggcta

SEQ ID NO: 502627 - DNA, 21 bp, Homo sapiens
gtgctgcccgtcttcagccta

SEQ ID NO: 502628 - DNA, 20 bp, Homo sapiens
gtgctggatggacagtgggc

SEQ ID NO: 502629 - DNA, 23 bp, Homo sapiens
gtgctggatggacagtgggcatc

SEQ ID NO: 502630 - DNA, 23 bp, Homo sapiens
gtggaactctcctgctcctcagg

SEQ ID NO: 502631 - DNA, 15 bp, Homo sapiens
gtggacaccaggagt

SEQ ID NO: 502632 - DNA, 22 bp, Homo sapiens
gtggacccagggatgacatgtc

SEQ ID NO: 502633 - DNA, 23 bp, Homo sapiens
gtggagcagccaacaagcagggg

SEQ ID NO: 502634 - DNA, 20 bp, Homo sapiens
gtggaggagctcaggacact

SEQ ID NO: 502635 - DNA, 23 bp, Homo sapiens
gtggaggagctcaggacactaat

SEQ ID NO: 502636 - DNA, 15 bp, Homo sapiens
gtggaggaggcctgg

SEQ ID NO: 502637 - DNA, 15 bp, Homo sapiens
gtggctgctgcccag

SEQ ID NO: 502638 - DNA, 16 bp, Homo sapiens
gtggctgctgcccagg

SEQ ID NO: 502639 - DNA, 13 bp, Homo sapiens
gtgggaaggccag

SEQ ID NO: 502640 - DNA, 16 bp, Homo sapiens
gtgggcttcccagtgg

SEQ ID NO: 502641 - DNA, 22 bp, Homo sapiens
gtgggcttcccagtggctgctg

SEQ ID NO: 502642 - DNA, 17 bp, Homo sapiens
gtgggggaagacctggc

SEQ ID NO: 502643 - DNA, 14 bp, Homo sapiens
gtggtggagccagt

SEQ ID NO: 502644 - DNA, 21 bp, Homo sapiens
gtgtcatgattcacccccaaa

SEQ ID NO: 502645 - DNA, 21 bp, Homo sapiens
gtgtctggattcccaggatga

SEQ ID NO: 502646 - DNA, 18 bp, Homo sapiens
gtgtggttgctcacagct

SEQ ID NO: 502647 - DNA, 14 bp, Homo sapiens
gtgtgttatttaaa

SEQ ID NO: 502648 - DNA, 22 bp, Homo sapiens
gttaagttgatggtgatgaaat

SEQ ID NO: 502649 - DNA, 20 bp, Homo sapiens
gttaatgtaatctgatggct

SEQ ID NO: 502650 - DNA, 15 bp, Homo sapiens
gttagaaatgcaaat

SEQ ID NO: 502651 - DNA, 13 bp, Homo sapiens
gttagggaatggc

SEQ ID NO: 502652 - DNA, 13 bp, Homo sapiens
gttatttaaatga

SEQ ID NO: 502653 - DNA, 20 bp, Homo sapiens
gttatttgtacagttcagtt

SEQ ID NO: 502654 - DNA, 13 bp, Homo sapiens
gttcaaaaagaaa

SEQ ID NO: 502655 - DNA, 17 bp, Homo sapiens
gttcagagactcagggc

SEQ ID NO: 502656 - DNA, 23 bp, Homo sapiens
gacttgaggattttgagtatctc

SEQ ID NO: 502657 - DNA, 17 bp, Homo sapiens
gacttttccatgtatct

SEQ ID NO: 502658 - DNA, 18 bp, Homo sapiens
gacttttccatgtatcta

SEQ ID NO: 502659 - DNA, 22 bp, Homo sapiens
gagaaaacttatttgagtgatt

SEQ ID NO: 502660 - DNA, 16 bp, Homo sapiens
gagaaagaggaagctt

SEQ ID NO: 502661 - DNA, 19 bp, Homo sapiens
gagaagctaaaacctgagc

SEQ ID NO: 502662 - DNA, 23 bp, Homo sapiens
gagaaggtgggttttcatcaaga

SEQ ID NO: 502663 - DNA, 13 bp, Homo sapiens
gagaatcagacct

SEQ ID NO: 502664 - DNA, 12 bp, Homo sapiens
gggtaggcggga

SEQ ID NO: 502665 - DNA, 12 bp, Homo sapiens
gggtcaaggaat

SEQ ID NO: 502666 - DNA, 12 bp, Homo sapiens
gggtctctgctg

SEQ ID NO: 502667 - DNA, 21 bp, Homo sapiens
gggtgccccccttgccagaca

SEQ ID NO: 502668 - DNA, 23 bp, Homo sapiens
ggtattgactcaacagtttccag

SEQ ID NO: 502669 - DNA, 14 bp, Homo sapiens
ggtcagagggccca

SEQ ID NO: 502670 - DNA, 16 bp, Homo sapiens
ggtcatagcagtgctt

SEQ ID NO: 502671 - DNA, 12 bp, Homo sapiens
ggtcctggggcc

SEQ ID NO: 502672 - DNA, 13 bp, Homo sapiens
ggtcggaccagct

SEQ ID NO: 502673 - DNA, 15 bp, Homo sapiens
ggtctctaggctggg

SEQ ID NO: 502674 - DNA, 12 bp, Homo sapiens
ggtctctgctgc

SEQ ID NO: 502675 - DNA, 13 bp, Homo sapiens
ggtctctgctgcc

SEQ ID NO: 502676 - DNA, 22 bp, Homo sapiens
ggtctgtgccaaagaagaatcc

SEQ ID NO: 502677 - DNA, 15 bp, Homo sapiens
ggtgatcagcagaga

SEQ ID NO: 502678 - DNA, 19 bp, Homo sapiens
ggtgatggggctgagcagg

SEQ ID NO: 502679 - DNA, 16 bp, Homo sapiens
ggtgccagatcctctt

SEQ ID NO: 502680 - DNA, 15 bp, Homo sapiens
ggtgctccaggcagg

SEQ ID NO: 502681 - DNA, 15 bp, Homo sapiens
ggttagggaggggta

SEQ ID NO: 502682 - DNA, 16 bp, Homo sapiens
ggttcagagactcagg

SEQ ID NO: 502683 - DNA, 21 bp, Homo sapiens
ggttctgatgatgtgcctggg

SEQ ID NO: 502684 - DNA, 23 bp, Homo sapiens
ggttgaccccaatccaacccggg

SEQ ID NO: 502685 - DNA, 16 bp, Homo sapiens
ggttgctcacagctgt

SEQ ID NO: 502686 - DNA, 20 bp, Homo sapiens
ctgcctcccctcctctgctt

SEQ ID NO: 502687 - DNA, 21 bp, Homo sapiens
ctgcctcccctcctctgcttg

SEQ ID NO: 502688 - DNA, 17 bp, Homo sapiens
ctgcctcccttcatgca

SEQ ID NO: 502689 - DNA, 21 bp, Homo sapiens
ctgcctcccttcatgcatgga

SEQ ID NO: 502690 - DNA, 16 bp, Homo sapiens
ctgcctgatggacctg

SEQ ID NO: 502691 - DNA, 18 bp, Homo sapiens
ctgcctgttctgaggatt

SEQ ID NO: 502692 - DNA, 21 bp, Homo sapiens
ctgctagcacttggagccaag

SEQ ID NO: 502693 - DNA, 22 bp, Homo sapiens
ctgctagcacttggagccaagg

SEQ ID NO: 502694 - DNA, 17 bp, Homo sapiens
ctgctatattttcatga

SEQ ID NO: 502695 - DNA, 16 bp, Homo sapiens
ctgctccagcctctgc

SEQ ID NO: 502696 - DNA, 18 bp, Homo sapiens
ctgctccagcctctgccg

SEQ ID NO: 502697 - DNA, 13 bp, Homo sapiens
ctgctcctcagga

SEQ ID NO: 502698 - DNA, 14 bp, Homo sapiens
ctgctcctcaggaa

SEQ ID NO: 502699 - DNA, 12 bp, Homo sapiens
ctgctgcccagg

SEQ ID NO: 502700 - DNA, 19 bp, Homo sapiens
ctgctgccgccccacccag

SEQ ID NO: 502701 - DNA, 20 bp, Homo sapiens
ctgctggtaatttgtatctg

SEQ ID NO: 502702 - DNA, 15 bp, Homo sapiens
ctgcttgccatccct

SEQ ID NO: 502703 - DNA, 20 bp, Homo sapiens
ctgcttgccatccctccctc

SEQ ID NO: 502704 - DNA, 13 bp, Homo sapiens
ctgcttgtcatcc

SEQ ID NO: 502705 - DNA, 21 bp, Homo sapiens
ctggaaatcagggttagtatt

SEQ ID NO: 502706 - DNA, 14 bp, Homo sapiens
ctggaacagattca

SEQ ID NO: 502707 - DNA, 21 bp, Homo sapiens
ctggaacagattcacactgtc

SEQ ID NO: 502708 - DNA, 13 bp, Homo sapiens
ctggaagacagag

SEQ ID NO: 502709 - DNA, 21 bp, Homo sapiens
ctggaagacagagacctcctg

SEQ ID NO: 502710 - DNA, 22 bp, Homo sapiens
ctggaagggctagaacctgtag

SEQ ID NO: 502711 - DNA, 20 bp, Homo sapiens
ctggaatctggagagctaga

SEQ ID NO: 502712 - DNA, 17 bp, Homo sapiens
ctggacacttgctcatg

SEQ ID NO: 502713 - DNA, 19 bp, Homo sapiens
ctggagaactagaacctgg

SEQ ID NO: 502714 - DNA, 23 bp, Homo sapiens
ctggagaactagaacctggaggg

SEQ ID NO: 502715 - DNA, 19 bp, Homo sapiens
ctggagactcctaggcagg

SEQ ID NO: 502716 - DNA, 19 bp, Homo sapiens
ctggagagccagaacctgg

SEQ ID NO: 502717 - DNA, 23 bp, Homo sapiens
ctggagagccagaacctggaggg

SEQ ID NO: 502718 - DNA, 20 bp, Homo sapiens
ctggagagctagaacctgga

SEQ ID NO: 502719 - DNA, 23 bp, Homo sapiens
ctggagagctagaacctggaggg

SEQ ID NO: 502720 - DNA, 16 bp, Homo sapiens
ctggagcctggtgccc

SEQ ID NO: 502721 - DNA, 17 bp, Homo sapiens
ctggagcctggtgccct

SEQ ID NO: 502722 - DNA, 21 bp, Homo sapiens
ctggagggaatgaacctggag

SEQ ID NO: 502723 - DNA, 22 bp, Homo sapiens
ctggagggaatgaacctggagg

SEQ ID NO: 502724 - DNA, 23 bp, Homo sapiens
ctggagggaatgaacctggaggg

SEQ ID NO: 502725 - DNA, 19 bp, Homo sapiens
ctggagggctagaacctgg

SEQ ID NO: 502726 - DNA, 22 bp, Homo sapiens
ctggagggctagaacctggcag

SEQ ID NO: 502727 - DNA, 22 bp, Homo sapiens
ctggagggctagaatctggaga

SEQ ID NO: 502728 - DNA, 20 bp, Homo sapiens
ctggagggctggaatctgga

SEQ ID NO: 502729 - DNA, 23 bp, Homo sapiens
ctggccagggcctggaagacaga

SEQ ID NO: 502730 - DNA, 23 bp, Homo sapiens
ctggccgttgatgttggctggga

SEQ ID NO: 502731 - DNA, 17 bp, Homo sapiens
ctggccttccacttggc

SEQ ID NO: 502732 - DNA, 18 bp, Homo sapiens
ctggcgtcatgcaaagtc

SEQ ID NO: 502733 - DNA, 16 bp, Homo sapiens
ctggcttcgcaaaatg

SEQ ID NO: 502734 - DNA, 13 bp, Homo sapiens
ctgggagccaggg

SEQ ID NO: 502735 - DNA, 23 bp, Homo sapiens
ctgggaggcagaggttgcagtga

SEQ ID NO: 502736 - DNA, 17 bp, Homo sapiens
agggtctgggcaggact

SEQ ID NO: 502737 - DNA, 19 bp, Homo sapiens
agggtgagacactgcacag

SEQ ID NO: 502738 - DNA, 18 bp, Homo sapiens
agggttcagagactcagg

SEQ ID NO: 502739 - DNA, 18 bp, Homo sapiens
aggtacccaaggtcacat

SEQ ID NO: 502740 - DNA, 22 bp, Homo sapiens
aggtatgaccttctaggaagct

SEQ ID NO: 502741 - DNA, 20 bp, Homo sapiens
aggtgagcccatggccctcc

SEQ ID NO: 502742 - DNA, 15 bp, Homo sapiens
aggtgctcattggct

SEQ ID NO: 502743 - DNA, 20 bp, Homo sapiens
aggttagaacctagaagggc

SEQ ID NO: 502744 - DNA, 17 bp, Homo sapiens
aggttatctgtcccagg

SEQ ID NO: 502745 - DNA, 15 bp, Homo sapiens
aggttcatgcccaag

SEQ ID NO: 502746 - DNA, 17 bp, Homo sapiens
aggttgccgtgagccaa

SEQ ID NO: 502747 - DNA, 15 bp, Homo sapiens
aggtttctgaaaatt

SEQ ID NO: 502748 - DNA, 18 bp, Homo sapiens
aggtttctggtctctagg

SEQ ID NO: 502749 - DNA, 14 bp, Homo sapiens
agtaaataaattgt

SEQ ID NO: 502750 - DNA, 19 bp, Homo sapiens
agtaaataaattgtttgac

SEQ ID NO: 502751 - DNA, 18 bp, Homo sapiens
agtaagcacctttagaat

SEQ ID NO: 502752 - DNA, 20 bp, Homo sapiens
agtaagcacctttagaatat

SEQ ID NO: 502753 - DNA, 13 bp, Homo sapiens
agtaatttattgt

SEQ ID NO: 502754 - DNA, 22 bp, Homo sapiens
agtaatttattgtttttccttg

SEQ ID NO: 502755 - DNA, 22 bp, Homo sapiens
agtacctcctgtctctggcctg

SEQ ID NO: 502756 - DNA, 20 bp, Homo sapiens
agtactggctgatggagtaa

SEQ ID NO: 502757 - DNA, 16 bp, Homo sapiens
agtagacgaacagctg

SEQ ID NO: 502758 - DNA, 19 bp, Homo sapiens
agtagataggccatgggca

SEQ ID NO: 502759 - DNA, 15 bp, Homo sapiens
agtagttaattctgt

SEQ ID NO: 502760 - DNA, 14 bp, Homo sapiens
agtatattcaaaaa

SEQ ID NO: 502761 - DNA, 22 bp, Homo sapiens
agtatgcactaatcaatacttt

SEQ ID NO: 502762 - DNA, 15 bp, Homo sapiens
agtattgtccaggtc

SEQ ID NO: 502763 - DNA, 18 bp, Homo sapiens
agtatttctatgaaatat

SEQ ID NO: 502764 - DNA, 17 bp, Homo sapiens
agtcaaattgtgtgaaa

SEQ ID NO: 502765 - DNA, 15 bp, Homo sapiens
agtcacctcatggaa

SEQ ID NO: 502766 - DNA, 15 bp, Homo sapiens
agtcaggaaagagaa

SEQ ID NO: 502767 - DNA, 16 bp, Homo sapiens
agtccaagcatttaga

SEQ ID NO: 502768 - DNA, 21 bp, Homo sapiens
agtccaaggaaaccacagctg

SEQ ID NO: 502769 - DNA, 20 bp, Homo sapiens
agtccacgcccaccagcctt

SEQ ID NO: 502770 - DNA, 20 bp, Homo sapiens
agtcctctgggtaggaatca

SEQ ID NO: 502771 - DNA, 14 bp, Homo sapiens
agtcgttgtgaggg

SEQ ID NO: 502772 - DNA, 23 bp, Homo sapiens
agtctaaagtttacagtaaataa

SEQ ID NO: 502773 - DNA, 16 bp, Homo sapiens
agtctcaataaactga

SEQ ID NO: 502774 - DNA, 16 bp, Homo sapiens
agtctctatcattaaa

SEQ ID NO: 502775 - DNA, 19 bp, Homo sapiens
agtctctatcattaaagtt

SEQ ID NO: 502776 - DNA, 21 bp, Homo sapiens
agtctctatcattaaagttct

SEQ ID NO: 502777 - DNA, 19 bp, Homo sapiens
agtctgatgatttcttgaa

SEQ ID NO: 502778 - DNA, 16 bp, Homo sapiens
agtctgctatattttc

SEQ ID NO: 502779 - DNA, 17 bp, Homo sapiens
agtctgctatattttca

SEQ ID NO: 502780 - DNA, 16 bp, Homo sapiens
agtcttatcaagcagc

SEQ ID NO: 502781 - DNA, 16 bp, Homo sapiens
agtgagatgcattctt

SEQ ID NO: 502782 - DNA, 13 bp, Homo sapiens
agtgatggtcaga

SEQ ID NO: 502783 - DNA, 22 bp, Homo sapiens
agtgcaaattgtcacaggacag

SEQ ID NO: 502784 - DNA, 23 bp, Homo sapiens
agtgcctgtacaagctgatgttt

SEQ ID NO: 502785 - DNA, 21 bp, Homo sapiens
agtggacagagcgcccctccc

SEQ ID NO: 502786 - DNA, 19 bp, Homo sapiens
agtggctgctgcccaggcc

SEQ ID NO: 502787 - DNA, 22 bp, Homo sapiens
agtgggataaaggcccagactc

SEQ ID NO: 502788 - DNA, 19 bp, Homo sapiens
agtgtatgagagggccctg

SEQ ID NO: 502789 - DNA, 14 bp, Homo sapiens
agtgtcaggaggaa

SEQ ID NO: 502790 - DNA, 20 bp, Homo sapiens
agtgtccaaagcagggtctg

SEQ ID NO: 502791 - DNA, 18 bp, Homo sapiens
agtgttggagaagaactg

SEQ ID NO: 502792 - DNA, 14 bp, Homo sapiens
agttcagagctgcc

SEQ ID NO: 502793 - DNA, 16 bp, Homo sapiens
agttcagttcctcttt

SEQ ID NO: 502794 - DNA, 23 bp, Homo sapiens
agttcagttcctctttgcatgga

SEQ ID NO: 502795 - DNA, 16 bp, Homo sapiens
agttccccatgcagac

SEQ ID NO: 502796 - DNA, 13 bp, Homo sapiens
agttctgaagaag

SEQ ID NO: 502797 - DNA, 15 bp, Homo sapiens
agttctgaagaagat

SEQ ID NO: 502798 - DNA, 16 bp, Homo sapiens
agttctgaagaagatg

SEQ ID NO: 502799 - DNA, 22 bp, Homo sapiens
agttctgttgtgtttgtcaaaa

SEQ ID NO: 502800 - DNA, 16 bp, Homo sapiens
agttgaggccaggagt

SEQ ID NO: 502801 - DNA, 17 bp, Homo sapiens
agttgcacggctgctga

SEQ ID NO: 502802 - DNA, 17 bp, Homo sapiens
agttgcatgaccacata

SEQ ID NO: 502803 - DNA, 16 bp, Homo sapiens
agttgctgtccccttc

SEQ ID NO: 502804 - DNA, 14 bp, Homo sapiens
agttgcttgtaaaa

SEQ ID NO: 502805 - DNA, 13 bp, Homo sapiens
agttgtttcattg

SEQ ID NO: 502806 - DNA, 17 bp, Homo sapiens
agtttaagaccagcctg

SEQ ID NO: 502807 - DNA, 20 bp, Homo sapiens
agtttacagtaaataaattg

SEQ ID NO: 502808 - DNA, 15 bp, Homo sapiens
agtttatgtctaaag

SEQ ID NO: 502809 - DNA, 15 bp, Homo sapiens
agtttccttggctgg

SEQ ID NO: 502810 - DNA, 18 bp, Homo sapiens
agtttccttggctggtgc

SEQ ID NO: 502811 - DNA, 19 bp, Homo sapiens
agtttccttggctggtgca

SEQ ID NO: 502812 - DNA, 17 bp, Homo sapiens
agtttctgtcctgctgg

SEQ ID NO: 502813 - DNA, 16 bp, Homo sapiens
agttttatatgcttct

SEQ ID NO: 502814 - DNA, 16 bp, Homo sapiens
ataaaaataaaagaga

SEQ ID NO: 502815 - DNA, 18 bp, Homo sapiens
ataaaacattttcacaca

SEQ ID NO: 502816 - DNA, 19 bp, Homo sapiens
ataaaatccatacatttgt

SEQ ID NO: 502817 - DNA, 15 bp, Homo sapiens
ataaaatgaccagta

SEQ ID NO: 502818 - DNA, 17 bp, Homo sapiens
ataaaattcattccatt

SEQ ID NO: 502819 - DNA, 18 bp, Homo sapiens
ataaaccacaagcatctc

SEQ ID NO: 502820 - DNA, 14 bp, Homo sapiens
ataaacttagaata

SEQ ID NO: 502821 - DNA, 15 bp, Homo sapiens
ataaagagagaaaaa

SEQ ID NO: 502822 - DNA, 18 bp, Homo sapiens
ataaagattatataaaga

SEQ ID NO: 502823 - DNA, 16 bp, Homo sapiens
ataaagcaatgaatac

SEQ ID NO: 502824 - DNA, 20 bp, Homo sapiens
ataaagccttggatgtatat

SEQ ID NO: 502825 - DNA, 17 bp, Homo sapiens
ataaagttggtgacaga

SEQ ID NO: 502826 - DNA, 13 bp, Homo sapiens
ataaattgtttga

SEQ ID NO: 502827 - DNA, 19 bp, Homo sapiens
ataacagtcttactgcagg

SEQ ID NO: 502828 - DNA, 22 bp, Homo sapiens
ataacataagctagaaaaatta

SEQ ID NO: 502829 - DNA, 19 bp, Homo sapiens
ataagagggcacacactgt

SEQ ID NO: 502830 - DNA, 13 bp, Homo sapiens
ataagtactgtgt

SEQ ID NO: 502831 - DNA, 12 bp, Homo sapiens
ataataaaattc

SEQ ID NO: 502832 - DNA, 19 bp, Homo sapiens
ataataaaattcattccat

SEQ ID NO: 502833 - DNA, 21 bp, Homo sapiens
ataataaaattcattccattt

SEQ ID NO: 502834 - DNA, 20 bp, Homo sapiens
ataatatttttaattaaata

SEQ ID NO: 502835 - DNA, 20 bp, Homo sapiens
ataatctactgtacacaatc

SEQ ID NO: 502836 - DNA, 18 bp, Homo sapiens
ataatgggcttagagcag

SEQ ID NO: 502837 - DNA, 13 bp, Homo sapiens
ataatgtttcaaa

SEQ ID NO: 502838 - DNA, 14 bp, Homo sapiens
ataattttgtgaag

SEQ ID NO: 502839 - DNA, 15 bp, Homo sapiens
ataattttgtgaagc

SEQ ID NO: 502840 - DNA, 20 bp, Homo sapiens
ataattttgtgaagcaaaat

SEQ ID NO: 502841 - DNA, 16 bp, Homo sapiens
ataatttttatatttg

SEQ ID NO: 502842 - DNA, 21 bp, Homo sapiens
ataatttttatatttgaaata

SEQ ID NO: 502843 - DNA, 20 bp, Homo sapiens
atacatcccttacctgggaa

SEQ ID NO: 502844 - DNA, 14 bp, Homo sapiens
atactaataaaata

SEQ ID NO: 502845 - DNA, 19 bp, Homo sapiens
atactaataaaatacatac

SEQ ID NO: 502846 - DNA, 11 bp, Homo sapiens
atactgaagat

SEQ ID NO: 502847 - DNA, 21 bp, Homo sapiens
atactttgaacacaaagcctg

SEQ ID NO: 502848 - DNA, 14 bp, Homo sapiens
atagaagaacagca

SEQ ID NO: 502849 - DNA, 20 bp, Homo sapiens
atagctgtgtgaacgtgtat

SEQ ID NO: 502850 - DNA, 13 bp, Homo sapiens
ataggtggcctct

SEQ ID NO: 502851 - DNA, 18 bp, Homo sapiens
ctgggcaacagagcaaga

SEQ ID NO: 502852 - DNA, 22 bp, Homo sapiens
ctgggcaccacctctgtgggca

SEQ ID NO: 502853 - DNA, 19 bp, Homo sapiens
ctgggcagctgcctcccct

SEQ ID NO: 502854 - DNA, 20 bp, Homo sapiens
ctgggcagctgcctcccctc

SEQ ID NO: 502855 - DNA, 20 bp, Homo sapiens
ctgggcagggatgatggcag

SEQ ID NO: 502856 - DNA, 16 bp, Homo sapiens
ctggggacagcaaggg

SEQ ID NO: 502857 - DNA, 19 bp, Homo sapiens
ctggggcctcggagcctca

SEQ ID NO: 502858 - DNA, 20 bp, Homo sapiens
ctggggcctcggagcctcat

SEQ ID NO: 502859 - DNA, 15 bp, Homo sapiens
ctggggctgctggcc

SEQ ID NO: 502860 - DNA, 15 bp, Homo sapiens
ctgggggtgctggat

SEQ ID NO: 502861 - DNA, 21 bp, Homo sapiens
ctggggtaccaagagactcct

SEQ ID NO: 502862 - DNA, 16 bp, Homo sapiens
ctgggtaaatgcagcg

SEQ ID NO: 502863 - DNA, 16 bp, Homo sapiens
ctgggtccaggcctgg

SEQ ID NO: 502864 - DNA, 20 bp, Homo sapiens
ctgggtggcactgccatgca

SEQ ID NO: 502865 - DNA, 17 bp, Homo sapiens
ctgggtgggagcatagg

SEQ ID NO: 502866 - DNA, 21 bp, Homo sapiens
ctggtaatttgtatctgaagg

SEQ ID NO: 502867 - DNA, 22 bp, Homo sapiens
ctggtaatttgtatctgaagga

SEQ ID NO: 502868 - DNA, 14 bp, Homo sapiens
ctggtctctaggct

SEQ ID NO: 502869 - DNA, 22 bp, Homo sapiens
ctgtaaacccctttagtggctt

SEQ ID NO: 502870 - DNA, 18 bp, Homo sapiens
ctgtagcattacagtggg

SEQ ID NO: 502871 - DNA, 13 bp, Homo sapiens
ctgtattttaaaa

SEQ ID NO: 502872 - DNA, 19 bp, Homo sapiens
ctgtattttaaaagaatga

SEQ ID NO: 502873 - DNA, 20 bp, Homo sapiens
ctgtccacacccagctcagc

SEQ ID NO: 502874 - DNA, 18 bp, Homo sapiens
ctgtccagggccctgagc

SEQ ID NO: 502875 - DNA, 13 bp, Homo sapiens
ctgtccccttcca

SEQ ID NO: 502876 - DNA, 13 bp, Homo sapiens
ctgtcctgctggt

SEQ ID NO: 502877 - DNA, 20 bp, Homo sapiens
ctgtctccttaacactgagc

SEQ ID NO: 502878 - DNA, 16 bp, Homo sapiens
ctgtctgccagccagc

SEQ ID NO: 502879 - DNA, 21 bp, Homo sapiens
ctgtctgccagccagcagcca

SEQ ID NO: 502880 - DNA, 21 bp, Homo sapiens
ctgtgatttatttggagtgga

SEQ ID NO: 502881 - DNA, 12 bp, Homo sapiens
ctgtgcacgcag

SEQ ID NO: 502882 - DNA, 17 bp, Homo sapiens
ctgtgcacgcagtggcc

SEQ ID NO: 502883 - DNA, 12 bp, Homo sapiens
ctgtgcagagac

SEQ ID NO: 502884 - DNA, 13 bp, Homo sapiens
ctgtgcagagact

SEQ ID NO: 502885 - DNA, 20 bp, Homo sapiens
ctgtgctgcccgtcttcagc

SEQ ID NO: 502886 - DNA, 16 bp, Homo sapiens
ctgtgggaaggccagc

SEQ ID NO: 502887 - DNA, 18 bp, Homo sapiens
ctgtgggaaggccagctg

SEQ ID NO: 502888 - DNA, 15 bp, Homo sapiens
ctgtgggccagattg

SEQ ID NO: 502889 - DNA, 18 bp, Homo sapiens
ctgtgtgactcaaaccaa

SEQ ID NO: 502890 - DNA, 19 bp, Homo sapiens
ctgtgtgttgccaggcagg

SEQ ID NO: 502891 - DNA, 22 bp, Homo sapiens
ctgtgttcttgccactgcactc

SEQ ID NO: 502892 - DNA, 14 bp, Homo sapiens
ctgttaagagagga

SEQ ID NO: 502893 - DNA, 17 bp, Homo sapiens
ctgttgtgtttgtcaaa

SEQ ID NO: 502894 - DNA, 14 bp, Homo sapiens
ctgttttataattt

SEQ ID NO: 502895 - DNA, 14 bp, Homo sapiens
cttaaacaaatgta

SEQ ID NO: 502896 - DNA, 23 bp, Homo sapiens
cttaacaaaccctcgtttctgat

SEQ ID NO: 502897 - DNA, 23 bp, Homo sapiens
cttaagaagactgcattatattt

SEQ ID NO: 502898 - DNA, 18 bp, Homo sapiens
cttaagaattttgagcag

SEQ ID NO: 502899 - DNA, 19 bp, Homo sapiens
cttaagacaaatgggactg

SEQ ID NO: 502900 - DNA, 22 bp, Homo sapiens
cttaagacaaatgggactgatg

SEQ ID NO: 502901 - DNA, 14 bp, Homo sapiens
cttacagctgggtg

SEQ ID NO: 502902 - DNA, 12 bp, Homo sapiens
cttagacctcag

SEQ ID NO: 502903 - DNA, 13 bp, Homo sapiens
cttagacctcagc

SEQ ID NO: 502904 - DNA, 14 bp, Homo sapiens
cttagacctcagcc

SEQ ID NO: 502905 - DNA, 19 bp, Homo sapiens
cttagatgcagttctgaag

SEQ ID NO: 502906 - DNA, 18 bp, Homo sapiens
cttagcttagacctcagc

SEQ ID NO: 502907 - DNA, 18 bp, Homo sapiens
cttagctttgctctgcca

SEQ ID NO: 502908 - DNA, 24 bp, Homo sapiens
cttaggcaccatagaagaacagca

SEQ ID NO: 502909 - DNA, 17 bp, Homo sapiens
cttaggcatgcacagct

SEQ ID NO: 502910 - DNA, 13 bp, Homo sapiens
cttatttattatt

SEQ ID NO: 502911 - DNA, 20 bp, Homo sapiens
cttcaataaaccacaagcat

SEQ ID NO: 502912 - DNA, 17 bp, Homo sapiens
cttcacacacaggcaac

SEQ ID NO: 502913 - DNA, 20 bp, Homo sapiens
cttcacctttcccactttct

SEQ ID NO: 502914 - DNA, 12 bp, Homo sapiens
cttcagagctga

SEQ ID NO: 502915 - DNA, 14 bp, Homo sapiens
cttcagagctgaca

SEQ ID NO: 502916 - DNA, 20 bp, Homo sapiens
cttcagcctagccgacctca

SEQ ID NO: 502917 - DNA, 22 bp, Homo sapiens
cttcagcctagccgacctcagc

SEQ ID NO: 502918 - DNA, 16 bp, Homo sapiens
cttcagcggtttatat

SEQ ID NO: 502919 - DNA, 14 bp, Homo sapiens
cttcagttgttttc

SEQ ID NO: 502920 - DNA, 17 bp, Homo sapiens
cttcagttgttttcccg

SEQ ID NO: 502921 - DNA, 16 bp, Homo sapiens
cttcattctcactctg

SEQ ID NO: 502922 - DNA, 22 bp, Homo sapiens
cttccagggacgaagaagagcc

SEQ ID NO: 502923 - DNA, 19 bp, Homo sapiens
cttccaggggtcaccttga

SEQ ID NO: 502924 - DNA, 14 bp, Homo sapiens
cttccatttggaat

SEQ ID NO: 502925 - DNA, 11 bp, Homo sapiens
cttcccagctt

SEQ ID NO: 502926 - DNA, 14 bp, Homo sapiens
cttcccagtggctg

SEQ ID NO: 502927 - DNA, 23 bp, Homo sapiens
gaaaatgctgtattagtcacaga

SEQ ID NO: 502928 - DNA, 22 bp, Homo sapiens
gaaacactgggcttctagaacc

SEQ ID NO: 502929 - DNA, 15 bp, Homo sapiens
gaaacataaataaaa

SEQ ID NO: 502930 - DNA, 19 bp, Homo sapiens
gaaaccattgttcagaaga

SEQ ID NO: 502931 - DNA, 23 bp, Homo sapiens
gaaacttcagcggtttatataag

SEQ ID NO: 502932 - DNA, 23 bp, Homo sapiens
gaaagaaagttgcacggctgctg

SEQ ID NO: 502933 - DNA, 16 bp, Homo sapiens
gaaagacagagctggg

SEQ ID NO: 502934 - DNA, 19 bp, Homo sapiens
gaaagtcagacctgtttct

SEQ ID NO: 502935 - DNA, 18 bp, Homo sapiens
gaaagttgcacggctgct

SEQ ID NO: 502936 - DNA, 19 bp, Homo sapiens
gaaagttgcacggctgctg

SEQ ID NO: 502937 - DNA, 20 bp, Homo sapiens
gaaagttgcacggctgctga

SEQ ID NO: 502938 - DNA, 17 bp, Homo sapiens
gaaatatacacacagca

SEQ ID NO: 502939 - DNA, 16 bp, Homo sapiens
gaaatattatgttaaa

SEQ ID NO: 502940 - DNA, 19 bp, Homo sapiens
gaaatcttacagctgggtg

SEQ ID NO: 502941 - DNA, 19 bp, Homo sapiens
gaacaagttgtttcattga

SEQ ID NO: 502942 - DNA, 20 bp, Homo sapiens
gaacactgggggaggggaca

SEQ ID NO: 502943 - DNA, 24 bp, Homo sapiens
gaacagttacctctgcctcagaaa

SEQ ID NO: 502944 - DNA, 15 bp, Homo sapiens
gaacatacagacaca

SEQ ID NO: 502945 - DNA, 21 bp, Homo sapiens
gaacatcatcaaggcactgcc

SEQ ID NO: 502946 - DNA, 17 bp, Homo sapiens
gaacatctgtcctgtga

SEQ ID NO: 502947 - DNA, 15 bp, Homo sapiens
gaaccacaagactgc

SEQ ID NO: 502948 - DNA, 12 bp, Homo sapiens
gaaccatcagaa

SEQ ID NO: 502949 - DNA, 12 bp, Homo sapiens
gaacctggagag

SEQ ID NO: 502950 - DNA, 16 bp, Homo sapiens
gaacctggagggctag

SEQ ID NO: 502951 - DNA, 21 bp, Homo sapiens
gaacctggagggctggaatct

SEQ ID NO: 502952 - DNA, 13 bp, Homo sapiens
gaacctggagggg

SEQ ID NO: 502953 - DNA, 15 bp, Homo sapiens
gaacctgtagagcta

SEQ ID NO: 502954 - DNA, 17 bp, Homo sapiens
gaactatgggagcctca

SEQ ID NO: 502955 - DNA, 15 bp, Homo sapiens
gaactcctaaatcaa

SEQ ID NO: 502956 - DNA, 13 bp, Homo sapiens
gaactgaaatcat

SEQ ID NO: 502957 - DNA, 22 bp, Homo sapiens
gaacttccagatcctggaaatc

SEQ ID NO: 502958 - DNA, 17 bp, Homo sapiens
gaacttggaggcaccat

SEQ ID NO: 502959 - DNA, 24 bp, Homo sapiens
gaactttccacattcagagcttac

SEQ ID NO: 502960 - DNA, 16 bp, Homo sapiens
gaagaaacatttatct

SEQ ID NO: 502961 - DNA, 21 bp, Homo sapiens
gaagaagcaccaatcatgaat

SEQ ID NO: 502962 - DNA, 12 bp, Homo sapiens
tcttctaccaga

SEQ ID NO: 502963 - DNA, 23 bp, Homo sapiens
tcttctgtgattcggtggagact

SEQ ID NO: 502964 - DNA, 17 bp, Homo sapiens
tcttggttggctggcct

SEQ ID NO: 502965 - DNA, 17 bp, Homo sapiens
tctttaacagctttctc

SEQ ID NO: 502966 - DNA, 19 bp, Homo sapiens
tctttccacagaagctcca

SEQ ID NO: 502967 - DNA, 14 bp, Homo sapiens
tctttgccaccctc

SEQ ID NO: 502968 - DNA, 17 bp, Homo sapiens
tctttgccaccctcatg

SEQ ID NO: 502969 - DNA, 21 bp, Homo sapiens
tgaaaaggactcttgagccct

SEQ ID NO: 502970 - DNA, 20 bp, Homo sapiens
tgaaaatgcaacaacatgta

SEQ ID NO: 502971 - DNA, 21 bp, Homo sapiens
tgaaaatgcaacaacatgtat

SEQ ID NO: 502972 - DNA, 13 bp, Homo sapiens
tgaaacacaaaca

SEQ ID NO: 502973 - DNA, 20 bp, Homo sapiens
tgaaacacaaacaatagtaa

SEQ ID NO: 502974 - DNA, 19 bp, Homo sapiens
tgaaacctgttctaccaat

SEQ ID NO: 502975 - DNA, 21 bp, Homo sapiens
tgaaactccaccttgcgggga

SEQ ID NO: 502976 - DNA, 19 bp, Homo sapiens
tgaaactcgttaatttgta

SEQ ID NO: 502977 - DNA, 15 bp, Homo sapiens
tgaaaggtacttcaa

SEQ ID NO: 502978 - DNA, 13 bp, Homo sapiens
tgaaataagagaa

SEQ ID NO: 502979 - DNA, 16 bp, Homo sapiens
tgaaatatacacacag

SEQ ID NO: 502980 - DNA, 20 bp, Homo sapiens
tgaaattttctagaatacta

SEQ ID NO: 502981 - DNA, 20 bp, Homo sapiens
tgaacaactcgaatcactca

SEQ ID NO: 502982 - DNA, 15 bp, Homo sapiens
tgaacacaaagcctg

SEQ ID NO: 502983 - DNA, 16 bp, Homo sapiens
tgaactttgctgagcc

SEQ ID NO: 502984 - DNA, 11 bp, Homo sapiens
tgaagaagaga

SEQ ID NO: 502985 - DNA, 22 bp, Homo sapiens
tgaagaagcaccaatcatgaat

SEQ ID NO: 502986 - DNA, 19 bp, Homo sapiens
tgaagaggaaaatgaataa

SEQ ID NO: 502987 - DNA, 21 bp, Homo sapiens
tgaagatccccaactgctcca

SEQ ID NO: 502988 - DNA, 17 bp, Homo sapiens
tgaagatttaccacttg

SEQ ID NO: 502989 - DNA, 14 bp, Homo sapiens
tgaagctgcagtga

SEQ ID NO: 502990 - DNA, 14 bp, Homo sapiens
tgaaggcaatgcca

SEQ ID NO: 502991 - DNA, 18 bp, Homo sapiens
tgaaggtttctgaaaatt

SEQ ID NO: 502992 - DNA, 14 bp, Homo sapiens
tgaagtaagcaaag

SEQ ID NO: 502993 - DNA, 21 bp, Homo sapiens
tgaagtttccttggctggtgc

SEQ ID NO: 502994 - DNA, 15 bp, Homo sapiens
tgaatgcataaaatg

SEQ ID NO: 502995 - DNA, 18 bp, Homo sapiens
tgaatgggaaaagagatg

SEQ ID NO: 502996 - DNA, 15 bp, Homo sapiens
tgaattacatttgta

SEQ ID NO: 502997 - DNA, 16 bp, Homo sapiens
tgaattacatttgtat

SEQ ID NO: 502998 - DNA, 21 bp, Homo sapiens
tgaattagaaacataaataaa

SEQ ID NO: 502999 - DNA, 21 bp, Homo sapiens
tgaatttctatggcatattga

SEQ ID NO: 503000 - DNA, 22 bp, Homo sapiens
tgacaactgaagagacacgtgg

SEQ ID NO: 503001 - DNA, 15 bp, Homo sapiens
tgacaagctcacaga

SEQ ID NO: 503002 - DNA, 16 bp, Homo sapiens
tgacacaggatgaagg

SEQ ID NO: 503003 - DNA, 15 bp, Homo sapiens
tgacattcatgcctg

SEQ ID NO: 503004 - DNA, 17 bp, Homo sapiens
tgacattcatgcctggc

SEQ ID NO: 503005 - DNA, 21 bp, Homo sapiens
tgacatttatttttctcatga

SEQ ID NO: 503006 - DNA, 12 bp, Homo sapiens
tgaccacataga

SEQ ID NO: 503007 - DNA, 20 bp, Homo sapiens
tgaccagtttaacctgatgc

SEQ ID NO: 503008 - DNA, 23 bp, Homo sapiens
tgaccagtttaacctgatgcagt

SEQ ID NO: 503009 - DNA, 16 bp, Homo sapiens
tgacctgcctcccttc

SEQ ID NO: 503010 - DNA, 16 bp, Homo sapiens
tgactcttaagaagac

SEQ ID NO: 503011 - DNA, 15 bp, Homo sapiens
tgactgagcttccct

SEQ ID NO: 503012 - DNA, 13 bp, Homo sapiens
tgactgtgattta

SEQ ID NO: 503013 - DNA, 14 bp, Homo sapiens
tgactgtgatttat

SEQ ID NO: 503014 - DNA, 16 bp, Homo sapiens
tgactttggctgcatg

SEQ ID NO: 503015 - DNA, 18 bp, Homo sapiens
tgacttttccatgtatct

SEQ ID NO: 503016 - DNA, 15 bp, Homo sapiens
tgagacactgcacag

SEQ ID NO: 503017 - DNA, 21 bp, Homo sapiens
tgagactatgcaaaagtacaa

SEQ ID NO: 503018 - DNA, 21 bp, Homo sapiens
tgagagacacactgaagaagc

SEQ ID NO: 503019 - DNA, 14 bp, Homo sapiens
tgagagaccaggca

SEQ ID NO: 503020 - DNA, 15 bp, Homo sapiens
tgagaggcatgacag

SEQ ID NO: 503021 - DNA, 19 bp, Homo sapiens
tgagaggctgaggtgggca

SEQ ID NO: 503022 - DNA, 16 bp, Homo sapiens
tgagagggccctgcct

SEQ ID NO: 503023 - DNA, 18 bp, Homo sapiens
tgagatatttttacctgc

SEQ ID NO: 503024 - DNA, 22 bp, Homo sapiens
tgagatgtagcaaattccaata

SEQ ID NO: 503025 - DNA, 15 bp, Homo sapiens
tgagcagtcaggaaa

SEQ ID NO: 503026 - DNA, 17 bp, Homo sapiens
tgagcagtcaggaaaga

SEQ ID NO: 503027 - DNA, 18 bp, Homo sapiens
tgagcatggagctggccg

SEQ ID NO: 503028 - DNA, 20 bp, Homo sapiens
tgagcctctttaacagcttt

SEQ ID NO: 503029 - DNA, 14 bp, Homo sapiens
tgagctcggtggac

SEQ ID NO: 503030 - DNA, 20 bp, Homo sapiens
tgagctcggtggacccaggg

SEQ ID NO: 503031 - DNA, 15 bp, Homo sapiens
tgaggaggaagcaga

SEQ ID NO: 503032 - DNA, 17 bp, Homo sapiens
tgaggaggaagcagaat

SEQ ID NO: 503033 - DNA, 14 bp, Homo sapiens
aggagattttcctt

SEQ ID NO: 503034 - DNA, 15 bp, Homo sapiens
aggagcaaaggctga

SEQ ID NO: 503035 - DNA, 19 bp, Homo sapiens
aggagcagcctcagaacaa

SEQ ID NO: 503036 - DNA, 16 bp, Homo sapiens
aggagcagcttcagtt

SEQ ID NO: 503037 - DNA, 14 bp, Homo sapiens
aggaggccacgtga

SEQ ID NO: 503038 - DNA, 13 bp, Homo sapiens
aggaggctgaggt

SEQ ID NO: 503039 - DNA, 15 bp, Homo sapiens
aggatccctctctgg

SEQ ID NO: 503040 - DNA, 21 bp, Homo sapiens
aggatgtgggggaagacctgg

SEQ ID NO: 503041 - DNA, 15 bp, Homo sapiens
actggagccatgggc

SEQ ID NO: 503042 - DNA, 20 bp, Homo sapiens
actggcttctgcttgtcatc

SEQ ID NO: 503043 - DNA, 18 bp, Homo sapiens
actggggtcctggggcct

SEQ ID NO: 503044 - DNA, 20 bp, Homo sapiens
actggggtcctggggcctcg

SEQ ID NO: 503045 - DNA, 15 bp, Homo sapiens
actgggttcaaaaag

SEQ ID NO: 503046 - DNA, 19 bp, Homo sapiens
actgggttcaaaaagaaaa

SEQ ID NO: 503047 - DNA, 12 bp, Homo sapiens
actggtgggcca

SEQ ID NO: 503048 - DNA, 22 bp, Homo sapiens
actgtaagaaaatatcacttgt

SEQ ID NO: 503049 - DNA, 16 bp, Homo sapiens
actgtcaaagaatcaa

SEQ ID NO: 503050 - DNA, 17 bp, Homo sapiens
actgtgatttatttgga

SEQ ID NO: 503051 - DNA, 18 bp, Homo sapiens
actgtgggtagacacaca

SEQ ID NO: 503052 - DNA, 23 bp, Homo sapiens
actgtgtacagtaaatggcttat

SEQ ID NO: 503053 - DNA, 16 bp, Homo sapiens
actgttcaagagcaca

SEQ ID NO: 503054 - DNA, 16 bp, Homo sapiens
acttaagaaacactga

SEQ ID NO: 503055 - DNA, 15 bp, Homo sapiens
acttaagacaaatgg

SEQ ID NO: 503056 - DNA, 23 bp, Homo sapiens
acttaagacaaatgggactgatg

SEQ ID NO: 503057 - DNA, 13 bp, Homo sapiens
acttaatgaatga

SEQ ID NO: 503058 - DNA, 15 bp, Homo sapiens
acttagaataaaatt

SEQ ID NO: 503059 - DNA, 16 bp, Homo sapiens
acttagaataaaattg

SEQ ID NO: 503060 - DNA, 18 bp, Homo sapiens
acttagaataaaattgta

SEQ ID NO: 503061 - DNA, 17 bp, Homo sapiens
acttcaaatccttgaag

SEQ ID NO: 503062 - DNA, 11 bp, Homo sapiens
acttccatttg

SEQ ID NO: 503063 - DNA, 22 bp, Homo sapiens
acttccatttggaatcatatgg

SEQ ID NO: 503064 - DNA, 11 bp, Homo sapiens
acttcccagct

SEQ ID NO: 503065 - DNA, 11 bp, Homo sapiens
acttctcttct

SEQ ID NO: 503066 - DNA, 16 bp, Homo sapiens
acttctcttctgagcc

SEQ ID NO: 503067 - DNA, 20 bp, Homo sapiens
acttgacagaacactgtctt

SEQ ID NO: 503068 - DNA, 15 bp, Homo sapiens
acttgagggtaataa

SEQ ID NO: 503069 - DNA, 19 bp, Homo sapiens
acttgagggtaataaactt

SEQ ID NO: 503070 - DNA, 17 bp, Homo sapiens
acttggctacacaggga

SEQ ID NO: 503071 - DNA, 20 bp, Homo sapiens
acttgtaaatgtggtaaaga

SEQ ID NO: 503072 - DNA, 15 bp, Homo sapiens
acttgtcaataaaat

SEQ ID NO: 503073 - DNA, 18 bp, Homo sapiens
acttgtgccaacactcaa

SEQ ID NO: 503074 - DNA, 16 bp, Homo sapiens
acttgtgttttgcaag

SEQ ID NO: 503075 - DNA, 20 bp, Homo sapiens
acctggagggctagaacctg

SEQ ID NO: 503076 - DNA, 22 bp, Homo sapiens
acctggagggctagaacctggc

SEQ ID NO: 503077 - DNA, 21 bp, Homo sapiens
acctgggcatactaataaagt

SEQ ID NO: 503078 - DNA, 18 bp, Homo sapiens
acctggggctgctggcct

SEQ ID NO: 503079 - DNA, 20 bp, Homo sapiens
acctggggctgctggcctga

SEQ ID NO: 503080 - DNA, 12 bp, Homo sapiens
acctgtcaatac

SEQ ID NO: 503081 - DNA, 21 bp, Homo sapiens
accttgaacactgggggaggg

SEQ ID NO: 503082 - DNA, 13 bp, Homo sapiens
acctttagaatat

SEQ ID NO: 503083 - DNA, 17 bp, Homo sapiens
acctttagaatattaaa

SEQ ID NO: 503084 - DNA, 16 bp, Homo sapiens
acctttcagctgtgaa

SEQ ID NO: 503085 - DNA, 20 bp, Homo sapiens
accttttggtctggagggaa

SEQ ID NO: 503086 - DNA, 17 bp, Homo sapiens
acgaagaagagccacag

SEQ ID NO: 503087 - DNA, 14 bp, Homo sapiens
acgacaaggaaagg

SEQ ID NO: 503088 - DNA, 15 bp, Homo sapiens
acgcacacacacata

SEQ ID NO: 503089 - DNA, 16 bp, Homo sapiens
acgcacgcacacacac

SEQ ID NO: 503090 - DNA, 14 bp, Homo sapiens
acgccactgcactc

SEQ ID NO: 503091 - DNA, 16 bp, Homo sapiens
acgcccaccagccttg

SEQ ID NO: 503092 - DNA, 17 bp, Homo sapiens
acgcccaccagccttgc

SEQ ID NO: 503093 - DNA, 21 bp, Homo sapiens
acgcccaccagccttgctctc

SEQ ID NO: 503094 - DNA, 18 bp, Homo sapiens
acggtgctccaggcaggc

SEQ ID NO: 503095 - DNA, 22 bp, Homo sapiens
acggtgctccaggcaggctaag

SEQ ID NO: 503096 - DNA, 20 bp, Homo sapiens
acgtatgtttttgtgtattt

SEQ ID NO: 503097 - DNA, 14 bp, Homo sapiens
acgtgacaacacaa

SEQ ID NO: 503098 - DNA, 16 bp, Homo sapiens
acgtgagatcattcac

SEQ ID NO: 503099 - DNA, 18 bp, Homo sapiens
acgtgatggtctgagact

SEQ ID NO: 503100 - DNA, 15 bp, Homo sapiens
actaagagagaatga

SEQ ID NO: 503101 - DNA, 12 bp, Homo sapiens
actaataaaata

SEQ ID NO: 503102 - DNA, 13 bp, Homo sapiens
actaataaaatac

SEQ ID NO: 503103 - DNA, 15 bp, Homo sapiens
actaataaaatacat

SEQ ID NO: 503104 - DNA, 21 bp, Homo sapiens
actaataaaatacatactata

SEQ ID NO: 503105 - DNA, 16 bp, Homo sapiens
actaatcaatactttg

SEQ ID NO: 503106 - DNA, 19 bp, Homo sapiens
actaatccaatacctcttg

SEQ ID NO: 503107 - DNA, 21 bp, Homo sapiens
actaatccaatacctcttgga

SEQ ID NO: 503108 - DNA, 17 bp, Homo sapiens
actacaatttaaagcaa

SEQ ID NO: 503109 - DNA, 23 bp, Homo sapiens
actagaacctggagggctagaac

SEQ ID NO: 503110 - DNA, 19 bp, Homo sapiens
actagactcccaagctgga

SEQ ID NO: 503111 - DNA, 14 bp, Homo sapiens
actagaggccaggg

SEQ ID NO: 503112 - DNA, 15 bp, Homo sapiens
actagaggccaggga

SEQ ID NO: 503113 - DNA, 16 bp, Homo sapiens
actagctctttgagat

SEQ ID NO: 503114 - DNA, 19 bp, Homo sapiens
actagtatttctatgaaat

SEQ ID NO: 503115 - DNA, 15 bp, Homo sapiens
actatattgtacaca

SEQ ID NO: 503116 - DNA, 16 bp, Homo sapiens
actatctcatttccaa

SEQ ID NO: 503117 - DNA, 17 bp, Homo sapiens
actatctcatttccaag

SEQ ID NO: 503118 - DNA, 13 bp, Homo sapiens
actatctgctttt

SEQ ID NO: 503119 - DNA, 16 bp, Homo sapiens
actatgatttggaaaa

SEQ ID NO: 503120 - DNA, 16 bp, Homo sapiens
actatgcaaaagtaca

SEQ ID NO: 503121 - DNA, 13 bp, Homo sapiens
actatgttgataa

SEQ ID NO: 503122 - DNA, 14 bp, Homo sapiens
actcaagaagcagg

SEQ ID NO: 503123 - DNA, 21 bp, Homo sapiens
actcaatattttccatgaaaa

SEQ ID NO: 503124 - DNA, 21 bp, Homo sapiens
actcaatgttactatctgctt

SEQ ID NO: 503125 - DNA, 16 bp, Homo sapiens
actcacatggctatgt

SEQ ID NO: 503126 - DNA, 23 bp, Homo sapiens
actcacctggggctgctggcctg

SEQ ID NO: 503127 - DNA, 19 bp, Homo sapiens
actcaggaggctgaggcag

SEQ ID NO: 503128 - DNA, 13 bp, Homo sapiens
actcagggcccca

SEQ ID NO: 503129 - DNA, 22 bp, Homo sapiens
actcagggccccagcactaaag

SEQ ID NO: 503130 - DNA, 15 bp, Homo sapiens
actcatacatctggc

SEQ ID NO: 503131 - DNA, 14 bp, Homo sapiens
actcatgagaagtt

SEQ ID NO: 503132 - DNA, 15 bp, Homo sapiens
actcatgggtaataa

SEQ ID NO: 503133 - DNA, 18 bp, Homo sapiens
actccagaaagtgacaag

SEQ ID NO: 503134 - DNA, 15 bp, Homo sapiens
actcccaagctggac

SEQ ID NO: 503135 - DNA, 13 bp, Homo sapiens
actcccaggcagc

SEQ ID NO: 503136 - DNA, 14 bp, Homo sapiens
actcctcttatttg

SEQ ID NO: 503137 - DNA, 17 bp, Homo sapiens
actccttgagagaccag

SEQ ID NO: 503138 - DNA, 18 bp, Homo sapiens
actccttgagagaccagg

SEQ ID NO: 503139 - DNA, 14 bp, Homo sapiens
actctcctctgcct

SEQ ID NO: 503140 - DNA, 16 bp, Homo sapiens
actctcctctgcctca

SEQ ID NO: 503141 - DNA, 18 bp, Homo sapiens
actctgccctactcactc

SEQ ID NO: 503142 - DNA, 14 bp, Homo sapiens
actcttaagaagac

SEQ ID NO: 503143 - DNA, 20 bp, Homo sapiens
actcttaagaagactgcatt

SEQ ID NO: 503144 - DNA, 21 bp, Homo sapiens
actcttgagccctcctggaat

SEQ ID NO: 503145 - DNA, 15 bp, Homo sapiens
actgaaatatacaca

SEQ ID NO: 503146 - DNA, 16 bp, Homo sapiens
actgaaatatacacac

SEQ ID NO: 503147 - DNA, 16 bp, Homo sapiens
actgaactttgctgag

SEQ ID NO: 503148 - DNA, 19 bp, Homo sapiens
actgaactttgctgagcct

SEQ ID NO: 503149 - DNA, 12 bp, Homo sapiens
actgaagaagca

SEQ ID NO: 503150 - DNA, 22 bp, Homo sapiens
actgaagaagcaccaatcatga

SEQ ID NO: 503151 - DNA, 13 bp, Homo sapiens
actgaatttctat

SEQ ID NO: 503152 - DNA, 14 bp, Homo sapiens
actgactcttaaga

SEQ ID NO: 503153 - DNA, 16 bp, Homo sapiens
actgactcttaagaag

SEQ ID NO: 503154 - DNA, 20 bp, Homo sapiens
actgactcttaagaagactg

SEQ ID NO: 503155 - DNA, 19 bp, Homo sapiens
actgaggcagacagcagct

SEQ ID NO: 503156 - DNA, 22 bp, Homo sapiens
actgaggcagacagcagctcag

SEQ ID NO: 503157 - DNA, 19 bp, Homo sapiens
actgatatgggtcttgata

SEQ ID NO: 503158 - DNA, 19 bp, Homo sapiens
actgatgtcatcttgagct

SEQ ID NO: 503159 - DNA, 20 bp, Homo sapiens
actgcaacttgtaaatgtgg

SEQ ID NO: 503160 - DNA, 17 bp, Homo sapiens
actgcactccagcctgg

SEQ ID NO: 503161 - DNA, 19 bp, Homo sapiens
actgcactccagcctgggc

SEQ ID NO: 503162 - DNA, 16 bp, Homo sapiens
actgccagtctcactg

SEQ ID NO: 503163 - DNA, 13 bp, Homo sapiens
actgccttctcaa

SEQ ID NO: 503164 - DNA, 20 bp, Homo sapiens
actgccttctcaactccaaa

SEQ ID NO: 503165 - DNA, 12 bp, Homo sapiens
actgctccagcc

SEQ ID NO: 503166 - DNA, 14 bp, Homo sapiens
actgctccagcctc

SEQ ID NO: 503167 - DNA, 16 bp, Homo sapiens
actgctccagcctctg

SEQ ID NO: 503168 - DNA, 17 bp, Homo sapiens
actgctccagcctctgc

SEQ ID NO: 503169 - DNA, 19 bp, Homo sapiens
actgctccagcctctgccg

SEQ ID NO: 503170 - DNA, 16 bp, Homo sapiens
actgcttgtgttttta

SEQ ID NO: 503171 - DNA, 18 bp, Homo sapiens
actgcttgtgtttttaac

SEQ ID NO: 503172 - DNA, 18 bp, Homo sapiens
actggagaattgaaaagg

SEQ ID NO: 503173 - DNA, 17 bp, Homo sapiens
actggagaggctagaac

SEQ ID NO: 503174 - DNA, 13 bp, Homo sapiens
tctcctgggcagc

SEQ ID NO: 503175 - DNA, 16 bp, Homo sapiens
tctcctgggcagctgc

SEQ ID NO: 503176 - DNA, 14 bp, Homo sapiens
tctctaggctgggg

SEQ ID NO: 503177 - DNA, 13 bp, Homo sapiens
tctctgctgccgc

SEQ ID NO: 503178 - DNA, 14 bp, Homo sapiens
tctctggatgcctg

SEQ ID NO: 503179 - DNA, 15 bp, Homo sapiens
tctcttcaataaacc

SEQ ID NO: 503180 - DNA, 17 bp, Homo sapiens
tctcttcaataaaccac

SEQ ID NO: 503181 - DNA, 14 bp, Homo sapiens
tctctttggtttct

SEQ ID NO: 503182 - DNA, 13 bp, Homo sapiens
tctgaagcctcac

SEQ ID NO: 503183 - DNA, 19 bp, Homo sapiens
tctgaaggagattttcctt

SEQ ID NO: 503184 - DNA, 23 bp, Homo sapiens
tctgaccagtttaacctgatgca

SEQ ID NO: 503185 - DNA, 21 bp, Homo sapiens
tctgactgtttccatcaaggg

SEQ ID NO: 503186 - DNA, 13 bp, Homo sapiens
tctgagaactcat

SEQ ID NO: 503187 - DNA, 20 bp, Homo sapiens
tctgagattattttaatcta

SEQ ID NO: 503188 - DNA, 15 bp, Homo sapiens
tctgagtctcttgga

SEQ ID NO: 503189 - DNA, 16 bp, Homo sapiens
tctgatgcaagcaaga

SEQ ID NO: 503190 - DNA, 13 bp, Homo sapiens
tctgccgctgcca

SEQ ID NO: 503191 - DNA, 15 bp, Homo sapiens
tctgccgctgccatg

SEQ ID NO: 503192 - DNA, 13 bp, Homo sapiens
tctgcctttttta

SEQ ID NO: 503193 - DNA, 21 bp, Homo sapiens
tctgctgccgccccacccaga

SEQ ID NO: 503194 - DNA, 11 bp, Homo sapiens
tctgcttgcca

SEQ ID NO: 503195 - DNA, 20 bp, Homo sapiens
tctgcttgccatccctccct

SEQ ID NO: 503196 - DNA, 23 bp, Homo sapiens
tctgcttgccatccctccctcca

SEQ ID NO: 503197 - DNA, 14 bp, Homo sapiens
tctggacacttgct

SEQ ID NO: 503198 - DNA, 16 bp, Homo sapiens
tctggagggaaacacc

SEQ ID NO: 503199 - DNA, 13 bp, Homo sapiens
tctggattcccag

SEQ ID NO: 503200 - DNA, 11 bp, Homo sapiens
tctggccaggc

SEQ ID NO: 503201 - DNA, 21 bp, Homo sapiens
tctgggcaccacctctgtggg

SEQ ID NO: 503202 - DNA, 20 bp, Homo sapiens
tctgggcaggactcagctcc

SEQ ID NO: 503203 - DNA, 17 bp, Homo sapiens
tctggtctctaggctgg

SEQ ID NO: 503204 - DNA, 21 bp, Homo sapiens
tctgtcccacttggcatcagc

SEQ ID NO: 503205 - DNA, 13 bp, Homo sapiens
tctgtcccaggtt

SEQ ID NO: 503206 - DNA, 12 bp, Homo sapiens
tctgtcctgctg

SEQ ID NO: 503207 - DNA, 14 bp, Homo sapiens
tctgtctcaaaaaa

SEQ ID NO: 503208 - DNA, 16 bp, Homo sapiens
tctgtggagatgccca

SEQ ID NO: 503209 - DNA, 18 bp, Homo sapiens
tctgttttataattttgt

SEQ ID NO: 503210 - DNA, 18 bp, Homo sapiens
tcttaagaagactgcatt

SEQ ID NO: 503211 - DNA, 14 bp, Homo sapiens
tcttaggagcagag

SEQ ID NO: 503212 - DNA, 19 bp, Homo sapiens
tcttaggcaatcacatagt

SEQ ID NO: 503213 - DNA, 14 bp, Homo sapiens
tcttagtagatttt

SEQ ID NO: 503214 - DNA, 13 bp, Homo sapiens
tcttatcaagcag

SEQ ID NO: 503215 - DNA, 16 bp, Homo sapiens
tcttatcaagcagcca

SEQ ID NO: 503216 - DNA, 14 bp, Homo sapiens
tcttcaataaacca

SEQ ID NO: 503217 - DNA, 22 bp, Homo sapiens
tcttcaataaaccacaagcatc

SEQ ID NO: 503218 - DNA, 12 bp, Homo sapiens
tcttcagcctag

SEQ ID NO: 503219 - DNA, 23 bp, Homo sapiens
tcttcagcctagccgacctcagc

SEQ ID NO: 503220 - DNA, 16 bp, Homo sapiens
tcttctcaaagctggg

SEQ ID NO: 503221 - DNA, 12 bp, Homo sapiens
tcttctgagcct

SEQ ID NO: 503222 - DNA, 21 bp, Homo sapiens
tcttctttttgaaatcagcat

SEQ ID NO: 503223 - DNA, 19 bp, Homo sapiens
tcttgagccctcctggaat

SEQ ID NO: 503224 - DNA, 21 bp, Homo sapiens
tcttggcacatttaagagaca

SEQ ID NO: 503225 - DNA, 20 bp, Homo sapiens
tcttgtttatacctttgcct

SEQ ID NO: 503226 - DNA, 20 bp, Homo sapiens
tctttcttacaaggaaggtg

SEQ ID NO: 503227 - DNA, 12 bp, Homo sapiens
tctttgcatgga

SEQ ID NO: 503228 - DNA, 20 bp, Homo sapiens
tctttgccaccctcatgctg

SEQ ID NO: 503229 - DNA, 21 bp, Homo sapiens
tctttgccaccctcatgctgt

SEQ ID NO: 503230 - DNA, 20 bp, Homo sapiens
tctttggccccttgctggag

SEQ ID NO: 503231 - DNA, 13 bp, Homo sapiens
tgaaactccacct

SEQ ID NO: 503232 - DNA, 17 bp, Homo sapiens
tgaaatatacacacagc

SEQ ID NO: 503233 - DNA, 16 bp, Homo sapiens
tgaaatattgactttt

SEQ ID NO: 503234 - DNA, 22 bp, Homo sapiens
tgaaattttctagaatactaat

SEQ ID NO: 503235 - DNA, 23 bp, Homo sapiens
tgaacaactcgaatcactcattt

SEQ ID NO: 503236 - DNA, 17 bp, Homo sapiens
tgaacaatcaaggcaac

SEQ ID NO: 503237 - DNA, 16 bp, Homo sapiens
tgaacactgggggagg

SEQ ID NO: 503238 - DNA, 17 bp, Homo sapiens
tgaacctgggaggcaga

SEQ ID NO: 503239 - DNA, 18 bp, Homo sapiens
tgaacctgggaggcagag

SEQ ID NO: 503240 - DNA, 21 bp, Homo sapiens
tgaactatggacggtgctcca

SEQ ID NO: 503241 - DNA, 11 bp, Homo sapiens
tgaactttgct

SEQ ID NO: 503242 - DNA, 18 bp, Homo sapiens
tgaagaaacatttatctt

SEQ ID NO: 503243 - DNA, 21 bp, Homo sapiens
tgaagaatctgtttcccagca

SEQ ID NO: 503244 - DNA, 13 bp, Homo sapiens
tgaagatccccaa

SEQ ID NO: 503245 - DNA, 24 bp, Homo sapiens
tgaagggattttagtcacacgtgg

SEQ ID NO: 503246 - DNA, 13 bp, Homo sapiens
tgaaggtttctga

SEQ ID NO: 503247 - DNA, 16 bp, Homo sapiens
tgaaggtttctgaaaa

SEQ ID NO: 503248 - DNA, 13 bp, Homo sapiens
tgaagtaagcaaa

SEQ ID NO: 503249 - DNA, 21 bp, Homo sapiens
tgaagtatgcactaatcaata

SEQ ID NO: 503250 - DNA, 13 bp, Homo sapiens
tgaagtccaagca

SEQ ID NO: 503251 - DNA, 22 bp, Homo sapiens
tgaagtccaagcatttagatgt

SEQ ID NO: 503252 - DNA, 21 bp, Homo sapiens
tgaagtcgtcttaactcacca

SEQ ID NO: 503253 - DNA, 20 bp, Homo sapiens
tgaagtgatatggtgagcag

SEQ ID NO: 503254 - DNA, 16 bp, Homo sapiens
tgaagtttccttggct

SEQ ID NO: 503255 - DNA, 16 bp, Homo sapiens
tgaatataaacactat

SEQ ID NO: 503256 - DNA, 21 bp, Homo sapiens
tgaatgcttataggtggcctc

SEQ ID NO: 503257 - DNA, 14 bp, Homo sapiens
tgaatgggaaaaga

SEQ ID NO: 503258 - DNA, 13 bp, Homo sapiens
tgaattacatttg

SEQ ID NO: 503259 - DNA, 18 bp, Homo sapiens
tgaattacatttgtataa

SEQ ID NO: 503260 - DNA, 23 bp, Homo sapiens
tgaattagaaacataaataaaat

SEQ ID NO: 503261 - DNA, 15 bp, Homo sapiens
tgaatttttcttgcg

SEQ ID NO: 503262 - DNA, 13 bp, Homo sapiens
tgacaacacaaat

SEQ ID NO: 503263 - DNA, 14 bp, Homo sapiens
tgacaactgaagag

SEQ ID NO: 503264 - DNA, 12 bp, Homo sapiens
tgacaagctcac

SEQ ID NO: 503265 - DNA, 16 bp, Homo sapiens
tgacacaaacctgcct

SEQ ID NO: 503266 - DNA, 17 bp, Homo sapiens
tgacacaaacctgcctg

SEQ ID NO: 503267 - DNA, 18 bp, Homo sapiens
tgacacaaacctgcctgg

SEQ ID NO: 503268 - DNA, 21 bp, Homo sapiens
tgacactggtattcctgcctc

SEQ ID NO: 503269 - DNA, 17 bp, Homo sapiens
tgacagaacactgtctt

SEQ ID NO: 503270 - DNA, 21 bp, Homo sapiens
tgacagaacactgtcttgaag

SEQ ID NO: 503271 - DNA, 16 bp, Homo sapiens
tgacatgggacatttg

SEQ ID NO: 503272 - DNA, 18 bp, Homo sapiens
tgacatgggacatttgct

SEQ ID NO: 503273 - DNA, 22 bp, Homo sapiens
tgacatttatttttctcatgaa

SEQ ID NO: 503274 - DNA, 13 bp, Homo sapiens
tgaccaggcctgg

SEQ ID NO: 503275 - DNA, 14 bp, Homo sapiens
tgacccaggctggg

SEQ ID NO: 503276 - DNA, 19 bp, Homo sapiens
tgacccaggctgggcaagg

SEQ ID NO: 503277 - DNA, 20 bp, Homo sapiens
ggagggctagaacctggaga

SEQ ID NO: 503278 - DNA, 17 bp, Homo sapiens
ggagtacaggtgaagca

SEQ ID NO: 503279 - DNA, 17 bp, Homo sapiens
ggagtaccatgtggcaa

SEQ ID NO: 503280 - DNA, 22 bp, Homo sapiens
ggatagaaaattatgcagcttg

SEQ ID NO: 503281 - DNA, 20 bp, Homo sapiens
ggatctatcacctgtcatca

SEQ ID NO: 503282 - DNA, 15 bp, Homo sapiens
ggatgacatgtccct

SEQ ID NO: 503283 - DNA, 15 bp, Homo sapiens
ggatggacagtgggc

SEQ ID NO: 503284 - DNA, 21 bp, Homo sapiens
ggatggcctggccagggcctg

SEQ ID NO: 503285 - DNA, 23 bp, Homo sapiens
ggatgtttctgtcacatcagctc

SEQ ID NO: 503286 - DNA, 15 bp, Homo sapiens
ctgggcagctgcctc

SEQ ID NO: 503287 - DNA, 17 bp, Homo sapiens
ctgggcaggactcagct

SEQ ID NO: 503288 - DNA, 14 bp, Homo sapiens
ctgggctgcagaga

SEQ ID NO: 503289 - DNA, 12 bp, Homo sapiens
ctggggctgctg

SEQ ID NO: 503290 - DNA, 14 bp, Homo sapiens
ctgggggtgctgga

SEQ ID NO: 503291 - DNA, 16 bp, Homo sapiens
ctggggtaccaagaga

SEQ ID NO: 503292 - DNA, 16 bp, Homo sapiens
ctgggtggcactgcca

SEQ ID NO: 503293 - DNA, 18 bp, Homo sapiens
ctgggttggaaaacagta

SEQ ID NO: 503294 - DNA, 17 bp, Homo sapiens
ctggtaatttgtatctg

SEQ ID NO: 503295 - DNA, 14 bp, Homo sapiens
ctggtattcctgcc

SEQ ID NO: 503296 - DNA, 17 bp, Homo sapiens
ctggtattcctgcctcc

SEQ ID NO: 503297 - DNA, 18 bp, Homo sapiens
ctggtctctaggctgggg

SEQ ID NO: 503298 - DNA, 12 bp, Homo sapiens
ctggtctgaggg

SEQ ID NO: 503299 - DNA, 20 bp, Homo sapiens
ctggtgccctaacctctgag

SEQ ID NO: 503300 - DNA, 23 bp, Homo sapiens
ctggtgccctaacctctgagtca

SEQ ID NO: 503301 - DNA, 14 bp, Homo sapiens
ctggtgtccagctg

SEQ ID NO: 503302 - DNA, 16 bp, Homo sapiens
ctggtgtccagctgag

SEQ ID NO: 503303 - DNA, 23 bp, Homo sapiens
ctggttctgatgatgtgcctggg

SEQ ID NO: 503304 - DNA, 17 bp, Homo sapiens
ctgtaaaataaaaggtc

SEQ ID NO: 503305 - DNA, 17 bp, Homo sapiens
ctgtagcattacagtgg

SEQ ID NO: 503306 - DNA, 19 bp, Homo sapiens
ctgtattagtcacagagat

SEQ ID NO: 503307 - DNA, 16 bp, Homo sapiens
ctgtattttaaaagaa

SEQ ID NO: 503308 - DNA, 20 bp, Homo sapiens
ctgtattttaaaagaatgat

SEQ ID NO: 503309 - DNA, 22 bp, Homo sapiens
ctgtattttaaaagaatgatta

SEQ ID NO: 503310 - DNA, 19 bp, Homo sapiens
ctgtccagggccctgagct

SEQ ID NO: 503311 - DNA, 20 bp, Homo sapiens
ctgtccagggccctgagctc

SEQ ID NO: 503312 - DNA, 22 bp, Homo sapiens
ctgtccagggccctgagctcgg

SEQ ID NO: 503313 - DNA, 23 bp, Homo sapiens
ctgtccagggccctgagctcggt

SEQ ID NO: 503314 - DNA, 15 bp, Homo sapiens
ctgtccccttccagg

SEQ ID NO: 503315 - DNA, 16 bp, Homo sapiens
ctgtccccttccaggg

SEQ ID NO: 503316 - DNA, 15 bp, Homo sapiens
ctgtctggccaggcc

SEQ ID NO: 503317 - DNA, 23 bp, Homo sapiens
ctgtctggtttcaccgaggacat

SEQ ID NO: 503318 - DNA, 18 bp, Homo sapiens
ctgtgaacatggactctt

SEQ ID NO: 503319 - DNA, 14 bp, Homo sapiens
ctgtgaagtaagga

SEQ ID NO: 503320 - DNA, 22 bp, Homo sapiens
ctgtgctccctggttctgatga

SEQ ID NO: 503321 - DNA, 22 bp, Homo sapiens
ctgtgctgcccgtcttcagcct

SEQ ID NO: 503322 - DNA, 16 bp, Homo sapiens
ctgtgggcactggtgg

SEQ ID NO: 503323 - DNA, 17 bp, Homo sapiens
ctgtgtaaaaagagagc

SEQ ID NO: 503324 - DNA, 21 bp, Homo sapiens
ctgtgtacagaattctgctac

SEQ ID NO: 503325 - DNA, 13 bp, Homo sapiens
ctgtgttactgat

SEQ ID NO: 503326 - DNA, 21 bp, Homo sapiens
ctgttcaagagcacacttggc

SEQ ID NO: 503327 - DNA, 23 bp, Homo sapiens
ctgttcaagagcacacttggccc

SEQ ID NO: 503328 - DNA, 16 bp, Homo sapiens
ctgttctcattcctgt

SEQ ID NO: 503329 - DNA, 20 bp, Homo sapiens
ctgttctcattcctgttctt

SEQ ID NO: 503330 - DNA, 17 bp, Homo sapiens
ctgtttccaggtcagaa

SEQ ID NO: 503331 - DNA, 15 bp, Homo sapiens
ctgttttataatttt

SEQ ID NO: 503332 - DNA, 19 bp, Homo sapiens
ctgttttataattttgtga

SEQ ID NO: 503333 - DNA, 19 bp, Homo sapiens
cttaacaaaccctcgtttc

SEQ ID NO: 503334 - DNA, 18 bp, Homo sapiens
cttaagacaaatgggact

SEQ ID NO: 503335 - DNA, 21 bp, Homo sapiens
cttaagacaaatgggactgat

SEQ ID NO: 503336 - DNA, 18 bp, Homo sapiens
cttacctaccacatgcca

SEQ ID NO: 503337 - DNA, 18 bp, Homo sapiens
cttagacctcagcctgtg

SEQ ID NO: 503338 - DNA, 16 bp, Homo sapiens
gcaggctacactgaca

SEQ ID NO: 503339 - DNA, 21 bp, Homo sapiens
gcagggatgatggcagagcca

SEQ ID NO: 503340 - DNA, 14 bp, Homo sapiens
gcagggatttgagg

SEQ ID NO: 503341 - DNA, 15 bp, Homo sapiens
gcagggatttgagga

SEQ ID NO: 503342 - DNA, 15 bp, Homo sapiens
gcagggtcaggagag

SEQ ID NO: 503343 - DNA, 16 bp, Homo sapiens
gcagggtcaggagagg

SEQ ID NO: 503344 - DNA, 16 bp, Homo sapiens
gcaggttagaacctag

SEQ ID NO: 503345 - DNA, 13 bp, Homo sapiens
gcagtattgagca

SEQ ID NO: 503346 - DNA, 17 bp, Homo sapiens
gcagtcacatctcttcc

SEQ ID NO: 503347 - DNA, 18 bp, Homo sapiens
gcagtgcaggcacagtat

SEQ ID NO: 503348 - DNA, 16 bp, Homo sapiens
gcagttcagagctgcc

SEQ ID NO: 503349 - DNA, 17 bp, Homo sapiens
gcagttcagagctgccc

SEQ ID NO: 503350 - DNA, 13 bp, Homo sapiens
gcagttctgaaga

SEQ ID NO: 503351 - DNA, 14 bp, Homo sapiens
gcagttctgaagaa

SEQ ID NO: 503352 - DNA, 16 bp, Homo sapiens
gcagtttctgtcctgc

SEQ ID NO: 503353 - DNA, 20 bp, Homo sapiens
gcatattgataataaaattc

SEQ ID NO: 503354 - DNA, 23 bp, Homo sapiens
gcatcctagtctctatcattaaa

SEQ ID NO: 503355 - DNA, 15 bp, Homo sapiens
gcatgaccacataga

SEQ ID NO: 503356 - DNA, 14 bp, Homo sapiens
gcatgcacagctgt

SEQ ID NO: 503357 - DNA, 18 bp, Homo sapiens
gcatggcatcacctccac

SEQ ID NO: 503358 - DNA, 13 bp, Homo sapiens
gcatggtggcatg

SEQ ID NO: 503359 - DNA, 20 bp, Homo sapiens
gccaacactcaagaagcagg

SEQ ID NO: 503360 - DNA, 23 bp, Homo sapiens
gccaagcactgtgctcagggcta

SEQ ID NO: 503361 - DNA, 20 bp, Homo sapiens
gccaagctcaggaccaggca

SEQ ID NO: 503362 - DNA, 22 bp, Homo sapiens
gccaatgtattgataagagggc

SEQ ID NO: 503363 - DNA, 12 bp, Homo sapiens
gccactgcactc

SEQ ID NO: 503364 - DNA, 19 bp, Homo sapiens
gccactgcactccaatctg

SEQ ID NO: 503365 - DNA, 15 bp, Homo sapiens
gccagattgccatcc

SEQ ID NO: 503366 - DNA, 19 bp, Homo sapiens
gccagattttcctgaaaac

SEQ ID NO: 503367 - DNA, 13 bp, Homo sapiens
gccagcagccagc

SEQ ID NO: 503368 - DNA, 17 bp, Homo sapiens
gccagcagccagctctc

SEQ ID NO: 503369 - DNA, 13 bp, Homo sapiens
gccagcagttcag

SEQ ID NO: 503370 - DNA, 23 bp, Homo sapiens
gccagcagttcagagctgccctc

SEQ ID NO: 503371 - DNA, 12 bp, Homo sapiens
gccagccagcag

SEQ ID NO: 503372 - DNA, 19 bp, Homo sapiens
gccagcctgctccttccca

SEQ ID NO: 503373 - DNA, 21 bp, Homo sapiens
gccaggcctcttggcagtcac

SEQ ID NO: 503374 - DNA, 14 bp, Homo sapiens
gccaggctgttgga

SEQ ID NO: 503375 - DNA, 16 bp, Homo sapiens
gccagggcctggaaga

SEQ ID NO: 503376 - DNA, 22 bp, Homo sapiens
gccagggcctggaagacagaga

SEQ ID NO: 503377 - DNA, 11 bp, Homo sapiens
gccagggctgc

SEQ ID NO: 503378 - DNA, 13 bp, Homo sapiens
gccatccctccct

SEQ ID NO: 503379 - DNA, 15 bp, Homo sapiens
gccatccctccctcc

SEQ ID NO: 503380 - DNA, 23 bp, Homo sapiens
gccatccctccctccacctccct

SEQ ID NO: 503381 - DNA, 12 bp, Homo sapiens
gccatctctgga

SEQ ID NO: 503382 - DNA, 15 bp, Homo sapiens
gccatgctttgagtc

SEQ ID NO: 503383 - DNA, 18 bp, Homo sapiens
gccatggagagctggagc

SEQ ID NO: 503384 - DNA, 19 bp, Homo sapiens
gccatgggcactgtgggta

SEQ ID NO: 503385 - DNA, 15 bp, Homo sapiens
gccatgtagaagctg

SEQ ID NO: 503386 - DNA, 23 bp, Homo sapiens
gcccaagggaaagaaaaggaagg

SEQ ID NO: 503387 - DNA, 13 bp, Homo sapiens
gcccaagtgggtc

SEQ ID NO: 503388 - DNA, 21 bp, Homo sapiens
gcccacctccttccagcactg

SEQ ID NO: 503389 - DNA, 22 bp, Homo sapiens
gcccagattaaagtctttatcc

SEQ ID NO: 503390 - DNA, 13 bp, Homo sapiens
gcccagggctcag

SEQ ID NO: 503391 - DNA, 17 bp, Homo sapiens
gcccagggctcagcctg

SEQ ID NO: 503392 - DNA, 18 bp, Homo sapiens
gcccagggctcagcctgg

SEQ ID NO: 503393 - DNA, 17 bp, Homo sapiens
gcccaggtttctggtct

SEQ ID NO: 503394 - DNA, 22 bp, Homo sapiens
gcccatctgcctgttctgagga

SEQ ID NO: 503395 - DNA, 12 bp, Homo sapiens
gccccagcacta

SEQ ID NO: 503396 - DNA, 19 bp, Homo sapiens
gccccagcactaaagcagt

SEQ ID NO: 503397 - DNA, 17 bp, Homo sapiens
gcccgtcttcagcctag

SEQ ID NO: 503398 - DNA, 21 bp, Homo sapiens
gccctaacctctgagtcacca

SEQ ID NO: 503399 - DNA, 17 bp, Homo sapiens
gccctagagcacactgt

SEQ ID NO: 503400 - DNA, 13 bp, Homo sapiens
gccctctcctggg

SEQ ID NO: 503401 - DNA, 14 bp, Homo sapiens
gccctctcctgggc

SEQ ID NO: 503402 - DNA, 16 bp, Homo sapiens
gccctctcctgggcag

SEQ ID NO: 503403 - DNA, 22 bp, Homo sapiens
gccctctcctgggcagctgcct

SEQ ID NO: 503404 - DNA, 22 bp, Homo sapiens
gccctgttctctaccaagctat

SEQ ID NO: 503405 - DNA, 19 bp, Homo sapiens
gcccttctttccacagaag

SEQ ID NO: 503406 - DNA, 14 bp, Homo sapiens
gccgacctcagcct

SEQ ID NO: 503407 - DNA, 14 bp, Homo sapiens
gccgccccacccag

SEQ ID NO: 503408 - DNA, 15 bp, Homo sapiens
gccgccccacccaga

SEQ ID NO: 503409 - DNA, 15 bp, Homo sapiens
gccgctcctgtctgc

SEQ ID NO: 503410 - DNA, 19 bp, Homo sapiens
gccgctcctgtctgccagc

SEQ ID NO: 503411 - DNA, 12 bp, Homo sapiens
gccgctgccatg

SEQ ID NO: 503412 - DNA, 20 bp, Homo sapiens
gcctagccgacctcagcctt

SEQ ID NO: 503413 - DNA, 22 bp, Homo sapiens
gcctattagtagttaattctgt

SEQ ID NO: 503414 - DNA, 17 bp, Homo sapiens
gcctcatccgaggcagg

SEQ ID NO: 503415 - DNA, 17 bp, Homo sapiens
gcctcccctcctctgct

SEQ ID NO: 503416 - DNA, 23 bp, Homo sapiens
gcctcccttcatgcatggaaatt

SEQ ID NO: 503417 - DNA, 13 bp, Homo sapiens
gcctcctctgtcc

SEQ ID NO: 503418 - DNA, 16 bp, Homo sapiens
gcctcctctgtccagg

SEQ ID NO: 503419 - DNA, 14 bp, Homo sapiens
gcctcggagcctca

SEQ ID NO: 503420 - DNA, 20 bp, Homo sapiens
gcctctccttgtggcctggg

SEQ ID NO: 503421 - DNA, 18 bp, Homo sapiens
gcctctgccgctgccatg

SEQ ID NO: 503422 - DNA, 23 bp, Homo sapiens
gcctctgccgctgccatgctttg

SEQ ID NO: 503423 - DNA, 13 bp, Homo sapiens
gcctgatggacct

SEQ ID NO: 503424 - DNA, 19 bp, Homo sapiens
gcctgattgccaagctcag

SEQ ID NO: 503425 - DNA, 19 bp, Homo sapiens
gcctggcaacagagcgaga

SEQ ID NO: 503426 - DNA, 13 bp, Homo sapiens
gcctgggagccag

SEQ ID NO: 503427 - DNA, 13 bp, Homo sapiens
gcctgggccagag

SEQ ID NO: 503428 - DNA, 13 bp, Homo sapiens
gcctggtgggcct

SEQ ID NO: 503429 - DNA, 15 bp, Homo sapiens
gcctggtgggcctcc

SEQ ID NO: 503430 - DNA, 22 bp, Homo sapiens
gcctgtagtcccagctactcag

SEQ ID NO: 503431 - DNA, 15 bp, Homo sapiens
gcctgtgctgcccgt

SEQ ID NO: 503432 - DNA, 16 bp, Homo sapiens
gcctgtgctgcccgtc

SEQ ID NO: 503433 - DNA, 18 bp, Homo sapiens
gcctgttctgaggattca

SEQ ID NO: 503434 - DNA, 22 bp, Homo sapiens
gccttccacttggctacacagg

SEQ ID NO: 503435 - DNA, 18 bp, Homo sapiens
gccttccccttgcccagg

SEQ ID NO: 503436 - DNA, 14 bp, Homo sapiens
gccttgctctcttc

SEQ ID NO: 503437 - DNA, 21 bp, Homo sapiens
gccttgctctcttcaataaac

SEQ ID NO: 503438 - DNA, 22 bp, Homo sapiens
gccttgctctcttcaataaacc

SEQ ID NO: 503439 - DNA, 21 bp, Homo sapiens
gcctttagtgatcacagcagc

SEQ ID NO: 503440 - DNA, 18 bp, Homo sapiens
gcctttccgcggagccct

SEQ ID NO: 503441 - DNA, 22 bp, Homo sapiens
gcgcacacgcacgcacacacac

SEQ ID NO: 503442 - DNA, 11 bp, Homo sapiens
gcgcccctccc

SEQ ID NO: 503443 - DNA, 15 bp, Homo sapiens
gcggagcccttggcc

SEQ ID NO: 503444 - DNA, 16 bp, Homo sapiens
gcggcattaaagccat

SEQ ID NO: 503445 - DNA, 19 bp, Homo sapiens
gcggtgatcagcagagaga

SEQ ID NO: 503446 - DNA, 13 bp, Homo sapiens
gcgtcctgtccac

SEQ ID NO: 503447 - DNA, 24 bp, Homo sapiens
gcgtcctgtccacacccagctcag

SEQ ID NO: 503448 - DNA, 17 bp, Homo sapiens
gcgttccatgatgctgg

SEQ ID NO: 503449 - DNA, 18 bp, Homo sapiens
gcgttccatgatgctggg

SEQ ID NO: 503450 - DNA, 14 bp, Homo sapiens
gctaaaacctgagc

SEQ ID NO: 503451 - DNA, 18 bp, Homo sapiens
gctaaatgtaagaatcat

SEQ ID NO: 503452 - DNA, 18 bp, Homo sapiens
gctaaggcgtggagctgc

SEQ ID NO: 503453 - DNA, 13 bp, Homo sapiens
tggagctgcctga

SEQ ID NO: 503454 - DNA, 20 bp, Homo sapiens
tggaggactagaacctggag

SEQ ID NO: 503455 - DNA, 13 bp, Homo sapiens
tggaggagcagtg

SEQ ID NO: 503456 - DNA, 20 bp, Homo sapiens
tggaggagcagtgcaggcac

SEQ ID NO: 503457 - DNA, 21 bp, Homo sapiens
tggaggagcagtgcaggcaca

SEQ ID NO: 503458 - DNA, 18 bp, Homo sapiens
tggaggaggcctgggggc

SEQ ID NO: 503459 - DNA, 14 bp, Homo sapiens
tggaggcattgttt

SEQ ID NO: 503460 - DNA, 22 bp, Homo sapiens
tggaggctacctcacctgggca

SEQ ID NO: 503461 - DNA, 21 bp, Homo sapiens
tggagggctagaacctggagg

SEQ ID NO: 503462 - DNA, 12 bp, Homo sapiens
tggagggctgga

SEQ ID NO: 503463 - DNA, 14 bp, Homo sapiens
tggagtggaggcat

SEQ ID NO: 503464 - DNA, 15 bp, Homo sapiens
tggagttcccgtgca

SEQ ID NO: 503465 - DNA, 22 bp, Homo sapiens
tggatagaaaattatgcagctt

SEQ ID NO: 503466 - DNA, 16 bp, Homo sapiens
tggatctatcacctgt

SEQ ID NO: 503467 - DNA, 20 bp, Homo sapiens
tggatctatcacctgtcatc

SEQ ID NO: 503468 - DNA, 20 bp, Homo sapiens
tggatgcatgttttccagct

SEQ ID NO: 503469 - DNA, 13 bp, Homo sapiens
tggatgcctgatt

SEQ ID NO: 503470 - DNA, 23 bp, Homo sapiens
tggatgcggaacccaaattacgt

SEQ ID NO: 503471 - DNA, 14 bp, Homo sapiens
tggcaacagagcga

SEQ ID NO: 503472 - DNA, 19 bp, Homo sapiens
tggcaaggacacagatgaa

SEQ ID NO: 503473 - DNA, 17 bp, Homo sapiens
tggcacacgcctgtagt

SEQ ID NO: 503474 - DNA, 18 bp, Homo sapiens
tggcacatttaagagaca

SEQ ID NO: 503475 - DNA, 11 bp, Homo sapiens
tggcagagcca

SEQ ID NO: 503476 - DNA, 19 bp, Homo sapiens
tggcaggatggcctggcca

SEQ ID NO: 503477 - DNA, 14 bp, Homo sapiens
tggcatcagctggc

SEQ ID NO: 503478 - DNA, 18 bp, Homo sapiens
tggcatcagctggcgtca

SEQ ID NO: 503479 - DNA, 15 bp, Homo sapiens
tggcatttccctact

SEQ ID NO: 503480 - DNA, 22 bp, Homo sapiens
tggccaacattgtaaaacccca

SEQ ID NO: 503481 - DNA, 14 bp, Homo sapiens
tggccatctctgga

SEQ ID NO: 503482 - DNA, 21 bp, Homo sapiens
tggcccaagtggcagagcttg

SEQ ID NO: 503483 - DNA, 14 bp, Homo sapiens
tggccgtgggcctg

SEQ ID NO: 503484 - DNA, 13 bp, Homo sapiens
tggcctcaagatc

SEQ ID NO: 503485 - DNA, 14 bp, Homo sapiens
tggcctgagaagag

SEQ ID NO: 503486 - DNA, 18 bp, Homo sapiens
tggcggtgatcagcagag

SEQ ID NO: 503487 - DNA, 15 bp, Homo sapiens
tggctgctagcactt

SEQ ID NO: 503488 - DNA, 11 bp, Homo sapiens
tggctgctgcc

SEQ ID NO: 503489 - DNA, 14 bp, Homo sapiens
tggctgctgcccag

SEQ ID NO: 503490 - DNA, 20 bp, Homo sapiens
tggcttcattagagcaggcg

SEQ ID NO: 503491 - DNA, 16 bp, Homo sapiens
tggcttctgcttgtca

SEQ ID NO: 503492 - DNA, 17 bp, Homo sapiens
tggcttctgcttgtcat

SEQ ID NO: 503493 - DNA, 15 bp, Homo sapiens
tgggaactcacctgg

SEQ ID NO: 503494 - DNA, 14 bp, Homo sapiens
tgggaatcaagatt

SEQ ID NO: 503495 - DNA, 18 bp, Homo sapiens
tgggacagtcacctcatg

SEQ ID NO: 503496 - DNA, 19 bp, Homo sapiens
tgggaccacgtgagatcat

SEQ ID NO: 503497 - DNA, 24 bp, Homo sapiens
tgggacctccaccgttggtgttca

SEQ ID NO: 503498 - DNA, 12 bp, Homo sapiens
tgggactggagt

SEQ ID NO: 503499 - DNA, 20 bp, Homo sapiens
tgggataaaggcccagactc

SEQ ID NO: 503500 - DNA, 14 bp, Homo sapiens
tgggcaaggaggcc

SEQ ID NO: 503501 - DNA, 20 bp, Homo sapiens
tgggcacaaagggcccagat

SEQ ID NO: 503502 - DNA, 14 bp, Homo sapiens
tgggcactggtggg

SEQ ID NO: 503503 - DNA, 10 bp, Homo sapiens
tgggcagctc

SEQ ID NO: 503504 - DNA, 19 bp, Homo sapiens
tgggcagctcatctctgtc

SEQ ID NO: 503505 - DNA, 13 bp, Homo sapiens
tgggcagctgcct

SEQ ID NO: 503506 - DNA, 19 bp, Homo sapiens
tgggcagctgcctcccctc

SEQ ID NO: 503507 - DNA, 17 bp, Homo sapiens
tgggcaggactcagctc

SEQ ID NO: 503508 - DNA, 18 bp, Homo sapiens
tgggcaggactcagctcc

SEQ ID NO: 503509 - DNA, 16 bp, Homo sapiens
tgggcatactaataaa

SEQ ID NO: 503510 - DNA, 21 bp, Homo sapiens
tgggcatactaataaagtatg

SEQ ID NO: 503511 - DNA, 22 bp, Homo sapiens
tgggcatagatgcaggtgagcc

SEQ ID NO: 503512 - DNA, 15 bp, Homo sapiens
tgggcatcagcagca

SEQ ID NO: 503513 - DNA, 12 bp, Homo sapiens
tgggcttcccag

SEQ ID NO: 503514 - DNA, 19 bp, Homo sapiens
tgggcttcccagtggctgc

SEQ ID NO: 503515 - DNA, 22 bp, Homo sapiens
tgggcttcccagtggctgctgc

SEQ ID NO: 503516 - DNA, 11 bp, Homo sapiens
tgggctttctg

SEQ ID NO: 503517 - DNA, 16 bp, Homo sapiens
tggggtcctggggcct

SEQ ID NO: 503518 - DNA, 18 bp, Homo sapiens
tgggtccaggcctggcca

SEQ ID NO: 503519 - DNA, 20 bp, Homo sapiens
tggtaaggggaattgaggac

SEQ ID NO: 503520 - DNA, 13 bp, Homo sapiens
tggtatgttttca

SEQ ID NO: 503521 - DNA, 16 bp, Homo sapiens
tggtcccagccagcag

SEQ ID NO: 503522 - DNA, 18 bp, Homo sapiens
tggtctctaggctgggga

SEQ ID NO: 503523 - DNA, 22 bp, Homo sapiens
tggtctgaggggcaactgagtc

SEQ ID NO: 503524 - DNA, 13 bp, Homo sapiens
tggtcttatcctg

SEQ ID NO: 503525 - DNA, 20 bp, Homo sapiens
tggtgccacaaataaaatgg

SEQ ID NO: 503526 - DNA, 21 bp, Homo sapiens
tggtgccagatcctcttctca

SEQ ID NO: 503527 - DNA, 20 bp, Homo sapiens
tggtgccctgttctctacca

SEQ ID NO: 503528 - DNA, 18 bp, Homo sapiens
tggtgcgggcacaataaa

SEQ ID NO: 503529 - DNA, 15 bp, Homo sapiens
tggtggtatctgagt

SEQ ID NO: 503530 - DNA, 13 bp, Homo sapiens
tggtgtccagctg

SEQ ID NO: 503531 - DNA, 17 bp, Homo sapiens
tggtgtccagctgagtt

SEQ ID NO: 503532 - DNA, 19 bp, Homo sapiens
tggtgtctggattcccagg

SEQ ID NO: 503533 - DNA, 16 bp, Homo sapiens
tggttactagtacagg

SEQ ID NO: 503534 - DNA, 17 bp, Homo sapiens
tggttcccttgatgaag

SEQ ID NO: 503535 - DNA, 20 bp, Homo sapiens
tggttcccttgatgaagaag

SEQ ID NO: 503536 - DNA, 18 bp, Homo sapiens
tgtaaatgtcttttcaaa

SEQ ID NO: 503537 - DNA, 11 bp, Homo sapiens
tgtaacactgt

SEQ ID NO: 503538 - DNA, 18 bp, Homo sapiens
tgtaagaaaatatcactt

SEQ ID NO: 503539 - DNA, 12 bp, Homo sapiens
ttccaagagctg

SEQ ID NO: 503540 - DNA, 13 bp, Homo sapiens
ttccaagagctga

SEQ ID NO: 503541 - DNA, 13 bp, Homo sapiens
ttccactggagaa

SEQ ID NO: 503542 - DNA, 12 bp, Homo sapiens
ttccacttggct

SEQ ID NO: 503543 - DNA, 19 bp, Homo sapiens
ttccacttggctacacagg

SEQ ID NO: 503544 - DNA, 19 bp, Homo sapiens
ttccagatcctggaaatca

SEQ ID NO: 503545 - DNA, 16 bp, Homo sapiens
ttccagccagggctgc

SEQ ID NO: 503546 - DNA, 22 bp, Homo sapiens
ttccagtcatggccaaatgttc

SEQ ID NO: 503547 - DNA, 21 bp, Homo sapiens
ttccagtgcaacactgaagct

SEQ ID NO: 503548 - DNA, 13 bp, Homo sapiens
ttccatattaaaa

SEQ ID NO: 503549 - DNA, 14 bp, Homo sapiens
ttccatggattttg

SEQ ID NO: 503550 - DNA, 20 bp, Homo sapiens
ttccattctggattttgtca

SEQ ID NO: 503551 - DNA, 12 bp, Homo sapiens
ttccatttgctg

SEQ ID NO: 503552 - DNA, 21 bp, Homo sapiens
ttcccaaaagcccattcattc

SEQ ID NO: 503553 - DNA, 18 bp, Homo sapiens
ttcccaactccagaaagt

SEQ ID NO: 503554 - DNA, 12 bp, Homo sapiens
ttcccaataaat

SEQ ID NO: 503555 - DNA, 18 bp, Homo sapiens
ttcccagcttctgccaca

SEQ ID NO: 503556 - DNA, 20 bp, Homo sapiens
ttcccagtggctgctgccca

SEQ ID NO: 503557 - DNA, 18 bp, Homo sapiens
ttcccatgacccaggctg

SEQ ID NO: 503558 - DNA, 20 bp, Homo sapiens
ttcccatgacccaggctggg

SEQ ID NO: 503559 - DNA, 22 bp, Homo sapiens
ttccccttgcccagggctcagc

SEQ ID NO: 503560 - DNA, 22 bp, Homo sapiens
ttcccgagcaaagtctaaagtt

SEQ ID NO: 503561 - DNA, 23 bp, Homo sapiens
ttcccgagcaaagtctaaagttt

SEQ ID NO: 503562 - DNA, 16 bp, Homo sapiens
ttccctatctttgcca

SEQ ID NO: 503563 - DNA, 16 bp, Homo sapiens
ttcccttcatctggaa

SEQ ID NO: 503564 - DNA, 18 bp, Homo sapiens
ttcccttgatgaagaagt

SEQ ID NO: 503565 - DNA, 17 bp, Homo sapiens
ttcctaaggcacccaca

SEQ ID NO: 503566 - DNA, 14 bp, Homo sapiens
ttccttagcattgt

SEQ ID NO: 503567 - DNA, 23 bp, Homo sapiens
ttccttagcttagacctcagcct

SEQ ID NO: 503568 - DNA, 13 bp, Homo sapiens
ttccttgcctgca

SEQ ID NO: 503569 - DNA, 15 bp, Homo sapiens
ttccttggctggtgc

SEQ ID NO: 503570 - DNA, 20 bp, Homo sapiens
ttctaactctagtttgcaga

SEQ ID NO: 503571 - DNA, 14 bp, Homo sapiens
ttctatcccaaact

SEQ ID NO: 503572 - DNA, 21 bp, Homo sapiens
ttctatgaaatattatgttaa

SEQ ID NO: 503573 - DNA, 13 bp, Homo sapiens
ttctatggcatat

SEQ ID NO: 503574 - DNA, 15 bp, Homo sapiens
ttctcatcctgcagg

SEQ ID NO: 503575 - DNA, 16 bp, Homo sapiens
ttctgacccagggcct

SEQ ID NO: 503576 - DNA, 14 bp, Homo sapiens
ttctgccacataaa

SEQ ID NO: 503577 - DNA, 15 bp, Homo sapiens
ttctgccacataaaa

SEQ ID NO: 503578 - DNA, 21 bp, Homo sapiens
ttctggtctctaggctgggga

SEQ ID NO: 503579 - DNA, 13 bp, Homo sapiens
ttctgtcctgctg

SEQ ID NO: 503580 - DNA, 19 bp, Homo sapiens
ttctgttgtgtttgtcaaa

SEQ ID NO: 503581 - DNA, 16 bp, Homo sapiens
ttctgtttggaggagc

SEQ ID NO: 503582 - DNA, 16 bp, Homo sapiens
ttcttctattgtgctt

SEQ ID NO: 503583 - DNA, 16 bp, Homo sapiens
ttctttatcacatgtt

SEQ ID NO: 503584 - DNA, 18 bp, Homo sapiens
ttctttccacagaagctc

SEQ ID NO: 503585 - DNA, 22 bp, Homo sapiens
ttctttggccccttgctggagt

SEQ ID NO: 503586 - DNA, 11 bp, Homo sapiens
ttgaaatgtac

SEQ ID NO: 503587 - DNA, 18 bp, Homo sapiens
ttgaacctgggaggcaga

SEQ ID NO: 503588 - DNA, 22 bp, Homo sapiens
ttgaagacactgaaatatacac

SEQ ID NO: 503589 - DNA, 13 bp, Homo sapiens
ttgaatcacagta

SEQ ID NO: 503590 - DNA, 16 bp, Homo sapiens
ttgacagaacactgtc

SEQ ID NO: 503591 - DNA, 21 bp, Homo sapiens
ttgacctgcctcccttcatgc

SEQ ID NO: 503592 - DNA, 22 bp, Homo sapiens
ttgacctgcctcccttcatgca

SEQ ID NO: 503593 - DNA, 23 bp, Homo sapiens
ttgacctgcctcccttcatgcat

SEQ ID NO: 503594 - DNA, 20 bp, Homo sapiens
ttgactgtgatttatttgga

SEQ ID NO: 503595 - DNA, 20 bp, Homo sapiens
ttgacttgacagaacactgt

SEQ ID NO: 503596 - DNA, 18 bp, Homo sapiens
ttgagaggcatgacagct

SEQ ID NO: 503597 - DNA, 14 bp, Homo sapiens
ttgaggacactgat

SEQ ID NO: 503598 - DNA, 17 bp, Homo sapiens
ttgaggattttgagtat

SEQ ID NO: 503599 - DNA, 16 bp, Homo sapiens
ttgagtccacgcccac

SEQ ID NO: 503600 - DNA, 14 bp, Homo sapiens
ttgataataaaatt

SEQ ID NO: 503601 - DNA, 17 bp, Homo sapiens
ttgataataaaattcat

SEQ ID NO: 503602 - DNA, 12 bp, Homo sapiens
ttgatgaagaag

SEQ ID NO: 503603 - DNA, 13 bp, Homo sapiens
ttgatgaagaagt

SEQ ID NO: 503604 - DNA, 12 bp, Homo sapiens
tgatgctgggat

SEQ ID NO: 503605 - DNA, 14 bp, Homo sapiens
tgatggcagagcca

SEQ ID NO: 503606 - DNA, 13 bp, Homo sapiens
tgatggcttctcc

SEQ ID NO: 503607 - DNA, 14 bp, Homo sapiens
tgatggtcagaggg

SEQ ID NO: 503608 - DNA, 15 bp, Homo sapiens
tgatggtcagagggc

SEQ ID NO: 503609 - DNA, 13 bp, Homo sapiens
tgatgtcatcttg

SEQ ID NO: 503610 - DNA, 14 bp, Homo sapiens
tgatgttggctggg

SEQ ID NO: 503611 - DNA, 22 bp, Homo sapiens
tgatgtttagaaacacaactat

SEQ ID NO: 503612 - DNA, 23 bp, Homo sapiens
tgattaagtaatgataactggaa

SEQ ID NO: 503613 - DNA, 22 bp, Homo sapiens
tgattatgaattacatttgtat

SEQ ID NO: 503614 - DNA, 12 bp, Homo sapiens
tgattcaattca

SEQ ID NO: 503615 - DNA, 17 bp, Homo sapiens
tgattcctttgaagagg

SEQ ID NO: 503616 - DNA, 20 bp, Homo sapiens
tgattcctttgaagaggaaa

SEQ ID NO: 503617 - DNA, 15 bp, Homo sapiens
tgattctcagggtct

SEQ ID NO: 503618 - DNA, 15 bp, Homo sapiens
tgattgggacagagg

SEQ ID NO: 503619 - DNA, 19 bp, Homo sapiens
tgatttatttggagtggag

SEQ ID NO: 503620 - DNA, 22 bp, Homo sapiens
tgatttatttggagtggaggca

SEQ ID NO: 503621 - DNA, 12 bp, Homo sapiens
tgatttggaaaa

SEQ ID NO: 503622 - DNA, 14 bp, Homo sapiens
tgcaaaaagggtca

SEQ ID NO: 503623 - DNA, 13 bp, Homo sapiens
tgcaaaggctggg

SEQ ID NO: 503624 - DNA, 14 bp, Homo sapiens
tgcaaaggctggga

SEQ ID NO: 503625 - DNA, 21 bp, Homo sapiens
tgcaaagtcatgcaaaggctg

SEQ ID NO: 503626 - DNA, 19 bp, Homo sapiens
tgcaaggaagccacagctg

SEQ ID NO: 503627 - DNA, 20 bp, Homo sapiens
tgcaatagaacagagaaaga

SEQ ID NO: 503628 - DNA, 16 bp, Homo sapiens
tgcacagatacacata

SEQ ID NO: 503629 - DNA, 17 bp, Homo sapiens
tgcacagcgtcctgtcc

SEQ ID NO: 503630 - DNA, 19 bp, Homo sapiens
tgcacagctgtagtacccc

SEQ ID NO: 503631 - DNA, 15 bp, Homo sapiens
tgcacctgcagcgcg

SEQ ID NO: 503632 - DNA, 14 bp, Homo sapiens
tgcactccaatctg

SEQ ID NO: 503633 - DNA, 14 bp, Homo sapiens
tgcactccagcctg

SEQ ID NO: 503634 - DNA, 15 bp, Homo sapiens
tgcagacatgagtgc

SEQ ID NO: 503635 - DNA, 20 bp, Homo sapiens
tgcagagacaggacctgact

SEQ ID NO: 503636 - DNA, 17 bp, Homo sapiens
tgcagtattgagcactg

SEQ ID NO: 503637 - DNA, 21 bp, Homo sapiens
tgcagtcacgtggaggagcag

SEQ ID NO: 503638 - DNA, 19 bp, Homo sapiens
tgcagttctgaagaagatg

SEQ ID NO: 503639 - DNA, 14 bp, Homo sapiens
tgcatagcagctgc

SEQ ID NO: 503640 - DNA, 20 bp, Homo sapiens
tgcatagtcccagctaccca

SEQ ID NO: 503641 - DNA, 17 bp, Homo sapiens
tgcatatatacatatat

SEQ ID NO: 503642 - DNA, 12 bp, Homo sapiens
tgcatatgtatg

SEQ ID NO: 503643 - DNA, 16 bp, Homo sapiens
tgcatgatctgtcaaa

SEQ ID NO: 503644 - DNA, 23 bp, Homo sapiens
tgcatggaaattcccttcatctg

SEQ ID NO: 503645 - DNA, 21 bp, Homo sapiens
tgcatgttttccagctcctca

SEQ ID NO: 503646 - DNA, 20 bp, Homo sapiens
tgcattatatttattactgt

SEQ ID NO: 503647 - DNA, 18 bp, Homo sapiens
tgcatttaaactcatttg

SEQ ID NO: 503648 - DNA, 23 bp, Homo sapiens
tgccaacactcaagaagcaggct

SEQ ID NO: 503649 - DNA, 21 bp, Homo sapiens
tgccaacttcttcagagctga

SEQ ID NO: 503650 - DNA, 18 bp, Homo sapiens
tgccaagctcaggaccag

SEQ ID NO: 503651 - DNA, 15 bp, Homo sapiens
tgccacagagcgggg

SEQ ID NO: 503652 - DNA, 14 bp, Homo sapiens
tgccactgcactcc

SEQ ID NO: 503653 - DNA, 12 bp, Homo sapiens
tgccagccagca

SEQ ID NO: 503654 - DNA, 11 bp, Homo sapiens
tgccaggcagg

SEQ ID NO: 503655 - DNA, 16 bp, Homo sapiens
tgccaggcaggcacct

SEQ ID NO: 503656 - DNA, 19 bp, Homo sapiens
tgccatatttttgagggct

SEQ ID NO: 503657 - DNA, 14 bp, Homo sapiens
tgccatccctccct

SEQ ID NO: 503658 - DNA, 23 bp, Homo sapiens
tgccatcctcaaacactgcaggc

SEQ ID NO: 503659 - DNA, 16 bp, Homo sapiens
tgcccaagccctgaga

SEQ ID NO: 503660 - DNA, 20 bp, Homo sapiens
tgcccagggctcagcctggt

SEQ ID NO: 503661 - DNA, 23 bp, Homo sapiens
tgcccagggctcagcctggtggg

SEQ ID NO: 503662 - DNA, 20 bp, Homo sapiens
tgcccaggtttctggtctct

SEQ ID NO: 503663 - DNA, 12 bp, Homo sapiens
tgccccagccag

SEQ ID NO: 503664 - DNA, 16 bp, Homo sapiens
tgcccgtcttcagcct

SEQ ID NO: 503665 - DNA, 17 bp, Homo sapiens
tgcccgtcttcagccta

SEQ ID NO: 503666 - DNA, 22 bp, Homo sapiens
tgccctaacctctgagtcacca

SEQ ID NO: 503667 - DNA, 15 bp, Homo sapiens
tgccctactcactct

SEQ ID NO: 503668 - DNA, 17 bp, Homo sapiens
tgccctagagcacactg

SEQ ID NO: 503669 - DNA, 23 bp, Homo sapiens
tgccctagagcacactgtagcat

SEQ ID NO: 503670 - DNA, 14 bp, Homo sapiens
tgccctctcctggg

SEQ ID NO: 503671 - DNA, 15 bp, Homo sapiens
tgccgacagaaggaa

SEQ ID NO: 503672 - DNA, 14 bp, Homo sapiens
tgccgccccaccca

SEQ ID NO: 503673 - DNA, 15 bp, Homo sapiens
tgccgccccacccag

SEQ ID NO: 503674 - DNA, 17 bp, Homo sapiens
tgcctacgtgacaacac

SEQ ID NO: 503675 - DNA, 18 bp, Homo sapiens
tgcctacgtgacaacaca

SEQ ID NO: 503676 - DNA, 21 bp, Homo sapiens
tgcctacgtgacaacacaaat

SEQ ID NO: 503677 - DNA, 18 bp, Homo sapiens
tgcctatagtcccagcta

SEQ ID NO: 503678 - DNA, 21 bp, Homo sapiens
tgcctcattttagaaccacca

SEQ ID NO: 503679 - DNA, 12 bp, Homo sapiens
tgcctcccctcc

SEQ ID NO: 503680 - DNA, 13 bp, Homo sapiens
tgcctcccctcct

SEQ ID NO: 503681 - DNA, 14 bp, Homo sapiens
tgcctcccctcctc

SEQ ID NO: 503682 - DNA, 16 bp, Homo sapiens
tgcctcccctcctctg

SEQ ID NO: 503683 - DNA, 19 bp, Homo sapiens
tgcctcccctcctctgctt

SEQ ID NO: 503684 - DNA, 13 bp, Homo sapiens
tgcctctgtcctt

SEQ ID NO: 503685 - DNA, 16 bp, Homo sapiens
tgcctgagtgcctggc

SEQ ID NO: 503686 - DNA, 20 bp, Homo sapiens
tgcctgattgccaagctcag

SEQ ID NO: 503687 - DNA, 19 bp, Homo sapiens
tgcctgcacaaactcacca

SEQ ID NO: 503688 - DNA, 16 bp, Homo sapiens
tgcctgtacaagctga

SEQ ID NO: 503689 - DNA, 21 bp, Homo sapiens
tgccttatctaaatcaccaga

SEQ ID NO: 503690 - DNA, 13 bp, Homo sapiens
tgcctttgacctg

SEQ ID NO: 503691 - DNA, 17 bp, Homo sapiens
tgcctttgacctgcctc

SEQ ID NO: 503692 - DNA, 15 bp, Homo sapiens
tgctaacccccaaat

SEQ ID NO: 503693 - DNA, 20 bp, Homo sapiens
tgctaactagcttggaaact

SEQ ID NO: 503694 - DNA, 19 bp, Homo sapiens
tgctacgtacatgtgaggc

SEQ ID NO: 503695 - DNA, 18 bp, Homo sapiens
tgctactagctctttgag

SEQ ID NO: 503696 - DNA, 14 bp, Homo sapiens
tgctagtaattgga

SEQ ID NO: 503697 - DNA, 21 bp, Homo sapiens
tgctataactatgttgataaa

SEQ ID NO: 503698 - DNA, 16 bp, Homo sapiens
tgctccagcctctgcc

SEQ ID NO: 503699 - DNA, 20 bp, Homo sapiens
cctgttttagaaggttctct

SEQ ID NO: 503700 - DNA, 18 bp, Homo sapiens
ccttagcttagacctcag

SEQ ID NO: 503701 - DNA, 15 bp, Homo sapiens
ccttcatgcatggaa

SEQ ID NO: 503702 - DNA, 19 bp, Homo sapiens
ccttcccaggagtggagga

SEQ ID NO: 503703 - DNA, 23 bp, Homo sapiens
ccttcccatgacccaggctgggc

SEQ ID NO: 503704 - DNA, 16 bp, Homo sapiens
ccttctccctcatttc

SEQ ID NO: 503705 - DNA, 18 bp, Homo sapiens
ccttgaacaatcaaggca

SEQ ID NO: 503706 - DNA, 18 bp, Homo sapiens
ccttgagagaccaggcaa

SEQ ID NO: 503707 - DNA, 16 bp, Homo sapiens
ccttgagaggcatgac

SEQ ID NO: 503708 - DNA, 21 bp, Homo sapiens
ccttgagaggcatgacagctg

SEQ ID NO: 503709 - DNA, 14 bp, Homo sapiens
ccttgatgaagaag

SEQ ID NO: 503710 - DNA, 15 bp, Homo sapiens
ccttgcaagaatcag

SEQ ID NO: 503711 - DNA, 18 bp, Homo sapiens
ccttgcacactcagaagc

SEQ ID NO: 503712 - DNA, 14 bp, Homo sapiens
ccttgcacatagta

SEQ ID NO: 503713 - DNA, 17 bp, Homo sapiens
ccttgcccagggctcag

SEQ ID NO: 503714 - DNA, 18 bp, Homo sapiens
ccttgcccagggctcagc

SEQ ID NO: 503715 - DNA, 21 bp, Homo sapiens
ccttgcccagggctcagcctg

SEQ ID NO: 503716 - DNA, 15 bp, Homo sapiens
ccttgctctcttcaa

SEQ ID NO: 503717 - DNA, 16 bp, Homo sapiens
ccttgctctcttcaat

SEQ ID NO: 503718 - DNA, 17 bp, Homo sapiens
ccttgctctcttcaata

SEQ ID NO: 503719 - DNA, 19 bp, Homo sapiens
ccttgctctcttcaataaa

SEQ ID NO: 503720 - DNA, 15 bp, Homo sapiens
ccttggacttgagga

SEQ ID NO: 503721 - DNA, 13 bp, Homo sapiens
ccttggcccctcg

SEQ ID NO: 503722 - DNA, 12 bp, Homo sapiens
ccttggctggtg

SEQ ID NO: 503723 - DNA, 21 bp, Homo sapiens
ccttgtatttaaatattaaat

SEQ ID NO: 503724 - DNA, 21 bp, Homo sapiens
cctttcacagagcagagtctg

SEQ ID NO: 503725 - DNA, 17 bp, Homo sapiens
cctttccgcggagccct

SEQ ID NO: 503726 - DNA, 13 bp, Homo sapiens
cctttgaagagga

SEQ ID NO: 503727 - DNA, 23 bp, Homo sapiens
cctttgaagaggaaaatgaataa

SEQ ID NO: 503728 - DNA, 12 bp, Homo sapiens
ccttttcccaac

SEQ ID NO: 503729 - DNA, 17 bp, Homo sapiens
cgaagaagagccacagt

SEQ ID NO: 503730 - DNA, 12 bp, Homo sapiens
cgacctcagcct

SEQ ID NO: 503731 - DNA, 13 bp, Homo sapiens
cgacctcagcctt

SEQ ID NO: 503732 - DNA, 15 bp, Homo sapiens
cgagtgctcatttca

SEQ ID NO: 503733 - DNA, 17 bp, Homo sapiens
cgagtttggtccctggg

SEQ ID NO: 503734 - DNA, 19 bp, Homo sapiens
cgcacacacacatacagag

SEQ ID NO: 503735 - DNA, 16 bp, Homo sapiens
cgcatcctagtctcta

SEQ ID NO: 503736 - DNA, 19 bp, Homo sapiens
cgcatcctagtctctatca

SEQ ID NO: 503737 - DNA, 21 bp, Homo sapiens
cgccactgcactccagcctgg

SEQ ID NO: 503738 - DNA, 24 bp, Homo sapiens
cgcccaccagccttgctctcttca

SEQ ID NO: 503739 - DNA, 17 bp, Homo sapiens
cgctcctgtctgccagc

SEQ ID NO: 503740 - DNA, 14 bp, Homo sapiens
cgctgattctcagg

SEQ ID NO: 503741 - DNA, 16 bp, Homo sapiens
cgctgattctcagggt

SEQ ID NO: 503742 - DNA, 21 bp, Homo sapiens
cgcttgaacctgggaggcaga

SEQ ID NO: 503743 - DNA, 15 bp, Homo sapiens
cggagcccttggccc

SEQ ID NO: 503744 - DNA, 17 bp, Homo sapiens
cggagcccttggcccct

SEQ ID NO: 503745 - DNA, 22 bp, Homo sapiens
cggagcccttggcccctcggac

SEQ ID NO: 503746 - DNA, 20 bp, Homo sapiens
cggagccgggaaagaagagc

SEQ ID NO: 503747 - DNA, 23 bp, Homo sapiens
cggagttcggaaaccgtcctgtg

SEQ ID NO: 503748 - DNA, 11 bp, Homo sapiens
cggctgctgag

SEQ ID NO: 503749 - DNA, 12 bp, Homo sapiens
cgggaaggaggg

SEQ ID NO: 503750 - DNA, 15 bp, Homo sapiens
cgggcacaataaatc

SEQ ID NO: 503751 - DNA, 12 bp, Homo sapiens
cgggggcagctg

SEQ ID NO: 503752 - DNA, 13 bp, Homo sapiens
cgggggcagctga

SEQ ID NO: 503753 - DNA, 16 bp, Homo sapiens
cggggtattttaggca

SEQ ID NO: 503754 - DNA, 16 bp, Homo sapiens
cggtgctccaggcagg

SEQ ID NO: 503755 - DNA, 12 bp, Homo sapiens
cggtttcagaag

SEQ ID NO: 503756 - DNA, 15 bp, Homo sapiens
cggtttgaagcctgg

SEQ ID NO: 503757 - DNA, 15 bp, Homo sapiens
cgtgacaacacaaat

SEQ ID NO: 503758 - DNA, 14 bp, Homo sapiens
cgtgccctaccaca

SEQ ID NO: 503759 - DNA, 18 bp, Homo sapiens
cgtgtatgtacctaggat

SEQ ID NO: 503760 - DNA, 20 bp, Homo sapiens
cgttccatgatgctgggatt

SEQ ID NO: 503761 - DNA, 15 bp, Homo sapiens
cgttttctgtttgga

SEQ ID NO: 503762 - DNA, 22 bp, Homo sapiens
ctaaaaataaaatgcatttaaa

SEQ ID NO: 503763 - DNA, 22 bp, Homo sapiens
ctaaaacctgagctagaagctg

SEQ ID NO: 503764 - DNA, 11 bp, Homo sapiens
ctaaagcagtg

SEQ ID NO: 503765 - DNA, 21 bp, Homo sapiens
ctaaagtttacagtaaataaa

SEQ ID NO: 503766 - DNA, 24 bp, Homo sapiens
ctaaagtttacagtaaataaattg

SEQ ID NO: 503767 - DNA, 17 bp, Homo sapiens
ctaaatgtaagaatcat

SEQ ID NO: 503768 - DNA, 22 bp, Homo sapiens
ctaaatgtaagaatcattgtaa

SEQ ID NO: 503769 - DNA, 20 bp, Homo sapiens
ctaagaagatgttttgaaat

SEQ ID NO: 503770 - DNA, 16 bp, Homo sapiens
ctaaggcgtggagctg

SEQ ID NO: 503771 - DNA, 18 bp, Homo sapiens
ctaaggcgtggagctgcc

SEQ ID NO: 503772 - DNA, 14 bp, Homo sapiens
ctaataaaatacat

SEQ ID NO: 503773 - DNA, 23 bp, Homo sapiens
ctaatgctgcagatttgggctgg

SEQ ID NO: 503774 - DNA, 19 bp, Homo sapiens
ctaatgtgcctagttcttt

SEQ ID NO: 503775 - DNA, 16 bp, Homo sapiens
ctacaatttaaagcaa

SEQ ID NO: 503776 - DNA, 21 bp, Homo sapiens
ctacacagggatgtacaaggc

SEQ ID NO: 503777 - DNA, 20 bp, Homo sapiens
ctacacccttggacttgagg

SEQ ID NO: 503778 - DNA, 15 bp, Homo sapiens
ctacactgacactgg

SEQ ID NO: 503779 - DNA, 20 bp, Homo sapiens
ctaccacacatctgtggaga

SEQ ID NO: 503780 - DNA, 19 bp, Homo sapiens
ctacccaggaggctgaggt

SEQ ID NO: 503781 - DNA, 15 bp, Homo sapiens
ctacctcacctgggc

SEQ ID NO: 503782 - DNA, 18 bp, Homo sapiens
ctagaacctggaagggct

SEQ ID NO: 503783 - DNA, 18 bp, Homo sapiens
ctagaacctggagggctg

SEQ ID NO: 503784 - DNA, 21 bp, Homo sapiens
ctagaagggctagaacctgga

SEQ ID NO: 503785 - DNA, 18 bp, Homo sapiens
ctagaatactaataaaat

SEQ ID NO: 503786 - DNA, 14 bp, Homo sapiens
ctagaggccaggga

SEQ ID NO: 503787 - DNA, 22 bp, Homo sapiens
ctagaggggggatttccagcca

SEQ ID NO: 503788 - DNA, 19 bp, Homo sapiens
ctagagtttagctggaaaa

SEQ ID NO: 503789 - DNA, 14 bp, Homo sapiens
ctagccgacctcag

SEQ ID NO: 503790 - DNA, 16 bp, Homo sapiens
ctagccgacctcagcc

SEQ ID NO: 503791 - DNA, 20 bp, Homo sapiens
ctagccgacctcagccttcc

SEQ ID NO: 503792 - DNA, 15 bp, Homo sapiens
ctaggaaatatttat

SEQ ID NO: 503793 - DNA, 22 bp, Homo sapiens
ctaggaaatatttattttaata

SEQ ID NO: 503794 - DNA, 22 bp, Homo sapiens
ctaggcaggacatgctgaagcc

SEQ ID NO: 503795 - DNA, 19 bp, Homo sapiens
ctaggtggcaaggctgtgc

SEQ ID NO: 503796 - DNA, 21 bp, Homo sapiens
ctaggtttatctcatttaagc

SEQ ID NO: 503797 - DNA, 16 bp, Homo sapiens
ctagtaattggaaagg

SEQ ID NO: 503798 - DNA, 19 bp, Homo sapiens
ctagtatttctatgaaata

SEQ ID NO: 503799 - DNA, 21 bp, Homo sapiens
ctagtgagcagtcaggaaaga

SEQ ID NO: 503800 - DNA, 15 bp, Homo sapiens
ctagtgatggtcaga

SEQ ID NO: 503801 - DNA, 15 bp, Homo sapiens
ctagttatgtgagaa

SEQ ID NO: 503802 - DNA, 13 bp, Homo sapiens
ctatactgcctct

SEQ ID NO: 503803 - DNA, 14 bp, Homo sapiens
ctatagattcttta

SEQ ID NO: 503804 - DNA, 14 bp, Homo sapiens
ctatagtcccagct

SEQ ID NO: 503805 - DNA, 15 bp, Homo sapiens
ctatattgtacacac

SEQ ID NO: 503806 - DNA, 20 bp, Homo sapiens
ctatcaaactgaagccagaa

SEQ ID NO: 503807 - DNA, 11 bp, Homo sapiens
ctatcacctgt

SEQ ID NO: 503808 - DNA, 14 bp, Homo sapiens
ctatcattaaagtt

SEQ ID NO: 503809 - DNA, 15 bp, Homo sapiens
ctatcattaaagttc

SEQ ID NO: 503810 - DNA, 16 bp, Homo sapiens
ctatcattaaagttct

SEQ ID NO: 503811 - DNA, 18 bp, Homo sapiens
ctatctaatttttattaa

SEQ ID NO: 503812 - DNA, 21 bp, Homo sapiens
ctatctaatttttattaattt

SEQ ID NO: 503813 - DNA, 15 bp, Homo sapiens
ctatctttgccaccc

SEQ ID NO: 503814 - DNA, 19 bp, Homo sapiens
ctatgatttggaaaataaa

SEQ ID NO: 503815 - DNA, 19 bp, Homo sapiens
ctatggacggtgctccagg

SEQ ID NO: 503816 - DNA, 21 bp, Homo sapiens
ctattgatataaataaaacat

SEQ ID NO: 503817 - DNA, 11 bp, Homo sapiens
ctattggtaaa

SEQ ID NO: 503818 - DNA, 14 bp, Homo sapiens
ctcaaacactgcag

SEQ ID NO: 503819 - DNA, 18 bp, Homo sapiens
ctcaaaccaaatcactga

SEQ ID NO: 503820 - DNA, 14 bp, Homo sapiens
ctcaacagtttcca

SEQ ID NO: 503821 - DNA, 11 bp, Homo sapiens
ctcaatatttt

SEQ ID NO: 503822 - DNA, 18 bp, Homo sapiens
ctcaatattttccatgaa

SEQ ID NO: 503823 - DNA, 19 bp, Homo sapiens
ctcaattcttccctatctt

SEQ ID NO: 503824 - DNA, 19 bp, Homo sapiens
ctcacaacatggtgtctgg

SEQ ID NO: 503825 - DNA, 16 bp, Homo sapiens
ctcacctctaaaacag

SEQ ID NO: 503826 - DNA, 23 bp, Homo sapiens
ctcactgtgggaaggccagctgc

SEQ ID NO: 503827 - DNA, 19 bp, Homo sapiens
ctcagaaaacaaggatgaa

SEQ ID NO: 503828 - DNA, 16 bp, Homo sapiens
ctcagagtatggagct

SEQ ID NO: 503829 - DNA, 13 bp, Homo sapiens
ctcagcctgtgct

SEQ ID NO: 503830 - DNA, 14 bp, Homo sapiens
ctcagcctgtgctg

SEQ ID NO: 503831 - DNA, 16 bp, Homo sapiens
ctcagcctgtgctgcc

SEQ ID NO: 503832 - DNA, 12 bp, Homo sapiens
ctcagctcccca

SEQ ID NO: 503833 - DNA, 14 bp, Homo sapiens
ctcagctccccaga

SEQ ID NO: 503834 - DNA, 13 bp, Homo sapiens
ctcagggccccag

SEQ ID NO: 503835 - DNA, 16 bp, Homo sapiens
ctcagggtctctgctg

SEQ ID NO: 503836 - DNA, 18 bp, Homo sapiens
ctcagggtctctgctgcc

SEQ ID NO: 503837 - DNA, 19 bp, Homo sapiens
ctcagtaagacgacaagga

SEQ ID NO: 503838 - DNA, 21 bp, Homo sapiens
ctcagtaagacgacaaggaaa

SEQ ID NO: 503839 - DNA, 20 bp, Homo sapiens
ctcagtaagtatctggagga

SEQ ID NO: 503840 - DNA, 21 bp, Homo sapiens
ctcagtaagtatctggaggaa

SEQ ID NO: 503841 - DNA, 19 bp, Homo sapiens
cctatctttgccaccctca

SEQ ID NO: 503842 - DNA, 20 bp, Homo sapiens
cctatctttgccaccctcat

SEQ ID NO: 503843 - DNA, 12 bp, Homo sapiens
cctcaaaagaaa

SEQ ID NO: 503844 - DNA, 23 bp, Homo sapiens
cctcactggggtcctggggcctc

SEQ ID NO: 503845 - DNA, 12 bp, Homo sapiens
cctcagcctgtg

SEQ ID NO: 503846 - DNA, 18 bp, Homo sapiens
cctcagggtccctcagga

SEQ ID NO: 503847 - DNA, 15 bp, Homo sapiens
cctcagtaagacgac

SEQ ID NO: 503848 - DNA, 15 bp, Homo sapiens
cctcatccagggctc

SEQ ID NO: 503849 - DNA, 14 bp, Homo sapiens
cctccacctccctg

SEQ ID NO: 503850 - DNA, 23 bp, Homo sapiens
cctccagtccaaggaaaccacag

SEQ ID NO: 503851 - DNA, 19 bp, Homo sapiens
cctccatattttctttaaa

SEQ ID NO: 503852 - DNA, 20 bp, Homo sapiens
cctcccctggggacagcaag

SEQ ID NO: 503853 - DNA, 23 bp, Homo sapiens
cctcccctggggacagcaagggc

SEQ ID NO: 503854 - DNA, 17 bp, Homo sapiens
cctccctccacctccct

SEQ ID NO: 503855 - DNA, 14 bp, Homo sapiens
cctccgaggccagt

SEQ ID NO: 503856 - DNA, 12 bp, Homo sapiens
cctcctgcctcc

SEQ ID NO: 503857 - DNA, 16 bp, Homo sapiens
cctcggagcctcatcc

SEQ ID NO: 503858 - DNA, 14 bp, Homo sapiens
cctctcctgggcag

SEQ ID NO: 503859 - DNA, 16 bp, Homo sapiens
cctctcctgggcagct

SEQ ID NO: 503860 - DNA, 21 bp, Homo sapiens
cctctcctgggcagctgcctc

SEQ ID NO: 503861 - DNA, 17 bp, Homo sapiens
cctctgccgctgccatg

SEQ ID NO: 503862 - DNA, 11 bp, Homo sapiens
cctctgcctca

SEQ ID NO: 503863 - DNA, 13 bp, Homo sapiens
cctctgcttgcca

SEQ ID NO: 503864 - DNA, 21 bp, Homo sapiens
cctctgtccagggccctgagc

SEQ ID NO: 503865 - DNA, 15 bp, Homo sapiens
cctctttgcatggaa

SEQ ID NO: 503866 - DNA, 11 bp, Homo sapiens
cctgagctaga

SEQ ID NO: 503867 - DNA, 21 bp, Homo sapiens
cctgagctagaagctggagga

SEQ ID NO: 503868 - DNA, 22 bp, Homo sapiens
cctgagctcggtggacccaggg

SEQ ID NO: 503869 - DNA, 23 bp, Homo sapiens
cctgagtctgctatattttcatg

SEQ ID NO: 503870 - DNA, 14 bp, Homo sapiens
cctgagtgcctggc

SEQ ID NO: 503871 - DNA, 15 bp, Homo sapiens
cctgagtgcctggcc

SEQ ID NO: 503872 - DNA, 17 bp, Homo sapiens
cctgatggacctgtcac

SEQ ID NO: 503873 - DNA, 16 bp, Homo sapiens
cctgcaataaaatggg

SEQ ID NO: 503874 - DNA, 19 bp, Homo sapiens
cctgccctagagcacactg

SEQ ID NO: 503875 - DNA, 24 bp, Homo sapiens
cctgccctagagcacactgtagca

SEQ ID NO: 503876 - DNA, 23 bp, Homo sapiens
cctgccttggagtcgtctggcat

SEQ ID NO: 503877 - DNA, 14 bp, Homo sapiens
cctgctcctcagga

SEQ ID NO: 503878 - DNA, 12 bp, Homo sapiens
cctggaagacag

SEQ ID NO: 503879 - DNA, 13 bp, Homo sapiens
cctggaagggcta

SEQ ID NO: 503880 - DNA, 14 bp, Homo sapiens
cctggagagccaga

SEQ ID NO: 503881 - DNA, 19 bp, Homo sapiens
cctggagagctagaaccta

SEQ ID NO: 503882 - DNA, 21 bp, Homo sapiens
cctggagagctagaacctaga

SEQ ID NO: 503883 - DNA, 23 bp, Homo sapiens
cctggagggctagaacctggaga

SEQ ID NO: 503884 - DNA, 20 bp, Homo sapiens
cctggaggggctagaaccta

SEQ ID NO: 503885 - DNA, 14 bp, Homo sapiens
cctggccagggcct

SEQ ID NO: 503886 - DNA, 20 bp, Homo sapiens
cctggccagggcctggaaga

SEQ ID NO: 503887 - DNA, 23 bp, Homo sapiens
cctggccagggcctggaagacag

SEQ ID NO: 503888 - DNA, 13 bp, Homo sapiens
cctgggaggcaga

SEQ ID NO: 503889 - DNA, 16 bp, Homo sapiens
cctgggcaacagagca

SEQ ID NO: 503890 - DNA, 19 bp, Homo sapiens
cctgggcaacagagcaaga

SEQ ID NO: 503891 - DNA, 22 bp, Homo sapiens
cctgggcaacagagcaagactc

SEQ ID NO: 503892 - DNA, 13 bp, Homo sapiens
cctgggcagctgc

SEQ ID NO: 503893 - DNA, 17 bp, Homo sapiens
cctgggcagctgcctcc

SEQ ID NO: 503894 - DNA, 18 bp, Homo sapiens
cctgggcagctgcctccc

SEQ ID NO: 503895 - DNA, 20 bp, Homo sapiens
cctgggcagctgcctcccct

SEQ ID NO: 503896 - DNA, 15 bp, Homo sapiens
cctgggctttctgga

SEQ ID NO: 503897 - DNA, 16 bp, Homo sapiens
cctgggtttaagggga

SEQ ID NO: 503898 - DNA, 18 bp, Homo sapiens
cctgtccacacccagctc

SEQ ID NO: 503899 - DNA, 15 bp, Homo sapiens
cctgtctgccagcca

SEQ ID NO: 503900 - DNA, 14 bp, Homo sapiens
cctgtgggcgcata

SEQ ID NO: 503901 - DNA, 20 bp, Homo sapiens
cctgtgtgttgccaggcagg

SEQ ID NO: 503902 - DNA, 21 bp, Homo sapiens
cctgtgtgttgccaggcaggc

SEQ ID NO: 503903 - DNA, 15 bp, Homo sapiens
cctgttagccaggtg

SEQ ID NO: 503904 - DNA, 23 bp, Homo sapiens
caggttagaacctagaagggcta

SEQ ID NO: 503905 - DNA, 16 bp, Homo sapiens
caggttatctgggcat

SEQ ID NO: 503906 - DNA, 17 bp, Homo sapiens
caggtttctggtctcta

SEQ ID NO: 503907 - DNA, 16 bp, Homo sapiens
cagtaaacagaggagt

SEQ ID NO: 503908 - DNA, 12 bp, Homo sapiens
cagtcaccccag

SEQ ID NO: 503909 - DNA, 16 bp, Homo sapiens
cagtcacctcatggaa

SEQ ID NO: 503910 - DNA, 18 bp, Homo sapiens
cagtcacgtggaggagca

SEQ ID NO: 503911 - DNA, 23 bp, Homo sapiens
cagtcacgtggaggagcagtgca

SEQ ID NO: 503912 - DNA, 14 bp, Homo sapiens
cagtccagcctgga

SEQ ID NO: 503913 - DNA, 15 bp, Homo sapiens
cagtccagcctggag

SEQ ID NO: 503914 - DNA, 22 bp, Homo sapiens
cagtctgatgagaactctgagc

SEQ ID NO: 503915 - DNA, 14 bp, Homo sapiens
cagtgcaggcacag

SEQ ID NO: 503916 - DNA, 18 bp, Homo sapiens
cagtgcttgccacagagc

SEQ ID NO: 503917 - DNA, 13 bp, Homo sapiens
cagtggctgctgc

SEQ ID NO: 503918 - DNA, 15 bp, Homo sapiens
cagttcctctttgca

SEQ ID NO: 503919 - DNA, 23 bp, Homo sapiens
cagttcctctttgcatggaattt

SEQ ID NO: 503920 - DNA, 16 bp, Homo sapiens
cagttctgaagaagat

SEQ ID NO: 503921 - DNA, 13 bp, Homo sapiens
cagttgttttccc

SEQ ID NO: 503922 - DNA, 18 bp, Homo sapiens
cagtttccagtcatggcc

SEQ ID NO: 503923 - DNA, 18 bp, Homo sapiens
cataaataaaatgaccag

SEQ ID NO: 503924 - DNA, 15 bp, Homo sapiens
cataagctagaaaaa

SEQ ID NO: 503925 - DNA, 15 bp, Homo sapiens
catactatagattct

SEQ ID NO: 503926 - DNA, 20 bp, Homo sapiens
catagctagttatgtgagaa

SEQ ID NO: 503927 - DNA, 18 bp, Homo sapiens
cataggaacatgtagttt

SEQ ID NO: 503928 - DNA, 16 bp, Homo sapiens
cataggaggggtctgg

SEQ ID NO: 503929 - DNA, 20 bp, Homo sapiens
catagtgagacccctgtctc

SEQ ID NO: 503930 - DNA, 21 bp, Homo sapiens
catagtgagacccctgtctcc

SEQ ID NO: 503931 - DNA, 15 bp, Homo sapiens
catatataacaatgc

SEQ ID NO: 503932 - DNA, 16 bp, Homo sapiens
catattaaaatcacaa

SEQ ID NO: 503933 - DNA, 17 bp, Homo sapiens
catattgataataaaat

SEQ ID NO: 503934 - DNA, 18 bp, Homo sapiens
catattgataataaaatt

SEQ ID NO: 503935 - DNA, 20 bp, Homo sapiens
catattgataataaaattca

SEQ ID NO: 503936 - DNA, 22 bp, Homo sapiens
catattgataataaaattcatt

SEQ ID NO: 503937 - DNA, 14 bp, Homo sapiens
catattgttattat

SEQ ID NO: 503938 - DNA, 15 bp, Homo sapiens
catcaaatggaagac

SEQ ID NO: 503939 - DNA, 16 bp, Homo sapiens
catcaagactggaagg

SEQ ID NO: 503940 - DNA, 21 bp, Homo sapiens
catcacatttgtaaatgtctt

SEQ ID NO: 503941 - DNA, 14 bp, Homo sapiens
catcagtggagcca

SEQ ID NO: 503942 - DNA, 18 bp, Homo sapiens
catcagttagagctgaca

SEQ ID NO: 503943 - DNA, 13 bp, Homo sapiens
catcatcaaggca

SEQ ID NO: 503944 - DNA, 20 bp, Homo sapiens
catcatcaaggcactgcctg

SEQ ID NO: 503945 - DNA, 15 bp, Homo sapiens
catcattaaattttt

SEQ ID NO: 503946 - DNA, 19 bp, Homo sapiens
catccacacaacaccagga

SEQ ID NO: 503947 - DNA, 19 bp, Homo sapiens
catccagggctctgaccag

SEQ ID NO: 503948 - DNA, 20 bp, Homo sapiens
catccctccctccacctccc

SEQ ID NO: 503949 - DNA, 21 bp, Homo sapiens
cagagtcacacgggggcagct

SEQ ID NO: 503950 - DNA, 18 bp, Homo sapiens
cagagttccccatgcaga

SEQ ID NO: 503951 - DNA, 24 bp, Homo sapiens
cagagttccccatgcagacatgag

SEQ ID NO: 503952 - DNA, 22 bp, Homo sapiens
cagagtttgatatgggctttct

SEQ ID NO: 503953 - DNA, 23 bp, Homo sapiens
cagagtttgatatgggctttctc

SEQ ID NO: 503954 - DNA, 14 bp, Homo sapiens
cagatcacgaggtc

SEQ ID NO: 503955 - DNA, 14 bp, Homo sapiens
cagatcctcttctc

SEQ ID NO: 503956 - DNA, 13 bp, Homo sapiens
cagatcctggaaa

SEQ ID NO: 503957 - DNA, 23 bp, Homo sapiens
cagatggcggtgatcagcagaga

SEQ ID NO: 503958 - DNA, 14 bp, Homo sapiens
cagatgggggaaag

SEQ ID NO: 503959 - DNA, 14 bp, Homo sapiens
cagattcacactgt

SEQ ID NO: 503960 - DNA, 22 bp, Homo sapiens
cagcaaaatgtgaatgggaaaa

SEQ ID NO: 503961 - DNA, 22 bp, Homo sapiens
cagcaagaagatcctaaaacaa

SEQ ID NO: 503962 - DNA, 14 bp, Homo sapiens
cagcactaaagcag

SEQ ID NO: 503963 - DNA, 17 bp, Homo sapiens
cagcactgactggaagg

SEQ ID NO: 503964 - DNA, 22 bp, Homo sapiens
cagcactttgggaggctgaggt

SEQ ID NO: 503965 - DNA, 12 bp, Homo sapiens
cagcagctcagg

SEQ ID NO: 503966 - DNA, 14 bp, Homo sapiens
cagcagctcaggca

SEQ ID NO: 503967 - DNA, 22 bp, Homo sapiens
cagcagttcagagctgccctct

SEQ ID NO: 503968 - DNA, 18 bp, Homo sapiens
cagcatcccttgaccagg

SEQ ID NO: 503969 - DNA, 18 bp, Homo sapiens
cagcattttactgattca

SEQ ID NO: 503970 - DNA, 21 bp, Homo sapiens
cagccaacgagtaatttattg

SEQ ID NO: 503971 - DNA, 22 bp, Homo sapiens
cagccagatggactccagcctg

SEQ ID NO: 503972 - DNA, 11 bp, Homo sapiens
cagccagcagc

SEQ ID NO: 503973 - DNA, 15 bp, Homo sapiens
cagccagcagccagc

SEQ ID NO: 503974 - DNA, 21 bp, Homo sapiens
cagccagcagttcagagctgc

SEQ ID NO: 503975 - DNA, 12 bp, Homo sapiens
cagccagctctc

SEQ ID NO: 503976 - DNA, 16 bp, Homo sapiens
cagccagctctcagcc

SEQ ID NO: 503977 - DNA, 21 bp, Homo sapiens
cagccagctctcagccaacga

SEQ ID NO: 503978 - DNA, 12 bp, Homo sapiens
cagccagggctg

SEQ ID NO: 503979 - DNA, 15 bp, Homo sapiens
cagccagggctgcta

SEQ ID NO: 503980 - DNA, 23 bp, Homo sapiens
cagccagggctgctagacggagg

SEQ ID NO: 503981 - DNA, 17 bp, Homo sapiens
cagcccaaagaaggaaa

SEQ ID NO: 503982 - DNA, 21 bp, Homo sapiens
cagcccccactgcctttgacc

SEQ ID NO: 503983 - DNA, 19 bp, Homo sapiens
cagcccctgatcctgtgaa

SEQ ID NO: 503984 - DNA, 12 bp, Homo sapiens
agtggctgctgc

SEQ ID NO: 503985 - DNA, 13 bp, Homo sapiens
agtggctgctgcc

SEQ ID NO: 503986 - DNA, 14 bp, Homo sapiens
agtggctgctgccc

SEQ ID NO: 503987 - DNA, 16 bp, Homo sapiens
agtggctgctgcccag

SEQ ID NO: 503988 - DNA, 17 bp, Homo sapiens
agtggctgctgcccagg

SEQ ID NO: 503989 - DNA, 20 bp, Homo sapiens
agtggcttcattagagcagg

SEQ ID NO: 503990 - DNA, 22 bp, Homo sapiens
agtggcttcattagagcaggcg

SEQ ID NO: 503991 - DNA, 20 bp, Homo sapiens
agtgggcatcagcagcaggg

SEQ ID NO: 503992 - DNA, 14 bp, Homo sapiens
agtggtggcagctc

SEQ ID NO: 503993 - DNA, 15 bp, Homo sapiens
agtggtggcagctca

SEQ ID NO: 503994 - DNA, 14 bp, Homo sapiens
agtgtccaaagcag

SEQ ID NO: 503995 - DNA, 17 bp, Homo sapiens
agtgtccaaagcagggt

SEQ ID NO: 503996 - DNA, 21 bp, Homo sapiens
agtgtccaaagcagggtctgg

SEQ ID NO: 503997 - DNA, 16 bp, Homo sapiens
agtgtctggcacacag

SEQ ID NO: 503998 - DNA, 14 bp, Homo sapiens
agtgttggagaaga

SEQ ID NO: 503999 - DNA, 16 bp, Homo sapiens
agtgttggagaagaac

SEQ ID NO: 504000 - DNA, 23 bp, Homo sapiens
agtgttggagaagaactgaaatc

SEQ ID NO: 504001 - DNA, 23 bp, Homo sapiens
agttactatcatgtcaaacgtga

SEQ ID NO: 504002 - DNA, 12 bp, Homo sapiens
agttagagctga

SEQ ID NO: 504003 - DNA, 17 bp, Homo sapiens
agttagggaatggcaca

SEQ ID NO: 504004 - DNA, 15 bp, Homo sapiens
agttcagagctgccc

SEQ ID NO: 504005 - DNA, 18 bp, Homo sapiens
agttcagagctgccctct

SEQ ID NO: 504006 - DNA, 20 bp, Homo sapiens
agttcagagctgccctctcc

SEQ ID NO: 504007 - DNA, 23 bp, Homo sapiens
agttcagagctgccctctcctgg

SEQ ID NO: 504008 - DNA, 14 bp, Homo sapiens
agttccccatgcag

SEQ ID NO: 504009 - DNA, 21 bp, Homo sapiens
agttcctctttgcatggaatt

SEQ ID NO: 504010 - DNA, 22 bp, Homo sapiens
agttctatttctatcccaaact

SEQ ID NO: 504011 - DNA, 19 bp, Homo sapiens
agttctgccttatctaaat

SEQ ID NO: 504012 - DNA, 22 bp, Homo sapiens
agttgacttgacagaacactgt

SEQ ID NO: 504013 - DNA, 15 bp, Homo sapiens
agttgatatagaaca

SEQ ID NO: 504014 - DNA, 21 bp, Homo sapiens
agttgatatgccttttcccaa

SEQ ID NO: 504015 - DNA, 15 bp, Homo sapiens
agttgcaatagaaca

SEQ ID NO: 504016 - DNA, 14 bp, Homo sapiens
agttgctcctcagg

SEQ ID NO: 504017 - DNA, 20 bp, Homo sapiens
agttgctgtccccttccagg

SEQ ID NO: 504018 - DNA, 15 bp, Homo sapiens
agttgttgccctggg

SEQ ID NO: 504019 - DNA, 15 bp, Homo sapiens
agttgtttcattgac

SEQ ID NO: 504020 - DNA, 13 bp, Homo sapiens
agtttacagtaaa

SEQ ID NO: 504021 - DNA, 14 bp, Homo sapiens
agtttacagtaaat

SEQ ID NO: 504022 - DNA, 22 bp, Homo sapiens
agtttacagtaaataaattgtt

SEQ ID NO: 504023 - DNA, 17 bp, Homo sapiens
agtttcactgccatata

SEQ ID NO: 504024 - DNA, 20 bp, Homo sapiens
agtttgatatgggctttctc

SEQ ID NO: 504025 - DNA, 13 bp, Homo sapiens
agtttgcagagga

SEQ ID NO: 504026 - DNA, 18 bp, Homo sapiens
agtttgtcacatgaaaca

SEQ ID NO: 504027 - DNA, 20 bp, Homo sapiens
ataaaacattttcacacaat

SEQ ID NO: 504028 - DNA, 20 bp, Homo sapiens
ataaaaggtcggaccagctt

SEQ ID NO: 504029 - DNA, 12 bp, Homo sapiens
ataaaataattt

SEQ ID NO: 504030 - DNA, 15 bp, Homo sapiens
ataaaataattttta

SEQ ID NO: 504031 - DNA, 18 bp, Homo sapiens
ataaaatccatacatttg

SEQ ID NO: 504032 - DNA, 16 bp, Homo sapiens
ataaaattaaagctga

SEQ ID NO: 504033 - DNA, 12 bp, Homo sapiens
ataaaattcatt

SEQ ID NO: 504034 - DNA, 16 bp, Homo sapiens
ataaaattcattccat

SEQ ID NO: 504035 - DNA, 18 bp, Homo sapiens
ataaaattcattccattt

SEQ ID NO: 504036 - DNA, 15 bp, Homo sapiens
ataaaccacaagcat

SEQ ID NO: 504037 - DNA, 17 bp, Homo sapiens
ataaaccacaagcatct

SEQ ID NO: 504038 - DNA, 16 bp, Homo sapiens
ataaagacctataaat

SEQ ID NO: 504039 - DNA, 15 bp, Homo sapiens
ataaagcaatgaata

SEQ ID NO: 504040 - DNA, 21 bp, Homo sapiens
ataaagctgttctcattcctg

SEQ ID NO: 504041 - DNA, 16 bp, Homo sapiens
ataaagttggtgacag

SEQ ID NO: 504042 - DNA, 14 bp, Homo sapiens
ataaataaaatgac

SEQ ID NO: 504043 - DNA, 19 bp, Homo sapiens
ataaattgtaattgtaaag

SEQ ID NO: 504044 - DNA, 15 bp, Homo sapiens
ataacaacctggaga

SEQ ID NO: 504045 - DNA, 19 bp, Homo sapiens
ataacaatgctgtatttta

SEQ ID NO: 504046 - DNA, 21 bp, Homo sapiens
ataacaatgctgtattttaaa

SEQ ID NO: 504047 - DNA, 13 bp, Homo sapiens
ataacacacagct

SEQ ID NO: 504048 - DNA, 23 bp, Homo sapiens
ataacacacagctaacacacagc

SEQ ID NO: 504049 - DNA, 16 bp, Homo sapiens
ataacataagctagaa

SEQ ID NO: 504050 - DNA, 12 bp, Homo sapiens
ataactggaaac

SEQ ID NO: 504051 - DNA, 17 bp, Homo sapiens
ataactgtgcagagact

SEQ ID NO: 504052 - DNA, 17 bp, Homo sapiens
ataagagggcacacact

SEQ ID NO: 504053 - DNA, 13 bp, Homo sapiens
ataagggcagagt

SEQ ID NO: 504054 - DNA, 21 bp, Homo sapiens
ataagtccttgcaagaatcag

SEQ ID NO: 504055 - DNA, 22 bp, Homo sapiens
ataagttaactattttattttc

SEQ ID NO: 504056 - DNA, 23 bp, Homo sapiens
ataagttctagttgcttgtaaaa

SEQ ID NO: 504057 - DNA, 13 bp, Homo sapiens
ataatacattccg

SEQ ID NO: 504058 - DNA, 14 bp, Homo sapiens
ataatatttttaat

SEQ ID NO: 504059 - DNA, 21 bp, Homo sapiens
ataatctttcacaggggacag

SEQ ID NO: 504060 - DNA, 23 bp, Homo sapiens
ataatgtttcaaacatatataac

SEQ ID NO: 504061 - DNA, 19 bp, Homo sapiens
ataatttttatatttgaaa

SEQ ID NO: 504062 - DNA, 14 bp, Homo sapiens
atacagagctctct

SEQ ID NO: 504063 - DNA, 18 bp, Homo sapiens
atacagagctctctgagg

SEQ ID NO: 504064 - DNA, 21 bp, Homo sapiens
atacatactatagattcttta

SEQ ID NO: 504065 - DNA, 17 bp, Homo sapiens
atacattgaattagaaa

SEQ ID NO: 504066 - DNA, 16 bp, Homo sapiens
ataccacccaatgctg

SEQ ID NO: 504067 - DNA, 15 bp, Homo sapiens
atacctttgccttgg

SEQ ID NO: 504068 - DNA, 12 bp, Homo sapiens
atactaataaaa

SEQ ID NO: 504069 - DNA, 13 bp, Homo sapiens
atactaataaaat

SEQ ID NO: 504070 - DNA, 17 bp, Homo sapiens
atagaacagagaaagag

SEQ ID NO: 504071 - DNA, 16 bp, Homo sapiens
atagaagaacagcaga

SEQ ID NO: 504072 - DNA, 13 bp, Homo sapiens
atagagtcttgct

SEQ ID NO: 504073 - DNA, 14 bp, Homo sapiens
atagcagctgctac

SEQ ID NO: 504074 - DNA, 12 bp, Homo sapiens
atagccaaaaat

SEQ ID NO: 504075 - DNA, 18 bp, Homo sapiens
atagctagttatgtgaga

SEQ ID NO: 504076 - DNA, 14 bp, Homo sapiens
atagctgtgtgaac

SEQ ID NO: 504077 - DNA, 23 bp, Homo sapiens
atagctgtgtgaacgtgtatgta

SEQ ID NO: 504078 - DNA, 23 bp, Homo sapiens
ataggaggggtctggacatgtgg

SEQ ID NO: 504079 - DNA, 17 bp, Homo sapiens
atagtcaaattgtgtga

SEQ ID NO: 504080 - DNA, 15 bp, Homo sapiens
atagttgctgtcccc

SEQ ID NO: 504081 - DNA, 20 bp, Homo sapiens
atagttgctgtccccttcca

SEQ ID NO: 504082 - DNA, 15 bp, Homo sapiens
atataaacactatat

SEQ ID NO: 504083 - DNA, 18 bp, Homo sapiens
atataaataaaacatttt

SEQ ID NO: 504084 - DNA, 15 bp, Homo sapiens
atataacaatgctgt

SEQ ID NO: 504085 - DNA, 19 bp, Homo sapiens
atataagcttgtattcctt

SEQ ID NO: 504086 - DNA, 17 bp, Homo sapiens
atatataacaatgctgt

SEQ ID NO: 504087 - DNA, 19 bp, Homo sapiens
atatataacaatgctgtat

SEQ ID NO: 504088 - DNA, 19 bp, Homo sapiens
atatgacattcatgcctgg

SEQ ID NO: 504089 - DNA, 18 bp, Homo sapiens
atatgatgtttaaaagca

SEQ ID NO: 504090 - DNA, 20 bp, Homo sapiens
atatgatgtttaaaagcata

SEQ ID NO: 504091 - DNA, 19 bp, Homo sapiens
atatgggctttctctttgg

SEQ ID NO: 504092 - DNA, 14 bp, Homo sapiens
atattaaaaattaa

SEQ ID NO: 504093 - DNA, 17 bp, Homo sapiens
atattaaaaattaattc

SEQ ID NO: 504094 - DNA, 14 bp, Homo sapiens
atattaaaatcaca

SEQ ID NO: 504095 - DNA, 14 bp, Homo sapiens
atattatgttaaaa

SEQ ID NO: 504096 - DNA, 16 bp, Homo sapiens
atattatgttaaaact

SEQ ID NO: 504097 - DNA, 17 bp, Homo sapiens
atattcaaaaattatat

SEQ ID NO: 504098 - DNA, 21 bp, Homo sapiens
atattgggtctcagccctagg

SEQ ID NO: 504099 - DNA, 14 bp, Homo sapiens
atattgtttgctaa

SEQ ID NO: 504100 - DNA, 14 bp, Homo sapiens
atatttacgtatga

SEQ ID NO: 504101 - DNA, 13 bp, Homo sapiens
atatttattttaa

SEQ ID NO: 504102 - DNA, 18 bp, Homo sapiens
atatttattttaataatg

SEQ ID NO: 504103 - DNA, 23 bp, Homo sapiens
atatttcagataatcacaataca

SEQ ID NO: 504104 - DNA, 21 bp, Homo sapiens
atatttccctcccctggggac

SEQ ID NO: 504105 - DNA, 23 bp, Homo sapiens
atatttgaaatattgacttttta

SEQ ID NO: 504106 - DNA, 11 bp, Homo sapiens
atattttaatt

SEQ ID NO: 504107 - DNA, 21 bp, Homo sapiens
atcaaatggaagacacattga

SEQ ID NO: 504108 - DNA, 15 bp, Homo sapiens
atcaaggcactgcct

SEQ ID NO: 504109 - DNA, 16 bp, Homo sapiens
atcaagggtacactgc

SEQ ID NO: 504110 - DNA, 22 bp, Homo sapiens
atcaagttggcttctaatcaaa

SEQ ID NO: 504111 - DNA, 23 bp, Homo sapiens
atcaagttggcttctaatcaaag

SEQ ID NO: 504112 - DNA, 14 bp, Homo sapiens
atcacagcagcttc

SEQ ID NO: 504113 - DNA, 18 bp, Homo sapiens
atcactcatttatttcca

SEQ ID NO: 504114 - DNA, 19 bp, Homo sapiens
atcacttgagacaaatcta

SEQ ID NO: 504115 - DNA, 20 bp, Homo sapiens
atcagaaacaccctcacact

SEQ ID NO: 504116 - DNA, 12 bp, Homo sapiens
atcagcagagag

SEQ ID NO: 504117 - DNA, 13 bp, Homo sapiens
atcagcttattgt

SEQ ID NO: 504118 - DNA, 13 bp, Homo sapiens
atcaggagaaaaa

SEQ ID NO: 504119 - DNA, 22 bp, Homo sapiens
atcaggagaaaaagcctccagt

SEQ ID NO: 504120 - DNA, 13 bp, Homo sapiens
atcagtggagcca

SEQ ID NO: 504121 - DNA, 22 bp, Homo sapiens
atcagttgaggccaggagttta

SEQ ID NO: 504122 - DNA, 18 bp, Homo sapiens
atcatcaaggcactgcct

SEQ ID NO: 504123 - DNA, 18 bp, Homo sapiens
atcatctgtggaacccat

SEQ ID NO: 504124 - DNA, 13 bp, Homo sapiens
atcattaaagttc

SEQ ID NO: 504125 - DNA, 15 bp, Homo sapiens
atcattaaagttcta

SEQ ID NO: 504126 - DNA, 13 bp, Homo sapiens
atccctccctcca

SEQ ID NO: 504127 - DNA, 17 bp, Homo sapiens
attctgacccagggcct

SEQ ID NO: 504128 - DNA, 16 bp, Homo sapiens
attcttacaaacatgt

SEQ ID NO: 504129 - DNA, 21 bp, Homo sapiens
attcttacaaacatgtggtta

SEQ ID NO: 504130 - DNA, 20 bp, Homo sapiens
attcttggttggctggcctt

SEQ ID NO: 504131 - DNA, 16 bp, Homo sapiens
attgacaactgaagag

SEQ ID NO: 504132 - DNA, 21 bp, Homo sapiens
attgactatcaaactgaagcc

SEQ ID NO: 504133 - DNA, 22 bp, Homo sapiens
attgaggacactgatatgggtc

SEQ ID NO: 504134 - DNA, 22 bp, Homo sapiens
attgataagagggcacacactg

SEQ ID NO: 504135 - DNA, 19 bp, Homo sapiens
attgcactctagcctggca

SEQ ID NO: 504136 - DNA, 22 bp, Homo sapiens
attgccaagctcaggaccaggc

SEQ ID NO: 504137 - DNA, 23 bp, Homo sapiens
attgcctttagtgatcacagcag

SEQ ID NO: 504138 - DNA, 13 bp, Homo sapiens
attggacttccat

SEQ ID NO: 504139 - DNA, 22 bp, Homo sapiens
attggagaagtaatcctaggga

SEQ ID NO: 504140 - DNA, 19 bp, Homo sapiens
attggggaagactgtggct

SEQ ID NO: 504141 - DNA, 17 bp, Homo sapiens
attggtctcctctcagc

SEQ ID NO: 504142 - DNA, 23 bp, Homo sapiens
attgtaaaaccccatctctacta

SEQ ID NO: 504143 - DNA, 17 bp, Homo sapiens
attgtaaaattgtatag

SEQ ID NO: 504144 - DNA, 15 bp, Homo sapiens
attgtcatcaggaga

SEQ ID NO: 504145 - DNA, 13 bp, Homo sapiens
attgttcagaaga

SEQ ID NO: 504146 - DNA, 22 bp, Homo sapiens
atttaacttgagggtaataaac

SEQ ID NO: 504147 - DNA, 23 bp, Homo sapiens
atttaacttgagggtaataaact

SEQ ID NO: 504148 - DNA, 13 bp, Homo sapiens
atttagatgtata

SEQ ID NO: 504149 - DNA, 22 bp, Homo sapiens
atttatttccatattaaaatca

SEQ ID NO: 504150 - DNA, 17 bp, Homo sapiens
atttattttaataatgt

SEQ ID NO: 504151 - DNA, 20 bp, Homo sapiens
atttattttgactgtgattt

SEQ ID NO: 504152 - DNA, 12 bp, Homo sapiens
atttcacttaat

SEQ ID NO: 504153 - DNA, 19 bp, Homo sapiens
atttcatttttacccttac

SEQ ID NO: 504154 - DNA, 15 bp, Homo sapiens
atttccaagagctga

SEQ ID NO: 504155 - DNA, 16 bp, Homo sapiens
atttccatattaaaat

SEQ ID NO: 504156 - DNA, 13 bp, Homo sapiens
atttcctttggct

SEQ ID NO: 504157 - DNA, 17 bp, Homo sapiens
atttctacctttctgag

SEQ ID NO: 504158 - DNA, 13 bp, Homo sapiens
atttctatcccaa

SEQ ID NO: 504159 - DNA, 14 bp, Homo sapiens
atttctatgaaata

SEQ ID NO: 504160 - DNA, 18 bp, Homo sapiens
atttctatgaaatattat

SEQ ID NO: 504161 - DNA, 20 bp, Homo sapiens
atttctatgaaatattatgt

SEQ ID NO: 504162 - DNA, 13 bp, Homo sapiens
atttcttaaacaa

SEQ ID NO: 504163 - DNA, 14 bp, Homo sapiens
atttcttactcaaa

SEQ ID NO: 504164 - DNA, 14 bp, Homo sapiens
atttgaaatattga

SEQ ID NO: 504165 - DNA, 23 bp, Homo sapiens
atttgaggagcagcttcagttgt

SEQ ID NO: 504166 - DNA, 18 bp, Homo sapiens
atttgagtgattatttgt

SEQ ID NO: 504167 - DNA, 22 bp, Homo sapiens
atttgcagagacaggacctgac

SEQ ID NO: 504168 - DNA, 17 bp, Homo sapiens
atttgcatatgtatgac

SEQ ID NO: 504169 - DNA, 14 bp, Homo sapiens
atttgctcatggaa

SEQ ID NO: 504170 - DNA, 19 bp, Homo sapiens
atttggaatcatatgggat

SEQ ID NO: 504171 - DNA, 20 bp, Homo sapiens
atttggtttggccatctctg

SEQ ID NO: 504172 - DNA, 23 bp, Homo sapiens
atttgtaagtttatgtctaaaga

SEQ ID NO: 504173 - DNA, 18 bp, Homo sapiens
atttgtacagttcagttc

SEQ ID NO: 504174 - DNA, 19 bp, Homo sapiens
atttgtagtgttggagaag

SEQ ID NO: 504175 - DNA, 17 bp, Homo sapiens
atttgtatctgaaggag

SEQ ID NO: 504176 - DNA, 12 bp, Homo sapiens
atttgttaatgg

SEQ ID NO: 504177 - DNA, 17 bp, Homo sapiens
atttgttatttgtacag

SEQ ID NO: 504178 - DNA, 16 bp, Homo sapiens
attttaaaagaatgat

SEQ ID NO: 504179 - DNA, 17 bp, Homo sapiens
attttaaaagaatgatt

SEQ ID NO: 504180 - DNA, 18 bp, Homo sapiens
attttaaaagaatgatta

SEQ ID NO: 504181 - DNA, 16 bp, Homo sapiens
attttaataatgtttc

SEQ ID NO: 504182 - DNA, 19 bp, Homo sapiens
attttaataatgtttcaaa

SEQ ID NO: 504183 - DNA, 15 bp, Homo sapiens
attttatacattaac

SEQ ID NO: 504184 - DNA, 21 bp, Homo sapiens
attttatgccttttatttctt

SEQ ID NO: 504185 - DNA, 20 bp, Homo sapiens
attttcacacaatacaataa

SEQ ID NO: 504186 - DNA, 15 bp, Homo sapiens
attttcacataaaat

SEQ ID NO: 504187 - DNA, 19 bp, Homo sapiens
attttcatgacttttccat

SEQ ID NO: 504188 - DNA, 21 bp, Homo sapiens
attttctagaatactaataaa

SEQ ID NO: 504189 - DNA, 22 bp, Homo sapiens
attttctagaatactaataaaa

SEQ ID NO: 504190 - DNA, 23 bp, Homo sapiens
attttctagaatactaataaaat

SEQ ID NO: 504191 - DNA, 18 bp, Homo sapiens
attttgactgtgatttat

SEQ ID NO: 504192 - DNA, 21 bp, Homo sapiens
attttgagtatctcggacctt

SEQ ID NO: 504193 - DNA, 22 bp, Homo sapiens
attttggatctatcacctgtca

SEQ ID NO: 504194 - DNA, 19 bp, Homo sapiens
atttttatatttgaaatat

SEQ ID NO: 504195 - DNA, 12 bp, Homo sapiens
atttttcttgcg

SEQ ID NO: 504196 - DNA, 19 bp, Homo sapiens
caaaaactagtaaagacat

SEQ ID NO: 504197 - DNA, 19 bp, Homo sapiens
caaaaatctcaatatttca

SEQ ID NO: 504198 - DNA, 16 bp, Homo sapiens
caaaagaaagagaaat

SEQ ID NO: 504199 - DNA, 18 bp, Homo sapiens
caaaataaagctgttctc

SEQ ID NO: 504200 - DNA, 21 bp, Homo sapiens
caaaattttttctctaggaaa

SEQ ID NO: 504201 - DNA, 13 bp, Homo sapiens
caaacacattaag

SEQ ID NO: 504202 - DNA, 20 bp, Homo sapiens
caaacactgcaggcatcaca

SEQ ID NO: 504203 - DNA, 17 bp, Homo sapiens
caaacatatataacaat

SEQ ID NO: 504204 - DNA, 12 bp, Homo sapiens
caaacctgcctg

SEQ ID NO: 504205 - DNA, 14 bp, Homo sapiens
caaactcatccatt

SEQ ID NO: 504206 - DNA, 17 bp, Homo sapiens
caaactcatccattaat

SEQ ID NO: 504207 - DNA, 17 bp, Homo sapiens
caaactgactcttaaga

SEQ ID NO: 504208 - DNA, 23 bp, Homo sapiens
caaacttccagtgcaacactgaa

SEQ ID NO: 504209 - DNA, 19 bp, Homo sapiens
caaagaaggaaaaggcagg

SEQ ID NO: 504210 - DNA, 13 bp, Homo sapiens
caaaggccatgga

SEQ ID NO: 504211 - DNA, 23 bp, Homo sapiens
caaaggctgagaacactgtgaaa

SEQ ID NO: 504212 - DNA, 15 bp, Homo sapiens
caaagtctaaagttt

SEQ ID NO: 504213 - DNA, 17 bp, Homo sapiens
caaagtctaaagtttac

SEQ ID NO: 504214 - DNA, 20 bp, Homo sapiens
caaagtctaaagtttacagt

SEQ ID NO: 504215 - DNA, 10 bp, Homo sapiens
caaataaaat

SEQ ID NO: 504216 - DNA, 15 bp, Homo sapiens
caaatccttgaagat

SEQ ID NO: 504217 - DNA, 19 bp, Homo sapiens
caaatgcccaagggaaaga

SEQ ID NO: 504218 - DNA, 21 bp, Homo sapiens
caaatggaaaggagaggaaag

SEQ ID NO: 504219 - DNA, 19 bp, Homo sapiens
caaatggaagacacattga

SEQ ID NO: 504220 - DNA, 13 bp, Homo sapiens
caaatgggactga

SEQ ID NO: 504221 - DNA, 18 bp, Homo sapiens
caaatgggactgatgtca

SEQ ID NO: 504222 - DNA, 20 bp, Homo sapiens
caaatgggactgatgtcatc

SEQ ID NO: 504223 - DNA, 21 bp, Homo sapiens
caaatgggactgatgtcatct

SEQ ID NO: 504224 - DNA, 15 bp, Homo sapiens
caaattccaatacat

SEQ ID NO: 504225 - DNA, 16 bp, Homo sapiens
caaattccaatacatt

SEQ ID NO: 504226 - DNA, 21 bp, Homo sapiens
caacaacatgtataatatttt

SEQ ID NO: 504227 - DNA, 22 bp, Homo sapiens
caacaacatgtataatattttt

SEQ ID NO: 504228 - DNA, 15 bp, Homo sapiens
caacaccccacagga

SEQ ID NO: 504229 - DNA, 14 bp, Homo sapiens
caacagagcaagac

SEQ ID NO: 504230 - DNA, 13 bp, Homo sapiens
caacatgtataat

SEQ ID NO: 504231 - DNA, 15 bp, Homo sapiens
caacattaaacacaa

SEQ ID NO: 504232 - DNA, 22 bp, Homo sapiens
caaccgccacacacacaggagc

SEQ ID NO: 504233 - DNA, 14 bp, Homo sapiens
caacggcaagacag

SEQ ID NO: 504234 - DNA, 15 bp, Homo sapiens
caactagtggagaga

SEQ ID NO: 504235 - DNA, 22 bp, Homo sapiens
caactatgatttggaaaataaa

SEQ ID NO: 504236 - DNA, 16 bp, Homo sapiens
caactgaggcagacag

SEQ ID NO: 504237 - DNA, 17 bp, Homo sapiens
caactgaggcagacagc

SEQ ID NO: 504238 - DNA, 21 bp, Homo sapiens
caactgaggcagacagcagct

SEQ ID NO: 504239 - DNA, 23 bp, Homo sapiens
caactgctccagcctctgccgct

SEQ ID NO: 504240 - DNA, 18 bp, Homo sapiens
caacttcttcagagctga

SEQ ID NO: 504241 - DNA, 23 bp, Homo sapiens
caagaagggctagaacctggagg

SEQ ID NO: 504242 - DNA, 15 bp, Homo sapiens
caagaccctgtctct

SEQ ID NO: 504243 - DNA, 13 bp, Homo sapiens
caagagcacactt

SEQ ID NO: 504244 - DNA, 14 bp, Homo sapiens
caagagcacacttg

SEQ ID NO: 504245 - DNA, 20 bp, Homo sapiens
caagagccatgtagaagctg

SEQ ID NO: 504246 - DNA, 21 bp, Homo sapiens
caagagccatgtagaagctgc

SEQ ID NO: 504247 - DNA, 14 bp, Homo sapiens
caagcaagtattag

SEQ ID NO: 504248 - DNA, 12 bp, Homo sapiens
caagcactgtgc

SEQ ID NO: 504249 - DNA, 12 bp, Homo sapiens
caagcagccaag

SEQ ID NO: 504250 - DNA, 16 bp, Homo sapiens
caagctatcctggctc

SEQ ID NO: 504251 - DNA, 18 bp, Homo sapiens
caagctcccaagggatgg

SEQ ID NO: 504252 - DNA, 17 bp, Homo sapiens
caaggaaaccacagctg

SEQ ID NO: 504253 - DNA, 20 bp, Homo sapiens
caaggaaaccacagctgctg

SEQ ID NO: 504254 - DNA, 15 bp, Homo sapiens
caaggaaaggcaaat

SEQ ID NO: 504255 - DNA, 14 bp, Homo sapiens
caaggaaatagagg

SEQ ID NO: 504256 - DNA, 20 bp, Homo sapiens
caaggagacacaacaactcc

SEQ ID NO: 504257 - DNA, 15 bp, Homo sapiens
caaggagaggaggca

SEQ ID NO: 504258 - DNA, 12 bp, Homo sapiens
caaggcactgcc

SEQ ID NO: 504259 - DNA, 15 bp, Homo sapiens
caaggcactgcctga

SEQ ID NO: 504260 - DNA, 18 bp, Homo sapiens
caaggcactgcctgatgg

SEQ ID NO: 504261 - DNA, 22 bp, Homo sapiens
caaggcccccgggccgacggag

SEQ ID NO: 504262 - DNA, 18 bp, Homo sapiens
caaggctgtgctccctgg

SEQ ID NO: 504263 - DNA, 20 bp, Homo sapiens
caagggttcagagactcagg

SEQ ID NO: 504264 - DNA, 14 bp, Homo sapiens
caaggtgagagagg

SEQ ID NO: 504265 - DNA, 13 bp, Homo sapiens
caagtagctgcta

SEQ ID NO: 504266 - DNA, 23 bp, Homo sapiens
caagtattaggggtaatatattg

SEQ ID NO: 504267 - DNA, 19 bp, Homo sapiens
caagtgattgggacagagg

SEQ ID NO: 504268 - DNA, 16 bp, Homo sapiens
gttcagagactcaggg

SEQ ID NO: 504269 - DNA, 13 bp, Homo sapiens
gttcagagctgcc

SEQ ID NO: 504270 - DNA, 19 bp, Homo sapiens
gttcagagctgccctctcc

SEQ ID NO: 504271 - DNA, 20 bp, Homo sapiens
gttcagagctgccctctcct

SEQ ID NO: 504272 - DNA, 14 bp, Homo sapiens
gttcaggctctgag

SEQ ID NO: 504273 - DNA, 15 bp, Homo sapiens
gttcaggctctgaga

SEQ ID NO: 504274 - DNA, 19 bp, Homo sapiens
gttcaggctctgagacaca

SEQ ID NO: 504275 - DNA, 16 bp, Homo sapiens
gttccatgatgctggg

SEQ ID NO: 504276 - DNA, 14 bp, Homo sapiens
gttcctctttgcat

SEQ ID NO: 504277 - DNA, 14 bp, Homo sapiens
gttctagttgcttg

SEQ ID NO: 504278 - DNA, 17 bp, Homo sapiens
gttctatttctatccca

SEQ ID NO: 504279 - DNA, 18 bp, Homo sapiens
gttctatttctatcccaa

SEQ ID NO: 504280 - DNA, 22 bp, Homo sapiens
gttctcaaacggtacacagact

SEQ ID NO: 504281 - DNA, 19 bp, Homo sapiens
gttctcattcctgttcttt

SEQ ID NO: 504282 - DNA, 12 bp, Homo sapiens
gttctgaagaag

SEQ ID NO: 504283 - DNA, 15 bp, Homo sapiens
gttctgaagaagatg

SEQ ID NO: 504284 - DNA, 17 bp, Homo sapiens
gttctgatgatgtgcct

SEQ ID NO: 504285 - DNA, 17 bp, Homo sapiens
gttcttctattgtgctt

SEQ ID NO: 504286 - DNA, 20 bp, Homo sapiens
gttgatggtggtatgttttc

SEQ ID NO: 504287 - DNA, 17 bp, Homo sapiens
gttgatgttggctggga

SEQ ID NO: 504288 - DNA, 19 bp, Homo sapiens
gttggagagctagaacctg

SEQ ID NO: 504289 - DNA, 21 bp, Homo sapiens
gtttagctggaaaagtatgtt

SEQ ID NO: 504290 - DNA, 13 bp, Homo sapiens
gtttatgtctaaa

SEQ ID NO: 504291 - DNA, 11 bp, Homo sapiens
gtttcattgac

SEQ ID NO: 504292 - DNA, 19 bp, Homo sapiens
gtttctgattaatgctaaa

SEQ ID NO: 504293 - DNA, 14 bp, Homo sapiens
gtttctggtctcta

SEQ ID NO: 504294 - DNA, 23 bp, Homo sapiens
gtttgatatgggctttctctttg

SEQ ID NO: 504295 - DNA, 14 bp, Homo sapiens
gtttgcaaggaagc

SEQ ID NO: 504296 - DNA, 15 bp, Homo sapiens
gtttggccatctctg

SEQ ID NO: 504297 - DNA, 22 bp, Homo sapiens
gttttcccgagcaaagtctaaa

SEQ ID NO: 504298 - DNA, 23 bp, Homo sapiens
gttttcccgagcaaagtctaaag

SEQ ID NO: 504299 - DNA, 23 bp, Homo sapiens
gtttttaagaaaaacatgtcatg

SEQ ID NO: 504300 - DNA, 19 bp, Homo sapiens
gtttttccttgtatttaaa

SEQ ID NO: 504301 - DNA, 16 bp, Homo sapiens
taaaaaagaaacattt

SEQ ID NO: 504302 - DNA, 14 bp, Homo sapiens
gactgatgtcatct

SEQ ID NO: 504303 - DNA, 17 bp, Homo sapiens
gactgatgtcatcttga

SEQ ID NO: 504304 - DNA, 16 bp, Homo sapiens
gactgcattatattta

SEQ ID NO: 504305 - DNA, 12 bp, Homo sapiens
gactgtggctgc

SEQ ID NO: 504306 - DNA, 14 bp, Homo sapiens
gactgtggctgcta

SEQ ID NO: 504307 - DNA, 13 bp, Homo sapiens
gacttccatttgg

SEQ ID NO: 504308 - DNA, 24 bp, Homo sapiens
gacttccatttggaatcatatggg

SEQ ID NO: 504309 - DNA, 16 bp, Homo sapiens
gacttgacagaacact

SEQ ID NO: 504310 - DNA, 23 bp, Homo sapiens
gacttgagaaacaaataatttgt

SEQ ID NO: 504311 - DNA, 11 bp, Homo sapiens
gactttcctct

SEQ ID NO: 504312 - DNA, 19 bp, Homo sapiens
gactttggctgcatgcgag

SEQ ID NO: 504313 - DNA, 22 bp, Homo sapiens
gactttttatggcactagtatt

SEQ ID NO: 504314 - DNA, 16 bp, Homo sapiens
gagaaaacttatttga

SEQ ID NO: 504315 - DNA, 19 bp, Homo sapiens
gagaactagaacctggagg

SEQ ID NO: 504316 - DNA, 13 bp, Homo sapiens
gagaagaactgaa

SEQ ID NO: 504317 - DNA, 20 bp, Homo sapiens
gagaagctaaaacctgagct

SEQ ID NO: 504318 - DNA, 11 bp, Homo sapiens
gagaaggagcc

SEQ ID NO: 504319 - DNA, 13 bp, Homo sapiens
gagaatcacttga

SEQ ID NO: 504320 - DNA, 18 bp, Homo sapiens
gagaatcagacctgggtg

SEQ ID NO: 504321 - DNA, 20 bp, Homo sapiens
gagaatgagagacacactga

SEQ ID NO: 504322 - DNA, 16 bp, Homo sapiens
gagacaggacctgact

SEQ ID NO: 504323 - DNA, 13 bp, Homo sapiens
gagacccctgtct

SEQ ID NO: 504324 - DNA, 16 bp, Homo sapiens
gagacctcctgcctcc

SEQ ID NO: 504325 - DNA, 19 bp, Homo sapiens
gagactctcttaggagcag

SEQ ID NO: 504326 - DNA, 14 bp, Homo sapiens
gagactctgtctca

SEQ ID NO: 504327 - DNA, 13 bp, Homo sapiens
gagagaaaactta

SEQ ID NO: 504328 - DNA, 20 bp, Homo sapiens
gagagctagaacccggcagg

SEQ ID NO: 504329 - DNA, 16 bp, Homo sapiens
gagagctagaacctgg

SEQ ID NO: 504330 - DNA, 19 bp, Homo sapiens
gagagctagaacctggagg

SEQ ID NO: 504331 - DNA, 12 bp, Homo sapiens
gagataatacat

SEQ ID NO: 504332 - DNA, 16 bp, Homo sapiens
gagataatacattccg

SEQ ID NO: 504333 - DNA, 18 bp, Homo sapiens
gagatcaaatggaaagga

SEQ ID NO: 504334 - DNA, 20 bp, Homo sapiens
gagatcacgccactgcactc

SEQ ID NO: 504335 - DNA, 16 bp, Homo sapiens
gagcaaagtctaaagt

SEQ ID NO: 504336 - DNA, 18 bp, Homo sapiens
gagcaagaccctgtctct

SEQ ID NO: 504337 - DNA, 18 bp, Homo sapiens
gagcacttcacacagaca

SEQ ID NO: 504338 - DNA, 17 bp, Homo sapiens
gagcagcctcagaacaa

SEQ ID NO: 504339 - DNA, 18 bp, Homo sapiens
gagcagcggacttcaaaa

SEQ ID NO: 504340 - DNA, 20 bp, Homo sapiens
gagcaggaggggggctgggt

SEQ ID NO: 504341 - DNA, 16 bp, Homo sapiens
gagcagggtgctgtgg

SEQ ID NO: 504342 - DNA, 15 bp, Homo sapiens
gagcagtgcaggcac

SEQ ID NO: 504343 - DNA, 17 bp, Homo sapiens
gagcagtgcaggcacag

SEQ ID NO: 504344 - DNA, 21 bp, Homo sapiens
gagcataataaatggatgagg

SEQ ID NO: 504345 - DNA, 18 bp, Homo sapiens
gagcataggaggggtctg

SEQ ID NO: 504346 - DNA, 14 bp, Homo sapiens
gagcatggagctgg

SEQ ID NO: 504347 - DNA, 18 bp, Homo sapiens
gagccatgggcacaaagg

SEQ ID NO: 504348 - DNA, 23 bp, Homo sapiens
gagccccttcatccgcctgtggg

SEQ ID NO: 504349 - DNA, 15 bp, Homo sapiens
gagccctcctggaat

SEQ ID NO: 504350 - DNA, 19 bp, Homo sapiens
gagcctcatccgaggcagg

SEQ ID NO: 504351 - DNA, 14 bp, Homo sapiens
gagctagaacctgg

SEQ ID NO: 504352 - DNA, 18 bp, Homo sapiens
gagctagaagctggagga

SEQ ID NO: 504353 - DNA, 17 bp, Homo sapiens
gagctgaggcaattcta

SEQ ID NO: 504354 - DNA, 14 bp, Homo sapiens
gagctgccctctcc

SEQ ID NO: 504355 - DNA, 16 bp, Homo sapiens
gagctgccctctcctg

SEQ ID NO: 504356 - DNA, 17 bp, Homo sapiens
gagctgccctctcctgg

SEQ ID NO: 504357 - DNA, 19 bp, Homo sapiens
gagctggccgtgggcctgg

SEQ ID NO: 504358 - DNA, 20 bp, Homo sapiens
gagctggccgtgggcctggg

SEQ ID NO: 504359 - DNA, 22 bp, Homo sapiens
gagctgtataactgtgcagaga

SEQ ID NO: 504360 - DNA, 22 bp, Homo sapiens
gagctttatgtaataatgtgaa

SEQ ID NO: 504361 - DNA, 14 bp, Homo sapiens
gaggaggaagcaga

SEQ ID NO: 504362 - DNA, 15 bp, Homo sapiens
gaggagtacaggtga

SEQ ID NO: 504363 - DNA, 13 bp, Homo sapiens
gaggattttgagt

SEQ ID NO: 504364 - DNA, 12 bp, Homo sapiens
gaggcagacagc

SEQ ID NO: 504365 - DNA, 15 bp, Homo sapiens
gaggcagacagcagc

SEQ ID NO: 504366 - DNA, 20 bp, Homo sapiens
gaggcagacagcagctcagg

SEQ ID NO: 504367 - DNA, 22 bp, Homo sapiens
gaggcagacagcagctcaggca

SEQ ID NO: 504368 - DNA, 12 bp, Homo sapiens
gaggcattgttt

SEQ ID NO: 504369 - DNA, 19 bp, Homo sapiens
gaggccccttctaggtggc

SEQ ID NO: 504370 - DNA, 15 bp, Homo sapiens
gaggccgaggcacga

SEQ ID NO: 504371 - DNA, 14 bp, Homo sapiens
gaggctgaggcagg

SEQ ID NO: 504372 - DNA, 19 bp, Homo sapiens
gagggctagaacctggaga

SEQ ID NO: 504373 - DNA, 18 bp, Homo sapiens
gagggctagaatctggag

SEQ ID NO: 504374 - DNA, 17 bp, Homo sapiens
tactctatgtgatttat

SEQ ID NO: 504375 - DNA, 23 bp, Homo sapiens
tactgtgtacagaattctgctac

SEQ ID NO: 504376 - DNA, 14 bp, Homo sapiens
tacttcaaatcctt

SEQ ID NO: 504377 - DNA, 15 bp, Homo sapiens
tactttttgtaaaaa

SEQ ID NO: 504378 - DNA, 17 bp, Homo sapiens
tagaaaattatgcagct

SEQ ID NO: 504379 - DNA, 18 bp, Homo sapiens
tagaaacataaataaaat

SEQ ID NO: 504380 - DNA, 22 bp, Homo sapiens
tagaaatagctccgtggagcag

SEQ ID NO: 504381 - DNA, 23 bp, Homo sapiens
tagaaccaagaagggctagaacc

SEQ ID NO: 504382 - DNA, 22 bp, Homo sapiens
tagaacccggcaggctagaacc

SEQ ID NO: 504383 - DNA, 16 bp, Homo sapiens
tagaacctagaagggc

SEQ ID NO: 504384 - DNA, 23 bp, Homo sapiens
tagaacctagagaagctaaaacc

SEQ ID NO: 504385 - DNA, 13 bp, Homo sapiens
tagaacctggaga

SEQ ID NO: 504386 - DNA, 17 bp, Homo sapiens
tagaacctggagggctg

SEQ ID NO: 504387 - DNA, 16 bp, Homo sapiens
tagaagaacagcagat

SEQ ID NO: 504388 - DNA, 17 bp, Homo sapiens
tagaagctggaggacta

SEQ ID NO: 504389 - DNA, 24 bp, Homo sapiens
tagaagggctagaacctggagagc

SEQ ID NO: 504390 - DNA, 19 bp, Homo sapiens
tagaataaaattgtaaaat

SEQ ID NO: 504391 - DNA, 13 bp, Homo sapiens
tagaatattaaaa

SEQ ID NO: 504392 - DNA, 18 bp, Homo sapiens
tagaatattaaaaattaa

SEQ ID NO: 504393 - DNA, 23 bp, Homo sapiens
tagaatattaaaaattaattctt

SEQ ID NO: 504394 - DNA, 13 bp, Homo sapiens
tagacctcagcct

SEQ ID NO: 504395 - DNA, 14 bp, Homo sapiens
tagacctcagcctg

SEQ ID NO: 504396 - DNA, 16 bp, Homo sapiens
tagagcacactgtagc

SEQ ID NO: 504397 - DNA, 17 bp, Homo sapiens
tagagcacactgtagca

SEQ ID NO: 504398 - DNA, 20 bp, Homo sapiens
tagagcaggcgttcagctca

SEQ ID NO: 504399 - DNA, 22 bp, Homo sapiens
tagagcagtttctgtcctgctg

SEQ ID NO: 504400 - DNA, 20 bp, Homo sapiens
tagatgactgaatttctatg

SEQ ID NO: 504401 - DNA, 15 bp, Homo sapiens
tagatgcagttctga

SEQ ID NO: 504402 - DNA, 19 bp, Homo sapiens
tagatgcagttctgaagaa

SEQ ID NO: 504403 - DNA, 12 bp, Homo sapiens
tagattctttat

SEQ ID NO: 504404 - DNA, 18 bp, Homo sapiens
tagattctttattagtga

SEQ ID NO: 504405 - DNA, 20 bp, Homo sapiens
tagcaaattccaatacatta

SEQ ID NO: 504406 - DNA, 14 bp, Homo sapiens
tagcagctgctact

SEQ ID NO: 504407 - DNA, 20 bp, Homo sapiens
tagccaaaaatgtctaaaag

SEQ ID NO: 504408 - DNA, 13 bp, Homo sapiens
tagccgacctcag

SEQ ID NO: 504409 - DNA, 16 bp, Homo sapiens
tagccgacctcagcct

SEQ ID NO: 504410 - DNA, 20 bp, Homo sapiens
tagctagttatgtgagaaag

SEQ ID NO: 504411 - DNA, 14 bp, Homo sapiens
tagctcaagcctat

SEQ ID NO: 504412 - DNA, 20 bp, Homo sapiens
tagctggttggagagctaga

SEQ ID NO: 504413 - DNA, 16 bp, Homo sapiens
tagcttagacctcagc

SEQ ID NO: 504414 - DNA, 20 bp, Homo sapiens
tagcttagacctcagcctgt

SEQ ID NO: 504415 - DNA, 14 bp, Homo sapiens
tagctttgctctgc

SEQ ID NO: 504416 - DNA, 12 bp, Homo sapiens
taggaatcagca

SEQ ID NO: 504417 - DNA, 17 bp, Homo sapiens
taggcaggaacatacag

SEQ ID NO: 504418 - DNA, 18 bp, Homo sapiens
taggcaggaacatacaga

SEQ ID NO: 504419 - DNA, 15 bp, Homo sapiens
taggcagggatttga

SEQ ID NO: 504420 - DNA, 16 bp, Homo sapiens
taggcgggaaggaggg

SEQ ID NO: 504421 - DNA, 13 bp, Homo sapiens
tagggaaagaaag

SEQ ID NO: 504422 - DNA, 21 bp, Homo sapiens
tagggaagggtggtggagcca

SEQ ID NO: 504423 - DNA, 21 bp, Homo sapiens
tagggaatggcacagcccaaa

SEQ ID NO: 504424 - DNA, 15 bp, Homo sapiens
taggtggcaaggctg

SEQ ID NO: 504425 - DNA, 17 bp, Homo sapiens
taggtgttcaggccagt

SEQ ID NO: 504426 - DNA, 16 bp, Homo sapiens
taggttgtctaaaaat

SEQ ID NO: 504427 - DNA, 15 bp, Homo sapiens
tagtaattctcaggc

SEQ ID NO: 504428 - DNA, 17 bp, Homo sapiens
tagtattgtccaggtct

SEQ ID NO: 504429 - DNA, 16 bp, Homo sapiens
tagtatttctatgaaa

SEQ ID NO: 504430 - DNA, 18 bp, Homo sapiens
tagtatttctatgaaata

SEQ ID NO: 504431 - DNA, 18 bp, Homo sapiens
tagtcctagaggacctga

SEQ ID NO: 504432 - DNA, 22 bp, Homo sapiens
tagtgaaactcgttaatttgta

SEQ ID NO: 504433 - DNA, 14 bp, Homo sapiens
tagtgcaaattgtc

SEQ ID NO: 504434 - DNA, 15 bp, Homo sapiens
tagtgcaaattgtca

SEQ ID NO: 504435 - DNA, 14 bp, Homo sapiens
tagtggagagaact

SEQ ID NO: 504436 - DNA, 12 bp, Homo sapiens
tagtgttggaga

SEQ ID NO: 504437 - DNA, 23 bp, Homo sapiens
tataaaataatttttatatttga

SEQ ID NO: 504438 - DNA, 18 bp, Homo sapiens
tataacaatgctgtattt

SEQ ID NO: 504439 - DNA, 14 bp, Homo sapiens
tataattttgtgaa

SEQ ID NO: 504440 - DNA, 17 bp, Homo sapiens
tatagagatatgcagaa

SEQ ID NO: 504441 - DNA, 17 bp, Homo sapiens
tatataacaatgctgta

SEQ ID NO: 504442 - DNA, 22 bp, Homo sapiens
tatataattacatatttgcata

SEQ ID NO: 504443 - DNA, 13 bp, Homo sapiens
tatatgcttctgt

SEQ ID NO: 504444 - DNA, 16 bp, Homo sapiens
tatatgcttctgtttt

SEQ ID NO: 504445 - DNA, 19 bp, Homo sapiens
tatatttattactgtaaga

SEQ ID NO: 504446 - DNA, 20 bp, Homo sapiens
tatatttgaaatattgactt

SEQ ID NO: 504447 - DNA, 21 bp, Homo sapiens
tatattttgaacaactcgaat

SEQ ID NO: 504448 - DNA, 16 bp, Homo sapiens
tatcatgtcaaacgtg

SEQ ID NO: 504449 - DNA, 19 bp, Homo sapiens
tatcccattctccctctca

SEQ ID NO: 504450 - DNA, 17 bp, Homo sapiens
tatcccttctcagaaaa

SEQ ID NO: 504451 - DNA, 16 bp, Homo sapiens
tatctttgccaccctc

SEQ ID NO: 504452 - DNA, 15 bp, Homo sapiens
tatgaagaagagagt

SEQ ID NO: 504453 - DNA, 19 bp, Homo sapiens
tatgacattcatgcctggc

SEQ ID NO: 504454 - DNA, 21 bp, Homo sapiens
tatgagagggccctgcctgct

SEQ ID NO: 504455 - DNA, 16 bp, Homo sapiens
tatgagctttatgtaa

SEQ ID NO: 504456 - DNA, 17 bp, Homo sapiens
tatgcactaatcaatac

SEQ ID NO: 504457 - DNA, 18 bp, Homo sapiens
tatgctctacccttgtgt

SEQ ID NO: 504458 - DNA, 16 bp, Homo sapiens
tatgcttctgttttat

SEQ ID NO: 504459 - DNA, 14 bp, Homo sapiens
tatggagtgcctgt

SEQ ID NO: 504460 - DNA, 16 bp, Homo sapiens
tatgtaataatgtgaa

SEQ ID NO: 504461 - DNA, 12 bp, Homo sapiens
tatgtctaaaga

SEQ ID NO: 504462 - DNA, 16 bp, Homo sapiens
tatgtctaaagagctt

SEQ ID NO: 504463 - DNA, 16 bp, Homo sapiens
tattaaaaattaattc

SEQ ID NO: 504464 - DNA, 19 bp, Homo sapiens
tattaaaaattaattcttt

SEQ ID NO: 504465 - DNA, 21 bp, Homo sapiens
tattaaaaattaattctttat

SEQ ID NO: 504466 - DNA, 13 bp, Homo sapiens
tattaaaatcaca

SEQ ID NO: 504467 - DNA, 15 bp, Homo sapiens
tattattgtgtgtta

SEQ ID NO: 504468 - DNA, 15 bp, Homo sapiens
tattcatctcaagga

SEQ ID NO: 504469 - DNA, 19 bp, Homo sapiens
tattggacttccatttgga

SEQ ID NO: 504470 - DNA, 22 bp, Homo sapiens
tattgtttttccttgtatttaa

SEQ ID NO: 504471 - DNA, 14 bp, Homo sapiens
tatttattactgta

SEQ ID NO: 504472 - DNA, 22 bp, Homo sapiens
tatttcaatttccaagagctga

SEQ ID NO: 504473 - DNA, 18 bp, Homo sapiens
tatttccatattaaaatc

SEQ ID NO: 504474 - DNA, 13 bp, Homo sapiens
tatttctatgaaa

SEQ ID NO: 504475 - DNA, 16 bp, Homo sapiens
tatttggagtggaggc

SEQ ID NO: 504476 - DNA, 19 bp, Homo sapiens
tatttggagtggaggcatt

SEQ ID NO: 504477 - DNA, 14 bp, Homo sapiens
tatttttctcatga

SEQ ID NO: 504478 - DNA, 14 bp, Homo sapiens
tcaaaagaaagaga

SEQ ID NO: 504479 - DNA, 21 bp, Homo sapiens
tcaaaatatgccccattcaac

SEQ ID NO: 504480 - DNA, 12 bp, Homo sapiens
tcaaacactgca

SEQ ID NO: 504481 - DNA, 16 bp, Homo sapiens
tcaaacactgcaggca

SEQ ID NO: 504482 - DNA, 20 bp, Homo sapiens
tcaaaccaaatcactgaact

SEQ ID NO: 504483 - DNA, 15 bp, Homo sapiens
tcaaacgtgaaaatg

SEQ ID NO: 504484 - DNA, 16 bp, Homo sapiens
tcaaacgtgaaaatgc

SEQ ID NO: 504485 - DNA, 15 bp, Homo sapiens
tcaaatccttgaaga

SEQ ID NO: 504486 - DNA, 15 bp, Homo sapiens
tcaaatggaaaggag

SEQ ID NO: 504487 - DNA, 18 bp, Homo sapiens
tcaaattgtgtgaaaggt

SEQ ID NO: 504488 - DNA, 17 bp, Homo sapiens
tcaacagtttccagtca

SEQ ID NO: 504489 - DNA, 15 bp, Homo sapiens
tcaacataacataag

SEQ ID NO: 504490 - DNA, 23 bp, Homo sapiens
tcaagaagcaggctacactgaca

SEQ ID NO: 504491 - DNA, 12 bp, Homo sapiens
tcaagcagccaa

SEQ ID NO: 504492 - DNA, 17 bp, Homo sapiens
tcaagccgcatcccaga

SEQ ID NO: 504493 - DNA, 21 bp, Homo sapiens
tcaaggcaactagtggagaga

SEQ ID NO: 504494 - DNA, 15 bp, Homo sapiens
tcaaggcactgcctg

SEQ ID NO: 504495 - DNA, 14 bp, Homo sapiens
tcaagggctgtagg

SEQ ID NO: 504496 - DNA, 21 bp, Homo sapiens
tcaataaaccacaagcatctc

SEQ ID NO: 504497 - DNA, 17 bp, Homo sapiens
tcaatactttgaacaca

SEQ ID NO: 504498 - DNA, 18 bp, Homo sapiens
tcaatactttgaacacaa

SEQ ID NO: 504499 - DNA, 15 bp, Homo sapiens
tcaatattttccatg

SEQ ID NO: 504500 - DNA, 17 bp, Homo sapiens
tcaatattttccatgaa

SEQ ID NO: 504501 - DNA, 18 bp, Homo sapiens
tcaatattttccatgaaa

SEQ ID NO: 504502 - DNA, 17 bp, Homo sapiens
tcaattcttccctatct

SEQ ID NO: 504503 - DNA, 21 bp, Homo sapiens
tcacacacaggcaactgaggc

SEQ ID NO: 504504 - DNA, 22 bp, Homo sapiens
tcacacgtctggcttcacagat

SEQ ID NO: 504505 - DNA, 16 bp, Homo sapiens
tcacagacctttgaac

SEQ ID NO: 504506 - DNA, 14 bp, Homo sapiens
tcacatagtgaaag

SEQ ID NO: 504507 - DNA, 13 bp, Homo sapiens
tcacctcatggaa

SEQ ID NO: 504508 - DNA, 14 bp, Homo sapiens
tcacctcatggaat

SEQ ID NO: 504509 - DNA, 20 bp, Homo sapiens
tcacctctaaaacagtcctt

SEQ ID NO: 504510 - DNA, 16 bp, Homo sapiens
tcacctggggctgctg

SEQ ID NO: 504511 - DNA, 22 bp, Homo sapiens
tcacctggggctgctggcctga

SEQ ID NO: 504512 - DNA, 14 bp, Homo sapiens
tcacctttcccact

SEQ ID NO: 504513 - DNA, 19 bp, Homo sapiens
tcacctttcccactttctt

SEQ ID NO: 504514 - DNA, 14 bp, Homo sapiens
tcactcatttattt

SEQ ID NO: 504515 - DNA, 19 bp, Homo sapiens
tcactcatttatttccata

SEQ ID NO: 504516 - DNA, 16 bp, Homo sapiens
tcactggggtcctggg

SEQ ID NO: 504517 - DNA, 17 bp, Homo sapiens
tcactggggtcctgggg

SEQ ID NO: 504518 - DNA, 21 bp, Homo sapiens
tcactgtgggaaggccagctg

SEQ ID NO: 504519 - DNA, 17 bp, Homo sapiens
tcacttgtcaataaaat

SEQ ID NO: 504520 - DNA, 22 bp, Homo sapiens
tcagaaaccattgttcagaaga

SEQ ID NO: 504521 - DNA, 19 bp, Homo sapiens
tcagaagacctccctgtga

SEQ ID NO: 504522 - DNA, 12 bp, Homo sapiens
tcagacctgggt

SEQ ID NO: 504523 - DNA, 14 bp, Homo sapiens
tcagagactcaggg

SEQ ID NO: 504524 - DNA, 12 bp, Homo sapiens
tcagagctgccc

SEQ ID NO: 504525 - DNA, 14 bp, Homo sapiens
tcagagctgccctc

SEQ ID NO: 504526 - DNA, 15 bp, Homo sapiens
tcagaggctgaggtg

SEQ ID NO: 504527 - DNA, 14 bp, Homo sapiens
tcagcccctgatcc

SEQ ID NO: 504528 - DNA, 20 bp, Homo sapiens
tcagcctagccgacctcagc

SEQ ID NO: 504529 - DNA, 21 bp, Homo sapiens
tcagcctagccgacctcagcc

SEQ ID NO: 504530 - DNA, 23 bp, Homo sapiens
tcagcctagccgacctcagcctt

SEQ ID NO: 504531 - DNA, 16 bp, Homo sapiens
tcagcctgtgctgccc

SEQ ID NO: 504532 - DNA, 17 bp, Homo sapiens
tcagcctgtgctgcccg

SEQ ID NO: 504533 - DNA, 14 bp, Homo sapiens
tcagctcactgttc

SEQ ID NO: 504534 - DNA, 18 bp, Homo sapiens
tcagctccactttcagtg

SEQ ID NO: 504535 - DNA, 17 bp, Homo sapiens
tcagctccccagagtcc

SEQ ID NO: 504536 - DNA, 17 bp, Homo sapiens
tcaggaactatgggagc

SEQ ID NO: 504537 - DNA, 13 bp, Homo sapiens
tcaggacactaat

SEQ ID NO: 504538 - DNA, 13 bp, Homo sapiens
tcaggaccaggca

SEQ ID NO: 504539 - DNA, 14 bp, Homo sapiens
tcaggaccaggcaa

SEQ ID NO: 504540 - DNA, 23 bp, Homo sapiens
tcaggaggaaggcttacacccac

SEQ ID NO: 504541 - DNA, 18 bp, Homo sapiens
tcaggaggctgaggcagg

SEQ ID NO: 504542 - DNA, 23 bp, Homo sapiens
tcagggctaaacgggcattgcct

SEQ ID NO: 504543 - DNA, 12 bp, Homo sapiens
tcagggtctctg

SEQ ID NO: 504544 - DNA, 18 bp, Homo sapiens
tcagggtctctgctgccg

SEQ ID NO: 504545 - DNA, 14 bp, Homo sapiens
tcagtgcaaagatt

SEQ ID NO: 504546 - DNA, 20 bp, Homo sapiens
tcagttcagaatcacttctg

SEQ ID NO: 504547 - DNA, 12 bp, Homo sapiens
tcagttctgcct

SEQ ID NO: 504548 - DNA, 19 bp, Homo sapiens
tcatcaaatggaagacaca

SEQ ID NO: 504549 - DNA, 18 bp, Homo sapiens
tcatcaaggcactgcctg

SEQ ID NO: 504550 - DNA, 17 bp, Homo sapiens
tcatccacacaacacca

SEQ ID NO: 504551 - DNA, 14 bp, Homo sapiens
tcatccagggctct

SEQ ID NO: 504552 - DNA, 21 bp, Homo sapiens
tcatccagggctctgaccagt

SEQ ID NO: 504553 - DNA, 17 bp, Homo sapiens
tcatccctaatgctgca

SEQ ID NO: 504554 - DNA, 18 bp, Homo sapiens
tcatccctaatgctgcag

SEQ ID NO: 504555 - DNA, 13 bp, Homo sapiens
tcatcctgcaggc

SEQ ID NO: 504556 - DNA, 16 bp, Homo sapiens
tcatctctctttaata

SEQ ID NO: 504557 - DNA, 14 bp, Homo sapiens
tcatctctgtccca

SEQ ID NO: 504558 - DNA, 12 bp, Homo sapiens
tcatctggaacc

SEQ ID NO: 504559 - DNA, 13 bp, Homo sapiens
tcatctggaacca

SEQ ID NO: 504560 - DNA, 16 bp, Homo sapiens
tcatgaatctgcaatg

SEQ ID NO: 504561 - DNA, 21 bp, Homo sapiens
tcatgaattagttttatatgc

SEQ ID NO: 504562 - DNA, 22 bp, Homo sapiens
tcatgattcacccccaaacagt

SEQ ID NO: 504563 - DNA, 13 bp, Homo sapiens
tcatgcctggctt

SEQ ID NO: 504564 - DNA, 17 bp, Homo sapiens
tcatgcctggcttcgca

SEQ ID NO: 504565 - DNA, 13 bp, Homo sapiens
tcattaaagttct

SEQ ID NO: 504566 - DNA, 19 bp, Homo sapiens
tcattccattctggaagtg

SEQ ID NO: 504567 - DNA, 16 bp, Homo sapiens
tcattccatttgctga

SEQ ID NO: 504568 - DNA, 15 bp, Homo sapiens
tcattcccctgccca

SEQ ID NO: 504569 - DNA, 21 bp, Homo sapiens
tcattgactatcaaactgaag

SEQ ID NO: 504570 - DNA, 19 bp, Homo sapiens
tcatttatttccatattaa

SEQ ID NO: 504571 - DNA, 12 bp, Homo sapiens
tcatttcaggat

SEQ ID NO: 504572 - DNA, 16 bp, Homo sapiens
tcatttccaagcaagt

SEQ ID NO: 504573 - DNA, 21 bp, Homo sapiens
tccaaaggccatggagagctg

SEQ ID NO: 504574 - DNA, 22 bp, Homo sapiens
tccaaaggccatggagagctgg

SEQ ID NO: 504575 - DNA, 19 bp, Homo sapiens
tccaacccggggaccccca

SEQ ID NO: 504576 - DNA, 21 bp, Homo sapiens
tccaactatctcatttccaag

SEQ ID NO: 504577 - DNA, 16 bp, Homo sapiens
tccaagagtctgatga

SEQ ID NO: 504578 - DNA, 14 bp, Homo sapiens
tccaagtggctgtg

SEQ ID NO: 504579 - DNA, 16 bp, Homo sapiens
tccaatacctcttgga

SEQ ID NO: 504580 - DNA, 13 bp, Homo sapiens
tccacacaacacc

SEQ ID NO: 504581 - DNA, 17 bp, Homo sapiens
tccacacaacaccagga

SEQ ID NO: 504582 - DNA, 18 bp, Homo sapiens
tccacacaacaccaggac

SEQ ID NO: 504583 - DNA, 23 bp, Homo sapiens
tccacactcacctctaaaacagt

SEQ ID NO: 504584 - DNA, 19 bp, Homo sapiens
tccacagaagctccaggta

SEQ ID NO: 504585 - DNA, 13 bp, Homo sapiens
tccacaggaagtg

SEQ ID NO: 504586 - DNA, 24 bp, Homo sapiens
tccacaggggctatcccttctcag

SEQ ID NO: 504587 - DNA, 15 bp, Homo sapiens
tccacctccctgcaa

SEQ ID NO: 504588 - DNA, 21 bp, Homo sapiens
tccacgcccaccagccttgct

SEQ ID NO: 504589 - DNA, 14 bp, Homo sapiens
tccactcccaggca

SEQ ID NO: 504590 - DNA, 19 bp, Homo sapiens
tccactcccaggcagccct

SEQ ID NO: 504591 - DNA, 14 bp, Homo sapiens
tccagatcctggaa

SEQ ID NO: 504592 - DNA, 17 bp, Homo sapiens
tccagatcctggaaatc

SEQ ID NO: 504593 - DNA, 14 bp, Homo sapiens
tccagccagggctg

SEQ ID NO: 504594 - DNA, 17 bp, Homo sapiens
tccagccagggctgcta

SEQ ID NO: 504595 - DNA, 14 bp, Homo sapiens
tccagcctctgccg

SEQ ID NO: 504596 - DNA, 15 bp, Homo sapiens
tccagcctctgccgc

SEQ ID NO: 504597 - DNA, 23 bp, Homo sapiens
tccagcctctgccgctgccatgc

SEQ ID NO: 504598 - DNA, 21 bp, Homo sapiens
tccagctatttttatttgttt

SEQ ID NO: 504599 - DNA, 17 bp, Homo sapiens
tccagggccctgagctc

SEQ ID NO: 504600 - DNA, 23 bp, Homo sapiens
tccaggggtcaccttgagaggca

SEQ ID NO: 504601 - DNA, 19 bp, Homo sapiens
tccaggtagagggtgtgta

SEQ ID NO: 504602 - DNA, 23 bp, Homo sapiens
tccagtccaaggaaaccacagct

SEQ ID NO: 504603 - DNA, 12 bp, Homo sapiens
tccatacatttg

SEQ ID NO: 504604 - DNA, 18 bp, Homo sapiens
tccatcagttagagctga

SEQ ID NO: 504605 - DNA, 14 bp, Homo sapiens
tccatgatgctggg

SEQ ID NO: 504606 - DNA, 14 bp, Homo sapiens
tccatggattttgg

SEQ ID NO: 504607 - DNA, 21 bp, Homo sapiens
tccattaatgtagataaagca

SEQ ID NO: 504608 - DNA, 21 bp, Homo sapiens
tcccacttggcatcagctggc

SEQ ID NO: 504609 - DNA, 17 bp, Homo sapiens
tcccagccagcagttca

SEQ ID NO: 504610 - DNA, 16 bp, Homo sapiens
tcccaggatgagcatc

SEQ ID NO: 504611 - DNA, 24 bp, Homo sapiens
tcccaggatgagcatcccaggatc

SEQ ID NO: 504612 - DNA, 15 bp, Homo sapiens
tcccagtggctgctg

SEQ ID NO: 504613 - DNA, 16 bp, Homo sapiens
tcccagtggctgctgc

SEQ ID NO: 504614 - DNA, 18 bp, Homo sapiens
tcccagtggctgctgccc

SEQ ID NO: 504615 - DNA, 19 bp, Homo sapiens
tcccagtggctgctgccca

SEQ ID NO: 504616 - DNA, 22 bp, Homo sapiens
tcccagtggctgctgcccaggc

SEQ ID NO: 504617 - DNA, 14 bp, Homo sapiens
tcccatgacccagg

SEQ ID NO: 504618 - DNA, 15 bp, Homo sapiens
tccccaactgctcca

SEQ ID NO: 504619 - DNA, 19 bp, Homo sapiens
tccccaactgctccagcct

SEQ ID NO: 504620 - DNA, 21 bp, Homo sapiens
tccccaactgctccagcctct

SEQ ID NO: 504621 - DNA, 22 bp, Homo sapiens
tccccaactgctccagcctctg

SEQ ID NO: 504622 - DNA, 23 bp, Homo sapiens
tccccaactgctccagcctctgc

SEQ ID NO: 504623 - DNA, 18 bp, Homo sapiens
tccccagagttccccatg

SEQ ID NO: 504624 - DNA, 16 bp, Homo sapiens
tccccatgcagacatg

SEQ ID NO: 504625 - DNA, 24 bp, Homo sapiens
tcccctcctctgcttgccatccct

SEQ ID NO: 504626 - DNA, 19 bp, Homo sapiens
tcccctggggacagcaagg

SEQ ID NO: 504627 - DNA, 15 bp, Homo sapiens
tccccttgcccaggg

SEQ ID NO: 504628 - DNA, 20 bp, Homo sapiens
tccccttgcccagggctcag

SEQ ID NO: 504629 - DNA, 22 bp, Homo sapiens
tccccttgcccagggctcagcc

SEQ ID NO: 504630 - DNA, 15 bp, Homo sapiens
tccctccacctccct

SEQ ID NO: 504631 - DNA, 15 bp, Homo sapiens
tccctccctccacct

SEQ ID NO: 504632 - DNA, 16 bp, Homo sapiens
tccctccctccacctc

SEQ ID NO: 504633 - DNA, 16 bp, Homo sapiens
tccctgcaataaaatg

SEQ ID NO: 504634 - DNA, 20 bp, Homo sapiens
tccctgtgagagagttgctc

SEQ ID NO: 504635 - DNA, 17 bp, Homo sapiens
tcccttcatgcatggaa

SEQ ID NO: 504636 - DNA, 13 bp, Homo sapiens
tccgcctgtgggc

SEQ ID NO: 504637 - DNA, 19 bp, Homo sapiens
tccgcggagcccttggccc

SEQ ID NO: 504638 - DNA, 17 bp, Homo sapiens
tcctacacccttggact

SEQ ID NO: 504639 - DNA, 14 bp, Homo sapiens
tcctagaggacctg

SEQ ID NO: 504640 - DNA, 14 bp, Homo sapiens
tcctcaaacactgc

SEQ ID NO: 504641 - DNA, 14 bp, Homo sapiens
tcctcaccacatgc

SEQ ID NO: 504642 - DNA, 19 bp, Homo sapiens
tcctcagggtccctcagga

SEQ ID NO: 504643 - DNA, 18 bp, Homo sapiens
tcctcatccagggctctg

SEQ ID NO: 504644 - DNA, 19 bp, Homo sapiens
tcctccccaaggagacaca

SEQ ID NO: 504645 - DNA, 16 bp, Homo sapiens
tcctctgcttgccatc

SEQ ID NO: 504646 - DNA, 17 bp, Homo sapiens
tcctctgcttgccatcc

SEQ ID NO: 504647 - DNA, 13 bp, Homo sapiens
tcctctgtccagg

SEQ ID NO: 504648 - DNA, 16 bp, Homo sapiens
tcctctgtccagggcc

SEQ ID NO: 504649 - DNA, 13 bp, Homo sapiens
tcctcttatttgc

SEQ ID NO: 504650 - DNA, 21 bp, Homo sapiens
tcctcttctcaaagctgggat

SEQ ID NO: 504651 - DNA, 17 bp, Homo sapiens
tcctctttgcatggaat

SEQ ID NO: 504652 - DNA, 23 bp, Homo sapiens
tcctgactgtctcccgggactac

SEQ ID NO: 504653 - DNA, 14 bp, Homo sapiens
tcctgcctccgcct

SEQ ID NO: 504654 - DNA, 16 bp, Homo sapiens
tcctgctcctcaggaa

SEQ ID NO: 504655 - DNA, 16 bp, Homo sapiens
tcctggaaatcagggt

SEQ ID NO: 504656 - DNA, 12 bp, Homo sapiens
tcctgggcagct

SEQ ID NO: 504657 - DNA, 19 bp, Homo sapiens
tcctgtccacacccagctc

SEQ ID NO: 504658 - DNA, 14 bp, Homo sapiens
tcctgtctgccagc

SEQ ID NO: 504659 - DNA, 18 bp, Homo sapiens
tcctgtggagatgacttg

SEQ ID NO: 504660 - DNA, 18 bp, Homo sapiens
tccttagcttagacctca

SEQ ID NO: 504661 - DNA, 23 bp, Homo sapiens
tccttcacctttcccactttctt

SEQ ID NO: 504662 - DNA, 21 bp, Homo sapiens
tccttcctacacccttggact

SEQ ID NO: 504663 - DNA, 22 bp, Homo sapiens
tccttcctacacccttggactt

SEQ ID NO: 504664 - DNA, 21 bp, Homo sapiens
tccttcctcacaccaggcttg

SEQ ID NO: 504665 - DNA, 20 bp, Homo sapiens
tccttgagagaccaggcaaa

SEQ ID NO: 504666 - DNA, 20 bp, Homo sapiens
tcctttgaagaggaaaatga

SEQ ID NO: 504667 - DNA, 23 bp, Homo sapiens
tcgaatcactcatttatttccat

SEQ ID NO: 504668 - DNA, 20 bp, Homo sapiens
tcgagcagggtgctgtgggt

SEQ ID NO: 504669 - DNA, 13 bp, Homo sapiens
tcgatatttccat

SEQ ID NO: 504670 - DNA, 14 bp, Homo sapiens
tcgatatttccatc

SEQ ID NO: 504671 - DNA, 10 bp, Homo sapiens
tcggaccagc

SEQ ID NO: 504672 - DNA, 23 bp, Homo sapiens
tcggagcctcatccgaggcaggg

SEQ ID NO: 504673 - DNA, 13 bp, Homo sapiens
tcgttaatttgta

SEQ ID NO: 504674 - DNA, 12 bp, Homo sapiens
tcgttgtgaggg

SEQ ID NO: 504675 - DNA, 17 bp, Homo sapiens
tcgtttgaatcacagta

SEQ ID NO: 504676 - DNA, 18 bp, Homo sapiens
tctaaagtttacagtaaa

SEQ ID NO: 504677 - DNA, 19 bp, Homo sapiens
tctaaagtttacagtaaat

SEQ ID NO: 504678 - DNA, 14 bp, Homo sapiens
tctaatatcagcaa

SEQ ID NO: 504679 - DNA, 20 bp, Homo sapiens
tctaattctaaggaatatga

SEQ ID NO: 504680 - DNA, 15 bp, Homo sapiens
tctaatttttattaa

SEQ ID NO: 504681 - DNA, 20 bp, Homo sapiens
tctaccaagctatcctggct

SEQ ID NO: 504682 - DNA, 19 bp, Homo sapiens
tctacggtgtatggttctg

SEQ ID NO: 504683 - DNA, 22 bp, Homo sapiens
tctacgtatggctccacacctc

SEQ ID NO: 504684 - DNA, 21 bp, Homo sapiens
tctagaatactaataaaatac

SEQ ID NO: 504685 - DNA, 21 bp, Homo sapiens
tctagcctggcaacagagcga

SEQ ID NO: 504686 - DNA, 16 bp, Homo sapiens
tctaggaaatatttat

SEQ ID NO: 504687 - DNA, 18 bp, Homo sapiens
tctaggtggcaaggctgt

SEQ ID NO: 504688 - DNA, 20 bp, Homo sapiens
tctaggtggcaaggctgtgc

SEQ ID NO: 504689 - DNA, 19 bp, Homo sapiens
tctagtgagcagtcaggaa

SEQ ID NO: 504690 - DNA, 13 bp, Homo sapiens
tctatcacctgtc

SEQ ID NO: 504691 - DNA, 17 bp, Homo sapiens
tctatcacctgtcatca

SEQ ID NO: 504692 - DNA, 14 bp, Homo sapiens
tctatcattaaagt

SEQ ID NO: 504693 - DNA, 17 bp, Homo sapiens
tctatgaaatattatgt

SEQ ID NO: 504694 - DNA, 22 bp, Homo sapiens
tctatggcatattgataataaa

SEQ ID NO: 504695 - DNA, 14 bp, Homo sapiens
tctcaataaactga

SEQ ID NO: 504696 - DNA, 15 bp, Homo sapiens
tctcagccaacgagt

SEQ ID NO: 504697 - DNA, 20 bp, Homo sapiens
tctcagggtctctgctgccg

SEQ ID NO: 504698 - DNA, 18 bp, Homo sapiens
tctcattcctgttctttc

SEQ ID NO: 504699 - DNA, 15 bp, Homo sapiens
tctcatttccaagca

SEQ ID NO: 504700 - DNA, 16 bp, Homo sapiens
tctccagaaccagtgt

SEQ ID NO: 504701 - DNA, 12 bp, Homo sapiens
tctcctccccaa

SEQ ID NO: 504702 - DNA, 17 bp, Homo sapiens
tctcctgctcctcagga

SEQ ID NO: 504703 - DNA, 14 bp, Homo sapiens
tctcctgggcagct

SEQ ID NO: 504704 - DNA, 18 bp, Homo sapiens
tctcctgggcagctgcct

SEQ ID NO: 504705 - DNA, 19 bp, Homo sapiens
tctccttgtggcctgggcc

SEQ ID NO: 504706 - DNA, 21 bp, Homo sapiens
tctcggacctttcagctgtga

SEQ ID NO: 504707 - DNA, 13 bp, Homo sapiens
tctctaggaaata

SEQ ID NO: 504708 - DNA, 14 bp, Homo sapiens
tctctatcattaaa

SEQ ID NO: 504709 - DNA, 15 bp, Homo sapiens
tctctatcattaaag

SEQ ID NO: 504710 - DNA, 23 bp, Homo sapiens
tctcttcaataaaccacaagcat

SEQ ID NO: 504711 - DNA, 18 bp, Homo sapiens
tctgaaaattaacactgc

SEQ ID NO: 504712 - DNA, 16 bp, Homo sapiens
tctgaaattttctaga

SEQ ID NO: 504713 - DNA, 18 bp, Homo sapiens
tctgaaattttctagaat

SEQ ID NO: 504714 - DNA, 20 bp, Homo sapiens
tctgaactggagccatgggc

SEQ ID NO: 504715 - DNA, 12 bp, Homo sapiens
tctgaaggagat

SEQ ID NO: 504716 - DNA, 19 bp, Homo sapiens
tctgaggggcaactgagtc

SEQ ID NO: 504717 - DNA, 23 bp, Homo sapiens
tctgatgcaagcaagaaacactg

SEQ ID NO: 504718 - DNA, 18 bp, Homo sapiens
tctgatggcttctccagg

SEQ ID NO: 504719 - DNA, 13 bp, Homo sapiens
tctgccagccagc

SEQ ID NO: 504720 - DNA, 23 bp, Homo sapiens
tctgccgctgccatgctttgagt

SEQ ID NO: 504721 - DNA, 13 bp, Homo sapiens
tctgcctgttctg

SEQ ID NO: 504722 - DNA, 17 bp, Homo sapiens
tctgcctgttctgagga

SEQ ID NO: 504723 - DNA, 17 bp, Homo sapiens
tctgctatattttcatg

SEQ ID NO: 504724 - DNA, 19 bp, Homo sapiens
tctggaagtgactttggct

SEQ ID NO: 504725 - DNA, 22 bp, Homo sapiens
tctggagagctagaacctggag

SEQ ID NO: 504726 - DNA, 14 bp, Homo sapiens
tctggattcccagg

SEQ ID NO: 504727 - DNA, 21 bp, Homo sapiens
tctggattcccaggatgagca

SEQ ID NO: 504728 - DNA, 14 bp, Homo sapiens
tctgggcaggactc

SEQ ID NO: 504729 - DNA, 17 bp, Homo sapiens
tctggggttatgatggc

SEQ ID NO: 504730 - DNA, 17 bp, Homo sapiens
tctgggtccaggcctgg

SEQ ID NO: 504731 - DNA, 18 bp, Homo sapiens
tctgggtccaggcctggc

SEQ ID NO: 504732 - DNA, 16 bp, Homo sapiens
tctggtctctaggctg

SEQ ID NO: 504733 - DNA, 19 bp, Homo sapiens
tctggtctctaggctgggg

SEQ ID NO: 504734 - DNA, 19 bp, Homo sapiens
tctgtccagggccctgagc

SEQ ID NO: 504735 - DNA, 19 bp, Homo sapiens
tctgtctccttaacactga

SEQ ID NO: 504736 - DNA, 22 bp, Homo sapiens
tctgtctccttaacactgagct

SEQ ID NO: 504737 - DNA, 21 bp, Homo sapiens
tctgtgcacgcagtggccttc

SEQ ID NO: 504738 - DNA, 20 bp, Homo sapiens
tctgttttataattttgtga

SEQ ID NO: 504739 - DNA, 16 bp, Homo sapiens
tcttacacaagagctg

SEQ ID NO: 504740 - DNA, 23 bp, Homo sapiens
tcttagatgcagttctgaagaag

SEQ ID NO: 504741 - DNA, 22 bp, Homo sapiens
tcttagggttatgattaagtaa

SEQ ID NO: 504742 - DNA, 11 bp, Homo sapiens
tcttatttgct

SEQ ID NO: 504743 - DNA, 20 bp, Homo sapiens
tcttcaataaaccacaagca

SEQ ID NO: 504744 - DNA, 23 bp, Homo sapiens
tcttcaataaaccacaagcatct

SEQ ID NO: 504745 - DNA, 11 bp, Homo sapiens
tcttcagccta

SEQ ID NO: 504746 - DNA, 22 bp, Homo sapiens
tcttcagcctagccgacctcag

SEQ ID NO: 504747 - DNA, 17 bp, Homo sapiens
tcttcctccgaggccag

SEQ ID NO: 504748 - DNA, 17 bp, Homo sapiens
tcttctcaaagctggga

SEQ ID NO: 504749 - DNA, 12 bp, Homo sapiens
tcttctccccag

SEQ ID NO: 504750 - DNA, 14 bp, Homo sapiens
tcttgataagacca

SEQ ID NO: 504751 - DNA, 22 bp, Homo sapiens
tcttggcacatttaagagacag

SEQ ID NO: 504752 - DNA, 13 bp, Homo sapiens
tcttggcagtcac

SEQ ID NO: 504753 - DNA, 16 bp, Homo sapiens
tcttgggtaggcggga

SEQ ID NO: 504754 - DNA, 23 bp, Homo sapiens
tcttgtaactgggttcaaaaaga

SEQ ID NO: 504755 - DNA, 14 bp, Homo sapiens
tctttattagtgaa

SEQ ID NO: 504756 - DNA, 17 bp, Homo sapiens
tctttccacagaagctc

SEQ ID NO: 504757 - DNA, 20 bp, Homo sapiens
tctttccctgcttaatgaaa

SEQ ID NO: 504758 - DNA, 18 bp, Homo sapiens
tctttgagataatacatt

SEQ ID NO: 504759 - DNA, 15 bp, Homo sapiens
tctttgcatggaatt

SEQ ID NO: 504760 - DNA, 18 bp, Homo sapiens
tctttgccaccctcatgc

SEQ ID NO: 504761 - DNA, 22 bp, Homo sapiens
tctttgccaccctcatgctgtg

SEQ ID NO: 504762 - DNA, 17 bp, Homo sapiens
tctttgctttgcccagc

SEQ ID NO: 504763 - DNA, 22 bp, Homo sapiens
tgaaaaggactcttgagccctc

SEQ ID NO: 504764 - DNA, 14 bp, Homo sapiens
tgaaaattaacact

SEQ ID NO: 504765 - DNA, 16 bp, Homo sapiens
tgaaaattaacactgc

SEQ ID NO: 504766 - DNA, 18 bp, Homo sapiens
tgaaaattaacactgctt

SEQ ID NO: 504767 - DNA, 16 bp, Homo sapiens
tgaaaggtacttcaaa

SEQ ID NO: 504768 - DNA, 15 bp, Homo sapiens
tgaaatatacacaca

SEQ ID NO: 504769 - DNA, 18 bp, Homo sapiens
tgaaatattatgttaaaa

SEQ ID NO: 504770 - DNA, 21 bp, Homo sapiens
tgaaatccacacatctttaga

SEQ ID NO: 504771 - DNA, 19 bp, Homo sapiens
tgaaatgcagagtcaatga

SEQ ID NO: 504772 - DNA, 22 bp, Homo sapiens
tgaaatgtaccatcaaatgtta

SEQ ID NO: 504773 - DNA, 12 bp, Homo sapiens
tgaaattttcta

SEQ ID NO: 504774 - DNA, 13 bp, Homo sapiens
tgaaattttctag

SEQ ID NO: 504775 - DNA, 18 bp, Homo sapiens
tgaaattttctagaatac

SEQ ID NO: 504776 - DNA, 20 bp, Homo sapiens
tgaacaagttgtttcattga

SEQ ID NO: 504777 - DNA, 14 bp, Homo sapiens
tgaacactggggga

SEQ ID NO: 504778 - DNA, 17 bp, Homo sapiens
tgaacactgggggaggg

SEQ ID NO: 504779 - DNA, 22 bp, Homo sapiens
tgaacactgggggaggggacat

SEQ ID NO: 504780 - DNA, 23 bp, Homo sapiens
tgaactagagtttagctggaaaa

SEQ ID NO: 504781 - DNA, 14 bp, Homo sapiens
tgaagaagatggta

SEQ ID NO: 504782 - DNA, 12 bp, Homo sapiens
tgaagaggaaaa

SEQ ID NO: 504783 - DNA, 16 bp, Homo sapiens
tgaagaggaaaatgaa

SEQ ID NO: 504784 - DNA, 20 bp, Homo sapiens
tgaagaggaaaatgaataat

SEQ ID NO: 504785 - DNA, 22 bp, Homo sapiens
tgaagaggaaaatgaataatac

SEQ ID NO: 504786 - DNA, 23 bp, Homo sapiens
tgaagatataactattgcccagg

SEQ ID NO: 504787 - DNA, 18 bp, Homo sapiens
tgaagatccccaactgct

SEQ ID NO: 504788 - DNA, 19 bp, Homo sapiens
tgaagatccccaactgctc

SEQ ID NO: 504789 - DNA, 14 bp, Homo sapiens
tgaagcaaacacat

SEQ ID NO: 504790 - DNA, 15 bp, Homo sapiens
tgaagcaaacacatt

SEQ ID NO: 504791 - DNA, 17 bp, Homo sapiens
tgaagcaccaagctcaa

SEQ ID NO: 504792 - DNA, 15 bp, Homo sapiens
tgaagccaaagccaa

SEQ ID NO: 504793 - DNA, 20 bp, Homo sapiens
tgaaggagattttccttcct

SEQ ID NO: 504794 - DNA, 11 bp, Homo sapiens
tgaagtccaag

SEQ ID NO: 504795 - DNA, 16 bp, Homo sapiens
tgaagtcgttgtgagg

SEQ ID NO: 504796 - DNA, 15 bp, Homo sapiens
tgaatataaacacta

SEQ ID NO: 504797 - DNA, 19 bp, Homo sapiens
tgaatcatggtttttctta

SEQ ID NO: 504798 - DNA, 16 bp, Homo sapiens
tgaatcttggtgtcta

SEQ ID NO: 504799 - DNA, 19 bp, Homo sapiens
tgaatgcttataggtggcc

SEQ ID NO: 504800 - DNA, 19 bp, Homo sapiens
tgacactggtattcctgcc

SEQ ID NO: 504801 - DNA, 15 bp, Homo sapiens
tgacagaacactgtc

SEQ ID NO: 504802 - DNA, 16 bp, Homo sapiens
tgacagaacactgtct

SEQ ID NO: 504803 - DNA, 22 bp, Homo sapiens
tgacagctgttccacaggggct

SEQ ID NO: 504804 - DNA, 15 bp, Homo sapiens
tgacatatttttgct

SEQ ID NO: 504805 - DNA, 14 bp, Homo sapiens
tgacatcagcatca

SEQ ID NO: 504806 - DNA, 14 bp, Homo sapiens
tgacatggagttcc

SEQ ID NO: 504807 - DNA, 17 bp, Homo sapiens
tgacatgggacatttgc

SEQ ID NO: 504808 - DNA, 16 bp, Homo sapiens
tgacatgtccctacac

SEQ ID NO: 504809 - DNA, 12 bp, Homo sapiens
tgaccaggcctg

SEQ ID NO: 504810 - DNA, 20 bp, Homo sapiens
tgaccaggcctgggccagag

SEQ ID NO: 504811 - DNA, 12 bp, Homo sapiens
tgacccaggctg

SEQ ID NO: 504812 - DNA, 15 bp, Homo sapiens
tgacccaggctgggc

SEQ ID NO: 504813 - DNA, 17 bp, Homo sapiens
tgacccaggctgggcaa

SEQ ID NO: 504814 - DNA, 19 bp, Homo sapiens
tgacctgcctcccttcatg

SEQ ID NO: 504815 - DNA, 23 bp, Homo sapiens
tgacctgcctcccttcatgcatg

SEQ ID NO: 504816 - DNA, 20 bp, Homo sapiens
tgactattgaagttgcagat

SEQ ID NO: 504817 - DNA, 22 bp, Homo sapiens
tgactcgggccttagaactttg

SEQ ID NO: 504818 - DNA, 15 bp, Homo sapiens
tgactcttaagaaga

SEQ ID NO: 504819 - DNA, 17 bp, Homo sapiens
tgactgaatttctatgg

SEQ ID NO: 504820 - DNA, 11 bp, Homo sapiens
tgactgagctt

SEQ ID NO: 504821 - DNA, 19 bp, Homo sapiens
tgactgtgatttatttgga

SEQ ID NO: 504822 - DNA, 18 bp, Homo sapiens
tgactgttcaagagcaca

SEQ ID NO: 504823 - DNA, 24 bp, Homo sapiens
tgactgttcaagagcacacttggc

SEQ ID NO: 504824 - DNA, 17 bp, Homo sapiens
tgacttgacagaacact

SEQ ID NO: 504825 - DNA, 19 bp, Homo sapiens
tgacttgacagaacactgt

SEQ ID NO: 504826 - DNA, 13 bp, Homo sapiens
tgacttttccatg

SEQ ID NO: 504827 - DNA, 16 bp, Homo sapiens
tgagacccctgtctcc

SEQ ID NO: 504828 - DNA, 19 bp, Homo sapiens
tgagactctcttaggagca

SEQ ID NO: 504829 - DNA, 16 bp, Homo sapiens
tgagagacacactgaa

SEQ ID NO: 504830 - DNA, 17 bp, Homo sapiens
tgagagacacactgaag

SEQ ID NO: 504831 - DNA, 22 bp, Homo sapiens
tgagagacacactgaagaagca

SEQ ID NO: 504832 - DNA, 24 bp, Homo sapiens
tgagagaccaggcaaagcaagtga

SEQ ID NO: 504833 - DNA, 19 bp, Homo sapiens
tgagagagttgctcctcag

SEQ ID NO: 504834 - DNA, 19 bp, Homo sapiens
tgagaggcatgacagctgt

SEQ ID NO: 504835 - DNA, 17 bp, Homo sapiens
tgagataatacattccg

SEQ ID NO: 504836 - DNA, 20 bp, Homo sapiens
tgagcagtcaggaaagagaa

SEQ ID NO: 504837 - DNA, 15 bp, Homo sapiens
tgagcatggagctgg

SEQ ID NO: 504838 - DNA, 16 bp, Homo sapiens
tgagcatggagctggc

SEQ ID NO: 504839 - DNA, 23 bp, Homo sapiens
tgagccccttcatccgcctgtgg

SEQ ID NO: 504840 - DNA, 22 bp, Homo sapiens
tgagctagaagctggaggacta

SEQ ID NO: 504841 - DNA, 21 bp, Homo sapiens
tgagctcggtggacccaggga

SEQ ID NO: 504842 - DNA, 23 bp, Homo sapiens
tgagcttaagaattttgagcagg

SEQ ID NO: 504843 - DNA, 22 bp, Homo sapiens
tgagctttatgtaataatgtga

SEQ ID NO: 504844 - DNA, 20 bp, Homo sapiens
tgaggagcagcttcagttgt

SEQ ID NO: 504845 - DNA, 16 bp, Homo sapiens
tgaggcagacagcagc

SEQ ID NO: 504846 - DNA, 20 bp, Homo sapiens
tgaggcagacagcagctcag

SEQ ID NO: 504847 - DNA, 17 bp, Homo sapiens
tgaggccaggagttcaa

SEQ ID NO: 504848 - DNA, 14 bp, Homo sapiens
tgaggggtccctga

SEQ ID NO: 504849 - DNA, 22 bp, Homo sapiens
tgagggtaataaacttagaata

SEQ ID NO: 504850 - DNA, 14 bp, Homo sapiens
tgaggttcagcaag

SEQ ID NO: 504851 - DNA, 15 bp, Homo sapiens
tgaggttcagcaagg

SEQ ID NO: 504852 - DNA, 13 bp, Homo sapiens
tgagtccacgccc

SEQ ID NO: 504853 - DNA, 21 bp, Homo sapiens
tgagtccacgcccaccagcct

SEQ ID NO: 504854 - DNA, 12 bp, Homo sapiens
tgagtgcctggc

SEQ ID NO: 504855 - DNA, 14 bp, Homo sapiens
tgagtgcctggcca

SEQ ID NO: 504856 - DNA, 20 bp, Homo sapiens
tgagttggtgttgacatgtg

SEQ ID NO: 504857 - DNA, 18 bp, Homo sapiens
tgagttttcttctgtgat

SEQ ID NO: 504858 - DNA, 19 bp, Homo sapiens
tgataagagggcacacact

SEQ ID NO: 504859 - DNA, 14 bp, Homo sapiens
tgataataaaattc

SEQ ID NO: 504860 - DNA, 15 bp, Homo sapiens
tgataataaaattca

SEQ ID NO: 504861 - DNA, 22 bp, Homo sapiens
tgataataaaattcattccatt

SEQ ID NO: 504862 - DNA, 15 bp, Homo sapiens
tgatagcctcttaga

SEQ ID NO: 504863 - DNA, 12 bp, Homo sapiens
tgatatgggtct

SEQ ID NO: 504864 - DNA, 13 bp, Homo sapiens
tgatcctgtgaag

SEQ ID NO: 504865 - DNA, 20 bp, Homo sapiens
tgatctgatgcaagcaagaa

SEQ ID NO: 504866 - DNA, 15 bp, Homo sapiens
tgatctgtgggcaca

SEQ ID NO: 504867 - DNA, 11 bp, Homo sapiens
tgatgaagaag

SEQ ID NO: 504868 - DNA, 12 bp, Homo sapiens
tgatgaagaagt

SEQ ID NO: 504869 - DNA, 16 bp, Homo sapiens
tgatgatgtgcctggg

SEQ ID NO: 504870 - DNA, 20 bp, Homo sapiens
tgatggcaggatggcctggc

SEQ ID NO: 504871 - DNA, 15 bp, Homo sapiens
tgatggcttctccag

SEQ ID NO: 504872 - DNA, 15 bp, Homo sapiens
tgatggtgatgaaat

SEQ ID NO: 504873 - DNA, 16 bp, Homo sapiens
tgatggtgatgaaatg

SEQ ID NO: 504874 - DNA, 17 bp, Homo sapiens
tgatggtgatgaaatgt

SEQ ID NO: 504875 - DNA, 16 bp, Homo sapiens
tgatgtcatcttgagc

SEQ ID NO: 504876 - DNA, 18 bp, Homo sapiens
tgatgtgggtcaaggaat

SEQ ID NO: 504877 - DNA, 15 bp, Homo sapiens
tgatgttggctggga

SEQ ID NO: 504878 - DNA, 15 bp, Homo sapiens
tgattaagtaatgat

SEQ ID NO: 504879 - DNA, 17 bp, Homo sapiens
tgattatgaattacatt

SEQ ID NO: 504880 - DNA, 21 bp, Homo sapiens
tgattatgaattacatttgta

SEQ ID NO: 504881 - DNA, 21 bp, Homo sapiens
tgattcaattcaacactccct

SEQ ID NO: 504882 - DNA, 22 bp, Homo sapiens
tgattcacccccaaacagtgac

SEQ ID NO: 504883 - DNA, 21 bp, Homo sapiens
tgattcctttgaagaggaaaa

SEQ ID NO: 504884 - DNA, 11 bp, Homo sapiens
tgattctcagg

SEQ ID NO: 504885 - DNA, 21 bp, Homo sapiens
tgattctcagggtctctgctg

SEQ ID NO: 504886 - DNA, 22 bp, Homo sapiens
tgattctcagggtctctgctgc

SEQ ID NO: 504887 - DNA, 22 bp, Homo sapiens
tgatttggccgttttgtgaaga

SEQ ID NO: 504888 - DNA, 20 bp, Homo sapiens
tgcaaagtcatgcaaaggct

SEQ ID NO: 504889 - DNA, 16 bp, Homo sapiens
tgcaacttgtaaatgt

SEQ ID NO: 504890 - DNA, 18 bp, Homo sapiens
tgcaacttgtaaatgtgg

SEQ ID NO: 504891 - DNA, 13 bp, Homo sapiens
tgcaaggcaaaga

SEQ ID NO: 504892 - DNA, 15 bp, Homo sapiens
tgcacaaactcacca

SEQ ID NO: 504893 - DNA, 14 bp, Homo sapiens
tgcacaacattaca

SEQ ID NO: 504894 - DNA, 15 bp, Homo sapiens
tgcacatcaaaatat

SEQ ID NO: 504895 - DNA, 15 bp, Homo sapiens
tgcacgaccttggga

SEQ ID NO: 504896 - DNA, 15 bp, Homo sapiens
tgcacggctgctgag

SEQ ID NO: 504897 - DNA, 23 bp, Homo sapiens
tgcagggagcatggctgtgagga

SEQ ID NO: 504898 - DNA, 14 bp, Homo sapiens
tgcagttctgaaga

SEQ ID NO: 504899 - DNA, 16 bp, Homo sapiens
tgcagttctgaagaag

SEQ ID NO: 504900 - DNA, 17 bp, Homo sapiens
tgcagttctgaagaaga

SEQ ID NO: 504901 - DNA, 19 bp, Homo sapiens
tgcatgaaggtttctgaaa

SEQ ID NO: 504902 - DNA, 24 bp, Homo sapiens
tgcatgaccacatagaacatgtgt

SEQ ID NO: 504903 - DNA, 11 bp, Homo sapiens
tgcatggaaat

SEQ ID NO: 504904 - DNA, 20 bp, Homo sapiens
tgccaacactcaagaagcag

SEQ ID NO: 504905 - DNA, 21 bp, Homo sapiens
tgccaacactcaagaagcagg

SEQ ID NO: 504906 - DNA, 22 bp, Homo sapiens
tgccaacactcaagaagcaggc

SEQ ID NO: 504907 - DNA, 14 bp, Homo sapiens
tgccaagcagcaga

SEQ ID NO: 504908 - DNA, 14 bp, Homo sapiens
tgccaagctcagga

SEQ ID NO: 504909 - DNA, 22 bp, Homo sapiens
tgccaagctcaggaccaggcaa

SEQ ID NO: 504910 - DNA, 19 bp, Homo sapiens
tgccaatagttgctgtccc

SEQ ID NO: 504911 - DNA, 17 bp, Homo sapiens
tgccaccctcatgctgt

SEQ ID NO: 504912 - DNA, 13 bp, Homo sapiens
tgccactgcactc

SEQ ID NO: 504913 - DNA, 12 bp, Homo sapiens
tgccagacatgt

SEQ ID NO: 504914 - DNA, 13 bp, Homo sapiens
tgccagacatgtg

SEQ ID NO: 504915 - DNA, 14 bp, Homo sapiens
tgccagatcctctt

SEQ ID NO: 504916 - DNA, 22 bp, Homo sapiens
tgccagccagcagccagctctc

SEQ ID NO: 504917 - DNA, 20 bp, Homo sapiens
tgccatccctccctccacct

SEQ ID NO: 504918 - DNA, 21 bp, Homo sapiens
tgccatccctccctccacctc

SEQ ID NO: 504919 - DNA, 11 bp, Homo sapiens
tgccatcctca

SEQ ID NO: 504920 - DNA, 19 bp, Homo sapiens
tgccatcctcaaacactgc

SEQ ID NO: 504921 - DNA, 18 bp, Homo sapiens
tgccatggacagaagaag

SEQ ID NO: 504922 - DNA, 20 bp, Homo sapiens
tgccatggacagaagaaggc

SEQ ID NO: 504923 - DNA, 14 bp, Homo sapiens
tgcccaagggaaag

SEQ ID NO: 504924 - DNA, 22 bp, Homo sapiens
tgcccacctccttccagcactg

SEQ ID NO: 504925 - DNA, 14 bp, Homo sapiens
tgcccaggcccaga

SEQ ID NO: 504926 - DNA, 15 bp, Homo sapiens
tgcccaggcccagac

SEQ ID NO: 504927 - DNA, 15 bp, Homo sapiens
tgcccagggctcagc

SEQ ID NO: 504928 - DNA, 18 bp, Homo sapiens
tgcccagggctcagcctg

SEQ ID NO: 504929 - DNA, 21 bp, Homo sapiens
tgcccagggctcagcctggtg

SEQ ID NO: 504930 - DNA, 13 bp, Homo sapiens
tgccccagccaga

SEQ ID NO: 504931 - DNA, 18 bp, Homo sapiens
tgcccgtcttcagcctag

SEQ ID NO: 504932 - DNA, 13 bp, Homo sapiens
tgccctctcctgg

SEQ ID NO: 504933 - DNA, 20 bp, Homo sapiens
tgccctctcctgggcagctg

SEQ ID NO: 504934 - DNA, 23 bp, Homo sapiens
tgccctctcctgggcagctgcct

SEQ ID NO: 504935 - DNA, 16 bp, Homo sapiens
tgccgccccacccaga

SEQ ID NO: 504936 - DNA, 16 bp, Homo sapiens
tgccgctgccatgctt

SEQ ID NO: 504937 - DNA, 19 bp, Homo sapiens
cagctcctcatccagggct

SEQ ID NO: 504938 - DNA, 20 bp, Homo sapiens
cagctcctcatccagggctc

SEQ ID NO: 504939 - DNA, 15 bp, Homo sapiens
cagctgacatggagt

SEQ ID NO: 504940 - DNA, 10 bp, Homo sapiens
cagctgcctc

SEQ ID NO: 504941 - DNA, 16 bp, Homo sapiens
cagctgcctcccctcc

SEQ ID NO: 504942 - DNA, 20 bp, Homo sapiens
cagctgcctcccctcctctg

SEQ ID NO: 504943 - DNA, 23 bp, Homo sapiens
cagctgcctcccctcctctgctt

SEQ ID NO: 504944 - DNA, 20 bp, Homo sapiens
cagctgggtggcactgccat

SEQ ID NO: 504945 - DNA, 19 bp, Homo sapiens
cagctgttccacaggggct

SEQ ID NO: 504946 - DNA, 19 bp, Homo sapiens
cagcttctcatcctgcagg

SEQ ID NO: 504947 - DNA, 18 bp, Homo sapiens
cagcttttcccaaaagcc

SEQ ID NO: 504948 - DNA, 20 bp, Homo sapiens
caggaaagagaacttccaga

SEQ ID NO: 504949 - DNA, 19 bp, Homo sapiens
caggaaggctgagaggaga

SEQ ID NO: 504950 - DNA, 16 bp, Homo sapiens
caggacatgctgaagc

SEQ ID NO: 504951 - DNA, 14 bp, Homo sapiens
caggactcagctcc

SEQ ID NO: 504952 - DNA, 17 bp, Homo sapiens
caggactcagctcccca

SEQ ID NO: 504953 - DNA, 18 bp, Homo sapiens
caggactcagctccccag

SEQ ID NO: 504954 - DNA, 17 bp, Homo sapiens
caggagaggggcagaac

SEQ ID NO: 504955 - DNA, 17 bp, Homo sapiens
caggaggctgaggcagg

SEQ ID NO: 504956 - DNA, 16 bp, Homo sapiens
caggagttggaagtgt

SEQ ID NO: 504957 - DNA, 23 bp, Homo sapiens
caggatggttcccttgatgaaga

SEQ ID NO: 504958 - DNA, 14 bp, Homo sapiens
caggcacctgggct

SEQ ID NO: 504959 - DNA, 12 bp, Homo sapiens
caggcagcccta

SEQ ID NO: 504960 - DNA, 14 bp, Homo sapiens
caggcaggcacctg

SEQ ID NO: 504961 - DNA, 15 bp, Homo sapiens
caggcaggcacctgg

SEQ ID NO: 504962 - DNA, 21 bp, Homo sapiens
caggccatcatcagtggagcc

SEQ ID NO: 504963 - DNA, 13 bp, Homo sapiens
caggctacactga

SEQ ID NO: 504964 - DNA, 18 bp, Homo sapiens
caggctgggcaaggaggc

SEQ ID NO: 504965 - DNA, 17 bp, Homo sapiens
caggcttgcctgcaggc

SEQ ID NO: 504966 - DNA, 18 bp, Homo sapiens
caggcttgcctgcaggca

SEQ ID NO: 504967 - DNA, 23 bp, Homo sapiens
cagggagaggagtgactgagctt

SEQ ID NO: 504968 - DNA, 12 bp, Homo sapiens
cagggatgagca

SEQ ID NO: 504969 - DNA, 16 bp, Homo sapiens
cagggatgagcatgga

SEQ ID NO: 504970 - DNA, 17 bp, Homo sapiens
cagggatgatggcagag

SEQ ID NO: 504971 - DNA, 20 bp, Homo sapiens
cagggatgatggcagagcca

SEQ ID NO: 504972 - DNA, 13 bp, Homo sapiens
cagggatttgagg

SEQ ID NO: 504973 - DNA, 14 bp, Homo sapiens
cagggccccagcac

SEQ ID NO: 504974 - DNA, 15 bp, Homo sapiens
cagggccccagcact

SEQ ID NO: 504975 - DNA, 12 bp, Homo sapiens
cagggcctggaa

SEQ ID NO: 504976 - DNA, 17 bp, Homo sapiens
cagggcctggaagacag

SEQ ID NO: 504977 - DNA, 13 bp, Homo sapiens
cagggctcagcct

SEQ ID NO: 504978 - DNA, 16 bp, Homo sapiens
caggggacaggatggt

SEQ ID NO: 504979 - DNA, 23 bp, Homo sapiens
caggggctgggggtgctggatgg

SEQ ID NO: 504980 - DNA, 15 bp, Homo sapiens
cagggtccctcagga

SEQ ID NO: 504981 - DNA, 14 bp, Homo sapiens
cagggtctgggcag

SEQ ID NO: 504982 - DNA, 19 bp, Homo sapiens
cagggtgagagtctgggtc

SEQ ID NO: 504983 - DNA, 15 bp, Homo sapiens
caggtgagcccatgg

SEQ ID NO: 504984 - DNA, 13 bp, Homo sapiens
caggtgcagacct

SEQ ID NO: 504985 - DNA, 23 bp, Homo sapiens
caggtgcagcccccactgccttt

SEQ ID NO: 504986 - DNA, 16 bp, Homo sapiens
caggtgggcttcccag

SEQ ID NO: 504987 - DNA, 22 bp, Homo sapiens
caggtgggcttcccagtggctg

SEQ ID NO: 504988 - DNA, 14 bp, Homo sapiens
cagtaaataaattg

SEQ ID NO: 504989 - DNA, 18 bp, Homo sapiens
cagtaacgcaggggaaac

SEQ ID NO: 504990 - DNA, 18 bp, Homo sapiens
cagtaagtatctggagga

SEQ ID NO: 504991 - DNA, 16 bp, Homo sapiens
cagtaattgtgaaaat

SEQ ID NO: 504992 - DNA, 20 bp, Homo sapiens
cagtacctcctgtctctggc

SEQ ID NO: 504993 - DNA, 16 bp, Homo sapiens
cagtatgggttaggga

SEQ ID NO: 504994 - DNA, 21 bp, Homo sapiens
cagtatgggttagggaaaaca

SEQ ID NO: 504995 - DNA, 16 bp, Homo sapiens
cagtatgtcccatagg

SEQ ID NO: 504996 - DNA, 17 bp, Homo sapiens
cagtcaccccaggactc

SEQ ID NO: 504997 - DNA, 18 bp, Homo sapiens
cagtcaggaaagagaact

SEQ ID NO: 504998 - DNA, 19 bp, Homo sapiens
cagtccaaggaaaccacag

SEQ ID NO: 504999 - DNA, 23 bp, Homo sapiens
cagtccaaggaaaccacagctgc

SEQ ID NO: 505000 - DNA, 13 bp, Homo sapiens
cagtccagcctgg

SEQ ID NO: 505001 - DNA, 17 bp, Homo sapiens
cagtccagcctggagat

SEQ ID NO: 505002 - DNA, 20 bp, Homo sapiens
cagtctggccaatatggaga

SEQ ID NO: 505003 - DNA, 14 bp, Homo sapiens
cagtcttgcagcag

SEQ ID NO: 505004 - DNA, 15 bp, Homo sapiens
cagtgcaacactgaa

SEQ ID NO: 505005 - DNA, 12 bp, Homo sapiens
cagtgcaggcac

SEQ ID NO: 505006 - DNA, 19 bp, Homo sapiens
cagtgcttgattgcgtgga

SEQ ID NO: 505007 - DNA, 15 bp, Homo sapiens
cagtgcttgccacag

SEQ ID NO: 505008 - DNA, 22 bp, Homo sapiens
cagtggacaccaggagtccctg

SEQ ID NO: 505009 - DNA, 15 bp, Homo sapiens
cagtggctgctgccc

SEQ ID NO: 505010 - DNA, 13 bp, Homo sapiens
cagtgggtgcccc

SEQ ID NO: 505011 - DNA, 15 bp, Homo sapiens
cagttcagagctgcc

SEQ ID NO: 505012 - DNA, 17 bp, Homo sapiens
cagttcagagctgccct

SEQ ID NO: 505013 - DNA, 22 bp, Homo sapiens
cagttcagagctgccctctcct

SEQ ID NO: 505014 - DNA, 23 bp, Homo sapiens
cagttcagagctgccctctcctg

SEQ ID NO: 505015 - DNA, 24 bp, Homo sapiens
cagttcagagctgccctctcctgg

SEQ ID NO: 505016 - DNA, 14 bp, Homo sapiens
cagttctgaagaag

SEQ ID NO: 505017 - DNA, 15 bp, Homo sapiens
cagttctgaagaaga

SEQ ID NO: 505018 - DNA, 22 bp, Homo sapiens
cagttctgaagaagatggtacc

SEQ ID NO: 505019 - DNA, 15 bp, Homo sapiens
cagtttctgtcctgc

SEQ ID NO: 505020 - DNA, 16 bp, Homo sapiens
cagtttgtcacatgaa

SEQ ID NO: 505021 - DNA, 22 bp, Homo sapiens
cataactggcttctgcttgtca

SEQ ID NO: 505022 - DNA, 19 bp, Homo sapiens
cataagctagaaaaattag

SEQ ID NO: 505023 - DNA, 19 bp, Homo sapiens
catacaaaaattagccggg

SEQ ID NO: 505024 - DNA, 13 bp, Homo sapiens
catacagacacat

SEQ ID NO: 505025 - DNA, 18 bp, Homo sapiens
catagaagaacagcagat

SEQ ID NO: 505026 - DNA, 11 bp, Homo sapiens
catagccatac

SEQ ID NO: 505027 - DNA, 22 bp, Homo sapiens
cataggaggggtctggacatgt

SEQ ID NO: 505028 - DNA, 11 bp, Homo sapiens
catattaaaat

SEQ ID NO: 505029 - DNA, 12 bp, Homo sapiens
catattaaaatc

SEQ ID NO: 505030 - DNA, 15 bp, Homo sapiens
catattaaaatcaca

SEQ ID NO: 505031 - DNA, 17 bp, Homo sapiens
catattaaaatcacaaa

SEQ ID NO: 505032 - DNA, 12 bp, Homo sapiens
catatttcaatt

SEQ ID NO: 505033 - DNA, 15 bp, Homo sapiens
catatttgcatatgt

SEQ ID NO: 505034 - DNA, 19 bp, Homo sapiens
catatttgcatatgtatga

SEQ ID NO: 505035 - DNA, 15 bp, Homo sapiens
catattttctccgaa

SEQ ID NO: 505036 - DNA, 19 bp, Homo sapiens
catcaaatggaagacacat

SEQ ID NO: 505037 - DNA, 15 bp, Homo sapiens
catcaagactggaag

SEQ ID NO: 505038 - DNA, 18 bp, Homo sapiens
catcaaggcactgcctga

SEQ ID NO: 505039 - DNA, 19 bp, Homo sapiens
catcagaaacaccctcaca

SEQ ID NO: 505040 - DNA, 12 bp, Homo sapiens
catcagcagcag

SEQ ID NO: 505041 - DNA, 15 bp, Homo sapiens
catcagcagcagggt

SEQ ID NO: 505042 - DNA, 22 bp, Homo sapiens
catcaggagaaaaagcctccag

SEQ ID NO: 505043 - DNA, 21 bp, Homo sapiens
catcattatttgcagagacag

SEQ ID NO: 505044 - DNA, 20 bp, Homo sapiens
catccattaatgtagataaa

SEQ ID NO: 505045 - DNA, 14 bp, Homo sapiens
catccctccctcca

SEQ ID NO: 505046 - DNA, 19 bp, Homo sapiens
catcccttgaccaggcctg

SEQ ID NO: 505047 - DNA, 20 bp, Homo sapiens
catcccttgaccaggcctgg

SEQ ID NO: 505048 - DNA, 15 bp, Homo sapiens
catccgaggcagggt

SEQ ID NO: 505049 - DNA, 15 bp, Homo sapiens
catccgcctgtgggc

SEQ ID NO: 505050 - DNA, 13 bp, Homo sapiens
catcctagtctct

SEQ ID NO: 505051 - DNA, 17 bp, Homo sapiens
catcctcaaacactgca

SEQ ID NO: 505052 - DNA, 18 bp, Homo sapiens
catccttcctcacaccag

SEQ ID NO: 505053 - DNA, 12 bp, Homo sapiens
catccttctgcc

SEQ ID NO: 505054 - DNA, 14 bp, Homo sapiens
catccttgagtcaa

SEQ ID NO: 505055 - DNA, 14 bp, Homo sapiens
catctctggatgcc

SEQ ID NO: 505056 - DNA, 19 bp, Homo sapiens
catctggaaccatcagaaa

SEQ ID NO: 505057 - DNA, 11 bp, Homo sapiens
catctgggctc

SEQ ID NO: 505058 - DNA, 13 bp, Homo sapiens
catctgggctcct

SEQ ID NO: 505059 - DNA, 17 bp, Homo sapiens
catctgtccctgcctca

SEQ ID NO: 505060 - DNA, 22 bp, Homo sapiens
catcttctttttgaaatcagca

SEQ ID NO: 505061 - DNA, 19 bp, Homo sapiens
catctttcctgatggcagg

SEQ ID NO: 505062 - DNA, 13 bp, Homo sapiens
catgaaaatgcaa

SEQ ID NO: 505063 - DNA, 15 bp, Homo sapiens
catgaaactccacct

SEQ ID NO: 505064 - DNA, 15 bp, Homo sapiens
catgaaggtttctga

SEQ ID NO: 505065 - DNA, 20 bp, Homo sapiens
catgaagtttccttggctgg

SEQ ID NO: 505066 - DNA, 16 bp, Homo sapiens
catgaattagttttat

SEQ ID NO: 505067 - DNA, 14 bp, Homo sapiens
catgaccacataga

SEQ ID NO: 505068 - DNA, 15 bp, Homo sapiens
catgacccaggctgg

SEQ ID NO: 505069 - DNA, 16 bp, Homo sapiens
catgacccaggctggg

SEQ ID NO: 505070 - DNA, 15 bp, Homo sapiens
catgatgctgggatt

SEQ ID NO: 505071 - DNA, 14 bp, Homo sapiens
catgcaaaggctgg

SEQ ID NO: 505072 - DNA, 14 bp, Homo sapiens
catgcacagctgta

SEQ ID NO: 505073 - DNA, 18 bp, Homo sapiens
catgcatagtcccagcta

SEQ ID NO: 505074 - DNA, 17 bp, Homo sapiens
catgcatggaaattccc

SEQ ID NO: 505075 - DNA, 18 bp, Homo sapiens
catgccaagcactgtgct

SEQ ID NO: 505076 - DNA, 13 bp, Homo sapiens
catgcctgcacct

SEQ ID NO: 505077 - DNA, 23 bp, Homo sapiens
catgcggagaacaaatgtgaagg

SEQ ID NO: 505078 - DNA, 16 bp, Homo sapiens
catgctgaagccaaag

SEQ ID NO: 505079 - DNA, 14 bp, Homo sapiens
catgctgtgtgact

SEQ ID NO: 505080 - DNA, 17 bp, Homo sapiens
catgctgtgtgactcaa

SEQ ID NO: 505081 - DNA, 17 bp, Homo sapiens
ctgggtaagagcacagg

SEQ ID NO: 505082 - DNA, 20 bp, Homo sapiens
ctgggtccaggcctggccat

SEQ ID NO: 505083 - DNA, 14 bp, Homo sapiens
ctgggtggcactgc

SEQ ID NO: 505084 - DNA, 15 bp, Homo sapiens
ctgggtggcactgcc

SEQ ID NO: 505085 - DNA, 21 bp, Homo sapiens
ctgggtggcactgccatgcag

SEQ ID NO: 505086 - DNA, 18 bp, Homo sapiens
ctgggtttaaggggagag

SEQ ID NO: 505087 - DNA, 22 bp, Homo sapiens
ctgggtttaaggggagaggaaa

SEQ ID NO: 505088 - DNA, 12 bp, Homo sapiens
ctggtaagcaaa

SEQ ID NO: 505089 - DNA, 15 bp, Homo sapiens
ctggtattcctgcct

SEQ ID NO: 505090 - DNA, 21 bp, Homo sapiens
ctggtcccagccagcagttca

SEQ ID NO: 505091 - DNA, 20 bp, Homo sapiens
ctggtctctaggctggggaa

SEQ ID NO: 505092 - DNA, 17 bp, Homo sapiens
ctggtgggcctcctctg

SEQ ID NO: 505093 - DNA, 20 bp, Homo sapiens
ctggttaacttgtttggcct

SEQ ID NO: 505094 - DNA, 15 bp, Homo sapiens
ctgtaaaaactgtgg

SEQ ID NO: 505095 - DNA, 20 bp, Homo sapiens
ctgtaagaaaatatcacttg

SEQ ID NO: 505096 - DNA, 23 bp, Homo sapiens
ctgtagtcccacttacttgggag

SEQ ID NO: 505097 - DNA, 15 bp, Homo sapiens
ctgtatgattcccag

SEQ ID NO: 505098 - DNA, 23 bp, Homo sapiens
ctgtcattcccaccaccctgagg

SEQ ID NO: 505099 - DNA, 15 bp, Homo sapiens
ctgtccacacccagc

SEQ ID NO: 505100 - DNA, 19 bp, Homo sapiens
ctgtcccaggttatctggg

SEQ ID NO: 505101 - DNA, 22 bp, Homo sapiens
ctgtcccaggttatctgggcat

SEQ ID NO: 505102 - DNA, 14 bp, Homo sapiens
ctgtccctgcctca

SEQ ID NO: 505103 - DNA, 20 bp, Homo sapiens
ctgtctacactaagagagaa

SEQ ID NO: 505104 - DNA, 13 bp, Homo sapiens
ctgtctcaaaaaa

SEQ ID NO: 505105 - DNA, 13 bp, Homo sapiens
ctgtctctggcct

SEQ ID NO: 505106 - DNA, 14 bp, Homo sapiens
ctgtctgccagcca

SEQ ID NO: 505107 - DNA, 17 bp, Homo sapiens
ctgtctgccagccagca

SEQ ID NO: 505108 - DNA, 19 bp, Homo sapiens
ctgtgaatttgtgtaagga

SEQ ID NO: 505109 - DNA, 14 bp, Homo sapiens
ctgtgagagagttg

SEQ ID NO: 505110 - DNA, 17 bp, Homo sapiens
ctgtgatttatttggag

SEQ ID NO: 505111 - DNA, 15 bp, Homo sapiens
ctgtgcagagacttt

SEQ ID NO: 505112 - DNA, 17 bp, Homo sapiens
ctgtggctgctagcact

SEQ ID NO: 505113 - DNA, 16 bp, Homo sapiens
ctgtgtaaaaagagag

SEQ ID NO: 505114 - DNA, 12 bp, Homo sapiens
ctgttagccagg

SEQ ID NO: 505115 - DNA, 13 bp, Homo sapiens
ctgttataatctt

SEQ ID NO: 505116 - DNA, 19 bp, Homo sapiens
ctgttataatctttcacag

SEQ ID NO: 505117 - DNA, 12 bp, Homo sapiens
ctgttcaagagc

SEQ ID NO: 505118 - DNA, 22 bp, Homo sapiens
ctgttctgaggattcaggggct

SEQ ID NO: 505119 - DNA, 12 bp, Homo sapiens
ctgttgcagtga

SEQ ID NO: 505120 - DNA, 12 bp, Homo sapiens
ctgtttcccagc

SEQ ID NO: 505121 - DNA, 15 bp, Homo sapiens
ctgtttcccagcagt

SEQ ID NO: 505122 - DNA, 23 bp, Homo sapiens
ctgtttggaggagcaaaggctga

SEQ ID NO: 505123 - DNA, 14 bp, Homo sapiens
cttaagacaaatgg

SEQ ID NO: 505124 - DNA, 17 bp, Homo sapiens
cttaagacaaatgggac

SEQ ID NO: 505125 - DNA, 20 bp, Homo sapiens
cttaagacaaatgggactga

SEQ ID NO: 505126 - DNA, 23 bp, Homo sapiens
cttaagctaggatgttgctcaga

SEQ ID NO: 505127 - DNA, 22 bp, Homo sapiens
cttacagctgggtggcactgcc

SEQ ID NO: 505128 - DNA, 14 bp, Homo sapiens
cttactccaggaga

SEQ ID NO: 505129 - DNA, 15 bp, Homo sapiens
cttagaataaaattg

SEQ ID NO: 505130 - DNA, 16 bp, Homo sapiens
cttagaataaaattgt

SEQ ID NO: 505131 - DNA, 17 bp, Homo sapiens
cttagaataaaattgta

SEQ ID NO: 505132 - DNA, 20 bp, Homo sapiens
cttagaataaaattgtaaaa

SEQ ID NO: 505133 - DNA, 17 bp, Homo sapiens
cttagacctcagcctgt

SEQ ID NO: 505134 - DNA, 20 bp, Homo sapiens
cttagacctcagcctgtgct

SEQ ID NO: 505135 - DNA, 11 bp, Homo sapiens
cttagagcagt

SEQ ID NO: 505136 - DNA, 14 bp, Homo sapiens
cttagcttagacct

SEQ ID NO: 505137 - DNA, 17 bp, Homo sapiens
cttagcttagacctcag

SEQ ID NO: 505138 - DNA, 20 bp, Homo sapiens
cttagcttagacctcagcct

SEQ ID NO: 505139 - DNA, 22 bp, Homo sapiens
cttagcttagacctcagcctgt

SEQ ID NO: 505140 - DNA, 19 bp, Homo sapiens
cttaggcatgactgtagaa

SEQ ID NO: 505141 - DNA, 21 bp, Homo sapiens
cttagggttatgattaagtaa

SEQ ID NO: 505142 - DNA, 15 bp, Homo sapiens
cttattgtagcatat

SEQ ID NO: 505143 - DNA, 12 bp, Homo sapiens
cttatttgagtg

SEQ ID NO: 505144 - DNA, 17 bp, Homo sapiens
cttcaaatccttgaaga

SEQ ID NO: 505145 - DNA, 11 bp, Homo sapiens
cttcaataaac

SEQ ID NO: 505146 - DNA, 13 bp, Homo sapiens
cttcaataaacca

SEQ ID NO: 505147 - DNA, 21 bp, Homo sapiens
cttcacacacaggcaactgag

SEQ ID NO: 505148 - DNA, 18 bp, Homo sapiens
cttcagagctgacacagg

SEQ ID NO: 505149 - DNA, 20 bp, Homo sapiens
cttcagagctgacacaggat

SEQ ID NO: 505150 - DNA, 13 bp, Homo sapiens
cttcagcctagcc

SEQ ID NO: 505151 - DNA, 21 bp, Homo sapiens
cttcagcctagccgacctcag

SEQ ID NO: 505152 - DNA, 18 bp, Homo sapiens
cttcagcggtttatataa

SEQ ID NO: 505153 - DNA, 17 bp, Homo sapiens
cttcatccgcctgtggg

SEQ ID NO: 505154 - DNA, 11 bp, Homo sapiens
cttcatctgga

SEQ ID NO: 505155 - DNA, 12 bp, Homo sapiens
cttcatctggaa

SEQ ID NO: 505156 - DNA, 21 bp, Homo sapiens
cttcatgcatggaaattccct

SEQ ID NO: 505157 - DNA, 23 bp, Homo sapiens
cttcatgctgtctacactaagag

SEQ ID NO: 505158 - DNA, 15 bp, Homo sapiens
cttcattagagcagg

SEQ ID NO: 505159 - DNA, 17 bp, Homo sapiens
cttccaggcctgaagtc

SEQ ID NO: 505160 - DNA, 19 bp, Homo sapiens
cttccagggacgaagaaga

SEQ ID NO: 505161 - DNA, 18 bp, Homo sapiens
cttccatctttcctgatg

SEQ ID NO: 505162 - DNA, 22 bp, Homo sapiens
cttccatctttcctgatggcag

SEQ ID NO: 505163 - DNA, 18 bp, Homo sapiens
cttcccagtggctgctgc

SEQ ID NO: 505164 - DNA, 19 bp, Homo sapiens
cttcccagtggctgctgcc

SEQ ID NO: 505165 - DNA, 20 bp, Homo sapiens
cttcccagtggctgctgccc

SEQ ID NO: 505166 - DNA, 17 bp, Homo sapiens
cttcccatgacccaggc

SEQ ID NO: 505167 - DNA, 16 bp, Homo sapiens
cttccccttgcccagg

SEQ ID NO: 505168 - DNA, 21 bp, Homo sapiens
catgctgtgtgactcaaacca

SEQ ID NO: 505169 - DNA, 12 bp, Homo sapiens
catgctttgagt

SEQ ID NO: 505170 - DNA, 15 bp, Homo sapiens
catgctttgagtcca

SEQ ID NO: 505171 - DNA, 20 bp, Homo sapiens
catgctttgagtccacgccc

SEQ ID NO: 505172 - DNA, 14 bp, Homo sapiens
catggagctggccg

SEQ ID NO: 505173 - DNA, 15 bp, Homo sapiens
catggcccctgtgag

SEQ ID NO: 505174 - DNA, 14 bp, Homo sapiens
catggctgtgagga

SEQ ID NO: 505175 - DNA, 19 bp, Homo sapiens
catgggcacaaagggccca

SEQ ID NO: 505176 - DNA, 21 bp, Homo sapiens
catgggcacaaagggcccaga

SEQ ID NO: 505177 - DNA, 19 bp, Homo sapiens
catgtagaagctgcatctt

SEQ ID NO: 505178 - DNA, 15 bp, Homo sapiens
catgtataatatttt

SEQ ID NO: 505179 - DNA, 18 bp, Homo sapiens
catgtataatatttttaa

SEQ ID NO: 505180 - DNA, 21 bp, Homo sapiens
catgtcatgtaggttgtctaa

SEQ ID NO: 505181 - DNA, 16 bp, Homo sapiens
catgtgcctctgtcct

SEQ ID NO: 505182 - DNA, 21 bp, Homo sapiens
catgtggtgggacagggaccc

SEQ ID NO: 505183 - DNA, 22 bp, Homo sapiens
catgtggttaatgccatggaca

SEQ ID NO: 505184 - DNA, 18 bp, Homo sapiens
catgttttaaagcttgct

SEQ ID NO: 505185 - DNA, 18 bp, Homo sapiens
catgttttccagctcctc

SEQ ID NO: 505186 - DNA, 21 bp, Homo sapiens
cattaatgtagataaagcact

SEQ ID NO: 505187 - DNA, 11 bp, Homo sapiens
cattagagcag

SEQ ID NO: 505188 - DNA, 23 bp, Homo sapiens
cattagagcaggcgttcagctca

SEQ ID NO: 505189 - DNA, 23 bp, Homo sapiens
cattatgatgtgggtcaaggaat

SEQ ID NO: 505190 - DNA, 16 bp, Homo sapiens
cattcatgcctggctt

SEQ ID NO: 505191 - DNA, 15 bp, Homo sapiens
cattcattccattct

SEQ ID NO: 505192 - DNA, 17 bp, Homo sapiens
cattctacacagagcag

SEQ ID NO: 505193 - DNA, 17 bp, Homo sapiens
cattcttggttggctgg

SEQ ID NO: 505194 - DNA, 21 bp, Homo sapiens
cattcttggttggctggcctt

SEQ ID NO: 505195 - DNA, 22 bp, Homo sapiens
cattgactatcaaactgaagcc

SEQ ID NO: 505196 - DNA, 22 bp, Homo sapiens
cattgtaatctttcatagccat

SEQ ID NO: 505197 - DNA, 23 bp, Homo sapiens
cattgtttttaagaaaaacatgt

SEQ ID NO: 505198 - DNA, 18 bp, Homo sapiens
catttaaactcatttgag

SEQ ID NO: 505199 - DNA, 22 bp, Homo sapiens
catttattttgactgtgattta

SEQ ID NO: 505200 - DNA, 15 bp, Homo sapiens
catttcaggagcagc

SEQ ID NO: 505201 - DNA, 22 bp, Homo sapiens
catttgcgttccatgatgctgg

SEQ ID NO: 505202 - DNA, 14 bp, Homo sapiens
catttgctcatgga

SEQ ID NO: 505203 - DNA, 15 bp, Homo sapiens
catttgctcatggaa

SEQ ID NO: 505204 - DNA, 14 bp, Homo sapiens
catttggaatcata

SEQ ID NO: 505205 - DNA, 14 bp, Homo sapiens
catttgtataaaat

SEQ ID NO: 505206 - DNA, 13 bp, Homo sapiens
ccaaacagtgaca

SEQ ID NO: 505207 - DNA, 22 bp, Homo sapiens
ccaaactgactcttaagaagac

SEQ ID NO: 505208 - DNA, 20 bp, Homo sapiens
ccaaagccaataacacacag

SEQ ID NO: 505209 - DNA, 21 bp, Homo sapiens
ccaaaggccatggagagctgg

SEQ ID NO: 505210 - DNA, 20 bp, Homo sapiens
ccaaatcactgaactttgct

SEQ ID NO: 505211 - DNA, 21 bp, Homo sapiens
ccaactccagaaagtgacaag

SEQ ID NO: 505212 - DNA, 15 bp, Homo sapiens
ccaactgctccagcc

SEQ ID NO: 505213 - DNA, 18 bp, Homo sapiens
ccaactgctccagcctct

SEQ ID NO: 505214 - DNA, 18 bp, Homo sapiens
ccaacttcttcagagctg

SEQ ID NO: 505215 - DNA, 16 bp, Homo sapiens
ccaagagtctgatgat

SEQ ID NO: 505216 - DNA, 13 bp, Homo sapiens
ccaagcatagaga

SEQ ID NO: 505217 - DNA, 17 bp, Homo sapiens
ccaagcatttagatgta

SEQ ID NO: 505218 - DNA, 18 bp, Homo sapiens
ccaaggaaaccacagctg

SEQ ID NO: 505219 - DNA, 19 bp, Homo sapiens
ccaaggaaaccacagctgc

SEQ ID NO: 505220 - DNA, 20 bp, Homo sapiens
ccaaggaaaccacagctgct

SEQ ID NO: 505221 - DNA, 23 bp, Homo sapiens
ccaaggagatgaagcaaacacat

SEQ ID NO: 505222 - DNA, 20 bp, Homo sapiens
ccaagggttcagagactcag

SEQ ID NO: 505223 - DNA, 23 bp, Homo sapiens
ccaagggttcagagactcagggc

SEQ ID NO: 505224 - DNA, 15 bp, Homo sapiens
ccaagtggcagagct

SEQ ID NO: 505225 - DNA, 17 bp, Homo sapiens
ccaagtggcagagcttg

SEQ ID NO: 505226 - DNA, 15 bp, Homo sapiens
ccaatacctcttgga

SEQ ID NO: 505227 - DNA, 22 bp, Homo sapiens
ccaatagttgttgattggcagg

SEQ ID NO: 505228 - DNA, 14 bp, Homo sapiens
ccaatgctgatgtc

SEQ ID NO: 505229 - DNA, 18 bp, Homo sapiens
ccaatgctgcctgggagc

SEQ ID NO: 505230 - DNA, 17 bp, Homo sapiens
ccacaaataaatgacaa

SEQ ID NO: 505231 - DNA, 17 bp, Homo sapiens
ccacacaacaccaggac

SEQ ID NO: 505232 - DNA, 12 bp, Homo sapiens
ccacacctgagc

SEQ ID NO: 505233 - DNA, 18 bp, Homo sapiens
ccacagaagctccaggta

SEQ ID NO: 505234 - DNA, 21 bp, Homo sapiens
ccacagacctgctctggacac

SEQ ID NO: 505235 - DNA, 14 bp, Homo sapiens
ccacagctgctgga

SEQ ID NO: 505236 - DNA, 16 bp, Homo sapiens
ccacagctgctggaga

SEQ ID NO: 505237 - DNA, 19 bp, Homo sapiens
ccacatgccaagcactgtg

SEQ ID NO: 505238 - DNA, 17 bp, Homo sapiens
ccacatgcggagaacaa

SEQ ID NO: 505239 - DNA, 13 bp, Homo sapiens
ccaccagccttgc

SEQ ID NO: 505240 - DNA, 18 bp, Homo sapiens
ccaccagccttgctctct

SEQ ID NO: 505241 - DNA, 20 bp, Homo sapiens
ccacctccttccagcactga

SEQ ID NO: 505242 - DNA, 13 bp, Homo sapiens
ccacctctgtggg

SEQ ID NO: 505243 - DNA, 23 bp, Homo sapiens
ccacctctgtgggcactggtggg

SEQ ID NO: 505244 - DNA, 14 bp, Homo sapiens
ccaccttgcgggga

SEQ ID NO: 505245 - DNA, 18 bp, Homo sapiens
ccacgcccaccagccttg

SEQ ID NO: 505246 - DNA, 13 bp, Homo sapiens
ccactcccaggca

SEQ ID NO: 505247 - DNA, 15 bp, Homo sapiens
ccactcccaggcagc

SEQ ID NO: 505248 - DNA, 18 bp, Homo sapiens
ccactgcactccagcctg

SEQ ID NO: 505249 - DNA, 22 bp, Homo sapiens
ccactgcctttgacctgcctcc

SEQ ID NO: 505250 - DNA, 23 bp, Homo sapiens
ccacttgacactattcactaaaa

SEQ ID NO: 505251 - DNA, 21 bp, Homo sapiens
ccagaaataaagttggtgaca

SEQ ID NO: 505252 - DNA, 15 bp, Homo sapiens
ccagaccttctagga

SEQ ID NO: 505253 - DNA, 18 bp, Homo sapiens
ccagagttccccatgcag

SEQ ID NO: 505254 - DNA, 19 bp, Homo sapiens
ccagagttccccatgcaga

SEQ ID NO: 505255 - DNA, 15 bp, Homo sapiens
ccagatcctggaaat

SEQ ID NO: 505256 - DNA, 20 bp, Homo sapiens
ccagatgggggaaagcacag

SEQ ID NO: 505257 - DNA, 20 bp, Homo sapiens
ccagcagccagctctcagcc

SEQ ID NO: 505258 - DNA, 21 bp, Homo sapiens
ccagcagttcagagctgccct

SEQ ID NO: 505259 - DNA, 23 bp, Homo sapiens
ccagcagttcagagctgccctct

SEQ ID NO: 505260 - DNA, 18 bp, Homo sapiens
ccagcatcccttgaccag

SEQ ID NO: 505261 - DNA, 18 bp, Homo sapiens
ccagcattttactgattc

SEQ ID NO: 505262 - DNA, 19 bp, Homo sapiens
ccagccagcagccagctct

SEQ ID NO: 505263 - DNA, 22 bp, Homo sapiens
ccagccagcagttcagagctgc

SEQ ID NO: 505264 - DNA, 13 bp, Homo sapiens
ccagccagggctg

SEQ ID NO: 505265 - DNA, 22 bp, Homo sapiens
ccagccggtacctgggaagggg

SEQ ID NO: 505266 - DNA, 14 bp, Homo sapiens
ccagcctctgccgc

SEQ ID NO: 505267 - DNA, 16 bp, Homo sapiens
ccagcctgcctggcag

SEQ ID NO: 505268 - DNA, 20 bp, Homo sapiens
ccagcctgcctggcaggctg

SEQ ID NO: 505269 - DNA, 20 bp, Homo sapiens
ccagcctggagatgaaatct

SEQ ID NO: 505270 - DNA, 16 bp, Homo sapiens
ccagccttgctctctt

SEQ ID NO: 505271 - DNA, 20 bp, Homo sapiens
ccagctactcaggaggctga

SEQ ID NO: 505272 - DNA, 22 bp, Homo sapiens
ccagctattgatataaataaaa

SEQ ID NO: 505273 - DNA, 21 bp, Homo sapiens
ccaggagtttaagaccagcct

SEQ ID NO: 505274 - DNA, 20 bp, Homo sapiens
ccaggcaggctaaggcgtgg

SEQ ID NO: 505275 - DNA, 21 bp, Homo sapiens
ccaggcaggctaaggcgtgga

SEQ ID NO: 505276 - DNA, 18 bp, Homo sapiens
ccaggcttgcctgcaggc

SEQ ID NO: 505277 - DNA, 21 bp, Homo sapiens
ccagggacgaagaagagccac

SEQ ID NO: 505278 - DNA, 13 bp, Homo sapiens
ccagggcctagga

SEQ ID NO: 505279 - DNA, 12 bp, Homo sapiens
ccagggctcagc

SEQ ID NO: 505280 - DNA, 23 bp, Homo sapiens
ctcaaggaataatgggcttagag

SEQ ID NO: 505281 - DNA, 21 bp, Homo sapiens
ctcaataaactgaatttttct

SEQ ID NO: 505282 - DNA, 19 bp, Homo sapiens
ctcaatgttactatctgct

SEQ ID NO: 505283 - DNA, 16 bp, Homo sapiens
ctcacagctgtaataa

SEQ ID NO: 505284 - DNA, 20 bp, Homo sapiens
ctcactggggtcctggggcc

SEQ ID NO: 505285 - DNA, 23 bp, Homo sapiens
ctcagagagggcaggcatgaagt

SEQ ID NO: 505286 - DNA, 18 bp, Homo sapiens
ctcagagtatggagctca

SEQ ID NO: 505287 - DNA, 20 bp, Homo sapiens
ctcagcccctgatcctgtga

SEQ ID NO: 505288 - DNA, 22 bp, Homo sapiens
ctcagcccctgatcctgtgaag

SEQ ID NO: 505289 - DNA, 20 bp, Homo sapiens
ctcagcctggtgggcctcct

SEQ ID NO: 505290 - DNA, 18 bp, Homo sapiens
ctcagcctgtgctgcccg

SEQ ID NO: 505291 - DNA, 14 bp, Homo sapiens
ctcaggaccaggca

SEQ ID NO: 505292 - DNA, 20 bp, Homo sapiens
ctcaggaggctgaggcagga

SEQ ID NO: 505293 - DNA, 14 bp, Homo sapiens
ctcagggccccagc

SEQ ID NO: 505294 - DNA, 18 bp, Homo sapiens
ctcagggccccagcacta

SEQ ID NO: 505295 - DNA, 17 bp, Homo sapiens
ctcagggtccctcagga

SEQ ID NO: 505296 - DNA, 13 bp, Homo sapiens
ctcagggtctctg

SEQ ID NO: 505297 - DNA, 17 bp, Homo sapiens
ctcagggtctctgctgc

SEQ ID NO: 505298 - DNA, 20 bp, Homo sapiens
ctcaggtgatccacctgcct

SEQ ID NO: 505299 - DNA, 23 bp, Homo sapiens
ctcatccattaatgtagataaag

SEQ ID NO: 505300 - DNA, 18 bp, Homo sapiens
ctcatccctaatgctgca

SEQ ID NO: 505301 - DNA, 15 bp, Homo sapiens
ctcatccgaggcagg

SEQ ID NO: 505302 - DNA, 12 bp, Homo sapiens
ctcattcctgtt

SEQ ID NO: 505303 - DNA, 12 bp, Homo sapiens
ctcatttccaag

SEQ ID NO: 505304 - DNA, 13 bp, Homo sapiens
ctcatttccaagc

SEQ ID NO: 505305 - DNA, 21 bp, Homo sapiens
ctccaaactgactcttaagaa

SEQ ID NO: 505306 - DNA, 14 bp, Homo sapiens
ctccacctccctgc

SEQ ID NO: 505307 - DNA, 16 bp, Homo sapiens
ctccacctccctgcaa

SEQ ID NO: 505308 - DNA, 14 bp, Homo sapiens
ctccagcctctgcc

SEQ ID NO: 505309 - DNA, 16 bp, Homo sapiens
ctccagcctctgccgc

SEQ ID NO: 505310 - DNA, 17 bp, Homo sapiens
ctccagcctgcctggca

SEQ ID NO: 505311 - DNA, 15 bp, Homo sapiens
ctccaggcaggctaa

SEQ ID NO: 505312 - DNA, 17 bp, Homo sapiens
ctcccataaccgctgat

SEQ ID NO: 505313 - DNA, 23 bp, Homo sapiens
ctcccctggggacagcaagggct

SEQ ID NO: 505314 - DNA, 21 bp, Homo sapiens
ctccctccacctccctgcaat

SEQ ID NO: 505315 - DNA, 14 bp, Homo sapiens
ctccctgcaataaa

SEQ ID NO: 505316 - DNA, 18 bp, Homo sapiens
ctccctggttctgatgat

SEQ ID NO: 505317 - DNA, 19 bp, Homo sapiens
ctcccttcatgcatggaaa

SEQ ID NO: 505318 - DNA, 21 bp, Homo sapiens
ctcctcacaacatggtgtctg

SEQ ID NO: 505319 - DNA, 22 bp, Homo sapiens
ctcctctgcttgccatccctcc

SEQ ID NO: 505320 - DNA, 16 bp, Homo sapiens
ctcctctgtccagggc

SEQ ID NO: 505321 - DNA, 11 bp, Homo sapiens
tgcctcccctc

SEQ ID NO: 505322 - DNA, 15 bp, Homo sapiens
tgcctcccctcctct

SEQ ID NO: 505323 - DNA, 18 bp, Homo sapiens
tgcctcccctcctctgct

SEQ ID NO: 505324 - DNA, 19 bp, Homo sapiens
tgcctccgcctcagtaaga

SEQ ID NO: 505325 - DNA, 15 bp, Homo sapiens
tgcctggcaggctgt

SEQ ID NO: 505326 - DNA, 12 bp, Homo sapiens
tgcctgtacaag

SEQ ID NO: 505327 - DNA, 15 bp, Homo sapiens
tgccttattatttct

SEQ ID NO: 505328 - DNA, 22 bp, Homo sapiens
tgccttctcaactccaaactga

SEQ ID NO: 505329 - DNA, 20 bp, Homo sapiens
tgcgagtgctcatttcagga

SEQ ID NO: 505330 - DNA, 15 bp, Homo sapiens
tgcggagaacaaatg

SEQ ID NO: 505331 - DNA, 17 bp, Homo sapiens
tgcggcattaaagccat

SEQ ID NO: 505332 - DNA, 18 bp, Homo sapiens
tgctagcacttggagcca

SEQ ID NO: 505333 - DNA, 22 bp, Homo sapiens
tgctatattttcatgacttttc

SEQ ID NO: 505334 - DNA, 13 bp, Homo sapiens
tgctcacagctgt

SEQ ID NO: 505335 - DNA, 23 bp, Homo sapiens
tgctcagttcagaatcacttctg

SEQ ID NO: 505336 - DNA, 11 bp, Homo sapiens
tgctcatggaa

SEQ ID NO: 505337 - DNA, 14 bp, Homo sapiens
tgctcatttcagga

SEQ ID NO: 505338 - DNA, 14 bp, Homo sapiens
tgctccagcctctg

SEQ ID NO: 505339 - DNA, 17 bp, Homo sapiens
tgctccagcctctgccg

SEQ ID NO: 505340 - DNA, 19 bp, Homo sapiens
tgctccagcctctgccgct

SEQ ID NO: 505341 - DNA, 12 bp, Homo sapiens
tgctccaggcag

SEQ ID NO: 505342 - DNA, 22 bp, Homo sapiens
tgctccaggcaggctaaggcgt

SEQ ID NO: 505343 - DNA, 18 bp, Homo sapiens
tgctccctggttctgatg

SEQ ID NO: 505344 - DNA, 13 bp, Homo sapiens
tgctcctcagggt

SEQ ID NO: 505345 - DNA, 23 bp, Homo sapiens
tgctgagcctgtaaaataaaagg

SEQ ID NO: 505346 - DNA, 17 bp, Homo sapiens
tgctgatgtcctcacca

SEQ ID NO: 505347 - DNA, 16 bp, Homo sapiens
tgctgcccaggcccag

SEQ ID NO: 505348 - DNA, 22 bp, Homo sapiens
tgctgcccgtcttcagcctagc

SEQ ID NO: 505349 - DNA, 19 bp, Homo sapiens
tgctgccgccccacccaga

SEQ ID NO: 505350 - DNA, 13 bp, Homo sapiens
tgctgtattttaa

SEQ ID NO: 505351 - DNA, 22 bp, Homo sapiens
tgctgtattttaaaagaatgat

SEQ ID NO: 505352 - DNA, 20 bp, Homo sapiens
tgctgtccccttccaggggt

SEQ ID NO: 505353 - DNA, 16 bp, Homo sapiens
tgctgtgtaacactgt

SEQ ID NO: 505354 - DNA, 17 bp, Homo sapiens
tgcttataggtggcctc

SEQ ID NO: 505355 - DNA, 14 bp, Homo sapiens
tgcttctgttttat

SEQ ID NO: 505356 - DNA, 21 bp, Homo sapiens
tgctttgagtccacgcccacc

SEQ ID NO: 505357 - DNA, 13 bp, Homo sapiens
tgctttgcccagc

SEQ ID NO: 505358 - DNA, 14 bp, Homo sapiens
tgctttgcccagca

SEQ ID NO: 505359 - DNA, 23 bp, Homo sapiens
tggaaacttcagcggtttatata

SEQ ID NO: 505360 - DNA, 13 bp, Homo sapiens
tggaaaggcagct

SEQ ID NO: 505361 - DNA, 22 bp, Homo sapiens
tggaactctcctgctcctcagg

SEQ ID NO: 505362 - DNA, 23 bp, Homo sapiens
tggaagacagagacctcctgcct

SEQ ID NO: 505363 - DNA, 17 bp, Homo sapiens
tggaagggaagttcagg

SEQ ID NO: 505364 - DNA, 13 bp, Homo sapiens
tggaaggtgggga

SEQ ID NO: 505365 - DNA, 23 bp, Homo sapiens
tggaagtgactttggctgcatgc

SEQ ID NO: 505366 - DNA, 21 bp, Homo sapiens
tggaagtgtgtgatctgtggg

SEQ ID NO: 505367 - DNA, 11 bp, Homo sapiens
tggaagttgca

SEQ ID NO: 505368 - DNA, 16 bp, Homo sapiens
tggaagttgcatggca

SEQ ID NO: 505369 - DNA, 16 bp, Homo sapiens
tggacaaggaggtctg

SEQ ID NO: 505370 - DNA, 20 bp, Homo sapiens
tggacaccaggagtccctgg

SEQ ID NO: 505371 - DNA, 21 bp, Homo sapiens
tggacaccaggagtccctggt

SEQ ID NO: 505372 - DNA, 12 bp, Homo sapiens
tggacatggccc

SEQ ID NO: 505373 - DNA, 14 bp, Homo sapiens
tggacggtgctcca

SEQ ID NO: 505374 - DNA, 16 bp, Homo sapiens
tggacggtgctccagg

SEQ ID NO: 505375 - DNA, 14 bp, Homo sapiens
tggactccagcctg

SEQ ID NO: 505376 - DNA, 22 bp, Homo sapiens
tggactccagcctgcctggcag

SEQ ID NO: 505377 - DNA, 23 bp, Homo sapiens
tggactccagcctgcctggcagg

SEQ ID NO: 505378 - DNA, 17 bp, Homo sapiens
tggactgagctggggga

SEQ ID NO: 505379 - DNA, 21 bp, Homo sapiens
tggagaactagaacctggagg

SEQ ID NO: 505380 - DNA, 20 bp, Homo sapiens
tggagagctagaacctggag

SEQ ID NO: 505381 - DNA, 18 bp, Homo sapiens
tggagagctggagcctgg

SEQ ID NO: 505382 - DNA, 20 bp, Homo sapiens
tggagagctggagcctggtg

SEQ ID NO: 505383 - DNA, 16 bp, Homo sapiens
tggagatagggaaaga

SEQ ID NO: 505384 - DNA, 14 bp, Homo sapiens
tggagcagaatcag

SEQ ID NO: 505385 - DNA, 17 bp, Homo sapiens
tggagccaagggttcag

SEQ ID NO: 505386 - DNA, 13 bp, Homo sapiens
tggagcctggtgc

SEQ ID NO: 505387 - DNA, 14 bp, Homo sapiens
tggagcctggtgcc

SEQ ID NO: 505388 - DNA, 18 bp, Homo sapiens
tggagctcagagagggca

SEQ ID NO: 505389 - DNA, 19 bp, Homo sapiens
tggaggactagaacctgga

SEQ ID NO: 505390 - DNA, 18 bp, Homo sapiens
tggaggagcaaaggctga

SEQ ID NO: 505391 - DNA, 20 bp, Homo sapiens
tggaggagcaaaggctgaga

SEQ ID NO: 505392 - DNA, 22 bp, Homo sapiens
tggaggagcagtgcaggcacag

SEQ ID NO: 505393 - DNA, 20 bp, Homo sapiens
tggagggaaacaccaaactc

SEQ ID NO: 505394 - DNA, 11 bp, Homo sapiens
tggagggaagc

SEQ ID NO: 505395 - DNA, 20 bp, Homo sapiens
tggagggctagaacctggag

SEQ ID NO: 505396 - DNA, 22 bp, Homo sapiens
tggagggctagaacctggagag

SEQ ID NO: 505397 - DNA, 23 bp, Homo sapiens
tggagggctagaacctggagagc

SEQ ID NO: 505398 - DNA, 20 bp, Homo sapiens
tggagggctagaactggaga

SEQ ID NO: 505399 - DNA, 21 bp, Homo sapiens
tggagggctggaatctggaga

SEQ ID NO: 505400 - DNA, 13 bp, Homo sapiens
tggagtggaggca

SEQ ID NO: 505401 - DNA, 20 bp, Homo sapiens
tggagttcccgtgcacctac

SEQ ID NO: 505402 - DNA, 18 bp, Homo sapiens
tggatctatcacctgtca

SEQ ID NO: 505403 - DNA, 23 bp, Homo sapiens
tggattggagaagtaatcctagg

SEQ ID NO: 505404 - DNA, 20 bp, Homo sapiens
tggcaaaagacatcctcaaa

SEQ ID NO: 505405 - DNA, 21 bp, Homo sapiens
tggcaagctagaacctggagg

SEQ ID NO: 505406 - DNA, 12 bp, Homo sapiens
tggcaaggctgt

SEQ ID NO: 505407 - DNA, 13 bp, Homo sapiens
tggcaccactctc

SEQ ID NO: 505408 - DNA, 22 bp, Homo sapiens
tggcagaatggggtgcatgaag

SEQ ID NO: 505409 - DNA, 19 bp, Homo sapiens
tggcaggagttggaagtgt

SEQ ID NO: 505410 - DNA, 15 bp, Homo sapiens
tggcaggtgcagccc

SEQ ID NO: 505411 - DNA, 15 bp, Homo sapiens
tggcatcagctggcg

SEQ ID NO: 505412 - DNA, 19 bp, Homo sapiens
tggccaggcctcttggcag

SEQ ID NO: 505413 - DNA, 14 bp, Homo sapiens
tggccgggcatggt

SEQ ID NO: 505414 - DNA, 19 bp, Homo sapiens
tggccgtgggcctggggta

SEQ ID NO: 505415 - DNA, 21 bp, Homo sapiens
tggcctcaagatcaatgaaat

SEQ ID NO: 505416 - DNA, 21 bp, Homo sapiens
tggcctctccttgtggcctgg

SEQ ID NO: 505417 - DNA, 14 bp, Homo sapiens
tggcctgggcctcc

SEQ ID NO: 505418 - DNA, 21 bp, Homo sapiens
tggctagggttccactggaga

SEQ ID NO: 505419 - DNA, 19 bp, Homo sapiens
tggctctttggagatcaag

SEQ ID NO: 505420 - DNA, 13 bp, Homo sapiens
tggctgctagcac

SEQ ID NO: 505421 - DNA, 14 bp, Homo sapiens
tggctgctagcact

SEQ ID NO: 505422 - DNA, 23 bp, Homo sapiens
tggctgggaactcacctggggct

SEQ ID NO: 505423 - DNA, 14 bp, Homo sapiens
tggcttctccaggg

SEQ ID NO: 505424 - DNA, 18 bp, Homo sapiens
tggcttctgcttgtcatc

SEQ ID NO: 505425 - DNA, 17 bp, Homo sapiens
tgggaactcacctgggg

SEQ ID NO: 505426 - DNA, 16 bp, Homo sapiens
tgggaaggccagctgc

SEQ ID NO: 505427 - DNA, 20 bp, Homo sapiens
tgggacagtcacctcatgga

SEQ ID NO: 505428 - DNA, 18 bp, Homo sapiens
tgggactgatgtcatctt

SEQ ID NO: 505429 - DNA, 18 bp, Homo sapiens
tgggactggagtccctgt

SEQ ID NO: 505430 - DNA, 14 bp, Homo sapiens
tgggaggcagaggt

SEQ ID NO: 505431 - DNA, 14 bp, Homo sapiens
tgggatgtttctgt

SEQ ID NO: 505432 - DNA, 19 bp, Homo sapiens
tgggcacaaagggcccaga

SEQ ID NO: 505433 - DNA, 17 bp, Homo sapiens
tgggcactggtgggcca

SEQ ID NO: 505434 - DNA, 22 bp, Homo sapiens
tgggcagatcatttgaggccag

SEQ ID NO: 505435 - DNA, 20 bp, Homo sapiens
tgggcctcctcacaacatgg

SEQ ID NO: 505436 - DNA, 18 bp, Homo sapiens
tgggcctcctctgtccag

SEQ ID NO: 505437 - DNA, 20 bp, Homo sapiens
tgggcctcctctgtccaggg

SEQ ID NO: 505438 - DNA, 14 bp, Homo sapiens
tgggcttagagcag

SEQ ID NO: 505439 - DNA, 17 bp, Homo sapiens
tggggacagagcagaac

SEQ ID NO: 505440 - DNA, 12 bp, Homo sapiens
tggggctgctgg

SEQ ID NO: 505441 - DNA, 13 bp, Homo sapiens
tggggctgctggc

SEQ ID NO: 505442 - DNA, 14 bp, Homo sapiens
tgggtagacacaca

SEQ ID NO: 505443 - DNA, 16 bp, Homo sapiens
tgggtagacacacatg

SEQ ID NO: 505444 - DNA, 13 bp, Homo sapiens
tgggtcaaggaat

SEQ ID NO: 505445 - DNA, 14 bp, Homo sapiens
tgggtccaagtggc

SEQ ID NO: 505446 - DNA, 23 bp, Homo sapiens
tgggtgccccccttgccagacat

SEQ ID NO: 505447 - DNA, 16 bp, Homo sapiens
tgggttagggaaaaca

SEQ ID NO: 505448 - DNA, 19 bp, Homo sapiens
tgggttagggaaaacattc

SEQ ID NO: 505449 - DNA, 21 bp, Homo sapiens
tggtaatttgtatctgaagga

SEQ ID NO: 505450 - DNA, 22 bp, Homo sapiens
tggtatctagacccatcttctt

SEQ ID NO: 505451 - DNA, 16 bp, Homo sapiens
tggtattgactcaaca

SEQ ID NO: 505452 - DNA, 14 bp, Homo sapiens
tggtctctaggctg

SEQ ID NO: 505453 - DNA, 17 bp, Homo sapiens
tggtctctaggctgggg

SEQ ID NO: 505454 - DNA, 20 bp, Homo sapiens
tggtctttcttacaaggaag

SEQ ID NO: 505455 - DNA, 17 bp, Homo sapiens
tggtgccacaaataaaa

SEQ ID NO: 505456 - DNA, 18 bp, Homo sapiens
tggtgccacaaataaaat

SEQ ID NO: 505457 - DNA, 20 bp, Homo sapiens
gtttatataagcttgtattc

SEQ ID NO: 505458 - DNA, 15 bp, Homo sapiens
gtttatgtctaaaga

SEQ ID NO: 505459 - DNA, 21 bp, Homo sapiens
gtttcaaacatatataacaat

SEQ ID NO: 505460 - DNA, 20 bp, Homo sapiens
gtttctgaaaattaacactg

SEQ ID NO: 505461 - DNA, 15 bp, Homo sapiens
tcaggagaggggcag

SEQ ID NO: 505462 - DNA, 17 bp, Homo sapiens
tcaggagaggggcagaa

SEQ ID NO: 505463 - DNA, 18 bp, Homo sapiens
tcaggagaggggcagaac

SEQ ID NO: 505464 - DNA, 22 bp, Homo sapiens
tcaggagcagcctcagaacaaa

SEQ ID NO: 505465 - DNA, 16 bp, Homo sapiens
tcaggaggctgaggca

SEQ ID NO: 505466 - DNA, 23 bp, Homo sapiens
tcaggccatcatcagtggagcca

SEQ ID NO: 505467 - DNA, 13 bp, Homo sapiens
tcaggctctgaga

SEQ ID NO: 505468 - DNA, 21 bp, Homo sapiens
tcagtaagacgacaaggaaag

SEQ ID NO: 505469 - DNA, 22 bp, Homo sapiens
tcagtaagacgacaaggaaagg

SEQ ID NO: 505470 - DNA, 17 bp, Homo sapiens
tcagtaagtatctggag

SEQ ID NO: 505471 - DNA, 16 bp, Homo sapiens
tcagtgtccaaagcag

SEQ ID NO: 505472 - DNA, 19 bp, Homo sapiens
tcagttcctctttgcatgg

SEQ ID NO: 505473 - DNA, 17 bp, Homo sapiens
tcatcaaggcactgcct

SEQ ID NO: 505474 - DNA, 18 bp, Homo sapiens
tcatccacacaacaccag

SEQ ID NO: 505475 - DNA, 23 bp, Homo sapiens
tcatccacacaacaccaggactt

SEQ ID NO: 505476 - DNA, 15 bp, Homo sapiens
tcatccgaggcaggg

SEQ ID NO: 505477 - DNA, 12 bp, Homo sapiens
tcatcctgcagg

SEQ ID NO: 505478 - DNA, 18 bp, Homo sapiens
tcatgcatagtcccagct

SEQ ID NO: 505479 - DNA, 17 bp, Homo sapiens
tcatgcccaagccctga

SEQ ID NO: 505480 - DNA, 15 bp, Homo sapiens
tcatgcctggcttcg

SEQ ID NO: 505481 - DNA, 18 bp, Homo sapiens
tcatgcctggcttcgcaa

SEQ ID NO: 505482 - DNA, 19 bp, Homo sapiens
tcatggaattggagctcgt

SEQ ID NO: 505483 - DNA, 17 bp, Homo sapiens
tcatgtgcctctgtcct

SEQ ID NO: 505484 - DNA, 14 bp, Homo sapiens
tcattaaagttcta

SEQ ID NO: 505485 - DNA, 15 bp, Homo sapiens
tcattagagcaggcg

SEQ ID NO: 505486 - DNA, 16 bp, Homo sapiens
tcattccattctggaa

SEQ ID NO: 505487 - DNA, 15 bp, Homo sapiens
tcattcctgttcttt

SEQ ID NO: 505488 - DNA, 22 bp, Homo sapiens
tcatttatttccatattaaaat

SEQ ID NO: 505489 - DNA, 16 bp, Homo sapiens
tcatttcaggagcagc

SEQ ID NO: 505490 - DNA, 13 bp, Homo sapiens
tcatttccaagca

SEQ ID NO: 505491 - DNA, 20 bp, Homo sapiens
tcatttgctaactagcttgg

SEQ ID NO: 505492 - DNA, 13 bp, Homo sapiens
tccaaagcagggt

SEQ ID NO: 505493 - DNA, 17 bp, Homo sapiens
tccaagcatttagatgt

SEQ ID NO: 505494 - DNA, 19 bp, Homo sapiens
tccaaggaaaccacagctg

SEQ ID NO: 505495 - DNA, 20 bp, Homo sapiens
tccaaggaaaccacagctgc

SEQ ID NO: 505496 - DNA, 21 bp, Homo sapiens
tccaaggaaaccacagctgct

SEQ ID NO: 505497 - DNA, 23 bp, Homo sapiens
tccaaggaaaccacagctgctgg

SEQ ID NO: 505498 - DNA, 15 bp, Homo sapiens
tccaagtggctgtga

SEQ ID NO: 505499 - DNA, 11 bp, Homo sapiens
tccaatacctc

SEQ ID NO: 505500 - DNA, 19 bp, Homo sapiens
tccaattccttgcacatag

SEQ ID NO: 505501 - DNA, 21 bp, Homo sapiens
tccacacaacaccaggactta

SEQ ID NO: 505502 - DNA, 18 bp, Homo sapiens
tccacacctccaatgctg

SEQ ID NO: 505503 - DNA, 14 bp, Homo sapiens
tccacaggggctat

SEQ ID NO: 505504 - DNA, 14 bp, Homo sapiens
tccacctccctgca

SEQ ID NO: 505505 - DNA, 19 bp, Homo sapiens
tccacgcccaccagccttg

SEQ ID NO: 505506 - DNA, 22 bp, Homo sapiens
tccacgcccaccagccttgctc

SEQ ID NO: 505507 - DNA, 23 bp, Homo sapiens
tccactggagaattgaaaaggac

SEQ ID NO: 505508 - DNA, 19 bp, Homo sapiens
tccagcctgcctggcaggc

SEQ ID NO: 505509 - DNA, 23 bp, Homo sapiens
tccagctcctcatccagggctct

SEQ ID NO: 505510 - DNA, 17 bp, Homo sapiens
tccagtcatggccaaat

SEQ ID NO: 505511 - DNA, 20 bp, Homo sapiens
tccatccttgagtcaaaaaa

SEQ ID NO: 505512 - DNA, 12 bp, Homo sapiens
tccatgaaaatg

SEQ ID NO: 505513 - DNA, 16 bp, Homo sapiens
tccatgaaaatgcaac

SEQ ID NO: 505514 - DNA, 23 bp, Homo sapiens
tcccacacaagacccaagtagct

SEQ ID NO: 505515 - DNA, 13 bp, Homo sapiens
tcccagacttgct

SEQ ID NO: 505516 - DNA, 17 bp, Homo sapiens
tcccagtacctcctgtc

SEQ ID NO: 505517 - DNA, 21 bp, Homo sapiens
tcccagtggctgctgcccagg

SEQ ID NO: 505518 - DNA, 14 bp, Homo sapiens
tcccataccaccca

SEQ ID NO: 505519 - DNA, 15 bp, Homo sapiens
tcccatgacccaggc

SEQ ID NO: 505520 - DNA, 17 bp, Homo sapiens
tccccaactgctccagc

SEQ ID NO: 505521 - DNA, 19 bp, Homo sapiens
tccccagagtcctctatga

SEQ ID NO: 505522 - DNA, 20 bp, Homo sapiens
tccccagagttccccatgca

SEQ ID NO: 505523 - DNA, 22 bp, Homo sapiens
tcccccactcctcttatttgct

SEQ ID NO: 505524 - DNA, 15 bp, Homo sapiens
tcccctcctctgctt

SEQ ID NO: 505525 - DNA, 18 bp, Homo sapiens
tcccctcctctgcttgcc

SEQ ID NO: 505526 - DNA, 19 bp, Homo sapiens
tcccgagcaaagtctaaag

SEQ ID NO: 505527 - DNA, 15 bp, Homo sapiens
tcccgcgcctttccg

SEQ ID NO: 505528 - DNA, 17 bp, Homo sapiens
tcccggtttcagaagct

SEQ ID NO: 505529 - DNA, 20 bp, Homo sapiens
tccctaatgctgcagatttg

SEQ ID NO: 505530 - DNA, 19 bp, Homo sapiens
tccctcatttcaggagcag

SEQ ID NO: 505531 - DNA, 14 bp, Homo sapiens
tccctccacctccc

SEQ ID NO: 505532 - DNA, 17 bp, Homo sapiens
tccctccacctccctgc

SEQ ID NO: 505533 - DNA, 19 bp, Homo sapiens
tccctccacctccctgcaa

SEQ ID NO: 505534 - DNA, 22 bp, Homo sapiens
tccctcccctggggacagcaag

SEQ ID NO: 505535 - DNA, 12 bp, Homo sapiens
tccctggttctg

SEQ ID NO: 505536 - DNA, 16 bp, Homo sapiens
tccctggttctgatga

SEQ ID NO: 505537 - DNA, 17 bp, Homo sapiens
tccctggttctgatgat

SEQ ID NO: 505538 - DNA, 22 bp, Homo sapiens
tcccttcccatgacccaggctg

SEQ ID NO: 505539 - DNA, 19 bp, Homo sapiens
tcccttctcagaaaacttc

SEQ ID NO: 505540 - DNA, 17 bp, Homo sapiens
tcccttgaccaggcctg

SEQ ID NO: 505541 - DNA, 15 bp, Homo sapiens
tcccttgatgaagaa

SEQ ID NO: 505542 - DNA, 16 bp, Homo sapiens
tcccttgatgaagaag

SEQ ID NO: 505543 - DNA, 22 bp, Homo sapiens
tcctaaaacaaaagctcatcca

SEQ ID NO: 505544 - DNA, 17 bp, Homo sapiens
tcctaaaataagggcag

SEQ ID NO: 505545 - DNA, 21 bp, Homo sapiens
tcctaaggcacccacaaataa

SEQ ID NO: 505546 - DNA, 23 bp, Homo sapiens
tcctagtctctatcattaaagtt

SEQ ID NO: 505547 - DNA, 20 bp, Homo sapiens
tcctcacaacatggtgtctg

SEQ ID NO: 505548 - DNA, 20 bp, Homo sapiens
tcctcagggtccctcaggac

SEQ ID NO: 505549 - DNA, 14 bp, Homo sapiens
tcctctgcttgcca

SEQ ID NO: 505550 - DNA, 15 bp, Homo sapiens
tcctctgcttgccat

SEQ ID NO: 505551 - DNA, 19 bp, Homo sapiens
tcctctgcttgccatccct

SEQ ID NO: 505552 - DNA, 20 bp, Homo sapiens
tcctctgcttgccatccctc

SEQ ID NO: 505553 - DNA, 21 bp, Homo sapiens
tcctctgcttgccatccctcc

SEQ ID NO: 505554 - DNA, 23 bp, Homo sapiens
tcctgagccagtgtcaggaggaa

SEQ ID NO: 505555 - DNA, 13 bp, Homo sapiens
tcctgggcagctg

SEQ ID NO: 505556 - DNA, 14 bp, Homo sapiens
tcctgggcagctgc

SEQ ID NO: 505557 - DNA, 15 bp, Homo sapiens
tcctgggcagctgcc

SEQ ID NO: 505558 - DNA, 16 bp, Homo sapiens
tcctgggcagctgcct

SEQ ID NO: 505559 - DNA, 18 bp, Homo sapiens
tcctgggcagctgcctcc

SEQ ID NO: 505560 - DNA, 19 bp, Homo sapiens
tcctgggcagctgcctccc

SEQ ID NO: 505561 - DNA, 23 bp, Homo sapiens
tcctgggcagctgcctcccctcc

SEQ ID NO: 505562 - DNA, 22 bp, Homo sapiens
tcctggggcctcggagcctcat

SEQ ID NO: 505563 - DNA, 17 bp, Homo sapiens
tcctgtccacacccagc

SEQ ID NO: 505564 - DNA, 17 bp, Homo sapiens
tcctgtctgccagccag

SEQ ID NO: 505565 - DNA, 22 bp, Homo sapiens
tccttagcttagacctcagcct

SEQ ID NO: 505566 - DNA, 20 bp, Homo sapiens
tccttcccaggagtggagga

SEQ ID NO: 505567 - DNA, 15 bp, Homo sapiens
tccttgtatttaaat

SEQ ID NO: 505568 - DNA, 19 bp, Homo sapiens
tccttgtggcctgggcctc

SEQ ID NO: 505569 - DNA, 19 bp, Homo sapiens
tcctttcaatggtttgcaa

SEQ ID NO: 505570 - DNA, 14 bp, Homo sapiens
tcctttgaagagga

SEQ ID NO: 505571 - DNA, 14 bp, Homo sapiens
tcgaaaagagcact

SEQ ID NO: 505572 - DNA, 20 bp, Homo sapiens
tcgagaccatcctggccaac

SEQ ID NO: 505573 - DNA, 15 bp, Homo sapiens
tcgcttccgcatcct

SEQ ID NO: 505574 - DNA, 21 bp, Homo sapiens
tcggacagcccatctgcctgt

SEQ ID NO: 505575 - DNA, 16 bp, Homo sapiens
tcgtcttaactcacca

SEQ ID NO: 505576 - DNA, 13 bp, Homo sapiens
tctaaagtttaca

SEQ ID NO: 505577 - DNA, 15 bp, Homo sapiens
tctaaagtttacagt

SEQ ID NO: 505578 - DNA, 16 bp, Homo sapiens
tctaaagtttacagta

SEQ ID NO: 505579 - DNA, 14 bp, Homo sapiens
tctacacagagcag

SEQ ID NO: 505580 - DNA, 17 bp, Homo sapiens
tctaccaaaaatctcaa

SEQ ID NO: 505581 - DNA, 21 bp, Homo sapiens
tctaccaattatagatcaaat

SEQ ID NO: 505582 - DNA, 15 bp, Homo sapiens
tctacctttctgagt

SEQ ID NO: 505583 - DNA, 22 bp, Homo sapiens
tctactaaaaacacaaaaatta

SEQ ID NO: 505584 - DNA, 14 bp, Homo sapiens
tctagaatactaat

SEQ ID NO: 505585 - DNA, 22 bp, Homo sapiens
tctagaatactaataaaataca

SEQ ID NO: 505586 - DNA, 17 bp, Homo sapiens
tctaggtggcaaggctg

SEQ ID NO: 505587 - DNA, 20 bp, Homo sapiens
tctatcattcccctgcccac

SEQ ID NO: 505588 - DNA, 14 bp, Homo sapiens
tctatctaattttt

SEQ ID NO: 505589 - DNA, 12 bp, Homo sapiens
tctattgtgctt

SEQ ID NO: 505590 - DNA, 22 bp, Homo sapiens
tctcaaacggtacacagactat

SEQ ID NO: 505591 - DNA, 13 bp, Homo sapiens
tctcaaagctggg

SEQ ID NO: 505592 - DNA, 22 bp, Homo sapiens
tctcaagccgcatcccagactt

SEQ ID NO: 505593 - DNA, 15 bp, Homo sapiens
tctcactctgctttg

SEQ ID NO: 505594 - DNA, 21 bp, Homo sapiens
tctcactgtgggaaggccagc

SEQ ID NO: 505595 - DNA, 22 bp, Homo sapiens
tctcagaaaacttctcttctga

SEQ ID NO: 505596 - DNA, 15 bp, Homo sapiens
tctcagggtctctgc

SEQ ID NO: 505597 - DNA, 16 bp, Homo sapiens
tctcagggtctctgct

SEQ ID NO: 505598 - DNA, 18 bp, Homo sapiens
tctcagggtctctgctgc

SEQ ID NO: 505599 - DNA, 22 bp, Homo sapiens
tctcatcacatttgtaaatgtc

SEQ ID NO: 505600 - DNA, 15 bp, Homo sapiens
tctcatcctgcaggc

SEQ ID NO: 505601 - DNA, 21 bp, Homo sapiens
tctccagaaccagtgtctgaa

SEQ ID NO: 505602 - DNA, 21 bp, Homo sapiens
aactccagaaagtgacaagct

SEQ ID NO: 505603 - DNA, 21 bp, Homo sapiens
aactcgaatcactcatttatt

SEQ ID NO: 505604 - DNA, 16 bp, Homo sapiens
aactctagtttgcaga

SEQ ID NO: 505605 - DNA, 20 bp, Homo sapiens
aactgaaatcatacttctta

SEQ ID NO: 505606 - DNA, 13 bp, Homo sapiens
aactgaagccaga

SEQ ID NO: 505607 - DNA, 19 bp, Homo sapiens
aactgactcttaagaagac

SEQ ID NO: 505608 - DNA, 20 bp, Homo sapiens
aactgaggcagacagcagct

SEQ ID NO: 505609 - DNA, 19 bp, Homo sapiens
aactgctccagcctctgcc

SEQ ID NO: 505610 - DNA, 22 bp, Homo sapiens
aactggcttctgcttgtcatcc

SEQ ID NO: 505611 - DNA, 18 bp, Homo sapiens
aacttagaataaaattgt

SEQ ID NO: 505612 - DNA, 21 bp, Homo sapiens
aacttagaataaaattgtaaa

SEQ ID NO: 505613 - DNA, 21 bp, Homo sapiens
aacttaggcatgcacagctgt

SEQ ID NO: 505614 - DNA, 18 bp, Homo sapiens
aacttccagatcctggaa

SEQ ID NO: 505615 - DNA, 16 bp, Homo sapiens
aacttgagggtaataa

SEQ ID NO: 505616 - DNA, 19 bp, Homo sapiens
aacttgagggtaataaact

SEQ ID NO: 505617 - DNA, 21 bp, Homo sapiens
aactttgaggaggaagcagaa

SEQ ID NO: 505618 - DNA, 22 bp, Homo sapiens
aactttgcatagcagctgctac

SEQ ID NO: 505619 - DNA, 15 bp, Homo sapiens
aagaaaaacatgtca

SEQ ID NO: 505620 - DNA, 19 bp, Homo sapiens
aagaaaaacatgtcatgta

SEQ ID NO: 505621 - DNA, 13 bp, Homo sapiens
aagaaaatatcac

SEQ ID NO: 505622 - DNA, 17 bp, Homo sapiens
aagaaagagaaggagcc

SEQ ID NO: 505623 - DNA, 20 bp, Homo sapiens
aagaaagttgcacggctgct

SEQ ID NO: 505624 - DNA, 22 bp, Homo sapiens
aagaaagttgcacggctgctga

SEQ ID NO: 505625 - DNA, 11 bp, Homo sapiens
aagaactgaaa

SEQ ID NO: 505626 - DNA, 12 bp, Homo sapiens
aagaactgaaat

SEQ ID NO: 505627 - DNA, 23 bp, Homo sapiens
aagaaggtttcagaaagaagtgg

SEQ ID NO: 505628 - DNA, 23 bp, Homo sapiens
aagaatcattgtaaacattagtt

SEQ ID NO: 505629 - DNA, 18 bp, Homo sapiens
aagaatgattatgaatta

SEQ ID NO: 505630 - DNA, 23 bp, Homo sapiens
aagacaatggcttactccaggag

SEQ ID NO: 505631 - DNA, 19 bp, Homo sapiens
aagaccaccacctcagagt

SEQ ID NO: 505632 - DNA, 21 bp, Homo sapiens
aagacctggcaaggacacaga

SEQ ID NO: 505633 - DNA, 17 bp, Homo sapiens
aagactctgtctcaaaa

SEQ ID NO: 505634 - DNA, 16 bp, Homo sapiens
aagactgcacatcaaa

SEQ ID NO: 505635 - DNA, 12 bp, Homo sapiens
aagactgtggct

SEQ ID NO: 505636 - DNA, 18 bp, Homo sapiens
aagagaagctactttgtt

SEQ ID NO: 505637 - DNA, 14 bp, Homo sapiens
aagagacagtcacc

SEQ ID NO: 505638 - DNA, 18 bp, Homo sapiens
aagagagaaaacttattt

SEQ ID NO: 505639 - DNA, 18 bp, Homo sapiens
aagagatcgagaccatcc

SEQ ID NO: 505640 - DNA, 15 bp, Homo sapiens
aagagattcctgagc

SEQ ID NO: 505641 - DNA, 19 bp, Homo sapiens
aagagccggagcctccagc

SEQ ID NO: 505642 - DNA, 16 bp, Homo sapiens
aagagctgtcctggta

SEQ ID NO: 505643 - DNA, 21 bp, Homo sapiens
aagaggaaaatgaataataca

SEQ ID NO: 505644 - DNA, 22 bp, Homo sapiens
aagatcacgccactgcactcca

SEQ ID NO: 505645 - DNA, 15 bp, Homo sapiens
aagatccccaactgc

SEQ ID NO: 505646 - DNA, 16 bp, Homo sapiens
aagatccccaactgct

SEQ ID NO: 505647 - DNA, 23 bp, Homo sapiens
aagatccccaactgctccagcct

SEQ ID NO: 505648 - DNA, 22 bp, Homo sapiens
aagatcctaaaacaaaagctca

SEQ ID NO: 505649 - DNA, 16 bp, Homo sapiens
aagcaagtattagaat

SEQ ID NO: 505650 - DNA, 15 bp, Homo sapiens
aagcaattagacaag

SEQ ID NO: 505651 - DNA, 14 bp, Homo sapiens
aagcacctttagaa

SEQ ID NO: 505652 - DNA, 20 bp, Homo sapiens
aagcacctttagaatattaa

SEQ ID NO: 505653 - DNA, 12 bp, Homo sapiens
aagcactgtgct

SEQ ID NO: 505654 - DNA, 15 bp, Homo sapiens
aagcactgtgctcag

SEQ ID NO: 505655 - DNA, 16 bp, Homo sapiens
aagcaggctacactga

SEQ ID NO: 505656 - DNA, 22 bp, Homo sapiens
aagcaggctacactgacactgg

SEQ ID NO: 505657 - DNA, 17 bp, Homo sapiens
aagcaggctcaacataa

SEQ ID NO: 505658 - DNA, 22 bp, Homo sapiens
aagcatcattatttgcagagac

SEQ ID NO: 505659 - DNA, 23 bp, Homo sapiens
aagcccattcattccattctgga

SEQ ID NO: 505660 - DNA, 21 bp, Homo sapiens
aagccttggggctgatgcagt

SEQ ID NO: 505661 - DNA, 17 bp, Homo sapiens
aagctcccaagggatgg

SEQ ID NO: 505662 - DNA, 19 bp, Homo sapiens
aagctcttgaagacactga

SEQ ID NO: 505663 - DNA, 21 bp, Homo sapiens
aagctcttgaagacactgaaa

SEQ ID NO: 505664 - DNA, 18 bp, Homo sapiens
aagctgttctcattcctg

SEQ ID NO: 505665 - DNA, 14 bp, Homo sapiens
aagcttgctcacat

SEQ ID NO: 505666 - DNA, 13 bp, Homo sapiens
aaggaaaggcaaa

SEQ ID NO: 505667 - DNA, 22 bp, Homo sapiens
aaggaagccacagctggtggta

SEQ ID NO: 505668 - DNA, 20 bp, Homo sapiens
aaggaatccactcccaggca

SEQ ID NO: 505669 - DNA, 21 bp, Homo sapiens
aaggaatccactcccaggcag

SEQ ID NO: 505670 - DNA, 13 bp, Homo sapiens
aaggagaggaggc

SEQ ID NO: 505671 - DNA, 22 bp, Homo sapiens
aaggcaactagtggagagaact

SEQ ID NO: 505672 - DNA, 12 bp, Homo sapiens
aaggcactgcct

SEQ ID NO: 505673 - DNA, 16 bp, Homo sapiens
aaggcgtggagctgcc

SEQ ID NO: 505674 - DNA, 16 bp, Homo sapiens
aaggctgtgctccctg

SEQ ID NO: 505675 - DNA, 22 bp, Homo sapiens
aagggattttagtcacacgtgg

SEQ ID NO: 505676 - DNA, 14 bp, Homo sapiens
aagggcatccttct

SEQ ID NO: 505677 - DNA, 19 bp, Homo sapiens
aagggctagaacctggagg

SEQ ID NO: 505678 - DNA, 15 bp, Homo sapiens
aagggctgttataat

SEQ ID NO: 505679 - DNA, 17 bp, Homo sapiens
aagggctgttataatct

SEQ ID NO: 505680 - DNA, 14 bp, Homo sapiens
aaggtcggaccagc

SEQ ID NO: 505681 - DNA, 17 bp, Homo sapiens
aaggttgtattgcatat

SEQ ID NO: 505682 - DNA, 16 bp, Homo sapiens
aaggtttctgaaaatt

SEQ ID NO: 505683 - DNA, 14 bp, Homo sapiens
aagtaatgataact

SEQ ID NO: 505684 - DNA, 17 bp, Homo sapiens
aagtagctgctaccttc

SEQ ID NO: 505685 - DNA, 23 bp, Homo sapiens
aagtatgttagtgcaaattgtca

SEQ ID NO: 505686 - DNA, 22 bp, Homo sapiens
aagtattaggggtaatatattg

SEQ ID NO: 505687 - DNA, 19 bp, Homo sapiens
aagtcatgcaaaggctggg

SEQ ID NO: 505688 - DNA, 21 bp, Homo sapiens
aagtcatgcgtttaatcacat

SEQ ID NO: 505689 - DNA, 13 bp, Homo sapiens
aagtctaaagttt

SEQ ID NO: 505690 - DNA, 21 bp, Homo sapiens
aagtctaaagtttacagtaaa

SEQ ID NO: 505691 - DNA, 20 bp, Homo sapiens
aagtgagacagtccagcctg

SEQ ID NO: 505692 - DNA, 17 bp, Homo sapiens
aagtgtaaacaccatag

SEQ ID NO: 505693 - DNA, 14 bp, Homo sapiens
aagttaaattttat

SEQ ID NO: 505694 - DNA, 11 bp, Homo sapiens
aagttaagaat

SEQ ID NO: 505695 - DNA, 14 bp, Homo sapiens
aagttcaggctctg

SEQ ID NO: 505696 - DNA, 23 bp, Homo sapiens
aagttcaggctctgagacacacc

SEQ ID NO: 505697 - DNA, 16 bp, Homo sapiens
aagttcttaggcacca

SEQ ID NO: 505698 - DNA, 12 bp, Homo sapiens
aagtttacagta

SEQ ID NO: 505699 - DNA, 18 bp, Homo sapiens
aagtttacagtaaataaa

SEQ ID NO: 505700 - DNA, 17 bp, Homo sapiens
aagtttccttggctggt

SEQ ID NO: 505701 - DNA, 18 bp, Homo sapiens
aagtttccttggctggtg

SEQ ID NO: 505702 - DNA, 22 bp, Homo sapiens
aataaaatccatacatttgtgt

SEQ ID NO: 505703 - DNA, 14 bp, Homo sapiens
aataaaattgtaaa

SEQ ID NO: 505704 - DNA, 12 bp, Homo sapiens
aataaaccacaa

SEQ ID NO: 505705 - DNA, 18 bp, Homo sapiens
aataaaccacaagcatct

SEQ ID NO: 505706 - DNA, 17 bp, Homo sapiens
aataaacttagaataaa

SEQ ID NO: 505707 - DNA, 21 bp, Homo sapiens
aataaacttagaataaaattg

SEQ ID NO: 505708 - DNA, 14 bp, Homo sapiens
aataaagcaatgaa

SEQ ID NO: 505709 - DNA, 22 bp, Homo sapiens
aataaagctgttctcattcctg

SEQ ID NO: 505710 - DNA, 20 bp, Homo sapiens
aataaattgtaattgtaaag

SEQ ID NO: 505711 - DNA, 13 bp, Homo sapiens
aataaattgtttg

SEQ ID NO: 505712 - DNA, 21 bp, Homo sapiens
aataagagaagctactttgtt

SEQ ID NO: 505713 - DNA, 20 bp, Homo sapiens
aataatacattgaattagaa

SEQ ID NO: 505714 - DNA, 20 bp, Homo sapiens
aataatgggcttagagcagt

SEQ ID NO: 505715 - DNA, 15 bp, Homo sapiens
aataatgtgaatcat

SEQ ID NO: 505716 - DNA, 12 bp, Homo sapiens
aataatgtttca

SEQ ID NO: 505717 - DNA, 19 bp, Homo sapiens
aatacagtttgtcacatga

SEQ ID NO: 505718 - DNA, 23 bp, Homo sapiens
aatacatactatagattctttat

SEQ ID NO: 505719 - DNA, 21 bp, Homo sapiens
aatacattattggacttccat

SEQ ID NO: 505720 - DNA, 18 bp, Homo sapiens
aatacattgaattagaaa

SEQ ID NO: 505721 - DNA, 13 bp, Homo sapiens
aatactaataaaa

SEQ ID NO: 505722 - DNA, 19 bp, Homo sapiens
aatagtcaaattgtgtgaa

SEQ ID NO: 505723 - DNA, 23 bp, Homo sapiens
aatagttgctgtccccttccagg

SEQ ID NO: 505724 - DNA, 20 bp, Homo sapiens
aatatcagcaagtctcttta

SEQ ID NO: 505725 - DNA, 14 bp, Homo sapiens
aatattaaaaatta

SEQ ID NO: 505726 - DNA, 14 bp, Homo sapiens
aatatttcagataa

SEQ ID NO: 505727 - DNA, 19 bp, Homo sapiens
aatatttgtcgatatttcc

SEQ ID NO: 505728 - DNA, 22 bp, Homo sapiens
aatatttgtcgatatttccatc

SEQ ID NO: 505729 - DNA, 22 bp, Homo sapiens
aatcaatgctataactatgttg

SEQ ID NO: 505730 - DNA, 22 bp, Homo sapiens
aatcactcatttatttccatat

SEQ ID NO: 505731 - DNA, 17 bp, Homo sapiens
aatcatgaattagtttt

SEQ ID NO: 505732 - DNA, 15 bp, Homo sapiens
aatccaatacctctt

SEQ ID NO: 505733 - DNA, 15 bp, Homo sapiens
aatccactcccaggc

SEQ ID NO: 505734 - DNA, 16 bp, Homo sapiens
aatccagcggttctca

SEQ ID NO: 505735 - DNA, 14 bp, Homo sapiens
aatccatacatttg

SEQ ID NO: 505736 - DNA, 17 bp, Homo sapiens
aatccatacatttgtgt

SEQ ID NO: 505737 - DNA, 15 bp, Homo sapiens
aatctggttgtgatt

SEQ ID NO: 505738 - DNA, 16 bp, Homo sapiens
actttcttctaccaga

SEQ ID NO: 505739 - DNA, 17 bp, Homo sapiens
actttgcatagcagctg

SEQ ID NO: 505740 - DNA, 20 bp, Homo sapiens
actttgcctttccataatca

SEQ ID NO: 505741 - DNA, 14 bp, Homo sapiens
actttggctgcatg

SEQ ID NO: 505742 - DNA, 23 bp, Homo sapiens
actttggtgcgggcacaataaat

SEQ ID NO: 505743 - DNA, 17 bp, Homo sapiens
actttttatattttata

SEQ ID NO: 505744 - DNA, 15 bp, Homo sapiens
agaaaaacatgtcat

SEQ ID NO: 505745 - DNA, 19 bp, Homo sapiens
agaaaaattagatgactga

SEQ ID NO: 505746 - DNA, 19 bp, Homo sapiens
agaaaacaaggatgaatta

SEQ ID NO: 505747 - DNA, 20 bp, Homo sapiens
agaaaacttctcttctgagc

SEQ ID NO: 505748 - DNA, 17 bp, Homo sapiens
agaaacaccctcacact

SEQ ID NO: 505749 - DNA, 22 bp, Homo sapiens
agaaacataaataaaatgacca

SEQ ID NO: 505750 - DNA, 19 bp, Homo sapiens
agaaagttgcacggctgct

SEQ ID NO: 505751 - DNA, 19 bp, Homo sapiens
agaaataaagttggtgaca

SEQ ID NO: 505752 - DNA, 16 bp, Homo sapiens
agaacaaagtgagaca

SEQ ID NO: 505753 - DNA, 22 bp, Homo sapiens
agaacactcgaaaagagcactt

SEQ ID NO: 505754 - DNA, 21 bp, Homo sapiens
agaacagtgcttgccacagag

SEQ ID NO: 505755 - DNA, 19 bp, Homo sapiens
agaaccagtgtctgaacca

SEQ ID NO: 505756 - DNA, 16 bp, Homo sapiens
agaacctagaagggct

SEQ ID NO: 505757 - DNA, 17 bp, Homo sapiens
agaacctggagagctag

SEQ ID NO: 505758 - DNA, 12 bp, Homo sapiens
agaacctggagg

SEQ ID NO: 505759 - DNA, 17 bp, Homo sapiens
agaacctggagggctgg

SEQ ID NO: 505760 - DNA, 17 bp, Homo sapiens
agaactagaacctggag

SEQ ID NO: 505761 - DNA, 18 bp, Homo sapiens
agaactagaacctggagg

SEQ ID NO: 505762 - DNA, 23 bp, Homo sapiens
agaactcatccctaatgctgcag

SEQ ID NO: 505763 - DNA, 14 bp, Homo sapiens
agaagaaggcagca

SEQ ID NO: 505764 - DNA, 11 bp, Homo sapiens
agaagagccac

SEQ ID NO: 505765 - DNA, 22 bp, Homo sapiens
agaagagccacagtgagggaga

SEQ ID NO: 505766 - DNA, 19 bp, Homo sapiens
agaagcaccaatcatgaat

SEQ ID NO: 505767 - DNA, 19 bp, Homo sapiens
agaagcctttgggaagggg

SEQ ID NO: 505768 - DNA, 20 bp, Homo sapiens
agaagctgaagatccccaac

SEQ ID NO: 505769 - DNA, 14 bp, Homo sapiens
agaagctgcagctg

SEQ ID NO: 505770 - DNA, 21 bp, Homo sapiens
agaagggatatctactgtggt

SEQ ID NO: 505771 - DNA, 13 bp, Homo sapiens
agaagggctagaa

SEQ ID NO: 505772 - DNA, 21 bp, Homo sapiens
agaagggctagaacctggaga

SEQ ID NO: 505773 - DNA, 23 bp, Homo sapiens
agaagggctagaacctggagagc

SEQ ID NO: 505774 - DNA, 18 bp, Homo sapiens
agaaggtttcagaaagaa

SEQ ID NO: 505775 - DNA, 20 bp, Homo sapiens
agaagtggggacagagcaga

SEQ ID NO: 505776 - DNA, 22 bp, Homo sapiens
agaatcacttctgagaactcat

SEQ ID NO: 505777 - DNA, 16 bp, Homo sapiens
agaatcagtgcaaaga

SEQ ID NO: 505778 - DNA, 13 bp, Homo sapiens
agaatctggagag

SEQ ID NO: 505779 - DNA, 16 bp, Homo sapiens
agaatctggagagcta

SEQ ID NO: 505780 - DNA, 17 bp, Homo sapiens
agaatgagagacacact

SEQ ID NO: 505781 - DNA, 22 bp, Homo sapiens
agaatgagagacacactgaaga

SEQ ID NO: 505782 - DNA, 23 bp, Homo sapiens
agaatgcacagtgggtggagcca

SEQ ID NO: 505783 - DNA, 15 bp, Homo sapiens
agaatggggtgcatg

SEQ ID NO: 505784 - DNA, 21 bp, Homo sapiens
agaattggctgaactcatgag

SEQ ID NO: 505785 - DNA, 16 bp, Homo sapiens
agacaaatcaaagcag

SEQ ID NO: 505786 - DNA, 15 bp, Homo sapiens
agacaaatgggactg

SEQ ID NO: 505787 - DNA, 19 bp, Homo sapiens
agacaaatgggactgatgt

SEQ ID NO: 505788 - DNA, 19 bp, Homo sapiens
agacacaacaactcctagg

SEQ ID NO: 505789 - DNA, 16 bp, Homo sapiens
agacacagaacacaga

SEQ ID NO: 505790 - DNA, 22 bp, Homo sapiens
agacactgcacagaagacagca

SEQ ID NO: 505791 - DNA, 12 bp, Homo sapiens
agacagagctgg

SEQ ID NO: 505792 - DNA, 23 bp, Homo sapiens
agacagcttctcatcctgcaggc

SEQ ID NO: 505793 - DNA, 17 bp, Homo sapiens
agacagtccagcctgga

SEQ ID NO: 505794 - DNA, 16 bp, Homo sapiens
agaccaccacctcaga

SEQ ID NO: 505795 - DNA, 12 bp, Homo sapiens
agaccagcctgg

SEQ ID NO: 505796 - DNA, 21 bp, Homo sapiens
agaccatcctggccaacatga

SEQ ID NO: 505797 - DNA, 23 bp, Homo sapiens
agacccccccccccaacagaaca

SEQ ID NO: 505798 - DNA, 13 bp, Homo sapiens
agacccctgtctc

SEQ ID NO: 505799 - DNA, 13 bp, Homo sapiens
agaccctgtctct

SEQ ID NO: 505800 - DNA, 11 bp, Homo sapiens
agacctcagcc

SEQ ID NO: 505801 - DNA, 15 bp, Homo sapiens
agacctcagcctgtg

SEQ ID NO: 505802 - DNA, 17 bp, Homo sapiens
agacctcagcctgtgct

SEQ ID NO: 505803 - DNA, 19 bp, Homo sapiens
agacctcagcctgtgctgc

SEQ ID NO: 505804 - DNA, 22 bp, Homo sapiens
agacctggcaaggacacagatg

SEQ ID NO: 505805 - DNA, 18 bp, Homo sapiens
agaccttctaggacgcca

SEQ ID NO: 505806 - DNA, 21 bp, Homo sapiens
agacgacaaggaaaggcaaat

SEQ ID NO: 505807 - DNA, 16 bp, Homo sapiens
agactattgacatcag

SEQ ID NO: 505808 - DNA, 20 bp, Homo sapiens
agactattgacatcagcatc

SEQ ID NO: 505809 - DNA, 12 bp, Homo sapiens
agactcagggcc

SEQ ID NO: 505810 - DNA, 18 bp, Homo sapiens
agactcagggccccagca

SEQ ID NO: 505811 - DNA, 21 bp, Homo sapiens
agactccagctgggttggaaa

SEQ ID NO: 505812 - DNA, 11 bp, Homo sapiens
agactcctagg

SEQ ID NO: 505813 - DNA, 16 bp, Homo sapiens
agactgaactgtgtga

SEQ ID NO: 505814 - DNA, 11 bp, Homo sapiens
agactgtggct

SEQ ID NO: 505815 - DNA, 14 bp, Homo sapiens
agactgtggctgct

SEQ ID NO: 505816 - DNA, 20 bp, Homo sapiens
agactgtggctgctagcact

SEQ ID NO: 505817 - DNA, 14 bp, Homo sapiens
agacttcccagctt

SEQ ID NO: 505818 - DNA, 19 bp, Homo sapiens
agactttttttaaatagta

SEQ ID NO: 505819 - DNA, 19 bp, Homo sapiens
agagaaaacttatttgagt

SEQ ID NO: 505820 - DNA, 15 bp, Homo sapiens
agagaatgagagaca

SEQ ID NO: 505821 - DNA, 21 bp, Homo sapiens
agagactccttgagagaccag

SEQ ID NO: 505822 - DNA, 19 bp, Homo sapiens
agagagaaaacttatttga

SEQ ID NO: 505823 - DNA, 16 bp, Homo sapiens
agagagaatcagacct

SEQ ID NO: 505824 - DNA, 19 bp, Homo sapiens
agagagattgaactttgag

SEQ ID NO: 505825 - DNA, 18 bp, Homo sapiens
agagagcttaatgataat

SEQ ID NO: 505826 - DNA, 15 bp, Homo sapiens
agagagggcaggcat

SEQ ID NO: 505827 - DNA, 20 bp, Homo sapiens
agagatatgcagaaggaagg

SEQ ID NO: 505828 - DNA, 15 bp, Homo sapiens
agagatcaaatggaa

SEQ ID NO: 505829 - DNA, 16 bp, Homo sapiens
agagatcgagaccatc

SEQ ID NO: 505830 - DNA, 23 bp, Homo sapiens
agagatcgagaccatcctggcca

SEQ ID NO: 505831 - DNA, 20 bp, Homo sapiens
agagattggaatgggcagct

SEQ ID NO: 505832 - DNA, 23 bp, Homo sapiens
agagcagtttctgtcctgctggt

SEQ ID NO: 505833 - DNA, 14 bp, Homo sapiens
agagcgcccctccc

SEQ ID NO: 505834 - DNA, 20 bp, Homo sapiens
agagctgacacaaacctgcc

SEQ ID NO: 505835 - DNA, 14 bp, Homo sapiens
agagctgccctctc

SEQ ID NO: 505836 - DNA, 16 bp, Homo sapiens
agagctgccctctcct

SEQ ID NO: 505837 - DNA, 19 bp, Homo sapiens
agagctgccctctcctggg

SEQ ID NO: 505838 - DNA, 12 bp, Homo sapiens
agagctggagcc

SEQ ID NO: 505839 - DNA, 13 bp, Homo sapiens
agagcttggactg

SEQ ID NO: 505840 - DNA, 18 bp, Homo sapiens
agaggagcaaattgaggt

SEQ ID NO: 505841 - DNA, 22 bp, Homo sapiens
agaggctgaggtgggcagatca

SEQ ID NO: 505842 - DNA, 18 bp, Homo sapiens
agagggccctgcctgctg

SEQ ID NO: 505843 - DNA, 18 bp, Homo sapiens
agaggtacccaaggtcac

SEQ ID NO: 505844 - DNA, 20 bp, Homo sapiens
agaggttatctgtcccaggt

SEQ ID NO: 505845 - DNA, 15 bp, Homo sapiens
agagtggtggcagct

SEQ ID NO: 505846 - DNA, 16 bp, Homo sapiens
agagtggtggcagctc

SEQ ID NO: 505847 - DNA, 16 bp, Homo sapiens
agagtttagctggaaa

SEQ ID NO: 505848 - DNA, 20 bp, Homo sapiens
agataaagcactgtttggat

SEQ ID NO: 505849 - DNA, 18 bp, Homo sapiens
agataattctagctttga

SEQ ID NO: 505850 - DNA, 12 bp, Homo sapiens
agataggcctgt

SEQ ID NO: 505851 - DNA, 16 bp, Homo sapiens
agatcaaatggaaagg

SEQ ID NO: 505852 - DNA, 16 bp, Homo sapiens
agatcaaggagaggag

SEQ ID NO: 505853 - DNA, 13 bp, Homo sapiens
agatcacgaggtc

SEQ ID NO: 505854 - DNA, 21 bp, Homo sapiens
agatccccaaaacaggccagg

SEQ ID NO: 505855 - DNA, 17 bp, Homo sapiens
agatccccaactgctcc

SEQ ID NO: 505856 - DNA, 14 bp, Homo sapiens
agatcctcttctca

SEQ ID NO: 505857 - DNA, 23 bp, Homo sapiens
agatctctgctttggaaatcaca

SEQ ID NO: 505858 - DNA, 17 bp, Homo sapiens
agatgaaacacaaacaa

SEQ ID NO: 505859 - DNA, 17 bp, Homo sapiens
agatgaagcaaacacat

SEQ ID NO: 505860 - DNA, 19 bp, Homo sapiens
agatgaagcaaacacatta

SEQ ID NO: 505861 - DNA, 21 bp, Homo sapiens
agatgcagttctgaagaagat

SEQ ID NO: 505862 - DNA, 22 bp, Homo sapiens
agatgcattcttggttggctgg

SEQ ID NO: 505863 - DNA, 15 bp, Homo sapiens
agatgcctgaagcca

SEQ ID NO: 505864 - DNA, 19 bp, Homo sapiens
agatggcctgagaagagag

SEQ ID NO: 505865 - DNA, 12 bp, Homo sapiens
agatgtctattc

SEQ ID NO: 505866 - DNA, 17 bp, Homo sapiens
agattcacactgtctgg

SEQ ID NO: 505867 - DNA, 13 bp, Homo sapiens
agattcctgtcct

SEQ ID NO: 505868 - DNA, 13 bp, Homo sapiens
agatttgggctgg

SEQ ID NO: 505869 - DNA, 14 bp, Homo sapiens
agatttgggctgga

SEQ ID NO: 505870 - DNA, 17 bp, Homo sapiens
agatttgggctggaaca

SEQ ID NO: 505871 - DNA, 14 bp, Homo sapiens
agattttcctgaaa

SEQ ID NO: 505872 - DNA, 15 bp, Homo sapiens
agattttcctgaaaa

SEQ ID NO: 505873 - DNA, 13 bp, Homo sapiens
agcaaacacatta

SEQ ID NO: 505874 - DNA, 23 bp, Homo sapiens
agcaaaggagtagaaagacagag

SEQ ID NO: 505875 - DNA, 18 bp, Homo sapiens
atgaaatattatgttaaa

SEQ ID NO: 505876 - DNA, 13 bp, Homo sapiens
atgaacctggagg

SEQ ID NO: 505877 - DNA, 17 bp, Homo sapiens
atgaacctggagggcta

SEQ ID NO: 505878 - DNA, 17 bp, Homo sapiens
atgaaggtttctgaaaa

SEQ ID NO: 505879 - DNA, 16 bp, Homo sapiens
atgacattcatgcctg

SEQ ID NO: 505880 - DNA, 14 bp, Homo sapiens
atgacccaggctgg

SEQ ID NO: 505881 - DNA, 15 bp, Homo sapiens
atgactgaatttcta

SEQ ID NO: 505882 - DNA, 16 bp, Homo sapiens
atgactgaatttctat

SEQ ID NO: 505883 - DNA, 17 bp, Homo sapiens
atgacttttccatgtat

SEQ ID NO: 505884 - DNA, 20 bp, Homo sapiens
atgacttttccatgtatcta

SEQ ID NO: 505885 - DNA, 20 bp, Homo sapiens
atgagagacacactgaagaa

SEQ ID NO: 505886 - DNA, 21 bp, Homo sapiens
atgagagacacactgaagaag

SEQ ID NO: 505887 - DNA, 18 bp, Homo sapiens
atgagagggccctgcctg

SEQ ID NO: 505888 - DNA, 18 bp, Homo sapiens
atgagatgcctgaagcca

SEQ ID NO: 505889 - DNA, 17 bp, Homo sapiens
atgagcatggagctggc

SEQ ID NO: 505890 - DNA, 18 bp, Homo sapiens
atgagcatggagctggcc

SEQ ID NO: 505891 - DNA, 18 bp, Homo sapiens
atgagctttatgtaataa

SEQ ID NO: 505892 - DNA, 20 bp, Homo sapiens
atgagctttatgtaataatg

SEQ ID NO: 505893 - DNA, 20 bp, Homo sapiens
atgagggtatcaaataaaat

SEQ ID NO: 505894 - DNA, 16 bp, Homo sapiens
atgagtgcgtgctcag

SEQ ID NO: 505895 - DNA, 15 bp, Homo sapiens
atgataactggaaac

SEQ ID NO: 505896 - DNA, 13 bp, Homo sapiens
atgatctgtcaaa

SEQ ID NO: 505897 - DNA, 14 bp, Homo sapiens
atgatctgtcaaag

SEQ ID NO: 505898 - DNA, 14 bp, Homo sapiens
atgattaagtaatg

SEQ ID NO: 505899 - DNA, 12 bp, Homo sapiens
atgattcccagc

SEQ ID NO: 505900 - DNA, 23 bp, Homo sapiens
atgcaaaagtacaagggctgaga

SEQ ID NO: 505901 - DNA, 13 bp, Homo sapiens
atgcaaaggctgg

SEQ ID NO: 505902 - DNA, 14 bp, Homo sapiens
atgcaaaggctggg

SEQ ID NO: 505903 - DNA, 16 bp, Homo sapiens
atgcacgaccttggga

SEQ ID NO: 505904 - DNA, 20 bp, Homo sapiens
atgcactaatcaatactttg

SEQ ID NO: 505905 - DNA, 16 bp, Homo sapiens
atgcagcaaaatgtga

SEQ ID NO: 505906 - DNA, 19 bp, Homo sapiens
atgcagggcctcacacggt

SEQ ID NO: 505907 - DNA, 16 bp, Homo sapiens
atgcatggaaattccc

SEQ ID NO: 505908 - DNA, 20 bp, Homo sapiens
atgcatttaaactcatttga

SEQ ID NO: 505909 - DNA, 18 bp, Homo sapiens
atgccaagcactgtgctc

SEQ ID NO: 505910 - DNA, 23 bp, Homo sapiens
atgcccaggatttgactcgggcc

SEQ ID NO: 505911 - DNA, 20 bp, Homo sapiens
atgccttttcccaactccag

SEQ ID NO: 505912 - DNA, 22 bp, Homo sapiens
atgccttttcccaactccagaa

SEQ ID NO: 505913 - DNA, 14 bp, Homo sapiens
atgctgtattttaa

SEQ ID NO: 505914 - DNA, 11 bp, Homo sapiens
atgctttgagt

SEQ ID NO: 505915 - DNA, 19 bp, Homo sapiens
atgctttgagtccacgccc

SEQ ID NO: 505916 - DNA, 20 bp, Homo sapiens
atgctttgagtccacgccca

SEQ ID NO: 505917 - DNA, 20 bp, Homo sapiens
atggaaattcccttcatctg

SEQ ID NO: 505918 - DNA, 13 bp, Homo sapiens
atggaagacacat

SEQ ID NO: 505919 - DNA, 14 bp, Homo sapiens
atggacctgtcacg

SEQ ID NO: 505920 - DNA, 13 bp, Homo sapiens
atggacggtgctc

SEQ ID NO: 505921 - DNA, 17 bp, Homo sapiens
atggacggtgctccagg

SEQ ID NO: 505922 - DNA, 21 bp, Homo sapiens
atggactccagcctgcctggc

SEQ ID NO: 505923 - DNA, 22 bp, Homo sapiens
atggagaaaccttgtctctact

SEQ ID NO: 505924 - DNA, 23 bp, Homo sapiens
atggagctgtataactgtgcaga

SEQ ID NO: 505925 - DNA, 15 bp, Homo sapiens
atggcagagccaggc

SEQ ID NO: 505926 - DNA, 17 bp, Homo sapiens
atggcaggatggcctgg

SEQ ID NO: 505927 - DNA, 22 bp, Homo sapiens
atggcaggatggcctggccagg

SEQ ID NO: 505928 - DNA, 15 bp, Homo sapiens
atggcagtgtctttc

SEQ ID NO: 505929 - DNA, 24 bp, Homo sapiens
atggccaaatgttcaatatgagtc

SEQ ID NO: 505930 - DNA, 21 bp, Homo sapiens
atggctataaacaattacatg

SEQ ID NO: 505931 - DNA, 19 bp, Homo sapiens
atggcttatccagctggtg

SEQ ID NO: 505932 - DNA, 20 bp, Homo sapiens
atgggacatttgctcatgga

SEQ ID NO: 505933 - DNA, 12 bp, Homo sapiens
atgggactgatg

SEQ ID NO: 505934 - DNA, 18 bp, Homo sapiens
atgggactgatgtcatct

SEQ ID NO: 505935 - DNA, 12 bp, Homo sapiens
atgggctttctc

SEQ ID NO: 505936 - DNA, 15 bp, Homo sapiens
atggtgagcagcgga

SEQ ID NO: 505937 - DNA, 21 bp, Homo sapiens
atggtggcacacgcctgtagt

SEQ ID NO: 505938 - DNA, 13 bp, Homo sapiens
atggttctgtgcc

SEQ ID NO: 505939 - DNA, 16 bp, Homo sapiens
atgtaataatgtgaat

SEQ ID NO: 505940 - DNA, 18 bp, Homo sapiens
atgtagcaaattccaata

SEQ ID NO: 505941 - DNA, 15 bp, Homo sapiens
atgtatctacctcac

SEQ ID NO: 505942 - DNA, 14 bp, Homo sapiens
atgtatgattacat

SEQ ID NO: 505943 - DNA, 12 bp, Homo sapiens
atgtcatcttga

SEQ ID NO: 505944 - DNA, 13 bp, Homo sapiens
atgtcatcttgag

SEQ ID NO: 505945 - DNA, 18 bp, Homo sapiens
atgtgactttgcatcagc

SEQ ID NO: 505946 - DNA, 20 bp, Homo sapiens
atgtgattcctttgaagagg

SEQ ID NO: 505947 - DNA, 21 bp, Homo sapiens
atgtggccctccagtgtatga

SEQ ID NO: 505948 - DNA, 12 bp, Homo sapiens
atgttgaatatt

SEQ ID NO: 505949 - DNA, 18 bp, Homo sapiens
atgtttcaaacatatata

SEQ ID NO: 505950 - DNA, 15 bp, Homo sapiens
atgttttcaggctag

SEQ ID NO: 505951 - DNA, 21 bp, Homo sapiens
atgttttcaggctagatgtat

SEQ ID NO: 505952 - DNA, 19 bp, Homo sapiens
attaaagttctagtgaccg

SEQ ID NO: 505953 - DNA, 11 bp, Homo sapiens
attaacactgc

SEQ ID NO: 505954 - DNA, 15 bp, Homo sapiens
attaagccttccaca

SEQ ID NO: 505955 - DNA, 21 bp, Homo sapiens
attaagtaatgataactggaa

SEQ ID NO: 505956 - DNA, 23 bp, Homo sapiens
attaagtaatgataactggaaac

SEQ ID NO: 505957 - DNA, 14 bp, Homo sapiens
attaatattttaat

SEQ ID NO: 505958 - DNA, 13 bp, Homo sapiens
attaatgtagata

SEQ ID NO: 505959 - DNA, 15 bp, Homo sapiens
attaatgtagataaa

SEQ ID NO: 505960 - DNA, 12 bp, Homo sapiens
attaattcttta

SEQ ID NO: 505961 - DNA, 17 bp, Homo sapiens
attaattctttatcaca

SEQ ID NO: 505962 - DNA, 15 bp, Homo sapiens
attacagtgggtgcc

SEQ ID NO: 505963 - DNA, 18 bp, Homo sapiens
attacatttgtataaaat

SEQ ID NO: 505964 - DNA, 16 bp, Homo sapiens
attactgtaagaaaat

SEQ ID NO: 505965 - DNA, 13 bp, Homo sapiens
attagagcaggcg

SEQ ID NO: 505966 - DNA, 20 bp, Homo sapiens
attagctggttggagagcta

SEQ ID NO: 505967 - DNA, 23 bp, Homo sapiens
attagtcattcaataaattgtaa

SEQ ID NO: 505968 - DNA, 17 bp, Homo sapiens
attagttctatttctat

SEQ ID NO: 505969 - DNA, 18 bp, Homo sapiens
attatgaattacatttgt

SEQ ID NO: 505970 - DNA, 19 bp, Homo sapiens
attatgaattacatttgta

SEQ ID NO: 505971 - DNA, 22 bp, Homo sapiens
attatgaattacatttgtataa

SEQ ID NO: 505972 - DNA, 18 bp, Homo sapiens
attatgggaatcaagatt

SEQ ID NO: 505973 - DNA, 21 bp, Homo sapiens
attatgttaaaactgggacag

SEQ ID NO: 505974 - DNA, 14 bp, Homo sapiens
attcaaaaattata

SEQ ID NO: 505975 - DNA, 20 bp, Homo sapiens
attcaaaaattatattttga

SEQ ID NO: 505976 - DNA, 22 bp, Homo sapiens
attcagctagaactttgaagga

SEQ ID NO: 505977 - DNA, 15 bp, Homo sapiens
attcaggggctgggg

SEQ ID NO: 505978 - DNA, 19 bp, Homo sapiens
attcattccattctggaag

SEQ ID NO: 505979 - DNA, 19 bp, Homo sapiens
attcccttcatctggaacc

SEQ ID NO: 505980 - DNA, 16 bp, Homo sapiens
attcctttgaagagga

SEQ ID NO: 505981 - DNA, 20 bp, Homo sapiens
attcctttgaagaggaaaat

SEQ ID NO: 505982 - DNA, 19 bp, Homo sapiens
attctcactctgctttgca

SEQ ID NO: 505983 - DNA, 22 bp, Homo sapiens
attctcagggtctctgctgccg

SEQ ID NO: 505984 - DNA, 15 bp, Homo sapiens
attctgctacctcac

SEQ ID NO: 505985 - DNA, 17 bp, Homo sapiens
attcttacaaacatgtg

SEQ ID NO: 505986 - DNA, 21 bp, Homo sapiens
attcttccctatctttgccac

SEQ ID NO: 505987 - DNA, 17 bp, Homo sapiens
attcttggttggctggc

SEQ ID NO: 505988 - DNA, 17 bp, Homo sapiens
attgacatcagcatcac

SEQ ID NO: 505989 - DNA, 13 bp, Homo sapiens
attgactttttat

SEQ ID NO: 505990 - DNA, 16 bp, Homo sapiens
attgataagagggcac

SEQ ID NO: 505991 - DNA, 14 bp, Homo sapiens
attgataataaaat

SEQ ID NO: 505992 - DNA, 18 bp, Homo sapiens
attgcactctagcctggc

SEQ ID NO: 505993 - DNA, 21 bp, Homo sapiens
attgctactacttacctacca

SEQ ID NO: 505994 - DNA, 23 bp, Homo sapiens
attggacttccatttggaatcat

SEQ ID NO: 505995 - DNA, 22 bp, Homo sapiens
attggctgaactcatgagaagt

SEQ ID NO: 505996 - DNA, 18 bp, Homo sapiens
attggtaaagaatggaag

SEQ ID NO: 505997 - DNA, 15 bp, Homo sapiens
attgtaaaattgtat

SEQ ID NO: 505998 - DNA, 15 bp, Homo sapiens
attgtatagagatat

SEQ ID NO: 505999 - DNA, 16 bp, Homo sapiens
attgtctgaaattttc

SEQ ID NO: 506000 - DNA, 21 bp, Homo sapiens
attgtctgaaattttctagaa

SEQ ID NO: 506001 - DNA, 18 bp, Homo sapiens
attgtgtgttatttaaat

SEQ ID NO: 506002 - DNA, 15 bp, Homo sapiens
atttaccacttgtgt

SEQ ID NO: 506003 - DNA, 15 bp, Homo sapiens
atttatattttaaag

SEQ ID NO: 506004 - DNA, 22 bp, Homo sapiens
atttattactgtaagaaaatat

SEQ ID NO: 506005 - DNA, 12 bp, Homo sapiens
atttatttggag

SEQ ID NO: 506006 - DNA, 13 bp, Homo sapiens
atttatttggagt

SEQ ID NO: 506007 - DNA, 19 bp, Homo sapiens
atttatttggagtggaggc

SEQ ID NO: 506008 - DNA, 22 bp, Homo sapiens
atttatttggagtggaggcatt

SEQ ID NO: 506009 - DNA, 14 bp, Homo sapiens
atttattttaataa

SEQ ID NO: 506010 - DNA, 21 bp, Homo sapiens
atttattttaataatgtttca

SEQ ID NO: 506011 - DNA, 17 bp, Homo sapiens
atttcacttaataatgt

SEQ ID NO: 506012 - DNA, 19 bp, Homo sapiens
cagctgcctcccctcctct

SEQ ID NO: 506013 - DNA, 22 bp, Homo sapiens
cagctgcctcccctcctctgct

SEQ ID NO: 506014 - DNA, 24 bp, Homo sapiens
cagctgcctcccctcctctgcttg

SEQ ID NO: 506015 - DNA, 14 bp, Homo sapiens
cagctgctggagac

SEQ ID NO: 506016 - DNA, 15 bp, Homo sapiens
cagctgctggagact

SEQ ID NO: 506017 - DNA, 18 bp, Homo sapiens
cagctgctggagactcct

SEQ ID NO: 506018 - DNA, 19 bp, Homo sapiens
cagctgggtggcactgcca

SEQ ID NO: 506019 - DNA, 21 bp, Homo sapiens
cagctgggtggcactgccatg

SEQ ID NO: 506020 - DNA, 22 bp, Homo sapiens
cagctgggtggcactgccatgc

SEQ ID NO: 506021 - DNA, 20 bp, Homo sapiens
cagctgtatgattcccagcc

SEQ ID NO: 506022 - DNA, 20 bp, Homo sapiens
cagctgtgaacatggactct

SEQ ID NO: 506023 - DNA, 20 bp, Homo sapiens
cagcttattgtctagtgaaa

SEQ ID NO: 506024 - DNA, 18 bp, Homo sapiens
cagcttctcatcctgcag

SEQ ID NO: 506025 - DNA, 20 bp, Homo sapiens
cagcttctcatcctgcaggc

SEQ ID NO: 506026 - DNA, 19 bp, Homo sapiens
cagcttctgccacataaaa

SEQ ID NO: 506027 - DNA, 16 bp, Homo sapiens
caggaaagagaacttc

SEQ ID NO: 506028 - DNA, 18 bp, Homo sapiens
caggaaccacaagactgc

SEQ ID NO: 506029 - DNA, 24 bp, Homo sapiens
caggacagcccttctttccacaga

SEQ ID NO: 506030 - DNA, 13 bp, Homo sapiens
caggacatgctga

SEQ ID NO: 506031 - DNA, 13 bp, Homo sapiens
caggacctgacta

SEQ ID NO: 506032 - DNA, 23 bp, Homo sapiens
caggacttaagacaaatgggact

SEQ ID NO: 506033 - DNA, 15 bp, Homo sapiens
caggagaggggcaga

SEQ ID NO: 506034 - DNA, 14 bp, Homo sapiens
caggaggctgaggt

SEQ ID NO: 506035 - DNA, 14 bp, Homo sapiens
caggagtccctggt

SEQ ID NO: 506036 - DNA, 23 bp, Homo sapiens
caggatcgcaagagccatgtaga

SEQ ID NO: 506037 - DNA, 24 bp, Homo sapiens
caggatggcctggccagggcctgg

SEQ ID NO: 506038 - DNA, 16 bp, Homo sapiens
caggcaaagcaagtga

SEQ ID NO: 506039 - DNA, 15 bp, Homo sapiens
caggcacctgggctt

SEQ ID NO: 506040 - DNA, 19 bp, Homo sapiens
caggcagctttttctctcc

SEQ ID NO: 506041 - DNA, 16 bp, Homo sapiens
caggcaggcacctggg

SEQ ID NO: 506042 - DNA, 14 bp, Homo sapiens
caggcatcacagct

SEQ ID NO: 506043 - DNA, 12 bp, Homo sapiens
caggcctcttgg

SEQ ID NO: 506044 - DNA, 17 bp, Homo sapiens
caggcctgggccagagt

SEQ ID NO: 506045 - DNA, 22 bp, Homo sapiens
caggcgttcagctcactgttct

SEQ ID NO: 506046 - DNA, 20 bp, Homo sapiens
caggctacactgacactggt

SEQ ID NO: 506047 - DNA, 15 bp, Homo sapiens
caggctagaacctgg

SEQ ID NO: 506048 - DNA, 17 bp, Homo sapiens
caggctcaacataacat

SEQ ID NO: 506049 - DNA, 16 bp, Homo sapiens
caggctctgagacaca

SEQ ID NO: 506050 - DNA, 16 bp, Homo sapiens
caggctgtctggccag

SEQ ID NO: 506051 - DNA, 17 bp, Homo sapiens
caggctgtctggccagg

SEQ ID NO: 506052 - DNA, 22 bp, Homo sapiens
caggctgttggaaaatccagaa

SEQ ID NO: 506053 - DNA, 15 bp, Homo sapiens
caggcttgcctgcag

SEQ ID NO: 506054 - DNA, 16 bp, Homo sapiens
caggcttgcctgcagg

SEQ ID NO: 506055 - DNA, 23 bp, Homo sapiens
cagggaatgcctgagtgcctggc

SEQ ID NO: 506056 - DNA, 15 bp, Homo sapiens
cagggagcatggctg

SEQ ID NO: 506057 - DNA, 19 bp, Homo sapiens
cagggatgatggcagagcc

SEQ ID NO: 506058 - DNA, 16 bp, Homo sapiens
cagggccccagcacta

SEQ ID NO: 506059 - DNA, 22 bp, Homo sapiens
cagggccccagcactaaagcag

SEQ ID NO: 506060 - DNA, 16 bp, Homo sapiens
cagggcctcacacggt

SEQ ID NO: 506061 - DNA, 19 bp, Homo sapiens
cagggctcagcctggtggg

SEQ ID NO: 506062 - DNA, 14 bp, Homo sapiens
cagggctgctagac

SEQ ID NO: 506063 - DNA, 21 bp, Homo sapiens
caggggctatcccttctcaga

SEQ ID NO: 506064 - DNA, 23 bp, Homo sapiens
caggggctatcccttctcagaaa

SEQ ID NO: 506065 - DNA, 14 bp, Homo sapiens
caggggtcaccttg

SEQ ID NO: 506066 - DNA, 18 bp, Homo sapiens
caggggtcaccttgagag

SEQ ID NO: 506067 - DNA, 14 bp, Homo sapiens
cagggtcaggagag

SEQ ID NO: 506068 - DNA, 16 bp, Homo sapiens
cagggtccctcaggac

SEQ ID NO: 506069 - DNA, 13 bp, Homo sapiens
cagggtctctgct

SEQ ID NO: 506070 - DNA, 15 bp, Homo sapiens
cagggtctctgctgc

SEQ ID NO: 506071 - DNA, 16 bp, Homo sapiens
cagggtctctgctgcc

SEQ ID NO: 506072 - DNA, 20 bp, Homo sapiens
caggtgagcccatggccctc

SEQ ID NO: 506073 - DNA, 16 bp, Homo sapiens
caggtgcagaccttgg

SEQ ID NO: 506074 - DNA, 19 bp, Homo sapiens
caggttagaacctagaagg

SEQ ID NO: 506075 - DNA, 20 bp, Homo sapiens
caggtttctggtctctaggc

SEQ ID NO: 506076 - DNA, 16 bp, Homo sapiens
cagtaaataaattgtt

SEQ ID NO: 506077 - DNA, 24 bp, Homo sapiens
cagtaaataaattgtttgaccatg

SEQ ID NO: 506078 - DNA, 14 bp, Homo sapiens
cagtaattgtgaaa

SEQ ID NO: 506079 - DNA, 12 bp, Homo sapiens
cagtacctcctg

SEQ ID NO: 506080 - DNA, 12 bp, Homo sapiens
cagtagacaagc

SEQ ID NO: 506081 - DNA, 18 bp, Homo sapiens
cagtagcagtagatgcat

SEQ ID NO: 506082 - DNA, 23 bp, Homo sapiens
cagtatgggttagggaaaacatt

SEQ ID NO: 506083 - DNA, 15 bp, Homo sapiens
cagtatttcagactg

SEQ ID NO: 506084 - DNA, 15 bp, Homo sapiens
cagtcacctcatgga

SEQ ID NO: 506085 - DNA, 15 bp, Homo sapiens
cagtcaggaaagaga

SEQ ID NO: 506086 - DNA, 22 bp, Homo sapiens
cagtccaaggaaaccacagctg

SEQ ID NO: 506087 - DNA, 23 bp, Homo sapiens
cagtctcactgtgggaaggccag

SEQ ID NO: 506088 - DNA, 15 bp, Homo sapiens
cagtcttgcagcagg

SEQ ID NO: 506089 - DNA, 13 bp, Homo sapiens
cagtgaaagcatc

SEQ ID NO: 506090 - DNA, 14 bp, Homo sapiens
cagtgaaagcatca

SEQ ID NO: 506091 - DNA, 13 bp, Homo sapiens
cagtgagctgtgt

SEQ ID NO: 506092 - DNA, 14 bp, Homo sapiens
cagtgcttgccaca

SEQ ID NO: 506093 - DNA, 18 bp, Homo sapiens
cagtggctgctgcccagg

SEQ ID NO: 506094 - DNA, 15 bp, Homo sapiens
cagtgggcatcagca

SEQ ID NO: 506095 - DNA, 18 bp, Homo sapiens
cagtgggcatcagcagca

SEQ ID NO: 506096 - DNA, 16 bp, Homo sapiens
cagtgtccaaagcagg

SEQ ID NO: 506097 - DNA, 17 bp, Homo sapiens
cagtgtccaaagcaggg

SEQ ID NO: 506098 - DNA, 20 bp, Homo sapiens
cagtgtctgaaccaccctgg

SEQ ID NO: 506099 - DNA, 22 bp, Homo sapiens
cagtgtctgaaccaccctggaa

SEQ ID NO: 506100 - DNA, 21 bp, Homo sapiens
cagttacctctgcctcagaaa

SEQ ID NO: 506101 - DNA, 19 bp, Homo sapiens
cagttcagagctgccctct

SEQ ID NO: 506102 - DNA, 21 bp, Homo sapiens
cagttcagagctgccctctcc

SEQ ID NO: 506103 - DNA, 17 bp, Homo sapiens
cagttcctctttgcatg

SEQ ID NO: 506104 - DNA, 18 bp, Homo sapiens
cagttcctctttgcatgg

SEQ ID NO: 506105 - DNA, 13 bp, Homo sapiens
cagttctgaagaa

SEQ ID NO: 506106 - DNA, 14 bp, Homo sapiens
cagttgttttcccg

SEQ ID NO: 506107 - DNA, 19 bp, Homo sapiens
cagtttctgtcctgctggt

SEQ ID NO: 506108 - DNA, 14 bp, Homo sapiens
cataaataaaatga

SEQ ID NO: 506109 - DNA, 21 bp, Homo sapiens
cataacataagctagaaaaat

SEQ ID NO: 506110 - DNA, 21 bp, Homo sapiens
catactatagattctttatta

SEQ ID NO: 506111 - DNA, 16 bp, Homo sapiens
catagatcctaagcca

SEQ ID NO: 506112 - DNA, 15 bp, Homo sapiens
catagatgcaggtga

SEQ ID NO: 506113 - DNA, 19 bp, Homo sapiens
cataggaggggtctggaca

SEQ ID NO: 506114 - DNA, 13 bp, Homo sapiens
catagtcccagct

SEQ ID NO: 506115 - DNA, 13 bp, Homo sapiens
catatataacaat

SEQ ID NO: 506116 - DNA, 20 bp, Homo sapiens
catatataacaatgctgtat

SEQ ID NO: 506117 - DNA, 22 bp, Homo sapiens
catatgacattcatgcctggct

SEQ ID NO: 506118 - DNA, 15 bp, Homo sapiens
catattgataataaa

SEQ ID NO: 506119 - DNA, 19 bp, Homo sapiens
catattgataataaaattc

SEQ ID NO: 506120 - DNA, 17 bp, Homo sapiens
catcaaatggaagacac

SEQ ID NO: 506121 - DNA, 13 bp, Homo sapiens
catcaagactgga

SEQ ID NO: 506122 - DNA, 17 bp, Homo sapiens
catcacagctaacaatt

SEQ ID NO: 506123 - DNA, 19 bp, Homo sapiens
catcaggagaaaaagcctc

SEQ ID NO: 506124 - DNA, 15 bp, Homo sapiens
catcagttagagctg

SEQ ID NO: 506125 - DNA, 16 bp, Homo sapiens
catcagttagagctga

SEQ ID NO: 506126 - DNA, 19 bp, Homo sapiens
catcatcaaggcactgcct

SEQ ID NO: 506127 - DNA, 21 bp, Homo sapiens
catcatggactgagctggggg

SEQ ID NO: 506128 - DNA, 21 bp, Homo sapiens
catccacacaacaccaggact

SEQ ID NO: 506129 - DNA, 22 bp, Homo sapiens
catccacacaacaccaggactt

SEQ ID NO: 506130 - DNA, 22 bp, Homo sapiens
catccatggccgggcttggtgg

SEQ ID NO: 506131 - DNA, 18 bp, Homo sapiens
catccctaatgctgcaga

SEQ ID NO: 506132 - DNA, 12 bp, Homo sapiens
catccctccctc

SEQ ID NO: 506133 - DNA, 22 bp, Homo sapiens
catccctccctccacctccctg

SEQ ID NO: 506134 - DNA, 18 bp, Homo sapiens
catcccttacctgggaaa

SEQ ID NO: 506135 - DNA, 23 bp, Homo sapiens
catcccttgaccaggcctgggcc

SEQ ID NO: 506136 - DNA, 13 bp, Homo sapiens
catccgaggcagg

SEQ ID NO: 506137 - DNA, 16 bp, Homo sapiens
catccgaggcagggtc

SEQ ID NO: 506138 - DNA, 22 bp, Homo sapiens
catccgaggcagggtcaggaga

SEQ ID NO: 506139 - DNA, 20 bp, Homo sapiens
catcctagtctctatcatta

SEQ ID NO: 506140 - DNA, 15 bp, Homo sapiens
catcctcaaaagaaa

SEQ ID NO: 506141 - DNA, 22 bp, Homo sapiens
catcctcaaacactgcaggcat

SEQ ID NO: 506142 - DNA, 14 bp, Homo sapiens
catctagtgagcag

SEQ ID NO: 506143 - DNA, 14 bp, Homo sapiens
catctctctttaat

SEQ ID NO: 506144 - DNA, 20 bp, Homo sapiens
catctgcctgttctgaggat

SEQ ID NO: 506145 - DNA, 17 bp, Homo sapiens
catctggaaccatcaga

SEQ ID NO: 506146 - DNA, 23 bp, Homo sapiens
catctggccgttgatgttggctg

SEQ ID NO: 506147 - DNA, 15 bp, Homo sapiens
catctgtgcacgcag

SEQ ID NO: 506148 - DNA, 13 bp, Homo sapiens
ctcaagaagcagg

SEQ ID NO: 506149 - DNA, 13 bp, Homo sapiens
ctcaatattttcc

SEQ ID NO: 506150 - DNA, 22 bp, Homo sapiens
ctcaatattttccatgaaaatg

SEQ ID NO: 506151 - DNA, 14 bp, Homo sapiens
ctcaattcttccct

SEQ ID NO: 506152 - DNA, 20 bp, Homo sapiens
ctcaccactacatcacttga

SEQ ID NO: 506153 - DNA, 14 bp, Homo sapiens
ctcaccatctgtgc

SEQ ID NO: 506154 - DNA, 23 bp, Homo sapiens
ctcaccccagactcctgactgtc

SEQ ID NO: 506155 - DNA, 13 bp, Homo sapiens
ctcactctgcttt

SEQ ID NO: 506156 - DNA, 22 bp, Homo sapiens
ctcactggggtcctggggcctc

SEQ ID NO: 506157 - DNA, 24 bp, Homo sapiens
ctcactgtgggaaggccagctgcc

SEQ ID NO: 506158 - DNA, 23 bp, Homo sapiens
ctcagaaaacaaggatgaattaa

SEQ ID NO: 506159 - DNA, 17 bp, Homo sapiens
ctcagagtatggagctc

SEQ ID NO: 506160 - DNA, 12 bp, Homo sapiens
ctcagcctggtg

SEQ ID NO: 506161 - DNA, 18 bp, Homo sapiens
ctcagcctggtgggcctc

SEQ ID NO: 506162 - DNA, 23 bp, Homo sapiens
ctcagccttccccttgcccaggg

SEQ ID NO: 506163 - DNA, 19 bp, Homo sapiens
ctcagctccccagagtcct

SEQ ID NO: 506164 - DNA, 19 bp, Homo sapiens
ctcaggaccaaagaacact

SEQ ID NO: 506165 - DNA, 12 bp, Homo sapiens
ctcaggaccagg

SEQ ID NO: 506166 - DNA, 13 bp, Homo sapiens
ctcaggaggctga

SEQ ID NO: 506167 - DNA, 18 bp, Homo sapiens
ctcaggaggctgaggcag

SEQ ID NO: 506168 - DNA, 16 bp, Homo sapiens
ctcagggccccagcac

SEQ ID NO: 506169 - DNA, 22 bp, Homo sapiens
ctcagggctaaacgggcattgc

SEQ ID NO: 506170 - DNA, 20 bp, Homo sapiens
ctcagggtccctcaggacca

SEQ ID NO: 506171 - DNA, 14 bp, Homo sapiens
ctcagggtctctgc

SEQ ID NO: 506172 - DNA, 15 bp, Homo sapiens
ctcatctctgtccca

SEQ ID NO: 506173 - DNA, 13 bp, Homo sapiens
ctcatgaatctgc

SEQ ID NO: 506174 - DNA, 18 bp, Homo sapiens
ctcatgcatagtcccagc

SEQ ID NO: 506175 - DNA, 19 bp, Homo sapiens
ctcatgcatagtcccagct

SEQ ID NO: 506176 - DNA, 20 bp, Homo sapiens
ctcatgcatagtcccagcta

SEQ ID NO: 506177 - DNA, 14 bp, Homo sapiens
ctcatgccctgcca

SEQ ID NO: 506178 - DNA, 15 bp, Homo sapiens
ctcatgccctgccaa

SEQ ID NO: 506179 - DNA, 20 bp, Homo sapiens
ctcattgcttggaattcagc

SEQ ID NO: 506180 - DNA, 21 bp, Homo sapiens
ctcatttcaggagcagcctca

SEQ ID NO: 506181 - DNA, 17 bp, Homo sapiens
ctcatttccaagcaagt

SEQ ID NO: 506182 - DNA, 21 bp, Homo sapiens
ctcatttccaagcaagtatta

SEQ ID NO: 506183 - DNA, 23 bp, Homo sapiens
ctccacctccctgcaataaaatg

SEQ ID NO: 506184 - DNA, 12 bp, Homo sapiens
ctccagcctctg

SEQ ID NO: 506185 - DNA, 15 bp, Homo sapiens
ctccagcctctgccg

SEQ ID NO: 506186 - DNA, 22 bp, Homo sapiens
ctccagcctctgccgctgccat

SEQ ID NO: 506187 - DNA, 23 bp, Homo sapiens
ctccagcctctgccgctgccatg

SEQ ID NO: 506188 - DNA, 16 bp, Homo sapiens
ctccagtccaaggaaa

SEQ ID NO: 506189 - DNA, 19 bp, Homo sapiens
ctccccatgatgtttagaa

SEQ ID NO: 506190 - DNA, 11 bp, Homo sapiens
ctcccctcctc

SEQ ID NO: 506191 - DNA, 20 bp, Homo sapiens
ctcccctcctctgcttgcca

SEQ ID NO: 506192 - DNA, 22 bp, Homo sapiens
ctccctccacctccctgcaata

SEQ ID NO: 506193 - DNA, 20 bp, Homo sapiens
ctccctgaagtaagcaaaga

SEQ ID NO: 506194 - DNA, 16 bp, Homo sapiens
ctccctgcaataaaat

SEQ ID NO: 506195 - DNA, 13 bp, Homo sapiens
ctccgtggagcag

SEQ ID NO: 506196 - DNA, 20 bp, Homo sapiens
ctcctcagggtccctcagga

SEQ ID NO: 506197 - DNA, 16 bp, Homo sapiens
ctcctcatccagggct

SEQ ID NO: 506198 - DNA, 20 bp, Homo sapiens
ctcctcatccagggctctga

SEQ ID NO: 506199 - DNA, 13 bp, Homo sapiens
ctcctctcagccc

SEQ ID NO: 506200 - DNA, 15 bp, Homo sapiens
ctcctctgcttgcca

SEQ ID NO: 506201 - DNA, 15 bp, Homo sapiens
ctcctctgtccaggg

SEQ ID NO: 506202 - DNA, 22 bp, Homo sapiens
ctcctgggcagctgcctcccct

SEQ ID NO: 506203 - DNA, 13 bp, Homo sapiens
ctcctgtctgcca

SEQ ID NO: 506204 - DNA, 15 bp, Homo sapiens
ctcctgtctgccagc

SEQ ID NO: 506205 - DNA, 16 bp, Homo sapiens
ctcctgtctgccagcc

SEQ ID NO: 506206 - DNA, 22 bp, Homo sapiens
ctcctgtctgccagccagcagc

SEQ ID NO: 506207 - DNA, 20 bp, Homo sapiens
ctccttaacactgagctgtc

SEQ ID NO: 506208 - DNA, 20 bp, Homo sapiens
ctccttgagagaccaggcaa

SEQ ID NO: 506209 - DNA, 13 bp, Homo sapiens
ctcggagcctcat

SEQ ID NO: 506210 - DNA, 23 bp, Homo sapiens
ctctagcctggcaacagagcgag

SEQ ID NO: 506211 - DNA, 15 bp, Homo sapiens
ctctaggaaatattt

SEQ ID NO: 506212 - DNA, 13 bp, Homo sapiens
ctctaggctgggg

SEQ ID NO: 506213 - DNA, 15 bp, Homo sapiens
ctctaggctggggaa

SEQ ID NO: 506214 - DNA, 17 bp, Homo sapiens
ctctagtttgcagagga

SEQ ID NO: 506215 - DNA, 18 bp, Homo sapiens
ctctatcattaaagttct

SEQ ID NO: 506216 - DNA, 11 bp, Homo sapiens
ctctcagccaa

SEQ ID NO: 506217 - DNA, 12 bp, Homo sapiens
ctctcctgggca

SEQ ID NO: 506218 - DNA, 21 bp, Homo sapiens
ctctcctgggcagctgcctcc

SEQ ID NO: 506219 - DNA, 14 bp, Homo sapiens
ctctcttcaataaa

SEQ ID NO: 506220 - DNA, 18 bp, Homo sapiens
ctctcttcaataaaccac

SEQ ID NO: 506221 - DNA, 15 bp, Homo sapiens
ctctgccgctgccat

SEQ ID NO: 506222 - DNA, 18 bp, Homo sapiens
ctctgccgctgccatgct

SEQ ID NO: 506223 - DNA, 17 bp, Homo sapiens
ctctggacacttgctca

SEQ ID NO: 506224 - DNA, 19 bp, Homo sapiens
ctctggatgcctgattgcc

SEQ ID NO: 506225 - DNA, 22 bp, Homo sapiens
ctctggattggagatagggaaa

SEQ ID NO: 506226 - DNA, 13 bp, Homo sapiens
ctcttcaataaac

SEQ ID NO: 506227 - DNA, 17 bp, Homo sapiens
ctcttcatttattttga

SEQ ID NO: 506228 - DNA, 21 bp, Homo sapiens
ctcttgaagacactgaaatat

SEQ ID NO: 506229 - DNA, 17 bp, Homo sapiens
ctctttaacagctttct

SEQ ID NO: 506230 - DNA, 22 bp, Homo sapiens
ctctttgagataatacattccg

SEQ ID NO: 506231 - DNA, 16 bp, Homo sapiens
ctgaaaattaacactg

SEQ ID NO: 506232 - DNA, 18 bp, Homo sapiens
ctgaaatatacacacagc

SEQ ID NO: 506233 - DNA, 19 bp, Homo sapiens
ctgaaatatacacacagca

SEQ ID NO: 506234 - DNA, 14 bp, Homo sapiens
ctgaagaagatggt

SEQ ID NO: 506235 - DNA, 23 bp, Homo sapiens
ctgaagaagcaccaatcatgaat

SEQ ID NO: 506236 - DNA, 21 bp, Homo sapiens
ctgaagatccccaactgctcc

SEQ ID NO: 506237 - DNA, 18 bp, Homo sapiens
ctgaaggagattttcctt

SEQ ID NO: 506238 - DNA, 21 bp, Homo sapiens
ctgaaggagattttccttcct

SEQ ID NO: 506239 - DNA, 18 bp, Homo sapiens
ctgaagtcttctcctcca

SEQ ID NO: 506240 - DNA, 13 bp, Homo sapiens
ctgaatttctatg

SEQ ID NO: 506241 - DNA, 18 bp, Homo sapiens
ctgaatttctatggcata

SEQ ID NO: 506242 - DNA, 23 bp, Homo sapiens
ctgaatttctatggcatattgat

SEQ ID NO: 506243 - DNA, 16 bp, Homo sapiens
ctgacacaaacctgcc

SEQ ID NO: 506244 - DNA, 14 bp, Homo sapiens
ctgacatggagttc

SEQ ID NO: 506245 - DNA, 18 bp, Homo sapiens
ctgacatggagttcccgt

SEQ ID NO: 506246 - DNA, 15 bp, Homo sapiens
ctgagaacactgtga

SEQ ID NO: 506247 - DNA, 17 bp, Homo sapiens
ctgagactctcttagga

SEQ ID NO: 506248 - DNA, 18 bp, Homo sapiens
ctgagcaagaccctgtct

SEQ ID NO: 506249 - DNA, 10 bp, Homo sapiens
ctgagcctct

SEQ ID NO: 506250 - DNA, 15 bp, Homo sapiens
ctgagcgcctgggtc

SEQ ID NO: 506251 - DNA, 17 bp, Homo sapiens
ctgagctcggtggaccc

SEQ ID NO: 506252 - DNA, 11 bp, Homo sapiens
ctgaggattca

SEQ ID NO: 506253 - DNA, 18 bp, Homo sapiens
ctgaggcagacagcagct

SEQ ID NO: 506254 - DNA, 17 bp, Homo sapiens
ctgaggtctagaaatag

SEQ ID NO: 506255 - DNA, 14 bp, Homo sapiens
ctgaggtgggcaga

SEQ ID NO: 506256 - DNA, 20 bp, Homo sapiens
ctgaggtgggcagatcacga

SEQ ID NO: 506257 - DNA, 19 bp, Homo sapiens
ctgagtgcctggccaaagg

SEQ ID NO: 506258 - DNA, 16 bp, Homo sapiens
ctgataacaacctgga

SEQ ID NO: 506259 - DNA, 18 bp, Homo sapiens
ctgataacaacctggaga

SEQ ID NO: 506260 - DNA, 13 bp, Homo sapiens
ctgatacgtgtat

SEQ ID NO: 506261 - DNA, 14 bp, Homo sapiens
ctgatggacaagga

SEQ ID NO: 506262 - DNA, 17 bp, Homo sapiens
ctgatggcaggatggcc

SEQ ID NO: 506263 - DNA, 13 bp, Homo sapiens
ctgatgtcatctt

SEQ ID NO: 506264 - DNA, 14 bp, Homo sapiens
ctgatgtcatcttg

SEQ ID NO: 506265 - DNA, 16 bp, Homo sapiens
ctgatgtcatcttgag

SEQ ID NO: 506266 - DNA, 15 bp, Homo sapiens
ctgatgtcctcacca

SEQ ID NO: 506267 - DNA, 15 bp, Homo sapiens
ctgattctcagggtc

SEQ ID NO: 506268 - DNA, 20 bp, Homo sapiens
ctgatttggccgttttgtga

SEQ ID NO: 506269 - DNA, 21 bp, Homo sapiens
ctgatttggccgttttgtgaa

SEQ ID NO: 506270 - DNA, 15 bp, Homo sapiens
ctgcactccagcctg

SEQ ID NO: 506271 - DNA, 16 bp, Homo sapiens
ctgcactccagcctgg

SEQ ID NO: 506272 - DNA, 15 bp, Homo sapiens
ctgcagcgcgcacac

SEQ ID NO: 506273 - DNA, 17 bp, Homo sapiens
ctgcaggcatcacagct

SEQ ID NO: 506274 - DNA, 22 bp, Homo sapiens
ctgccaacttcttcagagctga

SEQ ID NO: 506275 - DNA, 16 bp, Homo sapiens
ctgccacacctgagcc

SEQ ID NO: 506276 - DNA, 12 bp, Homo sapiens
ctgccagccagc

SEQ ID NO: 506277 - DNA, 16 bp, Homo sapiens
ctgccagccagcagcc

SEQ ID NO: 506278 - DNA, 23 bp, Homo sapiens
ctgccagccagcagccagctctc

SEQ ID NO: 506279 - DNA, 16 bp, Homo sapiens
ctgccatgctttgagt

SEQ ID NO: 506280 - DNA, 15 bp, Homo sapiens
ctgcccacctccttc

SEQ ID NO: 506281 - DNA, 23 bp, Homo sapiens
ctgccccggggaggggcgctcgc

SEQ ID NO: 506282 - DNA, 20 bp, Homo sapiens
ctgccctctcctgggcagct

SEQ ID NO: 506283 - DNA, 14 bp, Homo sapiens
ctgccgctgccatg

SEQ ID NO: 506284 - DNA, 19 bp, Homo sapiens
ctgccgctgccatgctttg

SEQ ID NO: 506285 - DNA, 23 bp, Homo sapiens
gaatgtcagggccaggtgcagac

SEQ ID NO: 506286 - DNA, 18 bp, Homo sapiens
gaattacatttgtataaa

SEQ ID NO: 506287 - DNA, 20 bp, Homo sapiens
gaattacatttgtataaaat

SEQ ID NO: 506288 - DNA, 14 bp, Homo sapiens
gaattgcagagtac

SEQ ID NO: 506289 - DNA, 19 bp, Homo sapiens
gaatttgaagctgcagtga

SEQ ID NO: 506290 - DNA, 14 bp, Homo sapiens
gaatttgtaagttt

SEQ ID NO: 506291 - DNA, 14 bp, Homo sapiens
gaatttttcttgcg

SEQ ID NO: 506292 - DNA, 22 bp, Homo sapiens
gacaaatgggactgatgtcatc

SEQ ID NO: 506293 - DNA, 23 bp, Homo sapiens
gacaaatgggactgatgtcatct

SEQ ID NO: 506294 - DNA, 14 bp, Homo sapiens
gacaactgaagaga

SEQ ID NO: 506295 - DNA, 15 bp, Homo sapiens
gacaagctcacagac

SEQ ID NO: 506296 - DNA, 17 bp, Homo sapiens
gacaaggaaaggcaaat

SEQ ID NO: 506297 - DNA, 13 bp, Homo sapiens
gacacactgaaga

SEQ ID NO: 506298 - DNA, 14 bp, Homo sapiens
gacacactgaagaa

SEQ ID NO: 506299 - DNA, 15 bp, Homo sapiens
gacacactgaagaag

SEQ ID NO: 506300 - DNA, 15 bp, Homo sapiens
gacacagatgaaaca

SEQ ID NO: 506301 - DNA, 16 bp, Homo sapiens
gacactattcactaaa

SEQ ID NO: 506302 - DNA, 20 bp, Homo sapiens
gacactggtattcctgcctc

SEQ ID NO: 506303 - DNA, 14 bp, Homo sapiens
gacagaacactgtc

SEQ ID NO: 506304 - DNA, 15 bp, Homo sapiens
gacagagacctcctg

SEQ ID NO: 506305 - DNA, 16 bp, Homo sapiens
gacagagacctcctgc

SEQ ID NO: 506306 - DNA, 13 bp, Homo sapiens
gacagcagctcag

SEQ ID NO: 506307 - DNA, 16 bp, Homo sapiens
gacagcagctcaggca

SEQ ID NO: 506308 - DNA, 21 bp, Homo sapiens
gacagcccttctttccacaga

SEQ ID NO: 506309 - DNA, 13 bp, Homo sapiens
gacagggacccac

SEQ ID NO: 506310 - DNA, 19 bp, Homo sapiens
gacagggacccacttcaca

SEQ ID NO: 506311 - DNA, 17 bp, Homo sapiens
gacagtcacctcatgga

SEQ ID NO: 506312 - DNA, 18 bp, Homo sapiens
gacatgctgaagccaaag

SEQ ID NO: 506313 - DNA, 16 bp, Homo sapiens
gaccagaaatcaaaaa

SEQ ID NO: 506314 - DNA, 15 bp, Homo sapiens
gaccagtaattgtga

SEQ ID NO: 506315 - DNA, 19 bp, Homo sapiens
gaccagtttaacctgatgc

SEQ ID NO: 506316 - DNA, 23 bp, Homo sapiens
gacccacttcacacacaggcaac

SEQ ID NO: 506317 - DNA, 13 bp, Homo sapiens
gacccaggctggg

SEQ ID NO: 506318 - DNA, 14 bp, Homo sapiens
gaccctgggtggga

SEQ ID NO: 506319 - DNA, 23 bp, Homo sapiens
gacctataaatcattaagacaac

SEQ ID NO: 506320 - DNA, 16 bp, Homo sapiens
gacctcagcctgtgct

SEQ ID NO: 506321 - DNA, 14 bp, Homo sapiens
gacctcagccttcc

SEQ ID NO: 506322 - DNA, 17 bp, Homo sapiens
gacctccctgtgagaga

SEQ ID NO: 506323 - DNA, 23 bp, Homo sapiens
gaccttctaggacgccacccagc

SEQ ID NO: 506324 - DNA, 14 bp, Homo sapiens
gacgccacccagca

SEQ ID NO: 506325 - DNA, 14 bp, Homo sapiens
gacggagccgggaa

SEQ ID NO: 506326 - DNA, 22 bp, Homo sapiens
gactatcaaactgaagccagaa

SEQ ID NO: 506327 - DNA, 16 bp, Homo sapiens
gactattgacatcagc

SEQ ID NO: 506328 - DNA, 20 bp, Homo sapiens
gactccagcctgcctggcag

SEQ ID NO: 506329 - DNA, 17 bp, Homo sapiens
gactcttaagaagactg

SEQ ID NO: 506330 - DNA, 18 bp, Homo sapiens
gactgagcaagaccctgt

SEQ ID NO: 506331 - DNA, 15 bp, Homo sapiens
gactgatgtcatctt

SEQ ID NO: 506332 - DNA, 19 bp, Homo sapiens
gactgatgtcatcttgagc

SEQ ID NO: 506333 - DNA, 12 bp, Homo sapiens
gactgtgattta

SEQ ID NO: 506334 - DNA, 21 bp, Homo sapiens
gactgtgatttatttggagtg

SEQ ID NO: 506335 - DNA, 23 bp, Homo sapiens
gactgtgatttatttggagtgga

SEQ ID NO: 506336 - DNA, 15 bp, Homo sapiens
gactgtggctgctag

SEQ ID NO: 506337 - DNA, 18 bp, Homo sapiens
gactgttcaagagcacac

SEQ ID NO: 506338 - DNA, 18 bp, Homo sapiens
gacttgacagaacactgt

SEQ ID NO: 506339 - DNA, 19 bp, Homo sapiens
gactttatcctgagtccct

SEQ ID NO: 506340 - DNA, 16 bp, Homo sapiens
gactttggctgcatgc

SEQ ID NO: 506341 - DNA, 18 bp, Homo sapiens
gagaaaacttatttgagt

SEQ ID NO: 506342 - DNA, 21 bp, Homo sapiens
gagaacccaaagagacagctc

SEQ ID NO: 506343 - DNA, 21 bp, Homo sapiens
gagaacctagggtgatattaa

SEQ ID NO: 506344 - DNA, 22 bp, Homo sapiens
gagaacctagggtgatattaac

SEQ ID NO: 506345 - DNA, 23 bp, Homo sapiens
gagaactcatccctaatgctgca

SEQ ID NO: 506346 - DNA, 20 bp, Homo sapiens
gagacacaacaactcctagg

SEQ ID NO: 506347 - DNA, 16 bp, Homo sapiens
gagacagtcaccccag

SEQ ID NO: 506348 - DNA, 17 bp, Homo sapiens
gagacagtccagcctgg

SEQ ID NO: 506349 - DNA, 14 bp, Homo sapiens
gagaccaggcaaag

SEQ ID NO: 506350 - DNA, 18 bp, Homo sapiens
gagaccaggcaaagcaag

SEQ ID NO: 506351 - DNA, 16 bp, Homo sapiens
gagaccatcctggcca

SEQ ID NO: 506352 - DNA, 15 bp, Homo sapiens
gagacccctgtctcc

SEQ ID NO: 506353 - DNA, 15 bp, Homo sapiens
gagacctcctgcctc

SEQ ID NO: 506354 - DNA, 16 bp, Homo sapiens
gagactcctaggcagg

SEQ ID NO: 506355 - DNA, 19 bp, Homo sapiens
gagagctagaacccggcag

SEQ ID NO: 506356 - DNA, 17 bp, Homo sapiens
gagagctagaacctaga

SEQ ID NO: 506357 - DNA, 18 bp, Homo sapiens
gagagctagaacctggag

SEQ ID NO: 506358 - DNA, 21 bp, Homo sapiens
gagaggaaatattgctggggt

SEQ ID NO: 506359 - DNA, 17 bp, Homo sapiens
gagatcaaatggaaagg

SEQ ID NO: 506360 - DNA, 23 bp, Homo sapiens
gagatcaaatggaaaggagagga

SEQ ID NO: 506361 - DNA, 18 bp, Homo sapiens
gagatgaagcaaacacat

SEQ ID NO: 506362 - DNA, 20 bp, Homo sapiens
gagatgaagcaaacacatta

SEQ ID NO: 506363 - DNA, 23 bp, Homo sapiens
gagatgcattcttggttggctgg

SEQ ID NO: 506364 - DNA, 22 bp, Homo sapiens
gagattcttcgtgtatagctgt

SEQ ID NO: 506365 - DNA, 16 bp, Homo sapiens
gagcaaaggctgagaa

SEQ ID NO: 506366 - DNA, 14 bp, Homo sapiens
gagcaaagtctaaa

SEQ ID NO: 506367 - DNA, 19 bp, Homo sapiens
gagcaaagtctaaagttta

SEQ ID NO: 506368 - DNA, 13 bp, Homo sapiens
gagcacactgtag

SEQ ID NO: 506369 - DNA, 15 bp, Homo sapiens
gagcacactgtagca

SEQ ID NO: 506370 - DNA, 18 bp, Homo sapiens
gagcacacttggcccaag

SEQ ID NO: 506371 - DNA, 15 bp, Homo sapiens
gagcagcttcagttg

SEQ ID NO: 506372 - DNA, 14 bp, Homo sapiens
gagcagtgcaggca

SEQ ID NO: 506373 - DNA, 15 bp, Homo sapiens
gagcatggagctggc

SEQ ID NO: 506374 - DNA, 19 bp, Homo sapiens
gagcatggctgtgaggatg

SEQ ID NO: 506375 - DNA, 21 bp, Homo sapiens
gagcatggctgtgaggatggg

SEQ ID NO: 506376 - DNA, 19 bp, Homo sapiens
gagccaagggttcagagac

SEQ ID NO: 506377 - DNA, 15 bp, Homo sapiens
gagccagcctgctcc

SEQ ID NO: 506378 - DNA, 21 bp, Homo sapiens
gagccatgtagaagctgcatc

SEQ ID NO: 506379 - DNA, 21 bp, Homo sapiens
gagccctcctggaatggagct

SEQ ID NO: 506380 - DNA, 12 bp, Homo sapiens
gagcccttggcc

SEQ ID NO: 506381 - DNA, 15 bp, Homo sapiens
gagcccttggcccct

SEQ ID NO: 506382 - DNA, 16 bp, Homo sapiens
gagccggagcctccag

SEQ ID NO: 506383 - DNA, 17 bp, Homo sapiens
gagcctcatccgaggca

SEQ ID NO: 506384 - DNA, 14 bp, Homo sapiens
gagcctggtgccct

SEQ ID NO: 506385 - DNA, 19 bp, Homo sapiens
gagctagaacctggagagc

SEQ ID NO: 506386 - DNA, 15 bp, Homo sapiens
gagctagaagctgga

SEQ ID NO: 506387 - DNA, 15 bp, Homo sapiens
gagctcggtggaccc

SEQ ID NO: 506388 - DNA, 18 bp, Homo sapiens
gagctgacacaaacctgc

SEQ ID NO: 506389 - DNA, 19 bp, Homo sapiens
gagctgccctctcctgggc

SEQ ID NO: 506390 - DNA, 21 bp, Homo sapiens
gagctgccctctcctgggcag

SEQ ID NO: 506391 - DNA, 12 bp, Homo sapiens
gagctggagcct

SEQ ID NO: 506392 - DNA, 15 bp, Homo sapiens
gagctggagcctggt

SEQ ID NO: 506393 - DNA, 21 bp, Homo sapiens
gagctgtataactgtgcagag

SEQ ID NO: 506394 - DNA, 12 bp, Homo sapiens
gaggaagcagaa

SEQ ID NO: 506395 - DNA, 18 bp, Homo sapiens
gaggactagaacctggag

SEQ ID NO: 506396 - DNA, 16 bp, Homo sapiens
gaggagcaaaggctga

SEQ ID NO: 506397 - DNA, 17 bp, Homo sapiens
gaggagcagtgcaggca

SEQ ID NO: 506398 - DNA, 18 bp, Homo sapiens
gaggatcacagtgctgag

SEQ ID NO: 506399 - DNA, 19 bp, Homo sapiens
gaggattcaggggctgggg

SEQ ID NO: 506400 - DNA, 21 bp, Homo sapiens
gaggcagacagcagctcaggc

SEQ ID NO: 506401 - DNA, 13 bp, Homo sapiens
gaggcatgacagc

SEQ ID NO: 506402 - DNA, 20 bp, Homo sapiens
gaggcatgacagctgttcca

SEQ ID NO: 506403 - DNA, 12 bp, Homo sapiens
gaggccagggat

SEQ ID NO: 506404 - DNA, 13 bp, Homo sapiens
gaggccagggata

SEQ ID NO: 506405 - DNA, 17 bp, Homo sapiens
gaggccagtacctttcc

SEQ ID NO: 506406 - DNA, 18 bp, Homo sapiens
gaggcctactcttccatc

SEQ ID NO: 506407 - DNA, 18 bp, Homo sapiens
gaggctgaggtgggcaga

SEQ ID NO: 506408 - DNA, 22 bp, Homo sapiens
gaggcttagctttgctctgcca

SEQ ID NO: 506409 - DNA, 16 bp, Homo sapiens
gagggaatgaacctgg

SEQ ID NO: 506410 - DNA, 12 bp, Homo sapiens
gagggcacacac

SEQ ID NO: 506411 - DNA, 15 bp, Homo sapiens
gagggcacacactgt

SEQ ID NO: 506412 - DNA, 23 bp, Homo sapiens
gagggcacattccttgcctgcac

SEQ ID NO: 506413 - DNA, 20 bp, Homo sapiens
gagggctagaacctggaagg

SEQ ID NO: 506414 - DNA, 18 bp, Homo sapiens
gagggctagaacctggag

SEQ ID NO: 506415 - DNA, 19 bp, Homo sapiens
gagggctagaactggagag

SEQ ID NO: 506416 - DNA, 21 bp, Homo sapiens
gagggctagaatctggagagc

SEQ ID NO: 506417 - DNA, 13 bp, Homo sapiens
gagggctggaatc

SEQ ID NO: 506418 - DNA, 12 bp, Homo sapiens
gaggggggctgg

SEQ ID NO: 506419 - DNA, 18 bp, Homo sapiens
gagggtgatggggctgag

SEQ ID NO: 506420 - DNA, 15 bp, Homo sapiens
gagggttagggaggg

SEQ ID NO: 506421 - DNA, 17 bp, Homo sapiens
gaggtacccaaggtcac

SEQ ID NO: 506422 - DNA, 19 bp, Homo sapiens
ggcatccttctgccttttt

SEQ ID NO: 506423 - DNA, 23 bp, Homo sapiens
ggcatgaagtttccttggctggt

SEQ ID NO: 506424 - DNA, 14 bp, Homo sapiens
ggccactgaagata

SEQ ID NO: 506425 - DNA, 19 bp, Homo sapiens
ggccagctgccccagccag

SEQ ID NO: 506426 - DNA, 16 bp, Homo sapiens
ggccaggtgcagacct

SEQ ID NO: 506427 - DNA, 19 bp, Homo sapiens
ggccatctctggatgcctg

SEQ ID NO: 506428 - DNA, 16 bp, Homo sapiens
ggccatggagagctgg

SEQ ID NO: 506429 - DNA, 22 bp, Homo sapiens
ggccatggagagctggagcctg

SEQ ID NO: 506430 - DNA, 13 bp, Homo sapiens
ggccccagcacta

SEQ ID NO: 506431 - DNA, 13 bp, Homo sapiens
ggcccctgtgagt

SEQ ID NO: 506432 - DNA, 16 bp, Homo sapiens
ggccccttgctggagt

SEQ ID NO: 506433 - DNA, 14 bp, Homo sapiens
ggccctcccagtac

SEQ ID NO: 506434 - DNA, 23 bp, Homo sapiens
ggccggaaggaatgtcagggcca

SEQ ID NO: 506435 - DNA, 17 bp, Homo sapiens
ggccgtgggcctggggt

SEQ ID NO: 506436 - DNA, 12 bp, Homo sapiens
ggcctcaagatc

SEQ ID NO: 506437 - DNA, 19 bp, Homo sapiens
ggcctcctctgtccagggc

SEQ ID NO: 506438 - DNA, 15 bp, Homo sapiens
ggcctcggagcctca

SEQ ID NO: 506439 - DNA, 19 bp, Homo sapiens
ggcctcggagcctcatccg

SEQ ID NO: 506440 - DNA, 13 bp, Homo sapiens
ggcctcttggcag

SEQ ID NO: 506441 - DNA, 23 bp, Homo sapiens
ggcctgaatgcttataggtggcc

SEQ ID NO: 506442 - DNA, 16 bp, Homo sapiens
ggcctggccatgtggc

SEQ ID NO: 506443 - DNA, 22 bp, Homo sapiens
ggcctgtgtgttgccaggcagg

SEQ ID NO: 506444 - DNA, 21 bp, Homo sapiens
ggcctgttttagaaggttctc

SEQ ID NO: 506445 - DNA, 18 bp, Homo sapiens
ggcggtgatcagcagaga

SEQ ID NO: 506446 - DNA, 12 bp, Homo sapiens
ggctacacaggg

SEQ ID NO: 506447 - DNA, 19 bp, Homo sapiens
ggctacctcacctgggcag

SEQ ID NO: 506448 - DNA, 21 bp, Homo sapiens
ggctagaacctagaagggcta

SEQ ID NO: 506449 - DNA, 13 bp, Homo sapiens
ggctagaatctgg

SEQ ID NO: 506450 - DNA, 17 bp, Homo sapiens
ggctatcccttctcaga

SEQ ID NO: 506451 - DNA, 18 bp, Homo sapiens
ggctatcccttctcagaa

SEQ ID NO: 506452 - DNA, 16 bp, Homo sapiens
ggctctgagacacacc

SEQ ID NO: 506453 - DNA, 12 bp, Homo sapiens
ggctgaggcagg

SEQ ID NO: 506454 - DNA, 15 bp, Homo sapiens
ggctgctctgcctgt

SEQ ID NO: 506455 - DNA, 14 bp, Homo sapiens
ggctggaatctgga

SEQ ID NO: 506456 - DNA, 18 bp, Homo sapiens
ggctggggaagtcctctg

SEQ ID NO: 506457 - DNA, 20 bp, Homo sapiens
ggctgtgctccctggttctg

SEQ ID NO: 506458 - DNA, 18 bp, Homo sapiens
ggcttcattagagcaggc

SEQ ID NO: 506459 - DNA, 11 bp, Homo sapiens
ggcttgctgcc

SEQ ID NO: 506460 - DNA, 12 bp, Homo sapiens
gggaaggccagc

SEQ ID NO: 506461 - DNA, 14 bp, Homo sapiens
gggaatgaacctgg

SEQ ID NO: 506462 - DNA, 14 bp, Homo sapiens
gggaattgaggaca

SEQ ID NO: 506463 - DNA, 20 bp, Homo sapiens
gggacagtcacctcatggaa

SEQ ID NO: 506464 - DNA, 20 bp, Homo sapiens
gggacatttgctcatggaat

SEQ ID NO: 506465 - DNA, 19 bp, Homo sapiens
gggacgaagaagagccaca

SEQ ID NO: 506466 - DNA, 21 bp, Homo sapiens
gggactgatgtcatcttgagc

SEQ ID NO: 506467 - DNA, 16 bp, Homo sapiens
gggagcatggctgtga

SEQ ID NO: 506468 - DNA, 18 bp, Homo sapiens
gggaggccgaggtgggca

SEQ ID NO: 506469 - DNA, 19 bp, Homo sapiens
gggaggccgaggtgggcag

SEQ ID NO: 506470 - DNA, 15 bp, Homo sapiens
gggatgaaagagaag

SEQ ID NO: 506471 - DNA, 21 bp, Homo sapiens
gggatgagcatggagctggcc

SEQ ID NO: 506472 - DNA, 20 bp, Homo sapiens
gggatttccagccagggctg

SEQ ID NO: 506473 - DNA, 12 bp, Homo sapiens
gggcacacactg

SEQ ID NO: 506474 - DNA, 23 bp, Homo sapiens
gggcagctgcctcccctcctctg

SEQ ID NO: 506475 - DNA, 20 bp, Homo sapiens
gggcatggtagctcaagcct

SEQ ID NO: 506476 - DNA, 22 bp, Homo sapiens
gggccctgagctcggtggaccc

SEQ ID NO: 506477 - DNA, 23 bp, Homo sapiens
gggctggaacagattcacactgt

SEQ ID NO: 506478 - DNA, 21 bp, Homo sapiens
gggcttcccagtggctgctgc

SEQ ID NO: 506479 - DNA, 23 bp, Homo sapiens
gggcttcccagtggctgctgccc

SEQ ID NO: 506480 - DNA, 13 bp, Homo sapiens
ggggcagaacagc

SEQ ID NO: 506481 - DNA, 17 bp, Homo sapiens
ggggcagaacagccgct

SEQ ID NO: 506482 - DNA, 13 bp, Homo sapiens
gggggagtgggcg

SEQ ID NO: 506483 - DNA, 21 bp, Homo sapiens
gggtaataaacttagaataaa

SEQ ID NO: 506484 - DNA, 23 bp, Homo sapiens
gggtaccttgaacactgggggag

SEQ ID NO: 506485 - DNA, 16 bp, Homo sapiens
gggtaggcgggaagga

SEQ ID NO: 506486 - DNA, 13 bp, Homo sapiens
gggtcaccttgag

SEQ ID NO: 506487 - DNA, 14 bp, Homo sapiens
gggtctctgctgcc

SEQ ID NO: 506488 - DNA, 18 bp, Homo sapiens
gggtgatatggacagcag

SEQ ID NO: 506489 - DNA, 20 bp, Homo sapiens
ggtaagcacttaatgaatga

SEQ ID NO: 506490 - DNA, 16 bp, Homo sapiens
ggtacccaattcaatt

SEQ ID NO: 506491 - DNA, 12 bp, Homo sapiens
ggtaccttgaac

SEQ ID NO: 506492 - DNA, 11 bp, Homo sapiens
ggtagaacaca

SEQ ID NO: 506493 - DNA, 15 bp, Homo sapiens
ggtagacacacatga

SEQ ID NO: 506494 - DNA, 14 bp, Homo sapiens
ggtattcctgcctc

SEQ ID NO: 506495 - DNA, 22 bp, Homo sapiens
ggtattttaggcagggatttga

SEQ ID NO: 506496 - DNA, 22 bp, Homo sapiens
ggtccctgataacaacctggag

SEQ ID NO: 506497 - DNA, 14 bp, Homo sapiens
ggtcggaccagctt

SEQ ID NO: 506498 - DNA, 18 bp, Homo sapiens
ggtctctaggctggggaa

SEQ ID NO: 506499 - DNA, 19 bp, Homo sapiens
ggtgagcccatggccctcc

SEQ ID NO: 506500 - DNA, 14 bp, Homo sapiens
ggtggacccaggga

SEQ ID NO: 506501 - DNA, 13 bp, Homo sapiens
ggtggcactgcca

SEQ ID NO: 506502 - DNA, 19 bp, Homo sapiens
ggtggctcacgcctgtaat

SEQ ID NO: 506503 - DNA, 13 bp, Homo sapiens
ggtggtggagcca

SEQ ID NO: 506504 - DNA, 16 bp, Homo sapiens
ggtgtatggttctgtg

SEQ ID NO: 506505 - DNA, 15 bp, Homo sapiens
ggttatctgtcccag

SEQ ID NO: 506506 - DNA, 11 bp, Homo sapiens
ggttggctggc

SEQ ID NO: 506507 - DNA, 18 bp, Homo sapiens
ggtttgaatataaacact

SEQ ID NO: 506508 - DNA, 14 bp, Homo sapiens
gtaaataaattgtt

SEQ ID NO: 506509 - DNA, 17 bp, Homo sapiens
gtaataatgtgaatcat

SEQ ID NO: 506510 - DNA, 20 bp, Homo sapiens
gtaatatattgctgctggta

SEQ ID NO: 506511 - DNA, 19 bp, Homo sapiens
gtaatgataactggaaact

SEQ ID NO: 506512 - DNA, 18 bp, Homo sapiens
gtaatgatgtcgtttgaa

SEQ ID NO: 506513 - DNA, 14 bp, Homo sapiens
gtaatttgtatctg

SEQ ID NO: 506514 - DNA, 17 bp, Homo sapiens
gtacaaggcgatcccat

SEQ ID NO: 506515 - DNA, 19 bp, Homo sapiens
gtacagtcttgcagcagga

SEQ ID NO: 506516 - DNA, 14 bp, Homo sapiens
gtacagttcagttc

SEQ ID NO: 506517 - DNA, 16 bp, Homo sapiens
gtacagttcagttcct

SEQ ID NO: 506518 - DNA, 13 bp, Homo sapiens
gtacatgtgaggc

SEQ ID NO: 506519 - DNA, 23 bp, Homo sapiens
gtactgtgtacagaattctgcta

SEQ ID NO: 506520 - DNA, 22 bp, Homo sapiens
gtacttcaaatccttgaagatt

SEQ ID NO: 506521 - DNA, 22 bp, Homo sapiens
gtagacaagcaattagacaaga

SEQ ID NO: 506522 - DNA, 18 bp, Homo sapiens
gtagacgaacagctgaca

SEQ ID NO: 506523 - DNA, 21 bp, Homo sapiens
gtagagctagaacatggagag

SEQ ID NO: 506524 - DNA, 15 bp, Homo sapiens
gtagataaagcactg

SEQ ID NO: 506525 - DNA, 15 bp, Homo sapiens
gtagcattacagtgg

SEQ ID NO: 506526 - DNA, 15 bp, Homo sapiens
gtaggttgtctaaaa

SEQ ID NO: 506527 - DNA, 16 bp, Homo sapiens
gtaggttgtctaaaaa

SEQ ID NO: 506528 - DNA, 14 bp, Homo sapiens
gtagtgttggagaa

SEQ ID NO: 506529 - DNA, 15 bp, Homo sapiens
gtagtgttggagaag

SEQ ID NO: 506530 - DNA, 18 bp, Homo sapiens
gtagttgcaatagaacag

SEQ ID NO: 506531 - DNA, 21 bp, Homo sapiens
gtataaaataatttttatatt

SEQ ID NO: 506532 - DNA, 24 bp, Homo sapiens
gtatattcaaaaattatattttga

SEQ ID NO: 506533 - DNA, 20 bp, Homo sapiens
gtatctagacccatcttctt

SEQ ID NO: 506534 - DNA, 14 bp, Homo sapiens
gtatgattcccagc

SEQ ID NO: 506535 - DNA, 13 bp, Homo sapiens
gtatggagctcag

SEQ ID NO: 506536 - DNA, 18 bp, Homo sapiens
gtatgtacttcatgctgt

SEQ ID NO: 506537 - DNA, 22 bp, Homo sapiens
gtattaggggtaatatattgct

SEQ ID NO: 506538 - DNA, 14 bp, Homo sapiens
gtattcctgcctcc

SEQ ID NO: 506539 - DNA, 16 bp, Homo sapiens
gtattttaaaagaatg

SEQ ID NO: 506540 - DNA, 17 bp, Homo sapiens
gtattttaaaagaatga

SEQ ID NO: 506541 - DNA, 17 bp, Homo sapiens
gtcaaacgtgaaaatgc

SEQ ID NO: 506542 - DNA, 21 bp, Homo sapiens
gtcaataaaatccatacattt

SEQ ID NO: 506543 - DNA, 22 bp, Homo sapiens
gtcaatccaagagtctgatgat

SEQ ID NO: 506544 - DNA, 14 bp, Homo sapiens
gtcacacagggcag

SEQ ID NO: 506545 - DNA, 22 bp, Homo sapiens
gtcatccacacaacaccaggac

SEQ ID NO: 506546 - DNA, 13 bp, Homo sapiens
gtcatcttgagct

SEQ ID NO: 506547 - DNA, 18 bp, Homo sapiens
gtcatgcaaaggctggga

SEQ ID NO: 506548 - DNA, 15 bp, Homo sapiens
gtcatgtgcctctgt

SEQ ID NO: 506549 - DNA, 16 bp, Homo sapiens
gtcatgtgcctctgtc

SEQ ID NO: 506550 - DNA, 15 bp, Homo sapiens
gtcattcaataaatt

SEQ ID NO: 506551 - DNA, 16 bp, Homo sapiens
gtccaagtggctgtga

SEQ ID NO: 506552 - DNA, 15 bp, Homo sapiens
gtccacgcccaccag

SEQ ID NO: 506553 - DNA, 21 bp, Homo sapiens
gtccacgcccaccagccttgc

SEQ ID NO: 506554 - DNA, 19 bp, Homo sapiens
gtcccacttggcatcagct

SEQ ID NO: 506555 - DNA, 17 bp, Homo sapiens
gtcccaggttatctggg

SEQ ID NO: 506556 - DNA, 16 bp, Homo sapiens
gtcccataggcccagt

SEQ ID NO: 506557 - DNA, 14 bp, Homo sapiens
gtcgatatttccat

SEQ ID NO: 506558 - DNA, 13 bp, Homo sapiens
gtcgttgtgaggg

SEQ ID NO: 506559 - DNA, 14 bp, Homo sapiens
gtctaaagagcttt

SEQ ID NO: 506560 - DNA, 20 bp, Homo sapiens
tattcaaaaattatattttg

SEQ ID NO: 506561 - DNA, 18 bp, Homo sapiens
tattgacatcagcatcac

SEQ ID NO: 506562 - DNA, 11 bp, Homo sapiens
tattgctgggg

SEQ ID NO: 506563 - DNA, 19 bp, Homo sapiens
tattgctgtgtaacactgt

SEQ ID NO: 506564 - DNA, 17 bp, Homo sapiens
tattggacttccatttg

SEQ ID NO: 506565 - DNA, 19 bp, Homo sapiens
tattgtgctttctatctaa

SEQ ID NO: 506566 - DNA, 19 bp, Homo sapiens
tattgtgtgttatttaaat

SEQ ID NO: 506567 - DNA, 14 bp, Homo sapiens
tatttattttaata

SEQ ID NO: 506568 - DNA, 16 bp, Homo sapiens
tatttattttaataat

SEQ ID NO: 506569 - DNA, 16 bp, Homo sapiens
tatttctatcccaaac

SEQ ID NO: 506570 - DNA, 15 bp, Homo sapiens
tatttctatgaaata

SEQ ID NO: 506571 - DNA, 21 bp, Homo sapiens
tatttctatgaaatattatgt

SEQ ID NO: 506572 - DNA, 22 bp, Homo sapiens
tatttctatgaaatattatgtt

SEQ ID NO: 506573 - DNA, 20 bp, Homo sapiens
tatttcttaaacaaatgtat

SEQ ID NO: 506574 - DNA, 20 bp, Homo sapiens
tatttgttaatggtttgaat

SEQ ID NO: 506575 - DNA, 22 bp, Homo sapiens
tattttaaagcttggtgctaaa

SEQ ID NO: 506576 - DNA, 13 bp, Homo sapiens
tcaaaaagtcatt

SEQ ID NO: 506577 - DNA, 14 bp, Homo sapiens
tcaaacactgcagg

SEQ ID NO: 506578 - DNA, 17 bp, Homo sapiens
tcaaacatatataacaa

SEQ ID NO: 506579 - DNA, 10 bp, Homo sapiens
tcaaagcaga

SEQ ID NO: 506580 - DNA, 17 bp, Homo sapiens
tcaaatggaagacacat

SEQ ID NO: 506581 - DNA, 14 bp, Homo sapiens
tcaaattgtgtgaa

SEQ ID NO: 506582 - DNA, 16 bp, Homo sapiens
tcaacagtttccagtc

SEQ ID NO: 506583 - DNA, 22 bp, Homo sapiens
tcaaccctaaaaagcagagctt

SEQ ID NO: 506584 - DNA, 23 bp, Homo sapiens
tcaaccctaaaaagcagagcttt

SEQ ID NO: 506585 - DNA, 20 bp, Homo sapiens
tcaacctactttcatactga

SEQ ID NO: 506586 - DNA, 19 bp, Homo sapiens
tcaactccaaactgactct

SEQ ID NO: 506587 - DNA, 22 bp, Homo sapiens
tcaactccaaactgactcttaa

SEQ ID NO: 506588 - DNA, 19 bp, Homo sapiens
tcaagactggaaggtgggg

SEQ ID NO: 506589 - DNA, 22 bp, Homo sapiens
tcaagatcaatgaaatgatgtc

SEQ ID NO: 506590 - DNA, 18 bp, Homo sapiens
tcaaggaataatgggctt

SEQ ID NO: 506591 - DNA, 20 bp, Homo sapiens
tcaagggaccctgggtggga

SEQ ID NO: 506592 - DNA, 15 bp, Homo sapiens
tcaataaactgaatt

SEQ ID NO: 506593 - DNA, 16 bp, Homo sapiens
tcaatatgagtctcaa

SEQ ID NO: 506594 - DNA, 17 bp, Homo sapiens
tcaatggtttgcaagga

SEQ ID NO: 506595 - DNA, 19 bp, Homo sapiens
tcaattcttccctatcttt

SEQ ID NO: 506596 - DNA, 23 bp, Homo sapiens
tcaattcttccctatctttgcca

SEQ ID NO: 506597 - DNA, 20 bp, Homo sapiens
tcacaaaagtatattcaaaa

SEQ ID NO: 506598 - DNA, 15 bp, Homo sapiens
tcacagcagcttcta

SEQ ID NO: 506599 - DNA, 19 bp, Homo sapiens
tcacattactgtatatact

SEQ ID NO: 506600 - DNA, 17 bp, Homo sapiens
tcacatttgtaaatgtc

SEQ ID NO: 506601 - DNA, 12 bp, Homo sapiens
tcacctgtcatc

SEQ ID NO: 506602 - DNA, 13 bp, Homo sapiens
tcacctgtcatca

SEQ ID NO: 506603 - DNA, 18 bp, Homo sapiens
tcacgattgtcatcagga

SEQ ID NO: 506604 - DNA, 17 bp, Homo sapiens
tcacgccactgcactcc

SEQ ID NO: 506605 - DNA, 16 bp, Homo sapiens
tcacgtggaggagcag

SEQ ID NO: 506606 - DNA, 21 bp, Homo sapiens
tcacgtggaggagcagtgcag

SEQ ID NO: 506607 - DNA, 17 bp, Homo sapiens
tcactcatacatctggc

SEQ ID NO: 506608 - DNA, 21 bp, Homo sapiens
tcactgaactttgctgagcct

SEQ ID NO: 506609 - DNA, 19 bp, Homo sapiens
tcactggggtcctggggcc

SEQ ID NO: 506610 - DNA, 22 bp, Homo sapiens
tcactgttctattcatctcaag

SEQ ID NO: 506611 - DNA, 17 bp, Homo sapiens
tcacttctgagaactca

SEQ ID NO: 506612 - DNA, 19 bp, Homo sapiens
tcacttgtgccaacactca

SEQ ID NO: 506613 - DNA, 21 bp, Homo sapiens
tcagaaacaccctcacactgg

SEQ ID NO: 506614 - DNA, 20 bp, Homo sapiens
tcagagactcagggccccag

SEQ ID NO: 506615 - DNA, 16 bp, Homo sapiens
tcagagctgccctctc

SEQ ID NO: 506616 - DNA, 20 bp, Homo sapiens
tcagagctgccctctcctgg

SEQ ID NO: 506617 - DNA, 20 bp, Homo sapiens
tcagagggcccaaatggcag

SEQ ID NO: 506618 - DNA, 23 bp, Homo sapiens
tcagcaaggtgagagaggtaccc

SEQ ID NO: 506619 - DNA, 19 bp, Homo sapiens
tcagcctagccgacctcag

SEQ ID NO: 506620 - DNA, 19 bp, Homo sapiens
tcagcctggtgggcctcct

SEQ ID NO: 506621 - DNA, 21 bp, Homo sapiens
tcagccttccccttgcccagg

SEQ ID NO: 506622 - DNA, 12 bp, Homo sapiens
tcagctgtgaac

SEQ ID NO: 506623 - DNA, 21 bp, Homo sapiens
tcagctgtgaacatggactct

SEQ ID NO: 506624 - DNA, 12 bp, Homo sapiens
tcaggacactaa

SEQ ID NO: 506625 - DNA, 20 bp, Homo sapiens
tcaggagaggggcagaacag

SEQ ID NO: 506626 - DNA, 10 bp, Homo sapiens
tcaggagcag

SEQ ID NO: 506627 - DNA, 19 bp, Homo sapiens
tcaggaggctgaggcagga

SEQ ID NO: 506628 - DNA, 14 bp, Homo sapiens
tcagggccccagca

SEQ ID NO: 506629 - DNA, 16 bp, Homo sapiens
tcagggtccctcagga

SEQ ID NO: 506630 - DNA, 17 bp, Homo sapiens
tcagggtctctgctgcc

SEQ ID NO: 506631 - DNA, 15 bp, Homo sapiens
tcagtgcttcgcaga

SEQ ID NO: 506632 - DNA, 16 bp, Homo sapiens
tcagttcctctttgca

SEQ ID NO: 506633 - DNA, 18 bp, Homo sapiens
tcagttcctctttgcatg

SEQ ID NO: 506634 - DNA, 21 bp, Homo sapiens
tcagttcctctttgcatggaa

SEQ ID NO: 506635 - DNA, 13 bp, Homo sapiens
tcagttctgcctt

SEQ ID NO: 506636 - DNA, 15 bp, Homo sapiens
tcagttctgccttat

SEQ ID NO: 506637 - DNA, 12 bp, Homo sapiens
tcagttgttttc

SEQ ID NO: 506638 - DNA, 13 bp, Homo sapiens
tcatactgaagat

SEQ ID NO: 506639 - DNA, 16 bp, Homo sapiens
tcatagccatacctgg

SEQ ID NO: 506640 - DNA, 19 bp, Homo sapiens
tcatcaaggcactgcctga

SEQ ID NO: 506641 - DNA, 21 bp, Homo sapiens
tcatcaaggcactgcctgatg

SEQ ID NO: 506642 - DNA, 20 bp, Homo sapiens
tcatccacacaacaccagga

SEQ ID NO: 506643 - DNA, 14 bp, Homo sapiens
tcatccgaggcagg

SEQ ID NO: 506644 - DNA, 18 bp, Homo sapiens
tcatccgcctgtgggcgc

SEQ ID NO: 506645 - DNA, 18 bp, Homo sapiens
tcatctggaaccatcaga

SEQ ID NO: 506646 - DNA, 17 bp, Homo sapiens
tcatgcaaaggctggga

SEQ ID NO: 506647 - DNA, 17 bp, Homo sapiens
tcatgcatagtcccagc

SEQ ID NO: 506648 - DNA, 14 bp, Homo sapiens
tcatgcatggaaat

SEQ ID NO: 506649 - DNA, 21 bp, Homo sapiens
tcatgccctgccaagcagcag

SEQ ID NO: 506650 - DNA, 15 bp, Homo sapiens
tcatgggtcaagaga

SEQ ID NO: 506651 - DNA, 18 bp, Homo sapiens
tcatgtaggttgtctaaa

SEQ ID NO: 506652 - DNA, 18 bp, Homo sapiens
tcatgtgcctctgtcctt

SEQ ID NO: 506653 - DNA, 12 bp, Homo sapiens
tcattaaagttc

SEQ ID NO: 506654 - DNA, 13 bp, Homo sapiens
tcattaccacagg

SEQ ID NO: 506655 - DNA, 16 bp, Homo sapiens
tcattatttgcagaga

SEQ ID NO: 506656 - DNA, 13 bp, Homo sapiens
tcattcaataaat

SEQ ID NO: 506657 - DNA, 14 bp, Homo sapiens
tcattccattctgg

SEQ ID NO: 506658 - DNA, 15 bp, Homo sapiens
tcattccattctgga

SEQ ID NO: 506659 - DNA, 14 bp, Homo sapiens
tcattcctgttctt

SEQ ID NO: 506660 - DNA, 18 bp, Homo sapiens
tcattcctgttctttctt

SEQ ID NO: 506661 - DNA, 20 bp, Homo sapiens
tcattgactatcaaactgaa

SEQ ID NO: 506662 - DNA, 14 bp, Homo sapiens
tcatttatttccat

SEQ ID NO: 506663 - DNA, 20 bp, Homo sapiens
tcatttatttccatattaaa

SEQ ID NO: 506664 - DNA, 14 bp, Homo sapiens
tcatttattttgac

SEQ ID NO: 506665 - DNA, 14 bp, Homo sapiens
tcatttttgaatac

SEQ ID NO: 506666 - DNA, 19 bp, Homo sapiens
tccaaactaccttccagtt

SEQ ID NO: 506667 - DNA, 23 bp, Homo sapiens
tccaaactgactcttaagaagac

SEQ ID NO: 506668 - DNA, 15 bp, Homo sapiens
tccacacaacaccag

SEQ ID NO: 506669 - DNA, 22 bp, Homo sapiens
tccacaggggctatcccttctc

SEQ ID NO: 506670 - DNA, 12 bp, Homo sapiens
tccacctccctg

SEQ ID NO: 506671 - DNA, 13 bp, Homo sapiens
tccacctccctgc

SEQ ID NO: 506672 - DNA, 16 bp, Homo sapiens
tccacctccctgcaat

SEQ ID NO: 506673 - DNA, 17 bp, Homo sapiens
tccacctccctgcaata

SEQ ID NO: 506674 - DNA, 23 bp, Homo sapiens
tccacctccctgcaataaaatgg

SEQ ID NO: 506675 - DNA, 14 bp, Homo sapiens
tccacgcccaccag

SEQ ID NO: 506676 - DNA, 15 bp, Homo sapiens
tccacgcccaccagc

SEQ ID NO: 506677 - DNA, 18 bp, Homo sapiens
tccacgcccaccagcctt

SEQ ID NO: 506678 - DNA, 20 bp, Homo sapiens
tccacgcccaccagccttgc

SEQ ID NO: 506679 - DNA, 12 bp, Homo sapiens
tccactggagaa

SEQ ID NO: 506680 - DNA, 18 bp, Homo sapiens
tccactttcagtgaaagc

SEQ ID NO: 506681 - DNA, 22 bp, Homo sapiens
tccagaaccagtgtctgaacca

SEQ ID NO: 506682 - DNA, 16 bp, Homo sapiens
tccagatcctggaaat

SEQ ID NO: 506683 - DNA, 13 bp, Homo sapiens
tccagccagggct

SEQ ID NO: 506684 - DNA, 13 bp, Homo sapiens
tccagcctctgcc

SEQ ID NO: 506685 - DNA, 16 bp, Homo sapiens
tccagcctctgccgct

SEQ ID NO: 506686 - DNA, 18 bp, Homo sapiens
tccagcctctgccgctgc

SEQ ID NO: 506687 - DNA, 21 bp, Homo sapiens
tccagcctctgccgctgccat

SEQ ID NO: 506688 - DNA, 16 bp, Homo sapiens
tccagcctgcctggca

SEQ ID NO: 506689 - DNA, 14 bp, Homo sapiens
tccagcctggagat

SEQ ID NO: 506690 - DNA, 18 bp, Homo sapiens
tccagctcctcatccagg

SEQ ID NO: 506691 - DNA, 16 bp, Homo sapiens
tccagctgccccgggg

SEQ ID NO: 506692 - DNA, 21 bp, Homo sapiens
tccagggacgaagaagagcca

SEQ ID NO: 506693 - DNA, 13 bp, Homo sapiens
tccagggccctga

SEQ ID NO: 506694 - DNA, 16 bp, Homo sapiens
tccagggccctgagct

SEQ ID NO: 506695 - DNA, 20 bp, Homo sapiens
tccagggccctgagctcggt

SEQ ID NO: 506696 - DNA, 17 bp, Homo sapiens
tccatcagttagagctg

SEQ ID NO: 506697 - DNA, 18 bp, Homo sapiens
tggcttcattagagcagg

SEQ ID NO: 506698 - DNA, 19 bp, Homo sapiens
tggcttctgcttgtcatcc

SEQ ID NO: 506699 - DNA, 13 bp, Homo sapiens
tgggaactagact

SEQ ID NO: 506700 - DNA, 18 bp, Homo sapiens
tgggaactcacctggggc

SEQ ID NO: 506701 - DNA, 15 bp, Homo sapiens
tgggaaggccagctg

SEQ ID NO: 506702 - DNA, 19 bp, Homo sapiens
tgggacatttgctcatgga

SEQ ID NO: 506703 - DNA, 11 bp, Homo sapiens
tgggactgatg

SEQ ID NO: 506704 - DNA, 17 bp, Homo sapiens
tgggactgatgtcatct

SEQ ID NO: 506705 - DNA, 13 bp, Homo sapiens
tgggactggagtc

SEQ ID NO: 506706 - DNA, 18 bp, Homo sapiens
tgggagactgctgagtca

SEQ ID NO: 506707 - DNA, 16 bp, Homo sapiens
tgggagcctcagactc

SEQ ID NO: 506708 - DNA, 14 bp, Homo sapiens
tgggaggctgaggt

SEQ ID NO: 506709 - DNA, 14 bp, Homo sapiens
tgggcagctgcctc

SEQ ID NO: 506710 - DNA, 15 bp, Homo sapiens
tgggcagctgcctcc

SEQ ID NO: 506711 - DNA, 22 bp, Homo sapiens
tgggcagctgcctcccctcctc

SEQ ID NO: 506712 - DNA, 23 bp, Homo sapiens
tgggcaggactcagctccccaga

SEQ ID NO: 506713 - DNA, 16 bp, Homo sapiens
tgggcatagatgcagg

SEQ ID NO: 506714 - DNA, 16 bp, Homo sapiens
tgggcatggtggggca

SEQ ID NO: 506715 - DNA, 13 bp, Homo sapiens
tgggcctcctcac

SEQ ID NO: 506716 - DNA, 14 bp, Homo sapiens
tgggcgcagtggct

SEQ ID NO: 506717 - DNA, 21 bp, Homo sapiens
tgggcttcccagtggctgctg

SEQ ID NO: 506718 - DNA, 12 bp, Homo sapiens
tgggctttctgg

SEQ ID NO: 506719 - DNA, 14 bp, Homo sapiens
tggggaagactgtg

SEQ ID NO: 506720 - DNA, 24 bp, Homo sapiens
tggggaagactgtggctgctagca

SEQ ID NO: 506721 - DNA, 17 bp, Homo sapiens
tgggggaagacctggca

SEQ ID NO: 506722 - DNA, 23 bp, Homo sapiens
tgggggaagactttaaaccacct

SEQ ID NO: 506723 - DNA, 19 bp, Homo sapiens
tgggggtgctggatggaca

SEQ ID NO: 506724 - DNA, 21 bp, Homo sapiens
tggggtaccaagagactcctt

SEQ ID NO: 506725 - DNA, 15 bp, Homo sapiens
tgggtaaatgcagcg

SEQ ID NO: 506726 - DNA, 21 bp, Homo sapiens
tgggttagggaaaacattcca

SEQ ID NO: 506727 - DNA, 12 bp, Homo sapiens
tgggttgacccc

SEQ ID NO: 506728 - DNA, 17 bp, Homo sapiens
tgggttggaaaacagta

SEQ ID NO: 506729 - DNA, 19 bp, Homo sapiens
tggtaatttgtatctgaag

SEQ ID NO: 506730 - DNA, 22 bp, Homo sapiens
tggtaatttgtatctgaaggag

SEQ ID NO: 506731 - DNA, 21 bp, Homo sapiens
tggtatgttttcaggctagat

SEQ ID NO: 506732 - DNA, 12 bp, Homo sapiens
tggtccctgggg

SEQ ID NO: 506733 - DNA, 19 bp, Homo sapiens
tggtctctaggctggggaa

SEQ ID NO: 506734 - DNA, 23 bp, Homo sapiens
tggtctgtttccaggtcagaaac

SEQ ID NO: 506735 - DNA, 20 bp, Homo sapiens
tggtgccagatcctcttctc

SEQ ID NO: 506736 - DNA, 20 bp, Homo sapiens
tggtttggccatctctggat

SEQ ID NO: 506737 - DNA, 17 bp, Homo sapiens
tgtaaaatttcacttaa

SEQ ID NO: 506738 - DNA, 17 bp, Homo sapiens
tgtaagaaaatatcact

SEQ ID NO: 506739 - DNA, 22 bp, Homo sapiens
tgtacacatgggagtttagtgt

SEQ ID NO: 506740 - DNA, 18 bp, Homo sapiens
tgtacagaattctgctac

SEQ ID NO: 506741 - DNA, 14 bp, Homo sapiens
tgtacagttcagtt

SEQ ID NO: 506742 - DNA, 15 bp, Homo sapiens
tgtacattctaaaat

SEQ ID NO: 506743 - DNA, 12 bp, Homo sapiens
tgtactacaatt

SEQ ID NO: 506744 - DNA, 22 bp, Homo sapiens
tgtagcaaattccaatacatta

SEQ ID NO: 506745 - DNA, 14 bp, Homo sapiens
tgtaggttgtctaa

SEQ ID NO: 506746 - DNA, 18 bp, Homo sapiens
tgtagtgttggagaagaa

SEQ ID NO: 506747 - DNA, 20 bp, Homo sapiens
tgtagtgttggagaagaact

SEQ ID NO: 506748 - DNA, 22 bp, Homo sapiens
tgtagtgttggagaagaactga

SEQ ID NO: 506749 - DNA, 15 bp, Homo sapiens
tgtagttttacttgg

SEQ ID NO: 506750 - DNA, 14 bp, Homo sapiens
tgtataaaataatt

SEQ ID NO: 506751 - DNA, 15 bp, Homo sapiens
tgtataatattttta

SEQ ID NO: 506752 - DNA, 20 bp, Homo sapiens
tgtatttgttaatggtttga

SEQ ID NO: 506753 - DNA, 18 bp, Homo sapiens
tgtattttaaaagaatga

SEQ ID NO: 506754 - DNA, 22 bp, Homo sapiens
tgtcatccacacaacaccagga

SEQ ID NO: 506755 - DNA, 15 bp, Homo sapiens
tgtcatctcagtgct

SEQ ID NO: 506756 - DNA, 17 bp, Homo sapiens
tgtccaaagcagggtct

SEQ ID NO: 506757 - DNA, 18 bp, Homo sapiens
tgtccaaagcagggtctg

SEQ ID NO: 506758 - DNA, 13 bp, Homo sapiens
tgtccagggccct

SEQ ID NO: 506759 - DNA, 23 bp, Homo sapiens
tgtctaaaaataaaatgcattta

SEQ ID NO: 506760 - DNA, 17 bp, Homo sapiens
tgtctccttaacactga

SEQ ID NO: 506761 - DNA, 22 bp, Homo sapiens
tgtctgaaattttctagaatac

SEQ ID NO: 506762 - DNA, 15 bp, Homo sapiens
tgtctgccagccagc

SEQ ID NO: 506763 - DNA, 15 bp, Homo sapiens
tgtctggattcccag

SEQ ID NO: 506764 - DNA, 16 bp, Homo sapiens
tgtgaatgggaaaaga

SEQ ID NO: 506765 - DNA, 19 bp, Homo sapiens
tgtgcatagagccacgtat

SEQ ID NO: 506766 - DNA, 20 bp, Homo sapiens
tgtgcctatagtcccagcta

SEQ ID NO: 506767 - DNA, 22 bp, Homo sapiens
tgtgctcatgcattgcttgtgt

SEQ ID NO: 506768 - DNA, 20 bp, Homo sapiens
tgtgctgcccgtcttcagcc

SEQ ID NO: 506769 - DNA, 19 bp, Homo sapiens
tgtggagggcacattcctt

SEQ ID NO: 506770 - DNA, 15 bp, Homo sapiens
tgtgggtcaaggaat

SEQ ID NO: 506771 - DNA, 21 bp, Homo sapiens
tgtgtacagaattctgctacc

SEQ ID NO: 506772 - DNA, 13 bp, Homo sapiens
tgtgtgaacgtgt

SEQ ID NO: 506773 - DNA, 13 bp, Homo sapiens
tgtgttatttaaa

SEQ ID NO: 506774 - DNA, 15 bp, Homo sapiens
tgttactatctgctt

SEQ ID NO: 506775 - DNA, 22 bp, Homo sapiens
tgttactgatttggccgttttg

SEQ ID NO: 506776 - DNA, 16 bp, Homo sapiens
tgttatttgtacagtt

SEQ ID NO: 506777 - DNA, 11 bp, Homo sapiens
tgttcagaaga

SEQ ID NO: 506778 - DNA, 16 bp, Homo sapiens
tgttctccgtccctgc

SEQ ID NO: 506779 - DNA, 14 bp, Homo sapiens
tgttgacatgtgct

SEQ ID NO: 506780 - DNA, 22 bp, Homo sapiens
tgttggctgggaactcacctgg

SEQ ID NO: 506781 - DNA, 19 bp, Homo sapiens
tgtttcaaacatatataac

SEQ ID NO: 506782 - DNA, 15 bp, Homo sapiens
tgttttccagctcct

SEQ ID NO: 506783 - DNA, 12 bp, Homo sapiens
tgtttttaactc

SEQ ID NO: 506784 - DNA, 23 bp, Homo sapiens
tgtttttaagaaaaacatgtcat

SEQ ID NO: 506785 - DNA, 15 bp, Homo sapiens
ttaaaaaagaaacat

SEQ ID NO: 506786 - DNA, 13 bp, Homo sapiens
ttaaaaattaatt

SEQ ID NO: 506787 - DNA, 13 bp, Homo sapiens
ttaaaagaatgat

SEQ ID NO: 506788 - DNA, 17 bp, Homo sapiens
ttaaaatcacaaactca

SEQ ID NO: 506789 - DNA, 19 bp, Homo sapiens
ttaacaaaccctcgtttct

SEQ ID NO: 506790 - DNA, 23 bp, Homo sapiens
ttaacaaaccctcgtttctgatt

SEQ ID NO: 506791 - DNA, 13 bp, Homo sapiens
ttaacctgatgca

SEQ ID NO: 506792 - DNA, 22 bp, Homo sapiens
ttaacttgagggtaataaactt

SEQ ID NO: 506793 - DNA, 20 bp, Homo sapiens
ttaagaagactgcattatat

SEQ ID NO: 506794 - DNA, 13 bp, Homo sapiens
ttaagacaaatgg

SEQ ID NO: 506795 - DNA, 14 bp, Homo sapiens
ttaagaccagcctg

SEQ ID NO: 506796 - DNA, 14 bp, Homo sapiens
ttaagatatgatgt

SEQ ID NO: 506797 - DNA, 18 bp, Homo sapiens
ttaagttagggaatggca

SEQ ID NO: 506798 - DNA, 18 bp, Homo sapiens
ttaatcccggtttcagaa

SEQ ID NO: 506799 - DNA, 20 bp, Homo sapiens
ttaatgtagataaagcactg

SEQ ID NO: 506800 - DNA, 12 bp, Homo sapiens
ttacaaacatgt

SEQ ID NO: 506801 - DNA, 15 bp, Homo sapiens
ttacaaacatgtggt

SEQ ID NO: 506802 - DNA, 15 bp, Homo sapiens
ttacagtaaataaat

SEQ ID NO: 506803 - DNA, 22 bp, Homo sapiens
ttacatatttgcatatgtatga

SEQ ID NO: 506804 - DNA, 12 bp, Homo sapiens
ttacatggctct

SEQ ID NO: 506805 - DNA, 22 bp, Homo sapiens
ttagaagctgaagatccccaac

SEQ ID NO: 506806 - DNA, 18 bp, Homo sapiens
ttagaaggttctctcctc

SEQ ID NO: 506807 - DNA, 13 bp, Homo sapiens
ttagaatattaaa

SEQ ID NO: 506808 - DNA, 15 bp, Homo sapiens
ttagacctcagcctg

SEQ ID NO: 506809 - DNA, 16 bp, Homo sapiens
ttagacctcagcctgt

SEQ ID NO: 506810 - DNA, 20 bp, Homo sapiens
ttagagcagtttctgtcctg

SEQ ID NO: 506811 - DNA, 21 bp, Homo sapiens
ttagagctgacacaaacctgc

SEQ ID NO: 506812 - DNA, 12 bp, Homo sapiens
ttagctaaagga

SEQ ID NO: 506813 - DNA, 10 bp, Homo sapiens
ttagctgtgc

SEQ ID NO: 506814 - DNA, 18 bp, Homo sapiens
ttaggcatgcacagctgt

SEQ ID NO: 506815 - DNA, 14 bp, Homo sapiens
ttagggaaaacatt

SEQ ID NO: 506816 - DNA, 17 bp, Homo sapiens
ttagggaaaacattcca

SEQ ID NO: 506817 - DNA, 16 bp, Homo sapiens
ttagggttatgattaa

SEQ ID NO: 506818 - DNA, 12 bp, Homo sapiens
ttatatttgaaa

SEQ ID NO: 506819 - DNA, 20 bp, Homo sapiens
ttatctgggcatagatgcag

SEQ ID NO: 506820 - DNA, 17 bp, Homo sapiens
ttatgaattacatttgt

SEQ ID NO: 506821 - DNA, 13 bp, Homo sapiens
ttatgtctaaaga

SEQ ID NO: 506822 - DNA, 19 bp, Homo sapiens
ttatgttaaaactgggaca

SEQ ID NO: 506823 - DNA, 20 bp, Homo sapiens
ttattagtgaagtatgcact

SEQ ID NO: 506824 - DNA, 18 bp, Homo sapiens
ttatttgcagagacagga

SEQ ID NO: 506825 - DNA, 23 bp, Homo sapiens
ttatttggagtggaggcattgtt

SEQ ID NO: 506826 - DNA, 15 bp, Homo sapiens
ttatttgtacagttc

SEQ ID NO: 506827 - DNA, 15 bp, Homo sapiens
ttattttaataatgt

SEQ ID NO: 506828 - DNA, 16 bp, Homo sapiens
ttattttaataatgtt

SEQ ID NO: 506829 - DNA, 15 bp, Homo sapiens
ttcaaacatatataa

SEQ ID NO: 506830 - DNA, 17 bp, Homo sapiens
ttcaatttccaagagct

SEQ ID NO: 506831 - DNA, 19 bp, Homo sapiens
ttcaatttccaagagctga

SEQ ID NO: 506832 - DNA, 13 bp, Homo sapiens
ttcacacagacaa

SEQ ID NO: 506833 - DNA, 13 bp, Homo sapiens
ttcacactgtctg

SEQ ID NO: 506834 - DNA, 19 bp, Homo sapiens
ttcacataaaatagatttt

SEQ ID NO: 506835 - DNA, 20 bp, Homo sapiens
cttgcccacttctccttcgc

SEQ ID NO: 506836 - DNA, 15 bp, Homo sapiens
gaagagtccaggaag

SEQ ID NO: 506837 - DNA, 20 bp, Homo sapiens
gacatttcatataaatggaa

SEQ ID NO: 506838 - DNA, 17 bp, Homo sapiens
gagaagagtccaggaag

SEQ ID NO: 506839 - DNA, 18 bp, Homo sapiens
gagaagtcggccaggtag

SEQ ID NO: 506840 - DNA, 17 bp, Homo sapiens
gagagaagagtccagga

SEQ ID NO: 506841 - DNA, 18 bp, Homo sapiens
gagccctaaacacacgcg

SEQ ID NO: 506842 - DNA, 19 bp, Homo sapiens
gagcgggcccgccaccctt

SEQ ID NO: 506843 - DNA, 15 bp, Homo sapiens
gcatccgtctcccct

SEQ ID NO: 506844 - DNA, 22 bp, Homo sapiens
gctgggcggtgcggagcgggcc

SEQ ID NO: 506845 - DNA, 16 bp, Homo sapiens
ggctcagcatcctcca

SEQ ID NO: 506846 - DNA, 18 bp, Homo sapiens
ggctcagcatcctccacg

SEQ ID NO: 506847 - DNA, 13 bp, Homo sapiens
gggcccgccaccc

SEQ ID NO: 506848 - DNA, 12 bp, Homo sapiens
gtctcccctcgt

SEQ ID NO: 506849 - DNA, 14 bp, Homo sapiens
gtcttcctcctccc

SEQ ID NO: 506850 - DNA, 15 bp, Homo sapiens
gtggattaaaggcaa

SEQ ID NO: 506851 - DNA, 19 bp, Homo sapiens
gttaacacatggcttccta

SEQ ID NO: 506852 - DNA, 18 bp, Homo sapiens
taactgcctggcctggca

SEQ ID NO: 506853 - DNA, 16 bp, Homo sapiens
taatgtaacttcctct

SEQ ID NO: 506854 - DNA, 17 bp, Homo sapiens
tataaatggaatcacac

SEQ ID NO: 506855 - DNA, 16 bp, Homo sapiens
tatccctgcacacggc

SEQ ID NO: 506856 - DNA, 19 bp, Homo sapiens
tcaatcacttgaaagtgaa

SEQ ID NO: 506857 - DNA, 11 bp, Homo sapiens
tcaccaaggaa

SEQ ID NO: 506858 - DNA, 21 bp, Homo sapiens
tccctgcacacggcacagagc

SEQ ID NO: 506859 - DNA, 14 bp, Homo sapiens
tcctccacgggctg

SEQ ID NO: 506860 - DNA, 21 bp, Homo sapiens
tcctcccctggcaactgctga

SEQ ID NO: 506861 - DNA, 14 bp, Homo sapiens
tccttcgctttcct

SEQ ID NO: 506862 - DNA, 17 bp, Homo sapiens
tctccttcgctttcctg

SEQ ID NO: 506863 - DNA, 16 bp, Homo sapiens
tcttcctcctcccctg

SEQ ID NO: 506864 - DNA, 17 bp, Homo sapiens
tcttcctcctcccctgg

SEQ ID NO: 506865 - DNA, 15 bp, Homo sapiens
tgaacacaggcaatg

SEQ ID NO: 506866 - DNA, 21 bp, Homo sapiens
tggaacattctgtcatcaccc

SEQ ID NO: 506867 - DNA, 15 bp, Homo sapiens
tggctcagcatcctc

SEQ ID NO: 506868 - DNA, 18 bp, Homo sapiens
tggctcagcatcctccac

SEQ ID NO: 506869 - DNA, 14 bp, Homo sapiens
tggcttcctaaatg

SEQ ID NO: 506870 - DNA, 19 bp, Homo sapiens
aagagagaagagtccagga

SEQ ID NO: 506871 - DNA, 13 bp, Homo sapiens
aagtcggccaggt

SEQ ID NO: 506872 - DNA, 22 bp, Homo sapiens
aatcaatcacttgaaagtgaac

SEQ ID NO: 506873 - DNA, 12 bp, Homo sapiens
aatggccctgtt

SEQ ID NO: 506874 - DNA, 20 bp, Homo sapiens
acacatggcttcctaaatgg

SEQ ID NO: 506875 - DNA, 22 bp, Homo sapiens
acatggcttcctaaatggccct

SEQ ID NO: 506876 - DNA, 18 bp, Homo sapiens
accccgtgaagcaatcat

SEQ ID NO: 506877 - DNA, 23 bp, Homo sapiens
acccttgcccacttctccttcgc

SEQ ID NO: 506878 - DNA, 21 bp, Homo sapiens
actttgtgtctctgttgtcta

SEQ ID NO: 506879 - DNA, 18 bp, Homo sapiens
agcatccgtctcccctcg

SEQ ID NO: 506880 - DNA, 19 bp, Homo sapiens
aggatgtttcaccaaggaa

SEQ ID NO: 506881 - DNA, 20 bp, Homo sapiens
aggcaatgactgcgcagagt

SEQ ID NO: 506882 - DNA, 19 bp, Homo sapiens
aggcaccacctctgtcacg

SEQ ID NO: 506883 - DNA, 14 bp, Homo sapiens
agtacatccagaaa

SEQ ID NO: 506884 - DNA, 15 bp, Homo sapiens
agtggattaaaggca

SEQ ID NO: 506885 - DNA, 15 bp, Homo sapiens
atccctgcacacggc

SEQ ID NO: 506886 - DNA, 23 bp, Homo sapiens
atttcccctcccgtcttcctcct

SEQ ID NO: 506887 - DNA, 15 bp, Homo sapiens
caatcatttcccctc

SEQ ID NO: 506888 - DNA, 17 bp, Homo sapiens
caatgactgcgcagagt

SEQ ID NO: 506889 - DNA, 20 bp, Homo sapiens
cacaggcaatgactgcgcag

SEQ ID NO: 506890 - DNA, 13 bp, Homo sapiens
cacatggcttcct

SEQ ID NO: 506891 - DNA, 22 bp, Homo sapiens
cacgggctgcgccgtctgctcg

SEQ ID NO: 506892 - DNA, 15 bp, Homo sapiens
cagagcatccgtctc

SEQ ID NO: 506893 - DNA, 18 bp, Homo sapiens
cagagtggattaaaggca

SEQ ID NO: 506894 - DNA, 21 bp, Homo sapiens
caggcaatgactgcgcagagt

SEQ ID NO: 506895 - DNA, 14 bp, Homo sapiens
catataaatggaat

SEQ ID NO: 506896 - DNA, 17 bp, Homo sapiens
catataaatggaatcac

SEQ ID NO: 506897 - DNA, 14 bp, Homo sapiens
catccgtctcccct

SEQ ID NO: 506898 - DNA, 15 bp, Homo sapiens
catccgtctcccctc

SEQ ID NO: 506899 - DNA, 18 bp, Homo sapiens
catttcatataaatggaa

SEQ ID NO: 506900 - DNA, 16 bp, Homo sapiens
catttcccctcccgtc

SEQ ID NO: 506901 - DNA, 23 bp, Homo sapiens
cccacttctccttcgctttcctg

SEQ ID NO: 506902 - DNA, 13 bp, Homo sapiens
cccgtcttcctcc

SEQ ID NO: 506903 - DNA, 15 bp, Homo sapiens
cccgtcttcctcctc

SEQ ID NO: 506904 - DNA, 14 bp, Homo sapiens
ccctgttctggaca

SEQ ID NO: 506905 - DNA, 15 bp, Homo sapiens
cctcctcccctggca

SEQ ID NO: 506906 - DNA, 22 bp, Homo sapiens
cctctgtcacgttctggaacat

SEQ ID NO: 506907 - DNA, 15 bp, Homo sapiens
cctgagccctaaaca

SEQ ID NO: 506908 - DNA, 17 bp, Homo sapiens
cctggcaactgctgatc

SEQ ID NO: 506909 - DNA, 15 bp, Homo sapiens
cctggcctggcaccg

SEQ ID NO: 506910 - DNA, 18 bp, Homo sapiens
ccttgcccacttctcctt
